United States Patent 11,369,692 (MATERIALS AND METHODS FOR TREATMENT OF DUCHENNE MUSCULAR DYSTROPHY) - sequence listing, part 8

SEQ ID NO: 237979 - DNA, 20 bp, Artificial Sequence
  chemically synthesized
aaacatgcaaaaacattggc

SEQ ID NO: 237980 - DNA, 20 bp, Artificial Sequence
  chemically synthesized
tagtaaacatgcaaaaacat

SEQ ID NO: 237981 - DNA, 20 bp, Artificial Sequence
  chemically synthesized
ttgcatgtttactaataatt

SEQ ID NO: 237982 - DNA, 20 bp, Artificial Sequence
  chemically synthesized
atatatgaatgctaaattat

SEQ ID NO: 237983 - DNA, 20 bp, Artificial Sequence
  chemically synthesized
tagcattcatatattttcaa

SEQ ID NO: 237984 - DNA, 20 bp, Artificial Sequence
  chemically synthesized
taaacttacgatatattcat

SEQ ID NO: 237985 - DNA, 20 bp, Artificial Sequence
  chemically synthesized
ataaacttacgatatattca

SEQ ID NO: 237986 - DNA, 20 bp, Artificial Sequence
  chemically synthesized
atgacctatgaatatatcgt

SEQ ID NO: 237987 - DNA, 20 bp, Artificial Sequence
  chemically synthesized
atgtgcaattcatttttaaa

SEQ ID NO: 237988 - DNA, 20 bp, Artificial Sequence
  chemically synthesized
aatgtgcaattcatttttaa

SEQ ID NO: 237989 - DNA, 20 bp, Artificial Sequence
  chemically synthesized
caatgtgcaattcattttta

SEQ ID NO: 237990 - DNA, 20 bp, Artificial Sequence
  chemically synthesized
gttacatgcatttgcatcac

SEQ ID NO: 237991 - DNA, 20 bp, Artificial Sequence
  chemically synthesized
tacatgcatttgcatcactg

SEQ ID NO: 237992 - DNA, 20 bp, Artificial Sequence
  chemically synthesized
catttgcatcactggagtca

SEQ ID NO: 237993 - DNA, 20 bp, Artificial Sequence
  chemically synthesized
caaaagcaactctttgactc

SEQ ID NO: 237994 - DNA, 20 bp, Artificial Sequence
  chemically synthesized
tttgcatcactggagtcaaa

SEQ ID NO: 237995 - DNA, 20 bp, Artificial Sequence
  chemically synthesized
tcaaagagttgcttttgaat

SEQ ID NO: 237996 - DNA, 20 bp, Artificial Sequence
  chemically synthesized
atttttagattctcattcaa

SEQ ID NO: 237997 - DNA, 20 bp, Artificial Sequence
  chemically synthesized
aactatgttgcatagatttt

SEQ ID NO: 237998 - DNA, 20 bp, Artificial Sequence
  chemically synthesized
atctaaaaatctatgcaaca

SEQ ID NO: 237999 - DNA, 20 bp, Artificial Sequence
  chemically synthesized
acaatgctaactatgttgca

SEQ ID NO: 238000 - DNA, 20 bp, Artificial Sequence
  chemically synthesized
aaaaatctatgcaacatagt

SEQ ID NO: 238001 - DNA, 20 bp, Artificial Sequence
  chemically synthesized
tagttagcattgttccatac

SEQ ID NO: 238002 - DNA, 20 bp, Artificial Sequence
  chemically synthesized
tagcattgttccatactggt

SEQ ID NO: 238003 - DNA, 20 bp, Artificial Sequence
  chemically synthesized
aaaatatagtctcaccagta

SEQ ID NO: 238004 - DNA, 20 bp, Artificial Sequence
  chemically synthesized
ataagaaaatatagtctcac

SEQ ID NO: 238005 - DNA, 20 bp, Artificial Sequence
  chemically synthesized
aaaaattatataagaaaata

SEQ ID NO: 238006 - DNA, 20 bp, Artificial Sequence
  chemically synthesized
aaaatatagaaaaattatat

SEQ ID NO: 238007 - DNA, 20 bp, Artificial Sequence
  chemically synthesized
tgtagacaaattgaaaaata

SEQ ID NO: 238008 - DNA, 20 bp, Artificial Sequence
  chemically synthesized
tcaatatgaaaagcacattg

SEQ ID NO: 238009 - DNA, 20 bp, Artificial Sequence
  chemically synthesized
tttctgactctcaatatgaa

SEQ ID NO: 238010 - DNA, 20 bp, Artificial Sequence
  chemically synthesized
tacaatgtgcttttcatatt

SEQ ID NO: 238011 - DNA, 20 bp, Artificial Sequence
  chemically synthesized
caatgtgcttttcatattga

SEQ ID NO: 238012 - DNA, 20 bp, Artificial Sequence
  chemically synthesized
gtgcttttcatattgagagt

SEQ ID NO: 238013 - DNA, 20 bp, Artificial Sequence
  chemically synthesized
atttaaaatttttttttaaa

SEQ ID NO: 238014 - DNA, 20 bp, Artificial Sequence
  chemically synthesized
taaaatttttttttaaatgg

SEQ ID NO: 238015 - DNA, 20 bp, Artificial Sequence
  chemically synthesized
gttagcagtcatttgcatat

SEQ ID NO: 238016 - DNA, 20 bp, Artificial Sequence
  chemically synthesized
aggaggagggttggagttag

SEQ ID NO: 238017 - DNA, 20 bp, Artificial Sequence
  chemically synthesized
agcaggaggagggttggagt

SEQ ID NO: 238018 - DNA, 20 bp, Artificial Sequence
  chemically synthesized
tggtagcaggaggagggttg

SEQ ID NO: 238019 - DNA, 20 bp, Artificial Sequence
  chemically synthesized
tgtggtagcaggaggagggt

SEQ ID NO: 238020 - DNA, 20 bp, Artificial Sequence
  chemically synthesized
agactgtggtagcaggagga

SEQ ID NO: 238021 - DNA, 20 bp, Artificial Sequence
  chemically synthesized
cagactgtggtagcaggagg

SEQ ID NO: 238022 - DNA, 20 bp, Artificial Sequence
  chemically synthesized
tcagactgtggtagcaggag

SEQ ID NO: 238023 - DNA, 20 bp, Artificial Sequence
  chemically synthesized
tctcagactgtggtagcagg

SEQ ID NO: 238024 - DNA, 20 bp, Artificial Sequence
  chemically synthesized
ttctcagactgtggtagcag

SEQ ID NO: 238025 - DNA, 20 bp, Artificial Sequence
  chemically synthesized
caaccctcctcctgctacca

SEQ ID NO: 238026 - DNA, 20 bp, Artificial Sequence
  chemically synthesized
gtttctcagactgtggtagc

SEQ ID NO: 238027 - DNA, 20 bp, Artificial Sequence
  chemically synthesized
tgtttctcagactgtggtag

SEQ ID NO: 238028 - DNA, 20 bp, Artificial Sequence
  chemically synthesized
gactgtttctcagactgtgg

SEQ ID NO: 238029 - DNA, 20 bp, Artificial Sequence
  chemically synthesized
tcctcctgctaccacagtct

SEQ ID NO: 238030 - DNA, 20 bp, Artificial Sequence
  chemically synthesized
gctgactgtttctcagactg

SEQ ID NO: 238031 - DNA, 20 bp, Artificial Sequence
  chemically synthesized
tgctaccacagtctgagaaa

SEQ ID NO: 238032 - DNA, 20 bp, Artificial Sequence
  chemically synthesized
gttagctgctgactgtttct

SEQ ID NO: 238033 - DNA, 20 bp, Artificial Sequence
  chemically synthesized
accacagtctgagaaacagt

SEQ ID NO: 238034 - DNA, 20 bp, Artificial Sequence
  chemically synthesized
acagtctgagaaacagtcag

SEQ ID NO: 238035 - DNA, 20 bp, Artificial Sequence
  chemically synthesized
agaaacagtcagcagctaac

SEQ ID NO: 238036 - DNA, 20 bp, Artificial Sequence
  chemically synthesized
aaacagtcagcagctaacca

SEQ ID NO: 238037 - DNA, 20 bp, Artificial Sequence
  chemically synthesized
gtacttctctgtgctctggt

SEQ ID NO: 238038 - DNA, 20 bp, Artificial Sequence
  chemically synthesized
gtcagcagctaaccagagca

SEQ ID NO: 238039 - DNA, 20 bp, Artificial Sequence
  chemically synthesized
cagcagctaaccagagcaca

SEQ ID NO: 238040 - DNA, 20 bp, Artificial Sequence
  chemically synthesized
actggtacttctctgtgctc

SEQ ID NO: 238041 - DNA, 20 bp, Artificial Sequence
  chemically synthesized
cagctaaccagagcacagag

SEQ ID NO: 238042 - DNA, 20 bp, Artificial Sequence
  chemically synthesized
accagagcacagagaagtac

SEQ ID NO: 238043 - DNA, 20 bp, Artificial Sequence
  chemically synthesized
gagcacagagaagtaccagt

SEQ ID NO: 238044 - DNA, 20 bp, Artificial Sequence
  chemically synthesized
agtggtaagtcgtgaccaac

SEQ ID NO: 238045 - DNA, 20 bp, Artificial Sequence
  chemically synthesized
tgctacaaaggtggagtggt

SEQ ID NO: 238046 - DNA, 20 bp, Artificial Sequence
  chemically synthesized
tggttgctacaaaggtggag

SEQ ID NO: 238047 - DNA, 20 bp, Artificial Sequence
  chemically synthesized
tgatggttgctacaaaggtg

SEQ ID NO: 238048 - DNA, 20 bp, Artificial Sequence
  chemically synthesized
gacttaccactccacctttg

SEQ ID NO: 238049 - DNA, 20 bp, Artificial Sequence
  chemically synthesized
actgatggttgctacaaagg

SEQ ID NO: 238050 - DNA, 20 bp, Artificial Sequence
  chemically synthesized
gagactgatggttgctacaa

SEQ ID NO: 238051 - DNA, 20 bp, Artificial Sequence
  chemically synthesized
ggagactgatggttgctaca

SEQ ID NO: 238052 - DNA, 20 bp, Artificial Sequence
  chemically synthesized
tccacctttgtagcaaccat

SEQ ID NO: 238053 - DNA, 20 bp, Artificial Sequence
  chemically synthesized
aaaccaagagtggagactga

SEQ ID NO: 238054 - DNA, 20 bp, Artificial Sequence
  chemically synthesized
caaccatcagtctccactct

SEQ ID NO: 238055 - DNA, 20 bp, Artificial Sequence
  chemically synthesized
aaaacagcaaaccaagagtg

SEQ ID NO: 238056 - DNA, 20 bp, Artificial Sequence
  chemically synthesized
gaaaaacagcaaaccaagag

SEQ ID NO: 238057 - DNA, 20 bp, Artificial Sequence
  chemically synthesized
taggaaaaacagcaaaccaa

SEQ ID NO: 238058 - DNA, 20 bp, Artificial Sequence
  chemically synthesized
ggtaggaaaaacagcaaacc

SEQ ID NO: 238059 - DNA, 20 bp, Artificial Sequence
  chemically synthesized
aagtgattgggtaggaaaaa

SEQ ID NO: 238060 - DNA, 20 bp, Artificial Sequence
  chemically synthesized
tatagttcaagtgattgggt

SEQ ID NO: 238061 - DNA, 20 bp, Artificial Sequence
  chemically synthesized
gtatagttcaagtgattggg

SEQ ID NO: 238062 - DNA, 20 bp, Artificial Sequence
  chemically synthesized
aaagtatagttcaagtgatt

SEQ ID NO: 238063 - DNA, 20 bp, Artificial Sequence
  chemically synthesized
aaaagtatagttcaagtgat

SEQ ID NO: 238064 - DNA, 20 bp, Artificial Sequence
  chemically synthesized
tgttggcaaaagtatagttc

SEQ ID NO: 238065 - DNA, 20 bp, Artificial Sequence
  chemically synthesized
taaaagtgttggcaaaagta

SEQ ID NO: 238066 - DNA, 20 bp, Artificial Sequence
  chemically synthesized
gtagctaaaagtgttggcaa

SEQ ID NO: 238067 - DNA, 20 bp, Artificial Sequence
  chemically synthesized
tatacttttgccaacacttt

SEQ ID NO: 238068 - DNA, 20 bp, Artificial Sequence
  chemically synthesized
ctcctagtagctaaaagtgt

SEQ ID NO: 238069 - DNA, 20 bp, Artificial Sequence
  chemically synthesized
agtcacctcctagtagctaa

SEQ ID NO: 238070 - DNA, 20 bp, Artificial Sequence
  chemically synthesized
ttgccaacacttttagctac

SEQ ID NO: 238071 - DNA, 20 bp, Artificial Sequence
  chemically synthesized
tgccaacacttttagctact

SEQ ID NO: 238072 - DNA, 20 bp, Artificial Sequence
  chemically synthesized
ccaacacttttagctactag

SEQ ID NO: 238073 - DNA, 20 bp, Artificial Sequence
  chemically synthesized
caacacttttagctactagg

SEQ ID NO: 238074 - DNA, 20 bp, Artificial Sequence
  chemically synthesized
gagaaacagtcacctcctag

SEQ ID NO: 238075 - DNA, 20 bp, Artificial Sequence
  chemically synthesized
tcagagaaacagtcacctcc

SEQ ID NO: 238076 - DNA, 20 bp, Artificial Sequence
  chemically synthesized
atagcagtatgtcagagaaa

SEQ ID NO: 238077 - DNA, 20 bp, Artificial Sequence
  chemically synthesized
gcatttatagcagtatgtca

SEQ ID NO: 238078 - DNA, 20 bp, Artificial Sequence
  chemically synthesized
gggcatttatagcagtatgt

SEQ ID NO: 238079 - DNA, 20 bp, Artificial Sequence
  chemically synthesized
tgaagaatgggcatttatag

SEQ ID NO: 238080 - DNA, 20 bp, Artificial Sequence
  chemically synthesized
aaatgaagaatgggcattta

SEQ ID NO: 238081 - DNA, 20 bp, Artificial Sequence
  chemically synthesized
aggatcctgaaatgaagaat

SEQ ID NO: 238082 - DNA, 20 bp, Artificial Sequence
  chemically synthesized
caggatcctgaaatgaagaa

SEQ ID NO: 238083 - DNA, 20 bp, Artificial Sequence
  chemically synthesized
taaatgcccattcttcattt

SEQ ID NO: 238084 - DNA, 20 bp, Artificial Sequence
  chemically synthesized
aaatgcccattcttcatttc

SEQ ID NO: 238085 - DNA, 20 bp, Artificial Sequence
  chemically synthesized
gtgtacaggatcctgaaatg

SEQ ID NO: 238086 - DNA, 20 bp, Artificial Sequence
  chemically synthesized
cgaaaatctttgaggtgtac

SEQ ID NO: 238087 - DNA, 20 bp, Artificial Sequence
  chemically synthesized
tcgaaaatctttgaggtgta

SEQ ID NO: 238088 - DNA, 20 bp, Artificial Sequence
  chemically synthesized
tcaggatcctgtacacctca

SEQ ID NO: 238089 - DNA, 20 bp, Artificial Sequence
  chemically synthesized
tttgaaatcgaaaatctttg

SEQ ID NO: 238090 - DNA, 20 bp, Artificial Sequence
  chemically synthesized
gtttgaaatcgaaaatcttt

SEQ ID NO: 238091 - DNA, 20 bp, Artificial Sequence
  chemically synthesized
tcgatttcaaacctgttgca

SEQ ID NO: 238092 - DNA, 20 bp, Artificial Sequence
  chemically synthesized
gagaaacaagtctgtgcaac

SEQ ID NO: 238093 - DNA, 20 bp, Artificial Sequence
  chemically synthesized
tgagaaacaagtctgtgcaa

SEQ ID NO: 238094 - DNA, 20 bp, Artificial Sequence
  chemically synthesized
atgatgagtgattgagaaac

SEQ ID NO: 238095 - DNA, 20 bp, Artificial Sequence
  chemically synthesized
taccaatatgatgagtgatt

SEQ ID NO: 238096 - DNA, 20 bp, Artificial Sequence
  chemically synthesized
ttctcaatcactcatcatat

SEQ ID NO: 238097 - DNA, 20 bp, Artificial Sequence
  chemically synthesized
atggcaattaccaatatgat

SEQ ID NO: 238098 - DNA, 20 bp, Artificial Sequence
  chemically synthesized
ttgttgaatttgatagagga

SEQ ID NO: 238099 - DNA, 20 bp, Artificial Sequence
  chemically synthesized
ggatttgttgaatttgatag

SEQ ID NO: 238100 - DNA, 20 bp, Artificial Sequence
  chemically synthesized
gggatttgttgaatttgata

SEQ ID NO: 238101 - DNA, 20 bp, Artificial Sequence
  chemically synthesized
gggggatttgttgaatttga

SEQ ID NO: 238102 - DNA, 20 bp, Artificial Sequence
  chemically synthesized
aaagaattcagggtgagagg

SEQ ID NO: 238103 - DNA, 20 bp, Artificial Sequence
  chemically synthesized
aaaagaattcagggtgagag

SEQ ID NO: 238104 - DNA, 20 bp, Artificial Sequence
  chemically synthesized
gaaaagaattcagggtgaga

SEQ ID NO: 238105 - DNA, 20 bp, Artificial Sequence
  chemically synthesized
ggaaaagaattcagggtgag

SEQ ID NO: 238106 - DNA, 20 bp, Artificial Sequence
  chemically synthesized
aggaaaagaattcagggtga

SEQ ID NO: 238107 - DNA, 20 bp, Artificial Sequence
  chemically synthesized
aaaggaaaagaattcagggt

SEQ ID NO: 238108 - DNA, 20 bp, Artificial Sequence
  chemically synthesized
gtaaaaaggaaaagaattca

SEQ ID NO: 238109 - DNA, 20 bp, Artificial Sequence
  chemically synthesized
tgtaaaaaggaaaagaattc

SEQ ID NO: 238110 - DNA, 20 bp, Artificial Sequence
  chemically synthesized
ttgtaaaaaggaaaagaatt

SEQ ID NO: 238111 - DNA, 20 bp, Artificial Sequence
  chemically synthesized
agataacttgtaaaaaggaa

SEQ ID NO: 238112 - DNA, 20 bp, Artificial Sequence
  chemically synthesized
tgaattcttttcctttttac

SEQ ID NO: 238113 - DNA, 20 bp, Artificial Sequence
  chemically synthesized
cttgtagataacttgtaaaa

SEQ ID NO: 238114 - DNA, 20 bp, Artificial Sequence
  chemically synthesized
acttgtagataacttgtaaa

SEQ ID NO: 238115 - DNA, 20 bp, Artificial Sequence
  chemically synthesized
cctttttacaagttatctac

SEQ ID NO: 238116 - DNA, 20 bp, Artificial Sequence
  chemically synthesized
agataacttgtagaaacttg

SEQ ID NO: 238117 - DNA, 20 bp, Artificial Sequence
  chemically synthesized
agttatctacaagtttctac

SEQ ID NO: 238118 - DNA, 20 bp, Artificial Sequence
  chemically synthesized
tgtaaaggaaagataacttg

SEQ ID NO: 238119 - DNA, 20 bp, Artificial Sequence
  chemically synthesized
tcttgggagaatgtaaagga

SEQ ID NO: 238120 - DNA, 20 bp, Artificial Sequence
  chemically synthesized
cttctcttgggagaatgtaa

SEQ ID NO: 238121 - DNA, 20 bp, Artificial Sequence
  chemically synthesized
tcttctcttgggagaatgta

SEQ ID NO: 238122 - DNA, 20 bp, Artificial Sequence
  chemically synthesized
tctttcctttacattctccc

SEQ ID NO: 238123 - DNA, 20 bp, Artificial Sequence
  chemically synthesized
tttcctttacattctcccaa

SEQ ID NO: 238124 - DNA, 20 bp, Artificial Sequence
  chemically synthesized
cctttacattctcccaagag

SEQ ID NO: 238125 - DNA, 20 bp, Artificial Sequence
  chemically synthesized
ttacggttttcttctcttgg

SEQ ID NO: 238126 - DNA, 20 bp, Artificial Sequence
  chemically synthesized
ccttacggttttcttctctt

SEQ ID NO: 238127 - DNA, 20 bp, Artificial Sequence
  chemically synthesized
cccttacggttttcttctct

SEQ ID NO: 238128 - DNA, 20 bp, Artificial Sequence
  chemically synthesized
tcccaagagaagaaaaccgt

SEQ ID NO: 238129 - DNA, 20 bp, Artificial Sequence
  chemically synthesized
cccaagagaagaaaaccgta

SEQ ID NO: 238130 - DNA, 20 bp, Artificial Sequence
  chemically synthesized
ccaagagaagaaaaccgtaa

SEQ ID NO: 238131 - DNA, 20 bp, Artificial Sequence
  chemically synthesized
agcaagtgtatgaaccctta

SEQ ID NO: 238132 - DNA, 20 bp, Artificial Sequence
  chemically synthesized
agggttcatacacttgctca

SEQ ID NO: 238133 - DNA, 20 bp, Artificial Sequence
  chemically synthesized
gagctacggataccatgagc

SEQ ID NO: 238134 - DNA, 20 bp, Artificial Sequence
  chemically synthesized
tacagagctacggataccat

SEQ ID NO: 238135 - DNA, 20 bp, Artificial Sequence
  chemically synthesized
acacttgctcatggtatccg

SEQ ID NO: 238136 - DNA, 20 bp, Artificial Sequence
  chemically synthesized
agctctgtcttacagagcta

SEQ ID NO: 238137 - DNA, 20 bp, Artificial Sequence
  chemically synthesized
catggtatccgtagctctgt

SEQ ID NO: 238138 - DNA, 20 bp, Artificial Sequence
  chemically synthesized
gtatccgtagctctgtaaga

SEQ ID NO: 238139 - DNA, 20 bp, Artificial Sequence
  chemically synthesized
acctccagctctgtcttaca

SEQ ID NO: 238140 - DNA, 20 bp, Artificial Sequence
  chemically synthesized
atccgtagctctgtaagaca

SEQ ID NO: 238141 - DNA, 20 bp, Artificial Sequence
  chemically synthesized
ctacctccagctctgtctta

SEQ ID NO: 238142 - DNA, 20 bp, Artificial Sequence
  chemically synthesized
gtagctctgtaagacagagc

SEQ ID NO: 238143 - DNA, 20 bp, Artificial Sequence
  chemically synthesized
agctctgtaagacagagctg

SEQ ID NO: 238144 - DNA, 20 bp, Artificial Sequence
  chemically synthesized
gctctgtaagacagagctgg

SEQ ID NO: 238145 - DNA, 20 bp, Artificial Sequence
  chemically synthesized
ctgtaagacagagctggagg

SEQ ID NO: 238146 - DNA, 20 bp, Artificial Sequence
  chemically synthesized
tgtaagacagagctggaggt

SEQ ID NO: 238147 - DNA, 20 bp, Artificial Sequence
  chemically synthesized
tccccttctcttcctacctc

SEQ ID NO: 238148 - DNA, 20 bp, Artificial Sequence
  chemically synthesized
aagacagagctggaggtagg

SEQ ID NO: 238149 - DNA, 20 bp, Artificial Sequence
  chemically synthesized
gacagagctggaggtaggaa

SEQ ID NO: 238150 - DNA, 20 bp, Artificial Sequence
  chemically synthesized
agagctggaggtaggaagag

SEQ ID NO: 238151 - DNA, 20 bp, Artificial Sequence
  chemically synthesized
gagctggaggtaggaagaga

SEQ ID NO: 238152 - DNA, 20 bp, Artificial Sequence
  chemically synthesized
agctggaggtaggaagagaa

SEQ ID NO: 238153 - DNA, 20 bp, Artificial Sequence
  chemically synthesized
gctggaggtaggaagagaag

SEQ ID NO: 238154 - DNA, 20 bp, Artificial Sequence
  chemically synthesized
aggtaggaagagaaggggaa

SEQ ID NO: 238155 - DNA, 20 bp, Artificial Sequence
  chemically synthesized
ggtaggaagagaaggggaac

SEQ ID NO: 238156 - DNA, 20 bp, Artificial Sequence
  chemically synthesized
ggaacaatggtgtaagtgga

SEQ ID NO: 238157 - DNA, 20 bp, Artificial Sequence
  chemically synthesized
tggaacaatggtgtaagtgg

SEQ ID NO: 238158 - DNA, 20 bp, Artificial Sequence
  chemically synthesized
gcctggaacaatggtgtaag

SEQ ID NO: 238159 - DNA, 20 bp, Artificial Sequence
  chemically synthesized
tgggcctggaacaatggtgt

SEQ ID NO: 238160 - DNA, 20 bp, Artificial Sequence
  chemically synthesized
ttccacttacaccattgttc

SEQ ID NO: 238161 - DNA, 20 bp, Artificial Sequence
  chemically synthesized
tccacttacaccattgttcc

SEQ ID NO: 238162 - DNA, 20 bp, Artificial Sequence
  chemically synthesized
ctcttgtgggcctggaacaa

SEQ ID NO: 238163 - DNA, 20 bp, Artificial Sequence
  chemically synthesized
caccattgttccaggcccac

SEQ ID NO: 238164 - DNA, 20 bp, Artificial Sequence
  chemically synthesized
ctgcctccctcttgtgggcc

SEQ ID NO: 238165 - DNA, 20 bp, Artificial Sequence
  chemically synthesized
ccattgttccaggcccacaa

SEQ ID NO: 238166 - DNA, 20 bp, Artificial Sequence
  chemically synthesized
cattgttccaggcccacaag

SEQ ID NO: 238167 - DNA, 20 bp, Artificial Sequence
  chemically synthesized
attgttccaggcccacaaga

SEQ ID NO: 238168 - DNA, 20 bp, Artificial Sequence
  chemically synthesized
ccatcctgcctccctcttgt

SEQ ID NO: 238169 - DNA, 20 bp, Artificial Sequence
  chemically synthesized
tgttccaggcccacaagagg

SEQ ID NO: 238170 - DNA, 20 bp, Artificial Sequence
  chemically synthesized
tccatcctgcctccctcttg

SEQ ID NO: 238171 - DNA, 20 bp, Artificial Sequence
  chemically synthesized
gttccaggcccacaagaggg

SEQ ID NO: 238172 - DNA, 20 bp, Artificial Sequence
  chemically synthesized
ccaggcccacaagagggagg

SEQ ID NO: 238173 - DNA, 20 bp, Artificial Sequence
  chemically synthesized
caggcccacaagagggaggc

SEQ ID NO: 238174 - DNA, 20 bp, Artificial Sequence
  chemically synthesized
cccacaagagggaggcagga

SEQ ID NO: 238175 - DNA, 20 bp, Artificial Sequence
  chemically synthesized
agtagcaggggtcgggcaga

SEQ ID NO: 238176 - DNA, 20 bp, Artificial Sequence
  chemically synthesized
agacagtagcaggggtcggg

SEQ ID NO: 238177 - DNA, 20 bp, Artificial Sequence
  chemically synthesized
ctaagacagtagcaggggtc

SEQ ID NO: 238178 - DNA, 20 bp, Artificial Sequence
  chemically synthesized
cctaagacagtagcaggggt

SEQ ID NO: 238179 - DNA, 20 bp, Artificial Sequence
  chemically synthesized
aagtcctaagacagtagcag

SEQ ID NO: 238180 - DNA, 20 bp, Artificial Sequence
  chemically synthesized
caagtcctaagacagtagca

SEQ ID NO: 238181 - DNA, 20 bp, Artificial Sequence
  chemically synthesized
acaagtcctaagacagtagc

SEQ ID NO: 238182 - DNA, 20 bp, Artificial Sequence
  chemically synthesized
cacaagtcctaagacagtag

SEQ ID NO: 238183 - DNA, 20 bp, Artificial Sequence
  chemically synthesized
cccgacccctgctactgtct

SEQ ID NO: 238184 - DNA, 20 bp, Artificial Sequence
  chemically synthesized
ccgacccctgctactgtctt

SEQ ID NO: 238185 - DNA, 20 bp, Artificial Sequence
  chemically synthesized
attcacaagtcctaagacag

SEQ ID NO: 238186 - DNA, 20 bp, Artificial Sequence
  chemically synthesized
caaattcacaagtcctaaga

SEQ ID NO: 238187 - DNA, 20 bp, Artificial Sequence
  chemically synthesized
tatgcaaattcacaagtcct

SEQ ID NO: 238188 - DNA, 20 bp, Artificial Sequence
  chemically synthesized
ctaccgatatgcaaattcac

SEQ ID NO: 238189 - DNA, 20 bp, Artificial Sequence
  chemically synthesized
ggacttgtgaatttgcatat

SEQ ID NO: 238190 - DNA, 20 bp, Artificial Sequence
  chemically synthesized
cttgtgaatttgcatatcgg

SEQ ID NO: 238191 - DNA, 20 bp, Artificial Sequence
  chemically synthesized
aaaagggaagaagggcattt

SEQ ID NO: 238192 - DNA, 20 bp, Artificial Sequence
  chemically synthesized
acgagagaaaaagggaagaa

SEQ ID NO: 238193 - DNA, 20 bp, Artificial Sequence
  chemically synthesized
gacgagagaaaaagggaaga

SEQ ID NO: 238194 - DNA, 20 bp, Artificial Sequence
  chemically synthesized
agacgagagaaaaagggaag

SEQ ID NO: 238195 - DNA, 20 bp, Artificial Sequence
  chemically synthesized
aggagacgagagaaaaaggg

SEQ ID NO: 238196 - DNA, 20 bp, Artificial Sequence
  chemically synthesized
acgaggagacgagagaaaaa

SEQ ID NO: 238197 - DNA, 20 bp, Artificial Sequence
  chemically synthesized
tacgaggagacgagagaaaa

SEQ ID NO: 238198 - DNA, 20 bp, Artificial Sequence
  chemically synthesized
atacgaggagacgagagaaa

SEQ ID NO: 238199 - DNA, 20 bp, Artificial Sequence
  chemically synthesized
tggattatacgaggagacga

SEQ ID NO: 238200 - DNA, 20 bp, Artificial Sequence
  chemically synthesized
tttggattatacgaggagac

SEQ ID NO: 238201 - DNA, 20 bp, Artificial Sequence
  chemically synthesized
aaaagtttggattatacgag

SEQ ID NO: 238202 - DNA, 20 bp, Artificial Sequence
  chemically synthesized
gcaaaagtttggattatacg

SEQ ID NO: 238203 - DNA, 20 bp, Artificial Sequence
  chemically synthesized
tgcaaaagtttggattatac

SEQ ID NO: 238204 - DNA, 20 bp, Artificial Sequence
  chemically synthesized
tccttgaggatgcaaaagtt

SEQ ID NO: 238205 - DNA, 20 bp, Artificial Sequence
  chemically synthesized
ttaggtccttgaggatgcaa

SEQ ID NO: 238206 - DNA, 20 bp, Artificial Sequence
  chemically synthesized
atccaaacttttgcatcctc

SEQ ID NO: 238207 - DNA, 20 bp, Artificial Sequence
  chemically synthesized
tccaaacttttgcatcctca

SEQ ID NO: 238208 - DNA, 20 bp, Artificial Sequence
  chemically synthesized
tcatttttattaggtccttg

SEQ ID NO: 238209 - DNA, 20 bp, Artificial Sequence
  chemically synthesized
gtcatttttattaggtcctt

SEQ ID NO: 238210 - DNA, 20 bp, Artificial Sequence
  chemically synthesized
cagcataagtcatttttatt

SEQ ID NO: 238211 - DNA, 20 bp, Artificial Sequence
  chemically synthesized
acagcataagtcatttttat

SEQ ID NO: 238212 - DNA, 20 bp, Artificial Sequence
  chemically synthesized
tatttataaagtgacagcat

SEQ ID NO: 238213 - DNA, 20 bp, Artificial Sequence
  chemically synthesized
tttatatatttataaagtga

SEQ ID NO: 238214 - DNA, 20 bp, Artificial Sequence
  chemically synthesized
ttcatatttatatatttata

SEQ ID NO: 238215 - DNA, 20 bp, Artificial Sequence
  chemically synthesized
tttataaatatataaatatg

SEQ ID NO: 238216 - DNA, 20 bp, Artificial Sequence
  chemically synthesized
taaatatgaagtatttatta

SEQ ID NO: 238217 - DNA, 20 bp, Artificial Sequence
  chemically synthesized
tacagttttcaaaggtttag

SEQ ID NO: 238218 - DNA, 20 bp, Artificial Sequence
  chemically synthesized
ctttacagttttcaaaggtt

SEQ ID NO: 238219 - DNA, 20 bp, Artificial Sequence
  chemically synthesized
atcaactttacagttttcaa

SEQ ID NO: 238220 - DNA, 20 bp, Artificial Sequence
  chemically synthesized
aatcaactttacagttttca

SEQ ID NO: 238221 - DNA, 20 bp, Artificial Sequence
  chemically synthesized
ctaaacctttgaaaactgta

SEQ ID NO: 238222 - DNA, 20 bp, Artificial Sequence
  chemically synthesized
ataaaattaaatcaacttta

SEQ ID NO: 238223 - DNA, 20 bp, Artificial Sequence
  chemically synthesized
attgaaattactgttgaaat

SEQ ID NO: 238224 - DNA, 20 bp, Artificial Sequence
  chemically synthesized
tgaatagttacttatttcaa

SEQ ID NO: 238225 - DNA, 20 bp, Artificial Sequence
  chemically synthesized
tctttaatattttgtttgaa

SEQ ID NO: 238226 - DNA, 20 bp, Artificial Sequence
  chemically synthesized
actattcaaacaaaatatta

SEQ ID NO: 238227 - DNA, 20 bp, Artificial Sequence
  chemically synthesized
aatattaaagaataaaatca

SEQ ID NO: 238228 - DNA, 20 bp, Artificial Sequence
  chemically synthesized
atattaaagaataaaatcat

SEQ ID NO: 238229 - DNA, 20 bp, Artificial Sequence
  chemically synthesized
attaagtgtcatcacatgta

SEQ ID NO: 238230 - DNA, 20 bp, Artificial Sequence
  chemically synthesized
catgtgatgacacttaatgt

SEQ ID NO: 238231 - DNA, 20 bp, Artificial Sequence
  chemically synthesized
aaagtattattactcacatt

SEQ ID NO: 238232 - DNA, 20 bp, Artificial Sequence
  chemically synthesized
taatgtgagtaataatactt

SEQ ID NO: 238233 - DNA, 20 bp, Artificial Sequence
  chemically synthesized
gaggcttgaaatggagtcta

SEQ ID NO: 238234 - DNA, 20 bp, Artificial Sequence
  chemically synthesized
aatactttagactccatttc

SEQ ID NO: 238235 - DNA, 20 bp, Artificial Sequence
  chemically synthesized
tttatgtgaggcttgaaatg

SEQ ID NO: 238236 - DNA, 20 bp, Artificial Sequence
  chemically synthesized
attttatgtgaggcttgaaa

SEQ ID NO: 238237 - DNA, 20 bp, Artificial Sequence
  chemically synthesized
gtattttaaaattttatgtg

SEQ ID NO: 238238 - DNA, 20 bp, Artificial Sequence
  chemically synthesized
tgtattttaaaattttatgt

SEQ ID NO: 238239 - DNA, 20 bp, Artificial Sequence
  chemically synthesized
aaattttaaaatacactttt

SEQ ID NO: 238240 - DNA, 20 bp, Artificial Sequence
  chemically synthesized
agcacctattaaatactgaa

SEQ ID NO: 238241 - DNA, 20 bp, Artificial Sequence
  chemically synthesized
atacacttttcagtatttaa

SEQ ID NO: 238242 - DNA, 20 bp, Artificial Sequence
  chemically synthesized
tacacttttcagtatttaat

SEQ ID NO: 238243 - DNA, 20 bp, Artificial Sequence
  chemically synthesized
tatttaataggtgctgttaa

SEQ ID NO: 238244 - DNA, 20 bp, Artificial Sequence
  chemically synthesized
gatttagactgtgctattaa

SEQ ID NO: 238245 - DNA, 20 bp, Artificial Sequence
  chemically synthesized
aataggtgctgttaatagca

SEQ ID NO: 238246 - DNA, 20 bp, Artificial Sequence
  chemically synthesized
agtaaattcaagaatagatt

SEQ ID NO: 238247 - DNA, 20 bp, Artificial Sequence
  chemically synthesized
ttacgtagtaaattcaagaa

SEQ ID NO: 238248 - DNA, 20 bp, Artificial Sequence
  chemically synthesized
taattttacgtagtaaattc

SEQ ID NO: 238249 - DNA, 20 bp, Artificial Sequence
  chemically synthesized
ataaaaaatgtaattttacg

SEQ ID NO: 238250 - DNA, 20 bp, Artificial Sequence
  chemically synthesized
ggtggaaaagagtttaaaag

SEQ ID NO: 238251 - DNA, 20 bp, Artificial Sequence
  chemically synthesized
cttggtggaaaagagtttaa

SEQ ID NO: 238252 - DNA, 20 bp, Artificial Sequence
  chemically synthesized
gaattttccttggtggaaaa

SEQ ID NO: 238253 - DNA, 20 bp, Artificial Sequence
  chemically synthesized
cttttaaactcttttccacc

SEQ ID NO: 238254 - DNA, 20 bp, Artificial Sequence
  chemically synthesized
tggaattttccttggtggaa

SEQ ID NO: 238255 - DNA, 20 bp, Artificial Sequence
  chemically synthesized
ttttaaactcttttccacca

SEQ ID NO: 238256 - DNA, 20 bp, Artificial Sequence
  chemically synthesized
tcatttggaattttccttgg

SEQ ID NO: 238257 - DNA, 20 bp, Artificial Sequence
  chemically synthesized
ttttcatttggaattttcct

SEQ ID NO: 238258 - DNA, 20 bp, Artificial Sequence
  chemically synthesized
atatatatatttttttcatt

SEQ ID NO: 238259 - DNA, 20 bp, Artificial Sequence
  chemically synthesized
aaatatatatatattttttc

SEQ ID NO: 238260 - DNA, 20 bp, Artificial Sequence
  chemically synthesized
taaatctaactttgtaaaac

SEQ ID NO: 238261 - DNA, 20 bp, Artificial Sequence
  chemically synthesized
atattttttctggttttaca

SEQ ID NO: 238262 - DNA, 20 bp, Artificial Sequence
  chemically synthesized
tttttctggttttacaaagt

SEQ ID NO: 238263 - DNA, 20 bp, Artificial Sequence
  chemically synthesized
tgactaattagatattaaat

SEQ ID NO: 238264 - DNA, 20 bp, Artificial Sequence
  chemically synthesized
ttaccaatttaatatctaat

SEQ ID NO: 238265 - DNA, 20 bp, Artificial Sequence
  chemically synthesized
tagggagcacagtgactaat

SEQ ID NO: 238266 - DNA, 20 bp, Artificial Sequence
  chemically synthesized
cgagacaaatttagggagca

SEQ ID NO: 238267 - DNA, 20 bp, Artificial Sequence
  chemically synthesized
tggagcgagacaaatttagg

SEQ ID NO: 238268 - DNA, 20 bp, Artificial Sequence
  chemically synthesized
aatggagcgagacaaattta

SEQ ID NO: 238269 - DNA, 20 bp, Artificial Sequence
  chemically synthesized
taatggagcgagacaaattt

SEQ ID NO: 238270 - DNA, 20 bp, Artificial Sequence
  chemically synthesized
ttaatggagcgagacaaatt

SEQ ID NO: 238271 - DNA, 20 bp, Artificial Sequence
  chemically synthesized
ggcagcccaattaatggagc

SEQ ID NO: 238272 - DNA, 20 bp, Artificial Sequence
  chemically synthesized
atttgtctcgctccattaat

SEQ ID NO: 238273 - DNA, 20 bp, Artificial Sequence
  chemically synthesized
catgggcagcccaattaatg

SEQ ID NO: 238274 - DNA, 20 bp, Artificial Sequence
  chemically synthesized
tttgtctcgctccattaatt

SEQ ID NO: 238275 - DNA, 20 bp, Artificial Sequence
  chemically synthesized
ttcatgggcagcccaattaa

SEQ ID NO: 238276 - DNA, 20 bp, Artificial Sequence
  chemically synthesized
ccatttgcttcattcatggg

SEQ ID NO: 238277 - DNA, 20 bp, Artificial Sequence
  chemically synthesized
aattgggctgcccatgaatg

SEQ ID NO: 238278 - DNA, 20 bp, Artificial Sequence
  chemically synthesized
ttaccatttgcttcattcat

SEQ ID NO: 238279 - DNA, 20 bp, Artificial Sequence
  chemically synthesized
gttaccatttgcttcattca

SEQ ID NO: 238280 - DNA, 20 bp, Artificial Sequence
  chemically synthesized
ctgcccatgaatgaagcaaa

SEQ ID NO: 238281 - DNA, 20 bp, Artificial Sequence
  chemically synthesized
atgaagcaaatggtaacaat

SEQ ID NO: 238282 - DNA, 20 bp, Artificial Sequence
  chemically synthesized
aaatggtaacaatgagaaac

SEQ ID NO: 238283 - DNA, 20 bp, Artificial Sequence
  chemically synthesized
tggtaacaatgagaaacaag

SEQ ID NO: 238284 - DNA, 20 bp, Artificial Sequence
  chemically synthesized
gtaacaatgagaaacaagta

SEQ ID NO: 238285 - DNA, 20 bp, Artificial Sequence
  chemically synthesized
acaagtagagacatcaaaaa

SEQ ID NO: 238286 - DNA, 20 bp, Artificial Sequence
  chemically synthesized
gagacatcaaaaatagcatt

SEQ ID NO: 238287 - DNA, 20 bp, Artificial Sequence
  chemically synthesized
agacatcaaaaatagcattc

SEQ ID NO: 238288 - DNA, 20 bp, Artificial Sequence
  chemically synthesized
gacatcaaaaatagcattca

SEQ ID NO: 238289 - DNA, 20 bp, Artificial Sequence
  chemically synthesized
tttcctagaaatattacaga

SEQ ID NO: 238290 - DNA, 20 bp, Artificial Sequence
  chemically synthesized
ttttcctagaaatattacag

SEQ ID NO: 238291 - DNA, 20 bp, Artificial Sequence
  chemically synthesized
tttttttcctagaaatatta

SEQ ID NO: 238292 - DNA, 20 bp, Artificial Sequence
  chemically synthesized
tttgccttctgtaatatttc

SEQ ID NO: 238293 - DNA, 20 bp, Artificial Sequence
  chemically synthesized
ttgccttctgtaatatttct

SEQ ID NO: 238294 - DNA, 20 bp, Artificial Sequence
  chemically synthesized
tgtaatatttctaggaaaaa

SEQ ID NO: 238295 - DNA, 20 bp, Artificial Sequence
  chemically synthesized
agaaaaaaaactttttttcc

SEQ ID NO: 238296 - DNA, 20 bp, Artificial Sequence
  chemically synthesized
ggaaaaaaagttttttttct

SEQ ID NO: 238297 - DNA, 20 bp, Artificial Sequence
  chemically synthesized
aaaaaagttttttttcttgg

SEQ ID NO: 238298 - DNA, 20 bp, Artificial Sequence
  chemically synthesized
aagttttttttcttggcagt

SEQ ID NO: 238299 - DNA, 20 bp, Artificial Sequence
  chemically synthesized
ccatatttcttcttactgcc

SEQ ID NO: 238300 - DNA, 20 bp, Artificial Sequence
  chemically synthesized
ttttttttcttggcagtaag

SEQ ID NO: 238301 - DNA, 20 bp, Artificial Sequence
  chemically synthesized
cttggcagtaagaagaaata

SEQ ID NO: 238302 - DNA, 20 bp, Artificial Sequence
  chemically synthesized
gcagtaagaagaaatatgga

SEQ ID NO: 238303 - DNA, 20 bp, Artificial Sequence
  chemically synthesized
aatatggatggaacttaaca

SEQ ID NO: 238304 - DNA, 20 bp, Artificial Sequence
  chemically synthesized
atatggatggaacttaacaa

SEQ ID NO: 238305 - DNA, 20 bp, Artificial Sequence
  chemically synthesized
tatggatggaacttaacaaa

SEQ ID NO: 238306 - DNA, 20 bp, Artificial Sequence
  chemically synthesized
acatttttttgccctttgtt

SEQ ID NO: 238307 - DNA, 20 bp, Artificial Sequence
  chemically synthesized
aacaaagggcaaaaaaatgt

SEQ ID NO: 238308 - DNA, 20 bp, Artificial Sequence
  chemically synthesized
aaaaatgtcagtataaacat

SEQ ID NO: 238309 - DNA, 20 bp, Artificial Sequence
  chemically synthesized
aaaatgtcagtataaacata

SEQ ID NO: 238310 - DNA, 20 bp, Artificial Sequence
  chemically synthesized
aaacataaggataataaatc

SEQ ID NO: 238311 - DNA, 20 bp, Artificial Sequence
  chemically synthesized
gataataaatcaagtgattt

SEQ ID NO: 238312 - DNA, 20 bp, Artificial Sequence
  chemically synthesized
ataccggttgcacggtgaat

SEQ ID NO: 238313 - DNA, 20 bp, Artificial Sequence
  chemically synthesized
attctcattcaccgtgcaac

SEQ ID NO: 238314 - DNA, 20 bp, Artificial Sequence
  chemically synthesized
aattttaaataccggttgca

SEQ ID NO: 238315 - DNA, 20 bp, Artificial Sequence
  chemically synthesized
agcagtgtaattttaaatac

SEQ ID NO: 238316 - DNA, 20 bp, Artificial Sequence
  chemically synthesized
gctgcacataaatgaagcag

SEQ ID NO: 238317 - DNA, 20 bp, Artificial Sequence
  chemically synthesized
tatgctgcacataaatgaag

SEQ ID NO: 238318 - DNA, 20 bp, Artificial Sequence
  chemically synthesized
agttatgctgcacataaatg

SEQ ID NO: 238319 - DNA, 20 bp, Artificial Sequence
  chemically synthesized
actgctgcttcatttatgtg

SEQ ID NO: 238320 - DNA, 20 bp, Artificial Sequence
  chemically synthesized
gatttagaacatcagaaaat

SEQ ID NO: 238321 - DNA, 20 bp, Artificial Sequence
  chemically synthesized
actaacttgatttagaacat

SEQ ID NO: 238322 - DNA, 20 bp, Artificial Sequence
  chemically synthesized
attttctgatgttctaaatc

SEQ ID NO: 238323 - DNA, 20 bp, Artificial Sequence
  chemically synthesized
ataatctgactaacttgatt

SEQ ID NO: 238324 - DNA, 20 bp, Artificial Sequence
  chemically synthesized
tctgatgttctaaatcaagt

SEQ ID NO: 238325 - DNA, 20 bp, Artificial Sequence
  chemically synthesized
atgttctaaatcaagttagt

SEQ ID NO: 238326 - DNA, 20 bp, Artificial Sequence
  chemically synthesized
aagttagtcagattattctc

SEQ ID NO: 238327 - DNA, 20 bp, Artificial Sequence
  chemically synthesized
cctaaatgtaatttatgctt

SEQ ID NO: 238328 - DNA, 20 bp, Artificial Sequence
  chemically synthesized
tctcaagcataaattacatt

SEQ ID NO: 238329 - DNA, 20 bp, Artificial Sequence
  chemically synthesized
ctcaagcataaattacattt

SEQ ID NO: 238330 - DNA, 20 bp, Artificial Sequence
  chemically synthesized
tcaagcataaattacattta

SEQ ID NO: 238331 - DNA, 20 bp, Artificial Sequence
  chemically synthesized
aagcataaattacatttagg

SEQ ID NO: 238332 - DNA, 20 bp, Artificial Sequence
  chemically synthesized
attacatttagggagtaatt

SEQ ID NO: 238333 - DNA, 20 bp, Artificial Sequence
  chemically synthesized
tagggagtaattcggtactc

SEQ ID NO: 238334 - DNA, 20 bp, Artificial Sequence
  chemically synthesized
agggagtaattcggtactct

SEQ ID NO: 238335 - DNA, 20 bp, Artificial Sequence
  chemically synthesized
gggagtaattcggtactctg

SEQ ID NO: 238336 - DNA, 20 bp, Artificial Sequence
  chemically synthesized
aagtgttaaagtatgcccca

SEQ ID NO: 238337 - DNA, 20 bp, Artificial Sequence
  chemically synthesized
gaaagtgttaaagtatgccc

SEQ ID NO: 238338 - DNA, 20 bp, Artificial Sequence
  chemically synthesized
ttaatggcccgaaagtgtta

SEQ ID NO: 238339 - DNA, 20 bp, Artificial Sequence
  chemically synthesized
ggggcatactttaacacttt

SEQ ID NO: 238340 - DNA, 20 bp, Artificial Sequence
  chemically synthesized
gggcatactttaacactttc

SEQ ID NO: 238341 - DNA, 20 bp, Artificial Sequence
  chemically synthesized
ctaccaccttaatggcccga

SEQ ID NO: 238342 - DNA, 20 bp, Artificial Sequence
  chemically synthesized
tttaacactttcgggccatt

SEQ ID NO: 238343 - DNA, 20 bp, Artificial Sequence
  chemically synthesized
ttaacactttcgggccatta

SEQ ID NO: 238344 - DNA, 20 bp, Artificial Sequence
  chemically synthesized
acactttcgggccattaagg

SEQ ID NO: 238345 - DNA, 20 bp, Artificial Sequence
  chemically synthesized
ggaatttactaccaccttaa

SEQ ID NO: 238346 - DNA, 20 bp, Artificial Sequence
  chemically synthesized
ctttcgggccattaaggtgg

SEQ ID NO: 238347 - DNA, 20 bp, Artificial Sequence
  chemically synthesized
tggtagtaaattccatgaaa

SEQ ID NO: 238348 - DNA, 20 bp, Artificial Sequence
  chemically synthesized
atttatttaaatctatttca

SEQ ID NO: 238349 - DNA, 20 bp, Artificial Sequence
  chemically synthesized
gatttaaataaataacaccc

SEQ ID NO: 238350 - DNA, 20 bp, Artificial Sequence
  chemically synthesized
ttaaataaataacaccctag

SEQ ID NO: 238351 - DNA, 20 bp, Artificial Sequence
  chemically synthesized
gatatgtcagaagtctacta

SEQ ID NO: 238352 - DNA, 20 bp, Artificial Sequence
  chemically synthesized
ggatatgtcagaagtctact

SEQ ID NO: 238353 - DNA, 20 bp, Artificial Sequence
  chemically synthesized
tggatatgtcagaagtctac

SEQ ID NO: 238354 - DNA, 20 bp, Artificial Sequence
  chemically synthesized
agcaacaatggatatgtcag

SEQ ID NO: 238355 - DNA, 20 bp, Artificial Sequence
  chemically synthesized
taaagcaacaatggatatgt

SEQ ID NO: 238356 - DNA, 20 bp, Artificial Sequence
  chemically synthesized
accgaagtataaagcaacaa

SEQ ID NO: 238357 - DNA, 20 bp, Artificial Sequence
  chemically synthesized
tccattgttgctttatactt

SEQ ID NO: 238358 - DNA, 20 bp, Artificial Sequence
  chemically synthesized
agtttccagaccgaagtata

SEQ ID NO: 238359 - DNA, 20 bp, Artificial Sequence
  chemically synthesized
tgttgctttatacttcggtc

SEQ ID NO: 238360 - DNA, 20 bp, Artificial Sequence
  chemically synthesized
aatgctgagtttccagaccg

SEQ ID NO: 238361 - DNA, 20 bp, Artificial Sequence
  chemically synthesized
tatacttcggtctggaaact

SEQ ID NO: 238362 - DNA, 20 bp, Artificial Sequence
  chemically synthesized
gcagtccaatgctgagtttc

SEQ ID NO: 238363 - DNA, 20 bp, Artificial Sequence
  chemically synthesized
tcggtctggaaactcagcat

SEQ ID NO: 238364 - DNA, 20 bp, Artificial Sequence
  chemically synthesized
ataatcagcagtccaatgct

SEQ ID NO: 238365 - DNA, 20 bp, Artificial Sequence
  chemically synthesized
ggatgggatgaaataatcag

SEQ ID NO: 238366 - DNA, 20 bp, Artificial Sequence
  chemically synthesized
gtgggatgggatgaaataat

SEQ ID NO: 238367 - DNA, 20 bp, Artificial Sequence
  chemically synthesized
aaagatgaaatatgtgggat

SEQ ID NO: 238368 - DNA, 20 bp, Artificial Sequence
  chemically synthesized
caaagatgaaatatgtggga

SEQ ID NO: 238369 - DNA, 20 bp, Artificial Sequence
  chemically synthesized
taatcaaagatgaaatatgt

SEQ ID NO: 238370 - DNA, 20 bp, Artificial Sequence
  chemically synthesized
ctaatcaaagatgaaatatg

SEQ ID NO: 238371 - DNA, 20 bp, Artificial Sequence
  chemically synthesized
ccacatatttcatctttgat

SEQ ID NO: 238372 - DNA, 20 bp, Artificial Sequence
  chemically synthesized
cacatatttcatctttgatt

SEQ ID NO: 238373 - DNA, 20 bp, Artificial Sequence
  chemically synthesized
ccctcctcctcacctaatca

SEQ ID NO: 238374 - DNA, 20 bp, Artificial Sequence
  chemically synthesized
tatttcatctttgattaggt

SEQ ID NO: 238375 - DNA, 20 bp, Artificial Sequence
  chemically synthesized
atttcatctttgattaggtg

SEQ ID NO: 238376 - DNA, 20 bp, Artificial Sequence
  chemically synthesized
ttcatctttgattaggtgag

SEQ ID NO: 238377 - DNA, 20 bp, Artificial Sequence
  chemically synthesized
tcatctttgattaggtgagg

SEQ ID NO: 238378 - DNA, 20 bp, Artificial Sequence
  chemically synthesized
atctttgattaggtgaggag

SEQ ID NO: 238379 - DNA, 20 bp, Artificial Sequence
  chemically synthesized
tctttgattaggtgaggagg

SEQ ID NO: 238380 - DNA, 20 bp, Artificial Sequence
  chemically synthesized
ctttgattaggtgaggagga

SEQ ID NO: 238381 - DNA, 20 bp, Artificial Sequence
  chemically synthesized
taggtgaggaggagggacct

SEQ ID NO: 238382 - DNA, 20 bp, Artificial Sequence
  chemically synthesized
ggaccatgagacacgagctc

SEQ ID NO: 238383 - DNA, 20 bp, Artificial Sequence
  chemically synthesized
tggaccatgagacacgagct

SEQ ID NO: 238384 - DNA, 20 bp, Artificial Sequence
  chemically synthesized
cagtttggaccatgagacac

SEQ ID NO: 238385 - DNA, 20 bp, Artificial Sequence
  chemically synthesized
ggacctgagctcgtgtctca

SEQ ID NO: 238386 - DNA, 20 bp, Artificial Sequence
  chemically synthesized
gcacatacagtttggaccat

SEQ ID NO: 238387 - DNA, 20 bp, Artificial Sequence
  chemically synthesized
atttattcgcacatacagtt

SEQ ID NO: 238388 - DNA, 20 bp, Artificial Sequence
  chemically synthesized
aacttatttattcgcacata

SEQ ID NO: 238389 - DNA, 20 bp, Artificial Sequence
  chemically synthesized
aactgtatgtgcgaataaat

SEQ ID NO: 238390 - DNA, 20 bp, Artificial Sequence
  chemically synthesized
gtatgtgcgaataaataagt

SEQ ID NO: 238391 - DNA, 20 bp, Artificial Sequence
  chemically synthesized
caaggtactatgatttgggg

SEQ ID NO: 238392 - DNA, 20 bp, Artificial Sequence
  chemically synthesized
tagttatctgccccaaatca

SEQ ID NO: 238393 - DNA, 20 bp, Artificial Sequence
  chemically synthesized
tagcaaggtactatgatttg

SEQ ID NO: 238394 - DNA, 20 bp, Artificial Sequence
  chemically synthesized
gtagcaaggtactatgattt

SEQ ID NO: 238395 - DNA, 20 bp, Artificial Sequence
  chemically synthesized
agtagcaaggtactatgatt

SEQ ID NO: 238396 - DNA, 20 bp, Artificial Sequence
  chemically synthesized
agggttggggagaagtagca

SEQ ID NO: 238397 - DNA, 20 bp, Artificial Sequence
  chemically synthesized
gagggttggggagaagtagc

SEQ ID NO: 238398 - DNA, 20 bp, Artificial Sequence
  chemically synthesized
agttgagggttggggagaag

SEQ ID NO: 238399 - DNA, 20 bp, Artificial Sequence
  chemically synthesized
ggaagttgagggttggggag

SEQ ID NO: 238400 - DNA, 20 bp, Artificial Sequence
  chemically synthesized
ttgggaagttgagggttggg

SEQ ID NO: 238401 - DNA, 20 bp, Artificial Sequence
  chemically synthesized
acttgggaagttgagggttg

SEQ ID NO: 238402 - DNA, 20 bp, Artificial Sequence
  chemically synthesized
tacttgggaagttgagggtt

SEQ ID NO: 238403 - DNA, 20 bp, Artificial Sequence
  chemically synthesized
ttacttgggaagttgagggt

SEQ ID NO: 238404 - DNA, 20 bp, Artificial Sequence
  chemically synthesized
tgtattacttgggaagttga

SEQ ID NO: 238405 - DNA, 20 bp, Artificial Sequence
  chemically synthesized
ttgtattacttgggaagttg

SEQ ID NO: 238406 - DNA, 20 bp, Artificial Sequence
  chemically synthesized
tttgtattacttgggaagtt

SEQ ID NO: 238407 - DNA, 20 bp, Artificial Sequence
  chemically synthesized
tccccaaccctcaacttccc

SEQ ID NO: 238408 - DNA, 20 bp, Artificial Sequence
  chemically synthesized
aaatatttgtattacttggg

SEQ ID NO: 238409 - DNA, 20 bp, Artificial Sequence
  chemically synthesized
actaaatatttgtattactt

SEQ ID NO: 238410 - DNA, 20 bp, Artificial Sequence
  chemically synthesized
tactaaatatttgtattact

SEQ ID NO: 238411 - DNA, 20 bp, Artificial Sequence
  chemically synthesized
tcccaagtaatacaaatatt

SEQ ID NO: 238412 - DNA, 20 bp, Artificial Sequence
  chemically synthesized
gtaatacaaatatttagtaa

SEQ ID NO: 238413 - DNA, 20 bp, Artificial Sequence
  chemically synthesized
acaaatatttagtaaaagat

SEQ ID NO: 238414 - DNA, 20 bp, Artificial Sequence
  chemically synthesized
ggtaagtacttcataattgg

SEQ ID NO: 238415 - DNA, 20 bp, Artificial Sequence
  chemically synthesized
taagtatactaccaattatg

SEQ ID NO: 238416 - DNA, 20 bp, Artificial Sequence
  chemically synthesized
ggaggtaagtacttcataat

SEQ ID NO: 238417 - DNA, 20 bp, Artificial Sequence
  chemically synthesized
ttatgaagtacttacctcct

SEQ ID NO: 238418 - DNA, 20 bp, Artificial Sequence
  chemically synthesized
cacaattaaccttaggaggt

SEQ ID NO: 238419 - DNA, 20 bp, Artificial Sequence
  chemically synthesized
tatgaagtacttacctccta

SEQ ID NO: 238420 - DNA, 20 bp, Artificial Sequence
  chemically synthesized
ctcccacaattaaccttagg

SEQ ID NO: 238421 - DNA, 20 bp, Artificial Sequence
  chemically synthesized
gctcccacaattaaccttag

SEQ ID NO: 238422 - DNA, 20 bp, Artificial Sequence
  chemically synthesized
gagctcccacaattaacctt

SEQ ID NO: 238423 - DNA, 20 bp, Artificial Sequence
  chemically synthesized
tgagctcccacaattaacct

SEQ ID NO: 238424 - DNA, 20 bp, Artificial Sequence
  chemically synthesized
ttacctcctaaggttaattg

SEQ ID NO: 238425 - DNA, 20 bp, Artificial Sequence
  chemically synthesized
tacctcctaaggttaattgt

SEQ ID NO: 238426 - DNA, 20 bp, Artificial Sequence
  chemically synthesized
cctcctaaggttaattgtgg

SEQ ID NO: 238427 - DNA, 20 bp, Artificial Sequence
  chemically synthesized
attgtgggagctcaataaat

SEQ ID NO: 238428 - DNA, 20 bp, Artificial Sequence
  chemically synthesized
tttatatatactcatttatt

SEQ ID NO: 238429 - DNA, 20 bp, Artificial Sequence
  chemically synthesized
taaaataaaagatgtaaaaa

SEQ ID NO: 238430 - DNA, 20 bp, Artificial Sequence
  chemically synthesized
taaaaacattaataaaataa

SEQ ID NO: 238431 - DNA, 20 bp, Artificial Sequence
  chemically synthesized
tttaaaaaattcaaattcaa

SEQ ID NO: 238432 - DNA, 20 bp, Artificial Sequence
  chemically synthesized
aattcaaattcaatagtctt

SEQ ID NO: 238433 - DNA, 20 bp, Artificial Sequence
  chemically synthesized
caaaaatcacttgtattcca

SEQ ID NO: 238434 - DNA, 20 bp, Artificial Sequence
  chemically synthesized
ttcaatagtctttggaatac

SEQ ID NO: 238435 - DNA, 20 bp, Artificial Sequence
  chemically synthesized
tttggaatacaagtgatttt

SEQ ID NO: 238436 - DNA, 20 bp, Artificial Sequence
  chemically synthesized
ggttacatgaatgaattgta

SEQ ID NO: 238437 - DNA, 20 bp, Artificial Sequence
  chemically synthesized
tacatgaatgaattgtatag

SEQ ID NO: 238438 - DNA, 20 bp, Artificial Sequence
  chemically synthesized
gaattgtatagaagtaaaat

SEQ ID NO: 238439 - DNA, 20 bp, Artificial Sequence
  chemically synthesized
agaagtaaaatcagatattt

SEQ ID NO: 238440 - DNA, 20 bp, Artificial Sequence
  chemically synthesized
ttttagtgcacgtgtcaccc

SEQ ID NO: 238441 - DNA, 20 bp, Artificial Sequence
  chemically synthesized
tagtgcacgtgtcacccaag

SEQ ID NO: 238442 - DNA, 20 bp, Artificial Sequence
  chemically synthesized
gggtgtaatgtacactactt

SEQ ID NO: 238443 - DNA, 20 bp, Artificial Sequence
  chemically synthesized
ggggtgtaatgtacactact

SEQ ID NO: 238444 - DNA, 20 bp, Artificial Sequence
  chemically synthesized
gtagtgtacattacacccca

SEQ ID NO: 238445 - DNA, 20 bp, Artificial Sequence
  chemically synthesized
tagtgtacattacaccccaa

SEQ ID NO: 238446 - DNA, 20 bp, Artificial Sequence
  chemically synthesized
gggataaaaaattacctttg

SEQ ID NO: 238447 - DNA, 20 bp, Artificial Sequence
  chemically synthesized
agggataaaaaattaccttt

SEQ ID NO: 238448 - DNA, 20 bp, Artificial Sequence
  chemically synthesized
gagggataaaaaattacctt

SEQ ID NO: 238449 - DNA, 20 bp, Artificial Sequence
  chemically synthesized
gcagagtgggaaggtagtga

SEQ ID NO: 238450 - DNA, 20 bp, Artificial Sequence
  chemically synthesized
ggcagagtgggaaggtagtg

SEQ ID NO: 238451 - DNA, 20 bp, Artificial Sequence
  chemically synthesized
gggcagagtgggaaggtagt

SEQ ID NO: 238452 - DNA, 20 bp, Artificial Sequence
  chemically synthesized
gaaggggcagagtgggaagg

SEQ ID NO: 238453 - DNA, 20 bp, Artificial Sequence
  chemically synthesized
tcagaaggggcagagtggga

SEQ ID NO: 238454 - DNA, 20 bp, Artificial Sequence
  chemically synthesized
ctcagaaggggcagagtggg

SEQ ID NO: 238455 - DNA, 20 bp, Artificial Sequence
  chemically synthesized
agactcagaaggggcagagt

SEQ ID NO: 238456 - DNA, 20 bp, Artificial Sequence
  chemically synthesized
aagactcagaaggggcagag

SEQ ID NO: 238457 - DNA, 20 bp, Artificial Sequence
  chemically synthesized
ttgaagactcagaaggggca

SEQ ID NO: 238458 - DNA, 20 bp, Artificial Sequence
  chemically synthesized
ctttgaagactcagaagggg

SEQ ID NO: 238459 - DNA, 20 bp, Artificial Sequence
  chemically synthesized
cttcccactctgccccttct

SEQ ID NO: 238460 - DNA, 20 bp, Artificial Sequence
  chemically synthesized
ggactttgaagactcagaag

SEQ ID NO: 238461 - DNA, 20 bp, Artificial Sequence
  chemically synthesized
tggactttgaagactcagaa

SEQ ID NO: 238462 - DNA, 20 bp, Artificial Sequence
  chemically synthesized
atggactttgaagactcaga

SEQ ID NO: 238463 - DNA, 20 bp, Artificial Sequence
  chemically synthesized
aatggactttgaagactcag

SEQ ID NO: 238464 - DNA, 20 bp, Artificial Sequence
  chemically synthesized
tagaatggactttgaagact

SEQ ID NO: 238465 - DNA, 20 bp, Artificial Sequence
  chemically synthesized
ctgccccttctgagtcttca

SEQ ID NO: 238466 - DNA, 20 bp, Artificial Sequence
  chemically synthesized
gagtggtagaatggactttg

SEQ ID NO: 238467 - DNA, 20 bp, Artificial Sequence
  chemically synthesized
aggcagacagagtggtagaa

SEQ ID NO: 238468 - DNA, 20 bp, Artificial Sequence
  chemically synthesized
cacaaaggcagacagagtgg

SEQ ID NO: 238469 - DNA, 20 bp, Artificial Sequence
  chemically synthesized
gtacacaaaggcagacagag

SEQ ID NO: 238470 - DNA, 20 bp, Artificial Sequence
  chemically synthesized
taggtacacaaaggcagaca

SEQ ID NO: 238471 - DNA, 20 bp, Artificial Sequence
  chemically synthesized
tgtaggtacacaaaggcaga

SEQ ID NO: 238472 - DNA, 20 bp, Artificial Sequence
  chemically synthesized
acgctgtaggtacacaaagg

SEQ ID NO: 238473 - DNA, 20 bp, Artificial Sequence
  chemically synthesized
gctacgctgtaggtacacaa

SEQ ID NO: 238474 - DNA, 20 bp, Artificial Sequence
  chemically synthesized
agctacgctgtaggtacaca

SEQ ID NO: 238475 - DNA, 20 bp, Artificial Sequence
  chemically synthesized
tgtctgcctttgtgtaccta

SEQ ID NO: 238476 - DNA, 20 bp, Artificial Sequence
  chemically synthesized
gcctttgtgtacctacagcg

SEQ ID NO: 238477 - DNA, 20 bp, Artificial Sequence
  chemically synthesized
ataagtgggagctacgctgt

SEQ ID NO: 238478 - DNA, 20 bp, Artificial Sequence
  chemically synthesized
tataagtgggagctacgctg

SEQ ID NO: 238479 - DNA, 20 bp, Artificial Sequence
  chemically synthesized
atgttctcacttataagtgg

SEQ ID NO: 238480 - DNA, 20 bp, Artificial Sequence
  chemically synthesized
acagcgtagctcccacttat

SEQ ID NO: 238481 - DNA, 20 bp, Artificial Sequence
  chemically synthesized
gtatgttctcacttataagt

SEQ ID NO: 238482 - DNA, 20 bp, Artificial Sequence
  chemically synthesized
tgtatgttctcacttataag

SEQ ID NO: 238483 - DNA, 20 bp, Artificial Sequence
  chemically synthesized
cgtagctcccacttataagt

SEQ ID NO: 238484 - DNA, 20 bp, Artificial Sequence
  chemically synthesized
tactgtatgttctcacttat

SEQ ID NO: 238485 - DNA, 20 bp, Artificial Sequence
  chemically synthesized
cacttataagtgagaacata

SEQ ID NO: 238486 - DNA, 20 bp, Artificial Sequence
  chemically synthesized
aagtgagaacatacagtatt

SEQ ID NO: 238487 - DNA, 20 bp, Artificial Sequence
  chemically synthesized
taagtgaagtaattcaggaa

SEQ ID NO: 238488 - DNA, 20 bp, Artificial Sequence
  chemically synthesized
tattctaagtgaagtaattc

SEQ ID NO: 238489 - DNA, 20 bp, Artificial Sequence
  chemically synthesized
ttattctaagtgaagtaatt

SEQ ID NO: 238490 - DNA, 20 bp, Artificial Sequence
  chemically synthesized
cattcctgaattacttcact

SEQ ID NO: 238491 - DNA, 20 bp, Artificial Sequence
  chemically synthesized
ggatgccattattctaagtg

SEQ ID NO: 238492 - DNA, 20 bp, Artificial Sequence
  chemically synthesized
aattacttcacttagaataa

SEQ ID NO: 238493 - DNA, 20 bp, Artificial Sequence
  chemically synthesized
gagctggatgccattattct

SEQ ID NO: 238494 - DNA, 20 bp, Artificial Sequence
  chemically synthesized
tcacttagaataatggcatc

SEQ ID NO: 238495 - DNA, 20 bp, Artificial Sequence
  chemically synthesized
tgcagcaactttgatggagc

SEQ ID NO: 238496 - DNA, 20 bp, Artificial Sequence
  chemically synthesized
aatggcatccagctccatca

SEQ ID NO: 238497 - DNA, 20 bp, Artificial Sequence
  chemically synthesized
cttttgcagcaactttgatg

SEQ ID NO: 238498 - DNA, 20 bp, Artificial Sequence
  chemically synthesized
gtcttttgcagcaactttga

SEQ ID NO: 238499 - DNA, 20 bp, Artificial Sequence
  chemically synthesized
ctccatcaaagttgctgcaa

SEQ ID NO: 238500 - DNA, 20 bp, Artificial Sequence
  chemically synthesized
taatgaaataatgtcttttg

SEQ ID NO: 238501 - DNA, 20 bp, Artificial Sequence
  chemically synthesized
cattatttcattattttcta

SEQ ID NO: 238502 - DNA, 20 bp, Artificial Sequence
  chemically synthesized
tttcattattttctacggct

SEQ ID NO: 238503 - DNA, 20 bp, Artificial Sequence
  chemically synthesized
catgcaatactactcagccg

SEQ ID NO: 238504 - DNA, 20 bp, Artificial Sequence
  chemically synthesized
cattattttctacggctgag

SEQ ID NO: 238505 - DNA, 20 bp, Artificial Sequence
  chemically synthesized
acataccatgcaatactact

SEQ ID NO: 238506 - DNA, 20 bp, Artificial Sequence
  chemically synthesized
tacggctgagtagtattgca

SEQ ID NO: 238507 - DNA, 20 bp, Artificial Sequence
  chemically synthesized
gagtagtattgcatggtatg

SEQ ID NO: 238508 - DNA, 20 bp, Artificial Sequence
  chemically synthesized
ttgcatggtatgtggctgaa

SEQ ID NO: 238509 - DNA, 20 bp, Artificial Sequence
  chemically synthesized
atataccgtgaaatactatt

SEQ ID NO: 238510 - DNA, 20 bp, Artificial Sequence
  chemically synthesized
tgtggctgaatagtatttca

SEQ ID NO: 238511 - DNA, 20 bp, Artificial Sequence
  chemically synthesized
atgagtggataaagaaaatg

SEQ ID NO: 238512 - DNA, 20 bp, Artificial Sequence
  chemically synthesized
agccgaccaatgagtggata

SEQ ID NO: 238513 - DNA, 20 bp, Artificial Sequence
  chemically synthesized
cattttctttatccactcat

SEQ ID NO: 238514 - DNA, 20 bp, Artificial Sequence
  chemically synthesized
agtgccagccgaccaatgag

SEQ ID NO: 238515 - DNA, 20 bp, Artificial Sequence
  chemically synthesized
ttctttatccactcattggt

SEQ ID NO: 238516 - DNA, 20 bp, Artificial Sequence
  chemically synthesized
ctaagtgccagccgaccaat

SEQ ID NO: 238517 - DNA, 20 bp, Artificial Sequence
  chemically synthesized
ttatccactcattggtcggc

SEQ ID NO: 238518 - DNA, 20 bp, Artificial Sequence
  chemically synthesized
ctcattggtcggctggcact

SEQ ID NO: 238519 - DNA, 20 bp, Artificial Sequence
  chemically synthesized
tcattggtcggctggcactt

SEQ ID NO: 238520 - DNA, 20 bp, Artificial Sequence
  chemically synthesized
tatggaaccatcctaagtgc

SEQ ID NO: 238521 - DNA, 20 bp, Artificial Sequence
  chemically synthesized
tggtcggctggcacttagga

SEQ ID NO: 238522 - DNA, 20 bp, Artificial Sequence
  chemically synthesized
caaagatatggaaccatcct

SEQ ID NO: 238523 - DNA, 20 bp, Artificial Sequence
  chemically synthesized
aattcacagttgcaaagata

SEQ ID NO: 238524 - DNA, 20 bp, Artificial Sequence
  chemically synthesized
cagcacaattcacagttgca

SEQ ID NO: 238525 - DNA, 20 bp, Artificial Sequence
  chemically synthesized
gtttatagcagcacaattca

SEQ ID NO: 238526 - DNA, 20 bp, Artificial Sequence
  chemically synthesized
ttgcacgcatatgtttatag

SEQ ID NO: 238527 - DNA, 20 bp, Artificial Sequence
  chemically synthesized
cacttgcacgcatatgttta

SEQ ID NO: 238528 - DNA, 20 bp, Artificial Sequence
  chemically synthesized
tgctataaacatatgcgtgc

SEQ ID NO: 238529 - DNA, 20 bp, Artificial Sequence
  chemically synthesized
agagaattcattatatcaaa

SEQ ID NO: 238530 - DNA, 20 bp, Artificial Sequence
  chemically synthesized
tataatgaattctcttcctc

SEQ ID NO: 238531 - DNA, 20 bp, Artificial Sequence
  chemically synthesized
ataatgaattctcttcctct

SEQ ID NO: 238532 - DNA, 20 bp, Artificial Sequence
  chemically synthesized
cgattatgtacctagaggaa

SEQ ID NO: 238533 - DNA, 20 bp, Artificial Sequence
  chemically synthesized
accgattatgtacctagagg

SEQ ID NO: 238534 - DNA, 20 bp, Artificial Sequence
  chemically synthesized
actaccgattatgtacctag

SEQ ID NO: 238535 - DNA, 20 bp, Artificial Sequence
  chemically synthesized
cactaccgattatgtaccta

SEQ ID NO: 238536 - DNA, 20 bp, Artificial Sequence
  chemically synthesized
ctcactaccgattatgtacc

SEQ ID NO: 238537 - DNA, 20 bp, Artificial Sequence
  chemically synthesized
tcttcctctaggtacataat

SEQ ID NO: 238538 - DNA, 20 bp, Artificial Sequence
  chemically synthesized
tcctctaggtacataatcgg

SEQ ID NO: 238539 - DNA, 20 bp, Artificial Sequence
  chemically synthesized
ctaggtacataatcggtagt

SEQ ID NO: 238540 - DNA, 20 bp, Artificial Sequence
  chemically synthesized
ataatcggtagtgagatttc

SEQ ID NO: 238541 - DNA, 20 bp, Artificial Sequence
  chemically synthesized
agtagatctaacatttgatc

SEQ ID NO: 238542 - DNA, 20 bp, Artificial Sequence
  chemically synthesized
gagatttccagatcaaatgt

SEQ ID NO: 238543 - DNA, 20 bp, Artificial Sequence
  chemically synthesized
tcaaatgttagatctacttt

SEQ ID NO: 238544 - DNA, 20 bp, Artificial Sequence
  chemically synthesized
atttcttaaagaactaaaag

SEQ ID NO: 238545 - DNA, 20 bp, Artificial Sequence
  chemically synthesized
aagatttcttaaagaactaa

SEQ ID NO: 238546 - DNA, 20 bp, Artificial Sequence
  chemically synthesized
agatctacttttagttcttt

SEQ ID NO: 238547 - DNA, 20 bp, Artificial Sequence
  chemically synthesized
aacagtatgaagatttctta

SEQ ID NO: 238548 - DNA, 20 bp, Artificial Sequence
  chemically synthesized
cctacatggaaaacagtatg

SEQ ID NO: 238549 - DNA, 20 bp, Artificial Sequence
  chemically synthesized
agtacaacctacatggaaaa

SEQ ID NO: 238550 - DNA, 20 bp, Artificial Sequence
  chemically synthesized
tcttcatactgttttccatg

SEQ ID NO: 238551 - DNA, 20 bp, Artificial Sequence
  chemically synthesized
cttcatactgttttccatgt

SEQ ID NO: 238552 - DNA, 20 bp, Artificial Sequence
  chemically synthesized
gtaaattagtacaacctaca

SEQ ID NO: 238553 - DNA, 20 bp, Artificial Sequence
  chemically synthesized
cactgctggtgattgtaaat

SEQ ID NO: 238554 - DNA, 20 bp, Artificial Sequence
  chemically synthesized
ttgtactaatttacaatcac

SEQ ID NO: 238555 - DNA, 20 bp, Artificial Sequence
  chemically synthesized
tactaatttacaatcaccag

SEQ ID NO: 238556 - DNA, 20 bp, Artificial Sequence
  chemically synthesized
acggaacatttgtacactgc

SEQ ID NO: 238557 - DNA, 20 bp, Artificial Sequence
  chemically synthesized
tgttgtgaatgtgatgaaaa

SEQ ID NO: 238558 - DNA, 20 bp, Artificial Sequence
  chemically synthesized
tgtatcccagaggttttgaa

SEQ ID NO: 238559 - DNA, 20 bp, Artificial Sequence
  chemically synthesized
caaaatctattcaaaacctc

SEQ ID NO: 238560 - DNA, 20 bp, Artificial Sequence
  chemically synthesized
aaaatctattcaaaacctct

SEQ ID NO: 238561 - DNA, 20 bp, Artificial Sequence
  chemically synthesized
ttgcttttgctgtatcccag

SEQ ID NO: 238562 - DNA, 20 bp, Artificial Sequence
  chemically synthesized
tattcaaaacctctgggata

SEQ ID NO: 238563 - DNA, 20 bp, Artificial Sequence
  chemically synthesized
cttgcttttgctgtatccca

SEQ ID NO: 238564 - DNA, 20 bp, Artificial Sequence
  chemically synthesized
gccttgcttttgctgtatcc

SEQ ID NO: 238565 - DNA, 20 bp, Artificial Sequence
  chemically synthesized
aaacctctgggatacagcaa

SEQ ID NO: 238566 - DNA, 20 bp, Artificial Sequence
  chemically synthesized
ctctgggatacagcaaaagc

SEQ ID NO: 238567 - DNA, 20 bp, Artificial Sequence
  chemically synthesized
tctgggatacagcaaaagca

SEQ ID NO: 238568 - DNA, 20 bp, Artificial Sequence
  chemically synthesized
gatacagcaaaagcaaggct

SEQ ID NO: 238569 - DNA, 20 bp, Artificial Sequence
  chemically synthesized
tacagcaaaagcaaggctaa

SEQ ID NO: 238570 - DNA, 20 bp, Artificial Sequence
  chemically synthesized
acagcaaaagcaaggctaag

SEQ ID NO: 238571 - DNA, 20 bp, Artificial Sequence
  chemically synthesized
ggtgctagaaaatttcctct

SEQ ID NO: 238572 - DNA, 20 bp, Artificial Sequence
  chemically synthesized
aaggctaagaggaaattttc

SEQ ID NO: 238573 - DNA, 20 bp, Artificial Sequence
  chemically synthesized
ttgatgtaggcatttggtgc

SEQ ID NO: 238574 - DNA, 20 bp, Artificial Sequence
  chemically synthesized
ggctctttgatgtaggcatt

SEQ ID NO: 238575 - DNA, 20 bp, Artificial Sequence
  chemically synthesized
agcaccaaatgcctacatca

SEQ ID NO: 238576 - DNA, 20 bp, Artificial Sequence
  chemically synthesized
actttcaggctctttgatgt

SEQ ID NO: 238577 - DNA, 20 bp, Artificial Sequence
  chemically synthesized
caccaaatgcctacatcaaa

SEQ ID NO: 238578 - DNA, 20 bp, Artificial Sequence
  chemically synthesized
aactttcaggctctttgatg

SEQ ID NO: 238579 - DNA, 20 bp, Artificial Sequence
  chemically synthesized
gcctacatcaaagagcctga

SEQ ID NO: 238580 - DNA, 20 bp, Artificial Sequence
  chemically synthesized
tagtcagactgtgaactttc

SEQ ID NO: 238581 - DNA, 20 bp, Artificial Sequence
  chemically synthesized
gtagtcagactgtgaacttt

SEQ ID NO: 238582 - DNA, 20 bp, Artificial Sequence
  chemically synthesized
tcaaagagcctgaaagttca

SEQ ID NO: 238583 - DNA, 20 bp, Artificial Sequence
  chemically synthesized
caggtgtgatgttaggtagt

SEQ ID NO: 238584 - DNA, 20 bp, Artificial Sequence
  chemically synthesized
ccttcaggtgtgatgttagg

SEQ ID NO: 238585 - DNA, 20 bp, Artificial Sequence
  chemically synthesized
gttccttcaggtgtgatgtt

SEQ ID NO: 238586 - DNA, 20 bp, Artificial Sequence
  chemically synthesized
agttccttcaggtgtgatgt

SEQ ID NO: 238587 - DNA, 20 bp, Artificial Sequence
  chemically synthesized
actacctaacatcacacctg

SEQ ID NO: 238588 - DNA, 20 bp, Artificial Sequence
  chemically synthesized
ctacctaacatcacacctga

SEQ ID NO: 238589 - DNA, 20 bp, Artificial Sequence
  chemically synthesized
gttgattctctagttccttc

SEQ ID NO: 238590 - DNA, 20 bp, Artificial Sequence
  chemically synthesized
aacatcacacctgaaggaac

SEQ ID NO: 238591 - DNA, 20 bp, Artificial Sequence
  chemically synthesized
tgttgattctctagttcctt

SEQ ID NO: 238592 - DNA, 20 bp, Artificial Sequence
  chemically synthesized
catcacacctgaaggaacta

SEQ ID NO: 238593 - DNA, 20 bp, Artificial Sequence
  chemically synthesized
tggctttgttgttgattctc

SEQ ID NO: 238594 - DNA, 20 bp, Artificial Sequence
  chemically synthesized
gaactagagaatcaacaaca

SEQ ID NO: 238595 - DNA, 20 bp, Artificial Sequence
  chemically synthesized
tcaacaacaaagccaacaca

SEQ ID NO: 238596 - DNA, 20 bp, Artificial Sequence
  chemically synthesized
tttcttctggagctttgtgt

SEQ ID NO: 238597 - DNA, 20 bp, Artificial Sequence
  chemically synthesized
acaaagccaacacaaagctc

SEQ ID NO: 238598 - DNA, 20 bp, Artificial Sequence
  chemically synthesized
aagccaacacaaagctccag

SEQ ID NO: 238599 - DNA, 20 bp, Artificial Sequence
  chemically synthesized
ttgttatttcttttcttctg

SEQ ID NO: 238600 - DNA, 20 bp, Artificial Sequence
  chemically synthesized
aacacaaagctccagaagaa

SEQ ID NO: 238601 - DNA, 20 bp, Artificial Sequence
  chemically synthesized
ctttgttatttcttttcttc

SEQ ID NO: 238602 - DNA, 20 bp, Artificial Sequence
  chemically synthesized
ccagaagaaaagaaataaca

SEQ ID NO: 238603 - DNA, 20 bp, Artificial Sequence
  chemically synthesized
agaaaagaaataacaaagat

SEQ ID NO: 238604 - DNA, 20 bp, Artificial Sequence
  chemically synthesized
aaaagaaataacaaagatca

SEQ ID NO: 238605 - DNA, 20 bp, Artificial Sequence
  chemically synthesized
agaaataacaaagatcagag

SEQ ID NO: 238606 - DNA, 20 bp, Artificial Sequence
  chemically synthesized
atttttgtttcaatttcatt

SEQ ID NO: 238607 - DNA, 20 bp, Artificial Sequence
  chemically synthesized
aaattgaaacaaaaatataa

SEQ ID NO: 238608 - DNA, 20 bp, Artificial Sequence
  chemically synthesized
caaaatgttgattctttgaa

SEQ ID NO: 238609 - DNA, 20 bp, Artificial Sequence
  chemically synthesized
caattttacttatcttttca

SEQ ID NO: 238610 - DNA, 20 bp, Artificial Sequence
  chemically synthesized
tgttgattctttgaaaagat

SEQ ID NO: 238611 - DNA, 20 bp, Artificial Sequence
  chemically synthesized
gaaaagataagtaaaattga

SEQ ID NO: 238612 - DNA, 20 bp, Artificial Sequence
  chemically synthesized
gataagtaaaattgatagac

SEQ ID NO: 238613 - DNA, 20 bp, Artificial Sequence
  chemically synthesized
aagtaaaattgatagaccag

SEQ ID NO: 238614 - DNA, 20 bp, Artificial Sequence
  chemically synthesized
aaaattgatagaccagtagt

SEQ ID NO: 238615 - DNA, 20 bp, Artificial Sequence
  chemically synthesized
ttcttggttaatctaactac

SEQ ID NO: 238616 - DNA, 20 bp, Artificial Sequence
  chemically synthesized
gaccagtagttagattaacc

SEQ ID NO: 238617 - DNA, 20 bp, Artificial Sequence
  chemically synthesized
gttagattaaccaagaaaaa

SEQ ID NO: 238618 - DNA, 20 bp, Artificial Sequence
  chemically synthesized
aatcttctctctttttttct

SEQ ID NO: 238619 - DNA, 20 bp, Artificial Sequence
  chemically synthesized
tagattaaccaagaaaaaaa

SEQ ID NO: 238620 - DNA, 20 bp, Artificial Sequence
  chemically synthesized
gattaaccaagaaaaaaaga

SEQ ID NO: 238621 - DNA, 20 bp, Artificial Sequence
  chemically synthesized
taaccaagaaaaaaagagag

SEQ ID NO: 238622 - DNA, 20 bp, Artificial Sequence
  chemically synthesized
gaaaaaaagagagaagattc

SEQ ID NO: 238623 - DNA, 20 bp, Artificial Sequence
  chemically synthesized
aaaagagagaagattcaagt

SEQ ID NO: 238624 - DNA, 20 bp, Artificial Sequence
  chemically synthesized
agagaagattcaagtaagct

SEQ ID NO: 238625 - DNA, 20 bp, Artificial Sequence
  chemically synthesized
ttgcattttcatttgtaact

SEQ ID NO: 238626 - DNA, 20 bp, Artificial Sequence
  chemically synthesized
aaaatgcaaatttcttaaaa

SEQ ID NO: 238627 - DNA, 20 bp, Artificial Sequence
  chemically synthesized
acactgccagatgctgtttt

SEQ ID NO: 238628 - DNA, 20 bp, Artificial Sequence
  chemically synthesized
aaatttcttaaaacagcatc

SEQ ID NO: 238629 - DNA, 20 bp, Artificial Sequence
  chemically synthesized
tttcttaaaacagcatctgg

SEQ ID NO: 238630 - DNA, 20 bp, Artificial Sequence
  chemically synthesized
tcatacttgtggaacactgc

SEQ ID NO: 238631 - DNA, 20 bp, Artificial Sequence
  chemically synthesized
agcatctggcagtgttccac

SEQ ID NO: 238632 - DNA, 20 bp, Artificial Sequence
  chemically synthesized
tggcagtgttccacaagtat

SEQ ID NO: 238633 - DNA, 20 bp, Artificial Sequence
  chemically synthesized
actactactactcatacttg

SEQ ID NO: 238634 - DNA, 20 bp, Artificial Sequence
  chemically synthesized
cagtgttccacaagtatgag

SEQ ID NO: 238635 - DNA, 20 bp, Artificial Sequence
  chemically synthesized
tgttccacaagtatgagtag

SEQ ID NO: 238636 - DNA, 20 bp, Artificial Sequence
  chemically synthesized
tccacaagtatgagtagtag

SEQ ID NO: 238637 - DNA, 20 bp, Artificial Sequence
  chemically synthesized
gtagtagttgttgtcattat

SEQ ID NO: 238638 - DNA, 20 bp, Artificial Sequence
  chemically synthesized
attattagtgtacctctatt

SEQ ID NO: 238639 - DNA, 20 bp, Artificial Sequence
  chemically synthesized
taaagtcttaagccaaatag

SEQ ID NO: 238640 - DNA, 20 bp, Artificial Sequence
  chemically synthesized
ttaaagtcttaagccaaata

SEQ ID NO: 238641 - DNA, 20 bp, Artificial Sequence
  chemically synthesized
atttaaagtcttaagccaaa

SEQ ID NO: 238642 - DNA, 20 bp, Artificial Sequence
  chemically synthesized
agtgtacctctatttggctt

SEQ ID NO: 238643 - DNA, 20 bp, Artificial Sequence
  chemically synthesized
ttatttgcatttaaagtctt

SEQ ID NO: 238644 - DNA, 20 bp, Artificial Sequence
  chemically synthesized
ggtcattttatttgcattta

SEQ ID NO: 238645 - DNA, 20 bp, Artificial Sequence
  chemically synthesized
tgcaaataaaatgaccaaca

SEQ ID NO: 238646 - DNA, 20 bp, Artificial Sequence
  chemically synthesized
gcatggctcagattctatgt

SEQ ID NO: 238647 - DNA, 20 bp, Artificial Sequence
  chemically synthesized
aaatgaccaacatagaatct

SEQ ID NO: 238648 - DNA, 20 bp, Artificial Sequence
  chemically synthesized
agagagacactagcatggct

SEQ ID NO: 238649 - DNA, 20 bp, Artificial Sequence
  chemically synthesized
acatagaatctgagccatgc

SEQ ID NO: 238650 - DNA, 20 bp, Artificial Sequence
  chemically synthesized
ccaccagagagacactagca

SEQ ID NO: 238651 - DNA, 20 bp, Artificial Sequence
  chemically synthesized
attccccaccagagagacac

SEQ ID NO: 238652 - DNA, 20 bp, Artificial Sequence
  chemically synthesized
gagccatgctagtgtctctc

SEQ ID NO: 238653 - DNA, 20 bp, Artificial Sequence
  chemically synthesized
ccatgctagtgtctctctgg

SEQ ID NO: 238654 - DNA, 20 bp, Artificial Sequence
  chemically synthesized
catgctagtgtctctctggt

SEQ ID NO: 238655 - DNA, 20 bp, Artificial Sequence
  chemically synthesized
atgctagtgtctctctggtg

SEQ ID NO: 238656 - DNA, 20 bp, Artificial Sequence
  chemically synthesized
tgggtctattccccaccaga

SEQ ID NO: 238657 - DNA, 20 bp, Artificial Sequence
  chemically synthesized
ggtgggtctattccccacca

SEQ ID NO: 238658 - DNA, 20 bp, Artificial Sequence
  chemically synthesized
tgggtgggtctattccccac

SEQ ID NO: 238659 - DNA, 20 bp, Artificial Sequence
  chemically synthesized
agtgtctctctggtggggaa

SEQ ID NO: 238660 - DNA, 20 bp, Artificial Sequence
  chemically synthesized
ggaatttctaatttatgggt

SEQ ID NO: 238661 - DNA, 20 bp, Artificial Sequence
  chemically synthesized
aggaatttctaatttatggg

SEQ ID NO: 238662 - DNA, 20 bp, Artificial Sequence
  chemically synthesized
gaatagacccacccataaat

SEQ ID NO: 238663 - DNA, 20 bp, Artificial Sequence
  chemically synthesized
agaaggaatttctaatttat

SEQ ID NO: 238664 - DNA, 20 bp, Artificial Sequence
  chemically synthesized
aagaaggaatttctaattta

SEQ ID NO: 238665 - DNA, 20 bp, Artificial Sequence
  chemically synthesized
taaattagaaattccttctt

SEQ ID NO: 238666 - DNA, 20 bp, Artificial Sequence
  chemically synthesized
aagaaggtaatttctcaaga

SEQ ID NO: 238667 - DNA, 20 bp, Artificial Sequence
  chemically synthesized
aaagaaggtaatttctcaag

SEQ ID NO: 238668 - DNA, 20 bp, Artificial Sequence
  chemically synthesized
attaaagaaggtaatttctc

SEQ ID NO: 238669 - DNA, 20 bp, Artificial Sequence
  chemically synthesized
ttaagtcctgaaattaaaga

SEQ ID NO: 238670 - DNA, 20 bp, Artificial Sequence
  chemically synthesized
tttaagtcctgaaattaaag

SEQ ID NO: 238671 - DNA, 20 bp, Artificial Sequence
  chemically synthesized
gaaattaccttctttaattt

SEQ ID NO: 238672 - DNA, 20 bp, Artificial Sequence
  chemically synthesized
aaattaccttctttaatttc

SEQ ID NO: 238673 - DNA, 20 bp, Artificial Sequence
  chemically synthesized
tactttaagtcctgaaatta

SEQ ID NO: 238674 - DNA, 20 bp, Artificial Sequence
  chemically synthesized
ttctttaatttcaggactta

SEQ ID NO: 238675 - DNA, 20 bp, Artificial Sequence
  chemically synthesized
actgcctatttaaatacttt

SEQ ID NO: 238676 - DNA, 20 bp, Artificial Sequence
  chemically synthesized
caggacttaaagtatttaaa

SEQ ID NO: 238677 - DNA, 20 bp, Artificial Sequence
  chemically synthesized
aggacttaaagtatttaaat

SEQ ID NO: 238678 - DNA, 20 bp, Artificial Sequence
  chemically synthesized
acttaaagtatttaaatagg

SEQ ID NO: 238679 - DNA, 20 bp, Artificial Sequence
  chemically synthesized
atttaaataggcagtgtcat

SEQ ID NO: 238680 - DNA, 20 bp, Artificial Sequence
  chemically synthesized
atgattcagatttcatcagc

SEQ ID NO: 238681 - DNA, 20 bp, Artificial Sequence
  chemically synthesized
aatgattcagatttcatcag

SEQ ID NO: 238682 - DNA, 20 bp, Artificial Sequence
  chemically synthesized
aataatgattcagatttcat

SEQ ID NO: 238683 - DNA, 20 bp, Artificial Sequence
  chemically synthesized
tctatgctgaaataatgatt

SEQ ID NO: 238684 - DNA, 20 bp, Artificial Sequence
  chemically synthesized
tgaaatctgaatcattattt

SEQ ID NO: 238685 - DNA, 20 bp, Artificial Sequence
  chemically synthesized
tctgaatcattatttcagca

SEQ ID NO: 238686 - DNA, 20 bp, Artificial Sequence
  chemically synthesized
ttatttcagcatagaatcca

SEQ ID NO: 238687 - DNA, 20 bp, Artificial Sequence
  chemically synthesized
ttcagcatagaatccatggt

SEQ ID NO: 238688 - DNA, 20 bp, Artificial Sequence
  chemically synthesized
gggataggcatggccaacca

SEQ ID NO: 238689 - DNA, 20 bp, Artificial Sequence
  chemically synthesized
aatgtactcagggataggca

SEQ ID NO: 238690 - DNA, 20 bp, Artificial Sequence
  chemically synthesized
ggttggccatgcctatccct

SEQ ID NO: 238691 - DNA, 20 bp, Artificial Sequence
  chemically synthesized
tatgtaatgtactcagggat

SEQ ID NO: 238692 - DNA, 20 bp, Artificial Sequence
  chemically synthesized
atatgtaatgtactcaggga

SEQ ID NO: 238693 - DNA, 20 bp, Artificial Sequence
  chemically synthesized
aaatatatgtaatgtactca

SEQ ID NO: 238694 - DNA, 20 bp, Artificial Sequence
  chemically synthesized
taaatatatgtaatgtactc

SEQ ID NO: 238695 - DNA, 20 bp, Artificial Sequence
  chemically synthesized
gtaaatatatgtaatgtact

SEQ ID NO: 238696 - DNA, 20 bp, Artificial Sequence
  chemically synthesized
cacaacaaaaagcatttaaa

SEQ ID NO: 238697 - DNA, 20 bp, Artificial Sequence
  chemically synthesized
atattatgtttcacaacaaa

SEQ ID NO: 238698 - DNA, 20 bp, Artificial Sequence
  chemically synthesized
ttttgttgtgaaacataata

SEQ ID NO: 238699 - DNA, 20 bp, Artificial Sequence
  chemically synthesized
tttgttgtgaaacataatat

SEQ ID NO: 238700 - DNA, 20 bp, Artificial Sequence
  chemically synthesized
ttgttgtgaaacataatata

SEQ ID NO: 238701 - DNA, 20 bp, Artificial Sequence
  chemically synthesized
tcaccatgggtttatatgaa

SEQ ID NO: 238702 - DNA, 20 bp, Artificial Sequence
  chemically synthesized
gaaccattcatataaaccca

SEQ ID NO: 238703 - DNA, 20 bp, Artificial Sequence
  chemically synthesized
gtctgggtgatggtcaccat

SEQ ID NO: 238704 - DNA, 20 bp, Artificial Sequence
  chemically synthesized
ggtctgggtgatggtcacca

SEQ ID NO: 238705 - DNA, 20 bp, Artificial Sequence
  chemically synthesized
aacccatggtgaccatcacc

SEQ ID NO: 238706 - DNA, 20 bp, Artificial Sequence
  chemically synthesized
ttatttcttggtctgggtga

SEQ ID NO: 238707 - DNA, 20 bp, Artificial Sequence
  chemically synthesized
tggtgaccatcacccagacc

SEQ ID NO: 238708 - DNA, 20 bp, Artificial Sequence
  chemically synthesized
gaagttttatttcttggtct

SEQ ID NO: 238709 - DNA, 20 bp, Artificial Sequence
  chemically synthesized
ggaagttttatttcttggtc

SEQ ID NO: 238710 - DNA, 20 bp, Artificial Sequence
  chemically synthesized
ctgctggaagttttatttct

SEQ ID NO: 238711 - DNA, 20 bp, Artificial Sequence
  chemically synthesized
agaccaagaaataaaacttc

SEQ ID NO: 238712 - DNA, 20 bp, Artificial Sequence
  chemically synthesized
ccaagaaataaaacttccag

SEQ ID NO: 238713 - DNA, 20 bp, Artificial Sequence
  chemically synthesized
gtgttccatttggctgctgg

SEQ ID NO: 238714 - DNA, 20 bp, Artificial Sequence
  chemically synthesized
agagtgttccatttggctgc

SEQ ID NO: 238715 - DNA, 20 bp, Artificial Sequence
  chemically synthesized
taaaacttccagcagccaaa

SEQ ID NO: 238716 - DNA, 20 bp, Artificial Sequence
  chemically synthesized
atgatatagagtgttccatt

SEQ ID NO: 238717 - DNA, 20 bp, Artificial Sequence
  chemically synthesized
aaatggaacactctatatca

SEQ ID NO: 238718 - DNA, 20 bp, Artificial Sequence
  chemically synthesized
aatcttgaaactatgatata

SEQ ID NO: 238719 - DNA, 20 bp, Artificial Sequence
  chemically synthesized
ttaatcttgaaactatgata

SEQ ID NO: 238720 - DNA, 20 bp, Artificial Sequence
  chemically synthesized
acactctatatcatagtttc

SEQ ID NO: 238721 - DNA, 20 bp, Artificial Sequence
  chemically synthesized
acaactaataagcaaagagg

SEQ ID NO: 238722 - DNA, 20 bp, Artificial Sequence
  chemically synthesized
tcaacaactaataagcaaag

SEQ ID NO: 238723 - DNA, 20 bp, Artificial Sequence
  chemically synthesized
atcaacaactaataagcaaa

SEQ ID NO: 238724 - DNA, 20 bp, Artificial Sequence
  chemically synthesized
taatctacctctttgcttat

SEQ ID NO: 238725 - DNA, 20 bp, Artificial Sequence
  chemically synthesized
taatcaacaactaataagca

SEQ ID NO: 238726 - DNA, 20 bp, Artificial Sequence
  chemically synthesized
gaaattaatcaacaactaat

SEQ ID NO: 238727 - DNA, 20 bp, Artificial Sequence
  chemically synthesized
gactaagacaatcatacagt

SEQ ID NO: 238728 - DNA, 20 bp, Artificial Sequence
  chemically synthesized
aacagactaagacaatcata

SEQ ID NO: 238729 - DNA, 20 bp, Artificial Sequence
  chemically synthesized
ttctcactgtatgattgtct

SEQ ID NO: 238730 - DNA, 20 bp, Artificial Sequence
  chemically synthesized
tataacagcacaaacagact

SEQ ID NO: 238731 - DNA, 20 bp, Artificial Sequence
  chemically synthesized
ttttgttataacagcacaaa

SEQ ID NO: 238732 - DNA, 20 bp, Artificial Sequence
  chemically synthesized
tctcaggcattttgttataa

SEQ ID NO: 238733 - DNA, 20 bp, Artificial Sequence
  chemically synthesized
gctgttataacaaaatgcct

SEQ ID NO: 238734 - DNA, 20 bp, Artificial Sequence
  chemically synthesized
tataacaaaatgcctgagac

SEQ ID NO: 238735 - DNA, 20 bp, Artificial Sequence
  chemically synthesized
ataacaaaatgcctgagact

SEQ ID NO: 238736 - DNA, 20 bp, Artificial Sequence
  chemically synthesized
tttgtaaattacccagtctc

SEQ ID NO: 238737 - DNA, 20 bp, Artificial Sequence
  chemically synthesized
atttgtaaattacccagtct

SEQ ID NO: 238738 - DNA, 20 bp, Artificial Sequence
  chemically synthesized
ggtattatttgtaaattacc

SEQ ID NO: 238739 - DNA, 20 bp, Artificial Sequence
  chemically synthesized
agaactgtgagtgaatacat

SEQ ID NO: 238740 - DNA, 20 bp, Artificial Sequence
  chemically synthesized
aataccaatgtattcactca

SEQ ID NO: 238741 - DNA, 20 bp, Artificial Sequence
  chemically synthesized
aatgtattcactcacagttc

SEQ ID NO: 238742 - DNA, 20 bp, Artificial Sequence
  chemically synthesized
ttcccagcctccagaactgt

SEQ ID NO: 238743 - DNA, 20 bp, Artificial Sequence
  chemically synthesized
tgtattcactcacagttctg

SEQ ID NO: 238744 - DNA, 20 bp, Artificial Sequence
  chemically synthesized
gtattcactcacagttctgg

SEQ ID NO: 238745 - DNA, 20 bp, Artificial Sequence
  chemically synthesized
tcactcacagttctggaggc

SEQ ID NO: 238746 - DNA, 20 bp, Artificial Sequence
  chemically synthesized
cactcacagttctggaggct

SEQ ID NO: 238747 - DNA, 20 bp, Artificial Sequence
  chemically synthesized
atcttggacttcccagcctc

SEQ ID NO: 238748 - DNA, 20 bp, Artificial Sequence
  chemically synthesized
tcacagttctggaggctggg

SEQ ID NO: 238749 - DNA, 20 bp, Artificial Sequence
  chemically synthesized
agcctttatcttggacttcc

SEQ ID NO: 238750 - DNA, 20 bp, Artificial Sequence
  chemically synthesized
ttctggaggctgggaagtcc

SEQ ID NO: 238751 - DNA, 20 bp, Artificial Sequence
  chemically synthesized
aggctgggaagtccaagata

SEQ ID NO: 238752 - DNA, 20 bp, Artificial Sequence
  chemically synthesized
ggctgggaagtccaagataa

SEQ ID NO: 238753 - DNA, 20 bp, Artificial Sequence
  chemically synthesized
aaatgccagagcctttatct

SEQ ID NO: 238754 - DNA, 20 bp, Artificial Sequence
  chemically synthesized
gaagtccaagataaaggctc

SEQ ID NO: 238755 - DNA, 20 bp, Artificial Sequence
  chemically synthesized
aagataaaggctctggcatt

SEQ ID NO: 238756 - DNA, 20 bp, Artificial Sequence
  chemically synthesized
tcaccagacaccaaatgcca

SEQ ID NO: 238757 - DNA, 20 bp, Artificial Sequence
  chemically synthesized
cctcaccagacaccaaatgc

SEQ ID NO: 238758 - DNA, 20 bp, Artificial Sequence
  chemically synthesized
aggctctggcatttggtgtc

SEQ ID NO: 238759 - DNA, 20 bp, Artificial Sequence
  chemically synthesized
tctggcatttggtgtctggt

SEQ ID NO: 238760 - DNA, 20 bp, Artificial Sequence
  chemically synthesized
ctggcatttggtgtctggtg

SEQ ID NO: 238761 - DNA, 20 bp, Artificial Sequence
  chemically synthesized
tggcatttggtgtctggtga

SEQ ID NO: 238762 - DNA, 20 bp, Artificial Sequence
  chemically synthesized
tacagcaggaaggccctcac

SEQ ID NO: 238763 - DNA, 20 bp, Artificial Sequence
  chemically synthesized
cttgtgaagatacagcagga

SEQ ID NO: 238764 - DNA, 20 bp, Artificial Sequence
  chemically synthesized
ccttgtgaagatacagcagg

SEQ ID NO: 238765 - DNA, 20 bp, Artificial Sequence
  chemically synthesized
ctgccttgtgaagatacagc

SEQ ID NO: 238766 - DNA, 20 bp, Artificial Sequence
  chemically synthesized
tctgccttgtgaagatacag

SEQ ID NO: 238767 - DNA, 20 bp, Artificial Sequence
  chemically synthesized
ccttctgccttgtgaagata

SEQ ID NO: 238768 - DNA, 20 bp, Artificial Sequence
  chemically synthesized
ccttcctgctgtatcttcac

SEQ ID NO: 238769 - DNA, 20 bp, Artificial Sequence
  chemically synthesized
cttcctgctgtatcttcaca

SEQ ID NO: 238770 - DNA, 20 bp, Artificial Sequence
  chemically synthesized
cctgctgtatcttcacaagg

SEQ ID NO: 238771 - DNA, 20 bp, Artificial Sequence
  chemically synthesized
cttctaccttctgccttgtg

SEQ ID NO: 238772 - DNA, 20 bp, Artificial Sequence
  chemically synthesized
gctgtatcttcacaaggcag

SEQ ID NO: 238773 - DNA, 20 bp, Artificial Sequence
  chemically synthesized
ctgtatcttcacaaggcaga

SEQ ID NO: 238774 - DNA, 20 bp, Artificial Sequence
  chemically synthesized
tatcttcacaaggcagaagg

SEQ ID NO: 238775 - DNA, 20 bp, Artificial Sequence
  chemically synthesized
cttcacaaggcagaaggtag

SEQ ID NO: 238776 - DNA, 20 bp, Artificial Sequence
  chemically synthesized
ttcacaaggcagaaggtaga

SEQ ID NO: 238777 - DNA, 20 bp, Artificial Sequence
  chemically synthesized
tcacaaggcagaaggtagaa

SEQ ID NO: 238778 - DNA, 20 bp, Artificial Sequence
  chemically synthesized
aaggcagaaggtagaagggc

SEQ ID NO: 238779 - DNA, 20 bp, Artificial Sequence
  chemically synthesized
ggcagaaggtagaagggcaa

SEQ ID NO: 238780 - DNA, 20 bp, Artificial Sequence
  chemically synthesized
cagaaggtagaagggcaaga

SEQ ID NO: 238781 - DNA, 20 bp, Artificial Sequence
  chemically synthesized
aggtagaagggcaagagagc

SEQ ID NO: 238782 - DNA, 20 bp, Artificial Sequence
  chemically synthesized
ggcttcacgcagcattcagt

SEQ ID NO: 238783 - DNA, 20 bp, Artificial Sequence
  chemically synthesized
acaaggcttcacgcagcatt

SEQ ID NO: 238784 - DNA, 20 bp, Artificial Sequence
  chemically synthesized
agctgactgaatgctgcgtg

SEQ ID NO: 238785 - DNA, 20 bp, Artificial Sequence
  chemically synthesized
cttataaacaaggcttcacg

SEQ ID NO: 238786 - DNA, 20 bp, Artificial Sequence
  chemically synthesized
ctgcgtgaagccttgtttat

SEQ ID NO: 238787 - DNA, 20 bp, Artificial Sequence
  chemically synthesized
aaataagacccttataaaca

SEQ ID NO: 238788 - DNA, 20 bp, Artificial Sequence
  chemically synthesized
tgcgtgaagccttgtttata

SEQ ID NO: 238789 - DNA, 20 bp, Artificial Sequence
  chemically synthesized
aaaataagacccttataaac

SEQ ID NO: 238790 - DNA, 20 bp, Artificial Sequence
  chemically synthesized
gcgtgaagccttgtttataa

SEQ ID NO: 238791 - DNA, 20 bp, Artificial Sequence
  chemically synthesized
ccttctttgttaataaaaat

SEQ ID NO: 238792 - DNA, 20 bp, Artificial Sequence
  chemically synthesized
gggtcttatttttattaaca

SEQ ID NO: 238793 - DNA, 20 bp, Artificial Sequence
  chemically synthesized
tcttatttttattaacaaag

SEQ ID NO: 238794 - DNA, 20 bp, Artificial Sequence
  chemically synthesized
cttatttttattaacaaaga

SEQ ID NO: 238795 - DNA, 20 bp, Artificial Sequence
  chemically synthesized
tatttttattaacaaagaag

SEQ ID NO: 238796 - DNA, 20 bp, Artificial Sequence
  chemically synthesized
taacaaagaaggagccctca

SEQ ID NO: 238797 - DNA, 20 bp, Artificial Sequence
  chemically synthesized
aagtggtgattaggccatga

SEQ ID NO: 238798 - DNA, 20 bp, Artificial Sequence
  chemically synthesized
taagtggtgattaggccatg

SEQ ID NO: 238799 - DNA, 20 bp, Artificial Sequence
  chemically synthesized
ttaagtggtgattaggccat

SEQ ID NO: 238800 - DNA, 20 bp, Artificial Sequence
  chemically synthesized
agggtgtttaagtggtgatt

SEQ ID NO: 238801 - DNA, 20 bp, Artificial Sequence
  chemically synthesized
tagggtgtttaagtggtgat

SEQ ID NO: 238802 - DNA, 20 bp, Artificial Sequence
  chemically synthesized
taagaggtagggtgtttaag

SEQ ID NO: 238803 - DNA, 20 bp, Artificial Sequence
  chemically synthesized
tactaagaggtagggtgttt

SEQ ID NO: 238804 - DNA, 20 bp, Artificial Sequence
  chemically synthesized
cacttaaacaccctacctct

SEQ ID NO: 238805 - DNA, 20 bp, Artificial Sequence
  chemically synthesized
tgtgctagtactaagaggta

SEQ ID NO: 238806 - DNA, 20 bp, Artificial Sequence
  chemically synthesized
atgtgctagtactaagaggt

SEQ ID NO: 238807 - DNA, 20 bp, Artificial Sequence
  chemically synthesized
aatgtgctagtactaagagg

SEQ ID NO: 238808 - DNA, 20 bp, Artificial Sequence
  chemically synthesized
gataatgtgctagtactaag

SEQ ID NO: 238809 - DNA, 20 bp, Artificial Sequence
  chemically synthesized
aacaccctacctcttagtac

SEQ ID NO: 238810 - DNA, 20 bp, Artificial Sequence
  chemically synthesized
cgataatgtgctagtactaa

SEQ ID NO: 238811 - DNA, 20 bp, Artificial Sequence
  chemically synthesized
gtcgataatgtgctagtact

SEQ ID NO: 238812 - DNA, 20 bp, Artificial Sequence
  chemically synthesized
ttcaggtgtcgataatgtgc

SEQ ID NO: 238813 - DNA, 20 bp, Artificial Sequence
  chemically synthesized
acattatcgacacctgaatt

SEQ ID NO: 238814 - DNA, 20 bp, Artificial Sequence
  chemically synthesized
atgtgtctctttccaaattc

SEQ ID NO: 238815 - DNA, 20 bp, Artificial Sequence
  chemically synthesized
aatgtgtctctttccaaatt

SEQ ID NO: 238816 - DNA, 20 bp, Artificial Sequence
  chemically synthesized
tatcgacacctgaatttgga

SEQ ID NO: 238817 - DNA, 20 bp, Artificial Sequence
  chemically synthesized
tcgacacctgaatttggaaa

SEQ ID NO: 238818 - DNA, 20 bp, Artificial Sequence
  chemically synthesized
aaagagacacattcaaacta

SEQ ID NO: 238819 - DNA, 20 bp, Artificial Sequence
  chemically synthesized
attaatagtaaaatttgcta

SEQ ID NO: 238820 - DNA, 20 bp, Artificial Sequence
  chemically synthesized
actacttcagtatttattaa

SEQ ID NO: 238821 - DNA, 20 bp, Artificial Sequence
  chemically synthesized
tttactattaataaatactg

SEQ ID NO: 238822 - DNA, 20 bp, Artificial Sequence
  chemically synthesized
actattaataaatactgaag

SEQ ID NO: 238823 - DNA, 20 bp, Artificial Sequence
  chemically synthesized
gccccaaaccaaaactactt

SEQ ID NO: 238824 - DNA, 20 bp, Artificial Sequence
  chemically synthesized
aataaatactgaagtagttt

SEQ ID NO: 238825 - DNA, 20 bp, Artificial Sequence
  chemically synthesized
atactgaagtagttttggtt

SEQ ID NO: 238826 - DNA, 20 bp, Artificial Sequence
  chemically synthesized
tactgaagtagttttggttt

SEQ ID NO: 238827 - DNA, 20 bp, Artificial Sequence
  chemically synthesized
actgaagtagttttggtttg

SEQ ID NO: 238828 - DNA, 20 bp, Artificial Sequence
  chemically synthesized
atgtcatagcagcatagtaa

SEQ ID NO: 238829 - DNA, 20 bp, Artificial Sequence
  chemically synthesized
ttgggaatgtcatagcagca

SEQ ID NO: 238830 - DNA, 20 bp, Artificial Sequence
  chemically synthesized
catgtttgggaatgtcatag

SEQ ID NO: 238831 - DNA, 20 bp, Artificial Sequence
  chemically synthesized
agacatgtttgggaatgtca

SEQ ID NO: 238832 - DNA, 20 bp, Artificial Sequence
  chemically synthesized
atattccaggagacatgttt

SEQ ID NO: 238833 - DNA, 20 bp, Artificial Sequence
  chemically synthesized
catattccaggagacatgtt

SEQ ID NO: 238834 - DNA, 20 bp, Artificial Sequence
  chemically synthesized
acattcccaaacatgtctcc

SEQ ID NO: 238835 - DNA, 20 bp, Artificial Sequence
  chemically synthesized
tgcatatgttcatattccag

SEQ ID NO: 238836 - DNA, 20 bp, Artificial Sequence
  chemically synthesized
aatgcatatgttcatattcc

SEQ ID NO: 238837 - DNA, 20 bp, Artificial Sequence
  chemically synthesized
aaatgcatatgttcatattc

SEQ ID NO: 238838 - DNA, 20 bp, Artificial Sequence
  chemically synthesized
tatgaacatatgcatttctg

SEQ ID NO: 238839 - DNA, 20 bp, Artificial Sequence
  chemically synthesized
tgaacatatgcatttctgta

SEQ ID NO: 238840 - DNA, 20 bp, Artificial Sequence
  chemically synthesized
acttctatatatacactcta

SEQ ID NO: 238841 - DNA, 20 bp, Artificial Sequence
  chemically synthesized
atttctgtagagtgtatata

SEQ ID NO: 238842 - DNA, 20 bp, Artificial Sequence
  chemically synthesized
tctgtagagtgtatatatag

SEQ ID NO: 238843 - DNA, 20 bp, Artificial Sequence
  chemically synthesized
tgtatatatagaagtgaaat

SEQ ID NO: 238844 - DNA, 20 bp, Artificial Sequence
  chemically synthesized
atatatagaagtgaaattgg

SEQ ID NO: 238845 - DNA, 20 bp, Artificial Sequence
  chemically synthesized
tatatagaagtgaaattggt

SEQ ID NO: 238846 - DNA, 20 bp, Artificial Sequence
  chemically synthesized
gaagtgaaattggtgggcta

SEQ ID NO: 238847 - DNA, 20 bp, Artificial Sequence
  chemically synthesized
aagtgaaattggtgggctat

SEQ ID NO: 238848 - DNA, 20 bp, Artificial Sequence
  chemically synthesized
tcaaagatctgcataaccta

SEQ ID NO: 238849 - DNA, 20 bp, Artificial Sequence
  chemically synthesized
ttggtgggctataggttatg

SEQ ID NO: 238850 - DNA, 20 bp, Artificial Sequence
  chemically synthesized
ggcactatttagtaaattca

SEQ ID NO: 238851 - DNA, 20 bp, Artificial Sequence
  chemically synthesized
agatctttgaatttactaaa

SEQ ID NO: 238852 - DNA, 20 bp, Artificial Sequence
  chemically synthesized
gaaatccatttggcactatt

SEQ ID NO: 238853 - DNA, 20 bp, Artificial Sequence
  chemically synthesized
atttactaaatagtgccaaa

SEQ ID NO: 238854 - DNA, 20 bp, Artificial Sequence
  chemically synthesized
ttcttggagtgaaatccatt

SEQ ID NO: 238855 - DNA, 20 bp, Artificial Sequence
  chemically synthesized
tgccaaatggatttcactcc

SEQ ID NO: 238856 - DNA, 20 bp, Artificial Sequence
  chemically synthesized
caaatggatttcactccaag

SEQ ID NO: 238857 - DNA, 20 bp, Artificial Sequence
  chemically synthesized
atggatttcactccaagaag

SEQ ID NO: 238858 - DNA, 20 bp, Artificial Sequence
  chemically synthesized
aattacactactgcttcttg

SEQ ID NO: 238859 - DNA, 20 bp, Artificial Sequence
  chemically synthesized
aaaattacactactgcttct

SEQ ID NO: 238860 - DNA, 20 bp, Artificial Sequence
  chemically synthesized
gatttcactccaagaagcag

SEQ ID NO: 238861 - DNA, 20 bp, Artificial Sequence
  chemically synthesized
ggtctgtgaattgtaaatag

SEQ ID NO: 238862 - DNA, 20 bp, Artificial Sequence
  chemically synthesized
cttggtctgtgaattgtaaa

SEQ ID NO: 238863 - DNA, 20 bp, Artificial Sequence
  chemically synthesized
acacttctatttacaattca

SEQ ID NO: 238864 - DNA, 20 bp, Artificial Sequence
  chemically synthesized
ctatttacaattcacagacc

SEQ ID NO: 238865 - DNA, 20 bp, Artificial Sequence
  chemically synthesized
aaatttcacacaatgttact

SEQ ID NO: 238866 - DNA, 20 bp, Artificial Sequence
  chemically synthesized
tggtgagaatatacagcaat

SEQ ID NO: 238867 - DNA, 20 bp, Artificial Sequence
  chemically synthesized
catgtggtggtgagaatata

SEQ ID NO: 238868 - DNA, 20 bp, Artificial Sequence
  chemically synthesized
tgacaattccatgtggtggt

SEQ ID NO: 238869 - DNA, 20 bp, Artificial Sequence
  chemically synthesized
tgtatattctcaccaccaca

SEQ ID NO: 238870 - DNA, 20 bp, Artificial Sequence
  chemically synthesized
agtctgacaattccatgtgg

SEQ ID NO: 238871 - DNA, 20 bp, Artificial Sequence
  chemically synthesized
ataagtctgacaattccatg

SEQ ID NO: 238872 - DNA, 20 bp, Artificial Sequence
  chemically synthesized
tcaccaccacatggaattgt

SEQ ID NO: 238873 - DNA, 20 bp, Artificial Sequence
  chemically synthesized
ccagaatcattgaaatttat

SEQ ID NO: 238874 - DNA, 20 bp, Artificial Sequence
  chemically synthesized
cttataaatttcaatgattc

SEQ ID NO: 238875 - DNA, 20 bp, Artificial Sequence
  chemically synthesized
taaatttcaatgattctggt

SEQ ID NO: 238876 - DNA, 20 bp, Artificial Sequence
  chemically synthesized
tttcaatgattctggttggt

SEQ ID NO: 238877 - DNA, 20 bp, Artificial Sequence
  chemically synthesized
aaatatcactgcttaccaac

SEQ ID NO: 238878 - DNA, 20 bp, Artificial Sequence
  chemically synthesized
caatgattctggttggtaag

SEQ ID NO: 238879 - DNA, 20 bp, Artificial Sequence
  chemically synthesized
taagcagtgatatttcattt

SEQ ID NO: 238880 - DNA, 20 bp, Artificial Sequence
  chemically synthesized
cattttagttttaatttgca

SEQ ID NO: 238881 - DNA, 20 bp, Artificial Sequence
  chemically synthesized
tagttttaatttgcatggcc

SEQ ID NO: 238882 - DNA, 20 bp, Artificial Sequence
  chemically synthesized
ctaagtcccattaatggtcc

SEQ ID NO: 238883 - DNA, 20 bp, Artificial Sequence
  chemically synthesized
tctaagtcccattaatggtc

SEQ ID NO: 238884 - DNA, 20 bp, Artificial Sequence
  chemically synthesized
tgcatggcctggaccattaa

SEQ ID NO: 238885 - DNA, 20 bp, Artificial Sequence
  chemically synthesized
gcatggcctggaccattaat

SEQ ID NO: 238886 - DNA, 20 bp, Artificial Sequence
  chemically synthesized
gaatttctaagtcccattaa

SEQ ID NO: 238887 - DNA, 20 bp, Artificial Sequence
  chemically synthesized
cctggaccattaatgggact

SEQ ID NO: 238888 - DNA, 20 bp, Artificial Sequence
  chemically synthesized
taaatatataaagaatttct

SEQ ID NO: 238889 - DNA, 20 bp, Artificial Sequence
  chemically synthesized
aaacggccaataaatatata

SEQ ID NO: 238890 - DNA, 20 bp, Artificial Sequence
  chemically synthesized
gaaattctttatatatttat

SEQ ID NO: 238891 - DNA, 20 bp, Artificial Sequence
  chemically synthesized
ttatatatttattggccgtt

SEQ ID NO: 238892 - DNA, 20 bp, Artificial Sequence
  chemically synthesized
tacaaaataagaaatccaaa

SEQ ID NO: 238893 - DNA, 20 bp, Artificial Sequence
  chemically synthesized
ttttgtcatctttacaaaat

SEQ ID NO: 238894 - DNA, 20 bp, Artificial Sequence
  chemically synthesized
tttggatttcttattttgta

SEQ ID NO: 238895 - DNA, 20 bp, Artificial Sequence
  chemically synthesized
ttatgcatcatagtaacgtt

SEQ ID NO: 238896 - DNA, 20 bp, Artificial Sequence
  chemically synthesized
ctaatgtgttttatgcatca

SEQ ID NO: 238897 - DNA, 20 bp, Artificial Sequence
  chemically synthesized
ctatgatgcataaaacacat

SEQ ID NO: 238898 - DNA, 20 bp, Artificial Sequence
  chemically synthesized
cacattagttatttactata

SEQ ID NO: 238899 - DNA, 20 bp, Artificial Sequence
  chemically synthesized
tttttaaggtgatcacttta

SEQ ID NO: 238900 - DNA, 20 bp, Artificial Sequence
  chemically synthesized
tgacctggatggcattttta

SEQ ID NO: 238901 - DNA, 20 bp, Artificial Sequence
  chemically synthesized
ttgacctggatggcattttt

SEQ ID NO: 238902 - DNA, 20 bp, Artificial Sequence
  chemically synthesized
atcaccttaaaaatgccatc

SEQ ID NO: 238903 - DNA, 20 bp, Artificial Sequence
  chemically synthesized
tcaccttaaaaatgccatcc

SEQ ID NO: 238904 - DNA, 20 bp, Artificial Sequence
  chemically synthesized
attctgtatcttgacctgga

SEQ ID NO: 238905 - DNA, 20 bp, Artificial Sequence
  chemically synthesized
ttaaaaatgccatccaggtc

SEQ ID NO: 238906 - DNA, 20 bp, Artificial Sequence
  chemically synthesized
caatattctgtatcttgacc

SEQ ID NO: 238907 - DNA, 20 bp, Artificial Sequence
  chemically synthesized
atgccatccaggtcaagata

SEQ ID NO: 238908 - DNA, 20 bp, Artificial Sequence
  chemically synthesized
gtcaagatacagaatattgc

SEQ ID NO: 238909 - DNA, 20 bp, Artificial Sequence
  chemically synthesized
aagatacagaatattgccag

SEQ ID NO: 238910 - DNA, 20 bp, Artificial Sequence
  chemically synthesized
agatacagaatattgccagc

SEQ ID NO: 238911 - DNA, 20 bp, Artificial Sequence
  chemically synthesized
aaaaagggcttgtggcctgc

SEQ ID NO: 238912 - DNA, 20 bp, Artificial Sequence
  chemically synthesized
gaatattgccagcaggccac

SEQ ID NO: 238913 - DNA, 20 bp, Artificial Sequence
  chemically synthesized
catggcacaaaaagggcttg

SEQ ID NO: 238914 - DNA, 20 bp, Artificial Sequence
  chemically synthesized
agtgaaccatggcacaaaaa

SEQ ID NO: 238915 - DNA, 20 bp, Artificial Sequence
  chemically synthesized
aagtgaaccatggcacaaaa

SEQ ID NO: 238916 - DNA, 20 bp, Artificial Sequence
  chemically synthesized
aaagtgaaccatggcacaaa

SEQ ID NO: 238917 - DNA, 20 bp, Artificial Sequence
  chemically synthesized
cacaagccctttttgtgcca

SEQ ID NO: 238918 - DNA, 20 bp, Artificial Sequence
  chemically synthesized
agttcttgaaaagtgaacca

SEQ ID NO: 238919 - DNA, 20 bp, Artificial Sequence
  chemically synthesized
tgtgccatggttcacttttc

SEQ ID NO: 238920 - DNA, 20 bp, Artificial Sequence
  chemically synthesized
aaatgggaaaagttcttgaa

SEQ ID NO: 238921 - DNA, 20 bp, Artificial Sequence
  chemically synthesized
atccaatagaaaaatgggaa

SEQ ID NO: 238922 - DNA, 20 bp, Artificial Sequence
  chemically synthesized
agataatccaatagaaaaat

SEQ ID NO: 238923 - DNA, 20 bp, Artificial Sequence
  chemically synthesized
cagataatccaatagaaaaa

SEQ ID NO: 238924 - DNA, 20 bp, Artificial Sequence
  chemically synthesized
aacttttcccatttttctat

SEQ ID NO: 238925 - DNA, 20 bp, Artificial Sequence
  chemically synthesized
gaaaagaacagataatccaa

SEQ ID NO: 238926 - DNA, 20 bp, Artificial Sequence
  chemically synthesized
acaaatctttcagaaaagaa

SEQ ID NO: 238927 - DNA, 20 bp, Artificial Sequence
  chemically synthesized
gattatctgttcttttctga

SEQ ID NO: 238928 - DNA, 20 bp, Artificial Sequence
  chemically synthesized
ttcctacaaatctttcagaa

SEQ ID NO: 238929 - DNA, 20 bp, Artificial Sequence
  chemically synthesized
aagaattcctacaaatcttt

SEQ ID NO: 238930 - DNA, 20 bp, Artificial Sequence
  chemically synthesized
gttcttttctgaaagatttg

SEQ ID NO: 238931 - DNA, 20 bp, Artificial Sequence
  chemically synthesized
ttcttttctgaaagatttgt

SEQ ID NO: 238932 - DNA, 20 bp, Artificial Sequence
  chemically synthesized
tgtgtgtattcataattata

SEQ ID NO: 238933 - DNA, 20 bp, Artificial Sequence
  chemically synthesized
tatttggaatacacacataa

SEQ ID NO: 238934 - DNA, 20 bp, Artificial Sequence
  chemically synthesized
acagagtaggataaattatt

SEQ ID NO: 238935 - DNA, 20 bp, Artificial Sequence
  chemically synthesized
aaataatttatcctactctg

SEQ ID NO: 238936 - DNA, 20 bp, Artificial Sequence
  chemically synthesized
aataatttatcctactctgt

SEQ ID NO: 238937 - DNA, 20 bp, Artificial Sequence
  chemically synthesized
aaaaatgaaacccacagagt

SEQ ID NO: 238938 - DNA, 20 bp, Artificial Sequence
  chemically synthesized
taaaaatgaaacccacagag

SEQ ID NO: 238939 - DNA, 20 bp, Artificial Sequence
  chemically synthesized
gagtaaaaatgaaacccaca

SEQ ID NO: 238940 - DNA, 20 bp, Artificial Sequence
  chemically synthesized
gagagtaaaaatgaaaccca

SEQ ID NO: 238941 - DNA, 20 bp, Artificial Sequence
  chemically synthesized
gggtttcatttttactctct

SEQ ID NO: 238942 - DNA, 20 bp, Artificial Sequence
  chemically synthesized
atcaaaagacagcactgaga

SEQ ID NO: 238943 - DNA, 20 bp, Artificial Sequence
  chemically synthesized
acatcaaaagacagcactga

SEQ ID NO: 238944 - DNA, 20 bp, Artificial Sequence
  chemically synthesized
atacatcaaaagacagcact

SEQ ID NO: 238945 - DNA, 20 bp, Artificial Sequence
  chemically synthesized
aacatctatacatcaaaaga

SEQ ID NO: 238946 - DNA, 20 bp, Artificial Sequence
  chemically synthesized
taataacatctatacatcaa

SEQ ID NO: 238947 - DNA, 20 bp, Artificial Sequence
  chemically synthesized
cagtgctgtcttttgatgta

SEQ ID NO: 238948 - DNA, 20 bp, Artificial Sequence
  chemically synthesized
tatagatgttattaatatac

SEQ ID NO: 238949 - DNA, 20 bp, Artificial Sequence
  chemically synthesized
atagatgttattaatataca

SEQ ID NO: 238950 - DNA, 20 bp, Artificial Sequence
  chemically synthesized
gatgttattaatatacaagg

SEQ ID NO: 238951 - DNA, 20 bp, Artificial Sequence
  chemically synthesized
catgaataaaaataataaag

SEQ ID NO: 238952 - DNA, 20 bp, Artificial Sequence
  chemically synthesized
aatcatgaataaaaataata

SEQ ID NO: 238953 - DNA, 20 bp, Artificial Sequence
  chemically synthesized
ttattatttttattcatgat

SEQ ID NO: 238954 - DNA, 20 bp, Artificial Sequence
  chemically synthesized
aattgcttacacaaatgatg

SEQ ID NO: 238955 - DNA, 20 bp, Artificial Sequence
  chemically synthesized
tagtgcttcatcatttgtgt

SEQ ID NO: 238956 - DNA, 20 bp, Artificial Sequence
  chemically synthesized
tatgttaattaatatagggt

SEQ ID NO: 238957 - DNA, 20 bp, Artificial Sequence
  chemically synthesized
agaatatgttaattaatata

SEQ ID NO: 238958 - DNA, 20 bp, Artificial Sequence
  chemically synthesized
gagaatatgttaattaatat

SEQ ID NO: 238959 - DNA, 20 bp, Artificial Sequence
  chemically synthesized
ggagaatatgttaattaata

SEQ ID NO: 238960 - DNA, 20 bp, Artificial Sequence
  chemically synthesized
gcttttacagtaaaatagag

SEQ ID NO: 238961 - DNA, 20 bp, Artificial Sequence
  chemically synthesized
aagcttttacagtaaaatag

SEQ ID NO: 238962 - DNA, 20 bp, Artificial Sequence
  chemically synthesized
aaagcttttacagtaaaata

SEQ ID NO: 238963 - DNA, 20 bp, Artificial Sequence
  chemically synthesized
ataaagcttttacagtaaaa

SEQ ID NO: 238964 - DNA, 20 bp, Artificial Sequence
  chemically synthesized
tctcctctattttactgtaa

SEQ ID NO: 238965 - DNA, 20 bp, Artificial Sequence
  chemically synthesized
acaaattgataaagctttta

SEQ ID NO: 238966 - DNA, 20 bp, Artificial Sequence
  chemically synthesized
gagaaaaaaacaaattgata

SEQ ID NO: 238967 - DNA, 20 bp, Artificial Sequence
  chemically synthesized
aatttgtttttttctcatgt

SEQ ID NO: 238968 - DNA, 20 bp, Artificial Sequence
  chemically synthesized
aggtgactaaaaactgacat

SEQ ID NO: 238969 - DNA, 20 bp, Artificial Sequence
  chemically synthesized
ttttttctcatgtcagtttt

SEQ ID NO: 238970 - DNA, 20 bp, Artificial Sequence
  chemically synthesized
catgtcagtttttagtcacc

SEQ ID NO: 238971 - DNA, 20 bp, Artificial Sequence
  chemically synthesized
atgtcagtttttagtcacct

SEQ ID NO: 238972 - DNA, 20 bp, Artificial Sequence
  chemically synthesized
atatacaaaaataaaatccc

SEQ ID NO: 238973 - DNA, 20 bp, Artificial Sequence
  chemically synthesized
tatatacaaaaataaaatcc

SEQ ID NO: 238974 - DNA, 20 bp, Artificial Sequence
  chemically synthesized
tgggattttatttttgtata

SEQ ID NO: 238975 - DNA, 20 bp, Artificial Sequence
  chemically synthesized
tttttgtatatagtttgaaa

SEQ ID NO: 238976 - DNA, 20 bp, Artificial Sequence
  chemically synthesized
agaatatatacttttttcct

SEQ ID NO: 238977 - DNA, 20 bp, Artificial Sequence
  chemically synthesized
gagtctcctgcttaggaaaa

SEQ ID NO: 238978 - DNA, 20 bp, Artificial Sequence
  chemically synthesized
atatatacttttttcctaag

SEQ ID NO: 238979 - DNA, 20 bp, Artificial Sequence
  chemically synthesized
tatatacttttttcctaagc

SEQ ID NO: 238980 - DNA, 20 bp, Artificial Sequence
  chemically synthesized
tatacttttttcctaagcag

SEQ ID NO: 238981 - DNA, 20 bp, Artificial Sequence
  chemically synthesized
taaaatggagtctcctgctt

SEQ ID NO: 238982 - DNA, 20 bp, Artificial Sequence
  chemically synthesized
ttaaaatggagtctcctgct

SEQ ID NO: 238983 - DNA, 20 bp, Artificial Sequence
  chemically synthesized
ttacctaaaaaattaaaatg

SEQ ID NO: 238984 - DNA, 20 bp, Artificial Sequence
  chemically synthesized
ttttacctaaaaaattaaaa

SEQ ID NO: 238985 - DNA, 20 bp, Artificial Sequence
  chemically synthesized
gagactccattttaattttt

SEQ ID NO: 238986 - DNA, 20 bp, Artificial Sequence
  chemically synthesized
agactccattttaatttttt

SEQ ID NO: 238987 - DNA, 20 bp, Artificial Sequence
  chemically synthesized
gtaaaacatgtgcactgtac

SEQ ID NO: 238988 - DNA, 20 bp, Artificial Sequence
  chemically synthesized
tgttcatgcattatcttgta

SEQ ID NO: 238989 - DNA, 20 bp, Artificial Sequence
  chemically synthesized
tgtacaagataatgcatgaa

SEQ ID NO: 238990 - DNA, 20 bp, Artificial Sequence
  chemically synthesized
acaagataatgcatgaacag

SEQ ID NO: 238991 - DNA, 20 bp, Artificial Sequence
  chemically synthesized
catgaacagcagaaaaataa

SEQ ID NO: 238992 - DNA, 20 bp, Artificial Sequence
  chemically synthesized
cagaaaaataaaagtgtgtg

SEQ ID NO: 238993 - DNA, 20 bp, Artificial Sequence
  chemically synthesized
ataaaagtgtgtgcagtgaa

SEQ ID NO: 238994 - DNA, 20 bp, Artificial Sequence
  chemically synthesized
tgagcagatcaaaattggga

SEQ ID NO: 238995 - DNA, 20 bp, Artificial Sequence
  chemically synthesized
agagtgagcagatcaaaatt

SEQ ID NO: 238996 - DNA, 20 bp, Artificial Sequence
  chemically synthesized
cagagtgagcagatcaaaat

SEQ ID NO: 238997 - DNA, 20 bp, Artificial Sequence
  chemically synthesized
caattttgatctgctcactc

SEQ ID NO: 238998 - DNA, 20 bp, Artificial Sequence
  chemically synthesized
agcagaactaccagagtgag

SEQ ID NO: 238999 - DNA, 20 bp, Artificial Sequence
  chemically synthesized
ttttgatctgctcactctgg

SEQ ID NO: 239000 - DNA, 20 bp, Artificial Sequence
  chemically synthesized
gagagcagaactaccagagt

SEQ ID NO: 239001 - DNA, 20 bp, Artificial Sequence
  chemically synthesized
cagtgagagcagaactacca

SEQ ID NO: 239002 - DNA, 20 bp, Artificial Sequence
  chemically synthesized
aacagtgagagcagaactac

SEQ ID NO: 239003 - DNA, 20 bp, Artificial Sequence
  chemically synthesized
atttttattaacagtgagag

SEQ ID NO: 239004 - DNA, 20 bp, Artificial Sequence
  chemically synthesized
aaaatttttattaacagtga

SEQ ID NO: 239005 - DNA, 20 bp, Artificial Sequence
  chemically synthesized
ataaaatttttattaacagt

SEQ ID NO: 239006 - DNA, 20 bp, Artificial Sequence
  chemically synthesized
aattataaaatttttattaa

SEQ ID NO: 239007 - DNA, 20 bp, Artificial Sequence
  chemically synthesized
tttataattttaaatattta

SEQ ID NO: 239008 - DNA, 20 bp, Artificial Sequence
  chemically synthesized
attttaaatatttatagaac

SEQ ID NO: 239009 - DNA, 20 bp, Artificial Sequence
  chemically synthesized
ttttaaatatttatagaaca

SEQ ID NO: 239010 - DNA, 20 bp, Artificial Sequence
  chemically synthesized
aatatttatagaacaaggca

SEQ ID NO: 239011 - DNA, 20 bp, Artificial Sequence
  chemically synthesized
acaaggcaaagaaataaaca

SEQ ID NO: 239012 - DNA, 20 bp, Artificial Sequence
  chemically synthesized
aacacagtgatataaaatga

SEQ ID NO: 239013 - DNA, 20 bp, Artificial Sequence
  chemically synthesized
aaaatgatagtctcctcatt

SEQ ID NO: 239014 - DNA, 20 bp, Artificial Sequence
  chemically synthesized
aagcagtaaaactgaatgag

SEQ ID NO: 239015 - DNA, 20 bp, Artificial Sequence
  chemically synthesized
gaaagcagtaaaactgaatg

SEQ ID NO: 239016 - DNA, 20 bp, Artificial Sequence
  chemically synthesized
tgaaagcagtaaaactgaat

SEQ ID NO: 239017 - DNA, 20 bp, Artificial Sequence
  chemically synthesized
agcattgaatatattgaaag

SEQ ID NO: 239018 - DNA, 20 bp, Artificial Sequence
  chemically synthesized
atcagcattgaatatattga

SEQ ID NO: 239019 - DNA, 20 bp, Artificial Sequence
  chemically synthesized
atccagagttgtaaaaatat

SEQ ID NO: 239020 - DNA, 20 bp, Artificial Sequence
  chemically synthesized
tgctgatatttttacaactc

SEQ ID NO: 239021 - DNA, 20 bp, Artificial Sequence
  chemically synthesized
caaagtataatgtcaatcca

SEQ ID NO: 239022 - DNA, 20 bp, Artificial Sequence
  chemically synthesized
tacaaagtataatgtcaatc

SEQ ID NO: 239023 - DNA, 20 bp, Artificial Sequence
  chemically synthesized
caataaaatagagtgttaca

SEQ ID NO: 239024 - DNA, 20 bp, Artificial Sequence
  chemically synthesized
gattagggatcaataaaata

SEQ ID NO: 239025 - DNA, 20 bp, Artificial Sequence
  chemically synthesized
aggattagggatcaataaaa

SEQ ID NO: 239026 - DNA, 20 bp, Artificial Sequence
  chemically synthesized
tcacaacctagggaggatta

SEQ ID NO: 239027 - DNA, 20 bp, Artificial Sequence
  chemically synthesized
ctcacaacctagggaggatt

SEQ ID NO: 239028 - DNA, 20 bp, Artificial Sequence
  chemically synthesized
gctcacaacctagggaggat

SEQ ID NO: 239029 - DNA, 20 bp, Artificial Sequence
  chemically synthesized
tattgatccctaatcctccc

SEQ ID NO: 239030 - DNA, 20 bp, Artificial Sequence
  chemically synthesized
attgatccctaatcctccct

SEQ ID NO: 239031 - DNA, 20 bp, Artificial Sequence
  chemically synthesized
acaaggctcacaacctaggg

SEQ ID NO: 239032 - DNA, 20 bp, Artificial Sequence
  chemically synthesized
aacaaggctcacaacctagg

SEQ ID NO: 239033 - DNA, 20 bp, Artificial Sequence
  chemically synthesized
agaacaaggctcacaaccta

SEQ ID NO: 239034 - DNA, 20 bp, Artificial Sequence
  chemically synthesized
cctaatcctccctaggttgt

SEQ ID NO: 239035 - DNA, 20 bp, Artificial Sequence
  chemically synthesized
gagaacaaggctcacaacct

SEQ ID NO: 239036 - DNA, 20 bp, Artificial Sequence
  chemically synthesized
tgagaacaaggctcacaacc

SEQ ID NO: 239037 - DNA, 20 bp, Artificial Sequence
  chemically synthesized
taggttgtgagccttgttct

SEQ ID NO: 239038 - DNA, 20 bp, Artificial Sequence
  chemically synthesized
aggttgtgagccttgttctc

SEQ ID NO: 239039 - DNA, 20 bp, Artificial Sequence
  chemically synthesized
gtatttgaagcctgagaaca

SEQ ID NO: 239040 - DNA, 20 bp, Artificial Sequence
  chemically synthesized
cgtatttgaagcctgagaac

SEQ ID NO: 239041 - DNA, 20 bp, Artificial Sequence
  chemically synthesized
tccaaacgtatttgaagcct

SEQ ID NO: 239042 - DNA, 20 bp, Artificial Sequence
  chemically synthesized
tatgactccaaacgtatttg

SEQ ID NO: 239043 - DNA, 20 bp, Artificial Sequence
  chemically synthesized
tctcaggcttcaaatacgtt

SEQ ID NO: 239044 - DNA, 20 bp, Artificial Sequence
  chemically synthesized
tcaggcttcaaatacgtttg

SEQ ID NO: 239045 - DNA, 20 bp, Artificial Sequence
  chemically synthesized
tggagtcatactttgatttt

SEQ ID NO: 239046 - DNA, 20 bp, Artificial Sequence
  chemically synthesized
ctgtgagaaacttaaaatca

SEQ ID NO: 239047 - DNA, 20 bp, Artificial Sequence
  chemically synthesized
ctttgattttaagtttctca

SEQ ID NO: 239048 - DNA, 20 bp, Artificial Sequence
  chemically synthesized
tcaagtattataaacactgt

SEQ ID NO: 239049 - DNA, 20 bp, Artificial Sequence
  chemically synthesized
tcacagtgtttataatactt

SEQ ID NO: 239050 - DNA, 20 bp, Artificial Sequence
  chemically synthesized
gtgtttataatacttgagct

SEQ ID NO: 239051 - DNA, 20 bp, Artificial Sequence
  chemically synthesized
tgtttataatacttgagctt

SEQ ID NO: 239052 - DNA, 20 bp, Artificial Sequence
  chemically synthesized
gagaatgagttcctaagctc

SEQ ID NO: 239053 - DNA, 20 bp, Artificial Sequence
  chemically synthesized
aggcatgagaatgagttcct

SEQ ID NO: 239054 - DNA, 20 bp, Artificial Sequence
  chemically synthesized
ggggataaaggcatgagaat

SEQ ID NO: 239055 - DNA, 20 bp, Artificial Sequence
  chemically synthesized
aagagaggggataaaggcat

SEQ ID NO: 239056 - DNA, 20 bp, Artificial Sequence
  chemically synthesized
acagcgaagagaggggataa

SEQ ID NO: 239057 - DNA, 20 bp, Artificial Sequence
  chemically synthesized
aacagcgaagagaggggata

SEQ ID NO: 239058 - DNA, 20 bp, Artificial Sequence
  chemically synthesized
aatttcaacagcgaagagag

SEQ ID NO: 239059 - DNA, 20 bp, Artificial Sequence
  chemically synthesized
gaatttcaacagcgaagaga

SEQ ID NO: 239060 - DNA, 20 bp, Artificial Sequence
  chemically synthesized
agaatttcaacagcgaagag

SEQ ID NO: 239061 - DNA, 20 bp, Artificial Sequence
  chemically synthesized
tagaatttcaacagcgaaga

SEQ ID NO: 239062 - DNA, 20 bp, Artificial Sequence
  chemically synthesized
tgtagaatttcaacagcgaa

SEQ ID NO: 239063 - DNA, 20 bp, Artificial Sequence
  chemically synthesized
tgtgtagaatttcaacagcg

SEQ ID NO: 239064 - DNA, 20 bp, Artificial Sequence
  chemically synthesized
aaaaatgtgtagaatttcaa

SEQ ID NO: 239065 - DNA, 20 bp, Artificial Sequence
  chemically synthesized
gaaataagggaaaaaatgtg

SEQ ID NO: 239066 - DNA, 20 bp, Artificial Sequence
  chemically synthesized
agtgaagttatgagaaataa

SEQ ID NO: 239067 - DNA, 20 bp, Artificial Sequence
  chemically synthesized
aagtgaagttatgagaaata

SEQ ID NO: 239068 - DNA, 20 bp, Artificial Sequence
  chemically synthesized
taagtgaagttatgagaaat

SEQ ID NO: 239069 - DNA, 20 bp, Artificial Sequence
  chemically synthesized
aatgcaataagtgaagttat

SEQ ID NO: 239070 - DNA, 20 bp, Artificial Sequence
  chemically synthesized
tattcagaatgcaataagtg

SEQ ID NO: 239071 - DNA, 20 bp, Artificial Sequence
  chemically synthesized
ctgtttattcagaatgcaat

SEQ ID NO: 239072 - DNA, 20 bp, Artificial Sequence
  chemically synthesized
cttattgcattctgaataaa

SEQ ID NO: 239073 - DNA, 20 bp, Artificial Sequence
  chemically synthesized
atttatctttgctgtttatt

SEQ ID NO: 239074 - DNA, 20 bp, Artificial Sequence
  chemically synthesized
tgcattctgaataaacagca

SEQ ID NO: 239075 - DNA, 20 bp, Artificial Sequence
  chemically synthesized
gatgttggtggtacaggtca

SEQ ID NO: 239076 - DNA, 20 bp, Artificial Sequence
  chemically synthesized
ggtgttgatgttggtggtac

SEQ ID NO: 239077 - DNA, 20 bp, Artificial Sequence
  chemically synthesized
aggtgttgatgttggtggta

SEQ ID NO: 239078 - DNA, 20 bp, Artificial Sequence
  chemically synthesized
actttaggtgttgatgttgg

SEQ ID NO: 239079 - DNA, 20 bp, Artificial Sequence
  chemically synthesized
gtcactttaggtgttgatgt

SEQ ID NO: 239080 - DNA, 20 bp, Artificial Sequence
  chemically synthesized
accaccaacatcaacaccta

SEQ ID NO: 239081 - DNA, 20 bp, Artificial Sequence
  chemically synthesized
aatgggaaagaggtcacttt

SEQ ID NO: 239082 - DNA, 20 bp, Artificial Sequence
  chemically synthesized
taatgggaaagaggtcactt

SEQ ID NO: 239083 - DNA, 20 bp, Artificial Sequence
  chemically synthesized
agtcccctataatgggaaag

SEQ ID NO: 239084 - DNA, 20 bp, Artificial Sequence
  chemically synthesized
gagtcccctataatgggaaa

SEQ ID NO: 239085 - DNA, 20 bp, Artificial Sequence
  chemically synthesized
aagagtcccctataatggga

SEQ ID NO: 239086 - DNA, 20 bp, Artificial Sequence
  chemically synthesized
aagtgacctctttcccatta

SEQ ID NO: 239087 - DNA, 20 bp, Artificial Sequence
  chemically synthesized
agtgacctctttcccattat

SEQ ID NO: 239088 - DNA, 20 bp, Artificial Sequence
  chemically synthesized
gtgacctctttcccattata

SEQ ID NO: 239089 - DNA, 20 bp, Artificial Sequence
  chemically synthesized
tgacctctttcccattatag

SEQ ID NO: 239090 - DNA, 20 bp, Artificial Sequence
  chemically synthesized
gtagaagagtcccctataat

SEQ ID NO: 239091 - DNA, 20 bp, Artificial Sequence
  chemically synthesized
agtagaagagtcccctataa

SEQ ID NO: 239092 - DNA, 20 bp, Artificial Sequence
  chemically synthesized
ctccattaagcacagtagaa

SEQ ID NO: 239093 - DNA, 20 bp, Artificial Sequence
  chemically synthesized
gtctccattaagcacagtag

SEQ ID NO: 239094 - DNA, 20 bp, Artificial Sequence
  chemically synthesized
ctagtctccattaagcacag

SEQ ID NO: 239095 - DNA, 20 bp, Artificial Sequence
  chemically synthesized
gactcttctactgtgcttaa

SEQ ID NO: 239096 - DNA, 20 bp, Artificial Sequence
  chemically synthesized
atcctagtctccattaagca

SEQ ID NO: 239097 - DNA, 20 bp, Artificial Sequence
  chemically synthesized
ctcttctactgtgcttaatg

SEQ ID NO: 239098 - DNA, 20 bp, Artificial Sequence
  chemically synthesized
aacacatcctagtctccatt

SEQ ID NO: 239099 - DNA, 20 bp, Artificial Sequence
  chemically synthesized
ctactgtgcttaatggagac

SEQ ID NO: 239100 - DNA, 20 bp, Artificial Sequence
  chemically synthesized
tactgtgcttaatggagact

SEQ ID NO: 239101 - DNA, 20 bp, Artificial Sequence
  chemically synthesized
cctttgaggggaacacatcc

SEQ ID NO: 239102 - DNA, 20 bp, Artificial Sequence
  chemically synthesized
actaggatgtgttcccctca

SEQ ID NO: 239103 - DNA, 20 bp, Artificial Sequence
  chemically synthesized
ctaggatgtgttcccctcaa

SEQ ID NO: 239104 - DNA, 20 bp, Artificial Sequence
  chemically synthesized
aaaactagaattcctttgag

SEQ ID NO: 239105 - DNA, 20 bp, Artificial Sequence
  chemically synthesized
aaaaactagaattcctttga

SEQ ID NO: 239106 - DNA, 20 bp, Artificial Sequence
  chemically synthesized
taaaaactagaattcctttg

SEQ ID NO: 239107 - DNA, 20 bp, Artificial Sequence
  chemically synthesized
ataaaaactagaattccttt

SEQ ID NO: 239108 - DNA, 20 bp, Artificial Sequence
  chemically synthesized
tgttcccctcaaaggaattc

SEQ ID NO: 239109 - DNA, 20 bp, Artificial Sequence
  chemically synthesized
caaaggaattctagttttta

SEQ ID NO: 239110 - DNA, 20 bp, Artificial Sequence
  chemically synthesized
acaagtttacctataaaaac

SEQ ID NO: 239111 - DNA, 20 bp, Artificial Sequence
  chemically synthesized
aaaggaattctagtttttat

SEQ ID NO: 239112 - DNA, 20 bp, Artificial Sequence
  chemically synthesized
gtccatacaagacatttaac

SEQ ID NO: 239113 - DNA, 20 bp, Artificial Sequence
  chemically synthesized
aacttgttaaatgtcttgta

SEQ ID NO: 239114 - DNA, 20 bp, Artificial Sequence
  chemically synthesized
tcataaggcagtgtccatac

SEQ ID NO: 239115 - DNA, 20 bp, Artificial Sequence
  chemically synthesized
gcaaatgaggtttcataagg

SEQ ID NO: 239116 - DNA, 20 bp, Artificial Sequence
  chemically synthesized
aaagcaaatgaggtttcata

SEQ ID NO: 239117 - DNA, 20 bp, Artificial Sequence
  chemically synthesized
gaaagcaaatgaggtttcat

SEQ ID NO: 239118 - DNA, 20 bp, Artificial Sequence
  chemically synthesized
tgaagctttgaaagcaaatg

SEQ ID NO: 239119 - DNA, 20 bp, Artificial Sequence
  chemically synthesized
ttgaagctttgaaagcaaat

SEQ ID NO: 239120 - DNA, 20 bp, Artificial Sequence
  chemically synthesized
tgaaacctcatttgctttca

SEQ ID NO: 239121 - DNA, 20 bp, Artificial Sequence
  chemically synthesized
gatgttagttgaagctttga

SEQ ID NO: 239122 - DNA, 20 bp, Artificial Sequence
  chemically synthesized
cctgctgtagatgttagttg

SEQ ID NO: 239123 - DNA, 20 bp, Artificial Sequence
  chemically synthesized
aaagcttcaactaacatcta

SEQ ID NO: 239124 - DNA, 20 bp, Artificial Sequence
  chemically synthesized
ccaatacctgctgtagatgt

SEQ ID NO: 239125 - DNA, 20 bp, Artificial Sequence
  chemically synthesized
gcttcaactaacatctacag

SEQ ID NO: 239126 - DNA, 20 bp, Artificial Sequence
  chemically synthesized
cttcaactaacatctacagc

SEQ ID NO: 239127 - DNA, 20 bp, Artificial Sequence
  chemically synthesized
aagtttgccaatacctgctg

SEQ ID NO: 239128 - DNA, 20 bp, Artificial Sequence
  chemically synthesized
ctaacatctacagcaggtat

SEQ ID NO: 239129 - DNA, 20 bp, Artificial Sequence
  chemically synthesized
gcaggtattggcaaacttta

SEQ ID NO: 239130 - DNA, 20 bp, Artificial Sequence
  chemically synthesized
tctcaagatctttatctata

SEQ ID NO: 239131 - DNA, 20 bp, Artificial Sequence
  chemically synthesized
attggcaaactttatagata

SEQ ID NO: 239132 - DNA, 20 bp, Artificial Sequence
  chemically synthesized
actttatagataaagatctt

SEQ ID NO: 239133 - DNA, 20 bp, Artificial Sequence
  chemically synthesized
agcctgaaatatttgttctc

SEQ ID NO: 239134 - DNA, 20 bp, Artificial Sequence
  chemically synthesized
gatcttgagaacaaatattt

SEQ ID NO: 239135 - DNA, 20 bp, Artificial Sequence
  chemically synthesized
atcttgagaacaaatatttc

SEQ ID NO: 239136 - DNA, 20 bp, Artificial Sequence
  chemically synthesized
aacaaatatttcaggctttg

SEQ ID NO: 239137 - DNA, 20 bp, Artificial Sequence
  chemically synthesized
acaaatatttcaggctttgt

SEQ ID NO: 239138 - DNA, 20 bp, Artificial Sequence
  chemically synthesized
caaaaaccatacggcccaca

SEQ ID NO: 239139 - DNA, 20 bp, Artificial Sequence
  chemically synthesized
ttcaggctttgtgggccgta

SEQ ID NO: 239140 - DNA, 20 bp, Artificial Sequence
  chemically synthesized
tagttgtaacaaaaaccata

SEQ ID NO: 239141 - DNA, 20 bp, Artificial Sequence
  chemically synthesized
aacttcaaggcagagttgag

SEQ ID NO: 239142 - DNA, 20 bp, Artificial Sequence
  chemically synthesized
ttgaacttcaaggcagagtt

SEQ ID NO: 239143 - DNA, 20 bp, Artificial Sequence
  chemically synthesized
aactactcaactctgccttg

SEQ ID NO: 239144 - DNA, 20 bp, Artificial Sequence
  chemically synthesized
tttttttgaacttcaaggca

SEQ ID NO: 239145 - DNA, 20 bp, Artificial Sequence
  chemically synthesized
cttttttttgaacttcaagg

SEQ ID NO: 239146 - DNA, 20 bp, Artificial Sequence
  chemically synthesized
taccttttttttgaacttca

SEQ ID NO: 239147 - DNA, 20 bp, Artificial Sequence
  chemically synthesized
ataccttttttttgaacttc

SEQ ID NO: 239148 - DNA, 20 bp, Artificial Sequence
  chemically synthesized
ctgccttgaagttcaaaaaa

SEQ ID NO: 239149 - DNA, 20 bp, Artificial Sequence
  chemically synthesized
tgccttgaagttcaaaaaaa

SEQ ID NO: 239150 - DNA, 20 bp, Artificial Sequence
  chemically synthesized
gttcaaaaaaaaggtataca

SEQ ID NO: 239151 - DNA, 20 bp, Artificial Sequence
  chemically synthesized
tcaaaaaaaaggtatacatg

SEQ ID NO: 239152 - DNA, 20 bp, Artificial Sequence
  chemically synthesized
aaaaggtatacatggagcat

SEQ ID NO: 239153 - DNA, 20 bp, Artificial Sequence
  chemically synthesized
atacatggagcataagcaaa

SEQ ID NO: 239154 - DNA, 20 bp, Artificial Sequence
  chemically synthesized
ggagcataagcaaatggata

SEQ ID NO: 239155 - DNA, 20 bp, Artificial Sequence
  chemically synthesized
cataagcaaatggatatggc

SEQ ID NO: 239156 - DNA, 20 bp, Artificial Sequence
  chemically synthesized
ataagcaaatggatatggct

SEQ ID NO: 239157 - DNA, 20 bp, Artificial Sequence
  chemically synthesized
tgtaaagtagtattgaatcc

SEQ ID NO: 239158 - DNA, 20 bp, Artificial Sequence
  chemically synthesized
caccacttgtttttgtaaag

SEQ ID NO: 239159 - DNA, 20 bp, Artificial Sequence
  chemically synthesized
acccaccacttgtttttgta

SEQ ID NO: 239160 - DNA, 20 bp, Artificial Sequence
  chemically synthesized
caatactactttacaaaaac

SEQ ID NO: 239161 - DNA, 20 bp, Artificial Sequence
  chemically synthesized
tactactttacaaaaacaag

SEQ ID NO: 239162 - DNA, 20 bp, Artificial Sequence
  chemically synthesized
tactttacaaaaacaagtgg

SEQ ID NO: 239163 - DNA, 20 bp, Artificial Sequence
  chemically synthesized
actttacaaaaacaagtggt

SEQ ID NO: 239164 - DNA, 20 bp, Artificial Sequence
  chemically synthesized
aaacaagtggtgggtgtaat

SEQ ID NO: 239165 - DNA, 20 bp, Artificial Sequence
  chemically synthesized
tggtgggtgtaattggccca

SEQ ID NO: 239166 - DNA, 20 bp, Artificial Sequence
  chemically synthesized
ggtgggtgtaattggcccat

SEQ ID NO: 239167 - DNA, 20 bp, Artificial Sequence
  chemically synthesized
gggtgtaattggcccatggg

SEQ ID NO: 239168 - DNA, 20 bp, Artificial Sequence
  chemically synthesized
ggtgtaattggcccatgggc

SEQ ID NO: 239169 - DNA, 20 bp, Artificial Sequence
  chemically synthesized
gtcaataatctcctgcccat

SEQ ID NO: 239170 - DNA, 20 bp, Artificial Sequence
  chemically synthesized
tgtaattggcccatgggcag

SEQ ID NO: 239171 - DNA, 20 bp, Artificial Sequence
  chemically synthesized
agtcaataatctcctgccca

SEQ ID NO: 239172 - DNA, 20 bp, Artificial Sequence
  chemically synthesized
gagattattgactcttaatc

SEQ ID NO: 239173 - DNA, 20 bp, Artificial Sequence
  chemically synthesized
agattattgactcttaatct

SEQ ID NO: 239174 - DNA, 20 bp, Artificial Sequence
  chemically synthesized
tcataatcagcctagattaa

SEQ ID NO: 239175 - DNA, 20 bp, Artificial Sequence
  chemically synthesized
tgtcataatcagcctagatt

SEQ ID NO: 239176 - DNA, 20 bp, Artificial Sequence
  chemically synthesized
gagctatgtcataatcagcc

SEQ ID NO: 239177 - DNA, 20 bp, Artificial Sequence
  chemically synthesized
atttggagctatgtcataat

SEQ ID NO: 239178 - DNA, 20 bp, Artificial Sequence
  chemically synthesized
aatctaggctgattatgaca

SEQ ID NO: 239179 - DNA, 20 bp, Artificial Sequence
  chemically synthesized
tatgacatagctccaaattt

SEQ ID NO: 239180 - DNA, 20 bp, Artificial Sequence
  chemically synthesized
cagataagggctgaaatttg

SEQ ID NO: 239181 - DNA, 20 bp, Artificial Sequence
  chemically synthesized
ctcagataagggctgaaatt

SEQ ID NO: 239182 - DNA, 20 bp, Artificial Sequence
  chemically synthesized
ccaaatttcagcccttatct

SEQ ID NO: 239183 - DNA, 20 bp, Artificial Sequence
  chemically synthesized
caaatttcagcccttatctg

SEQ ID NO: 239184 - DNA, 20 bp, Artificial Sequence
  chemically synthesized
tggctatatacctcagataa

SEQ ID NO: 239185 - DNA, 20 bp, Artificial Sequence
  chemically synthesized
ttggctatatacctcagata

SEQ ID NO: 239186 - DNA, 20 bp, Artificial Sequence
  chemically synthesized
gttggctatatacctcagat

SEQ ID NO: 239187 - DNA, 20 bp, Artificial Sequence
  chemically synthesized
cagcccttatctgaggtata

SEQ ID NO: 239188 - DNA, 20 bp, Artificial Sequence
  chemically synthesized
tagcagttggctatatacct

SEQ ID NO: 239189 - DNA, 20 bp, Artificial Sequence
  chemically synthesized
aggatagtccaagtagcagt

SEQ ID NO: 239190 - DNA, 20 bp, Artificial Sequence
  chemically synthesized
gtatatagccaactgctact

SEQ ID NO: 239191 - DNA, 20 bp, Artificial Sequence
  chemically synthesized
gatgaggatagtccaagtag

SEQ ID NO: 239192 - DNA, 20 bp, Artificial Sequence
  chemically synthesized
tctgatgaggatagtccaag

SEQ ID NO: 239193 - DNA, 20 bp, Artificial Sequence
  chemically synthesized
tgttctgatgaggatagtcc

SEQ ID NO: 239194 - DNA, 20 bp, Artificial Sequence
  chemically synthesized
gctacttggactatcctcat

SEQ ID NO: 239195 - DNA, 20 bp, Artificial Sequence
  chemically synthesized
atcaaatgttctgatgagga

SEQ ID NO: 239196 - DNA, 20 bp, Artificial Sequence
  chemically synthesized
tcacatcaaatgttctgatg

SEQ ID NO: 239197 - DNA, 20 bp, Artificial Sequence
  chemically synthesized
ttcacatcaaatgttctgat

SEQ ID NO: 239198 - DNA, 20 bp, Artificial Sequence
  chemically synthesized
aacatttgatgtgaacctca

SEQ ID NO: 239199 - DNA, 20 bp, Artificial Sequence
  chemically synthesized
ttgttgacataacatctttg

SEQ ID NO: 239200 - DNA, 20 bp, Artificial Sequence
  chemically synthesized
attgttgacataacatcttt

SEQ ID NO: 239201 - DNA, 20 bp, Artificial Sequence
  chemically synthesized
aagacttgcatgggaaaata

SEQ ID NO: 239202 - DNA, 20 bp, Artificial Sequence
  chemically synthesized
aaagacttgcatgggaaaat

SEQ ID NO: 239203 - DNA, 20 bp, Artificial Sequence
  chemically synthesized
aattccttattttcccatgc

SEQ ID NO: 239204 - DNA, 20 bp, Artificial Sequence
  chemically synthesized
atcatatcaaagacttgcat

SEQ ID NO: 239205 - DNA, 20 bp, Artificial Sequence
  chemically synthesized
aatcatatcaaagacttgca

SEQ ID NO: 239206 - DNA, 20 bp, Artificial Sequence
  chemically synthesized
cacagatccaaatcatatca

SEQ ID NO: 239207 - DNA, 20 bp, Artificial Sequence
  chemically synthesized
tgcaagtctttgatatgatt

SEQ ID NO: 239208 - DNA, 20 bp, Artificial Sequence
  chemically synthesized
atgagatttgggtggggaca

SEQ ID NO: 239209 - DNA, 20 bp, Artificial Sequence
  chemically synthesized
tttaatatgagatttgggtg

SEQ ID NO: 239210 - DNA, 20 bp, Artificial Sequence
  chemically synthesized
atttaatatgagatttgggt

SEQ ID NO: 239211 - DNA, 20 bp, Artificial Sequence
  chemically synthesized
aatttaatatgagatttggg

SEQ ID NO: 239212 - DNA, 20 bp, Artificial Sequence
  chemically synthesized
tacaatttaatatgagattt

SEQ ID NO: 239213 - DNA, 20 bp, Artificial Sequence
  chemically synthesized
ttacaatttaatatgagatt

SEQ ID NO: 239214 - DNA, 20 bp, Artificial Sequence
  chemically synthesized
tggggattacaatttaatat

SEQ ID NO: 239215 - DNA, 20 bp, Artificial Sequence
  chemically synthesized
taaattgtaatccccaatgt

SEQ ID NO: 239216 - DNA, 20 bp, Artificial Sequence
  chemically synthesized
aggccccacctccaacattg

SEQ ID NO: 239217 - DNA, 20 bp, Artificial Sequence
  chemically synthesized
aattgtaatccccaatgttg

SEQ ID NO: 239218 - DNA, 20 bp, Artificial Sequence
  chemically synthesized
caggccccacctccaacatt

SEQ ID NO: 239219 - DNA, 20 bp, Artificial Sequence
  chemically synthesized
attgtaatccccaatgttgg

SEQ ID NO: 239220 - DNA, 20 bp, Artificial Sequence
  chemically synthesized
ccaggccccacctccaacat

SEQ ID NO: 239221 - DNA, 20 bp, Artificial Sequence
  chemically synthesized
gtaatccccaatgttggagg

SEQ ID NO: 239222 - DNA, 20 bp, Artificial Sequence
  chemically synthesized
taatccccaatgttggaggt

SEQ ID NO: 239223 - DNA, 20 bp, Artificial Sequence
  chemically synthesized
aatccccaatgttggaggtg

SEQ ID NO: 239224 - DNA, 20 bp, Artificial Sequence
  chemically synthesized
ccaatgttggaggtggggcc

SEQ ID NO: 239225 - DNA, 20 bp, Artificial Sequence
  chemically synthesized
tgttggaggtggggcctggt

SEQ ID NO: 239226 - DNA, 20 bp, Artificial Sequence
  chemically synthesized
ttggaggtggggcctggtga

SEQ ID NO: 239227 - DNA, 20 bp, Artificial Sequence
  chemically synthesized
tggaggtggggcctggtgag

SEQ ID NO: 239228 - DNA, 20 bp, Artificial Sequence
  chemically synthesized
tgatccagtcacctctcacc

SEQ ID NO: 239229 - DNA, 20 bp, Artificial Sequence
  chemically synthesized
atgatccagtcacctctcac

SEQ ID NO: 239230 - DNA, 20 bp, Artificial Sequence
  chemically synthesized
ggggcctggtgagaggtgac

SEQ ID NO: 239231 - DNA, 20 bp, Artificial Sequence
  chemically synthesized
gtgagaggtgactggatcat

SEQ ID NO: 239232 - DNA, 20 bp, Artificial Sequence
  chemically synthesized
tgagaggtgactggatcatc

SEQ ID NO: 239233 - DNA, 20 bp, Artificial Sequence
  chemically synthesized
gagaaaccaccctgatgatc

SEQ ID NO: 239234 - DNA, 20 bp, Artificial Sequence
  chemically synthesized
gagaggtgactggatcatca

SEQ ID NO: 239235 - DNA, 20 bp, Artificial Sequence
  chemically synthesized
aggtgactggatcatcaggg

SEQ ID NO: 239236 - DNA, 20 bp, Artificial Sequence
  chemically synthesized
atcatcagggtggtttctca

SEQ ID NO: 239237 - DNA, 20 bp, Artificial Sequence
  chemically synthesized
agaggatggtattaaaccgt

SEQ ID NO: 239238 - DNA, 20 bp, Artificial Sequence
  chemically synthesized
acggtttaataccatcctct

SEQ ID NO: 239239 - DNA, 20 bp, Artificial Sequence
  chemically synthesized
tgaggacagtaccaagagga

SEQ ID NO: 239240 - DNA, 20 bp, Artificial Sequence
  chemically synthesized
ttcatgaggacagtaccaag

SEQ ID NO: 239241 - DNA, 20 bp, Artificial Sequence
  chemically synthesized
tttcatgaggacagtaccaa

SEQ ID NO: 239242 - DNA, 20 bp, Artificial Sequence
  chemically synthesized
attttcatgaggacagtacc

SEQ ID NO: 239243 - DNA, 20 bp, Artificial Sequence
  chemically synthesized
ctcactcattttcatgagga

SEQ ID NO: 239244 - DNA, 20 bp, Artificial Sequence
  chemically synthesized
agaactcactcattttcatg

SEQ ID NO: 239245 - DNA, 20 bp, Artificial Sequence
  chemically synthesized
gagaactcactcattttcat

SEQ ID NO: 239246 - DNA, 20 bp, Artificial Sequence
  chemically synthesized
ggtactgtcctcatgaaaat

SEQ ID NO: 239247 - DNA, 20 bp, Artificial Sequence
  chemically synthesized
ctgtcctcatgaaaatgagt

SEQ ID NO: 239248 - DNA, 20 bp, Artificial Sequence
  chemically synthesized
tgaaaatgagtgagttctcc

SEQ ID NO: 239249 - DNA, 20 bp, Artificial Sequence
  chemically synthesized
tgagtgagttctccaagatc

SEQ ID NO: 239250 - DNA, 20 bp, Artificial Sequence
  chemically synthesized
ttttaaacaaccagatcttg

SEQ ID NO: 239251 - DNA, 20 bp, Artificial Sequence
  chemically synthesized
acttttaaacaaccagatct

SEQ ID NO: 239252 - DNA, 20 bp, Artificial Sequence
  chemically synthesized
gctacctacttttaaacaac

SEQ ID NO: 239253 - DNA, 20 bp, Artificial Sequence
  chemically synthesized
tccaagatctggttgtttaa

SEQ ID NO: 239254 - DNA, 20 bp, Artificial Sequence
  chemically synthesized
aagatctggttgtttaaaag

SEQ ID NO: 239255 - DNA, 20 bp, Artificial Sequence
  chemically synthesized
agatctggttgtttaaaagt

SEQ ID NO: 239256 - DNA, 20 bp, Artificial Sequence
  chemically synthesized
tctggttgtttaaaagtagg

SEQ ID NO: 239257 - DNA, 20 bp, Artificial Sequence
  chemically synthesized
gagttggtggtgggggtggg

SEQ ID NO: 239258 - DNA, 20 bp, Artificial Sequence
  chemically synthesized
agagagttggtggtgggggt

SEQ ID NO: 239259 - DNA, 20 bp, Artificial Sequence
  chemically synthesized
gagagagttggtggtggggg

SEQ ID NO: 239260 - DNA, 20 bp, Artificial Sequence
  chemically synthesized
agagagagagttggtggtgg

SEQ ID NO: 239261 - DNA, 20 bp, Artificial Sequence
  chemically synthesized
gagagagagagttggtggtg

SEQ ID NO: 239262 - DNA, 20 bp, Artificial Sequence
  chemically synthesized
agagagagagagttggtggt

SEQ ID NO: 239263 - DNA, 20 bp, Artificial Sequence
  chemically synthesized
cagagagagagagttggtgg

SEQ ID NO: 239264 - DNA, 20 bp, Artificial Sequence
  chemically synthesized
aagcagagagagagagttgg

SEQ ID NO: 239265 - DNA, 20 bp, Artificial Sequence
  chemically synthesized
cgaaagcagagagagagagt

SEQ ID NO: 239266 - DNA, 20 bp, Artificial Sequence
  chemically synthesized
atggcgaaagcagagagaga

SEQ ID NO: 239267 - DNA, 20 bp, Artificial Sequence
  chemically synthesized
acatggcgaaagcagagaga

SEQ ID NO: 239268 - DNA, 20 bp, Artificial Sequence
  chemically synthesized
tcacatggcgaaagcagaga

SEQ ID NO: 239269 - DNA, 20 bp, Artificial Sequence
  chemically synthesized
tttcacatggcgaaagcaga

SEQ ID NO: 239270 - DNA, 20 bp, Artificial Sequence
  chemically synthesized
catttcacatggcgaaagca

SEQ ID NO: 239271 - DNA, 20 bp, Artificial Sequence
  chemically synthesized
ggcatttcacatggcgaaag

SEQ ID NO: 239272 - DNA, 20 bp, Artificial Sequence
  chemically synthesized
gtaggcatttcacatggcga

SEQ ID NO: 239273 - DNA, 20 bp, Artificial Sequence
  chemically synthesized
gcaggtgtaggcatttcaca

SEQ ID NO: 239274 - DNA, 20 bp, Artificial Sequence
  chemically synthesized
gtggaaggcagagcaggtgt

SEQ ID NO: 239275 - DNA, 20 bp, Artificial Sequence
  chemically synthesized
ggtggaaggcagagcaggtg

SEQ ID NO: 239276 - DNA, 20 bp, Artificial Sequence
  chemically synthesized
ctcatggtggaaggcagagc

SEQ ID NO: 239277 - DNA, 20 bp, Artificial Sequence
  chemically synthesized
actcatggtggaaggcagag

SEQ ID NO: 239278 - DNA, 20 bp, Artificial Sequence
  chemically synthesized
tttactcatggtggaaggca

SEQ ID NO: 239279 - DNA, 20 bp, Artificial Sequence
  chemically synthesized
cttttactcatggtggaagg

SEQ ID NO: 239280 - DNA, 20 bp, Artificial Sequence
  chemically synthesized
gagcttttactcatggtgga

SEQ ID NO: 239281 - DNA, 20 bp, Artificial Sequence
  chemically synthesized
cctgctctgccttccaccat

SEQ ID NO: 239282 - DNA, 20 bp, Artificial Sequence
  chemically synthesized
ggagcttttactcatggtgg

SEQ ID NO: 239283 - DNA, 20 bp, Artificial Sequence
  chemically synthesized
cagggagcttttactcatgg

SEQ ID NO: 239284 - DNA, 20 bp, Artificial Sequence
  chemically synthesized
ctgccttccaccatgagtaa

SEQ ID NO: 239285 - DNA, 20 bp, Artificial Sequence
  chemically synthesized
cctcagggagcttttactca

SEQ ID NO: 239286 - DNA, 20 bp, Artificial Sequence
  chemically synthesized
accatgagtaaaagctccct

SEQ ID NO: 239287 - DNA, 20 bp, Artificial Sequence
  chemically synthesized
ccatgagtaaaagctccctg

SEQ ID NO: 239288 - DNA, 20 bp, Artificial Sequence
  chemically synthesized
gtttctggggaggcctcagg

SEQ ID NO: 239289 - DNA, 20 bp, Artificial Sequence
  chemically synthesized
ctgtttctggggaggcctca

SEQ ID NO: 239290 - DNA, 20 bp, Artificial Sequence
  chemically synthesized
tctgtttctggggaggcctc

SEQ ID NO: 239291 - DNA, 20 bp, Artificial Sequence
  chemically synthesized
atctgtttctggggaggcct

SEQ ID NO: 239292 - DNA, 20 bp, Artificial Sequence
  chemically synthesized
aaagctccctgaggcctccc

SEQ ID NO: 239293 - DNA, 20 bp, Artificial Sequence
  chemically synthesized
agcaacatctgtttctgggg

SEQ ID NO: 239294 - DNA, 20 bp, Artificial Sequence
  chemically synthesized
tagcaacatctgtttctggg

SEQ ID NO: 239295 - DNA, 20 bp, Artificial Sequence
  chemically synthesized
ccctgaggcctccccagaaa

SEQ ID NO: 239296 - DNA, 20 bp, Artificial Sequence
  chemically synthesized
catagcaacatctgtttctg

SEQ ID NO: 239297 - DNA, 20 bp, Artificial Sequence
  chemically synthesized
gcatagcaacatctgtttct

SEQ ID NO: 239298 - DNA, 20 bp, Artificial Sequence
  chemically synthesized
agcatagcaacatctgtttc

SEQ ID NO: 239299 - DNA, 20 bp, Artificial Sequence
  chemically synthesized
tgcaggctctacaggaagca

SEQ ID NO: 239300 - DNA, 20 bp, Artificial Sequence
  chemically synthesized
agatgttgctatgcttcctg

SEQ ID NO: 239301 - DNA, 20 bp, Artificial Sequence
  chemically synthesized
atgttgctatgcttcctgta

SEQ ID NO: 239302 - DNA, 20 bp, Artificial Sequence
  chemically synthesized
gattctgcaggctctacagg

SEQ ID NO: 239303 - DNA, 20 bp, Artificial Sequence
  chemically synthesized
gacgattctgcaggctctac

SEQ ID NO: 239304 - DNA, 20 bp, Artificial Sequence
  chemically synthesized
tgacgattctgcaggctcta

SEQ ID NO: 239305 - DNA, 20 bp, Artificial Sequence
  chemically synthesized
tatgcttcctgtagagcctg

SEQ ID NO: 239306 - DNA, 20 bp, Artificial Sequence
  chemically synthesized
taattggctgacgattctgc

SEQ ID NO: 239307 - DNA, 20 bp, Artificial Sequence
  chemically synthesized
ttaattggctgacgattctg

SEQ ID NO: 239308 - DNA, 20 bp, Artificial Sequence
  chemically synthesized
tgtagagcctgcagaatcgt

SEQ ID NO: 239309 - DNA, 20 bp, Artificial Sequence
  chemically synthesized
ataaagtaaagaggtttaat

SEQ ID NO: 239310 - DNA, 20 bp, Artificial Sequence
  chemically synthesized
tgggtgtttataaagtaaag

SEQ ID NO: 239311 - DNA, 20 bp, Artificial Sequence
  chemically synthesized
ctgggtgtttataaagtaaa

SEQ ID NO: 239312 - DNA, 20 bp, Artificial Sequence
  chemically synthesized
gactgggtgtttataaagta

SEQ ID NO: 239313 - DNA, 20 bp, Artificial Sequence
  chemically synthesized
cctgagactgggtgtttata

SEQ ID NO: 239314 - DNA, 20 bp, Artificial Sequence
  chemically synthesized
ctctttactttataaacacc

SEQ ID NO: 239315 - DNA, 20 bp, Artificial Sequence
  chemically synthesized
actttataaacacccagtct

SEQ ID NO: 239316 - DNA, 20 bp, Artificial Sequence
  chemically synthesized
ctttataaacacccagtctc

SEQ ID NO: 239317 - DNA, 20 bp, Artificial Sequence
  chemically synthesized
ataaagaaatacctgagact

SEQ ID NO: 239318 - DNA, 20 bp, Artificial Sequence
  chemically synthesized
tataaagaaatacctgagac

SEQ ID NO: 239319 - DNA, 20 bp, Artificial Sequence
  chemically synthesized
attgctataaagaaatacct

SEQ ID NO: 239320 - DNA, 20 bp, Artificial Sequence
  chemically synthesized
cagtctcaggtatttcttta

SEQ ID NO: 239321 - DNA, 20 bp, Artificial Sequence
  chemically synthesized
gccattcttgcattgctata

SEQ ID NO: 239322 - DNA, 20 bp, Artificial Sequence
  chemically synthesized
gtatttctttatagcaatgc

SEQ ID NO: 239323 - DNA, 20 bp, Artificial Sequence
  chemically synthesized
tctttatagcaatgcaagaa

SEQ ID NO: 239324 - DNA, 20 bp, Artificial Sequence
  chemically synthesized
aatgcaagaatggcctaatc

SEQ ID NO: 239325 - DNA, 20 bp, Artificial Sequence
  chemically synthesized
ttaaaactaaggactggatt

SEQ ID NO: 239326 - DNA, 20 bp, Artificial Sequence
  chemically synthesized
attaaaactaaggactggat

SEQ ID NO: 239327 - DNA, 20 bp, Artificial Sequence
  chemically synthesized
gaatggcctaatccagtcct

SEQ ID NO: 239328 - DNA, 20 bp, Artificial Sequence
  chemically synthesized
ctaaaattaaaactaaggac

SEQ ID NO: 239329 - DNA, 20 bp, Artificial Sequence
  chemically synthesized
attgactaaaattaaaacta

SEQ ID NO: 239330 - DNA, 20 bp, Artificial Sequence
  chemically synthesized
cattgactaaaattaaaact

SEQ ID NO: 239331 - DNA, 20 bp, Artificial Sequence
  chemically synthesized
ccagtccttagttttaattt

SEQ ID NO: 239332 - DNA, 20 bp, Artificial Sequence
  chemically synthesized
aattttagtcaatgatttcc

SEQ ID NO: 239333 - DNA, 20 bp, Artificial Sequence
  chemically synthesized
ttagtcaatgatttccaagc

SEQ ID NO: 239334 - DNA, 20 bp, Artificial Sequence
  chemically synthesized
tggtctcaagatttctagct

SEQ ID NO: 239335 - DNA, 20 bp, Artificial Sequence
  chemically synthesized
aacgatggtctcaagatttc

SEQ ID NO: 239336 - DNA, 20 bp, Artificial Sequence
  chemically synthesized
atttccaagctagaaatctt

SEQ ID NO: 239337 - DNA, 20 bp, Artificial Sequence
  chemically synthesized
gagaagtaaacgatggtctc

SEQ ID NO: 239338 - DNA, 20 bp, Artificial Sequence
  chemically synthesized
agaagtcgagaagtaaacga

SEQ ID NO: 239339 - DNA, 20 bp, Artificial Sequence
  chemically synthesized
atgataagaaagaagtcgag

SEQ ID NO: 239340 - DNA, 20 bp, Artificial Sequence
  chemically synthesized
agcatgataagaaagaagtc

SEQ ID NO: 239341 - DNA, 20 bp, Artificial Sequence
  chemically synthesized
agacaagcatgataagaaag

SEQ ID NO: 239342 - DNA, 20 bp, Artificial Sequence
  chemically synthesized
tagagacaagcatgataaga

SEQ ID NO: 239343 - DNA, 20 bp, Artificial Sequence
  chemically synthesized
aatatagagacaagcatgat

SEQ ID NO: 239344 - DNA, 20 bp, Artificial Sequence
  chemically synthesized
aattgataaaatatagagac

SEQ ID NO: 239345 - DNA, 20 bp, Artificial Sequence
  chemically synthesized
tttagaattgataaaatata

SEQ ID NO: 239346 - DNA, 20 bp, Artificial Sequence
  chemically synthesized
ggtttagaattgataaaata

SEQ ID NO: 239347 - DNA, 20 bp, Artificial Sequence
  chemically synthesized
atattttatcaattctaaac

SEQ ID NO: 239348 - DNA, 20 bp, Artificial Sequence
  chemically synthesized
ttaaagagtcatttctggtt

SEQ ID NO: 239349 - DNA, 20 bp, Artificial Sequence
  chemically synthesized
ctaaattaaagagtcatttc

SEQ ID NO: 239350 - DNA, 20 bp, Artificial Sequence
  chemically synthesized
ccagaaatgactctttaatt

SEQ ID NO: 239351 - DNA, 20 bp, Artificial Sequence
  chemically synthesized
agagaagaggctaaattaaa

SEQ ID NO: 239352 - DNA, 20 bp, Artificial Sequence
  chemically synthesized
agagagaagaggctaaatta

SEQ ID NO: 239353 - DNA, 20 bp, Artificial Sequence
  chemically synthesized
acagtggggctagagagaag

SEQ ID NO: 239354 - DNA, 20 bp, Artificial Sequence
  chemically synthesized
ttaatttagcctcttctctc

SEQ ID NO: 239355 - DNA, 20 bp, Artificial Sequence
  chemically synthesized
gacagtggggctagagagaa

SEQ ID NO: 239356 - DNA, 20 bp, Artificial Sequence
  chemically synthesized
acgacagtggggctagagag

SEQ ID NO: 239357 - DNA, 20 bp, Artificial Sequence
  chemically synthesized
gccacgacagtggggctaga

SEQ ID NO: 239358 - DNA, 20 bp, Artificial Sequence
  chemically synthesized
aggccacgacagtggggcta

SEQ ID NO: 239359 - DNA, 20 bp, Artificial Sequence
  chemically synthesized
aaaggccacgacagtggggc

SEQ ID NO: 239360 - DNA, 20 bp, Artificial Sequence
  chemically synthesized
caagaaaggccacgacagtg

SEQ ID NO: 239361 - DNA, 20 bp, Artificial Sequence
  chemically synthesized
tctctctagccccactgtcg

SEQ ID NO: 239362 - DNA, 20 bp, Artificial Sequence
  chemically synthesized
tcaagaaaggccacgacagt

SEQ ID NO: 239363 - DNA, 20 bp, Artificial Sequence
  chemically synthesized
ttcaagaaaggccacgacag

SEQ ID NO: 239364 - DNA, 20 bp, Artificial Sequence
  chemically synthesized
gttttcaagaaaggccacga

SEQ ID NO: 239365 - DNA, 20 bp, Artificial Sequence
  chemically synthesized
ttattaggagttttcaagaa

SEQ ID NO: 239366 - DNA, 20 bp, Artificial Sequence
  chemically synthesized
gttattaggagttttcaaga

SEQ ID NO: 239367 - DNA, 20 bp, Artificial Sequence
  chemically synthesized
aaaagttattaggagttttc

SEQ ID NO: 239368 - DNA, 20 bp, Artificial Sequence
  chemically synthesized
tgctgaggaaaagttattag

SEQ ID NO: 239369 - DNA, 20 bp, Artificial Sequence
  chemically synthesized
tatgctgaggaaaagttatt

SEQ ID NO: 239370 - DNA, 20 bp, Artificial Sequence
  chemically synthesized
atatgctgaggaaaagttat

SEQ ID NO: 239371 - DNA, 20 bp, Artificial Sequence
  chemically synthesized
aactcctaataacttttcct

SEQ ID NO: 239372 - DNA, 20 bp, Artificial Sequence
  chemically synthesized
agttggaatatgctgaggaa

SEQ ID NO: 239373 - DNA, 20 bp, Artificial Sequence
  chemically synthesized
agatgagttggaatatgctg

SEQ ID NO: 239374 - DNA, 20 bp, Artificial Sequence
  chemically synthesized
gagatgagttggaatatgct

SEQ ID NO: 239375 - DNA, 20 bp, Artificial Sequence
  chemically synthesized
gaaaatagggagagatgagt

SEQ ID NO: 239376 - DNA, 20 bp, Artificial Sequence
  chemically synthesized
aaccgaaaatagggagagat

SEQ ID NO: 239377 - DNA, 20 bp, Artificial Sequence
  chemically synthesized
tgagaaaccgaaaataggga

SEQ ID NO: 239378 - DNA, 20 bp, Artificial Sequence
  chemically synthesized
gctgagaaaccgaaaatagg

SEQ ID NO: 239379 - DNA, 20 bp, Artificial Sequence
  chemically synthesized
aactcatctctccctatttt

SEQ ID NO: 239380 - DNA, 20 bp, Artificial Sequence
  chemically synthesized
gcgctgagaaaccgaaaata

SEQ ID NO: 239381 - DNA, 20 bp, Artificial Sequence
  chemically synthesized
agcgctgagaaaccgaaaat

SEQ ID NO: 239382 - DNA, 20 bp, Artificial Sequence
  chemically synthesized
gagcgctgagaaaccgaaaa

SEQ ID NO: 239383 - DNA, 20 bp, Artificial Sequence
  chemically synthesized
tctccctattttcggtttct

SEQ ID NO: 239384 - DNA, 20 bp, Artificial Sequence
  chemically synthesized
gttgtctgttagagagcgct

SEQ ID NO: 239385 - DNA, 20 bp, Artificial Sequence
  chemically synthesized
ggtttctcagcgctctctaa

SEQ ID NO: 239386 - DNA, 20 bp, Artificial Sequence
  chemically synthesized
aagtgaggttgtctgttaga

SEQ ID NO: 239387 - DNA, 20 bp, Artificial Sequence
  chemically synthesized
ggaagtgaggttgtctgtta

SEQ ID NO: 239388 - DNA, 20 bp, Artificial Sequence
  chemically synthesized
taggaagtgaggttgtctgt

SEQ ID NO: 239389 - DNA, 20 bp, Artificial Sequence
  chemically synthesized
agggaccaaagtaggaagtg

SEQ ID NO: 239390 - DNA, 20 bp, Artificial Sequence
  chemically synthesized
tagggaccaaagtaggaagt

SEQ ID NO: 239391 - DNA, 20 bp, Artificial Sequence
  chemically synthesized
gacaacctcacttcctactt

SEQ ID NO: 239392 - DNA, 20 bp, Artificial Sequence
  chemically synthesized
tgtatagggaccaaagtagg

SEQ ID NO: 239393 - DNA, 20 bp, Artificial Sequence
  chemically synthesized
gtttgtatagggaccaaagt

SEQ ID NO: 239394 - DNA, 20 bp, Artificial Sequence
  chemically synthesized
tgtttgtatagggaccaaag

SEQ ID NO: 239395 - DNA, 20 bp, Artificial Sequence
  chemically synthesized
gaatgtttgtatagggacca

SEQ ID NO: 239396 - DNA, 20 bp, Artificial Sequence
  chemically synthesized
gctatgtgaatgtttgtata

SEQ ID NO: 239397 - DNA, 20 bp, Artificial Sequence
  chemically synthesized
ggctatgtgaatgtttgtat

SEQ ID NO: 239398 - DNA, 20 bp, Artificial Sequence
  chemically synthesized
gggctatgtgaatgtttgta

SEQ ID NO: 239399 - DNA, 20 bp, Artificial Sequence
  chemically synthesized
tccctatacaaacattcaca

SEQ ID NO: 239400 - DNA, 20 bp, Artificial Sequence
  chemically synthesized
ttcagtacagtatacatggt

SEQ ID NO: 239401 - DNA, 20 bp, Artificial Sequence
  chemically synthesized
tttcagtacagtatacatgg

SEQ ID NO: 239402 - DNA, 20 bp, Artificial Sequence
  chemically synthesized
tgttttcagtacagtataca

SEQ ID NO: 239403 - DNA, 20 bp, Artificial Sequence
  chemically synthesized
gattttctatgttttcagta

SEQ ID NO: 239404 - DNA, 20 bp, Artificial Sequence
  chemically synthesized
tgtatactgtactgaaaaca

SEQ ID NO: 239405 - DNA, 20 bp, Artificial Sequence
  chemically synthesized
tttcagattttctatgtttt

SEQ ID NO: 239406 - DNA, 20 bp, Artificial Sequence
  chemically synthesized
ttggttgttatgaaaatttt

SEQ ID NO: 239407 - DNA, 20 bp, Artificial Sequence
  chemically synthesized
ccacagtaaaaaaggaattt

SEQ ID NO: 239408 - DNA, 20 bp, Artificial Sequence
  chemically synthesized
caaaaggcccacagtaaaaa

SEQ ID NO: 239409 - DNA, 20 bp, Artificial Sequence
  chemically synthesized
gcaaaaggcccacagtaaaa

SEQ ID NO: 239410 - DNA, 20 bp, Artificial Sequence
  chemically synthesized
ccaaaattccttttttactg

SEQ ID NO: 239411 - DNA, 20 bp, Artificial Sequence
  chemically synthesized
caaaattccttttttactgt

SEQ ID NO: 239412 - DNA, 20 bp, Artificial Sequence
  chemically synthesized
aaaatacagcaaaaggccca

SEQ ID NO: 239413 - DNA, 20 bp, Artificial Sequence
  chemically synthesized
tcattctaaaatacagcaaa

SEQ ID NO: 239414 - DNA, 20 bp, Artificial Sequence
  chemically synthesized
gtcattctaaaatacagcaa

SEQ ID NO: 239415 - DNA, 20 bp, Artificial Sequence
  chemically synthesized
gtgggccttttgctgtattt

SEQ ID NO: 239416 - DNA, 20 bp, Artificial Sequence
  chemically synthesized
tagggtgtcattctaaaata

SEQ ID NO: 239417 - DNA, 20 bp, Artificial Sequence
  chemically synthesized
gaatagtgacattttagata

SEQ ID NO: 239418 - DNA, 20 bp, Artificial Sequence
  chemically synthesized
ggaatagtgacattttagat

SEQ ID NO: 239419 - DNA, 20 bp, Artificial Sequence
  chemically synthesized
tggaatagtgacattttaga

SEQ ID NO: 239420 - DNA, 20 bp, Artificial Sequence
  chemically synthesized
cttatggaatagtgacattt

SEQ ID NO: 239421 - DNA, 20 bp, Artificial Sequence
  chemically synthesized
ctaaaatgtcactattccat

SEQ ID NO: 239422 - DNA, 20 bp, Artificial Sequence
  chemically synthesized
taaaatgtcactattccata

SEQ ID NO: 239423 - DNA, 20 bp, Artificial Sequence
  chemically synthesized
gggagagaagccttatggaa

SEQ ID NO: 239424 - DNA, 20 bp, Artificial Sequence
  chemically synthesized
tccaagggagagaagcctta

SEQ ID NO: 239425 - DNA, 20 bp, Artificial Sequence
  chemically synthesized
taactaattccaagggagag

SEQ ID NO: 239426 - DNA, 20 bp, Artificial Sequence
  chemically synthesized
tccataaggcttctctccct

SEQ ID NO: 239427 - DNA, 20 bp, Artificial Sequence
  chemically synthesized
aagtaactaattccaaggga

SEQ ID NO: 239428 - DNA, 20 bp, Artificial Sequence
  chemically synthesized
tgaagtaactaattccaagg

SEQ ID NO: 239429 - DNA, 20 bp, Artificial Sequence
  chemically synthesized
aggcttctctcccttggaat

SEQ ID NO: 239430 - DNA, 20 bp, Artificial Sequence
  chemically synthesized
tatgaagtaactaattccaa

SEQ ID NO: 239431 - DNA, 20 bp, Artificial Sequence
  chemically synthesized
ttatgaagtaactaattcca

SEQ ID NO: 239432 - DNA, 20 bp, Artificial Sequence
  chemically synthesized
cttatgaagtaactaattcc

SEQ ID NO: 239433 - DNA, 20 bp, Artificial Sequence
  chemically synthesized
cttggaattagttacttcat

SEQ ID NO: 239434 - DNA, 20 bp, Artificial Sequence
  chemically synthesized
ctgtggaagcttgtcttatg

SEQ ID NO: 239435 - DNA, 20 bp, Artificial Sequence
  chemically synthesized
aattagttacttcataagac

SEQ ID NO: 239436 - DNA, 20 bp, Artificial Sequence
  chemically synthesized
cttcataagacaagcttcca

SEQ ID NO: 239437 - DNA, 20 bp, Artificial Sequence
  chemically synthesized
aggttttcacaaagctgtgg

SEQ ID NO: 239438 - DNA, 20 bp, Artificial Sequence
  chemically synthesized
tagaggttttcacaaagctg

SEQ ID NO: 239439 - DNA, 20 bp, Artificial Sequence
  chemically synthesized
tgttaatagaggttttcaca

SEQ ID NO: 239440 - DNA, 20 bp, Artificial Sequence
  chemically synthesized
atgaagtagtatgttaatag

SEQ ID NO: 239441 - DNA, 20 bp, Artificial Sequence
  chemically synthesized
catgaagtagtatgttaata

SEQ ID NO: 239442 - DNA, 20 bp, Artificial Sequence
  chemically synthesized
aacatgaagtagtatgttaa

SEQ ID NO: 239443 - DNA, 20 bp, Artificial Sequence
  chemically synthesized
tacataattagaacatgaag

SEQ ID NO: 239444 - DNA, 20 bp, Artificial Sequence
  chemically synthesized
aaatacataattagaacatg

SEQ ID NO: 239445 - DNA, 20 bp, Artificial Sequence
  chemically synthesized
cagccttgtaaatacataat

SEQ ID NO: 239446 - DNA, 20 bp, Artificial Sequence
  chemically synthesized
tgttctaattatgtatttac

SEQ ID NO: 239447 - DNA, 20 bp, Artificial Sequence
  chemically synthesized
gttctaattatgtatttaca

SEQ ID NO: 239448 - DNA, 20 bp, Artificial Sequence
  chemically synthesized
atttacaaggctgtttgttc

SEQ ID NO: 239449 - DNA, 20 bp, Artificial Sequence
  chemically synthesized
acatagtgtactggaacaaa

SEQ ID NO: 239450 - DNA, 20 bp, Artificial Sequence
  chemically synthesized
ctaagaggtacatagtgtac

SEQ ID NO: 239451 - DNA, 20 bp, Artificial Sequence
  chemically synthesized
tccttattctaagaggtaca

SEQ ID NO: 239452 - DNA, 20 bp, Artificial Sequence
  chemically synthesized
ccagtacactatgtacctct

SEQ ID NO: 239453 - DNA, 20 bp, Artificial Sequence
  chemically synthesized
aacatcttccttattctaag

SEQ ID NO: 239454 - DNA, 20 bp, Artificial Sequence
  chemically synthesized
cactatgtacctcttagaat

SEQ ID NO: 239455 - DNA, 20 bp, Artificial Sequence
  chemically synthesized
aaacatcttccttattctaa

SEQ ID NO: 239456 - DNA, 20 bp, Artificial Sequence
  chemically synthesized
actatgtacctcttagaata

SEQ ID NO: 239457 - DNA, 20 bp, Artificial Sequence
  chemically synthesized
taaaacatcttccttattct

SEQ ID NO: 239458 - DNA, 20 bp, Artificial Sequence
  chemically synthesized
atgtacctcttagaataagg

SEQ ID NO: 239459 - DNA, 20 bp, Artificial Sequence
  chemically synthesized
gcttagtaccaggaattcaa

SEQ ID NO: 239460 - DNA, 20 bp, Artificial Sequence
  chemically synthesized
cgcttagtaccaggaattca

SEQ ID NO: 239461 - DNA, 20 bp, Artificial Sequence
  chemically synthesized
tttatgcacctttgaattcc

SEQ ID NO: 239462 - DNA, 20 bp, Artificial Sequence
  chemically synthesized
acctttgaattcctggtact

SEQ ID NO: 239463 - DNA, 20 bp, Artificial Sequence
  chemically synthesized
caggaacagcgcttagtacc

SEQ ID NO: 239464 - DNA, 20 bp, Artificial Sequence
  chemically synthesized
ccaggaacagcgcttagtac

SEQ ID NO: 239465 - DNA, 20 bp, Artificial Sequence
  chemically synthesized
catgtaccaggaacagcgct

SEQ ID NO: 239466 - DNA, 20 bp, Artificial Sequence
  chemically synthesized
ctggtactaagcgctgttcc

SEQ ID NO: 239467 - DNA, 20 bp, Artificial Sequence
  chemically synthesized
catttatcatgtaccaggaa

SEQ ID NO: 239468 - DNA, 20 bp, Artificial Sequence
  chemically synthesized
ttcaacatttatcatgtacc

SEQ ID NO: 239469 - DNA, 20 bp, Artificial Sequence
  chemically synthesized
attcaacatttatcatgtac

SEQ ID NO: 239470 - DNA, 20 bp, Artificial Sequence
  chemically synthesized
gacttttttattcattcatt

SEQ ID NO: 239471 - DNA, 20 bp, Artificial Sequence
  chemically synthesized
aactgaatgaatgaataaaa

SEQ ID NO: 239472 - DNA, 20 bp, Artificial Sequence
  chemically synthesized
gaatgaataaaaaagtccat

SEQ ID NO: 239473 - DNA, 20 bp, Artificial Sequence
  chemically synthesized
ggggtttgtgaaattactca

SEQ ID NO: 239474 - DNA, 20 bp, Artificial Sequence
  chemically synthesized
tcttaaatggaagatataag

SEQ ID NO: 239475 - DNA, 20 bp, Artificial Sequence
  chemically synthesized
ctcttaaatggaagatataa

SEQ ID NO: 239476 - DNA, 20 bp, Artificial Sequence
  chemically synthesized
gctcttaaatggaagatata

SEQ ID NO: 239477 - DNA, 20 bp, Artificial Sequence
  chemically synthesized
ggctcttaaatggaagatat

SEQ ID NO: 239478 - DNA, 20 bp, Artificial Sequence
  chemically synthesized
accccttatatcttccattt

SEQ ID NO: 239479 - DNA, 20 bp, Artificial Sequence
  chemically synthesized
cattcatggctcttaaatgg

SEQ ID NO: 239480 - DNA, 20 bp, Artificial Sequence
  chemically synthesized
cccttatatcttccatttaa

SEQ ID NO: 239481 - DNA, 20 bp, Artificial Sequence
  chemically synthesized
aagcattcatggctcttaaa

SEQ ID NO: 239482 - DNA, 20 bp, Artificial Sequence
  chemically synthesized
atagtgtatccaagcattca

SEQ ID NO: 239483 - DNA, 20 bp, Artificial Sequence
  chemically synthesized
atttaagagccatgaatgct

SEQ ID NO: 239484 - DNA, 20 bp, Artificial Sequence
  chemically synthesized
agaggtaaaatagtgtatcc

SEQ ID NO: 239485 - DNA, 20 bp, Artificial Sequence
  chemically synthesized
actgagactcagaggtaaaa

SEQ ID NO: 239486 - DNA, 20 bp, Artificial Sequence
  chemically synthesized
ggatacactattttacctct

SEQ ID NO: 239487 - DNA, 20 bp, Artificial Sequence
  chemically synthesized
gtgagataactgagactcag

SEQ ID NO: 239488 - DNA, 20 bp, Artificial Sequence
  chemically synthesized
actattttacctctgagtct

SEQ ID NO: 239489 - DNA, 20 bp, Artificial Sequence
  chemically synthesized
tgtgagataactgagactca

SEQ ID NO: 239490 - DNA, 20 bp, Artificial Sequence
  chemically synthesized
tgtgtgagataactgagact

SEQ ID NO: 239491 - DNA, 20 bp, Artificial Sequence
  chemically synthesized
ggtttatgtgtgagataact

SEQ ID NO: 239492 - DNA, 20 bp, Artificial Sequence
  chemically synthesized
attattctgggtttatgtgt

SEQ ID NO: 239493 - DNA, 20 bp, Artificial Sequence
  chemically synthesized
agttatctcacacataaacc

SEQ ID NO: 239494 - DNA, 20 bp, Artificial Sequence
  chemically synthesized
gaggtaggcagtattattct

SEQ ID NO: 239495 - DNA, 20 bp, Artificial Sequence
  chemically synthesized
tgaggtaggcagtattattc

SEQ ID NO: 239496 - DNA, 20 bp, Artificial Sequence
  chemically synthesized
aaaaagctgaatgaggtagg

SEQ ID NO: 239497 - DNA, 20 bp, Artificial Sequence
  chemically synthesized
ctgaaaaagctgaatgaggt

SEQ ID NO: 239498 - DNA, 20 bp, Artificial Sequence
  chemically synthesized
ataatactgcctacctcatt

SEQ ID NO: 239499 - DNA, 20 bp, Artificial Sequence
  chemically synthesized
cctgaaaaagctgaatgagg

SEQ ID NO: 239500 - DNA, 20 bp, Artificial Sequence
  chemically synthesized
cctcctgaaaaagctgaatg

SEQ ID NO: 239501 - DNA, 20 bp, Artificial Sequence
  chemically synthesized
tcctcctgaaaaagctgaat

SEQ ID NO: 239502 - DNA, 20 bp, Artificial Sequence
  chemically synthesized
cctacctcattcagcttttt

SEQ ID NO: 239503 - DNA, 20 bp, Artificial Sequence
  chemically synthesized
ctacctcattcagctttttc

SEQ ID NO: 239504 - DNA, 20 bp, Artificial Sequence
  chemically synthesized
acctcattcagctttttcag

SEQ ID NO: 239505 - DNA, 20 bp, Artificial Sequence
  chemically synthesized
cctcattcagctttttcagg

SEQ ID NO: 239506 - DNA, 20 bp, Artificial Sequence
  chemically synthesized
gtactttcatcctcctgaaa

SEQ ID NO: 239507 - DNA, 20 bp, Artificial Sequence
  chemically synthesized
cagctttttcaggaggatga

SEQ ID NO: 239508 - DNA, 20 bp, Artificial Sequence
  chemically synthesized
ggaggatgaaagtacactcc

SEQ ID NO: 239509 - DNA, 20 bp, Artificial Sequence
  chemically synthesized
ttattgctatttataacttg

SEQ ID NO: 239510 - DNA, 20 bp, Artificial Sequence
  chemically synthesized
ttttattgctatttataact

SEQ ID NO: 239511 - DNA, 20 bp, Artificial Sequence
  chemically synthesized
agtacactccaagttataaa

SEQ ID NO: 239512 - DNA, 20 bp, Artificial Sequence
  chemically synthesized
ttataaatagcaataaaatt

SEQ ID NO: 239513 - DNA, 20 bp, Artificial Sequence
  chemically synthesized
tagtattatcgatattaata

SEQ ID NO: 239514 - DNA, 20 bp, Artificial Sequence
  chemically synthesized
attatcgatattaatacagt

SEQ ID NO: 239515 - DNA, 20 bp, Artificial Sequence
  chemically synthesized
gtgtcggtattaaaaattta

SEQ ID NO: 239516 - DNA, 20 bp, Artificial Sequence
  chemically synthesized
ataaatttttaataccgaca

SEQ ID NO: 239517 - DNA, 20 bp, Artificial Sequence
  chemically synthesized
ttttattctaaattctgtgt

SEQ ID NO: 239518 - DNA, 20 bp, Artificial Sequence
  chemically synthesized
tttaataccgacacagaatt

SEQ ID NO: 239519 - DNA, 20 bp, Artificial Sequence
  chemically synthesized
ataaaaaaatcaatctacat

SEQ ID NO: 239520 - DNA, 20 bp, Artificial Sequence
  chemically synthesized
ttggaaaatgatttctgatg

SEQ ID NO: 239521 - DNA, 20 bp, Artificial Sequence
  chemically synthesized
aaatcattttccaaatatat

SEQ ID NO: 239522 - DNA, 20 bp, Artificial Sequence
  chemically synthesized
tatgtgattgctgatatatt

SEQ ID NO: 239523 - DNA, 20 bp, Artificial Sequence
  chemically synthesized
attgttgttttcattaataa

SEQ ID NO: 239524 - DNA, 20 bp, Artificial Sequence
  chemically synthesized
acacaaaatgatgattctta

SEQ ID NO: 239525 - DNA, 20 bp, Artificial Sequence
  chemically synthesized
ttgctaaattatttatcttt

SEQ ID NO: 239526 - DNA, 20 bp, Artificial Sequence
  chemically synthesized
attcttaaagataaataatt

SEQ ID NO: 239527 - DNA, 20 bp, Artificial Sequence
  chemically synthesized
ttaaagataaataatttagc

SEQ ID NO: 239528 - DNA, 20 bp, Artificial Sequence
  chemically synthesized
aagttcaacaccatcctaaa

SEQ ID NO: 239529 - DNA, 20 bp, Artificial Sequence
  chemically synthesized
aaagtgtattctttttagga

SEQ ID NO: 239530 - DNA, 20 bp, Artificial Sequence
  chemically synthesized
gtgcaaagtgtattcttttt

SEQ ID NO: 239531 - DNA, 20 bp, Artificial Sequence
  chemically synthesized
tgtgcaaagtgtattctttt

SEQ ID NO: 239532 - DNA, 20 bp, Artificial Sequence
  chemically synthesized
ggtctcagtaaatttgtgca

SEQ ID NO: 239533 - DNA, 20 bp, Artificial Sequence
  chemically synthesized
acactttgcacaaatttact

SEQ ID NO: 239534 - DNA, 20 bp, Artificial Sequence
  chemically synthesized
ctcatatttaaattaggtct

SEQ ID NO: 239535 - DNA, 20 bp, Artificial Sequence
  chemically synthesized
tgcatcctcatatttaaatt

SEQ ID NO: 239536 - DNA, 20 bp, Artificial Sequence
  chemically synthesized
gtgcatcctcatatttaaat

SEQ ID NO: 239537 - DNA, 20 bp, Artificial Sequence
  chemically synthesized
ctgagacctaatttaaatat

SEQ ID NO: 239538 - DNA, 20 bp, Artificial Sequence
  chemically synthesized
tgagacctaatttaaatatg

SEQ ID NO: 239539 - DNA, 20 bp, Artificial Sequence
  chemically synthesized
taaatatgaggatgcacatt

SEQ ID NO: 239540 - DNA, 20 bp, Artificial Sequence
  chemically synthesized
aaatatgaggatgcacattt

SEQ ID NO: 239541 - DNA, 20 bp, Artificial Sequence
  chemically synthesized
aatatgaggatgcacattta

SEQ ID NO: 239542 - DNA, 20 bp, Artificial Sequence
  chemically synthesized
cactcaccttaaaagagtca

SEQ ID NO: 239543 - DNA, 20 bp, Artificial Sequence
  chemically synthesized
ttagggactgtgactctttt

SEQ ID NO: 239544 - DNA, 20 bp, Artificial Sequence
  chemically synthesized
tagggactgtgactctttta

SEQ ID NO: 239545 - DNA, 20 bp, Artificial Sequence
  chemically synthesized
ttaaaacactcaccttaaaa

SEQ ID NO: 239546 - DNA, 20 bp, Artificial Sequence
  chemically synthesized
gactgtgactcttttaaggt

SEQ ID NO: 239547 - DNA, 20 bp, Artificial Sequence
  chemically synthesized
gtttaaaacactcaccttaa

SEQ ID NO: 239548 - DNA, 20 bp, Artificial Sequence
  chemically synthesized
gaattttatcaatattgttt

SEQ ID NO: 239549 - DNA, 20 bp, Artificial Sequence
  chemically synthesized
tattgataaaattcacccta

SEQ ID NO: 239550 - DNA, 20 bp, Artificial Sequence
  chemically synthesized
tgataaaattcaccctaaag

SEQ ID NO: 239551 - DNA, 20 bp, Artificial Sequence
  chemically synthesized
taatgctattgacttcttta

SEQ ID NO: 239552 - DNA, 20 bp, Artificial Sequence
  chemically synthesized
ataatgctattgacttcttt

SEQ ID NO: 239553 - DNA, 20 bp, Artificial Sequence
  chemically synthesized
aataatgctattgacttctt

SEQ ID NO: 239554 - DNA, 20 bp, Artificial Sequence
  chemically synthesized
attcaccctaaagaagtcaa

SEQ ID NO: 239555 - DNA, 20 bp, Artificial Sequence
  chemically synthesized
tcaatagcattatttaaaaa

SEQ ID NO: 239556 - DNA, 20 bp, Artificial Sequence
  chemically synthesized
attatttaaaaacagatgat

SEQ ID NO: 239557 - DNA, 20 bp, Artificial Sequence
  chemically synthesized
taaaaacagatgattggata

SEQ ID NO: 239558 - DNA, 20 bp, Artificial Sequence
  chemically synthesized
atgattggataaagaatatg

SEQ ID NO: 239559 - DNA, 20 bp, Artificial Sequence
  chemically synthesized
gattggataaagaatatgtg

SEQ ID NO: 239560 - DNA, 20 bp, Artificial Sequence
  chemically synthesized
tataaataaaagaatatgtg

SEQ ID NO: 239561 - DNA, 20 bp, Artificial Sequence
  chemically synthesized
catataaataaaagaatatg

SEQ ID NO: 239562 - DNA, 20 bp, Artificial Sequence
  chemically synthesized
attcacacacatataaataa

SEQ ID NO: 239563 - DNA, 20 bp, Artificial Sequence
  chemically synthesized
aatgaatgtattccattgtg

SEQ ID NO: 239564 - DNA, 20 bp, Artificial Sequence
  chemically synthesized
cacaatggaatactacacaa

SEQ ID NO: 239565 - DNA, 20 bp, Artificial Sequence
  chemically synthesized
aagctaggatagacacacaa

SEQ ID NO: 239566 - DNA, 20 bp, Artificial Sequence
  chemically synthesized
attccattgtgtgtctatcc

SEQ ID NO: 239567 - DNA, 20 bp, Artificial Sequence
  chemically synthesized
cttagacttagaagctagga

SEQ ID NO: 239568 - DNA, 20 bp, Artificial Sequence
  chemically synthesized
gtgtgtctatcctagcttct

SEQ ID NO: 239569 - DNA, 20 bp, Artificial Sequence
  chemically synthesized
tatgcttagacttagaagct

SEQ ID NO: 239570 - DNA, 20 bp, Artificial Sequence
  chemically synthesized
atatgcttagacttagaagc

SEQ ID NO: 239571 - DNA, 20 bp, Artificial Sequence
  chemically synthesized
atatatatgcttagacttag

SEQ ID NO: 239572 - DNA, 20 bp, Artificial Sequence
  chemically synthesized
ctatcctagcttctaagtct

SEQ ID NO: 239573 - DNA, 20 bp, Artificial Sequence
  chemically synthesized
tatatatatatgcttagact

SEQ ID NO: 239574 - DNA, 20 bp, Artificial Sequence
  chemically synthesized
tatatatatatatatatgct

SEQ ID NO: 239575 - DNA, 20 bp, Artificial Sequence
  chemically synthesized
acacacacacaaattgcgta

SEQ ID NO: 239576 - DNA, 20 bp, Artificial Sequence
  chemically synthesized
acacaatgaaaaatactaca

SEQ ID NO: 239577 - DNA, 20 bp, Artificial Sequence
  chemically synthesized
cattctttactatggctttg

SEQ ID NO: 239578 - DNA, 20 bp, Artificial Sequence
  chemically synthesized
tgaaaaatactacaaagcca

SEQ ID NO: 239579 - DNA, 20 bp, Artificial Sequence
  chemically synthesized
aatactacaaagccatagta

SEQ ID NO: 239580 - DNA, 20 bp, Artificial Sequence
  chemically synthesized
catgatttcattctttacta

SEQ ID NO: 239581 - DNA, 20 bp, Artificial Sequence
  chemically synthesized
gaatgaaatcatgtcttttg

SEQ ID NO: 239582 - DNA, 20 bp, Artificial Sequence
  chemically synthesized
ttccatccatgttgctgcaa

SEQ ID NO: 239583 - DNA, 20 bp, Artificial Sequence
  chemically synthesized
tcatgtcttttgcagcaaca

SEQ ID NO: 239584 - DNA, 20 bp, Artificial Sequence
  chemically synthesized
gtcttttgcagcaacatgga

SEQ ID NO: 239585 - DNA, 20 bp, Artificial Sequence
  chemically synthesized
tgcagcaacatggatggaac

SEQ ID NO: 239586 - DNA, 20 bp, Artificial Sequence
  chemically synthesized
agcaacatggatggaactgg

SEQ ID NO: 239587 - DNA, 20 bp, Artificial Sequence
  chemically synthesized
attccacttaagatgaccac

SEQ ID NO: 239588 - DNA, 20 bp, Artificial Sequence
  chemically synthesized
atggaactggtggtcatctt

SEQ ID NO: 239589 - DNA, 20 bp, Artificial Sequence
  chemically synthesized
gaactggtggtcatcttaag

SEQ ID NO: 239590 - DNA, 20 bp, Artificial Sequence
  chemically synthesized
gtttttgagttattccactt

SEQ ID NO: 239591 - DNA, 20 bp, Artificial Sequence
  chemically synthesized
taagtggaataactcaaaaa

SEQ ID NO: 239592 - DNA, 20 bp, Artificial Sequence
  chemically synthesized
atatttgactttctgttttt

SEQ ID NO: 239593 - DNA, 20 bp, Artificial Sequence
  chemically synthesized
tggaataactcaaaaacaga

SEQ ID NO: 239594 - DNA, 20 bp, Artificial Sequence
  chemically synthesized
tattgcatgttctcacttac

SEQ ID NO: 239595 - DNA, 20 bp, Artificial Sequence
  chemically synthesized
tttagcttccacttgtaagt

SEQ ID NO: 239596 - DNA, 20 bp, Artificial Sequence
  chemically synthesized
tgcatgttctcacttacaag

SEQ ID NO: 239597 - DNA, 20 bp, Artificial Sequence
  chemically synthesized
attatttagcttccacttgt

SEQ ID NO: 239598 - DNA, 20 bp, Artificial Sequence
  chemically synthesized
atgttctcacttacaagtgg

SEQ ID NO: 239599 - DNA, 20 bp, Artificial Sequence
  chemically synthesized
gcgcatgtgtacacattatt

SEQ ID NO: 239600 - DNA, 20 bp, Artificial Sequence
  chemically synthesized
ataatgtgtacacatgcgca

SEQ ID NO: 239601 - DNA, 20 bp, Artificial Sequence
  chemically synthesized
aatgtgtacacatgcgcaca

SEQ ID NO: 239602 - DNA, 20 bp, Artificial Sequence
  chemically synthesized
gtacacatgcgcacagagtg

SEQ ID NO: 239603 - DNA, 20 bp, Artificial Sequence
  chemically synthesized
gcgcacagagtgtggaataa

SEQ ID NO: 239604 - DNA, 20 bp, Artificial Sequence
  chemically synthesized
gagtgtggaataatagacac

SEQ ID NO: 239605 - DNA, 20 bp, Artificial Sequence
  chemically synthesized
gtgtggaataatagacactg

SEQ ID NO: 239606 - DNA, 20 bp, Artificial Sequence
  chemically synthesized
aataatagacactggagact

SEQ ID NO: 239607 - DNA, 20 bp, Artificial Sequence
  chemically synthesized
ctctcgcccttctgagtctc

SEQ ID NO: 239608 - DNA, 20 bp, Artificial Sequence
  chemically synthesized
aatagacactggagactcag

SEQ ID NO: 239609 - DNA, 20 bp, Artificial Sequence
  chemically synthesized
atagacactggagactcaga

SEQ ID NO: 239610 - DNA, 20 bp, Artificial Sequence
  chemically synthesized
tagacactggagactcagaa

SEQ ID NO: 239611 - DNA, 20 bp, Artificial Sequence
  chemically synthesized
tcccaccctctcgcccttct

SEQ ID NO: 239612 - DNA, 20 bp, Artificial Sequence
  chemically synthesized
cactggagactcagaagggc

SEQ ID NO: 239613 - DNA, 20 bp, Artificial Sequence
  chemically synthesized
ctggagactcagaagggcga

SEQ ID NO: 239614 - DNA, 20 bp, Artificial Sequence
  chemically synthesized
tggagactcagaagggcgag

SEQ ID NO: 239615 - DNA, 20 bp, Artificial Sequence
  chemically synthesized
ggagactcagaagggcgaga

SEQ ID NO: 239616 - DNA, 20 bp, Artificial Sequence
  chemically synthesized
gactcagaagggcgagaggg

SEQ ID NO: 239617 - DNA, 20 bp, Artificial Sequence
  chemically synthesized
actcagaagggcgagagggt

SEQ ID NO: 239618 - DNA, 20 bp, Artificial Sequence
  chemically synthesized
agaagggcgagagggtggga

SEQ ID NO: 239619 - DNA, 20 bp, Artificial Sequence
  chemically synthesized
gaagggcgagagggtgggat

SEQ ID NO: 239620 - DNA, 20 bp, Artificial Sequence
  chemically synthesized
aagggcgagagggtgggatg

SEQ ID NO: 239621 - DNA, 20 bp, Artificial Sequence
  chemically synthesized
agggcgagagggtgggatgg

SEQ ID NO: 239622 - DNA, 20 bp, Artificial Sequence
  chemically synthesized
gagagggtgggatgggggcg

SEQ ID NO: 239623 - DNA, 20 bp, Artificial Sequence
  chemically synthesized
agagggtgggatgggggcga

SEQ ID NO: 239624 - DNA, 20 bp, Artificial Sequence
  chemically synthesized
ggtgggatgggggcgaagga

SEQ ID NO: 239625 - DNA, 20 bp, Artificial Sequence
  chemically synthesized
gtgggatgggggcgaaggat

SEQ ID NO: 239626 - DNA, 20 bp, Artificial Sequence
  chemically synthesized
aaggataggaaattgcttaa

SEQ ID NO: 239627 - DNA, 20 bp, Artificial Sequence
  chemically synthesized
ggataggaaattgcttaatg

SEQ ID NO: 239628 - DNA, 20 bp, Artificial Sequence
  chemically synthesized
tgatgtaccttttctccatt

SEQ ID NO: 239629 - DNA, 20 bp, Artificial Sequence
  chemically synthesized
ggaaattgcttaatggagaa

SEQ ID NO: 239630 - DNA, 20 bp, Artificial Sequence
  chemically synthesized
gaaattgcttaatggagaaa

SEQ ID NO: 239631 - DNA, 20 bp, Artificial Sequence
  chemically synthesized
aaggtacatcatttgcatga

SEQ ID NO: 239632 - DNA, 20 bp, Artificial Sequence
  chemically synthesized
aggtacatcatttgcatgat

SEQ ID NO: 239633 - DNA, 20 bp, Artificial Sequence
  chemically synthesized
atgatgggtacacaaaaaac

SEQ ID NO: 239634 - DNA, 20 bp, Artificial Sequence
  chemically synthesized
tattgcagagtggcgaagtc

SEQ ID NO: 239635 - DNA, 20 bp, Artificial Sequence
  chemically synthesized
ggatatattgcagagtggcg

SEQ ID NO: 239636 - DNA, 20 bp, Artificial Sequence
  chemically synthesized
tacatggatatattgcagag

SEQ ID NO: 239637 - DNA, 20 bp, Artificial Sequence
  chemically synthesized
tgttacatggatatattgca

SEQ ID NO: 239638 - DNA, 20 bp, Artificial Sequence
  chemically synthesized
tttgttacatggatatattg

SEQ ID NO: 239639 - DNA, 20 bp, Artificial Sequence
  chemically synthesized
acaagtacatttttgttaca

SEQ ID NO: 239640 - DNA, 20 bp, Artificial Sequence
  chemically synthesized
tgtataaatttaaggtatac

SEQ ID NO: 239641 - DNA, 20 bp, Artificial Sequence
  chemically synthesized
tttttgtttgtataaattta

SEQ ID NO: 239642 - DNA, 20 bp, Artificial Sequence
  chemically synthesized
ttttttgtttgtataaattt

SEQ ID NO: 239643 - DNA, 20 bp, Artificial Sequence
  chemically synthesized
aaataatgcaatcaacattt

SEQ ID NO: 239644 - DNA, 20 bp, Artificial Sequence
  chemically synthesized
atgttgattgcattatttgt

SEQ ID NO: 239645 - DNA, 20 bp, Artificial Sequence
  chemically synthesized
tgataacctgaattgtttgt

SEQ ID NO: 239646 - DNA, 20 bp, Artificial Sequence
  chemically synthesized
gtaagaactcacaaacaatt

SEQ ID NO: 239647 - DNA, 20 bp, Artificial Sequence
  chemically synthesized
taagaactcacaaacaattc

SEQ ID NO: 239648 - DNA, 20 bp, Artificial Sequence
  chemically synthesized
aaacaattcaggttatcact

SEQ ID NO: 239649 - DNA, 20 bp, Artificial Sequence
  chemically synthesized
aagatttattttaatagtct

SEQ ID NO: 239650 - DNA, 20 bp, Artificial Sequence
  chemically synthesized
aattttaagatttattttaa

SEQ ID NO: 239651 - DNA, 20 bp, Artificial Sequence
  chemically synthesized
ttagaaatctaaagaatttt

SEQ ID NO: 239652 - DNA, 20 bp, Artificial Sequence
  chemically synthesized
aaataaatcttaaaattctt

SEQ ID NO: 239653 - DNA, 20 bp, Artificial Sequence
  chemically synthesized
aacaacactttagaaatcta

SEQ ID NO: 239654 - DNA, 20 bp, Artificial Sequence
  chemically synthesized
taaaattctttagatttcta

SEQ ID NO: 239655 - DNA, 20 bp, Artificial Sequence
  chemically synthesized
gcaaagtttaaacaacactt

SEQ ID NO: 239656 - DNA, 20 bp, Artificial Sequence
  chemically synthesized
aagtgttgtttaaactttgc

SEQ ID NO: 239657 - DNA, 20 bp, Artificial Sequence
  chemically synthesized
agcccaataagagtccagca

SEQ ID NO: 239658 - DNA, 20 bp, Artificial Sequence
  chemically synthesized
atttaagcccaataagagtc

SEQ ID NO: 239659 - DNA, 20 bp, Artificial Sequence
  chemically synthesized
aaactttgctggactcttat

SEQ ID NO: 239660 - DNA, 20 bp, Artificial Sequence
  chemically synthesized
aactttgctggactcttatt

SEQ ID NO: 239661 - DNA, 20 bp, Artificial Sequence
  chemically synthesized
tagagatttaagcccaataa

SEQ ID NO: 239662 - DNA, 20 bp, Artificial Sequence
  chemically synthesized
tctagagatttaagcccaat

SEQ ID NO: 239663 - DNA, 20 bp, Artificial Sequence
  chemically synthesized
tcttattgggcttaaatctc

SEQ ID NO: 239664 - DNA, 20 bp, Artificial Sequence
  chemically synthesized
atctgcctgtctagagattt

SEQ ID NO: 239665 - DNA, 20 bp, Artificial Sequence
  chemically synthesized
attgggcttaaatctctaga

SEQ ID NO: 239666 - DNA, 20 bp, Artificial Sequence
  chemically synthesized
ttgggcttaaatctctagac

SEQ ID NO: 239667 - DNA, 20 bp, Artificial Sequence
  chemically synthesized
tccacagatctgcctgtcta

SEQ ID NO: 239668 - DNA, 20 bp, Artificial Sequence
  chemically synthesized
ggcttaaatctctagacagg

SEQ ID NO: 239669 - DNA, 20 bp, Artificial Sequence
  chemically synthesized
cctccacagatctgcctgtc

SEQ ID NO: 239670 - DNA, 20 bp, Artificial Sequence
  chemically synthesized
tctctagacaggcagatctg

SEQ ID NO: 239671 - DNA, 20 bp, Artificial Sequence
  chemically synthesized
tctagacaggcagatctgtg

SEQ ID NO: 239672 - DNA, 20 bp, Artificial Sequence
  chemically synthesized
ctagacaggcagatctgtgg

SEQ ID NO: 239673 - DNA, 20 bp, Artificial Sequence
  chemically synthesized
agacaggcagatctgtggag

SEQ ID NO: 239674 - DNA, 20 bp, Artificial Sequence
  chemically synthesized
gacaggcagatctgtggagg

SEQ ID NO: 239675 - DNA, 20 bp, Artificial Sequence
  chemically synthesized
tgttacagcgtcctcctcca

SEQ ID NO: 239676 - DNA, 20 bp, Artificial Sequence
  chemically synthesized
tgtggaggaggacgctgtaa

SEQ ID NO: 239677 - DNA, 20 bp, Artificial Sequence
  chemically synthesized
ttgatgaggcttttctgtta

SEQ ID NO: 239678 - DNA, 20 bp, Artificial Sequence
  chemically synthesized
aggaggacgctgtaacagaa

SEQ ID NO: 239679 - DNA, 20 bp, Artificial Sequence
  chemically synthesized
aacagaaaagcctcatcaat

SEQ ID NO: 239680 - DNA, 20 bp, Artificial Sequence
  chemically synthesized
gcaatttcagcttattgatg

SEQ ID NO: 239681 - DNA, 20 bp, Artificial Sequence
  chemically synthesized
agcaatttcagcttattgat

SEQ ID NO: 239682 - DNA, 20 bp, Artificial Sequence
  chemically synthesized
tcgtttatctaaagcaattt

SEQ ID NO: 239683 - DNA, 20 bp, Artificial Sequence
  chemically synthesized
tcaataagctgaaattgctt

SEQ ID NO: 239684 - DNA, 20 bp, Artificial Sequence
  chemically synthesized
aaaaagtcctcgtttatcta

SEQ ID NO: 239685 - DNA, 20 bp, Artificial Sequence
  chemically synthesized
tgaaattgctttagataaac

SEQ ID NO: 239686 - DNA, 20 bp, Artificial Sequence
  chemically synthesized
gaaattgctttagataaacg

SEQ ID NO: 239687 - DNA, 20 bp, Artificial Sequence
  chemically synthesized
gtgtgcactttcagatcaaa

SEQ ID NO: 239688 - DNA, 20 bp, Artificial Sequence
  chemically synthesized
acgaggactttttgatctga

SEQ ID NO: 239689 - DNA, 20 bp, Artificial Sequence
  chemically synthesized
tgtatttttgtgtgcacttt

SEQ ID NO: 239690 - DNA, 20 bp, Artificial Sequence
  chemically synthesized
gtatacttatatacatatta

SEQ ID NO: 239691 - DNA, 20 bp, Artificial Sequence
  chemically synthesized
atatactttaatatgtatat

SEQ ID NO: 239692 - DNA, 20 bp, Artificial Sequence
  chemically synthesized
atataagtatacacacatat

SEQ ID NO: 239693 - DNA, 20 bp, Artificial Sequence
  chemically synthesized
atacacacatatcagaaact

SEQ ID NO: 239694 - DNA, 20 bp, Artificial Sequence
  chemically synthesized
acatatcagaaacttggcct

SEQ ID NO: 239695 - DNA, 20 bp, Artificial Sequence
  chemically synthesized
ccctaaaaatcactcaggcc

SEQ ID NO: 239696 - DNA, 20 bp, Artificial Sequence
  chemically synthesized
tagccccctaaaaatcactc

SEQ ID NO: 239697 - DNA, 20 bp, Artificial Sequence
  chemically synthesized
ttagccccctaaaaatcact

SEQ ID NO: 239698 - DNA, 20 bp, Artificial Sequence
  chemically synthesized
aacttggcctgagtgatttt

SEQ ID NO: 239699 - DNA, 20 bp, Artificial Sequence
  chemically synthesized
acttggcctgagtgattttt

SEQ ID NO: 239700 - DNA, 20 bp, Artificial Sequence
  chemically synthesized
cttggcctgagtgattttta

SEQ ID NO: 239701 - DNA, 20 bp, Artificial Sequence
  chemically synthesized
ttggcctgagtgatttttag

SEQ ID NO: 239702 - DNA, 20 bp, Artificial Sequence
  chemically synthesized
tggcctgagtgatttttagg

SEQ ID NO: 239703 - DNA, 20 bp, Artificial Sequence
  chemically synthesized
tgagtgatttttagggggct

SEQ ID NO: 239704 - DNA, 20 bp, Artificial Sequence
  chemically synthesized
gagtgatttttagggggcta

SEQ ID NO: 239705 - DNA, 20 bp, Artificial Sequence
  chemically synthesized
agtgatttttagggggctaa

SEQ ID NO: 239706 - DNA, 20 bp, Artificial Sequence
  chemically synthesized
gtgatttttagggggctaag

SEQ ID NO: 239707 - DNA, 20 bp, Artificial Sequence
  chemically synthesized
gtgcttaattaaggtcccct

SEQ ID NO: 239708 - DNA, 20 bp, Artificial Sequence
  chemically synthesized
gggctaaggggaccttaatt

SEQ ID NO: 239709 - DNA, 20 bp, Artificial Sequence
  chemically synthesized
caaaatagagtgcttaatta

SEQ ID NO: 239710 - DNA, 20 bp, Artificial Sequence
  chemically synthesized
ccaaaatagagtgcttaatt

SEQ ID NO: 239711 - DNA, 20 bp, Artificial Sequence
  chemically synthesized
cttaattaagcactctattt

SEQ ID NO: 239712 - DNA, 20 bp, Artificial Sequence
  chemically synthesized
ttttcccctaagccaaaata

SEQ ID NO: 239713 - DNA, 20 bp, Artificial Sequence
  chemically synthesized
tgttttcccctaagccaaaa

SEQ ID NO: 239714 - DNA, 20 bp, Artificial Sequence
  chemically synthesized
ttaagcactctattttggct

SEQ ID NO: 239715 - DNA, 20 bp, Artificial Sequence
  chemically synthesized
taagcactctattttggctt

SEQ ID NO: 239716 - DNA, 20 bp, Artificial Sequence
  chemically synthesized
aagcactctattttggctta

SEQ ID NO: 239717 - DNA, 20 bp, Artificial Sequence
  chemically synthesized
agcactctattttggcttag

SEQ ID NO: 239718 - DNA, 20 bp, Artificial Sequence
  chemically synthesized
tatttacggtgttttcccct

SEQ ID NO: 239719 - DNA, 20 bp, Artificial Sequence
  chemically synthesized
atttatctcaaggatattta

SEQ ID NO: 239720 - DNA, 20 bp, Artificial Sequence
  chemically synthesized
aaaacaccgtaaatatcctt

SEQ ID NO: 239721 - DNA, 20 bp, Artificial Sequence
  chemically synthesized
gtacttatcaatttatctca

SEQ ID NO: 239722 - DNA, 20 bp, Artificial Sequence
  chemically synthesized
agtacttatcaatttatctc

SEQ ID NO: 239723 - DNA, 20 bp, Artificial Sequence
  chemically synthesized
tatccttgagataaattgat

SEQ ID NO: 239724 - DNA, 20 bp, Artificial Sequence
  chemically synthesized
taaattgataagtactcaaa

SEQ ID NO: 239725 - DNA, 20 bp, Artificial Sequence
  chemically synthesized
ttgataagtactcaaatagt

SEQ ID NO: 239726 - DNA, 20 bp, Artificial Sequence
  chemically synthesized
aaatgaatctctaactattt

SEQ ID NO: 239727 - DNA, 20 bp, Artificial Sequence
  chemically synthesized
gataagtactcaaatagtta

SEQ ID NO: 239728 - DNA, 20 bp, Artificial Sequence
  chemically synthesized
tcagataccaagcataggta

SEQ ID NO: 239729 - DNA, 20 bp, Artificial Sequence
  chemically synthesized
ttcatttctttacctatgct

SEQ ID NO: 239730 - DNA, 20 bp, Artificial Sequence
  chemically synthesized
aataatcagataccaagcat

SEQ ID NO: 239731 - DNA, 20 bp, Artificial Sequence
  chemically synthesized
aaataatcagataccaagca

SEQ ID NO: 239732 - DNA, 20 bp, Artificial Sequence
  chemically synthesized
gagttaaataatcagatacc

SEQ ID NO: 239733 - DNA, 20 bp, Artificial Sequence
  chemically synthesized
ttactaaggagttaaataat

SEQ ID NO: 239734 - DNA, 20 bp, Artificial Sequence
  chemically synthesized
tatctgattatttaactcct

SEQ ID NO: 239735 - DNA, 20 bp, Artificial Sequence
  chemically synthesized
ctttctttgttattactaag

SEQ ID NO: 239736 - DNA, 20 bp, Artificial Sequence
  chemically synthesized
tgctttctttgttattacta

SEQ ID NO: 239737 - DNA, 20 bp, Artificial Sequence
  chemically synthesized
ttgctttctttgttattact

SEQ ID NO: 239738 - DNA, 20 bp, Artificial Sequence
  chemically synthesized
ttaactccttagtaataaca

SEQ ID NO: 239739 - DNA, 20 bp, Artificial Sequence
  chemically synthesized
ctccttagtaataacaaaga

SEQ ID NO: 239740 - DNA, 20 bp, Artificial Sequence
  chemically synthesized
agtaataacaaagaaagcaa

SEQ ID NO: 239741 - DNA, 20 bp, Artificial Sequence
  chemically synthesized
tctagacaatagtaatatca

SEQ ID NO: 239742 - DNA, 20 bp, Artificial Sequence
  chemically synthesized
ttctagacaatagtaatatc

SEQ ID NO: 239743 - DNA, 20 bp, Artificial Sequence
  chemically synthesized
gttctagacaatagtaatat

SEQ ID NO: 239744 - DNA, 20 bp, Artificial Sequence
  chemically synthesized
tccctgatattactattgtc

SEQ ID NO: 239745 - DNA, 20 bp, Artificial Sequence
  chemically synthesized
atttgcggagttctagacaa

SEQ ID NO: 239746 - DNA, 20 bp, Artificial Sequence
  chemically synthesized
aaagaaaatttgcggagttc

SEQ ID NO: 239747 - DNA, 20 bp, Artificial Sequence
  chemically synthesized
aagggcaaagaaaatttgcg

SEQ ID NO: 239748 - DNA, 20 bp, Artificial Sequence
  chemically synthesized
agaagggcaaagaaaatttg

SEQ ID NO: 239749 - DNA, 20 bp, Artificial Sequence
  chemically synthesized
atttataaaagagaagggca

SEQ ID NO: 239750 - DNA, 20 bp, Artificial Sequence
  chemically synthesized
aagagatttataaaagagaa

SEQ ID NO: 239751 - DNA, 20 bp, Artificial Sequence
  chemically synthesized
aaagagatttataaaagaga

SEQ ID NO: 239752 - DNA, 20 bp, Artificial Sequence
  chemically synthesized
caaagagatttataaaagag

SEQ ID NO: 239753 - DNA, 20 bp, Artificial Sequence
  chemically synthesized
tgtcaaagagatttataaaa

SEQ ID NO: 239754 - DNA, 20 bp, Artificial Sequence
  chemically synthesized
tgtgtcaaagagatttataa

SEQ ID NO: 239755 - DNA, 20 bp, Artificial Sequence
  chemically synthesized
gaacattatattgtgtcaaa

SEQ ID NO: 239756 - DNA, 20 bp, Artificial Sequence
  chemically synthesized
tggaacattatattgtgtca

SEQ ID NO: 239757 - DNA, 20 bp, Artificial Sequence
  chemically synthesized
tttgacacaatataatgttc

SEQ ID NO: 239758 - DNA, 20 bp, Artificial Sequence
  chemically synthesized
gacacaatataatgttccag

SEQ ID NO: 239759 - DNA, 20 bp, Artificial Sequence
  chemically synthesized
ttacattgtcagttgtctgc

SEQ ID NO: 239760 - DNA, 20 bp, Artificial Sequence
  chemically synthesized
tatcacaacctttacattgt

SEQ ID NO: 239761 - DNA, 20 bp, Artificial Sequence
  chemically synthesized
agcagacaactgacaatgta

SEQ ID NO: 239762 - DNA, 20 bp, Artificial Sequence
  chemically synthesized
gcagacaactgacaatgtaa

SEQ ID NO: 239763 - DNA, 20 bp, Artificial Sequence
  chemically synthesized
atttgaaaattccatcatga

SEQ ID NO: 239764 - DNA, 20 bp, Artificial Sequence
  chemically synthesized
tgaatatttttccatcatga

SEQ ID NO: 239765 - DNA, 20 bp, Artificial Sequence
  chemically synthesized
catcatgatggaaaaatatt

SEQ ID NO: 239766 - DNA, 20 bp, Artificial Sequence
  chemically synthesized
atcatgatggaaaaatattc

SEQ ID NO: 239767 - DNA, 20 bp, Artificial Sequence
  chemically synthesized
tcatgatggaaaaatattca

SEQ ID NO: 239768 - DNA, 20 bp, Artificial Sequence
  chemically synthesized
tttcagaagcagtgcaggaa

SEQ ID NO: 239769 - DNA, 20 bp, Artificial Sequence
  chemically synthesized
tattttttcagaagcagtgc

SEQ ID NO: 239770 - DNA, 20 bp, Artificial Sequence
  chemically synthesized
atattttttcagaagcagtg

SEQ ID NO: 239771 - DNA, 20 bp, Artificial Sequence
  chemically synthesized
cctacatattttttcagaag

SEQ ID NO: 239772 - DNA, 20 bp, Artificial Sequence
  chemically synthesized
aatcctacatattttttcag

SEQ ID NO: 239773 - DNA, 20 bp, Artificial Sequence
  chemically synthesized
cataatcctacatatttttt

SEQ ID NO: 239774 - DNA, 20 bp, Artificial Sequence
  chemically synthesized
actgcttctgaaaaaatatg

SEQ ID NO: 239775 - DNA, 20 bp, Artificial Sequence
  chemically synthesized
ctgcttctgaaaaaatatgt

SEQ ID NO: 239776 - DNA, 20 bp, Artificial Sequence
  chemically synthesized
gcataattttaggttaatat

SEQ ID NO: 239777 - DNA, 20 bp, Artificial Sequence
  chemically synthesized
cattgaaattgcataatttt

SEQ ID NO: 239778 - DNA, 20 bp, Artificial Sequence
  chemically synthesized
acattgaaattgcataattt

SEQ ID NO: 239779 - DNA, 20 bp, Artificial Sequence
  chemically synthesized
gcaatttcaatgtcttgatt

SEQ ID NO: 239780 - DNA, 20 bp, Artificial Sequence
  chemically synthesized
ggtgctaattgtgccaaatc

SEQ ID NO: 239781 - DNA, 20 bp, Artificial Sequence
  chemically synthesized
atgtcttgatttggcacaat

SEQ ID NO: 239782 - DNA, 20 bp, Artificial Sequence
  chemically synthesized
ctactttgggtatttttaca

SEQ ID NO: 239783 - DNA, 20 bp, Artificial Sequence
  chemically synthesized
gctactttgggtatttttac

SEQ ID NO: 239784 - DNA, 20 bp, Artificial Sequence
  chemically synthesized
tgctactttgggtattttta

SEQ ID NO: 239785 - DNA, 20 bp, Artificial Sequence
  chemically synthesized
gcaccctgtaaaaataccca

SEQ ID NO: 239786 - DNA, 20 bp, Artificial Sequence
  chemically synthesized
ccctgtaaaaatacccaaag

SEQ ID NO: 239787 - DNA, 20 bp, Artificial Sequence
  chemically synthesized
tgtaaaaatacccaaagtag

SEQ ID NO: 239788 - DNA, 20 bp, Artificial Sequence
  chemically synthesized
caaactatttctgctacttt

SEQ ID NO: 239789 - DNA, 20 bp, Artificial Sequence
  chemically synthesized
gcaaactatttctgctactt

SEQ ID NO: 239790 - DNA, 20 bp, Artificial Sequence
  chemically synthesized
aatacccaaagtagcagaaa

SEQ ID NO: 239791 - DNA, 20 bp, Artificial Sequence
  chemically synthesized
tagcagaaatagtttgctat

SEQ ID NO: 239792 - DNA, 20 bp, Artificial Sequence
  chemically synthesized
gtagcattacagatcactaa

SEQ ID NO: 239793 - DNA, 20 bp, Artificial Sequence
  chemically synthesized
tggtattaaaagtagcatta

SEQ ID NO: 239794 - DNA, 20 bp, Artificial Sequence
  chemically synthesized
aaaggtcttggtattaaaag

SEQ ID NO: 239795 - DNA, 20 bp, Artificial Sequence
  chemically synthesized
ccaaaaggtcttggtattaa

SEQ ID NO: 239796 - DNA, 20 bp, Artificial Sequence
  chemically synthesized
gtaatgctacttttaatacc

SEQ ID NO: 239797 - DNA, 20 bp, Artificial Sequence
  chemically synthesized
ctgatttctccaaaaggtct

SEQ ID NO: 239798 - DNA, 20 bp, Artificial Sequence
  chemically synthesized
cttttaataccaagaccttt

SEQ ID NO: 239799 - DNA, 20 bp, Artificial Sequence
  chemically synthesized
tttaataccaagaccttttg

SEQ ID NO: 239800 - DNA, 20 bp, Artificial Sequence
  chemically synthesized
ctgtagctgatttctccaaa

SEQ ID NO: 239801 - DNA, 20 bp, Artificial Sequence
  chemically synthesized
tctgtagctgatttctccaa

SEQ ID NO: 239802 - DNA, 20 bp, Artificial Sequence
  chemically synthesized
ccaagaccttttggagaaat

SEQ ID NO: 239803 - DNA, 20 bp, Artificial Sequence
  chemically synthesized
ccttttggagaaatcagcta

SEQ ID NO: 239804 - DNA, 20 bp, Artificial Sequence
  chemically synthesized
gcctgctgagtcagtttctg

SEQ ID NO: 239805 - DNA, 20 bp, Artificial Sequence
  chemically synthesized
atcagctacagaaactgact

SEQ ID NO: 239806 - DNA, 20 bp, Artificial Sequence
  chemically synthesized
agctacagaaactgactcag

SEQ ID NO: 239807 - DNA, 20 bp, Artificial Sequence
  chemically synthesized
gctacagaaactgactcagc

SEQ ID NO: 239808 - DNA, 20 bp, Artificial Sequence
  chemically synthesized
tttaacttagcctgctgagt

SEQ ID NO: 239809 - DNA, 20 bp, Artificial Sequence
  chemically synthesized
attatttaacttagcctgct

SEQ ID NO: 239810 - DNA, 20 bp, Artificial Sequence
  chemically synthesized
agaaactgactcagcaggct

SEQ ID NO: 239811 - DNA, 20 bp, Artificial Sequence
  chemically synthesized
gaaatttaaattatttaact

SEQ ID NO: 239812 - DNA, 20 bp, Artificial Sequence
  chemically synthesized
aataatttaaatttcttaat

SEQ ID NO: 239813 - DNA, 20 bp, Artificial Sequence
  chemically synthesized
tatgtcagtttaaacttatt

SEQ ID NO: 239814 - DNA, 20 bp, Artificial Sequence
  chemically synthesized
caaatcctcagagagtatgt

SEQ ID NO: 239815 - DNA, 20 bp, Artificial Sequence
  chemically synthesized
tttaaactgacatactctct

SEQ ID NO: 239816 - DNA, 20 bp, Artificial Sequence
  chemically synthesized
ttaaactgacatactctctg

SEQ ID NO: 239817 - DNA, 20 bp, Artificial Sequence
  chemically synthesized
gaatatatcaaatcctcaga

SEQ ID NO: 239818 - DNA, 20 bp, Artificial Sequence
  chemically synthesized
ttgaatatatcaaatcctca

SEQ ID NO: 239819 - DNA, 20 bp, Artificial Sequence
  chemically synthesized
ccttgaatatatcaaatcct

SEQ ID NO: 239820 - DNA, 20 bp, Artificial Sequence
  chemically synthesized
tctgaggatttgatatattc

SEQ ID NO: 239821 - DNA, 20 bp, Artificial Sequence
  chemically synthesized
ctgaggatttgatatattca

SEQ ID NO: 239822 - DNA, 20 bp, Artificial Sequence
  chemically synthesized
tgaggatttgatatattcaa

SEQ ID NO: 239823 - DNA, 20 bp, Artificial Sequence
  chemically synthesized
aatgctcacattttataaag

SEQ ID NO: 239824 - DNA, 20 bp, Artificial Sequence
  chemically synthesized
taaatgctcacattttataa

SEQ ID NO: 239825 - DNA, 20 bp, Artificial Sequence
  chemically synthesized
ttaaatgctcacattttata

SEQ ID NO: 239826 - DNA, 20 bp, Artificial Sequence
  chemically synthesized
gggtctcctttataaaatgt

SEQ ID NO: 239827 - DNA, 20 bp, Artificial Sequence
  chemically synthesized
taaaatgtgagcatttaatt

SEQ ID NO: 239828 - DNA, 20 bp, Artificial Sequence
  chemically synthesized
tagtagaggatatgtaaatt

SEQ ID NO: 239829 - DNA, 20 bp, Artificial Sequence
  chemically synthesized
tcatgtggactatatagtag

SEQ ID NO: 239830 - DNA, 20 bp, Artificial Sequence
  chemically synthesized
tttacatatcctctactata

SEQ ID NO: 239831 - DNA, 20 bp, Artificial Sequence
  chemically synthesized
ttcatgtggactatatagta

SEQ ID NO: 239832 - DNA, 20 bp, Artificial Sequence
  chemically synthesized
tcttcatgtggactatatag

SEQ ID NO: 239833 - DNA, 20 bp, Artificial Sequence
  chemically synthesized
tcctcttcatgtggactata

SEQ ID NO: 239834 - DNA, 20 bp, Artificial Sequence
  chemically synthesized
tctactatatagtccacatg

SEQ ID NO: 239835 - DNA, 20 bp, Artificial Sequence
  chemically synthesized
tactatatagtccacatgaa

SEQ ID NO: 239836 - DNA, 20 bp, Artificial Sequence
  chemically synthesized
actatatagtccacatgaag

SEQ ID NO: 239837 - DNA, 20 bp, Artificial Sequence
  chemically synthesized
aacaccatatcctcttcatg

SEQ ID NO: 239838 - DNA, 20 bp, Artificial Sequence
  chemically synthesized
tagtccacatgaagaggata

SEQ ID NO: 239839 - DNA, 20 bp, Artificial Sequence
  chemically synthesized
acatgaagaggatatggtgt

SEQ ID NO: 239840 - DNA, 20 bp, Artificial Sequence
  chemically synthesized
ggatatggtgttagacatcc

SEQ ID NO: 239841 - DNA, 20 bp, Artificial Sequence
  chemically synthesized
tgttagacatcctagcttcc

SEQ ID NO: 239842 - DNA, 20 bp, Artificial Sequence
  chemically synthesized
aaagctaagacttggaagct

SEQ ID NO: 239843 - DNA, 20 bp, Artificial Sequence
  chemically synthesized
gaaagctaagacttggaagc

SEQ ID NO: 239844 - DNA, 20 bp, Artificial Sequence
  chemically synthesized
aaatgaaagctaagacttgg

SEQ ID NO: 239845 - DNA, 20 bp, Artificial Sequence
  chemically synthesized
acatcctagcttccaagtct

SEQ ID NO: 239846 - DNA, 20 bp, Artificial Sequence
  chemically synthesized
aacaaatgaaagctaagact

SEQ ID NO: 239847 - DNA, 20 bp, Artificial Sequence
  chemically synthesized
ctagccaacaaatgaaagct

SEQ ID NO: 239848 - DNA, 20 bp, Artificial Sequence
  chemically synthesized
cccctctagccaacaaatga

SEQ ID NO: 239849 - DNA, 20 bp, Artificial Sequence
  chemically synthesized
aagtcttagctttcatttgt

SEQ ID NO: 239850 - DNA, 20 bp, Artificial Sequence
  chemically synthesized
cttagctttcatttgttggc

SEQ ID NO: 239851 - DNA, 20 bp, Artificial Sequence
  chemically synthesized
tagctttcatttgttggcta

SEQ ID NO: 239852 - DNA, 20 bp, Artificial Sequence
  chemically synthesized
agctttcatttgttggctag

SEQ ID NO: 239853 - DNA, 20 bp, Artificial Sequence
  chemically synthesized
gctttcatttgttggctaga

SEQ ID NO: 239854 - DNA, 20 bp, Artificial Sequence
  chemically synthesized
ctttcatttgttggctagag

SEQ ID NO: 239855 - DNA, 20 bp, Artificial Sequence
  chemically synthesized
attatttcaaatatcccctc

SEQ ID NO: 239856 - DNA, 20 bp, Artificial Sequence
  chemically synthesized
ttgtgtttgaatgaagagaa

SEQ ID NO: 239857 - DNA, 20 bp, Artificial Sequence
  chemically synthesized
tttgtgtttgaatgaagaga

SEQ ID NO: 239858 - DNA, 20 bp, Artificial Sequence
  chemically synthesized
atgttttgtgtttgaatgaa

SEQ ID NO: 239859 - DNA, 20 bp, Artificial Sequence
  chemically synthesized
atatgttttgtgtttgaatg

SEQ ID NO: 239860 - DNA, 20 bp, Artificial Sequence
  chemically synthesized
caaacacaaaacatatataa

SEQ ID NO: 239861 - DNA, 20 bp, Artificial Sequence
  chemically synthesized
aaacacaaaacatatataat

SEQ ID NO: 239862 - DNA, 20 bp, Artificial Sequence
  chemically synthesized
caaaacatatataataggtg

SEQ ID NO: 239863 - DNA, 20 bp, Artificial Sequence
  chemically synthesized
aaaacatatataataggtgt

SEQ ID NO: 239864 - DNA, 20 bp, Artificial Sequence
  chemically synthesized
taggtgtaggaacttttacc

SEQ ID NO: 239865 - DNA, 20 bp, Artificial Sequence
  chemically synthesized
ttgctcctatttctgggtaa

SEQ ID NO: 239866 - DNA, 20 bp, Artificial Sequence
  chemically synthesized
taggaacttttacccagaaa

SEQ ID NO: 239867 - DNA, 20 bp, Artificial Sequence
  chemically synthesized
aggaacttttacccagaaat

SEQ ID NO: 239868 - DNA, 20 bp, Artificial Sequence
  chemically synthesized
ttgcttttgctcctatttct

SEQ ID NO: 239869 - DNA, 20 bp, Artificial Sequence
  chemically synthesized
gaacttttacccagaaatag

SEQ ID NO: 239870 - DNA, 20 bp, Artificial Sequence
  chemically synthesized
gttgcttttgctcctatttc

SEQ ID NO: 239871 - DNA, 20 bp, Artificial Sequence
  chemically synthesized
ttacccagaaataggagcaa

SEQ ID NO: 239872 - DNA, 20 bp, Artificial Sequence
  chemically synthesized
gagtgcatagcatatatttg

SEQ ID NO: 239873 - DNA, 20 bp, Artificial Sequence
  chemically synthesized
gaagttttaattagagtgca

SEQ ID NO: 239874 - DNA, 20 bp, Artificial Sequence
  chemically synthesized
ttaatctgaagttttaatta

SEQ ID NO: 239875 - DNA, 20 bp, Artificial Sequence
  chemically synthesized
acttaatctgaagttttaat

SEQ ID NO: 239876 - DNA, 20 bp, Artificial Sequence
  chemically synthesized
atgcactctaattaaaactt

SEQ ID NO: 239877 - DNA, 20 bp, Artificial Sequence
  chemically synthesized
tctaattaaaacttcagatt

SEQ ID NO: 239878 - DNA, 20 bp, Artificial Sequence
  chemically synthesized
ttaatcatgtacttaatctg

SEQ ID NO: 239879 - DNA, 20 bp, Artificial Sequence
  chemically synthesized
acatgattaaatatactcca

SEQ ID NO: 239880 - DNA, 20 bp, Artificial Sequence
  chemically synthesized
acctaccccaaggtgctgtg

SEQ ID NO: 239881 - DNA, 20 bp, Artificial Sequence
  chemically synthesized
gtacctaccccaaggtgctg

SEQ ID NO: 239882 - DNA, 20 bp, Artificial Sequence
  chemically synthesized
aaatatactccacagcacct

SEQ ID NO: 239883 - DNA, 20 bp, Artificial Sequence
  chemically synthesized
aatatactccacagcacctt

SEQ ID NO: 239884 - DNA, 20 bp, Artificial Sequence
  chemically synthesized
atatactccacagcaccttg

SEQ ID NO: 239885 - DNA, 20 bp, Artificial Sequence
  chemically synthesized
tactccacagcaccttgggg

SEQ ID NO: 239886 - DNA, 20 bp, Artificial Sequence
  chemically synthesized
actccacagcaccttggggt

SEQ ID NO: 239887 - DNA, 20 bp, Artificial Sequence
  chemically synthesized
aaatgatagtacctacccca

SEQ ID NO: 239888 - DNA, 20 bp, Artificial Sequence
  chemically synthesized
aaaatgatagtacctacccc

SEQ ID NO: 239889 - DNA, 20 bp, Artificial Sequence
  chemically synthesized
ttgcaaaatgaataaaatga

SEQ ID NO: 239890 - DNA, 20 bp, Artificial Sequence
  chemically synthesized
attttattcattttgcaaat

SEQ ID NO: 239891 - DNA, 20 bp, Artificial Sequence
  chemically synthesized
attttgcaaatgagaaaact

SEQ ID NO: 239892 - DNA, 20 bp, Artificial Sequence
  chemically synthesized
aaatgagaaaactgagactt

SEQ ID NO: 239893 - DNA, 20 bp, Artificial Sequence
  chemically synthesized
aatgagaaaactgagacttt

SEQ ID NO: 239894 - DNA, 20 bp, Artificial Sequence
  chemically synthesized
aagttagactcccaaagtct

SEQ ID NO: 239895 - DNA, 20 bp, Artificial Sequence
  chemically synthesized
tgagaaaactgagactttgg

SEQ ID NO: 239896 - DNA, 20 bp, Artificial Sequence
  chemically synthesized
acatacaagttagactccca

SEQ ID NO: 239897 - DNA, 20 bp, Artificial Sequence
  chemically synthesized
ctgattagaaacatacaagt

SEQ ID NO: 239898 - DNA, 20 bp, Artificial Sequence
  chemically synthesized
attcctgattagaaacatac

SEQ ID NO: 239899 - DNA, 20 bp, Artificial Sequence
  chemically synthesized
ctaacttgtatgtttctaat

SEQ ID NO: 239900 - DNA, 20 bp, Artificial Sequence
  chemically synthesized
taacttgtatgtttctaatc

SEQ ID NO: 239901 - DNA, 20 bp, Artificial Sequence
  chemically synthesized
tattgtcttgcattcctgat

SEQ ID NO: 239902 - DNA, 20 bp, Artificial Sequence
  chemically synthesized
atgtttctaatcaggaatgc

SEQ ID NO: 239903 - DNA, 20 bp, Artificial Sequence
  chemically synthesized
aggaatgcaagacaataaca

SEQ ID NO: 239904 - DNA, 20 bp, Artificial Sequence
  chemically synthesized
agacaataacatagctgaat

SEQ ID NO: 239905 - DNA, 20 bp, Artificial Sequence
  chemically synthesized
gacaataacatagctgaata

SEQ ID NO: 239906 - DNA, 20 bp, Artificial Sequence
  chemically synthesized
cactataagctatccttatt

SEQ ID NO: 239907 - DNA, 20 bp, Artificial Sequence
  chemically synthesized
ataacatagctgaataagga

SEQ ID NO: 239908 - DNA, 20 bp, Artificial Sequence
  chemically synthesized
agctgaataaggatagctta

SEQ ID NO: 239909 - DNA, 20 bp, Artificial Sequence
  chemically synthesized
aaacaaaaaacatacactat

SEQ ID NO: 239910 - DNA, 20 bp, Artificial Sequence
  chemically synthesized
aaatgacacttaaaaaaaac

SEQ ID NO: 239911 - DNA, 20 bp, Artificial Sequence
  chemically synthesized
ttttgtttcttgtttttttt

SEQ ID NO: 239912 - DNA, 20 bp, Artificial Sequence
  chemically synthesized
tttttaagtgtcatttgaat

SEQ ID NO: 239913 - DNA, 20 bp, Artificial Sequence
  chemically synthesized
tgaatcagtaaacactgtat

SEQ ID NO: 239914 - DNA, 20 bp, Artificial Sequence
  chemically synthesized
ttctctttcacaagctaata

SEQ ID NO: 239915 - DNA, 20 bp, Artificial Sequence
  chemically synthesized
aacactgtattagcttgtga

SEQ ID NO: 239916 - DNA, 20 bp, Artificial Sequence
  chemically synthesized
cactgtattagcttgtgaaa

SEQ ID NO: 239917 - DNA, 20 bp, Artificial Sequence
  chemically synthesized
taggattttttctctttcac

SEQ ID NO: 239918 - DNA, 20 bp, Artificial Sequence
  chemically synthesized
tagtatattataggagaagt

SEQ ID NO: 239919 - DNA, 20 bp, Artificial Sequence
  chemically synthesized
atagtatattataggagaag

SEQ ID NO: 239920 - DNA, 20 bp, Artificial Sequence
  chemically synthesized
aggatagtatattataggag

SEQ ID NO: 239921 - DNA, 20 bp, Artificial Sequence
  chemically synthesized
aagaggatagtatattatag

SEQ ID NO: 239922 - DNA, 20 bp, Artificial Sequence
  chemically synthesized
ccaagaggatagtatattat

SEQ ID NO: 239923 - DNA, 20 bp, Artificial Sequence
  chemically synthesized
tccaagaggatagtatatta

SEQ ID NO: 239924 - DNA, 20 bp, Artificial Sequence
  chemically synthesized
cctataatatactatcctct

SEQ ID NO: 239925 - DNA, 20 bp, Artificial Sequence
  chemically synthesized
atgatttatttccaagagga

SEQ ID NO: 239926 - DNA, 20 bp, Artificial Sequence
  chemically synthesized
caacatgatttatttccaag

SEQ ID NO: 239927 - DNA, 20 bp, Artificial Sequence
  chemically synthesized
acaacatgatttatttccaa

SEQ ID NO: 239928 - DNA, 20 bp, Artificial Sequence
  chemically synthesized
taacaacatgatttatttcc

SEQ ID NO: 239929 - DNA, 20 bp, Artificial Sequence
  chemically synthesized
gaaataaatcatgttgttat

SEQ ID NO: 239930 - DNA, 20 bp, Artificial Sequence
  chemically synthesized
taaatcatgttgttattgga

SEQ ID NO: 239931 - DNA, 20 bp, Artificial Sequence
  chemically synthesized
tttcatgatcagaaacacgt

SEQ ID NO: 239932 - DNA, 20 bp, Artificial Sequence
  chemically synthesized
tgaaatataaatttcatgat

SEQ ID NO: 239933 - DNA, 20 bp, Artificial Sequence
  chemically synthesized
atcatgaaatttatatttca

SEQ ID NO: 239934 - DNA, 20 bp, Artificial Sequence
  chemically synthesized
tcatgaaatttatatttcaa

SEQ ID NO: 239935 - DNA, 20 bp, Artificial Sequence
  chemically synthesized
aaatttatatttcaaaggaa

SEQ ID NO: 239936 - DNA, 20 bp, Artificial Sequence
  chemically synthesized
tgctgcttagaaaggaggtt

SEQ ID NO: 239937 - DNA, 20 bp, Artificial Sequence
  chemically synthesized
atgctgcttagaaaggaggt

SEQ ID NO: 239938 - DNA, 20 bp, Artificial Sequence
  chemically synthesized
aataacctaacctcctttct

SEQ ID NO: 239939 - DNA, 20 bp, Artificial Sequence
  chemically synthesized
gcaaatgctgcttagaaagg

SEQ ID NO: 239940 - DNA, 20 bp, Artificial Sequence
  chemically synthesized
agcaaatgctgcttagaaag

SEQ ID NO: 239941 - DNA, 20 bp, Artificial Sequence
  chemically synthesized
aacctaacctcctttctaag

SEQ ID NO: 239942 - DNA, 20 bp, Artificial Sequence
  chemically synthesized
tgagcaaatgctgcttagaa

SEQ ID NO: 239943 - DNA, 20 bp, Artificial Sequence
  chemically synthesized
ttgagcaaatgctgcttaga

SEQ ID NO: 239944 - DNA, 20 bp, Artificial Sequence
  chemically synthesized
tattttgagcaaatgctgct

SEQ ID NO: 239945 - DNA, 20 bp, Artificial Sequence
  chemically synthesized
gtctagaaatatgttatttt

SEQ ID NO: 239946 - DNA, 20 bp, Artificial Sequence
  chemically synthesized
tgctcaaaataacatatttc

SEQ ID NO: 239947 - DNA, 20 bp, Artificial Sequence
  chemically synthesized
gatatataatgagaagtgtc

SEQ ID NO: 239948 - DNA, 20 bp, Artificial Sequence
  chemically synthesized
ttgtcatgatatataatgag

SEQ ID NO: 239949 - DNA, 20 bp, Artificial Sequence
  chemically synthesized
tacttgtcatgatatataat

SEQ ID NO: 239950 - DNA, 20 bp, Artificial Sequence
  chemically synthesized
ttctcattatatatcatgac

SEQ ID NO: 239951 - DNA, 20 bp, Artificial Sequence
  chemically synthesized
cattttgatttgagagtatg

SEQ ID NO: 239952 - DNA, 20 bp, Artificial Sequence
  chemically synthesized
ccattttgatttgagagtat

SEQ ID NO: 239953 - DNA, 20 bp, Artificial Sequence
  chemically synthesized
gaaattccattttgatttga

SEQ ID NO: 239954 - DNA, 20 bp, Artificial Sequence
  chemically synthesized
gagaaattccattttgattt

SEQ ID NO: 239955 - DNA, 20 bp, Artificial Sequence
  chemically synthesized
ctcatactctcaaatcaaaa

SEQ ID NO: 239956 - DNA, 20 bp, Artificial Sequence
  chemically synthesized
ggatgtttctgaaaaatcaa

SEQ ID NO: 239957 - DNA, 20 bp, Artificial Sequence
  chemically synthesized
tggaatttctcttgattttt

SEQ ID NO: 239958 - DNA, 20 bp, Artificial Sequence
  chemically synthesized
aaggatgtttctgaaaaatc

SEQ ID NO: 239959 - DNA, 20 bp, Artificial Sequence
  chemically synthesized
tgatttttcagaaacatcct

SEQ ID NO: 239960 - DNA, 20 bp, Artificial Sequence
  chemically synthesized
tttttcagaaacatccttgg

SEQ ID NO: 239961 - DNA, 20 bp, Artificial Sequence
  chemically synthesized
caaaagatgaagaaccacca

SEQ ID NO: 239962 - DNA, 20 bp, Artificial Sequence
  chemically synthesized
ccaaaagatgaagaaccacc

SEQ ID NO: 239963 - DNA, 20 bp, Artificial Sequence
  chemically synthesized
cttggtggttcttcatcttt

SEQ ID NO: 239964 - DNA, 20 bp, Artificial Sequence
  chemically synthesized
caaaaataaaccaaaagatg

SEQ ID NO: 239965 - DNA, 20 bp, Artificial Sequence
  chemically synthesized
tataaacaaaaataaaccaa

SEQ ID NO: 239966 - DNA, 20 bp, Artificial Sequence
  chemically synthesized
ttatattattccttttctta

SEQ ID NO: 239967 - DNA, 20 bp, Artificial Sequence
  chemically synthesized
agcaacgatactttaagaaa

SEQ ID NO: 239968 - DNA, 20 bp, Artificial Sequence
  chemically synthesized
aagcaacgatactttaagaa

SEQ ID NO: 239969 - DNA, 20 bp, Artificial Sequence
  chemically synthesized
aatataagcaacgatacttt

SEQ ID NO: 239970 - DNA, 20 bp, Artificial Sequence
  chemically synthesized
agaaaaatttaggacaatat

SEQ ID NO: 239971 - DNA, 20 bp, Artificial Sequence
  chemically synthesized
aggaaggtatagaaaaattt

SEQ ID NO: 239972 - DNA, 20 bp, Artificial Sequence
  chemically synthesized
gaggaaggtatagaaaaatt

SEQ ID NO: 239973 - DNA, 20 bp, Artificial Sequence
  chemically synthesized
ggttctcatggaggaaggta

SEQ ID NO: 239974 - DNA, 20 bp, Artificial Sequence
  chemically synthesized
agaaaggttctcatggagga

SEQ ID NO: 239975 - DNA, 20 bp, Artificial Sequence
  chemically synthesized
ttttctataccttcctccat

SEQ ID NO: 239976 - DNA, 20 bp, Artificial Sequence
  chemically synthesized
cagaaaggttctcatggagg

SEQ ID NO: 239977 - DNA, 20 bp, Artificial Sequence
  chemically synthesized
tatcagaaaggttctcatgg

SEQ ID NO: 239978 - DNA, 20 bp, Artificial Sequence
  chemically synthesized
gtatcagaaaggttctcatg

SEQ ID NO: 239979 - DNA, 20 bp, Artificial Sequence
  chemically synthesized
tagtatcagaaaggttctca

SEQ ID NO: 239980 - DNA, 20 bp, Artificial Sequence
  chemically synthesized
tctaattggtagtatcagaa

SEQ ID NO: 239981 - DNA, 20 bp, Artificial Sequence
  chemically synthesized
ttctaattggtagtatcaga

SEQ ID NO: 239982 - DNA, 20 bp, Artificial Sequence
  chemically synthesized
ttacttctaattggtagtat

SEQ ID NO: 239983 - DNA, 20 bp, Artificial Sequence
  chemically synthesized
acctttctgatactaccaat

SEQ ID NO: 239984 - DNA, 20 bp, Artificial Sequence
  chemically synthesized
gagggattacttctaattgg

SEQ ID NO: 239985 - DNA, 20 bp, Artificial Sequence
  chemically synthesized
tttctgatactaccaattag

SEQ ID NO: 239986 - DNA, 20 bp, Artificial Sequence
  chemically synthesized
ggggagggattacttctaat

SEQ ID NO: 239987 - DNA, 20 bp, Artificial Sequence
  chemically synthesized
gagtgttattaaagagggga

SEQ ID NO: 239988 - DNA, 20 bp, Artificial Sequence
  chemically synthesized
agagtgttattaaagagggg

SEQ ID NO: 239989 - DNA, 20 bp, Artificial Sequence
  chemically synthesized
aagagtgttattaaagaggg

SEQ ID NO: 239990 - DNA, 20 bp, Artificial Sequence
  chemically synthesized
aaaagagtgttattaaagag

SEQ ID NO: 239991 - DNA, 20 bp, Artificial Sequence
  chemically synthesized
aaaaagagtgttattaaaga

SEQ ID NO: 239992 - DNA, 20 bp, Artificial Sequence
  chemically synthesized
taaaaagagtgttattaaag

SEQ ID NO: 239993 - DNA, 20 bp, Artificial Sequence
  chemically synthesized
ataaaaagagtgttattaaa

SEQ ID NO: 239994 - DNA, 20 bp, Artificial Sequence
  chemically synthesized
taataaaaagagtgttatta

SEQ ID NO: 239995 - DNA, 20 bp, Artificial Sequence
  chemically synthesized
tttaataacactctttttat

SEQ ID NO: 239996 - DNA, 20 bp, Artificial Sequence
  chemically synthesized
aataatcaccctaataaaaa

SEQ ID NO: 239997 - DNA, 20 bp, Artificial Sequence
  chemically synthesized
ttaataacactctttttatt

SEQ ID NO: 239998 - DNA, 20 bp, Artificial Sequence
  chemically synthesized
taataacactctttttatta

SEQ ID NO: 239999 - DNA, 20 bp, Artificial Sequence
  chemically synthesized
aaaataatcaccctaataaa

SEQ ID NO: 240000 - DNA, 20 bp, Artificial Sequence
  chemically synthesized
ggtggttacaaaaaagaatc

SEQ ID NO: 240001 - DNA, 20 bp, Artificial Sequence
  chemically synthesized
tcattaaggtggttacaaaa

SEQ ID NO: 240002 - DNA, 20 bp, Artificial Sequence
  chemically synthesized
tcaatcatacttcattaagg

SEQ ID NO: 240003 - DNA, 20 bp, Artificial Sequence
  chemically synthesized
tttttgtaaccaccttaatg

SEQ ID NO: 240004 - DNA, 20 bp, Artificial Sequence
  chemically synthesized
atgtcaatcatacttcatta

SEQ ID NO: 240005 - DNA, 20 bp, Artificial Sequence
  chemically synthesized
tatgtcaatcatacttcatt

SEQ ID NO: 240006 - DNA, 20 bp, Artificial Sequence
  chemically synthesized
aagtatgattgacatacaaa

SEQ ID NO: 240007 - DNA, 20 bp, Artificial Sequence
  chemically synthesized
atatatatgtaaaatatgta

SEQ ID NO: 240008 - DNA, 20 bp, Artificial Sequence
  chemically synthesized
atatatatatatatatctca

SEQ ID NO: 240009 - DNA, 20 bp, Artificial Sequence
  chemically synthesized
atatatatatatatctcaaa

SEQ ID NO: 240010 - DNA, 20 bp, Artificial Sequence
  chemically synthesized
tatatatgatgaaactcttt

SEQ ID NO: 240011 - DNA, 20 bp, Artificial Sequence
  chemically synthesized
tatatatatatataaaatca

SEQ ID NO: 240012 - DNA, 20 bp, Artificial Sequence
  chemically synthesized
tatatatatataaaatcaaa

SEQ ID NO: 240013 - DNA, 20 bp, Artificial Sequence
  chemically synthesized
atatataaaatcaaagagtt

SEQ ID NO: 240014 - DNA, 20 bp, Artificial Sequence
  chemically synthesized
tatataaaatcaaagagttt

SEQ ID NO: 240015 - DNA, 20 bp, Artificial Sequence
  chemically synthesized
aaatcaaagagtttgggaat

SEQ ID NO: 240016 - DNA, 20 bp, Artificial Sequence
  chemically synthesized
catggtggcgatggttttgt

SEQ ID NO: 240017 - DNA, 20 bp, Artificial Sequence
  chemically synthesized
tcatggtggcgatggttttg

SEQ ID NO: 240018 - DNA, 20 bp, Artificial Sequence
  chemically synthesized
tatagccttcatggtggcga

SEQ ID NO: 240019 - DNA, 20 bp, Artificial Sequence
  chemically synthesized
acaaaaccatcgccaccatg

SEQ ID NO: 240020 - DNA, 20 bp, Artificial Sequence
  chemically synthesized
caaaaccatcgccaccatga

SEQ ID NO: 240021 - DNA, 20 bp, Artificial Sequence
  chemically synthesized
tatgtttatagccttcatgg

SEQ ID NO: 240022 - DNA, 20 bp, Artificial Sequence
  chemically synthesized
agatatgtttatagccttca

SEQ ID NO: 240023 - DNA, 20 bp, Artificial Sequence
  chemically synthesized
agtgatgacagatatgttta

SEQ ID NO: 240024 - DNA, 20 bp, Artificial Sequence
  chemically synthesized
gaggaaattttgagtgatga

SEQ ID NO: 240025 - DNA, 20 bp, Artificial Sequence
  chemically synthesized
aggggacaagaggaaatttt

SEQ ID NO: 240026 - DNA, 20 bp, Artificial Sequence
  chemically synthesized
acaataataaaggggacaag

SEQ ID NO: 240027 - DNA, 20 bp, Artificial Sequence
  chemically synthesized
aacaataataaaggggacaa

SEQ ID NO: 240028 - DNA, 20 bp, Artificial Sequence
  chemically synthesized
acaacaataataaaggggac

SEQ ID NO: 240029 - DNA, 20 bp, Artificial Sequence
  chemically synthesized
cagtaacaacaataataaag

SEQ ID NO: 240030 - DNA, 20 bp, Artificial Sequence
  chemically synthesized
ccagtaacaacaataataaa

SEQ ID NO: 240031 - DNA, 20 bp, Artificial Sequence
  chemically synthesized
accagtaacaacaataataa

SEQ ID NO: 240032 - DNA, 20 bp, Artificial Sequence
  chemically synthesized
caccagtaacaacaataata

SEQ ID NO: 240033 - DNA, 20 bp, Artificial Sequence
  chemically synthesized
ccctttattattgttgttac

SEQ ID NO: 240034 - DNA, 20 bp, Artificial Sequence
  chemically synthesized
tttattattgttgttactgg

SEQ ID NO: 240035 - DNA, 20 bp, Artificial Sequence
  chemically synthesized
ttattgttgttactggtggt

SEQ ID NO: 240036 - DNA, 20 bp, Artificial Sequence
  chemically synthesized
ttatgttgtgttcttaccac

SEQ ID NO: 240037 - DNA, 20 bp, Artificial Sequence
  chemically synthesized
tggtggtaagaacacaacat

SEQ ID NO: 240038 - DNA, 20 bp, Artificial Sequence
  chemically synthesized
gaacacaacataagatttct

SEQ ID NO: 240039 - DNA, 20 bp, Artificial Sequence
  chemically synthesized
aacacaacataagatttctt

SEQ ID NO: 240040 - DNA, 20 bp, Artificial Sequence
  chemically synthesized
tcggacacttaaaatttcct

SEQ ID NO: 240041 - DNA, 20 bp, Artificial Sequence
  chemically synthesized
aagatttcttaggaaatttt

SEQ ID NO: 240042 - DNA, 20 bp, Artificial Sequence
  chemically synthesized
gaaattttaagtgtccgaaa

SEQ ID NO: 240043 - DNA, 20 bp, Artificial Sequence
  chemically synthesized
tatagctaataatgctgttt

SEQ ID NO: 240044 - DNA, 20 bp, Artificial Sequence
  chemically synthesized
agtgtccgaaacagcattat

SEQ ID NO: 240045 - DNA, 20 bp, Artificial Sequence
  chemically synthesized
cgaaacagcattattagcta

SEQ ID NO: 240046 - DNA, 20 bp, Artificial Sequence
  chemically synthesized
gaaacagcattattagctat

SEQ ID NO: 240047 - DNA, 20 bp, Artificial Sequence
  chemically synthesized
attatacagcatagtgccta

SEQ ID NO: 240048 - DNA, 20 bp, Artificial Sequence
  chemically synthesized
tggagatctattatacagca

SEQ ID NO: 240049 - DNA, 20 bp, Artificial Sequence
  chemically synthesized
ataggcactatgctgtataa

SEQ ID NO: 240050 - DNA, 20 bp, Artificial Sequence
  chemically synthesized
aattctggagatctattata

SEQ ID NO: 240051 - DNA, 20 bp, Artificial Sequence
  chemically synthesized
tatgctgtataatagatctc

SEQ ID NO: 240052 - DNA, 20 bp, Artificial Sequence
  chemically synthesized
ttatggaagataaaattctg

SEQ ID NO: 240053 - DNA, 20 bp, Artificial Sequence
  chemically synthesized
agttatggaagataaaattc

SEQ ID NO: 240054 - DNA, 20 bp, Artificial Sequence
  chemically synthesized
ctacaaagtttcagttatgg

SEQ ID NO: 240055 - DNA, 20 bp, Artificial Sequence
  chemically synthesized
agactacaaagtttcagtta

SEQ ID NO: 240056 - DNA, 20 bp, Artificial Sequence
  chemically synthesized
tgttaaagactacaaagttt

SEQ ID NO: 240057 - DNA, 20 bp, Artificial Sequence
  chemically synthesized
cttccataactgaaactttg

SEQ ID NO: 240058 - DNA, 20 bp, Artificial Sequence
  chemically synthesized
aaggagtgttaaagactaca

SEQ ID NO: 240059 - DNA, 20 bp, Artificial Sequence
  chemically synthesized
gcaggacaaaaggagtgtta

SEQ ID NO: 240060 - DNA, 20 bp, Artificial Sequence
  chemically synthesized
tctttaaagcaggacaaaag

SEQ ID NO: 240061 - DNA, 20 bp, Artificial Sequence
  chemically synthesized
attctttaaagcaggacaaa

SEQ ID NO: 240062 - DNA, 20 bp, Artificial Sequence
  chemically synthesized
aattctttaaagcaggacaa

SEQ ID NO: 240063 - DNA, 20 bp, Artificial Sequence
  chemically synthesized
actccttttgtcctgcttta

SEQ ID NO: 240064 - DNA, 20 bp, Artificial Sequence
  chemically synthesized
tagaataaattctttaaagc

SEQ ID NO: 240065 - DNA, 20 bp, Artificial Sequence
  chemically synthesized
gtagaataaattctttaaag

SEQ ID NO: 240066 - DNA, 20 bp, Artificial Sequence
  chemically synthesized
agagtagaataaattcttta

SEQ ID NO: 240067 - DNA, 20 bp, Artificial Sequence
  chemically synthesized
gacactaatgtaaattagag

SEQ ID NO: 240068 - DNA, 20 bp, Artificial Sequence
  chemically synthesized
aatgacactaatgtaaatta

SEQ ID NO: 240069 - DNA, 20 bp, Artificial Sequence
  chemically synthesized
gtaatgacactaatgtaaat

SEQ ID NO: 240070 - DNA, 20 bp, Artificial Sequence
  chemically synthesized
tattctactctaatttacat

SEQ ID NO: 240071 - DNA, 20 bp, Artificial Sequence
  chemically synthesized
agggagcatttagtgtggtt

SEQ ID NO: 240072 - DNA, 20 bp, Artificial Sequence
  chemically synthesized
cccttagggagcatttagtg

SEQ ID NO: 240073 - DNA, 20 bp, Artificial Sequence
  chemically synthesized
ttctacccttagggagcatt

SEQ ID NO: 240074 - DNA, 20 bp, Artificial Sequence
  chemically synthesized
aaccacactaaatgctccct

SEQ ID NO: 240075 - DNA, 20 bp, Artificial Sequence
  chemically synthesized
accacactaaatgctcccta

SEQ ID NO: 240076 - DNA, 20 bp, Artificial Sequence
  chemically synthesized
ccacactaaatgctccctaa

SEQ ID NO: 240077 - DNA, 20 bp, Artificial Sequence
  chemically synthesized
atatagtttctacccttagg

SEQ ID NO: 240078 - DNA, 20 bp, Artificial Sequence
  chemically synthesized
cactaaatgctccctaaggg

SEQ ID NO: 240079 - DNA, 20 bp, Artificial Sequence
  chemically synthesized
caatatagtttctaccctta

SEQ ID NO: 240080 - DNA, 20 bp, Artificial Sequence
  chemically synthesized
tcaatatagtttctaccctt

SEQ ID NO: 240081 - DNA, 20 bp, Artificial Sequence
  chemically synthesized
ttcaatatagtttctaccct

SEQ ID NO: 240082 - DNA, 20 bp, Artificial Sequence
  chemically synthesized
gtaaaaatggtgattcaata

SEQ ID NO: 240083 - DNA, 20 bp, Artificial Sequence
  chemically synthesized
cctgttataggaggtaaaaa

SEQ ID NO: 240084 - DNA, 20 bp, Artificial Sequence
  chemically synthesized
accatttttacctcctataa

SEQ ID NO: 240085 - DNA, 20 bp, Artificial Sequence
  chemically synthesized
tttttggcacctgttatagg

SEQ ID NO: 240086 - DNA, 20 bp, Artificial Sequence
  chemically synthesized
ccatttttacctcctataac

SEQ ID NO: 240087 - DNA, 20 bp, Artificial Sequence
  chemically synthesized
ttttttggcacctgttatag

SEQ ID NO: 240088 - DNA, 20 bp, Artificial Sequence
  chemically synthesized
tattttttggcacctgttat

SEQ ID NO: 240089 - DNA, 20 bp, Artificial Sequence
  chemically synthesized
ttattttttggcacctgtta

SEQ ID NO: 240090 - DNA, 20 bp, Artificial Sequence
  chemically synthesized
ttaagtgcaacattattttt

SEQ ID NO: 240091 - DNA, 20 bp, Artificial Sequence
  chemically synthesized
aatttgaatctgcaaaaatt

SEQ ID NO: 240092 - DNA, 20 bp, Artificial Sequence
  chemically synthesized
aatgttgcacttaatttttg

SEQ ID NO: 240093 - DNA, 20 bp, Artificial Sequence
  chemically synthesized
gcagattcaaatttatccat

SEQ ID NO: 240094 - DNA, 20 bp, Artificial Sequence
  chemically synthesized
atttgtattaaaattactta

SEQ ID NO: 240095 - DNA, 20 bp, Artificial Sequence
  chemically synthesized
gtaattttaatacaaataat

SEQ ID NO: 240096 - DNA, 20 bp, Artificial Sequence
  chemically synthesized
gaaggtatactcatttgaag

SEQ ID NO: 240097 - DNA, 20 bp, Artificial Sequence
  chemically synthesized
aattggtatccacttcaaat

SEQ ID NO: 240098 - DNA, 20 bp, Artificial Sequence
  chemically synthesized
tcagaaggtatactcatttg

SEQ ID NO: 240099 - DNA, 20 bp, Artificial Sequence
  chemically synthesized
aaatgagtataccttctgaa

SEQ ID NO: 240100 - DNA, 20 bp, Artificial Sequence
  chemically synthesized
aaaccatgtttcttttcaga

SEQ ID NO: 240101 - DNA, 20 bp, Artificial Sequence
  chemically synthesized
aaaaccatgtttcttttcag

SEQ ID NO: 240102 - DNA, 20 bp, Artificial Sequence
  chemically synthesized
aaaaaaaccatgtttctttt

SEQ ID NO: 240103 - DNA, 20 bp, Artificial Sequence
  chemically synthesized
ataccttctgaaaagaaaca

SEQ ID NO: 240104 - DNA, 20 bp, Artificial Sequence
  chemically synthesized
tgttttgttttgttattttt

SEQ ID NO: 240105 - DNA, 20 bp, Artificial Sequence
  chemically synthesized
ttgttttgttatttttgaga

SEQ ID NO: 240106 - DNA, 20 bp, Artificial Sequence
  chemically synthesized
gttttgttatttttgagacg

SEQ ID NO: 240107 - DNA, 20 bp, Artificial Sequence
  chemically synthesized
tccagcctggttgacagagc

SEQ ID NO: 240108 - DNA, 20 bp, Artificial Sequence
  chemically synthesized
cggagtctcgctctgtcaac

SEQ ID NO: 240109 - DNA, 20 bp, Artificial Sequence
  chemically synthesized
gcactccagcctggttgaca

SEQ ID NO: 240110 - DNA, 20 bp, Artificial Sequence
  chemically synthesized
ggagtctcgctctgtcaacc

SEQ ID NO: 240111 - DNA, 20 bp, Artificial Sequence
  chemically synthesized
ctgcactccagcctggttga

SEQ ID NO: 240112 - DNA, 20 bp, Artificial Sequence
  chemically synthesized
tctcgctctgtcaaccaggc

SEQ ID NO: 240113 - DNA, 20 bp, Artificial Sequence
  chemically synthesized
tcgctctgtcaaccaggctg

SEQ ID NO: 240114 - DNA, 20 bp, Artificial Sequence
  chemically synthesized
cgcgccgctgcactccagcc

SEQ ID NO: 240115 - DNA, 20 bp, Artificial Sequence
  chemically synthesized
ctgtcaaccaggctggagtg

SEQ ID NO: 240116 - DNA, 20 bp, Artificial Sequence
  chemically synthesized
gagatcgcgccgctgcactc

SEQ ID NO: 240117 - DNA, 20 bp, Artificial Sequence
  chemically synthesized
tcaaccaggctggagtgcag

SEQ ID NO: 240118 - DNA, 20 bp, Artificial Sequence
  chemically synthesized
ggagtgcagcggcgcgatct

SEQ ID NO: 240119 - DNA, 20 bp, Artificial Sequence
  chemically synthesized
ggcagagcttgtagtgagcc

SEQ ID NO: 240120 - DNA, 20 bp, Artificial Sequence
  chemically synthesized
gcgcgatctcggctcactac

SEQ ID NO: 240121 - DNA, 20 bp, Artificial Sequence
  chemically synthesized
tgggaggcagagcttgtagt

SEQ ID NO: 240122 - DNA, 20 bp, Artificial Sequence
  chemically synthesized
aacctgggaggcagagcttg

SEQ ID NO: 240123 - DNA, 20 bp, Artificial Sequence
  chemically synthesized
tcactacaagctctgcctcc

SEQ ID NO: 240124 - DNA, 20 bp, Artificial Sequence
  chemically synthesized
aggcgtgaacctgggaggca

SEQ ID NO: 240125 - DNA, 20 bp, Artificial Sequence
  chemically synthesized
cactacaagctctgcctccc

SEQ ID NO: 240126 - DNA, 20 bp, Artificial Sequence
  chemically synthesized
aaaggcgtgaacctgggagg

SEQ ID NO: 240127 - DNA, 20 bp, Artificial Sequence
  chemically synthesized
gagaaaggcgtgaacctggg

SEQ ID NO: 240128 - DNA, 20 bp, Artificial Sequence
  chemically synthesized
ggagaaaggcgtgaacctgg

SEQ ID NO: 240129 - DNA, 20 bp, Artificial Sequence
  chemically synthesized
cgggagaaaggcgtgaacct

SEQ ID NO: 240130 - DNA, 20 bp, Artificial Sequence
  chemically synthesized
gcgggagaaaggcgtgaacc

SEQ ID NO: 240131 - DNA, 20 bp, Artificial Sequence
  chemically synthesized
gggaagctgaggcgggagaa

SEQ ID NO: 240132 - DNA, 20 bp, Artificial Sequence
  chemically synthesized
cgggaagctgaggcgggaga

SEQ ID NO: 240133 - DNA, 20 bp, Artificial Sequence
  chemically synthesized
ttcacgcctttctcccgcct

SEQ ID NO: 240134 - DNA, 20 bp, Artificial Sequence
  chemically synthesized
tactcgggaagctgaggcgg

SEQ ID NO: 240135 - DNA, 20 bp, Artificial Sequence
  chemically synthesized
gctactcgggaagctgaggc

SEQ ID NO: 240136 - DNA, 20 bp, Artificial Sequence
  chemically synthesized
agctactcgggaagctgagg

SEQ ID NO: 240137 - DNA, 20 bp, Artificial Sequence
  chemically synthesized
cccagctactcgggaagctg

SEQ ID NO: 240138 - DNA, 20 bp, Artificial Sequence
  chemically synthesized
tcccagctactcgggaagct

SEQ ID NO: 240139 - DNA, 20 bp, Artificial Sequence
  chemically synthesized
ttctcccgcctcagcttccc

SEQ ID NO: 240140 - DNA, 20 bp, Artificial Sequence
  chemically synthesized
tcccgcctcagcttcccgag

SEQ ID NO: 240141 - DNA, 20 bp, Artificial Sequence
  chemically synthesized
tgtagtcccagctactcggg

SEQ ID NO: 240142 - DNA, 20 bp, Artificial Sequence
  chemically synthesized
gcctcagcttcccgagtagc

SEQ ID NO: 240143 - DNA, 20 bp, Artificial Sequence
  chemically synthesized
gcctgtagtcccagctactc

SEQ ID NO: 240144 - DNA, 20 bp, Artificial Sequence
  chemically synthesized
cctcagcttcccgagtagct

SEQ ID NO: 240145 - DNA, 20 bp, Artificial Sequence
  chemically synthesized
cgcctgtagtcccagctact

SEQ ID NO: 240146 - DNA, 20 bp, Artificial Sequence
  chemically synthesized
ttcccgagtagctgggacta

SEQ ID NO: 240147 - DNA, 20 bp, Artificial Sequence
  chemically synthesized
tcccgagtagctgggactac

SEQ ID NO: 240148 - DNA, 20 bp, Artificial Sequence
  chemically synthesized
gtggcgggcgcctgtagtcc

SEQ ID NO: 240149 - DNA, 20 bp, Artificial Sequence
  chemically synthesized
ggcgtggtggcgggcgcctg

SEQ ID NO: 240150 - DNA, 20 bp, Artificial Sequence
  chemically synthesized
aattagccgggcgtggtggc

SEQ ID NO: 240151 - DNA, 20 bp, Artificial Sequence
  chemically synthesized
aaattagccgggcgtggtgg

SEQ ID NO: 240152 - DNA, 20 bp, Artificial Sequence
  chemically synthesized
caggcgcccgccaccacgcc

SEQ ID NO: 240153 - DNA, 20 bp, Artificial Sequence
  chemically synthesized
aaaaaattagccgggcgtgg

SEQ ID NO: 240154 - DNA, 20 bp, Artificial Sequence
  chemically synthesized
tacaaaaaattagccgggcg

SEQ ID NO: 240155 - DNA, 20 bp, Artificial Sequence
  chemically synthesized
aaaaatacaaaaaattagcc

SEQ ID NO: 240156 - DNA, 20 bp, Artificial Sequence
  chemically synthesized
aaaaaatacaaaaaattagc

SEQ ID NO: 240157 - DNA, 20 bp, Artificial Sequence
  chemically synthesized
tactaaaaaatacaaaaaat

SEQ ID NO: 240158 - DNA, 20 bp, Artificial Sequence
  chemically synthesized
ggctaattttttgtattttt

SEQ ID NO: 240159 - DNA, 20 bp, Artificial Sequence
  chemically synthesized
taattttttgtattttttag

SEQ ID NO: 240160 - DNA, 20 bp, Artificial Sequence
  chemically synthesized
attttttgtattttttagta

SEQ ID NO: 240161 - DNA, 20 bp, Artificial Sequence
  chemically synthesized
tttgtattttttagtagaga

SEQ ID NO: 240162 - DNA, 20 bp, Artificial Sequence
  chemically synthesized
ttgtattttttagtagagac

SEQ ID NO: 240163 - DNA, 20 bp, Artificial Sequence
  chemically synthesized
tgtattttttagtagagacg

SEQ ID NO: 240164 - DNA, 20 bp, Artificial Sequence
  chemically synthesized
gagacggggtttcaccttgt

SEQ ID NO: 240165 - DNA, 20 bp, Artificial Sequence
  chemically synthesized
cggggtttcaccttgttggc

SEQ ID NO: 240166 - DNA, 20 bp, Artificial Sequence
  chemically synthesized
cgagaccgtcctggccaaca

SEQ ID NO: 240167 - DNA, 20 bp, Artificial Sequence
  chemically synthesized
ggggtttcaccttgttggcc

SEQ ID NO: 240168 - DNA, 20 bp, Artificial Sequence
  chemically synthesized
tcgagaccgtcctggccaac

SEQ ID NO: 240169 - DNA, 20 bp, Artificial Sequence
  chemically synthesized
tttcaccttgttggccagga

SEQ ID NO: 240170 - DNA, 20 bp, Artificial Sequence
  chemically synthesized
tcaggagatcgagaccgtcc

SEQ ID NO: 240171 - DNA, 20 bp, Artificial Sequence
  chemically synthesized
gatcacgaggtcaggagatc

SEQ ID NO: 240172 - DNA, 20 bp, Artificial Sequence
  chemically synthesized
cagaaggatcacgaggtcag

SEQ ID NO: 240173 - DNA, 20 bp, Artificial Sequence
  chemically synthesized
ggcagaaggatcacgaggtc

SEQ ID NO: 240174 - DNA, 20 bp, Artificial Sequence
  chemically synthesized
aggcagaaggatcacgaggt

SEQ ID NO: 240175 - DNA, 20 bp, Artificial Sequence
  chemically synthesized
gccgaggcagaaggatcacg

SEQ ID NO: 240176 - DNA, 20 bp, Artificial Sequence
  chemically synthesized
ggccgaggcagaaggatcac

SEQ ID NO: 240177 - DNA, 20 bp, Artificial Sequence
  chemically synthesized
acctcgtgatccttctgcct

SEQ ID NO: 240178 - DNA, 20 bp, Artificial Sequence
  chemically synthesized
ctttgggaggccgaggcaga

SEQ ID NO: 240179 - DNA, 20 bp, Artificial Sequence
  chemically synthesized
actttgggaggccgaggcag

SEQ ID NO: 240180 - DNA, 20 bp, Artificial Sequence
  chemically synthesized
agcactttgggaggccgagg

SEQ ID NO: 240181 - DNA, 20 bp, Artificial Sequence
  chemically synthesized
cccagcactttgggaggccg

SEQ ID NO: 240182 - DNA, 20 bp, Artificial Sequence
  chemically synthesized
tcccagcactttgggaggcc

SEQ ID NO: 240183 - DNA, 20 bp, Artificial Sequence
  chemically synthesized
ccttctgcctcggcctccca

SEQ ID NO: 240184 - DNA, 20 bp, Artificial Sequence
  chemically synthesized
tgtaatcccagcactttggg

SEQ ID NO: 240185 - DNA, 20 bp, Artificial Sequence
  chemically synthesized
ctgtaatcccagcactttgg

SEQ ID NO: 240186 - DNA, 20 bp, Artificial Sequence
  chemically synthesized
gcctcggcctcccaaagtgc

SEQ ID NO: 240187 - DNA, 20 bp, Artificial Sequence
  chemically synthesized
gcctgtaatcccagcacttt

SEQ ID NO: 240188 - DNA, 20 bp, Artificial Sequence
  chemically synthesized
cctcggcctcccaaagtgct

SEQ ID NO: 240189 - DNA, 20 bp, Artificial Sequence
  chemically synthesized
cgcctgtaatcccagcactt

SEQ ID NO: 240190 - DNA, 20 bp, Artificial Sequence
  chemically synthesized
ctcccaaagtgctgggatta

SEQ ID NO: 240191 - DNA, 20 bp, Artificial Sequence
  chemically synthesized
tcccaaagtgctgggattac

SEQ ID NO: 240192 - DNA, 20 bp, Artificial Sequence
  chemically synthesized
gtggctcacgcctgtaatcc

SEQ ID NO: 240193 - DNA, 20 bp, Artificial Sequence
  chemically synthesized
agtgctgggattacaggcgt

SEQ ID NO: 240194 - DNA, 20 bp, Artificial Sequence
  chemically synthesized
caggcgtgagccaccgcgcc

SEQ ID NO: 240195 - DNA, 20 bp, Artificial Sequence
  chemically synthesized
atgtttttggccgggcgcgg

SEQ ID NO: 240196 - DNA, 20 bp, Artificial Sequence
  chemically synthesized
aacatgtttttggccgggcg

SEQ ID NO: 240197 - DNA, 20 bp, Artificial Sequence
  chemically synthesized
taaagaacatgtttttggcc

SEQ ID NO: 240198 - DNA, 20 bp, Artificial Sequence
  chemically synthesized
ctaaagaacatgtttttggc

SEQ ID NO: 240199 - DNA, 20 bp, Artificial Sequence
  chemically synthesized
agttctaaagaacatgtttt

SEQ ID NO: 240200 - DNA, 20 bp, Artificial Sequence
  chemically synthesized
ccggccaaaaacatgttctt

SEQ ID NO: 240201 - DNA, 20 bp, Artificial Sequence
  chemically synthesized
atgatactttgggagttcta

SEQ ID NO: 240202 - DNA, 20 bp, Artificial Sequence
  chemically synthesized
catgttctttagaactccca

SEQ ID NO: 240203 - DNA, 20 bp, Artificial Sequence
  chemically synthesized
actaaaagatgatactttgg

SEQ ID NO: 240204 - DNA, 20 bp, Artificial Sequence
  chemically synthesized
atactaaaagatgatacttt

SEQ ID NO: 240205 - DNA, 20 bp, Artificial Sequence
  chemically synthesized
catactaaaagatgatactt

SEQ ID NO: 240206 - DNA, 20 bp, Artificial Sequence
  chemically synthesized
actcccaaagtatcatcttt

SEQ ID NO: 240207 - DNA, 20 bp, Artificial Sequence
  chemically synthesized
aaaaaaaatcttcatactaa

SEQ ID NO: 240208 - DNA, 20 bp, Artificial Sequence
  chemically synthesized
aagtatcatcttttagtatg

SEQ ID NO: 240209 - DNA, 20 bp, Artificial Sequence
  chemically synthesized
tgaagattttttttgaaatt

SEQ ID NO: 240210 - DNA, 20 bp, Artificial Sequence
  chemically synthesized
ttttttttgaaattaagaac

SEQ ID NO: 240211 - DNA, 20 bp, Artificial Sequence
  chemically synthesized
tttttgaaattaagaacaag

SEQ ID NO: 240212 - DNA, 20 bp, Artificial Sequence
  chemically synthesized
agaacaagtagtaaaacaat

SEQ ID NO: 240213 - DNA, 20 bp, Artificial Sequence
  chemically synthesized
gaacaagtagtaaaacaatc

SEQ ID NO: 240214 - DNA, 20 bp, Artificial Sequence
  chemically synthesized
agtaaaacaatcaggttgta

SEQ ID NO: 240215 - DNA, 20 bp, Artificial Sequence
  chemically synthesized
tgtacagcatacaaaatttg

SEQ ID NO: 240216 - DNA, 20 bp, Artificial Sequence
  chemically synthesized
agcatacaaaatttgaagac

SEQ ID NO: 240217 - DNA, 20 bp, Artificial Sequence
  chemically synthesized
atttgaagacaagcaaacgt

SEQ ID NO: 240218 - DNA, 20 bp, Artificial Sequence
  chemically synthesized
agcactgttaggcaataaaa

SEQ ID NO: 240219 - DNA, 20 bp, Artificial Sequence
  chemically synthesized
aattctgttttattgcctaa

SEQ ID NO: 240220 - DNA, 20 bp, Artificial Sequence
  chemically synthesized
gaagtttacaaagcactgtt

SEQ ID NO: 240221 - DNA, 20 bp, Artificial Sequence
  chemically synthesized
tgaagtttacaaagcactgt

SEQ ID NO: 240222 - DNA, 20 bp, Artificial Sequence
  chemically synthesized
atcacttgctgaagtttaca

SEQ ID NO: 240223 - DNA, 20 bp, Artificial Sequence
  chemically synthesized
taacagtgctttgtaaactt

SEQ ID NO: 240224 - DNA, 20 bp, Artificial Sequence
  chemically synthesized
agtgctttgtaaacttcagc

SEQ ID NO: 240225 - DNA, 20 bp, Artificial Sequence
  chemically synthesized
ggaaattaaatcacttgctg

SEQ ID NO: 240226 - DNA, 20 bp, Artificial Sequence
  chemically synthesized
gtgatttaatttcctgattt

SEQ ID NO: 240227 - DNA, 20 bp, Artificial Sequence
  chemically synthesized
gatttaatttcctgatttca

SEQ ID NO: 240228 - DNA, 20 bp, Artificial Sequence
  chemically synthesized
caaatgagaactctgaaatc

SEQ ID NO: 240229 - DNA, 20 bp, Artificial Sequence
  chemically synthesized
acaaatgagaactctgaaat

SEQ ID NO: 240230 - DNA, 20 bp, Artificial Sequence
  chemically synthesized
attatgcctatttcacaaat

SEQ ID NO: 240231 - DNA, 20 bp, Artificial Sequence
  chemically synthesized
cagagttctcatttgtgaaa

SEQ ID NO: 240232 - DNA, 20 bp, Artificial Sequence
  chemically synthesized
agagttctcatttgtgaaat

SEQ ID NO: 240233 - DNA, 20 bp, Artificial Sequence
  chemically synthesized
taggcataatatatatttca

SEQ ID NO: 240234 - DNA, 20 bp, Artificial Sequence
  chemically synthesized
aggcataatatatatttcac

SEQ ID NO: 240235 - DNA, 20 bp, Artificial Sequence
  chemically synthesized
ggcataatatatatttcaca

SEQ ID NO: 240236 - DNA, 20 bp, Artificial Sequence
  chemically synthesized
atatttcacagggttgttat

SEQ ID NO: 240237 - DNA, 20 bp, Artificial Sequence
  chemically synthesized
tataagaattaaaaataata

SEQ ID NO: 240238 - DNA, 20 bp, Artificial Sequence
  chemically synthesized
gaattaaaaataatacagtg

SEQ ID NO: 240239 - DNA, 20 bp, Artificial Sequence
  chemically synthesized
ataatacagtgaagttttct

SEQ ID NO: 240240 - DNA, 20 bp, Artificial Sequence
  chemically synthesized
agtgaagttttctgagccca

SEQ ID NO: 240241 - DNA, 20 bp, Artificial Sequence
  chemically synthesized
ttgagcacttactatgggct

SEQ ID NO: 240242 - DNA, 20 bp, Artificial Sequence
  chemically synthesized
aagttttctgagcccatagt

SEQ ID NO: 240243 - DNA, 20 bp, Artificial Sequence
  chemically synthesized
caccattgagcacttactat

SEQ ID NO: 240244 - DNA, 20 bp, Artificial Sequence
  chemically synthesized
ccaccattgagcacttacta

SEQ ID NO: 240245 - DNA, 20 bp, Artificial Sequence
  chemically synthesized
agcccatagtaagtgctcaa

SEQ ID NO: 240246 - DNA, 20 bp, Artificial Sequence
  chemically synthesized
ccatagtaagtgctcaatgg

SEQ ID NO: 240247 - DNA, 20 bp, Artificial Sequence
  chemically synthesized
ttattgttattgccaccatt

SEQ ID NO: 240248 - DNA, 20 bp, Artificial Sequence
  chemically synthesized
ttatatactgtatatatatt

SEQ ID NO: 240249 - DNA, 20 bp, Artificial Sequence
  chemically synthesized
ataatatccaaatatatata

SEQ ID NO: 240250 - DNA, 20 bp, Artificial Sequence
  chemically synthesized
agtatataatttctgttatt

SEQ ID NO: 240251 - DNA, 20 bp, Artificial Sequence
  chemically synthesized
acttaatattttctaaataa

SEQ ID NO: 240252 - DNA, 20 bp, Artificial Sequence
  chemically synthesized
tctgttatttagaaaatatt

SEQ ID NO: 240253 - DNA, 20 bp, Artificial Sequence
  chemically synthesized
tattttcaatatctatgaat

SEQ ID NO: 240254 - DNA, 20 bp, Artificial Sequence
  chemically synthesized
attttcaatatctatgaatg

SEQ ID NO: 240255 - DNA, 20 bp, Artificial Sequence
  chemically synthesized
atacatattttcctcattca

SEQ ID NO: 240256 - DNA, 20 bp, Artificial Sequence
  chemically synthesized
aatgaggaaatgtataaaat

SEQ ID NO: 240257 - DNA, 20 bp, Artificial Sequence
  chemically synthesized
gattttatacatttcctcat

SEQ ID NO: 240258 - DNA, 20 bp, Artificial Sequence
  chemically synthesized
acaactttcatgtgccaatg

SEQ ID NO: 240259 - DNA, 20 bp, Artificial Sequence
  chemically synthesized
tacaactttcatgtgccaat

SEQ ID NO: 240260 - DNA, 20 bp, Artificial Sequence
  chemically synthesized
atttcctcattggcacatga

SEQ ID NO: 240261 - DNA, 20 bp, Artificial Sequence
  chemically synthesized
acatgaaagttgtatatctt

SEQ ID NO: 240262 - DNA, 20 bp, Artificial Sequence
  chemically synthesized
aagaagactaaatttagctg

SEQ ID NO: 240263 - DNA, 20 bp, Artificial Sequence
  chemically synthesized
tgtatatcttcagctaaatt

SEQ ID NO: 240264 - DNA, 20 bp, Artificial Sequence
  chemically synthesized
aagggcaagaagactaaatt

SEQ ID NO: 240265 - DNA, 20 bp, Artificial Sequence
  chemically synthesized
tttgagccttaaagggcaag

SEQ ID NO: 240266 - DNA, 20 bp, Artificial Sequence
  chemically synthesized
atttagtcttcttgcccttt

SEQ ID NO: 240267 - DNA, 20 bp, Artificial Sequence
  chemically synthesized
atgtttgagccttaaagggc

SEQ ID NO: 240268 - DNA, 20 bp, Artificial Sequence
  chemically synthesized
tttagtcttcttgcccttta

SEQ ID NO: 240269 - DNA, 20 bp, Artificial Sequence
  chemically synthesized
taaaatgtttgagccttaaa

SEQ ID NO: 240270 - DNA, 20 bp, Artificial Sequence
  chemically synthesized
gtaaaatgtttgagccttaa

SEQ ID NO: 240271 - DNA, 20 bp, Artificial Sequence
  chemically synthesized
agtaaaatgtttgagcctta

SEQ ID NO: 240272 - DNA, 20 bp, Artificial Sequence
  chemically synthesized
ttacacatagtaaaatgttt

SEQ ID NO: 240273 - DNA, 20 bp, Artificial Sequence
  chemically synthesized
gcagtaaaatcatttacaca

SEQ ID NO: 240274 - DNA, 20 bp, Artificial Sequence
  chemically synthesized
ggtttgcccaattacaatag

SEQ ID NO: 240275 - DNA, 20 bp, Artificial Sequence
  chemically synthesized
gattttactgctattgtaat

SEQ ID NO: 240276 - DNA, 20 bp, Artificial Sequence
  chemically synthesized
tttggtttgcccaattacaa

SEQ ID NO: 240277 - DNA, 20 bp, Artificial Sequence
  chemically synthesized
attttactgctattgtaatt

SEQ ID NO: 240278 - DNA, 20 bp, Artificial Sequence
  chemically synthesized
tccatttactgtaattgttt

SEQ ID NO: 240279 - DNA, 20 bp, Artificial Sequence
  chemically synthesized
tgggcaaaccaaaacaatta

SEQ ID NO: 240280 - DNA, 20 bp, Artificial Sequence
  chemically synthesized
accaaaacaattacagtaaa

SEQ ID NO: 240281 - DNA, 20 bp, Artificial Sequence
  chemically synthesized
ccctcgttgagaacgaaaca

SEQ ID NO: 240282 - DNA, 20 bp, Artificial Sequence
  chemically synthesized
gtctttgtttcgttctcaac

SEQ ID NO: 240283 - DNA, 20 bp, Artificial Sequence
  chemically synthesized
tctttgtttcgttctcaacg

SEQ ID NO: 240284 - DNA, 20 bp, Artificial Sequence
  chemically synthesized
ctttgtttcgttctcaacga

SEQ ID NO: 240285 - DNA, 20 bp, Artificial Sequence
  chemically synthesized
ttgtttcgttctcaacgagg

SEQ ID NO: 240286 - DNA, 20 bp, Artificial Sequence
  chemically synthesized
tgtactgttcctccctcgtt

SEQ ID NO: 240287 - DNA, 20 bp, Artificial Sequence
  chemically synthesized
tgtttcgttctcaacgaggg

SEQ ID NO: 240288 - DNA, 20 bp, Artificial Sequence
  chemically synthesized
cgttctcaacgagggaggaa

SEQ ID NO: 240289 - DNA, 20 bp, Artificial Sequence
  chemically synthesized
gaggaacagtacacttaaca

SEQ ID NO: 240290 - DNA, 20 bp, Artificial Sequence
  chemically synthesized
aatttttttgtagctgtgtt

SEQ ID NO: 240291 - DNA, 20 bp, Artificial Sequence
  chemically synthesized
aagtaagttaaatttttttg

SEQ ID NO: 240292 - DNA, 20 bp, Artificial Sequence
  chemically synthesized
ttcctttagcagaaaaaagt

SEQ ID NO: 240293 - DNA, 20 bp, Artificial Sequence
  chemically synthesized
cattttcctttagcagaaaa

SEQ ID NO: 240294 - DNA, 20 bp, Artificial Sequence
  chemically synthesized
taacttacttttttctgcta

SEQ ID NO: 240295 - DNA, 20 bp, Artificial Sequence
  chemically synthesized
aacttacttttttctgctaa

SEQ ID NO: 240296 - DNA, 20 bp, Artificial Sequence
  chemically synthesized
ttcatctcattttcctttag

SEQ ID NO: 240297 - DNA, 20 bp, Artificial Sequence
  chemically synthesized
tttttcatctcattttcctt

SEQ ID NO: 240298 - DNA, 20 bp, Artificial Sequence
  chemically synthesized
tttttctgctaaaggaaaat

SEQ ID NO: 240299 - DNA, 20 bp, Artificial Sequence
  chemically synthesized
taaaggaaaatgagatgaaa

SEQ ID NO: 240300 - DNA, 20 bp, Artificial Sequence
  chemically synthesized
ccattcgttttaaaataaaa

SEQ ID NO: 240301 - DNA, 20 bp, Artificial Sequence
  chemically synthesized
ccattttattttaaaacgaa

SEQ ID NO: 240302 - DNA, 20 bp, Artificial Sequence
  chemically synthesized
ttttattttaaaacgaatgg

SEQ ID NO: 240303 - DNA, 20 bp, Artificial Sequence
  chemically synthesized
gaatggcagattttgatttc

SEQ ID NO: 240304 - DNA, 20 bp, Artificial Sequence
  chemically synthesized
aatggcagattttgatttcg

SEQ ID NO: 240305 - DNA, 20 bp, Artificial Sequence
  chemically synthesized
gcagattttgatttcgaggc

SEQ ID NO: 240306 - DNA, 20 bp, Artificial Sequence
  chemically synthesized
attttgatttcgaggcaagt

SEQ ID NO: 240307 - DNA, 20 bp, Artificial Sequence
  chemically synthesized
ttttgatttcgaggcaagta

SEQ ID NO: 240308 - DNA, 20 bp, Artificial Sequence
  chemically synthesized
atttcgtgttatcttcccaa

SEQ ID NO: 240309 - DNA, 20 bp, Artificial Sequence
  chemically synthesized
attctcaccatacttttggg

SEQ ID NO: 240310 - DNA, 20 bp, Artificial Sequence
  chemically synthesized
gtgttatcttcccaaaagta

SEQ ID NO: 240311 - DNA, 20 bp, Artificial Sequence
  chemically synthesized
cgtattctcaccatactttt

SEQ ID NO: 240312 - DNA, 20 bp, Artificial Sequence
  chemically synthesized
tcgtattctcaccatacttt

SEQ ID NO: 240313 - DNA, 20 bp, Artificial Sequence
  chemically synthesized
tatcttcccaaaagtatggt

SEQ ID NO: 240314 - DNA, 20 bp, Artificial Sequence
  chemically synthesized
gaatacgaattccaaatatg

SEQ ID NO: 240315 - DNA, 20 bp, Artificial Sequence
  chemically synthesized
ttattcatactccgcatatt

SEQ ID NO: 240316 - DNA, 20 bp, Artificial Sequence
  chemically synthesized
atacgaattccaaatatgcg

SEQ ID NO: 240317 - DNA, 20 bp, Artificial Sequence
  chemically synthesized
tgcggagtatgaataaaaaa

SEQ ID NO: 240318 - DNA, 20 bp, Artificial Sequence
  chemically synthesized
gagtatgaataaaaaataga

SEQ ID NO: 240319 - DNA, 20 bp, Artificial Sequence
  chemically synthesized
agtatgaataaaaaatagaa

SEQ ID NO: 240320 - DNA, 20 bp, Artificial Sequence
  chemically synthesized
aggtatgacatttttcttct

SEQ ID NO: 240321 - DNA, 20 bp, Artificial Sequence
  chemically synthesized
ggtatgacatttttcttctt

SEQ ID NO: 240322 - DNA, 20 bp, Artificial Sequence
  chemically synthesized
atgacatttttcttcttagg

SEQ ID NO: 240323 - DNA, 20 bp, Artificial Sequence
  chemically synthesized
tatcattttggctgcctaag

SEQ ID NO: 240324 - DNA, 20 bp, Artificial Sequence
  chemically synthesized
aaatatcattttggctgcct

SEQ ID NO: 240325 - DNA, 20 bp, Artificial Sequence
  chemically synthesized
ctatggaagaaatatcattt

SEQ ID NO: 240326 - DNA, 20 bp, Artificial Sequence
  chemically synthesized
ccaaaatgatatttcttcca

SEQ ID NO: 240327 - DNA, 20 bp, Artificial Sequence
  chemically synthesized
caaaatgatatttcttccat

SEQ ID NO: 240328 - DNA, 20 bp, Artificial Sequence
  chemically synthesized
tttgccgcagcagcctatgg

SEQ ID NO: 240329 - DNA, 20 bp, Artificial Sequence
  chemically synthesized
tgatttgccgcagcagccta

SEQ ID NO: 240330 - DNA, 20 bp, Artificial Sequence
  chemically synthesized
atttcttccataggctgctg

SEQ ID NO: 240331 - DNA, 20 bp, Artificial Sequence
  chemically synthesized
tgtattttgatttgccgcag

SEQ ID NO: 240332 - DNA, 20 bp, Artificial Sequence
  chemically synthesized
tggtgtattttgatttgccg

SEQ ID NO: 240333 - DNA, 20 bp, Artificial Sequence
  chemically synthesized
caaatcaaaatacaccactt

SEQ ID NO: 240334 - DNA, 20 bp, Artificial Sequence
  chemically synthesized
tttcgtaagctgatctcaag

SEQ ID NO: 240335 - DNA, 20 bp, Artificial Sequence
  chemically synthesized
caaaatacaccacttgagat

SEQ ID NO: 240336 - DNA, 20 bp, Artificial Sequence
  chemically synthesized
cattttcgtaagctgatctc

SEQ ID NO: 240337 - DNA, 20 bp, Artificial Sequence
  chemically synthesized
tgtaaaagggacattttcgt

SEQ ID NO: 240338 - DNA, 20 bp, Artificial Sequence
  chemically synthesized
acgaaaatgtcccttttaca

SEQ ID NO: 240339 - DNA, 20 bp, Artificial Sequence
  chemically synthesized
aaaatgagtcccatgtaaaa

SEQ ID NO: 240340 - DNA, 20 bp, Artificial Sequence
  chemically synthesized
cgaaaatgtcccttttacat

SEQ ID NO: 240341 - DNA, 20 bp, Artificial Sequence
  chemically synthesized
gaaaatgagtcccatgtaaa

SEQ ID NO: 240342 - DNA, 20 bp, Artificial Sequence
  chemically synthesized
agaaaatgagtcccatgtaa

SEQ ID NO: 240343 - DNA, 20 bp, Artificial Sequence
  chemically synthesized
tttttatggccaaagaaaat

SEQ ID NO: 240344 - DNA, 20 bp, Artificial Sequence
  chemically synthesized
tacatgggactcattttctt

SEQ ID NO: 240345 - DNA, 20 bp, Artificial Sequence
  chemically synthesized
tctttaattttttatggcca

SEQ ID NO: 240346 - DNA, 20 bp, Artificial Sequence
  chemically synthesized
tcttaatctttaatttttta

SEQ ID NO: 240347 - DNA, 20 bp, Artificial Sequence
  chemically synthesized
tctttggccataaaaaatta

SEQ ID NO: 240348 - DNA, 20 bp, Artificial Sequence
  chemically synthesized
gccataaaaaattaaagatt

SEQ ID NO: 240349 - DNA, 20 bp, Artificial Sequence
  chemically synthesized
tatatattcaaagatagaca

SEQ ID NO: 240350 - DNA, 20 bp, Artificial Sequence
  chemically synthesized
catatatattcaaagataga

SEQ ID NO: 240351 - DNA, 20 bp, Artificial Sequence
  chemically synthesized
atgccatatatattcaaaga

SEQ ID NO: 240352 - DNA, 20 bp, Artificial Sequence
  chemically synthesized
tctcatgccatatatattca

SEQ ID NO: 240353 - DNA, 20 bp, Artificial Sequence
  chemically synthesized
tgtctatctttgaatatata

SEQ ID NO: 240354 - DNA, 20 bp, Artificial Sequence
  chemically synthesized
tctttgaatatatatggcat

SEQ ID NO: 240355 - DNA, 20 bp, Artificial Sequence
  chemically synthesized
tatttatgtatttgtaagtg

SEQ ID NO: 240356 - DNA, 20 bp, Artificial Sequence
  chemically synthesized
agttttatttatgtatttgt

SEQ ID NO: 240357 - DNA, 20 bp, Artificial Sequence
  chemically synthesized
aagtaaaaagtgaattgttt

SEQ ID NO: 240358 - DNA, 20 bp, Artificial Sequence
  chemically synthesized
gaaacaattcactttttact

SEQ ID NO: 240359 - DNA, 20 bp, Artificial Sequence
  chemically synthesized
ttagaataaagctaagtaaa

SEQ ID NO: 240360 - DNA, 20 bp, Artificial Sequence
  chemically synthesized
ttcccgtttagaataaagct

SEQ ID NO: 240361 - DNA, 20 bp, Artificial Sequence
  chemically synthesized
agaatttcccgtttagaata

SEQ ID NO: 240362 - DNA, 20 bp, Artificial Sequence
  chemically synthesized
ttacttagctttattctaaa

SEQ ID NO: 240363 - DNA, 20 bp, Artificial Sequence
  chemically synthesized
tacttagctttattctaaac

SEQ ID NO: 240364 - DNA, 20 bp, Artificial Sequence
  chemically synthesized
agaaaatagaatttcccgtt

SEQ ID NO: 240365 - DNA, 20 bp, Artificial Sequence
  chemically synthesized
aatagtagtaagagagaaaa

SEQ ID NO: 240366 - DNA, 20 bp, Artificial Sequence
  chemically synthesized
aaagtagaatagtagtaaga

SEQ ID NO: 240367 - DNA, 20 bp, Artificial Sequence
  chemically synthesized
agaaagtagaatagtagtaa

SEQ ID NO: 240368 - DNA, 20 bp, Artificial Sequence
  chemically synthesized
agagaaagtagaatagtagt

SEQ ID NO: 240369 - DNA, 20 bp, Artificial Sequence
  chemically synthesized
aaatagagaaagtagaatag

SEQ ID NO: 240370 - DNA, 20 bp, Artificial Sequence
  chemically synthesized
agaaaatagagaaagtagaa

SEQ ID NO: 240371 - DNA, 20 bp, Artificial Sequence
  chemically synthesized
gtgagagaaaatagagaaag

SEQ ID NO: 240372 - DNA, 20 bp, Artificial Sequence
  chemically synthesized
ccagtgagagaaaatagaga

SEQ ID NO: 240373 - DNA, 20 bp, Artificial Sequence
  chemically synthesized
ggtgccagtgagagaaaata

SEQ ID NO: 240374 - DNA, 20 bp, Artificial Sequence
  chemically synthesized
atggtgccagtgagagaaaa

SEQ ID NO: 240375 - DNA, 20 bp, Artificial Sequence
  chemically synthesized
ctttctctattttctctcac

SEQ ID NO: 240376 - DNA, 20 bp, Artificial Sequence
  chemically synthesized
gaaggtaatggtgccagtga

SEQ ID NO: 240377 - DNA, 20 bp, Artificial Sequence
  chemically synthesized
tggaaggtaatggtgccagt

SEQ ID NO: 240378 - DNA, 20 bp, Artificial Sequence
  chemically synthesized
cttgtggaaggtaatggtgc

SEQ ID NO: 240379 - DNA, 20 bp, Artificial Sequence
  chemically synthesized
aacagtcttgtggaaggtaa

SEQ ID NO: 240380 - DNA, 20 bp, Artificial Sequence
  chemically synthesized
ctggcaccattaccttccac

SEQ ID NO: 240381 - DNA, 20 bp, Artificial Sequence
  chemically synthesized
aggaaaaacagtcttgtgga

SEQ ID NO: 240382 - DNA, 20 bp, Artificial Sequence
  chemically synthesized
caggaaaaacagtcttgtgg

SEQ ID NO: 240383 - DNA, 20 bp, Artificial Sequence
  chemically synthesized
tcacaggaaaaacagtcttg

SEQ ID NO: 240384 - DNA, 20 bp, Artificial Sequence
  chemically synthesized
aactaccttcacaggaaaaa

SEQ ID NO: 240385 - DNA, 20 bp, Artificial Sequence
  chemically synthesized
acaagactgtttttcctgtg

SEQ ID NO: 240386 - DNA, 20 bp, Artificial Sequence
  chemically synthesized
caagactgtttttcctgtga

SEQ ID NO: 240387 - DNA, 20 bp, Artificial Sequence
  chemically synthesized
gactgtttttcctgtgaagg

SEQ ID NO: 240388 - DNA, 20 bp, Artificial Sequence
  chemically synthesized
ttaattataactaccttcac

SEQ ID NO: 240389 - DNA, 20 bp, Artificial Sequence
  chemically synthesized
gttaattataactaccttca

SEQ ID NO: 240390 - DNA, 20 bp, Artificial Sequence
  chemically synthesized
tgaaggtagttataattaac

SEQ ID NO: 240391 - DNA, 20 bp, Artificial Sequence
  chemically synthesized
aaggtagttataattaacaa

SEQ ID NO: 240392 - DNA, 20 bp, Artificial Sequence
  chemically synthesized
gaaaacttttatgtgtgtat

SEQ ID NO: 240393 - DNA, 20 bp, Artificial Sequence
  chemically synthesized
tgaaaacttttatgtgtgta

SEQ ID NO: 240394 - DNA, 20 bp, Artificial Sequence
  chemically synthesized
aagagcctatacacacataa

SEQ ID NO: 240395 - DNA, 20 bp, Artificial Sequence
  chemically synthesized
aaagttttcatttaccatat

SEQ ID NO: 240396 - DNA, 20 bp, Artificial Sequence
  chemically synthesized
gcttgatatgttcactaata

SEQ ID NO: 240397 - DNA, 20 bp, Artificial Sequence
  chemically synthesized
accatattagtgaacatatc

SEQ ID NO: 240398 - DNA, 20 bp, Artificial Sequence
  chemically synthesized
gtaaacattaagaaaaatga

SEQ ID NO: 240399 - DNA, 20 bp, Artificial Sequence
  chemically synthesized
agtaaaacttagtaaacatt

SEQ ID NO: 240400 - DNA, 20 bp, Artificial Sequence
  chemically synthesized
catttttcttaatgtttact

SEQ ID NO: 240401 - DNA, 20 bp, Artificial Sequence
  chemically synthesized
ggtttcaataaagtaaaact

SEQ ID NO: 240402 - DNA, 20 bp, Artificial Sequence
  chemically synthesized
ctttgagattggtttcaata

SEQ ID NO: 240403 - DNA, 20 bp, Artificial Sequence
  chemically synthesized
ctttattgaaaccaatctca

SEQ ID NO: 240404 - DNA, 20 bp, Artificial Sequence
  chemically synthesized
tttattgaaaccaatctcaa

SEQ ID NO: 240405 - DNA, 20 bp, Artificial Sequence
  chemically synthesized
aatgctgcaacctttgagat

SEQ ID NO: 240406 - DNA, 20 bp, Artificial Sequence
  chemically synthesized
ttttaaatgctgcaaccttt

SEQ ID NO: 240407 - DNA, 20 bp, Artificial Sequence
  chemically synthesized
gaaaccaatctcaaaggttg

SEQ ID NO: 240408 - DNA, 20 bp, Artificial Sequence
  chemically synthesized
aaaggttgcagcatttaaaa

SEQ ID NO: 240409 - DNA, 20 bp, Artificial Sequence
  chemically synthesized
tggaaaattattttataatt

SEQ ID NO: 240410 - DNA, 20 bp, Artificial Sequence
  chemically synthesized
aattataaaataattttcca

SEQ ID NO: 240411 - DNA, 20 bp, Artificial Sequence
  chemically synthesized
ataaaataattttccaaaga

SEQ ID NO: 240412 - DNA, 20 bp, Artificial Sequence
  chemically synthesized
ttggaatttttttctttctt

SEQ ID NO: 240413 - DNA, 20 bp, Artificial Sequence
  chemically synthesized
ccaacttataaaagtaaaat

SEQ ID NO: 240414 - DNA, 20 bp, Artificial Sequence
  chemically synthesized
aattccaattttacttttat

SEQ ID NO: 240415 - DNA, 20 bp, Artificial Sequence
  chemically synthesized
tagtaaattccaacttataa

SEQ ID NO: 240416 - DNA, 20 bp, Artificial Sequence
  chemically synthesized
ccaattttacttttataagt

SEQ ID NO: 240417 - DNA, 20 bp, Artificial Sequence
  chemically synthesized
actatatttgtgtgtatata

SEQ ID NO: 240418 - DNA, 20 bp, Artificial Sequence
  chemically synthesized
actatatatacacacaaata

SEQ ID NO: 240419 - DNA, 20 bp, Artificial Sequence
  chemically synthesized
gtgtttgcaacacacaaata

SEQ ID NO: 240420 - DNA, 20 bp, Artificial Sequence
  chemically synthesized
caaatatagtattattgaaa

SEQ ID NO: 240421 - DNA, 20 bp, Artificial Sequence
  chemically synthesized
aaatatagtattattgaaaa

SEQ ID NO: 240422 - DNA, 20 bp, Artificial Sequence
  chemically synthesized
atatagtattattgaaaaag

SEQ ID NO: 240423 - DNA, 20 bp, Artificial Sequence
  chemically synthesized
tatagtattattgaaaaagg

SEQ ID NO: 240424 - DNA, 20 bp, Artificial Sequence
  chemically synthesized
ttattgaaaaaggaggaatt

SEQ ID NO: 240425 - DNA, 20 bp, Artificial Sequence
  chemically synthesized
aggaggaatttagatgttcc

SEQ ID NO: 240426 - DNA, 20 bp, Artificial Sequence
  chemically synthesized
aggaatttagatgttccaag

SEQ ID NO: 240427 - DNA, 20 bp, Artificial Sequence
  chemically synthesized
aattttctgttaatgccact

SEQ ID NO: 240428 - DNA, 20 bp, Artificial Sequence
  chemically synthesized
gatgttccaagtggcattaa

SEQ ID NO: 240429 - DNA, 20 bp, Artificial Sequence
  chemically synthesized
aagtggcattaacagaaaat

SEQ ID NO: 240430 - DNA, 20 bp, Artificial Sequence
  chemically synthesized
atgctaatctggcataattt

SEQ ID NO: 240431 - DNA, 20 bp, Artificial Sequence
  chemically synthesized
aattagttctgaaattatgc

SEQ ID NO: 240432 - DNA, 20 bp, Artificial Sequence
  chemically synthesized
gttctgaaattatgccagat

SEQ ID NO: 240433 - DNA, 20 bp, Artificial Sequence
  chemically synthesized
ttctagttgaaatgctaatc

SEQ ID NO: 240434 - DNA, 20 bp, Artificial Sequence
  chemically synthesized
tgccagattagcatttcaac

SEQ ID NO: 240435 - DNA, 20 bp, Artificial Sequence
  chemically synthesized
tgctaatctggcataatttc

SEQ ID NO: 240436 - DNA, 20 bp, Artificial Sequence
  chemically synthesized
atttcaactagaaattatgc

SEQ ID NO: 240437 - DNA, 20 bp, Artificial Sequence
  chemically synthesized
aactagaaattatgccagat

SEQ ID NO: 240438 - DNA, 20 bp, Artificial Sequence
  chemically synthesized
ttctagttgaaatgctaatc

SEQ ID NO: 240439 - DNA, 20 bp, Artificial Sequence
  chemically synthesized
tgccagattagcatttcaac

SEQ ID NO: 240440 - DNA, 20 bp, Artificial Sequence
  chemically synthesized
attagcatttcaactagaaa

SEQ ID NO: 240441 - DNA, 20 bp, Artificial Sequence
  chemically synthesized
aagtttttccttgctatttc

SEQ ID NO: 240442 - DNA, 20 bp, Artificial Sequence
  chemically synthesized
gcatttcaactagaaatagc

SEQ ID NO: 240443 - DNA, 20 bp, Artificial Sequence
  chemically synthesized
catttcaactagaaatagca

SEQ ID NO: 240444 - DNA, 20 bp, Artificial Sequence
  chemically synthesized
aaatagcaaggaaaaacttc

SEQ ID NO: 240445 - DNA, 20 bp, Artificial Sequence
  chemically synthesized
aatagcaaggaaaaacttct

SEQ ID NO: 240446 - DNA, 20 bp, Artificial Sequence
  chemically synthesized
tatgacctcttatagcctag

SEQ ID NO: 240447 - DNA, 20 bp, Artificial Sequence
  chemically synthesized
aggaaaaacttctaggctat

SEQ ID NO: 240448 - DNA, 20 bp, Artificial Sequence
  chemically synthesized
acttatgacctcttatagcc

SEQ ID NO: 240449 - DNA, 20 bp, Artificial Sequence
  chemically synthesized
gaaaaacttctaggctataa

SEQ ID NO: 240450 - DNA, 20 bp, Artificial Sequence
  chemically synthesized
aaaaacttctaggctataag

SEQ ID NO: 240451 - DNA, 20 bp, Artificial Sequence
  chemically synthesized
ttactacttatgacctctta

SEQ ID NO: 240452 - DNA, 20 bp, Artificial Sequence
  chemically synthesized
tctaggctataagaggtcat

SEQ ID NO: 240453 - DNA, 20 bp, Artificial Sequence
  chemically synthesized
aggctataagaggtcataag

SEQ ID NO: 240454 - DNA, 20 bp, Artificial Sequence
  chemically synthesized
ataagaggtcataagtagta

SEQ ID NO: 240455 - DNA, 20 bp, Artificial Sequence
  chemically synthesized
tcataagtagtaaagaaaat

SEQ ID NO: 240456 - DNA, 20 bp, Artificial Sequence
  chemically synthesized
aagaaaataagaactatttt

SEQ ID NO: 240457 - DNA, 20 bp, Artificial Sequence
  chemically synthesized
agaaaataagaactattttc

SEQ ID NO: 240458 - DNA, 20 bp, Artificial Sequence
  chemically synthesized
aaaataagaactattttcag

SEQ ID NO: 240459 - DNA, 20 bp, Artificial Sequence
  chemically synthesized
taggtcatgtctcctgaaaa

SEQ ID NO: 240460 - DNA, 20 bp, Artificial Sequence
  chemically synthesized
ggagacatgacctattctgc

SEQ ID NO: 240461 - DNA, 20 bp, Artificial Sequence
  chemically synthesized
ggtgcaactcccggcagaat

SEQ ID NO: 240462 - DNA, 20 bp, Artificial Sequence
  chemically synthesized
gagacatgacctattctgcc

SEQ ID NO: 240463 - DNA, 20 bp, Artificial Sequence
  chemically synthesized
gggtgcaactcccggcagaa

SEQ ID NO: 240464 - DNA, 20 bp, Artificial Sequence
  chemically synthesized
gacatgacctattctgccgg

SEQ ID NO: 240465 - DNA, 20 bp, Artificial Sequence
  chemically synthesized
cttatgggtgcaactcccgg

SEQ ID NO: 240466 - DNA, 20 bp, Artificial Sequence
  chemically synthesized
tgccttatgggtgcaactcc

SEQ ID NO: 240467 - DNA, 20 bp, Artificial Sequence
  chemically synthesized
ctgccgggagttgcacccat

SEQ ID NO: 240468 - DNA, 20 bp, Artificial Sequence
  chemically synthesized
tgccgggagttgcacccata

SEQ ID NO: 240469 - DNA, 20 bp, Artificial Sequence
  chemically synthesized
cgggagttgcacccataagg

SEQ ID NO: 240470 - DNA, 20 bp, Artificial Sequence
  chemically synthesized
acccgttccctctgccttat

SEQ ID NO: 240471 - DNA, 20 bp, Artificial Sequence
  chemically synthesized
ggagttgcacccataaggca

SEQ ID NO: 240472 - DNA, 20 bp, Artificial Sequence
  chemically synthesized
gacccgttccctctgcctta

SEQ ID NO: 240473 - DNA, 20 bp, Artificial Sequence
  chemically synthesized
gagttgcacccataaggcag

SEQ ID NO: 240474 - DNA, 20 bp, Artificial Sequence
  chemically synthesized
agttgcacccataaggcaga

SEQ ID NO: 240475 - DNA, 20 bp, Artificial Sequence
  chemically synthesized
cacccataaggcagagggaa

SEQ ID NO: 240476 - DNA, 20 bp, Artificial Sequence
  chemically synthesized
acccataaggcagagggaac

SEQ ID NO: 240477 - DNA, 20 bp, Artificial Sequence
  chemically synthesized
atttttataagaaaatattt

SEQ ID NO: 240478 - DNA, 20 bp, Artificial Sequence
  chemically synthesized
aaaatattttcttataaaaa

SEQ ID NO: 240479 - DNA, 20 bp, Artificial Sequence
  chemically synthesized
tactgtatctctatttttat

SEQ ID NO: 240480 - DNA, 20 bp, Artificial Sequence
  chemically synthesized
aatattttcttataaaaata

SEQ ID NO: 240481 - DNA, 20 bp, Artificial Sequence
  chemically synthesized
ttcttataaaaatagagata

SEQ ID NO: 240482 - DNA, 20 bp, Artificial Sequence
  chemically synthesized
gagatacagtaattaatttc

SEQ ID NO: 240483 - DNA, 20 bp, Artificial Sequence
  chemically synthesized
agatacagtaattaatttca

SEQ ID NO: 240484 - DNA, 20 bp, Artificial Sequence
  chemically synthesized
tacagtaattaatttcaagg

SEQ ID NO: 240485 - DNA, 20 bp, Artificial Sequence
  chemically synthesized
attaatttcaaggcagattt

SEQ ID NO: 240486 - DNA, 20 bp, Artificial Sequence
  chemically synthesized
tttaacaaatttatcaaaaa

SEQ ID NO: 240487 - DNA, 20 bp, Artificial Sequence
  chemically synthesized
gttaaatcaattaaatatgc

SEQ ID NO: 240488 - DNA, 20 bp, Artificial Sequence
  chemically synthesized
ttaaatcaattaaatatgcc

SEQ ID NO: 240489 - DNA, 20 bp, Artificial Sequence
  chemically synthesized
taaatcaattaaatatgcca

SEQ ID NO: 240490 - DNA, 20 bp, Artificial Sequence
  chemically synthesized
aaatcaattaaatatgccag

SEQ ID NO: 240491 - DNA, 20 bp, Artificial Sequence
  chemically synthesized
tactcctaataaggggcccc

SEQ ID NO: 240492 - DNA, 20 bp, Artificial Sequence
  chemically synthesized
atatgccaggggccccttat

SEQ ID NO: 240493 - DNA, 20 bp, Artificial Sequence
  chemically synthesized
tatgccaggggccccttatt

SEQ ID NO: 240494 - DNA, 20 bp, Artificial Sequence
  chemically synthesized
acagccatactcctaataag

SEQ ID NO: 240495 - DNA, 20 bp, Artificial Sequence
  chemically synthesized
tgccaggggccccttattag

SEQ ID NO: 240496 - DNA, 20 bp, Artificial Sequence
  chemically synthesized
tacagccatactcctaataa

SEQ ID NO: 240497 - DNA, 20 bp, Artificial Sequence
  chemically synthesized
ttacagccatactcctaata

SEQ ID NO: 240498 - DNA, 20 bp, Artificial Sequence
  chemically synthesized
cttacagccatactcctaat

SEQ ID NO: 240499 - DNA, 20 bp, Artificial Sequence
  chemically synthesized
ggggccccttattaggagta

SEQ ID NO: 240500 - DNA, 20 bp, Artificial Sequence
  chemically synthesized
cttattaggagtatggctgt

SEQ ID NO: 240501 - DNA, 20 bp, Artificial Sequence
  chemically synthesized
ttattaggagtatggctgta

SEQ ID NO: 240502 - DNA, 20 bp, Artificial Sequence
  chemically synthesized
tcaaactaaaattagcctta

SEQ ID NO: 240503 - DNA, 20 bp, Artificial Sequence
  chemically synthesized
tatggctgtaaggctaattt

SEQ ID NO: 240504 - DNA, 20 bp, Artificial Sequence
  chemically synthesized
cagtagattcaaactaaaat

SEQ ID NO: 240505 - DNA, 20 bp, Artificial Sequence
  chemically synthesized
cttaatgtttatggtgtcag

SEQ ID NO: 240506 - DNA, 20 bp, Artificial Sequence
  chemically synthesized
cctcttaatgtttatggtgt

SEQ ID NO: 240507 - DNA, 20 bp, Artificial Sequence
  chemically synthesized
tgaaatcctcttaatgttta

SEQ ID NO: 240508 - DNA, 20 bp, Artificial Sequence
  chemically synthesized
ctactgacaccataaacatt

SEQ ID NO: 240509 - DNA, 20 bp, Artificial Sequence
  chemically synthesized
actgacaccataaacattaa

SEQ ID NO: 240510 - DNA, 20 bp, Artificial Sequence
  chemically synthesized
ctgacaccataaacattaag

SEQ ID NO: 240511 - DNA, 20 bp, Artificial Sequence
  chemically synthesized
tagggagtgggtaggagtgg

SEQ ID NO: 240512 - DNA, 20 bp, Artificial Sequence
  chemically synthesized
ctagggagtgggtaggagtg

SEQ ID NO: 240513 - DNA, 20 bp, Artificial Sequence
  chemically synthesized
gctagggagtgggtaggagt

SEQ ID NO: 240514 - DNA, 20 bp, Artificial Sequence
  chemically synthesized
ggctagggagtgggtaggag

SEQ ID NO: 240515 - DNA, 20 bp, Artificial Sequence
  chemically synthesized
acaggctagggagtgggtag

SEQ ID NO: 240516 - DNA, 20 bp, Artificial Sequence
  chemically synthesized
atacaggctagggagtgggt

SEQ ID NO: 240517 - DNA, 20 bp, Artificial Sequence
  chemically synthesized
catacaggctagggagtggg

SEQ ID NO: 240518 - DNA, 20 bp, Artificial Sequence
  chemically synthesized
ccccactcctacccactccc

SEQ ID NO: 240519 - DNA, 20 bp, Artificial Sequence
  chemically synthesized
ttacatacaggctagggagt

SEQ ID NO: 240520 - DNA, 20 bp, Artificial Sequence
  chemically synthesized
gttacatacaggctagggag

SEQ ID NO: 240521 - DNA, 20 bp, Artificial Sequence
  chemically synthesized
acagttacatacaggctagg

SEQ ID NO: 240522 - DNA, 20 bp, Artificial Sequence
  chemically synthesized
ccacagttacatacaggcta

SEQ ID NO: 240523 - DNA, 20 bp, Artificial Sequence
  chemically synthesized
cccacagttacatacaggct

SEQ ID NO: 240524 - DNA, 20 bp, Artificial Sequence
  chemically synthesized
tcccacagttacatacaggc

SEQ ID NO: 240525 - DNA, 20 bp, Artificial Sequence
  chemically synthesized
ctgctcccacagttacatac

SEQ ID NO: 240526 - DNA, 20 bp, Artificial Sequence
  chemically synthesized
cctgctcccacagttacata

SEQ ID NO: 240527 - DNA, 20 bp, Artificial Sequence
  chemically synthesized
ccctagcctgtatgtaactg

SEQ ID NO: 240528 - DNA, 20 bp, Artificial Sequence
  chemically synthesized
cctagcctgtatgtaactgt

SEQ ID NO: 240529 - DNA, 20 bp, Artificial Sequence
  chemically synthesized
tagcctgtatgtaactgtgg

SEQ ID NO: 240530 - DNA, 20 bp, Artificial Sequence
  chemically synthesized
cctgtatgtaactgtgggag

SEQ ID NO: 240531 - DNA, 20 bp, Artificial Sequence
  chemically synthesized
ctgtatgtaactgtgggagc

SEQ ID NO: 240532 - DNA, 20 bp, Artificial Sequence
  chemically synthesized
ctggaactgccctgctccca

SEQ ID NO: 240533 - DNA, 20 bp, Artificial Sequence
  chemically synthesized
tgtatgtaactgtgggagca

SEQ ID NO: 240534 - DNA, 20 bp, Artificial Sequence
  chemically synthesized
atgtaactgtgggagcaggg

SEQ ID NO: 240535 - DNA, 20 bp, Artificial Sequence
  chemically synthesized
ctgtgggagcagggcagttc

SEQ ID NO: 240536 - DNA, 20 bp, Artificial Sequence
  chemically synthesized
tgtgggagcagggcagttcc

SEQ ID NO: 240537 - DNA, 20 bp, Artificial Sequence
  chemically synthesized
tttctaacatggtgtcatcc

SEQ ID NO: 240538 - DNA, 20 bp, Artificial Sequence
  chemically synthesized
gttccaggatgacaccatgt

SEQ ID NO: 240539 - DNA, 20 bp, Artificial Sequence
  chemically synthesized
caggatgacaccatgttaga

SEQ ID NO: 240540 - DNA, 20 bp, Artificial Sequence
  chemically synthesized
gtgaagttgtctttctaaca

SEQ ID NO: 240541 - DNA, 20 bp, Artificial Sequence
  chemically synthesized
agttcagtaaatttgcagtg

SEQ ID NO: 240542 - DNA, 20 bp, Artificial Sequence
  chemically synthesized
atttcagttcagtaaatttg

SEQ ID NO: 240543 - DNA, 20 bp, Artificial Sequence
  chemically synthesized
acttgggtcagatttcagtt

SEQ ID NO: 240544 - DNA, 20 bp, Artificial Sequence
  chemically synthesized
gctatacttgggtcagattt

SEQ ID NO: 240545 - DNA, 20 bp, Artificial Sequence
  chemically synthesized
actgaactgaaatctgaccc

SEQ ID NO: 240546 - DNA, 20 bp, Artificial Sequence
  chemically synthesized
tagagctgctatacttgggt

SEQ ID NO: 240547 - DNA, 20 bp, Artificial Sequence
  chemically synthesized
actgaaatctgacccaagta

SEQ ID NO: 240548 - DNA, 20 bp, Artificial Sequence
  chemically synthesized
gacttagagctgctatactt

SEQ ID NO: 240549 - DNA, 20 bp, Artificial Sequence
  chemically synthesized
gaaatctgacccaagtatag

SEQ ID NO: 240550 - DNA, 20 bp, Artificial Sequence
  chemically synthesized
tgacttagagctgctatact

SEQ ID NO: 240551 - DNA, 20 bp, Artificial Sequence
  chemically synthesized
gacccaagtatagcagctct

SEQ ID NO: 240552 - DNA, 20 bp, Artificial Sequence
  chemically synthesized
agtatagcagctctaagtca

SEQ ID NO: 240553 - DNA, 20 bp, Artificial Sequence
  chemically synthesized
atgacattttctttgactta

SEQ ID NO: 240554 - DNA, 20 bp, Artificial Sequence
  chemically synthesized
tgatgacattttctttgact

SEQ ID NO: 240555 - DNA, 20 bp, Artificial Sequence
  chemically synthesized
ttactcataaggtagtaagt

SEQ ID NO: 240556 - DNA, 20 bp, Artificial Sequence
  chemically synthesized
atatttactcataaggtagt

SEQ ID NO: 240557 - DNA, 20 bp, Artificial Sequence
  chemically synthesized
catctgacttactaccttat

SEQ ID NO: 240558 - DNA, 20 bp, Artificial Sequence
  chemically synthesized
gatgatatttactcataagg

SEQ ID NO: 240559 - DNA, 20 bp, Artificial Sequence
  chemically synthesized
tgtgatgatatttactcata

SEQ ID NO: 240560 - DNA, 20 bp, Artificial Sequence
  chemically synthesized
ttgtgatgatatttactcat

SEQ ID NO: 240561 - DNA, 20 bp, Artificial Sequence
  chemically synthesized
atgagtaaatatcatcacaa

SEQ ID NO: 240562 - DNA, 20 bp, Artificial Sequence
  chemically synthesized
gtaaatatcatcacaaaagt

SEQ ID NO: 240563 - DNA, 20 bp, Artificial Sequence
  chemically synthesized
taaatatcatcacaaaagtc

SEQ ID NO: 240564 - DNA, 20 bp, Artificial Sequence
  chemically synthesized
agaatataaaatagcaaaag

SEQ ID NO: 240565 - DNA, 20 bp, Artificial Sequence
  chemically synthesized
tagaatataaaatagcaaaa

SEQ ID NO: 240566 - DNA, 20 bp, Artificial Sequence
  chemically synthesized
atagaatataaaatagcaaa

SEQ ID NO: 240567 - DNA, 20 bp, Artificial Sequence
  chemically synthesized
gatagaatataaaatagcaa

SEQ ID NO: 240568 - DNA, 20 bp, Artificial Sequence
  chemically synthesized
taataagatagaatataaaa

SEQ ID NO: 240569 - DNA, 20 bp, Artificial Sequence
  chemically synthesized
gcacctgtgttttaataaga

SEQ ID NO: 240570 - DNA, 20 bp, Artificial Sequence
  chemically synthesized
tcgtgcacctgtgttttaat

SEQ ID NO: 240571 - DNA, 20 bp, Artificial Sequence
  chemically synthesized
tattctatcttattaaaaca

SEQ ID NO: 240572 - DNA, 20 bp, Artificial Sequence
  chemically synthesized
attctatcttattaaaacac

SEQ ID NO: 240573 - DNA, 20 bp, Artificial Sequence
  chemically synthesized
ttattaaaacacaggtgcac

SEQ ID NO: 240574 - DNA, 20 bp, Artificial Sequence
  chemically synthesized
tattaaaacacaggtgcacg

SEQ ID NO: 240575 - DNA, 20 bp, Artificial Sequence
  chemically synthesized
attaaaacacaggtgcacga

SEQ ID NO: 240576 - DNA, 20 bp, Artificial Sequence
  chemically synthesized
gtgcacgagggaaatgttct

SEQ ID NO: 240577 - DNA, 20 bp, Artificial Sequence
  chemically synthesized
gaatgtagtagttttatgcc

SEQ ID NO: 240578 - DNA, 20 bp, Artificial Sequence
  chemically synthesized
aaaaaatttaatgaatgtag

SEQ ID NO: 240579 - DNA, 20 bp, Artificial Sequence
  chemically synthesized
aagaaaaaatttaatgaatg

SEQ ID NO: 240580 - DNA, 20 bp, Artificial Sequence
  chemically synthesized
atgtgccttccggtgtggga

SEQ ID NO: 240581 - DNA, 20 bp, Artificial Sequence
  chemically synthesized
aaattttttctttcccacac

SEQ ID NO: 240582 - DNA, 20 bp, Artificial Sequence
  chemically synthesized
ttttttctttcccacaccgg

SEQ ID NO: 240583 - DNA, 20 bp, Artificial Sequence
  chemically synthesized
agacatgtgccttccggtgt

SEQ ID NO: 240584 - DNA, 20 bp, Artificial Sequence
  chemically synthesized
tttttctttcccacaccgga

SEQ ID NO: 240585 - DNA, 20 bp, Artificial Sequence
  chemically synthesized
tagacatgtgccttccggtg

SEQ ID NO: 240586 - DNA, 20 bp, Artificial Sequence
  chemically synthesized
aggtttagacatgtgccttc

SEQ ID NO: 240587 - DNA, 20 bp, Artificial Sequence
  chemically synthesized
aaggcacatgtctaaacctg

SEQ ID NO: 240588 - DNA, 20 bp, Artificial Sequence
  chemically synthesized
aggcacatgtctaaacctgt

SEQ ID NO: 240589 - DNA, 20 bp, Artificial Sequence
  chemically synthesized
taaagcaacccctacaggtt

SEQ ID NO: 240590 - DNA, 20 bp, Artificial Sequence
  chemically synthesized
ggcacatgtctaaacctgta

SEQ ID NO: 240591 - DNA, 20 bp, Artificial Sequence
  chemically synthesized
gcacatgtctaaacctgtag

SEQ ID NO: 240592 - DNA, 20 bp, Artificial Sequence
  chemically synthesized
aataataaagcaacccctac

SEQ ID NO: 240593 - DNA, 20 bp, Artificial Sequence
  chemically synthesized
aaataataaagcaaccccta

SEQ ID NO: 240594 - DNA, 20 bp, Artificial Sequence
  chemically synthesized
tctgctctaattaaataata

SEQ ID NO: 240595 - DNA, 20 bp, Artificial Sequence
  chemically synthesized
gggttgctttattatttaat

SEQ ID NO: 240596 - DNA, 20 bp, Artificial Sequence
  chemically synthesized
gttgctttattatttaatta

SEQ ID NO: 240597 - DNA, 20 bp, Artificial Sequence
  chemically synthesized
gctttattatttaattagag

SEQ ID NO: 240598 - DNA, 20 bp, Artificial Sequence
  chemically synthesized
aaacacctaaaatgatagaa

SEQ ID NO: 240599 - DNA, 20 bp, Artificial Sequence
  chemically synthesized
cagattcttttctatcattt

SEQ ID NO: 240600 - DNA, 20 bp, Artificial Sequence
  chemically synthesized
agattcttttctatcatttt

SEQ ID NO: 240601 - DNA, 20 bp, Artificial Sequence
  chemically synthesized
agatgaaacacctaaaatga

SEQ ID NO: 240602 - DNA, 20 bp, Artificial Sequence
  chemically synthesized
cattttaggtgtttcatcta

SEQ ID NO: 240603 - DNA, 20 bp, Artificial Sequence
  chemically synthesized
tactgatgttaatcaaactt

SEQ ID NO: 240604 - DNA, 20 bp, Artificial Sequence
  chemically synthesized
atctaaagtttgattaacat

SEQ ID NO: 240605 - DNA, 20 bp, Artificial Sequence
  chemically synthesized
atcagtatatgctgtgctct

SEQ ID NO: 240606 - DNA, 20 bp, Artificial Sequence
  chemically synthesized
tcagtatatgctgtgctctc

SEQ ID NO: 240607 - DNA, 20 bp, Artificial Sequence
  chemically synthesized
tatttacttgcctgagagca

SEQ ID NO: 240608 - DNA, 20 bp, Artificial Sequence
  chemically synthesized
tatatgctgtgctctcaggc

SEQ ID NO: 240609 - DNA, 20 bp, Artificial Sequence
  chemically synthesized
agctatatttacttgcctga

SEQ ID NO: 240610 - DNA, 20 bp, Artificial Sequence
  chemically synthesized
gcagctatatttacttgcct

SEQ ID NO: 240611 - DNA, 20 bp, Artificial Sequence
  chemically synthesized
tgctctcaggcaagtaaata

SEQ ID NO: 240612 - DNA, 20 bp, Artificial Sequence
  chemically synthesized
gcaagtaaatatagctgccg

SEQ ID NO: 240613 - DNA, 20 bp, Artificial Sequence
  chemically synthesized
gtaaatatagctgccgtaga

SEQ ID NO: 240614 - DNA, 20 bp, Artificial Sequence
  chemically synthesized
gcttatttctctttctacgg

SEQ ID NO: 240615 - DNA, 20 bp, Artificial Sequence
  chemically synthesized
aaatatagctgccgtagaaa

SEQ ID NO: 240616 - DNA, 20 bp, Artificial Sequence
  chemically synthesized
tctgcttatttctctttcta

SEQ ID NO: 240617 - DNA, 20 bp, Artificial Sequence
  chemically synthesized
gctgccgtagaaagagaaat

SEQ ID NO: 240618 - DNA, 20 bp, Artificial Sequence
  chemically synthesized
gccgtagaaagagaaataag

SEQ ID NO: 240619 - DNA, 20 bp, Artificial Sequence
  chemically synthesized
gtagaaagagaaataagcag

SEQ ID NO: 240620 - DNA, 20 bp, Artificial Sequence
  chemically synthesized
aagcaacattttaaaaaata

SEQ ID NO: 240621 - DNA, 20 bp, Artificial Sequence
  chemically synthesized
aataaagaataacatgaaca

SEQ ID NO: 240622 - DNA, 20 bp, Artificial Sequence
  chemically synthesized
aagaataacatgaacatgga

SEQ ID NO: 240623 - DNA, 20 bp, Artificial Sequence
  chemically synthesized
aacatgaacatggaaagaaa

SEQ ID NO: 240624 - DNA, 20 bp, Artificial Sequence
  chemically synthesized
tggaaagaaaaagaaccttt

SEQ ID NO: 240625 - DNA, 20 bp, Artificial Sequence
  chemically synthesized
gtggatattttatttcttaa

SEQ ID NO: 240626 - DNA, 20 bp, Artificial Sequence
  chemically synthesized
tgtggatattttatttctta

SEQ ID NO: 240627 - DNA, 20 bp, Artificial Sequence
  chemically synthesized
taagaaataaaatatccaca

SEQ ID NO: 240628 - DNA, 20 bp, Artificial Sequence
  chemically synthesized
agcatttctagtgagctttg

SEQ ID NO: 240629 - DNA, 20 bp, Artificial Sequence
  chemically synthesized
aaaatatccacaaagctcac

SEQ ID NO: 240630 - DNA, 20 bp, Artificial Sequence
  chemically synthesized
gtttaggaagcatttctagt

SEQ ID NO: 240631 - DNA, 20 bp, Artificial Sequence
  chemically synthesized
acacgtttaggaagcatttc

SEQ ID NO: 240632 - DNA, 20 bp, Artificial Sequence
  chemically synthesized
acgcttcatacacgtttagg

SEQ ID NO: 240633 - DNA, 20 bp, Artificial Sequence
  chemically synthesized
catacgcttcatacacgttt

SEQ ID NO: 240634 - DNA, 20 bp, Artificial Sequence
  chemically synthesized
acatacgcttcatacacgtt

SEQ ID NO: 240635 - DNA, 20 bp, Artificial Sequence
  chemically synthesized
atgcttcctaaacgtgtatg

SEQ ID NO: 240636 - DNA, 20 bp, Artificial Sequence
  chemically synthesized
agattgagtaaatgaatcag

SEQ ID NO: 240637 - DNA, 20 bp, Artificial Sequence
  chemically synthesized
aaaagattgagtaaatgaat

SEQ ID NO: 240638 - DNA, 20 bp, Artificial Sequence
  chemically synthesized
taaatgtttatcaaaagatt

SEQ ID NO: 240639 - DNA, 20 bp, Artificial Sequence
  chemically synthesized
gctcaataaatgtttatcaa

SEQ ID NO: 240640 - DNA, 20 bp, Artificial Sequence
  chemically synthesized
tcttttgataaacatttatt

SEQ ID NO: 240641 - DNA, 20 bp, Artificial Sequence
  chemically synthesized
ataaacatttattgagcgct

SEQ ID NO: 240642 - DNA, 20 bp, Artificial Sequence
  chemically synthesized
tttattgagcgcttagtcct

SEQ ID NO: 240643 - DNA, 20 bp, Artificial Sequence
  chemically synthesized
ttattgagcgcttagtcctg

SEQ ID NO: 240644 - DNA, 20 bp, Artificial Sequence
  chemically synthesized
acactgctagcctcaggact

SEQ ID NO: 240645 - DNA, 20 bp, Artificial Sequence
  chemically synthesized
tgagcgcttagtcctgaggc

SEQ ID NO: 240646 - DNA, 20 bp, Artificial Sequence
  chemically synthesized
ttcaacacactgctagcctc

SEQ ID NO: 240647 - DNA, 20 bp, Artificial Sequence
  chemically synthesized
gcgcttagtcctgaggctag

SEQ ID NO: 240648 - DNA, 20 bp, Artificial Sequence
  chemically synthesized
attcaacacactgctagcct

SEQ ID NO: 240649 - DNA, 20 bp, Artificial Sequence
  chemically synthesized
ttccgaattcaacacactgc

SEQ ID NO: 240650 - DNA, 20 bp, Artificial Sequence
  chemically synthesized
ggctagcagtgtgttgaatt

SEQ ID NO: 240651 - DNA, 20 bp, Artificial Sequence
  chemically synthesized
tagcagtgtgttgaattcgg

SEQ ID NO: 240652 - DNA, 20 bp, Artificial Sequence
  chemically synthesized
agcagtgtgttgaattcgga

SEQ ID NO: 240653 - DNA, 20 bp, Artificial Sequence
  chemically synthesized
tgttgaattcggaaggtgta

SEQ ID NO: 240654 - DNA, 20 bp, Artificial Sequence
  chemically synthesized
cggaaggtgtaaagctgaaa

SEQ ID NO: 240655 - DNA, 20 bp, Artificial Sequence
  chemically synthesized
gatagagatagtatcttttt

SEQ ID NO: 240656 - DNA, 20 bp, Artificial Sequence
  chemically synthesized
caattgcccattgatagaga

SEQ ID NO: 240657 - DNA, 20 bp, Artificial Sequence
  chemically synthesized
aaagatactatctctatcaa

SEQ ID NO: 240658 - DNA, 20 bp, Artificial Sequence
  chemically synthesized
aagatactatctctatcaat

SEQ ID NO: 240659 - DNA, 20 bp, Artificial Sequence
  chemically synthesized
ctgtcaattgcccattgata

SEQ ID NO: 240660 - DNA, 20 bp, Artificial Sequence
  chemically synthesized
aactgtcaattgcccattga

SEQ ID NO: 240661 - DNA, 20 bp, Artificial Sequence
  chemically synthesized
ctctatcaatgggcaattga

SEQ ID NO: 240662 - DNA, 20 bp, Artificial Sequence
  chemically synthesized
tcaatgggcaattgacagtt

SEQ ID NO: 240663 - DNA, 20 bp, Artificial Sequence
  chemically synthesized
caattgacagtttagttgca

SEQ ID NO: 240664 - DNA, 20 bp, Artificial Sequence
  chemically synthesized
gtttagttgcacagtatttt

SEQ ID NO: 240665 - DNA, 20 bp, Artificial Sequence
  chemically synthesized
tttagttgcacagtatttta

SEQ ID NO: 240666 - DNA, 20 bp, Artificial Sequence
  chemically synthesized
tagttgcacagtattttaag

SEQ ID NO: 240667 - DNA, 20 bp, Artificial Sequence
  chemically synthesized
agttgcacagtattttaagg

SEQ ID NO: 240668 - DNA, 20 bp, Artificial Sequence
  chemically synthesized
gttgcacagtattttaagga

SEQ ID NO: 240669 - DNA, 20 bp, Artificial Sequence
  chemically synthesized
tttaaggagggtatgaactg

SEQ ID NO: 240670 - DNA, 20 bp, Artificial Sequence
  chemically synthesized
gagggtatgaactgaagttg

SEQ ID NO: 240671 - DNA, 20 bp, Artificial Sequence
  chemically synthesized
tacagcatgtgctacaactt

SEQ ID NO: 240672 - DNA, 20 bp, Artificial Sequence
  chemically synthesized
ggaagtgcatggagcaagta

SEQ ID NO: 240673 - DNA, 20 bp, Artificial Sequence
  chemically synthesized
caaggggaagtgcatggagc

SEQ ID NO: 240674 - DNA, 20 bp, Artificial Sequence
  chemically synthesized
aaggcaaggggaagtgcatg

SEQ ID NO: 240675 - DNA, 20 bp, Artificial Sequence
  chemically synthesized
gaaaggcaaggggaagtgca

SEQ ID NO: 240676 - DNA, 20 bp, Artificial Sequence
  chemically synthesized
tgaaatggaaaggcaagggg

SEQ ID NO: 240677 - DNA, 20 bp, Artificial Sequence
  chemically synthesized
ttttgaaatggaaaggcaag

SEQ ID NO: 240678 - DNA, 20 bp, Artificial Sequence
  chemically synthesized
attttgaaatggaaaggcaa

SEQ ID NO: 240679 - DNA, 20 bp, Artificial Sequence
  chemically synthesized
tattttgaaatggaaaggca

SEQ ID NO: 240680 - DNA, 20 bp, Artificial Sequence
  chemically synthesized
gtattttgaaatggaaaggc

SEQ ID NO: 240681 - DNA, 20 bp, Artificial Sequence
  chemically synthesized
cagtgtattttgaaatggaa

SEQ ID NO: 240682 - DNA, 20 bp, Artificial Sequence
  chemically synthesized
ccagtgtattttgaaatgga

SEQ ID NO: 240683 - DNA, 20 bp, Artificial Sequence
  chemically synthesized
caaaccagtgtattttgaaa

SEQ ID NO: 240684 - DNA, 20 bp, Artificial Sequence
  chemically synthesized
ctttccatttcaaaatacac

SEQ ID NO: 240685 - DNA, 20 bp, Artificial Sequence
  chemically synthesized
ctggcatttggaagtcaaac

SEQ ID NO: 240686 - DNA, 20 bp, Artificial Sequence
  chemically synthesized
atccaaatgctggcatttgg

SEQ ID NO: 240687 - DNA, 20 bp, Artificial Sequence
  chemically synthesized
ctggtttgacttccaaatgc

SEQ ID NO: 240688 - DNA, 20 bp, Artificial Sequence
  chemically synthesized
gaaatccaaatgctggcatt

SEQ ID NO: 240689 - DNA, 20 bp, Artificial Sequence
  chemically synthesized
gacttccaaatgccagcatt

SEQ ID NO: 240690 - DNA, 20 bp, Artificial Sequence
  chemically synthesized
aggtaatgaaatccaaatgc

SEQ ID NO: 240691 - DNA, 20 bp, Artificial Sequence
  chemically synthesized
catttggatttcattaccta

SEQ ID NO: 240692 - DNA, 20 bp, Artificial Sequence
  chemically synthesized
tgcaaccagaaagattccat

SEQ ID NO: 240693 - DNA, 20 bp, Artificial Sequence
  chemically synthesized
ctgcaaccagaaagattcca

SEQ ID NO: 240694 - DNA, 20 bp, Artificial Sequence
  chemically synthesized
cattacctatggaatctttc

SEQ ID NO: 240695 - DNA, 20 bp, Artificial Sequence
  chemically synthesized
atcagacctctgcaaccaga

SEQ ID NO: 240696 - DNA, 20 bp, Artificial Sequence
  chemically synthesized
ctatggaatctttctggttg

SEQ ID NO: 240697 - DNA, 20 bp, Artificial Sequence
  chemically synthesized
atggaatctttctggttgca

SEQ ID NO: 240698 - DNA, 20 bp, Artificial Sequence
  chemically synthesized
tggaatctttctggttgcag

SEQ ID NO: 240699 - DNA, 20 bp, Artificial Sequence
  chemically synthesized
cagcatcagacctctgcaac

SEQ ID NO: 240700 - DNA, 20 bp, Artificial Sequence
  chemically synthesized
caccccagtaacatcagcat

SEQ ID NO: 240701 - DNA, 20 bp, Artificial Sequence
  chemically synthesized
aggtctgatgctgatgttac

SEQ ID NO: 240702 - DNA, 20 bp, Artificial Sequence
  chemically synthesized
gctccccaccccagtaacat

SEQ ID NO: 240703 - DNA, 20 bp, Artificial Sequence
  chemically synthesized
ggtctgatgctgatgttact

SEQ ID NO: 240704 - DNA, 20 bp, Artificial Sequence
  chemically synthesized
gtctgatgctgatgttactg

SEQ ID NO: 240705 - DNA, 20 bp, Artificial Sequence
  chemically synthesized
tgatgctgatgttactgggg

SEQ ID NO: 240706 - DNA, 20 bp, Artificial Sequence
  chemically synthesized
gatgctgatgttactggggt

SEQ ID NO: 240707 - DNA, 20 bp, Artificial Sequence
  chemically synthesized
atgctgatgttactggggtg

SEQ ID NO: 240708 - DNA, 20 bp, Artificial Sequence
  chemically synthesized
gctgatgttactggggtggg

SEQ ID NO: 240709 - DNA, 20 bp, Artificial Sequence
  chemically synthesized
gaaaaatatgctccccaccc

SEQ ID NO: 240710 - DNA, 20 bp, Artificial Sequence
  chemically synthesized
tggggagcatatttttcaac

SEQ ID NO: 240711 - DNA, 20 bp, Artificial Sequence
  chemically synthesized
ggagcatatttttcaaccag

SEQ ID NO: 240712 - DNA, 20 bp, Artificial Sequence
  chemically synthesized
atatttttcaaccagtggca

SEQ ID NO: 240713 - DNA, 20 bp, Artificial Sequence
  chemically synthesized
ggccattccttccatgccac

SEQ ID NO: 240714 - DNA, 20 bp, Artificial Sequence
  chemically synthesized
tttttcaaccagtggcatgg

SEQ ID NO: 240715 - DNA, 20 bp, Artificial Sequence
  chemically synthesized
ttttcaaccagtggcatgga

SEQ ID NO: 240716 - DNA, 20 bp, Artificial Sequence
  chemically synthesized
aaccagtggcatggaaggaa

SEQ ID NO: 240717 - DNA, 20 bp, Artificial Sequence
  chemically synthesized
tggcatggaaggaatggccc

SEQ ID NO: 240718 - DNA, 20 bp, Artificial Sequence
  chemically synthesized
ggcatggaaggaatggccca

SEQ ID NO: 240719 - DNA, 20 bp, Artificial Sequence
  chemically synthesized
gcatggaaggaatggcccaa

SEQ ID NO: 240720 - DNA, 20 bp, Artificial Sequence
  chemically synthesized
ggaaggaatggcccaagggc

SEQ ID NO: 240721 - DNA, 20 bp, Artificial Sequence
  chemically synthesized
atcttgcccaactagccctt

SEQ ID NO: 240722 - DNA, 20 bp, Artificial Sequence
  chemically synthesized
catcttgcccaactagccct

SEQ ID NO: 240723 - DNA, 20 bp, Artificial Sequence
  chemically synthesized
ggaatggcccaagggctagt

SEQ ID NO: 240724 - DNA, 20 bp, Artificial Sequence
  chemically synthesized
gaatggcccaagggctagtt

SEQ ID NO: 240725 - DNA, 20 bp, Artificial Sequence
  chemically synthesized
ggcccaagggctagttgggc

SEQ ID NO: 240726 - DNA, 20 bp, Artificial Sequence
  chemically synthesized
tctagtacatcttgcccaac

SEQ ID NO: 240727 - DNA, 20 bp, Artificial Sequence
  chemically synthesized
gctagttgggcaagatgtac

SEQ ID NO: 240728 - DNA, 20 bp, Artificial Sequence
  chemically synthesized
gaaccttcataatgttgatc

SEQ ID NO: 240729 - DNA, 20 bp, Artificial Sequence
  chemically synthesized
tgtactagatcaacattatg

SEQ ID NO: 240730 - DNA, 20 bp, Artificial Sequence
  chemically synthesized
gtactagatcaacattatga

SEQ ID NO: 240731 - DNA, 20 bp, Artificial Sequence
  chemically synthesized
atgaaggttcatgaatatca

SEQ ID NO: 240732 - DNA, 20 bp, Artificial Sequence
  chemically synthesized
tcatgaatatcaaagttttt

SEQ ID NO: 240733 - DNA, 20 bp, Artificial Sequence
  chemically synthesized
agtttttgagttcatttatg

SEQ ID NO: 240734 - DNA, 20 bp, Artificial Sequence
  chemically synthesized
ttttgagttcatttatgcag

SEQ ID NO: 240735 - DNA, 20 bp, Artificial Sequence
  chemically synthesized
tgagttcatttatgcagaag

SEQ ID NO: 240736 - DNA, 20 bp, Artificial Sequence
  chemically synthesized
gcagaagtagtttattgcaa

SEQ ID NO: 240737 - DNA, 20 bp, Artificial Sequence
  chemically synthesized
agaagtagtttattgcaaaa

SEQ ID NO: 240738 - DNA, 20 bp, Artificial Sequence
  chemically synthesized
ctgcagctatttattttgtg

SEQ ID NO: 240739 - DNA, 20 bp, Artificial Sequence
  chemically synthesized
agagtaccacacaaaataaa

SEQ ID NO: 240740 - DNA, 20 bp, Artificial Sequence
  chemically synthesized
ccacacaaaataaatagctg

SEQ ID NO: 240741 - DNA, 20 bp, Artificial Sequence
  chemically synthesized
attgtattgtgaaagatctg

SEQ ID NO: 240742 - DNA, 20 bp, Artificial Sequence
  chemically synthesized
tttaatttattgtattgtga

SEQ ID NO: 240743 - DNA, 20 bp, Artificial Sequence
  chemically synthesized
aataaattaaaaaaacttct

SEQ ID NO: 240744 - DNA, 20 bp, Artificial Sequence
  chemically synthesized
taaattaaaaaaacttcttg

SEQ ID NO: 240745 - DNA, 20 bp, Artificial Sequence
  chemically synthesized
aaattaaaaaaacttcttgg

SEQ ID NO: 240746 - DNA, 20 bp, Artificial Sequence
  chemically synthesized
aattaaaaaaacttcttgga

SEQ ID NO: 240747 - DNA, 20 bp, Artificial Sequence
  chemically synthesized
attaaaaaaacttcttggag

SEQ ID NO: 240748 - DNA, 20 bp, Artificial Sequence
  chemically synthesized
atatattctccccctccaag

SEQ ID NO: 240749 - DNA, 20 bp, Artificial Sequence
  chemically synthesized
ttaaaaaaacttcttggagg

SEQ ID NO: 240750 - DNA, 20 bp, Artificial Sequence
  chemically synthesized
aaaaaaacttcttggagggg

SEQ ID NO: 240751 - DNA, 20 bp, Artificial Sequence
  chemically synthesized
tctatatattctccccctcc

SEQ ID NO: 240752 - DNA, 20 bp, Artificial Sequence
  chemically synthesized
tcttggagggggagaatata

SEQ ID NO: 240753 - DNA, 20 bp, Artificial Sequence
  chemically synthesized
ttggagggggagaatatata

SEQ ID NO: 240754 - DNA, 20 bp, Artificial Sequence
  chemically synthesized
attgtaccaggaagtggatt

SEQ ID NO: 240755 - DNA, 20 bp, Artificial Sequence
  chemically synthesized
aattgtaccaggaagtggat

SEQ ID NO: 240756 - DNA, 20 bp, Artificial Sequence
  chemically synthesized
agcattcccaatccacttcc

SEQ ID NO: 240757 - DNA, 20 bp, Artificial Sequence
  chemically synthesized
aaagaaattgtaccaggaag

SEQ ID NO: 240758 - DNA, 20 bp, Artificial Sequence
  chemically synthesized
gaaaaagaaattgtaccagg

SEQ ID NO: 240759 - DNA, 20 bp, Artificial Sequence
  chemically synthesized
aaagaaaaagaaattgtacc

SEQ ID NO: 240760 - DNA, 20 bp, Artificial Sequence
  chemically synthesized
aaaagaaaaagaaattgtac

SEQ ID NO: 240761 - DNA, 20 bp, Artificial Sequence
  chemically synthesized
aaataaataaataaaagaaa

SEQ ID NO: 240762 - DNA, 20 bp, Artificial Sequence
  chemically synthesized
ataaataaataaataaataa

SEQ ID NO: 240763 - DNA, 20 bp, Artificial Sequence
  chemically synthesized
tatttatttatttatttatt

SEQ ID NO: 240764 - DNA, 20 bp, Artificial Sequence
  chemically synthesized
tatttatttatttattgaga

SEQ ID NO: 240765 - DNA, 20 bp, Artificial Sequence
  chemically synthesized
tttatttatttattgagacg

SEQ ID NO: 240766 - DNA, 20 bp, Artificial Sequence
  chemically synthesized
cagctggggcaacaagagcg

SEQ ID NO: 240767 - DNA, 20 bp, Artificial Sequence
  chemically synthesized
cactccagctggggcaacaa

SEQ ID NO: 240768 - DNA, 20 bp, Artificial Sequence
  chemically synthesized
gagcttcgctcttgttgccc

SEQ ID NO: 240769 - DNA, 20 bp, Artificial Sequence
  chemically synthesized
tgcactccagctggggcaac

SEQ ID NO: 240770 - DNA, 20 bp, Artificial Sequence
  chemically synthesized
ttcgctcttgttgccccagc

SEQ ID NO: 240771 - DNA, 20 bp, Artificial Sequence
  chemically synthesized
cgctcttgttgccccagctg

SEQ ID NO: 240772 - DNA, 20 bp, Artificial Sequence
  chemically synthesized
acaccattgcactccagctg

SEQ ID NO: 240773 - DNA, 20 bp, Artificial Sequence
  chemically synthesized
cacaccattgcactccagct

SEQ ID NO: 240774 - DNA, 20 bp, Artificial Sequence
  chemically synthesized
tcacaccattgcactccagc

SEQ ID NO: 240775 - DNA, 20 bp, Artificial Sequence
  chemically synthesized
aagatcacaccattgcactc

SEQ ID NO: 240776 - DNA, 20 bp, Artificial Sequence
  chemically synthesized
ttgccccagctggagtgcaa

SEQ ID NO: 240777 - DNA, 20 bp, Artificial Sequence
  chemically synthesized
ggcataggttgtggtgagag

SEQ ID NO: 240778 - DNA, 20 bp, Artificial Sequence
  chemically synthesized
ggaggcataggttgtggtga

SEQ ID NO: 240779 - DNA, 20 bp, Artificial Sequence
  chemically synthesized
ctggaggcataggttgtggt

SEQ ID NO: 240780 - DNA, 20 bp, Artificial Sequence
  chemically synthesized
caccctggaggcataggttg

SEQ ID NO: 240781 - DNA, 20 bp, Artificial Sequence
  chemically synthesized
ctcaccacaacctatgcctc

SEQ ID NO: 240782 - DNA, 20 bp, Artificial Sequence
  chemically synthesized
ctcttccaccctggaggcat

SEQ ID NO: 240783 - DNA, 20 bp, Artificial Sequence
  chemically synthesized
tcaccacaacctatgcctcc

SEQ ID NO: 240784 - DNA, 20 bp, Artificial Sequence
  chemically synthesized
tctcttccaccctggaggca

SEQ ID NO: 240785 - DNA, 20 bp, Artificial Sequence
  chemically synthesized
caccacaacctatgcctcca

SEQ ID NO: 240786 - DNA, 20 bp, Artificial Sequence
  chemically synthesized
cacaacctatgcctccaggg

SEQ ID NO: 240787 - DNA, 20 bp, Artificial Sequence
  chemically synthesized
gagaatctcttccaccctgg

SEQ ID NO: 240788 - DNA, 20 bp, Artificial Sequence
  chemically synthesized
agagaatctcttccaccctg

SEQ ID NO: 240789 - DNA, 20 bp, Artificial Sequence
  chemically synthesized
aacctatgcctccagggtgg

SEQ ID NO: 240790 - DNA, 20 bp, Artificial Sequence
  chemically synthesized
caagagaatctcttccaccc

SEQ ID NO: 240791 - DNA, 20 bp, Artificial Sequence
  chemically synthesized
cctatgcctccagggtggaa

SEQ ID NO: 240792 - DNA, 20 bp, Artificial Sequence
  chemically synthesized
tggaagagattctcttgcct

SEQ ID NO: 240793 - DNA, 20 bp, Artificial Sequence
  chemically synthesized
tactcaggaggctaaggcaa

SEQ ID NO: 240794 - DNA, 20 bp, Artificial Sequence
  chemically synthesized
gctactcaggaggctaaggc

SEQ ID NO: 240795 - DNA, 20 bp, Artificial Sequence
  chemically synthesized
cccagctactcaggaggcta

SEQ ID NO: 240796 - DNA, 20 bp, Artificial Sequence
  chemically synthesized
ccccagctactcaggaggct

SEQ ID NO: 240797 - DNA, 20 bp, Artificial Sequence
  chemically synthesized
ttctcttgccttagcctcct

SEQ ID NO: 240798 - DNA, 20 bp, Artificial Sequence
  chemically synthesized
tcttgccttagcctcctgag

SEQ ID NO: 240799 - DNA, 20 bp, Artificial Sequence
  chemically synthesized
tgtaaccccagctactcagg

SEQ ID NO: 240800 - DNA, 20 bp, Artificial Sequence
  chemically synthesized
ctgtaaccccagctactcag

SEQ ID NO: 240801 - DNA, 20 bp, Artificial Sequence
  chemically synthesized
gccttagcctcctgagtagc

SEQ ID NO: 240802 - DNA, 20 bp, Artificial Sequence
  chemically synthesized
gcctgtaaccccagctactc

SEQ ID NO: 240803 - DNA, 20 bp, Artificial Sequence
  chemically synthesized
ccttagcctcctgagtagct

SEQ ID NO: 240804 - DNA, 20 bp, Artificial Sequence
  chemically synthesized
tgcctgtaaccccagctact

SEQ ID NO: 240805 - DNA, 20 bp, Artificial Sequence
  chemically synthesized
cttagcctcctgagtagctg

SEQ ID NO: 240806 - DNA, 20 bp, Artificial Sequence
  chemically synthesized
ctcctgagtagctggggtta

SEQ ID NO: 240807 - DNA, 20 bp, Artificial Sequence
  chemically synthesized
tcctgagtagctggggttac

SEQ ID NO: 240808 - DNA, 20 bp, Artificial Sequence
  chemically synthesized
gtggcgcatgcctgtaaccc

SEQ ID NO: 240809 - DNA, 20 bp, Artificial Sequence
  chemically synthesized
caggcatgcgccaccatgcc

SEQ ID NO: 240810 - DNA, 20 bp, Artificial Sequence
  chemically synthesized
acaaaattagccaggcatgg

SEQ ID NO: 240811 - DNA, 20 bp, Artificial Sequence
  chemically synthesized
aatacaaaattagccaggca

SEQ ID NO: 240812 - DNA, 20 bp, Artificial Sequence
  chemically synthesized
cttaaaatacaaaattagcc

SEQ ID NO: 240813 - DNA, 20 bp, Artificial Sequence
  chemically synthesized
acttaaaatacaaaattagc

SEQ ID NO: 240814 - DNA, 20 bp, Artificial Sequence
  chemically synthesized
ctctacttaaaatacaaaat

SEQ ID NO: 240815 - DNA, 20 bp, Artificial Sequence
  chemically synthesized
cctggctaattttgtatttt

SEQ ID NO: 240816 - DNA, 20 bp, Artificial Sequence
  chemically synthesized
ggctaattttgtattttaag

SEQ ID NO: 240817 - DNA, 20 bp, Artificial Sequence
  chemically synthesized
ctaattttgtattttaagta

SEQ ID NO: 240818 - DNA, 20 bp, Artificial Sequence
  chemically synthesized
aattttgtattttaagtaga

SEQ ID NO: 240819 - DNA, 20 bp, Artificial Sequence
  chemically synthesized
attttgtattttaagtagag

SEQ ID NO: 240820 - DNA, 20 bp, Artificial Sequence
  chemically synthesized
ttttgtattttaagtagaga

SEQ ID NO: 240821 - DNA, 20 bp, Artificial Sequence
  chemically synthesized
agaccagactgagcaacatg

SEQ ID NO: 240822 - DNA, 20 bp, Artificial Sequence
  chemically synthesized
gagggtttctccatgttgct

SEQ ID NO: 240823 - DNA, 20 bp, Artificial Sequence
  chemically synthesized
cgagaccagactgagcaaca

SEQ ID NO: 240824 - DNA, 20 bp, Artificial Sequence
  chemically synthesized
tttctccatgttgctcagtc

SEQ ID NO: 240825 - DNA, 20 bp, Artificial Sequence
  chemically synthesized
cgggagttcgagaccagact

SEQ ID NO: 240826 - DNA, 20 bp, Artificial Sequence
  chemically synthesized
tgaggtcgggagttcgagac

SEQ ID NO: 240827 - DNA, 20 bp, Artificial Sequence
  chemically synthesized
tcacctgaggtcgggagttc

SEQ ID NO: 240828 - DNA, 20 bp, Artificial Sequence
  chemically synthesized
tggtctcgaactcccgacct

SEQ ID NO: 240829 - DNA, 20 bp, Artificial Sequence
  chemically synthesized
ggcggatcacctgaggtcgg

SEQ ID NO: 240830 - DNA, 20 bp, Artificial Sequence
  chemically synthesized
ggtctcgaactcccgacctc

SEQ ID NO: 240831 - DNA, 20 bp, Artificial Sequence
  chemically synthesized
tgggcggatcacctgaggtc

SEQ ID NO: 240832 - DNA, 20 bp, Artificial Sequence
  chemically synthesized
gtgggcggatcacctgaggt

SEQ ID NO: 240833 - DNA, 20 bp, Artificial Sequence
  chemically synthesized
caaggtgggcggatcacctg

SEQ ID NO: 240834 - DNA, 20 bp, Artificial Sequence
  chemically synthesized
ccaaggtgggcggatcacct

SEQ ID NO: 240835 - DNA, 20 bp, Artificial Sequence
  chemically synthesized
ctcaggtgatccgcccacct

SEQ ID NO: 240836 - DNA, 20 bp, Artificial Sequence
  chemically synthesized
ctttgagagaccaaggtggg

SEQ ID NO: 240837 - DNA, 20 bp, Artificial Sequence
  chemically synthesized
gcactttgagagaccaaggt

SEQ ID NO: 240838 - DNA, 20 bp, Artificial Sequence
  chemically synthesized
agcactttgagagaccaagg

SEQ ID NO: 240839 - DNA, 20 bp, Artificial Sequence
  chemically synthesized
cccagcactttgagagacca

SEQ ID NO: 240840 - DNA, 20 bp, Artificial Sequence
  chemically synthesized
tcccagcactttgagagacc

SEQ ID NO: 240841 - DNA, 20 bp, Artificial Sequence
  chemically synthesized
ccgcccaccttggtctctca

SEQ ID NO: 240842 - DNA, 20 bp, Artificial Sequence
  chemically synthesized
ctgtaatcccagcactttga

SEQ ID NO: 240843 - DNA, 20 bp, Artificial Sequence
  chemically synthesized
accttggtctctcaaagtgc

SEQ ID NO: 240844 - DNA, 20 bp, Artificial Sequence
  chemically synthesized
gcctgtaatcccagcacttt

SEQ ID NO: 240845 - DNA, 20 bp, Artificial Sequence
  chemically synthesized
ccttggtctctcaaagtgct

SEQ ID NO: 240846 - DNA, 20 bp, Artificial Sequence
  chemically synthesized
ctctcaaagtgctgggatta

SEQ ID NO: 240847 - DNA, 20 bp, Artificial Sequence
  chemically synthesized
tctcaaagtgctgggattac

SEQ ID NO: 240848 - DNA, 20 bp, Artificial Sequence
  chemically synthesized
gtgactcatgcctgtaatcc

SEQ ID NO: 240849 - DNA, 20 bp, Artificial Sequence
  chemically synthesized
agtgctgggattacaggcat

SEQ ID NO: 240850 - DNA, 20 bp, Artificial Sequence
  chemically synthesized
caggcatgagtcaccacacc

SEQ ID NO: 240851 - DNA, 20 bp, Artificial Sequence
  chemically synthesized
aaattgtaccgggctgggtg

SEQ ID NO: 240852 - DNA, 20 bp, Artificial Sequence
  chemically synthesized
atgagtcaccacacccagcc

SEQ ID NO: 240853 - DNA, 20 bp, Artificial Sequence
  chemically synthesized
ctaagaaattgtaccgggct

SEQ ID NO: 240854 - DNA, 20 bp, Artificial Sequence
  chemically synthesized
cctaagaaattgtaccgggc

SEQ ID NO: 240855 - DNA, 20 bp, Artificial Sequence
  chemically synthesized
gaagcctaagaaattgtacc

SEQ ID NO: 240856 - DNA, 20 bp, Artificial Sequence
  chemically synthesized
tgaagcctaagaaattgtac

SEQ ID NO: 240857 - DNA, 20 bp, Artificial Sequence
  chemically synthesized
cccagcccggtacaatttct

SEQ ID NO: 240858 - DNA, 20 bp, Artificial Sequence
  chemically synthesized
ccagcccggtacaatttctt

SEQ ID NO: 240859 - DNA, 20 bp, Artificial Sequence
  chemically synthesized
tttggcacaaaatgaagcct

SEQ ID NO: 240860 - DNA, 20 bp, Artificial Sequence
  chemically synthesized
tacaattttggcacaaaatg

SEQ ID NO: 240861 - DNA, 20 bp, Artificial Sequence
  chemically synthesized
cttacatatatatacaattt

SEQ ID NO: 240862 - DNA, 20 bp, Artificial Sequence
  chemically synthesized
ccaaaattgtatatatatgt

SEQ ID NO: 240863 - DNA, 20 bp, Artificial Sequence
  chemically synthesized
atggaaaacatggtgaagta

SEQ ID NO: 240864 - DNA, 20 bp, Artificial Sequence
  chemically synthesized
ggttaatggaaaacatggtg

SEQ ID NO: 240865 - DNA, 20 bp, Artificial Sequence
  chemically synthesized
tgtagggttaatggaaaaca

SEQ ID NO: 240866 - DNA, 20 bp, Artificial Sequence
  chemically synthesized
aatcgcagttgtagggttaa

SEQ ID NO: 240867 - DNA, 20 bp, Artificial Sequence
  chemically synthesized
ctgccgaaatcgcagttgta

SEQ ID NO: 240868 - DNA, 20 bp, Artificial Sequence
  chemically synthesized
gctgccgaaatcgcagttgt

SEQ ID NO: 240869 - DNA, 20 bp, Artificial Sequence
  chemically synthesized
agctgccgaaatcgcagttg

SEQ ID NO: 240870 - DNA, 20 bp, Artificial Sequence
  chemically synthesized
taaccctacaactgcgattt

SEQ ID NO: 240871 - DNA, 20 bp, Artificial Sequence
  chemically synthesized
gcatgaagctgccgaaatcg

SEQ ID NO: 240872 - DNA, 20 bp, Artificial Sequence
  chemically synthesized
ccctacaactgcgatttcgg

SEQ ID NO: 240873 - DNA, 20 bp, Artificial Sequence
  chemically synthesized
catggctcttgagaagcatg

SEQ ID NO: 240874 - DNA, 20 bp, Artificial Sequence
  chemically synthesized
tcggcagcttcatgcttctc

SEQ ID NO: 240875 - DNA, 20 bp, Artificial Sequence
  chemically synthesized
ggcagcttcatgcttctcaa

SEQ ID NO: 240876 - DNA, 20 bp, Artificial Sequence
  chemically synthesized
cccataccatggctcttgag

SEQ ID NO: 240877 - DNA, 20 bp, Artificial Sequence
  chemically synthesized
tgacccataccatggctctt

SEQ ID NO: 240878 - DNA, 20 bp, Artificial Sequence
  chemically synthesized
ttcatgcttctcaagagcca

SEQ ID NO: 240879 - DNA, 20 bp, Artificial Sequence
  chemically synthesized
gcttctcaagagccatggta

SEQ ID NO: 240880 - DNA, 20 bp, Artificial Sequence
  chemically synthesized
cttctcaagagccatggtat

SEQ ID NO: 240881 - DNA, 20 bp, Artificial Sequence
  chemically synthesized
ttttactgtgacccatacca

SEQ ID NO: 240882 - DNA, 20 bp, Artificial Sequence
  chemically synthesized
aagagccatggtatgggtca

SEQ ID NO: 240883 - DNA, 20 bp, Artificial Sequence
  chemically synthesized
ggtatgggtcacagtaaaac

SEQ ID NO: 240884 - DNA, 20 bp, Artificial Sequence
  chemically synthesized
tgggtcacagtaaaactggc

SEQ ID NO: 240885 - DNA, 20 bp, Artificial Sequence
  chemically synthesized
tgtctatttggtggaccagc

SEQ ID NO: 240886 - DNA, 20 bp, Artificial Sequence
  chemically synthesized
ctgctgtctatttggtggac

SEQ ID NO: 240887 - DNA, 20 bp, Artificial Sequence
  chemically synthesized
aaactggctggtccaccaaa

SEQ ID NO: 240888 - DNA, 20 bp, Artificial Sequence
  chemically synthesized
cgtccctgctgtctatttgg

SEQ ID NO: 240889 - DNA, 20 bp, Artificial Sequence
  chemically synthesized
tggctggtccaccaaataga

SEQ ID NO: 240890 - DNA, 20 bp, Artificial Sequence
  chemically synthesized
tgccgtccctgctgtctatt

SEQ ID NO: 240891 - DNA, 20 bp, Artificial Sequence
  chemically synthesized
ctggtccaccaaatagacag

SEQ ID NO: 240892 - DNA, 20 bp, Artificial Sequence
  chemically synthesized
tggtccaccaaatagacagc

SEQ ID NO: 240893 - DNA, 20 bp, Artificial Sequence
  chemically synthesized
ggtccaccaaatagacagca

SEQ ID NO: 240894 - DNA, 20 bp, Artificial Sequence
  chemically synthesized
caccaaatagacagcaggga

SEQ ID NO: 240895 - DNA, 20 bp, Artificial Sequence
  chemically synthesized
caaatagacagcagggacgg

SEQ ID NO: 240896 - DNA, 20 bp, Artificial Sequence
  chemically synthesized
atagacagcagggacggcag

SEQ ID NO: 240897 - DNA, 20 bp, Artificial Sequence
  chemically synthesized
gcagggacggcagtggtgaa

SEQ ID NO: 240898 - DNA, 20 bp, Artificial Sequence
  chemically synthesized
ttctggtctctcgtggtcat

SEQ ID NO: 240899 - DNA, 20 bp, Artificial Sequence
  chemically synthesized
gtgaatagtcccatgaccac

SEQ ID NO: 240900 - DNA, 20 bp, Artificial Sequence
  chemically synthesized
tttctggtctctcgtggtca

SEQ ID NO: 240901 - DNA, 20 bp, Artificial Sequence
  chemically synthesized
gaatagtcccatgaccacga

SEQ ID NO: 240902 - DNA, 20 bp, Artificial Sequence
  chemically synthesized
taattctttctggtctctcg

SEQ ID NO: 240903 - DNA, 20 bp, Artificial Sequence
  chemically synthesized
gtcccatgaccacgagagac

SEQ ID NO: 240904 - DNA, 20 bp, Artificial Sequence
  chemically synthesized
catgaccacgagagaccaga

SEQ ID NO: 240905 - DNA, 20 bp, Artificial Sequence
  chemically synthesized
tatagacaactaattctttc

SEQ ID NO: 240906 - DNA, 20 bp, Artificial Sequence
  chemically synthesized
cacgagagaccagaaagaat

SEQ ID NO: 240907 - DNA, 20 bp, Artificial Sequence
  chemically synthesized
cagaaagaattagttgtcta

SEQ ID NO: 240908 - DNA, 20 bp, Artificial Sequence
  chemically synthesized
ctcacagacaagagtagcta

SEQ ID NO: 240909 - DNA, 20 bp, Artificial Sequence
  chemically synthesized
tataatctcacagacaagag

SEQ ID NO: 240910 - DNA, 20 bp, Artificial Sequence
  chemically synthesized
aactataatctcacagacaa

SEQ ID NO: 240911 - DNA, 20 bp, Artificial Sequence
  chemically synthesized
ctatagctactcttgtctgt

SEQ ID NO: 240912 - DNA, 20 bp, Artificial Sequence
  chemically synthesized
tgaactataatctcacagac

SEQ ID NO: 240913 - DNA, 20 bp, Artificial Sequence
  chemically synthesized
gaaaatgaactataatctca

SEQ ID NO: 240914 - DNA, 20 bp, Artificial Sequence
  chemically synthesized
tactcttgtctgtgagatta

SEQ ID NO: 240915 - DNA, 20 bp, Artificial Sequence
  chemically synthesized
atagttcattttcgccttga

SEQ ID NO: 240916 - DNA, 20 bp, Artificial Sequence
  chemically synthesized
tagttcattttcgccttgaa

SEQ ID NO: 240917 - DNA, 20 bp, Artificial Sequence
  chemically synthesized
ttcattttcgccttgaaagg

SEQ ID NO: 240918 - DNA, 20 bp, Artificial Sequence
  chemically synthesized
taactaaaaccttcctttca

SEQ ID NO: 240919 - DNA, 20 bp, Artificial Sequence
  chemically synthesized
tcattttcgccttgaaagga

SEQ ID NO: 240920 - DNA, 20 bp, Artificial Sequence
  chemically synthesized
ataactaaaaccttcctttc

SEQ ID NO: 240921 - DNA, 20 bp, Artificial Sequence
  chemically synthesized
tcgccttgaaaggaaggttt

SEQ ID NO: 240922 - DNA, 20 bp, Artificial Sequence
  chemically synthesized
aaggaaggttttagttatgt

SEQ ID NO: 240923 - DNA, 20 bp, Artificial Sequence
  chemically synthesized
aggaaggttttagttatgtt

SEQ ID NO: 240924 - DNA, 20 bp, Artificial Sequence
  chemically synthesized
aggttttagttatgttgggt

SEQ ID NO: 240925 - DNA, 20 bp, Artificial Sequence
  chemically synthesized
ggttttagttatgttgggtc

SEQ ID NO: 240926 - DNA, 20 bp, Artificial Sequence
  chemically synthesized
tagttatgttgggtcaggaa

SEQ ID NO: 240927 - DNA, 20 bp, Artificial Sequence
  chemically synthesized
tatgttgggtcaggaaaaga

SEQ ID NO: 240928 - DNA, 20 bp, Artificial Sequence
  chemically synthesized
ttgggtcaggaaaagacaga

SEQ ID NO: 240929 - DNA, 20 bp, Artificial Sequence
  chemically synthesized
tgggtcaggaaaagacagat

SEQ ID NO: 240930 - DNA, 20 bp, Artificial Sequence
  chemically synthesized
ggttattatttattgcctat

SEQ ID NO: 240931 - DNA, 20 bp, Artificial Sequence
  chemically synthesized
tgcacgtggttaaaactgat

SEQ ID NO: 240932 - DNA, 20 bp, Artificial Sequence
  chemically synthesized
ttgcacgtggttaaaactga

SEQ ID NO: 240933 - DNA, 20 bp, Artificial Sequence
  chemically synthesized
gcataacgttcatttgcacg

SEQ ID NO: 240934 - DNA, 20 bp, Artificial Sequence
  chemically synthesized
cgtgcaaatgaacgttatgc

SEQ ID NO: 240935 - DNA, 20 bp, Artificial Sequence
  chemically synthesized
aaatgaacgttatgcaagat

SEQ ID NO: 240936 - DNA, 20 bp, Artificial Sequence
  chemically synthesized
atgaacgttatgcaagatga

SEQ ID NO: 240937 - DNA, 20 bp, Artificial Sequence
  chemically synthesized
cgttatgcaagatgagagca

SEQ ID NO: 240938 - DNA, 20 bp, Artificial Sequence
  chemically synthesized
gttatgcaagatgagagcat

SEQ ID NO: 240939 - DNA, 20 bp, Artificial Sequence
  chemically synthesized
tatgcaagatgagagcatag

SEQ ID NO: 240940 - DNA, 20 bp, Artificial Sequence
  chemically synthesized
gcaagatgagagcataggag

SEQ ID NO: 240941 - DNA, 20 bp, Artificial Sequence
  chemically synthesized
gatgagagcataggagaagc

SEQ ID NO: 240942 - DNA, 20 bp, Artificial Sequence
  chemically synthesized
gagagcataggagaagctag

SEQ ID NO: 240943 - DNA, 20 bp, Artificial Sequence
  chemically synthesized
tcaagaactgattagacttc

SEQ ID NO: 240944 - DNA, 20 bp, Artificial Sequence
  chemically synthesized
ggagaagctagaagtctaat

SEQ ID NO: 240945 - DNA, 20 bp, Artificial Sequence
  chemically synthesized
ttccttcttcaagaactgat

SEQ ID NO: 240946 - DNA, 20 bp, Artificial Sequence
  chemically synthesized
agaagtctaatcagttcttg

SEQ ID NO: 240947 - DNA, 20 bp, Artificial Sequence
  chemically synthesized
agtctaatcagttcttgaag

SEQ ID NO: 240948 - DNA, 20 bp, Artificial Sequence
  chemically synthesized
gtctaatcagttcttgaaga

SEQ ID NO: 240949 - DNA, 20 bp, Artificial Sequence
  chemically synthesized
caatttcactttccttcttc

SEQ ID NO: 240950 - DNA, 20 bp, Artificial Sequence
  chemically synthesized
aatcagttcttgaagaagga

SEQ ID NO: 240951 - DNA, 20 bp, Artificial Sequence
  chemically synthesized
atttaaaaatataattttgt

SEQ ID NO: 240952 - DNA, 20 bp, Artificial Sequence
  chemically synthesized
atataattttgtaagctata

SEQ ID NO: 240953 - DNA, 20 bp, Artificial Sequence
  chemically synthesized
taattttgtaagctataaag

SEQ ID NO: 240954 - DNA, 20 bp, Artificial Sequence
  chemically synthesized
aattttgtaagctataaaga

SEQ ID NO: 240955 - DNA, 20 bp, Artificial Sequence
  chemically synthesized
attttgtaagctataaagaa

SEQ ID NO: 240956 - DNA, 20 bp, Artificial Sequence
  chemically synthesized
tctcaccacccccttcttta

SEQ ID NO: 240957 - DNA, 20 bp, Artificial Sequence
  chemically synthesized
ttttgtaagctataaagaag

SEQ ID NO: 240958 - DNA, 20 bp, Artificial Sequence
  chemically synthesized
tttgtaagctataaagaagg

SEQ ID NO: 240959 - DNA, 20 bp, Artificial Sequence
  chemically synthesized
gtaagctataaagaaggggg

SEQ ID NO: 240960 - DNA, 20 bp, Artificial Sequence
  chemically synthesized
gctataaagaagggggtggt

SEQ ID NO: 240961 - DNA, 20 bp, Artificial Sequence
  chemically synthesized
ataaagaagggggtggtgag

SEQ ID NO: 240962 - DNA, 20 bp, Artificial Sequence
  chemically synthesized
agaagggggtggtgagaagt

SEQ ID NO: 240963 - DNA, 20 bp, Artificial Sequence
  chemically synthesized
ggggtggtgagaagttagaa

SEQ ID NO: 240964 - DNA, 20 bp, Artificial Sequence
  chemically synthesized
gtggtgagaagttagaatag

SEQ ID NO: 240965 - DNA, 20 bp, Artificial Sequence
  chemically synthesized
ggatgactccattgtacagc

SEQ ID NO: 240966 - DNA, 20 bp, Artificial Sequence
  chemically synthesized
tttgcaaacttgctgtacaa

SEQ ID NO: 240967 - DNA, 20 bp, Artificial Sequence
  chemically synthesized
tgcaaacttgctgtacaatg

SEQ ID NO: 240968 - DNA, 20 bp, Artificial Sequence
  chemically synthesized
ccttggatgactccattgta

SEQ ID NO: 240969 - DNA, 20 bp, Artificial Sequence
  chemically synthesized
gctgtacaatggagtcatcc

SEQ ID NO: 240970 - DNA, 20 bp, Artificial Sequence
  chemically synthesized
ctgtacaatggagtcatcca

SEQ ID NO: 240971 - DNA, 20 bp, Artificial Sequence
  chemically synthesized
tattttttttttaagatcct

SEQ ID NO: 240972 - DNA, 20 bp, Artificial Sequence
  chemically synthesized
ctctggtgtatttttttttt

SEQ ID NO: 240973 - DNA, 20 bp, Artificial Sequence
  chemically synthesized
atcttaaaaaaaaaatacac

SEQ ID NO: 240974 - DNA, 20 bp, Artificial Sequence
  chemically synthesized
cttaaaaaaaaaatacacca

SEQ ID NO: 240975 - DNA, 20 bp, Artificial Sequence
  chemically synthesized
aatcagttgaatcagatctc

SEQ ID NO: 240976 - DNA, 20 bp, Artificial Sequence
  chemically synthesized
atgtcccaaatcagttgaat

SEQ ID NO: 240977 - DNA, 20 bp, Artificial Sequence
  chemically synthesized
gagatctgattcaactgatt

SEQ ID NO: 240978 - DNA, 20 bp, Artificial Sequence
  chemically synthesized
agatctgattcaactgattt

SEQ ID NO: 240979 - DNA, 20 bp, Artificial Sequence
  chemically synthesized
gccctggccatgtcccaaat

SEQ ID NO: 240980 - DNA, 20 bp, Artificial Sequence
  chemically synthesized
gattcaactgatttgggaca

SEQ ID NO: 240981 - DNA, 20 bp, Artificial Sequence
  chemically synthesized
caactgatttgggacatggc

SEQ ID NO: 240982 - DNA, 20 bp, Artificial Sequence
  chemically synthesized
aactgatttgggacatggcc

SEQ ID NO: 240983 - DNA, 20 bp, Artificial Sequence
  chemically synthesized
actgatttgggacatggcca

SEQ ID NO: 240984 - DNA, 20 bp, Artificial Sequence
  chemically synthesized
ttgggacatggccagggcat

SEQ ID NO: 240985 - DNA, 20 bp, Artificial Sequence
  chemically synthesized
gggtgaaaattctgatgccc

SEQ ID NO: 240986 - DNA, 20 bp, Artificial Sequence
  chemically synthesized
atttgttatgttaaaatatt

SEQ ID NO: 240987 - DNA, 20 bp, Artificial Sequence
  chemically synthesized
aatttgttatgttaaaatat

SEQ ID NO: 240988 - DNA, 20 bp, Artificial Sequence
  chemically synthesized
ataacatttttaaaaattac

SEQ ID NO: 240989 - DNA, 20 bp, Artificial Sequence
  chemically synthesized
acaagtgatatctatatatc

SEQ ID NO: 240990 - DNA, 20 bp, Artificial Sequence
  chemically synthesized
catggtggaatctagatata

SEQ ID NO: 240991 - DNA, 20 bp, Artificial Sequence
  chemically synthesized
aaaatgttcatggtggaatc

SEQ ID NO: 240992 - DNA, 20 bp, Artificial Sequence
  chemically synthesized
gtatagtaaaatgttcatgg

SEQ ID NO: 240993 - DNA, 20 bp, Artificial Sequence
  chemically synthesized
cgagtatagtaaaatgttca

SEQ ID NO: 240994 - DNA, 20 bp, Artificial Sequence
  chemically synthesized
atatgtgatcaaaacgagta

SEQ ID NO: 240995 - DNA, 20 bp, Artificial Sequence
  chemically synthesized
aaaagatatgtgatcaaaac

SEQ ID NO: 240996 - DNA, 20 bp, Artificial Sequence
  chemically synthesized
ggatggatcggaggaaggaa

SEQ ID NO: 240997 - DNA, 20 bp, Artificial Sequence
  chemically synthesized
ttgatggatggatcggagga

SEQ ID NO: 240998 - DNA, 20 bp, Artificial Sequence
  chemically synthesized
attgatggatggatcggagg

SEQ ID NO: 240999 - DNA, 20 bp, Artificial Sequence
  chemically synthesized
ttgattgatggatggatcgg

SEQ ID NO: 241000 - DNA, 20 bp, Artificial Sequence
  chemically synthesized
attgattgatggatggatcg

SEQ ID NO: 241001 - DNA, 20 bp, Artificial Sequence
  chemically synthesized
tgattgattgatggatggat

SEQ ID NO: 241002 - DNA, 20 bp, Artificial Sequence
  chemically synthesized
aaatatgattgattgatgga

SEQ ID NO: 241003 - DNA, 20 bp, Artificial Sequence
  chemically synthesized
tcaaaaatatgattgattga

SEQ ID NO: 241004 - DNA, 20 bp, Artificial Sequence
  chemically synthesized
tcatatttttgatgcatatc

SEQ ID NO: 241005 - DNA, 20 bp, Artificial Sequence
  chemically synthesized
catatttttgatgcatatcc

SEQ ID NO: 241006 - DNA, 20 bp, Artificial Sequence
  chemically synthesized
actgatgtcagcagtttacc

SEQ ID NO: 241007 - DNA, 20 bp, Artificial Sequence
  chemically synthesized
tccaggtaaactgctgacat

SEQ ID NO: 241008 - DNA, 20 bp, Artificial Sequence
  chemically synthesized
gtgaatgatactgatgtcag

SEQ ID NO: 241009 - DNA, 20 bp, Artificial Sequence
  chemically synthesized
aaggtgaatgatactgatgt

SEQ ID NO: 241010 - DNA, 20 bp, Artificial Sequence
  chemically synthesized
tatccatattgaggtattta

SEQ ID NO: 241011 - DNA, 20 bp, Artificial Sequence
  chemically synthesized
atatccatattgaggtattt

SEQ ID NO: 241012 - DNA, 20 bp, Artificial Sequence
  chemically synthesized
tcaccttaaatacctcaata

SEQ ID NO: 241013 - DNA, 20 bp, Artificial Sequence
  chemically synthesized
attcagtgatatccatattg

SEQ ID NO: 241014 - DNA, 20 bp, Artificial Sequence
  chemically synthesized
tattcagtgatatccatatt

SEQ ID NO: 241015 - DNA, 20 bp, Artificial Sequence
  chemically synthesized
tcaatatggatatcactgaa

SEQ ID NO: 241016 - DNA, 20 bp, Artificial Sequence
  chemically synthesized
gaaaccttatgaattctatt

SEQ ID NO: 241017 - DNA, 20 bp, Artificial Sequence
  chemically synthesized
tatcactgaatagaattcat

SEQ ID NO: 241018 - DNA, 20 bp, Artificial Sequence
  chemically synthesized
atcactgaatagaattcata

SEQ ID NO: 241019 - DNA, 20 bp, Artificial Sequence
  chemically synthesized
taaataataacataataata

SEQ ID NO: 241020 - DNA, 20 bp, Artificial Sequence
  chemically synthesized
atgttattatttactgtatt

SEQ ID NO: 241021 - DNA, 20 bp, Artificial Sequence
  chemically synthesized
ggtaaagaggacaccaaata

SEQ ID NO: 241022 - DNA, 20 bp, Artificial Sequence
  chemically synthesized
gaattggccataaggtaaag

SEQ ID NO: 241023 - DNA, 20 bp, Artificial Sequence
  chemically synthesized
tgaattggccataaggtaaa

SEQ ID NO: 241024 - DNA, 20 bp, Artificial Sequence
  chemically synthesized
ttggtgtcctctttacctta

SEQ ID NO: 241025 - DNA, 20 bp, Artificial Sequence
  chemically synthesized
cttgaattggccataaggta

SEQ ID NO: 241026 - DNA, 20 bp, Artificial Sequence
  chemically synthesized
tattacttgaattggccata

SEQ ID NO: 241027 - DNA, 20 bp, Artificial Sequence
  chemically synthesized
ttattacttgaattggccat

SEQ ID NO: 241028 - DNA, 20 bp, Artificial Sequence
  chemically synthesized
ctttaccttatggccaattc

SEQ ID NO: 241029 - DNA, 20 bp, Artificial Sequence
  chemically synthesized
tgcagagttattacttgaat

SEQ ID NO: 241030 - DNA, 20 bp, Artificial Sequence
  chemically synthesized
aattcaagtaataactctgc

SEQ ID NO: 241031 - DNA, 20 bp, Artificial Sequence
  chemically synthesized
attcaagtaataactctgca

SEQ ID NO: 241032 - DNA, 20 bp, Artificial Sequence
  chemically synthesized
caagtaataactctgcaagg

SEQ ID NO: 241033 - DNA, 20 bp, Artificial Sequence
  chemically synthesized
taagtaataactaccttgca

SEQ ID NO: 241034 - DNA, 20 bp, Artificial Sequence
  chemically synthesized
tctaagtaataactaccttg

SEQ ID NO: 241035 - DNA, 20 bp, Artificial Sequence
  chemically synthesized
tctgcaaggtagttattact

SEQ ID NO: 241036 - DNA, 20 bp, Artificial Sequence
  chemically synthesized
gcaaggtagttattacttag

SEQ ID NO: 241037 - DNA, 20 bp, Artificial Sequence
  chemically synthesized
caaggtagttattacttaga

SEQ ID NO: 241038 - DNA, 20 bp, Artificial Sequence
  chemically synthesized
ctgaatctttttttccttct

SEQ ID NO: 241039 - DNA, 20 bp, Artificial Sequence
  chemically synthesized
ttattacttagaaggaaaaa

SEQ ID NO: 241040 - DNA, 20 bp, Artificial Sequence
  chemically synthesized
cttagaaggaaaaaaagatt

SEQ ID NO: 241041 - DNA, 20 bp, Artificial Sequence
  chemically synthesized
tagaaggaaaaaaagattca

SEQ ID NO: 241042 - DNA, 20 bp, Artificial Sequence
  chemically synthesized
aaaaaagattcagagacatt

SEQ ID NO: 241043 - DNA, 20 bp, Artificial Sequence
  chemically synthesized
acttcccatgtgaacattaa

SEQ ID NO: 241044 - DNA, 20 bp, Artificial Sequence
  chemically synthesized
gtcatcttttaatgttcaca

SEQ ID NO: 241045 - DNA, 20 bp, Artificial Sequence
  chemically synthesized
tcatcttttaatgttcacat

SEQ ID NO: 241046 - DNA, 20 bp, Artificial Sequence
  chemically synthesized
tcttttaatgttcacatggg

SEQ ID NO: 241047 - DNA, 20 bp, Artificial Sequence
  chemically synthesized
aatgttcacatgggaagtaa

SEQ ID NO: 241048 - DNA, 20 bp, Artificial Sequence
  chemically synthesized
atgttcacatgggaagtaaa

SEQ ID NO: 241049 - DNA, 20 bp, Artificial Sequence
  chemically synthesized
ttcacatgggaagtaaaagg

SEQ ID NO: 241050 - DNA, 20 bp, Artificial Sequence
  chemically synthesized
cacatgggaagtaaaaggta

SEQ ID NO: 241051 - DNA, 20 bp, Artificial Sequence
  chemically synthesized
tgggaagtaaaaggtagagt

SEQ ID NO: 241052 - DNA, 20 bp, Artificial Sequence
  chemically synthesized
ggtagagttggattcaaatc

SEQ ID NO: 241053 - DNA, 20 bp, Artificial Sequence
  chemically synthesized
tttatgggataagtgaaagc

SEQ ID NO: 241054 - DNA, 20 bp, Artificial Sequence
  chemically synthesized
ctgttttatgggataagtga

SEQ ID NO: 241055 - DNA, 20 bp, Artificial Sequence
  chemically synthesized
ggaccactgttttatgggat

SEQ ID NO: 241056 - DNA, 20 bp, Artificial Sequence
  chemically synthesized
ctttcacttatcccataaaa

SEQ ID NO: 241057 - DNA, 20 bp, Artificial Sequence
  chemically synthesized
gtcagggaccactgttttat

SEQ ID NO: 241058 - DNA, 20 bp, Artificial Sequence
  chemically synthesized
ggtcagggaccactgtttta

SEQ ID NO: 241059 - DNA, 20 bp, Artificial Sequence
  chemically synthesized
tcacttatcccataaaacag

SEQ ID NO: 241060 - DNA, 20 bp, Artificial Sequence
  chemically synthesized
tcctggtgccaaaagggtca

SEQ ID NO: 241061 - DNA, 20 bp, Artificial Sequence
  chemically synthesized
ttcctggtgccaaaagggtc

SEQ ID NO: 241062 - DNA, 20 bp, Artificial Sequence
  chemically synthesized
acagtggtccctgacccttt

SEQ ID NO: 241063 - DNA, 20 bp, Artificial Sequence
  chemically synthesized
gttcctggtgccaaaagggt

SEQ ID NO: 241064 - DNA, 20 bp, Artificial Sequence
  chemically synthesized
atcagttcctggtgccaaaa

SEQ ID NO: 241065 - DNA, 20 bp, Artificial Sequence
  chemically synthesized
aatcagttcctggtgccaaa

SEQ ID NO: 241066 - DNA, 20 bp, Artificial Sequence
  chemically synthesized
gtccctgacccttttggcac

SEQ ID NO: 241067 - DNA, 20 bp, Artificial Sequence
  chemically synthesized
aaatcagttcctggtgccaa

SEQ ID NO: 241068 - DNA, 20 bp, Artificial Sequence
  chemically synthesized
tccctgacccttttggcacc

SEQ ID NO: 241069 - DNA, 20 bp, Artificial Sequence
  chemically synthesized
tcttccacaaaatcagttcc

SEQ ID NO: 241070 - DNA, 20 bp, Artificial Sequence
  chemically synthesized
ggcaccaggaactgattttg

SEQ ID NO: 241071 - DNA, 20 bp, Artificial Sequence
  chemically synthesized
aaaattgtcttccacaaaat

SEQ ID NO: 241072 - DNA, 20 bp, Artificial Sequence
  chemically synthesized
accaggaactgattttgtgg

SEQ ID NO: 241073 - DNA, 20 bp, Artificial Sequence
  chemically synthesized
tgtggaagacaatttttccg

SEQ ID NO: 241074 - DNA, 20 bp, Artificial Sequence
  chemically synthesized
aagacaatttttccgtggac

SEQ ID NO: 241075 - DNA, 20 bp, Artificial Sequence
  chemically synthesized
agacaatttttccgtggacc

SEQ ID NO: 241076 - DNA, 20 bp, Artificial Sequence
  chemically synthesized
ccatcctccaacccggtcca

SEQ ID NO: 241077 - DNA, 20 bp, Artificial Sequence
  chemically synthesized
aatttttccgtggaccgggt

SEQ ID NO: 241078 - DNA, 20 bp, Artificial Sequence
  chemically synthesized
tttttccgtggaccgggttg

SEQ ID NO: 241079 - DNA, 20 bp, Artificial Sequence
  chemically synthesized
ttttccgtggaccgggttgg

SEQ ID NO: 241080 - DNA, 20 bp, Artificial Sequence
  chemically synthesized
atggaaaccatcctccaacc

SEQ ID NO: 241081 - DNA, 20 bp, Artificial Sequence
  chemically synthesized
ccgtggaccgggttggagga

SEQ ID NO: 241082 - DNA, 20 bp, Artificial Sequence
  chemically synthesized
tgtaatgcacttgaatcata

SEQ ID NO: 241083 - DNA, 20 bp, Artificial Sequence
  chemically synthesized
ggatggtttccatatgattc

SEQ ID NO: 241084 - DNA, 20 bp, Artificial Sequence
  chemically synthesized
catatgattcaagtgcatta

SEQ ID NO: 241085 - DNA, 20 bp, Artificial Sequence
  chemically synthesized
cactgaatctacattatggt

SEQ ID NO: 241086 - DNA, 20 bp, Artificial Sequence
  chemically synthesized
ttatacaactcaccataatg

SEQ ID NO: 241087 - DNA, 20 bp, Artificial Sequence
  chemically synthesized
ctcccactgaatctacatta

SEQ ID NO: 241088 - DNA, 20 bp, Artificial Sequence
  chemically synthesized
aactcaccataatgtagatt

SEQ ID NO: 241089 - DNA, 20 bp, Artificial Sequence
  chemically synthesized
tcaccataatgtagattcag

SEQ ID NO: 241090 - DNA, 20 bp, Artificial Sequence
  chemically synthesized
caccataatgtagattcagt

SEQ ID NO: 241091 - DNA, 20 bp, Artificial Sequence
  chemically synthesized
ccataatgtagattcagtgg

SEQ ID NO: 241092 - DNA, 20 bp, Artificial Sequence
  chemically synthesized
gtagattcagtgggagcctt

SEQ ID NO: 241093 - DNA, 20 bp, Artificial Sequence
  chemically synthesized
gctgcaggaaaggaagctca

SEQ ID NO: 241094 - DNA, 20 bp, Artificial Sequence
  chemically synthesized
agctgcaggaaaggaagctc

SEQ ID NO: 241095 - DNA, 20 bp, Artificial Sequence
  chemically synthesized
ccatctagctgcaggaaagg

SEQ ID NO: 241096 - DNA, 20 bp, Artificial Sequence
  chemically synthesized
gccttgagcttcctttcctg

SEQ ID NO: 241097 - DNA, 20 bp, Artificial Sequence
  chemically synthesized
ggaccatctagctgcaggaa

SEQ ID NO: 241098 - DNA, 20 bp, Artificial Sequence
  chemically synthesized
gggaccatctagctgcagga

SEQ ID NO: 241099 - DNA, 20 bp, Artificial Sequence
  chemically synthesized
tgagcttcctttcctgcagc

SEQ ID NO: 241100 - DNA, 20 bp, Artificial Sequence
  chemically synthesized
agatgggaccatctagctgc

SEQ ID NO: 241101 - DNA, 20 bp, Artificial Sequence
  chemically synthesized
cagatgggaccatctagctg

SEQ ID NO: 241102 - DNA, 20 bp, Artificial Sequence
  chemically synthesized
cttcctttcctgcagctaga

SEQ ID NO: 241103 - DNA, 20 bp, Artificial Sequence
  chemically synthesized
accccccagatgggaccatc

SEQ ID NO: 241104 - DNA, 20 bp, Artificial Sequence
  chemically synthesized
tgcagctagatggtcccatc

SEQ ID NO: 241105 - DNA, 20 bp, Artificial Sequence
  chemically synthesized
gcagctagatggtcccatct

SEQ ID NO: 241106 - DNA, 20 bp, Artificial Sequence
  chemically synthesized
cagctagatggtcccatctg

SEQ ID NO: 241107 - DNA, 20 bp, Artificial Sequence
  chemically synthesized
agctagatggtcccatctgg

SEQ ID NO: 241108 - DNA, 20 bp, Artificial Sequence
  chemically synthesized
gctagatggtcccatctggg

SEQ ID NO: 241109 - DNA, 20 bp, Artificial Sequence
  chemically synthesized
tctcccatcaccccccagat

SEQ ID NO: 241110 - DNA, 20 bp, Artificial Sequence
  chemically synthesized
gtctcccatcaccccccaga

SEQ ID NO: 241111 - DNA, 20 bp, Artificial Sequence
  chemically synthesized
cactgtctcccatcaccccc

SEQ ID NO: 241112 - DNA, 20 bp, Artificial Sequence
  chemically synthesized
tggtcccatctggggggtga

SEQ ID NO: 241113 - DNA, 20 bp, Artificial Sequence
  chemically synthesized
ggtcccatctggggggtgat

SEQ ID NO: 241114 - DNA, 20 bp, Artificial Sequence
  chemically synthesized
tcccatctggggggtgatgg

SEQ ID NO: 241115 - DNA, 20 bp, Artificial Sequence
  chemically synthesized
atctggggggtgatgggaga

SEQ ID NO: 241116 - DNA, 20 bp, Artificial Sequence
  chemically synthesized
ggggtgatgggagacagtga

SEQ ID NO: 241117 - DNA, 20 bp, Artificial Sequence
  chemically synthesized
ggagacagtgacagatcatg

SEQ ID NO: 241118 - DNA, 20 bp, Artificial Sequence
  chemically synthesized
agtgacagatcatgcagcat

SEQ ID NO: 241119 - DNA, 20 bp, Artificial Sequence
  chemically synthesized
atgcagcattagattctcat

SEQ ID NO: 241120 - DNA, 20 bp, Artificial Sequence
  chemically synthesized
tgcagcattagattctcata

SEQ ID NO: 241121 - DNA, 20 bp, Artificial Sequence
  chemically synthesized
cagcattagattctcataag

SEQ ID NO: 241122 - DNA, 20 bp, Artificial Sequence
  chemically synthesized
ctaggttgcatgctccttat

SEQ ID NO: 241123 - DNA, 20 bp, Artificial Sequence
  chemically synthesized
ctcataaggagcatgcaacc

SEQ ID NO: 241124 - DNA, 20 bp, Artificial Sequence
  chemically synthesized
actactcatgcaagggatct

SEQ ID NO: 241125 - DNA, 20 bp, Artificial Sequence
  chemically synthesized
aactactcatgcaagggatc

SEQ ID NO: 241126 - DNA, 20 bp, Artificial Sequence
  chemically synthesized
gcaacctagatcccttgcat

SEQ ID NO: 241127 - DNA, 20 bp, Artificial Sequence
  chemically synthesized
attgtgaactactcatgcaa

SEQ ID NO: 241128 - DNA, 20 bp, Artificial Sequence
  chemically synthesized
tattgtgaactactcatgca

SEQ ID NO: 241129 - DNA, 20 bp, Artificial Sequence
  chemically synthesized
acctagatcccttgcatgag

SEQ ID NO: 241130 - DNA, 20 bp, Artificial Sequence
  chemically synthesized
ctattgtgaactactcatgc

SEQ ID NO: 241131 - DNA, 20 bp, Artificial Sequence
  chemically synthesized
cttgcatgagtagttcacaa

SEQ ID NO: 241132 - DNA, 20 bp, Artificial Sequence
  chemically synthesized
ttgcatgagtagttcacaat

SEQ ID NO: 241133 - DNA, 20 bp, Artificial Sequence
  chemically synthesized
tgcatgagtagttcacaata

SEQ ID NO: 241134 - DNA, 20 bp, Artificial Sequence
  chemically synthesized
caatagggtttgtgctccta

SEQ ID NO: 241135 - DNA, 20 bp, Artificial Sequence
  chemically synthesized
aatagggtttgtgctcctat

SEQ ID NO: 241136 - DNA, 20 bp, Artificial Sequence
  chemically synthesized
gccacattaaattcccatag

SEQ ID NO: 241137 - DNA, 20 bp, Artificial Sequence
  chemically synthesized
cagccacattaaattcccat

SEQ ID NO: 241138 - DNA, 20 bp, Artificial Sequence
  chemically synthesized
gcagccacattaaattccca

SEQ ID NO: 241139 - DNA, 20 bp, Artificial Sequence
  chemically synthesized
gctcctatgggaatttaatg

SEQ ID NO: 241140 - DNA, 20 bp, Artificial Sequence
  chemically synthesized
tccacctcctgtcagatcag

SEQ ID NO: 241141 - DNA, 20 bp, Artificial Sequence
  chemically synthesized
taatgtggctgctgatctga

SEQ ID NO: 241142 - DNA, 20 bp, Artificial Sequence
  chemically synthesized
aatgtggctgctgatctgac

SEQ ID NO: 241143 - DNA, 20 bp, Artificial Sequence
  chemically synthesized
agctccacctcctgtcagat

SEQ ID NO: 241144 - DNA, 20 bp, Artificial Sequence
  chemically synthesized
tgtggctgctgatctgacag

SEQ ID NO: 241145 - DNA, 20 bp, Artificial Sequence
  chemically synthesized
gtggctgctgatctgacagg

SEQ ID NO: 241146 - DNA, 20 bp, Artificial Sequence
  chemically synthesized
gcctgagctccacctcctgt

SEQ ID NO: 241147 - DNA, 20 bp, Artificial Sequence
  chemically synthesized
gctgctgatctgacaggagg

SEQ ID NO: 241148 - DNA, 20 bp, Artificial Sequence
  chemically synthesized
tgctgatctgacaggaggtg

SEQ ID NO: 241149 - DNA, 20 bp, Artificial Sequence
  chemically synthesized
atctgacaggaggtggagct

SEQ ID NO: 241150 - DNA, 20 bp, Artificial Sequence
  chemically synthesized
tctgacaggaggtggagctc

SEQ ID NO: 241151 - DNA, 20 bp, Artificial Sequence
  chemically synthesized
gacaggaggtggagctcagg

SEQ ID NO: 241152 - DNA, 20 bp, Artificial Sequence
  chemically synthesized
tcatcactccatttctgcct

SEQ ID NO: 241153 - DNA, 20 bp, Artificial Sequence
  chemically synthesized
aggtggagctcaggcagaaa

SEQ ID NO: 241154 - DNA, 20 bp, Artificial Sequence
  chemically synthesized
gtggagctcaggcagaaatg

SEQ ID NO: 241155 - DNA, 20 bp, Artificial Sequence
  chemically synthesized
tcaggcagaaatggagtgat

SEQ ID NO: 241156 - DNA, 20 bp, Artificial Sequence
  chemically synthesized
caggcagaaatggagtgatg

SEQ ID NO: 241157 - DNA, 20 bp, Artificial Sequence
  chemically synthesized
ggcagaaatggagtgatgag

SEQ ID NO: 241158 - DNA, 20 bp, Artificial Sequence
  chemically synthesized
agaaatggagtgatgaggag

SEQ ID NO: 241159 - DNA, 20 bp, Artificial Sequence
  chemically synthesized
atgaggagcagctgtaaata

SEQ ID NO: 241160 - DNA, 20 bp, Artificial Sequence
  chemically synthesized
ggaagcttcatctgtattta

SEQ ID NO: 241161 - DNA, 20 bp, Artificial Sequence
  chemically synthesized
agcagctgtaaatacagatg

SEQ ID NO: 241162 - DNA, 20 bp, Artificial Sequence
  chemically synthesized
acagatgaagcttccttccc

SEQ ID NO: 241163 - DNA, 20 bp, Artificial Sequence
  chemically synthesized
cagcagcgggctagggaagg

SEQ ID NO: 241164 - DNA, 20 bp, Artificial Sequence
  chemically synthesized
gagcagcagcgggctaggga

SEQ ID NO: 241165 - DNA, 20 bp, Artificial Sequence
  chemically synthesized
tgagcagcagcgggctaggg

SEQ ID NO: 241166 - DNA, 20 bp, Artificial Sequence
  chemically synthesized
aggtgagcagcagcgggcta

SEQ ID NO: 241167 - DNA, 20 bp, Artificial Sequence
  chemically synthesized
taggtgagcagcagcgggct

SEQ ID NO: 241168 - DNA, 20 bp, Artificial Sequence
  chemically synthesized
gtaggtgagcagcagcgggc

SEQ ID NO: 241169 - DNA, 20 bp, Artificial Sequence
  chemically synthesized
agcagtaggtgagcagcagc

SEQ ID NO: 241170 - DNA, 20 bp, Artificial Sequence
  chemically synthesized
aagcagtaggtgagcagcag

SEQ ID NO: 241171 - DNA, 20 bp, Artificial Sequence
  chemically synthesized
gcaaagcagtaggtgagcag

SEQ ID NO: 241172 - DNA, 20 bp, Artificial Sequence
  chemically synthesized
ttcgcaaagcagtaggtgag

SEQ ID NO: 241173 - DNA, 20 bp, Artificial Sequence
  chemically synthesized
cgattcgcaaagcagtaggt

SEQ ID NO: 241174 - DNA, 20 bp, Artificial Sequence
  chemically synthesized
gacccgattcgcaaagcagt

SEQ ID NO: 241175 - DNA, 20 bp, Artificial Sequence
  chemically synthesized
ggacccgattcgcaaagcag

SEQ ID NO: 241176 - DNA, 20 bp, Artificial Sequence
  chemically synthesized
tagggacccgattcgcaaag

SEQ ID NO: 241177 - DNA, 20 bp, Artificial Sequence
  chemically synthesized
tcacctactgctttgcgaat

SEQ ID NO: 241178 - DNA, 20 bp, Artificial Sequence
  chemically synthesized
tgttagggacccgattcgca

SEQ ID NO: 241179 - DNA, 20 bp, Artificial Sequence
  chemically synthesized
cacctactgctttgcgaatc

SEQ ID NO: 241180 - DNA, 20 bp, Artificial Sequence
  chemically synthesized
tttgcgaatcgggtccctaa

SEQ ID NO: 241181 - DNA, 20 bp, Artificial Sequence
  chemically synthesized
ttgcgaatcgggtccctaac

SEQ ID NO: 241182 - DNA, 20 bp, Artificial Sequence
  chemically synthesized
taccaatccgttgcctgtta

SEQ ID NO: 241183 - DNA, 20 bp, Artificial Sequence
  chemically synthesized
gtaccaatccgttgcctgtt

SEQ ID NO: 241184 - DNA, 20 bp, Artificial Sequence
  chemically synthesized
cgtaccaatccgttgcctgt

SEQ ID NO: 241185 - DNA, 20 bp, Artificial Sequence
  chemically synthesized
atcgggtccctaacaggcaa

SEQ ID NO: 241186 - DNA, 20 bp, Artificial Sequence
  chemically synthesized
gtccctaacaggcaacggat

SEQ ID NO: 241187 - DNA, 20 bp, Artificial Sequence
  chemically synthesized
taacaggcaacggattggta

SEQ ID NO: 241188 - DNA, 20 bp, Artificial Sequence
  chemically synthesized
aacaggcaacggattggtac

SEQ ID NO: 241189 - DNA, 20 bp, Artificial Sequence
  chemically synthesized
aacggattggtacgggtctg

SEQ ID NO: 241190 - DNA, 20 bp, Artificial Sequence
  chemically synthesized
ttggtacgggtctgtggctc

SEQ ID NO: 241191 - DNA, 20 bp, Artificial Sequence
  chemically synthesized
tggtacgggtctgtggctct

SEQ ID NO: 241192 - DNA, 20 bp, Artificial Sequence
  chemically synthesized
gtacctcaaccccagagcca

SEQ ID NO: 241193 - DNA, 20 bp, Artificial Sequence
  chemically synthesized
ggtacgggtctgtggctctg

SEQ ID NO: 241194 - DNA, 20 bp, Artificial Sequence
  chemically synthesized
gggtctgtggctctggggtt

SEQ ID NO: 241195 - DNA, 20 bp, Artificial Sequence
  chemically synthesized
ggcagggtacctcaacccca

SEQ ID NO: 241196 - DNA, 20 bp, Artificial Sequence
  chemically synthesized
ggtctgtggctctggggttg

SEQ ID NO: 241197 - DNA, 20 bp, Artificial Sequence
  chemically synthesized
atggcagggtacctcaaccc

SEQ ID NO: 241198 - DNA, 20 bp, Artificial Sequence
  chemically synthesized
aaatatagtattttatggca

SEQ ID NO: 241199 - DNA, 20 bp, Artificial Sequence
  chemically synthesized
aaaatatagtattttatggc

SEQ ID NO: 241200 - DNA, 20 bp, Artificial Sequence
  chemically synthesized
aaaaatatagtattttatgg

SEQ ID NO: 241201 - DNA, 20 bp, Artificial Sequence
  chemically synthesized
gaaaaaaatatagtatttta

SEQ ID NO: 241202 - DNA, 20 bp, Artificial Sequence
  chemically synthesized
ttggaaaaatgaaaaaaata

SEQ ID NO: 241203 - DNA, 20 bp, Artificial Sequence
  chemically synthesized
ctcatagcattagagacatt

SEQ ID NO: 241204 - DNA, 20 bp, Artificial Sequence
  chemically synthesized
cttctaccctcatagcatta

SEQ ID NO: 241205 - DNA, 20 bp, Artificial Sequence
  chemically synthesized
ccaaatgtctctaatgctat

SEQ ID NO: 241206 - DNA, 20 bp, Artificial Sequence
  chemically synthesized
cacttctaccctcatagcat

SEQ ID NO: 241207 - DNA, 20 bp, Artificial Sequence
  chemically synthesized
caaatgtctctaatgctatg

SEQ ID NO: 241208 - DNA, 20 bp, Artificial Sequence
  chemically synthesized
aaatgtctctaatgctatga

SEQ ID NO: 241209 - DNA, 20 bp, Artificial Sequence
  chemically synthesized
tgtctctaatgctatgaggg

SEQ ID NO: 241210 - DNA, 20 bp, Artificial Sequence
  chemically synthesized
cctttccacttctaccctca

SEQ ID NO: 241211 - DNA, 20 bp, Artificial Sequence
  chemically synthesized
ctctaatgctatgagggtag

SEQ ID NO: 241212 - DNA, 20 bp, Artificial Sequence
  chemically synthesized
taatgctatgagggtagaag

SEQ ID NO: 241213 - DNA, 20 bp, Artificial Sequence
  chemically synthesized
gctatgagggtagaagtgga

SEQ ID NO: 241214 - DNA, 20 bp, Artificial Sequence
  chemically synthesized
ctatgagggtagaagtggaa

SEQ ID NO: 241215 - DNA, 20 bp, Artificial Sequence
  chemically synthesized
atgagggtagaagtggaaag

SEQ ID NO: 241216 - DNA, 20 bp, Artificial Sequence
  chemically synthesized
gaagtggaaaggagtcgaat

SEQ ID NO: 241217 - DNA, 20 bp, Artificial Sequence
  chemically synthesized
cgaattagatatttaatttg

SEQ ID NO: 241218 - DNA, 20 bp, Artificial Sequence
  chemically synthesized
ccttccaaaattgtaatggg

SEQ ID NO: 241219 - DNA, 20 bp, Artificial Sequence
  chemically synthesized
taaccttccaaaattgtaat

SEQ ID NO: 241220 - DNA, 20 bp, Artificial Sequence
  chemically synthesized
ctaaccttccaaaattgtaa

SEQ ID NO: 241221 - DNA, 20 bp, Artificial Sequence
  chemically synthesized
aagtctacccattacaattt

SEQ ID NO: 241222 - DNA, 20 bp, Artificial Sequence
  chemically synthesized
tctacccattacaattttgg

SEQ ID NO: 241223 - DNA, 20 bp, Artificial Sequence
  chemically synthesized
ctacccattacaattttgga

SEQ ID NO: 241224 - DNA, 20 bp, Artificial Sequence
  chemically synthesized
ccattacaattttggaaggt

SEQ ID NO: 241225 - DNA, 20 bp, Artificial Sequence
  chemically synthesized
attacaattttggaaggtta

SEQ ID NO: 241226 - DNA, 20 bp, Artificial Sequence
  chemically synthesized
ttacaattttggaaggttag

SEQ ID NO: 241227 - DNA, 20 bp, Artificial Sequence
  chemically synthesized
tttggaaggttagaggccaa

SEQ ID NO: 241228 - DNA, 20 bp, Artificial Sequence
  chemically synthesized
ttggaaggttagaggccaaa

SEQ ID NO: 241229 - DNA, 20 bp, Artificial Sequence
  chemically synthesized
tggaaggttagaggccaaaa

SEQ ID NO: 241230 - DNA, 20 bp, Artificial Sequence
  chemically synthesized
ggaaggttagaggccaaaag

SEQ ID NO: 241231 - DNA, 20 bp, Artificial Sequence
  chemically synthesized
gaaggttagaggccaaaagg

SEQ ID NO: 241232 - DNA, 20 bp, Artificial Sequence
  chemically synthesized
aaacaagatacacccccttt

SEQ ID NO: 241233 - DNA, 20 bp, Artificial Sequence
  chemically synthesized
aaaagttgaaaaaataaaac

SEQ ID NO: 241234 - DNA, 20 bp, Artificial Sequence
  chemically synthesized
aacagttgtcatgttagaaa

SEQ ID NO: 241235 - DNA, 20 bp, Artificial Sequence
  chemically synthesized
tttttcaacagttgtcatgt

SEQ ID NO: 241236 - DNA, 20 bp, Artificial Sequence
  chemically synthesized
acatgatacttatttttcaa

SEQ ID NO: 241237 - DNA, 20 bp, Artificial Sequence
  chemically synthesized
catgacaactgttgaaaaat

SEQ ID NO: 241238 - DNA, 20 bp, Artificial Sequence
  chemically synthesized
aaaataagtatcatgtacaa

SEQ ID NO: 241239 - DNA, 20 bp, Artificial Sequence
  chemically synthesized
aaataagtatcatgtacaaa

SEQ ID NO: 241240 - DNA, 20 bp, Artificial Sequence
  chemically synthesized
catgtacaaaaggtaaataa

SEQ ID NO: 241241 - DNA, 20 bp, Artificial Sequence
  chemically synthesized
gtacaaaaggtaaataaaag

SEQ ID NO: 241242 - DNA, 20 bp, Artificial Sequence
  chemically synthesized
tccaaatgaaaacaaagtga

SEQ ID NO: 241243 - DNA, 20 bp, Artificial Sequence
  chemically synthesized
ctccaaatgaaaacaaagtg

SEQ ID NO: 241244 - DNA, 20 bp, Artificial Sequence
  chemically synthesized
aaatactccaaatgaaaaca

SEQ ID NO: 241245 - DNA, 20 bp, Artificial Sequence
  chemically synthesized
gccttcactttgttttcatt

SEQ ID NO: 241246 - DNA, 20 bp, Artificial Sequence
  chemically synthesized
cttcactttgttttcatttg

SEQ ID NO: 241247 - DNA, 20 bp, Artificial Sequence
  chemically synthesized
aatccatgttaaggcattat

SEQ ID NO: 241248 - DNA, 20 bp, Artificial Sequence
  chemically synthesized
catcttataatgccttaaca

SEQ ID NO: 241249 - DNA, 20 bp, Artificial Sequence
  chemically synthesized
taagttaaaaatccatgtta

SEQ ID NO: 241250 - DNA, 20 bp, Artificial Sequence
  chemically synthesized
ttaagttaaaaatccatgtt

SEQ ID NO: 241251 - DNA, 20 bp, Artificial Sequence
  chemically synthesized
aatttaagggcgatttcatt

SEQ ID NO: 241252 - DNA, 20 bp, Artificial Sequence
  chemically synthesized
tctgttaatgacaaatttaa

SEQ ID NO: 241253 - DNA, 20 bp, Artificial Sequence
  chemically synthesized
gtctgttaatgacaaattta

SEQ ID NO: 241254 - DNA, 20 bp, Artificial Sequence
  chemically synthesized
agtctgttaatgacaaattt

SEQ ID NO: 241255 - DNA, 20 bp, Artificial Sequence
  chemically synthesized
gcccttaaatttgtcattaa

SEQ ID NO: 241256 - DNA, 20 bp, Artificial Sequence
  chemically synthesized
tcattaacagactattgttt

SEQ ID NO: 241257 - DNA, 20 bp, Artificial Sequence
  chemically synthesized
aaacactaaaactaaaacaa

SEQ ID NO: 241258 - DNA, 20 bp, Artificial Sequence
  chemically synthesized
acagactattgttttagttt

SEQ ID NO: 241259 - DNA, 20 bp, Artificial Sequence
  chemically synthesized
atacaatgacaatattttca

SEQ ID NO: 241260 - DNA, 20 bp, Artificial Sequence
  chemically synthesized
ttgtcattgtattaaaaaat

SEQ ID NO: 241261 - DNA, 20 bp, Artificial Sequence
  chemically synthesized
attaaaaaataagaatttcc

SEQ ID NO: 241262 - DNA, 20 bp, Artificial Sequence
  chemically synthesized
ttcactgtcattttgtaact

SEQ ID NO: 241263 - DNA, 20 bp, Artificial Sequence
  chemically synthesized
atttccaagttacaaaatga

SEQ ID NO: 241264 - DNA, 20 bp, Artificial Sequence
  chemically synthesized
aaaatgacagtgaaaaaaac

SEQ ID NO: 241265 - DNA, 20 bp, Artificial Sequence
  chemically synthesized
tgagggtggaatggtatggc

SEQ ID NO: 241266 - DNA, 20 bp, Artificial Sequence
  chemically synthesized
tatgtgagggtggaatggta

SEQ ID NO: 241267 - DNA, 20 bp, Artificial Sequence
  chemically synthesized
gctgttatgtgagggtggaa

SEQ ID NO: 241268 - DNA, 20 bp, Artificial Sequence
  chemically synthesized
tgatagctgttatgtgaggg

SEQ ID NO: 241269 - DNA, 20 bp, Artificial Sequence
  chemically synthesized
tcctgatagctgttatgtga

SEQ ID NO: 241270 - DNA, 20 bp, Artificial Sequence
  chemically synthesized
accattccaccctcacataa

SEQ ID NO: 241271 - DNA, 20 bp, Artificial Sequence
  chemically synthesized
atcctgatagctgttatgtg

SEQ ID NO: 241272 - DNA, 20 bp, Artificial Sequence
  chemically synthesized
catcctgatagctgttatgt

SEQ ID NO: 241273 - DNA, 20 bp, Artificial Sequence
  chemically synthesized
caccctcacataacagctat

SEQ ID NO: 241274 - DNA, 20 bp, Artificial Sequence
  chemically synthesized
accctcacataacagctatc

SEQ ID NO: 241275 - DNA, 20 bp, Artificial Sequence
  chemically synthesized
aaaattattcttcatcctga

SEQ ID NO: 241276 - DNA, 20 bp, Artificial Sequence
  chemically synthesized
acataacagctatcaggatg

SEQ ID NO: 241277 - DNA, 20 bp, Artificial Sequence
  chemically synthesized
gagaactaataaatgataaa

SEQ ID NO: 241278 - DNA, 20 bp, Artificial Sequence
  chemically synthesized
tagagaactaataaatgata

SEQ ID NO: 241279 - DNA, 20 bp, Artificial Sequence
  chemically synthesized
tttttctctttatcatttat

SEQ ID NO: 241280 - DNA, 20 bp, Artificial Sequence
  chemically synthesized
ttccttaaaaaattaggtta

SEQ ID NO: 241281 - DNA, 20 bp, Artificial Sequence
  chemically synthesized
aattccttaaaaaattaggt

SEQ ID NO: 241282 - DNA, 20 bp, Artificial Sequence
  chemically synthesized
aatgaattccttaaaaaatt

SEQ ID NO: 241283 - DNA, 20 bp, Artificial Sequence
  chemically synthesized
gttctctaacctaatttttt

SEQ ID NO: 241284 - DNA, 20 bp, Artificial Sequence
  chemically synthesized
aaatgaattccttaaaaaat

SEQ ID NO: 241285 - DNA, 20 bp, Artificial Sequence
  chemically synthesized
ttctctaacctaatttttta

SEQ ID NO: 241286 - DNA, 20 bp, Artificial Sequence
  chemically synthesized
aaggaattcatttaaaatca

SEQ ID NO: 241287 - DNA, 20 bp, Artificial Sequence
  chemically synthesized
aaaatgaaaatataactaat

SEQ ID NO: 241288 - DNA, 20 bp, Artificial Sequence
  chemically synthesized
tgaaaatataactaataaga

SEQ ID NO: 241289 - DNA, 20 bp, Artificial Sequence
  chemically synthesized
cacctcaaatactatcttat

SEQ ID NO: 241290 - DNA, 20 bp, Artificial Sequence
  chemically synthesized
taactaataagatagtattt

SEQ ID NO: 241291 - DNA, 20 bp, Artificial Sequence
  chemically synthesized
aactaataagatagtatttg

SEQ ID NO: 241292 - DNA, 20 bp, Artificial Sequence
  chemically synthesized
taagatagtatttgaggtga

SEQ ID NO: 241293 - DNA, 20 bp, Artificial Sequence
  chemically synthesized
aagatagtatttgaggtgat

SEQ ID NO: 241294 - DNA, 20 bp, Artificial Sequence
  chemically synthesized
aggtgataggatttcctcct

SEQ ID NO: 241295 - DNA, 20 bp, Artificial Sequence
  chemically synthesized
taagattttcattgctgagg

SEQ ID NO: 241296 - DNA, 20 bp, Artificial Sequence
  chemically synthesized
gtaagattttcattgctgag

SEQ ID NO: 241297 - DNA, 20 bp, Artificial Sequence
  chemically synthesized
atgtaagattttcattgctg

SEQ ID NO: 241298 - DNA, 20 bp, Artificial Sequence
  chemically synthesized
tatgtaagattttcattgct

SEQ ID NO: 241299 - DNA, 20 bp, Artificial Sequence
  chemically synthesized
cggtctttaaatgattatgt

SEQ ID NO: 241300 - DNA, 20 bp, Artificial Sequence
  chemically synthesized
aaatcttacataatcattta

SEQ ID NO: 241301 - DNA, 20 bp, Artificial Sequence
  chemically synthesized
ttacataatcatttaaagac

SEQ ID NO: 241302 - DNA, 20 bp, Artificial Sequence
  chemically synthesized
taatcatttaaagaccggtg

SEQ ID NO: 241303 - DNA, 20 bp, Artificial Sequence
  chemically synthesized
tctgattttcagcacttcac

SEQ ID NO: 241304 - DNA, 20 bp, Artificial Sequence
  chemically synthesized
accggtgaagtgctgaaaat

SEQ ID NO: 241305 - DNA, 20 bp, Artificial Sequence
  chemically synthesized
ttgtaattttgtctgatttt

SEQ ID NO: 241306 - DNA, 20 bp, Artificial Sequence
  chemically synthesized
attacaatgtgaaaatcatc

SEQ ID NO: 241307 - DNA, 20 bp, Artificial Sequence
  chemically synthesized
tacaatgtgaaaatcatcaa

SEQ ID NO: 241308 - DNA, 20 bp, Artificial Sequence
  chemically synthesized
acaatgtgaaaatcatcaag

SEQ ID NO: 241309 - DNA, 20 bp, Artificial Sequence
  chemically synthesized
gaaaatcatcaagaggaaac

SEQ ID NO: 241310 - DNA, 20 bp, Artificial Sequence
  chemically synthesized
gaggaaacaagtctatttta

SEQ ID NO: 241311 - DNA, 20 bp, Artificial Sequence
  chemically synthesized
aggaaacaagtctattttaa

SEQ ID NO: 241312 - DNA, 20 bp, Artificial Sequence
  chemically synthesized
taattggcattcctttaaaa

SEQ ID NO: 241313 - DNA, 20 bp, Artificial Sequence
  chemically synthesized
tattttaaaggaatgccaat

SEQ ID NO: 241314 - DNA, 20 bp, Artificial Sequence
  chemically synthesized
cggtaagttgtcagtctaat

SEQ ID NO: 241315 - DNA, 20 bp, Artificial Sequence
  chemically synthesized
tctgttgaacggtaagttgt

SEQ ID NO: 241316 - DNA, 20 bp, Artificial Sequence
  chemically synthesized
catattttctgttgaacggt

SEQ ID NO: 241317 - DNA, 20 bp, Artificial Sequence
  chemically synthesized
actgacaacttaccgttcaa

SEQ ID NO: 241318 - DNA, 20 bp, Artificial Sequence
  chemically synthesized
cttccatattttctgttgaa

SEQ ID NO: 241319 - DNA, 20 bp, Artificial Sequence
  chemically synthesized
ttaccgttcaacagaaaata

SEQ ID NO: 241320 - DNA, 20 bp, Artificial Sequence
  chemically synthesized
ccgttcaacagaaaatatgg

SEQ ID NO: 241321 - DNA, 20 bp, Artificial Sequence
  chemically synthesized
aacagaaaatatggaagcct

SEQ ID NO: 241322 - DNA, 20 bp, Artificial Sequence
  chemically synthesized
aagatagcatgattgttctc

SEQ ID NO: 241323 - DNA, 20 bp, Artificial Sequence
  chemically synthesized
gaagatagcatgattgttct

SEQ ID NO: 241324 - DNA, 20 bp, Artificial Sequence
  chemically synthesized
ccagttaatcacattgaaga

SEQ ID NO: 241325 - DNA, 20 bp, Artificial Sequence
  chemically synthesized
cattccagttaatcacattg

SEQ ID NO: 241326 - DNA, 20 bp, Artificial Sequence
  chemically synthesized
ctatcttcaatgtgattaac

SEQ ID NO: 241327 - DNA, 20 bp, Artificial Sequence
  chemically synthesized
tgtcctaccaaacagcattc

SEQ ID NO: 241328 - DNA, 20 bp, Artificial Sequence
  chemically synthesized
tgattaactggaatgctgtt

SEQ ID NO: 241329 - DNA, 20 bp, Artificial Sequence
  chemically synthesized
ttaactggaatgctgtttgg

SEQ ID NO: 241330 - DNA, 20 bp, Artificial Sequence
  chemically synthesized
taactggaatgctgtttggt

SEQ ID NO: 241331 - DNA, 20 bp, Artificial Sequence
  chemically synthesized
ggatggcatgtcctaccaaa

SEQ ID NO: 241332 - DNA, 20 bp, Artificial Sequence
  chemically synthesized
ttggtaggacatgccatcct

SEQ ID NO: 241333 - DNA, 20 bp, Artificial Sequence
  chemically synthesized
taatctagttaaactgagga

SEQ ID NO: 241334 - DNA, 20 bp, Artificial Sequence
  chemically synthesized
gcaataatctagttaaactg

SEQ ID NO: 241335 - DNA, 20 bp, Artificial Sequence
  chemically synthesized
agcaataatctagttaaact

SEQ ID NO: 241336 - DNA, 20 bp, Artificial Sequence
  chemically synthesized
catgccatcctcagtttaac

SEQ ID NO: 241337 - DNA, 20 bp, Artificial Sequence
  chemically synthesized
agtgtaatttagcaataatc

SEQ ID NO: 241338 - DNA, 20 bp, Artificial Sequence
  chemically synthesized
aaccaatttagagtgtaatt

SEQ ID NO: 241339 - DNA, 20 bp, Artificial Sequence
  chemically synthesized
tgctaaattacactctaaat

SEQ ID NO: 241340 - DNA, 20 bp, Artificial Sequence
  chemically synthesized
aagttggtacaaccaattta

SEQ ID NO: 241341 - DNA, 20 bp, Artificial Sequence
  chemically synthesized
ttaagttggtacaaccaatt

SEQ ID NO: 241342 - DNA, 20 bp, Artificial Sequence
  chemically synthesized
attcttgtagaaatttaagt

SEQ ID NO: 241343 - DNA, 20 bp, Artificial Sequence
  chemically synthesized
tctcattcttgtagaaattt

SEQ ID NO: 241344 - DNA, 20 bp, Artificial Sequence
  chemically synthesized
gtaccaacttaaatttctac

SEQ ID NO: 241345 - DNA, 20 bp, Artificial Sequence
  chemically synthesized
acttaaatttctacaagaat

SEQ ID NO: 241346 - DNA, 20 bp, Artificial Sequence
  chemically synthesized
gtcacaaactctcattcttg

SEQ ID NO: 241347 - DNA, 20 bp, Artificial Sequence
  chemically synthesized
ttaaatttctacaagaatga

SEQ ID NO: 241348 - DNA, 20 bp, Artificial Sequence
  chemically synthesized
aaataaaataagattgtgaa

SEQ ID NO: 241349 - DNA, 20 bp, Artificial Sequence
  chemically synthesized
aaaataaaataagattgtga

SEQ ID NO: 241350 - DNA, 20 bp, Artificial Sequence
  chemically synthesized
gaacaagtaaaaaataaaat

SEQ ID NO: 241351 - DNA, 20 bp, Artificial Sequence
  chemically synthesized
attttattttttacttgttc

SEQ ID NO: 241352 - DNA, 20 bp, Artificial Sequence
  chemically synthesized
tactcccatcggactggaac

SEQ ID NO: 241353 - DNA, 20 bp, Artificial Sequence
  chemically synthesized
ttttacttgttccagtccga

SEQ ID NO: 241354 - DNA, 20 bp, Artificial Sequence
  chemically synthesized
tttacttgttccagtccgat

SEQ ID NO: 241355 - DNA, 20 bp, Artificial Sequence
  chemically synthesized
ataacgtactcccatcggac

SEQ ID NO: 241356 - DNA, 20 bp, Artificial Sequence
  chemically synthesized
tacttgttccagtccgatgg

SEQ ID NO: 241357 - DNA, 20 bp, Artificial Sequence
  chemically synthesized
gtgagataacgtactcccat

SEQ ID NO: 241358 - DNA, 20 bp, Artificial Sequence
  chemically synthesized
tgggagtacgttatctcact

SEQ ID NO: 241359 - DNA, 20 bp, Artificial Sequence
  chemically synthesized
caaaccatatcgtactaagt

SEQ ID NO: 241360 - DNA, 20 bp, Artificial Sequence
  chemically synthesized
ctgccaaaccatatcgtact

SEQ ID NO: 241361 - DNA, 20 bp, Artificial Sequence
  chemically synthesized
ttatctcacttagtacgata

SEQ ID NO: 241362 - DNA, 20 bp, Artificial Sequence
  chemically synthesized
tcacttagtacgatatggtt

SEQ ID NO: 241363 - DNA, 20 bp, Artificial Sequence
  chemically synthesized
cttagtacgatatggtttgg

SEQ ID NO: 241364 - DNA, 20 bp, Artificial Sequence
  chemically synthesized
ttcaagatgagatttgggtg

SEQ ID NO: 241365 - DNA, 20 bp, Artificial Sequence
  chemically synthesized
attcaagatgagatttgggt

SEQ ID NO: 241366 - DNA, 20 bp, Artificial Sequence
  chemically synthesized
aattcaagatgagatttggg

SEQ ID NO: 241367 - DNA, 20 bp, Artificial Sequence
  chemically synthesized
aggaattcaagatgagattt

SEQ ID NO: 241368 - DNA, 20 bp, Artificial Sequence
  chemically synthesized
taggaattcaagatgagatt

SEQ ID NO: 241369 - DNA, 20 bp, Artificial Sequence
  chemically synthesized
aacatgtaggaattcaagat

SEQ ID NO: 241370 - DNA, 20 bp, Artificial Sequence
  chemically synthesized
cccacaacatgtaggaattc

SEQ ID NO: 241371 - DNA, 20 bp, Artificial Sequence
  chemically synthesized
aggtccttcccacaacatgt

SEQ ID NO: 241372 - DNA, 20 bp, Artificial Sequence
  chemically synthesized
tcttgaattcctacatgttg

SEQ ID NO: 241373 - DNA, 20 bp, Artificial Sequence
  chemically synthesized
gaggtccttcccacaacatg

SEQ ID NO: 241374 - DNA, 20 bp, Artificial Sequence
  chemically synthesized
cttgaattcctacatgttgt

SEQ ID NO: 241375 - DNA, 20 bp, Artificial Sequence
  chemically synthesized
gaattcctacatgttgtggg

SEQ ID NO: 241376 - DNA, 20 bp, Artificial Sequence
  chemically synthesized
aattcctacatgttgtggga

SEQ ID NO: 241377 - DNA, 20 bp, Artificial Sequence
  chemically synthesized
atgttgtgggaaggacctcg

SEQ ID NO: 241378 - DNA, 20 bp, Artificial Sequence
  chemically synthesized
tgttgtgggaaggacctcgt

SEQ ID NO: 241379 - DNA, 20 bp, Artificial Sequence
  chemically synthesized
ttgtgggaaggacctcgtgg

SEQ ID NO: 241380 - DNA, 20 bp, Artificial Sequence
  chemically synthesized
tgtgggaaggacctcgtggg

SEQ ID NO: 241381 - DNA, 20 bp, Artificial Sequence
  chemically synthesized
tgattcaattacctcccacg

SEQ ID NO: 241382 - DNA, 20 bp, Artificial Sequence
  chemically synthesized
atgattcaattacctcccac

SEQ ID NO: 241383 - DNA, 20 bp, Artificial Sequence
  chemically synthesized
cgtgggaggtaattgaatca

SEQ ID NO: 241384 - DNA, 20 bp, Artificial Sequence
  chemically synthesized
gtgggaggtaattgaatcat

SEQ ID NO: 241385 - DNA, 20 bp, Artificial Sequence
  chemically synthesized
tgggaggtaattgaatcatg

SEQ ID NO: 241386 - DNA, 20 bp, Artificial Sequence
  chemically synthesized
gggaggtaattgaatcatgg

SEQ ID NO: 241387 - DNA, 20 bp, Artificial Sequence
  chemically synthesized
aggtaattgaatcatggggg

SEQ ID NO: 241388 - DNA, 20 bp, Artificial Sequence
  chemically synthesized
ggtaattgaatcatgggggc

SEQ ID NO: 241389 - DNA, 20 bp, Artificial Sequence
  chemically synthesized
atcacgagaacagcatggga

SEQ ID NO: 241390 - DNA, 20 bp, Artificial Sequence
  chemically synthesized
tatcacgagaacagcatggg

SEQ ID NO: 241391 - DNA, 20 bp, Artificial Sequence
  chemically synthesized
tactatcacgagaacagcat

SEQ ID NO: 241392 - DNA, 20 bp, Artificial Sequence
  chemically synthesized
ttactatcacgagaacagca

SEQ ID NO: 241393 - DNA, 20 bp, Artificial Sequence
  chemically synthesized
ctaatttactatcacgagaa

SEQ ID NO: 241394 - DNA, 20 bp, Artificial Sequence
  chemically synthesized
ttcccatgctgttctcgtga

SEQ ID NO: 241395 - DNA, 20 bp, Artificial Sequence
  chemically synthesized
tgagactaatttactatcac

SEQ ID NO: 241396 - DNA, 20 bp, Artificial Sequence
  chemically synthesized
ctgttctcgtgatagtaaat

SEQ ID NO: 241397 - DNA, 20 bp, Artificial Sequence
  chemically synthesized
tgatagtaaattagtctcat

SEQ ID NO: 241398 - DNA, 20 bp, Artificial Sequence
  chemically synthesized
ataaaaccatcagatctcat

SEQ ID NO: 241399 - DNA, 20 bp, Artificial Sequence
  chemically synthesized
attagtctcatgagatctga

SEQ ID NO: 241400 - DNA, 20 bp, Artificial Sequence
  chemically synthesized
agtcccctttataaaaccat

SEQ ID NO: 241401 - DNA, 20 bp, Artificial Sequence
  chemically synthesized
tgagatctgatggttttata

SEQ ID NO: 241402 - DNA, 20 bp, Artificial Sequence
  chemically synthesized
gagatctgatggttttataa

SEQ ID NO: 241403 - DNA, 20 bp, Artificial Sequence
  chemically synthesized
agatctgatggttttataaa

SEQ ID NO: 241404 - DNA, 20 bp, Artificial Sequence
  chemically synthesized
gatctgatggttttataaag

SEQ ID NO: 241405 - DNA, 20 bp, Artificial Sequence
  chemically synthesized
tgaatggcagaaggcaaaga

SEQ ID NO: 241406 - DNA, 20 bp, Artificial Sequence
  chemically synthesized
tacatgaatggcagaaggca

SEQ ID NO: 241407 - DNA, 20 bp, Artificial Sequence
  chemically synthesized
catcttacatgaatggcaga

SEQ ID NO: 241408 - DNA, 20 bp, Artificial Sequence
  chemically synthesized
acatcttacatgaatggcag

SEQ ID NO: 241409 - DNA, 20 bp, Artificial Sequence
  chemically synthesized
gtcacatcttacatgaatgg

SEQ ID NO: 241410 - DNA, 20 bp, Artificial Sequence
  chemically synthesized
ttgccttctgccattcatgt

SEQ ID NO: 241411 - DNA, 20 bp, Artificial Sequence
  chemically synthesized
caagtcacatcttacatgaa

SEQ ID NO: 241412 - DNA, 20 bp, Artificial Sequence
  chemically synthesized
ggcagaaggcaaggaggagc

SEQ ID NO: 241413 - DNA, 20 bp, Artificial Sequence
  chemically synthesized
tcttggcagaaggcaaggag

SEQ ID NO: 241414 - DNA, 20 bp, Artificial Sequence
  chemically synthesized
aatcttggcagaaggcaagg

SEQ ID NO: 241415 - DNA, 20 bp, Artificial Sequence
  chemically synthesized
caatcttggcagaaggcaag

SEQ ID NO: 241416 - DNA, 20 bp, Artificial Sequence
  chemically synthesized
cacaatcttggcagaaggca

SEQ ID NO: 241417 - DNA, 20 bp, Artificial Sequence
  chemically synthesized
tcacaatcttggcagaaggc

SEQ ID NO: 241418 - DNA, 20 bp, Artificial Sequence
  chemically synthesized
gctcctccttgccttctgcc

SEQ ID NO: 241419 - DNA, 20 bp, Artificial Sequence
  chemically synthesized
ggcctcacaatcttggcaga

SEQ ID NO: 241420 - DNA, 20 bp, Artificial Sequence
  chemically synthesized
aggcctcacaatcttggcag

SEQ ID NO: 241421 - DNA, 20 bp, Artificial Sequence
  chemically synthesized
gggaggcctcacaatcttgg

SEQ ID NO: 241422 - DNA, 20 bp, Artificial Sequence
  chemically synthesized
ttgccttctgccaagattgt

SEQ ID NO: 241423 - DNA, 20 bp, Artificial Sequence
  chemically synthesized
ctggggaggcctcacaatct

SEQ ID NO: 241424 - DNA, 20 bp, Artificial Sequence
  chemically synthesized
tgccttctgccaagattgtg

SEQ ID NO: 241425 - DNA, 20 bp, Artificial Sequence
  chemically synthesized
ccaagattgtgaggcctccc

SEQ ID NO: 241426 - DNA, 20 bp, Artificial Sequence
  chemically synthesized
acagttccacacagctgggg

SEQ ID NO: 241427 - DNA, 20 bp, Artificial Sequence
  chemically synthesized
tacagttccacacagctggg

SEQ ID NO: 241428 - DNA, 20 bp, Artificial Sequence
  chemically synthesized
cttacagttccacacagctg

SEQ ID NO: 241429 - DNA, 20 bp, Artificial Sequence
  chemically synthesized
gtgaggcctccccagctgtg

SEQ ID NO: 241430 - DNA, 20 bp, Artificial Sequence
  chemically synthesized
acttacagttccacacagct

SEQ ID NO: 241431 - DNA, 20 bp, Artificial Sequence
  chemically synthesized
gacttacagttccacacagc

SEQ ID NO: 241432 - DNA, 20 bp, Artificial Sequence
  chemically synthesized
aatggacttacagttccaca

SEQ ID NO: 241433 - DNA, 20 bp, Artificial Sequence
  chemically synthesized
ccccagctgtgtggaactgt

SEQ ID NO: 241434 - DNA, 20 bp, Artificial Sequence
  chemically synthesized
aaaaggatttaatggactta

SEQ ID NO: 241435 - DNA, 20 bp, Artificial Sequence
  chemically synthesized
atacaggaaaaaggatttaa

SEQ ID NO: 241436 - DNA, 20 bp, Artificial Sequence
  chemically synthesized
gggtcatttatacaggaaaa

SEQ ID NO: 241437 - DNA, 20 bp, Artificial Sequence
  chemically synthesized
tgggtcatttatacaggaaa

SEQ ID NO: 241438 - DNA, 20 bp, Artificial Sequence
  chemically synthesized
tgagactgggtcatttatac

SEQ ID NO: 241439 - DNA, 20 bp, Artificial Sequence
  chemically synthesized
atgagactgggtcatttata

SEQ ID NO: 241440 - DNA, 20 bp, Artificial Sequence
  chemically synthesized
tttttcctgtataaatgacc

SEQ ID NO: 241441 - DNA, 20 bp, Artificial Sequence
  chemically synthesized
ataaagacatacatgagact

SEQ ID NO: 241442 - DNA, 20 bp, Artificial Sequence
  chemically synthesized
gataaagacatacatgagac

SEQ ID NO: 241443 - DNA, 20 bp, Artificial Sequence
  chemically synthesized
ctgctgataaagacatacat

SEQ ID NO: 241444 - DNA, 20 bp, Artificial Sequence
  chemically synthesized
agtctcatgtatgtctttat

SEQ ID NO: 241445 - DNA, 20 bp, Artificial Sequence
  chemically synthesized
ctcatgtatgtctttatcag

SEQ ID NO: 241446 - DNA, 20 bp, Artificial Sequence
  chemically synthesized
cggttttcatgctgctgata

SEQ ID NO: 241447 - DNA, 20 bp, Artificial Sequence
  chemically synthesized
aaaaattacttcatattagt

SEQ ID NO: 241448 - DNA, 20 bp, Artificial Sequence
  chemically synthesized
catgaaaaccgactaatatg

SEQ ID NO: 241449 - DNA, 20 bp, Artificial Sequence
  chemically synthesized
ttggaaaaattacttcatat

SEQ ID NO: 241450 - DNA, 20 bp, Artificial Sequence
  chemically synthesized
tgctaactctcatttattat

SEQ ID NO: 241451 - DNA, 20 bp, Artificial Sequence
  chemically synthesized
taatttttccaataataaat

SEQ ID NO: 241452 - DNA, 20 bp, Artificial Sequence
  chemically synthesized
atttttccaataataaatga

SEQ ID NO: 241453 - DNA, 20 bp, Artificial Sequence
  chemically synthesized
ttccaataataaatgagagt

SEQ ID NO: 241454 - DNA, 20 bp, Artificial Sequence
  chemically synthesized
gagagttagcatctattcat

SEQ ID NO: 241455 - DNA, 20 bp, Artificial Sequence
  chemically synthesized
atgtcaaatacacttatgaa

SEQ ID NO: 241456 - DNA, 20 bp, Artificial Sequence
  chemically synthesized
tcataagtgtatttgacata

SEQ ID NO: 241457 - DNA, 20 bp, Artificial Sequence
  chemically synthesized
aaaaaataatagacagttca

SEQ ID NO: 241458 - DNA, 20 bp, Artificial Sequence
  chemically synthesized
aaagtttaaaaaataataga

SEQ ID NO: 241459 - DNA, 20 bp, Artificial Sequence
  chemically synthesized
ttttaaagtttaaaaaataa

SEQ ID NO: 241460 - DNA, 20 bp, Artificial Sequence
  chemically synthesized
ctaacaggaaaatattttta

SEQ ID NO: 241461 - DNA, 20 bp, Artificial Sequence
  chemically synthesized
ctttaaaaatattttcctgt

SEQ ID NO: 241462 - DNA, 20 bp, Artificial Sequence
  chemically synthesized
tttaaaaatattttcctgtt

SEQ ID NO: 241463 - DNA, 20 bp, Artificial Sequence
  chemically synthesized
caaaataaaaataacctaac

SEQ ID NO: 241464 - DNA, 20 bp, Artificial Sequence
  chemically synthesized
acaaaataaaaataacctaa

SEQ ID NO: 241465 - DNA, 20 bp, Artificial Sequence
  chemically synthesized
tttttattttgttctattga

SEQ ID NO: 241466 - DNA, 20 bp, Artificial Sequence
  chemically synthesized
ttttattttgttctattgat

SEQ ID NO: 241467 - DNA, 20 bp, Artificial Sequence
  chemically synthesized
gaaaaatatttacctatcaa

SEQ ID NO: 241468 - DNA, 20 bp, Artificial Sequence
  chemically synthesized
aaggatttatgtcataattt

SEQ ID NO: 241469 - DNA, 20 bp, Artificial Sequence
  chemically synthesized
ttgcaatactaaaacaataa

SEQ ID NO: 241470 - DNA, 20 bp, Artificial Sequence
  chemically synthesized
tttgcaatactaaaacaata

SEQ ID NO: 241471 - DNA, 20 bp, Artificial Sequence
  chemically synthesized
acataaatcctttattgttt

SEQ ID NO: 241472 - DNA, 20 bp, Artificial Sequence
  chemically synthesized
gtattgcaaatatactatct

SEQ ID NO: 241473 - DNA, 20 bp, Artificial Sequence
  chemically synthesized
agaaaagacataggctcaga

SEQ ID NO: 241474 - DNA, 20 bp, Artificial Sequence
  chemically synthesized
acaaagaaaagacataggct

SEQ ID NO: 241475 - DNA, 20 bp, Artificial Sequence
  chemically synthesized
cataaacaaagaaaagacat

SEQ ID NO: 241476 - DNA, 20 bp, Artificial Sequence
  chemically synthesized
tcataaacaaagaaaagaca

SEQ ID NO: 241477 - DNA, 20 bp, Artificial Sequence
  chemically synthesized
aagacttcataaacaaagaa

SEQ ID NO: 241478 - DNA, 20 bp, Artificial Sequence
  chemically synthesized
atgcaaagacttcataaaca

SEQ ID NO: 241479 - DNA, 20 bp, Artificial Sequence
  chemically synthesized
atgtcttttctttgtttatg

SEQ ID NO: 241480 - DNA, 20 bp, Artificial Sequence
  chemically synthesized
ttaaaaacctgtacaatgca

SEQ ID NO: 241481 - DNA, 20 bp, Artificial Sequence
  chemically synthesized
tatgaagtctttgcattgta

SEQ ID NO: 241482 - DNA, 20 bp, Artificial Sequence
  chemically synthesized
atgaagtctttgcattgtac

SEQ ID NO: 241483 - DNA, 20 bp, Artificial Sequence
  chemically synthesized
aagcaaaaattgtaaagaaa

SEQ ID NO: 241484 - DNA, 20 bp, Artificial Sequence
  chemically synthesized
agcacaaagcaaaaattgta

SEQ ID NO: 241485 - DNA, 20 bp, Artificial Sequence
  chemically synthesized
gtcccttaagcaacagcaca

SEQ ID NO: 241486 - DNA, 20 bp, Artificial Sequence
  chemically synthesized
tttgctttgtgctgttgctt

SEQ ID NO: 241487 - DNA, 20 bp, Artificial Sequence
  chemically synthesized
ttgctttgtgctgttgctta

SEQ ID NO: 241488 - DNA, 20 bp, Artificial Sequence
  chemically synthesized
aagaggtgtcccttaagcaa

SEQ ID NO: 241489 - DNA, 20 bp, Artificial Sequence
  chemically synthesized
tgctttgtgctgttgcttaa

SEQ ID NO: 241490 - DNA, 20 bp, Artificial Sequence
  chemically synthesized
gggcaaaagaggtgtccctt

SEQ ID NO: 241491 - DNA, 20 bp, Artificial Sequence
  chemically synthesized
tggggcatgtagggcaaaag

SEQ ID NO: 241492 - DNA, 20 bp, Artificial Sequence
  chemically synthesized
ttggggcatgtagggcaaaa

SEQ ID NO: 241493 - DNA, 20 bp, Artificial Sequence
  chemically synthesized
ttttggggcatgtagggcaa

SEQ ID NO: 241494 - DNA, 20 bp, Artificial Sequence
  chemically synthesized
aaaatattttggggcatgta

SEQ ID NO: 241495 - DNA, 20 bp, Artificial Sequence
  chemically synthesized
aaaaatattttggggcatgt

SEQ ID NO: 241496 - DNA, 20 bp, Artificial Sequence
  chemically synthesized
taaaaatattttggggcatg

SEQ ID NO: 241497 - DNA, 20 bp, Artificial Sequence
  chemically synthesized
aaatatataaaaatattttg

SEQ ID NO: 241498 - DNA, 20 bp, Artificial Sequence
  chemically synthesized
aaaatatataaaaatatttt

SEQ ID NO: 241499 - DNA, 20 bp, Artificial Sequence
  chemically synthesized
taaaatatataaaaatattt

SEQ ID NO: 241500 - DNA, 20 bp, Artificial Sequence
  chemically synthesized
ttgcctaaacatgaaaggca

SEQ ID NO: 241501 - DNA, 20 bp, Artificial Sequence
  chemically synthesized
atggattgcctaaacatgaa

SEQ ID NO: 241502 - DNA, 20 bp, Artificial Sequence
  chemically synthesized
aatgctttgcctttcatgtt

SEQ ID NO: 241503 - DNA, 20 bp, Artificial Sequence
  chemically synthesized
gatggattgcctaaacatga

SEQ ID NO: 241504 - DNA, 20 bp, Artificial Sequence
  chemically synthesized
atgctttgcctttcatgttt

SEQ ID NO: 241505 - DNA, 20 bp, Artificial Sequence
  chemically synthesized
acataaaaatggtaaattga

SEQ ID NO: 241506 - DNA, 20 bp, Artificial Sequence
  chemically synthesized
actgtacataaacataaaaa

SEQ ID NO: 241507 - DNA, 20 bp, Artificial Sequence
  chemically synthesized
accatttttatgtttatgta

SEQ ID NO: 241508 - DNA, 20 bp, Artificial Sequence
  chemically synthesized
tttatgtttatgtacagtgt

SEQ ID NO: 241509 - DNA, 20 bp, Artificial Sequence
  chemically synthesized
tgtttatgtacagtgtgaga

SEQ ID NO: 241510 - DNA, 20 bp, Artificial Sequence
  chemically synthesized
gtttatgtacagtgtgagat

SEQ ID NO: 241511 - DNA, 20 bp, Artificial Sequence
  chemically synthesized
tttatgtacagtgtgagata

SEQ ID NO: 241512 - DNA, 20 bp, Artificial Sequence
  chemically synthesized
attttattaaacataagaat

SEQ ID NO: 241513 - DNA, 20 bp, Artificial Sequence
  chemically synthesized
tttaaaattttattaaacat

SEQ ID NO: 241514 - DNA, 20 bp, Artificial Sequence
  chemically synthesized
atgtttaataaaattttaaa

SEQ ID NO: 241515 - DNA, 20 bp, Artificial Sequence
  chemically synthesized
atgacatgtatgacagacag

SEQ ID NO: 241516 - DNA, 20 bp, Artificial Sequence
  chemically synthesized
tatatgacatgtatgacaga

SEQ ID NO: 241517 - DNA, 20 bp, Artificial Sequence
  chemically synthesized
ataatatatgacatgtatga

SEQ ID NO: 241518 - DNA, 20 bp, Artificial Sequence
  chemically synthesized
gtggtattcttattgtgtaa

SEQ ID NO: 241519 - DNA, 20 bp, Artificial Sequence
  chemically synthesized
atattatactcttacacaat

SEQ ID NO: 241520 - DNA, 20 bp, Artificial Sequence
  chemically synthesized
aggtggtattcttattgtgt

SEQ ID NO: 241521 - DNA, 20 bp, Artificial Sequence
  chemically synthesized
tattcgaatgtattgagagg

SEQ ID NO: 241522 - DNA, 20 bp, Artificial Sequence
  chemically synthesized
atgtattcgaatgtattgag

SEQ ID NO: 241523 - DNA, 20 bp, Artificial Sequence
  chemically synthesized
aatgtattcgaatgtattga

SEQ ID NO: 241524 - DNA, 20 bp, Artificial Sequence
  chemically synthesized
ctaatgtattcgaatgtatt

SEQ ID NO: 241525 - DNA, 20 bp, Artificial Sequence
  chemically synthesized
ctcaatacattcgaatacat

SEQ ID NO: 241526 - DNA, 20 bp, Artificial Sequence
  chemically synthesized
acattagattttttttttct

SEQ ID NO: 241527 - DNA, 20 bp, Artificial Sequence
  chemically synthesized
gctccaggaattttgttacc

SEQ ID NO: 241528 - DNA, 20 bp, Artificial Sequence
  chemically synthesized
tttcttggtaacaaaattcc

SEQ ID NO: 241529 - DNA, 20 bp, Artificial Sequence
  chemically synthesized
tcttggtaacaaaattcctg

SEQ ID NO: 241530 - DNA, 20 bp, Artificial Sequence
  chemically synthesized
ggagaagaaaatagtgctcc

SEQ ID NO: 241531 - DNA, 20 bp, Artificial Sequence
  chemically synthesized
tggagaagaaaatagtgctc

SEQ ID NO: 241532 - DNA, 20 bp, Artificial Sequence
  chemically synthesized
gtacagattggagaagaaaa

SEQ ID NO: 241533 - DNA, 20 bp, Artificial Sequence
  chemically synthesized
gaaacctgtacagattggag

SEQ ID NO: 241534 - DNA, 20 bp, Artificial Sequence
  chemically synthesized
agagaaacctgtacagattg

SEQ ID NO: 241535 - DNA, 20 bp, Artificial Sequence
  chemically synthesized
attttcttctccaatctgta

SEQ ID NO: 241536 - DNA, 20 bp, Artificial Sequence
  chemically synthesized
agagagaaacctgtacagat

SEQ ID NO: 241537 - DNA, 20 bp, Artificial Sequence
  chemically synthesized
ttttcttctccaatctgtac

SEQ ID NO: 241538 - DNA, 20 bp, Artificial Sequence
  chemically synthesized
gttgtagagagaaacctgta

SEQ ID NO: 241539 - DNA, 20 bp, Artificial Sequence
  chemically synthesized
agctgtataacagttgtaga

SEQ ID NO: 241540 - DNA, 20 bp, Artificial Sequence
  chemically synthesized
acagctgtataacagttgta

SEQ ID NO: 241541 - DNA, 20 bp, Artificial Sequence
  chemically synthesized
caacagctgtataacagttg

SEQ ID NO: 241542 - DNA, 20 bp, Artificial Sequence
  chemically synthesized
ttctctctacaactgttata

SEQ ID NO: 241543 - DNA, 20 bp, Artificial Sequence
  chemically synthesized
ctgtaacaacagctgtataa

SEQ ID NO: 241544 - DNA, 20 bp, Artificial Sequence
  chemically synthesized
ctgttatacagctgttgtta

SEQ ID NO: 241545 - DNA, 20 bp, Artificial Sequence
  chemically synthesized
tgttatacagctgttgttac

SEQ ID NO: 241546 - DNA, 20 bp, Artificial Sequence
  chemically synthesized
tggaggagatcctgtaacaa

SEQ ID NO: 241547 - DNA, 20 bp, Artificial Sequence
  chemically synthesized
gtgccagaaagatggtggag

SEQ ID NO: 241548 - DNA, 20 bp, Artificial Sequence
  chemically synthesized
tggtgccagaaagatggtgg

SEQ ID NO: 241549 - DNA, 20 bp, Artificial Sequence
  chemically synthesized
gtggtgccagaaagatggtg

SEQ ID NO: 241550 - DNA, 20 bp, Artificial Sequence
  chemically synthesized
aagtggtgccagaaagatgg

SEQ ID NO: 241551 - DNA, 20 bp, Artificial Sequence
  chemically synthesized
gatctcctccaccatctttc

SEQ ID NO: 241552 - DNA, 20 bp, Artificial Sequence
  chemically synthesized
gcaaagtggtgccagaaaga

SEQ ID NO: 241553 - DNA, 20 bp, Artificial Sequence
  chemically synthesized
agatgcaaagtggtgccaga

SEQ ID NO: 241554 - DNA, 20 bp, Artificial Sequence
  chemically synthesized
aggaagatgcaaagtggtgc

SEQ ID NO: 241555 - DNA, 20 bp, Artificial Sequence
  chemically synthesized
cgtgggaggaagatgcaaag

SEQ ID NO: 241556 - DNA, 20 bp, Artificial Sequence
  chemically synthesized
caacgtgggaggaagatgca

SEQ ID NO: 241557 - DNA, 20 bp, Artificial Sequence
  chemically synthesized
agagaacccaacgtgggagg

SEQ ID NO: 241558 - DNA, 20 bp, Artificial Sequence
  chemically synthesized
tttgcatcttcctcccacgt

SEQ ID NO: 241559 - DNA, 20 bp, Artificial Sequence
  chemically synthesized
aacagagaacccaacgtggg

SEQ ID NO: 241560 - DNA, 20 bp, Artificial Sequence
  chemically synthesized
ttgcatcttcctcccacgtt

SEQ ID NO: 241561 - DNA, 20 bp, Artificial Sequence
  chemically synthesized
aaacagagaacccaacgtgg

SEQ ID NO: 241562 - DNA, 20 bp, Artificial Sequence
  chemically synthesized
gaaaacagagaacccaacgt

SEQ ID NO: 241563 - DNA, 20 bp, Artificial Sequence
  chemically synthesized
ggaaaacagagaacccaacg

SEQ ID NO: 241564 - DNA, 20 bp, Artificial Sequence
  chemically synthesized
acgttgggttctctgttttc

SEQ ID NO: 241565 - DNA, 20 bp, Artificial Sequence
  chemically synthesized
agcctaggatccggaaaaca

SEQ ID NO: 241566 - DNA, 20 bp, Artificial Sequence
  chemically synthesized
aaagcctaggatccggaaaa

SEQ ID NO: 241567 - DNA, 20 bp, Artificial Sequence
  chemically synthesized
gttctctgttttccggatcc

SEQ ID NO: 241568 - DNA, 20 bp, Artificial Sequence
  chemically synthesized
ttctctgttttccggatcct

SEQ ID NO: 241569 - DNA, 20 bp, Artificial Sequence
  chemically synthesized
tacctgcaaagcctaggatc

SEQ ID NO: 241570 - DNA, 20 bp, Artificial Sequence
  chemically synthesized
tagtattacctgcaaagcct

SEQ ID NO: 241571 - DNA, 20 bp, Artificial Sequence
  chemically synthesized
tttccggatcctaggctttg

SEQ ID NO: 241572 - DNA, 20 bp, Artificial Sequence
  chemically synthesized
ttagtattacctgcaaagcc

SEQ ID NO: 241573 - DNA, 20 bp, Artificial Sequence
  chemically synthesized
ttccggatcctaggctttgc

SEQ ID NO: 241574 - DNA, 20 bp, Artificial Sequence
  chemically synthesized
gagcattagtattacctgca

SEQ ID NO: 241575 - DNA, 20 bp, Artificial Sequence
  chemically synthesized
ttaggaaaatattggagcat

SEQ ID NO: 241576 - DNA, 20 bp, Artificial Sequence
  chemically synthesized
agagaattaggaaaatattg

SEQ ID NO: 241577 - DNA, 20 bp, Artificial Sequence
  chemically synthesized
taagagaattaggaaaatat

SEQ ID NO: 241578 - DNA, 20 bp, Artificial Sequence
  chemically synthesized
ttaagagaggtaagagaatt

SEQ ID NO: 241579 - DNA, 20 bp, Artificial Sequence
  chemically synthesized
tttaagagaggtaagagaat

SEQ ID NO: 241580 - DNA, 20 bp, Artificial Sequence
  chemically synthesized
aatatttttaagagaggtaa

SEQ ID NO: 241581 - DNA, 20 bp, Artificial Sequence
  chemically synthesized
ctaatatttttaagagaggt

SEQ ID NO: 241582 - DNA, 20 bp, Artificial Sequence
  chemically synthesized
atcactaatatttttaagag

SEQ ID NO: 241583 - DNA, 20 bp, Artificial Sequence
  chemically synthesized
aatcactaatatttttaaga

SEQ ID NO: 241584 - DNA, 20 bp, Artificial Sequence
  chemically synthesized
ataatcactaatatttttaa

SEQ ID NO: 241585 - DNA, 20 bp, Artificial Sequence
  chemically synthesized
ttataatcactaatattttt

SEQ ID NO: 241586 - DNA, 20 bp, Artificial Sequence
  chemically synthesized
cttacctctcttaaaaatat

SEQ ID NO: 241587 - DNA, 20 bp, Artificial Sequence
  chemically synthesized
gcctaactctgaggggacag

SEQ ID NO: 241588 - DNA, 20 bp, Artificial Sequence
  chemically synthesized
tgcctaactctgaggggaca

SEQ ID NO: 241589 - DNA, 20 bp, Artificial Sequence
  chemically synthesized
attataatcccctgtcccct

SEQ ID NO: 241590 - DNA, 20 bp, Artificial Sequence
  chemically synthesized
atgcctaactctgaggggac

SEQ ID NO: 241591 - DNA, 20 bp, Artificial Sequence
  chemically synthesized
catgcctaactctgagggga

SEQ ID NO: 241592 - DNA, 20 bp, Artificial Sequence
  chemically synthesized
tataatcccctgtcccctca

SEQ ID NO: 241593 - DNA, 20 bp, Artificial Sequence
  chemically synthesized
tggtcatgcctaactctgag

SEQ ID NO: 241594 - DNA, 20 bp, Artificial Sequence
  chemically synthesized
atcccctgtcccctcagagt

SEQ ID NO: 241595 - DNA, 20 bp, Artificial Sequence
  chemically synthesized
gtggtcatgcctaactctga

SEQ ID NO: 241596 - DNA, 20 bp, Artificial Sequence
  chemically synthesized
tcccctgtcccctcagagtt

SEQ ID NO: 241597 - DNA, 20 bp, Artificial Sequence
  chemically synthesized
cgtggtcatgcctaactctg

SEQ ID NO: 241598 - DNA, 20 bp, Artificial Sequence
  chemically synthesized
acgtggtcatgcctaactct

SEQ ID NO: 241599 - DNA, 20 bp, Artificial Sequence
  chemically synthesized
atcatccaaaggaagtcacg

SEQ ID NO: 241600 - DNA, 20 bp, Artificial Sequence
  chemically synthesized
catgaccacgtgacttcctt

SEQ ID NO: 241601 - DNA, 20 bp, Artificial Sequence
  chemically synthesized
ttcacttcatcatccaaagg

SEQ ID NO: 241602 - DNA, 20 bp, Artificial Sequence
  chemically synthesized
catttcacttcatcatccaa

SEQ ID NO: 241603 - DNA, 20 bp, Artificial Sequence
  chemically synthesized
tcatttcacttcatcatcca

SEQ ID NO: 241604 - DNA, 20 bp, Artificial Sequence
  chemically synthesized
gtgacttcctttggatgatg

SEQ ID NO: 241605 - DNA, 20 bp, Artificial Sequence
  chemically synthesized
tgacatatatcactcctaca

SEQ ID NO: 241606 - DNA, 20 bp, Artificial Sequence
  chemically synthesized
acatatatcactcctacata

SEQ ID NO: 241607 - DNA, 20 bp, Artificial Sequence
  chemically synthesized
tcttacatgcctctatgtag

SEQ ID NO: 241608 - DNA, 20 bp, Artificial Sequence
  chemically synthesized
catatatcactcctacatag

SEQ ID NO: 241609 - DNA, 20 bp, Artificial Sequence
  chemically synthesized
actcttacatgcctctatgt

SEQ ID NO: 241610 - DNA, 20 bp, Artificial Sequence
  chemically synthesized
gactcttacatgcctctatg

SEQ ID NO: 241611 - DNA, 20 bp, Artificial Sequence
  chemically synthesized
actcctacatagaggcatgt

SEQ ID NO: 241612 - DNA, 20 bp, Artificial Sequence
  chemically synthesized
tcctacatagaggcatgtaa

SEQ ID NO: 241613 - DNA, 20 bp, Artificial Sequence
  chemically synthesized
acatagaggcatgtaagagt

SEQ ID NO: 241614 - DNA, 20 bp, Artificial Sequence
  chemically synthesized
ccatgtcagtcaaaaatgcg

SEQ ID NO: 241615 - DNA, 20 bp, Artificial Sequence
  chemically synthesized
ccacgcatttttgactgaca

SEQ ID NO: 241616 - DNA, 20 bp, Artificial Sequence
  chemically synthesized
agctttagcgttcaccatgt

SEQ ID NO: 241617 - DNA, 20 bp, Artificial Sequence
  chemically synthesized
gactgacatggtgaacgcta

SEQ ID NO: 241618 - DNA, 20 bp, Artificial Sequence
  chemically synthesized
accgtaacaataagaagctt

SEQ ID NO: 241619 - DNA, 20 bp, Artificial Sequence
  chemically synthesized
cattctaccgtaacaataag

SEQ ID NO: 241620 - DNA, 20 bp, Artificial Sequence
  chemically synthesized
gctaaagcttcttattgtta

SEQ ID NO: 241621 - DNA, 20 bp, Artificial Sequence
  chemically synthesized
tatcattctaccgtaacaat

SEQ ID NO: 241622 - DNA, 20 bp, Artificial Sequence
  chemically synthesized
aaagcttcttattgttacgg

SEQ ID NO: 241623 - DNA, 20 bp, Artificial Sequence
  chemically synthesized
ttattgttacggtagaatga

SEQ ID NO: 241624 - DNA, 20 bp, Artificial Sequence
  chemically synthesized
acggtagaatgatagaatac

SEQ ID NO: 241625 - DNA, 20 bp, Artificial Sequence
  chemically synthesized
ggtagaatgatagaatacta

SEQ ID NO: 241626 - DNA, 20 bp, Artificial Sequence
  chemically synthesized
atctaagctgattcagtctc

SEQ ID NO: 241627 - DNA, 20 bp, Artificial Sequence
  chemically synthesized
tagaatactagagactgaat

SEQ ID NO: 241628 - DNA, 20 bp, Artificial Sequence
  chemically synthesized
ctcaggaatctaagctgatt

SEQ ID NO: 241629 - DNA, 20 bp, Artificial Sequence
  chemically synthesized
tactagagactgaatcagct

SEQ ID NO: 241630 - DNA, 20 bp, Artificial Sequence
  chemically synthesized
ttgtagtcactcaggaatct

SEQ ID NO: 241631 - DNA, 20 bp, Artificial Sequence
  chemically synthesized
ctgaatcagcttagattcct

SEQ ID NO: 241632 - DNA, 20 bp, Artificial Sequence
  chemically synthesized
tctgatcattgtagtcactc

SEQ ID NO: 241633 - DNA, 20 bp, Artificial Sequence
  chemically synthesized
ttctgatcattgtagtcact

SEQ ID NO: 241634 - DNA, 20 bp, Artificial Sequence
  chemically synthesized
tcctgagtgactacaatgat

SEQ ID NO: 241635 - DNA, 20 bp, Artificial Sequence
  chemically synthesized
gtcaagggttctgatcattg

SEQ ID NO: 241636 - DNA, 20 bp, Artificial Sequence
  chemically synthesized
atccaacacaagtcagtcaa

SEQ ID NO: 241637 - DNA, 20 bp, Artificial Sequence
  chemically synthesized
tatccaacacaagtcagtca

SEQ ID NO: 241638 - DNA, 20 bp, Artificial Sequence
  chemically synthesized
atatccaacacaagtcagtc

SEQ ID NO: 241639 - DNA, 20 bp, Artificial Sequence
  chemically synthesized
gcaacatatccaacacaagt

SEQ ID NO: 241640 - DNA, 20 bp, Artificial Sequence
  chemically synthesized
aacccttgactgacttgtgt

SEQ ID NO: 241641 - DNA, 20 bp, Artificial Sequence
  chemically synthesized
ctttgcaacatatccaacac

SEQ ID NO: 241642 - DNA, 20 bp, Artificial Sequence
  chemically synthesized
cttgtgttggatatgttgca

SEQ ID NO: 241643 - DNA, 20 bp, Artificial Sequence
  chemically synthesized
attagtggctagaaacacaa

SEQ ID NO: 241644 - DNA, 20 bp, Artificial Sequence
  chemically synthesized
tattagtggctagaaacaca

SEQ ID NO: 241645 - DNA, 20 bp, Artificial Sequence
  chemically synthesized
aaaatcaacctttgtgtttc

SEQ ID NO: 241646 - DNA, 20 bp, Artificial Sequence
  chemically synthesized
aattccaaaatattagtggc

SEQ ID NO: 241647 - DNA, 20 bp, Artificial Sequence
  chemically synthesized
aagcaattccaaaatattag

SEQ ID NO: 241648 - DNA, 20 bp, Artificial Sequence
  chemically synthesized
gtttctagccactaatattt

SEQ ID NO: 241649 - DNA, 20 bp, Artificial Sequence
  chemically synthesized
aataagcaattccaaaatat

SEQ ID NO: 241650 - DNA, 20 bp, Artificial Sequence
  chemically synthesized
tttggaattgcttattattg

SEQ ID NO: 241651 - DNA, 20 bp, Artificial Sequence
  chemically synthesized
ccttgttatgctgcaataat

SEQ ID NO: 241652 - DNA, 20 bp, Artificial Sequence
  chemically synthesized
gcttattattgcagcataac

SEQ ID NO: 241653 - DNA, 20 bp, Artificial Sequence
  chemically synthesized
cttattattgcagcataaca

SEQ ID NO: 241654 - DNA, 20 bp, Artificial Sequence
  chemically synthesized
gatcagaaggagagtgtttt

SEQ ID NO: 241655 - DNA, 20 bp, Artificial Sequence
  chemically synthesized
agatcagaaggagagtgttt

SEQ ID NO: 241656 - DNA, 20 bp, Artificial Sequence
  chemically synthesized
gtgattggagatcagaagga

SEQ ID NO: 241657 - DNA, 20 bp, Artificial Sequence
  chemically synthesized
ttgtgattggagatcagaag

SEQ ID NO: 241658 - DNA, 20 bp, Artificial Sequence
  chemically synthesized
agttgtgattggagatcaga

SEQ ID NO: 241659 - DNA, 20 bp, Artificial Sequence
  chemically synthesized
tagttgtgattggagatcag

SEQ ID NO: 241660 - DNA, 20 bp, Artificial Sequence
  chemically synthesized
gtttagttgtgattggagat

SEQ ID NO: 241661 - DNA, 20 bp, Artificial Sequence
  chemically synthesized
agaatgtttagttgtgattg

SEQ ID NO: 241662 - DNA, 20 bp, Artificial Sequence
  chemically synthesized
aaagaatgtttagttgtgat

SEQ ID NO: 241663 - DNA, 20 bp, Artificial Sequence
  chemically synthesized
caagaaagacaaagaatgtt

SEQ ID NO: 241664 - DNA, 20 bp, Artificial Sequence
  chemically synthesized
gaaagaaaccaagaaagaca

SEQ ID NO: 241665 - DNA, 20 bp, Artificial Sequence
  chemically synthesized
taaacattctttgtctttct

SEQ ID NO: 241666 - DNA, 20 bp, Artificial Sequence
  chemically synthesized
agtgaagaaagaaaccaaga

SEQ ID NO: 241667 - DNA, 20 bp, Artificial Sequence
  chemically synthesized
accaagtgaagaaagaaacc

SEQ ID NO: 241668 - DNA, 20 bp, Artificial Sequence
  chemically synthesized
tatactctaccaagtgaaga

SEQ ID NO: 241669 - DNA, 20 bp, Artificial Sequence
  chemically synthesized
tcttggtttctttcttcact

SEQ ID NO: 241670 - DNA, 20 bp, Artificial Sequence
  chemically synthesized
tggtttctttcttcacttgg

SEQ ID NO: 241671 - DNA, 20 bp, Artificial Sequence
  chemically synthesized
aaaatatactctaccaagtg

SEQ ID NO: 241672 - DNA, 20 bp, Artificial Sequence
  chemically synthesized
gtttctttcttcacttggta

SEQ ID NO: 241673 - DNA, 20 bp, Artificial Sequence
  chemically synthesized
tttcaaaaatatactctacc

SEQ ID NO: 241674 - DNA, 20 bp, Artificial Sequence
  chemically synthesized
gtagagtatatttttgaaaa

SEQ ID NO: 241675 - DNA, 20 bp, Artificial Sequence
  chemically synthesized
tatttttgaaaatagatttc

SEQ ID NO: 241676 - DNA, 20 bp, Artificial Sequence
  chemically synthesized
atttttgaaaatagatttct

SEQ ID NO: 241677 - DNA, 20 bp, Artificial Sequence
  chemically synthesized
tttttgaaaatagatttctg

SEQ ID NO: 241678 - DNA, 20 bp, Artificial Sequence
  chemically synthesized
aaatagatttctggggaaaa

SEQ ID NO: 241679 - DNA, 20 bp, Artificial Sequence
  chemically synthesized
tcccctaaaccttttttccc

SEQ ID NO: 241680 - DNA, 20 bp, Artificial Sequence
  chemically synthesized
aatagatttctggggaaaaa

SEQ ID NO: 241681 - DNA, 20 bp, Artificial Sequence
  chemically synthesized
atttctggggaaaaaaggtt

SEQ ID NO: 241682 - DNA, 20 bp, Artificial Sequence
  chemically synthesized
tttctggggaaaaaaggttt

SEQ ID NO: 241683 - DNA, 20 bp, Artificial Sequence
  chemically synthesized
ttctggggaaaaaaggttta

SEQ ID NO: 241684 - DNA, 20 bp, Artificial Sequence
  chemically synthesized
tctggggaaaaaaggtttag

SEQ ID NO: 241685 - DNA, 20 bp, Artificial Sequence
  chemically synthesized
tggggaaaaaaggtttaggg

SEQ ID NO: 241686 - DNA, 20 bp, Artificial Sequence
  chemically synthesized
aaaggtttaggggagtacat

SEQ ID NO: 241687 - DNA, 20 bp, Artificial Sequence
  chemically synthesized
aaggtttaggggagtacata

SEQ ID NO: 241688 - DNA, 20 bp, Artificial Sequence
  chemically synthesized
gagaaaataattttcagaga

SEQ ID NO: 241689 - DNA, 20 bp, Artificial Sequence
  chemically synthesized
tgcggagaaaataattttca

SEQ ID NO: 241690 - DNA, 20 bp, Artificial Sequence
  chemically synthesized
tgtgcggagaaaataatttt

SEQ ID NO: 241691 - DNA, 20 bp, Artificial Sequence
  chemically synthesized
gataaactataaattgtgcg

SEQ ID NO: 241692 - DNA, 20 bp, Artificial Sequence
  chemically synthesized
ctgataaactataaattgtg

SEQ ID NO: 241693 - DNA, 20 bp, Artificial Sequence
  chemically synthesized
tattttctccgcacaattta

SEQ ID NO: 241694 - DNA, 20 bp, Artificial Sequence
  chemically synthesized
ccgcacaatttatagtttat

SEQ ID NO: 241695 - DNA, 20 bp, Artificial Sequence
  chemically synthesized
cgcacaatttatagtttatc

SEQ ID NO: 241696 - DNA, 20 bp, Artificial Sequence
  chemically synthesized
gcacaatttatagtttatca

SEQ ID NO: 241697 - DNA, 20 bp, Artificial Sequence
  chemically synthesized
tttatatattgttgaataac

SEQ ID NO: 241698 - DNA, 20 bp, Artificial Sequence
  chemically synthesized
taacaagtcattccaaaatt

SEQ ID NO: 241699 - DNA, 20 bp, Artificial Sequence
  chemically synthesized
gtttttaagctgctaaattt

SEQ ID NO: 241700 - DNA, 20 bp, Artificial Sequence
  chemically synthesized
caagtcattccaaaatttag

SEQ ID NO: 241701 - DNA, 20 bp, Artificial Sequence
  chemically synthesized
taataaacatttttgttttt

SEQ ID NO: 241702 - DNA, 20 bp, Artificial Sequence
  chemically synthesized
aaacaaaaatgtttattatt

SEQ ID NO: 241703 - DNA, 20 bp, Artificial Sequence
  chemically synthesized
caaaaatgtttattatttgg

SEQ ID NO: 241704 - DNA, 20 bp, Artificial Sequence
  chemically synthesized
ttattatttggcagtttctg

SEQ ID NO: 241705 - DNA, 20 bp, Artificial Sequence
  chemically synthesized
tattatttggcagtttctga

SEQ ID NO: 241706 - DNA, 20 bp, Artificial Sequence
  chemically synthesized
tttggcagtttctgaaggtc

SEQ ID NO: 241707 - DNA, 20 bp, Artificial Sequence
  chemically synthesized
actctcagattcttgacctt

SEQ ID NO: 241708 - DNA, 20 bp, Artificial Sequence
  chemically synthesized
tttctgaaggtcaagaatct

SEQ ID NO: 241709 - DNA, 20 bp, Artificial Sequence
  chemically synthesized
tctgaaggtcaagaatctga

SEQ ID NO: 241710 - DNA, 20 bp, Artificial Sequence
  chemically synthesized
gaaggtcaagaatctgagag

SEQ ID NO: 241711 - DNA, 20 bp, Artificial Sequence
  chemically synthesized
ccaccctgctaagccactct

SEQ ID NO: 241712 - DNA, 20 bp, Artificial Sequence
  chemically synthesized
tcaagaatctgagagtggct

SEQ ID NO: 241713 - DNA, 20 bp, Artificial Sequence
  chemically synthesized
agaatctgagagtggcttag

SEQ ID NO: 241714 - DNA, 20 bp, Artificial Sequence
  chemically synthesized
gaatctgagagtggcttagc

SEQ ID NO: 241715 - DNA, 20 bp, Artificial Sequence
  chemically synthesized
aatctgagagtggcttagca

SEQ ID NO: 241716 - DNA, 20 bp, Artificial Sequence
  chemically synthesized
ctgagagtggcttagcaggg

SEQ ID NO: 241717 - DNA, 20 bp, Artificial Sequence
  chemically synthesized
tatgccagtcccaccctgct

SEQ ID NO: 241718 - DNA, 20 bp, Artificial Sequence
  chemically synthesized
tgagagtggcttagcagggt

SEQ ID NO: 241719 - DNA, 20 bp, Artificial Sequence
  chemically synthesized
gtggcttagcagggtgggac

SEQ ID NO: 241720 - DNA, 20 bp, Artificial Sequence
  chemically synthesized
ttagcagggtgggactggca

SEQ ID NO: 241721 - DNA, 20 bp, Artificial Sequence
  chemically synthesized
cctcataaaataagctatgc

SEQ ID NO: 241722 - DNA, 20 bp, Artificial Sequence
  chemically synthesized
actggcatagcttattttat

SEQ ID NO: 241723 - DNA, 20 bp, Artificial Sequence
  chemically synthesized
taactacaacctcataaaat

SEQ ID NO: 241724 - DNA, 20 bp, Artificial Sequence
  chemically synthesized
ctggcatagcttattttatg

SEQ ID NO: 241725 - DNA, 20 bp, Artificial Sequence
  chemically synthesized
tagcttattttatgaggttg

SEQ ID NO: 241726 - DNA, 20 bp, Artificial Sequence
  chemically synthesized
tattttatgaggttgtagtt

SEQ ID NO: 241727 - DNA, 20 bp, Artificial Sequence
  chemically synthesized
gaggctgcaagcatagacaa

SEQ ID NO: 241728 - DNA, 20 bp, Artificial Sequence
  chemically synthesized
taagctgttgtctatgcttg

SEQ ID NO: 241729 - DNA, 20 bp, Artificial Sequence
  chemically synthesized
atctcgagaggctgcaagca

SEQ ID NO: 241730 - DNA, 20 bp, Artificial Sequence
  chemically synthesized
gacaaatctcgagaggctgc

SEQ ID NO: 241731 - DNA, 20 bp, Artificial Sequence
  chemically synthesized
gtctatgcttgcagcctctc

SEQ ID NO: 241732 - DNA, 20 bp, Artificial Sequence
  chemically synthesized
aacaccagacaaatctcgag

SEQ ID NO: 241733 - DNA, 20 bp, Artificial Sequence
  chemically synthesized
taacaccagacaaatctcga

SEQ ID NO: 241734 - DNA, 20 bp, Artificial Sequence
  chemically synthesized
tttaacaccagacaaatctc

SEQ ID NO: 241735 - DNA, 20 bp, Artificial Sequence
  chemically synthesized
gcagcctctcgagatttgtc

SEQ ID NO: 241736 - DNA, 20 bp, Artificial Sequence
  chemically synthesized
agaagtgcatcatttaacac

SEQ ID NO: 241737 - DNA, 20 bp, Artificial Sequence
  chemically synthesized
gtgttaaatgatgcacttct

SEQ ID NO: 241738 - DNA, 20 bp, Artificial Sequence
  chemically synthesized
agccacaagaatgagcttag

SEQ ID NO: 241739 - DNA, 20 bp, Artificial Sequence
  chemically synthesized
aagagccacaagaatgagct

SEQ ID NO: 241740 - DNA, 20 bp, Artificial Sequence
  chemically synthesized
cacttctaagctcattcttg

SEQ ID NO: 241741 - DNA, 20 bp, Artificial Sequence
  chemically synthesized
ctgcaaagagccacaagaat

SEQ ID NO: 241742 - DNA, 20 bp, Artificial Sequence
  chemically synthesized
ggcctcctgcaaagagccac

SEQ ID NO: 241743 - DNA, 20 bp, Artificial Sequence
  chemically synthesized
ctcattcttgtggctctttg

SEQ ID NO: 241744 - DNA, 20 bp, Artificial Sequence
  chemically synthesized
tcattcttgtggctctttgc

SEQ ID NO: 241745 - DNA, 20 bp, Artificial Sequence
  chemically synthesized
attcttgtggctctttgcag

SEQ ID NO: 241746 - DNA, 20 bp, Artificial Sequence
  chemically synthesized
aaactaaggcctcctgcaaa

SEQ ID NO: 241747 - DNA, 20 bp, Artificial Sequence
  chemically synthesized
ttcttgtggctctttgcagg

SEQ ID NO: 241748 - DNA, 20 bp, Artificial Sequence
  chemically synthesized
agaaactaaggcctcctgca

SEQ ID NO: 241749 - DNA, 20 bp, Artificial Sequence
  chemically synthesized
tggctctttgcaggaggcct

SEQ ID NO: 241750 - DNA, 20 bp, Artificial Sequence
  chemically synthesized
gcacgtatgctgagaaacta

SEQ ID NO: 241751 - DNA, 20 bp, Artificial Sequence
  chemically synthesized
tgcaggaggccttagtttct

SEQ ID NO: 241752 - DNA, 20 bp, Artificial Sequence
  chemically synthesized
tgcacgtatgctgagaaact

SEQ ID NO: 241753 - DNA, 20 bp, Artificial Sequence
  chemically synthesized
tatggagatgcacgtatgct

SEQ ID NO: 241754 - DNA, 20 bp, Artificial Sequence
  chemically synthesized
tcagcatacgtgcatctcca

SEQ ID NO: 241755 - DNA, 20 bp, Artificial Sequence
  chemically synthesized
cagcatacgtgcatctccat

SEQ ID NO: 241756 - DNA, 20 bp, Artificial Sequence
  chemically synthesized
agcatacgtgcatctccata

SEQ ID NO: 241757 - DNA, 20 bp, Artificial Sequence
  chemically synthesized
atgtcatgagcagccctatg

SEQ ID NO: 241758 - DNA, 20 bp, Artificial Sequence
  chemically synthesized
acatgtcatgagcagcccta

SEQ ID NO: 241759 - DNA, 20 bp, Artificial Sequence
  chemically synthesized
gtgggaacacatgtcatgag

SEQ ID NO: 241760 - DNA, 20 bp, Artificial Sequence
  chemically synthesized
tctgtgggaacacatgtcat

SEQ ID NO: 241761 - DNA, 20 bp, Artificial Sequence
  chemically synthesized
gctcatgacatgtgttccca

SEQ ID NO: 241762 - DNA, 20 bp, Artificial Sequence
  chemically synthesized
catgacatgtgttcccacag

SEQ ID NO: 241763 - DNA, 20 bp, Artificial Sequence
  chemically synthesized
gacatgtgttcccacagaag

SEQ ID NO: 241764 - DNA, 20 bp, Artificial Sequence
  chemically synthesized
tcatgcattgcttcttctgt

SEQ ID NO: 241765 - DNA, 20 bp, Artificial Sequence
  chemically synthesized
ctcatgcattgcttcttctg

SEQ ID NO: 241766 - DNA, 20 bp, Artificial Sequence
  chemically synthesized
ccacagaagaagcaatgcat

SEQ ID NO: 241767 - DNA, 20 bp, Artificial Sequence
  chemically synthesized
acagaagaagcaatgcatga

SEQ ID NO: 241768 - DNA, 20 bp, Artificial Sequence
  chemically synthesized
agaagaagcaatgcatgaga

SEQ ID NO: 241769 - DNA, 20 bp, Artificial Sequence
  chemically synthesized
aagaagcaatgcatgagaga

SEQ ID NO: 241770 - DNA, 20 bp, Artificial Sequence
  chemically synthesized
gaagcaatgcatgagagaga

SEQ ID NO: 241771 - DNA, 20 bp, Artificial Sequence
  chemically synthesized
agcaatgcatgagagagaga

SEQ ID NO: 241772 - DNA, 20 bp, Artificial Sequence
  chemically synthesized
caatgcatgagagagagaga

SEQ ID NO: 241773 - DNA, 20 bp, Artificial Sequence
  chemically synthesized
atgcatgagagagagagaga

SEQ ID NO: 241774 - DNA, 20 bp, Artificial Sequence
  chemically synthesized
gcatgagagagagagagaga

SEQ ID NO: 241775 - DNA, 20 bp, Artificial Sequence
  chemically synthesized
atgagagagagagagagaga

SEQ ID NO: 241776 - DNA, 20 bp, Artificial Sequence
  chemically synthesized
gagagagagagagagagaga

SEQ ID NO: 241777 - DNA, 20 bp, Artificial Sequence
  chemically synthesized
gagagagagagagagagaga

SEQ ID NO: 241778 - DNA, 20 bp, Artificial Sequence
  chemically synthesized
gagagagagagagagagaga

SEQ ID NO: 241779 - DNA, 20 bp, Artificial Sequence
  chemically synthesized
gagagagagagagagagaga

SEQ ID NO: 241780 - DNA, 20 bp, Artificial Sequence
  chemically synthesized
gagagagagagagagagaga

SEQ ID NO: 241781 - DNA, 20 bp, Artificial Sequence
  chemically synthesized
gagagagagagagagagaaa

SEQ ID NO: 241782 - DNA, 20 bp, Artificial Sequence
  chemically synthesized
gagagagagagagagaaaga

SEQ ID NO: 241783 - DNA, 20 bp, Artificial Sequence
  chemically synthesized
gagagagagaaagagagaca

SEQ ID NO: 241784 - DNA, 20 bp, Artificial Sequence
  chemically synthesized
gagagagaaagagagacaca

SEQ ID NO: 241785 - DNA, 20 bp, Artificial Sequence
  chemically synthesized
gagagaaagagagacacaga

SEQ ID NO: 241786 - DNA, 20 bp, Artificial Sequence
  chemically synthesized
gagaaagagagacacagaga

SEQ ID NO: 241787 - DNA, 20 bp, Artificial Sequence
  chemically synthesized
aagagagacacagagagaga

SEQ ID NO: 241788 - DNA, 20 bp, Artificial Sequence
  chemically synthesized
agagagacacagagagagat

SEQ ID NO: 241789 - DNA, 20 bp, Artificial Sequence
  chemically synthesized
gacacagagagagataggcg

SEQ ID NO: 241790 - DNA, 20 bp, Artificial Sequence
  chemically synthesized
cagagagagataggcgtgga

SEQ ID NO: 241791 - DNA, 20 bp, Artificial Sequence
  chemically synthesized
gagagagataggcgtggatg

SEQ ID NO: 241792 - DNA, 20 bp, Artificial Sequence
  chemically synthesized
taggcgtggatggagaacac

SEQ ID NO: 241793 - DNA, 20 bp, Artificial Sequence
  chemically synthesized
agaacacaagacataaacca

SEQ ID NO: 241794 - DNA, 20 bp, Artificial Sequence
  chemically synthesized
tgtaggttgtagaaagactg

SEQ ID NO: 241795 - DNA, 20 bp, Artificial Sequence
  chemically synthesized
ttccaagtgtaggttgtaga

SEQ ID NO: 241796 - DNA, 20 bp, Artificial Sequence
  chemically synthesized
tcatttccaagtgtaggttg

SEQ ID NO: 241797 - DNA, 20 bp, Artificial Sequence
  chemically synthesized
gtctttctacaacctacact

SEQ ID NO: 241798 - DNA, 20 bp, Artificial Sequence
  chemically synthesized
gatatgtcatttccaagtgt

SEQ ID NO: 241799 - DNA, 20 bp, Artificial Sequence
  chemically synthesized
tgatatgtcatttccaagtg

SEQ ID NO: 241800 - DNA, 20 bp, Artificial Sequence
  chemically synthesized
tgtgatgatatgtcatttcc

SEQ ID NO: 241801 - DNA, 20 bp, Artificial Sequence
  chemically synthesized
gaaatgacatatcatcacaa

SEQ ID NO: 241802 - DNA, 20 bp, Artificial Sequence
  chemically synthesized
aatgacatatcatcacaaaa

SEQ ID NO: 241803 - DNA, 20 bp, Artificial Sequence
  chemically synthesized
cacaaaagagtcactgaatc

SEQ ID NO: 241804 - DNA, 20 bp, Artificial Sequence
  chemically synthesized
cattgagtgtggactagatt

SEQ ID NO: 241805 - DNA, 20 bp, Artificial Sequence
  chemically synthesized
ccctgtcattgagtgtggac

SEQ ID NO: 241806 - DNA, 20 bp, Artificial Sequence
  chemically synthesized
aatgtccctgtcattgagtg

SEQ ID NO: 241807 - DNA, 20 bp, Artificial Sequence
  chemically synthesized
atctagtccacactcaatga

SEQ ID NO: 241808 - DNA, 20 bp, Artificial Sequence
  chemically synthesized
tctagtccacactcaatgac

SEQ ID NO: 241809 - DNA, 20 bp, Artificial Sequence
  chemically synthesized
ctagtccacactcaatgaca

SEQ ID NO: 241810 - DNA, 20 bp, Artificial Sequence
  chemically synthesized
agctaaatgtccctgtcatt

SEQ ID NO: 241811 - DNA, 20 bp, Artificial Sequence
  chemically synthesized
cactcaatgacagggacatt

SEQ ID NO: 241812 - DNA, 20 bp, Artificial Sequence
  chemically synthesized
gctcttctattcaagagtta

SEQ ID NO: 241813 - DNA, 20 bp, Artificial Sequence
  chemically synthesized
atttagctgtaactcttgaa

SEQ ID NO: 241814 - DNA, 20 bp, Artificial Sequence
  chemically synthesized
tgtgatgctcttctattcaa

SEQ ID NO: 241815 - DNA, 20 bp, Artificial Sequence
  chemically synthesized
tagctgtaactcttgaatag

SEQ ID NO: 241816 - DNA, 20 bp, Artificial Sequence
  chemically synthesized
tctgtgatgctcttctattc

SEQ ID NO: 241817 - DNA, 20 bp, Artificial Sequence
  chemically synthesized
gctgtaactcttgaatagaa

SEQ ID NO: 241818 - DNA, 20 bp, Artificial Sequence
  chemically synthesized
tcttgaatagaagagcatca

SEQ ID NO: 241819 - DNA, 20 bp, Artificial Sequence
  chemically synthesized
tttgtgaacataatttcata

SEQ ID NO: 241820 - DNA, 20 bp, Artificial Sequence
  chemically synthesized
ttgtgaacataatttcatat

SEQ ID NO: 241821 - DNA, 20 bp, Artificial Sequence
  chemically synthesized
tcatataggatatgaaatca

SEQ ID NO: 241822 - DNA, 20 bp, Artificial Sequence
  chemically synthesized
aggatatgaaatcaaagcca

SEQ ID NO: 241823 - DNA, 20 bp, Artificial Sequence
  chemically synthesized
cttctaggaataattaactt

SEQ ID NO: 241824 - DNA, 20 bp, Artificial Sequence
  chemically synthesized
aagccaaagttaattattcc

SEQ ID NO: 241825 - DNA, 20 bp, Artificial Sequence
  chemically synthesized
ccaaagttaattattcctag

SEQ ID NO: 241826 - DNA, 20 bp, Artificial Sequence
  chemically synthesized
aacacttcctttaaacttct

SEQ ID NO: 241827 - DNA, 20 bp, Artificial Sequence
  chemically synthesized
gaacacttcctttaaacttc

SEQ ID NO: 241828 - DNA, 20 bp, Artificial Sequence
  chemically synthesized
taattattcctagaagttta

SEQ ID NO: 241829 - DNA, 20 bp, Artificial Sequence
  chemically synthesized
aattattcctagaagtttaa

SEQ ID NO: 241830 - DNA, 20 bp, Artificial Sequence
  chemically synthesized
tattcctagaagtttaaagg

SEQ ID NO: 241831 - DNA, 20 bp, Artificial Sequence
  chemically synthesized
agccatggaaaatagcagaa

SEQ ID NO: 241832 - DNA, 20 bp, Artificial Sequence
  chemically synthesized
tagccatggaaaatagcaga

SEQ ID NO: 241833 - DNA, 20 bp, Artificial Sequence
  chemically synthesized
gcaatagccatggaaaatag

SEQ ID NO: 241834 - DNA, 20 bp, Artificial Sequence
  chemically synthesized
ttcctttctgctattttcca

SEQ ID NO: 241835 - DNA, 20 bp, Artificial Sequence
  chemically synthesized
tcagcaatagccatggaaaa

SEQ ID NO: 241836 - DNA, 20 bp, Artificial Sequence
  chemically synthesized
ggacttttcagcaatagcca

SEQ ID NO: 241837 - DNA, 20 bp, Artificial Sequence
  chemically synthesized
ggctttggacttttcagcaa

SEQ ID NO: 241838 - DNA, 20 bp, Artificial Sequence
  chemically synthesized
tttccatggctattgctgaa

SEQ ID NO: 241839 - DNA, 20 bp, Artificial Sequence
  chemically synthesized
cagaatggctttggactttt

SEQ ID NO: 241840 - DNA, 20 bp, Artificial Sequence
  chemically synthesized
ggctattgctgaaaagtcca

SEQ ID NO: 241841 - DNA, 20 bp, Artificial Sequence
  chemically synthesized
atcagaaatcagaatggctt

SEQ ID NO: 241842 - DNA, 20 bp, Artificial Sequence
  chemically synthesized
tcacagatcagaaatcagaa

SEQ ID NO: 241843 - DNA, 20 bp, Artificial Sequence
  chemically synthesized
gaagttcacagatcagaaat

SEQ ID NO: 241844 - DNA, 20 bp, Artificial Sequence
  chemically synthesized
acaaagagaagttcacagat

SEQ ID NO: 241845 - DNA, 20 bp, Artificial Sequence
  chemically synthesized
caaggacaaagagaagttca

SEQ ID NO: 241846 - DNA, 20 bp, Artificial Sequence
  chemically synthesized
acaaaaacaaggacaaagag

SEQ ID NO: 241847 - DNA, 20 bp, Artificial Sequence
  chemically synthesized
tttacaaaaacaaggacaaa

SEQ ID NO: 241848 - DNA, 20 bp, Artificial Sequence
  chemically synthesized
tttttacaaaaacaaggaca

SEQ ID NO: 241849 - DNA, 20 bp, Artificial Sequence
  chemically synthesized
cataaatttttacaaaaaca

SEQ ID NO: 241850 - DNA, 20 bp, Artificial Sequence
  chemically synthesized
tcataaatttttacaaaaac

SEQ ID NO: 241851 - DNA, 20 bp, Artificial Sequence
  chemically synthesized
ttgtaaaaatttatgatgat

SEQ ID NO: 241852 - DNA, 20 bp, Artificial Sequence
  chemically synthesized
aaatttatgatgatgagcct

SEQ ID NO: 241853 - DNA, 20 bp, Artificial Sequence
  chemically synthesized
tatgatgatgagccttggtg

SEQ ID NO: 241854 - DNA, 20 bp, Artificial Sequence
  chemically synthesized
tgagctaaaaatctacacca

SEQ ID NO: 241855 - DNA, 20 bp, Artificial Sequence
  chemically synthesized
atgagctaaaaatctacacc

SEQ ID NO: 241856 - DNA, 20 bp, Artificial Sequence
  chemically synthesized
tgagccttggtgtagatttt

SEQ ID NO: 241857 - DNA, 20 bp, Artificial Sequence
  chemically synthesized
aaatgcccagcacagcaaat

SEQ ID NO: 241858 - DNA, 20 bp, Artificial Sequence
  chemically synthesized
ttttagctcatttgctgtgc

SEQ ID NO: 241859 - DNA, 20 bp, Artificial Sequence
  chemically synthesized
tttagctcatttgctgtgct

SEQ ID NO: 241860 - DNA, 20 bp, Artificial Sequence
  chemically synthesized
ggcttactaaatgcccagca

SEQ ID NO: 241861 - DNA, 20 bp, Artificial Sequence
  chemically synthesized
catttgctgtgctgggcatt

SEQ ID NO: 241862 - DNA, 20 bp, Artificial Sequence
  chemically synthesized
taaagggcttactaaatgcc

SEQ ID NO: 241863 - DNA, 20 bp, Artificial Sequence
  chemically synthesized
tgctgtgctgggcatttagt

SEQ ID NO: 241864 - DNA, 20 bp, Artificial Sequence
  chemically synthesized
aatgagtgtccaggtttaaa

SEQ ID NO: 241865 - DNA, 20 bp, Artificial Sequence
  chemically synthesized
tttagtaagccctttaaacc

SEQ ID NO: 241866 - DNA, 20 bp, Artificial Sequence
  chemically synthesized
aaatgagtgtccaggtttaa

SEQ ID NO: 241867 - DNA, 20 bp, Artificial Sequence
  chemically synthesized
aaaatgagtgtccaggttta

SEQ ID NO: 241868 - DNA, 20 bp, Artificial Sequence
  chemically synthesized
actgaagaaaatgagtgtcc

SEQ ID NO: 241869 - DNA, 20 bp, Artificial Sequence
  chemically synthesized
aactgaagaaaatgagtgtc

SEQ ID NO: 241870 - DNA, 20 bp, Artificial Sequence
  chemically synthesized
ttcttagaactgaagaaaat

SEQ ID NO: 241871 - DNA, 20 bp, Artificial Sequence
  chemically synthesized
acctggacactcattttctt

SEQ ID NO: 241872 - DNA, 20 bp, Artificial Sequence
  chemically synthesized
cactcattttcttcagttct

SEQ ID NO: 241873 - DNA, 20 bp, Artificial Sequence
  chemically synthesized
catcagttttcttagaactg

SEQ ID NO: 241874 - DNA, 20 bp, Artificial Sequence
  chemically synthesized
agtgacaacatcagttttct

SEQ ID NO: 241875 - DNA, 20 bp, Artificial Sequence
  chemically synthesized
tatcaaagaagtgacaacat

SEQ ID NO: 241876 - DNA, 20 bp, Artificial Sequence
  chemically synthesized
tggagagaaaattatcaaag

SEQ ID NO: 241877 - DNA, 20 bp, Artificial Sequence
  chemically synthesized
ctgtggagagaaaattatca

SEQ ID NO: 241878 - DNA, 20 bp, Artificial Sequence
  chemically synthesized
ctttgataattttctctcca

SEQ ID NO: 241879 - DNA, 20 bp, Artificial Sequence
  chemically synthesized
agaagagaggcaactgtgga

SEQ ID NO: 241880 - DNA, 20 bp, Artificial Sequence
  chemically synthesized
acagaagagaggcaactgtg

SEQ ID NO: 241881 - DNA, 20 bp, Artificial Sequence
  chemically synthesized
aaacagaagagaggcaactg

SEQ ID NO: 241882 - DNA, 20 bp, Artificial Sequence
  chemically synthesized
ttaaaaataaaacagaagag

SEQ ID NO: 241883 - DNA, 20 bp, Artificial Sequence
  chemically synthesized
gttaaaaataaaacagaaga

SEQ ID NO: 241884 - DNA, 20 bp, Artificial Sequence
  chemically synthesized
atgttaaaaataaaacagaa

SEQ ID NO: 241885 - DNA, 20 bp, Artificial Sequence
  chemically synthesized
agatgttaaaaataaaacag

SEQ ID NO: 241886 - DNA, 20 bp, Artificial Sequence
  chemically synthesized
aatagatgttaaaaataaaa

SEQ ID NO: 241887 - DNA, 20 bp, Artificial Sequence
  chemically synthesized
gtaatccaacattcaaataa

SEQ ID NO: 241888 - DNA, 20 bp, Artificial Sequence
  chemically synthesized
aacatctattatttgaatgt

SEQ ID NO: 241889 - DNA, 20 bp, Artificial Sequence
  chemically synthesized
tatttgaatgttggattaca

SEQ ID NO: 241890 - DNA, 20 bp, Artificial Sequence
  chemically synthesized
aatgttggattacatagaac

SEQ ID NO: 241891 - DNA, 20 bp, Artificial Sequence
  chemically synthesized
atgttggattacatagaaca

SEQ ID NO: 241892 - DNA, 20 bp, Artificial Sequence
  chemically synthesized
gtgtcaatagtgtttatgtt

SEQ ID NO: 241893 - DNA, 20 bp, Artificial Sequence
  chemically synthesized
tactcatttcaaagtgtcaa

SEQ ID NO: 241894 - DNA, 20 bp, Artificial Sequence
  chemically synthesized
cactattgacactttgaaat

SEQ ID NO: 241895 - DNA, 20 bp, Artificial Sequence
  chemically synthesized
accaagaattactcatttca

SEQ ID NO: 241896 - DNA, 20 bp, Artificial Sequence
  chemically synthesized
actttgaaatgagtaattct

SEQ ID NO: 241897 - DNA, 20 bp, Artificial Sequence
  chemically synthesized
aaatgagtaattcttggttg

SEQ ID NO: 241898 - DNA, 20 bp, Artificial Sequence
  chemically synthesized
ccatgcagccatccacaacc

SEQ ID NO: 241899 - DNA, 20 bp, Artificial Sequence
  chemically synthesized
gagtaattcttggttgtgga

SEQ ID NO: 241900 - DNA, 20 bp, Artificial Sequence
  chemically synthesized
cttggttgtggatggctgca

SEQ ID NO: 241901 - DNA, 20 bp, Artificial Sequence
  chemically synthesized
cgcaagaggaatgcaccatg

SEQ ID NO: 241902 - DNA, 20 bp, Artificial Sequence
  chemically synthesized
cttgtgaagagtgacgcaag

SEQ ID NO: 241903 - DNA, 20 bp, Artificial Sequence
  chemically synthesized
tcttgtgaagagtgacgcaa

SEQ ID NO: 241904 - DNA, 20 bp, Artificial Sequence
  chemically synthesized
cctcttgtgaagagtgacgc

SEQ ID NO: 241905 - DNA, 20 bp, Artificial Sequence
  chemically synthesized
cctcttgcgtcactcttcac

SEQ ID NO: 241906 - DNA, 20 bp, Artificial Sequence
  chemically synthesized
tcttgcgtcactcttcacaa

SEQ ID NO: 241907 - DNA, 20 bp, Artificial Sequence
  chemically synthesized
tactactggcctcttgtgaa

SEQ ID NO: 241908 - DNA, 20 bp, Artificial Sequence
  chemically synthesized
cttgcgtcactcttcacaag

SEQ ID NO: 241909 - DNA, 20 bp, Artificial Sequence
  chemically synthesized
tgtactactggcctcttgtg

SEQ ID NO: 241910 - DNA, 20 bp, Artificial Sequence
  chemically synthesized
cgtcactcttcacaagaggc

SEQ ID NO: 241911 - DNA, 20 bp, Artificial Sequence
  chemically synthesized
cactcttcacaagaggccag

SEQ ID NO: 241912 - DNA, 20 bp, Artificial Sequence
  chemically synthesized
ataaggaaaggatgtactac

SEQ ID NO: 241913 - DNA, 20 bp, Artificial Sequence
  chemically synthesized
tcgttgtcacaaataaggaa

SEQ ID NO: 241914 - DNA, 20 bp, Artificial Sequence
  chemically synthesized
ttcgttgtcacaaataagga

SEQ ID NO: 241915 - DNA, 20 bp, Artificial Sequence
  chemically synthesized
ctttttcgttgtcacaaata

SEQ ID NO: 241916 - DNA, 20 bp, Artificial Sequence
  chemically synthesized
cctttttcgttgtcacaaat

SEQ ID NO: 241917 - DNA, 20 bp, Artificial Sequence
  chemically synthesized
ccttatttgtgacaacgaaa

SEQ ID NO: 241918 - DNA, 20 bp, Artificial Sequence
  chemically synthesized
cttatttgtgacaacgaaaa

SEQ ID NO: 241919 - DNA, 20 bp, Artificial Sequence
  chemically synthesized
aggacgtttgacaatgtacg

SEQ ID NO: 241920 - DNA, 20 bp, Artificial Sequence
  chemically synthesized
agaggacgtttgacaatgta

SEQ ID NO: 241921 - DNA, 20 bp, Artificial Sequence
  chemically synthesized
acattgtcaaacgtcctctg

SEQ ID NO: 241922 - DNA, 20 bp, Artificial Sequence
  chemically synthesized
cattgtcaaacgtcctctgc

SEQ ID NO: 241923 - DNA, 20 bp, Artificial Sequence
  chemically synthesized
gaggtgattttgtcctgcag

SEQ ID NO: 241924 - DNA, 20 bp, Artificial Sequence
  chemically synthesized
agaggtgattttgtcctgca

SEQ ID NO: 241925 - DNA, 20 bp, Artificial Sequence
  chemically synthesized
atagaggtgattttgtcctg

SEQ ID NO: 241926 - DNA, 20 bp, Artificial Sequence
  chemically synthesized
ggtaagtgtttcacaaatag

SEQ ID NO: 241927 - DNA, 20 bp, Artificial Sequence
  chemically synthesized
aggtaagtgtttcacaaata

SEQ ID NO: 241928 - DNA, 20 bp, Artificial Sequence
  chemically synthesized
ctaggtaagtgtttcacaaa

SEQ ID NO: 241929 - DNA, 20 bp, Artificial Sequence
  chemically synthesized
ctatttgtgaaacacttacc

SEQ ID NO: 241930 - DNA, 20 bp, Artificial Sequence
  chemically synthesized
cttagaagatcattctaggt

SEQ ID NO: 241931 - DNA, 20 bp, Artificial Sequence
  chemically synthesized
gaatcttagaagatcattct

SEQ ID NO: 241932 - DNA, 20 bp, Artificial Sequence
  chemically synthesized
agaatcttagaagatcattc

SEQ ID NO: 241933 - DNA, 20 bp, Artificial Sequence
  chemically synthesized
cttacctagaatgatcttct

SEQ ID NO: 241934 - DNA, 20 bp, Artificial Sequence
  chemically synthesized
ggagagtataagaatcttag

SEQ ID NO: 241935 - DNA, 20 bp, Artificial Sequence
  chemically synthesized
atgggagagtataagaatct

SEQ ID NO: 241936 - DNA, 20 bp, Artificial Sequence
  chemically synthesized
catggaaaatgggagagtat

SEQ ID NO: 241937 - DNA, 20 bp, Artificial Sequence
  chemically synthesized
caaaagcatggaaaatggga

SEQ ID NO: 241938 - DNA, 20 bp, Artificial Sequence
  chemically synthesized
gccaaaagcatggaaaatgg

SEQ ID NO: 241939 - DNA, 20 bp, Artificial Sequence
  chemically synthesized
tagccaaaagcatggaaaat

SEQ ID NO: 241940 - DNA, 20 bp, Artificial Sequence
  chemically synthesized
atagccaaaagcatggaaaa

SEQ ID NO: 241941 - DNA, 20 bp, Artificial Sequence
  chemically synthesized
tctcccattttccatgcttt

SEQ ID NO: 241942 - DNA, 20 bp, Artificial Sequence
  chemically synthesized
agtataaatagccaaaagca

SEQ ID NO: 241943 - DNA, 20 bp, Artificial Sequence
  chemically synthesized
aaagcagtataaatagccaa

SEQ ID NO: 241944 - DNA, 20 bp, Artificial Sequence
  chemically synthesized
atctcataaagcagtataaa

SEQ ID NO: 241945 - DNA, 20 bp, Artificial Sequence
  chemically synthesized
ggctatttatactgctttat

SEQ ID NO: 241946 - DNA, 20 bp, Artificial Sequence
  chemically synthesized
tgaagaaatatctcataaag

SEQ ID NO: 241947 - DNA, 20 bp, Artificial Sequence
  chemically synthesized
atttgaagaaatatctcata

SEQ ID NO: 241948 - DNA, 20 bp, Artificial Sequence
  chemically synthesized
aaaagtagaagataaatttg

SEQ ID NO: 241949 - DNA, 20 bp, Artificial Sequence
  chemically synthesized
aaataaaagttcaaaagtag

SEQ ID NO: 241950 - DNA, 20 bp, Artificial Sequence
  chemically synthesized
cagaaataaaagttcaaaag

SEQ ID NO: 241951 - DNA, 20 bp, Artificial Sequence
  chemically synthesized
gagcagaaataaaagttcaa

SEQ ID NO: 241952 - DNA, 20 bp, Artificial Sequence
  chemically synthesized
aaaatgaagagcagaaataa

SEQ ID NO: 241953 - DNA, 20 bp, Artificial Sequence
  chemically synthesized
agtctattaaaaatgaagag

SEQ ID NO: 241954 - DNA, 20 bp, Artificial Sequence
  chemically synthesized
tcaagtctattaaaaatgaa

SEQ ID NO: 241955 - DNA, 20 bp, Artificial Sequence
  chemically synthesized
aatcaagtctattaaaaatg

SEQ ID NO: 241956 - DNA, 20 bp, Artificial Sequence
  chemically synthesized
tttctgctcttcatttttaa

SEQ ID NO: 241957 - DNA, 20 bp, Artificial Sequence
  chemically synthesized
taaaattgctttaaaaaatc

SEQ ID NO: 241958 - DNA, 20 bp, Artificial Sequence
  chemically synthesized
ttaatagacttgatttttta

SEQ ID NO: 241959 - DNA, 20 bp, Artificial Sequence
  chemically synthesized
ttaaagcaattttacattta

SEQ ID NO: 241960 - DNA, 20 bp, Artificial Sequence
  chemically synthesized
tttacatttatagcaaaatc

SEQ ID NO: 241961 - DNA, 20 bp, Artificial Sequence
  chemically synthesized
ttacatttatagcaaaatcg

SEQ ID NO: 241962 - DNA, 20 bp, Artificial Sequence
  chemically synthesized
tacatttatagcaaaatcga

SEQ ID NO: 241963 - DNA, 20 bp, Artificial Sequence
  chemically synthesized
acatttatagcaaaatcgag

SEQ ID NO: 241964 - DNA, 20 bp, Artificial Sequence
  chemically synthesized
ttatagcaaaatcgagggga

SEQ ID NO: 241965 - DNA, 20 bp, Artificial Sequence
  chemically synthesized
gcaaaatcgaggggaaagta

SEQ ID NO: 241966 - DNA, 20 bp, Artificial Sequence
  chemically synthesized
aaaatcgaggggaaagtaca

SEQ ID NO: 241967 - DNA, 20 bp, Artificial Sequence
  chemically synthesized
aagggggccagagagtatac

SEQ ID NO: 241968 - DNA, 20 bp, Artificial Sequence
  chemically synthesized
gaagggggccagagagtata

SEQ ID NO: 241969 - DNA, 20 bp, Artificial Sequence
  chemically synthesized
gagatttcccgtatactctc

SEQ ID NO: 241970 - DNA, 20 bp, Artificial Sequence
  chemically synthesized
taatgaggaagggggccaga

SEQ ID NO: 241971 - DNA, 20 bp, Artificial Sequence
  chemically synthesized
tgtaatgaggaagggggcca

SEQ ID NO: 241972 - DNA, 20 bp, Artificial Sequence
  chemically synthesized
tgtgtaatgaggaagggggc

SEQ ID NO: 241973 - DNA, 20 bp, Artificial Sequence
  chemically synthesized
gctgtgtgtaatgaggaagg

SEQ ID NO: 241974 - DNA, 20 bp, Artificial Sequence
  chemically synthesized
ggctgtgtgtaatgaggaag

SEQ ID NO: 241975 - DNA, 20 bp, Artificial Sequence
  chemically synthesized
aggctgtgtgtaatgaggaa

SEQ ID NO: 241976 - DNA, 20 bp, Artificial Sequence
  chemically synthesized
taggctgtgtgtaatgagga

SEQ ID NO: 241977 - DNA, 20 bp, Artificial Sequence
  chemically synthesized
gtaggctgtgtgtaatgagg

SEQ ID NO: 241978 - DNA, 20 bp, Artificial Sequence
  chemically synthesized
ggggtaggctgtgtgtaatg

SEQ ID NO: 241979 - DNA, 20 bp, Artificial Sequence
  chemically synthesized
cggggtaggctgtgtgtaat

SEQ ID NO: 241980 - DNA, 20 bp, Artificial Sequence
  chemically synthesized
gcccccttcctcattacaca

SEQ ID NO: 241981 - DNA, 20 bp, Artificial Sequence
  chemically synthesized
tgggatgttgatagcggggt

SEQ ID NO: 241982 - DNA, 20 bp, Artificial Sequence
  chemically synthesized
gtgggatgttgatagcgggg

SEQ ID NO: 241983 - DNA, 20 bp, Artificial Sequence
  chemically synthesized
ggtgtgggatgttgatagcg

SEQ ID NO: 241984 - DNA, 20 bp, Artificial Sequence
  chemically synthesized
tggtgtgggatgttgatagc

SEQ ID NO: 241985 - DNA, 20 bp, Artificial Sequence
  chemically synthesized
ctggtgtgggatgttgatag

SEQ ID NO: 241986 - DNA, 20 bp, Artificial Sequence
  chemically synthesized
actctggtgtgggatgttga

SEQ ID NO: 241987 - DNA, 20 bp, Artificial Sequence
  chemically synthesized
ccgctatcaacatcccacac

SEQ ID NO: 241988 - DNA, 20 bp, Artificial Sequence
  chemically synthesized
gctatcaacatcccacacca

SEQ ID NO: 241989 - DNA, 20 bp, Artificial Sequence
  chemically synthesized
caaatgtaccactctggtgt

SEQ ID NO: 241990 - DNA, 20 bp, Artificial Sequence
  chemically synthesized
acaaatgtaccactctggtg

SEQ ID NO: 241991 - DNA, 20 bp, Artificial Sequence
  chemically synthesized
atcaacatcccacaccagag

SEQ ID NO: 241992 - DNA, 20 bp, Artificial Sequence
  chemically synthesized
ttataacaaatgtaccactc

SEQ ID NO: 241993 - DNA, 20 bp, Artificial Sequence
  chemically synthesized
atatatcaatgtatgtaagt

SEQ ID NO: 241994 - DNA, 20 bp, Artificial Sequence
  chemically synthesized
aatgatatatcaatgtatgt

SEQ ID NO: 241995 - DNA, 20 bp, Artificial Sequence
  chemically synthesized
tgatatatcattaacactcg

SEQ ID NO: 241996 - DNA, 20 bp, Artificial Sequence
  chemically synthesized
taatgtaaactatggacttc

SEQ ID NO: 241997 - DNA, 20 bp, Artificial Sequence
  chemically synthesized
tcattaacactcgaagtcca

SEQ ID NO: 241998 - DNA, 20 bp, Artificial Sequence
  chemically synthesized
gcaaactctaatgtaaacta

SEQ ID NO: 241999 - DNA, 20 bp, Artificial Sequence
  chemically synthesized
tcgaagtccatagtttacat

SEQ ID NO: 242000 - DNA, 20 bp, Artificial Sequence
  chemically synthesized
gaagtccatagtttacatta

SEQ ID NO: 242001 - DNA, 20 bp, Artificial Sequence
  chemically synthesized
catagaagatacaacatcac

SEQ ID NO: 242002 - DNA, 20 bp, Artificial Sequence
  chemically synthesized
ttgtgatgttgtatcttcta

SEQ ID NO: 242003 - DNA, 20 bp, Artificial Sequence
  chemically synthesized
tgtgatgttgtatcttctat

SEQ ID NO: 242004 - DNA, 20 bp, Artificial Sequence
  chemically synthesized
atatttgtccaaacccatag

SEQ ID NO: 242005 - DNA, 20 bp, Artificial Sequence
  chemically synthesized
tgttgtatcttctatgggtt

SEQ ID NO: 242006 - DNA, 20 bp, Artificial Sequence
  chemically synthesized
tatatatttgtccaaaccca

SEQ ID NO: 242007 - DNA, 20 bp, Artificial Sequence
  chemically synthesized
tttggacaaatatataatga

SEQ ID NO: 242008 - DNA, 20 bp, Artificial Sequence
  chemically synthesized
ttggacaaatatataatgaa

SEQ ID NO: 242009 - DNA, 20 bp, Artificial Sequence
  chemically synthesized
atgaaaggtatccaccatta

SEQ ID NO: 242010 - DNA, 20 bp, Artificial Sequence
  chemically synthesized
tctgtgtgatactataatgg

SEQ ID NO: 242011 - DNA, 20 bp, Artificial Sequence
  chemically synthesized
tactctgtgtgatactataa

SEQ ID NO: 242012 - DNA, 20 bp, Artificial Sequence
  chemically synthesized
tccaccattatagtatcaca

SEQ ID NO: 242013 - DNA, 20 bp, Artificial Sequence
  chemically synthesized
caccattatagtatcacaca

SEQ ID NO: 242014 - DNA, 20 bp, Artificial Sequence
  chemically synthesized
cattatagtatcacacagag

SEQ ID NO: 242015 - DNA, 20 bp, Artificial Sequence
  chemically synthesized
tggtatgcatagcagtttta

SEQ ID NO: 242016 - DNA, 20 bp, Artificial Sequence
  chemically synthesized
catggtatgcatagcagttt

SEQ ID NO: 242017 - DNA, 20 bp, Artificial Sequence
  chemically synthesized
aacatacatggtatgcatag

SEQ ID NO: 242018 - DNA, 20 bp, Artificial Sequence
  chemically synthesized
aataacatacatggtatgca

SEQ ID NO: 242019 - DNA, 20 bp, Artificial Sequence
  chemically synthesized
caccactggaataacataca

SEQ ID NO: 242020 - DNA, 20 bp, Artificial Sequence
  chemically synthesized
gcataccatgtatgttattc

SEQ ID NO: 242021 - DNA, 20 bp, Artificial Sequence
  chemically synthesized
taccatgtatgttattccag

SEQ ID NO: 242022 - DNA, 20 bp, Artificial Sequence
  chemically synthesized
catgtatgttattccagtgg

SEQ ID NO: 242023 - DNA, 20 bp, Artificial Sequence
  chemically synthesized
gcttttagtatatccaccac

SEQ ID NO: 242024 - DNA, 20 bp, Artificial Sequence
  chemically synthesized
tccagtggtggatatactaa

SEQ ID NO: 242025 - DNA, 20 bp, Artificial Sequence
  chemically synthesized
agtggtgaaggcagagcttt

SEQ ID NO: 242026 - DNA, 20 bp, Artificial Sequence
  chemically synthesized
attttatagtggtgaaggca

SEQ ID NO: 242027 - DNA, 20 bp, Artificial Sequence
  chemically synthesized
atattttatagtggtgaagg

SEQ ID NO: 242028 - DNA, 20 bp, Artificial Sequence
  chemically synthesized
aatatattttatagtggtga

SEQ ID NO: 242029 - DNA, 20 bp, Artificial Sequence
  chemically synthesized
gaatatattttatagtggtg

SEQ ID NO: 242030 - DNA, 20 bp, Artificial Sequence
  chemically synthesized
tatatgaatatattttatag

SEQ ID NO: 242031 - DNA, 20 bp, Artificial Sequence
  chemically synthesized
tgttatatgaatatatttta

SEQ ID NO: 242032 - DNA, 20 bp, Artificial Sequence
  chemically synthesized
ttcatataacaaaattacac

SEQ ID NO: 242033 - DNA, 20 bp, Artificial Sequence
  chemically synthesized
tgtataaatttatgggttac

SEQ ID NO: 242034 - DNA, 20 bp, Artificial Sequence
  chemically synthesized
tcttaattgtataaatttat

SEQ ID NO: 242035 - DNA, 20 bp, Artificial Sequence
  chemically synthesized
ttcttaattgtataaattta

SEQ ID NO: 242036 - DNA, 20 bp, Artificial Sequence
  chemically synthesized
acccataaatttatacaatt

SEQ ID NO: 242037 - DNA, 20 bp, Artificial Sequence
  chemically synthesized
aattaatagtatagcaggtt

SEQ ID NO: 242038 - DNA, 20 bp, Artificial Sequence
  chemically synthesized
atttaaattaatagtatagc

SEQ ID NO: 242039 - DNA, 20 bp, Artificial Sequence
  chemically synthesized
tatttaaattaatagtatag

SEQ ID NO: 242040 - DNA, 20 bp, Artificial Sequence
  chemically synthesized
ggttatttaaattaatagta

SEQ ID NO: 242041 - DNA, 20 bp, Artificial Sequence
  chemically synthesized
ataagggttatttaaattaa

SEQ ID NO: 242042 - DNA, 20 bp, Artificial Sequence
  chemically synthesized
ggtatttccgagaaagataa

SEQ ID NO: 242043 - DNA, 20 bp, Artificial Sequence
  chemically synthesized
tggtatttccgagaaagata

SEQ ID NO: 242044 - DNA, 20 bp, Artificial Sequence
  chemically synthesized
gtggtatttccgagaaagat

SEQ ID NO: 242045 - DNA, 20 bp, Artificial Sequence
  chemically synthesized
taaataacccttatctttct

SEQ ID NO: 242046 - DNA, 20 bp, Artificial Sequence
  chemically synthesized
agaaggtggtatttccgaga

SEQ ID NO: 242047 - DNA, 20 bp, Artificial Sequence
  chemically synthesized
ctatagaaggtggtatttcc

SEQ ID NO: 242048 - DNA, 20 bp, Artificial Sequence
  chemically synthesized
ctcggaaataccaccttcta

SEQ ID NO: 242049 - DNA, 20 bp, Artificial Sequence
  chemically synthesized
gaacaagagactatagaagg

SEQ ID NO: 242050 - DNA, 20 bp, Artificial Sequence
  chemically synthesized
aaagaacaagagactataga

SEQ ID NO: 242051 - DNA, 20 bp, Artificial Sequence
  chemically synthesized
gaaagaacaagagactatag

SEQ ID NO: 242052 - DNA, 20 bp, Artificial Sequence
  chemically synthesized
taagaaagaacaagagacta

SEQ ID NO: 242053 - DNA, 20 bp, Artificial Sequence
  chemically synthesized
gtattcataagaaagaacaa

SEQ ID NO: 242054 - DNA, 20 bp, Artificial Sequence
  chemically synthesized
ctgtattcataagaaagaac

SEQ ID NO: 242055 - DNA, 20 bp, Artificial Sequence
  chemically synthesized
tagtcactgtattcataaga

SEQ ID NO: 242056 - DNA, 20 bp, Artificial Sequence
  chemically synthesized
cttgttctttcttatgaata

SEQ ID NO: 242057 - DNA, 20 bp, Artificial Sequence
  chemically synthesized
agactagtcactgtattcat

SEQ ID NO: 242058 - DNA, 20 bp, Artificial Sequence
  chemically synthesized
tttcttatgaatacagtgac

SEQ ID NO: 242059 - DNA, 20 bp, Artificial Sequence
  chemically synthesized
ttattatctcacagtgagac

SEQ ID NO: 242060 - DNA, 20 bp, Artificial Sequence
  chemically synthesized
acagtgactagtctcactgt

SEQ ID NO: 242061 - DNA, 20 bp, Artificial Sequence
  chemically synthesized
taaaattattatctcacagt

SEQ ID NO: 242062 - DNA, 20 bp, Artificial Sequence
  chemically synthesized
gctataaaattattatctca

SEQ ID NO: 242063 - DNA, 20 bp, Artificial Sequence
  chemically synthesized
actgtgagataataatttta

SEQ ID NO: 242064 - DNA, 20 bp, Artificial Sequence
  chemically synthesized
ttaagaaaactttttaaaga

SEQ ID NO: 242065 - DNA, 20 bp, Artificial Sequence
  chemically synthesized
attttatagctatctttaaa

SEQ ID NO: 242066 - DNA, 20 bp, Artificial Sequence
  chemically synthesized
gaccttaagaaaacttttta

SEQ ID NO: 242067 - DNA, 20 bp, Artificial Sequence
  chemically synthesized
tatctttaaaaagttttctt

SEQ ID NO: 242068 - DNA, 20 bp, Artificial Sequence
  chemically synthesized
atctttaaaaagttttctta

SEQ ID NO: 242069 - DNA, 20 bp, Artificial Sequence
  chemically synthesized
agagacaaggcatagacctt

SEQ ID NO: 242070 - DNA, 20 bp, Artificial Sequence
  chemically synthesized
gcagaaagagagacaaggca

SEQ ID NO: 242071 - DNA, 20 bp, Artificial Sequence
  chemically synthesized
tctctgcagaaagagagaca

SEQ ID NO: 242072 - DNA, 20 bp, Artificial Sequence
  chemically synthesized
atctctgcagaaagagagac

SEQ ID NO: 242073 - DNA, 20 bp, Artificial Sequence
  chemically synthesized
cagaaatctctgcagaaaga

SEQ ID NO: 242074 - DNA, 20 bp, Artificial Sequence
  chemically synthesized
atgccttgtctctctttctg

SEQ ID NO: 242075 - DNA, 20 bp, Artificial Sequence
  chemically synthesized
aacagaaatctctgcagaaa

SEQ ID NO: 242076 - DNA, 20 bp, Artificial Sequence
  chemically synthesized
gccttgtctctctttctgca

SEQ ID NO: 242077 - DNA, 20 bp, Artificial Sequence
  chemically synthesized
gaaacagaaatctctgcaga

SEQ ID NO: 242078 - DNA, 20 bp, Artificial Sequence
  chemically synthesized
aaatgaaacagaaatctctg

SEQ ID NO: 242079 - DNA, 20 bp, Artificial Sequence
  chemically synthesized
caatagccacataaatgaaa

SEQ ID NO: 242080 - DNA, 20 bp, Artificial Sequence
  chemically synthesized
agatttctgtttcatttatg

SEQ ID NO: 242081 - DNA, 20 bp, Artificial Sequence
  chemically synthesized
aaatattgggaaaaaaacaa

SEQ ID NO: 242082 - DNA, 20 bp, Artificial Sequence
  chemically synthesized
aaacaaaaagcagaaatatt

SEQ ID NO: 242083 - DNA, 20 bp, Artificial Sequence
  chemically synthesized
aaaacaaaaagcagaaatat

SEQ ID NO: 242084 - DNA, 20 bp, Artificial Sequence
  chemically synthesized
accaacataaaaacaaaaag

SEQ ID NO: 242085 - DNA, 20 bp, Artificial Sequence
  chemically synthesized
gaaaccaacataaaaacaaa

SEQ ID NO: 242086 - DNA, 20 bp, Artificial Sequence
  chemically synthesized
tctgctttttgtttttatgt

SEQ ID NO: 242087 - DNA, 20 bp, Artificial Sequence
  chemically synthesized
catgtctcaaagatggaaga

SEQ ID NO: 242088 - DNA, 20 bp, Artificial Sequence
  chemically synthesized
tgaacatgtctcaaagatgg

SEQ ID NO: 242089 - DNA, 20 bp, Artificial Sequence
  chemically synthesized
ggtttctgtcttccatcttt

SEQ ID NO: 242090 - DNA, 20 bp, Artificial Sequence
  chemically synthesized
atttgaacatgtctcaaaga

SEQ ID NO: 242091 - DNA, 20 bp, Artificial Sequence
  chemically synthesized
agatatttgaacatgtctca

SEQ ID NO: 242092 - DNA, 20 bp, Artificial Sequence
  chemically synthesized
ttgagacatgttcaaatatc

SEQ ID NO: 242093 - DNA, 20 bp, Artificial Sequence
  chemically synthesized
aagagacaatcaaggatttc

SEQ ID NO: 242094 - DNA, 20 bp, Artificial Sequence
  chemically synthesized
tcagttttaagagacaatca

SEQ ID NO: 242095 - DNA, 20 bp, Artificial Sequence
  chemically synthesized
ctcagttttaagagacaatc

SEQ ID NO: 242096 - DNA, 20 bp, Artificial Sequence
  chemically synthesized
atttaatgcctcagttttaa

SEQ ID NO: 242097 - DNA, 20 bp, Artificial Sequence
  chemically synthesized
cttgattgtctcttaaaact

SEQ ID NO: 242098 - DNA, 20 bp, Artificial Sequence
  chemically synthesized
ttgattgtctcttaaaactg

SEQ ID NO: 242099 - DNA, 20 bp, Artificial Sequence
  chemically synthesized
gcatttaatgcctcagtttt

SEQ ID NO: 242100 - DNA, 20 bp, Artificial Sequence
  chemically synthesized
tccaaaagcatttaatgcct

SEQ ID NO: 242101 - DNA, 20 bp, Artificial Sequence
  chemically synthesized
actgaggcattaaatgcttt

SEQ ID NO: 242102 - DNA, 20 bp, Artificial Sequence
  chemically synthesized
tacgcacaaggaatttccaa

SEQ ID NO: 242103 - DNA, 20 bp, Artificial Sequence
  chemically synthesized
ataagccctacatacgcaca

SEQ ID NO: 242104 - DNA, 20 bp, Artificial Sequence
  chemically synthesized
tataagccctacatacgcac

SEQ ID NO: 242105 - DNA, 20 bp, Artificial Sequence
  chemically synthesized
ggaaattccttgtgcgtatg

SEQ ID NO: 242106 - DNA, 20 bp, Artificial Sequence
  chemically synthesized
gaaattccttgtgcgtatgt

SEQ ID NO: 242107 - DNA, 20 bp, Artificial Sequence
  chemically synthesized
aaattccttgtgcgtatgta

SEQ ID NO: 242108 - DNA, 20 bp, Artificial Sequence
  chemically synthesized
gcgtatgtagggcttatact

SEQ ID NO: 242109 - DNA, 20 bp, Artificial Sequence
  chemically synthesized
tattgaagcccaccaagtat

SEQ ID NO: 242110 - DNA, 20 bp, Artificial Sequence
  chemically synthesized
tatgtagggcttatacttgg

SEQ ID NO: 242111 - DNA, 20 bp, Artificial Sequence
  chemically synthesized
atgtagggcttatacttggt

SEQ ID NO: 242112 - DNA, 20 bp, Artificial Sequence
  chemically synthesized
accatatattgaagcccacc

SEQ ID NO: 242113 - DNA, 20 bp, Artificial Sequence
  chemically synthesized
acttggtgggcttcaatata

SEQ ID NO: 242114 - DNA, 20 bp, Artificial Sequence
  chemically synthesized
tgcctaatgaccatatattg

SEQ ID NO: 242115 - DNA, 20 bp, Artificial Sequence
  chemically synthesized
gggcttcaatatatggtcat

SEQ ID NO: 242116 - DNA, 20 bp, Artificial Sequence
  chemically synthesized
ggcttcaatatatggtcatt

SEQ ID NO: 242117 - DNA, 20 bp, Artificial Sequence
  chemically synthesized
caatatatggtcattaggca

SEQ ID NO: 242118 - DNA, 20 bp, Artificial Sequence
  chemically synthesized
atggtcattaggcacagatc

SEQ ID NO: 242119 - DNA, 20 bp, Artificial Sequence
  chemically synthesized
tgatccaccagtgaaatagc

SEQ ID NO: 242120 - DNA, 20 bp, Artificial Sequence
  chemically synthesized
cacagatctggctatttcac

SEQ ID NO: 242121 - DNA, 20 bp, Artificial Sequence
  chemically synthesized
gtaatgatccaccagtgaaa

SEQ ID NO: 242122 - DNA, 20 bp, Artificial Sequence
  chemically synthesized
agatctggctatttcactgg

SEQ ID NO: 242123 - DNA, 20 bp, Artificial Sequence
  chemically synthesized
aatgatatgtaatgatccac

SEQ ID NO: 242124 - DNA, 20 bp, Artificial Sequence
  chemically synthesized
tcattacatatcattaattg

SEQ ID NO: 242125 - DNA, 20 bp, Artificial Sequence
  chemically synthesized
cattacatatcattaattgt

SEQ ID NO: 242126 - DNA, 20 bp, Artificial Sequence
  chemically synthesized
attgtaggttactatgatct

SEQ ID NO: 242127 - DNA, 20 bp, Artificial Sequence
  chemically synthesized
gcaagaacacactcagatca

SEQ ID NO: 242128 - DNA, 20 bp, Artificial Sequence
  chemically synthesized
aaattttgcaagaacacact

SEQ ID NO: 242129 - DNA, 20 bp, Artificial Sequence
  chemically synthesized
tttcaacgtataaattttgc

SEQ ID NO: 242130 - DNA, 20 bp, Artificial Sequence
  chemically synthesized
acgttgaaatcctcaccctc

SEQ ID NO: 242131 - DNA, 20 bp, Artificial Sequence
  chemically synthesized
atgtcatcaccttgagggtg

SEQ ID NO: 242132 - DNA, 20 bp, Artificial Sequence
  chemically synthesized
cgttgaaatcctcaccctca

SEQ ID NO: 242133 - DNA, 20 bp, Artificial Sequence
  chemically synthesized
aatgtcatcaccttgagggt

SEQ ID NO: 242134 - DNA, 20 bp, Artificial Sequence
  chemically synthesized
tcctaatgtcatcaccttga

SEQ ID NO: 242135 - DNA, 20 bp, Artificial Sequence
  chemically synthesized
ttcctaatgtcatcaccttg

SEQ ID NO: 242136 - DNA, 20 bp, Artificial Sequence
  chemically synthesized
cttcctaatgtcatcacctt

SEQ ID NO: 242137 - DNA, 20 bp, Artificial Sequence
  chemically synthesized
caccctcaaggtgatgacat

SEQ ID NO: 242138 - DNA, 20 bp, Artificial Sequence
  chemically synthesized
accctcaaggtgatgacatt

SEQ ID NO: 242139 - DNA, 20 bp, Artificial Sequence
  chemically synthesized
ctcaaggtgatgacattagg

SEQ ID NO: 242140 - DNA, 20 bp, Artificial Sequence
  chemically synthesized
aaggtgatgacattaggaag

SEQ ID NO: 242141 - DNA, 20 bp, Artificial Sequence
  chemically synthesized
aggtgatgacattaggaagt

SEQ ID NO: 242142 - DNA, 20 bp, Artificial Sequence
  chemically synthesized
ggtgatgacattaggaagtg

SEQ ID NO: 242143 - DNA, 20 bp, Artificial Sequence
  chemically synthesized
acattaggaagtggggcctt

SEQ ID NO: 242144 - DNA, 20 bp, Artificial Sequence
  chemically synthesized
ttaggaagtggggcctttgg

SEQ ID NO: 242145 - DNA, 20 bp, Artificial Sequence
  chemically synthesized
taggaagtggggcctttgga

SEQ ID NO: 242146 - DNA, 20 bp, Artificial Sequence
  chemically synthesized
atgacctaattaccttccaa

SEQ ID NO: 242147 - DNA, 20 bp, Artificial Sequence
  chemically synthesized
tatgacctaattaccttcca

SEQ ID NO: 242148 - DNA, 20 bp, Artificial Sequence
  chemically synthesized
tggggcctttggaaggtaat

SEQ ID NO: 242149 - DNA, 20 bp, Artificial Sequence
  chemically synthesized
ggggcctttggaaggtaatt

SEQ ID NO: 242150 - DNA, 20 bp, Artificial Sequence
  chemically synthesized
ttggaaggtaattaggtcat

SEQ ID NO: 242151 - DNA, 20 bp, Artificial Sequence
  chemically synthesized
tggaaggtaattaggtcata

SEQ ID NO: 242152 - DNA, 20 bp, Artificial Sequence
  chemically synthesized
gtaattaggtcataaggcca

SEQ ID NO: 242153 - DNA, 20 bp, Artificial Sequence
  chemically synthesized
attctcattctggatggctt

SEQ ID NO: 242154 - DNA, 20 bp, Artificial Sequence
  chemically synthesized
gtcataaggccaaagccatc

SEQ ID NO: 242155 - DNA, 20 bp, Artificial Sequence
  chemically synthesized
ggtactattctcattctgga

SEQ ID NO: 242156 - DNA, 20 bp, Artificial Sequence
  chemically synthesized
aggccaaagccatccagaat

SEQ ID NO: 242157 - DNA, 20 bp, Artificial Sequence
  chemically synthesized
taagggtactattctcattc

SEQ ID NO: 242158 - DNA, 20 bp, Artificial Sequence
  chemically synthesized
aaagccatccagaatgagaa

SEQ ID NO: 242159 - DNA, 20 bp, Artificial Sequence
  chemically synthesized
tgagaatagtacccttacaa

SEQ ID NO: 242160 - DNA, 20 bp, Artificial Sequence
  chemically synthesized
gtcttgggcctcttttgtaa

SEQ ID NO: 242161 - DNA, 20 bp, Artificial Sequence
  chemically synthesized
agaatagtacccttacaaaa

SEQ ID NO: 242162 - DNA, 20 bp, Artificial Sequence
  chemically synthesized
tgtcttgggcctcttttgta

SEQ ID NO: 242163 - DNA, 20 bp, Artificial Sequence
  chemically synthesized
gaatagtacccttacaaaag

SEQ ID NO: 242164 - DNA, 20 bp, Artificial Sequence
  chemically synthesized
ctgtcttgggcctcttttgt

SEQ ID NO: 242165 - DNA, 20 bp, Artificial Sequence
  chemically synthesized
tacccttacaaaagaggccc

SEQ ID NO: 242166 - DNA, 20 bp, Artificial Sequence
  chemically synthesized
cttacaaaagaggcccaaga

SEQ ID NO: 242167 - DNA, 20 bp, Artificial Sequence
  chemically synthesized
aggtccaagggaactgtctt

SEQ ID NO: 242168 - DNA, 20 bp, Artificial Sequence
  chemically synthesized
caggtccaagggaactgtct

SEQ ID NO: 242169 - DNA, 20 bp, Artificial Sequence
  chemically synthesized
gaggcccaagacagttccct

SEQ ID NO: 242170 - DNA, 20 bp, Artificial Sequence
  chemically synthesized
tcacaaggcagcaggtccaa

SEQ ID NO: 242171 - DNA, 20 bp, Artificial Sequence
  chemically synthesized
ctcacaaggcagcaggtcca

SEQ ID NO: 242172 - DNA, 20 bp, Artificial Sequence
  chemically synthesized
cctcacaaggcagcaggtcc

SEQ ID NO: 242173 - DNA, 20 bp, Artificial Sequence
  chemically synthesized
ctgtaacctcacaaggcagc

SEQ ID NO: 242174 - DNA, 20 bp, Artificial Sequence
  chemically synthesized
actgtaacctcacaaggcag

SEQ ID NO: 242175 - DNA, 20 bp, Artificial Sequence
  chemically synthesized
ccttggacctgctgccttgt

SEQ ID NO: 242176 - DNA, 20 bp, Artificial Sequence
  chemically synthesized
cttggacctgctgccttgtg

SEQ ID NO: 242177 - DNA, 20 bp, Artificial Sequence
  chemically synthesized
ctcactgtaacctcacaagg

SEQ ID NO: 242178 - DNA, 20 bp, Artificial Sequence
  chemically synthesized
cttctcactgtaacctcaca

SEQ ID NO: 242179 - DNA, 20 bp, Artificial Sequence
  chemically synthesized
tcttctcactgtaacctcac

SEQ ID NO: 242180 - DNA, 20 bp, Artificial Sequence
  chemically synthesized
cctgctgccttgtgaggtta

SEQ ID NO: 242181 - DNA, 20 bp, Artificial Sequence
  chemically synthesized
ctgccttgtgaggttacagt

SEQ ID NO: 242182 - DNA, 20 bp, Artificial Sequence
  chemically synthesized
ccttgtgaggttacagtgag

SEQ ID NO: 242183 - DNA, 20 bp, Artificial Sequence
  chemically synthesized
gtgaggttacagtgagaaga

SEQ ID NO: 242184 - DNA, 20 bp, Artificial Sequence
  chemically synthesized
tgaggttacagtgagaagac

SEQ ID NO: 242185 - DNA, 20 bp, Artificial Sequence
  chemically synthesized
acagtgagaagacaggaaat

SEQ ID NO: 242186 - DNA, 20 bp, Artificial Sequence
  chemically synthesized
gacaggaaatgagctttcac

SEQ ID NO: 242187 - DNA, 20 bp, Artificial Sequence
  chemically synthesized
gcaggtttggtgtctggtga

SEQ ID NO: 242188 - DNA, 20 bp, Artificial Sequence
  chemically synthesized
gcactggcaggtttggtgtc

SEQ ID NO: 242189 - DNA, 20 bp, Artificial Sequence
  chemically synthesized
tcaccagacaccaaacctgc

SEQ ID NO: 242190 - DNA, 20 bp, Artificial Sequence
  chemically synthesized
gatcaaggcactggcaggtt

SEQ ID NO: 242191 - DNA, 20 bp, Artificial Sequence
  chemically synthesized
ttcaagatcaaggcactggc

SEQ ID NO: 242192 - DNA, 20 bp, Artificial Sequence
  chemically synthesized
gttcaagatcaaggcactgg

SEQ ID NO: 242193 - DNA, 20 bp, Artificial Sequence
  chemically synthesized
gaagttcaagatcaaggcac

SEQ ID NO: 242194 - DNA, 20 bp, Artificial Sequence
  chemically synthesized
ggctgggaagttcaagatca

SEQ ID NO: 242195 - DNA, 20 bp, Artificial Sequence
  chemically synthesized
aggctgggaagttcaagatc

SEQ ID NO: 242196 - DNA, 20 bp, Artificial Sequence
  chemically synthesized
ttctggaggctgggaagttc

SEQ ID NO: 242197 - DNA, 20 bp, Artificial Sequence
  chemically synthesized
tgccttgatcttgaacttcc

SEQ ID NO: 242198 - DNA, 20 bp, Artificial Sequence
  chemically synthesized
tcaccgttctggaggctggg

SEQ ID NO: 242199 - DNA, 20 bp, Artificial Sequence
  chemically synthesized
atcttgaacttcccagcctc

SEQ ID NO: 242200 - DNA, 20 bp, Artificial Sequence
  chemically synthesized
ttctcaccgttctggaggct

SEQ ID NO: 242201 - DNA, 20 bp, Artificial Sequence
  chemically synthesized
tttctcaccgttctggaggc

SEQ ID NO: 242202 - DNA, 20 bp, Artificial Sequence
  chemically synthesized
gaacttcccagcctccagaa

SEQ ID NO: 242203 - DNA, 20 bp, Artificial Sequence
  chemically synthesized
tttatttctcaccgttctgg

SEQ ID NO: 242204 - DNA, 20 bp, Artificial Sequence
  chemically synthesized
ctttatttctcaccgttctg

SEQ ID NO: 242205 - DNA, 20 bp, Artificial Sequence
  chemically synthesized
ttcccagcctccagaacggt

SEQ ID NO: 242206 - DNA, 20 bp, Artificial Sequence
  chemically synthesized
acctttatttctcaccgttc

SEQ ID NO: 242207 - DNA, 20 bp, Artificial Sequence
  chemically synthesized
ctccagaacggtgagaaata

SEQ ID NO: 242208 - DNA, 20 bp, Artificial Sequence
  chemically synthesized
tccagaacggtgagaaataa

SEQ ID NO: 242209 - DNA, 20 bp, Artificial Sequence
  chemically synthesized
actggatgccttataaacaa

SEQ ID NO: 242210 - DNA, 20 bp, Artificial Sequence
  chemically synthesized
aataaaggtctgttgtttat

SEQ ID NO: 242211 - DNA, 20 bp, Artificial Sequence
  chemically synthesized
ataaaggtctgttgtttata

SEQ ID NO: 242212 - DNA, 20 bp, Artificial Sequence
  chemically synthesized
tctgttgtttataaggcatc

SEQ ID NO: 242213 - DNA, 20 bp, Artificial Sequence
  chemically synthesized
tttataaggcatccagtcta

SEQ ID NO: 242214 - DNA, 20 bp, Artificial Sequence
  chemically synthesized
tataacaaaataccatagac

SEQ ID NO: 242215 - DNA, 20 bp, Artificial Sequence
  chemically synthesized
attgctataacaaaatacca

SEQ ID NO: 242216 - DNA, 20 bp, Artificial Sequence
  chemically synthesized
cagtctatggtattttgtta

SEQ ID NO: 242217 - DNA, 20 bp, Artificial Sequence
  chemically synthesized
tacgaaaactatttttagtc

SEQ ID NO: 242218 - DNA, 20 bp, Artificial Sequence
  chemically synthesized
caataaaacttgactaaaaa

SEQ ID NO: 242219 - DNA, 20 bp, Artificial Sequence
  chemically synthesized
tgcaatacgaaaactatttt

SEQ ID NO: 242220 - DNA, 20 bp, Artificial Sequence
  chemically synthesized
taaaaatagttttcgtattg

SEQ ID NO: 242221 - DNA, 20 bp, Artificial Sequence
  chemically synthesized
aaaaatagttttcgtattgc

SEQ ID NO: 242222 - DNA, 20 bp, Artificial Sequence
  chemically synthesized
aatagttttcgtattgcagg

SEQ ID NO: 242223 - DNA, 20 bp, Artificial Sequence
  chemically synthesized
atagttttcgtattgcaggt

SEQ ID NO: 242224 - DNA, 20 bp, Artificial Sequence
  chemically synthesized
tcgtattgcaggtaggctct

SEQ ID NO: 242225 - DNA, 20 bp, Artificial Sequence
  chemically synthesized
cgtattgcaggtaggctctc

SEQ ID NO: 242226 - DNA, 20 bp, Artificial Sequence
  chemically synthesized
tattgcaggtaggctctcag

SEQ ID NO: 242227 - DNA, 20 bp, Artificial Sequence
  chemically synthesized
ttataaatttattctcctga

SEQ ID NO: 242228 - DNA, 20 bp, Artificial Sequence
  chemically synthesized
gattataaatttattctcct

SEQ ID NO: 242229 - DNA, 20 bp, Artificial Sequence
  chemically synthesized
taaatttataatctactgcc

SEQ ID NO: 242230 - DNA, 20 bp, Artificial Sequence
  chemically synthesized
aatttataatctactgccca

SEQ ID NO: 242231 - DNA, 20 bp, Artificial Sequence
  chemically synthesized
agtttctatcctctgggcag

SEQ ID NO: 242232 - DNA, 20 bp, Artificial Sequence
  chemically synthesized
atttataatctactgcccag

SEQ ID NO: 242233 - DNA, 20 bp, Artificial Sequence
  chemically synthesized
ttaagtttctatcctctggg

SEQ ID NO: 242234 - DNA, 20 bp, Artificial Sequence
  chemically synthesized
ataatctactgcccagagga

SEQ ID NO: 242235 - DNA, 20 bp, Artificial Sequence
  chemically synthesized
ctcttaagtttctatcctct

SEQ ID NO: 242236 - DNA, 20 bp, Artificial Sequence
  chemically synthesized
gctcttaagtttctatcctc

SEQ ID NO: 242237 - DNA, 20 bp, Artificial Sequence
  chemically synthesized
tgcccagaggatagaaactt

SEQ ID NO: 242238 - DNA, 20 bp, Artificial Sequence
  chemically synthesized
cccagaggatagaaacttaa

SEQ ID NO: 242239 - DNA, 20 bp, Artificial Sequence
  chemically synthesized
aggatagaaacttaagagcc

SEQ ID NO: 242240 - DNA, 20 bp, Artificial Sequence
  chemically synthesized
tcttcaccttcttggctctt

SEQ ID NO: 242241 - DNA, 20 bp, Artificial Sequence
  chemically synthesized
atagaaacttaagagccaag

SEQ ID NO: 242242 - DNA, 20 bp, Artificial Sequence
  chemically synthesized
tagaaacttaagagccaaga

SEQ ID NO: 242243 - DNA, 20 bp, Artificial Sequence
  chemically synthesized
gcagtccctcttcaccttct

SEQ ID NO: 242244 - DNA, 20 bp, Artificial Sequence
  chemically synthesized
acttaagagccaagaaggtg

SEQ ID NO: 242245 - DNA, 20 bp, Artificial Sequence
  chemically synthesized
ttaagagccaagaaggtgaa

SEQ ID NO: 242246 - DNA, 20 bp, Artificial Sequence
  chemically synthesized
taagagccaagaaggtgaag

SEQ ID NO: 242247 - DNA, 20 bp, Artificial Sequence
  chemically synthesized
aagagccaagaaggtgaaga

SEQ ID NO: 242248 - DNA, 20 bp, Artificial Sequence
  chemically synthesized
agaaggtgaagagggactgc

SEQ ID NO: 242249 - DNA, 20 bp, Artificial Sequence
  chemically synthesized
atatttaatggtgagaccag

SEQ ID NO: 242250 - DNA, 20 bp, Artificial Sequence
  chemically synthesized
aacatatttaatggtgagac

SEQ ID NO: 242251 - DNA, 20 bp, Artificial Sequence
  chemically synthesized
aagtcaacatatttaatggt

SEQ ID NO: 242252 - DNA, 20 bp, Artificial Sequence
  chemically synthesized
gttaaagtcaacatatttaa

SEQ ID NO: 242253 - DNA, 20 bp, Artificial Sequence
  chemically synthesized
gaaaatacaggattaagtta

SEQ ID NO: 242254 - DNA, 20 bp, Artificial Sequence
  chemically synthesized
catactgaaaatacaggatt

SEQ ID NO: 242255 - DNA, 20 bp, Artificial Sequence
  chemically synthesized
ttaacttaatcctgtatttt

SEQ ID NO: 242256 - DNA, 20 bp, Artificial Sequence
  chemically synthesized
agccaccatactgaaaatac

SEQ ID NO: 242257 - DNA, 20 bp, Artificial Sequence
  chemically synthesized
gagccaccatactgaaaata

SEQ ID NO: 242258 - DNA, 20 bp, Artificial Sequence
  chemically synthesized
ttaatcctgtattttcagta

SEQ ID NO: 242259 - DNA, 20 bp, Artificial Sequence
  chemically synthesized
atcctgtattttcagtatgg

SEQ ID NO: 242260 - DNA, 20 bp, Artificial Sequence
  chemically synthesized
ggattagttgatggaagaga

SEQ ID NO: 242261 - DNA, 20 bp, Artificial Sequence
  chemically synthesized
caggattagttgatggaaga

SEQ ID NO: 242262 - DNA, 20 bp, Artificial Sequence
  chemically synthesized
aacaggattagttgatggaa

SEQ ID NO: 242263 - DNA, 20 bp, Artificial Sequence
  chemically synthesized
acaacaggattagttgatgg

SEQ ID NO: 242264 - DNA, 20 bp, Artificial Sequence
  chemically synthesized
tggacaacaggattagttga

SEQ ID NO: 242265 - DNA, 20 bp, Artificial Sequence
  chemically synthesized
tggcatttggacaacaggat

SEQ ID NO: 242266 - DNA, 20 bp, Artificial Sequence
  chemically synthesized
acttttggcatttggacaac

SEQ ID NO: 242267 - DNA, 20 bp, Artificial Sequence
  chemically synthesized
aacttttggcatttggacaa

SEQ ID NO: 242268 - DNA, 20 bp, Artificial Sequence
  chemically synthesized
ctgaaacaacttttggcatt

SEQ ID NO: 242269 - DNA, 20 bp, Artificial Sequence
  chemically synthesized
tcctgttgtccaaatgccaa

SEQ ID NO: 242270 - DNA, 20 bp, Artificial Sequence
  chemically synthesized
ggtgaggctgaaacaacttt

SEQ ID NO: 242271 - DNA, 20 bp, Artificial Sequence
  chemically synthesized
ccaaatgccaaaagttgttt

SEQ ID NO: 242272 - DNA, 20 bp, Artificial Sequence
  chemically synthesized
aaaagttgtttcagcctcac

SEQ ID NO: 242273 - DNA, 20 bp, Artificial Sequence
  chemically synthesized
gttgtttcagcctcaccaga

SEQ ID NO: 242274 - DNA, 20 bp, Artificial Sequence
  chemically synthesized
gagtggtttgctttctggtg

SEQ ID NO: 242275 - DNA, 20 bp, Artificial Sequence
  chemically synthesized
tgagtggtttgctttctggt

SEQ ID NO: 242276 - DNA, 20 bp, Artificial Sequence
  chemically synthesized
tgagtgagtggtttgctttc

SEQ ID NO: 242277 - DNA, 20 bp, Artificial Sequence
  chemically synthesized
tcccagcagacgtgagtgag

SEQ ID NO: 242278 - DNA, 20 bp, Artificial Sequence
  chemically synthesized
tcatcccagcagacgtgagt

SEQ ID NO: 242279 - DNA, 20 bp, Artificial Sequence
  chemically synthesized
tctctcatcccagcagacgt

SEQ ID NO: 242280 - DNA, 20 bp, Artificial Sequence
  chemically synthesized
aaccactcactcacgtctgc

SEQ ID NO: 242281 - DNA, 20 bp, Artificial Sequence
  chemically synthesized
accactcactcacgtctgct

SEQ ID NO: 242282 - DNA, 20 bp, Artificial Sequence
  chemically synthesized
tcactcacgtctgctgggat

SEQ ID NO: 242283 - DNA, 20 bp, Artificial Sequence
  chemically synthesized
ctactcctctctcatcccag

SEQ ID NO: 242284 - DNA, 20 bp, Artificial Sequence
  chemically synthesized
actcacgtctgctgggatga

SEQ ID NO: 242285 - DNA, 20 bp, Artificial Sequence
  chemically synthesized
acactactcctctctcatcc

SEQ ID NO: 242286 - DNA, 20 bp, Artificial Sequence
  chemically synthesized
tcacgtctgctgggatgaga

SEQ ID NO: 242287 - DNA, 20 bp, Artificial Sequence
  chemically synthesized
cacgtctgctgggatgagag

SEQ ID NO: 242288 - DNA, 20 bp, Artificial Sequence
  chemically synthesized
cgtctgctgggatgagagag

SEQ ID NO: 242289 - DNA, 20 bp, Artificial Sequence
  chemically synthesized
ctgctgggatgagagaggag

SEQ ID NO: 242290 - DNA, 20 bp, Artificial Sequence
  chemically synthesized
cccagctcagggtagttaat

SEQ ID NO: 242291 - DNA, 20 bp, Artificial Sequence
  chemically synthesized
agtgtctaattaactaccct

SEQ ID NO: 242292 - DNA, 20 bp, Artificial Sequence
  chemically synthesized
ttcatgtccccagctcaggg

SEQ ID NO: 242293 - DNA, 20 bp, Artificial Sequence
  chemically synthesized
tctaattaactaccctgagc

SEQ ID NO: 242294 - DNA, 20 bp, Artificial Sequence
  chemically synthesized
ctaattaactaccctgagct

SEQ ID NO: 242295 - DNA, 20 bp, Artificial Sequence
  chemically synthesized
taattaactaccctgagctg

SEQ ID NO: 242296 - DNA, 20 bp, Artificial Sequence
  chemically synthesized
catttcatgtccccagctca

SEQ ID NO: 242297 - DNA, 20 bp, Artificial Sequence
  chemically synthesized
acatttcatgtccccagctc

SEQ ID NO: 242298 - DNA, 20 bp, Artificial Sequence
  chemically synthesized
tacatttcatgtccccagct

SEQ ID NO: 242299 - DNA, 20 bp, Artificial Sequence
  chemically synthesized
gcaattacatttcatgtccc

SEQ ID NO: 242300 - DNA, 20 bp, Artificial Sequence
  chemically synthesized
gaaatgtaattgcccctttt

SEQ ID NO: 242301 - DNA, 20 bp, Artificial Sequence
  chemically synthesized
aaatgtaattgcccctttta

SEQ ID NO: 242302 - DNA, 20 bp, Artificial Sequence
  chemically synthesized
aatgtaattgccccttttaa

SEQ ID NO: 242303 - DNA, 20 bp, Artificial Sequence
  chemically synthesized
tgttttgaatcccttaaaag

SEQ ID NO: 242304 - DNA, 20 bp, Artificial Sequence
  chemically synthesized
ttgttttgaatcccttaaaa

SEQ ID NO: 242305 - DNA, 20 bp, Artificial Sequence
  chemically synthesized
gttgttttgaatcccttaaa

SEQ ID NO: 242306 - DNA, 20 bp, Artificial Sequence
  chemically synthesized
ggttgttttgaatcccttaa

SEQ ID NO: 242307 - DNA, 20 bp, Artificial Sequence
  chemically synthesized
gagaggggctggaaataaag

SEQ ID NO: 242308 - DNA, 20 bp, Artificial Sequence
  chemically synthesized
cgagaggggctggaaataaa

SEQ ID NO: 242309 - DNA, 20 bp, Artificial Sequence
  chemically synthesized
caaaacaacccctttatttc

SEQ ID NO: 242310 - DNA, 20 bp, Artificial Sequence
  chemically synthesized
ccgagaggggctggaaataa

SEQ ID NO: 242311 - DNA, 20 bp, Artificial Sequence
  chemically synthesized
cccgagaggggctggaaata

SEQ ID NO: 242312 - DNA, 20 bp, Artificial Sequence
  chemically synthesized
catatattcccgagaggggc

SEQ ID NO: 242313 - DNA, 20 bp, Artificial Sequence
  chemically synthesized
cctttatttccagcccctct

SEQ ID NO: 242314 - DNA, 20 bp, Artificial Sequence
  chemically synthesized
ctttatttccagcccctctc

SEQ ID NO: 242315 - DNA, 20 bp, Artificial Sequence
  chemically synthesized
aggccatatattcccgagag

SEQ ID NO: 242316 - DNA, 20 bp, Artificial Sequence
  chemically synthesized
aaggccatatattcccgaga

SEQ ID NO: 242317 - DNA, 20 bp, Artificial Sequence
  chemically synthesized
gaaggccatatattcccgag

SEQ ID NO: 242318 - DNA, 20 bp, Artificial Sequence
  chemically synthesized
agaaggccatatattcccga

SEQ ID NO: 242319 - DNA, 20 bp, Artificial Sequence
  chemically synthesized
ttagaaggccatatattccc

SEQ ID NO: 242320 - DNA, 20 bp, Artificial Sequence
  chemically synthesized
cagcccctctcgggaatata

SEQ ID NO: 242321 - DNA, 20 bp, Artificial Sequence
  chemically synthesized
aagacgctaggtgttttaga

SEQ ID NO: 242322 - DNA, 20 bp, Artificial Sequence
  chemically synthesized
gaagacgctaggtgttttag

SEQ ID NO: 242323 - DNA, 20 bp, Artificial Sequence
  chemically synthesized
atatggccttctaaaacacc

SEQ ID NO: 242324 - DNA, 20 bp, Artificial Sequence
  chemically synthesized
attgaagacgctaggtgttt

SEQ ID NO: 242325 - DNA, 20 bp, Artificial Sequence
  chemically synthesized
acttgtggattgaagacgct

SEQ ID NO: 242326 - DNA, 20 bp, Artificial Sequence
  chemically synthesized
aacttgtggattgaagacgc

SEQ ID NO: 242327 - DNA, 20 bp, Artificial Sequence
  chemically synthesized
ccagaaaaacttgtggattg

SEQ ID NO: 242328 - DNA, 20 bp, Artificial Sequence
  chemically synthesized
acctagcgtcttcaatccac

SEQ ID NO: 242329 - DNA, 20 bp, Artificial Sequence
  chemically synthesized
caggatcccagaaaaacttg

SEQ ID NO: 242330 - DNA, 20 bp, Artificial Sequence
  chemically synthesized
cttcaatccacaagtttttc

SEQ ID NO: 242331 - DNA, 20 bp, Artificial Sequence
  chemically synthesized
ttcaatccacaagtttttct

SEQ ID NO: 242332 - DNA, 20 bp, Artificial Sequence
  chemically synthesized
caatttgtttttcaggatcc

SEQ ID NO: 242333 - DNA, 20 bp, Artificial Sequence
  chemically synthesized
agtaagccaatttgtttttc

SEQ ID NO: 242334 - DNA, 20 bp, Artificial Sequence
  chemically synthesized
aagtaagccaatttgttttt

SEQ ID NO: 242335 - DNA, 20 bp, Artificial Sequence
  chemically synthesized
tgggatcctgaaaaacaaat

SEQ ID NO: 242336 - DNA, 20 bp, Artificial Sequence
  chemically synthesized
agatgaaaattaggacaagt

SEQ ID NO: 242337 - DNA, 20 bp, Artificial Sequence
  chemically synthesized
aatgagatgaaaattaggac

SEQ ID NO: 242338 - DNA, 20 bp, Artificial Sequence
  chemically synthesized
aagtcaatgagatgaaaatt

SEQ ID NO: 242339 - DNA, 20 bp, Artificial Sequence
  chemically synthesized
caagtcaatgagatgaaaat

SEQ ID NO: 242340 - DNA, 20 bp, Artificial Sequence
  chemically synthesized
cacagacatatcaagtcaat

SEQ ID NO: 242341 - DNA, 20 bp, Artificial Sequence
  chemically synthesized
gacatctgcacagacatatc

SEQ ID NO: 242342 - DNA, 20 bp, Artificial Sequence
  chemically synthesized
attgacttgatatgtctgtg

SEQ ID NO: 242343 - DNA, 20 bp, Artificial Sequence
  chemically synthesized
tggaagaagagacatctgca

SEQ ID NO: 242344 - DNA, 20 bp, Artificial Sequence
  chemically synthesized
tgacaaataaaatggaagaa

SEQ ID NO: 242345 - DNA, 20 bp, Artificial Sequence
  chemically synthesized
aatgacaaataaaatggaag

SEQ ID NO: 242346 - DNA, 20 bp, Artificial Sequence
  chemically synthesized
taaaatgacaaataaaatgg

SEQ ID NO: 242347 - DNA, 20 bp, Artificial Sequence
  chemically synthesized
tcataaaatgacaaataaaa

SEQ ID NO: 242348 - DNA, 20 bp, Artificial Sequence
  chemically synthesized
ctaagggaataaaaacaata

SEQ ID NO: 242349 - DNA, 20 bp, Artificial Sequence
  chemically synthesized
ctgtattgtttttattccct

SEQ ID NO: 242350 - DNA, 20 bp, Artificial Sequence
  chemically synthesized
ttgttcaaagattacgctaa

SEQ ID NO: 242351 - DNA, 20 bp, Artificial Sequence
  chemically synthesized
attgttcaaagattacgcta

SEQ ID NO: 242352 - DNA, 20 bp, Artificial Sequence
  chemically synthesized
aattgttcaaagattacgct

SEQ ID NO: 242353 - DNA, 20 bp, Artificial Sequence
  chemically synthesized
tctctctcccaaattgttca

SEQ ID NO: 242354 - DNA, 20 bp, Artificial Sequence
  chemically synthesized
agcgtaatctttgaacaatt

SEQ ID NO: 242355 - DNA, 20 bp, Artificial Sequence
  chemically synthesized
gcgtaatctttgaacaattt

SEQ ID NO: 242356 - DNA, 20 bp, Artificial Sequence
  chemically synthesized
gtaatctttgaacaatttgg

SEQ ID NO: 242357 - DNA, 20 bp, Artificial Sequence
  chemically synthesized
aatctttgaacaatttggga

SEQ ID NO: 242358 - DNA, 20 bp, Artificial Sequence
  chemically synthesized
tctttgaacaatttgggaga

SEQ ID NO: 242359 - DNA, 20 bp, Artificial Sequence
  chemically synthesized
tttgaacaatttgggagaga

SEQ ID NO: 242360 - DNA, 20 bp, Artificial Sequence
  chemically synthesized
gaacaatttgggagagagag

SEQ ID NO: 242361 - DNA, 20 bp, Artificial Sequence
  chemically synthesized
ttttcgattgtcatttctat

SEQ ID NO: 242362 - DNA, 20 bp, Artificial Sequence
  chemically synthesized
ttcgattgtcatttctattg

SEQ ID NO: 242363 - DNA, 20 bp, Artificial Sequence
  chemically synthesized
tcgattgtcatttctattgg

SEQ ID NO: 242364 - DNA, 20 bp, Artificial Sequence
  chemically synthesized
acgtgaacatggacctccaa

SEQ ID NO: 242365 - DNA, 20 bp, Artificial Sequence
  chemically synthesized
acaagacacaaacgtgaaca

SEQ ID NO: 242366 - DNA, 20 bp, Artificial Sequence
  chemically synthesized
gatacctgaggagagagaac

SEQ ID NO: 242367 - DNA, 20 bp, Artificial Sequence
  chemically synthesized
tgtgtcttgttctctctcct

SEQ ID NO: 242368 - DNA, 20 bp, Artificial Sequence
  chemically synthesized
gtgtcttgttctctctcctc

SEQ ID NO: 242369 - DNA, 20 bp, Artificial Sequence
  chemically synthesized
gatgaggatacctgaggaga

SEQ ID NO: 242370 - DNA, 20 bp, Artificial Sequence
  chemically synthesized
tagatgaggatacctgagga

SEQ ID NO: 242371 - DNA, 20 bp, Artificial Sequence
  chemically synthesized
gctagatgaggatacctgag

SEQ ID NO: 242372 - DNA, 20 bp, Artificial Sequence
  chemically synthesized
atgctagatgaggatacctg

SEQ ID NO: 242373 - DNA, 20 bp, Artificial Sequence
  chemically synthesized
aatgctagatgaggatacct

SEQ ID NO: 242374 - DNA, 20 bp, Artificial Sequence
  chemically synthesized
tctcctcaggtatcctcatc

SEQ ID NO: 242375 - DNA, 20 bp, Artificial Sequence
  chemically synthesized
caactactaaatgctagatg

SEQ ID NO: 242376 - DNA, 20 bp, Artificial Sequence
  chemically synthesized
gcaactactaaatgctagat

SEQ ID NO: 242377 - DNA, 20 bp, Artificial Sequence
  chemically synthesized
aggtatcctcatctagcatt

SEQ ID NO: 242378 - DNA, 20 bp, Artificial Sequence
  chemically synthesized
cacatgcaactactaaatgc

SEQ ID NO: 242379 - DNA, 20 bp, Artificial Sequence
  chemically synthesized
tatcctcatctagcatttag

SEQ ID NO: 242380 - DNA, 20 bp, Artificial Sequence
  chemically synthesized
tgcatgtgcatcgcgtcccg

SEQ ID NO: 242381 - DNA, 20 bp, Artificial Sequence
  chemically synthesized
aaggggtggctggagaccac

SEQ ID NO: 242382 - DNA, 20 bp, Artificial Sequence
  chemically synthesized
gcatcgcgtcccgtggtctc

SEQ ID NO: 242383 - DNA, 20 bp, Artificial Sequence
  chemically synthesized
aaaggggtggctggagacca

SEQ ID NO: 242384 - DNA, 20 bp, Artificial Sequence
  chemically synthesized
aaaccttaaaggggtggctg

SEQ ID NO: 242385 - DNA, 20 bp, Artificial Sequence
  chemically synthesized
ttaaaccttaaaggggtggc

SEQ ID NO: 242386 - DNA, 20 bp, Artificial Sequence
  chemically synthesized
tggtctccagccaccccttt

SEQ ID NO: 242387 - DNA, 20 bp, Artificial Sequence
  chemically synthesized
aactttaaaccttaaagggg

SEQ ID NO: 242388 - DNA, 20 bp, Artificial Sequence
  chemically synthesized
ggtctccagccaccccttta

SEQ ID NO: 242389 - DNA, 20 bp, Artificial Sequence
  chemically synthesized
aagaactttaaaccttaaag

SEQ ID NO: 242390 - DNA, 20 bp, Artificial Sequence
  chemically synthesized
caagaactttaaaccttaaa

SEQ ID NO: 242391 - DNA, 20 bp, Artificial Sequence
  chemically synthesized
gcaagaactttaaaccttaa

SEQ ID NO: 242392 - DNA, 20 bp, Artificial Sequence
  chemically synthesized
tgcaagaactttaaacctta

SEQ ID NO: 242393 - DNA, 20 bp, Artificial Sequence
  chemically synthesized
agccacccctttaaggttta

SEQ ID NO: 242394 - DNA, 20 bp, Artificial Sequence
  chemically synthesized
ccccagtaacattgcagtgc

SEQ ID NO: 242395 - DNA, 20 bp, Artificial Sequence
  chemically synthesized
aattatccccagtaacattg

SEQ ID NO: 242396 - DNA, 20 bp, Artificial Sequence
  chemically synthesized
ttcttgcactgcaatgttac

SEQ ID NO: 242397 - DNA, 20 bp, Artificial Sequence
  chemically synthesized
tcttgcactgcaatgttact

SEQ ID NO: 242398 - DNA, 20 bp, Artificial Sequence
  chemically synthesized
cttgcactgcaatgttactg

SEQ ID NO: 242399 - DNA, 20 bp, Artificial Sequence
  chemically synthesized
gaatggattgaaattatccc

SEQ ID NO: 242400 - DNA, 20 bp, Artificial Sequence
  chemically synthesized
ataatttcaatccattcatc

SEQ ID NO: 242401 - DNA, 20 bp, Artificial Sequence
  chemically synthesized
ctgttctcttgcttgatgaa

SEQ ID NO: 242402 - DNA, 20 bp, Artificial Sequence
  chemically synthesized
tttcaatccattcatcaagc

SEQ ID NO: 242403 - DNA, 20 bp, Artificial Sequence
  chemically synthesized
tcaatccattcatcaagcaa

SEQ ID NO: 242404 - DNA, 20 bp, Artificial Sequence
  chemically synthesized
ccattcatcaagcaagagaa

SEQ ID NO: 242405 - DNA, 20 bp, Artificial Sequence
  chemically synthesized
gcaagagaacagatgcaaca

SEQ ID NO: 242406 - DNA, 20 bp, Artificial Sequence
  chemically synthesized
aacagatgcaacacagttcc

SEQ ID NO: 242407 - DNA, 20 bp, Artificial Sequence
  chemically synthesized
agatgcaacacagttcccag

SEQ ID NO: 242408 - DNA, 20 bp, Artificial Sequence
  chemically synthesized
gcaacacagttcccagcagc

SEQ ID NO: 242409 - DNA, 20 bp, Artificial Sequence
  chemically synthesized
caacacagttcccagcagca

SEQ ID NO: 242410 - DNA, 20 bp, Artificial Sequence
  chemically synthesized
aaagacatagccttgctgct

SEQ ID NO: 242411 - DNA, 20 bp, Artificial Sequence
  chemically synthesized
taaagacatagccttgctgc

SEQ ID NO: 242412 - DNA, 20 bp, Artificial Sequence
  chemically synthesized
taggtgtaagaataaagaca

SEQ ID NO: 242413 - DNA, 20 bp, Artificial Sequence
  chemically synthesized
cctatgtaggtgtaagaata

SEQ ID NO: 242414 - DNA, 20 bp, Artificial Sequence
  chemically synthesized
ttatgggcctatgtaggtgt

SEQ ID NO: 242415 - DNA, 20 bp, Artificial Sequence
  chemically synthesized
tctttattcttacacctaca

SEQ ID NO: 242416 - DNA, 20 bp, Artificial Sequence
  chemically synthesized
ctttattcttacacctacat

SEQ ID NO: 242417 - DNA, 20 bp, Artificial Sequence
  chemically synthesized
ctaaacttatgggcctatgt

SEQ ID NO: 242418 - DNA, 20 bp, Artificial Sequence
  chemically synthesized
cctaaacttatgggcctatg

SEQ ID NO: 242419 - DNA, 20 bp, Artificial Sequence
  chemically synthesized
ttacacctacataggcccat

SEQ ID NO: 242420 - DNA, 20 bp, Artificial Sequence
  chemically synthesized
cctacataggcccataagtt

SEQ ID NO: 242421 - DNA, 20 bp, Artificial Sequence
  chemically synthesized
tatggcttgcctaaacttat

SEQ ID NO: 242422 - DNA, 20 bp, Artificial Sequence
  chemically synthesized
ctacataggcccataagttt

SEQ ID NO: 242423 - DNA, 20 bp, Artificial Sequence
  chemically synthesized
ctatggcttgcctaaactta

SEQ ID NO: 242424 - DNA, 20 bp, Artificial Sequence
  chemically synthesized
ataggcccataagtttaggc

SEQ ID NO: 242425 - DNA, 20 bp, Artificial Sequence
  chemically synthesized
ccataagtttaggcaagcca

SEQ ID NO: 242426 - DNA, 20 bp, Artificial Sequence
  chemically synthesized
gtttaggcaagccatagcgt

SEQ ID NO: 242427 - DNA, 20 bp, Artificial Sequence
  chemically synthesized
tttaggcaagccatagcgtc

SEQ ID NO: 242428 - DNA, 20 bp, Artificial Sequence
  chemically synthesized
caggctgtagcctgacgcta

SEQ ID NO: 242429 - DNA, 20 bp, Artificial Sequence
  chemically synthesized
caagccatagcgtcaggcta

SEQ ID NO: 242430 - DNA, 20 bp, Artificial Sequence
  chemically synthesized
tagcgtcaggctacagcctg

SEQ ID NO: 242431 - DNA, 20 bp, Artificial Sequence
  chemically synthesized
aaaagtgcttcttcaggctg

SEQ ID NO: 242432 - DNA, 20 bp, Artificial Sequence
  chemically synthesized
cgtcaggctacagcctgaag

SEQ ID NO: 242433 - DNA, 20 bp, Artificial Sequence
  chemically synthesized
tggggaaaaagtgcttcttc

SEQ ID NO: 242434 - DNA, 20 bp, Artificial Sequence
  chemically synthesized
ctggggaaaaagtgcttctt

SEQ ID NO: 242435 - DNA, 20 bp, Artificial Sequence
  chemically synthesized
ctgaagaagcactttttccc

SEQ ID NO: 242436 - DNA, 20 bp, Artificial Sequence
  chemically synthesized
tgaagaagcactttttcccc

SEQ ID NO: 242437 - DNA, 20 bp, Artificial Sequence
  chemically synthesized
tgaaagaaaacctggggaaa

SEQ ID NO: 242438 - DNA, 20 bp, Artificial Sequence
  chemically synthesized
cattcgtgaaagaaaacctg

SEQ ID NO: 242439 - DNA, 20 bp, Artificial Sequence
  chemically synthesized
gcattcgtgaaagaaaacct

SEQ ID NO: 242440 - DNA, 20 bp, Artificial Sequence
  chemically synthesized
tgcattcgtgaaagaaaacc

SEQ ID NO: 242441 - DNA, 20 bp, Artificial Sequence
  chemically synthesized
tgtggtgcttgcattcgtga

SEQ ID NO: 242442 - DNA, 20 bp, Artificial Sequence
  chemically synthesized
aggttttctttcacgaatgc

SEQ ID NO: 242443 - DNA, 20 bp, Artificial Sequence
  chemically synthesized
tttcacgaatgcaagcacca

SEQ ID NO: 242444 - DNA, 20 bp, Artificial Sequence
  chemically synthesized
cgaatgcaagcaccacagcc

SEQ ID NO: 242445 - DNA, 20 bp, Artificial Sequence
  chemically synthesized
caaaaccagaggctgggctg

SEQ ID NO: 242446 - DNA, 20 bp, Artificial Sequence
  chemically synthesized
aagcaccacagcccagcctc

SEQ ID NO: 242447 - DNA, 20 bp, Artificial Sequence
  chemically synthesized
agtattcaaaaccagaggct

SEQ ID NO: 242448 - DNA, 20 bp, Artificial Sequence
  chemically synthesized
cagtattcaaaaccagaggc

SEQ ID NO: 242449 - DNA, 20 bp, Artificial Sequence
  chemically synthesized
aactcagtattcaaaaccag

SEQ ID NO: 242450 - DNA, 20 bp, Artificial Sequence
  chemically synthesized
aaactcagtattcaaaacca

SEQ ID NO: 242451 - DNA, 20 bp, Artificial Sequence
  chemically synthesized
acaaactcagtattcaaaac

SEQ ID NO: 242452 - DNA, 20 bp, Artificial Sequence
  chemically synthesized
agcctctggttttgaatact

SEQ ID NO: 242453 - DNA, 20 bp, Artificial Sequence
  chemically synthesized
tgtggaactggagacaaact

SEQ ID NO: 242454 - DNA, 20 bp, Artificial Sequence
  chemically synthesized
ttgaatactgagtttgtctc

SEQ ID NO: 242455 - DNA, 20 bp, Artificial Sequence
  chemically synthesized
tcaagcaaggtgtggaactg

SEQ ID NO: 242456 - DNA, 20 bp, Artificial Sequence
  chemically synthesized
cttcaagcaaggtgtggaac

SEQ ID NO: 242457 - DNA, 20 bp, Artificial Sequence
  chemically synthesized
aaattgcttcaagcaaggtg

SEQ ID NO: 242458 - DNA, 20 bp, Artificial Sequence
  chemically synthesized
ccagttccacaccttgcttg

SEQ ID NO: 242459 - DNA, 20 bp, Artificial Sequence
  chemically synthesized
gattaaaattgcttcaagca

SEQ ID NO: 242460 - DNA, 20 bp, Artificial Sequence
  chemically synthesized
ggattaaaattgcttcaagc

SEQ ID NO: 242461 - DNA, 20 bp, Artificial Sequence
  chemically synthesized
gttgggattaaaattgcttc

SEQ ID NO: 242462 - DNA, 20 bp, Artificial Sequence
  chemically synthesized
ttggatgctgcgggatagtt

SEQ ID NO: 242463 - DNA, 20 bp, Artificial Sequence
  chemically synthesized
tttggatgctgcgggatagt

SEQ ID NO: 242464 - DNA, 20 bp, Artificial Sequence
  chemically synthesized
ttttaatcccaactatcccg

SEQ ID NO: 242465 - DNA, 20 bp, Artificial Sequence
  chemically synthesized
ggaatttggatgctgcggga

SEQ ID NO: 242466 - DNA, 20 bp, Artificial Sequence
  chemically synthesized
gccaggaatttggatgctgc

SEQ ID NO: 242467 - DNA, 20 bp, Artificial Sequence
  chemically synthesized
agccaggaatttggatgctg

SEQ ID NO: 242468 - DNA, 20 bp, Artificial Sequence
  chemically synthesized
tcccgcagcatccaaattcc

SEQ ID NO: 242469 - DNA, 20 bp, Artificial Sequence
  chemically synthesized
aacagtggaagccaggaatt

SEQ ID NO: 242470 - DNA, 20 bp, Artificial Sequence
  chemically synthesized
acaaaacaacagtggaagcc

SEQ ID NO: 242471 - DNA, 20 bp, Artificial Sequence
  chemically synthesized
cacaaaacaacagtggaagc

SEQ ID NO: 242472 - DNA, 20 bp, Artificial Sequence
  chemically synthesized
gaaccacaaaacaacagtgg

SEQ ID NO: 242473 - DNA, 20 bp, Artificial Sequence
  chemically synthesized
actgaaccacaaaacaacag

SEQ ID NO: 242474 - DNA, 20 bp, Artificial Sequence
  chemically synthesized
gacactgaaccacaaaacaa

SEQ ID NO: 242475 - DNA, 20 bp, Artificial Sequence
  chemically synthesized
tggcttccactgttgttttg

SEQ ID NO: 242476 - DNA, 20 bp, Artificial Sequence
  chemically synthesized
tccactgttgttttgtggtt

SEQ ID NO: 242477 - DNA, 20 bp, Artificial Sequence
  chemically synthesized
ttgttttgtggttcagtgtc

SEQ ID NO: 242478 - DNA, 20 bp, Artificial Sequence
  chemically synthesized
tggttcagtgtcaagtctgt

SEQ ID NO: 242479 - DNA, 20 bp, Artificial Sequence
  chemically synthesized
ggttcagtgtcaagtctgtc

SEQ ID NO: 242480 - DNA, 20 bp, Artificial Sequence
  chemically synthesized
gttcagtgtcaagtctgtca

SEQ ID NO: 242481 - DNA, 20 bp, Artificial Sequence
  chemically synthesized
aatggggcggaagtccctga

SEQ ID NO: 242482 - DNA, 20 bp, Artificial Sequence
  chemically synthesized
taaagcagagaatggggcgg

SEQ ID NO: 242483 - DNA, 20 bp, Artificial Sequence
  chemically synthesized
atgtaaagcagagaatgggg

SEQ ID NO: 242484 - DNA, 20 bp, Artificial Sequence
  chemically synthesized
gaaatgtaaagcagagaatg

SEQ ID NO: 242485 - DNA, 20 bp, Artificial Sequence
  chemically synthesized
agaaatgtaaagcagagaat

SEQ ID NO: 242486 - DNA, 20 bp, Artificial Sequence
  chemically synthesized
cagaaatgtaaagcagagaa

SEQ ID NO: 242487 - DNA, 20 bp, Artificial Sequence
  chemically synthesized
atttacagaaatgtaaagca

SEQ ID NO: 242488 - DNA, 20 bp, Artificial Sequence
  chemically synthesized
atatttacagaaatgtaaag

SEQ ID NO: 242489 - DNA, 20 bp, Artificial Sequence
  chemically synthesized
aatatatttacagaaatgta

SEQ ID NO: 242490 - DNA, 20 bp, Artificial Sequence
  chemically synthesized
tatttacagaaatatattta

SEQ ID NO: 242491 - DNA, 20 bp, Artificial Sequence
  chemically synthesized
caaatcatgatgtgtattta

SEQ ID NO: 242492 - DNA, 20 bp, Artificial Sequence
  chemically synthesized
cagaaatatatgttgatgac

SEQ ID NO: 242493 - DNA, 20 bp, Artificial Sequence
  chemically synthesized
aacatatatttctgtaaata

SEQ ID NO: 242494 - DNA, 20 bp, Artificial Sequence
  chemically synthesized
tatttacagaactgtattta

SEQ ID NO: 242495 - DNA, 20 bp, Artificial Sequence
  chemically synthesized
aataaaaaaggatatattta

SEQ ID NO: 242496 - DNA, 20 bp, Artificial Sequence
  chemically synthesized
gaaaaaatagaaaataaaaa

SEQ ID NO: 242497 - DNA, 20 bp, Artificial Sequence
  chemically synthesized
tgaaaaaatagaaaataaaa

SEQ ID NO: 242498 - DNA, 20 bp, Artificial Sequence
  chemically synthesized
aaaatacagcaatgaaaaaa

SEQ ID NO: 242499 - DNA, 20 bp, Artificial Sequence
  chemically synthesized
attttttcattgctgtattt

SEQ ID NO: 242500 - DNA, 20 bp, Artificial Sequence
  chemically synthesized
ttttttcattgctgtatttt

SEQ ID NO: 242501 - DNA, 20 bp, Artificial Sequence
  chemically synthesized
cctcatctgctcccaaaata

SEQ ID NO: 242502 - DNA, 20 bp, Artificial Sequence
  chemically synthesized
ttttcattgctgtattttgg

SEQ ID NO: 242503 - DNA, 20 bp, Artificial Sequence
  chemically synthesized
tcattgctgtattttgggag

SEQ ID NO: 242504 - DNA, 20 bp, Artificial Sequence
  chemically synthesized
gctgtattttgggagcagat

SEQ ID NO: 242505 - DNA, 20 bp, Artificial Sequence
  chemically synthesized
ctgtattttgggagcagatg

SEQ ID NO: 242506 - DNA, 20 bp, Artificial Sequence
  chemically synthesized
gagcagatgaggataacact

SEQ ID NO: 242507 - DNA, 20 bp, Artificial Sequence
  chemically synthesized
gatgaggataacacttggat

SEQ ID NO: 242508 - DNA, 20 bp, Artificial Sequence
  chemically synthesized
tgattagagatttctaatcc

SEQ ID NO: 242509 - DNA, 20 bp, Artificial Sequence
  chemically synthesized
aaaccaatgcaaaatgatta

SEQ ID NO: 242510 - DNA, 20 bp, Artificial Sequence
  chemically synthesized
aaaaaccaatgcaaaatgat

SEQ ID NO: 242511 - DNA, 20 bp, Artificial Sequence
  chemically synthesized
aatctctaatcattttgcat

SEQ ID NO: 242512 - DNA, 20 bp, Artificial Sequence
  chemically synthesized
ttttgcattggtttttataa

SEQ ID NO: 242513 - DNA, 20 bp, Artificial Sequence
  chemically synthesized
tttgcattggtttttataat

SEQ ID NO: 242514 - DNA, 20 bp, Artificial Sequence
  chemically synthesized
ttggtttttataataggtac

SEQ ID NO: 242515 - DNA, 20 bp, Artificial Sequence
  chemically synthesized
tggaaaaatatacgttatgc

SEQ ID NO: 242516 - DNA, 20 bp, Artificial Sequence
  chemically synthesized
cataacgtatatttttccat

SEQ ID NO: 242517 - DNA, 20 bp, Artificial Sequence
  chemically synthesized
ataacgtatatttttccata

SEQ ID NO: 242518 - DNA, 20 bp, Artificial Sequence
  chemically synthesized
tctattgggtatatgcctta

SEQ ID NO: 242519 - DNA, 20 bp, Artificial Sequence
  chemically synthesized
tccataaggcatatacccaa

SEQ ID NO: 242520 - DNA, 20 bp, Artificial Sequence
  chemically synthesized
cataaggcatatacccaata

SEQ ID NO: 242521 - DNA, 20 bp, Artificial Sequence
  chemically synthesized
ataaggcatatacccaatag

SEQ ID NO: 242522 - DNA, 20 bp, Artificial Sequence
  chemically synthesized
taaggcatatacccaataga

SEQ ID NO: 242523 - DNA, 20 bp, Artificial Sequence
  chemically synthesized
aaaatagtggtccctctatt

SEQ ID NO: 242524 - DNA, 20 bp, Artificial Sequence
  chemically synthesized
taaaatagtggtccctctat

SEQ ID NO: 242525 - DNA, 20 bp, Artificial Sequence
  chemically synthesized
cacttaaggctataaaatag

SEQ ID NO: 242526 - DNA, 20 bp, Artificial Sequence
  chemically synthesized
atagagggaccactatttta

SEQ ID NO: 242527 - DNA, 20 bp, Artificial Sequence
  chemically synthesized
ttccacttaaggctataaaa

SEQ ID NO: 242528 - DNA, 20 bp, Artificial Sequence
  chemically synthesized
gaccactattttatagcctt

SEQ ID NO: 242529 - DNA, 20 bp, Artificial Sequence
  chemically synthesized
cactattttatagccttaag

SEQ ID NO: 242530 - DNA, 20 bp, Artificial Sequence
  chemically synthesized
tattttatagccttaagtgg

SEQ ID NO: 242531 - DNA, 20 bp, Artificial Sequence
  chemically synthesized
cataacagagcttccactta

SEQ ID NO: 242532 - DNA, 20 bp, Artificial Sequence
  chemically synthesized
tcataacagagcttccactt

SEQ ID NO: 242533 - DNA, 20 bp, Artificial Sequence
  chemically synthesized
ttaagtggaagctctgttat

SEQ ID NO: 242534 - DNA, 20 bp, Artificial Sequence
  chemically synthesized
gacacatatgtctcataaca

SEQ ID NO: 242535 - DNA, 20 bp, Artificial Sequence
  chemically synthesized
gagacacatatgtctcataa

SEQ ID NO: 242536 - DNA, 20 bp, Artificial Sequence
  chemically synthesized
gagacatatgtgtctcaacc

SEQ ID NO: 242537 - DNA, 20 bp, Artificial Sequence
  chemically synthesized
tgtatagaaccggctgggtt

SEQ ID NO: 242538 - DNA, 20 bp, Artificial Sequence
  chemically synthesized
catatgtgtctcaacccagc

SEQ ID NO: 242539 - DNA, 20 bp, Artificial Sequence
  chemically synthesized
taaactgtatagaaccggct

SEQ ID NO: 242540 - DNA, 20 bp, Artificial Sequence
  chemically synthesized
gtaaactgtatagaaccggc

SEQ ID NO: 242541 - DNA, 20 bp, Artificial Sequence
  chemically synthesized
tcttgtaaactgtatagaac

SEQ ID NO: 242542 - DNA, 20 bp, Artificial Sequence
  chemically synthesized
tcaacccagccggttctata

SEQ ID NO: 242543 - DNA, 20 bp, Artificial Sequence
  chemically synthesized
acctggtcttgtaaactgta

SEQ ID NO: 242544 - DNA, 20 bp, Artificial Sequence
  chemically synthesized
gccggttctatacagtttac

SEQ ID NO: 242545 - DNA, 20 bp, Artificial Sequence
  chemically synthesized
ttctatacagtttacaagac

SEQ ID NO: 242546 - DNA, 20 bp, Artificial Sequence
  chemically synthesized
tctatacagtttacaagacc

SEQ ID NO: 242547 - DNA, 20 bp, Artificial Sequence
  chemically synthesized
atacagtttacaagaccagg

SEQ ID NO: 242548 - DNA, 20 bp, Artificial Sequence
  chemically synthesized
ggggagcatgatgatctacc

SEQ ID NO: 242549 - DNA, 20 bp, Artificial Sequence
  chemically synthesized
aggtagatcatcatgctccc

SEQ ID NO: 242550 - DNA, 20 bp, Artificial Sequence
  chemically synthesized
gtagatcatcatgctcccca

SEQ ID NO: 242551 - DNA, 20 bp, Artificial Sequence
  chemically synthesized
agatcatcatgctccccaga

SEQ ID NO: 242552 - DNA, 20 bp, Artificial Sequence
  chemically synthesized
ttatcttgggtctctctggg

SEQ ID NO: 242553 - DNA, 20 bp, Artificial Sequence
  chemically synthesized
tcttatcttgggtctctctg

SEQ ID NO: 242554 - DNA, 20 bp, Artificial Sequence
  chemically synthesized
atcttatcttgggtctctct

SEQ ID NO: 242555 - DNA, 20 bp, Artificial Sequence
  chemically synthesized
catcttatcttgggtctctc

SEQ ID NO: 242556 - DNA, 20 bp, Artificial Sequence
  chemically synthesized
catgctccccagagagaccc

SEQ ID NO: 242557 - DNA, 20 bp, Artificial Sequence
  chemically synthesized
tccccagagagacccaagat

SEQ ID NO: 242558 - DNA, 20 bp, Artificial Sequence
  chemically synthesized
aaccctaatcatcttatctt

SEQ ID NO: 242559 - DNA, 20 bp, Artificial Sequence
  chemically synthesized
taaccctaatcatcttatct

SEQ ID NO: 242560 - DNA, 20 bp, Artificial Sequence
  chemically synthesized
gagacccaagataagatgat

SEQ ID NO: 242561 - DNA, 20 bp, Artificial Sequence
  chemically synthesized
agacccaagataagatgatt

SEQ ID NO: 242562 - DNA, 20 bp, Artificial Sequence
  chemically synthesized
gacccaagataagatgatta

SEQ ID NO: 242563 - DNA, 20 bp, Artificial Sequence
  chemically synthesized
gatgattagggttatttttc

SEQ ID NO: 242564 - DNA, 20 bp, Artificial Sequence
  chemically synthesized
aggaagtctattttatgtgc

SEQ ID NO: 242565 - DNA, 20 bp, Artificial Sequence
  chemically synthesized
tatttttctagcacataaaa

SEQ ID NO: 242566 - DNA, 20 bp, Artificial Sequence
  chemically synthesized
ggcctccatgtcagaaaagg

SEQ ID NO: 242567 - DNA, 20 bp, Artificial Sequence
  chemically synthesized
tcaggcctccatgtcagaaa

SEQ ID NO: 242568 - DNA, 20 bp, Artificial Sequence
  chemically synthesized
ttcaggcctccatgtcagaa

SEQ ID NO: 242569 - DNA, 20 bp, Artificial Sequence
  chemically synthesized
atagacttccttttctgaca

SEQ ID NO: 242570 - DNA, 20 bp, Artificial Sequence
  chemically synthesized
agacttccttttctgacatg

SEQ ID NO: 242571 - DNA, 20 bp, Artificial Sequence
  chemically synthesized
gacttccttttctgacatgg

SEQ ID NO: 242572 - DNA, 20 bp, Artificial Sequence
  chemically synthesized
taggattcaggcctccatgt

SEQ ID NO: 242573 - DNA, 20 bp, Artificial Sequence
  chemically synthesized
aggaaatttggttaggattc

SEQ ID NO: 242574 - DNA, 20 bp, Artificial Sequence
  chemically synthesized
aaggaaatttggttaggatt

SEQ ID NO: 242575 - DNA, 20 bp, Artificial Sequence
  chemically synthesized
gttaccaaggaaatttggtt

SEQ ID NO: 242576 - DNA, 20 bp, Artificial Sequence
  chemically synthesized
agttaccaaggaaatttggt

SEQ ID NO: 242577 - DNA, 20 bp, Artificial Sequence
  chemically synthesized
ttgcagttaccaaggaaatt

SEQ ID NO: 242578 - DNA, 20 bp, Artificial Sequence
  chemically synthesized
gaatcctaaccaaatttcct

SEQ ID NO: 242579 - DNA, 20 bp, Artificial Sequence
  chemically synthesized
agttcttgttgcagttacca

SEQ ID NO: 242580 - DNA, 20 bp, Artificial Sequence
  chemically synthesized
cagttcttgttgcagttacc

SEQ ID NO: 242581 - DNA, 20 bp, Artificial Sequence
  chemically synthesized
atttccttggtaactgcaac

SEQ ID NO: 242582 - DNA, 20 bp, Artificial Sequence
  chemically synthesized
tatgtagacagttcttgttg

SEQ ID NO: 242583 - DNA, 20 bp, Artificial Sequence
  chemically synthesized
gaattggaacaatatgtaga

SEQ ID NO: 242584 - DNA, 20 bp, Artificial Sequence
  chemically synthesized
ggtggaattggaacaatatg

SEQ ID NO: 242585 - DNA, 20 bp, Artificial Sequence
  chemically synthesized
tgaaggactgaaggtggaat

SEQ ID NO: 242586 - DNA, 20 bp, Artificial Sequence
  chemically synthesized
tattgttccaattccacctt

SEQ ID NO: 242587 - DNA, 20 bp, Artificial Sequence
  chemically synthesized
gttccctgaaggactgaagg

SEQ ID NO: 242588 - DNA, 20 bp, Artificial Sequence
  chemically synthesized
actgttccctgaaggactga

SEQ ID NO: 242589 - DNA, 20 bp, Artificial Sequence
  chemically synthesized
cactgttccctgaaggactg

SEQ ID NO: 242590 - DNA, 20 bp, Artificial Sequence
  chemically synthesized
caattccaccttcagtcctt

SEQ ID NO: 242591 - DNA, 20 bp, Artificial Sequence
  chemically synthesized
aattccaccttcagtccttc

SEQ ID NO: 242592 - DNA, 20 bp, Artificial Sequence
  chemically synthesized
attccaccttcagtccttca

SEQ ID NO: 242593 - DNA, 20 bp, Artificial Sequence
  chemically synthesized
caccagacactgttccctga

SEQ ID NO: 242594 - DNA, 20 bp, Artificial Sequence
  chemically synthesized
accttcagtccttcagggaa

SEQ ID NO: 242595 - DNA, 20 bp, Artificial Sequence
  chemically synthesized
acaccagacactgttccctg

SEQ ID NO: 242596 - DNA, 20 bp, Artificial Sequence
  chemically synthesized
gtccttcagggaacagtgtc

SEQ ID NO: 242597 - DNA, 20 bp, Artificial Sequence
  chemically synthesized
agggaacagtgtctggtgtg

SEQ ID NO: 242598 - DNA, 20 bp, Artificial Sequence
  chemically synthesized
atgttacataggccacacac

SEQ ID NO: 242599 - DNA, 20 bp, Artificial Sequence
  chemically synthesized
agtgctgtgtaatgttacat

SEQ ID NO: 242600 - DNA, 20 bp, Artificial Sequence
  chemically synthesized
gagtgctgtgtaatgttaca

SEQ ID NO: 242601 - DNA, 20 bp, Artificial Sequence
  chemically synthesized
gtggcctatgtaacattaca

SEQ ID NO: 242602 - DNA, 20 bp, Artificial Sequence
  chemically synthesized
tgtaacattacacagcactc

SEQ ID NO: 242603 - DNA, 20 bp, Artificial Sequence
  chemically synthesized
taacattacacagcactctg

SEQ ID NO: 242604 - DNA, 20 bp, Artificial Sequence
  chemically synthesized
gcagatctgtggaatctcca

SEQ ID NO: 242605 - DNA, 20 bp, Artificial Sequence
  chemically synthesized
ctgcagatctgtggaatctc

SEQ ID NO: 242606 - DNA, 20 bp, Artificial Sequence
  chemically synthesized
acagcactctggagattcca

SEQ ID NO: 242607 - DNA, 20 bp, Artificial Sequence
  chemically synthesized
ttactaggcctgcagatctg

SEQ ID NO: 242608 - DNA, 20 bp, Artificial Sequence
  chemically synthesized
ctggagattccacagatctg

SEQ ID NO: 242609 - DNA, 20 bp, Artificial Sequence
  chemically synthesized
tggagattccacagatctgc

SEQ ID NO: 242610 - DNA, 20 bp, Artificial Sequence
  chemically synthesized
attccacagatctgcaggcc

SEQ ID NO: 242611 - DNA, 20 bp, Artificial Sequence
  chemically synthesized
tatttttgttactaggcctg

SEQ ID NO: 242612 - DNA, 20 bp, Artificial Sequence
  chemically synthesized
gaacttctatttttgttact

SEQ ID NO: 242613 - DNA, 20 bp, Artificial Sequence
  chemically synthesized
tgaacttctatttttgttac

SEQ ID NO: 242614 - DNA, 20 bp, Artificial Sequence
  chemically synthesized
tgcaggcctagtaacaaaaa

SEQ ID NO: 242615 - DNA, 20 bp, Artificial Sequence
  chemically synthesized
aggcctagtaacaaaaatag

SEQ ID NO: 242616 - DNA, 20 bp, Artificial Sequence
  chemically synthesized
atccttgttggttgattggt

SEQ ID NO: 242617 - DNA, 20 bp, Artificial Sequence
  chemically synthesized
agtgatccttgttggttgat

SEQ ID NO: 242618 - DNA, 20 bp, Artificial Sequence
  chemically synthesized
caactaaccaatcaaccaac

SEQ ID NO: 242619 - DNA, 20 bp, Artificial Sequence
  chemically synthesized
aactaaccaatcaaccaaca

SEQ ID NO: 242620 - DNA, 20 bp, Artificial Sequence
  chemically synthesized
tggcccagagtgatccttgt

SEQ ID NO: 242621 - DNA, 20 bp, Artificial Sequence
  chemically synthesized
tcaaccaacaaggatcactc

SEQ ID NO: 242622 - DNA, 20 bp, Artificial Sequence
  chemically synthesized
caaccaacaaggatcactct

SEQ ID NO: 242623 - DNA, 20 bp, Artificial Sequence
  chemically synthesized
aacaggacttaggtggccca

SEQ ID NO: 242624 - DNA, 20 bp, Artificial Sequence
  chemically synthesized
gtaacaggacttaggtggcc

SEQ ID NO: 242625 - DNA, 20 bp, Artificial Sequence
  chemically synthesized
aggatcactctgggccacct

SEQ ID NO: 242626 - DNA, 20 bp, Artificial Sequence
  chemically synthesized
cttctgtaacaggacttagg

SEQ ID NO: 242627 - DNA, 20 bp, Artificial Sequence
  chemically synthesized
tgtcttctgtaacaggactt

SEQ ID NO: 242628 - DNA, 20 bp, Artificial Sequence
  chemically synthesized
ttgtcttctgtaacaggact

SEQ ID NO: 242629 - DNA, 20 bp, Artificial Sequence
  chemically synthesized
gggccacctaagtcctgtta

SEQ ID NO: 242630 - DNA, 20 bp, Artificial Sequence
  chemically synthesized
ccacctaagtcctgttacag

SEQ ID NO: 242631 - DNA, 20 bp, Artificial Sequence
  chemically synthesized
attactttgtcttctgtaac

SEQ ID NO: 242632 - DNA, 20 bp, Artificial Sequence
  chemically synthesized
cattactttgtcttctgtaa

SEQ ID NO: 242633 - DNA, 20 bp, Artificial Sequence
  chemically synthesized
aagtcctgttacagaagaca

SEQ ID NO: 242634 - DNA, 20 bp, Artificial Sequence
  chemically synthesized
acagaagacaaagtaatgat

SEQ ID NO: 242635 - DNA, 20 bp, Artificial Sequence
  chemically synthesized
gtttaaaggaggggagtgat

SEQ ID NO: 242636 - DNA, 20 bp, Artificial Sequence
  chemically synthesized
cactgaagtttaaaggaggg

SEQ ID NO: 242637 - DNA, 20 bp, Artificial Sequence
  chemically synthesized
gacactgaagtttaaaggag

SEQ ID NO: 242638 - DNA, 20 bp, Artificial Sequence
  chemically synthesized
ggacactgaagtttaaagga

SEQ ID NO: 242639 - DNA, 20 bp, Artificial Sequence
  chemically synthesized
aggacactgaagtttaaagg

SEQ ID NO: 242640 - DNA, 20 bp, Artificial Sequence
  chemically synthesized
aaggacactgaagtttaaag

SEQ ID NO: 242641 - DNA, 20 bp, Artificial Sequence
  chemically synthesized
ccaaggacactgaagtttaa

SEQ ID NO: 242642 - DNA, 20 bp, Artificial Sequence
  chemically synthesized
cactcccctcctttaaactt

SEQ ID NO: 242643 - DNA, 20 bp, Artificial Sequence
  chemically synthesized
accaaggacactgaagttta

SEQ ID NO: 242644 - DNA, 20 bp, Artificial Sequence
  chemically synthesized
tattagtaccaaggacactg

SEQ ID NO: 242645 - DNA, 20 bp, Artificial Sequence
  chemically synthesized
cctttaaacttcagtgtcct

SEQ ID NO: 242646 - DNA, 20 bp, Artificial Sequence
  chemically synthesized
catgagtgttattagtacca

SEQ ID NO: 242647 - DNA, 20 bp, Artificial Sequence
  chemically synthesized
acatgagtgttattagtacc

SEQ ID NO: 242648 - DNA, 20 bp, Artificial Sequence
  chemically synthesized
atttccaacatgagtgttat

SEQ ID NO: 242649 - DNA, 20 bp, Artificial Sequence
  chemically synthesized
ggtactaataacactcatgt

SEQ ID NO: 242650 - DNA, 20 bp, Artificial Sequence
  chemically synthesized
attggctttatttccaacat

SEQ ID NO: 242651 - DNA, 20 bp, Artificial Sequence
  chemically synthesized
taacactcatgttggaaata

SEQ ID NO: 242652 - DNA, 20 bp, Artificial Sequence
  chemically synthesized
catgttggaaataaagccaa

SEQ ID NO: 242653 - DNA, 20 bp, Artificial Sequence
  chemically synthesized
catatgcagaatgattctat

SEQ ID NO: 242654 - DNA, 20 bp, Artificial Sequence
  chemically synthesized
ttcaggtaataaagcatatg

SEQ ID NO: 242655 - DNA, 20 bp, Artificial Sequence
  chemically synthesized
aggtggtatttcaggtaata

SEQ ID NO: 242656 - DNA, 20 bp, Artificial Sequence
  chemically synthesized
aatgttaaaggtggtatttc

SEQ ID NO: 242657 - DNA, 20 bp, Artificial Sequence
  chemically synthesized
taatgttaaaggtggtattt

SEQ ID NO: 242658 - DNA, 20 bp, Artificial Sequence
  chemically synthesized
tcagagggtaatgttaaagg

SEQ ID NO: 242659 - DNA, 20 bp, Artificial Sequence
  chemically synthesized
tcatcagagggtaatgttaa

SEQ ID NO: 242660 - DNA, 20 bp, Artificial Sequence
  chemically synthesized
gtcatcagagggtaatgtta

SEQ ID NO: 242661 - DNA, 20 bp, Artificial Sequence
  chemically synthesized
actgttaaaaagtcatcaga

SEQ ID NO: 242662 - DNA, 20 bp, Artificial Sequence
  chemically synthesized
aactgttaaaaagtcatcag

SEQ ID NO: 242663 - DNA, 20 bp, Artificial Sequence
  chemically synthesized
taactgttaaaaagtcatca

SEQ ID NO: 242664 - DNA, 20 bp, Artificial Sequence
  chemically synthesized
gttaactgttaaaaagtcat

SEQ ID NO: 242665 - DNA, 20 bp, Artificial Sequence
  chemically synthesized
accctctgatgactttttaa

SEQ ID NO: 242666 - DNA, 20 bp, Artificial Sequence
  chemically synthesized
cattgaagttaactgttaaa

SEQ ID NO: 242667 - DNA, 20 bp, Artificial Sequence
  chemically synthesized
taacagttaacttcaatgtc

SEQ ID NO: 242668 - DNA, 20 bp, Artificial Sequence
  chemically synthesized
tagcaacgtgctagacattg

SEQ ID NO: 242669 - DNA, 20 bp, Artificial Sequence
  chemically synthesized
atagacatatagcaacgtgc

SEQ ID NO: 242670 - DNA, 20 bp, Artificial Sequence
  chemically synthesized
attgaaaaaaaatagacata

SEQ ID NO: 242671 - DNA, 20 bp, Artificial Sequence
  chemically synthesized
cttccattattgaaaaaaaa

SEQ ID NO: 242672 - DNA, 20 bp, Artificial Sequence
  chemically synthesized
tgtctattttttttcaataa

SEQ ID NO: 242673 - DNA, 20 bp, Artificial Sequence
  chemically synthesized
ctattttttttcaataatgg

SEQ ID NO: 242674 - DNA, 20 bp, Artificial Sequence
  chemically synthesized
tttttcaataatggaagcac

SEQ ID NO: 242675 - DNA, 20 bp, Artificial Sequence
  chemically synthesized
ttcaataatggaagcactag

SEQ ID NO: 242676 - DNA, 20 bp, Artificial Sequence
  chemically synthesized
tcaataatggaagcactaga

SEQ ID NO: 242677 - DNA, 20 bp, Artificial Sequence
  chemically synthesized
caataatggaagcactagaa

SEQ ID NO: 242678 - DNA, 20 bp, Artificial Sequence
  chemically synthesized
taataatgccatttcccttc

SEQ ID NO: 242679 - DNA, 20 bp, Artificial Sequence
  chemically synthesized
tggaagcactagaagggaaa

SEQ ID NO: 242680 - DNA, 20 bp, Artificial Sequence
  chemically synthesized
tggcattattatgtacacga

SEQ ID NO: 242681 - DNA, 20 bp, Artificial Sequence
  chemically synthesized
acacgaaagatttatataca

SEQ ID NO: 242682 - DNA, 20 bp, Artificial Sequence
  chemically synthesized
acgaaagatttatatacaaa

SEQ ID NO: 242683 - DNA, 20 bp, Artificial Sequence
  chemically synthesized
aaagtattaacaaataaaat

SEQ ID NO: 242684 - DNA, 20 bp, Artificial Sequence
  chemically synthesized
cttatttggaaaagtagcaa

SEQ ID NO: 242685 - DNA, 20 bp, Artificial Sequence
  chemically synthesized
ccttttcttatttggaaaag

SEQ ID NO: 242686 - DNA, 20 bp, Artificial Sequence
  chemically synthesized
ttaccttttcttatttggaa

SEQ ID NO: 242687 - DNA, 20 bp, Artificial Sequence
  chemically synthesized
cttttgctacttttccaaat

SEQ ID NO: 242688 - DNA, 20 bp, Artificial Sequence
  chemically synthesized
atgttttaccttttcttatt

SEQ ID NO: 242689 - DNA, 20 bp, Artificial Sequence
  chemically synthesized
gctacttttccaaataagaa

SEQ ID NO: 242690 - DNA, 20 bp, Artificial Sequence
  chemically synthesized
ctacttttccaaataagaaa

SEQ ID NO: 242691 - DNA, 20 bp, Artificial Sequence
  chemically synthesized
atgttccatgtgattttata

SEQ ID NO: 242692 - DNA, 20 bp, Artificial Sequence
  chemically synthesized
aatgttccatgtgattttat

SEQ ID NO: 242693 - DNA, 20 bp, Artificial Sequence
  chemically synthesized
aaatgttccatgtgatttta

SEQ ID NO: 242694 - DNA, 20 bp, Artificial Sequence
  chemically synthesized
atgcaccctataaaatcaca

SEQ ID NO: 242695 - DNA, 20 bp, Artificial Sequence
  chemically synthesized
taaaatcacatggaacattt

SEQ ID NO: 242696 - DNA, 20 bp, Artificial Sequence
  chemically synthesized
taatgttttagaacacacag

SEQ ID NO: 242697 - DNA, 20 bp, Artificial Sequence
  chemically synthesized
ttataatgttttagaacaca

SEQ ID NO: 242698 - DNA, 20 bp, Artificial Sequence
  chemically synthesized
aatgaagtattataatgttt

SEQ ID NO: 242699 - DNA, 20 bp, Artificial Sequence
  chemically synthesized
aatccaaccctcaagaaatg

SEQ ID NO: 242700 - DNA, 20 bp, Artificial Sequence
  chemically synthesized
attataatacttcatttctt

SEQ ID NO: 242701 - DNA, 20 bp, Artificial Sequence
  chemically synthesized
ttataatacttcatttcttg

SEQ ID NO: 242702 - DNA, 20 bp, Artificial Sequence
  chemically synthesized
tataatacttcatttcttga

SEQ ID NO: 242703 - DNA, 20 bp, Artificial Sequence
  chemically synthesized
atacttcatttcttgagggt

SEQ ID NO: 242704 - DNA, 20 bp, Artificial Sequence
  chemically synthesized
gataagagaatccaaccctc

SEQ ID NO: 242705 - DNA, 20 bp, Artificial Sequence
  chemically synthesized
gatattattattgatgataa

SEQ ID NO: 242706 - DNA, 20 bp, Artificial Sequence
  chemically synthesized
atgatattattattgatgat

SEQ ID NO: 242707 - DNA, 20 bp, Artificial Sequence
  chemically synthesized
tcatcaataataatatcatg

SEQ ID NO: 242708 - DNA, 20 bp, Artificial Sequence
  chemically synthesized
caataataatatcatgtagt

SEQ ID NO: 242709 - DNA, 20 bp, Artificial Sequence
  chemically synthesized
atcatgtagttagaacgcat

SEQ ID NO: 242710 - DNA, 20 bp, Artificial Sequence
  chemically synthesized
gtagttagaacgcattggca

SEQ ID NO: 242711 - DNA, 20 bp, Artificial Sequence
  chemically synthesized
atagatatataatcatttta

SEQ ID NO: 242712 - DNA, 20 bp, Artificial Sequence
  chemically synthesized
tagatatataatcattttat

SEQ ID NO: 242713 - DNA, 20 bp, Artificial Sequence
  chemically synthesized
attttatgggtccgtgaaat

SEQ ID NO: 242714 - DNA, 20 bp, Artificial Sequence
  chemically synthesized
ttttatgggtccgtgaaatg

SEQ ID NO: 242715 - DNA, 20 bp, Artificial Sequence
  chemically synthesized
ccaattctatcctcatttca

SEQ ID NO: 242716 - DNA, 20 bp, Artificial Sequence
  chemically synthesized
atgggtccgtgaaatgagga

SEQ ID NO: 242717 - DNA, 20 bp, Artificial Sequence
  chemically synthesized
ccgtgaaatgaggatagaat

SEQ ID NO: 242718 - DNA, 20 bp, Artificial Sequence
  chemically synthesized
cgtgaaatgaggatagaatt

SEQ ID NO: 242719 - DNA, 20 bp, Artificial Sequence
  chemically synthesized
tgaaatgaggatagaattgg

SEQ ID NO: 242720 - DNA, 20 bp, Artificial Sequence
  chemically synthesized
gaaatgaggatagaattggg

SEQ ID NO: 242721 - DNA, 20 bp, Artificial Sequence
  chemically synthesized
ttgggaggtcacaatttttg

SEQ ID NO: 242722 - DNA, 20 bp, Artificial Sequence
  chemically synthesized
agcaatatttttgttattgt

SEQ ID NO: 242723 - DNA, 20 bp, Artificial Sequence
  chemically synthesized
tgttattgttagtttttttg

SEQ ID NO: 242724 - DNA, 20 bp, Artificial Sequence
  chemically synthesized
agtttttttgtggtactgaa

SEQ ID NO: 242725 - DNA, 20 bp, Artificial Sequence
  chemically synthesized
tttttgtggtactgaaaaga

SEQ ID NO: 242726 - DNA, 20 bp, Artificial Sequence
  chemically synthesized
ttcttcgcttgctttctttt

SEQ ID NO: 242727 - DNA, 20 bp, Artificial Sequence
  chemically synthesized
tgtggtactgaaaagaaagc

SEQ ID NO: 242728 - DNA, 20 bp, Artificial Sequence
  chemically synthesized
tactgaaaagaaagcaagcg

SEQ ID NO: 242729 - DNA, 20 bp, Artificial Sequence
  chemically synthesized
gaaaagaaagcaagcgaaga

SEQ ID NO: 242730 - DNA, 20 bp, Artificial Sequence
  chemically synthesized
agaaagcaagcgaagaaagc

SEQ ID NO: 242731 - DNA, 20 bp, Artificial Sequence
  chemically synthesized
gaaagcaagcgaagaaagca

SEQ ID NO: 242732 - DNA, 20 bp, Artificial Sequence
  chemically synthesized
gcaagcgaagaaagcaagga

SEQ ID NO: 242733 - DNA, 20 bp, Artificial Sequence
  chemically synthesized
cgaagaaagcaaggaaagca

SEQ ID NO: 242734 - DNA, 20 bp, Artificial Sequence
  chemically synthesized
gaagaaagcaaggaaagcaa

SEQ ID NO: 242735 - DNA, 20 bp, Artificial Sequence
  chemically synthesized
aaggaaagcaaaggaacgca

SEQ ID NO: 242736 - DNA, 20 bp, Artificial Sequence
  chemically synthesized
aggaaagcaaaggaacgcaa

SEQ ID NO: 242737 - DNA, 20 bp, Artificial Sequence
  chemically synthesized
agcaaaggaacgcaaaggaa

SEQ ID NO: 242738 - DNA, 20 bp, Artificial Sequence
  chemically synthesized
gcaaaggaacgcaaaggaaa

SEQ ID NO: 242739 - DNA, 20 bp, Artificial Sequence
  chemically synthesized
ggaacgcaaaggaaaaggaa

SEQ ID NO: 242740 - DNA, 20 bp, Artificial Sequence
  chemically synthesized
gaacgcaaaggaaaaggaaa

SEQ ID NO: 242741 - DNA, 20 bp, Artificial Sequence
  chemically synthesized
caaaggaaaaggaaaaggaa

SEQ ID NO: 242742 - DNA, 20 bp, Artificial Sequence
  chemically synthesized
aaaggaaaaggaaaaggaaa

SEQ ID NO: 242743 - DNA, 20 bp, Artificial Sequence
  chemically synthesized
aaaaggaaaaggaaaaggaa

SEQ ID NO: 242744 - DNA, 20 bp, Artificial Sequence
  chemically synthesized
aggaaaaggaaaaggaacag

SEQ ID NO: 242745 - DNA, 20 bp, Artificial Sequence
  chemically synthesized
ggaaaaggaaaaggaacaga

SEQ ID NO: 242746 - DNA, 20 bp, Artificial Sequence
  chemically synthesized
aaggaaaaggaacagaagga

SEQ ID NO: 242747 - DNA, 20 bp, Artificial Sequence
  chemically synthesized
aggaaaaggaacagaaggaa

SEQ ID NO: 242748 - DNA, 20 bp, Artificial Sequence
  chemically synthesized
aaaggaacagaaggaaagga

SEQ ID NO: 242749 - DNA, 20 bp, Artificial Sequence
  chemically synthesized
aaggaacagaaggaaaggaa

SEQ ID NO: 242750 - DNA, 20 bp, Artificial Sequence
  chemically synthesized
gaacagaaggaaaggaaagg

SEQ ID NO: 242751 - DNA, 20 bp, Artificial Sequence
  chemically synthesized
cagaaggaaaggaaaggaag

SEQ ID NO: 242752 - DNA, 20 bp, Artificial Sequence
  chemically synthesized
agaaggaaaggaaaggaaga

SEQ ID NO: 242753 - DNA, 20 bp, Artificial Sequence
  chemically synthesized
aggaaaggaaaggaagaagg

SEQ ID NO: 242754 - DNA, 20 bp, Artificial Sequence
  chemically synthesized
ggaaaggaaaggaagaagga

SEQ ID NO: 242755 - DNA, 20 bp, Artificial Sequence
  chemically synthesized
aaggaaaggaagaaggaagg

SEQ ID NO: 242756 - DNA, 20 bp, Artificial Sequence
  chemically synthesized
aggaaaggaagaaggaagga

SEQ ID NO: 242757 - DNA, 20 bp, Artificial Sequence
  chemically synthesized
aaaggaagaaggaaggaagg

SEQ ID NO: 242758 - DNA, 20 bp, Artificial Sequence
  chemically synthesized
aaggaagaaggaaggaagga

SEQ ID NO: 242759 - DNA, 20 bp, Artificial Sequence
  chemically synthesized
gaagaaggaaggaaggaagg

SEQ ID NO: 242760 - DNA, 20 bp, Artificial Sequence
  chemically synthesized
aggaaggaaggaagaaacaa

SEQ ID NO: 242761 - DNA, 20 bp, Artificial Sequence
  chemically synthesized
aggaaggaagaaacaaaaga

SEQ ID NO: 242762 - DNA, 20 bp, Artificial Sequence
  chemically synthesized
ggaaggaagaaacaaaagaa

SEQ ID NO: 242763 - DNA, 20 bp, Artificial Sequence
  chemically synthesized
ggaagaaacaaaagaaagga

SEQ ID NO: 242764 - DNA, 20 bp, Artificial Sequence
  chemically synthesized
gaagaaacaaaagaaaggaa

SEQ ID NO: 242765 - DNA, 20 bp, Artificial Sequence
  chemically synthesized
aaacaaaagaaaggaaagga

SEQ ID NO: 242766 - DNA, 20 bp, Artificial Sequence
  chemically synthesized
caaaagaaaggaaaggaaag

SEQ ID NO: 242767 - DNA, 20 bp, Artificial Sequence
  chemically synthesized
aagaaaggaaaggaaagcag

SEQ ID NO: 242768 - DNA, 20 bp, Artificial Sequence
  chemically synthesized
aggaaaggaaagcagaagta

SEQ ID NO: 242769 - DNA, 20 bp, Artificial Sequence
  chemically synthesized
aggaaagcagaagtaaagaa

SEQ ID NO: 242770 - DNA, 20 bp, Artificial Sequence
  chemically synthesized
aagcagaagtaaagaaaaga

SEQ ID NO: 242771 - DNA, 20 bp, Artificial Sequence
  chemically synthesized
gtaaagaaaagaaagaaaaa

SEQ ID NO: 242772 - DNA, 20 bp, Artificial Sequence
  chemically synthesized
gaaagaaaaaaagaaaaacc

SEQ ID NO: 242773 - DNA, 20 bp, Artificial Sequence
  chemically synthesized
gaaaaaaagaaaaaccaagc

SEQ ID NO: 242774 - DNA, 20 bp, Artificial Sequence
  chemically synthesized
aaaaagaaaaaccaagcaag

SEQ ID NO: 242775 - DNA, 20 bp, Artificial Sequence
  chemically synthesized
aaaagaaaaaccaagcaagc

SEQ ID NO: 242776 - DNA, 20 bp, Artificial Sequence
  chemically synthesized
tgcctgtctgcctgcttgct

SEQ ID NO: 242777 - DNA, 20 bp, Artificial Sequence
  chemically synthesized
agaaaaaccaagcaagcagg

SEQ ID NO: 242778 - DNA, 20 bp, Artificial Sequence
  chemically synthesized
aaaccaagcaagcaggcaga

SEQ ID NO: 242779 - DNA, 20 bp, Artificial Sequence
  chemically synthesized
aaccaagcaagcaggcagac

SEQ ID NO: 242780 - DNA, 20 bp, Artificial Sequence
  chemically synthesized
caagcaagcaggcagacagg

SEQ ID NO: 242781 - DNA, 20 bp, Artificial Sequence
  chemically synthesized
caagcaggcagacaggcaga

SEQ ID NO: 242782 - DNA, 20 bp, Artificial Sequence
  chemically synthesized
aagcaggcagacaggcagac

SEQ ID NO: 242783 - DNA, 20 bp, Artificial Sequence
  chemically synthesized
caggcagacaggcagacagg

SEQ ID NO: 242784 - DNA, 20 bp, Artificial Sequence
  chemically synthesized
aggcagacaggcagacaggc

SEQ ID NO: 242785 - DNA, 20 bp, Artificial Sequence
  chemically synthesized
agacaggcagacaggcaggc

SEQ ID NO: 242786 - DNA, 20 bp, Artificial Sequence
  chemically synthesized
aggcagacaggcaggcaagc

SEQ ID NO: 242787 - DNA, 20 bp, Artificial Sequence
  chemically synthesized
agacaggcaggcaagcaagc

SEQ ID NO: 242788 - DNA, 20 bp, Artificial Sequence
  chemically synthesized
ggcaggcaagcaagctagtt

SEQ ID NO: 242789 - DNA, 20 bp, Artificial Sequence
  chemically synthesized
ggcaagcaagctagttaagt

SEQ ID NO: 242790 - DNA, 20 bp, Artificial Sequence
  chemically synthesized
tatctaaaatcttacttaac

SEQ ID NO: 242791 - DNA, 20 bp, Artificial Sequence
  chemically synthesized
aagctagttaagtaagattt

SEQ ID NO: 242792 - DNA, 20 bp, Artificial Sequence
  chemically synthesized
agttaagtaagattttagat

SEQ ID NO: 242793 - DNA, 20 bp, Artificial Sequence
  chemically synthesized
gttaagtaagattttagata

SEQ ID NO: 242794 - DNA, 20 bp, Artificial Sequence
  chemically synthesized
attttagataaggaaataaa

SEQ ID NO: 242795 - DNA, 20 bp, Artificial Sequence
  chemically synthesized
ttttagataaggaaataaat

SEQ ID NO: 242796 - DNA, 20 bp, Artificial Sequence
  chemically synthesized
aggaaataaataggaataaa

SEQ ID NO: 242797 - DNA, 20 bp, Artificial Sequence
  chemically synthesized
ggaaataaataggaataaat

SEQ ID NO: 242798 - DNA, 20 bp, Artificial Sequence
  chemically synthesized
aaataaataggaataaatag

SEQ ID NO: 242799 - DNA, 20 bp, Artificial Sequence
  chemically synthesized
gagatgaaattatatgatcc

SEQ ID NO: 242800 - DNA, 20 bp, Artificial Sequence
  chemically synthesized
agatgaaattatatgatcct

SEQ ID NO: 242801 - DNA, 20 bp, Artificial Sequence
  chemically synthesized
gatgaaattatatgatccta

SEQ ID NO: 242802 - DNA, 20 bp, Artificial Sequence
  chemically synthesized
aaattatatgatcctagggc

SEQ ID NO: 242803 - DNA, 20 bp, Artificial Sequence
  chemically synthesized
aattatatgatcctagggct

SEQ ID NO: 242804 - DNA, 20 bp, Artificial Sequence
  chemically synthesized
attatatgatcctagggcta

SEQ ID NO: 242805 - DNA, 20 bp, Artificial Sequence
  chemically synthesized
cttttctttaccctagccct

SEQ ID NO: 242806 - DNA, 20 bp, Artificial Sequence
  chemically synthesized
tcttttctttaccctagccc

SEQ ID NO: 242807 - DNA, 20 bp, Artificial Sequence
  chemically synthesized
atgatcctagggctagggta

SEQ ID NO: 242808 - DNA, 20 bp, Artificial Sequence
  chemically synthesized
ttttgctcttttctttaccc

SEQ ID NO: 242809 - DNA, 20 bp, Artificial Sequence
  chemically synthesized
cctagggctagggtaaagaa

SEQ ID NO: 242810 - DNA, 20 bp, Artificial Sequence
  chemically synthesized
tagggctagggtaaagaaaa

SEQ ID NO: 242811 - DNA, 20 bp, Artificial Sequence
  chemically synthesized
agggtaaagaaaagagcaaa

SEQ ID NO: 242812 - DNA, 20 bp, Artificial Sequence
  chemically synthesized
gggtaaagaaaagagcaaaa

SEQ ID NO: 242813 - DNA, 20 bp, Artificial Sequence
  chemically synthesized
tacgctacagaaagatttta

SEQ ID NO: 242814 - DNA, 20 bp, Artificial Sequence
  chemically synthesized
aaggccataaaatctttctg

SEQ ID NO: 242815 - DNA, 20 bp, Artificial Sequence
  chemically synthesized
ttttattattacgctacaga

SEQ ID NO: 242816 - DNA, 20 bp, Artificial Sequence
  chemically synthesized
ttatttttattattacgcta

SEQ ID NO: 242817 - DNA, 20 bp, Artificial Sequence
  chemically synthesized
aataataaaaataacttcaa

SEQ ID NO: 242818 - DNA, 20 bp, Artificial Sequence
  chemically synthesized
catcaacccaagcacttttg

SEQ ID NO: 242819 - DNA, 20 bp, Artificial Sequence
  chemically synthesized
aaaataacttcaaaagtgct

SEQ ID NO: 242820 - DNA, 20 bp, Artificial Sequence
  chemically synthesized
aaataacttcaaaagtgctt

SEQ ID NO: 242821 - DNA, 20 bp, Artificial Sequence
  chemically synthesized
tgtcaggctatcatcaaccc

SEQ ID NO: 242822 - DNA, 20 bp, Artificial Sequence
  chemically synthesized
aaaagtgcttgggttgatga

SEQ ID NO: 242823 - DNA, 20 bp, Artificial Sequence
  chemically synthesized
tgggttgatgatagcctgac

SEQ ID NO: 242824 - DNA, 20 bp, Artificial Sequence
  chemically synthesized
gggttgatgatagcctgaca

SEQ ID NO: 242825 - DNA, 20 bp, Artificial Sequence
  chemically synthesized
tacccaagctaatccttgtc

SEQ ID NO: 242826 - DNA, 20 bp, Artificial Sequence
  chemically synthesized
gtacccaagctaatccttgt

SEQ ID NO: 242827 - DNA, 20 bp, Artificial Sequence
  chemically synthesized
gatgatagcctgacaaggat

SEQ ID NO: 242828 - DNA, 20 bp, Artificial Sequence
  chemically synthesized
tagcctgacaaggattagct

SEQ ID NO: 242829 - DNA, 20 bp, Artificial Sequence
  chemically synthesized
agcctgacaaggattagctt

SEQ ID NO: 242830 - DNA, 20 bp, Artificial Sequence
  chemically synthesized
tctttaattggtatgtaccc

SEQ ID NO: 242831 - DNA, 20 bp, Artificial Sequence
  chemically synthesized
gcttgggtacataccaatta

SEQ ID NO: 242832 - DNA, 20 bp, Artificial Sequence
  chemically synthesized
ctagaccagctgtctttaat

SEQ ID NO: 242833 - DNA, 20 bp, Artificial Sequence
  chemically synthesized
gggtacataccaattaaaga

SEQ ID NO: 242834 - DNA, 20 bp, Artificial Sequence
  chemically synthesized
acataccaattaaagacagc

SEQ ID NO: 242835 - DNA, 20 bp, Artificial Sequence
  chemically synthesized
ccaattaaagacagctggtc

SEQ ID NO: 242836 - DNA, 20 bp, Artificial Sequence
  chemically synthesized
attaaagacagctggtctag

SEQ ID NO: 242837 - DNA, 20 bp, Artificial Sequence
  chemically synthesized
tgtgaaaccagcttctagac

SEQ ID NO: 242838 - DNA, 20 bp, Artificial Sequence
  chemically synthesized
aagacagctggtctagaagc

SEQ ID NO: 242839 - DNA, 20 bp, Artificial Sequence
  chemically synthesized
catcatgtgaaaccagcttc

SEQ ID NO: 242840 - DNA, 20 bp, Artificial Sequence
  chemically synthesized
actgtagcatcatgtgaaac

SEQ ID NO: 242841 - DNA, 20 bp, Artificial Sequence
  chemically synthesized
gctggtttcacatgatgcta

SEQ ID NO: 242842 - DNA, 20 bp, Artificial Sequence
  chemically synthesized
cttgctttaccagtttactg

SEQ ID NO: 242843 - DNA, 20 bp, Artificial Sequence
  chemically synthesized
cacatgatgctacagtaaac

SEQ ID NO: 242844 - DNA, 20 bp, Artificial Sequence
  chemically synthesized
gatgctacagtaaactggta

SEQ ID NO: 242845 - DNA, 20 bp, Artificial Sequence
  chemically synthesized
ctacagtaaactggtaaagc

SEQ ID NO: 242846 - DNA, 20 bp, Artificial Sequence
  chemically synthesized
ggttttaatacttgctttac

SEQ ID NO: 242847 - DNA, 20 bp, Artificial Sequence
  chemically synthesized
taaagcaagtattaaaacct

SEQ ID NO: 242848 - DNA, 20 bp, Artificial Sequence
  chemically synthesized
aaagcaagtattaaaaccta

SEQ ID NO: 242849 - DNA, 20 bp, Artificial Sequence
  chemically synthesized
cacaggagagtttgttcctt

SEQ ID NO: 242850 - DNA, 20 bp, Artificial Sequence
  chemically synthesized
tcacaggagagtttgttcct

SEQ ID NO: 242851 - DNA, 20 bp, Artificial Sequence
  chemically synthesized
agccagtaaatatcacagga

SEQ ID NO: 242852 - DNA, 20 bp, Artificial Sequence
  chemically synthesized
tgagccagtaaatatcacag

SEQ ID NO: 242853 - DNA, 20 bp, Artificial Sequence
  chemically synthesized
gttgagccagtaaatatcac

SEQ ID NO: 242854 - DNA, 20 bp, Artificial Sequence
  chemically synthesized
tgttgagccagtaaatatca

SEQ ID NO: 242855 - DNA, 20 bp, Artificial Sequence
  chemically synthesized
aactctcctgtgatatttac

SEQ ID NO: 242856 - DNA, 20 bp, Artificial Sequence
  chemically synthesized
ttatccttaagatgttgagc

SEQ ID NO: 242857 - DNA, 20 bp, Artificial Sequence
  chemically synthesized
tcttttatccttaagatgtt

SEQ ID NO: 242858 - DNA, 20 bp, Artificial Sequence
  chemically synthesized
atttactggctcaacatctt

SEQ ID NO: 242859 - DNA, 20 bp, Artificial Sequence
  chemically synthesized
tttactggctcaacatctta

SEQ ID NO: 242860 - DNA, 20 bp, Artificial Sequence
  chemically synthesized
tataattgtcttttatcctt

SEQ ID NO: 242861 - DNA, 20 bp, Artificial Sequence
  chemically synthesized
gctcaacatcttaaggataa

SEQ ID NO: 242862 - DNA, 20 bp, Artificial Sequence
  chemically synthesized
acaattatatgatgttaatt

SEQ ID NO: 242863 - DNA, 20 bp, Artificial Sequence
  chemically synthesized
ttatatgatgttaattaaga

SEQ ID NO: 242864 - DNA, 20 bp, Artificial Sequence
  chemically synthesized
taattaagacagtgctatgc

SEQ ID NO: 242865 - DNA, 20 bp, Artificial Sequence
  chemically synthesized
ttgttagacatttaccagca

SEQ ID NO: 242866 - DNA, 20 bp, Artificial Sequence
  chemically synthesized
tctgattgttagacatttac

SEQ ID NO: 242867 - DNA, 20 bp, Artificial Sequence
  chemically synthesized
gctggtaaatgtctaacaat

SEQ ID NO: 242868 - DNA, 20 bp, Artificial Sequence
  chemically synthesized
ctctcaggggatctgattgt

SEQ ID NO: 242869 - DNA, 20 bp, Artificial Sequence
  chemically synthesized
gtctaacaatcagatcccct

SEQ ID NO: 242870 - DNA, 20 bp, Artificial Sequence
  chemically synthesized
ctaacaatcagatcccctga

SEQ ID NO: 242871 - DNA, 20 bp, Artificial Sequence
  chemically synthesized
taacaatcagatcccctgag

SEQ ID NO: 242872 - DNA, 20 bp, Artificial Sequence
  chemically synthesized
aaatatgtccttcctctcag

SEQ ID NO: 242873 - DNA, 20 bp, Artificial Sequence
  chemically synthesized
caatcagatcccctgagagg

SEQ ID NO: 242874 - DNA, 20 bp, Artificial Sequence
  chemically synthesized
caaatatgtccttcctctca

SEQ ID NO: 242875 - DNA, 20 bp, Artificial Sequence
  chemically synthesized
aatcagatcccctgagagga

SEQ ID NO: 242876 - DNA, 20 bp, Artificial Sequence
  chemically synthesized
tcaaatatgtccttcctctc

SEQ ID NO: 242877 - DNA, 20 bp, Artificial Sequence
  chemically synthesized
ttcaaatatgtccttcctct

SEQ ID NO: 242878 - DNA, 20 bp, Artificial Sequence
  chemically synthesized
aggacatatttgaatattcc

SEQ ID NO: 242879 - DNA, 20 bp, Artificial Sequence
  chemically synthesized
agcttaaaattaaacatact

SEQ ID NO: 242880 - DNA, 20 bp, Artificial Sequence
  chemically synthesized
tagcttaaaattaaacatac

SEQ ID NO: 242881 - DNA, 20 bp, Artificial Sequence
  chemically synthesized
ttcccagtatgtttaatttt

SEQ ID NO: 242882 - DNA, 20 bp, Artificial Sequence
  chemically synthesized
gtttggtgacattataatga

SEQ ID NO: 242883 - DNA, 20 bp, Artificial Sequence
  chemically synthesized
ttataatgtcaccaaacatg

SEQ ID NO: 242884 - DNA, 20 bp, Artificial Sequence
  chemically synthesized
tgtagtgctaacttcatgtt

SEQ ID NO: 242885 - DNA, 20 bp, Artificial Sequence
  chemically synthesized
aatgtcaccaaacatgaagt

SEQ ID NO: 242886 - DNA, 20 bp, Artificial Sequence
  chemically synthesized
ggaatgactgtataatggtg

SEQ ID NO: 242887 - DNA, 20 bp, Artificial Sequence
  chemically synthesized
gttagcactacaccattata

SEQ ID NO: 242888 - DNA, 20 bp, Artificial Sequence
  chemically synthesized
ataatggaatgactgtataa

SEQ ID NO: 242889 - DNA, 20 bp, Artificial Sequence
  chemically synthesized
tatacagtcattccattata

SEQ ID NO: 242890 - DNA, 20 bp, Artificial Sequence
  chemically synthesized
atacagtcattccattatac

SEQ ID NO: 242891 - DNA, 20 bp, Artificial Sequence
  chemically synthesized
cgggtttgttacctgtataa

SEQ ID NO: 242892 - DNA, 20 bp, Artificial Sequence
  chemically synthesized
ttatacaggtaacaaacccg

SEQ ID NO: 242893 - DNA, 20 bp, Artificial Sequence
  chemically synthesized
tatatttcactattatctac

SEQ ID NO: 242894 - DNA, 20 bp, Artificial Sequence
  chemically synthesized
ggtaacaaacccgtagataa

SEQ ID NO: 242895 - DNA, 20 bp, Artificial Sequence
  chemically synthesized
ttatatttcactattatcta

SEQ ID NO: 242896 - DNA, 20 bp, Artificial Sequence
  chemically synthesized
ataatagtgaaatataataa

SEQ ID NO: 242897 - DNA, 20 bp, Artificial Sequence
  chemically synthesized
gtgaaatataataaaagaat

SEQ ID NO: 242898 - DNA, 20 bp, Artificial Sequence
  chemically synthesized
tgaaatataataaaagaatt

SEQ ID NO: 242899 - DNA, 20 bp, Artificial Sequence
  chemically synthesized
aatataataaaagaattagg

SEQ ID NO: 242900 - DNA, 20 bp, Artificial Sequence
  chemically synthesized
caaatgtactagatgcacaa

SEQ ID NO: 242901 - DNA, 20 bp, Artificial Sequence
  chemically synthesized
agtgatgacttttgtgcatc

SEQ ID NO: 242902 - DNA, 20 bp, Artificial Sequence
  chemically synthesized
tatattgttcacaaatgtac

SEQ ID NO: 242903 - DNA, 20 bp, Artificial Sequence
  chemically synthesized
caatatatttcatttaatgt

SEQ ID NO: 242904 - DNA, 20 bp, Artificial Sequence
  chemically synthesized
cattatcaaaaattaaatta

SEQ ID NO: 242905 - DNA, 20 bp, Artificial Sequence
  chemically synthesized
cataatttaatttttgataa

SEQ ID NO: 242906 - DNA, 20 bp, Artificial Sequence
  chemically synthesized
ttgataatggttgtgtttaa

SEQ ID NO: 242907 - DNA, 20 bp, Artificial Sequence
  chemically synthesized
gttaaattttcaagaatttt

SEQ ID NO: 242908 - DNA, 20 bp, Artificial Sequence
  chemically synthesized
gaaatacttgttaaattttc

SEQ ID NO: 242909 - DNA, 20 bp, Artificial Sequence
  chemically synthesized
aaaattcttgaaaatttaac

SEQ ID NO: 242910 - DNA, 20 bp, Artificial Sequence
  chemically synthesized
gaaaatttaacaagtatttc

SEQ ID NO: 242911 - DNA, 20 bp, Artificial Sequence
  chemically synthesized
tttaacttgagtcgatgtgc

SEQ ID NO: 242912 - DNA, 20 bp, Artificial Sequence
  chemically synthesized
tatttccagcacatcgactc

SEQ ID NO: 242913 - DNA, 20 bp, Artificial Sequence
  chemically synthesized
gataaactaatgtttaactt

SEQ ID NO: 242914 - DNA, 20 bp, Artificial Sequence
  chemically synthesized
catcgactcaagttaaacat

SEQ ID NO: 242915 - DNA, 20 bp, Artificial Sequence
  chemically synthesized
gtttatcacaatgtacacaa

SEQ ID NO: 242916 - DNA, 20 bp, Artificial Sequence
  chemically synthesized
tatcacaatgtacacaaaag

SEQ ID NO: 242917 - DNA, 20 bp, Artificial Sequence
  chemically synthesized
tcacaatgtacacaaaagaa

SEQ ID NO: 242918 - DNA, 20 bp, Artificial Sequence
  chemically synthesized
cacaatgtacacaaaagaag

SEQ ID NO: 242919 - DNA, 20 bp, Artificial Sequence
  chemically synthesized
acaaaagaagaggttcttat

SEQ ID NO: 242920 - DNA, 20 bp, Artificial Sequence
  chemically synthesized
tgtatgggataggtactgat

SEQ ID NO: 242921 - DNA, 20 bp, Artificial Sequence
  chemically synthesized
aaattaatgatgtatgggat

SEQ ID NO: 242922 - DNA, 20 bp, Artificial Sequence
  chemically synthesized
aaaattaatgatgtatggga

SEQ ID NO: 242923 - DNA, 20 bp, Artificial Sequence
  chemically synthesized
aggaaaaattaatgatgtat

SEQ ID NO: 242924 - DNA, 20 bp, Artificial Sequence
  chemically synthesized
taggaaaaattaatgatgta

SEQ ID NO: 242925 - DNA, 20 bp, Artificial Sequence
  chemically synthesized
aactaatacctgagaagaat

SEQ ID NO: 242926 - DNA, 20 bp, Artificial Sequence
  chemically synthesized
ttaatttttcctattcttct

SEQ ID NO: 242927 - DNA, 20 bp, Artificial Sequence
  chemically synthesized
aaactaatacctgagaagaa

SEQ ID NO: 242928 - DNA, 20 bp, Artificial Sequence
  chemically synthesized
taatttttcctattcttctc

SEQ ID NO: 242929 - DNA, 20 bp, Artificial Sequence
  chemically synthesized
tatataaactaatacctgag

SEQ ID NO: 242930 - DNA, 20 bp, Artificial Sequence
  chemically synthesized
ttcctattcttctcaggtat

SEQ ID NO: 242931 - DNA, 20 bp, Artificial Sequence
  chemically synthesized
ttttatataaactaatacct

SEQ ID NO: 242932 - DNA, 20 bp, Artificial Sequence
  chemically synthesized
caagactccttattttcaaa

SEQ ID NO: 242933 - DNA, 20 bp, Artificial Sequence
  chemically synthesized
tttgttttctctttgaaaat

SEQ ID NO: 242934 - DNA, 20 bp, Artificial Sequence
  chemically synthesized
tgcaagactccttattttca

SEQ ID NO: 242935 - DNA, 20 bp, Artificial Sequence
  chemically synthesized
ttgttttctctttgaaaata

SEQ ID NO: 242936 - DNA, 20 bp, Artificial Sequence
  chemically synthesized
gttttctctttgaaaataag

SEQ ID NO: 242937 - DNA, 20 bp, Artificial Sequence
  chemically synthesized
tagaattttcatacaaatgc

SEQ ID NO: 242938 - DNA, 20 bp, Artificial Sequence
  chemically synthesized
atttgtatgaaaattctaac

SEQ ID NO: 242939 - DNA, 20 bp, Artificial Sequence
  chemically synthesized
ttgtatgaaaattctaacaa

SEQ ID NO: 242940 - DNA, 20 bp, Artificial Sequence
  chemically synthesized
tgtatgaaaattctaacaag

SEQ ID NO: 242941 - DNA, 20 bp, Artificial Sequence
  chemically synthesized
aaaaagttcgttcctcttgt

SEQ ID NO: 242942 - DNA, 20 bp, Artificial Sequence
  chemically synthesized
aaagtataataaaaaaaaaa

SEQ ID NO: 242943 - DNA, 20 bp, Artificial Sequence
  chemically synthesized
ttttttttttattatacttt

SEQ ID NO: 242944 - DNA, 20 bp, Artificial Sequence
  chemically synthesized
ttttattatactttaagttt

SEQ ID NO: 242945 - DNA, 20 bp, Artificial Sequence
  chemically synthesized
cacatgtaccctaaaactta

SEQ ID NO: 242946 - DNA, 20 bp, Artificial Sequence
  chemically synthesized
tttattatactttaagtttt

SEQ ID NO: 242947 - DNA, 20 bp, Artificial Sequence
  chemically synthesized
ttattatactttaagtttta

SEQ ID NO: 242948 - DNA, 20 bp, Artificial Sequence
  chemically synthesized
gggtacatgtgcacattgtg

SEQ ID NO: 242949 - DNA, 20 bp, Artificial Sequence
  chemically synthesized
ggtacatgtgcacattgtgt

SEQ ID NO: 242950 - DNA, 20 bp, Artificial Sequence
  chemically synthesized
catgtgcacattgtgtaggt

SEQ ID NO: 242951 - DNA, 20 bp, Artificial Sequence
  chemically synthesized
tatgtatacatgtgccatgc

SEQ ID NO: 242952 - DNA, 20 bp, Artificial Sequence
  chemically synthesized
gtgggtgcagcgcaccagca

SEQ ID NO: 242953 - DNA, 20 bp, Artificial Sequence
  chemically synthesized
agttagtgggtgcagcgcac

SEQ ID NO: 242954 - DNA, 20 bp, Artificial Sequence
  chemically synthesized
agatgacgagttagtgggtg

SEQ ID NO: 242955 - DNA, 20 bp, Artificial Sequence
  chemically synthesized
atgctagatgacgagttagt

SEQ ID NO: 242956 - DNA, 20 bp, Artificial Sequence
  chemically synthesized
aatgctagatgacgagttag

SEQ ID NO: 242957 - DNA, 20 bp, Artificial Sequence
  chemically synthesized
cctaatgctagatgacgagt

SEQ ID NO: 242958 - DNA, 20 bp, Artificial Sequence
  chemically synthesized
gcacccactaactcgtcatc

SEQ ID NO: 242959 - DNA, 20 bp, Artificial Sequence
  chemically synthesized
tatacctaatgctagatgac

SEQ ID NO: 242960 - DNA, 20 bp, Artificial Sequence
  chemically synthesized
actaactcgtcatctagcat

SEQ ID NO: 242961 - DNA, 20 bp, Artificial Sequence
  chemically synthesized
ctaactcgtcatctagcatt

SEQ ID NO: 242962 - DNA, 20 bp, Artificial Sequence
  chemically synthesized
ttgggagatatacctaatgc

SEQ ID NO: 242963 - DNA, 20 bp, Artificial Sequence
  chemically synthesized
ggggggagggatagcattgg

SEQ ID NO: 242964 - DNA, 20 bp, Artificial Sequence
  chemically synthesized
gaggggggagggatagcatt

SEQ ID NO: 242965 - DNA, 20 bp, Artificial Sequence
  chemically synthesized
ggaggggggagggatagcat

SEQ ID NO: 242966 - DNA, 20 bp, Artificial Sequence
  chemically synthesized
gtggggggaggggggaggga

SEQ ID NO: 242967 - DNA, 20 bp, Artificial Sequence
  chemically synthesized
tggggtggggggagggggga

SEQ ID NO: 242968 - DNA, 20 bp, Artificial Sequence
  chemically synthesized
gtggggtggggggagggggg

SEQ ID NO: 242969 - DNA, 20 bp, Artificial Sequence
  chemically synthesized
ggtggggtggggggaggggg

SEQ ID NO: 242970 - DNA, 20 bp, Artificial Sequence
  chemically synthesized
gtggtggggtggggggaggg

SEQ ID NO: 242971 - DNA, 20 bp, Artificial Sequence
  chemically synthesized
tgtggtggggtggggggagg

SEQ ID NO: 242972 - DNA, 20 bp, Artificial Sequence
  chemically synthesized
ctgtggtggggtggggggag

SEQ ID NO: 242973 - DNA, 20 bp, Artificial Sequence
  chemically synthesized
actgtggtggggtgggggga

SEQ ID NO: 242974 - DNA, 20 bp, Artificial Sequence
  chemically synthesized
gactgtggtggggtgggggg

SEQ ID NO: 242975 - DNA, 20 bp, Artificial Sequence
  chemically synthesized
ggactgtggtggggtggggg

SEQ ID NO: 242976 - DNA, 20 bp, Artificial Sequence
  chemically synthesized
ggggactgtggtggggtggg

SEQ ID NO: 242977 - DNA, 20 bp, Artificial Sequence
  chemically synthesized
tggggactgtggtggggtgg

SEQ ID NO: 242978 - DNA, 20 bp, Artificial Sequence
  chemically synthesized
ctggggactgtggtggggtg

SEQ ID NO: 242979 - DNA, 20 bp, Artificial Sequence
  chemically synthesized
tctggggactgtggtggggt

SEQ ID NO: 242980 - DNA, 20 bp, Artificial Sequence
  chemically synthesized
ctctggggactgtggtgggg

SEQ ID NO: 242981 - DNA, 20 bp, Artificial Sequence
  chemically synthesized
cccctccccccaccccacca

SEQ ID NO: 242982 - DNA, 20 bp, Artificial Sequence
  chemically synthesized
acactctggggactgtggtg

SEQ ID NO: 242983 - DNA, 20 bp, Artificial Sequence
  chemically synthesized
cacactctggggactgtggt

SEQ ID NO: 242984 - DNA, 20 bp, Artificial Sequence
  chemically synthesized
tcacactctggggactgtgg

SEQ ID NO: 242985 - DNA, 20 bp, Artificial Sequence
  chemically synthesized
ccccaccccaccacagtccc

SEQ ID NO: 242986 - DNA, 20 bp, Artificial Sequence
  chemically synthesized
atatcacactctggggactg

SEQ ID NO: 242987 - DNA, 20 bp, Artificial Sequence
  chemically synthesized
ccaccccaccacagtcccca

SEQ ID NO: 242988 - DNA, 20 bp, Artificial Sequence
  chemically synthesized
aaggggaatatcacactctg

SEQ ID NO: 242989 - DNA, 20 bp, Artificial Sequence
  chemically synthesized
gaaggggaatatcacactct

SEQ ID NO: 242990 - DNA, 20 bp, Artificial Sequence
  chemically synthesized
ggaaggggaatatcacactc

SEQ ID NO: 242991 - DNA, 20 bp, Artificial Sequence
  chemically synthesized
gatcacatggacacaggaag

SEQ ID NO: 242992 - DNA, 20 bp, Artificial Sequence
  chemically synthesized
agatcacatggacacaggaa

SEQ ID NO: 242993 - DNA, 20 bp, Artificial Sequence
  chemically synthesized
gagatcacatggacacagga

SEQ ID NO: 242994 - DNA, 20 bp, Artificial Sequence
  chemically synthesized
tgagatcacatggacacagg

SEQ ID NO: 242995 - DNA, 20 bp, Artificial Sequence
  chemically synthesized
caatgagatcacatggacac

SEQ ID NO: 242996 - DNA, 20 bp, Artificial Sequence
  chemically synthesized
acaatgagatcacatggaca

SEQ ID NO: 242997 - DNA, 20 bp, Artificial Sequence
  chemically synthesized
aattgaacaatgagatcaca

SEQ ID NO: 242998 - DNA, 20 bp, Artificial Sequence
  chemically synthesized
tggggtgggaattgaacaat

SEQ ID NO: 242999 - DNA, 20 bp, Artificial Sequence
  chemically synthesized
ttctcactcataggtggggt

SEQ ID NO: 243000 - DNA, 20 bp, Artificial Sequence
  chemically synthesized
attctcactcataggtgggg

SEQ ID NO: 243001 - DNA, 20 bp, Artificial Sequence
  chemically synthesized
tcaattcccaccccacctat

SEQ ID NO: 243002 - DNA, 20 bp, Artificial Sequence
  chemically synthesized
catattctcactcataggtg

SEQ ID NO: 243003 - DNA, 20 bp, Artificial Sequence
  chemically synthesized
gcatattctcactcataggt

SEQ ID NO: 243004 - DNA, 20 bp, Artificial Sequence
  chemically synthesized
tgcatattctcactcatagg

SEQ ID NO: 243005 - DNA, 20 bp, Artificial Sequence
  chemically synthesized
ttcccaccccacctatgagt

SEQ ID NO: 243006 - DNA, 20 bp, Artificial Sequence
  chemically synthesized
cactgcatattctcactcat

SEQ ID NO: 243007 - DNA, 20 bp, Artificial Sequence
  chemically synthesized
acactgcatattctcactca

SEQ ID NO: 243008 - DNA, 20 bp, Artificial Sequence
  chemically synthesized
cacctatgagtgagaatatg

SEQ ID NO: 243009 - DNA, 20 bp, Artificial Sequence
  chemically synthesized
gagtgagaatatgcagtgtt

SEQ ID NO: 243010 - DNA, 20 bp, Artificial Sequence
  chemically synthesized
ttggttttttgttcttgcga

SEQ ID NO: 243011 - DNA, 20 bp, Artificial Sequence
  chemically synthesized
cattctcagtaaactatcgc

SEQ ID NO: 243012 - DNA, 20 bp, Artificial Sequence
  chemically synthesized
tgttcttgcgatagtttact

SEQ ID NO: 243013 - DNA, 20 bp, Artificial Sequence
  chemically synthesized
cgatagtttactgagaatga

SEQ ID NO: 243014 - DNA, 20 bp, Artificial Sequence
  chemically synthesized
aaactggaaaccgtcattct

SEQ ID NO: 243015 - DNA, 20 bp, Artificial Sequence
  chemically synthesized
ttactgagaatgacggtttc

SEQ ID NO: 243016 - DNA, 20 bp, Artificial Sequence
  chemically synthesized
tgtagggacatggatgaaac

SEQ ID NO: 243017 - DNA, 20 bp, Artificial Sequence
  chemically synthesized
tcatgtcctttgtagggaca

SEQ ID NO: 243018 - DNA, 20 bp, Artificial Sequence
  chemically synthesized
gtttcatccatgtccctaca

SEQ ID NO: 243019 - DNA, 20 bp, Artificial Sequence
  chemically synthesized
tttcatccatgtccctacaa

SEQ ID NO: 243020 - DNA, 20 bp, Artificial Sequence
  chemically synthesized
atgagttcatgtcctttgta

SEQ ID NO: 243021 - DNA, 20 bp, Artificial Sequence
  chemically synthesized
gatgagttcatgtcctttgt

SEQ ID NO: 243022 - DNA, 20 bp, Artificial Sequence
  chemically synthesized
tgatgagttcatgtcctttg

SEQ ID NO: 243023 - DNA, 20 bp, Artificial Sequence
  chemically synthesized
atgcagccagaaaaaatgat

SEQ ID NO: 243024 - DNA, 20 bp, Artificial Sequence
  chemically synthesized
catgaactcatcattttttc

SEQ ID NO: 243025 - DNA, 20 bp, Artificial Sequence
  chemically synthesized
catcattttttctggctgca

SEQ ID NO: 243026 - DNA, 20 bp, Artificial Sequence
  chemically synthesized
accatggaatactatgcagc

SEQ ID NO: 243027 - DNA, 20 bp, Artificial Sequence
  chemically synthesized
atacaccatggaatactatg

SEQ ID NO: 243028 - DNA, 20 bp, Artificial Sequence
  chemically synthesized
tctggctgcatagtattcca

SEQ ID NO: 243029 - DNA, 20 bp, Artificial Sequence
  chemically synthesized
aatgtggcacatatacacca

SEQ ID NO: 243030 - DNA, 20 bp, Artificial Sequence
  chemically synthesized
tagactggattaagaaaatg

SEQ ID NO: 243031 - DNA, 20 bp, Artificial Sequence
  chemically synthesized
tgtgccacattttcttaatc

SEQ ID NO: 243032 - DNA, 20 bp, Artificial Sequence
  chemically synthesized
caacaatgatagactggatt

SEQ ID NO: 243033 - DNA, 20 bp, Artificial Sequence
  chemically synthesized
aatgtccaacaatgatagac

SEQ ID NO: 243034 - DNA, 20 bp, Artificial Sequence
  chemically synthesized
ttaatccagtctatcattgt

SEQ ID NO: 243035 - DNA, 20 bp, Artificial Sequence
  chemically synthesized
acccaaatgtccaacaatga

SEQ ID NO: 243036 - DNA, 20 bp, Artificial Sequence
  chemically synthesized
gtctatcattgttggacatt

SEQ ID NO: 243037 - DNA, 20 bp, Artificial Sequence
  chemically synthesized
tctatcattgttggacattt

SEQ ID NO: 243038 - DNA, 20 bp, Artificial Sequence
  chemically synthesized
tcattgttggacatttgggt

SEQ ID NO: 243039 - DNA, 20 bp, Artificial Sequence
  chemically synthesized
tggacatttgggttggttcc

SEQ ID NO: 243040 - DNA, 20 bp, Artificial Sequence
  chemically synthesized
tattcacaataacaaagact

SEQ ID NO: 243041 - DNA, 20 bp, Artificial Sequence
  chemically synthesized
cagcactattcacaataaca

SEQ ID NO: 243042 - DNA, 20 bp, Artificial Sequence
  chemically synthesized
caagtctttgttattgtgaa

SEQ ID NO: 243043 - DNA, 20 bp, Artificial Sequence
  chemically synthesized
atgcacacgtatgtttattg

SEQ ID NO: 243044 - DNA, 20 bp, Artificial Sequence
  chemically synthesized
tacgtgtgcatgtgtcttta

SEQ ID NO: 243045 - DNA, 20 bp, Artificial Sequence
  chemically synthesized
gtgtgcatgtgtctttatag

SEQ ID NO: 243046 - DNA, 20 bp, Artificial Sequence
  chemically synthesized
ctataaatcatgctgctata

SEQ ID NO: 243047 - DNA, 20 bp, Artificial Sequence
  chemically synthesized
ctttatagcagcatgattta

SEQ ID NO: 243048 - DNA, 20 bp, Artificial Sequence
  chemically synthesized
cagcatgatttatagtcctt

SEQ ID NO: 243049 - DNA, 20 bp, Artificial Sequence
  chemically synthesized
agcatgatttatagtccttt

SEQ ID NO: 243050 - DNA, 20 bp, Artificial Sequence
  chemically synthesized
attactgggtatatacccaa

SEQ ID NO: 243051 - DNA, 20 bp, Artificial Sequence
  chemically synthesized
cattactgggtatataccca

SEQ ID NO: 243052 - DNA, 20 bp, Artificial Sequence
  chemically synthesized
tagtcctttgggtatatacc

SEQ ID NO: 243053 - DNA, 20 bp, Artificial Sequence
  chemically synthesized
tttgggtatatacccagtaa

SEQ ID NO: 243054 - DNA, 20 bp, Artificial Sequence
  chemically synthesized
ttgggtatatacccagtaat

SEQ ID NO: 243055 - DNA, 20 bp, Artificial Sequence
  chemically synthesized
gacccagccatcccattact

SEQ ID NO: 243056 - DNA, 20 bp, Artificial Sequence
  chemically synthesized
tgacccagccatcccattac

SEQ ID NO: 243057 - DNA, 20 bp, Artificial Sequence
  chemically synthesized
gtatatacccagtaatggga

SEQ ID NO: 243058 - DNA, 20 bp, Artificial Sequence
  chemically synthesized
atacccagtaatgggatggc

SEQ ID NO: 243059 - DNA, 20 bp, Artificial Sequence
  chemically synthesized
tacccagtaatgggatggct

SEQ ID NO: 243060 - DNA, 20 bp, Artificial Sequence
  chemically synthesized
aatgggatggctgggtcaaa

SEQ ID NO: 243061 - DNA, 20 bp, Artificial Sequence
  chemically synthesized
actagaaataccatttgacc

SEQ ID NO: 243062 - DNA, 20 bp, Artificial Sequence
  chemically synthesized
gctgggtcaaatggtatttc

SEQ ID NO: 243063 - DNA, 20 bp, Artificial Sequence
  chemically synthesized
tcaaatggtatttctagttc

SEQ ID NO: 243064 - DNA, 20 bp, Artificial Sequence
  chemically synthesized
attcctcagggatctagaac

SEQ ID NO: 243065 - DNA, 20 bp, Artificial Sequence
  chemically synthesized
atttctagttctagatccct

SEQ ID NO: 243066 - DNA, 20 bp, Artificial Sequence
  chemically synthesized
gtggcgattcctcagggatc

SEQ ID NO: 243067 - DNA, 20 bp, Artificial Sequence
  chemically synthesized
tttctagttctagatccctg

SEQ ID NO: 243068 - DNA, 20 bp, Artificial Sequence
  chemically synthesized
gtcagtgtggcgattcctca

SEQ ID NO: 243069 - DNA, 20 bp, Artificial Sequence
  chemically synthesized
agtcagtgtggcgattcctc

SEQ ID NO: 243070 - DNA, 20 bp, Artificial Sequence
  chemically synthesized
aagtcagtgtggcgattcct

SEQ ID NO: 243071 - DNA, 20 bp, Artificial Sequence
  chemically synthesized
aaccattgtggaagtcagtg

SEQ ID NO: 243072 - DNA, 20 bp, Artificial Sequence
  chemically synthesized
agttcaaccattgtggaagt

SEQ ID NO: 243073 - DNA, 20 bp, Artificial Sequence
  chemically synthesized
cgccacactgacttccacaa

SEQ ID NO: 243074 - DNA, 20 bp, Artificial Sequence
  chemically synthesized
aactagttcaaccattgtgg

SEQ ID NO: 243075 - DNA, 20 bp, Artificial Sequence
  chemically synthesized
gtaaactagttcaaccattg

SEQ ID NO: 243076 - DNA, 20 bp, Artificial Sequence
  chemically synthesized
gacttccacaatggttgaac

SEQ ID NO: 243077 - DNA, 20 bp, Artificial Sequence
  chemically synthesized
acaatggttgaactagttta

SEQ ID NO: 243078 - DNA, 20 bp, Artificial Sequence
  chemically synthesized
ctgttggtgggactgtaaac

SEQ ID NO: 243079 - DNA, 20 bp, Artificial Sequence
  chemically synthesized
ctagtttacagtcccaccaa

SEQ ID NO: 243080 - DNA, 20 bp, Artificial Sequence
  chemically synthesized
aacacttttacactgttggt

SEQ ID NO: 243081 - DNA, 20 bp, Artificial Sequence
  chemically synthesized
gaacacttttacactgttgg

SEQ ID NO: 243082 - DNA, 20 bp, Artificial Sequence
  chemically synthesized
taggaacacttttacactgt

SEQ ID NO: 243083 - DNA, 20 bp, Artificial Sequence
  chemically synthesized
cagtcccaccaacagtgtaa

SEQ ID NO: 243084 - DNA, 20 bp, Artificial Sequence
  chemically synthesized
tggagaggatgtggagaaat

SEQ ID NO: 243085 - DNA, 20 bp, Artificial Sequence
  chemically synthesized
ctggagaggatgtggagaaa

SEQ ID NO: 243086 - DNA, 20 bp, Artificial Sequence
  chemically synthesized
caggtgctggagaggatgtg

SEQ ID NO: 243087 - DNA, 20 bp, Artificial Sequence
  chemically synthesized
aacaggtgctggagaggatg

SEQ ID NO: 243088 - DNA, 20 bp, Artificial Sequence
  chemically synthesized
ctatttctccacatcctctc

SEQ ID NO: 243089 - DNA, 20 bp, Artificial Sequence
  chemically synthesized
ggaaacaacaggtgctggag

SEQ ID NO: 243090 - DNA, 20 bp, Artificial Sequence
  chemically synthesized
aggaaacaacaggtgctgga

SEQ ID NO: 243091 - DNA, 20 bp, Artificial Sequence
  chemically synthesized
tcaggaaacaacaggtgctg

SEQ ID NO: 243092 - DNA, 20 bp, Artificial Sequence
  chemically synthesized
agtcaggaaacaacaggtgc

SEQ ID NO: 243093 - DNA, 20 bp, Artificial Sequence
  chemically synthesized
ttcaaaagtcaggaaacaac

SEQ ID NO: 243094 - DNA, 20 bp, Artificial Sequence
  chemically synthesized
attcaaaagtcaggaaacaa

SEQ ID NO: 243095 - DNA, 20 bp, Artificial Sequence
  chemically synthesized
atggcaatcattcaaaagtc

SEQ ID NO: 243096 - DNA, 20 bp, Artificial Sequence
  chemically synthesized
aatggcaatcattcaaaagt

SEQ ID NO: 243097 - DNA, 20 bp, Artificial Sequence
  chemically synthesized
ttagaatggcaatcattcaa

SEQ ID NO: 243098 - DNA, 20 bp, Artificial Sequence
  chemically synthesized
tgaatgattgccattctaac

SEQ ID NO: 243099 - DNA, 20 bp, Artificial Sequence
  chemically synthesized
tcatctcacaccagttagaa

SEQ ID NO: 243100 - DNA, 20 bp, Artificial Sequence
  chemically synthesized
agatatcatctcacaccagt

SEQ ID NO: 243101 - DNA, 20 bp, Artificial Sequence
  chemically synthesized
attgccattctaactggtgt

SEQ ID NO: 243102 - DNA, 20 bp, Artificial Sequence
  chemically synthesized
tatgagatatcatctcacac

SEQ ID NO: 243103 - DNA, 20 bp, Artificial Sequence
  chemically synthesized
tggtgtgagatgatatctca

SEQ ID NO: 243104 - DNA, 20 bp, Artificial Sequence
  chemically synthesized
tgtgagatgatatctcatag

SEQ ID NO: 243105 - DNA, 20 bp, Artificial Sequence
  chemically synthesized
atgcaaatcaaaaccactat

SEQ ID NO: 243106 - DNA, 20 bp, Artificial Sequence
  chemically synthesized
tttgatttgcattactctga

SEQ ID NO: 243107 - DNA, 20 bp, Artificial Sequence
  chemically synthesized
atttgcattactctgatggc

SEQ ID NO: 243108 - DNA, 20 bp, Artificial Sequence
  chemically synthesized
ctcaccatcactggccatca

SEQ ID NO: 243109 - DNA, 20 bp, Artificial Sequence
  chemically synthesized
tcctcaccatcactggccat

SEQ ID NO: 243110 - DNA, 20 bp, Artificial Sequence
  chemically synthesized
attactctgatggccagtga

SEQ ID NO: 243111 - DNA, 20 bp, Artificial Sequence
  chemically synthesized
gaaaaaatcctcaccatcac

SEQ ID NO: 243112 - DNA, 20 bp, Artificial Sequence
  chemically synthesized
ctctgatggccagtgatggt

SEQ ID NO: 243113 - DNA, 20 bp, Artificial Sequence
  chemically synthesized
tctgatggccagtgatggtg

SEQ ID NO: 243114 - DNA, 20 bp, Artificial Sequence
  chemically synthesized
ggattttttcatgtgttttt

SEQ ID NO: 243115 - DNA, 20 bp, Artificial Sequence
  chemically synthesized
ctcaaaagaagacatttatg

SEQ ID NO: 243116 - DNA, 20 bp, Artificial Sequence
  chemically synthesized
ctgcataaatgtcttctttt

SEQ ID NO: 243117 - DNA, 20 bp, Artificial Sequence
  chemically synthesized
gaacagacacttctcaaaag

SEQ ID NO: 243118 - DNA, 20 bp, Artificial Sequence
  chemically synthesized
cataaatgtcttcttttgag

SEQ ID NO: 243119 - DNA, 20 bp, Artificial Sequence
  chemically synthesized
catgaacagacacttctcaa

SEQ ID NO: 243120 - DNA, 20 bp, Artificial Sequence
  chemically synthesized
aagtgagcgaaggacatgaa

SEQ ID NO: 243121 - DNA, 20 bp, Artificial Sequence
  chemically synthesized
ccccatcaaaaagtgagcga

SEQ ID NO: 243122 - DNA, 20 bp, Artificial Sequence
  chemically synthesized
accccatcaaaaagtgagcg

SEQ ID NO: 243123 - DNA, 20 bp, Artificial Sequence
  chemically synthesized
aaacaaccccatcaaaaagt

SEQ ID NO: 243124 - DNA, 20 bp, Artificial Sequence
  chemically synthesized
gtccttcgctcactttttga

SEQ ID NO: 243125 - DNA, 20 bp, Artificial Sequence
  chemically synthesized
tccttcgctcactttttgat

SEQ ID NO: 243126 - DNA, 20 bp, Artificial Sequence
  chemically synthesized
ccttcgctcactttttgatg

SEQ ID NO: 243127 - DNA, 20 bp, Artificial Sequence
  chemically synthesized
aaacaaacaaccccatcaaa

SEQ ID NO: 243128 - DNA, 20 bp, Artificial Sequence
  chemically synthesized
atgaactcaaacaaatttac

SEQ ID NO: 243129 - DNA, 20 bp, Artificial Sequence
  chemically synthesized
tttttcttgtaaatttgttt

SEQ ID NO: 243130 - DNA, 20 bp, Artificial Sequence
  chemically synthesized
aaatttgtttgagttcattg

SEQ ID NO: 243131 - DNA, 20 bp, Artificial Sequence
  chemically synthesized
tttgagttcattgtagattc

SEQ ID NO: 243132 - DNA, 20 bp, Artificial Sequence
  chemically synthesized
tcattgtagattctggatat

SEQ ID NO: 243133 - DNA, 20 bp, Artificial Sequence
  chemically synthesized
tctgacaaagggctaatatc

SEQ ID NO: 243134 - DNA, 20 bp, Artificial Sequence
  chemically synthesized
tctggatattagccctttgt

SEQ ID NO: 243135 - DNA, 20 bp, Artificial Sequence
  chemically synthesized
caacctactcatctgacaaa

SEQ ID NO: 243136 - DNA, 20 bp, Artificial Sequence
  chemically synthesized
gcaacctactcatctgacaa

SEQ ID NO: 243137 - DNA, 20 bp, Artificial Sequence
  chemically synthesized
cgcaacctactcatctgaca

SEQ ID NO: 243138 - DNA, 20 bp, Artificial Sequence
  chemically synthesized
atattagccctttgtcagat

SEQ ID NO: 243139 - DNA, 20 bp, Artificial Sequence
  chemically synthesized
ttagccctttgtcagatgag

SEQ ID NO: 243140 - DNA, 20 bp, Artificial Sequence
  chemically synthesized
tagccctttgtcagatgagt

SEQ ID NO: 243141 - DNA, 20 bp, Artificial Sequence
  chemically synthesized
acagggaacctacaacatgg

SEQ ID NO: 243142 - DNA, 20 bp, Artificial Sequence
  chemically synthesized
gaaaattttctcccatgttg

SEQ ID NO: 243143 - DNA, 20 bp, Artificial Sequence
  chemically synthesized
aaaattttctcccatgttgt

SEQ ID NO: 243144 - DNA, 20 bp, Artificial Sequence
  chemically synthesized
gaacagggaacctacaacat

SEQ ID NO: 243145 - DNA, 20 bp, Artificial Sequence
  chemically synthesized
tgaacagggaacctacaaca

SEQ ID NO: 243146 - DNA, 20 bp, Artificial Sequence
  chemically synthesized
aactaccatcagagtgaaca

SEQ ID NO: 243147 - DNA, 20 bp, Artificial Sequence
  chemically synthesized
aaactaccatcagagtgaac

SEQ ID NO: 243148 - DNA, 20 bp, Artificial Sequence
  chemically synthesized
gaaactaccatcagagtgaa

SEQ ID NO: 243149 - DNA, 20 bp, Artificial Sequence
  chemically synthesized
aggttccctgttcactctga

SEQ ID NO: 243150 - DNA, 20 bp, Artificial Sequence
  chemically synthesized
ttccctgttcactctgatgg

SEQ ID NO: 243151 - DNA, 20 bp, Artificial Sequence
  chemically synthesized
agcaaaagaaactaccatca

SEQ ID NO: 243152 - DNA, 20 bp, Artificial Sequence
  chemically synthesized
acagcaaaagaaactaccat

SEQ ID NO: 243153 - DNA, 20 bp, Artificial Sequence
  chemically synthesized
aaagagcttctgcacagcaa

SEQ ID NO: 243154 - DNA, 20 bp, Artificial Sequence
  chemically synthesized
tggtagtttcttttgctgtg

SEQ ID NO: 243155 - DNA, 20 bp, Artificial Sequence
  chemically synthesized
tagtttcttttgctgtgcag

SEQ ID NO: 243156 - DNA, 20 bp, Artificial Sequence
  chemically synthesized
taaactaaagagcttctgca

SEQ ID NO: 243157 - DNA, 20 bp, Artificial Sequence
  chemically synthesized
tttgctgtgcagaagctctt

SEQ ID NO: 243158 - DNA, 20 bp, Artificial Sequence
  chemically synthesized
tgggatctaattaaactaaa

SEQ ID NO: 243159 - DNA, 20 bp, Artificial Sequence
  chemically synthesized
aatgggatctaattaaacta

SEQ ID NO: 243160 - DNA, 20 bp, Artificial Sequence
  chemically synthesized
cagaagctctttagtttaat

SEQ ID NO: 243161 - DNA, 20 bp, Artificial Sequence
  chemically synthesized
aaaagccaaaattgacaaat

SEQ ID NO: 243162 - DNA, 20 bp, Artificial Sequence
  chemically synthesized
caaaagccaaaattgacaaa

SEQ ID NO: 243163 - DNA, 20 bp, Artificial Sequence
  chemically synthesized
tagatcccatttgtcaattt

SEQ ID NO: 243164 - DNA, 20 bp, Artificial Sequence
  chemically synthesized
accaaaagcaatggcaacaa

SEQ ID NO: 243165 - DNA, 20 bp, Artificial Sequence
  chemically synthesized
gcttttgttgccattgcttt

SEQ ID NO: 243166 - DNA, 20 bp, Artificial Sequence
  chemically synthesized
gtccaaaacaccaaaagcaa

SEQ ID NO: 243167 - DNA, 20 bp, Artificial Sequence
  chemically synthesized
cttcatgtccaaaacaccaa

SEQ ID NO: 243168 - DNA, 20 bp, Artificial Sequence
  chemically synthesized
tgccattgcttttggtgttt

SEQ ID NO: 243169 - DNA, 20 bp, Artificial Sequence
  chemically synthesized
cttttggtgttttggacatg

SEQ ID NO: 243170 - DNA, 20 bp, Artificial Sequence
  chemically synthesized
tcaggacataggcatgggca

SEQ ID NO: 243171 - DNA, 20 bp, Artificial Sequence
  chemically synthesized
ttcaggacataggcatgggc

SEQ ID NO: 243172 - DNA, 20 bp, Artificial Sequence
  chemically synthesized
accattcaggacataggcat

SEQ ID NO: 243173 - DNA, 20 bp, Artificial Sequence
  chemically synthesized
taccattcaggacataggca

SEQ ID NO: 243174 - DNA, 20 bp, Artificial Sequence
  chemically synthesized
ggcattaccattcaggacat

SEQ ID NO: 243175 - DNA, 20 bp, Artificial Sequence
  chemically synthesized
aggcattaccattcaggaca

SEQ ID NO: 243176 - DNA, 20 bp, Artificial Sequence
  chemically synthesized
gcccatgcctatgtcctgaa

SEQ ID NO: 243177 - DNA, 20 bp, Artificial Sequence
  chemically synthesized
aaacctaggcattaccattc

SEQ ID NO: 243178 - DNA, 20 bp, Artificial Sequence
  chemically synthesized
aaaacctaggcattaccatt

SEQ ID NO: 243179 - DNA, 20 bp, Artificial Sequence
  chemically synthesized
atgtcctgaatggtaatgcc

SEQ ID NO: 243180 - DNA, 20 bp, Artificial Sequence
  chemically synthesized
tgtcctgaatggtaatgcct

SEQ ID NO: 243181 - DNA, 20 bp, Artificial Sequence
  chemically synthesized
aaaaccctagaagaaaacct

SEQ ID NO: 243182 - DNA, 20 bp, Artificial Sequence
  chemically synthesized
aaaaaccctagaagaaaacc

SEQ ID NO: 243183 - DNA, 20 bp, Artificial Sequence
  chemically synthesized
gtaatgcctaggttttcttc

SEQ ID NO: 243184 - DNA, 20 bp, Artificial Sequence
  chemically synthesized
taatgcctaggttttcttct

SEQ ID NO: 243185 - DNA, 20 bp, Artificial Sequence
  chemically synthesized
aatgcctaggttttcttcta

SEQ ID NO: 243186 - DNA, 20 bp, Artificial Sequence
  chemically synthesized
taaaaccataaaaaccctag

SEQ ID NO: 243187 - DNA, 20 bp, Artificial Sequence
  chemically synthesized
acctaaaaccataaaaaccc

SEQ ID NO: 243188 - DNA, 20 bp, Artificial Sequence
  chemically synthesized
gttttcttctagggttttta

SEQ ID NO: 243189 - DNA, 20 bp, Artificial Sequence
  chemically synthesized
ttctagggtttttatggttt

SEQ ID NO: 243190 - DNA, 20 bp, Artificial Sequence
  chemically synthesized
tctagggtttttatggtttt

SEQ ID NO: 243191 - DNA, 20 bp, Artificial Sequence
  chemically synthesized
tggattaaagatttaaacat

SEQ ID NO: 243192 - DNA, 20 bp, Artificial Sequence
  chemically synthesized
aatcaattcaagatggatta

SEQ ID NO: 243193 - DNA, 20 bp, Artificial Sequence
  chemically synthesized
atacaaaaatcaattcaaga

SEQ ID NO: 243194 - DNA, 20 bp, Artificial Sequence
  chemically synthesized
ccttatacaaaaatcaattc

SEQ ID NO: 243195 - DNA, 20 bp, Artificial Sequence
  chemically synthesized
tcttgaattgatttttgtat

SEQ ID NO: 243196 - DNA, 20 bp, Artificial Sequence
  chemically synthesized
cttgaattgatttttgtata

SEQ ID NO: 243197 - DNA, 20 bp, Artificial Sequence
  chemically synthesized
ttgatttttgtataaggtgt

SEQ ID NO: 243198 - DNA, 20 bp, Artificial Sequence
  chemically synthesized
tgatttttgtataaggtgta

SEQ ID NO: 243199 - DNA, 20 bp, Artificial Sequence
  chemically synthesized
tttttgtataaggtgtaagg

SEQ ID NO: 243200 - DNA, 20 bp, Artificial Sequence
  chemically synthesized
ttttgtataaggtgtaagga

SEQ ID NO: 243201 - DNA, 20 bp, Artificial Sequence
  chemically synthesized
tttgtataaggtgtaaggaa

SEQ ID NO: 243202 - DNA, 20 bp, Artificial Sequence
  chemically synthesized
taaggtgtaaggaagggatc

SEQ ID NO: 243203 - DNA, 20 bp, Artificial Sequence
  chemically synthesized
gtaaggaagggatccagttt

SEQ ID NO: 243204 - DNA, 20 bp, Artificial Sequence
  chemically synthesized
catatgtagaaagctgaaac

SEQ ID NO: 243205 - DNA, 20 bp, Artificial Sequence
  chemically synthesized
actggctagccatatgtaga

SEQ ID NO: 243206 - DNA, 20 bp, Artificial Sequence
  chemically synthesized
cagtttcagctttctacata

SEQ ID NO: 243207 - DNA, 20 bp, Artificial Sequence
  chemically synthesized
gaagactggctagccatatg

SEQ ID NO: 243208 - DNA, 20 bp, Artificial Sequence
  chemically synthesized
ttcagctttctacatatggc

SEQ ID NO: 243209 - DNA, 20 bp, Artificial Sequence
  chemically synthesized
gctttctacatatggctagc

SEQ ID NO: 243210 - DNA, 20 bp, Artificial Sequence
  chemically synthesized
atggtgctgggaagactggc

SEQ ID NO: 243211 - DNA, 20 bp, Artificial Sequence
  chemically synthesized
atatggctagccagtcttcc

SEQ ID NO: 243212 - DNA, 20 bp, Artificial Sequence
  chemically synthesized
ataaatggtgctgggaagac

SEQ ID NO: 243213 - DNA, 20 bp, Artificial Sequence
  chemically synthesized
atttaataaatggtgctggg

SEQ ID NO: 243214 - DNA, 20 bp, Artificial Sequence
  chemically synthesized
cctatttaataaatggtgct

SEQ ID NO: 243215 - DNA, 20 bp, Artificial Sequence
  chemically synthesized
ccctatttaataaatggtgc

SEQ ID NO: 243216 - DNA, 20 bp, Artificial Sequence
  chemically synthesized
aggattccctatttaataaa

SEQ ID NO: 243217 - DNA, 20 bp, Artificial Sequence
  chemically synthesized
tcccagcaccatttattaaa

SEQ ID NO: 243218 - DNA, 20 bp, Artificial Sequence
  chemically synthesized
cccagcaccatttattaaat

SEQ ID NO: 243219 - DNA, 20 bp, Artificial Sequence
  chemically synthesized
ccagcaccatttattaaata

SEQ ID NO: 243220 - DNA, 20 bp, Artificial Sequence
  chemically synthesized
ggaaaacaagcaatggggaa

SEQ ID NO: 243221 - DNA, 20 bp, Artificial Sequence
  chemically synthesized
aggaaaacaagcaatgggga

SEQ ID NO: 243222 - DNA, 20 bp, Artificial Sequence
  chemically synthesized
cctgaggaaaacaagcaatg

SEQ ID NO: 243223 - DNA, 20 bp, Artificial Sequence
  chemically synthesized
acctgaggaaaacaagcaat

SEQ ID NO: 243224 - DNA, 20 bp, Artificial Sequence
  chemically synthesized
aacctgaggaaaacaagcaa

SEQ ID NO: 243225 - DNA, 20 bp, Artificial Sequence
  chemically synthesized
ttgacaaacctgaggaaaac

SEQ ID NO: 243226 - DNA, 20 bp, Artificial Sequence
  chemically synthesized
tccccattgcttgttttcct

SEQ ID NO: 243227 - DNA, 20 bp, Artificial Sequence
  chemically synthesized
ccccattgcttgttttcctc

SEQ ID NO: 243228 - DNA, 20 bp, Artificial Sequence
  chemically synthesized
tctgatctttgacaaacctg

SEQ ID NO: 243229 - DNA, 20 bp, Artificial Sequence
  chemically synthesized
atctgatctttgacaaacct

SEQ ID NO: 243230 - DNA, 20 bp, Artificial Sequence
  chemically synthesized
tgttttcctcaggtttgtca

SEQ ID NO: 243231 - DNA, 20 bp, Artificial Sequence
  chemically synthesized
tcctcaggtttgtcaaagat

SEQ ID NO: 243232 - DNA, 20 bp, Artificial Sequence
  chemically synthesized
caggtttgtcaaagatcaga

SEQ ID NO: 243233 - DNA, 20 bp, Artificial Sequence
  chemically synthesized
tgtcaaagatcagatagttg

SEQ ID NO: 243234 - DNA, 20 bp, Artificial Sequence
  chemically synthesized
gtcaaagatcagatagttgt

SEQ ID NO: 243235 - DNA, 20 bp, Artificial Sequence
  chemically synthesized
atcagatagttgtaggtatg

SEQ ID NO: 243236 - DNA, 20 bp, Artificial Sequence
  chemically synthesized
aggtatgtggcgttatttct

SEQ ID NO: 243237 - DNA, 20 bp, Artificial Sequence
  chemically synthesized
ggtatgtggcgttatttctg

SEQ ID NO: 243238 - DNA, 20 bp, Artificial Sequence
  chemically synthesized
gtatgtggcgttatttctga

SEQ ID NO: 243239 - DNA, 20 bp, Artificial Sequence
  chemically synthesized
atggaacagaacagagccct

SEQ ID NO: 243240 - DNA, 20 bp, Artificial Sequence
  chemically synthesized
tagatcaatggaacagaaca

SEQ ID NO: 243241 - DNA, 20 bp, Artificial Sequence
  chemically synthesized
tatagatcaatggaacagaa

SEQ ID NO: 243242 - DNA, 20 bp, Artificial Sequence
  chemically synthesized
agagatatagatcaatggaa

SEQ ID NO: 243243 - DNA, 20 bp, Artificial Sequence
  chemically synthesized
aaaacagagatatagatcaa

SEQ ID NO: 243244 - DNA, 20 bp, Artificial Sequence
  chemically synthesized
ctggtaccaaaacagagata

SEQ ID NO: 243245 - DNA, 20 bp, Artificial Sequence
  chemically synthesized
attgatctatatctctgttt

SEQ ID NO: 243246 - DNA, 20 bp, Artificial Sequence
  chemically synthesized
atggtactggtaccaaaaca

SEQ ID NO: 243247 - DNA, 20 bp, Artificial Sequence
  chemically synthesized
gcatggtactggtaccaaaa

SEQ ID NO: 243248 - DNA, 20 bp, Artificial Sequence
  chemically synthesized
ctatatctctgttttggtac

SEQ ID NO: 243249 - DNA, 20 bp, Artificial Sequence
  chemically synthesized
taaccaaaacagcatggtac

SEQ ID NO: 243250 - DNA, 20 bp, Artificial Sequence
  chemically synthesized
ctacagtaaccaaaacagca

SEQ ID NO: 243251 - DNA, 20 bp, Artificial Sequence
  chemically synthesized
gtaccagtaccatgctgttt

SEQ ID NO: 243252 - DNA, 20 bp, Artificial Sequence
  chemically synthesized
caaggctacagtaaccaaaa

SEQ ID NO: 243253 - DNA, 20 bp, Artificial Sequence
  chemically synthesized
ccatgctgttttggttactg

SEQ ID NO: 243254 - DNA, 20 bp, Artificial Sequence
  chemically synthesized
caaactatactacaaggcta

SEQ ID NO: 243255 - DNA, 20 bp, Artificial Sequence
  chemically synthesized
ttttggttactgtagccttg

SEQ ID NO: 243256 - DNA, 20 bp, Artificial Sequence
  chemically synthesized
gttactgtagccttgtagta

SEQ ID NO: 243257 - DNA, 20 bp, Artificial Sequence
  chemically synthesized
tgacttcaaactatactaca

SEQ ID NO: 243258 - DNA, 20 bp, Artificial Sequence
  chemically synthesized
ctgacttcaaactatactac

SEQ ID NO: 243259 - DNA, 20 bp, Artificial Sequence
  chemically synthesized
tagccttgtagtatagtttg

SEQ ID NO: 243260 - DNA, 20 bp, Artificial Sequence
  chemically synthesized
cttgtagtatagtttgaagt

SEQ ID NO: 243261 - DNA, 20 bp, Artificial Sequence
  chemically synthesized
tagtatagtttgaagtcagc

SEQ ID NO: 243262 - DNA, 20 bp, Artificial Sequence
  chemically synthesized
caaagctggaggcatcacac

SEQ ID NO: 243263 - DNA, 20 bp, Artificial Sequence
  chemically synthesized
gtcagctagtgtgatgcctc

SEQ ID NO: 243264 - DNA, 20 bp, Artificial Sequence
  chemically synthesized
agccaaaagaacaaagctgg

SEQ ID NO: 243265 - DNA, 20 bp, Artificial Sequence
  chemically synthesized
aagccaaaagaacaaagctg

SEQ ID NO: 243266 - DNA, 20 bp, Artificial Sequence
  chemically synthesized
ctaagccaaaagaacaaagc

SEQ ID NO: 243267 - DNA, 20 bp, Artificial Sequence
  chemically synthesized
aatcctaagccaaaagaaca

SEQ ID NO: 243268 - DNA, 20 bp, Artificial Sequence
  chemically synthesized
tgcctccagctttgttcttt

SEQ ID NO: 243269 - DNA, 20 bp, Artificial Sequence
  chemically synthesized
ccagctttgttcttttggct

SEQ ID NO: 243270 - DNA, 20 bp, Artificial Sequence
  chemically synthesized
cagctttgttcttttggctt

SEQ ID NO: 243271 - DNA, 20 bp, Artificial Sequence
  chemically synthesized
ccaagtcaatcctaagccaa

SEQ ID NO: 243272 - DNA, 20 bp, Artificial Sequence
  chemically synthesized
cgcatcgccaagtcaatcct

SEQ ID NO: 243273 - DNA, 20 bp, Artificial Sequence
  chemically synthesized
cttttggcttaggattgact

SEQ ID NO: 243274 - DNA, 20 bp, Artificial Sequence
  chemically synthesized
ttaggattgacttggcgatg

SEQ ID NO: 243275 - DNA, 20 bp, Artificial Sequence
  chemically synthesized
aaaaaagagcccgcatcgcc

SEQ ID NO: 243276 - DNA, 20 bp, Artificial Sequence
  chemically synthesized
taggattgacttggcgatgc

SEQ ID NO: 243277 - DNA, 20 bp, Artificial Sequence
  chemically synthesized
tggcgatgcgggctcttttt

SEQ ID NO: 243278 - DNA, 20 bp, Artificial Sequence
  chemically synthesized
gttcatatggaaccaaaaaa

SEQ ID NO: 243279 - DNA, 20 bp, Artificial Sequence
  chemically synthesized
aagttcatatggaaccaaaa

SEQ ID NO: 243280 - DNA, 20 bp, Artificial Sequence
  chemically synthesized
aaactactttaaagttcata

SEQ ID NO: 243281 - DNA, 20 bp, Artificial Sequence
  chemically synthesized
ttggttccatatgaacttta

SEQ ID NO: 243282 - DNA, 20 bp, Artificial Sequence
  chemically synthesized
gttccatatgaactttaaag

SEQ ID NO: 243283 - DNA, 20 bp, Artificial Sequence
  chemically synthesized
aattggaaaaaactacttta

SEQ ID NO: 243284 - DNA, 20 bp, Artificial Sequence
  chemically synthesized
aatgcctttcttcacagaat

SEQ ID NO: 243285 - DNA, 20 bp, Artificial Sequence
  chemically synthesized
tagttttttccaattctgtg

SEQ ID NO: 243286 - DNA, 20 bp, Artificial Sequence
  chemically synthesized
tttttccaattctgtgaaga

SEQ ID NO: 243287 - DNA, 20 bp, Artificial Sequence
  chemically synthesized
ttttccaattctgtgaagaa

SEQ ID NO: 243288 - DNA, 20 bp, Artificial Sequence
  chemically synthesized
gctaccaatgcctttcttca

SEQ ID NO: 243289 - DNA, 20 bp, Artificial Sequence
  chemically synthesized
aattctgtgaagaaaggcat

SEQ ID NO: 243290 - DNA, 20 bp, Artificial Sequence
  chemically synthesized
tctgtgaagaaaggcattgg

SEQ ID NO: 243291 - DNA, 20 bp, Artificial Sequence
  chemically synthesized
gaaaggcattggtagcttga

SEQ ID NO: 243292 - DNA, 20 bp, Artificial Sequence
  chemically synthesized
aaaggcattggtagcttgat

SEQ ID NO: 243293 - DNA, 20 bp, Artificial Sequence
  chemically synthesized
aaggcattggtagcttgatg

SEQ ID NO: 243294 - DNA, 20 bp, Artificial Sequence
  chemically synthesized
gattcaatgccatccccatc

SEQ ID NO: 243295 - DNA, 20 bp, Artificial Sequence
  chemically synthesized
cattggtagcttgatgggga

SEQ ID NO: 243296 - DNA, 20 bp, Artificial Sequence
  chemically synthesized
atactgcccaaggtgattta

SEQ ID NO: 243297 - DNA, 20 bp, Artificial Sequence
  chemically synthesized
attgaatctgtaaatcacct

SEQ ID NO: 243298 - DNA, 20 bp, Artificial Sequence
  chemically synthesized
ttgaatctgtaaatcacctt

SEQ ID NO: 243299 - DNA, 20 bp, Artificial Sequence
  chemically synthesized
aatctgtaaatcaccttggg

SEQ ID NO: 243300 - DNA, 20 bp, Artificial Sequence
  chemically synthesized
gaaaatggccatactgccca

SEQ ID NO: 243301 - DNA, 20 bp, Artificial Sequence
  chemically synthesized
tgaaaatggccatactgccc

SEQ ID NO: 243302 - DNA, 20 bp, Artificial Sequence
  chemically synthesized
gtaaatcaccttgggcagta

SEQ ID NO: 243303 - DNA, 20 bp, Artificial Sequence
  chemically synthesized
aagaatcaatatcgtgaaaa

SEQ ID NO: 243304 - DNA, 20 bp, Artificial Sequence
  chemically synthesized
attccatgctcatgggtagg

SEQ ID NO: 243305 - DNA, 20 bp, Artificial Sequence
  chemically synthesized
tattgattcttcctacccat

SEQ ID NO: 243306 - DNA, 20 bp, Artificial Sequence
  chemically synthesized
aacattccatgctcatgggt

SEQ ID NO: 243307 - DNA, 20 bp, Artificial Sequence
  chemically synthesized
gaacattccatgctcatggg

SEQ ID NO: 243308 - DNA, 20 bp, Artificial Sequence
  chemically synthesized
attcttcctacccatgagca

SEQ ID NO: 243309 - DNA, 20 bp, Artificial Sequence
  chemically synthesized
gaagaacattccatgctcat

SEQ ID NO: 243310 - DNA, 20 bp, Artificial Sequence
  chemically synthesized
ggaagaacattccatgctca

SEQ ID NO: 243311 - DNA, 20 bp, Artificial Sequence
  chemically synthesized
aagaggatacaaacaaatgg

SEQ ID NO: 243312 - DNA, 20 bp, Artificial Sequence
  chemically synthesized
taaaagaggatacaaacaaa

SEQ ID NO: 243313 - DNA, 20 bp, Artificial Sequence
  chemically synthesized
actgctcaaggaaataaaag

SEQ ID NO: 243314 - DNA, 20 bp, Artificial Sequence
  chemically synthesized
cactgctcaaggaaataaaa

SEQ ID NO: 243315 - DNA, 20 bp, Artificial Sequence
  chemically synthesized
accactgctcaaggaaataa

SEQ ID NO: 243316 - DNA, 20 bp, Artificial Sequence
  chemically synthesized
gtatcctcttttatttcctt

SEQ ID NO: 243317 - DNA, 20 bp, Artificial Sequence
  chemically synthesized
tcctcttttatttccttgag

SEQ ID NO: 243318 - DNA, 20 bp, Artificial Sequence
  chemically synthesized
tcttttatttccttgagcag

SEQ ID NO: 243319 - DNA, 20 bp, Artificial Sequence
  chemically synthesized
gaactacaaaccactgctca

SEQ ID NO: 243320 - DNA, 20 bp, Artificial Sequence
  chemically synthesized
agaactacaaaccactgctc

SEQ ID NO: 243321 - DNA, 20 bp, Artificial Sequence
  chemically synthesized
tttccttgagcagtggtttg

SEQ ID NO: 243322 - DNA, 20 bp, Artificial Sequence
  chemically synthesized
gtggtttgtagttctccttg

SEQ ID NO: 243323 - DNA, 20 bp, Artificial Sequence
  chemically synthesized
ggtttgtagttctccttgaa

SEQ ID NO: 243324 - DNA, 20 bp, Artificial Sequence
  chemically synthesized
gtttgtagttctccttgaag

SEQ ID NO: 243325 - DNA, 20 bp, Artificial Sequence
  chemically synthesized
atgtgaaggacctcttcaag

SEQ ID NO: 243326 - DNA, 20 bp, Artificial Sequence
  chemically synthesized
ggatgtgaaggacctcttca

SEQ ID NO: 243327 - DNA, 20 bp, Artificial Sequence
  chemically synthesized
gggatgtgaaggacctcttc

SEQ ID NO: 243328 - DNA, 20 bp, Artificial Sequence
  chemically synthesized
ccaacttacaagggatgtga

SEQ ID NO: 243329 - DNA, 20 bp, Artificial Sequence
  chemically synthesized
tccaacttacaagggatgtg

SEQ ID NO: 243330 - DNA, 20 bp, Artificial Sequence
  chemically synthesized
aggtccttcacatcccttgt

SEQ ID NO: 243331 - DNA, 20 bp, Artificial Sequence
  chemically synthesized
cctaggaatccaacttacaa

SEQ ID NO: 243332 - DNA, 20 bp, Artificial Sequence
  chemically synthesized
ccttcacatcccttgtaagt

SEQ ID NO: 243333 - DNA, 20 bp, Artificial Sequence
  chemically synthesized
acctaggaatccaacttaca

SEQ ID NO: 243334 - DNA, 20 bp, Artificial Sequence
  chemically synthesized
tacctaggaatccaacttac

SEQ ID NO: 243335 - DNA, 20 bp, Artificial Sequence
  chemically synthesized
tcccttgtaagttggattcc

SEQ ID NO: 243336 - DNA, 20 bp, Artificial Sequence
  chemically synthesized
cccttgtaagttggattcct

SEQ ID NO: 243337 - DNA, 20 bp, Artificial Sequence
  chemically synthesized
tcaaagagaataaaatacct

SEQ ID NO: 243338 - DNA, 20 bp, Artificial Sequence
  chemically synthesized
ttcaaagagaataaaatacc

SEQ ID NO: 243339 - DNA, 20 bp, Artificial Sequence
  chemically synthesized
taggtattttattctctttg

SEQ ID NO: 243340 - DNA, 20 bp, Artificial Sequence
  chemically synthesized
ccattcacaattgcttcaaa

SEQ ID NO: 243341 - DNA, 20 bp, Artificial Sequence
  chemically synthesized
tcccattcacaattgcttca

SEQ ID NO: 243342 - DNA, 20 bp, Artificial Sequence
  chemically synthesized
ctctttgaagcaattgtgaa

SEQ ID NO: 243343 - DNA, 20 bp, Artificial Sequence
  chemically synthesized
tctttgaagcaattgtgaat

SEQ ID NO: 243344 - DNA, 20 bp, Artificial Sequence
  chemically synthesized
tttgaagcaattgtgaatgg

SEQ ID NO: 243345 - DNA, 20 bp, Artificial Sequence
  chemically synthesized
atgggagttcactcatgatt

SEQ ID NO: 243346 - DNA, 20 bp, Artificial Sequence
  chemically synthesized
caaacagagagccaaatcat

SEQ ID NO: 243347 - DNA, 20 bp, Artificial Sequence
  chemically synthesized
accaacaacagacaaacaga

SEQ ID NO: 243348 - DNA, 20 bp, Artificial Sequence
  chemically synthesized
acaccaacaacagacaaaca

SEQ ID NO: 243349 - DNA, 20 bp, Artificial Sequence
  chemically synthesized
atacaccaacaacagacaaa

SEQ ID NO: 243350 - DNA, 20 bp, Artificial Sequence
  chemically synthesized
gctctctgtttgtctgttgt

SEQ ID NO: 243351 - DNA, 20 bp, Artificial Sequence
  chemically synthesized
gcattcttatacaccaacaa

SEQ ID NO: 243352 - DNA, 20 bp, Artificial Sequence
  chemically synthesized
tttgtctgttgttggtgtat

SEQ ID NO: 243353 - DNA, 20 bp, Artificial Sequence
  chemically synthesized
aatcaatgtacagaaatcac

SEQ ID NO: 243354 - DNA, 20 bp, Artificial Sequence
  chemically synthesized
caggatacaaaatcaatgta

SEQ ID NO: 243355 - DNA, 20 bp, Artificial Sequence
  chemically synthesized
gtacattgattttgtatcct

SEQ ID NO: 243356 - DNA, 20 bp, Artificial Sequence
  chemically synthesized
agcaacttcagcaaagtctc

SEQ ID NO: 243357 - DNA, 20 bp, Artificial Sequence
  chemically synthesized
aagcaacttcagcaaagtct

SEQ ID NO: 243358 - DNA, 20 bp, Artificial Sequence
  chemically synthesized
tgtatcctgagactttgctg

SEQ ID NO: 243359 - DNA, 20 bp, Artificial Sequence
  chemically synthesized
gctgataagcaacttcagca

SEQ ID NO: 243360 - DNA, 20 bp, Artificial Sequence
  chemically synthesized
cttaagctgataagcaactt

SEQ ID NO: 243361 - DNA, 20 bp, Artificial Sequence
  chemically synthesized
actttgctgaagttgcttat

SEQ ID NO: 243362 - DNA, 20 bp, Artificial Sequence
  chemically synthesized
caaaatctccttaagctgat

SEQ ID NO: 243363 - DNA, 20 bp, Artificial Sequence
  chemically synthesized
ctgaagttgcttatcagctt

SEQ ID NO: 243364 - DNA, 20 bp, Artificial Sequence
  chemically synthesized
tgaagttgcttatcagctta

SEQ ID NO: 243365 - DNA, 20 bp, Artificial Sequence
  chemically synthesized
aagttgcttatcagcttaag

SEQ ID NO: 243366 - DNA, 20 bp, Artificial Sequence
  chemically synthesized
tctcagcccaaaatctcctt

SEQ ID NO: 243367 - DNA, 20 bp, Artificial Sequence
  chemically synthesized
ttatcagcttaaggagattt

SEQ ID NO: 243368 - DNA, 20 bp, Artificial Sequence
  chemically synthesized
tatcagcttaaggagatttt

SEQ ID NO: 243369 - DNA, 20 bp, Artificial Sequence
  chemically synthesized
gcttaaggagattttgggct

SEQ ID NO: 243370 - DNA, 20 bp, Artificial Sequence
  chemically synthesized
gagattttgggctgagacga

SEQ ID NO: 243371 - DNA, 20 bp, Artificial Sequence
  chemically synthesized
agattttgggctgagacgat

SEQ ID NO: 243372 - DNA, 20 bp, Artificial Sequence
  chemically synthesized
tctagaaaaccccatcgtct

SEQ ID NO: 243373 - DNA, 20 bp, Artificial Sequence
  chemically synthesized
gattttgggctgagacgatg

SEQ ID NO: 243374 - DNA, 20 bp, Artificial Sequence
  chemically synthesized
gctgagacgatggggttttc

SEQ ID NO: 243375 - DNA, 20 bp, Artificial Sequence
  chemically synthesized
agacgacatgattgtttatc

SEQ ID NO: 243376 - DNA, 20 bp, Artificial Sequence
  chemically synthesized
acaatcatgtcgtctgcaaa

SEQ ID NO: 243377 - DNA, 20 bp, Artificial Sequence
  chemically synthesized
caatcatgtcgtctgcaaac

SEQ ID NO: 243378 - DNA, 20 bp, Artificial Sequence
  chemically synthesized
aatcatgtcgtctgcaaaca

SEQ ID NO: 243379 - DNA, 20 bp, Artificial Sequence
  chemically synthesized
agtcaaattgtccctgtttg

SEQ ID NO: 243380 - DNA, 20 bp, Artificial Sequence
  chemically synthesized
tattcagttaggaaaagagg

SEQ ID NO: 243381 - DNA, 20 bp, Artificial Sequence
  chemically synthesized
aggtattcagttaggaaaag

SEQ ID NO: 243382 - DNA, 20 bp, Artificial Sequence
  chemically synthesized
aaggtattcagttaggaaaa

SEQ ID NO: 243383 - DNA, 20 bp, Artificial Sequence
  chemically synthesized
aaaaggtattcagttaggaa

SEQ ID NO: 243384 - DNA, 20 bp, Artificial Sequence
  chemically synthesized
gaaataaaaggtattcagtt

SEQ ID NO: 243385 - DNA, 20 bp, Artificial Sequence
  chemically synthesized
ggaaataaaaggtattcagt

SEQ ID NO: 243386 - DNA, 20 bp, Artificial Sequence
  chemically synthesized
agaaggaaataaaaggtatt

SEQ ID NO: 243387 - DNA, 20 bp, Artificial Sequence
  chemically synthesized
aggcaggagaaggaaataaa

SEQ ID NO: 243388 - DNA, 20 bp, Artificial Sequence
  chemically synthesized
caggcaggagaaggaaataa

SEQ ID NO: 243389 - DNA, 20 bp, Artificial Sequence
  chemically synthesized
cagggcaatcaggcaggaga

SEQ ID NO: 243390 - DNA, 20 bp, Artificial Sequence
  chemically synthesized
ccagggcaatcaggcaggag

SEQ ID NO: 243391 - DNA, 20 bp, Artificial Sequence
  chemically synthesized
tggccagggcaatcaggcag

SEQ ID NO: 243392 - DNA, 20 bp, Artificial Sequence
  chemically synthesized
tctggccagggcaatcaggc

SEQ ID NO: 243393 - DNA, 20 bp, Artificial Sequence
  chemically synthesized
ttctggccagggcaatcagg

SEQ ID NO: 243394 - DNA, 20 bp, Artificial Sequence
  chemically synthesized
aagttctggccagggcaatc

SEQ ID NO: 243395 - DNA, 20 bp, Artificial Sequence
  chemically synthesized
cttctcctgcctgattgccc

SEQ ID NO: 243396 - DNA, 20 bp, Artificial Sequence
  chemically synthesized
gaagttctggccagggcaat

SEQ ID NO: 243397 - DNA, 20 bp, Artificial Sequence
  chemically synthesized
tcctgcctgattgccctggc

SEQ ID NO: 243398 - DNA, 20 bp, Artificial Sequence
  chemically synthesized
agtgttggaagttctggcca

SEQ ID NO: 243399 - DNA, 20 bp, Artificial Sequence
  chemically synthesized
tagtgttggaagttctggcc

SEQ ID NO: 243400 - DNA, 20 bp, Artificial Sequence
  chemically synthesized
atagtgttggaagttctggc

SEQ ID NO: 243401 - DNA, 20 bp, Artificial Sequence
  chemically synthesized
caacatagtgttggaagttc

SEQ ID NO: 243402 - DNA, 20 bp, Artificial Sequence
  chemically synthesized
cctattcaacatagtgttgg

SEQ ID NO: 243403 - DNA, 20 bp, Artificial Sequence
  chemically synthesized
gctcctattcaacatagtgt

SEQ ID NO: 243404 - DNA, 20 bp, Artificial Sequence
  chemically synthesized
acttccaacactatgttgaa

SEQ ID NO: 243405 - DNA, 20 bp, Artificial Sequence
  chemically synthesized
ctcaccgctcctattcaaca

SEQ ID NO: 243406 - DNA, 20 bp, Artificial Sequence
  chemically synthesized
cttccaacactatgttgaat

SEQ ID NO: 243407 - DNA, 20 bp, Artificial Sequence
  chemically synthesized
tccaacactatgttgaatag

SEQ ID NO: 243408 - DNA, 20 bp, Artificial Sequence
  chemically synthesized
aacactatgttgaataggag

SEQ ID NO: 243409 - DNA, 20 bp, Artificial Sequence
  chemically synthesized
ctatgttgaataggagcggt

SEQ ID NO: 243410 - DNA, 20 bp, Artificial Sequence
  chemically synthesized
atgttgaataggagcggtga

SEQ ID NO: 243411 - DNA, 20 bp, Artificial Sequence
  chemically synthesized
gttgaataggagcggtgaga

SEQ ID NO: 243412 - DNA, 20 bp, Artificial Sequence
  chemically synthesized
ttgaataggagcggtgagag

SEQ ID NO: 243413 - DNA, 20 bp, Artificial Sequence
  chemically synthesized
tgaataggagcggtgagaga

SEQ ID NO: 243414 - DNA, 20 bp, Artificial Sequence
  chemically synthesized
ttgaaaactggcacaagaca

SEQ ID NO: 243415 - DNA, 20 bp, Artificial Sequence
  chemically synthesized
tttgaaaactggcacaagac

SEQ ID NO: 243416 - DNA, 20 bp, Artificial Sequence
  chemically synthesized
ctttgaaaactggcacaaga

SEQ ID NO: 243417 - DNA, 20 bp, Artificial Sequence
  chemically synthesized
agggcatccctgtcttgtgc

SEQ ID NO: 243418 - DNA, 20 bp, Artificial Sequence
  chemically synthesized
ttccctttgaaaactggcac

SEQ ID NO: 243419 - DNA, 20 bp, Artificial Sequence
  chemically synthesized
ctgtcttgtgccagttttca

SEQ ID NO: 243420 - DNA, 20 bp, Artificial Sequence
  chemically synthesized
gaagcattccctttgaaaac

SEQ ID NO: 243421 - DNA, 20 bp, Artificial Sequence
  chemically synthesized
tgtcttgtgccagttttcaa

SEQ ID NO: 243422 - DNA, 20 bp, Artificial Sequence
  chemically synthesized
gtcttgtgccagttttcaaa

SEQ ID NO: 243423 - DNA, 20 bp, Artificial Sequence
  chemically synthesized
gttttcaaagggaatgcttc

SEQ ID NO: 243424 - DNA, 20 bp, Artificial Sequence
  chemically synthesized
actgaatgggcaaaaactgg

SEQ ID NO: 243425 - DNA, 20 bp, Artificial Sequence
  chemically synthesized
catactgaatgggcaaaaac

SEQ ID NO: 243426 - DNA, 20 bp, Artificial Sequence
  chemically synthesized
gcttccagtttttgcccatt

SEQ ID NO: 243427 - DNA, 20 bp, Artificial Sequence
  chemically synthesized
cagccaatatcatactgaat

SEQ ID NO: 243428 - DNA, 20 bp, Artificial Sequence
  chemically synthesized
acagccaatatcatactgaa

SEQ ID NO: 243429 - DNA, 20 bp, Artificial Sequence
  chemically synthesized
ttgcccattcagtatgatat

SEQ ID NO: 243430 - DNA, 20 bp, Artificial Sequence
  chemically synthesized
attcagtatgatattggctg

SEQ ID NO: 243431 - DNA, 20 bp, Artificial Sequence
  chemically synthesized
ttcagtatgatattggctgt

SEQ ID NO: 243432 - DNA, 20 bp, Artificial Sequence
  chemically synthesized
agctatctatgacaaaccca

SEQ ID NO: 243433 - DNA, 20 bp, Artificial Sequence
  chemically synthesized
tattggctgtgggtttgtca

SEQ ID NO: 243434 - DNA, 20 bp, Artificial Sequence
  chemically synthesized
ggctgtgggtttgtcataga

SEQ ID NO: 243435 - DNA, 20 bp, Artificial Sequence
  chemically synthesized
gacatatctcaaaataataa

SEQ ID NO: 243436 - DNA, 20 bp, Artificial Sequence
  chemically synthesized
gggacatatctcaaaataat

SEQ ID NO: 243437 - DNA, 20 bp, Artificial Sequence
  chemically synthesized
tagatagctcttattatttt

SEQ ID NO: 243438 - DNA, 20 bp, Artificial Sequence
  chemically synthesized
tcaataaattaggtattgat

SEQ ID NO: 243439 - DNA, 20 bp, Artificial Sequence
  chemically synthesized
ctcaataaattaggtattga

SEQ ID NO: 243440 - DNA, 20 bp, Artificial Sequence
  chemically synthesized
ctaaaaactctcaataaatt

SEQ ID NO: 243441 - DNA, 20 bp, Artificial Sequence
  chemically synthesized
ccatcaatacctaatttatt

SEQ ID NO: 243442 - DNA, 20 bp, Artificial Sequence
  chemically synthesized
gctaaaaactctcaataaat

SEQ ID NO: 243443 - DNA, 20 bp, Artificial Sequence
  chemically synthesized
atcaatacctaatttattga

SEQ ID NO: 243444 - DNA, 20 bp, Artificial Sequence
  chemically synthesized
cctaatttattgagagtttt

SEQ ID NO: 243445 - DNA, 20 bp, Artificial Sequence
  chemically synthesized
tattgagagtttttagcatg

SEQ ID NO: 243446 - DNA, 20 bp, Artificial Sequence
  chemically synthesized
attgagagtttttagcatga

SEQ ID NO: 243447 - DNA, 20 bp, Artificial Sequence
  chemically synthesized
ttgagagtttttagcatgaa

SEQ ID NO: 243448 - DNA, 20 bp, Artificial Sequence
  chemically synthesized
agggttgttgaattttgtca

SEQ ID NO: 243449 - DNA, 20 bp, Artificial Sequence
  chemically synthesized
gggttgttgaattttgtcaa

SEQ ID NO: 243450 - DNA, 20 bp, Artificial Sequence
  chemically synthesized
tatctcaatagatgcagaaa

SEQ ID NO: 243451 - DNA, 20 bp, Artificial Sequence
  chemically synthesized
catgattatctcaatagatg

SEQ ID NO: 243452 - DNA, 20 bp, Artificial Sequence
  chemically synthesized
aggctttttctgcatctatt

SEQ ID NO: 243453 - DNA, 20 bp, Artificial Sequence
  chemically synthesized
aaaccacatgattatctcaa

SEQ ID NO: 243454 - DNA, 20 bp, Artificial Sequence
  chemically synthesized
catctattgagataatcatg

SEQ ID NO: 243455 - DNA, 20 bp, Artificial Sequence
  chemically synthesized
aatcatgtggtttttgtctt

SEQ ID NO: 243456 - DNA, 20 bp, Artificial Sequence
  chemically synthesized
ccagcatataaacagagcca

SEQ ID NO: 243457 - DNA, 20 bp, Artificial Sequence
  chemically synthesized
tgtaatccagcatataaaca

SEQ ID NO: 243458 - DNA, 20 bp, Artificial Sequence
  chemically synthesized
aatgtaatccagcatataaa

SEQ ID NO: 243459 - DNA, 20 bp, Artificial Sequence
  chemically synthesized
ctttggctctgtttatatgc

SEQ ID NO: 243460 - DNA, 20 bp, Artificial Sequence
  chemically synthesized
gcaaatcaataaatgtaatc

SEQ ID NO: 243461 - DNA, 20 bp, Artificial Sequence
  chemically synthesized
ttgatttgcgtatattgaac

SEQ ID NO: 243462 - DNA, 20 bp, Artificial Sequence
  chemically synthesized
tcatccttgggatgcaaggc

SEQ ID NO: 243463 - DNA, 20 bp, Artificial Sequence
  chemically synthesized
ggcttcatccttgggatgca

SEQ ID NO: 243464 - DNA, 20 bp, Artificial Sequence
  chemically synthesized
ttgaaccagccttgcatccc

SEQ ID NO: 243465 - DNA, 20 bp, Artificial Sequence
  chemically synthesized
gggcttcatccttgggatgc

SEQ ID NO: 243466 - DNA, 20 bp, Artificial Sequence
  chemically synthesized
tgaaccagccttgcatccca

SEQ ID NO: 243467 - DNA, 20 bp, Artificial Sequence
  chemically synthesized
agccttgcatcccaaggatg

SEQ ID NO: 243468 - DNA, 20 bp, Artificial Sequence
  chemically synthesized
atcaagtgggcttcatcctt

SEQ ID NO: 243469 - DNA, 20 bp, Artificial Sequence
  chemically synthesized
gatcaagtgggcttcatcct

SEQ ID NO: 243470 - DNA, 20 bp, Artificial Sequence
  chemically synthesized
cttatccaccatgatcaagt

SEQ ID NO: 243471 - DNA, 20 bp, Artificial Sequence
  chemically synthesized
gcttatccaccatgatcaag

SEQ ID NO: 243472 - DNA, 20 bp, Artificial Sequence
  chemically synthesized
ggatgaagcccacttgatca

SEQ ID NO: 243473 - DNA, 20 bp, Artificial Sequence
  chemically synthesized
aaagcttatccaccatgatc

SEQ ID NO: 243474 - DNA, 20 bp, Artificial Sequence
  chemically synthesized
tgaagcccacttgatcatgg

SEQ ID NO: 243475 - DNA, 20 bp, Artificial Sequence
  chemically synthesized
cccacttgatcatggtggat

SEQ ID NO: 243476 - DNA, 20 bp, Artificial Sequence
  chemically synthesized
gaatccagcagcacatcaaa

SEQ ID NO: 243477 - DNA, 20 bp, Artificial Sequence
  chemically synthesized
taagctttttgatgtgctgc

SEQ ID NO: 243478 - DNA, 20 bp, Artificial Sequence
  chemically synthesized
ttttgatgtgctgctggatt

SEQ ID NO: 243479 - DNA, 20 bp, Artificial Sequence
  chemically synthesized
tactggcataccgaatccag

SEQ ID NO: 243480 - DNA, 20 bp, Artificial Sequence
  chemically synthesized
aaatactggcataccgaatc

SEQ ID NO: 243481 - DNA, 20 bp, Artificial Sequence
  chemically synthesized
tgctgctggattcggtatgc

SEQ ID NO: 243482 - DNA, 20 bp, Artificial Sequence
  chemically synthesized
aaaaatcctcaataaaatac

SEQ ID NO: 243483 - DNA, 20 bp, Artificial Sequence
  chemically synthesized
cggtatgccagtattttatt

SEQ ID NO: 243484 - DNA, 20 bp, Artificial Sequence
  chemically synthesized
ggtatgccagtattttattg

SEQ ID NO: 243485 - DNA, 20 bp, Artificial Sequence
  chemically synthesized
tttttgcatcaatgttcatc

SEQ ID NO: 243486 - DNA, 20 bp, Artificial Sequence
  chemically synthesized
ttttgcatcaatgttcatca

SEQ ID NO: 243487 - DNA, 20 bp, Artificial Sequence
  chemically synthesized
tcaatgttcatcaaggatat

SEQ ID NO: 243488 - DNA, 20 bp, Artificial Sequence
  chemically synthesized
acaaccaaaaaagagaattt

SEQ ID NO: 243489 - DNA, 20 bp, Artificial Sequence
  chemically synthesized
tggtctaaaattctcttttt

SEQ ID NO: 243490 - DNA, 20 bp, Artificial Sequence
  chemically synthesized
gcagagacacaaccaaaaaa

SEQ ID NO: 243491 - DNA, 20 bp, Artificial Sequence
  chemically synthesized
gggcagagacacaaccaaaa

SEQ ID NO: 243492 - DNA, 20 bp, Artificial Sequence
  chemically synthesized
tttttggttgtgtctctgcc

SEQ ID NO: 243493 - DNA, 20 bp, Artificial Sequence
  chemically synthesized
tctgataccaaagccgggca

SEQ ID NO: 243494 - DNA, 20 bp, Artificial Sequence
  chemically synthesized
attctgataccaaagccggg

SEQ ID NO: 243495 - DNA, 20 bp, Artificial Sequence
  chemically synthesized
gttgtgtctctgcccggctt

SEQ ID NO: 243496 - DNA, 20 bp, Artificial Sequence
  chemically synthesized
atcattctgataccaaagcc

SEQ ID NO: 243497 - DNA, 20 bp, Artificial Sequence
  chemically synthesized
catcattctgataccaaagc

SEQ ID NO: 243498 - DNA, 20 bp, Artificial Sequence
  chemically synthesized
tctctgcccggctttggtat

SEQ ID NO: 243499 - DNA, 20 bp, Artificial Sequence
  chemically synthesized
ccagcatcattctgatacca

SEQ ID NO: 243500 - DNA, 20 bp, Artificial Sequence
  chemically synthesized
ctttggtatcagaatgatgc

SEQ ID NO: 243501 - DNA, 20 bp, Artificial Sequence
  chemically synthesized
cctaactcattttatgaggc

SEQ ID NO: 243502 - DNA, 20 bp, Artificial Sequence
  chemically synthesized
cctccctaactcattttatg

SEQ ID NO: 243503 - DNA, 20 bp, Artificial Sequence
  chemically synthesized
tgatgctggcctcataaaat

SEQ ID NO: 243504 - DNA, 20 bp, Artificial Sequence
  chemically synthesized
tcctccctaactcattttat

SEQ ID NO: 243505 - DNA, 20 bp, Artificial Sequence
  chemically synthesized
gctggcctcataaaatgagt

SEQ ID NO: 243506 - DNA, 20 bp, Artificial Sequence
  chemically synthesized
ctggcctcataaaatgagtt

SEQ ID NO: 243507 - DNA, 20 bp, Artificial Sequence
  chemically synthesized
tggcctcataaaatgagtta

SEQ ID NO: 243508 - DNA, 20 bp, Artificial Sequence
  chemically synthesized
gcctcataaaatgagttagg

SEQ ID NO: 243509 - DNA, 20 bp, Artificial Sequence
  chemically synthesized
cctcataaaatgagttaggg

SEQ ID NO: 243510 - DNA, 20 bp, Artificial Sequence
  chemically synthesized
ttccaatcaatagaaaaaga

SEQ ID NO: 243511 - DNA, 20 bp, Artificial Sequence
  chemically synthesized
attccaatcaatagaaaaag

SEQ ID NO: 243512 - DNA, 20 bp, Artificial Sequence
  chemically synthesized
tattccaatcaatagaaaaa

SEQ ID NO: 243513 - DNA, 20 bp, Artificial Sequence
  chemically synthesized
actattccaatcaatagaaa

SEQ ID NO: 243514 - DNA, 20 bp, Artificial Sequence
  chemically synthesized
ttccctctttttctattgat

SEQ ID NO: 243515 - DNA, 20 bp, Artificial Sequence
  chemically synthesized
tctgaaactattccaatcaa

SEQ ID NO: 243516 - DNA, 20 bp, Artificial Sequence
  chemically synthesized
tctttttctattgattggaa

SEQ ID NO: 243517 - DNA, 20 bp, Artificial Sequence
  chemically synthesized
tctattgattggaatagttt

SEQ ID NO: 243518 - DNA, 20 bp, Artificial Sequence
  chemically synthesized
attgattggaatagtttcag

SEQ ID NO: 243519 - DNA, 20 bp, Artificial Sequence
  chemically synthesized
ttgattggaatagtttcaga

SEQ ID NO: 243520 - DNA, 20 bp, Artificial Sequence
  chemically synthesized
tggaatagtttcagaaggaa

SEQ ID NO: 243521 - DNA, 20 bp, Artificial Sequence
  chemically synthesized
agtttcagaaggaatggtac

SEQ ID NO: 243522 - DNA, 20 bp, Artificial Sequence
  chemically synthesized
ccagaggtacaaggaggaac

SEQ ID NO: 243523 - DNA, 20 bp, Artificial Sequence
  chemically synthesized
attctaccagaggtacaagg

SEQ ID NO: 243524 - DNA, 20 bp, Artificial Sequence
  chemically synthesized
aattctaccagaggtacaag

SEQ ID NO: 243525 - DNA, 20 bp, Artificial Sequence
  chemically synthesized
cgaattctaccagaggtaca

SEQ ID NO: 243526 - DNA, 20 bp, Artificial Sequence
  chemically synthesized
ccagttcctccttgtacctc

SEQ ID NO: 243527 - DNA, 20 bp, Artificial Sequence
  chemically synthesized
ccgaattctaccagaggtac

SEQ ID NO: 243528 - DNA, 20 bp, Artificial Sequence
  chemically synthesized
gttcctccttgtacctctgg

SEQ ID NO: 243529 - DNA, 20 bp, Artificial Sequence
  chemically synthesized
tcacagccgaattctaccag

SEQ ID NO: 243530 - DNA, 20 bp, Artificial Sequence
  chemically synthesized
ttcacagccgaattctacca

SEQ ID NO: 243531 - DNA, 20 bp, Artificial Sequence
  chemically synthesized
gattcacagccgaattctac

SEQ ID NO: 243532 - DNA, 20 bp, Artificial Sequence
  chemically synthesized
cttgtacctctggtagaatt

SEQ ID NO: 243533 - DNA, 20 bp, Artificial Sequence
  chemically synthesized
tccaggaccagatggattca

SEQ ID NO: 243534 - DNA, 20 bp, Artificial Sequence
  chemically synthesized
aattcggctgtgaatccatc

SEQ ID NO: 243535 - DNA, 20 bp, Artificial Sequence
  chemically synthesized
aaaaagagtccaggaccaga

SEQ ID NO: 243536 - DNA, 20 bp, Artificial Sequence
  chemically synthesized
gctgtgaatccatctggtcc

SEQ ID NO: 243537 - DNA, 20 bp, Artificial Sequence
  chemically synthesized
aaccaaaaagagtccaggac

SEQ ID NO: 243538 - DNA, 20 bp, Artificial Sequence
  chemically synthesized
ttaccaaccaaaaagagtcc

SEQ ID NO: 243539 - DNA, 20 bp, Artificial Sequence
  chemically synthesized
cttaccaaccaaaaagagtc

SEQ ID NO: 243540 - DNA, 20 bp, Artificial Sequence
  chemically synthesized
atctggtcctggactctttt

SEQ ID NO: 243541 - DNA, 20 bp, Artificial Sequence
  chemically synthesized
aatagcttaccaaccaaaaa

SEQ ID NO: 243542 - DNA, 20 bp, Artificial Sequence
  chemically synthesized
ggtcctggactctttttggt

SEQ ID NO: 243543 - DNA, 20 bp, Artificial Sequence
  chemically synthesized
tcaatagcttaccaaccaaa

SEQ ID NO: 243544 - DNA, 20 bp, Artificial Sequence
  chemically synthesized
ctggactctttttggttggt

SEQ ID NO: 243545 - DNA, 20 bp, Artificial Sequence
  chemically synthesized
gaaattgtggcaataatcaa

SEQ ID NO: 243546 - DNA, 20 bp, Artificial Sequence
  chemically synthesized
attgattattgccacaattt

SEQ ID NO: 243547 - DNA, 20 bp, Artificial Sequence
  chemically synthesized
aataacaggagctgaaattg

SEQ ID NO: 243548 - DNA, 20 bp, Artificial Sequence
  chemically synthesized
acaatttcagctcctgttat

SEQ ID NO: 243549 - DNA, 20 bp, Artificial Sequence
  chemically synthesized
tctgaatagaccaataacag

SEQ ID NO: 243550 - DNA, 20 bp, Artificial Sequence
  chemically synthesized
tctctgaatagaccaataac

SEQ ID NO: 243551 - DNA, 20 bp, Artificial Sequence
  chemically synthesized
atctctgaatagaccaataa

SEQ ID NO: 243552 - DNA, 20 bp, Artificial Sequence
  chemically synthesized
gctcctgttattggtctatt

SEQ ID NO: 243553 - DNA, 20 bp, Artificial Sequence
  chemically synthesized
tcctgttattggtctattca

SEQ ID NO: 243554 - DNA, 20 bp, Artificial Sequence
  chemically synthesized
gaagaagttgaatctctgaa

SEQ ID NO: 243555 - DNA, 20 bp, Artificial Sequence
  chemically synthesized
tcagagattcaacttcttcc

SEQ ID NO: 243556 - DNA, 20 bp, Artificial Sequence
  chemically synthesized
cccaagactaaaccaggaag

SEQ ID NO: 243557 - DNA, 20 bp, Artificial Sequence
  chemically synthesized
gattcaacttcttcctggtt

SEQ ID NO: 243558 - DNA, 20 bp, Artificial Sequence
  chemically synthesized
tctcccaagactaaaccagg

SEQ ID NO: 243559 - DNA, 20 bp, Artificial Sequence
  chemically synthesized
cactctcccaagactaaacc

SEQ ID NO: 243560 - DNA, 20 bp, Artificial Sequence
  chemically synthesized
acactctcccaagactaaac

SEQ ID NO: 243561 - DNA, 20 bp, Artificial Sequence
  chemically synthesized
acttcttcctggtttagtct

SEQ ID NO: 243562 - DNA, 20 bp, Artificial Sequence
  chemically synthesized
cttcttcctggtttagtctt

SEQ ID NO: 243563 - DNA, 20 bp, Artificial Sequence
  chemically synthesized
tcttcctggtttagtcttgg

SEQ ID NO: 243564 - DNA, 20 bp, Artificial Sequence
  chemically synthesized
ttcctggtttagtcttggga

SEQ ID NO: 243565 - DNA, 20 bp, Artificial Sequence
  chemically synthesized
ctcgacacatacactctccc

SEQ ID NO: 243566 - DNA, 20 bp, Artificial Sequence
  chemically synthesized
cttgggagagtgtatgtgtc

SEQ ID NO: 243567 - DNA, 20 bp, Artificial Sequence
  chemically synthesized
ttgggagagtgtatgtgtcg

SEQ ID NO: 243568 - DNA, 20 bp, Artificial Sequence
  chemically synthesized
aggaatgtatccatttcttc

SEQ ID NO: 243569 - DNA, 20 bp, Artificial Sequence
  chemically synthesized
actagaaaatctagaagaaa

SEQ ID NO: 243570 - DNA, 20 bp, Artificial Sequence
  chemically synthesized
aaataaactagaaaatctag

SEQ ID NO: 243571 - DNA, 20 bp, Artificial Sequence
  chemically synthesized
tccatttcttctagattttc

SEQ ID NO: 243572 - DNA, 20 bp, Artificial Sequence
  chemically synthesized
cacaaataaactagaaaatc

SEQ ID NO: 243573 - DNA, 20 bp, Artificial Sequence
  chemically synthesized
acacctctacacaaataaac

SEQ ID NO: 243574 - DNA, 20 bp, Artificial Sequence
  chemically synthesized
gattttctagtttatttgtg

SEQ ID NO: 243575 - DNA, 20 bp, Artificial Sequence
  chemically synthesized
ttttctagtttatttgtgta

SEQ ID NO: 243576 - DNA, 20 bp, Artificial Sequence
  chemically synthesized
tttctagtttatttgtgtag

SEQ ID NO: 243577 - DNA, 20 bp, Artificial Sequence
  chemically synthesized
tatttgtgtagaggtgtttg

SEQ ID NO: 243578 - DNA, 20 bp, Artificial Sequence
  chemically synthesized
gtgtttgtagtattctctga

SEQ ID NO: 243579 - DNA, 20 bp, Artificial Sequence
  chemically synthesized
tttgtagtattctctgacgg

SEQ ID NO: 243580 - DNA, 20 bp, Artificial Sequence
  chemically synthesized
agaaatacaaactaccgtca

SEQ ID NO: 243581 - DNA, 20 bp, Artificial Sequence
  chemically synthesized
acagaaatacaaactaccgt

SEQ ID NO: 243582 - DNA, 20 bp, Artificial Sequence
  chemically synthesized
gacggtagtttgtatttctg

SEQ ID NO: 243583 - DNA, 20 bp, Artificial Sequence
  chemically synthesized
acggtagtttgtatttctgt

SEQ ID NO: 243584 - DNA, 20 bp, Artificial Sequence
  chemically synthesized
agtttgtatttctgtgggat

SEQ ID NO: 243585 - DNA, 20 bp, Artificial Sequence
  chemically synthesized
tgatatcaccaccgatccca

SEQ ID NO: 243586 - DNA, 20 bp, Artificial Sequence
  chemically synthesized
ttgtatttctgtgggatcgg

SEQ ID NO: 243587 - DNA, 20 bp, Artificial Sequence
  chemically synthesized
ttgacttgtagagttaacag

SEQ ID NO: 243588 - DNA, 20 bp, Artificial Sequence
  chemically synthesized
ggtttgacttgtagagttaa

SEQ ID NO: 243589 - DNA, 20 bp, Artificial Sequence
  chemically synthesized
atcacttctgttaactctac

SEQ ID NO: 243590 - DNA, 20 bp, Artificial Sequence
  chemically synthesized
gatttcaggtttgacttgta

SEQ ID NO: 243591 - DNA, 20 bp, Artificial Sequence
  chemically synthesized
atgatttcaggtttgacttg

SEQ ID NO: 243592 - DNA, 20 bp, Artificial Sequence
  chemically synthesized
acaagtcaaacctgaaatca

SEQ ID NO: 243593 - DNA, 20 bp, Artificial Sequence
  chemically synthesized
tggttgtgagccatgatttc

SEQ ID NO: 243594 - DNA, 20 bp, Artificial Sequence
  chemically synthesized
ctggttgtgagccatgattt

SEQ ID NO: 243595 - DNA, 20 bp, Artificial Sequence
  chemically synthesized
ctgaaatcatggctcacaac

SEQ ID NO: 243596 - DNA, 20 bp, Artificial Sequence
  chemically synthesized
cattaggtggtgctggttgt

SEQ ID NO: 243597 - DNA, 20 bp, Artificial Sequence
  chemically synthesized
tgcctgacattaggtggtgc

SEQ ID NO: 243598 - DNA, 20 bp, Artificial Sequence
  chemically synthesized
ttccaatgcctgacattagg

SEQ ID NO: 243599 - DNA, 20 bp, Artificial Sequence
  chemically synthesized
caaccagcaccacctaatgt

SEQ ID NO: 243600 - DNA, 20 bp, Artificial Sequence
  chemically synthesized
aaccagcaccacctaatgtc

SEQ ID NO: 243601 - DNA, 20 bp, Artificial Sequence
  chemically synthesized
caattccaatgcctgacatt

SEQ ID NO: 243602 - DNA, 20 bp, Artificial Sequence
  chemically synthesized
gcaattccaatgcctgacat

SEQ ID NO: 243603 - DNA, 20 bp, Artificial Sequence
  chemically synthesized
caccacctaatgtcaggcat

SEQ ID NO: 243604 - DNA, 20 bp, Artificial Sequence
  chemically synthesized
aggcattggaattgcatatg

SEQ ID NO: 243605 - DNA, 20 bp, Artificial Sequence
  chemically synthesized
gcattggaattgcatatgta

SEQ ID NO: 243606 - DNA, 20 bp, Artificial Sequence
  chemically synthesized
ggaattgcatatgtagagcc

SEQ ID NO: 243607 - DNA, 20 bp, Artificial Sequence
  chemically synthesized
gcatatgtagagcccagaat

SEQ ID NO: 243608 - DNA, 20 bp, Artificial Sequence
  chemically synthesized
gtacgtggaaaaccaattct

SEQ ID NO: 243609 - DNA, 20 bp, Artificial Sequence
  chemically synthesized
agtacgtggaaaaccaattc

SEQ ID NO: 243610 - DNA, 20 bp, Artificial Sequence
  chemically synthesized
aattggttttccacgtactt

SEQ ID NO: 243611 - DNA, 20 bp, Artificial Sequence
  chemically synthesized
acatttgactctgaagtacg

SEQ ID NO: 243612 - DNA, 20 bp, Artificial Sequence
  chemically synthesized
ttggttttccacgtacttca

SEQ ID NO: 243613 - DNA, 20 bp, Artificial Sequence
  chemically synthesized
tagcttcacatttgactctg

SEQ ID NO: 243614 - DNA, 20 bp, Artificial Sequence
  chemically synthesized
gtacttcagagtcaaatgtg

SEQ ID NO: 243615 - DNA, 20 bp, Artificial Sequence
  chemically synthesized
tgtgtgggtgtgtgtgcatt

SEQ ID NO: 243616 - DNA, 20 bp, Artificial Sequence
  chemically synthesized
gccatatctgtagggtgtgt

SEQ ID NO: 243617 - DNA, 20 bp, Artificial Sequence
  chemically synthesized
ggccatatctgtagggtgtg

SEQ ID NO: 243618 - DNA, 20 bp, Artificial Sequence
  chemically synthesized
acacacacccacacacccta

SEQ ID NO: 243619 - DNA, 20 bp, Artificial Sequence
  chemically synthesized
gggtcctggccatatctgta

SEQ ID NO: 243620 - DNA, 20 bp, Artificial Sequence
  chemically synthesized
acccacacaccctacagata

SEQ ID NO: 243621 - DNA, 20 bp, Artificial Sequence
  chemically synthesized
tgggtcctggccatatctgt

SEQ ID NO: 243622 - DNA, 20 bp, Artificial Sequence
  chemically synthesized
gtgggtcctggccatatctg

SEQ ID NO: 243623 - DNA, 20 bp, Artificial Sequence
  chemically synthesized
acacaccctacagatatggc

SEQ ID NO: 243624 - DNA, 20 bp, Artificial Sequence
  chemically synthesized
cacaccctacagatatggcc

SEQ ID NO: 243625 - DNA, 20 bp, Artificial Sequence
  chemically synthesized
atttggtctggggtgggtcc

SEQ ID NO: 243626 - DNA, 20 bp, Artificial Sequence
  chemically synthesized
gatatggccaggacccaccc

SEQ ID NO: 243627 - DNA, 20 bp, Artificial Sequence
  chemically synthesized
ctggttatttggtctggggt

SEQ ID NO: 243628 - DNA, 20 bp, Artificial Sequence
  chemically synthesized
cctggttatttggtctgggg

SEQ ID NO: 243629 - DNA, 20 bp, Artificial Sequence
  chemically synthesized
tatcctggttatttggtctg

SEQ ID NO: 243630 - DNA, 20 bp, Artificial Sequence
  chemically synthesized
atatcctggttatttggtct

SEQ ID NO: 243631 - DNA, 20 bp, Artificial Sequence
  chemically synthesized
gatatcctggttatttggtc

SEQ ID NO: 243632 - DNA, 20 bp, Artificial Sequence
  chemically synthesized
cccaccccagaccaaataac

SEQ ID NO: 243633 - DNA, 20 bp, Artificial Sequence
  chemically synthesized
ccaccccagaccaaataacc

SEQ ID NO: 243634 - DNA, 20 bp, Artificial Sequence
  chemically synthesized
aattagatatcctggttatt

SEQ ID NO: 243635 - DNA, 20 bp, Artificial Sequence
  chemically synthesized
taaaaataaattagatatcc

SEQ ID NO: 243636 - DNA, 20 bp, Artificial Sequence
  chemically synthesized
acatggctataaaaataaat

SEQ ID NO: 243637 - DNA, 20 bp, Artificial Sequence
  chemically synthesized
ggatatctaatttattttta

SEQ ID NO: 243638 - DNA, 20 bp, Artificial Sequence
  chemically synthesized
aatttatttttatagccatg

SEQ ID NO: 243639 - DNA, 20 bp, Artificial Sequence
  chemically synthesized
atttatttttatagccatgt

SEQ ID NO: 243640 - DNA, 20 bp, Artificial Sequence
  chemically synthesized
ctgaatttaaattacctaca

SEQ ID NO: 243641 - DNA, 20 bp, Artificial Sequence
  chemically synthesized
ccatgtaggtaatttaaatt

SEQ ID NO: 243642 - DNA, 20 bp, Artificial Sequence
  chemically synthesized
ttaaattcagttgttgaacc

SEQ ID NO: 243643 - DNA, 20 bp, Artificial Sequence
  chemically synthesized
ttgacaatcgttttcaaact

SEQ ID NO: 243644 - DNA, 20 bp, Artificial Sequence
  chemically synthesized
aagtttgaaaacgattgtca

SEQ ID NO: 243645 - DNA, 20 bp, Artificial Sequence
  chemically synthesized
ttgaaaacgattgtcaaaga

SEQ ID NO: 243646 - DNA, 20 bp, Artificial Sequence
  chemically synthesized
gaaaacgattgtcaaagaaa

SEQ ID NO: 243647 - DNA, 20 bp, Artificial Sequence
  chemically synthesized
aaaacgattgtcaaagaaag

SEQ ID NO: 243648 - DNA, 20 bp, Artificial Sequence
  chemically synthesized
aaattttaaaatcagaatta

SEQ ID NO: 243649 - DNA, 20 bp, Artificial Sequence
  chemically synthesized
atgatgtaaaattttaaaat

SEQ ID NO: 243650 - DNA, 20 bp, Artificial Sequence
  chemically synthesized
ttacatcatgaaaatcttca

SEQ ID NO: 243651 - DNA, 20 bp, Artificial Sequence
  chemically synthesized
tttacttatatatgtctttg

SEQ ID NO: 243652 - DNA, 20 bp, Artificial Sequence
  chemically synthesized
aaatcttcaaagacatatat

SEQ ID NO: 243653 - DNA, 20 bp, Artificial Sequence
  chemically synthesized
ttcaaagacatatataagta

SEQ ID NO: 243654 - DNA, 20 bp, Artificial Sequence
  chemically synthesized
caaagacatatataagtaaa

SEQ ID NO: 243655 - DNA, 20 bp, Artificial Sequence
  chemically synthesized
acatatataagtaaagagaa

SEQ ID NO: 243656 - DNA, 20 bp, Artificial Sequence
  chemically synthesized
gtaaagagaacagtatatta

SEQ ID NO: 243657 - DNA, 20 bp, Artificial Sequence
  chemically synthesized
aggtggtgacaggtgcatgg

SEQ ID NO: 243658 - DNA, 20 bp, Artificial Sequence
  chemically synthesized
aaggtggtgacaggtgcatg

SEQ ID NO: 243659 - DNA, 20 bp, Artificial Sequence
  chemically synthesized
caaggtggtgacaggtgcat

SEQ ID NO: 243660 - DNA, 20 bp, Artificial Sequence
  chemically synthesized
tcaaggtggtgacaggtgca

SEQ ID NO: 243661 - DNA, 20 bp, Artificial Sequence
  chemically synthesized
taattgctcaaggtggtgac

SEQ ID NO: 243662 - DNA, 20 bp, Artificial Sequence
  chemically synthesized
ataattgctcaaggtggtga

SEQ ID NO: 243663 - DNA, 20 bp, Artificial Sequence
  chemically synthesized
catgcacctgtcaccacctt

SEQ ID NO: 243664 - DNA, 20 bp, Artificial Sequence
  chemically synthesized
atgttgataattgctcaagg

SEQ ID NO: 243665 - DNA, 20 bp, Artificial Sequence
  chemically synthesized
caaatgttgataattgctca

SEQ ID NO: 243666 - DNA, 20 bp, Artificial Sequence
  chemically synthesized
gcaaatgttgataattgctc

SEQ ID NO: 243667 - DNA, 20 bp, Artificial Sequence
  chemically synthesized
gcaatggaggaagattaaac

SEQ ID NO: 243668 - DNA, 20 bp, Artificial Sequence
  chemically synthesized
aatataaagagcaatggagg

SEQ ID NO: 243669 - DNA, 20 bp, Artificial Sequence
  chemically synthesized
tttaatataaagagcaatgg

SEQ ID NO: 243670 - DNA, 20 bp, Artificial Sequence
  chemically synthesized
ttttaatataaagagcaatg

SEQ ID NO: 243671 - DNA, 20 bp, Artificial Sequence
  chemically synthesized
atttttaatataaagagcaa

SEQ ID NO: 243672 - DNA, 20 bp, Artificial Sequence
  chemically synthesized
gaaattatttttaatataaa

SEQ ID NO: 243673 - DNA, 20 bp, Artificial Sequence
  chemically synthesized
aggaaattatttttaatata

SEQ ID NO: 243674 - DNA, 20 bp, Artificial Sequence
  chemically synthesized
tatattaaaaataatttcct

SEQ ID NO: 243675 - DNA, 20 bp, Artificial Sequence
  chemically synthesized
attaaaaataatttccttgg

SEQ ID NO: 243676 - DNA, 20 bp, Artificial Sequence
  chemically synthesized
tttgttttgacaaacttcca

SEQ ID NO: 243677 - DNA, 20 bp, Artificial Sequence
  chemically synthesized
ttttgttttgacaaacttcc

SEQ ID NO: 243678 - DNA, 20 bp, Artificial Sequence
  chemically synthesized
ggtgaagtaatgtgattcgt

SEQ ID NO: 243679 - DNA, 20 bp, Artificial Sequence
  chemically synthesized
aggtgaagtaatgtgattcg

SEQ ID NO: 243680 - DNA, 20 bp, Artificial Sequence
  chemically synthesized
tgccaaagtattttcaggtg

SEQ ID NO: 243681 - DNA, 20 bp, Artificial Sequence
  chemically synthesized
atacatgccaaagtattttc

SEQ ID NO: 243682 - DNA, 20 bp, Artificial Sequence
  chemically synthesized
gatacatgccaaagtatttt

SEQ ID NO: 243683 - DNA, 20 bp, Artificial Sequence
  chemically synthesized
tacttcacctgaaaatactt

SEQ ID NO: 243684 - DNA, 20 bp, Artificial Sequence
  chemically synthesized
gaaattctagatacatgcca

SEQ ID NO: 243685 - DNA, 20 bp, Artificial Sequence
  chemically synthesized
aaaatactttggcatgtatc

SEQ ID NO: 243686 - DNA, 20 bp, Artificial Sequence
  chemically synthesized
tgctatttaaagagaaattc

SEQ ID NO: 243687 - DNA, 20 bp, Artificial Sequence
  chemically synthesized
atctagaatttctctttaaa

SEQ ID NO: 243688 - DNA, 20 bp, Artificial Sequence
  chemically synthesized
aatagattgtgctatttaaa

SEQ ID NO: 243689 - DNA, 20 bp, Artificial Sequence
  chemically synthesized
ataatagattgtgctattta

SEQ ID NO: 243690 - DNA, 20 bp, Artificial Sequence
  chemically synthesized
ttaaatagcacaatctatta

SEQ ID NO: 243691 - DNA, 20 bp, Artificial Sequence
  chemically synthesized
aatagcacaatctattatag

SEQ ID NO: 243692 - DNA, 20 bp, Artificial Sequence
  chemically synthesized
ggcatttattgctactataa

SEQ ID NO: 243693 - DNA, 20 bp, Artificial Sequence
  chemically synthesized
aagaaatacttaacgatttt

SEQ ID NO: 243694 - DNA, 20 bp, Artificial Sequence
  chemically synthesized
aataaatgccaaaaatcgtt

SEQ ID NO: 243695 - DNA, 20 bp, Artificial Sequence
  chemically synthesized
atatctggctcaatatttaa

SEQ ID NO: 243696 - DNA, 20 bp, Artificial Sequence
  chemically synthesized
aagtatttcttttaaatatt

SEQ ID NO: 243697 - DNA, 20 bp, Artificial Sequence
  chemically synthesized
atttcttttaaatattgagc

SEQ ID NO: 243698 - DNA, 20 bp, Artificial Sequence
  chemically synthesized
aaatattgagccagatatga

SEQ ID NO: 243699 - DNA, 20 bp, Artificial Sequence
  chemically synthesized
gcagcaactaccatcatatc

SEQ ID NO: 243700 - DNA, 20 bp, Artificial Sequence
  chemically synthesized
tattgagccagatatgatgg

SEQ ID NO: 243701 - DNA, 20 bp, Artificial Sequence
  chemically synthesized
agatatgatggtagttgctg

SEQ ID NO: 243702 - DNA, 20 bp, Artificial Sequence
  chemically synthesized
actaaggtttttcacatctg

SEQ ID NO: 243703 - DNA, 20 bp, Artificial Sequence
  chemically synthesized
gctgcagatgtgaaaaacct

SEQ ID NO: 243704 - DNA, 20 bp, Artificial Sequence
  chemically synthesized
ttaaaaaataattgtcacta

SEQ ID NO: 243705 - DNA, 20 bp, Artificial Sequence
  chemically synthesized
attaaaaaataattgtcact

SEQ ID NO: 243706 - DNA, 20 bp, Artificial Sequence
  chemically synthesized
ttttaattttatcttacata

SEQ ID NO: 243707 - DNA, 20 bp, Artificial Sequence
  chemically synthesized
gaatctaactggctttatgt

SEQ ID NO: 243708 - DNA, 20 bp, Artificial Sequence
  chemically synthesized
aattttatcttacataaagc

SEQ ID NO: 243709 - DNA, 20 bp, Artificial Sequence
  chemically synthesized
ttatcttacataaagccagt

SEQ ID NO: 243710 - DNA, 20 bp, Artificial Sequence
  chemically synthesized
aatgtgtctctgaatctaac

SEQ ID NO: 243711 - DNA, 20 bp, Artificial Sequence
  chemically synthesized
tacataaagccagttagatt

SEQ ID NO: 243712 - DNA, 20 bp, Artificial Sequence
  chemically synthesized
cataaagccagttagattca

SEQ ID NO: 243713 - DNA, 20 bp, Artificial Sequence
  chemically synthesized
gttagattcagagacacatt

SEQ ID NO: 243714 - DNA, 20 bp, Artificial Sequence
  chemically synthesized
ctatttatatgtcaaggaca

SEQ ID NO: 243715 - DNA, 20 bp, Artificial Sequence
  chemically synthesized
gaaacactatttatatgtca

SEQ ID NO: 243716 - DNA, 20 bp, Artificial Sequence
  chemically synthesized
agaaacactatttatatgtc

SEQ ID NO: 243717 - DNA, 20 bp, Artificial Sequence
  chemically synthesized
ctttgtccttgacatataaa

SEQ ID NO: 243718 - DNA, 20 bp, Artificial Sequence
  chemically synthesized
agataatggaaagtttagga

SEQ ID NO: 243719 - DNA, 20 bp, Artificial Sequence
  chemically synthesized
aaccagataatggaaagttt

SEQ ID NO: 243720 - DNA, 20 bp, Artificial Sequence
  chemically synthesized
taaccagataatggaaagtt

SEQ ID NO: 243721 - DNA, 20 bp, Artificial Sequence
  chemically synthesized
gaaattaaccagataatgga

SEQ ID NO: 243722 - DNA, 20 bp, Artificial Sequence
  chemically synthesized
ttcctaaactttccattatc

SEQ ID NO: 243723 - DNA, 20 bp, Artificial Sequence
  chemically synthesized
aggagaaattaaccagataa

SEQ ID NO: 243724 - DNA, 20 bp, Artificial Sequence
  chemically synthesized
aaagtttaggagaaattaac

SEQ ID NO: 243725 - DNA, 20 bp, Artificial Sequence
  chemically synthesized
ccagataatggaaagtttag

SEQ ID NO: 243726 - DNA, 20 bp, Artificial Sequence
  chemically synthesized
atccagataatggaaagttt

SEQ ID NO: 243727 - DNA, 20 bp, Artificial Sequence
  chemically synthesized
tatccagataatggaaagtt

SEQ ID NO: 243728 - DNA, 20 bp, Artificial Sequence
  chemically synthesized
gaaattatccagataatgga

SEQ ID NO: 243729 - DNA, 20 bp, Artificial Sequence
  chemically synthesized
ctcctaaactttccattatc

SEQ ID NO: 243730 - DNA, 20 bp, Artificial Sequence
  chemically synthesized
aggagaaattatccagataa

SEQ ID NO: 243731 - DNA, 20 bp, Artificial Sequence
  chemically synthesized
aaaaatgaggagaaattatc

SEQ ID NO: 243732 - DNA, 20 bp, Artificial Sequence
  chemically synthesized
attgagttctaaaaaatgag

SEQ ID NO: 243733 - DNA, 20 bp, Artificial Sequence
  chemically synthesized
gataatttctcctcattttt

SEQ ID NO: 243734 - DNA, 20 bp, Artificial Sequence
  chemically synthesized
gaattgagttctaaaaaatg

SEQ ID NO: 243735 - DNA, 20 bp, Artificial Sequence
  chemically synthesized
tgaattgagttctaaaaaat

SEQ ID NO: 243736 - DNA, 20 bp, Artificial Sequence
  chemically synthesized
cattttttagaactcaattc

SEQ ID NO: 243737 - DNA, 20 bp, Artificial Sequence
  chemically synthesized
attttttagaactcaattca

SEQ ID NO: 243738 - DNA, 20 bp, Artificial Sequence
  chemically synthesized
ggtgagatgatccttgaatt

SEQ ID NO: 243739 - DNA, 20 bp, Artificial Sequence
  chemically synthesized
aattcaaggatcatctcacc

SEQ ID NO: 243740 - DNA, 20 bp, Artificial Sequence
  chemically synthesized
cagtctggaaggatccgggt

SEQ ID NO: 243741 - DNA, 20 bp, Artificial Sequence
  chemically synthesized
gtctcagtctggaaggatcc

SEQ ID NO: 243742 - DNA, 20 bp, Artificial Sequence
  chemically synthesized
ggtctcagtctggaaggatc

SEQ ID NO: 243743 - DNA, 20 bp, Artificial Sequence
  chemically synthesized
tcatctcacccggatccttc

SEQ ID NO: 243744 - DNA, 20 bp, Artificial Sequence
  chemically synthesized
tttgggggtctcagtctgga

SEQ ID NO: 243745 - DNA, 20 bp, Artificial Sequence
  chemically synthesized
cacccggatccttccagact

SEQ ID NO: 243746 - DNA, 20 bp, Artificial Sequence
  chemically synthesized
gtttgggggtctcagtctgg

SEQ ID NO: 243747 - DNA, 20 bp, Artificial Sequence
  chemically synthesized
acagtttgggggtctcagtc

SEQ ID NO: 243748 - DNA, 20 bp, Artificial Sequence
  chemically synthesized
ctaacacagtttgggggtct

SEQ ID NO: 243749 - DNA, 20 bp, Artificial Sequence
  chemically synthesized
gactgtctaacacagtttgg

SEQ ID NO: 243750 - DNA, 20 bp, Artificial Sequence
  chemically synthesized
ggactgtctaacacagtttg

SEQ ID NO: 243751 - DNA, 20 bp, Artificial Sequence
  chemically synthesized
aggactgtctaacacagttt

SEQ ID NO: 243752 - DNA, 20 bp, Artificial Sequence
  chemically synthesized
caggactgtctaacacagtt

SEQ ID NO: 243753 - DNA, 20 bp, Artificial Sequence
  chemically synthesized
ctgagacccccaaactgtgt

SEQ ID NO: 243754 - DNA, 20 bp, Artificial Sequence
  chemically synthesized
gacccccaaactgtgttaga

SEQ ID NO: 243755 - DNA, 20 bp, Artificial Sequence
  chemically synthesized
caaagcaggactgtctaaca

SEQ ID NO: 243756 - DNA, 20 bp, Artificial Sequence
  chemically synthesized
tgtgttagacagtcctgctt

SEQ ID NO: 243757 - DNA, 20 bp, Artificial Sequence
  chemically synthesized
agctaggcatataccaaagc

SEQ ID NO: 243758 - DNA, 20 bp, Artificial Sequence
  chemically synthesized
gagctaggcatataccaaag

SEQ ID NO: 243759 - DNA, 20 bp, Artificial Sequence
  chemically synthesized
tgggagctaggcatatacca

SEQ ID NO: 243760 - DNA, 20 bp, Artificial Sequence
  chemically synthesized
gtcctgctttggtatatgcc

SEQ ID NO: 243761 - DNA, 20 bp, Artificial Sequence
  chemically synthesized
ttggtatatgcctagctccc

SEQ ID NO: 243762 - DNA, 20 bp, Artificial Sequence
  chemically synthesized
tcatgtctgccttgggagct

SEQ ID NO: 243763 - DNA, 20 bp, Artificial Sequence
  chemically synthesized
tggtatatgcctagctccca

SEQ ID NO: 243764 - DNA, 20 bp, Artificial Sequence
  chemically synthesized
ttcatgtctgccttgggagc

SEQ ID NO: 243765 - DNA, 20 bp, Artificial Sequence
  chemically synthesized
tatatgcctagctcccaagg

SEQ ID NO: 243766 - DNA, 20 bp, Artificial Sequence
  chemically synthesized
tcagttcatgtctgccttgg

SEQ ID NO: 243767 - DNA, 20 bp, Artificial Sequence
  chemically synthesized
cctcagttcatgtctgcctt

SEQ ID NO: 243768 - DNA, 20 bp, Artificial Sequence
  chemically synthesized
tcctcagttcatgtctgcct

SEQ ID NO: 243769 - DNA, 20 bp, Artificial Sequence
  chemically synthesized
tcccaaggcagacatgaact

SEQ ID NO: 243770 - DNA, 20 bp, Artificial Sequence
  chemically synthesized
cccaaggcagacatgaactg

SEQ ID NO: 243771 - DNA, 20 bp, Artificial Sequence
  chemically synthesized
aatgcacagtgacgagtcct

SEQ ID NO: 243772 - DNA, 20 bp, Artificial Sequence
  chemically synthesized
cagttttaatgcacagtgac

SEQ ID NO: 243773 - DNA, 20 bp, Artificial Sequence
  chemically synthesized
gaactcacagttttaatgca

SEQ ID NO: 243774 - DNA, 20 bp, Artificial Sequence
  chemically synthesized
tcactgtgcattaaaactgt

SEQ ID NO: 243775 - DNA, 20 bp, Artificial Sequence
  chemically synthesized
agaaaggaattatgaactca

SEQ ID NO: 243776 - DNA, 20 bp, Artificial Sequence
  chemically synthesized
ctgtatttatatatacagaa

SEQ ID NO: 243777 - DNA, 20 bp, Artificial Sequence
  chemically synthesized
tctgtatttatatatacaga

SEQ ID NO: 243778 - DNA, 20 bp, Artificial Sequence
  chemically synthesized
gatttctgtatttatatata

SEQ ID NO: 243779 - DNA, 20 bp, Artificial Sequence
  chemically synthesized
cctttctgtatatataaata

SEQ ID NO: 243780 - DNA, 20 bp, Artificial Sequence
  chemically synthesized
gtatatataaatacagaaat

SEQ ID NO: 243781 - DNA, 20 bp, Artificial Sequence
  chemically synthesized
tatatataaatacagaaatc

SEQ ID NO: 243782 - DNA, 20 bp, Artificial Sequence
  chemically synthesized
atatataaatacagaaatca

SEQ ID NO: 243783 - DNA, 20 bp, Artificial Sequence
  chemically synthesized
atcagggtttatatgttatt

SEQ ID NO: 243784 - DNA, 20 bp, Artificial Sequence
  chemically synthesized
gttattcagttttatatttc

SEQ ID NO: 243785 - DNA, 20 bp, Artificial Sequence
  chemically synthesized
agttttatatttctagccct

SEQ ID NO: 243786 - DNA, 20 bp, Artificial Sequence
  chemically synthesized
cctactatgattctgagggc

SEQ ID NO: 243787 - DNA, 20 bp, Artificial Sequence
  chemically synthesized
tgaccctactatgattctga

SEQ ID NO: 243788 - DNA, 20 bp, Artificial Sequence
  chemically synthesized
gtgaccctactatgattctg

SEQ ID NO: 243789 - DNA, 20 bp, Artificial Sequence
  chemically synthesized
atttctagccctcagaatca

SEQ ID NO: 243790 - DNA, 20 bp, Artificial Sequence
  chemically synthesized
tgtgaccctactatgattct

SEQ ID NO: 243791 - DNA, 20 bp, Artificial Sequence
  chemically synthesized
tctagccctcagaatcatag

SEQ ID NO: 243792 - DNA, 20 bp, Artificial Sequence
  chemically synthesized
ctagccctcagaatcatagt

SEQ ID NO: 243793 - DNA, 20 bp, Artificial Sequence
  chemically synthesized
tagccctcagaatcatagta

SEQ ID NO: 243794 - DNA, 20 bp, Artificial Sequence
  chemically synthesized
attattcattcaacaaagat

SEQ ID NO: 243795 - DNA, 20 bp, Artificial Sequence
  chemically synthesized
gactcattattcattcaaca

SEQ ID NO: 243796 - DNA, 20 bp, Artificial Sequence
  chemically synthesized
atctttgttgaatgaataat

SEQ ID NO: 243797 - DNA, 20 bp, Artificial Sequence
  chemically synthesized
tctgtcaaactggtcattca

SEQ ID NO: 243798 - DNA, 20 bp, Artificial Sequence
  chemically synthesized
ataatgagtctatgaatgac

SEQ ID NO: 243799 - DNA, 20 bp, Artificial Sequence
  chemically synthesized
tctatgaatgaccagtttga

SEQ ID NO: 243800 - DNA, 20 bp, Artificial Sequence
  chemically synthesized
acacttaaactctgtcaaac

SEQ ID NO: 243801 - DNA, 20 bp, Artificial Sequence
  chemically synthesized
tatgaatgaccagtttgaca

SEQ ID NO: 243802 - DNA, 20 bp, Artificial Sequence
  chemically synthesized
tgaccagtttgacagagttt

SEQ ID NO: 243803 - DNA, 20 bp, Artificial Sequence
  chemically synthesized
agtttgacagagtttaagtg

SEQ ID NO: 243804 - DNA, 20 bp, Artificial Sequence
  chemically synthesized
agagtttaagtgtggatgtc

SEQ ID NO: 243805 - DNA, 20 bp, Artificial Sequence
  chemically synthesized
gagtttaagtgtggatgtca

SEQ ID NO: 243806 - DNA, 20 bp, Artificial Sequence
  chemically synthesized
gtggatgtcaaggataaatg

SEQ ID NO: 243807 - DNA, 20 bp, Artificial Sequence
  chemically synthesized
tcaaggataaatgaagaaat

SEQ ID NO: 243808 - DNA, 20 bp, Artificial Sequence
  chemically synthesized
gataaatgaagaaattagcc

SEQ ID NO: 243809 - DNA, 20 bp, Artificial Sequence
  chemically synthesized
catcttcatattagcagact

SEQ ID NO: 243810 - DNA, 20 bp, Artificial Sequence
  chemically synthesized
aatatacatcttcatattag

SEQ ID NO: 243811 - DNA, 20 bp, Artificial Sequence
  chemically synthesized
tagccaagtctgctaatatg

SEQ ID NO: 243812 - DNA, 20 bp, Artificial Sequence
  chemically synthesized
ttaaatatacatcttcatat

SEQ ID NO: 243813 - DNA, 20 bp, Artificial Sequence
  chemically synthesized
atgaagatgtatatttaaat

SEQ ID NO: 243814 - DNA, 20 bp, Artificial Sequence
  chemically synthesized
aagatgtatatttaaatgag

SEQ ID NO: 243815 - DNA, 20 bp, Artificial Sequence
  chemically synthesized
ggtcataattatgaaagtgt

SEQ ID NO: 243816 - DNA, 20 bp, Artificial Sequence
  chemically synthesized
caatgtggtcataattatga

SEQ ID NO: 243817 - DNA, 20 bp, Artificial Sequence
  chemically synthesized
ataaaaccttcaaatcaatg

SEQ ID NO: 243818 - DNA, 20 bp, Artificial Sequence
  chemically synthesized
attatgaccacattgatttg

SEQ ID NO: 243819 - DNA, 20 bp, Artificial Sequence
  chemically synthesized
ttatgaccacattgatttga

SEQ ID NO: 243820 - DNA, 20 bp, Artificial Sequence
  chemically synthesized
attgatttgaaggttttatg

SEQ ID NO: 243821 - DNA, 20 bp, Artificial Sequence
  chemically synthesized
tgatttgaaggttttatgaa

SEQ ID NO: 243822 - DNA, 20 bp, Artificial Sequence
  chemically synthesized
ttgaaggttttatgaagaga

SEQ ID NO: 243823 - DNA, 20 bp, Artificial Sequence
  chemically synthesized
gaaggttttatgaagagaaa

SEQ ID NO: 243824 - DNA, 20 bp, Artificial Sequence
  chemically synthesized
aaggttttatgaagagaaag

SEQ ID NO: 243825 - DNA, 20 bp, Artificial Sequence
  chemically synthesized
agaggttatactaattattt

SEQ ID NO: 243826 - DNA, 20 bp, Artificial Sequence
  chemically synthesized
aaagaaacagctcaaataat

SEQ ID NO: 243827 - DNA, 20 bp, Artificial Sequence
  chemically synthesized
caatcacttatgaaaagaaa

SEQ ID NO: 243828 - DNA, 20 bp, Artificial Sequence
  chemically synthesized
tttgagctgtttcttttcat

SEQ ID NO: 243829 - DNA, 20 bp, Artificial Sequence
  chemically synthesized
tgaccacaatcacttatgaa

SEQ ID NO: 243830 - DNA, 20 bp, Artificial Sequence
  chemically synthesized
tttcttttcataagtgattg

SEQ ID NO: 243831 - DNA, 20 bp, Artificial Sequence
  chemically synthesized
ttttcataagtgattgtggt

SEQ ID NO: 243832 - DNA, 20 bp, Artificial Sequence
  chemically synthesized
gtagcatcattgtttaattt

SEQ ID NO: 243833 - DNA, 20 bp, Artificial Sequence
  chemically synthesized
aattaaacaatgatgctacg

SEQ ID NO: 243834 - DNA, 20 bp, Artificial Sequence
  chemically synthesized
aaacaatgatgctacgaaga

SEQ ID NO: 243835 - DNA, 20 bp, Artificial Sequence
  chemically synthesized
ccttccttaatctttcttcg

SEQ ID NO: 243836 - DNA, 20 bp, Artificial Sequence
  chemically synthesized
tgatgctacgaagaaagatt

SEQ ID NO: 243837 - DNA, 20 bp, Artificial Sequence
  chemically synthesized
gatgctacgaagaaagatta

SEQ ID NO: 243838 - DNA, 20 bp, Artificial Sequence
  chemically synthesized
gctacgaagaaagattaagg

SEQ ID NO: 243839 - DNA, 20 bp, Artificial Sequence
  chemically synthesized
ctacgaagaaagattaagga

SEQ ID NO: 243840 - DNA, 20 bp, Artificial Sequence
  chemically synthesized
taaggaaggatattatcaaa

SEQ ID NO: 243841 - DNA, 20 bp, Artificial Sequence
  chemically synthesized
atgaaggactggcaggtttg

SEQ ID NO: 243842 - DNA, 20 bp, Artificial Sequence
  chemically synthesized
catgaaggactggcaggttt

SEQ ID NO: 243843 - DNA, 20 bp, Artificial Sequence
  chemically synthesized
tcaaacagccccaaacctgc

SEQ ID NO: 243844 - DNA, 20 bp, Artificial Sequence
  chemically synthesized
ccatgaaggactggcaggtt

SEQ ID NO: 243845 - DNA, 20 bp, Artificial Sequence
  chemically synthesized
tgaaaccatgaaggactggc

SEQ ID NO: 243846 - DNA, 20 bp, Artificial Sequence
  chemically synthesized
gtgaaaccatgaaggactgg

SEQ ID NO: 243847 - DNA, 20 bp, Artificial Sequence
  chemically synthesized
acagtgaaaccatgaaggac

SEQ ID NO: 243848 - DNA, 20 bp, Artificial Sequence
  chemically synthesized
ccaaacctgccagtccttca

SEQ ID NO: 243849 - DNA, 20 bp, Artificial Sequence
  chemically synthesized
catttacagtgaaaccatga

SEQ ID NO: 243850 - DNA, 20 bp, Artificial Sequence
  chemically synthesized
gcatttacagtgaaaccatg

SEQ ID NO: 243851 - DNA, 20 bp, Artificial Sequence
  chemically synthesized
tggctgtacctgagcattta

SEQ ID NO: 243852 - DNA, 20 bp, Artificial Sequence
  chemically synthesized
atggtttcactgtaaatgct

SEQ ID NO: 243853 - DNA, 20 bp, Artificial Sequence
  chemically synthesized
tggtttcactgtaaatgctc

SEQ ID NO: 243854 - DNA, 20 bp, Artificial Sequence
  chemically synthesized
tcactgtaaatgctcaggta

SEQ ID NO: 243855 - DNA, 20 bp, Artificial Sequence
  chemically synthesized
tataagtattggctgtacct

SEQ ID NO: 243856 - DNA, 20 bp, Artificial Sequence
  chemically synthesized
taaaattcatatataagtat

SEQ ID NO: 243857 - DNA, 20 bp, Artificial Sequence
  chemically synthesized
gattattaaaattcatatat

SEQ ID NO: 243858 - DNA, 20 bp, Artificial Sequence
  chemically synthesized
atatgagataaatttaagaa

SEQ ID NO: 243859 - DNA, 20 bp, Artificial Sequence
  chemically synthesized
cacaaatatgagataaattt

SEQ ID NO: 243860 - DNA, 20 bp, Artificial Sequence
  chemically synthesized
ttaaatttatctcatatttg

SEQ ID NO: 243861 - DNA, 20 bp, Artificial Sequence
  chemically synthesized
atctcctctaccacaaatat

SEQ ID NO: 243862 - DNA, 20 bp, Artificial Sequence
  chemically synthesized
aatttatctcatatttgtgg

SEQ ID NO: 243863 - DNA, 20 bp, Artificial Sequence
  chemically synthesized
tttatctcatatttgtggta

SEQ ID NO: 243864 - DNA, 20 bp, Artificial Sequence
  chemically synthesized
ttatctcatatttgtggtag

SEQ ID NO: 243865 - DNA, 20 bp, Artificial Sequence
  chemically synthesized
atctcatatttgtggtagag

SEQ ID NO: 243866 - DNA, 20 bp, Artificial Sequence
  chemically synthesized
ggtagaggagatttacaaaa

SEQ ID NO: 243867 - DNA, 20 bp, Artificial Sequence
  chemically synthesized
gtagaggagatttacaaaaa

SEQ ID NO: 243868 - DNA, 20 bp, Artificial Sequence
  chemically synthesized
aaaaaaggcattgttaacat

SEQ ID NO: 243869 - DNA, 20 bp, Artificial Sequence
  chemically synthesized
ttatttaacaacagttgtat

SEQ ID NO: 243870 - DNA, 20 bp, Artificial Sequence
  chemically synthesized
tcagaagttttatttaacaa

SEQ ID NO: 243871 - DNA, 20 bp, Artificial Sequence
  chemically synthesized
gttgttaaataaaacttctg

SEQ ID NO: 243872 - DNA, 20 bp, Artificial Sequence
  chemically synthesized
aaataactatatgacttcag

SEQ ID NO: 243873 - DNA, 20 bp, Artificial Sequence
  chemically synthesized
aataaataactatatgactt

SEQ ID NO: 243874 - DNA, 20 bp, Artificial Sequence
  chemically synthesized
ataaaacttctgaagtcata

SEQ ID NO: 243875 - DNA, 20 bp, Artificial Sequence
  chemically synthesized
tatgataagatggtttatac

SEQ ID NO: 243876 - DNA, 20 bp, Artificial Sequence
  chemically synthesized
caaaaaagaatatgataaga

SEQ ID NO: 243877 - DNA, 20 bp, Artificial Sequence
  chemically synthesized
gctccaaaaaagaatatgat

SEQ ID NO: 243878 - DNA, 20 bp, Artificial Sequence
  chemically synthesized
catcttatcatattcttttt

SEQ ID NO: 243879 - DNA, 20 bp, Artificial Sequence
  chemically synthesized
tcttatcatattcttttttg

SEQ ID NO: 243880 - DNA, 20 bp, Artificial Sequence
  chemically synthesized
atatgtaaacagctccaaaa

SEQ ID NO: 243881 - DNA, 20 bp, Artificial Sequence
  chemically synthesized
gagattaaaagatatgtaaa

SEQ ID NO: 243882 - DNA, 20 bp, Artificial Sequence
  chemically synthesized
tttcttagttcagagattaa

SEQ ID NO: 243883 - DNA, 20 bp, Artificial Sequence
  chemically synthesized
tatcttttaatctctgaact

SEQ ID NO: 243884 - DNA, 20 bp, Artificial Sequence
  chemically synthesized
aattttaatttcttagttca

SEQ ID NO: 243885 - DNA, 20 bp, Artificial Sequence
  chemically synthesized
acaattttaatttcttagtt

SEQ ID NO: 243886 - DNA, 20 bp, Artificial Sequence
  chemically synthesized
caaatacaattttaatttct

SEQ ID NO: 243887 - DNA, 20 bp, Artificial Sequence
  chemically synthesized
aaattgtatttgacaacaat

SEQ ID NO: 243888 - DNA, 20 bp, Artificial Sequence
  chemically synthesized
atatattttaattataattt

SEQ ID NO: 243889 - DNA, 20 bp, Artificial Sequence
  chemically synthesized
atgttgttacacacctcgac

SEQ ID NO: 243890 - DNA, 20 bp, Artificial Sequence
  chemically synthesized
ttctgagtgcttgcttgtcg

SEQ ID NO: 243891 - DNA, 20 bp, Artificial Sequence
  chemically synthesized
tgttacacacctcgacaagc

SEQ ID NO: 243892 - DNA, 20 bp, Artificial Sequence
  chemically synthesized
tttctgagtgcttgcttgtc

SEQ ID NO: 243893 - DNA, 20 bp, Artificial Sequence
  chemically synthesized
cacctcgacaagcaagcact

SEQ ID NO: 243894 - DNA, 20 bp, Artificial Sequence
  chemically synthesized
agaatataaagtgggtttct

SEQ ID NO: 243895 - DNA, 20 bp, Artificial Sequence
  chemically synthesized
atagaaacagaatataaagt

SEQ ID NO: 243896 - DNA, 20 bp, Artificial Sequence
  chemically synthesized
aatagaaacagaatataaag

SEQ ID NO: 243897 - DNA, 20 bp, Artificial Sequence
  chemically synthesized
cctaatagaaacagaatata

SEQ ID NO: 243898 - DNA, 20 bp, Artificial Sequence
  chemically synthesized
actttatattctgtttctat

SEQ ID NO: 243899 - DNA, 20 bp, Artificial Sequence
  chemically synthesized
aattagtatcctaatagaaa

SEQ ID NO: 243900 - DNA, 20 bp, Artificial Sequence
  chemically synthesized
ctttatattctgtttctatt

SEQ ID NO: 243901 - DNA, 20 bp, Artificial Sequence
  chemically synthesized
tgccataattagtatcctaa

SEQ ID NO: 243902 - DNA, 20 bp, Artificial Sequence
  chemically synthesized
ttctattaggatactaatta

SEQ ID NO: 243903 - DNA, 20 bp, Artificial Sequence
  chemically synthesized
ttttggaatagtgccataat

SEQ ID NO: 243904 - DNA, 20 bp, Artificial Sequence
  chemically synthesized
ctttgtttttttttttggaa

SEQ ID NO: 243905 - DNA, 20 bp, Artificial Sequence
  chemically synthesized
tgtttctttgtttttttttt

SEQ ID NO: 243906 - DNA, 20 bp, Artificial Sequence
  chemically synthesized
ctattccaaaaaaaaaaaca

SEQ ID NO: 243907 - DNA, 20 bp, Artificial Sequence
  chemically synthesized
aaaaaaaaaacaaagaaaca

SEQ ID NO: 243908 - DNA, 20 bp, Artificial Sequence
  chemically synthesized
aatagtattgtgtttgcaat

SEQ ID NO: 243909 - DNA, 20 bp, Artificial Sequence
  chemically synthesized
aaccaaggagttaaaattaa

SEQ ID NO: 243910 - DNA, 20 bp, Artificial Sequence
  chemically synthesized
tactattaattttaactcct

SEQ ID NO: 243911 - DNA, 20 bp, Artificial Sequence
  chemically synthesized
aaattttattgagaaccaag

SEQ ID NO: 243912 - DNA, 20 bp, Artificial Sequence
  chemically synthesized
tcaaattttattgagaacca

SEQ ID NO: 243913 - DNA, 20 bp, Artificial Sequence
  chemically synthesized
ctcaaattttattgagaacc

SEQ ID NO: 243914 - DNA, 20 bp, Artificial Sequence
  chemically synthesized
ttactagctcaaattttatt

SEQ ID NO: 243915 - DNA, 20 bp, Artificial Sequence
  chemically synthesized
cttggttctcaataaaattt

SEQ ID NO: 243916 - DNA, 20 bp, Artificial Sequence
  chemically synthesized
gttctcaataaaatttgagc

SEQ ID NO: 243917 - DNA, 20 bp, Artificial Sequence
  chemically synthesized
ataattaattacgtggttac

SEQ ID NO: 243918 - DNA, 20 bp, Artificial Sequence
  chemically synthesized
gcaattaataattaattacg

SEQ ID NO: 243919 - DNA, 20 bp, Artificial Sequence
  chemically synthesized
gtaattaattattaattgct

SEQ ID NO: 243920 - DNA, 20 bp, Artificial Sequence
  chemically synthesized
ttggcatagtggagtgcact

SEQ ID NO: 243921 - DNA, 20 bp, Artificial Sequence
  chemically synthesized
ataattaacttggcatagtg

SEQ ID NO: 243922 - DNA, 20 bp, Artificial Sequence
  chemically synthesized
tcagtgcactccactatgcc

SEQ ID NO: 243923 - DNA, 20 bp, Artificial Sequence
  chemically synthesized
tgataattaacttggcatag

SEQ ID NO: 243924 - DNA, 20 bp, Artificial Sequence
  chemically synthesized
tcttgataattaacttggca

SEQ ID NO: 243925 - DNA, 20 bp, Artificial Sequence
  chemically synthesized
gttattcttgataattaact

SEQ ID NO: 243926 - DNA, 20 bp, Artificial Sequence
  chemically synthesized
actatgccaagttaattatc

SEQ ID NO: 243927 - DNA, 20 bp, Artificial Sequence
  chemically synthesized
gttaattatcaagaataact

SEQ ID NO: 243928 - DNA, 20 bp, Artificial Sequence
  chemically synthesized
ttcataataaaagtcacacc

SEQ ID NO: 243929 - DNA, 20 bp, Artificial Sequence
  chemically synthesized
taattatccattcataataa

SEQ ID NO: 243930 - DNA, 20 bp, Artificial Sequence
  chemically synthesized
ggtgtgacttttattatgaa

SEQ ID NO: 243931 - DNA, 20 bp, Artificial Sequence
  chemically synthesized
ctgataattctagaaaaaca

SEQ ID NO: 243932 - DNA, 20 bp, Artificial Sequence
  chemically synthesized
taattacaaccttgtttttc

SEQ ID NO: 243933 - DNA, 20 bp, Artificial Sequence
  chemically synthesized
cctgataattctagaaaaac

SEQ ID NO: 243934 - DNA, 20 bp, Artificial Sequence
  chemically synthesized
ccttgtttttctagaattat

SEQ ID NO: 243935 - DNA, 20 bp, Artificial Sequence
  chemically synthesized
gtttaaaatcctgataattc

SEQ ID NO: 243936 - DNA, 20 bp, Artificial Sequence
  chemically synthesized
cttgtttttctagaattatc

SEQ ID NO: 243937 - DNA, 20 bp, Artificial Sequence
  chemically synthesized
taaacatgaaaataataatg

SEQ ID NO: 243938 - DNA, 20 bp, Artificial Sequence
  chemically synthesized
aaacatgaaaataataatga

SEQ ID NO: 243939 - DNA, 20 bp, Artificial Sequence
  chemically synthesized
tgaaaataataatgaaggta

SEQ ID NO: 243940 - DNA, 20 bp, Artificial Sequence
  chemically synthesized
taataatgaaggtaaagata

SEQ ID NO: 243941 - DNA, 20 bp, Artificial Sequence
  chemically synthesized
aataatgaaggtaaagatat

SEQ ID NO: 243942 - DNA, 20 bp, Artificial Sequence
  chemically synthesized
tagcatatcagcatatttaa

SEQ ID NO: 243943 - DNA, 20 bp, Artificial Sequence
  chemically synthesized
attagcatatcagcatattt

SEQ ID NO: 243944 - DNA, 20 bp, Artificial Sequence
  chemically synthesized
tttcataatgattagcatat

SEQ ID NO: 243945 - DNA, 20 bp, Artificial Sequence
  chemically synthesized
tcctattatttcataatgat

SEQ ID NO: 243946 - DNA, 20 bp, Artificial Sequence
  chemically synthesized
tgctaatcattatgaaataa

SEQ ID NO: 243947 - DNA, 20 bp, Artificial Sequence
  chemically synthesized
gctaatcattatgaaataat

SEQ ID NO: 243948 - DNA, 20 bp, Artificial Sequence
  chemically synthesized
taggatgttcatttttataa

SEQ ID NO: 243949 - DNA, 20 bp, Artificial Sequence
  chemically synthesized
ataatagtatcattcttata

SEQ ID NO: 243950 - DNA, 20 bp, Artificial Sequence
  chemically synthesized
taatagtatcattcttatat

SEQ ID NO: 243951 - DNA, 20 bp, Artificial Sequence
  chemically synthesized
aatagtatcattcttatata

SEQ ID NO: 243952 - DNA, 20 bp, Artificial Sequence
  chemically synthesized
tcctgtcttggtccctatat

SEQ ID NO: 243953 - DNA, 20 bp, Artificial Sequence
  chemically synthesized
atcattcttatatagggacc

SEQ ID NO: 243954 - DNA, 20 bp, Artificial Sequence
  chemically synthesized
ttcttatatagggaccaaga

SEQ ID NO: 243955 - DNA, 20 bp, Artificial Sequence
  chemically synthesized
tcttatatagggaccaagac

SEQ ID NO: 243956 - DNA, 20 bp, Artificial Sequence
  chemically synthesized
agtacttttctatcctgtct

SEQ ID NO: 243957 - DNA, 20 bp, Artificial Sequence
  chemically synthesized
atatagggaccaagacagga

SEQ ID NO: 243958 - DNA, 20 bp, Artificial Sequence
  chemically synthesized
gggaccaagacaggatagaa

SEQ ID NO: 243959 - DNA, 20 bp, Artificial Sequence
  chemically synthesized
agacaggatagaaaagtact

SEQ ID NO: 243960 - DNA, 20 bp, Artificial Sequence
  chemically synthesized
aggatagaaaagtacttaga

SEQ ID NO: 243961 - DNA, 20 bp, Artificial Sequence
  chemically synthesized
tgtttagcttagtactttct

SEQ ID NO: 243962 - DNA, 20 bp, Artificial Sequence
  chemically synthesized
aaaagtacttagaaagtact

SEQ ID NO: 243963 - DNA, 20 bp, Artificial Sequence
  chemically synthesized
gttaacttatttgtttagct

SEQ ID NO: 243964 - DNA, 20 bp, Artificial Sequence
  chemically synthesized
aagtactaagctaaacaaat

SEQ ID NO: 243965 - DNA, 20 bp, Artificial Sequence
  chemically synthesized
cctttgttaacttatttgtt

SEQ ID NO: 243966 - DNA, 20 bp, Artificial Sequence
  chemically synthesized
gctaaacaaataagttaaca

SEQ ID NO: 243967 - DNA, 20 bp, Artificial Sequence
  chemically synthesized
ctaaacaaataagttaacaa

SEQ ID NO: 243968 - DNA, 20 bp, Artificial Sequence
  chemically synthesized
atatatatcattatatataa

SEQ ID NO: 243969 - DNA, 20 bp, Artificial Sequence
  chemically synthesized
tataatgatatatattcgtg

SEQ ID NO: 243970 - DNA, 20 bp, Artificial Sequence
  chemically synthesized
gatatatattcgtgaagtga

SEQ ID NO: 243971 - DNA, 20 bp, Artificial Sequence
  chemically synthesized
atatatattcgtgaagtgaa

SEQ ID NO: 243972 - DNA, 20 bp, Artificial Sequence
  chemically synthesized
tgaagtgaaaggccaattct

SEQ ID NO: 243973 - DNA, 20 bp, Artificial Sequence
  chemically synthesized
actaatgtctaactaagaat

SEQ ID NO: 243974 - DNA, 20 bp, Artificial Sequence
  chemically synthesized
gtgaaaggccaattcttagt

SEQ ID NO: 243975 - DNA, 20 bp, Artificial Sequence
  chemically synthesized
aataaaactaatgtctaact

SEQ ID NO: 243976 - DNA, 20 bp, Artificial Sequence
  chemically synthesized
gccaattcttagttagacat

SEQ ID NO: 243977 - DNA, 20 bp, Artificial Sequence
  chemically synthesized
gttagacattagttttattc

SEQ ID NO: 243978 - DNA, 20 bp, Artificial Sequence
  chemically synthesized
acattagttttattccagcc

SEQ ID NO: 243979 - DNA, 20 bp, Artificial Sequence
  chemically synthesized
cattagttttattccagcct

SEQ ID NO: 243980 - DNA, 20 bp, Artificial Sequence
  chemically synthesized
ttagttttattccagcctag

SEQ ID NO: 243981 - DNA, 20 bp, Artificial Sequence
  chemically synthesized
gaatgagaattctcctaggc

SEQ ID NO: 243982 - DNA, 20 bp, Artificial Sequence
  chemically synthesized
gaatgaatgagaattctcct

SEQ ID NO: 243983 - DNA, 20 bp, Artificial Sequence
  chemically synthesized
ggaatgaatgagaattctcc

SEQ ID NO: 243984 - DNA, 20 bp, Artificial Sequence
  chemically synthesized
ggtagagcatgggaatgaat

SEQ ID NO: 243985 - DNA, 20 bp, Artificial Sequence
  chemically synthesized
taattcttatggtagagcat

SEQ ID NO: 243986 - DNA, 20 bp, Artificial Sequence
  chemically synthesized
gtaattcttatggtagagca

SEQ ID NO: 243987 - DNA, 20 bp, Artificial Sequence
  chemically synthesized
tcattcccatgctctaccat

SEQ ID NO: 243988 - DNA, 20 bp, Artificial Sequence
  chemically synthesized
tatttgtaattcttatggta

SEQ ID NO: 243989 - DNA, 20 bp, Artificial Sequence
  chemically synthesized
gatatttgtaattcttatgg

SEQ ID NO: 243990 - DNA, 20 bp, Artificial Sequence
  chemically synthesized
ttagatatttgtaattctta

SEQ ID NO: 243991 - DNA, 20 bp, Artificial Sequence
  chemically synthesized
cataagaattacaaatatct

SEQ ID NO: 243992 - DNA, 20 bp, Artificial Sequence
  chemically synthesized
tgtttatacatacatgtact

SEQ ID NO: 243993 - DNA, 20 bp, Artificial Sequence
  chemically synthesized
atgcataaccaaaataggtt

SEQ ID NO: 243994 - DNA, 20 bp, Artificial Sequence
  chemically synthesized
aacatttgctgaacctattt

SEQ ID NO: 243995 - DNA, 20 bp, Artificial Sequence
  chemically synthesized
atttaatgcataaccaaaat

SEQ ID NO: 243996 - DNA, 20 bp, Artificial Sequence
  chemically synthesized
tatttaatgcataaccaaaa

SEQ ID NO: 243997 - DNA, 20 bp, Artificial Sequence
  chemically synthesized
tactgttgtgttcacattta

SEQ ID NO: 243998 - DNA, 20 bp, Artificial Sequence
  chemically synthesized
atctttaaatgtgaacacaa

SEQ ID NO: 243999 - DNA, 20 bp, Artificial Sequence
  chemically synthesized
tgttttcatcaattttattt

SEQ ID NO: 244000 - DNA, 20 bp, Artificial Sequence
  chemically synthesized
tcaattttatttcagttact

SEQ ID NO: 244001 - DNA, 20 bp, Artificial Sequence
  chemically synthesized
ttttatttcagttactgagt

SEQ ID NO: 244002 - DNA, 20 bp, Artificial Sequence
  chemically synthesized
tcagttgggcagttctgact

SEQ ID NO: 244003 - DNA, 20 bp, Artificial Sequence
  chemically synthesized
caaaactttattcagttggg

SEQ ID NO: 244004 - DNA, 20 bp, Artificial Sequence
  chemically synthesized
ttacaaaactttattcagtt

SEQ ID NO: 244005 - DNA, 20 bp, Artificial Sequence
  chemically synthesized
tttacaaaactttattcagt

SEQ ID NO: 244006 - DNA, 20 bp, Artificial Sequence
  chemically synthesized
cagaactgcccaactgaata

SEQ ID NO: 244007 - DNA, 20 bp, Artificial Sequence
  chemically synthesized
tatgtttacaaaactttatt

SEQ ID NO: 244008 - DNA, 20 bp, Artificial Sequence
  chemically synthesized
aataaagttttgtaaacata

SEQ ID NO: 244009 - DNA, 20 bp, Artificial Sequence
  chemically synthesized
tttgtaaacatatagcttta

SEQ ID NO: 244010 - DNA, 20 bp, Artificial Sequence
  chemically synthesized
tttagatttaaggaactata

SEQ ID NO: 244011 - DNA, 20 bp, Artificial Sequence
  chemically synthesized
ttagagtagatttagattta

SEQ ID NO: 244012 - DNA, 20 bp, Artificial Sequence
  chemically synthesized
attagagtagatttagattt

SEQ ID NO: 244013 - DNA, 20 bp, Artificial Sequence
  chemically synthesized
tttgaaaattagagtagatt

SEQ ID NO: 244014 - DNA, 20 bp, Artificial Sequence
  chemically synthesized
ttgtgctttgaaaattagag

SEQ ID NO: 244015 - DNA, 20 bp, Artificial Sequence
  chemically synthesized
tttttgtgctttgaaaatta

SEQ ID NO: 244016 - DNA, 20 bp, Artificial Sequence
  chemically synthesized
taaatctactctaattttca

SEQ ID NO: 244017 - DNA, 20 bp, Artificial Sequence
  chemically synthesized
tttttttgtgctttgaaaat

SEQ ID NO: 244018 - DNA, 20 bp, Artificial Sequence
  chemically synthesized
tcaaagcacaaaaaaataca

SEQ ID NO: 244019 - DNA, 20 bp, Artificial Sequence
  chemically synthesized
attttagtaggatatttgat

SEQ ID NO: 244020 - DNA, 20 bp, Artificial Sequence
  chemically synthesized
attcaaaggaacattttagt

SEQ ID NO: 244021 - DNA, 20 bp, Artificial Sequence
  chemically synthesized
gattcaaaggaacattttag

SEQ ID NO: 244022 - DNA, 20 bp, Artificial Sequence
  chemically synthesized
atagattcaaaggaacattt

SEQ ID NO: 244023 - DNA, 20 bp, Artificial Sequence
  chemically synthesized
atgggagaccatagattcaa

SEQ ID NO: 244024 - DNA, 20 bp, Artificial Sequence
  chemically synthesized
aatgggagaccatagattca

SEQ ID NO: 244025 - DNA, 20 bp, Artificial Sequence
  chemically synthesized
aaaatgttcctttgaatcta

SEQ ID NO: 244026 - DNA, 20 bp, Artificial Sequence
  chemically synthesized
accaaacaaatgggagacca

SEQ ID NO: 244027 - DNA, 20 bp, Artificial Sequence
  chemically synthesized
cttgatcaccaaacaaatgg

SEQ ID NO: 244028 - DNA, 20 bp, Artificial Sequence
  chemically synthesized
tctatggtctcccatttgtt

SEQ ID NO: 244029 - DNA, 20 bp, Artificial Sequence
  chemically synthesized
ctcttgatcaccaaacaaat

SEQ ID NO: 244030 - DNA, 20 bp, Artificial Sequence
  chemically synthesized
gctcttgatcaccaaacaaa

SEQ ID NO: 244031 - DNA, 20 bp, Artificial Sequence
  chemically synthesized
ctcccatttgtttggtgatc

SEQ ID NO: 244032 - DNA, 20 bp, Artificial Sequence
  chemically synthesized
cccatttgtttggtgatcaa

SEQ ID NO: 244033 - DNA, 20 bp, Artificial Sequence
  chemically synthesized
ttctttgaaattatgaacag

SEQ ID NO: 244034 - DNA, 20 bp, Artificial Sequence
  chemically synthesized
agattctttgaaattatgaa

SEQ ID NO: 244035 - DNA, 20 bp, Artificial Sequence
  chemically synthesized
agctactgttcataatttca

SEQ ID NO: 244036 - DNA, 20 bp, Artificial Sequence
  chemically synthesized
cttttccactttgttatttc

SEQ ID NO: 244037 - DNA, 20 bp, Artificial Sequence
  chemically synthesized
caaagaatcttgaaataaca

SEQ ID NO: 244038 - DNA, 20 bp, Artificial Sequence
  chemically synthesized
agaatcttgaaataacaaag

SEQ ID NO: 244039 - DNA, 20 bp, Artificial Sequence
  chemically synthesized
cttgaaataacaaagtggaa

SEQ ID NO: 244040 - DNA, 20 bp, Artificial Sequence
  chemically synthesized
aacaaagtggaaaagtgctt

SEQ ID NO: 244041 - DNA, 20 bp, Artificial Sequence
  chemically synthesized
acaaagtggaaaagtgcttg

SEQ ID NO: 244042 - DNA, 20 bp, Artificial Sequence
  chemically synthesized
aagtggaaaagtgcttgagg

SEQ ID NO: 244043 - DNA, 20 bp, Artificial Sequence
  chemically synthesized
gtggaaaagtgcttgaggaa

SEQ ID NO: 244044 - DNA, 20 bp, Artificial Sequence
  chemically synthesized
tgtatcctggtctcttcctc

SEQ ID NO: 244045 - DNA, 20 bp, Artificial Sequence
  chemically synthesized
aaagtgcttgaggaagagac

SEQ ID NO: 244046 - DNA, 20 bp, Artificial Sequence
  chemically synthesized
aagtgcttgaggaagagacc

SEQ ID NO: 244047 - DNA, 20 bp, Artificial Sequence
  chemically synthesized
agctacttgtcagtgtatcc

SEQ ID NO: 244048 - DNA, 20 bp, Artificial Sequence
  chemically synthesized
agagaccaggatacactgac

SEQ ID NO: 244049 - DNA, 20 bp, Artificial Sequence
  chemically synthesized
gaccaggatacactgacaag

SEQ ID NO: 244050 - DNA, 20 bp, Artificial Sequence
  chemically synthesized
tagcactctgagctacttgt

SEQ ID NO: 244051 - DNA, 20 bp, Artificial Sequence
  chemically synthesized
ggatacactgacaagtagct

SEQ ID NO: 244052 - DNA, 20 bp, Artificial Sequence
  chemically synthesized
atacactgacaagtagctca

SEQ ID NO: 244053 - DNA, 20 bp, Artificial Sequence
  chemically synthesized
acccttgccattagcactct

SEQ ID NO: 244054 - DNA, 20 bp, Artificial Sequence
  chemically synthesized
caagtagctcagagtgctaa

SEQ ID NO: 244055 - DNA, 20 bp, Artificial Sequence
  chemically synthesized
tagctcagagtgctaatggc

SEQ ID NO: 244056 - DNA, 20 bp, Artificial Sequence
  chemically synthesized
agctcagagtgctaatggca

SEQ ID NO: 244057 - DNA, 20 bp, Artificial Sequence
  chemically synthesized
gctcagagtgctaatggcaa

SEQ ID NO: 244058 - DNA, 20 bp, Artificial Sequence
  chemically synthesized
atgattctgacccttgccat

SEQ ID NO: 244059 - DNA, 20 bp, Artificial Sequence
  chemically synthesized
agagtgctaatggcaagggt

SEQ ID NO: 244060 - DNA, 20 bp, Artificial Sequence
  chemically synthesized
aatggcaagggtcagaatca

SEQ ID NO: 244061 - DNA, 20 bp, Artificial Sequence
  chemically synthesized
taagtaaaataggcataata

SEQ ID NO: 244062 - DNA, 20 bp, Artificial Sequence
  chemically synthesized
aattttctcataagtaaaat

SEQ ID NO: 244063 - DNA, 20 bp, Artificial Sequence
  chemically synthesized
caattttctcataagtaaaa

SEQ ID NO: 244064 - DNA, 20 bp, Artificial Sequence
  chemically synthesized
attatgcctattttacttat

SEQ ID NO: 244065 - DNA, 20 bp, Artificial Sequence
  chemically synthesized
ctgaacctcaattttctcat

SEQ ID NO: 244066 - DNA, 20 bp, Artificial Sequence
  chemically synthesized
attttacttatgagaaaatt

SEQ ID NO: 244067 - DNA, 20 bp, Artificial Sequence
  chemically synthesized
ttttacttatgagaaaattg

SEQ ID NO: 244068 - DNA, 20 bp, Artificial Sequence
  chemically synthesized
cttatgagaaaattgaggtt

SEQ ID NO: 244069 - DNA, 20 bp, Artificial Sequence
  chemically synthesized
tgtgaatttttggcaagttt

SEQ ID NO: 244070 - DNA, 20 bp, Artificial Sequence
  chemically synthesized
tgattgtgtgaatttttggc

SEQ ID NO: 244071 - DNA, 20 bp, Artificial Sequence
  chemically synthesized
tctctgattgtgtgaatttt

SEQ ID NO: 244072 - DNA, 20 bp, Artificial Sequence
  chemically synthesized
ttgccaaaaattcacacaat

SEQ ID NO: 244073 - DNA, 20 bp, Artificial Sequence
  chemically synthesized
gccaaaaattcacacaatca

SEQ ID NO: 244074 - DNA, 20 bp, Artificial Sequence
  chemically synthesized
ttcacacaatcagagattga

SEQ ID NO: 244075 - DNA, 20 bp, Artificial Sequence
  chemically synthesized
cacacaatcagagattgatg

SEQ ID NO: 244076 - DNA, 20 bp, Artificial Sequence
  chemically synthesized
attgacctgagtttgaatcg

SEQ ID NO: 244077 - DNA, 20 bp, Artificial Sequence
  chemically synthesized
atggagccacgattcaaact

SEQ ID NO: 244078 - DNA, 20 bp, Artificial Sequence
  chemically synthesized
tggagccacgattcaaactc

SEQ ID NO: 244079 - DNA, 20 bp, Artificial Sequence
  chemically synthesized
ctttggaattagattgacct

SEQ ID NO: 244080 - DNA, 20 bp, Artificial Sequence
  chemically synthesized
ctcaggtcaatctaattcca

SEQ ID NO: 244081 - DNA, 20 bp, Artificial Sequence
  chemically synthesized
taagagcttggctttggaat

SEQ ID NO: 244082 - DNA, 20 bp, Artificial Sequence
  chemically synthesized
gtcaatctaattccaaagcc

SEQ ID NO: 244083 - DNA, 20 bp, Artificial Sequence
  chemically synthesized
cacagttaagagcttggctt

SEQ ID NO: 244084 - DNA, 20 bp, Artificial Sequence
  chemically synthesized
ctcagacacagttaagagct

SEQ ID NO: 244085 - DNA, 20 bp, Artificial Sequence
  chemically synthesized
tgagtctcagacacagttaa

SEQ ID NO: 244086 - DNA, 20 bp, Artificial Sequence
  chemically synthesized
agtgagtctcagacacagtt

SEQ ID NO: 244087 - DNA, 20 bp, Artificial Sequence
  chemically synthesized
ccaagctcttaactgtgtct

SEQ ID NO: 244088 - DNA, 20 bp, Artificial Sequence
  chemically synthesized
ggataagtgagtctcagaca

SEQ ID NO: 244089 - DNA, 20 bp, Artificial Sequence
  chemically synthesized
ttccagggataagtgagtct

SEQ ID NO: 244090 - DNA, 20 bp, Artificial Sequence
  chemically synthesized
tagcttttccagggataagt

SEQ ID NO: 244091 - DNA, 20 bp, Artificial Sequence
  chemically synthesized
gtctgagactcacttatccc

SEQ ID NO: 244092 - DNA, 20 bp, Artificial Sequence
  chemically synthesized
tttgtagcttttccagggat

SEQ ID NO: 244093 - DNA, 20 bp, Artificial Sequence
  chemically synthesized
agactcacttatccctggaa

SEQ ID NO: 244094 - DNA, 20 bp, Artificial Sequence
  chemically synthesized
ccagatttgtagcttttcca

SEQ ID NO: 244095 - DNA, 20 bp, Artificial Sequence
  chemically synthesized
gccagatttgtagcttttcc

SEQ ID NO: 244096 - DNA, 20 bp, Artificial Sequence
  chemically synthesized
agccagatttgtagcttttc

SEQ ID NO: 244097 - DNA, 20 bp, Artificial Sequence
  chemically synthesized
ccctggaaaagctacaaatc

SEQ ID NO: 244098 - DNA, 20 bp, Artificial Sequence
  chemically synthesized
acaggagaaagccagatttg

SEQ ID NO: 244099 - DNA, 20 bp, Artificial Sequence
  chemically synthesized
gaatattgacaggagaaagc

SEQ ID NO: 244100 - DNA, 20 bp, Artificial Sequence
  chemically synthesized
tgtcgaatattgacaggaga

SEQ ID NO: 244101 - DNA, 20 bp, Artificial Sequence
  chemically synthesized
tttgtgtcgaatattgacag

SEQ ID NO: 244102 - DNA, 20 bp, Artificial Sequence
  chemically synthesized
attttgtgtcgaatattgac

SEQ ID NO: 244103 - DNA, 20 bp, Artificial Sequence
  chemically synthesized
cattttgtgtcgaatattga

SEQ ID NO: 244104 - DNA, 20 bp, Artificial Sequence
  chemically synthesized
tcaatattcgacacaaaatg

SEQ ID NO: 244105 - DNA, 20 bp, Artificial Sequence
  chemically synthesized
caatattcgacacaaaatga

SEQ ID NO: 244106 - DNA, 20 bp, Artificial Sequence
  chemically synthesized
aatgaaggcaacctttatac

SEQ ID NO: 244107 - DNA, 20 bp, Artificial Sequence
  chemically synthesized
aataaaagccacttgtataa

SEQ ID NO: 244108 - DNA, 20 bp, Artificial Sequence
  chemically synthesized
aaataaaagccacttgtata

SEQ ID NO: 244109 - DNA, 20 bp, Artificial Sequence
  chemically synthesized
gaaggcaacctttatacaag

SEQ ID NO: 244110 - DNA, 20 bp, Artificial Sequence
  chemically synthesized
acaagaatagaaagaaataa

SEQ ID NO: 244111 - DNA, 20 bp, Artificial Sequence
  chemically synthesized
gaaccaaggacaagaataga

SEQ ID NO: 244112 - DNA, 20 bp, Artificial Sequence
  chemically synthesized
ccttgaaccaaggacaagaa

SEQ ID NO: 244113 - DNA, 20 bp, Artificial Sequence
  chemically synthesized
tttctttctattcttgtcct

SEQ ID NO: 244114 - DNA, 20 bp, Artificial Sequence
  chemically synthesized
tcgatccttgaaccaaggac

SEQ ID NO: 244115 - DNA, 20 bp, Artificial Sequence
  chemically synthesized
tctattcttgtccttggttc

SEQ ID NO: 244116 - DNA, 20 bp, Artificial Sequence
  chemically synthesized
ctattcttgtccttggttca

SEQ ID NO: 244117 - DNA, 20 bp, Artificial Sequence
  chemically synthesized
agtgttcgatccttgaacca

SEQ ID NO: 244118 - DNA, 20 bp, Artificial Sequence
  chemically synthesized
gagtgttcgatccttgaacc

SEQ ID NO: 244119 - DNA, 20 bp, Artificial Sequence
  chemically synthesized
ggttcaaggatcgaacactc

SEQ ID NO: 244120 - DNA, 20 bp, Artificial Sequence
  chemically synthesized
gttcaaggatcgaacactca

SEQ ID NO: 244121 - DNA, 20 bp, Artificial Sequence
  chemically synthesized
tcaaggatcgaacactcaag

SEQ ID NO: 244122 - DNA, 20 bp, Artificial Sequence
  chemically synthesized
caaaatatttaggtctcctt

SEQ ID NO: 244123 - DNA, 20 bp, Artificial Sequence
  chemically synthesized
gctcctattccaaaatattt

SEQ ID NO: 244124 - DNA, 20 bp, Artificial Sequence
  chemically synthesized
tcaaggagacctaaatattt

SEQ ID NO: 244125 - DNA, 20 bp, Artificial Sequence
  chemically synthesized
ggctcctattccaaaatatt

SEQ ID NO: 244126 - DNA, 20 bp, Artificial Sequence
  chemically synthesized
gagacctaaatattttggaa

SEQ ID NO: 244127 - DNA, 20 bp, Artificial Sequence
  chemically synthesized
agacctaaatattttggaat

SEQ ID NO: 244128 - DNA, 20 bp, Artificial Sequence
  chemically synthesized
acctaaatattttggaatag

SEQ ID NO: 244129 - DNA, 20 bp, Artificial Sequence
  chemically synthesized
aaatattttggaataggagc

SEQ ID NO: 244130 - DNA, 20 bp, Artificial Sequence
  chemically synthesized
aatattttggaataggagcc

SEQ ID NO: 244131 - DNA, 20 bp, Artificial Sequence
  chemically synthesized
tctctgaggacaggttatcc

SEQ ID NO: 244132 - DNA, 20 bp, Artificial Sequence
  chemically synthesized
gagccaggataacctgtcct

SEQ ID NO: 244133 - DNA, 20 bp, Artificial Sequence
  chemically synthesized
gccaggataacctgtcctca

SEQ ID NO: 244134 - DNA, 20 bp, Artificial Sequence
  chemically synthesized
aaggaagcatctctgaggac

SEQ ID NO: 244135 - DNA, 20 bp, Artificial Sequence
  chemically synthesized
caaggaagcatctctgagga

SEQ ID NO: 244136 - DNA, 20 bp, Artificial Sequence
  chemically synthesized
cagccaaggaagcatctctg

SEQ ID NO: 244137 - DNA, 20 bp, Artificial Sequence
  chemically synthesized
gcagccaaggaagcatctct

SEQ ID NO: 244138 - DNA, 20 bp, Artificial Sequence
  chemically synthesized
tgtcctcagagatgcttcct

SEQ ID NO: 244139 - DNA, 20 bp, Artificial Sequence
  chemically synthesized
gctaggtgatgcagccaagg

SEQ ID NO: 244140 - DNA, 20 bp, Artificial Sequence
  chemically synthesized
atggctaggtgatgcagcca

SEQ ID NO: 244141 - DNA, 20 bp, Artificial Sequence
  chemically synthesized
tatggctaggtgatgcagcc

SEQ ID NO: 244142 - DNA, 20 bp, Artificial Sequence
  chemically synthesized
gcttccttggctgcatcacc

SEQ ID NO: 244143 - DNA, 20 bp, Artificial Sequence
  chemically synthesized
gtacttatggctaggtgatg

SEQ ID NO: 244144 - DNA, 20 bp, Artificial Sequence
  chemically synthesized
tggctgcatcacctagccat

SEQ ID NO: 244145 - DNA, 20 bp, Artificial Sequence
  chemically synthesized
aaaagggagtacttatggct

SEQ ID NO: 244146 - DNA, 20 bp, Artificial Sequence
  chemically synthesized
aaaaagggagtacttatggc

SEQ ID NO: 244147 - DNA, 20 bp, Artificial Sequence
  chemically synthesized
ctgcaaaaagggagtactta

SEQ ID NO: 244148 - DNA, 20 bp, Artificial Sequence
  chemically synthesized
caagttttcctgcaaaaagg

SEQ ID NO: 244149 - DNA, 20 bp, Artificial Sequence
  chemically synthesized
ccataagtactccctttttg

SEQ ID NO: 244150 - DNA, 20 bp, Artificial Sequence
  chemically synthesized
cataagtactccctttttgc

SEQ ID NO: 244151 - DNA, 20 bp, Artificial Sequence
  chemically synthesized
tgcaagttttcctgcaaaaa

SEQ ID NO: 244152 - DNA, 20 bp, Artificial Sequence
  chemically synthesized
ttgcaagttttcctgcaaaa

SEQ ID NO: 244153 - DNA, 20 bp, Artificial Sequence
  chemically synthesized
gttgcaagttttcctgcaaa

SEQ ID NO: 244154 - DNA, 20 bp, Artificial Sequence
  chemically synthesized
tgcaggaaaacttgcaaccc

SEQ ID NO: 244155 - DNA, 20 bp, Artificial Sequence
  chemically synthesized
tggtatggttctagggttgc

SEQ ID NO: 244156 - DNA, 20 bp, Artificial Sequence
  chemically synthesized
tttggtatggtatggttcta

SEQ ID NO: 244157 - DNA, 20 bp, Artificial Sequence
  chemically synthesized
gtttggtatggtatggttct

SEQ ID NO: 244158 - DNA, 20 bp, Artificial Sequence
  chemically synthesized
agtttggtatggtatggttc

SEQ ID NO: 244159 - DNA, 20 bp, Artificial Sequence
  chemically synthesized
gaaggaagtttggtatggta

SEQ ID NO: 244160 - DNA, 20 bp, Artificial Sequence
  chemically synthesized
aaaatgaaggaagtttggta

SEQ ID NO: 244161 - DNA, 20 bp, Artificial Sequence
  chemically synthesized
atcagaaaatgaaggaagtt

SEQ ID NO: 244162 - DNA, 20 bp, Artificial Sequence
  chemically synthesized
ttttaatcagaaaatgaagg

SEQ ID NO: 244163 - DNA, 20 bp, Artificial Sequence
  chemically synthesized
tagttttaatcagaaaatga

SEQ ID NO: 244164 - DNA, 20 bp, Artificial Sequence
  chemically synthesized
atagttttaatcagaaaatg

SEQ ID NO: 244165 - DNA, 20 bp, Artificial Sequence
  chemically synthesized
atgtacaaaatagttttaat

SEQ ID NO: 244166 - DNA, 20 bp, Artificial Sequence
  chemically synthesized
gtgggacattatgtacaaaa

SEQ ID NO: 244167 - DNA, 20 bp, Artificial Sequence
  chemically synthesized
gtttgtgatgcaaaaaaagt

SEQ ID NO: 244168 - DNA, 20 bp, Artificial Sequence
  chemically synthesized
cgtttgtgatgcaaaaaaag

SEQ ID NO: 244169 - DNA, 20 bp, Artificial Sequence
  chemically synthesized
aggcgtttgtgatgcaaaaa

SEQ ID NO: 244170 - DNA, 20 bp, Artificial Sequence
  chemically synthesized
cttgtgtacttaatggttca

SEQ ID NO: 244171 - DNA, 20 bp, Artificial Sequence
  chemically synthesized
acttgtgtacttaatggttc

SEQ ID NO: 244172 - DNA, 20 bp, Artificial Sequence
  chemically synthesized
cacaaacgccttgaaccatt

SEQ ID NO: 244173 - DNA, 20 bp, Artificial Sequence
  chemically synthesized
gaatatacttgtgtacttaa

SEQ ID NO: 244174 - DNA, 20 bp, Artificial Sequence
  chemically synthesized
ccttgaaccattaagtacac

SEQ ID NO: 244175 - DNA, 20 bp, Artificial Sequence
  chemically synthesized
taagtacacaagtatattcc

SEQ ID NO: 244176 - DNA, 20 bp, Artificial Sequence
  chemically synthesized
aagtacacaagtatattcct

SEQ ID NO: 244177 - DNA, 20 bp, Artificial Sequence
  chemically synthesized
tacacaagtatattcctggg

SEQ ID NO: 244178 - DNA, 20 bp, Artificial Sequence
  chemically synthesized
agaccttaattcatcttccc

SEQ ID NO: 244179 - DNA, 20 bp, Artificial Sequence
  chemically synthesized
aagaccttaattcatcttcc

SEQ ID NO: 244180 - DNA, 20 bp, Artificial Sequence
  chemically synthesized
tattcctgggaagatgaatt

SEQ ID NO: 244181 - DNA, 20 bp, Artificial Sequence
  chemically synthesized
attcctgggaagatgaatta

SEQ ID NO: 244182 - DNA, 20 bp, Artificial Sequence
  chemically synthesized
tactttctaagaacaagatg

SEQ ID NO: 244183 - DNA, 20 bp, Artificial Sequence
  chemically synthesized
taaggtcttcatcttgttct

SEQ ID NO: 244184 - DNA, 20 bp, Artificial Sequence
  chemically synthesized
aacacatactttctaagaac

SEQ ID NO: 244185 - DNA, 20 bp, Artificial Sequence
  chemically synthesized
gtcttcatcttgttcttaga

SEQ ID NO: 244186 - DNA, 20 bp, Artificial Sequence
  chemically synthesized
aaaataaacacatactttct

SEQ ID NO: 244187 - DNA, 20 bp, Artificial Sequence
  chemically synthesized
agtatgtgtttattttctga

SEQ ID NO: 244188 - DNA, 20 bp, Artificial Sequence
  chemically synthesized
atgtgtttattttctgatag

SEQ ID NO: 244189 - DNA, 20 bp, Artificial Sequence
  chemically synthesized
agtattattatttctgctat

SEQ ID NO: 244190 - DNA, 20 bp, Artificial Sequence
  chemically synthesized
gcagaaataataatacttta

SEQ ID NO: 244191 - DNA, 20 bp, Artificial Sequence
  chemically synthesized
gaagattctataaaactata

SEQ ID NO: 244192 - DNA, 20 bp, Artificial Sequence
  chemically synthesized
aataatactttatagtttta

SEQ ID NO: 244193 - DNA, 20 bp, Artificial Sequence
  chemically synthesized
gttttatagaatcttctcaa

SEQ ID NO: 244194 - DNA, 20 bp, Artificial Sequence
  chemically synthesized
tttatagaatcttctcaatg

SEQ ID NO: 244195 - DNA, 20 bp, Artificial Sequence
  chemically synthesized
cctaaaaatcctccattgag

SEQ ID NO: 244196 - DNA, 20 bp, Artificial Sequence
  chemically synthesized
ttatagaatcttctcaatgg

SEQ ID NO: 244197 - DNA, 20 bp, Artificial Sequence
  chemically synthesized
gctcctaaaaatcctccatt

SEQ ID NO: 244198 - DNA, 20 bp, Artificial Sequence
  chemically synthesized
tcttctcaatggaggatttt

SEQ ID NO: 244199 - DNA, 20 bp, Artificial Sequence
  chemically synthesized
cttctcaatggaggattttt

SEQ ID NO: 244200 - DNA, 20 bp, Artificial Sequence
  chemically synthesized
tctcaatggaggatttttag

SEQ ID NO: 244201 - DNA, 20 bp, Artificial Sequence
  chemically synthesized
caatcagtaatatacatgtg

SEQ ID NO: 244202 - DNA, 20 bp, Artificial Sequence
  chemically synthesized
cacatgtatattactgattg

SEQ ID NO: 244203 - DNA, 20 bp, Artificial Sequence
  chemically synthesized
catgtatattactgattgcg

SEQ ID NO: 244204 - DNA, 20 bp, Artificial Sequence
  chemically synthesized
caataaaaacactccgcaat

SEQ ID NO: 244205 - DNA, 20 bp, Artificial Sequence
  chemically synthesized
tgtttttattgcatatatct

SEQ ID NO: 244206 - DNA, 20 bp, Artificial Sequence
  chemically synthesized
ttttattgcatatatctcag

SEQ ID NO: 244207 - DNA, 20 bp, Artificial Sequence
  chemically synthesized
tttattgcatatatctcagt

SEQ ID NO: 244208 - DNA, 20 bp, Artificial Sequence
  chemically synthesized
tattgcatatatctcagtgg

SEQ ID NO: 244209 - DNA, 20 bp, Artificial Sequence
  chemically synthesized
ccatttccaatactcccact

SEQ ID NO: 244210 - DNA, 20 bp, Artificial Sequence
  chemically synthesized
atatatctcagtgggagtat

SEQ ID NO: 244211 - DNA, 20 bp, Artificial Sequence
  chemically synthesized
ctcagtgggagtattggaaa

SEQ ID NO: 244212 - DNA, 20 bp, Artificial Sequence
  chemically synthesized
tcagtgggagtattggaaat

SEQ ID NO: 244213 - DNA, 20 bp, Artificial Sequence
  chemically synthesized
aggaagtgggattttttaaa

SEQ ID NO: 244214 - DNA, 20 bp, Artificial Sequence
  chemically synthesized
ttgtaagcagaagaggaagt

SEQ ID NO: 244215 - DNA, 20 bp, Artificial Sequence
  chemically synthesized
attgtaagcagaagaggaag

SEQ ID NO: 244216 - DNA, 20 bp, Artificial Sequence
  chemically synthesized
tagattgtaagcagaagagg

SEQ ID NO: 244217 - DNA, 20 bp, Artificial Sequence
  chemically synthesized
gaatagattgtaagcagaag

SEQ ID NO: 244218 - DNA, 20 bp, Artificial Sequence
  chemically synthesized
agaatagattgtaagcagaa

SEQ ID NO: 244219 - DNA, 20 bp, Artificial Sequence
  chemically synthesized
agagaatagattgtaagcag

SEQ ID NO: 244220 - DNA, 20 bp, Artificial Sequence
  chemically synthesized
gacagagaatagattgtaag

SEQ ID NO: 244221 - DNA, 20 bp, Artificial Sequence
  chemically synthesized
gaagacagagaatagattgt

SEQ ID NO: 244222 - DNA, 20 bp, Artificial Sequence
  chemically synthesized
atcactttgaagacagagaa

SEQ ID NO: 244223 - DNA, 20 bp, Artificial Sequence
  chemically synthesized
atattatcactttgaagaca

SEQ ID NO: 244224 - DNA, 20 bp, Artificial Sequence
  chemically synthesized
caatctattctctgtcttca

SEQ ID NO: 244225 - DNA, 20 bp, Artificial Sequence
  chemically synthesized
gaatattatcactttgaaga

SEQ ID NO: 244226 - DNA, 20 bp, Artificial Sequence
  chemically synthesized
aagtgaatattatcactttg

SEQ ID NO: 244227 - DNA, 20 bp, Artificial Sequence
  chemically synthesized
gtgtttccaaagtcgacatt

SEQ ID NO: 244228 - DNA, 20 bp, Artificial Sequence
  chemically synthesized
tattcacttaatgtcgactt

SEQ ID NO: 244229 - DNA, 20 bp, Artificial Sequence
  chemically synthesized
atttttattatgtgtttcca

SEQ ID NO: 244230 - DNA, 20 bp, Artificial Sequence
  chemically synthesized
ttggaaacacataataaaaa

SEQ ID NO: 244231 - DNA, 20 bp, Artificial Sequence
  chemically synthesized
cataataaaaatggtaaatg

SEQ ID NO: 244232 - DNA, 20 bp, Artificial Sequence
  chemically synthesized
tattagctaaaaagagagtg

SEQ ID NO: 244233 - DNA, 20 bp, Artificial Sequence
  chemically synthesized
atattagctaaaaagagagt

SEQ ID NO: 244234 - DNA, 20 bp, Artificial Sequence
  chemically synthesized
gattttcctcactctctttt

SEQ ID NO: 244235 - DNA, 20 bp, Artificial Sequence
  chemically synthesized
cacaatattagctaaaaaga

SEQ ID NO: 244236 - DNA, 20 bp, Artificial Sequence
  chemically synthesized
gccacaatattagctaaaaa

SEQ ID NO: 244237 - DNA, 20 bp, Artificial Sequence
  chemically synthesized
ttgccacaatattagctaaa

SEQ ID NO: 244238 - DNA, 20 bp, Artificial Sequence
  chemically synthesized
tctctttttagctaatattg

SEQ ID NO: 244239 - DNA, 20 bp, Artificial Sequence
  chemically synthesized
gaagacatttgccacaatat

SEQ ID NO: 244240 - DNA, 20 bp, Artificial Sequence
  chemically synthesized
atattgcttacaaagggaag

SEQ ID NO: 244241 - DNA, 20 bp, Artificial Sequence
  chemically synthesized
aaaatattgcttacaaaggg

SEQ ID NO: 244242 - DNA, 20 bp, Artificial Sequence
  chemically synthesized
aaatgtcttcttccctttgt

SEQ ID NO: 244243 - DNA, 20 bp, Artificial Sequence
  chemically synthesized
gagaaaatattgcttacaaa

SEQ ID NO: 244244 - DNA, 20 bp, Artificial Sequence
  chemically synthesized
agagaaaatattgcttacaa

SEQ ID NO: 244245 - DNA, 20 bp, Artificial Sequence
  chemically synthesized
gagagaaaatattgcttaca

SEQ ID NO: 244246 - DNA, 20 bp, Artificial Sequence
  chemically synthesized
ataaagcttaatagaaaaga

SEQ ID NO: 244247 - DNA, 20 bp, Artificial Sequence
  chemically synthesized
aaataaagcttaatagaaaa

SEQ ID NO: 244248 - DNA, 20 bp, Artificial Sequence
  chemically synthesized
tattttctctcttttctatt

SEQ ID NO: 244249 - DNA, 20 bp, Artificial Sequence
  chemically synthesized
gcaaataaagcttaatagaa

SEQ ID NO: 244250 - DNA, 20 bp, Artificial Sequence
  chemically synthesized
actaggcaaataaagcttaa

SEQ ID NO: 244251 - DNA, 20 bp, Artificial Sequence
  chemically synthesized
cctgctaaactaggcaaata

SEQ ID NO: 244252 - DNA, 20 bp, Artificial Sequence
  chemically synthesized
tctattaagctttatttgcc

SEQ ID NO: 244253 - DNA, 20 bp, Artificial Sequence
  chemically synthesized
taagctttatttgcctagtt

SEQ ID NO: 244254 - DNA, 20 bp, Artificial Sequence
  chemically synthesized
gctttatttgcctagtttag

SEQ ID NO: 244255 - DNA, 20 bp, Artificial Sequence
  chemically synthesized
aaaataaaacctgctaaact

SEQ ID NO: 244256 - DNA, 20 bp, Artificial Sequence
  chemically synthesized
ctttatttgcctagtttagc

SEQ ID NO: 244257 - DNA, 20 bp, Artificial Sequence
  chemically synthesized
aaaaataaaacctgctaaac

SEQ ID NO: 244258 - DNA, 20 bp, Artificial Sequence
  chemically synthesized
gataggaatacgataagcag

SEQ ID NO: 244259 - DNA, 20 bp, Artificial Sequence
  chemically synthesized
tggataggaatacgataagc

SEQ ID NO: 244260 - DNA, 20 bp, Artificial Sequence
  chemically synthesized
atggataggaatacgataag

SEQ ID NO: 244261 - DNA, 20 bp, Artificial Sequence
  chemically synthesized
cgcatggataggaatacgat

SEQ ID NO: 244262 - DNA, 20 bp, Artificial Sequence
  chemically synthesized
ttatcgtattcctatccatg

SEQ ID NO: 244263 - DNA, 20 bp, Artificial Sequence
  chemically synthesized
tccttttgacccgcatggat

SEQ ID NO: 244264 - DNA, 20 bp, Artificial Sequence
  chemically synthesized
tatcgtattcctatccatgc

SEQ ID NO: 244265 - DNA, 20 bp, Artificial Sequence
  chemically synthesized
ttccttttgacccgcatgga

SEQ ID NO: 244266 - DNA, 20 bp, Artificial Sequence
  chemically synthesized
taatttccttttgacccgca

SEQ ID NO: 244267 - DNA, 20 bp, Artificial Sequence
  chemically synthesized
ttcctatccatgcgggtcaa

SEQ ID NO: 244268 - DNA, 20 bp, Artificial Sequence
  chemically synthesized
tcctatccatgcgggtcaaa

SEQ ID NO: 244269 - DNA, 20 bp, Artificial Sequence
  chemically synthesized
cgggtcaaaaggaaattaat

SEQ ID NO: 244270 - DNA, 20 bp, Artificial Sequence
  chemically synthesized
ttttgtgtcagaggaaacaa

SEQ ID NO: 244271 - DNA, 20 bp, Artificial Sequence
  chemically synthesized
tgttttgtgtcagaggaaac

SEQ ID NO: 244272 - DNA, 20 bp, Artificial Sequence
  chemically synthesized
agaaaaatgttttgtgtcag

SEQ ID NO: 244273 - DNA, 20 bp, Artificial Sequence
  chemically synthesized
aagaaaaatgttttgtgtca

SEQ ID NO: 244274 - DNA, 20 bp, Artificial Sequence
  chemically synthesized
ccaagaaaaatgttttgtgt

SEQ ID NO: 244275 - DNA, 20 bp, Artificial Sequence
  chemically synthesized
ctgacacaaaacatttttct

SEQ ID NO: 244276 - DNA, 20 bp, Artificial Sequence
  chemically synthesized
aaaacatttttcttggtaca

SEQ ID NO: 244277 - DNA, 20 bp, Artificial Sequence
  chemically synthesized
gggaggcagaactgtgtacc

SEQ ID NO: 244278 - DNA, 20 bp, Artificial Sequence
  chemically synthesized
ggtacacagttctgcctccc

SEQ ID NO: 244279 - DNA, 20 bp, Artificial Sequence
  chemically synthesized
gagtgaaaacactggggagg

SEQ ID NO: 244280 - DNA, 20 bp, Artificial Sequence
  chemically synthesized
ccagagtgaaaacactgggg

SEQ ID NO: 244281 - DNA, 20 bp, Artificial Sequence
  chemically synthesized
tccagagtgaaaacactggg

SEQ ID NO: 244282 - DNA, 20 bp, Artificial Sequence
  chemically synthesized
tgtccagagtgaaaacactg

SEQ ID NO: 244283 - DNA, 20 bp, Artificial Sequence
  chemically synthesized
atgtccagagtgaaaacact

SEQ ID NO: 244284 - DNA, 20 bp, Artificial Sequence
  chemically synthesized
catgtccagagtgaaaacac

SEQ ID NO: 244285 - DNA, 20 bp, Artificial Sequence
  chemically synthesized
cctccccagtgttttcactc

SEQ ID NO: 244286 - DNA, 20 bp, Artificial Sequence
  chemically synthesized
cactgtttccgtcatgtcca

SEQ ID NO: 244287 - DNA, 20 bp, Artificial Sequence
  chemically synthesized
tgttttcactctggacatga

SEQ ID NO: 244288 - DNA, 20 bp, Artificial Sequence
  chemically synthesized
ttcactgtttccgtcatgtc

SEQ ID NO: 244289 - DNA, 20 bp, Artificial Sequence
  chemically synthesized
cactctggacatgacggaaa

SEQ ID NO: 244290 - DNA, 20 bp, Artificial Sequence
  chemically synthesized
gacatgacggaaacagtgaa

SEQ ID NO: 244291 - DNA, 20 bp, Artificial Sequence
  chemically synthesized
acggaaacagtgaaaagcaa

SEQ ID NO: 244292 - DNA, 20 bp, Artificial Sequence
  chemically synthesized
cggaaacagtgaaaagcaat

SEQ ID NO: 244293 - DNA, 20 bp, Artificial Sequence
  chemically synthesized
gaaacagtgaaaagcaatag

SEQ ID NO: 244294 - DNA, 20 bp, Artificial Sequence
  chemically synthesized
cagtgaaaagcaataggaga

SEQ ID NO: 244295 - DNA, 20 bp, Artificial Sequence
  chemically synthesized
agtgaaaagcaataggagat

SEQ ID NO: 244296 - DNA, 20 bp, Artificial Sequence
  chemically synthesized
tgaaaagcaataggagatgg

SEQ ID NO: 244297 - DNA, 20 bp, Artificial Sequence
  chemically synthesized
aaagcaataggagatgggag

SEQ ID NO: 244298 - DNA, 20 bp, Artificial Sequence
  chemically synthesized
aagcaataggagatgggaga

SEQ ID NO: 244299 - DNA, 20 bp, Artificial Sequence
  chemically synthesized
ttgcattcgcaatcaacata

SEQ ID NO: 244300 - DNA, 20 bp, Artificial Sequence
  chemically synthesized
attcgcaatcaacatatggt

SEQ ID NO: 244301 - DNA, 20 bp, Artificial Sequence
  chemically synthesized
tgctgaaaactcattggaag

SEQ ID NO: 244302 - DNA, 20 bp, Artificial Sequence
  chemically synthesized
tatggtcagccacttccaat

SEQ ID NO: 244303 - DNA, 20 bp, Artificial Sequence
  chemically synthesized
cagtgctgaaaactcattgg

SEQ ID NO: 244304 - DNA, 20 bp, Artificial Sequence
  chemically synthesized
catcagtgctgaaaactcat

SEQ ID NO: 244305 - DNA, 20 bp, Artificial Sequence
  chemically synthesized
agccacttccaatgagtttt

SEQ ID NO: 244306 - DNA, 20 bp, Artificial Sequence
  chemically synthesized
acagcagtgatagtgttcat

SEQ ID NO: 244307 - DNA, 20 bp, Artificial Sequence
  chemically synthesized
taagcttaagacagcagtga

SEQ ID NO: 244308 - DNA, 20 bp, Artificial Sequence
  chemically synthesized
aacactatcactgctgtctt

SEQ ID NO: 244309 - DNA, 20 bp, Artificial Sequence
  chemically synthesized
ccagcataagcttaagacag

SEQ ID NO: 244310 - DNA, 20 bp, Artificial Sequence
  chemically synthesized
acaccagcataagcttaaga

SEQ ID NO: 244311 - DNA, 20 bp, Artificial Sequence
  chemically synthesized
atggacaccagcataagctt

SEQ ID NO: 244312 - DNA, 20 bp, Artificial Sequence
  chemically synthesized
ctgctgtcttaagcttatgc

SEQ ID NO: 244313 - DNA, 20 bp, Artificial Sequence
  chemically synthesized
acagtaatggacaccagcat

SEQ ID NO: 244314 - DNA, 20 bp, Artificial Sequence
  chemically synthesized
cagtggacagtaatggacac

SEQ ID NO: 244315 - DNA, 20 bp, Artificial Sequence
  chemically synthesized
aagcagccagtggacagtaa

SEQ ID NO: 244316 - DNA, 20 bp, Artificial Sequence
  chemically synthesized
tggtgtccattactgtccac

SEQ ID NO: 244317 - DNA, 20 bp, Artificial Sequence
  chemically synthesized
ttcacaaagcagccagtgga

SEQ ID NO: 244318 - DNA, 20 bp, Artificial Sequence
  chemically synthesized
tagtttcacaaagcagccag

SEQ ID NO: 244319 - DNA, 20 bp, Artificial Sequence
  chemically synthesized
atgtagtttcacaaagcagc

SEQ ID NO: 244320 - DNA, 20 bp, Artificial Sequence
  chemically synthesized
ggagatgtagtttcacaaag

SEQ ID NO: 244321 - DNA, 20 bp, Artificial Sequence
  chemically synthesized
ccaggagatgtagtttcaca

SEQ ID NO: 244322 - DNA, 20 bp, Artificial Sequence
  chemically synthesized
ctttgtgaaactacatctcc

SEQ ID NO: 244323 - DNA, 20 bp, Artificial Sequence
  chemically synthesized
atgaagaaagccaggagatg

SEQ ID NO: 244324 - DNA, 20 bp, Artificial Sequence
  chemically synthesized
cgaggtatgaagaaagccag

SEQ ID NO: 244325 - DNA, 20 bp, Artificial Sequence
  chemically synthesized
atcgaggtatgaagaaagcc

SEQ ID NO: 244326 - DNA, 20 bp, Artificial Sequence
  chemically synthesized
catcgaggtatgaagaaagc

SEQ ID NO: 244327 - DNA, 20 bp, Artificial Sequence
  chemically synthesized
aaaccatcgaggtatgaaga

SEQ ID NO: 244328 - DNA, 20 bp, Artificial Sequence
  chemically synthesized
acaaaaaccatcgaggtatg

SEQ ID NO: 244329 - DNA, 20 bp, Artificial Sequence
  chemically synthesized
tggctttcttcatacctcga

SEQ ID NO: 244330 - DNA, 20 bp, Artificial Sequence
  chemically synthesized
aaggagcacaaaaaccatcg

SEQ ID NO: 244331 - DNA, 20 bp, Artificial Sequence
  chemically synthesized
aaaggagcacaaaaaccatc

SEQ ID NO: 244332 - DNA, 20 bp, Artificial Sequence
  chemically synthesized
atggtttttgtgctcctttt

SEQ ID NO: 244333 - DNA, 20 bp, Artificial Sequence
  chemically synthesized
tggtttttgtgctccttttc

SEQ ID NO: 244334 - DNA, 20 bp, Artificial Sequence
  chemically synthesized
ggtttttgtgctccttttca

SEQ ID NO: 244335 - DNA, 20 bp, Artificial Sequence
  chemically synthesized
taaggaataaccctgaaaag

SEQ ID NO: 244336 - DNA, 20 bp, Artificial Sequence
  chemically synthesized
ggtaaggaataaccctgaaa

SEQ ID NO: 244337 - DNA, 20 bp, Artificial Sequence
  chemically synthesized
gggtaaggaataaccctgaa

SEQ ID NO: 244338 - DNA, 20 bp, Artificial Sequence
  chemically synthesized
tttcagggttattccttacc

SEQ ID NO: 244339 - DNA, 20 bp, Artificial Sequence
  chemically synthesized
atgcatttagtgactgggta

SEQ ID NO: 244340 - DNA, 20 bp, Artificial Sequence
  chemically synthesized
aatgcatttagtgactgggt

SEQ ID NO: 244341 - DNA, 20 bp, Artificial Sequence
  chemically synthesized
ttttaatgcatttagtgact

SEQ ID NO: 244342 - DNA, 20 bp, Artificial Sequence
  chemically synthesized
cttttaatgcatttagtgac

SEQ ID NO: 244343 - DNA, 20 bp, Artificial Sequence
  chemically synthesized
tgaggtacttttaatgcatt

SEQ ID NO: 244344 - DNA, 20 bp, Artificial Sequence
  chemically synthesized
ccagtcactaaatgcattaa

SEQ ID NO: 244345 - DNA, 20 bp, Artificial Sequence
  chemically synthesized
attaaaagtacctcataaaa

SEQ ID NO: 244346 - DNA, 20 bp, Artificial Sequence
  chemically synthesized
tgaagtcatcctgttttatg

SEQ ID NO: 244347 - DNA, 20 bp, Artificial Sequence
  chemically synthesized
ttaaaagtacctcataaaac

SEQ ID NO: 244348 - DNA, 20 bp, Artificial Sequence
  chemically synthesized
atgaagtcatcctgttttat

SEQ ID NO: 244349 - DNA, 20 bp, Artificial Sequence
  chemically synthesized
atgtccctgcaaaggacatg

SEQ ID NO: 244350 - DNA, 20 bp, Artificial Sequence
  chemically synthesized
ggatgacttcatgtcctttg

SEQ ID NO: 244351 - DNA, 20 bp, Artificial Sequence
  chemically synthesized
gatgacttcatgtcctttgc

SEQ ID NO: 244352 - DNA, 20 bp, Artificial Sequence
  chemically synthesized
atgacttcatgtcctttgca

SEQ ID NO: 244353 - DNA, 20 bp, Artificial Sequence
  chemically synthesized
cttcatccatgtccctgcaa

SEQ ID NO: 244354 - DNA, 20 bp, Artificial Sequence
  chemically synthesized
gcttcatccatgtccctgca

SEQ ID NO: 244355 - DNA, 20 bp, Artificial Sequence
  chemically synthesized
tcatgtcctttgcagggaca

SEQ ID NO: 244356 - DNA, 20 bp, Artificial Sequence
  chemically synthesized
cctttgcagggacatggatg

SEQ ID NO: 244357 - DNA, 20 bp, Artificial Sequence
  chemically synthesized
tgcagggacatggatgaagc

SEQ ID NO: 244358 - DNA, 20 bp, Artificial Sequence
  chemically synthesized
ttgctaagaatgatggtttc

SEQ ID NO: 244359 - DNA, 20 bp, Artificial Sequence
  chemically synthesized
aagctggaaaccatcattct

SEQ ID NO: 244360 - DNA, 20 bp, Artificial Sequence
  chemically synthesized
tgttagtttgctaagaatga

SEQ ID NO: 244361 - DNA, 20 bp, Artificial Sequence
  chemically synthesized
tgttcctgtgttagtttgct

SEQ ID NO: 244362 - DNA, 20 bp, Artificial Sequence
  chemically synthesized
tcattcttagcaaactaaca

SEQ ID NO: 244363 - DNA, 20 bp, Artificial Sequence
  chemically synthesized
cattcttagcaaactaacac

SEQ ID NO: 244364 - DNA, 20 bp, Artificial Sequence
  chemically synthesized
ttcattttctgttcctgtgt

SEQ ID NO: 244365 - DNA, 20 bp, Artificial Sequence
  chemically synthesized
ttagcaaactaacacaggaa

SEQ ID NO: 244366 - DNA, 20 bp, Artificial Sequence
  chemically synthesized
acagaaaatgaaacactgca

SEQ ID NO: 244367 - DNA, 20 bp, Artificial Sequence
  chemically synthesized
cacttacgagtgagtccatg

SEQ ID NO: 244368 - DNA, 20 bp, Artificial Sequence
  chemically synthesized
cactgcatggactcactcgt

SEQ ID NO: 244369 - DNA, 20 bp, Artificial Sequence
  chemically synthesized
ttccactcccacttacgagt

SEQ ID NO: 244370 - DNA, 20 bp, Artificial Sequence
  chemically synthesized
tgcatggactcactcgtaag

SEQ ID NO: 244371 - DNA, 20 bp, Artificial Sequence
  chemically synthesized
gcatggactcactcgtaagt

SEQ ID NO: 244372 - DNA, 20 bp, Artificial Sequence
  chemically synthesized
actgttccactcccacttac

SEQ ID NO: 244373 - DNA, 20 bp, Artificial Sequence
  chemically synthesized
atggactcactcgtaagtgg

SEQ ID NO: 244374 - DNA, 20 bp, Artificial Sequence
  chemically synthesized
gactcactcgtaagtgggag

SEQ ID NO: 244375 - DNA, 20 bp, Artificial Sequence
  chemically synthesized
actcgtaagtgggagtggaa

SEQ ID NO: 244376 - DNA, 20 bp, Artificial Sequence
  chemically synthesized
gtaagtgggagtggaacagt

SEQ ID NO: 244377 - DNA, 20 bp, Artificial Sequence
  chemically synthesized
agtggaacagtgagaacaca

SEQ ID NO: 244378 - DNA, 20 bp, Artificial Sequence
  chemically synthesized
acagtgagaacacatggaca

SEQ ID NO: 244379 - DNA, 20 bp, Artificial Sequence
  chemically synthesized
cagtgagaacacatggacac

SEQ ID NO: 244380 - DNA, 20 bp, Artificial Sequence
  chemically synthesized
agtgagaacacatggacaca

SEQ ID NO: 244381 - DNA, 20 bp, Artificial Sequence
  chemically synthesized
tgagaacacatggacacagg

SEQ ID NO: 244382 - DNA, 20 bp, Artificial Sequence
  chemically synthesized
gagaacacatggacacaggg

SEQ ID NO: 244383 - DNA, 20 bp, Artificial Sequence
  chemically synthesized
agaacacatggacacaggga

SEQ ID NO: 244384 - DNA, 20 bp, Artificial Sequence
  chemically synthesized
gaacacatggacacagggag

SEQ ID NO: 244385 - DNA, 20 bp, Artificial Sequence
  chemically synthesized
gggaggggaacaacacacac

SEQ ID NO: 244386 - DNA, 20 bp, Artificial Sequence
  chemically synthesized
cccccacccccaacaggcac

SEQ ID NO: 244387 - DNA, 20 bp, Artificial Sequence
  chemically synthesized
caacacacactggtgcctgt

SEQ ID NO: 244388 - DNA, 20 bp, Artificial Sequence
  chemically synthesized
aacacacactggtgcctgtt

SEQ ID NO: 244389 - DNA, 20 bp, Artificial Sequence
  chemically synthesized
acacacactggtgcctgttg

SEQ ID NO: 244390 - DNA, 20 bp, Artificial Sequence
  chemically synthesized
cacacactggtgcctgttgg

SEQ ID NO: 244391 - DNA, 20 bp, Artificial Sequence
  chemically synthesized
cctagccccccacccccaac

SEQ ID NO: 244392 - DNA, 20 bp, Artificial Sequence
  chemically synthesized
acactggtgcctgttggggg

SEQ ID NO: 244393 - DNA, 20 bp, Artificial Sequence
  chemically synthesized
ccctagccccccacccccaa

SEQ ID NO: 244394 - DNA, 20 bp, Artificial Sequence
  chemically synthesized
cactggtgcctgttgggggt

SEQ ID NO: 244395 - DNA, 20 bp, Artificial Sequence
  chemically synthesized
actggtgcctgttgggggtg

SEQ ID NO: 244396 - DNA, 20 bp, Artificial Sequence
  chemically synthesized
ctggtgcctgttgggggtgg

SEQ ID NO: 244397 - DNA, 20 bp, Artificial Sequence
  chemically synthesized
tggtgcctgttgggggtggg

SEQ ID NO: 244398 - DNA, 20 bp, Artificial Sequence
  chemically synthesized
gcctgttgggggtggggggc

SEQ ID NO: 244399 - DNA, 20 bp, Artificial Sequence
  chemically synthesized
cctgttgggggtggggggct

SEQ ID NO: 244400 - DNA, 20 bp, Artificial Sequence
  chemically synthesized
ctgttgggggtggggggcta

SEQ ID NO: 244401 - DNA, 20 bp, Artificial Sequence
  chemically synthesized
ttgggggtggggggctaggg

SEQ ID NO: 244402 - DNA, 20 bp, Artificial Sequence
  chemically synthesized
tgggggtggggggctagggt

SEQ ID NO: 244403 - DNA, 20 bp, Artificial Sequence
  chemically synthesized
gggggtggggggctagggta

SEQ ID NO: 244404 - DNA, 20 bp, Artificial Sequence
  chemically synthesized
tcctaatgctatccctaccc

SEQ ID NO: 244405 - DNA, 20 bp, Artificial Sequence
  chemically synthesized
gtggggggctagggtaggga

SEQ ID NO: 244406 - DNA, 20 bp, Artificial Sequence
  chemically synthesized
ggctagggtagggatagcat

SEQ ID NO: 244407 - DNA, 20 bp, Artificial Sequence
  chemically synthesized
gctagggtagggatagcatt

SEQ ID NO: 244408 - DNA, 20 bp, Artificial Sequence
  chemically synthesized
tagggtagggatagcattag

SEQ ID NO: 244409 - DNA, 20 bp, Artificial Sequence
  chemically synthesized
attaggagaaatacctaatg

SEQ ID NO: 244410 - DNA, 20 bp, Artificial Sequence
  chemically synthesized
atcaacccgtcatctacatt

SEQ ID NO: 244411 - DNA, 20 bp, Artificial Sequence
  chemically synthesized
catcaacccgtcatctacat

SEQ ID NO: 244412 - DNA, 20 bp, Artificial Sequence
  chemically synthesized
gaaatacctaatgtagatga

SEQ ID NO: 244413 - DNA, 20 bp, Artificial Sequence
  chemically synthesized
aaatacctaatgtagatgac

SEQ ID NO: 244414 - DNA, 20 bp, Artificial Sequence
  chemically synthesized
taatgtagatgacgggttga

SEQ ID NO: 244415 - DNA, 20 bp, Artificial Sequence
  chemically synthesized
aatgtagatgacgggttgat

SEQ ID NO: 244416 - DNA, 20 bp, Artificial Sequence
  chemically synthesized
agatgacgggttgatgggtg

SEQ ID NO: 244417 - DNA, 20 bp, Artificial Sequence
  chemically synthesized
atgggtgcagcaaaccacca

SEQ ID NO: 244418 - DNA, 20 bp, Artificial Sequence
  chemically synthesized
taggtatacacgtgctatgg

SEQ ID NO: 244419 - DNA, 20 bp, Artificial Sequence
  chemically synthesized
acataggtatacacgtgcta

SEQ ID NO: 244420 - DNA, 20 bp, Artificial Sequence
  chemically synthesized
aacgtgcaggtttgttacat

SEQ ID NO: 244421 - DNA, 20 bp, Artificial Sequence
  chemically synthesized
gaacgtgcaggtttgttaca

SEQ ID NO: 244422 - DNA, 20 bp, Artificial Sequence
  chemically synthesized
gatacaggtgcagaacgtgc

SEQ ID NO: 244423 - DNA, 20 bp, Artificial Sequence
  chemically synthesized
ggatacaggtgcagaacgtg

SEQ ID NO: 244424 - DNA, 20 bp, Artificial Sequence
  chemically synthesized
tacgttctgggatacaggtg

SEQ ID NO: 244425 - DNA, 20 bp, Artificial Sequence
  chemically synthesized
cacgttctgcacctgtatcc

SEQ ID NO: 244426 - DNA, 20 bp, Artificial Sequence
  chemically synthesized
tactttacgttctgggatac

SEQ ID NO: 244427 - DNA, 20 bp, Artificial Sequence
  chemically synthesized
atactttacgttctgggata

SEQ ID NO: 244428 - DNA, 20 bp, Artificial Sequence
  chemically synthesized
attattatactttacgttct

SEQ ID NO: 244429 - DNA, 20 bp, Artificial Sequence
  chemically synthesized
cacctgtatcccagaacgta

SEQ ID NO: 244430 - DNA, 20 bp, Artificial Sequence
  chemically synthesized
tattattatactttacgttc

SEQ ID NO: 244431 - DNA, 20 bp, Artificial Sequence
  chemically synthesized
ataataataattaaaaaaaa

SEQ ID NO: 244432 - DNA, 20 bp, Artificial Sequence
  chemically synthesized
ttaaaaaaaaaagttcctca

SEQ ID NO: 244433 - DNA, 20 bp, Artificial Sequence
  chemically synthesized
ttgatcaggacaaatctttg

SEQ ID NO: 244434 - DNA, 20 bp, Artificial Sequence
  chemically synthesized
attgatcaggacaaatcttt

SEQ ID NO: 244435 - DNA, 20 bp, Artificial Sequence
  chemically synthesized
ctgtaggtagaagattgatc

SEQ ID NO: 244436 - DNA, 20 bp, Artificial Sequence
  chemically synthesized
actgtaggtagaagattgat

SEQ ID NO: 244437 - DNA, 20 bp, Artificial Sequence
  chemically synthesized
cctgatcaatcttctaccta

SEQ ID NO: 244438 - DNA, 20 bp, Artificial Sequence
  chemically synthesized
taaagagagactgtaggtag

SEQ ID NO: 244439 - DNA, 20 bp, Artificial Sequence
  chemically synthesized
acctaaagagagactgtagg

SEQ ID NO: 244440 - DNA, 20 bp, Artificial Sequence
  chemically synthesized
ataacctaaagagagactgt

SEQ ID NO: 244441 - DNA, 20 bp, Artificial Sequence
  chemically synthesized
aataacctaaagagagactg

SEQ ID NO: 244442 - DNA, 20 bp, Artificial Sequence
  chemically synthesized
ttctacctacagtctctctt

SEQ ID NO: 244443 - DNA, 20 bp, Artificial Sequence
  chemically synthesized
tctacctacagtctctcttt

SEQ ID NO: 244444 - DNA, 20 bp, Artificial Sequence
  chemically synthesized
tgggtgcaataacctaaaga

SEQ ID NO: 244445 - DNA, 20 bp, Artificial Sequence
  chemically synthesized
agtgggtgcaataacctaaa

SEQ ID NO: 244446 - DNA, 20 bp, Artificial Sequence
  chemically synthesized
tgagtgggtgcaataaccta

SEQ ID NO: 244447 - DNA, 20 bp, Artificial Sequence
  chemically synthesized
atatttaaagttatgtgagt

SEQ ID NO: 244448 - DNA, 20 bp, Artificial Sequence
  chemically synthesized
aatatttaaagttatgtgag

SEQ ID NO: 244449 - DNA, 20 bp, Artificial Sequence
  chemically synthesized
aataatatttaaagttatgt

SEQ ID NO: 244450 - DNA, 20 bp, Artificial Sequence
  chemically synthesized
aggcatgtaaataatattta

SEQ ID NO: 244451 - DNA, 20 bp, Artificial Sequence
  chemically synthesized
ttaaatattatttacatgcc

SEQ ID NO: 244452 - DNA, 20 bp, Artificial Sequence
  chemically synthesized
taaatattatttacatgcct

SEQ ID NO: 244453 - DNA, 20 bp, Artificial Sequence
  chemically synthesized
gatacatacgtgggatacct

SEQ ID NO: 244454 - DNA, 20 bp, Artificial Sequence
  chemically synthesized
agatacatacgtgggatacc

SEQ ID NO: 244455 - DNA, 20 bp, Artificial Sequence
  chemically synthesized
tgtgaccaagatacatacgt

SEQ ID NO: 244456 - DNA, 20 bp, Artificial Sequence
  chemically synthesized
ctgtgaccaagatacatacg

SEQ ID NO: 244457 - DNA, 20 bp, Artificial Sequence
  chemically synthesized
ggtatcccacgtatgtatct

SEQ ID NO: 244458 - DNA, 20 bp, Artificial Sequence
  chemically synthesized
ccacgtatgtatcttggtca

SEQ ID NO: 244459 - DNA, 20 bp, Artificial Sequence
  chemically synthesized
tggatgaaatatctgtgacc

SEQ ID NO: 244460 - DNA, 20 bp, Artificial Sequence
  chemically synthesized
tgaaacatctacatgaaacg

SEQ ID NO: 244461 - DNA, 20 bp, Artificial Sequence
  chemically synthesized
tatttcatccacgtttcatg

SEQ ID NO: 244462 - DNA, 20 bp, Artificial Sequence
  chemically synthesized
cacgtttcatgtagatgttt

SEQ ID NO: 244463 - DNA, 20 bp, Artificial Sequence
  chemically synthesized
tctagatttatattcaattt

SEQ ID NO: 244464 - DNA, 20 bp, Artificial Sequence
  chemically synthesized
tctcaaattgaatataaatc

SEQ ID NO: 244465 - DNA, 20 bp, Artificial Sequence
  chemically synthesized
aaattgaatataaatctaga

SEQ ID NO: 244466 - DNA, 20 bp, Artificial Sequence
  chemically synthesized
aattgaatataaatctagaa

SEQ ID NO: 244467 - DNA, 20 bp, Artificial Sequence
  chemically synthesized
tttggaggtggagacctttc

SEQ ID NO: 244468 - DNA, 20 bp, Artificial Sequence
  chemically synthesized
aaggggcagatttggaggtg

SEQ ID NO: 244469 - DNA, 20 bp, Artificial Sequence
  chemically synthesized
agaaggggcagatttggagg

SEQ ID NO: 244470 - DNA, 20 bp, Artificial Sequence
  chemically synthesized
aaaagaaggggcagatttgg

SEQ ID NO: 244471 - DNA, 20 bp, Artificial Sequence
  chemically synthesized
gaaaagaaggggcagatttg

SEQ ID NO: 244472 - DNA, 20 bp, Artificial Sequence
  chemically synthesized
cagaaaagaaggggcagatt

SEQ ID NO: 244473 - DNA, 20 bp, Artificial Sequence
  chemically synthesized
ggagaacagaaaagaagggg

SEQ ID NO: 244474 - DNA, 20 bp, Artificial Sequence
  chemically synthesized
gctggagaacagaaaagaag

SEQ ID NO: 244475 - DNA, 20 bp, Artificial Sequence
  chemically synthesized
agctggagaacagaaaagaa

SEQ ID NO: 244476 - DNA, 20 bp, Artificial Sequence
  chemically synthesized
gagctggagaacagaaaaga

SEQ ID NO: 244477 - DNA, 20 bp, Artificial Sequence
  chemically synthesized
tgagctggagaacagaaaag

SEQ ID NO: 244478 - DNA, 20 bp, Artificial Sequence
  chemically synthesized
tattgagctggagaacagaa

SEQ ID NO: 244479 - DNA, 20 bp, Artificial Sequence
  chemically synthesized
gccccttcttttctgttctc

SEQ ID NO: 244480 - DNA, 20 bp, Artificial Sequence
  chemically synthesized
gataatattgagctggagaa

SEQ ID NO: 244481 - DNA, 20 bp, Artificial Sequence
  chemically synthesized
tattagataatattgagctg

SEQ ID NO: 244482 - DNA, 20 bp, Artificial Sequence
  chemically synthesized
catattagataatattgagc

SEQ ID NO: 244483 - DNA, 20 bp, Artificial Sequence
  chemically synthesized
tgagcatattagataatatt

SEQ ID NO: 244484 - DNA, 20 bp, Artificial Sequence
  chemically synthesized
tcaatattatctaatatgct

SEQ ID NO: 244485 - DNA, 20 bp, Artificial Sequence
  chemically synthesized
gggatgatccctgagcatat

SEQ ID NO: 244486 - DNA, 20 bp, Artificial Sequence
  chemically synthesized
caatattatctaatatgctc

SEQ ID NO: 244487 - DNA, 20 bp, Artificial Sequence
  chemically synthesized
aatattatctaatatgctca

SEQ ID NO: 244488 - DNA, 20 bp, Artificial Sequence
  chemically synthesized
aagtgtcagggatgatccct

SEQ ID NO: 244489 - DNA, 20 bp, Artificial Sequence
  chemically synthesized
tgaaagacagtgaagtgtca

SEQ ID NO: 244490 - DNA, 20 bp, Artificial Sequence
  chemically synthesized
ttgaaagacagtgaagtgtc

SEQ ID NO: 244491 - DNA, 20 bp, Artificial Sequence
  chemically synthesized
gttgaaagacagtgaagtgt

SEQ ID NO: 244492 - DNA, 20 bp, Artificial Sequence
  chemically synthesized
agtggagttgaaagacagtg

SEQ ID NO: 244493 - DNA, 20 bp, Artificial Sequence
  chemically synthesized
ttgaaagtggagttgaaaga

SEQ ID NO: 244494 - DNA, 20 bp, Artificial Sequence
  chemically synthesized
agatttgaaagtggagttga

SEQ ID NO: 244495 - DNA, 20 bp, Artificial Sequence
  chemically synthesized
ttttgacagatttgaaagtg

SEQ ID NO: 244496 - DNA, 20 bp, Artificial Sequence
  chemically synthesized
acttttgacagatttgaaag

SEQ ID NO: 244497 - DNA, 20 bp, Artificial Sequence
  chemically synthesized
gcaacttttgacagatttga

SEQ ID NO: 244498 - DNA, 20 bp, Artificial Sequence
  chemically synthesized
tccactttcaaatctgtcaa

SEQ ID NO: 244499 - DNA, 20 bp, Artificial Sequence
  chemically synthesized
ctattagtagcaacttttga

SEQ ID NO: 244500 - DNA, 20 bp, Artificial Sequence
  chemically synthesized
ctgtcaaaagttgctactaa

SEQ ID NO: 244501 - DNA, 20 bp, Artificial Sequence
  chemically synthesized
tatgttaatggagctattag

SEQ ID NO: 244502 - DNA, 20 bp, Artificial Sequence
  chemically synthesized
acttatgttaatggagctat

SEQ ID NO: 244503 - DNA, 20 bp, Artificial Sequence
  chemically synthesized
ctttgatacttatgttaatg

SEQ ID NO: 244504 - DNA, 20 bp, Artificial Sequence
  chemically synthesized
actaatagctccattaacat

SEQ ID NO: 244505 - DNA, 20 bp, Artificial Sequence
  chemically synthesized
gtctttgatacttatgttaa

SEQ ID NO: 244506 - DNA, 20 bp, Artificial Sequence
  chemically synthesized
ctccattaacataagtatca

SEQ ID NO: 244507 - DNA, 20 bp, Artificial Sequence
  chemically synthesized
ccttgagatggcaatggaag

SEQ ID NO: 244508 - DNA, 20 bp, Artificial Sequence
  chemically synthesized
aagccttgagatggcaatgg

SEQ ID NO: 244509 - DNA, 20 bp, Artificial Sequence
  chemically synthesized
accaagccttgagatggcaa

SEQ ID NO: 244510 - DNA, 20 bp, Artificial Sequence
  chemically synthesized
tccacttccattgccatctc

SEQ ID NO: 244511 - DNA, 20 bp, Artificial Sequence
  chemically synthesized
ccacttccattgccatctca

SEQ ID NO: 244512 - DNA, 20 bp, Artificial Sequence
  chemically synthesized
gcatagaccaagccttgaga

SEQ ID NO: 244513 - DNA, 20 bp, Artificial Sequence
  chemically synthesized
tccattgccatctcaaggct

SEQ ID NO: 244514 - DNA, 20 bp, Artificial Sequence
  chemically synthesized
caaagcatagaccaagcctt

SEQ ID NO: 244515 - DNA, 20 bp, Artificial Sequence
  chemically synthesized
agaataccaaagcatagacc

SEQ ID NO: 244516 - DNA, 20 bp, Artificial Sequence
  chemically synthesized
tcaaggcttggtctatgctt

SEQ ID NO: 244517 - DNA, 20 bp, Artificial Sequence
  chemically synthesized
ccacttagaataccaaagca

SEQ ID NO: 244518 - DNA, 20 bp, Artificial Sequence
  chemically synthesized
aatggccacttagaatacca

SEQ ID NO: 244519 - DNA, 20 bp, Artificial Sequence
  chemically synthesized
ggtctatgctttggtattct

SEQ ID NO: 244520 - DNA, 20 bp, Artificial Sequence
  chemically synthesized
ctatgctttggtattctaag

SEQ ID NO: 244521 - DNA, 20 bp, Artificial Sequence
  chemically synthesized
ctgaaaacagaatggccact

SEQ ID NO: 244522 - DNA, 20 bp, Artificial Sequence
  chemically synthesized
gaacctccctgaaaacagaa

SEQ ID NO: 244523 - DNA, 20 bp, Artificial Sequence
  chemically synthesized
ctaagtggccattctgtttt

SEQ ID NO: 244524 - DNA, 20 bp, Artificial Sequence
  chemically synthesized
taagtggccattctgttttc

SEQ ID NO: 244525 - DNA, 20 bp, Artificial Sequence
  chemically synthesized
aagtggccattctgttttca

SEQ ID NO: 244526 - DNA, 20 bp, Artificial Sequence
  chemically synthesized
ttagggaacctccctgaaaa

SEQ ID NO: 244527 - DNA, 20 bp, Artificial Sequence
  chemically synthesized
gtggccattctgttttcagg

SEQ ID NO: 244528 - DNA, 20 bp, Artificial Sequence
  chemically synthesized
tggccattctgttttcaggg

SEQ ID NO: 244529 - DNA, 20 bp, Artificial Sequence
  chemically synthesized
gttttcagggaggttcccta

SEQ ID NO: 244530 - DNA, 20 bp, Artificial Sequence
  chemically synthesized
gctgaaaacaatgtacttta

SEQ ID NO: 244531 - DNA, 20 bp, Artificial Sequence
  chemically synthesized
tgctgaaaacaatgtacttt

SEQ ID NO: 244532 - DNA, 20 bp, Artificial Sequence
  chemically synthesized
ttgctgaaaacaatgtactt

SEQ ID NO: 244533 - DNA, 20 bp, Artificial Sequence
  chemically synthesized
tccctaaagtacattgtttt

SEQ ID NO: 244534 - DNA, 20 bp, Artificial Sequence
  chemically synthesized
tgattatgtcactaccttgc

SEQ ID NO: 244535 - DNA, 20 bp, Artificial Sequence
  chemically synthesized
gattatgtcactaccttgct

SEQ ID NO: 244536 - DNA, 20 bp, Artificial Sequence
  chemically synthesized
agccacctcacccagcaagg

SEQ ID NO: 244537 - DNA, 20 bp, Artificial Sequence
  chemically synthesized
atgagccacctcacccagca

SEQ ID NO: 244538 - DNA, 20 bp, Artificial Sequence
  chemically synthesized
atgtcactaccttgctgggt

SEQ ID NO: 244539 - DNA, 20 bp, Artificial Sequence
  chemically synthesized
tatgagccacctcacccagc

SEQ ID NO: 244540 - DNA, 20 bp, Artificial Sequence
  chemically synthesized
tgtcactaccttgctgggtg

SEQ ID NO: 244541 - DNA, 20 bp, Artificial Sequence
  chemically synthesized
cactaccttgctgggtgagg

SEQ ID NO: 244542 - DNA, 20 bp, Artificial Sequence
  chemically synthesized
cagatatgagccacctcacc

SEQ ID NO: 244543 - DNA, 20 bp, Artificial Sequence
  chemically synthesized
aatggtgggattacagatat

SEQ ID NO: 244544 - DNA, 20 bp, Artificial Sequence
  chemically synthesized
ctcttaaaatggtgggatta

SEQ ID NO: 244545 - DNA, 20 bp, Artificial Sequence
  chemically synthesized
cctcatcctcttaaaatggt

SEQ ID NO: 244546 - DNA, 20 bp, Artificial Sequence
  chemically synthesized
atctgtaatcccaccatttt

SEQ ID NO: 244547 - DNA, 20 bp, Artificial Sequence
  chemically synthesized
gcctcatcctcttaaaatgg

SEQ ID NO: 244548 - DNA, 20 bp, Artificial Sequence
  chemically synthesized
ctgtaatcccaccattttaa

SEQ ID NO: 244549 - DNA, 20 bp, Artificial Sequence
  chemically synthesized
tgtaatcccaccattttaag

SEQ ID NO: 244550 - DNA, 20 bp, Artificial Sequence
  chemically synthesized
cccgcctcatcctcttaaaa

SEQ ID NO: 244551 - DNA, 20 bp, Artificial Sequence
  chemically synthesized
tcccaccattttaagaggat

SEQ ID NO: 244552 - DNA, 20 bp, Artificial Sequence
  chemically synthesized
cccaccattttaagaggatg

SEQ ID NO: 244553 - DNA, 20 bp, Artificial Sequence
  chemically synthesized
accattttaagaggatgagg

SEQ ID NO: 244554 - DNA, 20 bp, Artificial Sequence
  chemically synthesized
ccattttaagaggatgaggc

SEQ ID NO: 244555 - DNA, 20 bp, Artificial Sequence
  chemically synthesized
attttaagaggatgaggcgg

SEQ ID NO: 244556 - DNA, 20 bp, Artificial Sequence
  chemically synthesized
ttttaagaggatgaggcggg

SEQ ID NO: 244557 - DNA, 20 bp, Artificial Sequence
  chemically synthesized
gatgaggcgggaggattgct

SEQ ID NO: 244558 - DNA, 20 bp, Artificial Sequence
  chemically synthesized
atgaggcgggaggattgctt

SEQ ID NO: 244559 - DNA, 20 bp, Artificial Sequence
  chemically synthesized
gcgggaggattgcttgggcc

SEQ ID NO: 244560 - DNA, 20 bp, Artificial Sequence
  chemically synthesized
gatcttggattactgggccc

SEQ ID NO: 244561 - DNA, 20 bp, Artificial Sequence
  chemically synthesized
aaggctgatcttggattact

SEQ ID NO: 244562 - DNA, 20 bp, Artificial Sequence
  chemically synthesized
ttgcttgggcccagtaatcc

SEQ ID NO: 244563 - DNA, 20 bp, Artificial Sequence
  chemically synthesized
taaggctgatcttggattac

SEQ ID NO: 244564 - DNA, 20 bp, Artificial Sequence
  chemically synthesized
tgggcccagtaatccaagat

SEQ ID NO: 244565 - DNA, 20 bp, Artificial Sequence
  chemically synthesized
taagtttctaaggctgatct

SEQ ID NO: 244566 - DNA, 20 bp, Artificial Sequence
  chemically synthesized
cagtaatccaagatcagcct

SEQ ID NO: 244567 - DNA, 20 bp, Artificial Sequence
  chemically synthesized
gttacgtttctaagtttcta

SEQ ID NO: 244568 - DNA, 20 bp, Artificial Sequence
  chemically synthesized
caagatcagccttagaaact

SEQ ID NO: 244569 - DNA, 20 bp, Artificial Sequence
  chemically synthesized
tgttacgtttctaagtttct

SEQ ID NO: 244570 - DNA, 20 bp, Artificial Sequence
  chemically synthesized
cagggtcttgttacgtttct

SEQ ID NO: 244571 - DNA, 20 bp, Artificial Sequence
  chemically synthesized
tagaaacttagaaacgtaac

SEQ ID NO: 244572 - DNA, 20 bp, Artificial Sequence
  chemically synthesized
acaattattttgaagagaca

SEQ ID NO: 244573 - DNA, 20 bp, Artificial Sequence
  chemically synthesized
aacaattattttgaagagac

SEQ ID NO: 244574 - DNA, 20 bp, Artificial Sequence
  chemically synthesized
aaacaattattttgaagaga

SEQ ID NO: 244575 - DNA, 20 bp, Artificial Sequence
  chemically synthesized
ctttaaacaattattttgaa

SEQ ID NO: 244576 - DNA, 20 bp, Artificial Sequence
  chemically synthesized
aactttaaacaattattttg

SEQ ID NO: 244577 - DNA, 20 bp, Artificial Sequence
  chemically synthesized
ctcttcaaaataattgttta

SEQ ID NO: 244578 - DNA, 20 bp, Artificial Sequence
  chemically synthesized
tcaaaataattgtttaaagt

SEQ ID NO: 244579 - DNA, 20 bp, Artificial Sequence
  chemically synthesized
aataattgtttaaagttagc

SEQ ID NO: 244580 - DNA, 20 bp, Artificial Sequence
  chemically synthesized
ataattgtttaaagttagcc

SEQ ID NO: 244581 - DNA, 20 bp, Artificial Sequence
  chemically synthesized
tgtttaaagttagccaggca

SEQ ID NO: 244582 - DNA, 20 bp, Artificial Sequence
  chemically synthesized
ttaaagttagccaggcatag

SEQ ID NO: 244583 - DNA, 20 bp, Artificial Sequence
  chemically synthesized
caggcatttgccactatgcc

SEQ ID NO: 244584 - DNA, 20 bp, Artificial Sequence
  chemically synthesized
ggcatagtggcaaatgcctg

SEQ ID NO: 244585 - DNA, 20 bp, Artificial Sequence
  chemically synthesized
atagtggcaaatgcctgtag

SEQ ID NO: 244586 - DNA, 20 bp, Artificial Sequence
  chemically synthesized
tgggtagctgggactactac

SEQ ID NO: 244587 - DNA, 20 bp, Artificial Sequence
  chemically synthesized
ctgggtagctgggactacta

SEQ ID NO: 244588 - DNA, 20 bp, Artificial Sequence
  chemically synthesized
gcaaatgcctgtagtagtcc

SEQ ID NO: 244589 - DNA, 20 bp, Artificial Sequence
  chemically synthesized
ctgtagtagtcccagctacc

SEQ ID NO: 244590 - DNA, 20 bp, Artificial Sequence
  chemically synthesized
cctcagcttcctgggtagct

SEQ ID NO: 244591 - DNA, 20 bp, Artificial Sequence
  chemically synthesized
tgtagtagtcccagctaccc

SEQ ID NO: 244592 - DNA, 20 bp, Artificial Sequence
  chemically synthesized
acctcagcttcctgggtagc

SEQ ID NO: 244593 - DNA, 20 bp, Artificial Sequence
  chemically synthesized
agtagtcccagctacccagg

SEQ ID NO: 244594 - DNA, 20 bp, Artificial Sequence
  chemically synthesized
tcctacctcagcttcctggg

SEQ ID NO: 244595 - DNA, 20 bp, Artificial Sequence
  chemically synthesized
ccctcctacctcagcttcct

SEQ ID NO: 244596 - DNA, 20 bp, Artificial Sequence
  chemically synthesized
tcccagctacccaggaagct

SEQ ID NO: 244597 - DNA, 20 bp, Artificial Sequence
  chemically synthesized
accctcctacctcagcttcc

SEQ ID NO: 244598 - DNA, 20 bp, Artificial Sequence
  chemically synthesized
cccagctacccaggaagctg

SEQ ID NO: 244599 - DNA, 20 bp, Artificial Sequence
  chemically synthesized
agctacccaggaagctgagg

SEQ ID NO: 244600 - DNA, 20 bp, Artificial Sequence
  chemically synthesized
gctacccaggaagctgaggt

SEQ ID NO: 244601 - DNA, 20 bp, Artificial Sequence
  chemically synthesized
tacccaggaagctgaggtag

SEQ ID NO: 244602 - DNA, 20 bp, Artificial Sequence
  chemically synthesized
acccaggaagctgaggtagg

SEQ ID NO: 244603 - DNA, 20 bp, Artificial Sequence
  chemically synthesized
cccatatcaccctcctacct

SEQ ID NO: 244604 - DNA, 20 bp, Artificial Sequence
  chemically synthesized
cccaggaagctgaggtagga

SEQ ID NO: 244605 - DNA, 20 bp, Artificial Sequence
  chemically synthesized
gctgaggtaggagggtgata

SEQ ID NO: 244606 - DNA, 20 bp, Artificial Sequence
  chemically synthesized
ctgaggtaggagggtgatat

SEQ ID NO: 244607 - DNA, 20 bp, Artificial Sequence
  chemically synthesized
gaggtaggagggtgatatgg

SEQ ID NO: 244608 - DNA, 20 bp, Artificial Sequence
  chemically synthesized
aggtaggagggtgatatggg

SEQ ID NO: 244609 - DNA, 20 bp, Artificial Sequence
  chemically synthesized
gtgatatgggaggattgctt

SEQ ID NO: 244610 - DNA, 20 bp, Artificial Sequence
  chemically synthesized
tgggaggattgcttgagccc

SEQ ID NO: 244611 - DNA, 20 bp, Artificial Sequence
  chemically synthesized
gggaggattgcttgagccca

SEQ ID NO: 244612 - DNA, 20 bp, Artificial Sequence
  chemically synthesized
gccttgaactccttgggctc

SEQ ID NO: 244613 - DNA, 20 bp, Artificial Sequence
  chemically synthesized
gaggattgcttgagcccaag

SEQ ID NO: 244614 - DNA, 20 bp, Artificial Sequence
  chemically synthesized
actgcagccttgaactcctt

SEQ ID NO: 244615 - DNA, 20 bp, Artificial Sequence
  chemically synthesized
cactgcagccttgaactcct

SEQ ID NO: 244616 - DNA, 20 bp, Artificial Sequence
  chemically synthesized
tgcttgagcccaaggagttc

SEQ ID NO: 244617 - DNA, 20 bp, Artificial Sequence
  chemically synthesized
gcttgagcccaaggagttca

SEQ ID NO: 244618 - DNA, 20 bp, Artificial Sequence
  chemically synthesized
gcccaaggagttcaaggctg

SEQ ID NO: 244619 - DNA, 20 bp, Artificial Sequence
  chemically synthesized
aaggagttcaaggctgcagt

SEQ ID NO: 244620 - DNA, 20 bp, Artificial Sequence
  chemically synthesized
gacatgatcacggctcactg

SEQ ID NO: 244621 - DNA, 20 bp, Artificial Sequence
  chemically synthesized
ggagtgcagtgacatgatca

SEQ ID NO: 244622 - DNA, 20 bp, Artificial Sequence
  chemically synthesized
gtgatcatgtcactgcactc

SEQ ID NO: 244623 - DNA, 20 bp, Artificial Sequence
  chemically synthesized
ctgttgcccaggctggagtg

SEQ ID NO: 244624 - DNA, 20 bp, Artificial Sequence
  chemically synthesized
catgtcactgcactccagcc

SEQ ID NO: 244625 - DNA, 20 bp, Artificial Sequence
  chemically synthesized
atgtcactgcactccagcct

SEQ ID NO: 244626 - DNA, 20 bp, Artificial Sequence
  chemically synthesized
tcactctgttgcccaggctg

SEQ ID NO: 244627 - DNA, 20 bp, Artificial Sequence
  chemically synthesized
tctcactctgttgcccaggc

SEQ ID NO: 244628 - DNA, 20 bp, Artificial Sequence
  chemically synthesized
ctgcactccagcctgggcaa

SEQ ID NO: 244629 - DNA, 20 bp, Artificial Sequence
  chemically synthesized
acaatctcactctgttgccc

SEQ ID NO: 244630 - DNA, 20 bp, Artificial Sequence
  chemically synthesized
gcactccagcctgggcaaca

SEQ ID NO: 244631 - DNA, 20 bp, Artificial Sequence
  chemically synthesized
cacaatctcactctgttgcc

SEQ ID NO: 244632 - DNA, 20 bp, Artificial Sequence
  chemically synthesized
tccagcctgggcaacagagt

SEQ ID NO: 244633 - DNA, 20 bp, Artificial Sequence
  chemically synthesized
tttacttatttatttatttc

SEQ ID NO: 244634 - DNA, 20 bp, Artificial Sequence
  chemically synthesized
gtgtcttgaaataaataaat

SEQ ID NO: 244635 - DNA, 20 bp, Artificial Sequence
  chemically synthesized
aaataagtaaaacaaaattt

SEQ ID NO: 244636 - DNA, 20 bp, Artificial Sequence
  chemically synthesized
atcaaaaaataaacttgtaa

SEQ ID NO: 244637 - DNA, 20 bp, Artificial Sequence
  chemically synthesized
gtgcaacggaaaaccattac

SEQ ID NO: 244638 - DNA, 20 bp, Artificial Sequence
  chemically synthesized
taatggttttccgttgcact

SEQ ID NO: 244639 - DNA, 20 bp, Artificial Sequence
  chemically synthesized
tagattttatctaagtgcaa

SEQ ID NO: 244640 - DNA, 20 bp, Artificial Sequence
  chemically synthesized
aataagtatagattttatct

SEQ ID NO: 244641 - DNA, 20 bp, Artificial Sequence
  chemically synthesized
gtaggccacaaaaataagta

SEQ ID NO: 244642 - DNA, 20 bp, Artificial Sequence
  chemically synthesized
aaaatctatacttatttttg

SEQ ID NO: 244643 - DNA, 20 bp, Artificial Sequence
  chemically synthesized
tcattgtaggccacaaaaat

SEQ ID NO: 244644 - DNA, 20 bp, Artificial Sequence
  chemically synthesized
tacgttgtacaagtcattgt

SEQ ID NO: 244645 - DNA, 20 bp, Artificial Sequence
  chemically synthesized
ttacgttgtacaagtcattg

SEQ ID NO: 244646 - DNA, 20 bp, Artificial Sequence
  chemically synthesized
tggcaagttttacgttgtac

SEQ ID NO: 244647 - DNA, 20 bp, Artificial Sequence
  chemically synthesized
tgagagagggagagcgtggc

SEQ ID NO: 244648 - DNA, 20 bp, Artificial Sequence
  chemically synthesized
atggtgagagagggagagcg

SEQ ID NO: 244649 - DNA, 20 bp, Artificial Sequence
  chemically synthesized
ggggtatggtgagagaggga

SEQ ID NO: 244650 - DNA, 20 bp, Artificial Sequence
  chemically synthesized
atggggtatggtgagagagg

SEQ ID NO: 244651 - DNA, 20 bp, Artificial Sequence
  chemically synthesized
gtatggggtatggtgagaga

SEQ ID NO: 244652 - DNA, 20 bp, Artificial Sequence
  chemically synthesized
tgtatggggtatggtgagag

SEQ ID NO: 244653 - DNA, 20 bp, Artificial Sequence
  chemically synthesized
gtgtatggggtatggtgaga

SEQ ID NO: 244654 - DNA, 20 bp, Artificial Sequence
  chemically synthesized
ttgtgtatggggtatggtga

SEQ ID NO: 244655 - DNA, 20 bp, Artificial Sequence
  chemically synthesized
ccttgtgtatggggtatggt

SEQ ID NO: 244656 - DNA, 20 bp, Artificial Sequence
  chemically synthesized
aagcccttgtgtatggggta

SEQ ID NO: 244657 - DNA, 20 bp, Artificial Sequence
  chemically synthesized
tctcaccataccccatacac

SEQ ID NO: 244658 - DNA, 20 bp, Artificial Sequence
  chemically synthesized
aaagaaagcccttgtgtatg

SEQ ID NO: 244659 - DNA, 20 bp, Artificial Sequence
  chemically synthesized
ctcaccataccccatacaca

SEQ ID NO: 244660 - DNA, 20 bp, Artificial Sequence
  chemically synthesized
aaaagaaagcccttgtgtat

SEQ ID NO: 244661 - DNA, 20 bp, Artificial Sequence
  chemically synthesized
tcaccataccccatacacaa

SEQ ID NO: 244662 - DNA, 20 bp, Artificial Sequence
  chemically synthesized
taaaagaaagcccttgtgta

SEQ ID NO: 244663 - DNA, 20 bp, Artificial Sequence
  chemically synthesized
catacacaagggctttcttt

SEQ ID NO: 244664 - DNA, 20 bp, Artificial Sequence
  chemically synthesized
atgttcgaaattctaaaaga

SEQ ID NO: 244665 - DNA, 20 bp, Artificial Sequence
  chemically synthesized
tggaatgttcgaaattctaa

SEQ ID NO: 244666 - DNA, 20 bp, Artificial Sequence
  chemically synthesized
tttagaatttcgaacattcc

SEQ ID NO: 244667 - DNA, 20 bp, Artificial Sequence
  chemically synthesized
tgagatgttggtagagatct

SEQ ID NO: 244668 - DNA, 20 bp, Artificial Sequence
  chemically synthesized
aaagtcttgagatgttggta

SEQ ID NO: 244669 - DNA, 20 bp, Artificial Sequence
  chemically synthesized
acaaagtcttgagatgttgg

SEQ ID NO: 244670 - DNA, 20 bp, Artificial Sequence
  chemically synthesized
aagatctctaccaacatctc

SEQ ID NO: 244671 - DNA, 20 bp, Artificial Sequence
  chemically synthesized
tgaacaaagtcttgagatgt

SEQ ID NO: 244672 - DNA, 20 bp, Artificial Sequence
  chemically synthesized
agtcacatgaacaaagtctt

SEQ ID NO: 244673 - DNA, 20 bp, Artificial Sequence
  chemically synthesized
tgtagggagtcacatgaaca

SEQ ID NO: 244674 - DNA, 20 bp, Artificial Sequence
  chemically synthesized
aactcagtaaagagtgtagg

SEQ ID NO: 244675 - DNA, 20 bp, Artificial Sequence
  chemically synthesized
gcaactcagtaaagagtgta

SEQ ID NO: 244676 - DNA, 20 bp, Artificial Sequence
  chemically synthesized
tgcaactcagtaaagagtgt

SEQ ID NO: 244677 - DNA, 20 bp, Artificial Sequence
  chemically synthesized
ctgcaactcagtaaagagtg

SEQ ID NO: 244678 - DNA, 20 bp, Artificial Sequence
  chemically synthesized
gactccctacactctttact

SEQ ID NO: 244679 - DNA, 20 bp, Artificial Sequence
  chemically synthesized
gagacctgcaactcagtaaa

SEQ ID NO: 244680 - DNA, 20 bp, Artificial Sequence
  chemically synthesized
cagagacctgcaactcagta

SEQ ID NO: 244681 - DNA, 20 bp, Artificial Sequence
  chemically synthesized
ctacactctttactgagttg

SEQ ID NO: 244682 - DNA, 20 bp, Artificial Sequence
  chemically synthesized
tacactctttactgagttgc

SEQ ID NO: 244683 - DNA, 20 bp, Artificial Sequence
  chemically synthesized
tgaagcagagacctgcaact

SEQ ID NO: 244684 - DNA, 20 bp, Artificial Sequence
  chemically synthesized
tgaggaaaagtattgaagca

SEQ ID NO: 244685 - DNA, 20 bp, Artificial Sequence
  chemically synthesized
tgtgaggaaaagtattgaag

SEQ ID NO: 244686 - DNA, 20 bp, Artificial Sequence
  chemically synthesized
atctgtgaggaaaagtattg

SEQ ID NO: 244687 - DNA, 20 bp, Artificial Sequence
  chemically synthesized
tgcttcaatacttttcctca

SEQ ID NO: 244688 - DNA, 20 bp, Artificial Sequence
  chemically synthesized
gagtaattatctgtgaggaa

SEQ ID NO: 244689 - DNA, 20 bp, Artificial Sequence
  chemically synthesized
actgagagtaattatctgtg

SEQ ID NO: 244690 - DNA, 20 bp, Artificial Sequence
  chemically synthesized
gactgagagtaattatctgt

SEQ ID NO: 244691 - DNA, 20 bp, Artificial Sequence
  chemically synthesized
tcctcacagataattactct

SEQ ID NO: 244692 - DNA, 20 bp, Artificial Sequence
  chemically synthesized
tgctgcagtctagagactga

SEQ ID NO: 244693 - DNA, 20 bp, Artificial Sequence
  chemically synthesized
agataattactctcagtctc

SEQ ID NO: 244694 - DNA, 20 bp, Artificial Sequence
  chemically synthesized
aatgctgcagtctagagact

SEQ ID NO: 244695 - DNA, 20 bp, Artificial Sequence
  chemically synthesized
tactctcagtctctagactg

SEQ ID NO: 244696 - DNA, 20 bp, Artificial Sequence
  chemically synthesized
aaaagaaatgctgcagtcta

SEQ ID NO: 244697 - DNA, 20 bp, Artificial Sequence
  chemically synthesized
caaaaagaaatgctgcagtc

SEQ ID NO: 244698 - DNA, 20 bp, Artificial Sequence
  chemically synthesized
tctaacaaaaagaaatgctg

SEQ ID NO: 244699 - DNA, 20 bp, Artificial Sequence
  chemically synthesized
actgcagcatttctttttgt

SEQ ID NO: 244700 - DNA, 20 bp, Artificial Sequence
  chemically synthesized
ctatgagatattctaacaaa

SEQ ID NO: 244701 - DNA, 20 bp, Artificial Sequence
  chemically synthesized
ctttttgttagaatatctca

SEQ ID NO: 244702 - DNA, 20 bp, Artificial Sequence
  chemically synthesized
tgaaaagtataaggagctat

SEQ ID NO: 244703 - DNA, 20 bp, Artificial Sequence
  chemically synthesized
ctatgaatgaaaagtataag

SEQ ID NO: 244704 - DNA, 20 bp, Artificial Sequence
  chemically synthesized
tgctatgaatgaaaagtata

SEQ ID NO: 244705 - DNA, 20 bp, Artificial Sequence
  chemically synthesized
gtgctatgaatgaaaagtat

SEQ ID NO: 244706 - DNA, 20 bp, Artificial Sequence
  chemically synthesized
cagtaggtgctatgaatgaa

SEQ ID NO: 244707 - DNA, 20 bp, Artificial Sequence
  chemically synthesized
ctccttatacttttcattca

SEQ ID NO: 244708 - DNA, 20 bp, Artificial Sequence
  chemically synthesized
ttcattcatagcacctactg

SEQ ID NO: 244709 - DNA, 20 bp, Artificial Sequence
  chemically synthesized
gtatatttacaagccgcagt

SEQ ID NO: 244710 - DNA, 20 bp, Artificial Sequence
  chemically synthesized
tgtatatttacaagccgcag

SEQ ID NO: 244711 - DNA, 20 bp, Artificial Sequence
  chemically synthesized
gagtgtatatttacaagccg

SEQ ID NO: 244712 - DNA, 20 bp, Artificial Sequence
  chemically synthesized
atacatgagtgtatatttac

SEQ ID NO: 244713 - DNA, 20 bp, Artificial Sequence
  chemically synthesized
aaggcaataatcatatacat

SEQ ID NO: 244714 - DNA, 20 bp, Artificial Sequence
  chemically synthesized
gtgggggaaaatgtatttta

SEQ ID NO: 244715 - DNA, 20 bp, Artificial Sequence
  chemically synthesized
agtgggggaaaatgtatttt

SEQ ID NO: 244716 - DNA, 20 bp, Artificial Sequence
  chemically synthesized
tggagctgaatgtttagtgg

SEQ ID NO: 244717 - DNA, 20 bp, Artificial Sequence
  chemically synthesized
ttggagctgaatgtttagtg

SEQ ID NO: 244718 - DNA, 20 bp, Artificial Sequence
  chemically synthesized
tttggagctgaatgtttagt

SEQ ID NO: 244719 - DNA, 20 bp, Artificial Sequence
  chemically synthesized
ttttggagctgaatgtttag

SEQ ID NO: 244720 - DNA, 20 bp, Artificial Sequence
  chemically synthesized
attttcccccactaaacatt

SEQ ID NO: 244721 - DNA, 20 bp, Artificial Sequence
  chemically synthesized
cctttttggagctgaatgtt

SEQ ID NO: 244722 - DNA, 20 bp, Artificial Sequence
  chemically synthesized
actaaacattcagctccaaa

SEQ ID NO: 244723 - DNA, 20 bp, Artificial Sequence
  chemically synthesized
ctaaacattcagctccaaaa

SEQ ID NO: 244724 - DNA, 20 bp, Artificial Sequence
  chemically synthesized
acattgtttctgcctttttg

SEQ ID NO: 244725 - DNA, 20 bp, Artificial Sequence
  chemically synthesized
aacattcagctccaaaaagg

SEQ ID NO: 244726 - DNA, 20 bp, Artificial Sequence
  chemically synthesized
acacattgtttctgcctttt

SEQ ID NO: 244727 - DNA, 20 bp, Artificial Sequence
  chemically synthesized
aaactctacagaaattaaca

SEQ ID NO: 244728 - DNA, 20 bp, Artificial Sequence
  chemically synthesized
gtgttctttgttaatttctg

SEQ ID NO: 244729 - DNA, 20 bp, Artificial Sequence
  chemically synthesized
gttctttgttaatttctgta

SEQ ID NO: 244730 - DNA, 20 bp, Artificial Sequence
  chemically synthesized
atcctgtctcaaaaactcta

SEQ ID NO: 244731 - DNA, 20 bp, Artificial Sequence
  chemically synthesized
ttaatttctgtagagttttt

SEQ ID NO: 244732 - DNA, 20 bp, Artificial Sequence
  chemically synthesized
tttctgtagagtttttgaga

SEQ ID NO: 244733 - DNA, 20 bp, Artificial Sequence
  chemically synthesized
ttctgtagagtttttgagac

SEQ ID NO: 244734 - DNA, 20 bp, Artificial Sequence
  chemically synthesized
tagagtttttgagacaggat

SEQ ID NO: 244735 - DNA, 20 bp, Artificial Sequence
  chemically synthesized
gtattcatttattcaacata

SEQ ID NO: 244736 - DNA, 20 bp, Artificial Sequence
  chemically synthesized
atatgttgaataaatgaata

SEQ ID NO: 244737 - DNA, 20 bp, Artificial Sequence
  chemically synthesized
tgaatacagaaataaaaata

SEQ ID NO: 244738 - DNA, 20 bp, Artificial Sequence
  chemically synthesized
cactatatatcagtgagcaa

SEQ ID NO: 244739 - DNA, 20 bp, Artificial Sequence
  chemically synthesized
gcactatatatcagtgagca

SEQ ID NO: 244740 - DNA, 20 bp, Artificial Sequence
  chemically synthesized
atatggcactatatatcagt

SEQ ID NO: 244741 - DNA, 20 bp, Artificial Sequence
  chemically synthesized
tgcctttgctcactgatata

SEQ ID NO: 244742 - DNA, 20 bp, Artificial Sequence
  chemically synthesized
atatatatggcactatatat

SEQ ID NO: 244743 - DNA, 20 bp, Artificial Sequence
  chemically synthesized
tgtttatatatatatatata

SEQ ID NO: 244744 - DNA, 20 bp, Artificial Sequence
  chemically synthesized
atatatatataaatatatat

SEQ ID NO: 244745 - DNA, 20 bp, Artificial Sequence
  chemically synthesized
aatatatacataaatatata

SEQ ID NO: 244746 - DNA, 20 bp, Artificial Sequence
  chemically synthesized
gtatatatatttatattcaa

SEQ ID NO: 244747 - DNA, 20 bp, Artificial Sequence
  chemically synthesized
tatttatattcaacggtaaa

SEQ ID NO: 244748 - DNA, 20 bp, Artificial Sequence
  chemically synthesized
caatacttaatcgatcggga

SEQ ID NO: 244749 - DNA, 20 bp, Artificial Sequence
  chemically synthesized
ataccaatacttaatcgatc

SEQ ID NO: 244750 - DNA, 20 bp, Artificial Sequence
  chemically synthesized
taaaactttcccgatcgatt

SEQ ID NO: 244751 - DNA, 20 bp, Artificial Sequence
  chemically synthesized
cataccaatacttaatcgat

SEQ ID NO: 244752 - DNA, 20 bp, Artificial Sequence
  chemically synthesized
tttcccgatcgattaagtat

SEQ ID NO: 244753 - DNA, 20 bp, Artificial Sequence
  chemically synthesized
cgatcgattaagtattggta

SEQ ID NO: 244754 - DNA, 20 bp, Artificial Sequence
  chemically synthesized
atcgattaagtattggtatg

SEQ ID NO: 244755 - DNA, 20 bp, Artificial Sequence
  chemically synthesized
attaagtattggtatggagt

SEQ ID NO: 244756 - DNA, 20 bp, Artificial Sequence
  chemically synthesized
taagtattggtatggagtca

SEQ ID NO: 244757 - DNA, 20 bp, Artificial Sequence
  chemically synthesized
gtattggtatggagtcagag

SEQ ID NO: 244758 - DNA, 20 bp, Artificial Sequence
  chemically synthesized
tggtatggagtcagagaagt

SEQ ID NO: 244759 - DNA, 20 bp, Artificial Sequence
  chemically synthesized
ggtatggagtcagagaagtg

SEQ ID NO: 244760 - DNA, 20 bp, Artificial Sequence
  chemically synthesized
gtatggagtcagagaagtga

SEQ ID NO: 244761 - DNA, 20 bp, Artificial Sequence
  chemically synthesized
gtcagagaagtgagggaaaa

SEQ ID NO: 244762 - DNA, 20 bp, Artificial Sequence
  chemically synthesized
ccatgatatctcaaagatgg

SEQ ID NO: 244763 - DNA, 20 bp, Artificial Sequence
  chemically synthesized
cagttttatctaccatcttt

SEQ ID NO: 244764 - DNA, 20 bp, Artificial Sequence
  chemically synthesized
tcaccatgatatctcaaaga

SEQ ID NO: 244765 - DNA, 20 bp, Artificial Sequence
  chemically synthesized
aatctcaccatgatatctca

SEQ ID NO: 244766 - DNA, 20 bp, Artificial Sequence
  chemically synthesized
ctaccatctttgagatatca

SEQ ID NO: 244767 - DNA, 20 bp, Artificial Sequence
  chemically synthesized
catctttgagatatcatggt

SEQ ID NO: 244768 - DNA, 20 bp, Artificial Sequence
  chemically synthesized
gagatatcatggtgagattt

SEQ ID NO: 244769 - DNA, 20 bp, Artificial Sequence
  chemically synthesized
agatatcatggtgagattta

SEQ ID NO: 244770 - DNA, 20 bp, Artificial Sequence
  chemically synthesized
catggtgagatttaaggata

SEQ ID NO: 244771 - DNA, 20 bp, Artificial Sequence
  chemically synthesized
tggtgagatttaaggataca

SEQ ID NO: 244772 - DNA, 20 bp, Artificial Sequence
  chemically synthesized
cagagattaaatatattgtc

SEQ ID NO: 244773 - DNA, 20 bp, Artificial Sequence
  chemically synthesized
agagattaaatatattgtcc

SEQ ID NO: 244774 - DNA, 20 bp, Artificial Sequence
  chemically synthesized
aatatattgtccaggtcttt

SEQ ID NO: 244775 - DNA, 20 bp, Artificial Sequence
  chemically synthesized
ctatgaggttcttaaagacc

SEQ ID NO: 244776 - DNA, 20 bp, Artificial Sequence
  chemically synthesized
ctctgtctatgaggttctta

SEQ ID NO: 244777 - DNA, 20 bp, Artificial Sequence
  chemically synthesized
ccaggtctttaagaacctca

SEQ ID NO: 244778 - DNA, 20 bp, Artificial Sequence
  chemically synthesized
gtctttaagaacctcataga

SEQ ID NO: 244779 - DNA, 20 bp, Artificial Sequence
  chemically synthesized
acacataaactctgtctatg

SEQ ID NO: 244780 - DNA, 20 bp, Artificial Sequence
  chemically synthesized
ctttaagaacctcatagaca

SEQ ID NO: 244781 - DNA, 20 bp, Artificial Sequence
  chemically synthesized
cacacataaactctgtctat

SEQ ID NO: 244782 - DNA, 20 bp, Artificial Sequence
  chemically synthesized
ttatgtgtgactctaaaaaa

SEQ ID NO: 244783 - DNA, 20 bp, Artificial Sequence
  chemically synthesized
ttatcttcatctatttttta

SEQ ID NO: 244784 - DNA, 20 bp, Artificial Sequence
  chemically synthesized
tcttatcttcatctattttt

SEQ ID NO: 244785 - DNA, 20 bp, Artificial Sequence
  chemically synthesized
gtgactctaaaaaatagatg

SEQ ID NO: 244786 - DNA, 20 bp, Artificial Sequence
  chemically synthesized
tctaaaaaatagatgaagat

SEQ ID NO: 244787 - DNA, 20 bp, Artificial Sequence
  chemically synthesized
aaaaaatagatgaagataag

SEQ ID NO: 244788 - DNA, 20 bp, Artificial Sequence
  chemically synthesized
atagatgaagataagaagat

SEQ ID NO: 244789 - DNA, 20 bp, Artificial Sequence
  chemically synthesized
agtatttaaatgaaaaaatt

SEQ ID NO: 244790 - DNA, 20 bp, Artificial Sequence
  chemically synthesized
gtatttaaatgaaaaaattg

SEQ ID NO: 244791 - DNA, 20 bp, Artificial Sequence
  chemically synthesized
tttaaatgaaaaaattgagg

SEQ ID NO: 244792 - DNA, 20 bp, Artificial Sequence
  chemically synthesized
atgaaaaaattgaggcggcc

SEQ ID NO: 244793 - DNA, 20 bp, Artificial Sequence
  chemically synthesized
tgaaaaaattgaggcggcca

SEQ ID NO: 244794 - DNA, 20 bp, Artificial Sequence
  chemically synthesized
gaaaaaattgaggcggccaa

SEQ ID NO: 244795 - DNA, 20 bp, Artificial Sequence
  chemically synthesized
aattgaggcggccaagggtt

SEQ ID NO: 244796 - DNA, 20 bp, Artificial Sequence
  chemically synthesized
attgaggcggccaagggttt

SEQ ID NO: 244797 - DNA, 20 bp, Artificial Sequence
  chemically synthesized
tcataagctccccaaaccct

SEQ ID NO: 244798 - DNA, 20 bp, Artificial Sequence
  chemically synthesized
ttgaggcggccaagggtttg

SEQ ID NO: 244799 - DNA, 20 bp, Artificial Sequence
  chemically synthesized
gaggcggccaagggtttggg

SEQ ID NO: 244800 - DNA, 20 bp, Artificial Sequence
  chemically synthesized
atagggttaaagacagtcat

SEQ ID NO: 244801 - DNA, 20 bp, Artificial Sequence
  chemically synthesized
agtgtcgatagggttaaaga

SEQ ID NO: 244802 - DNA, 20 bp, Artificial Sequence
  chemically synthesized
tcttagtgtcgatagggtta

SEQ ID NO: 244803 - DNA, 20 bp, Artificial Sequence
  chemically synthesized
ctattctcttagtgtcgata

SEQ ID NO: 244804 - DNA, 20 bp, Artificial Sequence
  chemically synthesized
tctattctcttagtgtcgat

SEQ ID NO: 244805 - DNA, 20 bp, Artificial Sequence
  chemically synthesized
ttctattctcttagtgtcga

SEQ ID NO: 244806 - DNA, 20 bp, Artificial Sequence
  chemically synthesized
tctttaaccctatcgacact

SEQ ID NO: 244807 - DNA, 20 bp, Artificial Sequence
  chemically synthesized
tttaaccctatcgacactaa

SEQ ID NO: 244808 - DNA, 20 bp, Artificial Sequence
  chemically synthesized
ccctatcgacactaagagaa

SEQ ID NO: 244809 - DNA, 20 bp, Artificial Sequence
  chemically synthesized
gtaagcaacttctattctct

SEQ ID NO: 244810 - DNA, 20 bp, Artificial Sequence
  chemically synthesized
tatcgacactaagagaatag

SEQ ID NO: 244811 - DNA, 20 bp, Artificial Sequence
  chemically synthesized
aatagaagttgcttactaac

SEQ ID NO: 244812 - DNA, 20 bp, Artificial Sequence
  chemically synthesized
cagctaagtgaccagttagt

SEQ ID NO: 244813 - DNA, 20 bp, Artificial Sequence
  chemically synthesized
cagtcagctaagtgaccagt

SEQ ID NO: 244814 - DNA, 20 bp, Artificial Sequence
  chemically synthesized
ttgcttactaactggtcact

SEQ ID NO: 244815 - DNA, 20 bp, Artificial Sequence
  chemically synthesized
gtttcagtcagctaagtgac

SEQ ID NO: 244816 - DNA, 20 bp, Artificial Sequence
  chemically synthesized
agaagctgtttcagtcagct

SEQ ID NO: 244817 - DNA, 20 bp, Artificial Sequence
  chemically synthesized
ggtcacttagctgactgaaa

SEQ ID NO: 244818 - DNA, 20 bp, Artificial Sequence
  chemically synthesized
aagagagaagctgtttcagt

SEQ ID NO: 244819 - DNA, 20 bp, Artificial Sequence
  chemically synthesized
tacaaagagagaagctgttt

SEQ ID NO: 244820 - DNA, 20 bp, Artificial Sequence
  chemically synthesized
taaacttcctacaaagagag

SEQ ID NO: 244821 - DNA, 20 bp, Artificial Sequence
  chemically synthesized
tgaaacagcttctctctttg

SEQ ID NO: 244822 - DNA, 20 bp, Artificial Sequence
  chemically synthesized
gaaacagcttctctctttgt

SEQ ID NO: 244823 - DNA, 20 bp, Artificial Sequence
  chemically synthesized
acttaaacttcctacaaaga

SEQ ID NO: 244824 - DNA, 20 bp, Artificial Sequence
  chemically synthesized
gaacttaaacttcctacaaa

SEQ ID NO: 244825 - DNA, 20 bp, Artificial Sequence
  chemically synthesized
acagcttctctctttgtagg

SEQ ID NO: 244826 - DNA, 20 bp, Artificial Sequence
  chemically synthesized
tggaacttaaacttcctaca

SEQ ID NO: 244827 - DNA, 20 bp, Artificial Sequence
  chemically synthesized
tctctctttgtaggaagttt

SEQ ID NO: 244828 - DNA, 20 bp, Artificial Sequence
  chemically synthesized
tttttggcaccgagtaattg

SEQ ID NO: 244829 - DNA, 20 bp, Artificial Sequence
  chemically synthesized
gtttaagttccacaattact

SEQ ID NO: 244830 - DNA, 20 bp, Artificial Sequence
  chemically synthesized
acacagtattttttggcacc

SEQ ID NO: 244831 - DNA, 20 bp, Artificial Sequence
  chemically synthesized
gaatagcacacagtattttt

SEQ ID NO: 244832 - DNA, 20 bp, Artificial Sequence
  chemically synthesized
ccagaaatttgaatagcaca

SEQ ID NO: 244833 - DNA, 20 bp, Artificial Sequence
  chemically synthesized
tcatcctccagaaatttgaa

SEQ ID NO: 244834 - DNA, 20 bp, Artificial Sequence
  chemically synthesized
ctgtgtgctattcaaatttc

SEQ ID NO: 244835 - DNA, 20 bp, Artificial Sequence
  chemically synthesized
gtgtgctattcaaatttctg

SEQ ID NO: 244836 - DNA, 20 bp, Artificial Sequence
  chemically synthesized
tgtgctattcaaatttctgg

SEQ ID NO: 244837 - DNA, 20 bp, Artificial Sequence
  chemically synthesized
ctatgtagcttttcatcctc

SEQ ID NO: 244838 - DNA, 20 bp, Artificial Sequence
  chemically synthesized
tcaaatttctggaggatgaa

SEQ ID NO: 244839 - DNA, 20 bp, Artificial Sequence
  chemically synthesized
ctggaggatgaaaagctaca

SEQ ID NO: 244840 - DNA, 20 bp, Artificial Sequence
  chemically synthesized
tggaggatgaaaagctacat

SEQ ID NO: 244841 - DNA, 20 bp, Artificial Sequence
  chemically synthesized
ggaggatgaaaagctacata

SEQ ID NO: 244842 - DNA, 20 bp, Artificial Sequence
  chemically synthesized
gttctgccatatgccctatg

SEQ ID NO: 244843 - DNA, 20 bp, Artificial Sequence
  chemically synthesized
gaaaagctacatagggcata

SEQ ID NO: 244844 - DNA, 20 bp, Artificial Sequence
  chemically synthesized
aagctacatagggcatatgg

SEQ ID NO: 244845 - DNA, 20 bp, Artificial Sequence
  chemically synthesized
gcatatggcagaacgatgta

SEQ ID NO: 244846 - DNA, 20 bp, Artificial Sequence
  chemically synthesized
tggcagaacgatgtaaagtg

SEQ ID NO: 244847 - DNA, 20 bp, Artificial Sequence
  chemically synthesized
tgtaaagtgcagaatatgct

SEQ ID NO: 244848 - DNA, 20 bp, Artificial Sequence
  chemically synthesized
gtgcagaatatgcttagctg

SEQ ID NO: 244849 - DNA, 20 bp, Artificial Sequence
  chemically synthesized
ctttgggacaatcttcagct

SEQ ID NO: 244850 - DNA, 20 bp, Artificial Sequence
  chemically synthesized
aagagctttgggacaatctt

SEQ ID NO: 244851 - DNA, 20 bp, Artificial Sequence
  chemically synthesized
cttagctgaagattgtccca

SEQ ID NO: 244852 - DNA, 20 bp, Artificial Sequence
  chemically synthesized
aaacatctcccaagagcttt

SEQ ID NO: 244853 - DNA, 20 bp, Artificial Sequence
  chemically synthesized
gaagattgtcccaaagctct

SEQ ID NO: 244854 - DNA, 20 bp, Artificial Sequence
  chemically synthesized
taaacatctcccaagagctt

SEQ ID NO: 244855 - DNA, 20 bp, Artificial Sequence
  chemically synthesized
aagattgtcccaaagctctt

SEQ ID NO: 244856 - DNA, 20 bp, Artificial Sequence
  chemically synthesized
gattgtcccaaagctcttgg

SEQ ID NO: 244857 - DNA, 20 bp, Artificial Sequence
  chemically synthesized
accaaataaacatctcccaa

SEQ ID NO: 244858 - DNA, 20 bp, Artificial Sequence
  chemically synthesized
tcaccaaataaacatctccc

SEQ ID NO: 244859 - DNA, 20 bp, Artificial Sequence
  chemically synthesized
gctcttgggagatgtttatt

SEQ ID NO: 244860 - DNA, 20 bp, Artificial Sequence
  chemically synthesized
aacaaagggctgacaatata

SEQ ID NO: 244861 - DNA, 20 bp, Artificial Sequence
  chemically synthesized
tcgcattcactttatattgt

SEQ ID NO: 244862 - DNA, 20 bp, Artificial Sequence
  chemically synthesized
ttatattgtcagccctttgt

SEQ ID NO: 244863 - DNA, 20 bp, Artificial Sequence
  chemically synthesized
agtaaggatgatctaacaaa

SEQ ID NO: 244864 - DNA, 20 bp, Artificial Sequence
  chemically synthesized
gagtaaggatgatctaacaa

SEQ ID NO: 244865 - DNA, 20 bp, Artificial Sequence
  chemically synthesized
tgagtaaggatgatctaaca

SEQ ID NO: 244866 - DNA, 20 bp, Artificial Sequence
  chemically synthesized
gttagatcatccttactcat

SEQ ID NO: 244867 - DNA, 20 bp, Artificial Sequence
  chemically synthesized
ggatcagaccctgatgagta

SEQ ID NO: 244868 - DNA, 20 bp, Artificial Sequence
  chemically synthesized
ttagatcatccttactcatc

SEQ ID NO: 244869 - DNA, 20 bp, Artificial Sequence
  chemically synthesized
aggatcagaccctgatgagt

SEQ ID NO: 244870 - DNA, 20 bp, Artificial Sequence
  chemically synthesized
tagatcatccttactcatca

SEQ ID NO: 244871 - DNA, 20 bp, Artificial Sequence
  chemically synthesized
agcaaggatcagaccctgat

SEQ ID NO: 244872 - DNA, 20 bp, Artificial Sequence
  chemically synthesized
agtacaattaaagcaaggat

SEQ ID NO: 244873 - DNA, 20 bp, Artificial Sequence
  chemically synthesized
ccctaagtacaattaaagca

SEQ ID NO: 244874 - DNA, 20 bp, Artificial Sequence
  chemically synthesized
tccctaagtacaattaaagc

SEQ ID NO: 244875 - DNA, 20 bp, Artificial Sequence
  chemically synthesized
taattccctaagtacaatta

SEQ ID NO: 244876 - DNA, 20 bp, Artificial Sequence
  chemically synthesized
atccttgctttaattgtact

SEQ ID NO: 244877 - DNA, 20 bp, Artificial Sequence
  chemically synthesized
tccttgctttaattgtactt

SEQ ID NO: 244878 - DNA, 20 bp, Artificial Sequence
  chemically synthesized
ccttgctttaattgtactta

SEQ ID NO: 244879 - DNA, 20 bp, Artificial Sequence
  chemically synthesized
atagagataaataattccct

SEQ ID NO: 244880 - DNA, 20 bp, Artificial Sequence
  chemically synthesized
atcaattttagattgatata

SEQ ID NO: 244881 - DNA, 20 bp, Artificial Sequence
  chemically synthesized
aaatcaattttagattgata

SEQ ID NO: 244882 - DNA, 20 bp, Artificial Sequence
  chemically synthesized
aaaaaagattaaatcaattt

SEQ ID NO: 244883 - DNA, 20 bp, Artificial Sequence
  chemically synthesized
catctcaaaaaaaaaaaaaa

SEQ ID NO: 244884 - DNA, 20 bp, Artificial Sequence
  chemically synthesized
aatctttttttttttttttt

SEQ ID NO: 244885 - DNA, 20 bp, Artificial Sequence
  chemically synthesized
ttttttttttttttgagatg

SEQ ID NO: 244886 - DNA, 20 bp, Artificial Sequence
  chemically synthesized
tccagcctgggtgacagagc

SEQ ID NO: 244887 - DNA, 20 bp, Artificial Sequence
  chemically synthesized
tgtagtctcgctctgtcacc

SEQ ID NO: 244888 - DNA, 20 bp, Artificial Sequence
  chemically synthesized
gcactccagcctgggtgaca

SEQ ID NO: 244889 - DNA, 20 bp, Artificial Sequence
  chemically synthesized
gtagtctcgctctgtcaccc

SEQ ID NO: 244890 - DNA, 20 bp, Artificial Sequence
  chemically synthesized
ctgcactccagcctgggtga

SEQ ID NO: 244891 - DNA, 20 bp, Artificial Sequence
  chemically synthesized
tctcgctctgtcacccaggc

SEQ ID NO: 244892 - DNA, 20 bp, Artificial Sequence
  chemically synthesized
tcgctctgtcacccaggctg

SEQ ID NO: 244893 - DNA, 20 bp, Artificial Sequence
  chemically synthesized
acgccactgcactccagcct

SEQ ID NO: 244894 - DNA, 20 bp, Artificial Sequence
  chemically synthesized
cacgccactgcactccagcc

SEQ ID NO: 244895 - DNA, 20 bp, Artificial Sequence
  chemically synthesized
ctgtcacccaggctggagtg

SEQ ID NO: 244896 - DNA, 20 bp, Artificial Sequence
  chemically synthesized
aagatcacgccactgcactc

SEQ ID NO: 244897 - DNA, 20 bp, Artificial Sequence
  chemically synthesized
tcacccaggctggagtgcag

SEQ ID NO: 244898 - DNA, 20 bp, Artificial Sequence
  chemically synthesized
ggagtgcagtggcgtgatct

SEQ ID NO: 244899 - DNA, 20 bp, Artificial Sequence
  chemically synthesized
ggcggaggttgcagtgagcc

SEQ ID NO: 244900 - DNA, 20 bp, Artificial Sequence
  chemically synthesized
cagcaggcggaggttgcagt

SEQ ID NO: 244901 - DNA, 20 bp, Artificial Sequence
  chemically synthesized
aacccagcaggcggaggttg

SEQ ID NO: 244902 - DNA, 20 bp, Artificial Sequence
  chemically synthesized
ctcctgaacccagcaggcgg

SEQ ID NO: 244903 - DNA, 20 bp, Artificial Sequence
  chemically synthesized
tcactgcaacctccgcctgc

SEQ ID NO: 244904 - DNA, 20 bp, Artificial Sequence
  chemically synthesized
tctcctgaacccagcaggcg

SEQ ID NO: 244905 - DNA, 20 bp, Artificial Sequence
  chemically synthesized
cactgcaacctccgcctgct

SEQ ID NO: 244906 - DNA, 20 bp, Artificial Sequence
  chemically synthesized
aatctcctgaacccagcagg

SEQ ID NO: 244907 - DNA, 20 bp, Artificial Sequence
  chemically synthesized
aagaatctcctgaacccagc

SEQ ID NO: 244908 - DNA, 20 bp, Artificial Sequence
  chemically synthesized
caacctccgcctgctgggtt

SEQ ID NO: 244909 - DNA, 20 bp, Artificial Sequence
  chemically synthesized
gaagaatctcctgaacccag

SEQ ID NO: 244910 - DNA, 20 bp, Artificial Sequence
  chemically synthesized
aacctccgcctgctgggttc

SEQ ID NO: 244911 - DNA, 20 bp, Artificial Sequence
  chemically synthesized
cctccgcctgctgggttcag

SEQ ID NO: 244912 - DNA, 20 bp, Artificial Sequence
  chemically synthesized
gcagaagaatctcctgaacc

SEQ ID NO: 244913 - DNA, 20 bp, Artificial Sequence
  chemically synthesized
ttcaggagattcttctgcct

SEQ ID NO: 244914 - DNA, 20 bp, Artificial Sequence
  chemically synthesized
tacttgggaggctgaggcag

SEQ ID NO: 244915 - DNA, 20 bp, Artificial Sequence
  chemically synthesized
agctacttgggaggctgagg

SEQ ID NO: 244916 - DNA, 20 bp, Artificial Sequence
  chemically synthesized
cccagctacttgggaggctg

SEQ ID NO: 244917 - DNA, 20 bp, Artificial Sequence
  chemically synthesized
tcccagctacttgggaggct

SEQ ID NO: 244918 - DNA, 20 bp, Artificial Sequence
  chemically synthesized
ttcttctgcctcagcctccc

SEQ ID NO: 244919 - DNA, 20 bp, Artificial Sequence
  chemically synthesized
ttctgcctcagcctcccaag

SEQ ID NO: 244920 - DNA, 20 bp, Artificial Sequence
  chemically synthesized
tatagtcccagctacttggg

SEQ ID NO: 244921 - DNA, 20 bp, Artificial Sequence
  chemically synthesized
ctatagtcccagctacttgg

SEQ ID NO: 244922 - DNA, 20 bp, Artificial Sequence
  chemically synthesized
gcctcagcctcccaagtagc

SEQ ID NO: 244923 - DNA, 20 bp, Artificial Sequence
  chemically synthesized
gcctatagtcccagctactt

SEQ ID NO: 244924 - DNA, 20 bp, Artificial Sequence
  chemically synthesized
cctcagcctcccaagtagct

SEQ ID NO: 244925 - DNA, 20 bp, Artificial Sequence
  chemically synthesized
cgcctatagtcccagctact

SEQ ID NO: 244926 - DNA, 20 bp, Artificial Sequence
  chemically synthesized
ctcccaagtagctgggacta

SEQ ID NO: 244927 - DNA, 20 bp, Artificial Sequence
  chemically synthesized
tcccaagtagctgggactat

SEQ ID NO: 244928 - DNA, 20 bp, Artificial Sequence
  chemically synthesized
gtggtgcacgcctatagtcc

SEQ ID NO: 244929 - DNA, 20 bp, Artificial Sequence
  chemically synthesized
ggcttggtggtgcacgccta

SEQ ID NO: 244930 - DNA, 20 bp, Artificial Sequence
  chemically synthesized
gactataggcgtgcaccacc

SEQ ID NO: 244931 - DNA, 20 bp, Artificial Sequence
  chemically synthesized
taggcgtgcaccaccaagcc

SEQ ID NO: 244932 - DNA, 20 bp, Artificial Sequence
  chemically synthesized
caaaaattagccgggcttgg

SEQ ID NO: 244933 - DNA, 20 bp, Artificial Sequence
  chemically synthesized
atacaaaaattagccgggct

SEQ ID NO: 244934 - DNA, 20 bp, Artificial Sequence
  chemically synthesized
taaaaatacaaaaattagcc

SEQ ID NO: 244935 - DNA, 20 bp, Artificial Sequence
  chemically synthesized
ctaaaaatacaaaaattagc

SEQ ID NO: 244936 - DNA, 20 bp, Artificial Sequence
  chemically synthesized
tctactaaaaatacaaaaat

SEQ ID NO: 244937 - DNA, 20 bp, Artificial Sequence
  chemically synthesized
ccggctaatttttgtatttt

SEQ ID NO: 244938 - DNA, 20 bp, Artificial Sequence
  chemically synthesized
gctaatttttgtatttttag

SEQ ID NO: 244939 - DNA, 20 bp, Artificial Sequence
  chemically synthesized
taatttttgtatttttagta

SEQ ID NO: 244940 - DNA, 20 bp, Artificial Sequence
  chemically synthesized
ttttgtatttttagtagaga

SEQ ID NO: 244941 - DNA, 20 bp, Artificial Sequence
  chemically synthesized
tttgtatttttagtagagac

SEQ ID NO: 244942 - DNA, 20 bp, Artificial Sequence
  chemically synthesized
ttgtatttttagtagagaca

SEQ ID NO: 244943 - DNA, 20 bp, Artificial Sequence
  chemically synthesized
gagacagggtttcaccatat

SEQ ID NO: 244944 - DNA, 20 bp, Artificial Sequence
  chemically synthesized
cagggtttcaccatattggc

SEQ ID NO: 244945 - DNA, 20 bp, Artificial Sequence
  chemically synthesized
cgaaaacagcctagccaata

SEQ ID NO: 244946 - DNA, 20 bp, Artificial Sequence
  chemically synthesized
agggtttcaccatattggct

SEQ ID NO: 244947 - DNA, 20 bp, Artificial Sequence
  chemically synthesized
tcaggagttcgaaaacagcc

SEQ ID NO: 244948 - DNA, 20 bp, Artificial Sequence
  chemically synthesized
tgaggtcaggagttcgaaaa

SEQ ID NO: 244949 - DNA, 20 bp, Artificial Sequence
  chemically synthesized
cgggcagattatgaggtcag

SEQ ID NO: 244950 - DNA, 20 bp, Artificial Sequence
  chemically synthesized
gacgggcagattatgaggtc

SEQ ID NO: 244951 - DNA, 20 bp, Artificial Sequence
  chemically synthesized
agacgggcagattatgaggt

SEQ ID NO: 244952 - DNA, 20 bp, Artificial Sequence
  chemically synthesized
gctgagacgggcagattatg

SEQ ID NO: 244953 - DNA, 20 bp, Artificial Sequence
  chemically synthesized
ggctgagacgggcagattat

SEQ ID NO: 244954 - DNA, 20 bp, Artificial Sequence
  chemically synthesized
acctcataatctgcccgtct

SEQ ID NO: 244955 - DNA, 20 bp, Artificial Sequence
  chemically synthesized
ctttgggaggctgagacggg

SEQ ID NO: 244956 - DNA, 20 bp, Artificial Sequence
  chemically synthesized
gcactttgggaggctgagac

SEQ ID NO: 244957 - DNA, 20 bp, Artificial Sequence
  chemically synthesized
agcactttgggaggctgaga

SEQ ID NO: 244958 - DNA, 20 bp, Artificial Sequence
  chemically synthesized
tcgcagcactttgggaggct

SEQ ID NO: 244959 - DNA, 20 bp, Artificial Sequence
  chemically synthesized
ctgcccgtctcagcctccca

SEQ ID NO: 244960 - DNA, 20 bp, Artificial Sequence
  chemically synthesized
tgtaatcgcagcactttggg

SEQ ID NO: 244961 - DNA, 20 bp, Artificial Sequence
  chemically synthesized
ctgtaatcgcagcactttgg

SEQ ID NO: 244962 - DNA, 20 bp, Artificial Sequence
  chemically synthesized
gcctgtaatcgcagcacttt

SEQ ID NO: 244963 - DNA, 20 bp, Artificial Sequence
  chemically synthesized
cgcctgtaatcgcagcactt

SEQ ID NO: 244964 - DNA, 20 bp, Artificial Sequence
  chemically synthesized
ctcccaaagtgctgcgatta

SEQ ID NO: 244965 - DNA, 20 bp, Artificial Sequence
  chemically synthesized
tcccaaagtgctgcgattac

SEQ ID NO: 244966 - DNA, 20 bp, Artificial Sequence
  chemically synthesized
gtggctcacgcctgtaatcg

SEQ ID NO: 244967 - DNA, 20 bp, Artificial Sequence
  chemically synthesized
agtgctgcgattacaggcgt

SEQ ID NO: 244968 - DNA, 20 bp, Artificial Sequence
  chemically synthesized
caggcgtgagccaccacgcc

SEQ ID NO: 244969 - DNA, 20 bp, Artificial Sequence
  chemically synthesized
aatcaattgaccaggcgtgg

SEQ ID NO: 244970 - DNA, 20 bp, Artificial Sequence
  chemically synthesized
caaaatcaattgaccaggcg

SEQ ID NO: 244971 - DNA, 20 bp, Artificial Sequence
  chemically synthesized
taagacaaaatcaattgacc

SEQ ID NO: 244972 - DNA, 20 bp, Artificial Sequence
  chemically synthesized
gtaagacaaaatcaattgac

SEQ ID NO: 244973 - DNA, 20 bp, Artificial Sequence
  chemically synthesized
cccagaagagaaaattgtgt

SEQ ID NO: 244974 - DNA, 20 bp, Artificial Sequence
  chemically synthesized
tcttacacaattttctcttc

SEQ ID NO: 244975 - DNA, 20 bp, Artificial Sequence
  chemically synthesized
cttacacaattttctcttct

SEQ ID NO: 244976 - DNA, 20 bp, Artificial Sequence
  chemically synthesized
aacgatagtgatgcccagaa

SEQ ID NO: 244977 - DNA, 20 bp, Artificial Sequence
  chemically synthesized
tgaacgatagtgatgcccag

SEQ ID NO: 244978 - DNA, 20 bp, Artificial Sequence
  chemically synthesized
ggatgaacgatagtgatgcc

SEQ ID NO: 244979 - DNA, 20 bp, Artificial Sequence
  chemically synthesized
aagaagatgaggatgaacga

SEQ ID NO: 244980 - DNA, 20 bp, Artificial Sequence
  chemically synthesized
catagaggaaaaagaagatg

SEQ ID NO: 244981 - DNA, 20 bp, Artificial Sequence
  chemically synthesized
acatagaggaaaaagaagat

SEQ ID NO: 244982 - DNA, 20 bp, Artificial Sequence
  chemically synthesized
tttaaacatagaggaaaaag

SEQ ID NO: 244983 - DNA, 20 bp, Artificial Sequence
  chemically synthesized
atttttaaacatagaggaaa

SEQ ID NO: 244984 - DNA, 20 bp, Artificial Sequence
  chemically synthesized
gttttcatttttaaacatag

SEQ ID NO: 244985 - DNA, 20 bp, Artificial Sequence
  chemically synthesized
agttttcatttttaaacata

SEQ ID NO: 244986 - DNA, 20 bp, Artificial Sequence
  chemically synthesized
agagttttcatttttaaaca

SEQ ID NO: 244987 - DNA, 20 bp, Artificial Sequence
  chemically synthesized
taataaactcttttgcagaa

SEQ ID NO: 244988 - DNA, 20 bp, Artificial Sequence
  chemically synthesized
aaatgaaaactcttctgcaa

SEQ ID NO: 244989 - DNA, 20 bp, Artificial Sequence
  chemically synthesized
tttaataaactcttttgcag

SEQ ID NO: 244990 - DNA, 20 bp, Artificial Sequence
  chemically synthesized
atgaaaactcttctgcaaaa

SEQ ID NO: 244991 - DNA, 20 bp, Artificial Sequence
  chemically synthesized
agctttaataaactcttttg

SEQ ID NO: 244992 - DNA, 20 bp, Artificial Sequence
  chemically synthesized
ttctgcaaaagagtttatta

SEQ ID NO: 244993 - DNA, 20 bp, Artificial Sequence
  chemically synthesized
aaaacaaacaaagaataaat

SEQ ID NO: 244994 - DNA, 20 bp, Artificial Sequence
  chemically synthesized
ctctgtctcaaaaacaaaca

SEQ ID NO: 244995 - DNA, 20 bp, Artificial Sequence
  chemically synthesized
tttattctttgtttgttttt

SEQ ID NO: 244996 - DNA, 20 bp, Artificial Sequence
  chemically synthesized
ttctttgtttgtttttgaga

SEQ ID NO: 244997 - DNA, 20 bp, Artificial Sequence
  chemically synthesized
ctttgtttgtttttgagaca

SEQ ID NO: 244998 - DNA, 20 bp, Artificial Sequence
  chemically synthesized
tccagcctgggcaacagagc

SEQ ID NO: 244999 - DNA, 20 bp, Artificial Sequence
  chemically synthesized
cagagtcttgctctgttgcc

SEQ ID NO: 245000 - DNA, 20 bp, Artificial Sequence
  chemically synthesized
gccctccagcctgggcaaca

SEQ ID NO: 245001 - DNA, 20 bp, Artificial Sequence
  chemically synthesized
agagtcttgctctgttgccc

SEQ ID NO: 245002 - DNA, 20 bp, Artificial Sequence
  chemically synthesized
ctgccctccagcctgggcaa

SEQ ID NO: 245003 - DNA, 20 bp, Artificial Sequence
  chemically synthesized
tcttgctctgttgcccaggc

SEQ ID NO: 245004 - DNA, 20 bp, Artificial Sequence
  chemically synthesized
ttgctctgttgcccaggctg

SEQ ID NO: 245005 - DNA, 20 bp, Artificial Sequence
  chemically synthesized
tgctctgttgcccaggctgg

SEQ ID NO: 245006 - DNA, 20 bp, Artificial Sequence
  chemically synthesized
atgccactgccctccagcct

SEQ ID NO: 245007 - DNA, 20 bp, Artificial Sequence
  chemically synthesized
gctctgttgcccaggctgga

SEQ ID NO: 245008 - DNA, 20 bp, Artificial Sequence
  chemically synthesized
catgccactgccctccagcc

SEQ ID NO: 245009 - DNA, 20 bp, Artificial Sequence
  chemically synthesized
ctgttgcccaggctggaggg

SEQ ID NO: 245010 - DNA, 20 bp, Artificial Sequence
  chemically synthesized
aagatcatgccactgccctc

SEQ ID NO: 245011 - DNA, 20 bp, Artificial Sequence
  chemically synthesized
ttgcccaggctggagggcag

SEQ ID NO: 245012 - DNA, 20 bp, Artificial Sequence
  chemically synthesized
ggagggcagtggcatgatct

SEQ ID NO: 245013 - DNA, 20 bp, Artificial Sequence
  chemically synthesized
ggcggaggttgcagtgagct

SEQ ID NO: 245014 - DNA, 20 bp, Artificial Sequence
  chemically synthesized
caggaggcggaggttgcagt

SEQ ID NO: 245015 - DNA, 20 bp, Artificial Sequence
  chemically synthesized
aacccaggaggcggaggttg

SEQ ID NO: 245016 - DNA, 20 bp, Artificial Sequence
  chemically synthesized
cactggaacccaggaggcgg

SEQ ID NO: 245017 - DNA, 20 bp, Artificial Sequence
  chemically synthesized
tcactgcaacctccgcctcc

SEQ ID NO: 245018 - DNA, 20 bp, Artificial Sequence
  chemically synthesized
tcactggaacccaggaggcg

SEQ ID NO: 245019 - DNA, 20 bp, Artificial Sequence
  chemically synthesized
cactgcaacctccgcctcct

SEQ ID NO: 245020 - DNA, 20 bp, Artificial Sequence
  chemically synthesized
aatcactggaacccaggagg

SEQ ID NO: 245021 - DNA, 20 bp, Artificial Sequence
  chemically synthesized
gagaatcactggaacccagg

SEQ ID NO: 245022 - DNA, 20 bp, Artificial Sequence
  chemically synthesized
ggagaatcactggaacccag

SEQ ID NO: 245023 - DNA, 20 bp, Artificial Sequence
  chemically synthesized
aacctccgcctcctgggttc

SEQ ID NO: 245024 - DNA, 20 bp, Artificial Sequence
  chemically synthesized
caggagaatcactggaaccc

SEQ ID NO: 245025 - DNA, 20 bp, Artificial Sequence
  chemically synthesized
gcaggagaatcactggaacc

SEQ ID NO: 245026 - DNA, 20 bp, Artificial Sequence
  chemically synthesized
ggctgaggcaggagaatcac

SEQ ID NO: 245027 - DNA, 20 bp, Artificial Sequence
  chemically synthesized
ttccagtgattctcctgcct

SEQ ID NO: 245028 - DNA, 20 bp, Artificial Sequence
  chemically synthesized
tacttgggaggctgaggcag

SEQ ID NO: 245029 - DNA, 20 bp, Artificial Sequence
  chemically synthesized
gctacttgggaggctgaggc

SEQ ID NO: 245030 - DNA, 20 bp, Artificial Sequence
  chemically synthesized
agctacttgggaggctgagg

SEQ ID NO: 245031 - DNA, 20 bp, Artificial Sequence
  chemically synthesized
cccagctacttgggaggctg

SEQ ID NO: 245032 - DNA, 20 bp, Artificial Sequence
  chemically synthesized
tcccagctacttgggaggct

SEQ ID NO: 245033 - DNA, 20 bp, Artificial Sequence
  chemically synthesized
ttctcctgcctcagcctccc

SEQ ID NO: 245034 - DNA, 20 bp, Artificial Sequence
  chemically synthesized
tcctgcctcagcctcccaag

SEQ ID NO: 245035 - DNA, 20 bp, Artificial Sequence
  chemically synthesized
tgtaatcccagctacttggg

SEQ ID NO: 245036 - DNA, 20 bp, Artificial Sequence
  chemically synthesized
ttgtaatcccagctacttgg

SEQ ID NO: 245037 - DNA, 20 bp, Artificial Sequence
  chemically synthesized
gcctcagcctcccaagtagc

SEQ ID NO: 245038 - DNA, 20 bp, Artificial Sequence
  chemically synthesized
gcttgtaatcccagctactt

SEQ ID NO: 245039 - DNA, 20 bp, Artificial Sequence
  chemically synthesized
cctcagcctcccaagtagct

SEQ ID NO: 245040 - DNA, 20 bp, Artificial Sequence
  chemically synthesized
tgcttgtaatcccagctact

SEQ ID NO: 245041 - DNA, 20 bp, Artificial Sequence
  chemically synthesized
tcccaagtagctgggattac

SEQ ID NO: 245042 - DNA, 20 bp, Artificial Sequence
  chemically synthesized
ttggcgcatgcttgtaatcc

SEQ ID NO: 245043 - DNA, 20 bp, Artificial Sequence
  chemically synthesized
caagcatgcgccaacacgcc

SEQ ID NO: 245044 - DNA, 20 bp, Artificial Sequence
  chemically synthesized
caaaaattggccaggcgtgt

SEQ ID NO: 245045 - DNA, 20 bp, Artificial Sequence
  chemically synthesized
taaaaatacaaaaattggcc

SEQ ID NO: 245046 - DNA, 20 bp, Artificial Sequence
  chemically synthesized
ctaaaaatacaaaaattggc

SEQ ID NO: 245047 - DNA, 20 bp, Artificial Sequence
  chemically synthesized
tctgctaaaaatacaaaaat

SEQ ID NO: 245048 - DNA, 20 bp, Artificial Sequence
  chemically synthesized
ctggccaatttttgtatttt

SEQ ID NO: 245049 - DNA, 20 bp, Artificial Sequence
  chemically synthesized
gccaatttttgtatttttag

SEQ ID NO: 245050 - DNA, 20 bp, Artificial Sequence
  chemically synthesized
caatttttgtatttttagca

SEQ ID NO: 245051 - DNA, 20 bp, Artificial Sequence
  chemically synthesized
ttttgtatttttagcagaga

SEQ ID NO: 245052 - DNA, 20 bp, Artificial Sequence
  chemically synthesized
tttgtatttttagcagagat

SEQ ID NO: 245053 - DNA, 20 bp, Artificial Sequence
  chemically synthesized
ttgtatttttagcagagatg

SEQ ID NO: 245054 - DNA, 20 bp, Artificial Sequence
  chemically synthesized
gagatggggtttcaccatgt

SEQ ID NO: 245055 - DNA, 20 bp, Artificial Sequence
  chemically synthesized
tggggtttcaccatgttggc

SEQ ID NO: 245056 - DNA, 20 bp, Artificial Sequence
  chemically synthesized
agagtccagcccagccaaca

SEQ ID NO: 245057 - DNA, 20 bp, Artificial Sequence
  chemically synthesized
ggggtttcaccatgttggct

SEQ ID NO: 245058 - DNA, 20 bp, Artificial Sequence
  chemically synthesized
tttcaccatgttggctgggc

SEQ ID NO: 245059 - DNA, 20 bp, Artificial Sequence
  chemically synthesized
ccaggagttagagtccagcc

SEQ ID NO: 245060 - DNA, 20 bp, Artificial Sequence
  chemically synthesized
tgaggccaggagttagagtc

SEQ ID NO: 245061 - DNA, 20 bp, Artificial Sequence
  chemically synthesized
ctgggctggactctaactcc

SEQ ID NO: 245062 - DNA, 20 bp, Artificial Sequence
  chemically synthesized
tcacttgaggccaggagtta

SEQ ID NO: 245063 - DNA, 20 bp, Artificial Sequence
  chemically synthesized
gatcacttgaggccaggagt

SEQ ID NO: 245064 - DNA, 20 bp, Artificial Sequence
  chemically synthesized
ggcagatcacttgaggccag

SEQ ID NO: 245065 - DNA, 20 bp, Artificial Sequence
  chemically synthesized
ggactctaactcctggcctc

SEQ ID NO: 245066 - DNA, 20 bp, Artificial Sequence
  chemically synthesized
tgggcagatcacttgaggcc

SEQ ID NO: 245067 - DNA, 20 bp, Artificial Sequence
  chemically synthesized
gtgggcagatcacttgaggc

SEQ ID NO: 245068 - DNA, 20 bp, Artificial Sequence
  chemically synthesized
cgaggtgggcagatcacttg

SEQ ID NO: 245069 - DNA, 20 bp, Artificial Sequence
  chemically synthesized
ccgaggtgggcagatcactt

SEQ ID NO: 245070 - DNA, 20 bp, Artificial Sequence
  chemically synthesized
ctcaagtgatctgcccacct

SEQ ID NO: 245071 - DNA, 20 bp, Artificial Sequence
  chemically synthesized
atttgagaggccgaggtggg

SEQ ID NO: 245072 - DNA, 20 bp, Artificial Sequence
  chemically synthesized
gcaatttgagaggccgaggt

SEQ ID NO: 245073 - DNA, 20 bp, Artificial Sequence
  chemically synthesized
agcaatttgagaggccgagg

SEQ ID NO: 245074 - DNA, 20 bp, Artificial Sequence
  chemically synthesized
cccagcaatttgagaggccg

SEQ ID NO: 245075 - DNA, 20 bp, Artificial Sequence
  chemically synthesized
tcccagcaatttgagaggcc

SEQ ID NO: 245076 - DNA, 20 bp, Artificial Sequence
  chemically synthesized
tgtaatcccagcaatttgag

SEQ ID NO: 245077 - DNA, 20 bp, Artificial Sequence
  chemically synthesized
ctgtaatcccagcaatttga

SEQ ID NO: 245078 - DNA, 20 bp, Artificial Sequence
  chemically synthesized
acctcggcctctcaaattgc

SEQ ID NO: 245079 - DNA, 20 bp, Artificial Sequence
  chemically synthesized
gcctgtaatcccagcaattt

SEQ ID NO: 245080 - DNA, 20 bp, Artificial Sequence
  chemically synthesized
cctcggcctctcaaattgct

SEQ ID NO: 245081 - DNA, 20 bp, Artificial Sequence
  chemically synthesized
ctctcaaattgctgggatta

SEQ ID NO: 245082 - DNA, 20 bp, Artificial Sequence
  chemically synthesized
tctcaaattgctgggattac

SEQ ID NO: 245083 - DNA, 20 bp, Artificial Sequence
  chemically synthesized
gtggctctcgcctgtaatcc

SEQ ID NO: 245084 - DNA, 20 bp, Artificial Sequence
  chemically synthesized
aaattgctgggattacaggc

SEQ ID NO: 245085 - DNA, 20 bp, Artificial Sequence
  chemically synthesized
attgctgggattacaggcga

SEQ ID NO: 245086 - DNA, 20 bp, Artificial Sequence
  chemically synthesized
caggcgagagccaccacacc

SEQ ID NO: 245087 - DNA, 20 bp, Artificial Sequence
  chemically synthesized
aaagaataggccaggtgtgg

SEQ ID NO: 245088 - DNA, 20 bp, Artificial Sequence
  chemically synthesized
aaaaaagaataggccaggtg

SEQ ID NO: 245089 - DNA, 20 bp, Artificial Sequence
  chemically synthesized
aaaacaaaaaagaataggcc

SEQ ID NO: 245090 - DNA, 20 bp, Artificial Sequence
  chemically synthesized
taaaacaaaaaagaataggc

SEQ ID NO: 245091 - DNA, 20 bp, Artificial Sequence
  chemically synthesized
tatataaaacaaaaaagaat

SEQ ID NO: 245092 - DNA, 20 bp, Artificial Sequence
  chemically synthesized
ttatataaaacaaaaaagaa

SEQ ID NO: 245093 - DNA, 20 bp, Artificial Sequence
  chemically synthesized
acttcttatataaaacaaaa

SEQ ID NO: 245094 - DNA, 20 bp, Artificial Sequence
  chemically synthesized
tattcttttttgttttatat

SEQ ID NO: 245095 - DNA, 20 bp, Artificial Sequence
  chemically synthesized
tcttttttgttttatataag

SEQ ID NO: 245096 - DNA, 20 bp, Artificial Sequence
  chemically synthesized
tttgttttatataagaagtg

SEQ ID NO: 245097 - DNA, 20 bp, Artificial Sequence
  chemically synthesized
gtgtagcatataataatgtg

SEQ ID NO: 245098 - DNA, 20 bp, Artificial Sequence
  chemically synthesized
tagcatataataatgtgtgg

SEQ ID NO: 245099 - DNA, 20 bp, Artificial Sequence
  chemically synthesized
tataataatgtgtggtggtg

SEQ ID NO: 245100 - DNA, 20 bp, Artificial Sequence
  chemically synthesized
aataatgtgtggtggtgtgg

SEQ ID NO: 245101 - DNA, 20 bp, Artificial Sequence
  chemically synthesized
taatgtgtggtggtgtggta

SEQ ID NO: 245102 - DNA, 20 bp, Artificial Sequence
  chemically synthesized
tgtggtggtgtggtagagat

SEQ ID NO: 245103 - DNA, 20 bp, Artificial Sequence
  chemically synthesized
ggtggtgtggtagagataag

SEQ ID NO: 245104 - DNA, 20 bp, Artificial Sequence
  chemically synthesized
ggtgtggtagagataagaag

SEQ ID NO: 245105 - DNA, 20 bp, Artificial Sequence
  chemically synthesized
gataagaagtggtttttgaa

SEQ ID NO: 245106 - DNA, 20 bp, Artificial Sequence
  chemically synthesized
ataagaagtggtttttgaaa

SEQ ID NO: 245107 - DNA, 20 bp, Artificial Sequence
  chemically synthesized
catatacattattcacttgc

SEQ ID NO: 245108 - DNA, 20 bp, Artificial Sequence
  chemically synthesized
acccagtaagcataactagc

SEQ ID NO: 245109 - DNA, 20 bp, Artificial Sequence
  chemically synthesized
agatacccagtaagcataac

SEQ ID NO: 245110 - DNA, 20 bp, Artificial Sequence
  chemically synthesized
cacttgctagttatgcttac

SEQ ID NO: 245111 - DNA, 20 bp, Artificial Sequence
  chemically synthesized
acttgctagttatgcttact

SEQ ID NO: 245112 - DNA, 20 bp, Artificial Sequence
  chemically synthesized
tggccaagtagatacccagt

SEQ ID NO: 245113 - DNA, 20 bp, Artificial Sequence
  chemically synthesized
tgtttggccaagtagatacc

SEQ ID NO: 245114 - DNA, 20 bp, Artificial Sequence
  chemically synthesized
atgcttactgggtatctact

SEQ ID NO: 245115 - DNA, 20 bp, Artificial Sequence
  chemically synthesized
tgattcattgtttggccaag

SEQ ID NO: 245116 - DNA, 20 bp, Artificial Sequence
  chemically synthesized
acttgattcattgtttggcc

SEQ ID NO: 245117 - DNA, 20 bp, Artificial Sequence
  chemically synthesized
tcgttacttgattcattgtt

SEQ ID NO: 245118 - DNA, 20 bp, Artificial Sequence
  chemically synthesized
acttggccaaacaatgaatc

SEQ ID NO: 245119 - DNA, 20 bp, Artificial Sequence
  chemically synthesized
tgtgaacttctttagaatga

SEQ ID NO: 245120 - DNA, 20 bp, Artificial Sequence
  chemically synthesized
aaaatgtaactgtcattcta

SEQ ID NO: 245121 - DNA, 20 bp, Artificial Sequence
  chemically synthesized
atgtaactgtcattctaaag

SEQ ID NO: 245122 - DNA, 20 bp, Artificial Sequence
  chemically synthesized
atacacactgtgaacttctt

SEQ ID NO: 245123 - DNA, 20 bp, Artificial Sequence
  chemically synthesized
tgtcattctaaagaagttca

SEQ ID NO: 245124 - DNA, 20 bp, Artificial Sequence
  chemically synthesized
gtatgttgtttgtacatgta

SEQ ID NO: 245125 - DNA, 20 bp, Artificial Sequence
  chemically synthesized
atgttgtttgtacatgtaca

SEQ ID NO: 245126 - DNA, 20 bp, Artificial Sequence
  chemically synthesized
tttgtacatgtacagagtca

SEQ ID NO: 245127 - DNA, 20 bp, Artificial Sequence
  chemically synthesized
tgtacatgtacagagtcata

SEQ ID NO: 245128 - DNA, 20 bp, Artificial Sequence
  chemically synthesized
gtacatgtacagagtcatag

SEQ ID NO: 245129 - DNA, 20 bp, Artificial Sequence
  chemically synthesized
atgtacagagtcatagaggt

SEQ ID NO: 245130 - DNA, 20 bp, Artificial Sequence
  chemically synthesized
gtacagagtcatagaggtga

SEQ ID NO: 245131 - DNA, 20 bp, Artificial Sequence
  chemically synthesized
acagagtcatagaggtgaga

SEQ ID NO: 245132 - DNA, 20 bp, Artificial Sequence
  chemically synthesized
agtcatagaggtgagagaga

SEQ ID NO: 245133 - DNA, 20 bp, Artificial Sequence
  chemically synthesized
tcatagaggtgagagagatg

SEQ ID NO: 245134 - DNA, 20 bp, Artificial Sequence
  chemically synthesized
gaggtgagagagatggagaa

SEQ ID NO: 245135 - DNA, 20 bp, Artificial Sequence
  chemically synthesized
atggagaaaagtgatttaat

SEQ ID NO: 245136 - DNA, 20 bp, Artificial Sequence
  chemically synthesized
agaaaagtgatttaataagt

SEQ ID NO: 245137 - DNA, 20 bp, Artificial Sequence
  chemically synthesized
ataacatgattcataatgtg

SEQ ID NO: 245138 - DNA, 20 bp, Artificial Sequence
  chemically synthesized
taacatgattcataatgtga

SEQ ID NO: 245139 - DNA, 20 bp, Artificial Sequence
  chemically synthesized
aacatgattcataatgtgaa

SEQ ID NO: 245140 - DNA, 20 bp, Artificial Sequence
  chemically synthesized
aagggtgtttatatccacaa

SEQ ID NO: 245141 - DNA, 20 bp, Artificial Sequence
  chemically synthesized
accaatttccatttccattg

SEQ ID NO: 245142 - DNA, 20 bp, Artificial Sequence
  chemically synthesized
gtttatatccacaatggaaa

SEQ ID NO: 245143 - DNA, 20 bp, Artificial Sequence
  chemically synthesized
tccacaatggaaatggaaat

SEQ ID NO: 245144 - DNA, 20 bp, Artificial Sequence
  chemically synthesized
caatggaaatggaaattggt

SEQ ID NO: 245145 - DNA, 20 bp, Artificial Sequence
  chemically synthesized
gggtaacatctaataaaaat

SEQ ID NO: 245146 - DNA, 20 bp, Artificial Sequence
  chemically synthesized
tggtgagtaccaatttttat

SEQ ID NO: 245147 - DNA, 20 bp, Artificial Sequence
  chemically synthesized
attgcatgtaatgcaatggt

SEQ ID NO: 245148 - DNA, 20 bp, Artificial Sequence
  chemically synthesized
aattgcatgtaatgcaatgg

SEQ ID NO: 245149 - DNA, 20 bp, Artificial Sequence
  chemically synthesized
aacaattgcatgtaatgcaa

SEQ ID NO: 245150 - DNA, 20 bp, Artificial Sequence
  chemically synthesized
tgcagctgatatggttaaga

SEQ ID NO: 245151 - DNA, 20 bp, Artificial Sequence
  chemically synthesized
ttagtgcagctgatatggtt

SEQ ID NO: 245152 - DNA, 20 bp, Artificial Sequence
  chemically synthesized
ttgttccatcttaaccatat

SEQ ID NO: 245153 - DNA, 20 bp, Artificial Sequence
  chemically synthesized
catgtttagtgcagctgata

SEQ ID NO: 245154 - DNA, 20 bp, Artificial Sequence
  chemically synthesized
gtaatgagccatgtttagtg

SEQ ID NO: 245155 - DNA, 20 bp, Artificial Sequence
  chemically synthesized
catatcagctgcactaaaca

SEQ ID NO: 245156 - DNA, 20 bp, Artificial Sequence
  chemically synthesized
gagcagtaatgagccatgtt

SEQ ID NO: 245157 - DNA, 20 bp, Artificial Sequence
  chemically synthesized
tcctattagtgagcagtaat

SEQ ID NO: 245158 - DNA, 20 bp, Artificial Sequence
  chemically synthesized
tctgtattcctattagtgag

SEQ ID NO: 245159 - DNA, 20 bp, Artificial Sequence
  chemically synthesized
ggctcattactgctcactaa

SEQ ID NO: 245160 - DNA, 20 bp, Artificial Sequence
  chemically synthesized
gctcattactgctcactaat

SEQ ID NO: 245161 - DNA, 20 bp, Artificial Sequence
  chemically synthesized
aaatctgtattcctattagt

SEQ ID NO: 245162 - DNA, 20 bp, Artificial Sequence
  chemically synthesized
atataaatctgtattcctat

SEQ ID NO: 245163 - DNA, 20 bp, Artificial Sequence
  chemically synthesized
actgctcactaataggaata

SEQ ID NO: 245164 - DNA, 20 bp, Artificial Sequence
  chemically synthesized
ataggaatacagatttatat

SEQ ID NO: 245165 - DNA, 20 bp, Artificial Sequence
  chemically synthesized
acagatttatatcagcaatt

SEQ ID NO: 245166 - DNA, 20 bp, Artificial Sequence
  chemically synthesized
cagatttatatcagcaattt

SEQ ID NO: 245167 - DNA, 20 bp, Artificial Sequence
  chemically synthesized
atatcagcaatttgggcaca

SEQ ID NO: 245168 - DNA, 20 bp, Artificial Sequence
  chemically synthesized
tatcagcaatttgggcacat

SEQ ID NO: 245169 - DNA, 20 bp, Artificial Sequence
  chemically synthesized
ttcccacagttaaaaaagac

SEQ ID NO: 245170 - DNA, 20 bp, Artificial Sequence
  chemically synthesized
atattttcccacagttaaaa

SEQ ID NO: 245171 - DNA, 20 bp, Artificial Sequence
  chemically synthesized
gggcttgtcttttttaactg

SEQ ID NO: 245172 - DNA, 20 bp, Artificial Sequence
  chemically synthesized
ggcttgtcttttttaactgt

SEQ ID NO: 245173 - DNA, 20 bp, Artificial Sequence
  chemically synthesized
atattttgtatattttccca

SEQ ID NO: 245174 - DNA, 20 bp, Artificial Sequence
  chemically synthesized
caaaatatttcaaccattgt

SEQ ID NO: 245175 - DNA, 20 bp, Artificial Sequence
  chemically synthesized
tgaactgtatacacttacaa

SEQ ID NO: 245176 - DNA, 20 bp, Artificial Sequence
  chemically synthesized
tcaaccattgtaagtgtata

SEQ ID NO: 245177 - DNA, 20 bp, Artificial Sequence
  chemically synthesized
cattgtaagtgtatacagtt

SEQ ID NO: 245178 - DNA, 20 bp, Artificial Sequence
  chemically synthesized
tgtaagtgtatacagttcag

SEQ ID NO: 245179 - DNA, 20 bp, Artificial Sequence
  chemically synthesized
tgtatacagttcagtggcat

SEQ ID NO: 245180 - DNA, 20 bp, Artificial Sequence
  chemically synthesized
tggcattagatacattcaca

SEQ ID NO: 245181 - DNA, 20 bp, Artificial Sequence
  chemically synthesized
agagttttggagatagatgg

SEQ ID NO: 245182 - DNA, 20 bp, Artificial Sequence
  chemically synthesized
tgaagagttttggagataga

SEQ ID NO: 245183 - DNA, 20 bp, Artificial Sequence
  chemically synthesized
aagatgaagagttttggaga

SEQ ID NO: 245184 - DNA, 20 bp, Artificial Sequence
  chemically synthesized
tagaaagatgaagagttttg

SEQ ID NO: 245185 - DNA, 20 bp, Artificial Sequence
  chemically synthesized
tttagaaagatgaagagttt

SEQ ID NO: 245186 - DNA, 20 bp, Artificial Sequence
  chemically synthesized
tttcagtttagaaagatgaa

SEQ ID NO: 245187 - DNA, 20 bp, Artificial Sequence
  chemically synthesized
agtttcagtttagaaagatg

SEQ ID NO: 245188 - DNA, 20 bp, Artificial Sequence
  chemically synthesized
gtatagagtttcagtttaga

SEQ ID NO: 245189 - DNA, 20 bp, Artificial Sequence
  chemically synthesized
attggtatagagtttcagtt

SEQ ID NO: 245190 - DNA, 20 bp, Artificial Sequence
  chemically synthesized
gtgtcattggtatagagttt

SEQ ID NO: 245191 - DNA, 20 bp, Artificial Sequence
  chemically synthesized
gttcttgtgtcattggtata

SEQ ID NO: 245192 - DNA, 20 bp, Artificial Sequence
  chemically synthesized
cagttcttgtgtcattggta

SEQ ID NO: 245193 - DNA, 20 bp, Artificial Sequence
  chemically synthesized
aaactctataccaatgacac

SEQ ID NO: 245194 - DNA, 20 bp, Artificial Sequence
  chemically synthesized
atgagcagttcttgtgtcat

SEQ ID NO: 245195 - DNA, 20 bp, Artificial Sequence
  chemically synthesized
ggaggggtaggggaaatgag

SEQ ID NO: 245196 - DNA, 20 bp, Artificial Sequence
  chemically synthesized
cagggaggggtaggggaaat

SEQ ID NO: 245197 - DNA, 20 bp, Artificial Sequence
  chemically synthesized
cagggaccagggaggggtag

SEQ ID NO: 245198 - DNA, 20 bp, Artificial Sequence
  chemically synthesized
ccagggaccagggaggggta

SEQ ID NO: 245199 - DNA, 20 bp, Artificial Sequence
  chemically synthesized
gccagggaccagggaggggt

SEQ ID NO: 245200 - DNA, 20 bp, Artificial Sequence
  chemically synthesized
tgccagggaccagggagggg

SEQ ID NO: 245201 - DNA, 20 bp, Artificial Sequence
  chemically synthesized
tcatttcccctacccctccc

SEQ ID NO: 245202 - DNA, 20 bp, Artificial Sequence
  chemically synthesized
ggttgccagggaccagggag

SEQ ID NO: 245203 - DNA, 20 bp, Artificial Sequence
  chemically synthesized
tggttgccagggaccaggga

SEQ ID NO: 245204 - DNA, 20 bp, Artificial Sequence
  chemically synthesized
atggttgccagggaccaggg

SEQ ID NO: 245205 - DNA, 20 bp, Artificial Sequence
  chemically synthesized
catggttgccagggaccagg

SEQ ID NO: 245206 - DNA, 20 bp, Artificial Sequence
  chemically synthesized
ccctacccctccctggtccc

SEQ ID NO: 245207 - DNA, 20 bp, Artificial Sequence
  chemically synthesized
tgcatggttgccagggacca

SEQ ID NO: 245208 - DNA, 20 bp, Artificial Sequence
  chemically synthesized
ttgcatggttgccagggacc

SEQ ID NO: 245209 - DNA, 20 bp, Artificial Sequence
  chemically synthesized
gttgcatggttgccagggac

SEQ ID NO: 245210 - DNA, 20 bp, Artificial Sequence
  chemically synthesized
aaatagttgcatggttgcca

SEQ ID NO: 245211 - DNA, 20 bp, Artificial Sequence
  chemically synthesized
caaatagttgcatggttgcc

SEQ ID NO: 245212 - DNA, 20 bp, Artificial Sequence
  chemically synthesized
acaaatagttgcatggttgc

SEQ ID NO: 245213 - DNA, 20 bp, Artificial Sequence
  chemically synthesized
ttcttagacaaatagttgca

SEQ ID NO: 245214 - DNA, 20 bp, Artificial Sequence
  chemically synthesized
aaccatgcaactatttgtct

SEQ ID NO: 245215 - DNA, 20 bp, Artificial Sequence
  chemically synthesized
tagttaaattcttagacaaa

SEQ ID NO: 245216 - DNA, 20 bp, Artificial Sequence
  chemically synthesized
acctagagtagttaaattct

SEQ ID NO: 245217 - DNA, 20 bp, Artificial Sequence
  chemically synthesized
gtctaagaatttaactactc

SEQ ID NO: 245218 - DNA, 20 bp, Artificial Sequence
  chemically synthesized
tctaagaatttaactactct

SEQ ID NO: 245219 - DNA, 20 bp, Artificial Sequence
  chemically synthesized
aagaatttaactactctagg

SEQ ID NO: 245220 - DNA, 20 bp, Artificial Sequence
  chemically synthesized
tggagatattccacctagag

SEQ ID NO: 245221 - DNA, 20 bp, Artificial Sequence
  chemically synthesized
ctttggagatattccaccta

SEQ ID NO: 245222 - DNA, 20 bp, Artificial Sequence
  chemically synthesized
aactttggagatattccacc

SEQ ID NO: 245223 - DNA, 20 bp, Artificial Sequence
  chemically synthesized
ctctaggtggaatatctcca

SEQ ID NO: 245224 - DNA, 20 bp, Artificial Sequence
  chemically synthesized
taaaatagggatgaactttg

SEQ ID NO: 245225 - DNA, 20 bp, Artificial Sequence
  chemically synthesized
cctaaaatagggatgaactt

SEQ ID NO: 245226 - DNA, 20 bp, Artificial Sequence
  chemically synthesized
tccaaagttcatccctattt

SEQ ID NO: 245227 - DNA, 20 bp, Artificial Sequence
  chemically synthesized
ccaaagttcatccctatttt

SEQ ID NO: 245228 - DNA, 20 bp, Artificial Sequence
  chemically synthesized
ttctgtcacatcctaaaata

SEQ ID NO: 245229 - DNA, 20 bp, Artificial Sequence
  chemically synthesized
attctgtcacatcctaaaat

SEQ ID NO: 245230 - DNA, 20 bp, Artificial Sequence
  chemically synthesized
aattctgtcacatcctaaaa

SEQ ID NO: 245231 - DNA, 20 bp, Artificial Sequence
  chemically synthesized
atccctattttaggatgtga

SEQ ID NO: 245232 - DNA, 20 bp, Artificial Sequence
  chemically synthesized
cagaatttcattccttttta

SEQ ID NO: 245233 - DNA, 20 bp, Artificial Sequence
  chemically synthesized
aacagtattctgctttaaaa

SEQ ID NO: 245234 - DNA, 20 bp, Artificial Sequence
  chemically synthesized
aatttcattcctttttaaag

SEQ ID NO: 245235 - DNA, 20 bp, Artificial Sequence
  chemically synthesized
gaacagtattctgctttaaa

SEQ ID NO: 245236 - DNA, 20 bp, Artificial Sequence
  chemically synthesized
ggtgtatccatacagcagaa

SEQ ID NO: 245237 - DNA, 20 bp, Artificial Sequence
  chemically synthesized
cagaatactgttctgctgta

SEQ ID NO: 245238 - DNA, 20 bp, Artificial Sequence
  chemically synthesized
aacgtggtgtatccatacag

SEQ ID NO: 245239 - DNA, 20 bp, Artificial Sequence
  chemically synthesized
caaaacgtggtgtatccata

SEQ ID NO: 245240 - DNA, 20 bp, Artificial Sequence
  chemically synthesized
aagaatggagaaacaaaacg

SEQ ID NO: 245241 - DNA, 20 bp, Artificial Sequence
  chemically synthesized
acgttttgtttctccattct

SEQ ID NO: 245242 - DNA, 20 bp, Artificial Sequence
  chemically synthesized
gtgtacactgaccaagaatg

SEQ ID NO: 245243 - DNA, 20 bp, Artificial Sequence
  chemically synthesized
ctgtgtacactgaccaagaa

SEQ ID NO: 245244 - DNA, 20 bp, Artificial Sequence
  chemically synthesized
tttgtttctccattcttggt

SEQ ID NO: 245245 - DNA, 20 bp, Artificial Sequence
  chemically synthesized
gtacactgtgtacactgacc

SEQ ID NO: 245246 - DNA, 20 bp, Artificial Sequence
  chemically synthesized
ccattcttggtcagtgtaca

SEQ ID NO: 245247 - DNA, 20 bp, Artificial Sequence
  chemically synthesized
attttactgtagagaaaagg

SEQ ID NO: 245248 - DNA, 20 bp, Artificial Sequence
  chemically synthesized
catattttactgtagagaaa

SEQ ID NO: 245249 - DNA, 20 bp, Artificial Sequence
  chemically synthesized
ttgtttctaccttttctcta

SEQ ID NO: 245250 - DNA, 20 bp, Artificial Sequence
  chemically synthesized
gcatattttactgtagagaa

SEQ ID NO: 245251 - DNA, 20 bp, Artificial Sequence
  chemically synthesized
tagcagcatattttactgta

SEQ ID NO: 245252 - DNA, 20 bp, Artificial Sequence
  chemically synthesized
catagcagcatattttactg

SEQ ID NO: 245253 - DNA, 20 bp, Artificial Sequence
  chemically synthesized
ttgtacacccaagttcatag

SEQ ID NO: 245254 - DNA, 20 bp, Artificial Sequence
  chemically synthesized
aaaatatgctgctatgaact

SEQ ID NO: 245255 - DNA, 20 bp, Artificial Sequence
  chemically synthesized
aaatatgctgctatgaactt

SEQ ID NO: 245256 - DNA, 20 bp, Artificial Sequence
  chemically synthesized
tatttgtacacccaagttca

SEQ ID NO: 245257 - DNA, 20 bp, Artificial Sequence
  chemically synthesized
acacagatatttgtacaccc

SEQ ID NO: 245258 - DNA, 20 bp, Artificial Sequence
  chemically synthesized
attgaaaacaggtattcaca

SEQ ID NO: 245259 - DNA, 20 bp, Artificial Sequence
  chemically synthesized
tacccaaaataattgaaaac

SEQ ID NO: 245260 - DNA, 20 bp, Artificial Sequence
  chemically synthesized
atacccaaaataattgaaaa

SEQ ID NO: 245261 - DNA, 20 bp, Artificial Sequence
  chemically synthesized
atacctgttttcaattattt

SEQ ID NO: 245262 - DNA, 20 bp, Artificial Sequence
  chemically synthesized
tacctgttttcaattatttt

SEQ ID NO: 245263 - DNA, 20 bp, Artificial Sequence
  chemically synthesized
aattattttgggtatatacc

SEQ ID NO: 245264 - DNA, 20 bp, Artificial Sequence
  chemically synthesized
tattttgggtatatacccag

SEQ ID NO: 245265 - DNA, 20 bp, Artificial Sequence
  chemically synthesized
tttgggtatatacccagaag

SEQ ID NO: 245266 - DNA, 20 bp, Artificial Sequence
  chemically synthesized
gatccaataattccacttct

SEQ ID NO: 245267 - DNA, 20 bp, Artificial Sequence
  chemically synthesized
tgatccaataattccacttc

SEQ ID NO: 245268 - DNA, 20 bp, Artificial Sequence
  chemically synthesized
atacccagaagtggaattat

SEQ ID NO: 245269 - DNA, 20 bp, Artificial Sequence
  chemically synthesized
ggaattattggatcatataa

SEQ ID NO: 245270 - DNA, 20 bp, Artificial Sequence
  chemically synthesized
tcttaaaataaaatttaaca

SEQ ID NO: 245271 - DNA, 20 bp, Artificial Sequence
  chemically synthesized
tctttgttaaattttatttt

SEQ ID NO: 245272 - DNA, 20 bp, Artificial Sequence
  chemically synthesized
ttaaattttattttaagaac

SEQ ID NO: 245273 - DNA, 20 bp, Artificial Sequence
  chemically synthesized
tattttaagaactagtcttg

SEQ ID NO: 245274 - DNA, 20 bp, Artificial Sequence
  chemically synthesized
ttatttttaaactacaagac

SEQ ID NO: 245275 - DNA, 20 bp, Artificial Sequence
  chemically synthesized
aaactttatttttaaactac

SEQ ID NO: 245276 - DNA, 20 bp, Artificial Sequence
  chemically synthesized
agtcttgtagtttaaaaata

SEQ ID NO: 245277 - DNA, 20 bp, Artificial Sequence
  chemically synthesized
gtttaaaaataaagttttat

SEQ ID NO: 245278 - DNA, 20 bp, Artificial Sequence
  chemically synthesized
tagacaatatgtaaatgaat

SEQ ID NO: 245279 - DNA, 20 bp, Artificial Sequence
  chemically synthesized
attcatttacatattgtcta

SEQ ID NO: 245280 - DNA, 20 bp, Artificial Sequence
  chemically synthesized
tttttttgcaaaagcaacca

SEQ ID NO: 245281 - DNA, 20 bp, Artificial Sequence
  chemically synthesized
atttttttttttttttgcaa

SEQ ID NO: 245282 - DNA, 20 bp, Artificial Sequence
  chemically synthesized
tttgcaaaaaaaaaaaaaaa

SEQ ID NO: 245283 - DNA, 20 bp, Artificial Sequence
  chemically synthesized
gcaaaaaaaaaaaaaaatgg

SEQ ID NO: 245284 - DNA, 20 bp, Artificial Sequence
  chemically synthesized
aaaaaaaaaaaaaaatggca

SEQ ID NO: 245285 - DNA, 20 bp, Artificial Sequence
  chemically synthesized
aaaaaaatggcagagtttaa

SEQ ID NO: 245286 - DNA, 20 bp, Artificial Sequence
  chemically synthesized
tggcagagtttaatagttgt

SEQ ID NO: 245287 - DNA, 20 bp, Artificial Sequence
  chemically synthesized
agagtttaatagttgtgaga

SEQ ID NO: 245288 - DNA, 20 bp, Artificial Sequence
  chemically synthesized
tagttgtgagatagaccata

SEQ ID NO: 245289 - DNA, 20 bp, Artificial Sequence
  chemically synthesized
tataggctttgcgggccata

SEQ ID NO: 245290 - DNA, 20 bp, Artificial Sequence
  chemically synthesized
gatagaccatatggcccgca

SEQ ID NO: 245291 - DNA, 20 bp, Artificial Sequence
  chemically synthesized
gtaaatattataggctttgc

SEQ ID NO: 245292 - DNA, 20 bp, Artificial Sequence
  chemically synthesized
agtaaatattataggctttg

SEQ ID NO: 245293 - DNA, 20 bp, Artificial Sequence
  chemically synthesized
aacaagatagtaaatattat

SEQ ID NO: 245294 - DNA, 20 bp, Artificial Sequence
  chemically synthesized
gaacaagatagtaaatatta

SEQ ID NO: 245295 - DNA, 20 bp, Artificial Sequence
  chemically synthesized
ttattctgtaaggaacaaga

SEQ ID NO: 245296 - DNA, 20 bp, Artificial Sequence
  chemically synthesized
aaacttattctgtaaggaac

SEQ ID NO: 245297 - DNA, 20 bp, Artificial Sequence
  chemically synthesized
atttactatcttgttcctta

SEQ ID NO: 245298 - DNA, 20 bp, Artificial Sequence
  chemically synthesized
gttagcaaacttattctgta

SEQ ID NO: 245299 - DNA, 20 bp, Artificial Sequence
  chemically synthesized
tatcttgttccttacagaat

SEQ ID NO: 245300 - DNA, 20 bp, Artificial Sequence
  chemically synthesized
agttagcaaacttattctgt

SEQ ID NO: 245301 - DNA, 20 bp, Artificial Sequence
  chemically synthesized
caattttgtaagacagaagt

SEQ ID NO: 245302 - DNA, 20 bp, Artificial Sequence
  chemically synthesized
actgcaattttgtaagacag

SEQ ID NO: 245303 - DNA, 20 bp, Artificial Sequence
  chemically synthesized
gctactgcaattttgtaaga

SEQ ID NO: 245304 - DNA, 20 bp, Artificial Sequence
  chemically synthesized
aattgctactgcaattttgt

SEQ ID NO: 245305 - DNA, 20 bp, Artificial Sequence
  chemically synthesized
acttctgtcttacaaaattg

SEQ ID NO: 245306 - DNA, 20 bp, Artificial Sequence
  chemically synthesized
tctgtcttacaaaattgcag

SEQ ID NO: 245307 - DNA, 20 bp, Artificial Sequence
  chemically synthesized
aaattgcagtagcaattcct

SEQ ID NO: 245308 - DNA, 20 bp, Artificial Sequence
  chemically synthesized
atatgtttcatgtgaaacca

SEQ ID NO: 245309 - DNA, 20 bp, Artificial Sequence
  chemically synthesized
catatgtttcatgtgaaacc

SEQ ID NO: 245310 - DNA, 20 bp, Artificial Sequence
  chemically synthesized
atgaaacatatgtcttcaaa

SEQ ID NO: 245311 - DNA, 20 bp, Artificial Sequence
  chemically synthesized
aaaggtcttttaactgtttg

SEQ ID NO: 245312 - DNA, 20 bp, Artificial Sequence
  chemically synthesized
atatgtcttcaaacagttaa

SEQ ID NO: 245313 - DNA, 20 bp, Artificial Sequence
  chemically synthesized
agttaaaagacctttcatgt

SEQ ID NO: 245314 - DNA, 20 bp, Artificial Sequence
  chemically synthesized
tttctatttcccaacatgaa

SEQ ID NO: 245315 - DNA, 20 bp, Artificial Sequence
  chemically synthesized
gttaaaagacctttcatgtt

SEQ ID NO: 245316 - DNA, 20 bp, Artificial Sequence
  chemically synthesized
gtttctatttcccaacatga

SEQ ID NO: 245317 - DNA, 20 bp, Artificial Sequence
  chemically synthesized
agacctttcatgttgggaaa

SEQ ID NO: 245318 - DNA, 20 bp, Artificial Sequence
  chemically synthesized
ttcatgttgggaaatagaaa

SEQ ID NO: 245319 - DNA, 20 bp, Artificial Sequence
  chemically synthesized
tcatgttgggaaatagaaac

SEQ ID NO: 245320 - DNA, 20 bp, Artificial Sequence
  chemically synthesized
aaacaggataattttattct

SEQ ID NO: 245321 - DNA, 20 bp, Artificial Sequence
  chemically synthesized
tgttttctcatatgtaggcc

SEQ ID NO: 245322 - DNA, 20 bp, Artificial Sequence
  chemically synthesized
tttattctcggcctacatat

SEQ ID NO: 245323 - DNA, 20 bp, Artificial Sequence
  chemically synthesized
ttccttgttttctcatatgt

SEQ ID NO: 245324 - DNA, 20 bp, Artificial Sequence
  chemically synthesized
tttccttgttttctcatatg

SEQ ID NO: 245325 - DNA, 20 bp, Artificial Sequence
  chemically synthesized
cggcctacatatgagaaaac

SEQ ID NO: 245326 - DNA, 20 bp, Artificial Sequence
  chemically synthesized
ggcctacatatgagaaaaca

SEQ ID NO: 245327 - DNA, 20 bp, Artificial Sequence
  chemically synthesized
tacatatgagaaaacaagga

SEQ ID NO: 245328 - DNA, 20 bp, Artificial Sequence
  chemically synthesized
tgcaacttccatgtggcatt

SEQ ID NO: 245329 - DNA, 20 bp, Artificial Sequence
  chemically synthesized
ggaaagtgctgaatgccaca

SEQ ID NO: 245330 - DNA, 20 bp, Artificial Sequence
  chemically synthesized
aagtgctgaatgccacatgg

SEQ ID NO: 245331 - DNA, 20 bp, Artificial Sequence
  chemically synthesized
ttgagattgcaacttccatg

SEQ ID NO: 245332 - DNA, 20 bp, Artificial Sequence
  chemically synthesized
acatggaagttgcaatctca

SEQ ID NO: 245333 - DNA, 20 bp, Artificial Sequence
  chemically synthesized
catggaagttgcaatctcaa

SEQ ID NO: 245334 - DNA, 20 bp, Artificial Sequence
  chemically synthesized
ggaagttgcaatctcaaagg

SEQ ID NO: 245335 - DNA, 20 bp, Artificial Sequence
  chemically synthesized
atattggattaacttccttt

SEQ ID NO: 245336 - DNA, 20 bp, Artificial Sequence
  chemically synthesized
tgaggtctggatattaatat

SEQ ID NO: 245337 - DNA, 20 bp, Artificial Sequence
  chemically synthesized
gttaatccaatattaatatc

SEQ ID NO: 245338 - DNA, 20 bp, Artificial Sequence
  chemically synthesized
ttagctgcaacaatgaggtc

SEQ ID NO: 245339 - DNA, 20 bp, Artificial Sequence
  chemically synthesized
tagatttagctgcaacaatg

SEQ ID NO: 245340 - DNA, 20 bp, Artificial Sequence
  chemically synthesized
atatccagacctcattgttg

SEQ ID NO: 245341 - DNA, 20 bp, Artificial Sequence
  chemically synthesized
atagatttagctgcaacaat

SEQ ID NO: 245342 - DNA, 20 bp, Artificial Sequence
  chemically synthesized
gatttgtgatgagatagatt

SEQ ID NO: 245343 - DNA, 20 bp, Artificial Sequence
  chemically synthesized
ctctgtgatttgtgatgaga

SEQ ID NO: 245344 - DNA, 20 bp, Artificial Sequence
  chemically synthesized
ataactctgtgatttgtgat

SEQ ID NO: 245345 - DNA, 20 bp, Artificial Sequence
  chemically synthesized
atctatctcatcacaaatca

SEQ ID NO: 245346 - DNA, 20 bp, Artificial Sequence
  chemically synthesized
ctatctcatcacaaatcaca

SEQ ID NO: 245347 - DNA, 20 bp, Artificial Sequence
  chemically synthesized
tttctatatagcatataaag

SEQ ID NO: 245348 - DNA, 20 bp, Artificial Sequence
  chemically synthesized
agttttctatatagcatata

SEQ ID NO: 245349 - DNA, 20 bp, Artificial Sequence
  chemically synthesized
ttacttctttatatgctata

SEQ ID NO: 245350 - DNA, 20 bp, Artificial Sequence
  chemically synthesized
gtatatctgagttttctata

SEQ ID NO: 245351 - DNA, 20 bp, Artificial Sequence
  chemically synthesized
tatatgctatatagaaaact

SEQ ID NO: 245352 - DNA, 20 bp, Artificial Sequence
  chemically synthesized
gatatagggaaagtatatct

SEQ ID NO: 245353 - DNA, 20 bp, Artificial Sequence
  chemically synthesized
acatcgcattgatataggga

SEQ ID NO: 245354 - DNA, 20 bp, Artificial Sequence
  chemically synthesized
tgaaacatcgcattgatata

SEQ ID NO: 245355 - DNA, 20 bp, Artificial Sequence
  chemically synthesized
atgaaacatcgcattgatat

SEQ ID NO: 245356 - DNA, 20 bp, Artificial Sequence
  chemically synthesized
catgaaacatcgcattgata

SEQ ID NO: 245357 - DNA, 20 bp, Artificial Sequence
  chemically synthesized
ccatcttcaataaaagaaga

SEQ ID NO: 245358 - DNA, 20 bp, Artificial Sequence
  chemically synthesized
caccccatcttcaataaaag

SEQ ID NO: 245359 - DNA, 20 bp, Artificial Sequence
  chemically synthesized
catgctttcttcttttattg

SEQ ID NO: 245360 - DNA, 20 bp, Artificial Sequence
  chemically synthesized
tcccaccccatcttcaataa

SEQ ID NO: 245361 - DNA, 20 bp, Artificial Sequence
  chemically synthesized
ctttcttcttttattgaaga

SEQ ID NO: 245362 - DNA, 20 bp, Artificial Sequence
  chemically synthesized
tttcttcttttattgaagat

SEQ ID NO: 245363 - DNA, 20 bp, Artificial Sequence
  chemically synthesized
ttcttcttttattgaagatg

SEQ ID NO: 245364 - DNA, 20 bp, Artificial Sequence
  chemically synthesized
ttcttttattgaagatgggg

SEQ ID NO: 245365 - DNA, 20 bp, Artificial Sequence
  chemically synthesized
tcttttattgaagatggggt

SEQ ID NO: 245366 - DNA, 20 bp, Artificial Sequence
  chemically synthesized
tggggtgggaatactgcatc

SEQ ID NO: 245367 - DNA, 20 bp, Artificial Sequence
  chemically synthesized
ctcaagtctctcacttgatg

SEQ ID NO: 245368 - DNA, 20 bp, Artificial Sequence
  chemically synthesized
gtgggaatactgcatcaagt

SEQ ID NO: 245369 - DNA, 20 bp, Artificial Sequence
  chemically synthesized
gggaatactgcatcaagtga

SEQ ID NO: 245370 - DNA, 20 bp, Artificial Sequence
  chemically synthesized
ctgcatcaagtgagagactt

SEQ ID NO: 245371 - DNA, 20 bp, Artificial Sequence
  chemically synthesized
tcaagtgagagacttgagtc

SEQ ID NO: 245372 - DNA, 20 bp, Artificial Sequence
  chemically synthesized
caagtgagagacttgagtct

SEQ ID NO: 245373 - DNA, 20 bp, Artificial Sequence
  chemically synthesized
actcagcctctcccagactc

SEQ ID NO: 245374 - DNA, 20 bp, Artificial Sequence
  chemically synthesized
agtgagagacttgagtctgg

SEQ ID NO: 245375 - DNA, 20 bp, Artificial Sequence
  chemically synthesized
tgagagacttgagtctggga

SEQ ID NO: 245376 - DNA, 20 bp, Artificial Sequence
  chemically synthesized
gagagacttgagtctgggag

SEQ ID NO: 245377 - DNA, 20 bp, Artificial Sequence
  chemically synthesized
ttatacaactcagcctctcc

SEQ ID NO: 245378 - DNA, 20 bp, Artificial Sequence
  chemically synthesized
acttgagtctgggagaggct

SEQ ID NO: 245379 - DNA, 20 bp, Artificial Sequence
  chemically synthesized
gatttcacagttatacaact

SEQ ID NO: 245380 - DNA, 20 bp, Artificial Sequence
  chemically synthesized
ttggaggacaaatgatttca

SEQ ID NO: 245381 - DNA, 20 bp, Artificial Sequence
  chemically synthesized
tgaaatcatttgtcctccaa

SEQ ID NO: 245382 - DNA, 20 bp, Artificial Sequence
  chemically synthesized
ttttaaatccaagcttttgg

SEQ ID NO: 245383 - DNA, 20 bp, Artificial Sequence
  chemically synthesized
attttaaatccaagcttttg

SEQ ID NO: 245384 - DNA, 20 bp, Artificial Sequence
  chemically synthesized
tcatttgtcctccaaaagct

SEQ ID NO: 245385 - DNA, 20 bp, Artificial Sequence
  chemically synthesized
atattttaaatccaagcttt

SEQ ID NO: 245386 - DNA, 20 bp, Artificial Sequence
  chemically synthesized
atctgttatattttaaatcc

SEQ ID NO: 245387 - DNA, 20 bp, Artificial Sequence
  chemically synthesized
agcttggatttaaaatataa

SEQ ID NO: 245388 - DNA, 20 bp, Artificial Sequence
  chemically synthesized
agtatgttttcagtcataca

SEQ ID NO: 245389 - DNA, 20 bp, Artificial Sequence
  chemically synthesized
attccaggcaagtatgtttt

SEQ ID NO: 245390 - DNA, 20 bp, Artificial Sequence
  chemically synthesized
tgactgaaaacatacttgcc

SEQ ID NO: 245391 - DNA, 20 bp, Artificial Sequence
  chemically synthesized
tgatctttaacattccaggc

SEQ ID NO: 245392 - DNA, 20 bp, Artificial Sequence
  chemically synthesized
accctgatctttaacattcc

SEQ ID NO: 245393 - DNA, 20 bp, Artificial Sequence
  chemically synthesized
taccctgatctttaacattc

SEQ ID NO: 245394 - DNA, 20 bp, Artificial Sequence
  chemically synthesized
catacttgcctggaatgtta

SEQ ID NO: 245395 - DNA, 20 bp, Artificial Sequence
  chemically synthesized
ttgcctggaatgttaaagat

SEQ ID NO: 245396 - DNA, 20 bp, Artificial Sequence
  chemically synthesized
tgcctggaatgttaaagatc

SEQ ID NO: 245397 - DNA, 20 bp, Artificial Sequence
  chemically synthesized
gcctggaatgttaaagatca

SEQ ID NO: 245398 - DNA, 20 bp, Artificial Sequence
  chemically synthesized
tcaatattagattaacgaga

SEQ ID NO: 245399 - DNA, 20 bp, Artificial Sequence
  chemically synthesized
actgtcaatattagattaac

SEQ ID NO: 245400 - DNA, 20 bp, Artificial Sequence
  chemically synthesized
tctcgttaatctaatattga

SEQ ID NO: 245401 - DNA, 20 bp, Artificial Sequence
  chemically synthesized
ttatactccactgtcaatat

SEQ ID NO: 245402 - DNA, 20 bp, Artificial Sequence
  chemically synthesized
cgttaatctaatattgacag

SEQ ID NO: 245403 - DNA, 20 bp, Artificial Sequence
  chemically synthesized
ttaatctaatattgacagtg

SEQ ID NO: 245404 - DNA, 20 bp, Artificial Sequence
  chemically synthesized
atattgacagtggagtataa

SEQ ID NO: 245405 - DNA, 20 bp, Artificial Sequence
  chemically synthesized
ctcctacacagtaatagtga

SEQ ID NO: 245406 - DNA, 20 bp, Artificial Sequence
  chemically synthesized
cactcctacacagtaatagt

SEQ ID NO: 245407 - DNA, 20 bp, Artificial Sequence
  chemically synthesized
cttacactcctacacagtaa

SEQ ID NO: 245408 - DNA, 20 bp, Artificial Sequence
  chemically synthesized
agtctctcactattactgtg

SEQ ID NO: 245409 - DNA, 20 bp, Artificial Sequence
  chemically synthesized
gtctctcactattactgtgt

SEQ ID NO: 245410 - DNA, 20 bp, Artificial Sequence
  chemically synthesized
ctctcactattactgtgtag

SEQ ID NO: 245411 - DNA, 20 bp, Artificial Sequence
  chemically synthesized
aagagacttacactcctaca

SEQ ID NO: 245412 - DNA, 20 bp, Artificial Sequence
  chemically synthesized
ctattactgtgtaggagtgt

SEQ ID NO: 245413 - DNA, 20 bp, Artificial Sequence
  chemically synthesized
taggagtgtaagtctctttg

SEQ ID NO: 245414 - DNA, 20 bp, Artificial Sequence
  chemically synthesized
aggagtgtaagtctctttgt

SEQ ID NO: 245415 - DNA, 20 bp, Artificial Sequence
  chemically synthesized
agttcctagagacctacaaa

SEQ ID NO: 245416 - DNA, 20 bp, Artificial Sequence
  chemically synthesized
caagttcctagagacctaca

SEQ ID NO: 245417 - DNA, 20 bp, Artificial Sequence
  chemically synthesized
taagtctctttgtaggtctc

SEQ ID NO: 245418 - DNA, 20 bp, Artificial Sequence
  chemically synthesized
aagtctctttgtaggtctct

SEQ ID NO: 245419 - DNA, 20 bp, Artificial Sequence
  chemically synthesized
attcgtaaagcaagttccta

SEQ ID NO: 245420 - DNA, 20 bp, Artificial Sequence
  chemically synthesized
agattcgtaaagcaagttcc

SEQ ID NO: 245421 - DNA, 20 bp, Artificial Sequence
  chemically synthesized
agcacccagattcgtaaagc

SEQ ID NO: 245422 - DNA, 20 bp, Artificial Sequence
  chemically synthesized
caggagcacccagattcgta

SEQ ID NO: 245423 - DNA, 20 bp, Artificial Sequence
  chemically synthesized
aggaacttgctttacgaatc

SEQ ID NO: 245424 - DNA, 20 bp, Artificial Sequence
  chemically synthesized
ggaacttgctttacgaatct

SEQ ID NO: 245425 - DNA, 20 bp, Artificial Sequence
  chemically synthesized
gcacccaatacaggagcacc

SEQ ID NO: 245426 - DNA, 20 bp, Artificial Sequence
  chemically synthesized
gaatctgggtgctcctgtat

SEQ ID NO: 245427 - DNA, 20 bp, Artificial Sequence
  chemically synthesized
aatctgggtgctcctgtatt

SEQ ID NO: 245428 - DNA, 20 bp, Artificial Sequence
  chemically synthesized
tatatatgcacccaatacag

SEQ ID NO: 245429 - DNA, 20 bp, Artificial Sequence
  chemically synthesized
aatatatatgcacccaatac

SEQ ID NO: 245430 - DNA, 20 bp, Artificial Sequence
  chemically synthesized
aaatatatatgcacccaata

SEQ ID NO: 245431 - DNA, 20 bp, Artificial Sequence
  chemically synthesized
gtattgggtgcatatatatt

SEQ ID NO: 245432 - DNA, 20 bp, Artificial Sequence
  chemically synthesized
gggtgcatatatatttagaa

SEQ ID NO: 245433 - DNA, 20 bp, Artificial Sequence
  chemically synthesized
gcatatatatttagaatagt

SEQ ID NO: 245434 - DNA, 20 bp, Artificial Sequence
  chemically synthesized
aaagggagcaacgcaacaag

SEQ ID NO: 245435 - DNA, 20 bp, Artificial Sequence
  chemically synthesized
ggtaaagggagcaacgcaac

SEQ ID NO: 245436 - DNA, 20 bp, Artificial Sequence
  chemically synthesized
acattacataatggtaaagg

SEQ ID NO: 245437 - DNA, 20 bp, Artificial Sequence
  chemically synthesized
ttacattacataatggtaaa

SEQ ID NO: 245438 - DNA, 20 bp, Artificial Sequence
  chemically synthesized
attacattacataatggtaa

SEQ ID NO: 245439 - DNA, 20 bp, Artificial Sequence
  chemically synthesized
tattacattacataatggta

SEQ ID NO: 245440 - DNA, 20 bp, Artificial Sequence
  chemically synthesized
aagggtattacattacataa

SEQ ID NO: 245441 - DNA, 20 bp, Artificial Sequence
  chemically synthesized
agatcaagaaagacaaagaa

SEQ ID NO: 245442 - DNA, 20 bp, Artificial Sequence
  chemically synthesized
aagatcaagaaagacaaaga

SEQ ID NO: 245443 - DNA, 20 bp, Artificial Sequence
  chemically synthesized
aaagatcaagaaagacaaag

SEQ ID NO: 245444 - DNA, 20 bp, Artificial Sequence
  chemically synthesized
aacaaagatcaagaaagaca

SEQ ID NO: 245445 - DNA, 20 bp, Artificial Sequence
  chemically synthesized
taaaccaacaaagatcaaga

SEQ ID NO: 245446 - DNA, 20 bp, Artificial Sequence
  chemically synthesized
actttaaaccaacaaagatc

SEQ ID NO: 245447 - DNA, 20 bp, Artificial Sequence
  chemically synthesized
ttgtctttcttgatctttgt

SEQ ID NO: 245448 - DNA, 20 bp, Artificial Sequence
  chemically synthesized
aaacagactttaaaccaaca

SEQ ID NO: 245449 - DNA, 20 bp, Artificial Sequence
  chemically synthesized
tcttgatctttgttggttta

SEQ ID NO: 245450 - DNA, 20 bp, Artificial Sequence
  chemically synthesized
tggtttaaagtctgttttat

SEQ ID NO: 245451 - DNA, 20 bp, Artificial Sequence
  chemically synthesized
aatcctagtctctgataaaa

SEQ ID NO: 245452 - DNA, 20 bp, Artificial Sequence
  chemically synthesized
gtttaaagtctgttttatca

SEQ ID NO: 245453 - DNA, 20 bp, Artificial Sequence
  chemically synthesized
aagtctgttttatcagagac

SEQ ID NO: 245454 - DNA, 20 bp, Artificial Sequence
  chemically synthesized
agtctgttttatcagagact

SEQ ID NO: 245455 - DNA, 20 bp, Artificial Sequence
  chemically synthesized
aaaaacaggggttacaatcc

SEQ ID NO: 245456 - DNA, 20 bp, Artificial Sequence
  chemically synthesized
aaaaataaaaaaaaaaacag

SEQ ID NO: 245457 - DNA, 20 bp, Artificial Sequence
  chemically synthesized
aaaaaataaaaaaaaaaaca

SEQ ID NO: 245458 - DNA, 20 bp, Artificial Sequence
  chemically synthesized
aaaaaaataaaaaaaaaaac

SEQ ID NO: 245459 - DNA, 20 bp, Artificial Sequence
  chemically synthesized
aaaaaaaataaaaaaaaaaa

SEQ ID NO: 245460 - DNA, 20 bp, Artificial Sequence
  chemically synthesized
atattttccaagcaaatgga

SEQ ID NO: 245461 - DNA, 20 bp, Artificial Sequence
  chemically synthesized
ttttttgctttccatttgct

SEQ ID NO: 245462 - DNA, 20 bp, Artificial Sequence
  chemically synthesized
cggaatattttccaagcaaa

SEQ ID NO: 245463 - DNA, 20 bp, Artificial Sequence
  chemically synthesized
gggatggcggaatattttcc

SEQ ID NO: 245464 - DNA, 20 bp, Artificial Sequence
  chemically synthesized
ggctcaaagcaaagggatgg

SEQ ID NO: 245465 - DNA, 20 bp, Artificial Sequence
  chemically synthesized
ataggctcaaagcaaaggga

SEQ ID NO: 245466 - DNA, 20 bp, Artificial Sequence
  chemically synthesized
acacataggctcaaagcaaa

SEQ ID NO: 245467 - DNA, 20 bp, Artificial Sequence
  chemically synthesized
ttccgccatccctttgcttt

SEQ ID NO: 245468 - DNA, 20 bp, Artificial Sequence
  chemically synthesized
cacacataggctcaaagcaa

SEQ ID NO: 245469 - DNA, 20 bp, Artificial Sequence
  chemically synthesized
acacacataggctcaaagca

SEQ ID NO: 245470 - DNA, 20 bp, Artificial Sequence
  chemically synthesized
caaacacacacataggctca

SEQ ID NO: 245471 - DNA, 20 bp, Artificial Sequence
  chemically synthesized
tcacatgcaaacacacacat

SEQ ID NO: 245472 - DNA, 20 bp, Artificial Sequence
  chemically synthesized
ctcacatgcaaacacacaca

SEQ ID NO: 245473 - DNA, 20 bp, Artificial Sequence
  chemically synthesized
ctatgtgtgtgtttgcatgt

SEQ ID NO: 245474 - DNA, 20 bp, Artificial Sequence
  chemically synthesized
gtgtgtgtttgcatgtgaga

SEQ ID NO: 245475 - DNA, 20 bp, Artificial Sequence
  chemically synthesized
tgtgtgtttgcatgtgagat

SEQ ID NO: 245476 - DNA, 20 bp, Artificial Sequence
  chemically synthesized
catcagtgtggtgtattcag

SEQ ID NO: 245477 - DNA, 20 bp, Artificial Sequence
  chemically synthesized
accatcagtgtggtgtattc

SEQ ID NO: 245478 - DNA, 20 bp, Artificial Sequence
  chemically synthesized
gaccatcagtgtggtgtatt

SEQ ID NO: 245479 - DNA, 20 bp, Artificial Sequence
  chemically synthesized
tcctgaatacaccacactga

SEQ ID NO: 245480 - DNA, 20 bp, Artificial Sequence
  chemically synthesized
aagagtcaggaccatcagtg

SEQ ID NO: 245481 - DNA, 20 bp, Artificial Sequence
  chemically synthesized
ggataaagagtcaggaccat

SEQ ID NO: 245482 - DNA, 20 bp, Artificial Sequence
  chemically synthesized
ggcaaattggataaagagtc

SEQ ID NO: 245483 - DNA, 20 bp, Artificial Sequence
  chemically synthesized
tggcaaattggataaagagt

SEQ ID NO: 245484 - DNA, 20 bp, Artificial Sequence
  chemically synthesized
agactggcaaattggataaa

SEQ ID NO: 245485 - DNA, 20 bp, Artificial Sequence
  chemically synthesized
acagactggcaaattggata

SEQ ID NO: 245486 - DNA, 20 bp, Artificial Sequence
  chemically synthesized
tgactctttatccaatttgc

SEQ ID NO: 245487 - DNA, 20 bp, Artificial Sequence
  chemically synthesized
aaagacacagactggcaaat

SEQ ID NO: 245488 - DNA, 20 bp, Artificial Sequence
  chemically synthesized
cccaattaaaagacacagac

SEQ ID NO: 245489 - DNA, 20 bp, Artificial Sequence
  chemically synthesized
aatgccccaattaaaagaca

SEQ ID NO: 245490 - DNA, 20 bp, Artificial Sequence
  chemically synthesized
gccagtctgtgtcttttaat

SEQ ID NO: 245491 - DNA, 20 bp, Artificial Sequence
  chemically synthesized
ccagtctgtgtcttttaatt

SEQ ID NO: 245492 - DNA, 20 bp, Artificial Sequence
  chemically synthesized
cagtctgtgtcttttaattg

SEQ ID NO: 245493 - DNA, 20 bp, Artificial Sequence
  chemically synthesized
gggctaaatgccccaattaa

SEQ ID NO: 245494 - DNA, 20 bp, Artificial Sequence
  chemically synthesized
tgtcttttaattggggcatt

SEQ ID NO: 245495 - DNA, 20 bp, Artificial Sequence
  chemically synthesized
tattaactttaaatgtaaat

SEQ ID NO: 245496 - DNA, 20 bp, Artificial Sequence
  chemically synthesized
atattaactttaaatgtaaa

SEQ ID NO: 245497 - DNA, 20 bp, Artificial Sequence
  chemically synthesized
atttagcccatttacattta

SEQ ID NO: 245498 - DNA, 20 bp, Artificial Sequence
  chemically synthesized
ctaaccaacatcataattac

SEQ ID NO: 245499 - DNA, 20 bp, Artificial Sequence
  chemically synthesized
actaaccaacatcataatta

SEQ ID NO: 245500 - DNA, 20 bp, Artificial Sequence
  chemically synthesized
tgatcctgtaattatgatgt

SEQ ID NO: 245501 - DNA, 20 bp, Artificial Sequence
  chemically synthesized
cctgtaattatgatgttggt

SEQ ID NO: 245502 - DNA, 20 bp, Artificial Sequence
  chemically synthesized
tggttagttattttgcctgt

SEQ ID NO: 245503 - DNA, 20 bp, Artificial Sequence
  chemically synthesized
agttattttgcctgttagtt

SEQ ID NO: 245504 - DNA, 20 bp, Artificial Sequence
  chemically synthesized
aagaaactgcctcaactaac

SEQ ID NO: 245505 - DNA, 20 bp, Artificial Sequence
  chemically synthesized
gttattttgcctgttagttg

SEQ ID NO: 245506 - DNA, 20 bp, Artificial Sequence
  chemically synthesized
gaagaaactgcctcaactaa

SEQ ID NO: 245507 - DNA, 20 bp, Artificial Sequence
  chemically synthesized
attttgcctgttagttgagg

SEQ ID NO: 245508 - DNA, 20 bp, Artificial Sequence
  chemically synthesized
tagttgaggcagtttcttca

SEQ ID NO: 245509 - DNA, 20 bp, Artificial Sequence
  chemically synthesized
agttgaggcagtttcttcat

SEQ ID NO: 245510 - DNA, 20 bp, Artificial Sequence
  chemically synthesized
gttgaggcagtttcttcata

SEQ ID NO: 245511 - DNA, 20 bp, Artificial Sequence
  chemically synthesized
taaagaccatcgaccctatg

SEQ ID NO: 245512 - DNA, 20 bp, Artificial Sequence
  chemically synthesized
cagtttcttcatagggtcga

SEQ ID NO: 245513 - DNA, 20 bp, Artificial Sequence
  chemically synthesized
ggtcgatggtctttacaatt

SEQ ID NO: 245514 - DNA, 20 bp, Artificial Sequence
  chemically synthesized
gagaaacataccaaattgta

SEQ ID NO: 245515 - DNA, 20 bp, Artificial Sequence
  chemically synthesized
acaatttggtatgtttctct

SEQ ID NO: 245516 - DNA, 20 bp, Artificial Sequence
  chemically synthesized
atttggtatgtttctctcag

SEQ ID NO: 245517 - DNA, 20 bp, Artificial Sequence
  chemically synthesized
aaaccggtaccagccactga

SEQ ID NO: 245518 - DNA, 20 bp, Artificial Sequence
  chemically synthesized
ggtatgtttctctcagtggc

SEQ ID NO: 245519 - DNA, 20 bp, Artificial Sequence
  chemically synthesized
aaaaaccggtaccagccact

SEQ ID NO: 245520 - DNA, 20 bp, Artificial Sequence
  chemically synthesized
tttctctcagtggctggtac

SEQ ID NO: 245521 - DNA, 20 bp, Artificial Sequence
  chemically synthesized
tggaaaggaaaaaccggtac

SEQ ID NO: 245522 - DNA, 20 bp, Artificial Sequence
  chemically synthesized
taaacatggaaaggaaaaac

SEQ ID NO: 245523 - DNA, 20 bp, Artificial Sequence
  chemically synthesized
aggaatcactaaacatggaa

SEQ ID NO: 245524 - DNA, 20 bp, Artificial Sequence
  chemically synthesized
aaggaatcactaaacatgga

SEQ ID NO: 245525 - DNA, 20 bp, Artificial Sequence
  chemically synthesized
cggtttttcctttccatgtt

SEQ ID NO: 245526 - DNA, 20 bp, Artificial Sequence
  chemically synthesized
cctgaaggaatcactaaaca

SEQ ID NO: 245527 - DNA, 20 bp, Artificial Sequence
  chemically synthesized
tccatgtttagtgattcctt

SEQ ID NO: 245528 - DNA, 20 bp, Artificial Sequence
  chemically synthesized
ccatgtttagtgattccttc

SEQ ID NO: 245529 - DNA, 20 bp, Artificial Sequence
  chemically synthesized
atgtttagtgattccttcag

SEQ ID NO: 245530 - DNA, 20 bp, Artificial Sequence
  chemically synthesized
tggcttacaagagctcctga

SEQ ID NO: 245531 - DNA, 20 bp, Artificial Sequence
  chemically synthesized
ctggcttacaagagctcctg

SEQ ID NO: 245532 - DNA, 20 bp, Artificial Sequence
  chemically synthesized
attccttcaggagctcttgt

SEQ ID NO: 245533 - DNA, 20 bp, Artificial Sequence
  chemically synthesized
ccaccaggcctggcttacaa

SEQ ID NO: 245534 - DNA, 20 bp, Artificial Sequence
  chemically synthesized
cttcaggagctcttgtaagc

SEQ ID NO: 245535 - DNA, 20 bp, Artificial Sequence
  chemically synthesized
ttcaggagctcttgtaagcc

SEQ ID NO: 245536 - DNA, 20 bp, Artificial Sequence
  chemically synthesized
caccaccaggcctggcttac

SEQ ID NO: 245537 - DNA, 20 bp, Artificial Sequence
  chemically synthesized
gagctcttgtaagccaggcc

SEQ ID NO: 245538 - DNA, 20 bp, Artificial Sequence
  chemically synthesized
ctcttgtaagccaggcctgg

SEQ ID NO: 245539 - DNA, 20 bp, Artificial Sequence
  chemically synthesized
gattttgtcaccaccaggcc

SEQ ID NO: 245540 - DNA, 20 bp, Artificial Sequence
  chemically synthesized
tgagtgattttgtcaccacc

SEQ ID NO: 245541 - DNA, 20 bp, Artificial Sequence
  chemically synthesized
ctgagtgattttgtcaccac

SEQ ID NO: 245542 - DNA, 20 bp, Artificial Sequence
  chemically synthesized
ctggtggtgacaaaatcact

SEQ ID NO: 245543 - DNA, 20 bp, Artificial Sequence
  chemically synthesized
tttacagacaagcaaatgct

SEQ ID NO: 245544 - DNA, 20 bp, Artificial Sequence
  chemically synthesized
tcagcatttgcttgtctgta

SEQ ID NO: 245545 - DNA, 20 bp, Artificial Sequence
  chemically synthesized
aaataaaatcctttacagac

SEQ ID NO: 245546 - DNA, 20 bp, Artificial Sequence
  chemically synthesized
cagcatttgcttgtctgtaa

SEQ ID NO: 245547 - DNA, 20 bp, Artificial Sequence
  chemically synthesized
aggagaaataaaatccttta

SEQ ID NO: 245548 - DNA, 20 bp, Artificial Sequence
  chemically synthesized
actaagtttcataagcaaag

SEQ ID NO: 245549 - DNA, 20 bp, Artificial Sequence
  chemically synthesized
aaactaagtttcataagcaa

SEQ ID NO: 245550 - DNA, 20 bp, Artificial Sequence
  chemically synthesized
caaactaagtttcataagca

SEQ ID NO: 245551 - DNA, 20 bp, Artificial Sequence
  chemically synthesized
ccagccaaactaagtttcat

SEQ ID NO: 245552 - DNA, 20 bp, Artificial Sequence
  chemically synthesized
tctcctttgcttatgaaact

SEQ ID NO: 245553 - DNA, 20 bp, Artificial Sequence
  chemically synthesized
tttgcttatgaaacttagtt

SEQ ID NO: 245554 - DNA, 20 bp, Artificial Sequence
  chemically synthesized
atttcatatccagccaaact

SEQ ID NO: 245555 - DNA, 20 bp, Artificial Sequence
  chemically synthesized
cttatgaaacttagtttggc

SEQ ID NO: 245556 - DNA, 20 bp, Artificial Sequence
  chemically synthesized
tcaacccagaatttcatatc

SEQ ID NO: 245557 - DNA, 20 bp, Artificial Sequence
  chemically synthesized
tttggctggatatgaaattc

SEQ ID NO: 245558 - DNA, 20 bp, Artificial Sequence
  chemically synthesized
ttggctggatatgaaattct

SEQ ID NO: 245559 - DNA, 20 bp, Artificial Sequence
  chemically synthesized
caataagggaattttcaacc

SEQ ID NO: 245560 - DNA, 20 bp, Artificial Sequence
  chemically synthesized
ggttgaaaattcccttattg

SEQ ID NO: 245561 - DNA, 20 bp, Artificial Sequence
  chemically synthesized
tattcaacactcttcaataa

SEQ ID NO: 245562 - DNA, 20 bp, Artificial Sequence
  chemically synthesized
ttgaaaattcccttattgaa

SEQ ID NO: 245563 - DNA, 20 bp, Artificial Sequence
  chemically synthesized
atattcaacactcttcaata

SEQ ID NO: 245564 - DNA, 20 bp, Artificial Sequence
  chemically synthesized
aatattcaacactcttcaat

SEQ ID NO: 245565 - DNA, 20 bp, Artificial Sequence
  chemically synthesized
tattgaagagtgttgaatat

SEQ ID NO: 245566 - DNA, 20 bp, Artificial Sequence
  chemically synthesized
cctacaagctagaagagagt

SEQ ID NO: 245567 - DNA, 20 bp, Artificial Sequence
  chemically synthesized
ccctacaagctagaagagag

SEQ ID NO: 245568 - DNA, 20 bp, Artificial Sequence
  chemically synthesized
tattggcacccactctcttc

SEQ ID NO: 245569 - DNA, 20 bp, Artificial Sequence
  chemically synthesized
aaaccctacaagctagaaga

SEQ ID NO: 245570 - DNA, 20 bp, Artificial Sequence
  chemically synthesized
agaaaccctacaagctagaa

SEQ ID NO: 245571 - DNA, 20 bp, Artificial Sequence
  chemically synthesized
gcagaaaccctacaagctag

SEQ ID NO: 245572 - DNA, 20 bp, Artificial Sequence
  chemically synthesized
acccactctcttctagcttg

SEQ ID NO: 245573 - DNA, 20 bp, Artificial Sequence
  chemically synthesized
cccactctcttctagcttgt

SEQ ID NO: 245574 - DNA, 20 bp, Artificial Sequence
  chemically synthesized
ccactctcttctagcttgta

SEQ ID NO: 245575 - DNA, 20 bp, Artificial Sequence
  chemically synthesized
tctgcagaaaccctacaagc

SEQ ID NO: 245576 - DNA, 20 bp, Artificial Sequence
  chemically synthesized
tcactctgcagaaaccctac

SEQ ID NO: 245577 - DNA, 20 bp, Artificial Sequence
  chemically synthesized
tctagcttgtagggtttctg

SEQ ID NO: 245578 - DNA, 20 bp, Artificial Sequence
  chemically synthesized
tagcttgtagggtttctgca

SEQ ID NO: 245579 - DNA, 20 bp, Artificial Sequence
  chemically synthesized
actaacagtggatcactctg

SEQ ID NO: 245580 - DNA, 20 bp, Artificial Sequence
  chemically synthesized
tctgcagagtgatccactgt

SEQ ID NO: 245581 - DNA, 20 bp, Artificial Sequence
  chemically synthesized
gaagcccatcagactaacag

SEQ ID NO: 245582 - DNA, 20 bp, Artificial Sequence
  chemically synthesized
agggaagcccatcagactaa

SEQ ID NO: 245583 - DNA, 20 bp, Artificial Sequence
  chemically synthesized
gtgatccactgttagtctga

SEQ ID NO: 245584 - DNA, 20 bp, Artificial Sequence
  chemically synthesized
tgatccactgttagtctgat

SEQ ID NO: 245585 - DNA, 20 bp, Artificial Sequence
  chemically synthesized
acccacaaagggaagcccat

SEQ ID NO: 245586 - DNA, 20 bp, Artificial Sequence
  chemically synthesized
gtctgatgggcttccctttg

SEQ ID NO: 245587 - DNA, 20 bp, Artificial Sequence
  chemically synthesized
gctgggttacccacaaaggg

SEQ ID NO: 245588 - DNA, 20 bp, Artificial Sequence
  chemically synthesized
tctgatgggcttccctttgt

SEQ ID NO: 245589 - DNA, 20 bp, Artificial Sequence
  chemically synthesized
aaggctgggttacccacaaa

SEQ ID NO: 245590 - DNA, 20 bp, Artificial Sequence
  chemically synthesized
aaaggctgggttacccacaa

SEQ ID NO: 245591 - DNA, 20 bp, Artificial Sequence
  chemically synthesized
gaaaggctgggttacccaca

SEQ ID NO: 245592 - DNA, 20 bp, Artificial Sequence
  chemically synthesized
gcttccctttgtgggtaacc

SEQ ID NO: 245593 - DNA, 20 bp, Artificial Sequence
  chemically synthesized
ggcagccagagagaaaggct

SEQ ID NO: 245594 - DNA, 20 bp, Artificial Sequence
  chemically synthesized
gggcagccagagagaaaggc

SEQ ID NO: 245595 - DNA, 20 bp, Artificial Sequence
  chemically synthesized
ggtaacccagcctttctctc

SEQ ID NO: 245596 - DNA, 20 bp, Artificial Sequence
  chemically synthesized
ttaggggcagccagagagaa

SEQ ID NO: 245597 - DNA, 20 bp, Artificial Sequence
  chemically synthesized
gttaggggcagccagagaga

SEQ ID NO: 245598 - DNA, 20 bp, Artificial Sequence
  chemically synthesized
taatgttaggggcagccaga

SEQ ID NO: 245599 - DNA, 20 bp, Artificial Sequence
  chemically synthesized
cgtaatgttaggggcagcca

SEQ ID NO: 245600 - DNA, 20 bp, Artificial Sequence
  chemically synthesized
ctcgtaatgttaggggcagc

SEQ ID NO: 245601 - DNA, 20 bp, Artificial Sequence
  chemically synthesized
gttgctcgtaatgttagggg

SEQ ID NO: 245602 - DNA, 20 bp, Artificial Sequence
  chemically synthesized
gaagttgctcgtaatgttag

SEQ ID NO: 245603 - DNA, 20 bp, Artificial Sequence
  chemically synthesized
tgaagttgctcgtaatgtta

SEQ ID NO: 245604 - DNA, 20 bp, Artificial Sequence
  chemically synthesized
ctgaagttgctcgtaatgtt

SEQ ID NO: 245605 - DNA, 20 bp, Artificial Sequence
  chemically synthesized
ctggctgcccctaacattac

SEQ ID NO: 245606 - DNA, 20 bp, Artificial Sequence
  chemically synthesized
gctgaagttgctcgtaatgt

SEQ ID NO: 245607 - DNA, 20 bp, Artificial Sequence
  chemically synthesized
cctaacattacgagcaactt

SEQ ID NO: 245608 - DNA, 20 bp, Artificial Sequence
  chemically synthesized
cattacgagcaacttcagcc

SEQ ID NO: 245609 - DNA, 20 bp, Artificial Sequence
  chemically synthesized
tgtattctgagacttggctg

SEQ ID NO: 245610 - DNA, 20 bp, Artificial Sequence
  chemically synthesized
gagcaacttcagccaagtct

SEQ ID NO: 245611 - DNA, 20 bp, Artificial Sequence
  chemically synthesized
tgattttgtattctgagact

SEQ ID NO: 245612 - DNA, 20 bp, Artificial Sequence
  chemically synthesized
tcactttgattttgtattct

SEQ ID NO: 245613 - DNA, 20 bp, Artificial Sequence
  chemically synthesized
agtctcagaatacaaaatca

SEQ ID NO: 245614 - DNA, 20 bp, Artificial Sequence
  chemically synthesized
gaatacaaaatcaaagtgaa

SEQ ID NO: 245615 - DNA, 20 bp, Artificial Sequence
  chemically synthesized
aatcaaagtgaaaagatcac

SEQ ID NO: 245616 - DNA, 20 bp, Artificial Sequence
  chemically synthesized
cacaagcattcctatacacc

SEQ ID NO: 245617 - DNA, 20 bp, Artificial Sequence
  chemically synthesized
tttgtctattcttggtgtat

SEQ ID NO: 245618 - DNA, 20 bp, Artificial Sequence
  chemically synthesized
gtttgtctattcttggtgta

SEQ ID NO: 245619 - DNA, 20 bp, Artificial Sequence
  chemically synthesized
gcattcctatacaccaagaa

SEQ ID NO: 245620 - DNA, 20 bp, Artificial Sequence
  chemically synthesized
gctctctgtttgtctattct

SEQ ID NO: 245621 - DNA, 20 bp, Artificial Sequence
  chemically synthesized
atacaccaagaatagacaaa

SEQ ID NO: 245622 - DNA, 20 bp, Artificial Sequence
  chemically synthesized
acaccaagaatagacaaaca

SEQ ID NO: 245623 - DNA, 20 bp, Artificial Sequence
  chemically synthesized
accaagaatagacaaacaga

SEQ ID NO: 245624 - DNA, 20 bp, Artificial Sequence
  chemically synthesized
acaaacagagagccaaatcg

SEQ ID NO: 245625 - DNA, 20 bp, Artificial Sequence
  chemically synthesized
caaacagagagccaaatcgt

SEQ ID NO: 245626 - DNA, 20 bp, Artificial Sequence
  chemically synthesized
ataggagttcacccacgatt

SEQ ID NO: 245627 - DNA, 20 bp, Artificial Sequence
  chemically synthesized
tttgtagcaattgtgaatag

SEQ ID NO: 245628 - DNA, 20 bp, Artificial Sequence
  chemically synthesized
tctttgtagcaattgtgaat

SEQ ID NO: 245629 - DNA, 20 bp, Artificial Sequence
  chemically synthesized
ctctttgtagcaattgtgaa

SEQ ID NO: 245630 - DNA, 20 bp, Artificial Sequence
  chemically synthesized
tcctattcacaattgctaca

SEQ ID NO: 245631 - DNA, 20 bp, Artificial Sequence
  chemically synthesized
ctattcacaattgctacaaa

SEQ ID NO: 245632 - DNA, 20 bp, Artificial Sequence
  chemically synthesized
taggcactttattctctttg

SEQ ID NO: 245633 - DNA, 20 bp, Artificial Sequence
  chemically synthesized
caattgctacaaagagaata

SEQ ID NO: 245634 - DNA, 20 bp, Artificial Sequence
  chemically synthesized
tacaaagagaataaagtgcc

SEQ ID NO: 245635 - DNA, 20 bp, Artificial Sequence
  chemically synthesized
acaaagagaataaagtgcct

SEQ ID NO: 245636 - DNA, 20 bp, Artificial Sequence
  chemically synthesized
cccttgtaagttgtattcct

SEQ ID NO: 245637 - DNA, 20 bp, Artificial Sequence
  chemically synthesized
tcccttgtaagttgtattcc

SEQ ID NO: 245638 - DNA, 20 bp, Artificial Sequence
  chemically synthesized
tgcctaggaatacaacttac

SEQ ID NO: 245639 - DNA, 20 bp, Artificial Sequence
  chemically synthesized
gcctaggaatacaacttaca

SEQ ID NO: 245640 - DNA, 20 bp, Artificial Sequence
  chemically synthesized
cctaggaatacaacttacaa

SEQ ID NO: 245641 - DNA, 20 bp, Artificial Sequence
  chemically synthesized
aggtccttcacatcccttgt

SEQ ID NO: 245642 - DNA, 20 bp, Artificial Sequence
  chemically synthesized
tacaacttacaagggatgtg

SEQ ID NO: 245643 - DNA, 20 bp, Artificial Sequence
  chemically synthesized
acaacttacaagggatgtga

SEQ ID NO: 245644 - DNA, 20 bp, Artificial Sequence
  chemically synthesized
gggatgtgaaggacctcttc

SEQ ID NO: 245645 - DNA, 20 bp, Artificial Sequence
  chemically synthesized
ggatgtgaaggacctcttca

SEQ ID NO: 245646 - DNA, 20 bp, Artificial Sequence
  chemically synthesized
atgtgaaggacctcttcaag

SEQ ID NO: 245647 - DNA, 20 bp, Artificial Sequence
  chemically synthesized
gtttgtagttctccttgaag

SEQ ID NO: 245648 - DNA, 20 bp, Artificial Sequence
  chemically synthesized
ggtttgtagttctccttgaa

SEQ ID NO: 245649 - DNA, 20 bp, Artificial Sequence
  chemically synthesized
gtggtttgtagttctccttg

SEQ ID NO: 245650 - DNA, 20 bp, Artificial Sequence
  chemically synthesized
ttttcttgaacagtggtttg

SEQ ID NO: 245651 - DNA, 20 bp, Artificial Sequence
  chemically synthesized
agaactacaaaccactgttc

SEQ ID NO: 245652 - DNA, 20 bp, Artificial Sequence
  chemically synthesized
tttcgtattttcttgaacag

SEQ ID NO: 245653 - DNA, 20 bp, Artificial Sequence
  chemically synthesized
tcctttcgtattttcttgaa

SEQ ID NO: 245654 - DNA, 20 bp, Artificial Sequence
  chemically synthesized
cactgttcaagaaaatacga

SEQ ID NO: 245655 - DNA, 20 bp, Artificial Sequence
  chemically synthesized
actgttcaagaaaatacgaa

SEQ ID NO: 245656 - DNA, 20 bp, Artificial Sequence
  chemically synthesized
tacgaaaggacgcaaacaaa

SEQ ID NO: 245657 - DNA, 20 bp, Artificial Sequence
  chemically synthesized
gaaaaaacatttcatgctcg

SEQ ID NO: 245658 - DNA, 20 bp, Artificial Sequence
  chemically synthesized
aaacatttcatgctcgtggt

SEQ ID NO: 245659 - DNA, 20 bp, Artificial Sequence
  chemically synthesized
aacatttcatgctcgtggtt

SEQ ID NO: 245660 - DNA, 20 bp, Artificial Sequence
  chemically synthesized
cactgattcttcctaaccac

SEQ ID NO: 245661 - DNA, 20 bp, Artificial Sequence
  chemically synthesized
atttcatgctcgtggttagg

SEQ ID NO: 245662 - DNA, 20 bp, Artificial Sequence
  chemically synthesized
tgctcgtggttaggaagaat

SEQ ID NO: 245663 - DNA, 20 bp, Artificial Sequence
  chemically synthesized
tcgtggttaggaagaatcag

SEQ ID NO: 245664 - DNA, 20 bp, Artificial Sequence
  chemically synthesized
gtggttaggaagaatcagtg

SEQ ID NO: 245665 - DNA, 20 bp, Artificial Sequence
  chemically synthesized
aagaatcagtggagtgaaaa

SEQ ID NO: 245666 - DNA, 20 bp, Artificial Sequence
  chemically synthesized
gtaaattaatttggacagta

SEQ ID NO: 245667 - DNA, 20 bp, Artificial Sequence
  chemically synthesized
aatctgtaaattaatttgga

SEQ ID NO: 245668 - DNA, 20 bp, Artificial Sequence
  chemically synthesized
attgaatctgtaaattaatt

SEQ ID NO: 245669 - DNA, 20 bp, Artificial Sequence
  chemically synthesized
atactgtccaaattaattta

SEQ ID NO: 245670 - DNA, 20 bp, Artificial Sequence
  chemically synthesized
agattcaatgctatccccaa

SEQ ID NO: 245671 - DNA, 20 bp, Artificial Sequence
  chemically synthesized
cagtggtagcctgttgggga

SEQ ID NO: 245672 - DNA, 20 bp, Artificial Sequence
  chemically synthesized
gattcaatgctatccccaac

SEQ ID NO: 245673 - DNA, 20 bp, Artificial Sequence
  chemically synthesized
aagtcagtggtagcctgttg

SEQ ID NO: 245674 - DNA, 20 bp, Artificial Sequence
  chemically synthesized
aaagtcagtggtagcctgtt

SEQ ID NO: 245675 - DNA, 20 bp, Artificial Sequence
  chemically synthesized
gaaagtcagtggtagcctgt

SEQ ID NO: 245676 - DNA, 20 bp, Artificial Sequence
  chemically synthesized
tctgtaaagaaagtcagtgg

SEQ ID NO: 245677 - DNA, 20 bp, Artificial Sequence
  chemically synthesized
aattctgtaaagaaagtcag

SEQ ID NO: 245678 - DNA, 20 bp, Artificial Sequence
  chemically synthesized
cctaattctgtaaagaaagt

SEQ ID NO: 245679 - DNA, 20 bp, Artificial Sequence
  chemically synthesized
gctaccactgactttcttta

SEQ ID NO: 245680 - DNA, 20 bp, Artificial Sequence
  chemically synthesized
ttttcctaattctgtaaaga

SEQ ID NO: 245681 - DNA, 20 bp, Artificial Sequence
  chemically synthesized
taatttttcctaattctgta

SEQ ID NO: 245682 - DNA, 20 bp, Artificial Sequence
  chemically synthesized
actgactttctttacagaat

SEQ ID NO: 245683 - DNA, 20 bp, Artificial Sequence
  chemically synthesized
ctgactttctttacagaatt

SEQ ID NO: 245684 - DNA, 20 bp, Artificial Sequence
  chemically synthesized
ggaaaaattactttacattt

SEQ ID NO: 245685 - DNA, 20 bp, Artificial Sequence
  chemically synthesized
ttggttccatctgaaatgta

SEQ ID NO: 245686 - DNA, 20 bp, Artificial Sequence
  chemically synthesized
aaattactttacatttcaga

SEQ ID NO: 245687 - DNA, 20 bp, Artificial Sequence
  chemically synthesized
catttcagatggaaccaaaa

SEQ ID NO: 245688 - DNA, 20 bp, Artificial Sequence
  chemically synthesized
tttcagatggaaccaaaaaa

SEQ ID NO: 245689 - DNA, 20 bp, Artificial Sequence
  chemically synthesized
tggctatacaagctcttttt

SEQ ID NO: 245690 - DNA, 20 bp, Artificial Sequence
  chemically synthesized
gaaccaaaaaagagcttgta

SEQ ID NO: 245691 - DNA, 20 bp, Artificial Sequence
  chemically synthesized
taggattgtcttggctatac

SEQ ID NO: 245692 - DNA, 20 bp, Artificial Sequence
  chemically synthesized
aaaaaagagcttgtatagcc

SEQ ID NO: 245693 - DNA, 20 bp, Artificial Sequence
  chemically synthesized
cattttacttaggattgtct

SEQ ID NO: 245694 - DNA, 20 bp, Artificial Sequence
  chemically synthesized
tgtatagccaagacaatcct

SEQ ID NO: 245695 - DNA, 20 bp, Artificial Sequence
  chemically synthesized
cagctttgttcattttactt

SEQ ID NO: 245696 - DNA, 20 bp, Artificial Sequence
  chemically synthesized
ccagctttgttcattttact

SEQ ID NO: 245697 - DNA, 20 bp, Artificial Sequence
  chemically synthesized
aatcctaagtaaaatgaaca

SEQ ID NO: 245698 - DNA, 20 bp, Artificial Sequence
  chemically synthesized
ctaagtaaaatgaacaaagc

SEQ ID NO: 245699 - DNA, 20 bp, Artificial Sequence
  chemically synthesized
aagtaaaatgaacaaagctg

SEQ ID NO: 245700 - DNA, 20 bp, Artificial Sequence
  chemically synthesized
agtaaaatgaacaaagctgg

SEQ ID NO: 245701 - DNA, 20 bp, Artificial Sequence
  chemically synthesized
gtcaggtagcatgatgcctc

SEQ ID NO: 245702 - DNA, 20 bp, Artificial Sequence
  chemically synthesized
tagtatagtttgaagtcagg

SEQ ID NO: 245703 - DNA, 20 bp, Artificial Sequence
  chemically synthesized
ttgtagtatagtttgaagtc

SEQ ID NO: 245704 - DNA, 20 bp, Artificial Sequence
  chemically synthesized
cttgtagtatagtttgaagt

SEQ ID NO: 245705 - DNA, 20 bp, Artificial Sequence
  chemically synthesized
tagccttgtagtatagtttg

SEQ ID NO: 245706 - DNA, 20 bp, Artificial Sequence
  chemically synthesized
ctgacttcaaactatactac

SEQ ID NO: 245707 - DNA, 20 bp, Artificial Sequence
  chemically synthesized
tgacttcaaactatactaca

SEQ ID NO: 245708 - DNA, 20 bp, Artificial Sequence
  chemically synthesized
cttactgtagccttgtagta

SEQ ID NO: 245709 - DNA, 20 bp, Artificial Sequence
  chemically synthesized
ttttgcttactgtagccttg

SEQ ID NO: 245710 - DNA, 20 bp, Artificial Sequence
  chemically synthesized
caaactatactacaaggcta

SEQ ID NO: 245711 - DNA, 20 bp, Artificial Sequence
  chemically synthesized
ctatactacaaggctacagt

SEQ ID NO: 245712 - DNA, 20 bp, Artificial Sequence
  chemically synthesized
ccagtctgttttgcttactg

SEQ ID NO: 245713 - DNA, 20 bp, Artificial Sequence
  chemically synthesized
caaggctacagtaagcaaaa

SEQ ID NO: 245714 - DNA, 20 bp, Artificial Sequence
  chemically synthesized
ctacagtaagcaaaacagac

SEQ ID NO: 245715 - DNA, 20 bp, Artificial Sequence
  chemically synthesized
taagcaaaacagactggtac

SEQ ID NO: 245716 - DNA, 20 bp, Artificial Sequence
  chemically synthesized
gcaaaacagactggtactgg

SEQ ID NO: 245717 - DNA, 20 bp, Artificial Sequence
  chemically synthesized
atctgttttgctaccagtac

SEQ ID NO: 245718 - DNA, 20 bp, Artificial Sequence
  chemically synthesized
ctatatatctgttttgctac

SEQ ID NO: 245719 - DNA, 20 bp, Artificial Sequence
  chemically synthesized
gactggtactggtagcaaaa

SEQ ID NO: 245720 - DNA, 20 bp, Artificial Sequence
  chemically synthesized
ctggtagcaaaacagatata

SEQ ID NO: 245721 - DNA, 20 bp, Artificial Sequence
  chemically synthesized
aaaacagatatatagaccaa

SEQ ID NO: 245722 - DNA, 20 bp, Artificial Sequence
  chemically synthesized
agatatatagaccaatggaa

SEQ ID NO: 245723 - DNA, 20 bp, Artificial Sequence
  chemically synthesized
tggcctctgttctgttccat

SEQ ID NO: 245724 - DNA, 20 bp, Artificial Sequence
  chemically synthesized
tatagaccaatggaacagaa

SEQ ID NO: 245725 - DNA, 20 bp, Artificial Sequence
  chemically synthesized
tagaccaatggaacagaaca

SEQ ID NO: 245726 - DNA, 20 bp, Artificial Sequence
  chemically synthesized
agaccaatggaacagaacag

SEQ ID NO: 245727 - DNA, 20 bp, Artificial Sequence
  chemically synthesized
caatggaacagaacagaggc

SEQ ID NO: 245728 - DNA, 20 bp, Artificial Sequence
  chemically synthesized
gatgtgtggcattatttttc

SEQ ID NO: 245729 - DNA, 20 bp, Artificial Sequence
  chemically synthesized
atcagatggttgtagatgtg

SEQ ID NO: 245730 - DNA, 20 bp, Artificial Sequence
  chemically synthesized
tgtcaaagatcagatggttg

SEQ ID NO: 245731 - DNA, 20 bp, Artificial Sequence
  chemically synthesized
caggtttgtcaaagatcaga

SEQ ID NO: 245732 - DNA, 20 bp, Artificial Sequence
  chemically synthesized
ttgtcaggtttgtcaaagat

SEQ ID NO: 245733 - DNA, 20 bp, Artificial Sequence
  chemically synthesized
tgtttttgtcaggtttgtca

SEQ ID NO: 245734 - DNA, 20 bp, Artificial Sequence
  chemically synthesized
ccccgttgcttgtttttgtc

SEQ ID NO: 245735 - DNA, 20 bp, Artificial Sequence
  chemically synthesized
tccccgttgcttgtttttgt

SEQ ID NO: 245736 - DNA, 20 bp, Artificial Sequence
  chemically synthesized
ttgacaaacctgacaaaaac

SEQ ID NO: 245737 - DNA, 20 bp, Artificial Sequence
  chemically synthesized
aacctgacaaaaacaagcaa

SEQ ID NO: 245738 - DNA, 20 bp, Artificial Sequence
  chemically synthesized
acctgacaaaaacaagcaac

SEQ ID NO: 245739 - DNA, 20 bp, Artificial Sequence
  chemically synthesized
cctgacaaaaacaagcaacg

SEQ ID NO: 245740 - DNA, 20 bp, Artificial Sequence
  chemically synthesized
acaaaaacaagcaacgggga

SEQ ID NO: 245741 - DNA, 20 bp, Artificial Sequence
  chemically synthesized
caaaaacaagcaacggggaa

SEQ ID NO: 245742 - DNA, 20 bp, Artificial Sequence
  chemically synthesized
ccaacaccatttattaaata

SEQ ID NO: 245743 - DNA, 20 bp, Artificial Sequence
  chemically synthesized
cccaacaccatttattaaat

SEQ ID NO: 245744 - DNA, 20 bp, Artificial Sequence
  chemically synthesized
tcccaacaccatttattaaa

SEQ ID NO: 245745 - DNA, 20 bp, Artificial Sequence
  chemically synthesized
aggattccctatttaataaa

SEQ ID NO: 245746 - DNA, 20 bp, Artificial Sequence
  chemically synthesized
ccctatttaataaatggtgt

SEQ ID NO: 245747 - DNA, 20 bp, Artificial Sequence
  chemically synthesized
cctatttaataaatggtgtt

SEQ ID NO: 245748 - DNA, 20 bp, Artificial Sequence
  chemically synthesized
ataaatggtgttgggaaaac

SEQ ID NO: 245749 - DNA, 20 bp, Artificial Sequence
  chemically synthesized
atggtgttgggaaaactggc

SEQ ID NO: 245750 - DNA, 20 bp, Artificial Sequence
  chemically synthesized
gttttctgcatatgactagc

SEQ ID NO: 245751 - DNA, 20 bp, Artificial Sequence
  chemically synthesized
ttccgttttctgcatatgac

SEQ ID NO: 245752 - DNA, 20 bp, Artificial Sequence
  chemically synthesized
gaaaactggctagtcatatg

SEQ ID NO: 245753 - DNA, 20 bp, Artificial Sequence
  chemically synthesized
ggctagtcatatgcagaaaa

SEQ ID NO: 245754 - DNA, 20 bp, Artificial Sequence
  chemically synthesized
catatgcagaaaacggaaac

SEQ ID NO: 245755 - DNA, 20 bp, Artificial Sequence
  chemically synthesized
taaggggtaaggaaggggtc

SEQ ID NO: 245756 - DNA, 20 bp, Artificial Sequence
  chemically synthesized
ttgtataaggggtaaggaag

SEQ ID NO: 245757 - DNA, 20 bp, Artificial Sequence
  chemically synthesized
tttgtataaggggtaaggaa

SEQ ID NO: 245758 - DNA, 20 bp, Artificial Sequence
  chemically synthesized
ttttgtataaggggtaagga

SEQ ID NO: 245759 - DNA, 20 bp, Artificial Sequence
  chemically synthesized
tttttgtataaggggtaagg

SEQ ID NO: 245760 - DNA, 20 bp, Artificial Sequence
  chemically synthesized
tgatttttgtataaggggta

SEQ ID NO: 245761 - DNA, 20 bp, Artificial Sequence
  chemically synthesized
ttgatttttgtataaggggt

SEQ ID NO: 245762 - DNA, 20 bp, Artificial Sequence
  chemically synthesized
tgagttgatttttgtataag

SEQ ID NO: 245763 - DNA, 20 bp, Artificial Sequence
  chemically synthesized
ttgagttgatttttgtataa

SEQ ID NO: 245764 - DNA, 20 bp, Artificial Sequence
  chemically synthesized
cttgagttgatttttgtata

SEQ ID NO: 245765 - DNA, 20 bp, Artificial Sequence
  chemically synthesized
tcttgagttgatttttgtat

SEQ ID NO: 245766 - DNA, 20 bp, Artificial Sequence
  chemically synthesized
ccttatacaaaaatcaactc

SEQ ID NO: 245767 - DNA, 20 bp, Artificial Sequence
  chemically synthesized
ttaagtctttaatgcatctt

SEQ ID NO: 245768 - DNA, 20 bp, Artificial Sequence
  chemically synthesized
aatcaactcaagatgcatta

SEQ ID NO: 245769 - DNA, 20 bp, Artificial Sequence
  chemically synthesized
tggttttcggttttaggttt

SEQ ID NO: 245770 - DNA, 20 bp, Artificial Sequence
  chemically synthesized
ttttgatggttttcggtttt

SEQ ID NO: 245771 - DNA, 20 bp, Artificial Sequence
  chemically synthesized
gttttgatggttttcggttt

SEQ ID NO: 245772 - DNA, 20 bp, Artificial Sequence
  chemically synthesized
tctagggttttgatggtttt

SEQ ID NO: 245773 - DNA, 20 bp, Artificial Sequence
  chemically synthesized
gttttcttctagggttttga

SEQ ID NO: 245774 - DNA, 20 bp, Artificial Sequence
  chemically synthesized
accgaaaaccatcaaaaccc

SEQ ID NO: 245775 - DNA, 20 bp, Artificial Sequence
  chemically synthesized
gaaaaccatcaaaaccctag

SEQ ID NO: 245776 - DNA, 20 bp, Artificial Sequence
  chemically synthesized
attgcctaggttttcttcta

SEQ ID NO: 245777 - DNA, 20 bp, Artificial Sequence
  chemically synthesized
tattgcctaggttttcttct

SEQ ID NO: 245778 - DNA, 20 bp, Artificial Sequence
  chemically synthesized
gtattgcctaggttttcttc

SEQ ID NO: 245779 - DNA, 20 bp, Artificial Sequence
  chemically synthesized
caaaaccctagaagaaaacc

SEQ ID NO: 245780 - DNA, 20 bp, Artificial Sequence
  chemically synthesized
aaaaccctagaagaaaacct

SEQ ID NO: 245781 - DNA, 20 bp, Artificial Sequence
  chemically synthesized
tgtcctgaatggtattgcct

SEQ ID NO: 245782 - DNA, 20 bp, Artificial Sequence
  chemically synthesized
gtgtcctgaatggtattgcc

SEQ ID NO: 245783 - DNA, 20 bp, Artificial Sequence
  chemically synthesized
aaaacctaggcaataccatt

SEQ ID NO: 245784 - DNA, 20 bp, Artificial Sequence
  chemically synthesized
aaacctaggcaataccattc

SEQ ID NO: 245785 - DNA, 20 bp, Artificial Sequence
  chemically synthesized
ccccgtacttgtgtcctgaa

SEQ ID NO: 245786 - DNA, 20 bp, Artificial Sequence
  chemically synthesized
ggcaataccattcaggacac

SEQ ID NO: 245787 - DNA, 20 bp, Artificial Sequence
  chemically synthesized
taccattcaggacacaagta

SEQ ID NO: 245788 - DNA, 20 bp, Artificial Sequence
  chemically synthesized
accattcaggacacaagtac

SEQ ID NO: 245789 - DNA, 20 bp, Artificial Sequence
  chemically synthesized
ccattcaggacacaagtacg

SEQ ID NO: 245790 - DNA, 20 bp, Artificial Sequence
  chemically synthesized
tcaggacacaagtacgggga

SEQ ID NO: 245791 - DNA, 20 bp, Artificial Sequence
  chemically synthesized
cttttggtgttttagtcatg

SEQ ID NO: 245792 - DNA, 20 bp, Artificial Sequence
  chemically synthesized
tgctgttgcttttggtgttt

SEQ ID NO: 245793 - DNA, 20 bp, Artificial Sequence
  chemically synthesized
ctgcatgactaaaacaccaa

SEQ ID NO: 245794 - DNA, 20 bp, Artificial Sequence
  chemically synthesized
gactaaaacaccaaaagcaa

SEQ ID NO: 245795 - DNA, 20 bp, Artificial Sequence
  chemically synthesized
gcttttgttgctgttgcttt

SEQ ID NO: 245796 - DNA, 20 bp, Artificial Sequence
  chemically synthesized
accaaaagcaacagcaacaa

SEQ ID NO: 245797 - DNA, 20 bp, Artificial Sequence
  chemically synthesized
tagatcccatttgtcaattt

SEQ ID NO: 245798 - DNA, 20 bp, Artificial Sequence
  chemically synthesized
caaaagccaaaattgacaaa

SEQ ID NO: 245799 - DNA, 20 bp, Artificial Sequence
  chemically synthesized
aaaagccaaaattgacaaat

SEQ ID NO: 245800 - DNA, 20 bp, Artificial Sequence
  chemically synthesized
tagaagctctttagtttcat

SEQ ID NO: 245801 - DNA, 20 bp, Artificial Sequence
  chemically synthesized
aatgggatctaatgaaacta

SEQ ID NO: 245802 - DNA, 20 bp, Artificial Sequence
  chemically synthesized
tgggatctaatgaaactaaa

SEQ ID NO: 245803 - DNA, 20 bp, Artificial Sequence
  chemically synthesized
tttgcagtgtagaagctctt

SEQ ID NO: 245804 - DNA, 20 bp, Artificial Sequence
  chemically synthesized
tagtttcttttgcagtgtag

SEQ ID NO: 245805 - DNA, 20 bp, Artificial Sequence
  chemically synthesized
tgatagtttcttttgcagtg

SEQ ID NO: 245806 - DNA, 20 bp, Artificial Sequence
  chemically synthesized
aaagagcttctacactgcaa

SEQ ID NO: 245807 - DNA, 20 bp, Artificial Sequence
  chemically synthesized
tctcatgatagtttcttttg

SEQ ID NO: 245808 - DNA, 20 bp, Artificial Sequence
  chemically synthesized
actgcaaaagaaactatcat

SEQ ID NO: 245809 - DNA, 20 bp, Artificial Sequence
  chemically synthesized
tgcaaaagaaactatcatga

SEQ ID NO: 245810 - DNA, 20 bp, Artificial Sequence
  chemically synthesized
ttgcctgttcactctcatga

SEQ ID NO: 245811 - DNA, 20 bp, Artificial Sequence
  chemically synthesized
gaaactatcatgagagtgaa

SEQ ID NO: 245812 - DNA, 20 bp, Artificial Sequence
  chemically synthesized
aaactatcatgagagtgaac

SEQ ID NO: 245813 - DNA, 20 bp, Artificial Sequence
  chemically synthesized
gagagtgaacaggcaaacta

SEQ ID NO: 245814 - DNA, 20 bp, Artificial Sequence
  chemically synthesized
tgaacaggcaaactacagat

SEQ ID NO: 245815 - DNA, 20 bp, Artificial Sequence
  chemically synthesized
gaacaggcaaactacagatt

SEQ ID NO: 245816 - DNA, 20 bp, Artificial Sequence
  chemically synthesized
aaaaattttctcccaatctg

SEQ ID NO: 245817 - DNA, 20 bp, Artificial Sequence
  chemically synthesized
acaggcaaactacagattgg

SEQ ID NO: 245818 - DNA, 20 bp, Artificial Sequence
  chemically synthesized
ttagccctttgtcagatgta

SEQ ID NO: 245819 - DNA, 20 bp, Artificial Sequence
  chemically synthesized
tgcaatctatacatctgaca

SEQ ID NO: 245820 - DNA, 20 bp, Artificial Sequence
  chemically synthesized
gcaatctatacatctgacaa

SEQ ID NO: 245821 - DNA, 20 bp, Artificial Sequence
  chemically synthesized
caatctatacatctgacaaa

SEQ ID NO: 245822 - DNA, 20 bp, Artificial Sequence
  chemically synthesized
tccgggtattagccctttgt

SEQ ID NO: 245823 - DNA, 20 bp, Artificial Sequence
  chemically synthesized
tctgacaaagggctaatacc

SEQ ID NO: 245824 - DNA, 20 bp, Artificial Sequence
  chemically synthesized
tccttatagattccgggtat

SEQ ID NO: 245825 - DNA, 20 bp, Artificial Sequence
  chemically synthesized
ttaagttccttatagattcc

SEQ ID NO: 245826 - DNA, 20 bp, Artificial Sequence
  chemically synthesized
tttaagttccttatagattc

SEQ ID NO: 245827 - DNA, 20 bp, Artificial Sequence
  chemically synthesized
ggctaatacccggaatctat

SEQ ID NO: 245828 - DNA, 20 bp, Artificial Sequence
  chemically synthesized
gctaatacccggaatctata

SEQ ID NO: 245829 - DNA, 20 bp, Artificial Sequence
  chemically synthesized
aaatttgtttaagttcctta

SEQ ID NO: 245830 - DNA, 20 bp, Artificial Sequence
  chemically synthesized
tttttcttgtaaatttgttt

SEQ ID NO: 245831 - DNA, 20 bp, Artificial Sequence
  chemically synthesized
aggaacttaaacaaatttac

SEQ ID NO: 245832 - DNA, 20 bp, Artificial Sequence
  chemically synthesized
caagaaaaaaaaaaacccat

SEQ ID NO: 245833 - DNA, 20 bp, Artificial Sequence
  chemically synthesized
aaaaaaaaaaacccatcaga

SEQ ID NO: 245834 - DNA, 20 bp, Artificial Sequence
  chemically synthesized
tccttagcccactttctgat

SEQ ID NO: 245835 - DNA, 20 bp, Artificial Sequence
  chemically synthesized
atccttagcccactttctga

SEQ ID NO: 245836 - DNA, 20 bp, Artificial Sequence
  chemically synthesized
aaaaaaaacccatcagaaag

SEQ ID NO: 245837 - DNA, 20 bp, Artificial Sequence
  chemically synthesized
aaaaaaacccatcagaaagt

SEQ ID NO: 245838 - DNA, 20 bp, Artificial Sequence
  chemically synthesized
aacccatcagaaagtgggct

SEQ ID NO: 245839 - DNA, 20 bp, Artificial Sequence
  chemically synthesized
acccatcagaaagtgggcta

SEQ ID NO: 245840 - DNA, 20 bp, Artificial Sequence
  chemically synthesized
gaagtgtctgttcatatcct

SEQ ID NO: 245841 - DNA, 20 bp, Artificial Sequence
  chemically synthesized
aagtgggctaaggatatgaa

SEQ ID NO: 245842 - DNA, 20 bp, Artificial Sequence
  chemically synthesized
cataaatgtcttgttttgag

SEQ ID NO: 245843 - DNA, 20 bp, Artificial Sequence
  chemically synthesized
gaacagacacttctcaaaac

SEQ ID NO: 245844 - DNA, 20 bp, Artificial Sequence
  chemically synthesized
ctgcataaatgtcttgtttt

SEQ ID NO: 245845 - DNA, 20 bp, Artificial Sequence
  chemically synthesized
ctcaaaacaagacatttatg

SEQ ID NO: 245846 - DNA, 20 bp, Artificial Sequence
  chemically synthesized
aaacaagacatttatgcagc

SEQ ID NO: 245847 - DNA, 20 bp, Artificial Sequence
  chemically synthesized
gctttttttgatatgtttgc

SEQ ID NO: 245848 - DNA, 20 bp, Artificial Sequence
  chemically synthesized
gccagcaaacatatcaaaaa

SEQ ID NO: 245849 - DNA, 20 bp, Artificial Sequence
  chemically synthesized
ctctaatgaccagtgataat

SEQ ID NO: 245850 - DNA, 20 bp, Artificial Sequence
  chemically synthesized
caaaaaaagctcattatcac

SEQ ID NO: 245851 - DNA, 20 bp, Artificial Sequence
  chemically synthesized
agctcattatcactggtcat

SEQ ID NO: 245852 - DNA, 20 bp, Artificial Sequence
  chemically synthesized
ctcattatcactggtcatta

SEQ ID NO: 245853 - DNA, 20 bp, Artificial Sequence
  chemically synthesized
atttgcattcctctaatgac

SEQ ID NO: 245854 - DNA, 20 bp, Artificial Sequence
  chemically synthesized
tcattatcactggtcattag

SEQ ID NO: 245855 - DNA, 20 bp, Artificial Sequence
  chemically synthesized
atgcaaatcaaaaccacaat

SEQ ID NO: 245856 - DNA, 20 bp, Artificial Sequence
  chemically synthesized
tgtgagatggtatctcattg

SEQ ID NO: 245857 - DNA, 20 bp, Artificial Sequence
  chemically synthesized
ccattctaactggtgtgaga

SEQ ID NO: 245858 - DNA, 20 bp, Artificial Sequence
  chemically synthesized
aatgagataccatctcacac

SEQ ID NO: 245859 - DNA, 20 bp, Artificial Sequence
  chemically synthesized
ttcgccattctaactggtgt

SEQ ID NO: 245860 - DNA, 20 bp, Artificial Sequence
  chemically synthesized
agataccatctcacaccagt

SEQ ID NO: 245861 - DNA, 20 bp, Artificial Sequence
  chemically synthesized
ccatctcacaccagttagaa

SEQ ID NO: 245862 - DNA, 20 bp, Artificial Sequence
  chemically synthesized
tgaatgttcgccattctaac

SEQ ID NO: 245863 - DNA, 20 bp, Artificial Sequence
  chemically synthesized
ttagaatggcgaacattcaa

SEQ ID NO: 245864 - DNA, 20 bp, Artificial Sequence
  chemically synthesized
aatggcgaacattcaaaagt

SEQ ID NO: 245865 - DNA, 20 bp, Artificial Sequence
  chemically synthesized
atggcgaacattcaaaagtc

SEQ ID NO: 245866 - DNA, 20 bp, Artificial Sequence
  chemically synthesized
attcaaaagtcaggcaacaa

SEQ ID NO: 245867 - DNA, 20 bp, Artificial Sequence
  chemically synthesized
agtcaggcaacaacagatgc

SEQ ID NO: 245868 - DNA, 20 bp, Artificial Sequence
  chemically synthesized
tcaggcaacaacagatgctg

SEQ ID NO: 245869 - DNA, 20 bp, Artificial Sequence
  chemically synthesized
aggcaacaacagatgctgga

SEQ ID NO: 245870 - DNA, 20 bp, Artificial Sequence
  chemically synthesized
ggcaacaacagatgctggag

SEQ ID NO: 245871 - DNA, 20 bp, Artificial Sequence
  chemically synthesized
ctttttctccacatcctctc

SEQ ID NO: 245872 - DNA, 20 bp, Artificial Sequence
  chemically synthesized
aacagatgctggagaggatg

SEQ ID NO: 245873 - DNA, 20 bp, Artificial Sequence
  chemically synthesized
cagatgctggagaggatgtg

SEQ ID NO: 245874 - DNA, 20 bp, Artificial Sequence
  chemically synthesized
ctggagaggatgtggagaaa

SEQ ID NO: 245875 - DNA, 20 bp, Artificial Sequence
  chemically synthesized
tggagaggatgtggagaaaa

SEQ ID NO: 245876 - DNA, 20 bp, Artificial Sequence
  chemically synthesized
cagtcccaccaacagtgtaa

SEQ ID NO: 245877 - DNA, 20 bp, Artificial Sequence
  chemically synthesized
aaggaacgcttttacactgt

SEQ ID NO: 245878 - DNA, 20 bp, Artificial Sequence
  chemically synthesized
gaacgcttttacactgttgg

SEQ ID NO: 245879 - DNA, 20 bp, Artificial Sequence
  chemically synthesized
aacgcttttacactgttggt

SEQ ID NO: 245880 - DNA, 20 bp, Artificial Sequence
  chemically synthesized
ctagtttacagtcccaccaa

SEQ ID NO: 245881 - DNA, 20 bp, Artificial Sequence
  chemically synthesized
ctgttggtgggactgtaaac

SEQ ID NO: 245882 - DNA, 20 bp, Artificial Sequence
  chemically synthesized
acaatggttgaactagttta

SEQ ID NO: 245883 - DNA, 20 bp, Artificial Sequence
  chemically synthesized
gtcttccacaatggttgaac

SEQ ID NO: 245884 - DNA, 20 bp, Artificial Sequence
  chemically synthesized
gtaaactagttcaaccattg

SEQ ID NO: 245885 - DNA, 20 bp, Artificial Sequence
  chemically synthesized
aactagttcaaccattgtgg

SEQ ID NO: 245886 - DNA, 20 bp, Artificial Sequence
  chemically synthesized
cgccacactgtcttccacaa

SEQ ID NO: 245887 - DNA, 20 bp, Artificial Sequence
  chemically synthesized
agttcaaccattgtggaaga

SEQ ID NO: 245888 - DNA, 20 bp, Artificial Sequence
  chemically synthesized
aaccattgtggaagacagtg

SEQ ID NO: 245889 - DNA, 20 bp, Artificial Sequence
  chemically synthesized
agacagtgtggcgattcctc

SEQ ID NO: 245890 - DNA, 20 bp, Artificial Sequence
  chemically synthesized
gacagtgtggcgattcctca

SEQ ID NO: 245891 - DNA, 20 bp, Artificial Sequence
  chemically synthesized
tttctggttctgtatccttg

SEQ ID NO: 245892 - DNA, 20 bp, Artificial Sequence
  chemically synthesized
gtggcgattcctcaaggata

SEQ ID NO: 245893 - DNA, 20 bp, Artificial Sequence
  chemically synthesized
atttctggttctgtatcctt

SEQ ID NO: 245894 - DNA, 20 bp, Artificial Sequence
  chemically synthesized
attcctcaaggatacagaac

SEQ ID NO: 245895 - DNA, 20 bp, Artificial Sequence
  chemically synthesized
gctgggtcaaatggtatttc

SEQ ID NO: 245896 - DNA, 20 bp, Artificial Sequence
  chemically synthesized
accagaaataccatttgacc

SEQ ID NO: 245897 - DNA, 20 bp, Artificial Sequence
  chemically synthesized
aatgggattgctgggtcaaa

SEQ ID NO: 245898 - DNA, 20 bp, Artificial Sequence
  chemically synthesized
tatgcagtaatgggattgct

SEQ ID NO: 245899 - DNA, 20 bp, Artificial Sequence
  chemically synthesized
atatgcagtaatgggattgc

SEQ ID NO: 245900 - DNA, 20 bp, Artificial Sequence
  chemically synthesized
ttgggtatatatgcagtaat

SEQ ID NO: 245901 - DNA, 20 bp, Artificial Sequence
  chemically synthesized
tttgggtatatatgcagtaa

SEQ ID NO: 245902 - DNA, 20 bp, Artificial Sequence
  chemically synthesized
taatactttgggtatatatg

SEQ ID NO: 245903 - DNA, 20 bp, Artificial Sequence
  chemically synthesized
cattactgcatatataccca

SEQ ID NO: 245904 - DNA, 20 bp, Artificial Sequence
  chemically synthesized
agaatgatttataatacttt

SEQ ID NO: 245905 - DNA, 20 bp, Artificial Sequence
  chemically synthesized
gagaatgatttataatactt

SEQ ID NO: 245906 - DNA, 20 bp, Artificial Sequence
  chemically synthesized
ttataaatcattctcctata

SEQ ID NO: 245907 - DNA, 20 bp, Artificial Sequence
  chemically synthesized
gtgtgcatgtgtctttatag

SEQ ID NO: 245908 - DNA, 20 bp, Artificial Sequence
  chemically synthesized
acgtgtgcatgtgtctttat

SEQ ID NO: 245909 - DNA, 20 bp, Artificial Sequence
  chemically synthesized
tacgtgtgcatgtgtcttta

SEQ ID NO: 245910 - DNA, 20 bp, Artificial Sequence
  chemically synthesized
atgcacacgtatgtttattg

SEQ ID NO: 245911 - DNA, 20 bp, Artificial Sequence
  chemically synthesized
tattgcagcactatttacaa

SEQ ID NO: 245912 - DNA, 20 bp, Artificial Sequence
  chemically synthesized
caagtctttgctattgtaaa

SEQ ID NO: 245913 - DNA, 20 bp, Artificial Sequence
  chemically synthesized
cagcactatttacaatagca

SEQ ID NO: 245914 - DNA, 20 bp, Artificial Sequence
  chemically synthesized
tatttacaatagcaaagact

SEQ ID NO: 245915 - DNA, 20 bp, Artificial Sequence
  chemically synthesized
tgggcatttgggttggttcc

SEQ ID NO: 245916 - DNA, 20 bp, Artificial Sequence
  chemically synthesized
tcattgatgggcatttgggt

SEQ ID NO: 245917 - DNA, 20 bp, Artificial Sequence
  chemically synthesized
tctatcattgatgggcattt

SEQ ID NO: 245918 - DNA, 20 bp, Artificial Sequence
  chemically synthesized
gtctatcattgatgggcatt

SEQ ID NO: 245919 - DNA, 20 bp, Artificial Sequence
  chemically synthesized
ttatccagtctatcattgat

SEQ ID NO: 245920 - DNA, 20 bp, Artificial Sequence
  chemically synthesized
acccaaatgcccatcaatga

SEQ ID NO: 245921 - DNA, 20 bp, Artificial Sequence
  chemically synthesized
tttatccagtctatcattga

SEQ ID NO: 245922 - DNA, 20 bp, Artificial Sequence
  chemically synthesized
aatgcccatcaatgatagac

SEQ ID NO: 245923 - DNA, 20 bp, Artificial Sequence
  chemically synthesized
catcaatgatagactggata

SEQ ID NO: 245924 - DNA, 20 bp, Artificial Sequence
  chemically synthesized
atgtgccaattttctttatc

SEQ ID NO: 245925 - DNA, 20 bp, Artificial Sequence
  chemically synthesized
atagactggataaagaaaat

SEQ ID NO: 245926 - DNA, 20 bp, Artificial Sequence
  chemically synthesized
aaattggcacatatacacca

SEQ ID NO: 245927 - DNA, 20 bp, Artificial Sequence
  chemically synthesized
tatggctgcatagtattcca

SEQ ID NO: 245928 - DNA, 20 bp, Artificial Sequence
  chemically synthesized
atacaccatggaatactatg

SEQ ID NO: 245929 - DNA, 20 bp, Artificial Sequence
  chemically synthesized
cattcttttttatggctgca

SEQ ID NO: 245930 - DNA, 20 bp, Artificial Sequence
  chemically synthesized
aatactatgcagccataaaa

SEQ ID NO: 245931 - DNA, 20 bp, Artificial Sequence
  chemically synthesized
catgaactcattctttttta

SEQ ID NO: 245932 - DNA, 20 bp, Artificial Sequence
  chemically synthesized
atgcagccataaaaaagaat

SEQ ID NO: 245933 - DNA, 20 bp, Artificial Sequence
  chemically synthesized
atgagttcatgtcctttgca

SEQ ID NO: 245934 - DNA, 20 bp, Artificial Sequence
  chemically synthesized
cttcatccatgtccgtgcaa

SEQ ID NO: 245935 - DNA, 20 bp, Artificial Sequence
  chemically synthesized
gcttcatccatgtccgtgca

SEQ ID NO: 245936 - DNA, 20 bp, Artificial Sequence
  chemically synthesized
tcatgtcctttgcacggaca

SEQ ID NO: 245937 - DNA, 20 bp, Artificial Sequence
  chemically synthesized
cctttgcacggacatggatg

SEQ ID NO: 245938 - DNA, 20 bp, Artificial Sequence
  chemically synthesized
tgcacggacatggatgaagc

SEQ ID NO: 245939 - DNA, 20 bp, Artificial Sequence
  chemically synthesized
ttgctgagaatgatggtttc

SEQ ID NO: 245940 - DNA, 20 bp, Artificial Sequence
  chemically synthesized
aagctggaaaccatcattct

SEQ ID NO: 245941 - DNA, 20 bp, Artificial Sequence
  chemically synthesized
tgttagtttgctgagaatga

SEQ ID NO: 245942 - DNA, 20 bp, Artificial Sequence
  chemically synthesized
tgttcctgtgttagtttgct

SEQ ID NO: 245943 - DNA, 20 bp, Artificial Sequence
  chemically synthesized
tcattctcagcaaactaaca

SEQ ID NO: 245944 - DNA, 20 bp, Artificial Sequence
  chemically synthesized
cattctcagcaaactaacac

SEQ ID NO: 245945 - DNA, 20 bp, Artificial Sequence
  chemically synthesized
ttggttttctgttcctgtgt

SEQ ID NO: 245946 - DNA, 20 bp, Artificial Sequence
  chemically synthesized
tcagcaaactaacacaggaa

SEQ ID NO: 245947 - DNA, 20 bp, Artificial Sequence
  chemically synthesized
gggtgagaatatgtggtgtt

SEQ ID NO: 245948 - DNA, 20 bp, Artificial Sequence
  chemically synthesized
cacttatgggtgagaatatg

SEQ ID NO: 245949 - DNA, 20 bp, Artificial Sequence
  chemically synthesized
caccacatattctcacccat

SEQ ID NO: 245950 - DNA, 20 bp, Artificial Sequence
  chemically synthesized
ttcaactcccacttatgggt

SEQ ID NO: 245951 - DNA, 20 bp, Artificial Sequence
  chemically synthesized
cacatattctcacccataag

SEQ ID NO: 245952 - DNA, 20 bp, Artificial Sequence
  chemically synthesized
acatattctcacccataagt

SEQ ID NO: 245953 - DNA, 20 bp, Artificial Sequence
  chemically synthesized
atcgttcaactcccacttat

SEQ ID NO: 245954 - DNA, 20 bp, Artificial Sequence
  chemically synthesized
atattctcacccataagtgg

SEQ ID NO: 245955 - DNA, 20 bp, Artificial Sequence
  chemically synthesized
catcgttcaactcccactta

SEQ ID NO: 245956 - DNA, 20 bp, Artificial Sequence
  chemically synthesized
ataagtgggagttgaacgat

SEQ ID NO: 245957 - DNA, 20 bp, Artificial Sequence
  chemically synthesized
agttgaacgatgagaacaca

SEQ ID NO: 245958 - DNA, 20 bp, Artificial Sequence
  chemically synthesized
acgatgagaacacatagaca

SEQ ID NO: 245959 - DNA, 20 bp, Artificial Sequence
  chemically synthesized
cgatgagaacacatagacac

SEQ ID NO: 245960 - DNA, 20 bp, Artificial Sequence
  chemically synthesized
gatgagaacacatagacaca

SEQ ID NO: 245961 - DNA, 20 bp, Artificial Sequence
  chemically synthesized
gagaacacatagacacaggg

SEQ ID NO: 245962 - DNA, 20 bp, Artificial Sequence
  chemically synthesized
agaacacatagacacagggc

SEQ ID NO: 245963 - DNA, 20 bp, Artificial Sequence
  chemically synthesized
gaacacatagacacagggcg

SEQ ID NO: 245964 - DNA, 20 bp, Artificial Sequence
  chemically synthesized
gggcggggaacatcacacac

SEQ ID NO: 245965 - DNA, 20 bp, Artificial Sequence
  chemically synthesized
ggcggggaacatcacacacc

SEQ ID NO: 245966 - DNA, 20 bp, Artificial Sequence
  chemically synthesized
gcggggaacatcacacaccg

SEQ ID NO: 245967 - DNA, 20 bp, Artificial Sequence
  chemically synthesized
ccccatcccctgagaggccc

SEQ ID NO: 245968 - DNA, 20 bp, Artificial Sequence
  chemically synthesized
catcacacaccggggcctct

SEQ ID NO: 245969 - DNA, 20 bp, Artificial Sequence
  chemically synthesized
atcacacaccggggcctctc

SEQ ID NO: 245970 - DNA, 20 bp, Artificial Sequence
  chemically synthesized
tcacacaccggggcctctca

SEQ ID NO: 245971 - DNA, 20 bp, Artificial Sequence
  chemically synthesized
cacacaccggggcctctcag

SEQ ID NO: 245972 - DNA, 20 bp, Artificial Sequence
  chemically synthesized
ctaaccccccatcccctgag

SEQ ID NO: 245973 - DNA, 20 bp, Artificial Sequence
  chemically synthesized
cctaaccccccatcccctga

SEQ ID NO: 245974 - DNA, 20 bp, Artificial Sequence
  chemically synthesized
caccggggcctctcagggga

SEQ ID NO: 245975 - DNA, 20 bp, Artificial Sequence
  chemically synthesized
accggggcctctcaggggat

SEQ ID NO: 245976 - DNA, 20 bp, Artificial Sequence
  chemically synthesized
cccctaaccccccatcccct

SEQ ID NO: 245977 - DNA, 20 bp, Artificial Sequence
  chemically synthesized
ccggggcctctcaggggatg

SEQ ID NO: 245978 - DNA, 20 bp, Artificial Sequence
  chemically synthesized
cggggcctctcaggggatgg

SEQ ID NO: 245979 - DNA, 20 bp, Artificial Sequence
  chemically synthesized
ggggcctctcaggggatggg

SEQ ID NO: 245980 - DNA, 20 bp, Artificial Sequence
  chemically synthesized
cctctcaggggatggggggt

SEQ ID NO: 245981 - DNA, 20 bp, Artificial Sequence
  chemically synthesized
ctctcaggggatggggggtt

SEQ ID NO: 245982 - DNA, 20 bp, Artificial Sequence
  chemically synthesized
tctcaggggatggggggtta

SEQ ID NO: 245983 - DNA, 20 bp, Artificial Sequence
  chemically synthesized
ctcaggggatggggggttag

SEQ ID NO: 245984 - DNA, 20 bp, Artificial Sequence
  chemically synthesized
caggggatggggggttaggg

SEQ ID NO: 245985 - DNA, 20 bp, Artificial Sequence
  chemically synthesized
aggggatggggggttagggg

SEQ ID NO: 245986 - DNA, 20 bp, Artificial Sequence
  chemically synthesized
ggggatggggggttagggga

SEQ ID NO: 245987 - DNA, 20 bp, Artificial Sequence
  chemically synthesized
atggggggttaggggaggga

SEQ ID NO: 245988 - DNA, 20 bp, Artificial Sequence
  chemically synthesized
ggttaggggagggatagcat

SEQ ID NO: 245989 - DNA, 20 bp, Artificial Sequence
  chemically synthesized
gttaggggagggatagcatt

SEQ ID NO: 245990 - DNA, 20 bp, Artificial Sequence
  chemically synthesized
taggggagggatagcattag

SEQ ID NO: 245991 - DNA, 20 bp, Artificial Sequence
  chemically synthesized
attaggagaaatacctaatg

SEQ ID NO: 245992 - DNA, 20 bp, Artificial Sequence
  chemically synthesized
atcaacccatcatctacatt

SEQ ID NO: 245993 - DNA, 20 bp, Artificial Sequence
  chemically synthesized
catcaacccatcatctacat

SEQ ID NO: 245994 - DNA, 20 bp, Artificial Sequence
  chemically synthesized
gaaatacctaatgtagatga

SEQ ID NO: 245995 - DNA, 20 bp, Artificial Sequence
  chemically synthesized
aaatacctaatgtagatgat

SEQ ID NO: 245996 - DNA, 20 bp, Artificial Sequence
  chemically synthesized
agatgatgggttgatgtgtg

SEQ ID NO: 245997 - DNA, 20 bp, Artificial Sequence
  chemically synthesized
atgtgtgcagcaaaccacca

SEQ ID NO: 245998 - DNA, 20 bp, Artificial Sequence
  chemically synthesized
taggtgtacacgttccatgg

SEQ ID NO: 245999 - DNA, 20 bp, Artificial Sequence
  chemically synthesized
gcataggtgtacacgttcca

SEQ ID NO: 246000 - DNA, 20 bp, Artificial Sequence
  chemically synthesized
aacgggcaggtttgttgcat

SEQ ID NO: 246001 - DNA, 20 bp, Artificial Sequence
  chemically synthesized
gaacgggcaggtttgttgca

SEQ ID NO: 246002 - DNA, 20 bp, Artificial Sequence
  chemically synthesized
gacacacgtgcagaacgggc

SEQ ID NO: 246003 - DNA, 20 bp, Artificial Sequence
  chemically synthesized
ggacacacgtgcagaacggg

SEQ ID NO: 246004 - DNA, 20 bp, Artificial Sequence
  chemically synthesized
ctgggacacacgtgcagaac

SEQ ID NO: 246005 - DNA, 20 bp, Artificial Sequence
  chemically synthesized
tctgggacacacgtgcagaa

SEQ ID NO: 246006 - DNA, 20 bp, Artificial Sequence
  chemically synthesized
taagttctgggacacacgtg

SEQ ID NO: 246007 - DNA, 20 bp, Artificial Sequence
  chemically synthesized
cccgttctgcacgtgtgtcc

SEQ ID NO: 246008 - DNA, 20 bp, Artificial Sequence
  chemically synthesized
attattatactttaagttct

SEQ ID NO: 246009 - DNA, 20 bp, Artificial Sequence
  chemically synthesized
cacgtgtgtcccagaactta

SEQ ID NO: 246010 - DNA, 20 bp, Artificial Sequence
  chemically synthesized
cattattatactttaagttc

SEQ ID NO: 246011 - DNA, 20 bp, Artificial Sequence
  chemically synthesized
ttttttcattattatacttt

SEQ ID NO: 246012 - DNA, 20 bp, Artificial Sequence
  chemically synthesized
taaagtataataatgaaaaa

SEQ ID NO: 246013 - DNA, 20 bp, Artificial Sequence
  chemically synthesized
tataataatgaaaaaaagat

SEQ ID NO: 246014 - DNA, 20 bp, Artificial Sequence
  chemically synthesized
ataataatgaaaaaaagatc

SEQ ID NO: 246015 - DNA, 20 bp, Artificial Sequence
  chemically synthesized
taataatgaaaaaaagatca

SEQ ID NO: 246016 - DNA, 20 bp, Artificial Sequence
  chemically synthesized
ttttgtcattgttttgaaca

SEQ ID NO: 246017 - DNA, 20 bp, Artificial Sequence
  chemically synthesized
cattgttttgaacatagcca

SEQ ID NO: 246018 - DNA, 20 bp, Artificial Sequence
  chemically synthesized
attgttttgaacatagccat

SEQ ID NO: 246019 - DNA, 20 bp, Artificial Sequence
  chemically synthesized
gttttgaacatagccatagg

SEQ ID NO: 246020 - DNA, 20 bp, Artificial Sequence
  chemically synthesized
ttttgaacatagccataggt

SEQ ID NO: 246021 - DNA, 20 bp, Artificial Sequence
  chemically synthesized
ctattttatgatcctaccta

SEQ ID NO: 246022 - DNA, 20 bp, Artificial Sequence
  chemically synthesized
ccataggtaggatcataaaa

SEQ ID NO: 246023 - DNA, 20 bp, Artificial Sequence
  chemically synthesized
ataaaatagcacaacttaaa

SEQ ID NO: 246024 - DNA, 20 bp, Artificial Sequence
  chemically synthesized
aatcatttatttttctattt

SEQ ID NO: 246025 - DNA, 20 bp, Artificial Sequence
  chemically synthesized
aaatagaaaaataaatgatt

SEQ ID NO: 246026 - DNA, 20 bp, Artificial Sequence
  chemically synthesized
aaaaataaatgattcagaat

SEQ ID NO: 246027 - DNA, 20 bp, Artificial Sequence
  chemically synthesized
aaaataaatgattcagaatc

SEQ ID NO: 246028 - DNA, 20 bp, Artificial Sequence
  chemically synthesized
aatgattcagaatcaggtct

SEQ ID NO: 246029 - DNA, 20 bp, Artificial Sequence
  chemically synthesized
atgattcagaatcaggtctc

SEQ ID NO: 246030 - DNA, 20 bp, Artificial Sequence
  chemically synthesized
tattttggctgtttgtacct

SEQ ID NO: 246031 - DNA, 20 bp, Artificial Sequence
  chemically synthesized
aatcaggtctcaggtacaaa

SEQ ID NO: 246032 - DNA, 20 bp, Artificial Sequence
  chemically synthesized
ataatttcattgaattattt

SEQ ID NO: 246033 - DNA, 20 bp, Artificial Sequence
  chemically synthesized
agtccacaatttgtagtata

SEQ ID NO: 246034 - DNA, 20 bp, Artificial Sequence
  chemically synthesized
tgagtccacaatttgtagta

SEQ ID NO: 246035 - DNA, 20 bp, Artificial Sequence
  chemically synthesized
tttctctatactacaaattg

SEQ ID NO: 246036 - DNA, 20 bp, Artificial Sequence
  chemically synthesized
ccatgtgagtccacaatttg

SEQ ID NO: 246037 - DNA, 20 bp, Artificial Sequence
  chemically synthesized
ctacaaattgtggactcaca

SEQ ID NO: 246038 - DNA, 20 bp, Artificial Sequence
  chemically synthesized
tatcagatatgatgccatgt

SEQ ID NO: 246039 - DNA, 20 bp, Artificial Sequence
  chemically synthesized
aaataaactattatttatat

SEQ ID NO: 246040 - DNA, 20 bp, Artificial Sequence
  chemically synthesized
atcatatctgatataaataa

SEQ ID NO: 246041 - DNA, 20 bp, Artificial Sequence
  chemically synthesized
tagtttattttaaatgaata

SEQ ID NO: 246042 - DNA, 20 bp, Artificial Sequence
  chemically synthesized
ttattttaaatgaatataga

SEQ ID NO: 246043 - DNA, 20 bp, Artificial Sequence
  chemically synthesized
tattttaaatgaatatagac

SEQ ID NO: 246044 - DNA, 20 bp, Artificial Sequence
  chemically synthesized
ttttaaatgaatatagacag

SEQ ID NO: 246045 - DNA, 20 bp, Artificial Sequence
  chemically synthesized
taaatgaatatagacaggag

SEQ ID NO: 246046 - DNA, 20 bp, Artificial Sequence
  chemically synthesized
tgaatatagacaggagtggc

SEQ ID NO: 246047 - DNA, 20 bp, Artificial Sequence
  chemically synthesized
aaatacatgcttttagtttc

SEQ ID NO: 246048 - DNA, 20 bp, Artificial Sequence
  chemically synthesized
caggagtggctggaaactaa

SEQ ID NO: 246049 - DNA, 20 bp, Artificial Sequence
  chemically synthesized
ggagaagaaatacatgcttt

SEQ ID NO: 246050 - DNA, 20 bp, Artificial Sequence
  chemically synthesized
agcatgtatttcttctccat

SEQ ID NO: 246051 - DNA, 20 bp, Artificial Sequence
  chemically synthesized
tcctctttcatcttatggag

SEQ ID NO: 246052 - DNA, 20 bp, Artificial Sequence
  chemically synthesized
aaatcctctttcatcttatg

SEQ ID NO: 246053 - DNA, 20 bp, Artificial Sequence
  chemically synthesized
ctaaatcctctttcatctta

SEQ ID NO: 246054 - DNA, 20 bp, Artificial Sequence
  chemically synthesized
atttcttctccataagatga

SEQ ID NO: 246055 - DNA, 20 bp, Artificial Sequence
  chemically synthesized
ttcttctccataagatgaaa

SEQ ID NO: 246056 - DNA, 20 bp, Artificial Sequence
  chemically synthesized
tcttctccataagatgaaag

SEQ ID NO: 246057 - DNA, 20 bp, Artificial Sequence
  chemically synthesized
ccataagatgaaagaggatt

SEQ ID NO: 246058 - DNA, 20 bp, Artificial Sequence
  chemically synthesized
cataagatgaaagaggattt

SEQ ID NO: 246059 - DNA, 20 bp, Artificial Sequence
  chemically synthesized
agaggatttaggatacactt

SEQ ID NO: 246060 - DNA, 20 bp, Artificial Sequence
  chemically synthesized
aagatttagtatgttatctt

SEQ ID NO: 246061 - DNA, 20 bp, Artificial Sequence
  chemically synthesized
tacactggcaaaacaagatt

SEQ ID NO: 246062 - DNA, 20 bp, Artificial Sequence
  chemically synthesized
catactaaatcttgttttgc

SEQ ID NO: 246063 - DNA, 20 bp, Artificial Sequence
  chemically synthesized
agaagctacactggcaaaac

SEQ ID NO: 246064 - DNA, 20 bp, Artificial Sequence
  chemically synthesized
taaatcttgttttgccagtg

SEQ ID NO: 246065 - DNA, 20 bp, Artificial Sequence
  chemically synthesized
atgccaagcagaagctacac

SEQ ID NO: 246066 - DNA, 20 bp, Artificial Sequence
  chemically synthesized
ttgccagtgtagcttctgct

SEQ ID NO: 246067 - DNA, 20 bp, Artificial Sequence
  chemically synthesized
gatatttaaatgccaagcag

SEQ ID NO: 246068 - DNA, 20 bp, Artificial Sequence
  chemically synthesized
acagatatttaaatgccaag

SEQ ID NO: 246069 - DNA, 20 bp, Artificial Sequence
  chemically synthesized
gtaacagatatttaaatgcc

SEQ ID NO: 246070 - DNA, 20 bp, Artificial Sequence
  chemically synthesized
tgaatgtttctattaagtaa

SEQ ID NO: 246071 - DNA, 20 bp, Artificial Sequence
  chemically synthesized
tttaaatatctgttacttaa

SEQ ID NO: 246072 - DNA, 20 bp, Artificial Sequence
  chemically synthesized
caaaattgaatgtttctatt

SEQ ID NO: 246073 - DNA, 20 bp, Artificial Sequence
  chemically synthesized
ttaatagaaacattcaattt

SEQ ID NO: 246074 - DNA, 20 bp, Artificial Sequence
  chemically synthesized
taatattgtgtgatatttta

SEQ ID NO: 246075 - DNA, 20 bp, Artificial Sequence
  chemically synthesized
ataatattgtgtgatatttt

SEQ ID NO: 246076 - DNA, 20 bp, Artificial Sequence
  chemically synthesized
aataatattgtgtgatattt

SEQ ID NO: 246077 - DNA, 20 bp, Artificial Sequence
  chemically synthesized
atggctagacagatttgagt

SEQ ID NO: 246078 - DNA, 20 bp, Artificial Sequence
  chemically synthesized
tatggctagacagatttgag

SEQ ID NO: 246079 - DNA, 20 bp, Artificial Sequence
  chemically synthesized
tgatatggctagacagattt

SEQ ID NO: 246080 - DNA, 20 bp, Artificial Sequence
  chemically synthesized
tatacctactcaaatctgtc

SEQ ID NO: 246081 - DNA, 20 bp, Artificial Sequence
  chemically synthesized
cgctatatgatatggctaga

SEQ ID NO: 246082 - DNA, 20 bp, Artificial Sequence
  chemically synthesized
cagtcgctatatgatatggc

SEQ ID NO: 246083 - DNA, 20 bp, Artificial Sequence
  chemically synthesized
atctgtctagccatatcata

SEQ ID NO: 246084 - DNA, 20 bp, Artificial Sequence
  chemically synthesized
atatcagtcgctatatgata

SEQ ID NO: 246085 - DNA, 20 bp, Artificial Sequence
  chemically synthesized
catatagcgactgatatttt

SEQ ID NO: 246086 - DNA, 20 bp, Artificial Sequence
  chemically synthesized
tgggtttgatctaaaaatat

SEQ ID NO: 246087 - DNA, 20 bp, Artificial Sequence
  chemically synthesized
tatttttagatcaaacccac

SEQ ID NO: 246088 - DNA, 20 bp, Artificial Sequence
  chemically synthesized
gaaaaatatttcacacttgt

SEQ ID NO: 246089 - DNA, 20 bp, Artificial Sequence
  chemically synthesized
tgaaaaatatttcacacttg

SEQ ID NO: 246090 - DNA, 20 bp, Artificial Sequence
  chemically synthesized
gtgaaatatttttcatttta

SEQ ID NO: 246091 - DNA, 20 bp, Artificial Sequence
  chemically synthesized
aatacatattaaatgtaaaa

SEQ ID NO: 246092 - DNA, 20 bp, Artificial Sequence
  chemically synthesized
tgaatacatattaaatgtaa

SEQ ID NO: 246093 - DNA, 20 bp, Artificial Sequence
  chemically synthesized
gtgctttaaatttaaaaagt

SEQ ID NO: 246094 - DNA, 20 bp, Artificial Sequence
  chemically synthesized
gaaggtgctttaaatttaaa

SEQ ID NO: 246095 - DNA, 20 bp, Artificial Sequence
  chemically synthesized
atgctaactttttaaattta

SEQ ID NO: 246096 - DNA, 20 bp, Artificial Sequence
  chemically synthesized
attaaaatacatttcataga

SEQ ID NO: 246097 - DNA, 20 bp, Artificial Sequence
  chemically synthesized
tattaaaatacatttcatag

SEQ ID NO: 246098 - DNA, 20 bp, Artificial Sequence
  chemically synthesized
ttgtattaaaatacatttca

SEQ ID NO: 246099 - DNA, 20 bp, Artificial Sequence
  chemically synthesized
gaagtaaattatacaatata

SEQ ID NO: 246100 - DNA, 20 bp, Artificial Sequence
  chemically synthesized
tgaagtaaattatacaatat

SEQ ID NO: 246101 - DNA, 20 bp, Artificial Sequence
  chemically synthesized
ttgaagtaaattatacaata

SEQ ID NO: 246102 - DNA, 20 bp, Artificial Sequence
  chemically synthesized
gtggaaaatttacaacgttg

SEQ ID NO: 246103 - DNA, 20 bp, Artificial Sequence
  chemically synthesized
gtgaatgatacacatcgtcg

SEQ ID NO: 246104 - DNA, 20 bp, Artificial Sequence
  chemically synthesized
caataattttatatatgttt

SEQ ID NO: 246105 - DNA, 20 bp, Artificial Sequence
  chemically synthesized
ttaaacatatataaaattat

SEQ ID NO: 246106 - DNA, 20 bp, Artificial Sequence
  chemically synthesized
atcccattacatttagtaca

SEQ ID NO: 246107 - DNA, 20 bp, Artificial Sequence
  chemically synthesized
ttactttgtactaaatgtaa

SEQ ID NO: 246108 - DNA, 20 bp, Artificial Sequence
  chemically synthesized
atatcaaatcccattacatt

SEQ ID NO: 246109 - DNA, 20 bp, Artificial Sequence
  chemically synthesized
tactttgtactaaatgtaat

SEQ ID NO: 246110 - DNA, 20 bp, Artificial Sequence
  chemically synthesized
tttatattcatgatgaatat

SEQ ID NO: 246111 - DNA, 20 bp, Artificial Sequence
  chemically synthesized
gatgaatataagtaaacatt

SEQ ID NO: 246112 - DNA, 20 bp, Artificial Sequence
  chemically synthesized
aatataagtaaacattgagt

SEQ ID NO: 246113 - DNA, 20 bp, Artificial Sequence
  chemically synthesized
cattgagtaagaaatgtttt

SEQ ID NO: 246114 - DNA, 20 bp, Artificial Sequence
  chemically synthesized
tgaatagtcattcatgcaga

SEQ ID NO: 246115 - DNA, 20 bp, Artificial Sequence
  chemically synthesized
gtattgaatagtcattcatg

SEQ ID NO: 246116 - DNA, 20 bp, Artificial Sequence
  chemically synthesized
ttcaataaaaatgtattgaa

SEQ ID NO: 246117 - DNA, 20 bp, Artificial Sequence
  chemically synthesized
atttttattgaacatccatc

SEQ ID NO: 246118 - DNA, 20 bp, Artificial Sequence
  chemically synthesized
attcatcgcaacgaactcga

SEQ ID NO: 246119 - DNA, 20 bp, Artificial Sequence
  chemically synthesized
cgagttcgttgcgatgaata

SEQ ID NO: 246120 - DNA, 20 bp, Artificial Sequence
  chemically synthesized
cgttgcgatgaatacagttt

SEQ ID NO: 246121 - DNA, 20 bp, Artificial Sequence
  chemically synthesized
tagaaaaaatactaatactc

SEQ ID NO: 246122 - DNA, 20 bp, Artificial Sequence
  chemically synthesized
agtcttcgaagccagagtat

SEQ ID NO: 246123 - DNA, 20 bp, Artificial Sequence
  chemically synthesized
catagcagtcttcgaagcca

SEQ ID NO: 246124 - DNA, 20 bp, Artificial Sequence
  chemically synthesized
atactaatactctggcttcg

SEQ ID NO: 246125 - DNA, 20 bp, Artificial Sequence
  chemically synthesized
tacatagcagtcttcgaagc

SEQ ID NO: 246126 - DNA, 20 bp, Artificial Sequence
  chemically synthesized
tcaatacatagcagtcttcg

SEQ ID NO: 246127 - DNA, 20 bp, Artificial Sequence
  chemically synthesized
tgtagaccttcaatacatag

SEQ ID NO: 246128 - DNA, 20 bp, Artificial Sequence
  chemically synthesized
tcgaagactgctatgtattg

SEQ ID NO: 246129 - DNA, 20 bp, Artificial Sequence
  chemically synthesized
cattgtagaccttcaataca

SEQ ID NO: 246130 - DNA, 20 bp, Artificial Sequence
  chemically synthesized
cgaagactgctatgtattga

SEQ ID NO: 246131 - DNA, 20 bp, Artificial Sequence
  chemically synthesized
ctacagcattcaaagcattg

SEQ ID NO: 246132 - DNA, 20 bp, Artificial Sequence
  chemically synthesized
ttgtcttcctacagcattca

SEQ ID NO: 246133 - DNA, 20 bp, Artificial Sequence
  chemically synthesized
ctacaatgctttgaatgctg

SEQ ID NO: 246134 - DNA, 20 bp, Artificial Sequence
  chemically synthesized
tacaatgctttgaatgctgt

SEQ ID NO: 246135 - DNA, 20 bp, Artificial Sequence
  chemically synthesized
aatgctttgaatgctgtagg

SEQ ID NO: 246136 - DNA, 20 bp, Artificial Sequence
  chemically synthesized
taatttatcttgtcttccta

SEQ ID NO: 246137 - DNA, 20 bp, Artificial Sequence
  chemically synthesized
tttgaatgctgtaggaagac

SEQ ID NO: 246138 - DNA, 20 bp, Artificial Sequence
  chemically synthesized
tgtaggaagacaagataaat

SEQ ID NO: 246139 - DNA, 20 bp, Artificial Sequence
  chemically synthesized
gtaggaagacaagataaatt

SEQ ID NO: 246140 - DNA, 20 bp, Artificial Sequence
  chemically synthesized
ttttatgggacggtgatcaa

SEQ ID NO: 246141 - DNA, 20 bp, Artificial Sequence
  chemically synthesized
aattataagcttttatggga

SEQ ID NO: 246142 - DNA, 20 bp, Artificial Sequence
  chemically synthesized
ttttgatcaccgtcccataa

SEQ ID NO: 246143 - DNA, 20 bp, Artificial Sequence
  chemically synthesized
gacaaattataagcttttat

SEQ ID NO: 246144 - DNA, 20 bp, Artificial Sequence
  chemically synthesized
agacaaattataagctttta

SEQ ID NO: 246145 - DNA, 20 bp, Artificial Sequence
  chemically synthesized
ttccttattagacaaattat

SEQ ID NO: 246146 - DNA, 20 bp, Artificial Sequence
  chemically synthesized
aagcttataatttgtctaat

SEQ ID NO: 246147 - DNA, 20 bp, Artificial Sequence
  chemically synthesized
agcttataatttgtctaata

SEQ ID NO: 246148 - DNA, 20 bp, Artificial Sequence
  chemically synthesized
aattgttggctattccttat

SEQ ID NO: 246149 - DNA, 20 bp, Artificial Sequence
  chemically synthesized
ataatttgtctaataaggaa

SEQ ID NO: 246150 - DNA, 20 bp, Artificial Sequence
  chemically synthesized
tctcctattgtaataattgt

SEQ ID NO: 246151 - DNA, 20 bp, Artificial Sequence
  chemically synthesized
atagccaacaattattacaa

SEQ ID NO: 246152 - DNA, 20 bp, Artificial Sequence
  chemically synthesized
tagccaacaattattacaat

SEQ ID NO: 246153 - DNA, 20 bp, Artificial Sequence
  chemically synthesized
gccaacaattattacaatag

SEQ ID NO: 246154 - DNA, 20 bp, Artificial Sequence
  chemically synthesized
acaattattacaataggaga

SEQ ID NO: 246155 - DNA, 20 bp, Artificial Sequence
  chemically synthesized
caataggagacagtaaaaat

SEQ ID NO: 246156 - DNA, 20 bp, Artificial Sequence
  chemically synthesized
taggagacagtaaaaataag

SEQ ID NO: 246157 - DNA, 20 bp, Artificial Sequence
  chemically synthesized
ataagtagaatgcaatgttc

SEQ ID NO: 246158 - DNA, 20 bp, Artificial Sequence
  chemically synthesized
aatgcaatgttccagatgtt

SEQ ID NO: 246159 - DNA, 20 bp, Artificial Sequence
  chemically synthesized
ctccaactcctctgaacatc

SEQ ID NO: 246160 - DNA, 20 bp, Artificial Sequence
  chemically synthesized
tgcaatgttccagatgttca

SEQ ID NO: 246161 - DNA, 20 bp, Artificial Sequence
  chemically synthesized
gcaatgttccagatgttcag

SEQ ID NO: 246162 - DNA, 20 bp, Artificial Sequence
  chemically synthesized
aatgttccagatgttcagag

SEQ ID NO: 246163 - DNA, 20 bp, Artificial Sequence
  chemically synthesized
ttccagatgttcagaggagt

SEQ ID NO: 246164 - DNA, 20 bp, Artificial Sequence
  chemically synthesized
ccagatgttcagaggagttg

SEQ ID NO: 246165 - DNA, 20 bp, Artificial Sequence
  chemically synthesized
agttggagatcatctcctta

SEQ ID NO: 246166 - DNA, 20 bp, Artificial Sequence
  chemically synthesized
gttggagatcatctccttat

SEQ ID NO: 246167 - DNA, 20 bp, Artificial Sequence
  chemically synthesized
tctcttgaccaacccataag

SEQ ID NO: 246168 - DNA, 20 bp, Artificial Sequence
  chemically synthesized
gagatcatctccttatgggt

SEQ ID NO: 246169 - DNA, 20 bp, Artificial Sequence
  chemically synthesized
gctctcttgaccaacccata

SEQ ID NO: 246170 - DNA, 20 bp, Artificial Sequence
  chemically synthesized
ggctctcttgaccaacccat

SEQ ID NO: 246171 - DNA, 20 bp, Artificial Sequence
  chemically synthesized
catctccttatgggttggtc

SEQ ID NO: 246172 - DNA, 20 bp, Artificial Sequence
  chemically synthesized
tctccttatgggttggtcaa

SEQ ID NO: 246173 - DNA, 20 bp, Artificial Sequence
  chemically synthesized
tccttatgggttggtcaaga

SEQ ID NO: 246174 - DNA, 20 bp, Artificial Sequence
  chemically synthesized
gttggtcaagagagccttaa

SEQ ID NO: 246175 - DNA, 20 bp, Artificial Sequence
  chemically synthesized
agatgctacattttccatta

SEQ ID NO: 246176 - DNA, 20 bp, Artificial Sequence
  chemically synthesized
cagatgctacattttccatt

SEQ ID NO: 246177 - DNA, 20 bp, Artificial Sequence
  chemically synthesized
gagagccttaatggaaaatg

SEQ ID NO: 246178 - DNA, 20 bp, Artificial Sequence
  chemically synthesized
taatggaaaatgtagcatct

SEQ ID NO: 246179 - DNA, 20 bp, Artificial Sequence
  chemically synthesized
tggaaaatgtagcatctgag

SEQ ID NO: 246180 - DNA, 20 bp, Artificial Sequence
  chemically synthesized
ggaaaatgtagcatctgagc

SEQ ID NO: 246181 - DNA, 20 bp, Artificial Sequence
  chemically synthesized
gaaaatgtagcatctgagca

SEQ ID NO: 246182 - DNA, 20 bp, Artificial Sequence
  chemically synthesized
tgatccttccatgccctgct

SEQ ID NO: 246183 - DNA, 20 bp, Artificial Sequence
  chemically synthesized
tgtagcatctgagcagggca

SEQ ID NO: 246184 - DNA, 20 bp, Artificial Sequence
  chemically synthesized
agcatctgagcagggcatgg

SEQ ID NO: 246185 - DNA, 20 bp, Artificial Sequence
  chemically synthesized
gcatctgagcagggcatgga

SEQ ID NO: 246186 - DNA, 20 bp, Artificial Sequence
  chemically synthesized
cagggcatggaaggatcatt

SEQ ID NO: 246187 - DNA, 20 bp, Artificial Sequence
  chemically synthesized
ggcatggaaggatcatttag

SEQ ID NO: 246188 - DNA, 20 bp, Artificial Sequence
  chemically synthesized
gacaaaaaattttgggacag

SEQ ID NO: 246189 - DNA, 20 bp, Artificial Sequence
  chemically synthesized
agacaaaaaattttgggaca

SEQ ID NO: 246190 - DNA, 20 bp, Artificial Sequence
  chemically synthesized
acagacaaaaaattttggga

SEQ ID NO: 246191 - DNA, 20 bp, Artificial Sequence
  chemically synthesized
ttggacagacaaaaaatttt

SEQ ID NO: 246192 - DNA, 20 bp, Artificial Sequence
  chemically synthesized
attggacagacaaaaaattt

SEQ ID NO: 246193 - DNA, 20 bp, Artificial Sequence
  chemically synthesized
accacagaagggatattgga

SEQ ID NO: 246194 - DNA, 20 bp, Artificial Sequence
  chemically synthesized
cttcaccacagaagggatat

SEQ ID NO: 246195 - DNA, 20 bp, Artificial Sequence
  chemically synthesized
tctgtccaatatcccttctg

SEQ ID NO: 246196 - DNA, 20 bp, Artificial Sequence
  chemically synthesized
taattttcttcaccacagaa

SEQ ID NO: 246197 - DNA, 20 bp, Artificial Sequence
  chemically synthesized
ctaattttcttcaccacaga

SEQ ID NO: 246198 - DNA, 20 bp, Artificial Sequence
  chemically synthesized
actaattttcttcaccacag

SEQ ID NO: 246199 - DNA, 20 bp, Artificial Sequence
  chemically synthesized
ccaatatcccttctgtggtg

SEQ ID NO: 246200 - DNA, 20 bp, Artificial Sequence
  chemically synthesized
agtactaattttcttcacca

SEQ ID NO: 246201 - DNA, 20 bp, Artificial Sequence
  chemically synthesized
ccttctgtggtgaagaaaat

SEQ ID NO: 246202 - DNA, 20 bp, Artificial Sequence
  chemically synthesized
tgaagaaaattagtactctt

SEQ ID NO: 246203 - DNA, 20 bp, Artificial Sequence
  chemically synthesized
tcaataccaagatatccaaa

SEQ ID NO: 246204 - DNA, 20 bp, Artificial Sequence
  chemically synthesized
aatcaataccaagatatcca

SEQ ID NO: 246205 - DNA, 20 bp, Artificial Sequence
  chemically synthesized
ttagtactctttggatatct

SEQ ID NO: 246206 - DNA, 20 bp, Artificial Sequence
  chemically synthesized
aacataatgaaatcaatacc

SEQ ID NO: 246207 - DNA, 20 bp, Artificial Sequence
  chemically synthesized
acgaaacctcaagggaacat

SEQ ID NO: 246208 - DNA, 20 bp, Artificial Sequence
  chemically synthesized
tatgtttctcatgttccctt

SEQ ID NO: 246209 - DNA, 20 bp, Artificial Sequence
  chemically synthesized
atgtttctcatgttcccttg

SEQ ID NO: 246210 - DNA, 20 bp, Artificial Sequence
  chemically synthesized
ttgcactcacgaaacctcaa

SEQ ID NO: 246211 - DNA, 20 bp, Artificial Sequence
  chemically synthesized
attgcactcacgaaacctca

SEQ ID NO: 246212 - DNA, 20 bp, Artificial Sequence
  chemically synthesized
aattgcactcacgaaacctc

SEQ ID NO: 246213 - DNA, 20 bp, Artificial Sequence
  chemically synthesized
atgttcccttgaggtttcgt

SEQ ID NO: 246214 - DNA, 20 bp, Artificial Sequence
  chemically synthesized
gtgcaattgtgattgaatcc

SEQ ID NO: 246215 - DNA, 20 bp, Artificial Sequence
  chemically synthesized
aattgtgattgaatcctgga

SEQ ID NO: 246216 - DNA, 20 bp, Artificial Sequence
  chemically synthesized
tgtgattgaatcctggaaag

SEQ ID NO: 246217 - DNA, 20 bp, Artificial Sequence
  chemically synthesized
gtgattgaatcctggaaagt

SEQ ID NO: 246218 - DNA, 20 bp, Artificial Sequence
  chemically synthesized
cctacactttcccactttcc

SEQ ID NO: 246219 - DNA, 20 bp, Artificial Sequence
  chemically synthesized
tcctacactttcccactttc

SEQ ID NO: 246220 - DNA, 20 bp, Artificial Sequence
  chemically synthesized
ttgaatcctggaaagtggga

SEQ ID NO: 246221 - DNA, 20 bp, Artificial Sequence
  chemically synthesized
tcctggaaagtgggaaagtg

SEQ ID NO: 246222 - DNA, 20 bp, Artificial Sequence
  chemically synthesized
cctggaaagtgggaaagtgt

SEQ ID NO: 246223 - DNA, 20 bp, Artificial Sequence
  chemically synthesized
ggaaagtgggaaagtgtagg

SEQ ID NO: 246224 - DNA, 20 bp, Artificial Sequence
  chemically synthesized
tgatgcatcacttcttgcct

SEQ ID NO: 246225 - DNA, 20 bp, Artificial Sequence
  chemically synthesized
tatcaagtacctcaggcaag

SEQ ID NO: 246226 - DNA, 20 bp, Artificial Sequence
  chemically synthesized
gatgcatcacttcttgcctg

SEQ ID NO: 246227 - DNA, 20 bp, Artificial Sequence
  chemically synthesized
aactatcaagtacctcaggc

SEQ ID NO: 246228 - DNA, 20 bp, Artificial Sequence
  chemically synthesized
cactaactatcaagtacctc

SEQ ID NO: 246229 - DNA, 20 bp, Artificial Sequence
  chemically synthesized
acactaactatcaagtacct

SEQ ID NO: 246230 - DNA, 20 bp, Artificial Sequence
  chemically synthesized
ttcttgcctgaggtacttga

SEQ ID NO: 246231 - DNA, 20 bp, Artificial Sequence
  chemically synthesized
tgcctgaggtacttgatagt

SEQ ID NO: 246232 - DNA, 20 bp, Artificial Sequence
  chemically synthesized
agaaattgacactaactatc

SEQ ID NO: 246233 - DNA, 20 bp, Artificial Sequence
  chemically synthesized
gatagttagtgtcaatttct

SEQ ID NO: 246234 - DNA, 20 bp, Artificial Sequence
  chemically synthesized
ggtattgacaaaggagagct

SEQ ID NO: 246235 - DNA, 20 bp, Artificial Sequence
  chemically synthesized
tcagaggtattgacaaagga

SEQ ID NO: 246236 - DNA, 20 bp, Artificial Sequence
  chemically synthesized
cttcagaggtattgacaaag

SEQ ID NO: 246237 - DNA, 20 bp, Artificial Sequence
  chemically synthesized
aacttcagaggtattgacaa

SEQ ID NO: 246238 - DNA, 20 bp, Artificial Sequence
  chemically synthesized
aaacttcagaggtattgaca

SEQ ID NO: 246239 - DNA, 20 bp, Artificial Sequence
  chemically synthesized
ctcctttgtcaatacctctg

SEQ ID NO: 246240 - DNA, 20 bp, Artificial Sequence
  chemically synthesized
tgtcaacattgaaacttcag

SEQ ID NO: 246241 - DNA, 20 bp, Artificial Sequence
  chemically synthesized
atgtcaacattgaaacttca

SEQ ID NO: 246242 - DNA, 20 bp, Artificial Sequence
  chemically synthesized
ccatgtcaacattgaaactt

SEQ ID NO: 246243 - DNA, 20 bp, Artificial Sequence
  chemically synthesized
ctgaagtttcaatgttgaca

SEQ ID NO: 246244 - DNA, 20 bp, Artificial Sequence
  chemically synthesized
aagtttcaatgttgacatgg

SEQ ID NO: 246245 - DNA, 20 bp, Artificial Sequence
  chemically synthesized
gtttcaatgttgacatggca

SEQ ID NO: 246246 - DNA, 20 bp, Artificial Sequence
  chemically synthesized
tgttgacatggcagagccac

SEQ ID NO: 246247 - DNA, 20 bp, Artificial Sequence
  chemically synthesized
cctaaattgctttcatcttg

SEQ ID NO: 246248 - DNA, 20 bp, Artificial Sequence
  chemically synthesized
atggcagagccacaagatga

SEQ ID NO: 246249 - DNA, 20 bp, Artificial Sequence
  chemically synthesized
gccacaagatgaaagcaatt

SEQ ID NO: 246250 - DNA, 20 bp, Artificial Sequence
  chemically synthesized
ccacaagatgaaagcaattt

SEQ ID NO: 246251 - DNA, 20 bp, Artificial Sequence
  chemically synthesized
tgaaagcaatttaggtccct

SEQ ID NO: 246252 - DNA, 20 bp, Artificial Sequence
  chemically synthesized
cattccttcacagtgactca

SEQ ID NO: 246253 - DNA, 20 bp, Artificial Sequence
  chemically synthesized
gcattccttcacagtgactc

SEQ ID NO: 246254 - DNA, 20 bp, Artificial Sequence
  chemically synthesized
agcattccttcacagtgact

SEQ ID NO: 246255 - DNA, 20 bp, Artificial Sequence
  chemically synthesized
taggtccctgagtcactgtg

SEQ ID NO: 246256 - DNA, 20 bp, Artificial Sequence
  chemically synthesized
aggtccctgagtcactgtga

SEQ ID NO: 246257 - DNA, 20 bp, Artificial Sequence
  chemically synthesized
aatcaggtagcattccttca

SEQ ID NO: 246258 - DNA, 20 bp, Artificial Sequence
  chemically synthesized
aaagtctgatataaatcagg

SEQ ID NO: 246259 - DNA, 20 bp, Artificial Sequence
  chemically synthesized
tataaagtctgatataaatc

SEQ ID NO: 246260 - DNA, 20 bp, Artificial Sequence
  chemically synthesized
atataaagtctgatataaat

SEQ ID NO: 246261 - DNA, 20 bp, Artificial Sequence
  chemically synthesized
gaatgctacctgatttatat

SEQ ID NO: 246262 - DNA, 20 bp, Artificial Sequence
  chemically synthesized
atttatatcagactttatat

SEQ ID NO: 246263 - DNA, 20 bp, Artificial Sequence
  chemically synthesized
gcttatttattgctcatata

SEQ ID NO: 246264 - DNA, 20 bp, Artificial Sequence
  chemically synthesized
actttatatgagcaataaat

SEQ ID NO: 246265 - DNA, 20 bp, Artificial Sequence
  chemically synthesized
agcaataaataagcattcat

SEQ ID NO: 246266 - DNA, 20 bp, Artificial Sequence
  chemically synthesized
gcaataaataagcattcatt

SEQ ID NO: 246267 - DNA, 20 bp, Artificial Sequence
  chemically synthesized
aactaaccctgaaatcaaag

SEQ ID NO: 246268 - DNA, 20 bp, Artificial Sequence
  chemically synthesized
tcattaggccactttgattt

SEQ ID NO: 246269 - DNA, 20 bp, Artificial Sequence
  chemically synthesized
cattaggccactttgatttc

SEQ ID NO: 246270 - DNA, 20 bp, Artificial Sequence
  chemically synthesized
aaaaactaaccctgaaatca

SEQ ID NO: 246271 - DNA, 20 bp, Artificial Sequence
  chemically synthesized
attaggccactttgatttca

SEQ ID NO: 246272 - DNA, 20 bp, Artificial Sequence
  chemically synthesized
ggccactttgatttcagggt

SEQ ID NO: 246273 - DNA, 20 bp, Artificial Sequence
  chemically synthesized
tttcagggttagtttttttg

SEQ ID NO: 246274 - DNA, 20 bp, Artificial Sequence
  chemically synthesized
ttattcagaacaattaatgt

SEQ ID NO: 246275 - DNA, 20 bp, Artificial Sequence
  chemically synthesized
taacattaattgttctgaat

SEQ ID NO: 246276 - DNA, 20 bp, Artificial Sequence
  chemically synthesized
aaagagtggagatacttatt

SEQ ID NO: 246277 - DNA, 20 bp, Artificial Sequence
  chemically synthesized
gaataagtatctccactctt

SEQ ID NO: 246278 - DNA, 20 bp, Artificial Sequence
  chemically synthesized
gtaccattcaccaaagagtg

SEQ ID NO: 246279 - DNA, 20 bp, Artificial Sequence
  chemically synthesized
gggtaccattcaccaaagag

SEQ ID NO: 246280 - DNA, 20 bp, Artificial Sequence
  chemically synthesized
gcagggtaccattcaccaaa

SEQ ID NO: 246281 - DNA, 20 bp, Artificial Sequence
  chemically synthesized
tatctccactctttggtgaa

SEQ ID NO: 246282 - DNA, 20 bp, Artificial Sequence
  chemically synthesized
aagcagggtaccattcacca

SEQ ID NO: 246283 - DNA, 20 bp, Artificial Sequence
  chemically synthesized
atttcatccaaggaaaagca

SEQ ID NO: 246284 - DNA, 20 bp, Artificial Sequence
  chemically synthesized
aatttcatccaaggaaaagc

SEQ ID NO: 246285 - DNA, 20 bp, Artificial Sequence
  chemically synthesized
taatttcatccaaggaaaag

SEQ ID NO: 246286 - DNA, 20 bp, Artificial Sequence
  chemically synthesized
aatggtaccctgcttttcct

SEQ ID NO: 246287 - DNA, 20 bp, Artificial Sequence
  chemically synthesized
gagtaatttcatccaaggaa

SEQ ID NO: 246288 - DNA, 20 bp, Artificial Sequence
  chemically synthesized
gggaagagtaatttcatcca

SEQ ID NO: 246289 - DNA, 20 bp, Artificial Sequence
  chemically synthesized
agggaagagtaatttcatcc

SEQ ID NO: 246290 - DNA, 20 bp, Artificial Sequence
  chemically synthesized
gatcatgcagaatgagggaa

SEQ ID NO: 246291 - DNA, 20 bp, Artificial Sequence
  chemically synthesized
aagatcatgcagaatgaggg

SEQ ID NO: 246292 - DNA, 20 bp, Artificial Sequence
  chemically synthesized
cctaagatcatgcagaatga

SEQ ID NO: 246293 - DNA, 20 bp, Artificial Sequence
  chemically synthesized
ccctaagatcatgcagaatg

SEQ ID NO: 246294 - DNA, 20 bp, Artificial Sequence
  chemically synthesized
cccctaagatcatgcagaat

SEQ ID NO: 246295 - DNA, 20 bp, Artificial Sequence
  chemically synthesized
taggtccccctaagatcatg

SEQ ID NO: 246296 - DNA, 20 bp, Artificial Sequence
  chemically synthesized
tccctcattctgcatgatct

SEQ ID NO: 246297 - DNA, 20 bp, Artificial Sequence
  chemically synthesized
ccctcattctgcatgatctt

SEQ ID NO: 246298 - DNA, 20 bp, Artificial Sequence
  chemically synthesized
cctcattctgcatgatctta

SEQ ID NO: 246299 - DNA, 20 bp, Artificial Sequence
  chemically synthesized
ctcattctgcatgatcttag

SEQ ID NO: 246300 - DNA, 20 bp, Artificial Sequence
  chemically synthesized
tcattctgcatgatcttagg

SEQ ID NO: 246301 - DNA, 20 bp, Artificial Sequence
  chemically synthesized
ctatgattataggtccccct

SEQ ID NO: 246302 - DNA, 20 bp, Artificial Sequence
  chemically synthesized
cttagggggacctataatca

SEQ ID NO: 246303 - DNA, 20 bp, Artificial Sequence
  chemically synthesized
ttacagagcactatgattat

SEQ ID NO: 246304 - DNA, 20 bp, Artificial Sequence
  chemically synthesized
tttacagagcactatgatta

SEQ ID NO: 246305 - DNA, 20 bp, Artificial Sequence
  chemically synthesized
accagtttatagagtttaca

SEQ ID NO: 246306 - DNA, 20 bp, Artificial Sequence
  chemically synthesized
ccaccagtttatagagttta

SEQ ID NO: 246307 - DNA, 20 bp, Artificial Sequence
  chemically synthesized
gctctgtaaactctataaac

SEQ ID NO: 246308 - DNA, 20 bp, Artificial Sequence
  chemically synthesized
acttgtcccaccagtttata

SEQ ID NO: 246309 - DNA, 20 bp, Artificial Sequence
  chemically synthesized
gaacttgtcccaccagttta

SEQ ID NO: 246310 - DNA, 20 bp, Artificial Sequence
  chemically synthesized
ctgtaaactctataaactgg

SEQ ID NO: 246311 - DNA, 20 bp, Artificial Sequence
  chemically synthesized
tgtaaactctataaactggt

SEQ ID NO: 246312 - DNA, 20 bp, Artificial Sequence
  chemically synthesized
actctataaactggtgggac

SEQ ID NO: 246313 - DNA, 20 bp, Artificial Sequence
  chemically synthesized
aaattaggaacttgtcccac

SEQ ID NO: 246314 - DNA, 20 bp, Artificial Sequence
  chemically synthesized
aaatgtaattggcataaatt

SEQ ID NO: 246315 - DNA, 20 bp, Artificial Sequence
  chemically synthesized
taaatgtaattggcataaat

SEQ ID NO: 246316 - DNA, 20 bp, Artificial Sequence
  chemically synthesized
ttcaaatttctaaatgtaat

SEQ ID NO: 246317 - DNA, 20 bp, Artificial Sequence
  chemically synthesized
taatttatgccaattacatt

SEQ ID NO: 246318 - DNA, 20 bp, Artificial Sequence
  chemically synthesized
tacatttagaaatttgaatc

SEQ ID NO: 246319 - DNA, 20 bp, Artificial Sequence
  chemically synthesized
agaaatttgaatctagaatt

SEQ ID NO: 246320 - DNA, 20 bp, Artificial Sequence
  chemically synthesized
gactctacctttctcaattc

SEQ ID NO: 246321 - DNA, 20 bp, Artificial Sequence
  chemically synthesized
atttgaatctagaattgaga

SEQ ID NO: 246322 - DNA, 20 bp, Artificial Sequence
  chemically synthesized
tttgaatctagaattgagaa

SEQ ID NO: 246323 - DNA, 20 bp, Artificial Sequence
  chemically synthesized
gaatctagaattgagaaagg

SEQ ID NO: 246324 - DNA, 20 bp, Artificial Sequence
  chemically synthesized
atctagaattgagaaaggta

SEQ ID NO: 246325 - DNA, 20 bp, Artificial Sequence
  chemically synthesized
agaattgagaaaggtagagt

SEQ ID NO: 246326 - DNA, 20 bp, Artificial Sequence
  chemically synthesized
ggtagagtcagtacaatttg

SEQ ID NO: 246327 - DNA, 20 bp, Artificial Sequence
  chemically synthesized
gtcagtacaatttgaagctg

SEQ ID NO: 246328 - DNA, 20 bp, Artificial Sequence
  chemically synthesized
atgctgtcattaaaatgctt

SEQ ID NO: 246329 - DNA, 20 bp, Artificial Sequence
  chemically synthesized
aagctgaagcattttaatga

SEQ ID NO: 246330 - DNA, 20 bp, Artificial Sequence
  chemically synthesized
ttttaatgacagcatccaaa

SEQ ID NO: 246331 - DNA, 20 bp, Artificial Sequence
  chemically synthesized
actccagggaagttactttt

SEQ ID NO: 246332 - DNA, 20 bp, Artificial Sequence
  chemically synthesized
catccaaaaagtaacttccc

SEQ ID NO: 246333 - DNA, 20 bp, Artificial Sequence
  chemically synthesized
tccaaaaagtaacttccctg

SEQ ID NO: 246334 - DNA, 20 bp, Artificial Sequence
  chemically synthesized
gagagtcaggaactccaggg

SEQ ID NO: 246335 - DNA, 20 bp, Artificial Sequence
  chemically synthesized
actgagagtcaggaactcca

SEQ ID NO: 246336 - DNA, 20 bp, Artificial Sequence
  chemically synthesized
cactgagagtcaggaactcc

SEQ ID NO: 246337 - DNA, 20 bp, Artificial Sequence
  chemically synthesized
gcactgagagtcaggaactc

SEQ ID NO: 246338 - DNA, 20 bp, Artificial Sequence
  chemically synthesized
tccctggagttcctgactct

SEQ ID NO: 246339 - DNA, 20 bp, Artificial Sequence
  chemically synthesized
ggagggcagcactgagagtc

SEQ ID NO: 246340 - DNA, 20 bp, Artificial Sequence
  chemically synthesized
gggagggcagcactgagagt

SEQ ID NO: 246341 - DNA, 20 bp, Artificial Sequence
  chemically synthesized
cagagggagggcagcactga

SEQ ID NO: 246342 - DNA, 20 bp, Artificial Sequence
  chemically synthesized
ggcagagggagggcagcact

SEQ ID NO: 246343 - DNA, 20 bp, Artificial Sequence
  chemically synthesized
caactgtggcagagggaggg

SEQ ID NO: 246344 - DNA, 20 bp, Artificial Sequence
  chemically synthesized
aggcaactgtggcagaggga

SEQ ID NO: 246345 - DNA, 20 bp, Artificial Sequence
  chemically synthesized
aaggcaactgtggcagaggg

SEQ ID NO: 246346 - DNA, 20 bp, Artificial Sequence
  chemically synthesized
gaaggcaactgtggcagagg

SEQ ID NO: 246347 - DNA, 20 bp, Artificial Sequence
  chemically synthesized
gtgctgccctccctctgcca

SEQ ID NO: 246348 - DNA, 20 bp, Artificial Sequence
  chemically synthesized
aagaaggcaactgtggcaga

SEQ ID NO: 246349 - DNA, 20 bp, Artificial Sequence
  chemically synthesized
aaagaaggcaactgtggcag

SEQ ID NO: 246350 - DNA, 20 bp, Artificial Sequence
  chemically synthesized
aaaagaaggcaactgtggca

SEQ ID NO: 246351 - DNA, 20 bp, Artificial Sequence
  chemically synthesized
ggaaaagaaggcaactgtgg

SEQ ID NO: 246352 - DNA, 20 bp, Artificial Sequence
  chemically synthesized
gaaggaaaagaaggcaactg

SEQ ID NO: 246353 - DNA, 20 bp, Artificial Sequence
  chemically synthesized
cttggaaatgaaggaaaaga

SEQ ID NO: 246354 - DNA, 20 bp, Artificial Sequence
  chemically synthesized
tcttggaaatgaaggaaaag

SEQ ID NO: 246355 - DNA, 20 bp, Artificial Sequence
  chemically synthesized
agttcttggaaatgaaggaa

SEQ ID NO: 246356 - DNA, 20 bp, Artificial Sequence
  chemically synthesized
tgtatagttcttggaaatga

SEQ ID NO: 246357 - DNA, 20 bp, Artificial Sequence
  chemically synthesized
ccttcttttccttcatttcc

SEQ ID NO: 246358 - DNA, 20 bp, Artificial Sequence
  chemically synthesized
atgtatagttcttggaaatg

SEQ ID NO: 246359 - DNA, 20 bp, Artificial Sequence
  chemically synthesized
gagggataatgtatagttct

SEQ ID NO: 246360 - DNA, 20 bp, Artificial Sequence
  chemically synthesized
cttactggagggataatgta

SEQ ID NO: 246361 - DNA, 20 bp, Artificial Sequence
  chemically synthesized
agaactatacattatccctc

SEQ ID NO: 246362 - DNA, 20 bp, Artificial Sequence
  chemically synthesized
ctatacattatccctccagt

SEQ ID NO: 246363 - DNA, 20 bp, Artificial Sequence
  chemically synthesized
gtgaaatgaaacttactgga

SEQ ID NO: 246364 - DNA, 20 bp, Artificial Sequence
  chemically synthesized
agtgaaatgaaacttactgg

SEQ ID NO: 246365 - DNA, 20 bp, Artificial Sequence
  chemically synthesized
aagtgaaatgaaacttactg

SEQ ID NO: 246366 - DNA, 20 bp, Artificial Sequence
  chemically synthesized
tgaagtgaaatgaaacttac

SEQ ID NO: 246367 - DNA, 20 bp, Artificial Sequence
  chemically synthesized
cagtaagtttcatttcactt

SEQ ID NO: 246368 - DNA, 20 bp, Artificial Sequence
  chemically synthesized
aagccatctccatttaactg

SEQ ID NO: 246369 - DNA, 20 bp, Artificial Sequence
  chemically synthesized
ttcatttcacttcagttaaa

SEQ ID NO: 246370 - DNA, 20 bp, Artificial Sequence
  chemically synthesized
catttcacttcagttaaatg

SEQ ID NO: 246371 - DNA, 20 bp, Artificial Sequence
  chemically synthesized
tcacttcagttaaatggaga

SEQ ID NO: 246372 - DNA, 20 bp, Artificial Sequence
  chemically synthesized
gctttgattcgaagaagcag

SEQ ID NO: 246373 - DNA, 20 bp, Artificial Sequence
  chemically synthesized
gaagctttgattcgaagaag

SEQ ID NO: 246374 - DNA, 20 bp, Artificial Sequence
  chemically synthesized
taggaagctttgattcgaag

SEQ ID NO: 246375 - DNA, 20 bp, Artificial Sequence
  chemically synthesized
gcttctgcttcttcgaatca

SEQ ID NO: 246376 - DNA, 20 bp, Artificial Sequence
  chemically synthesized
cattaggaagctttgattcg

SEQ ID NO: 246377 - DNA, 20 bp, Artificial Sequence
  chemically synthesized
caccacctgtaaacattagg

SEQ ID NO: 246378 - DNA, 20 bp, Artificial Sequence
  chemically synthesized
cctcaccacctgtaaacatt

SEQ ID NO: 246379 - DNA, 20 bp, Artificial Sequence
  chemically synthesized
tcaaagcttcctaatgttta

SEQ ID NO: 246380 - DNA, 20 bp, Artificial Sequence
  chemically synthesized
tcctcaccacctgtaaacat

SEQ ID NO: 246381 - DNA, 20 bp, Artificial Sequence
  chemically synthesized
caaagcttcctaatgtttac

SEQ ID NO: 246382 - DNA, 20 bp, Artificial Sequence
  chemically synthesized
agcttcctaatgtttacagg

SEQ ID NO: 246383 - DNA, 20 bp, Artificial Sequence
  chemically synthesized
tcctaatgtttacaggtggt

SEQ ID NO: 246384 - DNA, 20 bp, Artificial Sequence
  chemically synthesized
cctaatgtttacaggtggtg

SEQ ID NO: 246385 - DNA, 20 bp, Artificial Sequence
  chemically synthesized
gagtgtaattttatatataa

SEQ ID NO: 246386 - DNA, 20 bp, Artificial Sequence
  chemically synthesized
atatataaaattacactcca

SEQ ID NO: 246387 - DNA, 20 bp, Artificial Sequence
  chemically synthesized
tataaaattacactccaaag

SEQ ID NO: 246388 - DNA, 20 bp, Artificial Sequence
  chemically synthesized
ccttattccatacttctttg

SEQ ID NO: 246389 - DNA, 20 bp, Artificial Sequence
  chemically synthesized
acccttattccatacttctt

SEQ ID NO: 246390 - DNA, 20 bp, Artificial Sequence
  chemically synthesized
aattacactccaaagaagta

SEQ ID NO: 246391 - DNA, 20 bp, Artificial Sequence
  chemically synthesized
actccaaagaagtatggaat

SEQ ID NO: 246392 - DNA, 20 bp, Artificial Sequence
  chemically synthesized
ctccaaagaagtatggaata

SEQ ID NO: 246393 - DNA, 20 bp, Artificial Sequence
  chemically synthesized
tccaaagaagtatggaataa

SEQ ID NO: 246394 - DNA, 20 bp, Artificial Sequence
  chemically synthesized
agtatggaataagggtattt

SEQ ID NO: 246395 - DNA, 20 bp, Artificial Sequence
  chemically synthesized
tatggaataagggtatttta

SEQ ID NO: 246396 - DNA, 20 bp, Artificial Sequence
  chemically synthesized
aagggtattttagagaaaat

SEQ ID NO: 246397 - DNA, 20 bp, Artificial Sequence
  chemically synthesized
aaaataagtacattttgctg

SEQ ID NO: 246398 - DNA, 20 bp, Artificial Sequence
  chemically synthesized
aataagtacattttgctgta

SEQ ID NO: 246399 - DNA, 20 bp, Artificial Sequence
  chemically synthesized
tgtatctctatgcaactcta

SEQ ID NO: 246400 - DNA, 20 bp, Artificial Sequence
  chemically synthesized
cattttgctgtagagttgca

SEQ ID NO: 246401 - DNA, 20 bp, Artificial Sequence
  chemically synthesized
ttttgctgtagagttgcata

SEQ ID NO: 246402 - DNA, 20 bp, Artificial Sequence
  chemically synthesized
gtagagttgcatagagatac

SEQ ID NO: 246403 - DNA, 20 bp, Artificial Sequence
  chemically synthesized
ttgcatagagatacaagtga

SEQ ID NO: 246404 - DNA, 20 bp, Artificial Sequence
  chemically synthesized
catagagatacaagtgacag

SEQ ID NO: 246405 - DNA, 20 bp, Artificial Sequence
  chemically synthesized
agatacaagtgacagaagct

SEQ ID NO: 246406 - DNA, 20 bp, Artificial Sequence
  chemically synthesized
acaagtgacagaagctaagt

SEQ ID NO: 246407 - DNA, 20 bp, Artificial Sequence
  chemically synthesized
caagtgacagaagctaagtt

SEQ ID NO: 246408 - DNA, 20 bp, Artificial Sequence
  chemically synthesized
aagtgacagaagctaagtta

SEQ ID NO: 246409 - DNA, 20 bp, Artificial Sequence
  chemically synthesized
ggcacttataaaccctaact

SEQ ID NO: 246410 - DNA, 20 bp, Artificial Sequence
  chemically synthesized
gaagctaagttagggtttat

SEQ ID NO: 246411 - DNA, 20 bp, Artificial Sequence
  chemically synthesized
aagttagggtttataagtgc

SEQ ID NO: 246412 - DNA, 20 bp, Artificial Sequence
  chemically synthesized
aacatccagaattcatagtc

SEQ ID NO: 246413 - DNA, 20 bp, Artificial Sequence
  chemically synthesized
aagtgccagactatgaattc

SEQ ID NO: 246414 - DNA, 20 bp, Artificial Sequence
  chemically synthesized
aggctaacatccagaattca

SEQ ID NO: 246415 - DNA, 20 bp, Artificial Sequence
  chemically synthesized
agactatgaattctggatgt

SEQ ID NO: 246416 - DNA, 20 bp, Artificial Sequence
  chemically synthesized
ctaggccagaggctaacatc

SEQ ID NO: 246417 - DNA, 20 bp, Artificial Sequence
  chemically synthesized
gaattctggatgttagcctc

SEQ ID NO: 246418 - DNA, 20 bp, Artificial Sequence
  chemically synthesized
ctggatgttagcctctggcc

SEQ ID NO: 246419 - DNA, 20 bp, Artificial Sequence
  chemically synthesized
tggatgttagcctctggcct

SEQ ID NO: 246420 - DNA, 20 bp, Artificial Sequence
  chemically synthesized
tttctaacctcctaggccag

SEQ ID NO: 246421 - DNA, 20 bp, Artificial Sequence
  chemically synthesized
ttttctaacctcctaggcca

SEQ ID NO: 246422 - DNA, 20 bp, Artificial Sequence
  chemically synthesized
gatgttagcctctggcctag

SEQ ID NO: 246423 - DNA, 20 bp, Artificial Sequence
  chemically synthesized
atgttagcctctggcctagg

SEQ ID NO: 246424 - DNA, 20 bp, Artificial Sequence
  chemically synthesized
gattttctaacctcctaggc

SEQ ID NO: 246425 - DNA, 20 bp, Artificial Sequence
  chemically synthesized
tagcctctggcctaggaggt

SEQ ID NO: 246426 - DNA, 20 bp, Artificial Sequence
  chemically synthesized
atttgattttctaacctcct

SEQ ID NO: 246427 - DNA, 20 bp, Artificial Sequence
  chemically synthesized
catttgattttctaacctcc

SEQ ID NO: 246428 - DNA, 20 bp, Artificial Sequence
  chemically synthesized
gttagaaaatcaaatgcctt

SEQ ID NO: 246429 - DNA, 20 bp, Artificial Sequence
  chemically synthesized
ttagaaaatcaaatgccttc

SEQ ID NO: 246430 - DNA, 20 bp, Artificial Sequence
  chemically synthesized
tagaaaatcaaatgccttca

SEQ ID NO: 246431 - DNA, 20 bp, Artificial Sequence
  chemically synthesized
agaaaatcaaatgccttcag

SEQ ID NO: 246432 - DNA, 20 bp, Artificial Sequence
  chemically synthesized
gtgtcccacgtgtcccctga

SEQ ID NO: 246433 - DNA, 20 bp, Artificial Sequence
  chemically synthesized
tgtgtcccacgtgtcccctg

SEQ ID NO: 246434 - DNA, 20 bp, Artificial Sequence
  chemically synthesized
aaatgccttcaggggacacg

SEQ ID NO: 246435 - DNA, 20 bp, Artificial Sequence
  chemically synthesized
aatgccttcaggggacacgt

SEQ ID NO: 246436 - DNA, 20 bp, Artificial Sequence
  chemically synthesized
gtgggacacataaaattgta

SEQ ID NO: 246437 - DNA, 20 bp, Artificial Sequence
  chemically synthesized
cacataaaattgtaaagcct

SEQ ID NO: 246438 - DNA, 20 bp, Artificial Sequence
  chemically synthesized
taaaattgtaaagccttaga

SEQ ID NO: 246439 - DNA, 20 bp, Artificial Sequence
  chemically synthesized
acttattgctatactttcta

SEQ ID NO: 246440 - DNA, 20 bp, Artificial Sequence
  chemically synthesized
cacttattgctatactttct

SEQ ID NO: 246441 - DNA, 20 bp, Artificial Sequence
  chemically synthesized
ttgtaaagccttagaaagta

SEQ ID NO: 246442 - DNA, 20 bp, Artificial Sequence
  chemically synthesized
gccttagaaagtatagcaat

SEQ ID NO: 246443 - DNA, 20 bp, Artificial Sequence
  chemically synthesized
agcaataagtgctaaactga

SEQ ID NO: 246444 - DNA, 20 bp, Artificial Sequence
  chemically synthesized
actgatcaacaccatcagtt

SEQ ID NO: 246445 - DNA, 20 bp, Artificial Sequence
  chemically synthesized
actggactgatcaacaccat

SEQ ID NO: 246446 - DNA, 20 bp, Artificial Sequence
  chemically synthesized
gctaaactgatggtgttgat

SEQ ID NO: 246447 - DNA, 20 bp, Artificial Sequence
  chemically synthesized
actgatggtgttgatcagtc

SEQ ID NO: 246448 - DNA, 20 bp, Artificial Sequence
  chemically synthesized
caatgaaaccgggcagagac

SEQ ID NO: 246449 - DNA, 20 bp, Artificial Sequence
  chemically synthesized
tgatcagtccagtctctgcc

SEQ ID NO: 246450 - DNA, 20 bp, Artificial Sequence
  chemically synthesized
aaaggcaatgaaaccgggca

SEQ ID NO: 246451 - DNA, 20 bp, Artificial Sequence
  chemically synthesized
taaaaggcaatgaaaccggg

SEQ ID NO: 246452 - DNA, 20 bp, Artificial Sequence
  chemically synthesized
cattaaaaggcaatgaaacc

SEQ ID NO: 246453 - DNA, 20 bp, Artificial Sequence
  chemically synthesized
acattaaaaggcaatgaaac

SEQ ID NO: 246454 - DNA, 20 bp, Artificial Sequence
  chemically synthesized
gacctgcaaggaacattaaa

SEQ ID NO: 246455 - DNA, 20 bp, Artificial Sequence
  chemically synthesized
tgacctgcaaggaacattaa

SEQ ID NO: 246456 - DNA, 20 bp, Artificial Sequence
  chemically synthesized
ttgccttttaatgttccttg

SEQ ID NO: 246457 - DNA, 20 bp, Artificial Sequence
  chemically synthesized
tgccttttaatgttccttgc

SEQ ID NO: 246458 - DNA, 20 bp, Artificial Sequence
  chemically synthesized
gctgctttgtttgacctgca

SEQ ID NO: 246459 - DNA, 20 bp, Artificial Sequence
  chemically synthesized
ggctgctttgtttgacctgc

SEQ ID NO: 246460 - DNA, 20 bp, Artificial Sequence
  chemically synthesized
tgttccttgcaggtcaaaca

SEQ ID NO: 246461 - DNA, 20 bp, Artificial Sequence
  chemically synthesized
tccttgcaggtcaaacaaag

SEQ ID NO: 246462 - DNA, 20 bp, Artificial Sequence
  chemically synthesized
gcaggtcaaacaaagcagcc

SEQ ID NO: 246463 - DNA, 20 bp, Artificial Sequence
  chemically synthesized
gctgaaggatatgttttgct

SEQ ID NO: 246464 - DNA, 20 bp, Artificial Sequence
  chemically synthesized
gccaagcaaaacatatcctt

SEQ ID NO: 246465 - DNA, 20 bp, Artificial Sequence
  chemically synthesized
ccaggagaaaagagagctga

SEQ ID NO: 246466 - DNA, 20 bp, Artificial Sequence
  chemically synthesized
cccaggagaaaagagagctg

SEQ ID NO: 246467 - DNA, 20 bp, Artificial Sequence
  chemically synthesized
ggtagccccaggagaaaaga

SEQ ID NO: 246468 - DNA, 20 bp, Artificial Sequence
  chemically synthesized
cgggtagccccaggagaaaa

SEQ ID NO: 246469 - DNA, 20 bp, Artificial Sequence
  chemically synthesized
ccttcagctctcttttctcc

SEQ ID NO: 246470 - DNA, 20 bp, Artificial Sequence
  chemically synthesized
cttcagctctcttttctcct

SEQ ID NO: 246471 - DNA, 20 bp, Artificial Sequence
  chemically synthesized
aacgggtagccccaggagaa

SEQ ID NO: 246472 - DNA, 20 bp, Artificial Sequence
  chemically synthesized
ttcagctctcttttctcctg

SEQ ID NO: 246473 - DNA, 20 bp, Artificial Sequence
  chemically synthesized
tttcaaacgggtagccccag

SEQ ID NO: 246474 - DNA, 20 bp, Artificial Sequence
  chemically synthesized
gatttcaaacgggtagcccc

SEQ ID NO: 246475 - DNA, 20 bp, Artificial Sequence
  chemically synthesized
tgatttcaaacgggtagccc

SEQ ID NO: 246476 - DNA, 20 bp, Artificial Sequence
  chemically synthesized
tagctttgatttcaaacggg

SEQ ID NO: 246477 - DNA, 20 bp, Artificial Sequence
  chemically synthesized
tgatagctttgatttcaaac

SEQ ID NO: 246478 - DNA, 20 bp, Artificial Sequence
  chemically synthesized
ttgatagctttgatttcaaa

SEQ ID NO: 246479 - DNA, 20 bp, Artificial Sequence
  chemically synthesized
gggctacccgtttgaaatca

SEQ ID NO: 246480 - DNA, 20 bp, Artificial Sequence
  chemically synthesized
tttgaaatcaaagctatcaa

SEQ ID NO: 246481 - DNA, 20 bp, Artificial Sequence
  chemically synthesized
tgaaatcaaagctatcaaca

SEQ ID NO: 246482 - DNA, 20 bp, Artificial Sequence
  chemically synthesized
cttcagtgtttctctgttga

SEQ ID NO: 246483 - DNA, 20 bp, Artificial Sequence
  chemically synthesized
ctatcaacagagaaacactg

SEQ ID NO: 246484 - DNA, 20 bp, Artificial Sequence
  chemically synthesized
tatcaacagagaaacactga

SEQ ID NO: 246485 - DNA, 20 bp, Artificial Sequence
  chemically synthesized
tttcccagcacaggaacctt

SEQ ID NO: 246486 - DNA, 20 bp, Artificial Sequence
  chemically synthesized
aacactgaaggttcctgtgc

SEQ ID NO: 246487 - DNA, 20 bp, Artificial Sequence
  chemically synthesized
acactgaaggttcctgtgct

SEQ ID NO: 246488 - DNA, 20 bp, Artificial Sequence
  chemically synthesized
tgcttcacatttcccagcac

SEQ ID NO: 246489 - DNA, 20 bp, Artificial Sequence
  chemically synthesized
ctgcttcacatttcccagca

SEQ ID NO: 246490 - DNA, 20 bp, Artificial Sequence
  chemically synthesized
cactcctgcttcacatttcc

SEQ ID NO: 246491 - DNA, 20 bp, Artificial Sequence
  chemically synthesized
ttcctgtgctgggaaatgtg

SEQ ID NO: 246492 - DNA, 20 bp, Artificial Sequence
  chemically synthesized
ctgtgctgggaaatgtgaag

SEQ ID NO: 246493 - DNA, 20 bp, Artificial Sequence
  chemically synthesized
tgtgctgggaaatgtgaagc

SEQ ID NO: 246494 - DNA, 20 bp, Artificial Sequence
  chemically synthesized
tgctgggaaatgtgaagcag

SEQ ID NO: 246495 - DNA, 20 bp, Artificial Sequence
  chemically synthesized
gtgaagcaggagtgctgctt

SEQ ID NO: 246496 - DNA, 20 bp, Artificial Sequence
  chemically synthesized
agcaggagtgctgcttcaga

SEQ ID NO: 246497 - DNA, 20 bp, Artificial Sequence
  chemically synthesized
aagagttaacctttctgaag

SEQ ID NO: 246498 - DNA, 20 bp, Artificial Sequence
  chemically synthesized
gcaggagtgctgcttcagaa

SEQ ID NO: 246499 - DNA, 20 bp, Artificial Sequence
  chemically synthesized
tgaaagagttaacctttctg

SEQ ID NO: 246500 - DNA, 20 bp, Artificial Sequence
  chemically synthesized
agaaaggttaactctttcaa

SEQ ID NO: 246501 - DNA, 20 bp, Artificial Sequence
  chemically synthesized
aatcactgtttcttttgaaa

SEQ ID NO: 246502 - DNA, 20 bp, Artificial Sequence
  chemically synthesized
caaatcactgtttcttttga

SEQ ID NO: 246503 - DNA, 20 bp, Artificial Sequence
  chemically synthesized
gttaactctttcaaaagaaa

SEQ ID NO: 246504 - DNA, 20 bp, Artificial Sequence
  chemically synthesized
tttcaaaagaaacagtgatt

SEQ ID NO: 246505 - DNA, 20 bp, Artificial Sequence
  chemically synthesized
ttcaaaagaaacagtgattt

SEQ ID NO: 246506 - DNA, 20 bp, Artificial Sequence
  chemically synthesized
aaaagaaacagtgatttggg

SEQ ID NO: 246507 - DNA, 20 bp, Artificial Sequence
  chemically synthesized
aagaaacagtgatttgggtg

SEQ ID NO: 246508 - DNA, 20 bp, Artificial Sequence
  chemically synthesized
gaaacagtgatttgggtgga

SEQ ID NO: 246509 - DNA, 20 bp, Artificial Sequence
  chemically synthesized
aacagtgatttgggtggaga

SEQ ID NO: 246510 - DNA, 20 bp, Artificial Sequence
  chemically synthesized
ggtggagagagatctcttac

SEQ ID NO: 246511 - DNA, 20 bp, Artificial Sequence
  chemically synthesized
gtggagagagatctcttaca

SEQ ID NO: 246512 - DNA, 20 bp, Artificial Sequence
  chemically synthesized
agtcagtagataccttgtaa

SEQ ID NO: 246513 - DNA, 20 bp, Artificial Sequence
  chemically synthesized
caagtcagtagataccttgt

SEQ ID NO: 246514 - DNA, 20 bp, Artificial Sequence
  chemically synthesized
ggacatcaatcgcaagtcag

SEQ ID NO: 246515 - DNA, 20 bp, Artificial Sequence
  chemically synthesized
cctggacatcaatcgcaagt

SEQ ID NO: 246516 - DNA, 20 bp, Artificial Sequence
  chemically synthesized
ttctcctggacatcaatcgc

SEQ ID NO: 246517 - DNA, 20 bp, Artificial Sequence
  chemically synthesized
actgacttgcgattgatgtc

SEQ ID NO: 246518 - DNA, 20 bp, Artificial Sequence
  chemically synthesized
ctgacttgcgattgatgtcc

SEQ ID NO: 246519 - DNA, 20 bp, Artificial Sequence
  chemically synthesized
gacttgcgattgatgtccag

SEQ ID NO: 246520 - DNA, 20 bp, Artificial Sequence
  chemically synthesized
gccctcccttttcattctcc

SEQ ID NO: 246521 - DNA, 20 bp, Artificial Sequence
  chemically synthesized
ttgatgtccaggagaatgaa

SEQ ID NO: 246522 - DNA, 20 bp, Artificial Sequence
  chemically synthesized
tgatgtccaggagaatgaaa

SEQ ID NO: 246523 - DNA, 20 bp, Artificial Sequence
  chemically synthesized
gatgtccaggagaatgaaaa

SEQ ID NO: 246524 - DNA, 20 bp, Artificial Sequence
  chemically synthesized
tgtccaggagaatgaaaagg

SEQ ID NO: 246525 - DNA, 20 bp, Artificial Sequence
  chemically synthesized
gtccaggagaatgaaaaggg

SEQ ID NO: 246526 - DNA, 20 bp, Artificial Sequence
  chemically synthesized
tccaggagaatgaaaaggga

SEQ ID NO: 246527 - DNA, 20 bp, Artificial Sequence
  chemically synthesized
ggagggcatgaaaacataaa

SEQ ID NO: 246528 - DNA, 20 bp, Artificial Sequence
  chemically synthesized
atgaaaacataaaaagtgta

SEQ ID NO: 246529 - DNA, 20 bp, Artificial Sequence
  chemically synthesized
cataaaaagtgtacagaatc

SEQ ID NO: 246530 - DNA, 20 bp, Artificial Sequence
  chemically synthesized
agtgtacagaatccagtaaa

SEQ ID NO: 246531 - DNA, 20 bp, Artificial Sequence
  chemically synthesized
ttgaatattttgccatttac

SEQ ID NO: 246532 - DNA, 20 bp, Artificial Sequence
  chemically synthesized
aatggcaaaatattcaatta

SEQ ID NO: 246533 - DNA, 20 bp, Artificial Sequence
  chemically synthesized
caaaatattcaattaaagtg

SEQ ID NO: 246534 - DNA, 20 bp, Artificial Sequence
  chemically synthesized
aaaatattcaattaaagtgc

SEQ ID NO: 246535 - DNA, 20 bp, Artificial Sequence
  chemically synthesized
aaatattcaattaaagtgca

SEQ ID NO: 246536 - DNA, 20 bp, Artificial Sequence
  chemically synthesized
atattcaattaaagtgcagg

SEQ ID NO: 246537 - DNA, 20 bp, Artificial Sequence
  chemically synthesized
tattcaattaaagtgcaggg

SEQ ID NO: 246538 - DNA, 20 bp, Artificial Sequence
  chemically synthesized
ttaaagtgcagggaggtata

SEQ ID NO: 246539 - DNA, 20 bp, Artificial Sequence
  chemically synthesized
agtgcagggaggtataaaga

SEQ ID NO: 246540 - DNA, 20 bp, Artificial Sequence
  chemically synthesized
gtgcagggaggtataaagaa

SEQ ID NO: 246541 - DNA, 20 bp, Artificial Sequence
  chemically synthesized
gacaacacatgttttaatct

SEQ ID NO: 246542 - DNA, 20 bp, Artificial Sequence
  chemically synthesized
acaacacatgttttaatctg

SEQ ID NO: 246543 - DNA, 20 bp, Artificial Sequence
  chemically synthesized
attatttcttataatgtcct

SEQ ID NO: 246544 - DNA, 20 bp, Artificial Sequence
  chemically synthesized
ttttaatctgaggacattat

SEQ ID NO: 246545 - DNA, 20 bp, Artificial Sequence
  chemically synthesized
gaggacattataagaaataa

SEQ ID NO: 246546 - DNA, 20 bp, Artificial Sequence
  chemically synthesized
gacattataagaaataatgg

SEQ ID NO: 246547 - DNA, 20 bp, Artificial Sequence
  chemically synthesized
aaataatggtggtatgttct

SEQ ID NO: 246548 - DNA, 20 bp, Artificial Sequence
  chemically synthesized
ggtggtatgttcttggaatt

SEQ ID NO: 246549 - DNA, 20 bp, Artificial Sequence
  chemically synthesized
tagttaggcttctcaattcc

SEQ ID NO: 246550 - DNA, 20 bp, Artificial Sequence
  chemically synthesized
ggtatgttcttggaattgag

SEQ ID NO: 246551 - DNA, 20 bp, Artificial Sequence
  chemically synthesized
tggaattgagaagcctaact

SEQ ID NO: 246552 - DNA, 20 bp, Artificial Sequence
  chemically synthesized
ctataacctgtgacttagtt

SEQ ID NO: 246553 - DNA, 20 bp, Artificial Sequence
  chemically synthesized
cctataacctgtgacttagt

SEQ ID NO: 246554 - DNA, 20 bp, Artificial Sequence
  chemically synthesized
tgagaagcctaactaagtca

SEQ ID NO: 246555 - DNA, 20 bp, Artificial Sequence
  chemically synthesized
gagaagcctaactaagtcac

SEQ ID NO: 246556 - DNA, 20 bp, Artificial Sequence
  chemically synthesized
gattcctataacctgtgact

SEQ ID NO: 246557 - DNA, 20 bp, Artificial Sequence
  chemically synthesized
cctaactaagtcacaggtta

SEQ ID NO: 246558 - DNA, 20 bp, Artificial Sequence
  chemically synthesized
ctaactaagtcacaggttat

SEQ ID NO: 246559 - DNA, 20 bp, Artificial Sequence
  chemically synthesized
gtcacaggttataggaatca

SEQ ID NO: 246560 - DNA, 20 bp, Artificial Sequence
  chemically synthesized
acaggttataggaatcaaag

SEQ ID NO: 246561 - DNA, 20 bp, Artificial Sequence
  chemically synthesized
ggttataggaatcaaagtgg

SEQ ID NO: 246562 - DNA, 20 bp, Artificial Sequence
  chemically synthesized
aagtggtggtgctattgact

SEQ ID NO: 246563 - DNA, 20 bp, Artificial Sequence
  chemically synthesized
tcttaaatttaccaagtcaa

SEQ ID NO: 246564 - DNA, 20 bp, Artificial Sequence
  chemically synthesized
aaagttctcttaaatttacc

SEQ ID NO: 246565 - DNA, 20 bp, Artificial Sequence
  chemically synthesized
gctattgacttggtaaattt

SEQ ID NO: 246566 - DNA, 20 bp, Artificial Sequence
  chemically synthesized
tattgacttggtaaatttaa

SEQ ID NO: 246567 - DNA, 20 bp, Artificial Sequence
  chemically synthesized
acgaattcacaaattttata

SEQ ID NO: 246568 - DNA, 20 bp, Artificial Sequence
  chemically synthesized
gtgctattgcatttaagata

SEQ ID NO: 246569 - DNA, 20 bp, Artificial Sequence
  chemically synthesized
gcattagtgctattgcattt

SEQ ID NO: 246570 - DNA, 20 bp, Artificial Sequence
  chemically synthesized
tttctttatcttaaatgcaa

SEQ ID NO: 246571 - DNA, 20 bp, Artificial Sequence
  chemically synthesized
aggttgttcttttgaggcat

SEQ ID NO: 246572 - DNA, 20 bp, Artificial Sequence
  chemically synthesized
caatagcactaatgcctcaa

SEQ ID NO: 246573 - DNA, 20 bp, Artificial Sequence
  chemically synthesized
atttgtaggttgttcttttg

SEQ ID NO: 246574 - DNA, 20 bp, Artificial Sequence
  chemically synthesized
catttgtaggttgttctttt

SEQ ID NO: 246575 - DNA, 20 bp, Artificial Sequence
  chemically synthesized
ttctgtgggtagacatttgt

SEQ ID NO: 246576 - DNA, 20 bp, Artificial Sequence
  chemically synthesized
cttctgtgggtagacatttg

SEQ ID NO: 246577 - DNA, 20 bp, Artificial Sequence
  chemically synthesized
aacctacaaatgtctaccca

SEQ ID NO: 246578 - DNA, 20 bp, Artificial Sequence
  chemically synthesized
ctacaaatgtctacccacag

SEQ ID NO: 246579 - DNA, 20 bp, Artificial Sequence
  chemically synthesized
gcctgtataacttctgtggg

SEQ ID NO: 246580 - DNA, 20 bp, Artificial Sequence
  chemically synthesized
atagcctgtataacttctgt

SEQ ID NO: 246581 - DNA, 20 bp, Artificial Sequence
  chemically synthesized
aatagcctgtataacttctg

SEQ ID NO: 246582 - DNA, 20 bp, Artificial Sequence
  chemically synthesized
gtctacccacagaagttata

SEQ ID NO: 246583 - DNA, 20 bp, Artificial Sequence
  chemically synthesized
tctacccacagaagttatac

SEQ ID NO: 246584 - DNA, 20 bp, Artificial Sequence
  chemically synthesized
agccattcattgaaacaaaa

SEQ ID NO: 246585 - DNA, 20 bp, Artificial Sequence
  chemically synthesized
ggctattttgtttcaatgaa

SEQ ID NO: 246586 - DNA, 20 bp, Artificial Sequence
  chemically synthesized
attttgtttcaatgaatggc

SEQ ID NO: 246587 - DNA, 20 bp, Artificial Sequence
  chemically synthesized
tttcaatgaatggctggccc

SEQ ID NO: 246588 - DNA, 20 bp, Artificial Sequence
  chemically synthesized
gtgcaaccattttctcgggc

SEQ ID NO: 246589 - DNA, 20 bp, Artificial Sequence
  chemically synthesized
gaatggctggcccgagaaaa

SEQ ID NO: 246590 - DNA, 20 bp, Artificial Sequence
  chemically synthesized
ttgagtgcaaccattttctc

SEQ ID NO: 246591 - DNA, 20 bp, Artificial Sequence
  chemically synthesized
cttgagtgcaaccattttct

SEQ ID NO: 246592 - DNA, 20 bp, Artificial Sequence
  chemically synthesized
ccgagaaaatggttgcactc

SEQ ID NO: 246593 - DNA, 20 bp, Artificial Sequence
  chemically synthesized
gagaaaatggttgcactcaa

SEQ ID NO: 246594 - DNA, 20 bp, Artificial Sequence
  chemically synthesized
gaaaatggttgcactcaaga

SEQ ID NO: 246595 - DNA, 20 bp, Artificial Sequence
  chemically synthesized
agtcgcaaacattctctctt

SEQ ID NO: 246596 - DNA, 20 bp, Artificial Sequence
  chemically synthesized
agaatgtttgcgactgtttt

SEQ ID NO: 246597 - DNA, 20 bp, Artificial Sequence
  chemically synthesized
cacagaagaatttccaaaaa

SEQ ID NO: 246598 - DNA, 20 bp, Artificial Sequence
  chemically synthesized
tgtttttggaaattcttctg

SEQ ID NO: 246599 - DNA, 20 bp, Artificial Sequence
  chemically synthesized
gtttttggaaattcttctgt

SEQ ID NO: 246600 - DNA, 20 bp, Artificial Sequence
  chemically synthesized
tattattacccaacccacag

SEQ ID NO: 246601 - DNA, 20 bp, Artificial Sequence
  chemically synthesized
ttggaaattcttctgtgggt

SEQ ID NO: 246602 - DNA, 20 bp, Artificial Sequence
  chemically synthesized
tggaaattcttctgtgggtt

SEQ ID NO: 246603 - DNA, 20 bp, Artificial Sequence
  chemically synthesized
gtgtattattacccaaccca

SEQ ID NO: 246604 - DNA, 20 bp, Artificial Sequence
  chemically synthesized
ggttgggtaataatacactc

SEQ ID NO: 246605 - DNA, 20 bp, Artificial Sequence
  chemically synthesized
ttgggtaataatacactcaa

SEQ ID NO: 246606 - DNA, 20 bp, Artificial Sequence
  chemically synthesized
aaatcacaaacatgtctctt

SEQ ID NO: 246607 - DNA, 20 bp, Artificial Sequence
  chemically synthesized
agacatgtttgtgatttttc

SEQ ID NO: 246608 - DNA, 20 bp, Artificial Sequence
  chemically synthesized
gacatgtttgtgatttttct

SEQ ID NO: 246609 - DNA, 20 bp, Artificial Sequence
  chemically synthesized
cactccacgaaaaaatttcc

SEQ ID NO: 246610 - DNA, 20 bp, Artificial Sequence
  chemically synthesized
ttttctgggaaattttttcg

SEQ ID NO: 246611 - DNA, 20 bp, Artificial Sequence
  chemically synthesized
ttctgggaaattttttcgtg

SEQ ID NO: 246612 - DNA, 20 bp, Artificial Sequence
  chemically synthesized
tgggaaattttttcgtggag

SEQ ID NO: 246613 - DNA, 20 bp, Artificial Sequence
  chemically synthesized
gggaaattttttcgtggagt

SEQ ID NO: 246614 - DNA, 20 bp, Artificial Sequence
  chemically synthesized
ttcgtggagtgggtaataaa

SEQ ID NO: 246615 - DNA, 20 bp, Artificial Sequence
  chemically synthesized
cgtggagtgggtaataaata

SEQ ID NO: 246616 - DNA, 20 bp, Artificial Sequence
  chemically synthesized
ggagtgggtaataaatagag

SEQ ID NO: 246617 - DNA, 20 bp, Artificial Sequence
  chemically synthesized
taataaatagagcagaatat

SEQ ID NO: 246618 - DNA, 20 bp, Artificial Sequence
  chemically synthesized
aataaatagagcagaatatt

SEQ ID NO: 246619 - DNA, 20 bp, Artificial Sequence
  chemically synthesized
aatagagcagaatattaggt

SEQ ID NO: 246620 - DNA, 20 bp, Artificial Sequence
  chemically synthesized
aggtgagaaatactcaattt

SEQ ID NO: 246621 - DNA, 20 bp, Artificial Sequence
  chemically synthesized
ggtgagaaatactcaatttc

SEQ ID NO: 246622 - DNA, 20 bp, Artificial Sequence
  chemically synthesized
aaataactagtcctgaaatt

SEQ ID NO: 246623 - DNA, 20 bp, Artificial Sequence
  chemically synthesized
gaaatactcaatttcaggac

SEQ ID NO: 246624 - DNA, 20 bp, Artificial Sequence
  chemically synthesized
ttacaacagtttaaaataac

SEQ ID NO: 246625 - DNA, 20 bp, Artificial Sequence
  chemically synthesized
tttaatattataatttacaa

SEQ ID NO: 246626 - DNA, 20 bp, Artificial Sequence
  chemically synthesized
ttaatacctgagtacagaaa

SEQ ID NO: 246627 - DNA, 20 bp, Artificial Sequence
  chemically synthesized
atatgttctttttctgtact

SEQ ID NO: 246628 - DNA, 20 bp, Artificial Sequence
  chemically synthesized
tatgttctttttctgtactc

SEQ ID NO: 246629 - DNA, 20 bp, Artificial Sequence
  chemically synthesized
tttgatttaatacctgagta

SEQ ID NO: 246630 - DNA, 20 bp, Artificial Sequence
  chemically synthesized
aaatatttgatttaatacct

SEQ ID NO: 246631 - DNA, 20 bp, Artificial Sequence
  chemically synthesized
ggtattaaatcaaatatttt

SEQ ID NO: 246632 - DNA, 20 bp, Artificial Sequence
  chemically synthesized
gtattaaatcaaatattttt

SEQ ID NO: 246633 - DNA, 20 bp, Artificial Sequence
  chemically synthesized
atcaaatatttttgggtaat

SEQ ID NO: 246634 - DNA, 20 bp, Artificial Sequence
  chemically synthesized
aaatatttttgggtaattag

SEQ ID NO: 246635 - DNA, 20 bp, Artificial Sequence
  chemically synthesized
tatttttgggtaattagtgg

SEQ ID NO: 246636 - DNA, 20 bp, Artificial Sequence
  chemically synthesized
atttttgggtaattagtgga

SEQ ID NO: 246637 - DNA, 20 bp, Artificial Sequence
  chemically synthesized
ttgggtaattagtggaaggt

SEQ ID NO: 246638 - DNA, 20 bp, Artificial Sequence
  chemically synthesized
gtggaaggtgagcttataaa

SEQ ID NO: 246639 - DNA, 20 bp, Artificial Sequence
  chemically synthesized
tttgctatcaatctttttat

SEQ ID NO: 246640 - DNA, 20 bp, Artificial Sequence
  chemically synthesized
tgagcttataaaaagattga

SEQ ID NO: 246641 - DNA, 20 bp, Artificial Sequence
  chemically synthesized
aagattgatagcaaataaaa

SEQ ID NO: 246642 - DNA, 20 bp, Artificial Sequence
  chemically synthesized
aagtaaccctggagttgagg

SEQ ID NO: 246643 - DNA, 20 bp, Artificial Sequence
  chemically synthesized
aacagtaactgcctcaactc

SEQ ID NO: 246644 - DNA, 20 bp, Artificial Sequence
  chemically synthesized
acagtaactgcctcaactcc

SEQ ID NO: 246645 - DNA, 20 bp, Artificial Sequence
  chemically synthesized
atcaagtaaccctggagttg

SEQ ID NO: 246646 - DNA, 20 bp, Artificial Sequence
  chemically synthesized
cagtaactgcctcaactcca

SEQ ID NO: 246647 - DNA, 20 bp, Artificial Sequence
  chemically synthesized
tatcaagtaaccctggagtt

SEQ ID NO: 246648 - DNA, 20 bp, Artificial Sequence
  chemically synthesized
ttaggtatcaagtaaccctg

SEQ ID NO: 246649 - DNA, 20 bp, Artificial Sequence
  chemically synthesized
ccttaggtatcaagtaaccc

SEQ ID NO: 246650 - DNA, 20 bp, Artificial Sequence
  chemically synthesized
tccagggttacttgatacct

SEQ ID NO: 246651 - DNA, 20 bp, Artificial Sequence
  chemically synthesized
tggattagcccttaggtatc

SEQ ID NO: 246652 - DNA, 20 bp, Artificial Sequence
  chemically synthesized
ccagggttacttgataccta

SEQ ID NO: 246653 - DNA, 20 bp, Artificial Sequence
  chemically synthesized
cagggttacttgatacctaa

SEQ ID NO: 246654 - DNA, 20 bp, Artificial Sequence
  chemically synthesized
tcatgtttggattagccctt

SEQ ID NO: 246655 - DNA, 20 bp, Artificial Sequence
  chemically synthesized
atcatgtttggattagccct

SEQ ID NO: 246656 - DNA, 20 bp, Artificial Sequence
  chemically synthesized
agatactatcatgtttggat

SEQ ID NO: 246657 - DNA, 20 bp, Artificial Sequence
  chemically synthesized
aagggctaatccaaacatga

SEQ ID NO: 246658 - DNA, 20 bp, Artificial Sequence
  chemically synthesized
tttaaagatactatcatgtt

SEQ ID NO: 246659 - DNA, 20 bp, Artificial Sequence
  chemically synthesized
gggtctacattatgtattta

SEQ ID NO: 246660 - DNA, 20 bp, Artificial Sequence
  chemically synthesized
gtatctttaaatacataatg

SEQ ID NO: 246661 - DNA, 20 bp, Artificial Sequence
  chemically synthesized
cataatgtagacccataaac

SEQ ID NO: 246662 - DNA, 20 bp, Artificial Sequence
  chemically synthesized
tgattccgatactagtttat

SEQ ID NO: 246663 - DNA, 20 bp, Artificial Sequence
  chemically synthesized
ttgattccgatactagttta

SEQ ID NO: 246664 - DNA, 20 bp, Artificial Sequence
  chemically synthesized
gtagacccataaactagtat

SEQ ID NO: 246665 - DNA, 20 bp, Artificial Sequence
  chemically synthesized
ttgtaatttgattccgatac

SEQ ID NO: 246666 - DNA, 20 bp, Artificial Sequence
  chemically synthesized
tgtgattacacacattaaga

SEQ ID NO: 246667 - DNA, 20 bp, Artificial Sequence
  chemically synthesized
tccgtgtgattacacacatt

SEQ ID NO: 246668 - DNA, 20 bp, Artificial Sequence
  chemically synthesized
tcttaatgtgtgtaatcaca

SEQ ID NO: 246669 - DNA, 20 bp, Artificial Sequence
  chemically synthesized
ttaatgtgtgtaatcacacg

SEQ ID NO: 246670 - DNA, 20 bp, Artificial Sequence
  chemically synthesized
tcatattattcacaaaatga

SEQ ID NO: 246671 - DNA, 20 bp, Artificial Sequence
  chemically synthesized
attattcacaaaatgaaagt

SEQ ID NO: 246672 - DNA, 20 bp, Artificial Sequence
  chemically synthesized
attcacaaaatgaaagttag

SEQ ID NO: 246673 - DNA, 20 bp, Artificial Sequence
  chemically synthesized
aatgaaagttagtagtttgt

SEQ ID NO: 246674 - DNA, 20 bp, Artificial Sequence
  chemically synthesized
agttagtagtttgtgagtga

SEQ ID NO: 246675 - DNA, 20 bp, Artificial Sequence
  chemically synthesized
tagtagtttgtgagtgaaag

SEQ ID NO: 246676 - DNA, 20 bp, Artificial Sequence
  chemically synthesized
agtagtttgtgagtgaaaga

SEQ ID NO: 246677 - DNA, 20 bp, Artificial Sequence
  chemically synthesized
agtttgtgagtgaaagaagg

SEQ ID NO: 246678 - DNA, 20 bp, Artificial Sequence
  chemically synthesized
gtgagtgaaagaaggcagac

SEQ ID NO: 246679 - DNA, 20 bp, Artificial Sequence
  chemically synthesized
aaagaaggcagaccagaaat

SEQ ID NO: 246680 - DNA, 20 bp, Artificial Sequence
  chemically synthesized
aagaaggcagaccagaaata

SEQ ID NO: 246681 - DNA, 20 bp, Artificial Sequence
  chemically synthesized
tgaagtatgtaccttatttc

SEQ ID NO: 246682 - DNA, 20 bp, Artificial Sequence
  chemically synthesized
tttataaaagtagaatcatg

SEQ ID NO: 246683 - DNA, 20 bp, Artificial Sequence
  chemically synthesized
tttatagaattttataaaag

SEQ ID NO: 246684 - DNA, 20 bp, Artificial Sequence
  chemically synthesized
cgttttatagaattttataa

SEQ ID NO: 246685 - DNA, 20 bp, Artificial Sequence
  chemically synthesized
atagataagtttgcgtttta

SEQ ID NO: 246686 - DNA, 20 bp, Artificial Sequence
  chemically synthesized
tgctgactggcattatagat

SEQ ID NO: 246687 - DNA, 20 bp, Artificial Sequence
  chemically synthesized
cgcaaacttatctataatgc

SEQ ID NO: 246688 - DNA, 20 bp, Artificial Sequence
  chemically synthesized
actgatgctgactggcatta

SEQ ID NO: 246689 - DNA, 20 bp, Artificial Sequence
  chemically synthesized
aacttatctataatgccagt

SEQ ID NO: 246690 - DNA, 20 bp, Artificial Sequence
  chemically synthesized
aggttaccactgatgctgac

SEQ ID NO: 246691 - DNA, 20 bp, Artificial Sequence
  chemically synthesized
tctataatgccagtcagcat

SEQ ID NO: 246692 - DNA, 20 bp, Artificial Sequence
  chemically synthesized
ataatgccagtcagcatcag

SEQ ID NO: 246693 - DNA, 20 bp, Artificial Sequence
  chemically synthesized
agtcagcatcagtggtaacc

SEQ ID NO: 246694 - DNA, 20 bp, Artificial Sequence
  chemically synthesized
gtcagcatcagtggtaacct

SEQ ID NO: 246695 - DNA, 20 bp, Artificial Sequence
  chemically synthesized
tcagtggtaacctgggaatc

SEQ ID NO: 246696 - DNA, 20 bp, Artificial Sequence
  chemically synthesized
ctgcccctcccttgattccc

SEQ ID NO: 246697 - DNA, 20 bp, Artificial Sequence
  chemically synthesized
cagtggtaacctgggaatca

SEQ ID NO: 246698 - DNA, 20 bp, Artificial Sequence
  chemically synthesized
cctgcccctcccttgattcc

SEQ ID NO: 246699 - DNA, 20 bp, Artificial Sequence
  chemically synthesized
agtggtaacctgggaatcaa

SEQ ID NO: 246700 - DNA, 20 bp, Artificial Sequence
  chemically synthesized
tggtaacctgggaatcaagg

SEQ ID NO: 246701 - DNA, 20 bp, Artificial Sequence
  chemically synthesized
ggtaacctgggaatcaaggg

SEQ ID NO: 246702 - DNA, 20 bp, Artificial Sequence
  chemically synthesized
gtaacctgggaatcaaggga

SEQ ID NO: 246703 - DNA, 20 bp, Artificial Sequence
  chemically synthesized
taacctgggaatcaagggag

SEQ ID NO: 246704 - DNA, 20 bp, Artificial Sequence
  chemically synthesized
cctgggaatcaagggagggg

SEQ ID NO: 246705 - DNA, 20 bp, Artificial Sequence
  chemically synthesized
ctgggaatcaagggaggggc

SEQ ID NO: 246706 - DNA, 20 bp, Artificial Sequence
  chemically synthesized
gggaatcaagggaggggcag

SEQ ID NO: 246707 - DNA, 20 bp, Artificial Sequence
  chemically synthesized
gaatcaagggaggggcagga

SEQ ID NO: 246708 - DNA, 20 bp, Artificial Sequence
  chemically synthesized
atcaagggaggggcaggaga

SEQ ID NO: 246709 - DNA, 20 bp, Artificial Sequence
  chemically synthesized
gagagagtgattaccgaaaa

SEQ ID NO: 246710 - DNA, 20 bp, Artificial Sequence
  chemically synthesized
tatcctcacaagtctgtttt

SEQ ID NO: 246711 - DNA, 20 bp, Artificial Sequence
  chemically synthesized
attaccgaaaacagacttgt

SEQ ID NO: 246712 - DNA, 20 bp, Artificial Sequence
  chemically synthesized
ttaccgaaaacagacttgtg

SEQ ID NO: 246713 - DNA, 20 bp, Artificial Sequence
  chemically synthesized
aacatatccaatatcctcac

SEQ ID NO: 246714 - DNA, 20 bp, Artificial Sequence
  chemically synthesized
aaacagacttgtgaggatat

SEQ ID NO: 246715 - DNA, 20 bp, Artificial Sequence
  chemically synthesized
gtgaaactattagcacagtc

SEQ ID NO: 246716 - DNA, 20 bp, Artificial Sequence
  chemically synthesized
tattatcttgactgtgctaa

SEQ ID NO: 246717 - DNA, 20 bp, Artificial Sequence
  chemically synthesized
taccagtgaaactattagca

SEQ ID NO: 246718 - DNA, 20 bp, Artificial Sequence
  chemically synthesized
gcaaataccagtgaaactat

SEQ ID NO: 246719 - DNA, 20 bp, Artificial Sequence
  chemically synthesized
gactgtgctaatagtttcac

SEQ ID NO: 246720 - DNA, 20 bp, Artificial Sequence
  chemically synthesized
gttttgacatatgcaaatac

SEQ ID NO: 246721 - DNA, 20 bp, Artificial Sequence
  chemically synthesized
tttaaatagtacaatttgat

SEQ ID NO: 246722 - DNA, 20 bp, Artificial Sequence
  chemically synthesized
caataagctacacatttaaa

SEQ ID NO: 246723 - DNA, 20 bp, Artificial Sequence
  chemically synthesized
aattgtactatttaaatgtg

SEQ ID NO: 246724 - DNA, 20 bp, Artificial Sequence
  chemically synthesized
tggtataaatgatatacaat

SEQ ID NO: 246725 - DNA, 20 bp, Artificial Sequence
  chemically synthesized
ttttggaaacaatttcattg

SEQ ID NO: 246726 - DNA, 20 bp, Artificial Sequence
  chemically synthesized
acaatgaaattgtttccaaa

SEQ ID NO: 246727 - DNA, 20 bp, Artificial Sequence
  chemically synthesized
caatgaaattgtttccaaaa

SEQ ID NO: 246728 - DNA, 20 bp, Artificial Sequence
  chemically synthesized
ttggccaagctagtcctttt

SEQ ID NO: 246729 - DNA, 20 bp, Artificial Sequence
  chemically synthesized
aaattgtttccaaaaaggac

SEQ ID NO: 246730 - DNA, 20 bp, Artificial Sequence
  chemically synthesized
gtttccaaaaaggactagct

SEQ ID NO: 246731 - DNA, 20 bp, Artificial Sequence
  chemically synthesized
aggtagtgtattggccaagc

SEQ ID NO: 246732 - DNA, 20 bp, Artificial Sequence
  chemically synthesized
atttaggtagtgtattggcc

SEQ ID NO: 246733 - DNA, 20 bp, Artificial Sequence
  chemically synthesized
aatgcatttaggtagtgtat

SEQ ID NO: 246734 - DNA, 20 bp, Artificial Sequence
  chemically synthesized
tacctagtaatgcatttagg

SEQ ID NO: 246735 - DNA, 20 bp, Artificial Sequence
  chemically synthesized
gtatacctagtaatgcattt

SEQ ID NO: 246736 - DNA, 20 bp, Artificial Sequence
  chemically synthesized
tgtatacctagtaatgcatt

SEQ ID NO: 246737 - DNA, 20 bp, Artificial Sequence
  chemically synthesized
acactacctaaatgcattac

SEQ ID NO: 246738 - DNA, 20 bp, Artificial Sequence
  chemically synthesized
cactacctaaatgcattact

SEQ ID NO: 246739 - DNA, 20 bp, Artificial Sequence
  chemically synthesized
aaatgcattactaggtatac

SEQ ID NO: 246740 - DNA, 20 bp, Artificial Sequence
  chemically synthesized
ttaagtaaaacttgtatacc

SEQ ID NO: 246741 - DNA, 20 bp, Artificial Sequence
  chemically synthesized
ttgagacatatattgttttt

SEQ ID NO: 246742 - DNA, 20 bp, Artificial Sequence
  chemically synthesized
aaaacaatatatgtctcaat

SEQ ID NO: 246743 - DNA, 20 bp, Artificial Sequence
  chemically synthesized
cggtaatctttatacttatt

SEQ ID NO: 246744 - DNA, 20 bp, Artificial Sequence
  chemically synthesized
tatatgtctcaataagtata

SEQ ID NO: 246745 - DNA, 20 bp, Artificial Sequence
  chemically synthesized
aataagtataaagattaccg

SEQ ID NO: 246746 - DNA, 20 bp, Artificial Sequence
  chemically synthesized
gcacaccacagtgttcgcta

SEQ ID NO: 246747 - DNA, 20 bp, Artificial Sequence
  chemically synthesized
gattaccgtagcgaacactg

SEQ ID NO: 246748 - DNA, 20 bp, Artificial Sequence
  chemically synthesized
tgaatctcggtggcacacca

SEQ ID NO: 246749 - DNA, 20 bp, Artificial Sequence
  chemically synthesized
gaacactgtggtgtgccacc

SEQ ID NO: 246750 - DNA, 20 bp, Artificial Sequence
  chemically synthesized
ttgtaattggtgaatctcgg

SEQ ID NO: 246751 - DNA, 20 bp, Artificial Sequence
  chemically synthesized
catttgtaattggtgaatct

SEQ ID NO: 246752 - DNA, 20 bp, Artificial Sequence
  chemically synthesized
atgaatgcttcatttgtaat

SEQ ID NO: 246753 - DNA, 20 bp, Artificial Sequence
  chemically synthesized
agattcaccaattacaaatg

SEQ ID NO: 246754 - DNA, 20 bp, Artificial Sequence
  chemically synthesized
aaatgaagcattcattctcc

SEQ ID NO: 246755 - DNA, 20 bp, Artificial Sequence
  chemically synthesized
ataacaatcccagcaactgg

SEQ ID NO: 246756 - DNA, 20 bp, Artificial Sequence
  chemically synthesized
gcattcattctcccagttgc

SEQ ID NO: 246757 - DNA, 20 bp, Artificial Sequence
  chemically synthesized
cattcattctcccagttgct

SEQ ID NO: 246758 - DNA, 20 bp, Artificial Sequence
  chemically synthesized
agataacaatcccagcaact

SEQ ID NO: 246759 - DNA, 20 bp, Artificial Sequence
  chemically synthesized
tagataacaatcccagcaac

SEQ ID NO: 246760 - DNA, 20 bp, Artificial Sequence
  chemically synthesized
ctgttagtagataacaatcc

SEQ ID NO: 246761 - DNA, 20 bp, Artificial Sequence
  chemically synthesized
ctgggattgttatctactaa

SEQ ID NO: 246762 - DNA, 20 bp, Artificial Sequence
  chemically synthesized
gcttaggtatgatctgttag

SEQ ID NO: 246763 - DNA, 20 bp, Artificial Sequence
  chemically synthesized
agagcttaggtatgatctgt

SEQ ID NO: 246764 - DNA, 20 bp, Artificial Sequence
  chemically synthesized
tctactaacagatcatacct

SEQ ID NO: 246765 - DNA, 20 bp, Artificial Sequence
  chemically synthesized
gaaatttcttggaagagctt

SEQ ID NO: 246766 - DNA, 20 bp, Artificial Sequence
  chemically synthesized
agaaatttcttggaagagct

SEQ ID NO: 246767 - DNA, 20 bp, Artificial Sequence
  chemically synthesized
gatcatacctaagctcttcc

SEQ ID NO: 246768 - DNA, 20 bp, Artificial Sequence
  chemically synthesized
ctgagagaaatttcttggaa

SEQ ID NO: 246769 - DNA, 20 bp, Artificial Sequence
  chemically synthesized
tgctgagagaaatttcttgg

SEQ ID NO: 246770 - DNA, 20 bp, Artificial Sequence
  chemically synthesized
gtctgctgagagaaatttct

SEQ ID NO: 246771 - DNA, 20 bp, Artificial Sequence
  chemically synthesized
ctcttccaagaaatttctct

SEQ ID NO: 246772 - DNA, 20 bp, Artificial Sequence
  chemically synthesized
ttccaagaaatttctctcag

SEQ ID NO: 246773 - DNA, 20 bp, Artificial Sequence
  chemically synthesized
aagaagtgcctgtctgctga

SEQ ID NO: 246774 - DNA, 20 bp, Artificial Sequence
  chemically synthesized
aagaaatttctctcagcaga

SEQ ID NO: 246775 - DNA, 20 bp, Artificial Sequence
  chemically synthesized
agaaatttctctcagcagac

SEQ ID NO: 246776 - DNA, 20 bp, Artificial Sequence
  chemically synthesized
caaagaagtgcctgtctgct

SEQ ID NO: 246777 - DNA, 20 bp, Artificial Sequence
  chemically synthesized
caatatcatcttggtcaaag

SEQ ID NO: 246778 - DNA, 20 bp, Artificial Sequence
  chemically synthesized
agacaggcacttctttgacc

SEQ ID NO: 246779 - DNA, 20 bp, Artificial Sequence
  chemically synthesized
gggcaatatcatcttggtca

SEQ ID NO: 246780 - DNA, 20 bp, Artificial Sequence
  chemically synthesized
gcttccgggcaatatcatct

SEQ ID NO: 246781 - DNA, 20 bp, Artificial Sequence
  chemically synthesized
ttgaccaagatgatattgcc

SEQ ID NO: 246782 - DNA, 20 bp, Artificial Sequence
  chemically synthesized
accaagatgatattgcccgg

SEQ ID NO: 246783 - DNA, 20 bp, Artificial Sequence
  chemically synthesized
agatgatattgcccggaagc

SEQ ID NO: 246784 - DNA, 20 bp, Artificial Sequence
  chemically synthesized
cctcccaactaccagcttcc

SEQ ID NO: 246785 - DNA, 20 bp, Artificial Sequence
  chemically synthesized
gcctcccaactaccagcttc

SEQ ID NO: 246786 - DNA, 20 bp, Artificial Sequence
  chemically synthesized
tgatattgcccggaagctgg

SEQ ID NO: 246787 - DNA, 20 bp, Artificial Sequence
  chemically synthesized
attgcccggaagctggtagt

SEQ ID NO: 246788 - DNA, 20 bp, Artificial Sequence
  chemically synthesized
ttgcccggaagctggtagtt

SEQ ID NO: 246789 - DNA, 20 bp, Artificial Sequence
  chemically synthesized
gatgtgagcctcccaactac

SEQ ID NO: 246790 - DNA, 20 bp, Artificial Sequence
  chemically synthesized
gcccggaagctggtagttgg

SEQ ID NO: 246791 - DNA, 20 bp, Artificial Sequence
  chemically synthesized
cccggaagctggtagttggg

SEQ ID NO: 246792 - DNA, 20 bp, Artificial Sequence
  chemically synthesized
atccattagtcattagatgt

SEQ ID NO: 246793 - DNA, 20 bp, Artificial Sequence
  chemically synthesized
atccctaatccattagtcat

SEQ ID NO: 246794 - DNA, 20 bp, Artificial Sequence
  chemically synthesized
ggctcacatctaatgactaa

SEQ ID NO: 246795 - DNA, 20 bp, Artificial Sequence
  chemically synthesized
acatctaatgactaatggat

SEQ ID NO: 246796 - DNA, 20 bp, Artificial Sequence
  chemically synthesized
catctaatgactaatggatt

SEQ ID NO: 246797 - DNA, 20 bp, Artificial Sequence
  chemically synthesized
ccattgtatccctaatccat

SEQ ID NO: 246798 - DNA, 20 bp, Artificial Sequence
  chemically synthesized
atctaatgactaatggatta

SEQ ID NO: 246799 - DNA, 20 bp, Artificial Sequence
  chemically synthesized
ctaatggattagggatacaa

SEQ ID NO: 246800 - DNA, 20 bp, Artificial Sequence
  chemically synthesized
accgtatgaagcaaggaagg

SEQ ID NO: 246801 - DNA, 20 bp, Artificial Sequence
  chemically synthesized
attaccgtatgaagcaagga

SEQ ID NO: 246802 - DNA, 20 bp, Artificial Sequence
  chemically synthesized
tattaccgtatgaagcaagg

SEQ ID NO: 246803 - DNA, 20 bp, Artificial Sequence
  chemically synthesized
gagtattaccgtatgaagca

SEQ ID NO: 246804 - DNA, 20 bp, Artificial Sequence
  chemically synthesized
agagtattaccgtatgaagc

SEQ ID NO: 246805 - DNA, 20 bp, Artificial Sequence
  chemically synthesized
tccaccttccttgcttcata

SEQ ID NO: 246806 - DNA, 20 bp, Artificial Sequence
  chemically synthesized
atttagagtattaccgtatg

SEQ ID NO: 246807 - DNA, 20 bp, Artificial Sequence
  chemically synthesized
tcatacggtaatactctaaa

SEQ ID NO: 246808 - DNA, 20 bp, Artificial Sequence
  chemically synthesized
ggggttgggatgaccattta

SEQ ID NO: 246809 - DNA, 20 bp, Artificial Sequence
  chemically synthesized
gtggggttgggatgaccatt

SEQ ID NO: 246810 - DNA, 20 bp, Artificial Sequence
  chemically synthesized
atctggtcccatgtggggtt

SEQ ID NO: 246811 - DNA, 20 bp, Artificial Sequence
  chemically synthesized
tatctggtcccatgtggggt

SEQ ID NO: 246812 - DNA, 20 bp, Artificial Sequence
  chemically synthesized
atggtcatcccaaccccaca

SEQ ID NO: 246813 - DNA, 20 bp, Artificial Sequence
  chemically synthesized
tggtcatcccaaccccacat

SEQ ID NO: 246814 - DNA, 20 bp, Artificial Sequence
  chemically synthesized
atcttatctggtcccatgtg

SEQ ID NO: 246815 - DNA, 20 bp, Artificial Sequence
  chemically synthesized
gatcttatctggtcccatgt

SEQ ID NO: 246816 - DNA, 20 bp, Artificial Sequence
  chemically synthesized
agatcttatctggtcccatg

SEQ ID NO: 246817 - DNA, 20 bp, Artificial Sequence
  chemically synthesized
atcccaaccccacatgggac

SEQ ID NO: 246818 - DNA, 20 bp, Artificial Sequence
  chemically synthesized
aaccccacatgggaccagat

SEQ ID NO: 246819 - DNA, 20 bp, Artificial Sequence
  chemically synthesized
gtgaaatggaagatcttatc

SEQ ID NO: 246820 - DNA, 20 bp, Artificial Sequence
  chemically synthesized
atgatgatgcagtgaaatgg

SEQ ID NO: 246821 - DNA, 20 bp, Artificial Sequence
  chemically synthesized
tgaatgatgatgcagtgaaa

SEQ ID NO: 246822 - DNA, 20 bp, Artificial Sequence
  chemically synthesized
agaggagttgaatgatgatg

SEQ ID NO: 246823 - DNA, 20 bp, Artificial Sequence
  chemically synthesized
gcaggattgaggagagagag

SEQ ID NO: 246824 - DNA, 20 bp, Artificial Sequence
  chemically synthesized
cagcaggattgaggagagag

SEQ ID NO: 246825 - DNA, 20 bp, Artificial Sequence
  chemically synthesized
gcagcaggattgaggagaga

SEQ ID NO: 246826 - DNA, 20 bp, Artificial Sequence
  chemically synthesized
aggcagcaggattgaggaga

SEQ ID NO: 246827 - DNA, 20 bp, Artificial Sequence
  chemically synthesized
aaaggcagcaggattgagga

SEQ ID NO: 246828 - DNA, 20 bp, Artificial Sequence
  chemically synthesized
gtaaaggcagcaggattgag

SEQ ID NO: 246829 - DNA, 20 bp, Artificial Sequence
  chemically synthesized
gagtaaaggcagcaggattg

SEQ ID NO: 246830 - DNA, 20 bp, Artificial Sequence
  chemically synthesized
ggagtaaaggcagcaggatt

SEQ ID NO: 246831 - DNA, 20 bp, Artificial Sequence
  chemically synthesized
tgggagggagtaaaggcagc

SEQ ID NO: 246832 - DNA, 20 bp, Artificial Sequence
  chemically synthesized
ctgggagggagtaaaggcag

SEQ ID NO: 246833 - DNA, 20 bp, Artificial Sequence
  chemically synthesized
tgcctgggagggagtaaagg

SEQ ID NO: 246834 - DNA, 20 bp, Artificial Sequence
  chemically synthesized
aaatgcctgggagggagtaa

SEQ ID NO: 246835 - DNA, 20 bp, Artificial Sequence
  chemically synthesized
aaaatgcctgggagggagta

SEQ ID NO: 246836 - DNA, 20 bp, Artificial Sequence
  chemically synthesized
ctgctgcctttactccctcc

SEQ ID NO: 246837 - DNA, 20 bp, Artificial Sequence
  chemically synthesized
tgctgcctttactccctccc

SEQ ID NO: 246838 - DNA, 20 bp, Artificial Sequence
  chemically synthesized
taagaaaaatgcctgggagg

SEQ ID NO: 246839 - DNA, 20 bp, Artificial Sequence
  chemically synthesized
tttaagaaaaatgcctggga

SEQ ID NO: 246840 - DNA, 20 bp, Artificial Sequence
  chemically synthesized
ttttaagaaaaatgcctggg

SEQ ID NO: 246841 - DNA, 20 bp, Artificial Sequence
  chemically synthesized
cttttaagaaaaatgcctgg

SEQ ID NO: 246842 - DNA, 20 bp, Artificial Sequence
  chemically synthesized
tgcttttaagaaaaatgcct

SEQ ID NO: 246843 - DNA, 20 bp, Artificial Sequence
  chemically synthesized
gtgcttttaagaaaaatgcc

SEQ ID NO: 246844 - DNA, 20 bp, Artificial Sequence
  chemically synthesized
ctcccaggcatttttcttaa

SEQ ID NO: 246845 - DNA, 20 bp, Artificial Sequence
  chemically synthesized
gtttcttagtgagtgctttt

SEQ ID NO: 246846 - DNA, 20 bp, Artificial Sequence
  chemically synthesized
ttttcttaaaagcactcact

SEQ ID NO: 246847 - DNA, 20 bp, Artificial Sequence
  chemically synthesized
catgcagatggtttcttagt

SEQ ID NO: 246848 - DNA, 20 bp, Artificial Sequence
  chemically synthesized
tttccatgcagatggtttct

SEQ ID NO: 246849 - DNA, 20 bp, Artificial Sequence
  chemically synthesized
tcactaagaaaccatctgca

SEQ ID NO: 246850 - DNA, 20 bp, Artificial Sequence
  chemically synthesized
gacagagatttccatgcaga

SEQ ID NO: 246851 - DNA, 20 bp, Artificial Sequence
  chemically synthesized
ctaagacagagatttccatg

SEQ ID NO: 246852 - DNA, 20 bp, Artificial Sequence
  chemically synthesized
ctgcatggaaatctctgtct

SEQ ID NO: 246853 - DNA, 20 bp, Artificial Sequence
  chemically synthesized
gcatggaaatctctgtctta

SEQ ID NO: 246854 - DNA, 20 bp, Artificial Sequence
  chemically synthesized
aagacatagactctaagaca

SEQ ID NO: 246855 - DNA, 20 bp, Artificial Sequence
  chemically synthesized
ctaagacatagactctaaga

SEQ ID NO: 246856 - DNA, 20 bp, Artificial Sequence
  chemically synthesized
ttttctaagacatagactct

SEQ ID NO: 246857 - DNA, 20 bp, Artificial Sequence
  chemically synthesized
ctgtcttagagtctatgtct

SEQ ID NO: 246858 - DNA, 20 bp, Artificial Sequence
  chemically synthesized
agattggattttctaagaca

SEQ ID NO: 246859 - DNA, 20 bp, Artificial Sequence
  chemically synthesized
tatcttagattggattttct

SEQ ID NO: 246860 - DNA, 20 bp, Artificial Sequence
  chemically synthesized
tgtcttagaaaatccaatct

SEQ ID NO: 246861 - DNA, 20 bp, Artificial Sequence
  chemically synthesized
attaggttgttatcttagat

SEQ ID NO: 246862 - DNA, 20 bp, Artificial Sequence
  chemically synthesized
aacatattaggttgttatct

SEQ ID NO: 246863 - DNA, 20 bp, Artificial Sequence
  chemically synthesized
ttttaacttctcaacatatt

SEQ ID NO: 246864 - DNA, 20 bp, Artificial Sequence
  chemically synthesized
agataacaacctaatatgtt

SEQ ID NO: 246865 - DNA, 20 bp, Artificial Sequence
  chemically synthesized
attttaacttctcaacatat

SEQ ID NO: 246866 - DNA, 20 bp, Artificial Sequence
  chemically synthesized
taacaacctaatatgttgag

SEQ ID NO: 246867 - DNA, 20 bp, Artificial Sequence
  chemically synthesized
tatgttgagaagttaaaatg

SEQ ID NO: 246868 - DNA, 20 bp, Artificial Sequence
  chemically synthesized
agaagttaaaatgtagaaaa

SEQ ID NO: 246869 - DNA, 20 bp, Artificial Sequence
  chemically synthesized
aaaacagaaatacatatctg

SEQ ID NO: 246870 - DNA, 20 bp, Artificial Sequence
  chemically synthesized
tgttatttaaatgattactt

SEQ ID NO: 246871 - DNA, 20 bp, Artificial Sequence
  chemically synthesized
aacattatgaaaatgtacat

SEQ ID NO: 246872 - DNA, 20 bp, Artificial Sequence
  chemically synthesized
tgtacatcagtatttataaa

SEQ ID NO: 246873 - DNA, 20 bp, Artificial Sequence
  chemically synthesized
aattgtatcattgtatataa

SEQ ID NO: 246874 - DNA, 20 bp, Artificial Sequence
  chemically synthesized
tgaaatctagcagtaagttg

SEQ ID NO: 246875 - DNA, 20 bp, Artificial Sequence
  chemically synthesized
tcatttcttcaacttactgc

SEQ ID NO: 246876 - DNA, 20 bp, Artificial Sequence
  chemically synthesized
tttccctgaaatctagcagt

SEQ ID NO: 246877 - DNA, 20 bp, Artificial Sequence
  chemically synthesized
tatttttccctgaaatctag

SEQ ID NO: 246878 - DNA, 20 bp, Artificial Sequence
  chemically synthesized
ttcaacttactgctagattt

SEQ ID NO: 246879 - DNA, 20 bp, Artificial Sequence
  chemically synthesized
tcaacttactgctagatttc

SEQ ID NO: 246880 - DNA, 20 bp, Artificial Sequence
  chemically synthesized
caacttactgctagatttca

SEQ ID NO: 246881 - DNA, 20 bp, Artificial Sequence
  chemically synthesized
ctgtatttttccctgaaatc

SEQ ID NO: 246882 - DNA, 20 bp, Artificial Sequence
  chemically synthesized
ctagatttcagggaaaaata

SEQ ID NO: 246883 - DNA, 20 bp, Artificial Sequence
  chemically synthesized
tagatttcagggaaaaatac

SEQ ID NO: 246884 - DNA, 20 bp, Artificial Sequence
  chemically synthesized
cagggaaaaatacaggatac

SEQ ID NO: 246885 - DNA, 20 bp, Artificial Sequence
  chemically synthesized
atacaggatacaagtactta

SEQ ID NO: 246886 - DNA, 20 bp, Artificial Sequence
  chemically synthesized
aggatacaagtacttaaaga

SEQ ID NO: 246887 - DNA, 20 bp, Artificial Sequence
  chemically synthesized
ctccttcttgagctttcttt

SEQ ID NO: 246888 - DNA, 20 bp, Artificial Sequence
  chemically synthesized
caagtacttaaagaaagctc

SEQ ID NO: 246889 - DNA, 20 bp, Artificial Sequence
  chemically synthesized
gtacttaaagaaagctcaag

SEQ ID NO: 246890 - DNA, 20 bp, Artificial Sequence
  chemically synthesized
tacttaaagaaagctcaaga

SEQ ID NO: 246891 - DNA, 20 bp, Artificial Sequence
  chemically synthesized
cttaaagaaagctcaagaag

SEQ ID NO: 246892 - DNA, 20 bp, Artificial Sequence
  chemically synthesized
atcagccatatctccttctt

SEQ ID NO: 246893 - DNA, 20 bp, Artificial Sequence
  chemically synthesized
gaaagctcaagaaggagata

SEQ ID NO: 246894 - DNA, 20 bp, Artificial Sequence
  chemically synthesized
aaaatattctattatgcaat

SEQ ID NO: 246895 - DNA, 20 bp, Artificial Sequence
  chemically synthesized
agatatggctgattgcataa

SEQ ID NO: 246896 - DNA, 20 bp, Artificial Sequence
  chemically synthesized
ttgcataatagaatattttg

SEQ ID NO: 246897 - DNA, 20 bp, Artificial Sequence
  chemically synthesized
ccagcgtcctcaatagttga

SEQ ID NO: 246898 - DNA, 20 bp, Artificial Sequence
  chemically synthesized
tttgcagactgtcaactatt

SEQ ID NO: 246899 - DNA, 20 bp, Artificial Sequence
  chemically synthesized
ttgcagactgtcaactattg

SEQ ID NO: 246900 - DNA, 20 bp, Artificial Sequence
  chemically synthesized
aaacatgccagcgtcctcaa

SEQ ID NO: 246901 - DNA, 20 bp, Artificial Sequence
  chemically synthesized
ctgtcaactattgaggacgc

SEQ ID NO: 246902 - DNA, 20 bp, Artificial Sequence
  chemically synthesized
attgaggacgctggcatgtt

SEQ ID NO: 246903 - DNA, 20 bp, Artificial Sequence
  chemically synthesized
agttattcttccaaacatgc

SEQ ID NO: 246904 - DNA, 20 bp, Artificial Sequence
  chemically synthesized
gaggacgctggcatgtttgg

SEQ ID NO: 246905 - DNA, 20 bp, Artificial Sequence
  chemically synthesized
tatgttctaaaatttaataa

SEQ ID NO: 246906 - DNA, 20 bp, Artificial Sequence
  chemically synthesized
gaataactgttattaaattt

SEQ ID NO: 246907 - DNA, 20 bp, Artificial Sequence
  chemically synthesized
ttattaaattttagaacata

SEQ ID NO: 246908 - DNA, 20 bp, Artificial Sequence
  chemically synthesized
tattaaattttagaacataa

SEQ ID NO: 246909 - DNA, 20 bp, Artificial Sequence
  chemically synthesized
aaatgctgaatggatttatt

SEQ ID NO: 246910 - DNA, 20 bp, Artificial Sequence
  chemically synthesized
tcaatcttaataaatccatt

SEQ ID NO: 246911 - DNA, 20 bp, Artificial Sequence
  chemically synthesized
tgttattctgaaatgctgaa

SEQ ID NO: 246912 - DNA, 20 bp, Artificial Sequence
  chemically synthesized
aataaatccattcagcattt

SEQ ID NO: 246913 - DNA, 20 bp, Artificial Sequence
  chemically synthesized
ataacatgaaaatatgccaa

SEQ ID NO: 246914 - DNA, 20 bp, Artificial Sequence
  chemically synthesized
tagtaaaatggaatttctgt

SEQ ID NO: 246915 - DNA, 20 bp, Artificial Sequence
  chemically synthesized
tgatagtaacaatagtaaaa

SEQ ID NO: 246916 - DNA, 20 bp, Artificial Sequence
  chemically synthesized
caagttcttgatagtaacaa

SEQ ID NO: 246917 - DNA, 20 bp, Artificial Sequence
  chemically synthesized
attttactattgttactatc

SEQ ID NO: 246918 - DNA, 20 bp, Artificial Sequence
  chemically synthesized
aaattttgccaagttcttga

SEQ ID NO: 246919 - DNA, 20 bp, Artificial Sequence
  chemically synthesized
tattgttactatcaagaact

SEQ ID NO: 246920 - DNA, 20 bp, Artificial Sequence
  chemically synthesized
gtaaaaaaccaaattttgcc

SEQ ID NO: 246921 - DNA, 20 bp, Artificial Sequence
  chemically synthesized
atcaagaacttggcaaaatt

SEQ ID NO: 246922 - DNA, 20 bp, Artificial Sequence
  chemically synthesized
tatcatttaatacattcaca

SEQ ID NO: 246923 - DNA, 20 bp, Artificial Sequence
  chemically synthesized
tgtgaatgtattaaatgata

SEQ ID NO: 246924 - DNA, 20 bp, Artificial Sequence
  chemically synthesized
gtgaatgtattaaatgatac

SEQ ID NO: 246925 - DNA, 20 bp, Artificial Sequence
  chemically synthesized
aatgatacaggtaacatata

SEQ ID NO: 246926 - DNA, 20 bp, Artificial Sequence
  chemically synthesized
aacctgctacagttagcata

SEQ ID NO: 246927 - DNA, 20 bp, Artificial Sequence
  chemically synthesized
aattaactatatgctaactg

SEQ ID NO: 246928 - DNA, 20 bp, Artificial Sequence
  chemically synthesized
taactatatgctaactgtag

SEQ ID NO: 246929 - DNA, 20 bp, Artificial Sequence
  chemically synthesized
aaagtgaaacctgctacagt

SEQ ID NO: 246930 - DNA, 20 bp, Artificial Sequence
  chemically synthesized
aactatatgctaactgtagc

SEQ ID NO: 246931 - DNA, 20 bp, Artificial Sequence
  chemically synthesized
ttgaaaagtgaaacctgcta

SEQ ID NO: 246932 - DNA, 20 bp, Artificial Sequence
  chemically synthesized
cggctatttcgtttattgaa

SEQ ID NO: 246933 - DNA, 20 bp, Artificial Sequence
  chemically synthesized
tcacttttcaataaacgaaa

SEQ ID NO: 246934 - DNA, 20 bp, Artificial Sequence
  chemically synthesized
tcctaaagacagaattgtca

SEQ ID NO: 246935 - DNA, 20 bp, Artificial Sequence
  chemically synthesized
agccgtgacaattctgtctt

SEQ ID NO: 246936 - DNA, 20 bp, Artificial Sequence
  chemically synthesized
gccgtgacaattctgtcttt

SEQ ID NO: 246937 - DNA, 20 bp, Artificial Sequence
  chemically synthesized
ctctctcttcatcctaaaga

SEQ ID NO: 246938 - DNA, 20 bp, Artificial Sequence
  chemically synthesized
acaattctgtctttaggatg

SEQ ID NO: 246939 - DNA, 20 bp, Artificial Sequence
  chemically synthesized
aatgctctctcttcatccta

SEQ ID NO: 246940 - DNA, 20 bp, Artificial Sequence
  chemically synthesized
aattctgtctttaggatgaa

SEQ ID NO: 246941 - DNA, 20 bp, Artificial Sequence
  chemically synthesized
ttctgtctttaggatgaaga

SEQ ID NO: 246942 - DNA, 20 bp, Artificial Sequence
  chemically synthesized
ctgtctttaggatgaagaga

SEQ ID NO: 246943 - DNA, 20 bp, Artificial Sequence
  chemically synthesized
aaaatcaattcagattttca

SEQ ID NO: 246944 - DNA, 20 bp, Artificial Sequence
  chemically synthesized
ttagatagtgaaaatcaatt

SEQ ID NO: 246945 - DNA, 20 bp, Artificial Sequence
  chemically synthesized
gaattgattttcactatcta

SEQ ID NO: 246946 - DNA, 20 bp, Artificial Sequence
  chemically synthesized
atgtgtttcatgtctttaga

SEQ ID NO: 246947 - DNA, 20 bp, Artificial Sequence
  chemically synthesized
gcatatgtgtttcatgtctt

SEQ ID NO: 246948 - DNA, 20 bp, Artificial Sequence
  chemically synthesized
aagacatgaaacacatatgc

SEQ ID NO: 246949 - DNA, 20 bp, Artificial Sequence
  chemically synthesized
tgaaacacatatgctagctc

SEQ ID NO: 246950 - DNA, 20 bp, Artificial Sequence
  chemically synthesized
cttcttttgtcgtccagagc

SEQ ID NO: 246951 - DNA, 20 bp, Artificial Sequence
  chemically synthesized
tcatcttcttttgtcgtcca

SEQ ID NO: 246952 - DNA, 20 bp, Artificial Sequence
  chemically synthesized
tttcatcttcttttgtcgtc

SEQ ID NO: 246953 - DNA, 20 bp, Artificial Sequence
  chemically synthesized
atgctagctctggacgacaa

SEQ ID NO: 246954 - DNA, 20 bp, Artificial Sequence
  chemically synthesized
ctagctctggacgacaaaag

SEQ ID NO: 246955 - DNA, 20 bp, Artificial Sequence
  chemically synthesized
gaagatgaaaatgtcctcta

SEQ ID NO: 246956 - DNA, 20 bp, Artificial Sequence
  chemically synthesized
aagatgaaaatgtcctctat

SEQ ID NO: 246957 - DNA, 20 bp, Artificial Sequence
  chemically synthesized
atgaaaatgtcctctatagg

SEQ ID NO: 246958 - DNA, 20 bp, Artificial Sequence
  chemically synthesized
cctggatggccttcctatag

SEQ ID NO: 246959 - DNA, 20 bp, Artificial Sequence
  chemically synthesized
tgaaaatgtcctctatagga

SEQ ID NO: 246960 - DNA, 20 bp, Artificial Sequence
  chemically synthesized
tcctggatggccttcctata

SEQ ID NO: 246961 - DNA, 20 bp, Artificial Sequence
  chemically synthesized
catcctggatggccttccta

SEQ ID NO: 246962 - DNA, 20 bp, Artificial Sequence
  chemically synthesized
tcctctataggaaggccatc

SEQ ID NO: 246963 - DNA, 20 bp, Artificial Sequence
  chemically synthesized
cctctataggaaggccatcc

SEQ ID NO: 246964 - DNA, 20 bp, Artificial Sequence
  chemically synthesized
ttaccattcaacatcctgga

SEQ ID NO: 246965 - DNA, 20 bp, Artificial Sequence
  chemically synthesized
tctcttaccattcaacatcc

SEQ ID NO: 246966 - DNA, 20 bp, Artificial Sequence
  chemically synthesized
aggccatccaggatgttgaa

SEQ ID NO: 246967 - DNA, 20 bp, Artificial Sequence
  chemically synthesized
catccaggatgttgaatggt

SEQ ID NO: 246968 - DNA, 20 bp, Artificial Sequence
  chemically synthesized
tccaggatgttgaatggtaa

SEQ ID NO: 246969 - DNA, 20 bp, Artificial Sequence
  chemically synthesized
atgtgtctataattagatgg

SEQ ID NO: 246970 - DNA, 20 bp, Artificial Sequence
  chemically synthesized
ttaatgtgtctataattaga

SEQ ID NO: 246971 - DNA, 20 bp, Artificial Sequence
  chemically synthesized
agacaacttccatctaatta

SEQ ID NO: 246972 - DNA, 20 bp, Artificial Sequence
  chemically synthesized
tgttttaatgtgtctataat

SEQ ID NO: 246973 - DNA, 20 bp, Artificial Sequence
  chemically synthesized
attatagacacattaaaaca

SEQ ID NO: 246974 - DNA, 20 bp, Artificial Sequence
  chemically synthesized
aggataagggttgtagttaa

SEQ ID NO: 246975 - DNA, 20 bp, Artificial Sequence
  chemically synthesized
aagggaaaggataagggttg

SEQ ID NO: 246976 - DNA, 20 bp, Artificial Sequence
  chemically synthesized
ggtagaaagggaaaggataa

SEQ ID NO: 246977 - DNA, 20 bp, Artificial Sequence
  chemically synthesized
tggtagaaagggaaaggata

SEQ ID NO: 246978 - DNA, 20 bp, Artificial Sequence
  chemically synthesized
ttggtagaaagggaaaggat

SEQ ID NO: 246979 - DNA, 20 bp, Artificial Sequence
  chemically synthesized
gagggttggtagaaagggaa

SEQ ID NO: 246980 - DNA, 20 bp, Artificial Sequence
  chemically synthesized
tgagggttggtagaaaggga

SEQ ID NO: 246981 - DNA, 20 bp, Artificial Sequence
  chemically synthesized
taaatgagggttggtagaaa

SEQ ID NO: 246982 - DNA, 20 bp, Artificial Sequence
  chemically synthesized
ataaatgagggttggtagaa

SEQ ID NO: 246983 - DNA, 20 bp, Artificial Sequence
  chemically synthesized
gataaatgagggttggtaga

SEQ ID NO: 246984 - DNA, 20 bp, Artificial Sequence
  chemically synthesized
gagggataaatgagggttgg

SEQ ID NO: 246985 - DNA, 20 bp, Artificial Sequence
  chemically synthesized
gctgagggataaatgagggt

SEQ ID NO: 246986 - DNA, 20 bp, Artificial Sequence
  chemically synthesized
aatggctgagggataaatga

SEQ ID NO: 246987 - DNA, 20 bp, Artificial Sequence
  chemically synthesized
caatggctgagggataaatg

SEQ ID NO: 246988 - DNA, 20 bp, Artificial Sequence
  chemically synthesized
tcaatggctgagggataaat

SEQ ID NO: 246989 - DNA, 20 bp, Artificial Sequence
  chemically synthesized
accaaccctcatttatccct

SEQ ID NO: 246990 - DNA, 20 bp, Artificial Sequence
  chemically synthesized
tttttaaaatcaatggctga

SEQ ID NO: 246991 - DNA, 20 bp, Artificial Sequence
  chemically synthesized
ttttttaaaatcaatggctg

SEQ ID NO: 246992 - DNA, 20 bp, Artificial Sequence
  chemically synthesized
attttttaaaatcaatggct

SEQ ID NO: 246993 - DNA, 20 bp, Artificial Sequence
  chemically synthesized
aaaatattttttaaaatcaa

SEQ ID NO: 246994 - DNA, 20 bp, Artificial Sequence
  chemically synthesized
ttttatatatttgacaccca

SEQ ID NO: 246995 - DNA, 20 bp, Artificial Sequence
  chemically synthesized
tttatatatttgacacccaa

SEQ ID NO: 246996 - DNA, 20 bp, Artificial Sequence
  chemically synthesized
tcatttacattttttccttt

SEQ ID NO: 246997 - DNA, 20 bp, Artificial Sequence
  chemically synthesized
ttcatttacattttttcctt

SEQ ID NO: 246998 - DNA, 20 bp, Artificial Sequence
  chemically synthesized
tgtaaatgaaactcacttcc

SEQ ID NO: 246999 - DNA, 20 bp, Artificial Sequence
  chemically synthesized
agcagtagtctcttggaagt

SEQ ID NO: 247000 - DNA, 20 bp, Artificial Sequence
  chemically synthesized
taaatgaaactcacttccaa

SEQ ID NO: 247001 - DNA, 20 bp, Artificial Sequence
  chemically synthesized
tgagagcagtagtctcttgg

SEQ ID NO: 247002 - DNA, 20 bp, Artificial Sequence
  chemically synthesized
tgctgagagcagtagtctct

SEQ ID NO: 247003 - DNA, 20 bp, Artificial Sequence
  chemically synthesized
ttccaagagactactgctct

SEQ ID NO: 247004 - DNA, 20 bp, Artificial Sequence
  chemically synthesized
ttttggtttgctgagagcag

SEQ ID NO: 247005 - DNA, 20 bp, Artificial Sequence
  chemically synthesized
tctttttggtttgctgagag

SEQ ID NO: 247006 - DNA, 20 bp, Artificial Sequence
  chemically synthesized
ttctctttttggtttgctga

SEQ ID NO: 247007 - DNA, 20 bp, Artificial Sequence
  chemically synthesized
tattctctttttggtttgct

SEQ ID NO: 247008 - DNA, 20 bp, Artificial Sequence
  chemically synthesized
actgctctcagcaaaccaaa

SEQ ID NO: 247009 - DNA, 20 bp, Artificial Sequence
  chemically synthesized
tgctctcagcaaaccaaaaa

SEQ ID NO: 247010 - DNA, 20 bp, Artificial Sequence
  chemically synthesized
tttgttttttattctctttt

SEQ ID NO: 247011 - DNA, 20 bp, Artificial Sequence
  chemically synthesized
ttctacattgaagaaatttg

SEQ ID NO: 247012 - DNA, 20 bp, Artificial Sequence
  chemically synthesized
gtctacaaatttcttcaatg

SEQ ID NO: 247013 - DNA, 20 bp, Artificial Sequence
  chemically synthesized
tgaattgtttttctacattg

SEQ ID NO: 247014 - DNA, 20 bp, Artificial Sequence
  chemically synthesized
caatgtagaaaaacaattca

SEQ ID NO: 247015 - DNA, 20 bp, Artificial Sequence
  chemically synthesized
aaaacaattcatagatctta

SEQ ID NO: 247016 - DNA, 20 bp, Artificial Sequence
  chemically synthesized
aaacaattcatagatcttaa

SEQ ID NO: 247017 - DNA, 20 bp, Artificial Sequence
  chemically synthesized
caattcatagatcttaaagg

SEQ ID NO: 247018 - DNA, 20 bp, Artificial Sequence
  chemically synthesized
caaaccctatcactgccttt

SEQ ID NO: 247019 - DNA, 20 bp, Artificial Sequence
  chemically synthesized
atagatcttaaaggcagtga

SEQ ID NO: 247020 - DNA, 20 bp, Artificial Sequence
  chemically synthesized
tagatcttaaaggcagtgat

SEQ ID NO: 247021 - DNA, 20 bp, Artificial Sequence
  chemically synthesized
agatcttaaaggcagtgata

SEQ ID NO: 247022 - DNA, 20 bp, Artificial Sequence
  chemically synthesized
ttaaaggcagtgatagggtt

SEQ ID NO: 247023 - DNA, 20 bp, Artificial Sequence
  chemically synthesized
acgggatttgggtggggaca

SEQ ID NO: 247024 - DNA, 20 bp, Artificial Sequence
  chemically synthesized
ttcaagacgggatttgggtg

SEQ ID NO: 247025 - DNA, 20 bp, Artificial Sequence
  chemically synthesized
attcaagacgggatttgggt

SEQ ID NO: 247026 - DNA, 20 bp, Artificial Sequence
  chemically synthesized
aattcaagacgggatttggg

SEQ ID NO: 247027 - DNA, 20 bp, Artificial Sequence
  chemically synthesized
tgcaattcaagacgggattt

SEQ ID NO: 247028 - DNA, 20 bp, Artificial Sequence
  chemically synthesized
ctgcaattcaagacgggatt

SEQ ID NO: 247029 - DNA, 20 bp, Artificial Sequence
  chemically synthesized
tgggaactgcaattcaagac

SEQ ID NO: 247030 - DNA, 20 bp, Artificial Sequence
  chemically synthesized
atgggaactgcaattcaaga

SEQ ID NO: 247031 - DNA, 20 bp, Artificial Sequence
  chemically synthesized
ccaaatcccgtcttgaattg

SEQ ID NO: 247032 - DNA, 20 bp, Artificial Sequence
  chemically synthesized
gattatgggaactgcaattc

SEQ ID NO: 247033 - DNA, 20 bp, Artificial Sequence
  chemically synthesized
ccatgacatctggggattat

SEQ ID NO: 247034 - DNA, 20 bp, Artificial Sequence
  chemically synthesized
attgcagttcccataatccc

SEQ ID NO: 247035 - DNA, 20 bp, Artificial Sequence
  chemically synthesized
cccatgacatctggggatta

SEQ ID NO: 247036 - DNA, 20 bp, Artificial Sequence
  chemically synthesized
gatccctcccatgacatctg

SEQ ID NO: 247037 - DNA, 20 bp, Artificial Sequence
  chemically synthesized
ggatccctcccatgacatct

SEQ ID NO: 247038 - DNA, 20 bp, Artificial Sequence
  chemically synthesized
cccataatccccagatgtca

SEQ ID NO: 247039 - DNA, 20 bp, Artificial Sequence
  chemically synthesized
tggatccctcccatgacatc

SEQ ID NO: 247040 - DNA, 20 bp, Artificial Sequence
  chemically synthesized
ccataatccccagatgtcat

SEQ ID NO: 247041 - DNA, 20 bp, Artificial Sequence
  chemically synthesized
ataatccccagatgtcatgg

SEQ ID NO: 247042 - DNA, 20 bp, Artificial Sequence
  chemically synthesized
taatccccagatgtcatggg

SEQ ID NO: 247043 - DNA, 20 bp, Artificial Sequence
  chemically synthesized
aatccccagatgtcatggga

SEQ ID NO: 247044 - DNA, 20 bp, Artificial Sequence
  chemically synthesized
cagatgtcatgggagggatc

SEQ ID NO: 247045 - DNA, 20 bp, Artificial Sequence
  chemically synthesized
atgtcatgggagggatccag

SEQ ID NO: 247046 - DNA, 20 bp, Artificial Sequence
  chemically synthesized
tgtcatgggagggatccagt

SEQ ID NO: 247047 - DNA, 20 bp, Artificial Sequence
  chemically synthesized
tcatgggagggatccagtgg

SEQ ID NO: 247048 - DNA, 20 bp, Artificial Sequence
  chemically synthesized
catgggagggatccagtggg

SEQ ID NO: 247049 - DNA, 20 bp, Artificial Sequence
  chemically synthesized
atgattcagttacctcccac

SEQ ID NO: 247050 - DNA, 20 bp, Artificial Sequence
  chemically synthesized
agtgggaggtaactgaatca

SEQ ID NO: 247051 - DNA, 20 bp, Artificial Sequence
  chemically synthesized
gtgggaggtaactgaatcat

SEQ ID NO: 247052 - DNA, 20 bp, Artificial Sequence
  chemically synthesized
tgggaggtaactgaatcatg

SEQ ID NO: 247053 - DNA, 20 bp, Artificial Sequence
  chemically synthesized
agtgaccaccccccatgatt

SEQ ID NO: 247054 - DNA, 20 bp, Artificial Sequence
  chemically synthesized
gggaggtaactgaatcatgg

SEQ ID NO: 247055 - DNA, 20 bp, Artificial Sequence
  chemically synthesized
ggaggtaactgaatcatggg

SEQ ID NO: 247056 - DNA, 20 bp, Artificial Sequence
  chemically synthesized
ggtaactgaatcatgggggg

SEQ ID NO: 247057 - DNA, 20 bp, Artificial Sequence
  chemically synthesized
tcataagaacagcagcacgg

SEQ ID NO: 247058 - DNA, 20 bp, Artificial Sequence
  chemically synthesized
tatcataagaacagcagcac

SEQ ID NO: 247059 - DNA, 20 bp, Artificial Sequence
  chemically synthesized
ctatcataagaacagcagca

SEQ ID NO: 247060 - DNA, 20 bp, Artificial Sequence
  chemically synthesized
gctcactatcataagaacag

SEQ ID NO: 247061 - DNA, 20 bp, Artificial Sequence
  chemically synthesized
agagctcactatcataagaa

SEQ ID NO: 247062 - DNA, 20 bp, Artificial Sequence
  chemically synthesized
ccgtgctgctgttcttatga

SEQ ID NO: 247063 - DNA, 20 bp, Artificial Sequence
  chemically synthesized
tcatgagagctcactatcat

SEQ ID NO: 247064 - DNA, 20 bp, Artificial Sequence
  chemically synthesized
gctgctgttcttatgatagt

SEQ ID NO: 247065 - DNA, 20 bp, Artificial Sequence
  chemically synthesized
ttatgatagtgagctctcat

SEQ ID NO: 247066 - DNA, 20 bp, Artificial Sequence
  chemically synthesized
atgatagtgagctctcatga

SEQ ID NO: 247067 - DNA, 20 bp, Artificial Sequence
  chemically synthesized
gaaaccatcagctctcatga

SEQ ID NO: 247068 - DNA, 20 bp, Artificial Sequence
  chemically synthesized
atgaaaccatcagctctcat

SEQ ID NO: 247069 - DNA, 20 bp, Artificial Sequence
  chemically synthesized
tgagctctcatgagagctga

SEQ ID NO: 247070 - DNA, 20 bp, Artificial Sequence
  chemically synthesized
aaagccccttatgaaaccat

SEQ ID NO: 247071 - DNA, 20 bp, Artificial Sequence
  chemically synthesized
atgagagctgatggtttcat

SEQ ID NO: 247072 - DNA, 20 bp, Artificial Sequence
  chemically synthesized
tgagagctgatggtttcata

SEQ ID NO: 247073 - DNA, 20 bp, Artificial Sequence
  chemically synthesized
gagagctgatggtttcataa

SEQ ID NO: 247074 - DNA, 20 bp, Artificial Sequence
  chemically synthesized
agagctgatggtttcataag

SEQ ID NO: 247075 - DNA, 20 bp, Artificial Sequence
  chemically synthesized
agtgccgagcaaaggaggaa

SEQ ID NO: 247076 - DNA, 20 bp, Artificial Sequence
  chemically synthesized
ggagaagtgccgagcaaagg

SEQ ID NO: 247077 - DNA, 20 bp, Artificial Sequence
  chemically synthesized
ggggcttttcctcctttgct

SEQ ID NO: 247078 - DNA, 20 bp, Artificial Sequence
  chemically synthesized
aggagaagtgccgagcaaag

SEQ ID NO: 247079 - DNA, 20 bp, Artificial Sequence
  chemically synthesized
gaaggagaagtgccgagcaa

SEQ ID NO: 247080 - DNA, 20 bp, Artificial Sequence
  chemically synthesized
agaaggagaagtgccgagca

SEQ ID NO: 247081 - DNA, 20 bp, Artificial Sequence
  chemically synthesized
tggcaagaaggagaagtgcc

SEQ ID NO: 247082 - DNA, 20 bp, Artificial Sequence
  chemically synthesized
cacatgatggcaagaaggag

SEQ ID NO: 247083 - DNA, 20 bp, Artificial Sequence
  chemically synthesized
tgtcacatgatggcaagaag

SEQ ID NO: 247084 - DNA, 20 bp, Artificial Sequence
  chemically synthesized
tttgtcacatgatggcaaga

SEQ ID NO: 247085 - DNA, 20 bp, Artificial Sequence
  chemically synthesized
ctttgtcacatgatggcaag

SEQ ID NO: 247086 - DNA, 20 bp, Artificial Sequence
  chemically synthesized
atcctttgtcacatgatggc

SEQ ID NO: 247087 - DNA, 20 bp, Artificial Sequence
  chemically synthesized
acacatcctttgtcacatga

SEQ ID NO: 247088 - DNA, 20 bp, Artificial Sequence
  chemically synthesized
cttcttgccatcatgtgaca

SEQ ID NO: 247089 - DNA, 20 bp, Artificial Sequence
  chemically synthesized
ttcttgccatcatgtgacaa

SEQ ID NO: 247090 - DNA, 20 bp, Artificial Sequence
  chemically synthesized
tacaatcactgtggaagcag

SEQ ID NO: 247091 - DNA, 20 bp, Artificial Sequence
  chemically synthesized
tgtgtttgcttctgcttcca

SEQ ID NO: 247092 - DNA, 20 bp, Artificial Sequence
  chemically synthesized
acttacaatcactgtggaag

SEQ ID NO: 247093 - DNA, 20 bp, Artificial Sequence
  chemically synthesized
gaaacttacaatcactgtgg

SEQ ID NO: 247094 - DNA, 20 bp, Artificial Sequence
  chemically synthesized
caggaaacttacaatcactg

SEQ ID NO: 247095 - DNA, 20 bp, Artificial Sequence
  chemically synthesized
tctgcttccacagtgattgt

SEQ ID NO: 247096 - DNA, 20 bp, Artificial Sequence
  chemically synthesized
acagtgattgtaagtttcct

SEQ ID NO: 247097 - DNA, 20 bp, Artificial Sequence
  chemically synthesized
cagtgattgtaagtttcctg

SEQ ID NO: 247098 - DNA, 20 bp, Artificial Sequence
  chemically synthesized
tgcatggctggggaggcctc

SEQ ID NO: 247099 - DNA, 20 bp, Artificial Sequence
  chemically synthesized
ttgcatggctggggaggcct

SEQ ID NO: 247100 - DNA, 20 bp, Artificial Sequence
  chemically synthesized
taagtttcctgaggcctccc

SEQ ID NO: 247101 - DNA, 20 bp, Artificial Sequence
  chemically synthesized
actggtttgcatggctgggg

SEQ ID NO: 247102 - DNA, 20 bp, Artificial Sequence
  chemically synthesized
cactggtttgcatggctggg

SEQ ID NO: 247103 - DNA, 20 bp, Artificial Sequence
  chemically synthesized
ctcactggtttgcatggctg

SEQ ID NO: 247104 - DNA, 20 bp, Artificial Sequence
  chemically synthesized
actcactggtttgcatggct

SEQ ID NO: 247105 - DNA, 20 bp, Artificial Sequence
  chemically synthesized
gactcactggtttgcatggc

SEQ ID NO: 247106 - DNA, 20 bp, Artificial Sequence
  chemically synthesized
gcctccccagccatgcaaac

SEQ ID NO: 247107 - DNA, 20 bp, Artificial Sequence
  chemically synthesized
aattgactcactggtttgca

SEQ ID NO: 247108 - DNA, 20 bp, Artificial Sequence
  chemically synthesized
ccccagccatgcaaaccagt

SEQ ID NO: 247109 - DNA, 20 bp, Artificial Sequence
  chemically synthesized
acgaggtttaattgactcac

SEQ ID NO: 247110 - DNA, 20 bp, Artificial Sequence
  chemically synthesized
gggtaatttataaaggaacg

SEQ ID NO: 247111 - DNA, 20 bp, Artificial Sequence
  chemically synthesized
tgggtaatttataaaggaac

SEQ ID NO: 247112 - DNA, 20 bp, Artificial Sequence
  chemically synthesized
tgagactgggtaatttataa

SEQ ID NO: 247113 - DNA, 20 bp, Artificial Sequence
  chemically synthesized
ctgagactgggtaatttata

SEQ ID NO: 247114 - DNA, 20 bp, Artificial Sequence
  chemically synthesized
tcgttcctttataaattacc

SEQ ID NO: 247115 - DNA, 20 bp, Artificial Sequence
  chemically synthesized
ctttataaattacccagtct

SEQ ID NO: 247116 - DNA, 20 bp, Artificial Sequence
  chemically synthesized
tttataaattacccagtctc

SEQ ID NO: 247117 - DNA, 20 bp, Artificial Sequence
  chemically synthesized
ataaagaactacctgagact

SEQ ID NO: 247118 - DNA, 20 bp, Artificial Sequence
  chemically synthesized
tataaagaactacctgagac

SEQ ID NO: 247119 - DNA, 20 bp, Artificial Sequence
  chemically synthesized
ataaattacccagtctcagg

SEQ ID NO: 247120 - DNA, 20 bp, Artificial Sequence
  chemically synthesized
gctgctataaagaactacct

SEQ ID NO: 247121 - DNA, 20 bp, Artificial Sequence
  chemically synthesized
cagtctcaggtagttcttta

SEQ ID NO: 247122 - DNA, 20 bp, Artificial Sequence
  chemically synthesized
tctcaggtagttctttatag

SEQ ID NO: 247123 - DNA, 20 bp, Artificial Sequence
  chemically synthesized
tctgttctcatgctgctata

SEQ ID NO: 247124 - DNA, 20 bp, Artificial Sequence
  chemically synthesized
gtagttctttatagcagcat

SEQ ID NO: 247125 - DNA, 20 bp, Artificial Sequence
  chemically synthesized
tctttatagcagcatgagaa

SEQ ID NO: 247126 - DNA, 20 bp, Artificial Sequence
  chemically synthesized
agcatgagaacagactaata

SEQ ID NO: 247127 - DNA, 20 bp, Artificial Sequence
  chemically synthesized
gtggtaccaatttactgtat

SEQ ID NO: 247128 - DNA, 20 bp, Artificial Sequence
  chemically synthesized
aacagactaatacagtaaat

SEQ ID NO: 247129 - DNA, 20 bp, Artificial Sequence
  chemically synthesized
aatacagtaaattggtacca

SEQ ID NO: 247130 - DNA, 20 bp, Artificial Sequence
  chemically synthesized
tacagtaaattggtaccaca

SEQ ID NO: 247131 - DNA, 20 bp, Artificial Sequence
  chemically synthesized
cagtaaattggtaccacaga

SEQ ID NO: 247132 - DNA, 20 bp, Artificial Sequence
  chemically synthesized
taaattggtaccacagagag

SEQ ID NO: 247133 - DNA, 20 bp, Artificial Sequence
  chemically synthesized
tagcagtatcccactctctg

SEQ ID NO: 247134 - DNA, 20 bp, Artificial Sequence
  chemically synthesized
aaattggtaccacagagagt

SEQ ID NO: 247135 - DNA, 20 bp, Artificial Sequence
  chemically synthesized
gagagtgggatactgctata

SEQ ID NO: 247136 - DNA, 20 bp, Artificial Sequence
  chemically synthesized
atttttgggtttctttatag

SEQ ID NO: 247137 - DNA, 20 bp, Artificial Sequence
  chemically synthesized
cacatttttgggtttcttta

SEQ ID NO: 247138 - DNA, 20 bp, Artificial Sequence
  chemically synthesized
tataaagaaacccaaaaatg

SEQ ID NO: 247139 - DNA, 20 bp, Artificial Sequence
  chemically synthesized
aaagttgcttccacattttt

SEQ ID NO: 247140 - DNA, 20 bp, Artificial Sequence
  chemically synthesized
caaagttgcttccacatttt

SEQ ID NO: 247141 - DNA, 20 bp, Artificial Sequence
  chemically synthesized
aaagaaacccaaaaatgtgg

SEQ ID NO: 247142 - DNA, 20 bp, Artificial Sequence
  chemically synthesized
caaaaatgtggaagcaactt

SEQ ID NO: 247143 - DNA, 20 bp, Artificial Sequence
  chemically synthesized
tgtggaagcaactttggaac

SEQ ID NO: 247144 - DNA, 20 bp, Artificial Sequence
  chemically synthesized
gtggaagcaactttggaact

SEQ ID NO: 247145 - DNA, 20 bp, Artificial Sequence
  chemically synthesized
ctgcctgttacccagttcca

SEQ ID NO: 247146 - DNA, 20 bp, Artificial Sequence
  chemically synthesized
gcaactttggaactgggtaa

SEQ ID NO: 247147 - DNA, 20 bp, Artificial Sequence
  chemically synthesized
caactttggaactgggtaac

SEQ ID NO: 247148 - DNA, 20 bp, Artificial Sequence
  chemically synthesized
ttcaacctctgcctgttacc

SEQ ID NO: 247149 - DNA, 20 bp, Artificial Sequence
  chemically synthesized
ctttggaactgggtaacagg

SEQ ID NO: 247150 - DNA, 20 bp, Artificial Sequence
  chemically synthesized
ttggaactgggtaacaggca

SEQ ID NO: 247151 - DNA, 20 bp, Artificial Sequence
  chemically synthesized
tggaactgggtaacaggcag

SEQ ID NO: 247152 - DNA, 20 bp, Artificial Sequence
  chemically synthesized
gtaacaggcagaggttgaaa

SEQ ID NO: 247153 - DNA, 20 bp, Artificial Sequence
  chemically synthesized
caggcagaggttgaaacagt

SEQ ID NO: 247154 - DNA, 20 bp, Artificial Sequence
  chemically synthesized
aggcagaggttgaaacagtt

SEQ ID NO: 247155 - DNA, 20 bp, Artificial Sequence
  chemically synthesized
gcagaggttgaaacagttgg

SEQ ID NO: 247156 - DNA, 20 bp, Artificial Sequence
  chemically synthesized
cagaggttgaaacagttggg

SEQ ID NO: 247157 - DNA, 20 bp, Artificial Sequence
  chemically synthesized
ttgaaacagttgggaggact

SEQ ID NO: 247158 - DNA, 20 bp, Artificial Sequence
  chemically synthesized
aaacagttgggaggactcag

SEQ ID NO: 247159 - DNA, 20 bp, Artificial Sequence
  chemically synthesized
cagttgggaggactcagaag

SEQ ID NO: 247160 - DNA, 20 bp, Artificial Sequence
  chemically synthesized
atactttcctgtcttcttct

SEQ ID NO: 247161 - DNA, 20 bp, Artificial Sequence
  chemically synthesized
tgggaggactcagaagaaga

SEQ ID NO: 247162 - DNA, 20 bp, Artificial Sequence
  chemically synthesized
gggaggactcagaagaagac

SEQ ID NO: 247163 - DNA, 20 bp, Artificial Sequence
  chemically synthesized
ggactcagaagaagacagga

SEQ ID NO: 247164 - DNA, 20 bp, Artificial Sequence
  chemically synthesized
cagaagaagacaggaaagta

SEQ ID NO: 247165 - DNA, 20 bp, Artificial Sequence
  chemically synthesized
agaagaagacaggaaagtat

SEQ ID NO: 247166 - DNA, 20 bp, Artificial Sequence
  chemically synthesized
caggaaagtatgggaaactc

SEQ ID NO: 247167 - DNA, 20 bp, Artificial Sequence
  chemically synthesized
caattctctaggaagttcca

SEQ ID NO: 247168 - DNA, 20 bp, Artificial Sequence
  chemically synthesized
tccaattctctaggaagttc

SEQ ID NO: 247169 - DNA, 20 bp, Artificial Sequence
  chemically synthesized
tgggaaactctggaacttcc

SEQ ID NO: 247170 - DNA, 20 bp, Artificial Sequence
  chemically synthesized
ggaaactctggaacttccta

SEQ ID NO: 247171 - DNA, 20 bp, Artificial Sequence
  chemically synthesized
gacccctccaattctctagg

SEQ ID NO: 247172 - DNA, 20 bp, Artificial Sequence
  chemically synthesized
tctggaacttcctagagaat

SEQ ID NO: 247173 - DNA, 20 bp, Artificial Sequence
  chemically synthesized
tctgacccctccaattctct

SEQ ID NO: 247174 - DNA, 20 bp, Artificial Sequence
  chemically synthesized
ttctgacccctccaattctc

SEQ ID NO: 247175 - DNA, 20 bp, Artificial Sequence
  chemically synthesized
tggaacttcctagagaattg

SEQ ID NO: 247176 - DNA, 20 bp, Artificial Sequence
  chemically synthesized
ggaacttcctagagaattgg

SEQ ID NO: 247177 - DNA, 20 bp, Artificial Sequence
  chemically synthesized
gaacttcctagagaattgga

SEQ ID NO: 247178 - DNA, 20 bp, Artificial Sequence
  chemically synthesized
aacttcctagagaattggag

SEQ ID NO: 247179 - DNA, 20 bp, Artificial Sequence
  chemically synthesized
tcctagagaattggaggggt

SEQ ID NO: 247180 - DNA, 20 bp, Artificial Sequence
  chemically synthesized
tagagaattggaggggtcag

SEQ ID NO: 247181 - DNA, 20 bp, Artificial Sequence
  chemically synthesized
gaattggaggggtcagaaga

SEQ ID NO: 247182 - DNA, 20 bp, Artificial Sequence
  chemically synthesized
aattggaggggtcagaagac

SEQ ID NO: 247183 - DNA, 20 bp, Artificial Sequence
  chemically synthesized
tggaggggtcagaagacagg

SEQ ID NO: 247184 - DNA, 20 bp, Artificial Sequence
  chemically synthesized
ggtcagaagacaggaagatg

SEQ ID NO: 247185 - DNA, 20 bp, Artificial Sequence
  chemically synthesized
gtcagaagacaggaagatgt

SEQ ID NO: 247186 - DNA, 20 bp, Artificial Sequence
  chemically synthesized
gaagacaggaagatgtggga

SEQ ID NO: 247187 - DNA, 20 bp, Artificial Sequence
  chemically synthesized
caggaagatgtgggaaagtt

SEQ ID NO: 247188 - DNA, 20 bp, Artificial Sequence
  chemically synthesized
tgggaaagtttggaacttcc

SEQ ID NO: 247189 - DNA, 20 bp, Artificial Sequence
  chemically synthesized
ggaaagtttggaacttccta

SEQ ID NO: 247190 - DNA, 20 bp, Artificial Sequence
  chemically synthesized
ccattcaacaagtctctagg

SEQ ID NO: 247191 - DNA, 20 bp, Artificial Sequence
  chemically synthesized
aagccattcaacaagtctct

SEQ ID NO: 247192 - DNA, 20 bp, Artificial Sequence
  chemically synthesized
aaagccattcaacaagtctc

SEQ ID NO: 247193 - DNA, 20 bp, Artificial Sequence
  chemically synthesized
cttcctagagacttgttgaa

SEQ ID NO: 247194 - DNA, 20 bp, Artificial Sequence
  chemically synthesized
ttgggtcaaagccattcaac

SEQ ID NO: 247195 - DNA, 20 bp, Artificial Sequence
  chemically synthesized
cactatcagcatttgggtca

SEQ ID NO: 247196 - DNA, 20 bp, Artificial Sequence
  chemically synthesized
ccatatcactatcagcattt

SEQ ID NO: 247197 - DNA, 20 bp, Artificial Sequence
  chemically synthesized
tccatatcactatcagcatt

SEQ ID NO: 247198 - DNA, 20 bp, Artificial Sequence
  chemically synthesized
ggctttgacccaaatgctga

SEQ ID NO: 247199 - DNA, 20 bp, Artificial Sequence
  chemically synthesized
tttattgtccatatcactat

SEQ ID NO: 247200 - DNA, 20 bp, Artificial Sequence
  chemically synthesized
cccaaatgctgatagtgata

SEQ ID NO: 247201 - DNA, 20 bp, Artificial Sequence
  chemically synthesized
tgatagtgatatggacaata

SEQ ID NO: 247202 - DNA, 20 bp, Artificial Sequence
  chemically synthesized
gtgatatggacaataaagtc

SEQ ID NO: 247203 - DNA, 20 bp, Artificial Sequence
  chemically synthesized
tggacaataaagtccagact

SEQ ID NO: 247204 - DNA, 20 bp, Artificial Sequence
  chemically synthesized
ggacaataaagtccagactg

SEQ ID NO: 247205 - DNA, 20 bp, Artificial Sequence
  chemically synthesized
cctctgagaccacctcagtc

SEQ ID NO: 247206 - DNA, 20 bp, Artificial Sequence
  chemically synthesized
caataaagtccagactgagg

SEQ ID NO: 247207 - DNA, 20 bp, Artificial Sequence
  chemically synthesized
atctccctctgagaccacct

SEQ ID NO: 247208 - DNA, 20 bp, Artificial Sequence
  chemically synthesized
agtccagactgaggtggtct

SEQ ID NO: 247209 - DNA, 20 bp, Artificial Sequence
  chemically synthesized
tccagactgaggtggtctca

SEQ ID NO: 247210 - DNA, 20 bp, Artificial Sequence
  chemically synthesized
ccagactgaggtggtctcag

SEQ ID NO: 247211 - DNA, 20 bp, Artificial Sequence
  chemically synthesized
cagactgaggtggtctcaga

SEQ ID NO: 247212 - DNA, 20 bp, Artificial Sequence
  chemically synthesized
gactgaggtggtctcagagg

SEQ ID NO: 247213 - DNA, 20 bp, Artificial Sequence
  chemically synthesized
gaagtttctcatctccctct

SEQ ID NO: 247214 - DNA, 20 bp, Artificial Sequence
  chemically synthesized
aggtggtctcagagggagat

SEQ ID NO: 247215 - DNA, 20 bp, Artificial Sequence
  chemically synthesized
gagggagatgagaaacttct

SEQ ID NO: 247216 - DNA, 20 bp, Artificial Sequence
  chemically synthesized
cctttactacagttaccaag

SEQ ID NO: 247217 - DNA, 20 bp, Artificial Sequence
  chemically synthesized
tgacctttactacagttacc

SEQ ID NO: 247218 - DNA, 20 bp, Artificial Sequence
  chemically synthesized
gagaaacttcttggtaactg

SEQ ID NO: 247219 - DNA, 20 bp, Artificial Sequence
  chemically synthesized
acttcttggtaactgtagta

SEQ ID NO: 247220 - DNA, 20 bp, Artificial Sequence
  chemically synthesized
cttcttggtaactgtagtaa

SEQ ID NO: 247221 - DNA, 20 bp, Artificial Sequence
  chemically synthesized
agcaaaagtgacctttacta

SEQ ID NO: 247222 - DNA, 20 bp, Artificial Sequence
  chemically synthesized
tctttgctaaagcgtagcaa

SEQ ID NO: 247223 - DNA, 20 bp, Artificial Sequence
  chemically synthesized
aggtcacttttgctacgctt

SEQ ID NO: 247224 - DNA, 20 bp, Artificial Sequence
  chemically synthesized
ccagtctctttgctaaagcg

SEQ ID NO: 247225 - DNA, 20 bp, Artificial Sequence
  chemically synthesized
acttttgctacgctttagca

SEQ ID NO: 247226 - DNA, 20 bp, Artificial Sequence
  chemically synthesized
ttttgctacgctttagcaaa

SEQ ID NO: 247227 - DNA, 20 bp, Artificial Sequence
  chemically synthesized
agccaccagtctctttgcta

SEQ ID NO: 247228 - DNA, 20 bp, Artificial Sequence
  chemically synthesized
ctacgctttagcaaagagac

SEQ ID NO: 247229 - DNA, 20 bp, Artificial Sequence
  chemically synthesized
cgctttagcaaagagactgg

SEQ ID NO: 247230 - DNA, 20 bp, Artificial Sequence
  chemically synthesized
ggacaggggcaaaaagccac

SEQ ID NO: 247231 - DNA, 20 bp, Artificial Sequence
  chemically synthesized
atctctcggacaggggcaaa

SEQ ID NO: 247232 - DNA, 20 bp, Artificial Sequence
  chemically synthesized
gtggctttttgcccctgtcc

SEQ ID NO: 247233 - DNA, 20 bp, Artificial Sequence
  chemically synthesized
tccacagatctctcggacag

SEQ ID NO: 247234 - DNA, 20 bp, Artificial Sequence
  chemically synthesized
ggctttttgcccctgtccga

SEQ ID NO: 247235 - DNA, 20 bp, Artificial Sequence
  chemically synthesized
ttccacagatctctcggaca

SEQ ID NO: 247236 - DNA, 20 bp, Artificial Sequence
  chemically synthesized
attccacagatctctcggac

SEQ ID NO: 247237 - DNA, 20 bp, Artificial Sequence
  chemically synthesized
aattccacagatctctcgga

SEQ ID NO: 247238 - DNA, 20 bp, Artificial Sequence
  chemically synthesized
tcaaaattccacagatctct

SEQ ID NO: 247239 - DNA, 20 bp, Artificial Sequence
  chemically synthesized
gcccctgtccgagagatctg

SEQ ID NO: 247240 - DNA, 20 bp, Artificial Sequence
  chemically synthesized
ctctcatgttcaaaattcca

SEQ ID NO: 247241 - DNA, 20 bp, Artificial Sequence
  chemically synthesized
atctgtggaattttgaacat

SEQ ID NO: 247242 - DNA, 20 bp, Artificial Sequence
  chemically synthesized
ctgtggaattttgaacatga

SEQ ID NO: 247243 - DNA, 20 bp, Artificial Sequence
  chemically synthesized
gtggaattttgaacatgaga

SEQ ID NO: 247244 - DNA, 20 bp, Artificial Sequence
  chemically synthesized
tgaacatgagagagatgatt

SEQ ID NO: 247245 - DNA, 20 bp, Artificial Sequence
  chemically synthesized
gaacatgagagagatgattt

SEQ ID NO: 247246 - DNA, 20 bp, Artificial Sequence
  chemically synthesized
aacatgagagagatgattta

SEQ ID NO: 247247 - DNA, 20 bp, Artificial Sequence
  chemically synthesized
gagagatgatttagggcatc

SEQ ID NO: 247248 - DNA, 20 bp, Artificial Sequence
  chemically synthesized
agatgatttagggcatctgg

SEQ ID NO: 247249 - DNA, 20 bp, Artificial Sequence
  chemically synthesized
tgatttagggcatctggtgg

SEQ ID NO: 247250 - DNA, 20 bp, Artificial Sequence
  chemically synthesized
gatttagggcatctggtgga

SEQ ID NO: 247251 - DNA, 20 bp, Artificial Sequence
  chemically synthesized
tgtttagaaattccttccac

SEQ ID NO: 247252 - DNA, 20 bp, Artificial Sequence
  chemically synthesized
tggtggaaggaatttctaaa

SEQ ID NO: 247253 - DNA, 20 bp, Artificial Sequence
  chemically synthesized
gaaggaatttctaaacagca

SEQ ID NO: 247254 - DNA, 20 bp, Artificial Sequence
  chemically synthesized
atcttgaacactttgctgtt

SEQ ID NO: 247255 - DNA, 20 bp, Artificial Sequence
  chemically synthesized
ttctaaacagcaaagtgttc

SEQ ID NO: 247256 - DNA, 20 bp, Artificial Sequence
  chemically synthesized
aaagtgttcaagatttgact

SEQ ID NO: 247257 - DNA, 20 bp, Artificial Sequence
  chemically synthesized
aagtgttcaagatttgactt

SEQ ID NO: 247258 - DNA, 20 bp, Artificial Sequence
  chemically synthesized
gaatgcttttaacagcaccc

SEQ ID NO: 247259 - DNA, 20 bp, Artificial Sequence
  chemically synthesized
tttgacttgggtgctgttaa

SEQ ID NO: 247260 - DNA, 20 bp, Artificial Sequence
  chemically synthesized
ataaaactgaatgcttttaa

SEQ ID NO: 247261 - DNA, 20 bp, Artificial Sequence
  chemically synthesized
tgggtgctgttaaaagcatt

SEQ ID NO: 247262 - DNA, 20 bp, Artificial Sequence
  chemically synthesized
ttcagttttatgtatccaca

SEQ ID NO: 247263 - DNA, 20 bp, Artificial Sequence
  chemically synthesized
aattccaaaccatatctttg

SEQ ID NO: 247264 - DNA, 20 bp, Artificial Sequence
  chemically synthesized
tttatgtatccacaaagata

SEQ ID NO: 247265 - DNA, 20 bp, Artificial Sequence
  chemically synthesized
gtatccacaaagatatggtt

SEQ ID NO: 247266 - DNA, 20 bp, Artificial Sequence
  chemically synthesized
acaaagatatggtttggaat

SEQ ID NO: 247267 - DNA, 20 bp, Artificial Sequence
  chemically synthesized
gaattggaaattatgtttaa

SEQ ID NO: 247268 - DNA, 20 bp, Artificial Sequence
  chemically synthesized
aattggaaattatgtttaaa

SEQ ID NO: 247269 - DNA, 20 bp, Artificial Sequence
  chemically synthesized
attggaaattatgtttaaaa

SEQ ID NO: 247270 - DNA, 20 bp, Artificial Sequence
  chemically synthesized
ggaaattatgtttaaaaggg

SEQ ID NO: 247271 - DNA, 20 bp, Artificial Sequence
  chemically synthesized
aattatgtttaaaagggaag

SEQ ID NO: 247272 - DNA, 20 bp, Artificial Sequence
  chemically synthesized
ttatgtttaaaagggaagca

SEQ ID NO: 247273 - DNA, 20 bp, Artificial Sequence
  chemically synthesized
aaaagggaagcagagcataa

SEQ ID NO: 247274 - DNA, 20 bp, Artificial Sequence
  chemically synthesized
ggaagcagagcataaaagtt

SEQ ID NO: 247275 - DNA, 20 bp, Artificial Sequence
  chemically synthesized
ataaaagttcagaaaatttg

SEQ ID NO: 247276 - DNA, 20 bp, Artificial Sequence
  chemically synthesized
ttcagaaaatttgcagcctg

SEQ ID NO: 247277 - DNA, 20 bp, Artificial Sequence
  chemically synthesized
ttcttttctattgcatcttc

SEQ ID NO: 247278 - DNA, 20 bp, Artificial Sequence
  chemically synthesized
tttcttttctattgcatctt

SEQ ID NO: 247279 - DNA, 20 bp, Artificial Sequence
  chemically synthesized
tttgcagcctgaagatgcaa

SEQ ID NO: 247280 - DNA, 20 bp, Artificial Sequence
  chemically synthesized
agcctgaagatgcaatagaa

SEQ ID NO: 247281 - DNA, 20 bp, Artificial Sequence
  chemically synthesized
aaaagaaaaactcattttct

SEQ ID NO: 247282 - DNA, 20 bp, Artificial Sequence
  chemically synthesized
tgaatttctcctcagaaaat

SEQ ID NO: 247283 - DNA, 20 bp, Artificial Sequence
  chemically synthesized
aaagaaaaactcattttctg

SEQ ID NO: 247284 - DNA, 20 bp, Artificial Sequence
  chemically synthesized
agaaaaactcattttctgag

SEQ ID NO: 247285 - DNA, 20 bp, Artificial Sequence
  chemically synthesized
agtcagattgaatttctcct

SEQ ID NO: 247286 - DNA, 20 bp, Artificial Sequence
  chemically synthesized
ggagaaattcaatctgacta

SEQ ID NO: 247287 - DNA, 20 bp, Artificial Sequence
  chemically synthesized
catatgcaaatttctgtagt

SEQ ID NO: 247288 - DNA, 20 bp, Artificial Sequence
  chemically synthesized
gttacatatgcaaatttctg

SEQ ID NO: 247289 - DNA, 20 bp, Artificial Sequence
  chemically synthesized
cagaaatttgcatatgtaac

SEQ ID NO: 247290 - DNA, 20 bp, Artificial Sequence
  chemically synthesized
agaaatttgcatatgtaacg

SEQ ID NO: 247291 - DNA, 20 bp, Artificial Sequence
  chemically synthesized
aaatttgcatatgtaacgag

SEQ ID NO: 247292 - DNA, 20 bp, Artificial Sequence
  chemically synthesized
ttgccttggtgattaacatt

SEQ ID NO: 247293 - DNA, 20 bp, Artificial Sequence
  chemically synthesized
ggagccaaatgttaatcacc

SEQ ID NO: 247294 - DNA, 20 bp, Artificial Sequence
  chemically synthesized
gagccaaatgttaatcacca

SEQ ID NO: 247295 - DNA, 20 bp, Artificial Sequence
  chemically synthesized
aatgttaatcaccaaggcaa

SEQ ID NO: 247296 - DNA, 20 bp, Artificial Sequence
  chemically synthesized
atgttaatcaccaaggcaat

SEQ ID NO: 247297 - DNA, 20 bp, Artificial Sequence
  chemically synthesized
agacaattttcccattgcct

SEQ ID NO: 247298 - DNA, 20 bp, Artificial Sequence
  chemically synthesized
ggcaatgggaaaattgtctc

SEQ ID NO: 247299 - DNA, 20 bp, Artificial Sequence
  chemically synthesized
gcaatgggaaaattgtctcc

SEQ ID NO: 247300 - DNA, 20 bp, Artificial Sequence
  chemically synthesized
aaaacttctggcatttcctg

SEQ ID NO: 247301 - DNA, 20 bp, Artificial Sequence
  chemically synthesized
tgaaaacttctggcatttcc

SEQ ID NO: 247302 - DNA, 20 bp, Artificial Sequence
  chemically synthesized
aaattgtctccaggaaatgc

SEQ ID NO: 247303 - DNA, 20 bp, Artificial Sequence
  chemically synthesized
ttgtctccaggaaatgccag

SEQ ID NO: 247304 - DNA, 20 bp, Artificial Sequence
  chemically synthesized
ggggctgccatgaaaacttc

SEQ ID NO: 247305 - DNA, 20 bp, Artificial Sequence
  chemically synthesized
ggaaatgccagaagttttca

SEQ ID NO: 247306 - DNA, 20 bp, Artificial Sequence
  chemically synthesized
aatgccagaagttttcatgg

SEQ ID NO: 247307 - DNA, 20 bp, Artificial Sequence
  chemically synthesized
ctctggtcctatgatgggag

SEQ ID NO: 247308 - DNA, 20 bp, Artificial Sequence
  chemically synthesized
cctctggtcctatgatggga

SEQ ID NO: 247309 - DNA, 20 bp, Artificial Sequence
  chemically synthesized
catggcagcccctcccatca

SEQ ID NO: 247310 - DNA, 20 bp, Artificial Sequence
  chemically synthesized
gcctctggtcctatgatggg

SEQ ID NO: 247311 - DNA, 20 bp, Artificial Sequence
  chemically synthesized
atggcagcccctcccatcat

SEQ ID NO: 247312 - DNA, 20 bp, Artificial Sequence
  chemically synthesized
ggcctctggtcctatgatgg

SEQ ID NO: 247313 - DNA, 20 bp, Artificial Sequence
  chemically synthesized
taggcctctggtcctatgat

SEQ ID NO: 247314 - DNA, 20 bp, Artificial Sequence
  chemically synthesized
ctaggcctctggtcctatga

SEQ ID NO: 247315 - DNA, 20 bp, Artificial Sequence
  chemically synthesized
agcccctcccatcataggac

SEQ ID NO: 247316 - DNA, 20 bp, Artificial Sequence
  chemically synthesized
cccctcccatcataggacca

SEQ ID NO: 247317 - DNA, 20 bp, Artificial Sequence
  chemically synthesized
ccctcccatcataggaccag

SEQ ID NO: 247318 - DNA, 20 bp, Artificial Sequence
  chemically synthesized
ccatcataggaccagaggcc

SEQ ID NO: 247319 - DNA, 20 bp, Artificial Sequence
  chemically synthesized
catcataggaccagaggcct

SEQ ID NO: 247320 - DNA, 20 bp, Artificial Sequence
  chemically synthesized
attttgccttcctaggcctc

SEQ ID NO: 247321 - DNA, 20 bp, Artificial Sequence
  chemically synthesized
cataggaccagaggcctagg

SEQ ID NO: 247322 - DNA, 20 bp, Artificial Sequence
  chemically synthesized
ataggaccagaggcctagga

SEQ ID NO: 247323 - DNA, 20 bp, Artificial Sequence
  chemically synthesized
ggaaaccattttgccttcct

SEQ ID NO: 247324 - DNA, 20 bp, Artificial Sequence
  chemically synthesized
aggaaaccattttgccttcc

SEQ ID NO: 247325 - DNA, 20 bp, Artificial Sequence
  chemically synthesized
agaggcctaggaaggcaaaa

SEQ ID NO: 247326 - DNA, 20 bp, Artificial Sequence
  chemically synthesized
aggaaggcaaaatggtttcc

SEQ ID NO: 247327 - DNA, 20 bp, Artificial Sequence
  chemically synthesized
ggaaggcaaaatggtttcct

SEQ ID NO: 247328 - DNA, 20 bp, Artificial Sequence
  chemically synthesized
ggcaaaatggtttcctgggc

SEQ ID NO: 247329 - DNA, 20 bp, Artificial Sequence
  chemically synthesized
gcaaaatggtttcctgggcc

SEQ ID NO: 247330 - DNA, 20 bp, Artificial Sequence
  chemically synthesized
gggggctctgggcccggccc

SEQ ID NO: 247331 - DNA, 20 bp, Artificial Sequence
  chemically synthesized
ggggggctctgggcccggcc

SEQ ID NO: 247332 - DNA, 20 bp, Artificial Sequence
  chemically synthesized
atggtttcctgggccgggcc

SEQ ID NO: 247333 - DNA, 20 bp, Artificial Sequence
  chemically synthesized
ggtttcctgggccgggccca

SEQ ID NO: 247334 - DNA, 20 bp, Artificial Sequence
  chemically synthesized
tagcaggggggctctgggcc

SEQ ID NO: 247335 - DNA, 20 bp, Artificial Sequence
  chemically synthesized
gcacatagcaggggggctct

SEQ ID NO: 247336 - DNA, 20 bp, Artificial Sequence
  chemically synthesized
tgcacatagcaggggggctc

SEQ ID NO: 247337 - DNA, 20 bp, Artificial Sequence
  chemically synthesized
ctaggctgcacatagcaggg

SEQ ID NO: 247338 - DNA, 20 bp, Artificial Sequence
  chemically synthesized
cctaggctgcacatagcagg

SEQ ID NO: 247339 - DNA, 20 bp, Artificial Sequence
  chemically synthesized
ccctaggctgcacatagcag

SEQ ID NO: 247340 - DNA, 20 bp, Artificial Sequence
  chemically synthesized
tccctaggctgcacatagca

SEQ ID NO: 247341 - DNA, 20 bp, Artificial Sequence
  chemically synthesized
gtccctaggctgcacatagc

SEQ ID NO: 247342 - DNA, 20 bp, Artificial Sequence
  chemically synthesized
cagagcccccctgctatgtg

SEQ ID NO: 247343 - DNA, 20 bp, Artificial Sequence
  chemically synthesized
agtccctaggctgcacatag

SEQ ID NO: 247344 - DNA, 20 bp, Artificial Sequence
  chemically synthesized
cctagtccctaggctgcaca

SEQ ID NO: 247345 - DNA, 20 bp, Artificial Sequence
  chemically synthesized
cccccctgctatgtgcagcc

SEQ ID NO: 247346 - DNA, 20 bp, Artificial Sequence
  chemically synthesized
ccccctgctatgtgcagcct

SEQ ID NO: 247347 - DNA, 20 bp, Artificial Sequence
  chemically synthesized
cccctgctatgtgcagccta

SEQ ID NO: 247348 - DNA, 20 bp, Artificial Sequence
  chemically synthesized
gctatgtgcagcctagggac

SEQ ID NO: 247349 - DNA, 20 bp, Artificial Sequence
  chemically synthesized
ctatgtgcagcctagggact

SEQ ID NO: 247350 - DNA, 20 bp, Artificial Sequence
  chemically synthesized
atgcagggcacctagtccct

SEQ ID NO: 247351 - DNA, 20 bp, Artificial Sequence
  chemically synthesized
gatgcagggcacctagtccc

SEQ ID NO: 247352 - DNA, 20 bp, Artificial Sequence
  chemically synthesized
tggctgggatgcagggcacc

SEQ ID NO: 247353 - DNA, 20 bp, Artificial Sequence
  chemically synthesized
ggactaggtgccctgcatcc

SEQ ID NO: 247354 - DNA, 20 bp, Artificial Sequence
  chemically synthesized
gctggagtggctgggatgca

SEQ ID NO: 247355 - DNA, 20 bp, Artificial Sequence
  chemically synthesized
ggctggagtggctgggatgc

SEQ ID NO: 247356 - DNA, 20 bp, Artificial Sequence
  chemically synthesized
tggctggagtggctgggatg

SEQ ID NO: 247357 - DNA, 20 bp, Artificial Sequence
  chemically synthesized
tagccatggctggagtggct

SEQ ID NO: 247358 - DNA, 20 bp, Artificial Sequence
  chemically synthesized
gccctgcatcccagccactc

SEQ ID NO: 247359 - DNA, 20 bp, Artificial Sequence
  chemically synthesized
ttagccatggctggagtggc

SEQ ID NO: 247360 - DNA, 20 bp, Artificial Sequence
  chemically synthesized
ccttttagccatggctggag

SEQ ID NO: 247361 - DNA, 20 bp, Artificial Sequence
  chemically synthesized
catcccagccactccagcca

SEQ ID NO: 247362 - DNA, 20 bp, Artificial Sequence
  chemically synthesized
gctccttttagccatggctg

SEQ ID NO: 247363 - DNA, 20 bp, Artificial Sequence
  chemically synthesized
tggctccttttagccatggc

SEQ ID NO: 247364 - DNA, 20 bp, Artificial Sequence
  chemically synthesized
gccactccagccatggctaa

SEQ ID NO: 247365 - DNA, 20 bp, Artificial Sequence
  chemically synthesized
atcttggctccttttagcca

SEQ ID NO: 247366 - DNA, 20 bp, Artificial Sequence
  chemically synthesized
ccactccagccatggctaaa

SEQ ID NO: 247367 - DNA, 20 bp, Artificial Sequence
  chemically synthesized
actccagccatggctaaaag

SEQ ID NO: 247368 - DNA, 20 bp, Artificial Sequence
  chemically synthesized
agctctatcttggctccttt

SEQ ID NO: 247369 - DNA, 20 bp, Artificial Sequence
  chemically synthesized
agccatggctaaaaggagcc

SEQ ID NO: 247370 - DNA, 20 bp, Artificial Sequence
  chemically synthesized
atggctaaaaggagccaaga

SEQ ID NO: 247371 - DNA, 20 bp, Artificial Sequence
  chemically synthesized
ggctaaaaggagccaagata

SEQ ID NO: 247372 - DNA, 20 bp, Artificial Sequence
  chemically synthesized
ccatgggctgagctctatct

SEQ ID NO: 247373 - DNA, 20 bp, Artificial Sequence
  chemically synthesized
aaaggagccaagatagagct

SEQ ID NO: 247374 - DNA, 20 bp, Artificial Sequence
  chemically synthesized
ccaagatagagctcagccca

SEQ ID NO: 247375 - DNA, 20 bp, Artificial Sequence
  chemically synthesized
accctctgtagccatgggct

SEQ ID NO: 247376 - DNA, 20 bp, Artificial Sequence
  chemically synthesized
tagagctcagcccatggcta

SEQ ID NO: 247377 - DNA, 20 bp, Artificial Sequence
  chemically synthesized
cttgcaccctctgtagccat

SEQ ID NO: 247378 - DNA, 20 bp, Artificial Sequence
  chemically synthesized
gcttgcaccctctgtagcca

SEQ ID NO: 247379 - DNA, 20 bp, Artificial Sequence
  chemically synthesized
gagctcagcccatggctaca

SEQ ID NO: 247380 - DNA, 20 bp, Artificial Sequence
  chemically synthesized
agctcagcccatggctacag

SEQ ID NO: 247381 - DNA, 20 bp, Artificial Sequence
  chemically synthesized
gctcagcccatggctacaga

SEQ ID NO: 247382 - DNA, 20 bp, Artificial Sequence
  chemically synthesized
cttggggcttgcaccctctg

SEQ ID NO: 247383 - DNA, 20 bp, Artificial Sequence
  chemically synthesized
cccatggctacagagggtgc

SEQ ID NO: 247384 - DNA, 20 bp, Artificial Sequence
  chemically synthesized
ctacagagggtgcaagcccc

SEQ ID NO: 247385 - DNA, 20 bp, Artificial Sequence
  chemically synthesized
agggtgcaagccccaagatt

SEQ ID NO: 247386 - DNA, 20 bp, Artificial Sequence
  chemically synthesized
atggaagctgccaaatcttg

SEQ ID NO: 247387 - DNA, 20 bp, Artificial Sequence
  chemically synthesized
catggaagctgccaaatctt

SEQ ID NO: 247388 - DNA, 20 bp, Artificial Sequence
  chemically synthesized
acatggaagctgccaaatct

SEQ ID NO: 247389 - DNA, 20 bp, Artificial Sequence
  chemically synthesized
gtgcaagccccaagatttgg

SEQ ID NO: 247390 - DNA, 20 bp, Artificial Sequence
  chemically synthesized
aagatttggcagcttccatg

SEQ ID NO: 247391 - DNA, 20 bp, Artificial Sequence
  chemically synthesized
acaggctcaacaccacatgg

SEQ ID NO: 247392 - DNA, 20 bp, Artificial Sequence
  chemically synthesized
cccacaggctcaacaccaca

SEQ ID NO: 247393 - DNA, 20 bp, Artificial Sequence
  chemically synthesized
ggcagcttccatgtggtgtt

SEQ ID NO: 247394 - DNA, 20 bp, Artificial Sequence
  chemically synthesized
tccatgtggtgttgagcctg

SEQ ID NO: 247395 - DNA, 20 bp, Artificial Sequence
  chemically synthesized
ccatgtggtgttgagcctgt

SEQ ID NO: 247396 - DNA, 20 bp, Artificial Sequence
  chemically synthesized
cttgacttctgtgtacccac

SEQ ID NO: 247397 - DNA, 20 bp, Artificial Sequence
  chemically synthesized
tcttgacttctgtgtaccca

SEQ ID NO: 247398 - DNA, 20 bp, Artificial Sequence
  chemically synthesized
gtgttgagcctgtgggtaca

SEQ ID NO: 247399 - DNA, 20 bp, Artificial Sequence
  chemically synthesized
ttgagcctgtgggtacacag

SEQ ID NO: 247400 - DNA, 20 bp, Artificial Sequence
  chemically synthesized
cctgtgggtacacagaagtc

SEQ ID NO: 247401 - DNA, 20 bp, Artificial Sequence
  chemically synthesized
gtacacagaagtcaagaact

SEQ ID NO: 247402 - DNA, 20 bp, Artificial Sequence
  chemically synthesized
agaagtcaagaactgagctt

SEQ ID NO: 247403 - DNA, 20 bp, Artificial Sequence
  chemically synthesized
gaagtcaagaactgagcttt

SEQ ID NO: 247404 - DNA, 20 bp, Artificial Sequence
  chemically synthesized
aggtagaagttcccaaagct

SEQ ID NO: 247405 - DNA, 20 bp, Artificial Sequence
  chemically synthesized
aatctaggtagaagttccca

SEQ ID NO: 247406 - DNA, 20 bp, Artificial Sequence
  chemically synthesized
gagctttgggaacttctacc

SEQ ID NO: 247407 - DNA, 20 bp, Artificial Sequence
  chemically synthesized
atcctctgaaatctaggtag

SEQ ID NO: 247408 - DNA, 20 bp, Artificial Sequence
  chemically synthesized
tatatcctctgaaatctagg

SEQ ID NO: 247409 - DNA, 20 bp, Artificial Sequence
  chemically synthesized
gggaacttctacctagattt

SEQ ID NO: 247410 - DNA, 20 bp, Artificial Sequence
  chemically synthesized
ccatatatcctctgaaatct

SEQ ID NO: 247411 - DNA, 20 bp, Artificial Sequence
  chemically synthesized
gaacttctacctagatttca

SEQ ID NO: 247412 - DNA, 20 bp, Artificial Sequence
  chemically synthesized
tccatatatcctctgaaatc

SEQ ID NO: 247413 - DNA, 20 bp, Artificial Sequence
  chemically synthesized
aacttctacctagatttcag

SEQ ID NO: 247414 - DNA, 20 bp, Artificial Sequence
  chemically synthesized
cctagatttcagaggatata

SEQ ID NO: 247415 - DNA, 20 bp, Artificial Sequence
  chemically synthesized
agaggatatatggaaatgtc

SEQ ID NO: 247416 - DNA, 20 bp, Artificial Sequence
  chemically synthesized
tatggaaatgtctagatatc

SEQ ID NO: 247417 - DNA, 20 bp, Artificial Sequence
  chemically synthesized
atggaaatgtctagatatcc

SEQ ID NO: 247418 - DNA, 20 bp, Artificial Sequence
  chemically synthesized
caaacttctgcctggatatc

SEQ ID NO: 247419 - DNA, 20 bp, Artificial Sequence
  chemically synthesized
gaaatgtctagatatccagg

SEQ ID NO: 247420 - DNA, 20 bp, Artificial Sequence
  chemically synthesized
atgtctagatatccaggcag

SEQ ID NO: 247421 - DNA, 20 bp, Artificial Sequence
  chemically synthesized
ctctgcagcaaacttctgcc

SEQ ID NO: 247422 - DNA, 20 bp, Artificial Sequence
  chemically synthesized
atccaggcagaagtttgctg

SEQ ID NO: 247423 - DNA, 20 bp, Artificial Sequence
  chemically synthesized
ccaggcagaagtttgctgca

SEQ ID NO: 247424 - DNA, 20 bp, Artificial Sequence
  chemically synthesized
gcagaagtttgctgcagaga

SEQ ID NO: 247425 - DNA, 20 bp, Artificial Sequence
  chemically synthesized
cagaagtttgctgcagagat

SEQ ID NO: 247426 - DNA, 20 bp, Artificial Sequence
  chemically synthesized
ctctgagggccccatctctg

SEQ ID NO: 247427 - DNA, 20 bp, Artificial Sequence
  chemically synthesized
agaagtttgctgcagagatg

SEQ ID NO: 247428 - DNA, 20 bp, Artificial Sequence
  chemically synthesized
tgctgcagagatggggccct

SEQ ID NO: 247429 - DNA, 20 bp, Artificial Sequence
  chemically synthesized
ctgcagagatggggccctca

SEQ ID NO: 247430 - DNA, 20 bp, Artificial Sequence
  chemically synthesized
gcagagatggggccctcaga

SEQ ID NO: 247431 - DNA, 20 bp, Artificial Sequence
  chemically synthesized
ctagtagaggttctctctga

SEQ ID NO: 247432 - DNA, 20 bp, Artificial Sequence
  chemically synthesized
cctagtagaggttctctctg

SEQ ID NO: 247433 - DNA, 20 bp, Artificial Sequence
  chemically synthesized
acctagtagaggttctctct

SEQ ID NO: 247434 - DNA, 20 bp, Artificial Sequence
  chemically synthesized
ccctcagagagaacctctac

SEQ ID NO: 247435 - DNA, 20 bp, Artificial Sequence
  chemically synthesized
cctcagagagaacctctact

SEQ ID NO: 247436 - DNA, 20 bp, Artificial Sequence
  chemically synthesized
cttctgcactgacctagtag

SEQ ID NO: 247437 - DNA, 20 bp, Artificial Sequence
  chemically synthesized
tcttctgcactgacctagta

SEQ ID NO: 247438 - DNA, 20 bp, Artificial Sequence
  chemically synthesized
agagagaacctctactaggt

SEQ ID NO: 247439 - DNA, 20 bp, Artificial Sequence
  chemically synthesized
tctcttctgcactgacctag

SEQ ID NO: 247440 - DNA, 20 bp, Artificial Sequence
  chemically synthesized
atttctcttctgcactgacc

SEQ ID NO: 247441 - DNA, 20 bp, Artificial Sequence
  chemically synthesized
gaacctctactaggtcagtg

SEQ ID NO: 247442 - DNA, 20 bp, Artificial Sequence
  chemically synthesized
cctctactaggtcagtgcag

SEQ ID NO: 247443 - DNA, 20 bp, Artificial Sequence
  chemically synthesized
tctactaggtcagtgcagaa

SEQ ID NO: 247444 - DNA, 20 bp, Artificial Sequence
  chemically synthesized
gtcagtgcagaagagaaatg

SEQ ID NO: 247445 - DNA, 20 bp, Artificial Sequence
  chemically synthesized
tcagtgcagaagagaaatgt

SEQ ID NO: 247446 - DNA, 20 bp, Artificial Sequence
  chemically synthesized
cagtgcagaagagaaatgtg

SEQ ID NO: 247447 - DNA, 20 bp, Artificial Sequence
  chemically synthesized
gcagaagagaaatgtggggt

SEQ ID NO: 247448 - DNA, 20 bp, Artificial Sequence
  chemically synthesized
agaagagaaatgtggggttg

SEQ ID NO: 247449 - DNA, 20 bp, Artificial Sequence
  chemically synthesized
gtggggttggagcccccaca

SEQ ID NO: 247450 - DNA, 20 bp, Artificial Sequence
  chemically synthesized
ggggttggagcccccacata

SEQ ID NO: 247451 - DNA, 20 bp, Artificial Sequence
  chemically synthesized
ccagtggggactctatgtgg

SEQ ID NO: 247452 - DNA, 20 bp, Artificial Sequence
  chemically synthesized
cccagtggggactctatgtg

SEQ ID NO: 247453 - DNA, 20 bp, Artificial Sequence
  chemically synthesized
ccccagtggggactctatgt

SEQ ID NO: 247454 - DNA, 20 bp, Artificial Sequence
  chemically synthesized
gccccagtggggactctatg

SEQ ID NO: 247455 - DNA, 20 bp, Artificial Sequence
  chemically synthesized
cccccacatagagtccccac

SEQ ID NO: 247456 - DNA, 20 bp, Artificial Sequence
  chemically synthesized
ccccacatagagtccccact

SEQ ID NO: 247457 - DNA, 20 bp, Artificial Sequence
  chemically synthesized
cccacatagagtccccactg

SEQ ID NO: 247458 - DNA, 20 bp, Artificial Sequence
  chemically synthesized
tactaggcagtgccccagtg

SEQ ID NO: 247459 - DNA, 20 bp, Artificial Sequence
  chemically synthesized
ctactaggcagtgccccagt

SEQ ID NO: 247460 - DNA, 20 bp, Artificial Sequence
  chemically synthesized
tctactaggcagtgccccag

SEQ ID NO: 247461 - DNA, 20 bp, Artificial Sequence
  chemically synthesized
agctctactaggcagtgccc

SEQ ID NO: 247462 - DNA, 20 bp, Artificial Sequence
  chemically synthesized
gtccccactggggcactgcc

SEQ ID NO: 247463 - DNA, 20 bp, Artificial Sequence
  chemically synthesized
cccactggggcactgcctag

SEQ ID NO: 247464 - DNA, 20 bp, Artificial Sequence
  chemically synthesized
cactggggcactgcctagta

SEQ ID NO: 247465 - DNA, 20 bp, Artificial Sequence
  chemically synthesized
cttctcacagctctactagg

SEQ ID NO: 247466 - DNA, 20 bp, Artificial Sequence
  chemically synthesized
cctcttctcacagctctact

SEQ ID NO: 247467 - DNA, 20 bp, Artificial Sequence
  chemically synthesized
ccctcttctcacagctctac

SEQ ID NO: 247468 - DNA, 20 bp, Artificial Sequence
  chemically synthesized
gcactgcctagtagagctgt

SEQ ID NO: 247469 - DNA, 20 bp, Artificial Sequence
  chemically synthesized
ctgcctagtagagctgtgag

SEQ ID NO: 247470 - DNA, 20 bp, Artificial Sequence
  chemically synthesized
gcctagtagagctgtgagaa

SEQ ID NO: 247471 - DNA, 20 bp, Artificial Sequence
  chemically synthesized
cctagtagagctgtgagaag

SEQ ID NO: 247472 - DNA, 20 bp, Artificial Sequence
  chemically synthesized
tggatcaagccctcttctca

SEQ ID NO: 247473 - DNA, 20 bp, Artificial Sequence
  chemically synthesized
ctagtagagctgtgagaaga

SEQ ID NO: 247474 - DNA, 20 bp, Artificial Sequence
  chemically synthesized
ttccatgcacacggtggatc

SEQ ID NO: 247475 - DNA, 20 bp, Artificial Sequence
  chemically synthesized
tggctgttccatgcacacgg

SEQ ID NO: 247476 - DNA, 20 bp, Artificial Sequence
  chemically synthesized
ggcttgatccaccgtgtgca

SEQ ID NO: 247477 - DNA, 20 bp, Artificial Sequence
  chemically synthesized
ctgtggctgttccatgcaca

SEQ ID NO: 247478 - DNA, 20 bp, Artificial Sequence
  chemically synthesized
gatccaccgtgtgcatggaa

SEQ ID NO: 247479 - DNA, 20 bp, Artificial Sequence
  chemically synthesized
ccgtgtgcatggaacagcca

SEQ ID NO: 247480 - DNA, 20 bp, Artificial Sequence
  chemically synthesized
aggctagcattgagtgtctg

SEQ ID NO: 247481 - DNA, 20 bp, Artificial Sequence
  chemically synthesized
cagccacagacactcaatgc

SEQ ID NO: 247482 - DNA, 20 bp, Artificial Sequence
  chemically synthesized
tgctttcacaggctagcatt

SEQ ID NO: 247483 - DNA, 20 bp, Artificial Sequence
  chemically synthesized
tcctggctgctttcacaggc

SEQ ID NO: 247484 - DNA, 20 bp, Artificial Sequence
  chemically synthesized
cactcaatgctagcctgtga

SEQ ID NO: 247485 - DNA, 20 bp, Artificial Sequence
  chemically synthesized
tcaatgctagcctgtgaaag

SEQ ID NO: 247486 - DNA, 20 bp, Artificial Sequence
  chemically synthesized
cccttcctggctgctttcac

SEQ ID NO: 247487 - DNA, 20 bp, Artificial Sequence
  chemically synthesized
ccccttcctggctgctttca

SEQ ID NO: 247488 - DNA, 20 bp, Artificial Sequence
  chemically synthesized
tgctagcctgtgaaagcagc

SEQ ID NO: 247489 - DNA, 20 bp, Artificial Sequence
  chemically synthesized
gctagcctgtgaaagcagcc

SEQ ID NO: 247490 - DNA, 20 bp, Artificial Sequence
  chemically synthesized
agcctgtgaaagcagccagg

SEQ ID NO: 247491 - DNA, 20 bp, Artificial Sequence
  chemically synthesized
gcctgtgaaagcagccagga

SEQ ID NO: 247492 - DNA, 20 bp, Artificial Sequence
  chemically synthesized
cctgtgaaagcagccaggaa

SEQ ID NO: 247493 - DNA, 20 bp, Artificial Sequence
  chemically synthesized
ctgtgaaagcagccaggaag

SEQ ID NO: 247494 - DNA, 20 bp, Artificial Sequence
  chemically synthesized
tgtgaaagcagccaggaagg

SEQ ID NO: 247495 - DNA, 20 bp, Artificial Sequence
  chemically synthesized
gcagggtacagcccccttcc

SEQ ID NO: 247496 - DNA, 20 bp, Artificial Sequence
  chemically synthesized
tcctttggcgttgcagggta

SEQ ID NO: 247497 - DNA, 20 bp, Artificial Sequence
  chemically synthesized
tccactcctttggcgttgca

SEQ ID NO: 247498 - DNA, 20 bp, Artificial Sequence
  chemically synthesized
ctccactcctttggcgttgc

SEQ ID NO: 247499 - DNA, 20 bp, Artificial Sequence
  chemically synthesized
gctccactcctttggcgttg

SEQ ID NO: 247500 - DNA, 20 bp, Artificial Sequence
  chemically synthesized
ggctgtaccctgcaacgcca

SEQ ID NO: 247501 - DNA, 20 bp, Artificial Sequence
  chemically synthesized
gctgtaccctgcaacgccaa

SEQ ID NO: 247502 - DNA, 20 bp, Artificial Sequence
  chemically synthesized
tgtaccctgcaacgccaaag

SEQ ID NO: 247503 - DNA, 20 bp, Artificial Sequence
  chemically synthesized
accctgcaacgccaaaggag

SEQ ID NO: 247504 - DNA, 20 bp, Artificial Sequence
  chemically synthesized
cttgggtagctccactcctt

SEQ ID NO: 247505 - DNA, 20 bp, Artificial Sequence
  chemically synthesized
cctgcaacgccaaaggagtg

SEQ ID NO: 247506 - DNA, 20 bp, Artificial Sequence
  chemically synthesized
ccaaaggagtggagctaccc

SEQ ID NO: 247507 - DNA, 20 bp, Artificial Sequence
  chemically synthesized
caaaggagtggagctaccca

SEQ ID NO: 247508 - DNA, 20 bp, Artificial Sequence
  chemically synthesized
tgggctcccacagccttggg

SEQ ID NO: 247509 - DNA, 20 bp, Artificial Sequence
  chemically synthesized
agtggagctacccaaggctg

SEQ ID NO: 247510 - DNA, 20 bp, Artificial Sequence
  chemically synthesized
aggtgggctcccacagcctt

SEQ ID NO: 247511 - DNA, 20 bp, Artificial Sequence
  chemically synthesized
gtggagctacccaaggctgt

SEQ ID NO: 247512 - DNA, 20 bp, Artificial Sequence
  chemically synthesized
aaggtgggctcccacagcct

SEQ ID NO: 247513 - DNA, 20 bp, Artificial Sequence
  chemically synthesized
ggagctacccaaggctgtgg

SEQ ID NO: 247514 - DNA, 20 bp, Artificial Sequence
  chemically synthesized
tgatgcaaggtgggctccca

SEQ ID NO: 247515 - DNA, 20 bp, Artificial Sequence
  chemically synthesized
aggtcacgctgatgcaaggt

SEQ ID NO: 247516 - DNA, 20 bp, Artificial Sequence
  chemically synthesized
caggtcacgctgatgcaagg

SEQ ID NO: 247517 - DNA, 20 bp, Artificial Sequence
  chemically synthesized
tgtgggagcccaccttgcat

SEQ ID NO: 247518 - DNA, 20 bp, Artificial Sequence
  chemically synthesized
atccaggtcacgctgatgca

SEQ ID NO: 247519 - DNA, 20 bp, Artificial Sequence
  chemically synthesized
catccaggtcacgctgatgc

SEQ ID NO: 247520 - DNA, 20 bp, Artificial Sequence
  chemically synthesized
caccttgcatcagcgtgacc

SEQ ID NO: 247521 - DNA, 20 bp, Artificial Sequence
  chemically synthesized
catcagcgtgacctggatgt

SEQ ID NO: 247522 - DNA, 20 bp, Artificial Sequence
  chemically synthesized
tgactctgtgtctcacatcc

SEQ ID NO: 247523 - DNA, 20 bp, Artificial Sequence
  chemically synthesized
ttgactctgtgtctcacatc

SEQ ID NO: 247524 - DNA, 20 bp, Artificial Sequence
  chemically synthesized
cgtgacctggatgtgagaca

SEQ ID NO: 247525 - DNA, 20 bp, Artificial Sequence
  chemically synthesized
tgacctggatgtgagacaca

SEQ ID NO: 247526 - DNA, 20 bp, Artificial Sequence
  chemically synthesized
ggatgtgagacacagagtca

SEQ ID NO: 247527 - DNA, 20 bp, Artificial Sequence
  chemically synthesized
gatgtgagacacagagtcaa

SEQ ID NO: 247528 - DNA, 20 bp, Artificial Sequence
  chemically synthesized
tgtgagacacagagtcaaag

SEQ ID NO: 247529 - DNA, 20 bp, Artificial Sequence
  chemically synthesized
agagtcaaaggagattatct

SEQ ID NO: 247530 - DNA, 20 bp, Artificial Sequence
  chemically synthesized
agtcaaaggagattatcttg

SEQ ID NO: 247531 - DNA, 20 bp, Artificial Sequence
  chemically synthesized
taattaaatcttaaagctcc

SEQ ID NO: 247532 - DNA, 20 bp, Artificial Sequence
  chemically synthesized
ggagattatcttggagcttt

SEQ ID NO: 247533 - DNA, 20 bp, Artificial Sequence
  chemically synthesized
gaggcagtaattaaatctta

SEQ ID NO: 247534 - DNA, 20 bp, Artificial Sequence
  chemically synthesized
agatttaattactgcctcat

SEQ ID NO: 247535 - DNA, 20 bp, Artificial Sequence
  chemically synthesized
gcatgtcaaatccaatgagg

SEQ ID NO: 247536 - DNA, 20 bp, Artificial Sequence
  chemically synthesized
catgcatgtcaaatccaatg

SEQ ID NO: 247537 - DNA, 20 bp, Artificial Sequence
  chemically synthesized
ccatgcatgtcaaatccaat

SEQ ID NO: 247538 - DNA, 20 bp, Artificial Sequence
  chemically synthesized
ctcattggatttgacatgca

SEQ ID NO: 247539 - DNA, 20 bp, Artificial Sequence
  chemically synthesized
cattggatttgacatgcatg

SEQ ID NO: 247540 - DNA, 20 bp, Artificial Sequence
  chemically synthesized
gatttgacatgcatggagcc

SEQ ID NO: 247541 - DNA, 20 bp, Artificial Sequence
  chemically synthesized
tttgacatgcatggagcctg

SEQ ID NO: 247542 - DNA, 20 bp, Artificial Sequence
  chemically synthesized
ggcccaaacaaaggggctcc

SEQ ID NO: 247543 - DNA, 20 bp, Artificial Sequence
  chemically synthesized
tggcccaaacaaaggggctc

SEQ ID NO: 247544 - DNA, 20 bp, Artificial Sequence
  chemically synthesized
gagcctggagcccctttgtt

SEQ ID NO: 247545 - DNA, 20 bp, Artificial Sequence
  chemically synthesized
agaaattggcccaaacaaag

SEQ ID NO: 247546 - DNA, 20 bp, Artificial Sequence
  chemically synthesized
agcctggagcccctttgttt

SEQ ID NO: 247547 - DNA, 20 bp, Artificial Sequence
  chemically synthesized
gagaaattggcccaaacaaa

SEQ ID NO: 247548 - DNA, 20 bp, Artificial Sequence
  chemically synthesized
ggagaaattggcccaaacaa

SEQ ID NO: 247549 - DNA, 20 bp, Artificial Sequence
  chemically synthesized
gggagaaattggcccaaaca

SEQ ID NO: 247550 - DNA, 20 bp, Artificial Sequence
  chemically synthesized
ccattccagatgggagaaat

SEQ ID NO: 247551 - DNA, 20 bp, Artificial Sequence
  chemically synthesized
ttgggccaatttctcccatc

SEQ ID NO: 247552 - DNA, 20 bp, Artificial Sequence
  chemically synthesized
aatacacccattccagatgg

SEQ ID NO: 247553 - DNA, 20 bp, Artificial Sequence
  chemically synthesized
taaatacacccattccagat

SEQ ID NO: 247554 - DNA, 20 bp, Artificial Sequence
  chemically synthesized
ccaatttctcccatctggaa

SEQ ID NO: 247555 - DNA, 20 bp, Artificial Sequence
  chemically synthesized
ttaaatacacccattccaga

SEQ ID NO: 247556 - DNA, 20 bp, Artificial Sequence
  chemically synthesized
caatttctcccatctggaat

SEQ ID NO: 247557 - DNA, 20 bp, Artificial Sequence
  chemically synthesized
ttggttaaatacacccattc

SEQ ID NO: 247558 - DNA, 20 bp, Artificial Sequence
  chemically synthesized
tgggtgtatttaaccaatgc

SEQ ID NO: 247559 - DNA, 20 bp, Artificial Sequence
  chemically synthesized
tacaatggaggtaccagcat

SEQ ID NO: 247560 - DNA, 20 bp, Artificial Sequence
  chemically synthesized
tctaggtacaatggaggtac

SEQ ID NO: 247561 - DNA, 20 bp, Artificial Sequence
  chemically synthesized
ttactttctaggtacaatgg

SEQ ID NO: 247562 - DNA, 20 bp, Artificial Sequence
  chemically synthesized
gttactttctaggtacaatg

SEQ ID NO: 247563 - DNA, 20 bp, Artificial Sequence
  chemically synthesized
gctggtacctccattgtacc

SEQ ID NO: 247564 - DNA, 20 bp, Artificial Sequence
  chemically synthesized
tagttactttctaggtacaa

SEQ ID NO: 247565 - DNA, 20 bp, Artificial Sequence
  chemically synthesized
gtacctccattgtacctaga

SEQ ID NO: 247566 - DNA, 20 bp, Artificial Sequence
  chemically synthesized
aagcaagttagttactttct

SEQ ID NO: 247567 - DNA, 20 bp, Artificial Sequence
  chemically synthesized
aaagcaagttagttactttc

SEQ ID NO: 247568 - DNA, 20 bp, Artificial Sequence
  chemically synthesized
ccataaaatcaaaagcaagt

SEQ ID NO: 247569 - DNA, 20 bp, Artificial Sequence
  chemically synthesized
ggagccataaaatcaaaagc

SEQ ID NO: 247570 - DNA, 20 bp, Artificial Sequence
  chemically synthesized
cctaggagccataaaatcaa

SEQ ID NO: 247571 - DNA, 20 bp, Artificial Sequence
  chemically synthesized
ctaacttgcttttgatttta

SEQ ID NO: 247572 - DNA, 20 bp, Artificial Sequence
  chemically synthesized
gcttttgattttatggctcc

SEQ ID NO: 247573 - DNA, 20 bp, Artificial Sequence
  chemically synthesized
cttttgattttatggctcct

SEQ ID NO: 247574 - DNA, 20 bp, Artificial Sequence
  chemically synthesized
ttgattttatggctcctagg

SEQ ID NO: 247575 - DNA, 20 bp, Artificial Sequence
  chemically synthesized
ggcaagtcacttctgcctag

SEQ ID NO: 247576 - DNA, 20 bp, Artificial Sequence
  chemically synthesized
attttatggctcctaggcag

SEQ ID NO: 247577 - DNA, 20 bp, Artificial Sequence
  chemically synthesized
aaggcaagtcacttctgcct

SEQ ID NO: 247578 - DNA, 20 bp, Artificial Sequence
  chemically synthesized
caaggcaagtcacttctgcc

SEQ ID NO: 247579 - DNA, 20 bp, Artificial Sequence
  chemically synthesized
agtctcatctgagacaaggc

SEQ ID NO: 247580 - DNA, 20 bp, Artificial Sequence
  chemically synthesized
agaagtgacttgccttgtct

SEQ ID NO: 247581 - DNA, 20 bp, Artificial Sequence
  chemically synthesized
ccaaagtctcatctgagaca

SEQ ID NO: 247582 - DNA, 20 bp, Artificial Sequence
  chemically synthesized
tccaaagtctcatctgagac

SEQ ID NO: 247583 - DNA, 20 bp, Artificial Sequence
  chemically synthesized
tgacttgccttgtctcagat

SEQ ID NO: 247584 - DNA, 20 bp, Artificial Sequence
  chemically synthesized
ccaagtccaaagtctcatct

SEQ ID NO: 247585 - DNA, 20 bp, Artificial Sequence
  chemically synthesized
ccttgtctcagatgagactt

SEQ ID NO: 247586 - DNA, 20 bp, Artificial Sequence
  chemically synthesized
ctcagatgagactttggact

SEQ ID NO: 247587 - DNA, 20 bp, Artificial Sequence
  chemically synthesized
aacccaggagtccaagtcca

SEQ ID NO: 247588 - DNA, 20 bp, Artificial Sequence
  chemically synthesized
agactttggacttggactcc

SEQ ID NO: 247589 - DNA, 20 bp, Artificial Sequence
  chemically synthesized
tagcattaacccaggagtcc

SEQ ID NO: 247590 - DNA, 20 bp, Artificial Sequence
  chemically synthesized
gactttggacttggactcct

SEQ ID NO: 247591 - DNA, 20 bp, Artificial Sequence
  chemically synthesized
tcactctagcattaacccag

SEQ ID NO: 247592 - DNA, 20 bp, Artificial Sequence
  chemically synthesized
actcactctagcattaaccc

SEQ ID NO: 247593 - DNA, 20 bp, Artificial Sequence
  chemically synthesized
aactcactctagcattaacc

SEQ ID NO: 247594 - DNA, 20 bp, Artificial Sequence
  chemically synthesized
ttggactcctgggttaatgc

SEQ ID NO: 247595 - DNA, 20 bp, Artificial Sequence
  chemically synthesized
ggactcctgggttaatgcta

SEQ ID NO: 247596 - DNA, 20 bp, Artificial Sequence
  chemically synthesized
tcctgggttaatgctagagt

SEQ ID NO: 247597 - DNA, 20 bp, Artificial Sequence
  chemically synthesized
ctcaaagtcttaactcactc

SEQ ID NO: 247598 - DNA, 20 bp, Artificial Sequence
  chemically synthesized
ggttaatgctagagtgagtt

SEQ ID NO: 247599 - DNA, 20 bp, Artificial Sequence
  chemically synthesized
ctagagtgagttaagacttt

SEQ ID NO: 247600 - DNA, 20 bp, Artificial Sequence
  chemically synthesized
gccttcccaacagtcactca

SEQ ID NO: 247601 - DNA, 20 bp, Artificial Sequence
  chemically synthesized
ttaagactttgagtgactgt

SEQ ID NO: 247602 - DNA, 20 bp, Artificial Sequence
  chemically synthesized
taagactttgagtgactgtt

SEQ ID NO: 247603 - DNA, 20 bp, Artificial Sequence
  chemically synthesized
gactttgagtgactgttggg

SEQ ID NO: 247604 - DNA, 20 bp, Artificial Sequence
  chemically synthesized
actttgagtgactgttggga

SEQ ID NO: 247605 - DNA, 20 bp, Artificial Sequence
  chemically synthesized
acacaataatgccttcccaa

SEQ ID NO: 247606 - DNA, 20 bp, Artificial Sequence
  chemically synthesized
ttattgtgttttgaaatgtg

SEQ ID NO: 247607 - DNA, 20 bp, Artificial Sequence
  chemically synthesized
aaatgtgaagacgtgccatt

SEQ ID NO: 247608 - DNA, 20 bp, Artificial Sequence
  chemically synthesized
aatgtgaagacgtgccattt

SEQ ID NO: 247609 - DNA, 20 bp, Artificial Sequence
  chemically synthesized
tgtgaagacgtgccatttgg

SEQ ID NO: 247610 - DNA, 20 bp, Artificial Sequence
  chemically synthesized
gtgaagacgtgccatttggg

SEQ ID NO: 247611 - DNA, 20 bp, Artificial Sequence
  chemically synthesized
tgaagacgtgccatttggga

SEQ ID NO: 247612 - DNA, 20 bp, Artificial Sequence
  chemically synthesized
catccctggcccctcccaaa

SEQ ID NO: 247613 - DNA, 20 bp, Artificial Sequence
  chemically synthesized
gaagacgtgccatttgggag

SEQ ID NO: 247614 - DNA, 20 bp, Artificial Sequence
  chemically synthesized
acgtgccatttgggaggggc

SEQ ID NO: 247615 - DNA, 20 bp, Artificial Sequence
  chemically synthesized
cgtgccatttgggaggggcc

SEQ ID NO: 247616 - DNA, 20 bp, Artificial Sequence
  chemically synthesized
gtgccatttgggaggggcca

SEQ ID NO: 247617 - DNA, 20 bp, Artificial Sequence
  chemically synthesized
aaaccatatcatttcatccc

SEQ ID NO: 247618 - DNA, 20 bp, Artificial Sequence
  chemically synthesized
gggccagggatgaaatgata

SEQ ID NO: 247619 - DNA, 20 bp, Artificial Sequence
  chemically synthesized
agggatgaaatgatatggtt

SEQ ID NO: 247620 - DNA, 20 bp, Artificial Sequence
  chemically synthesized
atgagatttgggtggggaca

SEQ ID NO: 247621 - DNA, 20 bp, Artificial Sequence
  chemically synthesized
ttcagaatgagatttgggtg

SEQ ID NO: 247622 - DNA, 20 bp, Artificial Sequence
  chemically synthesized
attcagaatgagatttgggt

SEQ ID NO: 247623 - DNA, 20 bp, Artificial Sequence
  chemically synthesized
aattcagaatgagatttggg

SEQ ID NO: 247624 - DNA, 20 bp, Artificial Sequence
  chemically synthesized
tacaattcagaatgagattt

SEQ ID NO: 247625 - DNA, 20 bp, Artificial Sequence
  chemically synthesized
ctacaattcagaatgagatt

SEQ ID NO: 247626 - DNA, 20 bp, Artificial Sequence
  chemically synthesized
caggaactacaattcagaat

SEQ ID NO: 247627 - DNA, 20 bp, Artificial Sequence
  chemically synthesized
ccaaatctcattctgaattg

SEQ ID NO: 247628 - DNA, 20 bp, Artificial Sequence
  chemically synthesized
ggattacaggaactacaatt

SEQ ID NO: 247629 - DNA, 20 bp, Artificial Sequence
  chemically synthesized
acatgacacatggggattac

SEQ ID NO: 247630 - DNA, 20 bp, Artificial Sequence
  chemically synthesized
cacatgacacatggggatta

SEQ ID NO: 247631 - DNA, 20 bp, Artificial Sequence
  chemically synthesized
ggtccctcacatgacacatg

SEQ ID NO: 247632 - DNA, 20 bp, Artificial Sequence
  chemically synthesized
gggtccctcacatgacacat

SEQ ID NO: 247633 - DNA, 20 bp, Artificial Sequence
  chemically synthesized
tgggtccctcacatgacaca

SEQ ID NO: 247634 - DNA, 20 bp, Artificial Sequence
  chemically synthesized
gtaatccccatgtgtcatgt

SEQ ID NO: 247635 - DNA, 20 bp, Artificial Sequence
  chemically synthesized
taatccccatgtgtcatgtg

SEQ ID NO: 247636 - DNA, 20 bp, Artificial Sequence
  chemically synthesized
aatccccatgtgtcatgtga

SEQ ID NO: 247637 - DNA, 20 bp, Artificial Sequence
  chemically synthesized
catgtgtcatgtgagggacc

SEQ ID NO: 247638 - DNA, 20 bp, Artificial Sequence
  chemically synthesized
tgtcatgtgagggacccagt

SEQ ID NO: 247639 - DNA, 20 bp, Artificial Sequence
  chemically synthesized
tcatgtgagggacccagttg

SEQ ID NO: 247640 - DNA, 20 bp, Artificial Sequence
  chemically synthesized
catgtgagggacccagttgg

SEQ ID NO: 247641 - DNA, 20 bp, Artificial Sequence
  chemically synthesized
taattcaattacctccaact

SEQ ID NO: 247642 - DNA, 20 bp, Artificial Sequence
  chemically synthesized
gtaattcaattacctccaac

SEQ ID NO: 247643 - DNA, 20 bp, Artificial Sequence
  chemically synthesized
agttggaggtaattgaatta

SEQ ID NO: 247644 - DNA, 20 bp, Artificial Sequence
  chemically synthesized
gttggaggtaattgaattac

SEQ ID NO: 247645 - DNA, 20 bp, Artificial Sequence
  chemically synthesized
ttggaggtaattgaattaca

SEQ ID NO: 247646 - DNA, 20 bp, Artificial Sequence
  chemically synthesized
tggaggtaattgaattacag

SEQ ID NO: 247647 - DNA, 20 bp, Artificial Sequence
  chemically synthesized
aggtaattgaattacagggg

SEQ ID NO: 247648 - DNA, 20 bp, Artificial Sequence
  chemically synthesized
tacaggggcggttatcccca

SEQ ID NO: 247649 - DNA, 20 bp, Artificial Sequence
  chemically synthesized
atcacaagaacagcaccatg

SEQ ID NO: 247650 - DNA, 20 bp, Artificial Sequence
  chemically synthesized
tatcacaagaacagcaccat

SEQ ID NO: 247651 - DNA, 20 bp, Artificial Sequence
  chemically synthesized
ctatcacaagaacagcacca

SEQ ID NO: 247652 - DNA, 20 bp, Artificial Sequence
  chemically synthesized
agaactcactatcacaagaa

SEQ ID NO: 247653 - DNA, 20 bp, Artificial Sequence
  chemically synthesized
ccatggtgctgttcttgtga

SEQ ID NO: 247654 - DNA, 20 bp, Artificial Sequence
  chemically synthesized
tcatgagaactcactatcac

SEQ ID NO: 247655 - DNA, 20 bp, Artificial Sequence
  chemically synthesized
ggtgctgttcttgtgatagt

SEQ ID NO: 247656 - DNA, 20 bp, Artificial Sequence
  chemically synthesized
ttgtgatagtgagttctcat

SEQ ID NO: 247657 - DNA, 20 bp, Artificial Sequence
  chemically synthesized
ataaaaccattggatctcat

SEQ ID NO: 247658 - DNA, 20 bp, Artificial Sequence
  chemically synthesized
tgagttctcatgagatccaa

SEQ ID NO: 247659 - DNA, 20 bp, Artificial Sequence
  chemically synthesized
aaagccccttataaaaccat

SEQ ID NO: 247660 - DNA, 20 bp, Artificial Sequence
  chemically synthesized
atgagatccaatggttttat

SEQ ID NO: 247661 - DNA, 20 bp, Artificial Sequence
  chemically synthesized
tgagatccaatggttttata

SEQ ID NO: 247662 - DNA, 20 bp, Artificial Sequence
  chemically synthesized
gagatccaatggttttataa

SEQ ID NO: 247663 - DNA, 20 bp, Artificial Sequence
  chemically synthesized
agatccaatggttttataag

SEQ ID NO: 247664 - DNA, 20 bp, Artificial Sequence
  chemically synthesized
agtgctgagcaaagggggaa

SEQ ID NO: 247665 - DNA, 20 bp, Artificial Sequence
  chemically synthesized
ggagaagtgctgagcaaagg

SEQ ID NO: 247666 - DNA, 20 bp, Artificial Sequence
  chemically synthesized
ggggcttttccccctttgct

SEQ ID NO: 247667 - DNA, 20 bp, Artificial Sequence
  chemically synthesized
aggagaagtgctgagcaaag

SEQ ID NO: 247668 - DNA, 20 bp, Artificial Sequence
  chemically synthesized
aaggagaagtgctgagcaaa

SEQ ID NO: 247669 - DNA, 20 bp, Artificial Sequence
  chemically synthesized
aaaggagaagtgctgagcaa

SEQ ID NO: 247670 - DNA, 20 bp, Artificial Sequence
  chemically synthesized
gaaaggagaagtgctgagca

SEQ ID NO: 247671 - DNA, 20 bp, Artificial Sequence
  chemically synthesized
tggcagaaaggagaagtgct

SEQ ID NO: 247672 - DNA, 20 bp, Artificial Sequence
  chemically synthesized
catatggtggcagaaaggag

SEQ ID NO: 247673 - DNA, 20 bp, Artificial Sequence
  chemically synthesized
cttcatatggtggcagaaag

SEQ ID NO: 247674 - DNA, 20 bp, Artificial Sequence
  chemically synthesized
ttcttcatatggtggcagaa

SEQ ID NO: 247675 - DNA, 20 bp, Artificial Sequence
  chemically synthesized
cttcttcatatggtggcaga

SEQ ID NO: 247676 - DNA, 20 bp, Artificial Sequence
  chemically synthesized
catccttcttcatatggtgg

SEQ ID NO: 247677 - DNA, 20 bp, Artificial Sequence
  chemically synthesized
ctcctttctgccaccatatg

SEQ ID NO: 247678 - DNA, 20 bp, Artificial Sequence
  chemically synthesized
tcacatccttcttcatatgg

SEQ ID NO: 247679 - DNA, 20 bp, Artificial Sequence
  chemically synthesized
ctttctgccaccatatgaag

SEQ ID NO: 247680 - DNA, 20 bp, Artificial Sequence
  chemically synthesized
caatcacatccttcttcata

SEQ ID NO: 247681 - DNA, 20 bp, Artificial Sequence
  chemically synthesized
tttctgccaccatatgaaga

SEQ ID NO: 247682 - DNA, 20 bp, Artificial Sequence
  chemically synthesized
gatgtgattgcttccccttc

SEQ ID NO: 247683 - DNA, 20 bp, Artificial Sequence
  chemically synthesized
tacaaccatgccagaagggg

SEQ ID NO: 247684 - DNA, 20 bp, Artificial Sequence
  chemically synthesized
acttacaaccatgccagaag

SEQ ID NO: 247685 - DNA, 20 bp, Artificial Sequence
  chemically synthesized
aacttacaaccatgccagaa

SEQ ID NO: 247686 - DNA, 20 bp, Artificial Sequence
  chemically synthesized
gattgcttccccttctggca

SEQ ID NO: 247687 - DNA, 20 bp, Artificial Sequence
  chemically synthesized
aaacttacaaccatgccaga

SEQ ID NO: 247688 - DNA, 20 bp, Artificial Sequence
  chemically synthesized
aaaacttacaaccatgccag

SEQ ID NO: 247689 - DNA, 20 bp, Artificial Sequence
  chemically synthesized
gggaaaacttacaaccatgc

SEQ ID NO: 247690 - DNA, 20 bp, Artificial Sequence
  chemically synthesized
tccccttctggcatggttgt

SEQ ID NO: 247691 - DNA, 20 bp, Artificial Sequence
  chemically synthesized
catggttgtaagttttccct

SEQ ID NO: 247692 - DNA, 20 bp, Artificial Sequence
  chemically synthesized
atggttgtaagttttccctg

SEQ ID NO: 247693 - DNA, 20 bp, Artificial Sequence
  chemically synthesized
acatggctggggaggcctca

SEQ ID NO: 247694 - DNA, 20 bp, Artificial Sequence
  chemically synthesized
cacatggctggggaggcctc

SEQ ID NO: 247695 - DNA, 20 bp, Artificial Sequence
  chemically synthesized
ccacatggctggggaggcct

SEQ ID NO: 247696 - DNA, 20 bp, Artificial Sequence
  chemically synthesized
agttttccctgaggcctccc

SEQ ID NO: 247697 - DNA, 20 bp, Artificial Sequence
  chemically synthesized
acagttccacatggctgggg

SEQ ID NO: 247698 - DNA, 20 bp, Artificial Sequence
  chemically synthesized
cacagttccacatggctggg

SEQ ID NO: 247699 - DNA, 20 bp, Artificial Sequence
  chemically synthesized
ctcacagttccacatggctg

SEQ ID NO: 247700 - DNA, 20 bp, Artificial Sequence
  chemically synthesized
ctgaggcctccccagccatg

SEQ ID NO: 247701 - DNA, 20 bp, Artificial Sequence
  chemically synthesized
actcacagttccacatggct

SEQ ID NO: 247702 - DNA, 20 bp, Artificial Sequence
  chemically synthesized
gactcacagttccacatggc

SEQ ID NO: 247703 - DNA, 20 bp, Artificial Sequence
  chemically synthesized
aattgactcacagttccaca

SEQ ID NO: 247704 - DNA, 20 bp, Artificial Sequence
  chemically synthesized
ccccagccatgtggaactgt

SEQ ID NO: 247705 - DNA, 20 bp, Artificial Sequence
  chemically synthesized
acagaggtttaattgactca

SEQ ID NO: 247706 - DNA, 20 bp, Artificial Sequence
  chemically synthesized
gaataatttataaaggacag

SEQ ID NO: 247707 - DNA, 20 bp, Artificial Sequence
  chemically synthesized
tgaataatttataaaggaca

SEQ ID NO: 247708 - DNA, 20 bp, Artificial Sequence
  chemically synthesized
actgaataatttataaagga

SEQ ID NO: 247709 - DNA, 20 bp, Artificial Sequence
  chemically synthesized
caagactgaataatttataa

SEQ ID NO: 247710 - DNA, 20 bp, Artificial Sequence
  chemically synthesized
ccaagactgaataatttata

SEQ ID NO: 247711 - DNA, 20 bp, Artificial Sequence
  chemically synthesized
tctgtcctttataaattatt

SEQ ID NO: 247712 - DNA, 20 bp, Artificial Sequence
  chemically synthesized
ctttataaattattcagtct

SEQ ID NO: 247713 - DNA, 20 bp, Artificial Sequence
  chemically synthesized
tttataaattattcagtctt

SEQ ID NO: 247714 - DNA, 20 bp, Artificial Sequence
  chemically synthesized
ataaattattcagtcttggg

SEQ ID NO: 247715 - DNA, 20 bp, Artificial Sequence
  chemically synthesized
gctgctctaaagaactgccc

SEQ ID NO: 247716 - DNA, 20 bp, Artificial Sequence
  chemically synthesized
ttcagtcttgggcagttctt

SEQ ID NO: 247717 - DNA, 20 bp, Artificial Sequence
  chemically synthesized
cagtcttgggcagttcttta

SEQ ID NO: 247718 - DNA, 20 bp, Artificial Sequence
  chemically synthesized
tcttgggcagttctttagag

SEQ ID NO: 247719 - DNA, 20 bp, Artificial Sequence
  chemically synthesized
tctgttctcatgctgctcta

SEQ ID NO: 247720 - DNA, 20 bp, Artificial Sequence
  chemically synthesized
gcagttctttagagcagcat

SEQ ID NO: 247721 - DNA, 20 bp, Artificial Sequence
  chemically synthesized
tctttagagcagcatgagaa

SEQ ID NO: 247722 - DNA, 20 bp, Artificial Sequence
  chemically synthesized
agcatgagaacagactaata

SEQ ID NO: 247723 - DNA, 20 bp, Artificial Sequence
  chemically synthesized
attgatcatacagtctgtat

SEQ ID NO: 247724 - DNA, 20 bp, Artificial Sequence
  chemically synthesized
agtaaaatatattgatcata

SEQ ID NO: 247725 - DNA, 20 bp, Artificial Sequence
  chemically synthesized
atcaatatattttactttct

SEQ ID NO: 247726 - DNA, 20 bp, Artificial Sequence
  chemically synthesized
cattaataagtaaactcaga

SEQ ID NO: 247727 - DNA, 20 bp, Artificial Sequence
  chemically synthesized
ttagcattaataagtaaact

SEQ ID NO: 247728 - DNA, 20 bp, Artificial Sequence
  chemically synthesized
aaatacagtttagcattaat

SEQ ID NO: 247729 - DNA, 20 bp, Artificial Sequence
  chemically synthesized
aaaaaggtaaaaatacagtt

SEQ ID NO: 247730 - DNA, 20 bp, Artificial Sequence
  chemically synthesized
aaagtaaaaaggtaaaaata

SEQ ID NO: 247731 - DNA, 20 bp, Artificial Sequence
  chemically synthesized
aatggcgttcaaaagtaaaa

SEQ ID NO: 247732 - DNA, 20 bp, Artificial Sequence
  chemically synthesized
caatggcgttcaaaagtaaa

SEQ ID NO: 247733 - DNA, 20 bp, Artificial Sequence
  chemically synthesized
aatatgacaatggcgttcaa

SEQ ID NO: 247734 - DNA, 20 bp, Artificial Sequence
  chemically synthesized
ttctcttattaatatgacaa

SEQ ID NO: 247735 - DNA, 20 bp, Artificial Sequence
  chemically synthesized
aacgccattgtcatattaat

SEQ ID NO: 247736 - DNA, 20 bp, Artificial Sequence
  chemically synthesized
cgccattgtcatattaataa

SEQ ID NO: 247737 - DNA, 20 bp, Artificial Sequence
  chemically synthesized
taagagaatttttttgacca

SEQ ID NO: 247738 - DNA, 20 bp, Artificial Sequence
  chemically synthesized
gtacagaacttaaaatgctt

SEQ ID NO: 247739 - DNA, 20 bp, Artificial Sequence
  chemically synthesized
ttttttgaccaaagcatttt

SEQ ID NO: 247740 - DNA, 20 bp, Artificial Sequence
  chemically synthesized
gatcaaatactgcaagtgta

SEQ ID NO: 247741 - DNA, 20 bp, Artificial Sequence
  chemically synthesized
ttttaagttctgtacacttg

SEQ ID NO: 247742 - DNA, 20 bp, Artificial Sequence
  chemically synthesized
atctgtagatcaaatactgc

SEQ ID NO: 247743 - DNA, 20 bp, Artificial Sequence
  chemically synthesized
cacttgcagtatttgatcta

SEQ ID NO: 247744 - DNA, 20 bp, Artificial Sequence
  chemically synthesized
gtccatgatgtgtaaatctg

SEQ ID NO: 247745 - DNA, 20 bp, Artificial Sequence
  chemically synthesized
atctacagatttacacatca

SEQ ID NO: 247746 - DNA, 20 bp, Artificial Sequence
  chemically synthesized
acagatttacacatcatgga

SEQ ID NO: 247747 - DNA, 20 bp, Artificial Sequence
  chemically synthesized
aatgttatgaaaatcattta

SEQ ID NO: 247748 - DNA, 20 bp, Artificial Sequence
  chemically synthesized
tcatttacagaattatttaa

SEQ ID NO: 247749 - DNA, 20 bp, Artificial Sequence
  chemically synthesized
ttttcatatgttgtacatgt

SEQ ID NO: 247750 - DNA, 20 bp, Artificial Sequence
  chemically synthesized
atgtaagaaatctgatttta

SEQ ID NO: 247751 - DNA, 20 bp, Artificial Sequence
  chemically synthesized
cttatcaatggccataaaat

SEQ ID NO: 247752 - DNA, 20 bp, Artificial Sequence
  chemically synthesized
ctgattttatggccattgat

SEQ ID NO: 247753 - DNA, 20 bp, Artificial Sequence
  chemically synthesized
gattttatggccattgataa

SEQ ID NO: 247754 - DNA, 20 bp, Artificial Sequence
  chemically synthesized
gccattatcgctcttatcaa

SEQ ID NO: 247755 - DNA, 20 bp, Artificial Sequence
  chemically synthesized
gccattgataagagcgataa

SEQ ID NO: 247756 - DNA, 20 bp, Artificial Sequence
  chemically synthesized
attgataagagcgataatgg

SEQ ID NO: 247757 - DNA, 20 bp, Artificial Sequence
  chemically synthesized
gataatggcagccttcatat

SEQ ID NO: 247758 - DNA, 20 bp, Artificial Sequence
  chemically synthesized
cagaaatgtatcttatatga

SEQ ID NO: 247759 - DNA, 20 bp, Artificial Sequence
  chemically synthesized
acagaaatgtatcttatatg

SEQ ID NO: 247760 - DNA, 20 bp, Artificial Sequence
  chemically synthesized
tataatcaaaaataaaaaga

SEQ ID NO: 247761 - DNA, 20 bp, Artificial Sequence
  chemically synthesized
caggtataatcaaaaataaa

SEQ ID NO: 247762 - DNA, 20 bp, Artificial Sequence
  chemically synthesized
ttatttttgattatacctgc

SEQ ID NO: 247763 - DNA, 20 bp, Artificial Sequence
  chemically synthesized
tttttgattatacctgcaag

SEQ ID NO: 247764 - DNA, 20 bp, Artificial Sequence
  chemically synthesized
aggaccatgtgtcttcttgc

SEQ ID NO: 247765 - DNA, 20 bp, Artificial Sequence
  chemically synthesized
taggaccatgtgtcttcttg

SEQ ID NO: 247766 - DNA, 20 bp, Artificial Sequence
  chemically synthesized
tatacctgcaagaagacaca

SEQ ID NO: 247767 - DNA, 20 bp, Artificial Sequence
  chemically synthesized
agaagacacatggtcctatg

SEQ ID NO: 247768 - DNA, 20 bp, Artificial Sequence
  chemically synthesized
caactatttattggctgcat

SEQ ID NO: 247769 - DNA, 20 bp, Artificial Sequence
  chemically synthesized
acaactatttattggctgca

SEQ ID NO: 247770 - DNA, 20 bp, Artificial Sequence
  chemically synthesized
ggtcctatgcagccaataaa

SEQ ID NO: 247771 - DNA, 20 bp, Artificial Sequence
  chemically synthesized
attattatacaactatttat

SEQ ID NO: 247772 - DNA, 20 bp, Artificial Sequence
  chemically synthesized
taaatagttgtataataata

SEQ ID NO: 247773 - DNA, 20 bp, Artificial Sequence
  chemically synthesized
tggtgtatgtaaaacatgaa

SEQ ID NO: 247774 - DNA, 20 bp, Artificial Sequence
  chemically synthesized
gtggtgtatgtaaaacatga

SEQ ID NO: 247775 - DNA, 20 bp, Artificial Sequence
  chemically synthesized
catagttcctttgcatttgg

SEQ ID NO: 247776 - DNA, 20 bp, Artificial Sequence
  chemically synthesized
tacatacaccaccaaatgca

SEQ ID NO: 247777 - DNA, 20 bp, Artificial Sequence
  chemically synthesized
acatacaccaccaaatgcaa

SEQ ID NO: 247778 - DNA, 20 bp, Artificial Sequence
  chemically synthesized
cttcatagttcctttgcatt

SEQ ID NO: 247779 - DNA, 20 bp, Artificial Sequence
  chemically synthesized
ccaaatgcaaaggaactatg

SEQ ID NO: 247780 - DNA, 20 bp, Artificial Sequence
  chemically synthesized
aatgcaaaggaactatgaag

SEQ ID NO: 247781 - DNA, 20 bp, Artificial Sequence
  chemically synthesized
tctcagtgcaaactgcttca

SEQ ID NO: 247782 - DNA, 20 bp, Artificial Sequence
  chemically synthesized
actatgaagcagtttgcact

SEQ ID NO: 247783 - DNA, 20 bp, Artificial Sequence
  chemically synthesized
gaagcagtttgcactgagac

SEQ ID NO: 247784 - DNA, 20 bp, Artificial Sequence
  chemically synthesized
atttaggttttaactggtct

SEQ ID NO: 247785 - DNA, 20 bp, Artificial Sequence
  chemically synthesized
gggagaatttaggttttaac

SEQ ID NO: 247786 - DNA, 20 bp, Artificial Sequence
  chemically synthesized
atagctaaaggggagaattt

SEQ ID NO: 247787 - DNA, 20 bp, Artificial Sequence
  chemically synthesized
catagctaaaggggagaatt

SEQ ID NO: 247788 - DNA, 20 bp, Artificial Sequence
  chemically synthesized
aaaacctaaattctcccctt

SEQ ID NO: 247789 - DNA, 20 bp, Artificial Sequence
  chemically synthesized
atcaccgcatagctaaaggg

SEQ ID NO: 247790 - DNA, 20 bp, Artificial Sequence
  chemically synthesized
agatcaccgcatagctaaag

SEQ ID NO: 247791 - DNA, 20 bp, Artificial Sequence
  chemically synthesized
tagatcaccgcatagctaaa

SEQ ID NO: 247792 - DNA, 20 bp, Artificial Sequence
  chemically synthesized
atagatcaccgcatagctaa

SEQ ID NO: 247793 - DNA, 20 bp, Artificial Sequence
  chemically synthesized
aatagatcaccgcatagcta

SEQ ID NO: 247794 - DNA, 20 bp, Artificial Sequence
  chemically synthesized
aattctcccctttagctatg

SEQ ID NO: 247795 - DNA, 20 bp, Artificial Sequence
  chemically synthesized
gcaggaaatagatcaccgca

SEQ ID NO: 247796 - DNA, 20 bp, Artificial Sequence
  chemically synthesized
attttgtatgtagcaggaaa

SEQ ID NO: 247797 - DNA, 20 bp, Artificial Sequence
  chemically synthesized
ttcaggattttgtatgtagc

SEQ ID NO: 247798 - DNA, 20 bp, Artificial Sequence
  chemically synthesized
tttcaggattttgtatgtag

SEQ ID NO: 247799 - DNA, 20 bp, Artificial Sequence
  chemically synthesized
ttttttcaggattttgtatg

SEQ ID NO: 247800 - DNA, 20 bp, Artificial Sequence
  chemically synthesized
catacaaaatcctgaaaaaa

SEQ ID NO: 247801 - DNA, 20 bp, Artificial Sequence
  chemically synthesized
acttccagccccattttttc

SEQ ID NO: 247802 - DNA, 20 bp, Artificial Sequence
  chemically synthesized
atacaaaatcctgaaaaaat

SEQ ID NO: 247803 - DNA, 20 bp, Artificial Sequence
  chemically synthesized
tacttccagccccatttttt

SEQ ID NO: 247804 - DNA, 20 bp, Artificial Sequence
  chemically synthesized
tacaaaatcctgaaaaaatg

SEQ ID NO: 247805 - DNA, 20 bp, Artificial Sequence
  chemically synthesized
aaatcctgaaaaaatggggc

SEQ ID NO: 247806 - DNA, 20 bp, Artificial Sequence
  chemically synthesized
tcctgaaaaaatggggctgg

SEQ ID NO: 247807 - DNA, 20 bp, Artificial Sequence
  chemically synthesized
aaaagcactggaattacttc

SEQ ID NO: 247808 - DNA, 20 bp, Artificial Sequence
  chemically synthesized
aatggggctggaagtaattc

SEQ ID NO: 247809 - DNA, 20 bp, Artificial Sequence
  chemically synthesized
tagattgggtttaaaagcac

SEQ ID NO: 247810 - DNA, 20 bp, Artificial Sequence
  chemically synthesized
aaattgtagattgggtttaa

SEQ ID NO: 247811 - DNA, 20 bp, Artificial Sequence
  chemically synthesized
aggaaattaaattgtagatt

SEQ ID NO: 247812 - DNA, 20 bp, Artificial Sequence
  chemically synthesized
aaggaaattaaattgtagat

SEQ ID NO: 247813 - DNA, 20 bp, Artificial Sequence
  chemically synthesized
tcacaaaggaaattaaattg

SEQ ID NO: 247814 - DNA, 20 bp, Artificial Sequence
  chemically synthesized
tgatgtttcaaaggtcacaa

SEQ ID NO: 247815 - DNA, 20 bp, Artificial Sequence
  chemically synthesized
gtgatgtttcaaaggtcaca

SEQ ID NO: 247816 - DNA, 20 bp, Artificial Sequence
  chemically synthesized
ctataacagtgatgtttcaa

SEQ ID NO: 247817 - DNA, 20 bp, Artificial Sequence
  chemically synthesized
tctataacagtgatgtttca

SEQ ID NO: 247818 - DNA, 20 bp, Artificial Sequence
  chemically synthesized
cctttgaaacatcactgtta

SEQ ID NO: 247819 - DNA, 20 bp, Artificial Sequence
  chemically synthesized
ttgaaacatcactgttatag

SEQ ID NO: 247820 - DNA, 20 bp, Artificial Sequence
  chemically synthesized
gaatggtggaacttctataa

SEQ ID NO: 247821 - DNA, 20 bp, Artificial Sequence
  chemically synthesized
atctggggcattaggaatgg

SEQ ID NO: 247822 - DNA, 20 bp, Artificial Sequence
  chemically synthesized
caaatctggggcattaggaa

SEQ ID NO: 247823 - DNA, 20 bp, Artificial Sequence
  chemically synthesized
ttccaccattcctaatgccc

SEQ ID NO: 247824 - DNA, 20 bp, Artificial Sequence
  chemically synthesized
agtggcaaatctggggcatt

SEQ ID NO: 247825 - DNA, 20 bp, Artificial Sequence
  chemically synthesized
cagtggcaaatctggggcat

SEQ ID NO: 247826 - DNA, 20 bp, Artificial Sequence
  chemically synthesized
aaacaacagtggcaaatctg

SEQ ID NO: 247827 - DNA, 20 bp, Artificial Sequence
  chemically synthesized
gaaacaacagtggcaaatct

SEQ ID NO: 247828 - DNA, 20 bp, Artificial Sequence
  chemically synthesized
ggaaacaacagtggcaaatc

SEQ ID NO: 247829 - DNA, 20 bp, Artificial Sequence
  chemically synthesized
tcttaataaggaaacaacag

SEQ ID NO: 247830 - DNA, 20 bp, Artificial Sequence
  chemically synthesized
gcttcttaataaggaaacaa

SEQ ID NO: 247831 - DNA, 20 bp, Artificial Sequence
  chemically synthesized
gccactgttgtttccttatt

SEQ ID NO: 247832 - DNA, 20 bp, Artificial Sequence
  chemically synthesized
actgttgtttccttattaag

SEQ ID NO: 247833 - DNA, 20 bp, Artificial Sequence
  chemically synthesized
ctttgttttgcttcttaata

SEQ ID NO: 247834 - DNA, 20 bp, Artificial Sequence
  chemically synthesized
actttgttttgcttcttaat

SEQ ID NO: 247835 - DNA, 20 bp, Artificial Sequence
  chemically synthesized
ccttattaagaagcaaaaca

SEQ ID NO: 247836 - DNA, 20 bp, Artificial Sequence
  chemically synthesized
gagaactcaaaattatgtga

SEQ ID NO: 247837 - DNA, 20 bp, Artificial Sequence
  chemically synthesized
agagaactcaaaattatgtg

SEQ ID NO: 247838 - DNA, 20 bp, Artificial Sequence
  chemically synthesized
aaaaaccttcacataatttt

SEQ ID NO: 247839 - DNA, 20 bp, Artificial Sequence
  chemically synthesized
cttcccttactgagaagaaa

SEQ ID NO: 247840 - DNA, 20 bp, Artificial Sequence
  chemically synthesized
ttttgagttctctttcttct

SEQ ID NO: 247841 - DNA, 20 bp, Artificial Sequence
  chemically synthesized
tccttcccttactgagaaga

SEQ ID NO: 247842 - DNA, 20 bp, Artificial Sequence
  chemically synthesized
gagttctctttcttctcagt

SEQ ID NO: 247843 - DNA, 20 bp, Artificial Sequence
  chemically synthesized
agttctctttcttctcagta

SEQ ID NO: 247844 - DNA, 20 bp, Artificial Sequence
  chemically synthesized
aaaatccttcccttactgag

SEQ ID NO: 247845 - DNA, 20 bp, Artificial Sequence
  chemically synthesized
gttctctttcttctcagtaa

SEQ ID NO: 247846 - DNA, 20 bp, Artificial Sequence
  chemically synthesized
gtgaaaatccttcccttact

SEQ ID NO: 247847 - DNA, 20 bp, Artificial Sequence
  chemically synthesized
ctctttcttctcagtaaggg

SEQ ID NO: 247848 - DNA, 20 bp, Artificial Sequence
  chemically synthesized
tctttcttctcagtaaggga

SEQ ID NO: 247849 - DNA, 20 bp, Artificial Sequence
  chemically synthesized
aaaatgagataagtgaagtt

SEQ ID NO: 247850 - DNA, 20 bp, Artificial Sequence
  chemically synthesized
acagaaaaatgagataagtg

SEQ ID NO: 247851 - DNA, 20 bp, Artificial Sequence
  chemically synthesized
agaacacagaaaaatgagat

SEQ ID NO: 247852 - DNA, 20 bp, Artificial Sequence
  chemically synthesized
gttgaagaacacagaaaaat

SEQ ID NO: 247853 - DNA, 20 bp, Artificial Sequence
  chemically synthesized
tagtttaaggttgaagaaca

SEQ ID NO: 247854 - DNA, 20 bp, Artificial Sequence
  chemically synthesized
ctggatgtagtttaaggttg

SEQ ID NO: 247855 - DNA, 20 bp, Artificial Sequence
  chemically synthesized
acaaggctggatgtagttta

SEQ ID NO: 247856 - DNA, 20 bp, Artificial Sequence
  chemically synthesized
aacaaggctggatgtagttt

SEQ ID NO: 247857 - DNA, 20 bp, Artificial Sequence
  chemically synthesized
cttcaaccttaaactacatc

SEQ ID NO: 247858 - DNA, 20 bp, Artificial Sequence
  chemically synthesized
gacatgaacaaggctggatg

SEQ ID NO: 247859 - DNA, 20 bp, Artificial Sequence
  chemically synthesized
aagagagacatgaacaaggc

SEQ ID NO: 247860 - DNA, 20 bp, Artificial Sequence
  chemically synthesized
gtttaagagagacatgaaca

SEQ ID NO: 247861 - DNA, 20 bp, Artificial Sequence
  chemically synthesized
agtttaagagagacatgaac

SEQ ID NO: 247862 - DNA, 20 bp, Artificial Sequence
  chemically synthesized
ataaagaagaaagtttaaga

SEQ ID NO: 247863 - DNA, 20 bp, Artificial Sequence
  chemically synthesized
gtataaagaagaaagtttaa

SEQ ID NO: 247864 - DNA, 20 bp, Artificial Sequence
  chemically synthesized
atgtataaagaagaaagttt

SEQ ID NO: 247865 - DNA, 20 bp, Artificial Sequence
  chemically synthesized
tttgaaatgtataaagaaga

SEQ ID NO: 247866 - DNA, 20 bp, Artificial Sequence
  chemically synthesized
agcttttgaaatgtataaag

SEQ ID NO: 247867 - DNA, 20 bp, Artificial Sequence
  chemically synthesized
caaagcttttgaaatgtata

SEQ ID NO: 247868 - DNA, 20 bp, Artificial Sequence
  chemically synthesized
ttcttctttatacatttcaa

SEQ ID NO: 247869 - DNA, 20 bp, Artificial Sequence
  chemically synthesized
tagatgacagaaaaagagca

SEQ ID NO: 247870 - DNA, 20 bp, Artificial Sequence
  chemically synthesized
ccaattagatgacagaaaaa

SEQ ID NO: 247871 - DNA, 20 bp, Artificial Sequence
  chemically synthesized
gcccaattagatgacagaaa

SEQ ID NO: 247872 - DNA, 20 bp, Artificial Sequence
  chemically synthesized
gatctagcccaattagatga

SEQ ID NO: 247873 - DNA, 20 bp, Artificial Sequence
  chemically synthesized
ctctttttctgtcatctaat

SEQ ID NO: 247874 - DNA, 20 bp, Artificial Sequence
  chemically synthesized
tctttttctgtcatctaatt

SEQ ID NO: 247875 - DNA, 20 bp, Artificial Sequence
  chemically synthesized
tttctgtcatctaattgggc

SEQ ID NO: 247876 - DNA, 20 bp, Artificial Sequence
  chemically synthesized
gaatagagatctagcccaat

SEQ ID NO: 247877 - DNA, 20 bp, Artificial Sequence
  chemically synthesized
gagtaatatgaatagagatc

SEQ ID NO: 247878 - DNA, 20 bp, Artificial Sequence
  chemically synthesized
cataaagagtaatatgaata

SEQ ID NO: 247879 - DNA, 20 bp, Artificial Sequence
  chemically synthesized
aacataaagagtaatatgaa

SEQ ID NO: 247880 - DNA, 20 bp, Artificial Sequence
  chemically synthesized
ttaataggttgtaacataaa

SEQ ID NO: 247881 - DNA, 20 bp, Artificial Sequence
  chemically synthesized
ggttaataggttgtaacata

SEQ ID NO: 247882 - DNA, 20 bp, Artificial Sequence
  chemically synthesized
atgaaaatattttggttaat

SEQ ID NO: 247883 - DNA, 20 bp, Artificial Sequence
  chemically synthesized
catgaaaatattttggttaa

SEQ ID NO: 247884 - DNA, 20 bp, Artificial Sequence
  chemically synthesized
tttgccacatgaaaatattt

SEQ ID NO: 247885 - DNA, 20 bp, Artificial Sequence
  chemically synthesized
ttaaccaaaatattttcatg

SEQ ID NO: 247886 - DNA, 20 bp, Artificial Sequence
  chemically synthesized
caaaatattttcatgtggca

SEQ ID NO: 247887 - DNA, 20 bp, Artificial Sequence
  chemically synthesized
tggcaaagaattctgatcat

SEQ ID NO: 247888 - DNA, 20 bp, Artificial Sequence
  chemically synthesized
ggcaaagaattctgatcatg

SEQ ID NO: 247889 - DNA, 20 bp, Artificial Sequence
  chemically synthesized
agttcattttgcctcatgat

SEQ ID NO: 247890 - DNA, 20 bp, Artificial Sequence
  chemically synthesized
atgaggcaaaatgaactaat

SEQ ID NO: 247891 - DNA, 20 bp, Artificial Sequence
  chemically synthesized
tgaagacaaatttttctcat

SEQ ID NO: 247892 - DNA, 20 bp, Artificial Sequence
  chemically synthesized
gaaaaatttgtcttcatttc

SEQ ID NO: 247893 - DNA, 20 bp, Artificial Sequence
  chemically synthesized
attagttttcactagaaatg

SEQ ID NO: 247894 - DNA, 20 bp, Artificial Sequence
  chemically synthesized
aagaataaattagttttcac

SEQ ID NO: 247895 - DNA, 20 bp, Artificial Sequence
  chemically synthesized
tagagaaagcaagaataaat

SEQ ID NO: 247896 - DNA, 20 bp, Artificial Sequence
  chemically synthesized
gaaatatccctagagaaagc

SEQ ID NO: 247897 - DNA, 20 bp, Artificial Sequence
  chemically synthesized
taatttattcttgctttctc

SEQ ID NO: 247898 - DNA, 20 bp, Artificial Sequence
  chemically synthesized
aatttattcttgctttctct

SEQ ID NO: 247899 - DNA, 20 bp, Artificial Sequence
  chemically synthesized
atttattcttgctttctcta

SEQ ID NO: 247900 - DNA, 20 bp, Artificial Sequence
  chemically synthesized
tcttgaaatatccctagaga

SEQ ID NO: 247901 - DNA, 20 bp, Artificial Sequence
  chemically synthesized
caattcttgaaatatcccta

SEQ ID NO: 247902 - DNA, 20 bp, Artificial Sequence
  chemically synthesized
tacaattcttgaaatatccc

SEQ ID NO: 247903 - DNA, 20 bp, Artificial Sequence
  chemically synthesized
gctttctctagggatatttc

SEQ ID NO: 247904 - DNA, 20 bp, Artificial Sequence
  chemically synthesized
tatttcaagaattgtacttt

SEQ ID NO: 247905 - DNA, 20 bp, Artificial Sequence
  chemically synthesized
tcaaagtcctaaaagaccaa

SEQ ID NO: 247906 - DNA, 20 bp, Artificial Sequence
  chemically synthesized
gaattgtacttttggtcttt

SEQ ID NO: 247907 - DNA, 20 bp, Artificial Sequence
  chemically synthesized
aattgtacttttggtctttt

SEQ ID NO: 247908 - DNA, 20 bp, Artificial Sequence
  chemically synthesized
caacattttcaaagtcctaa

SEQ ID NO: 247909 - DNA, 20 bp, Artificial Sequence
  chemically synthesized
taccaattccaacattttca

SEQ ID NO: 247910 - DNA, 20 bp, Artificial Sequence
  chemically synthesized
ttttaggactttgaaaatgt

SEQ ID NO: 247911 - DNA, 20 bp, Artificial Sequence
  chemically synthesized
gactttgaaaatgttggaat

SEQ ID NO: 247912 - DNA, 20 bp, Artificial Sequence
  chemically synthesized
tttgaaaatgttggaattgg

SEQ ID NO: 247913 - DNA, 20 bp, Artificial Sequence
  chemically synthesized
actttatgcacagttttggt

SEQ ID NO: 247914 - DNA, 20 bp, Artificial Sequence
  chemically synthesized
gctgactttatgcacagttt

SEQ ID NO: 247915 - DNA, 20 bp, Artificial Sequence
  chemically synthesized
tctaaccaaaactgtgcata

SEQ ID NO: 247916 - DNA, 20 bp, Artificial Sequence
  chemically synthesized
gaagcagctgactttatgca

SEQ ID NO: 247917 - DNA, 20 bp, Artificial Sequence
  chemically synthesized
accaaaactgtgcataaagt

SEQ ID NO: 247918 - DNA, 20 bp, Artificial Sequence
  chemically synthesized
gcataaagtcagctgcttca

SEQ ID NO: 247919 - DNA, 20 bp, Artificial Sequence
  chemically synthesized
ttctatgacttgctttgaag

SEQ ID NO: 247920 - DNA, 20 bp, Artificial Sequence
  chemically synthesized
aaagtcagctgcttcaaagc

SEQ ID NO: 247921 - DNA, 20 bp, Artificial Sequence
  chemically synthesized
ggcttctatgacttgctttg

SEQ ID NO: 247922 - DNA, 20 bp, Artificial Sequence
  chemically synthesized
agctgcttcaaagcaagtca

SEQ ID NO: 247923 - DNA, 20 bp, Artificial Sequence
  chemically synthesized
tgcttcaaagcaagtcatag

SEQ ID NO: 247924 - DNA, 20 bp, Artificial Sequence
  chemically synthesized
aagcaagtcatagaagcctc

SEQ ID NO: 247925 - DNA, 20 bp, Artificial Sequence
  chemically synthesized
tttggtcacagaattgctgg

SEQ ID NO: 247926 - DNA, 20 bp, Artificial Sequence
  chemically synthesized
ctttggtcacagaattgctg

SEQ ID NO: 247927 - DNA, 20 bp, Artificial Sequence
  chemically synthesized
ttctttggtcacagaattgc

SEQ ID NO: 247928 - DNA, 20 bp, Artificial Sequence
  chemically synthesized
ctccagcaattctgtgacca

SEQ ID NO: 247929 - DNA, 20 bp, Artificial Sequence
  chemically synthesized
gggttacttttctttggtca

SEQ ID NO: 247930 - DNA, 20 bp, Artificial Sequence
  chemically synthesized
gcaattctgtgaccaaagaa

SEQ ID NO: 247931 - DNA, 20 bp, Artificial Sequence
  chemically synthesized
atattagggttacttttctt

SEQ ID NO: 247932 - DNA, 20 bp, Artificial Sequence
  chemically synthesized
caaaggaaaggttaatatta

SEQ ID NO: 247933 - DNA, 20 bp, Artificial Sequence
  chemically synthesized
tcaaaggaaaggttaatatt

SEQ ID NO: 247934 - DNA, 20 bp, Artificial Sequence
  chemically synthesized
gtcaaaggaaaggttaatat

SEQ ID NO: 247935 - DNA, 20 bp, Artificial Sequence
  chemically synthesized
tgtctttaaagtcaaaggaa

SEQ ID NO: 247936 - DNA, 20 bp, Artificial Sequence
  chemically synthesized
ttgtctttaaagtcaaagga

SEQ ID NO: 247937 - DNA, 20 bp, Artificial Sequence
  chemically synthesized
attattgtctttaaagtcaa

SEQ ID NO: 247938 - DNA, 20 bp, Artificial Sequence
  chemically synthesized
aattattgtctttaaagtca

SEQ ID NO: 247939 - DNA, 20 bp, Artificial Sequence
  chemically synthesized
taacctttcctttgacttta

SEQ ID NO: 247940 - DNA, 20 bp, Artificial Sequence
  chemically synthesized
tattcaaattattgtcttta

SEQ ID NO: 247941 - DNA, 20 bp, Artificial Sequence
  chemically synthesized
acaataatttgaataatttc

SEQ ID NO: 247942 - DNA, 20 bp, Artificial Sequence
  chemically synthesized
caataatttgaataatttcc

SEQ ID NO: 247943 - DNA, 20 bp, Artificial Sequence
  chemically synthesized
ataatttgaataatttccag

SEQ ID NO: 247944 - DNA, 20 bp, Artificial Sequence
  chemically synthesized
gaagattttttcaagtctcc

SEQ ID NO: 247945 - DNA, 20 bp, Artificial Sequence
  chemically synthesized
ttttgtgtgaagattttttc

SEQ ID NO: 247946 - DNA, 20 bp, Artificial Sequence
  chemically synthesized
caaaactttatttttgtgtg

SEQ ID NO: 247947 - DNA, 20 bp, Artificial Sequence
  chemically synthesized
aaaatcttcacacaaaaata

SEQ ID NO: 247948 - DNA, 20 bp, Artificial Sequence
  chemically synthesized
ttttgttaaatcaatacttt

SEQ ID NO: 247949 - DNA, 20 bp, Artificial Sequence
  chemically synthesized
taatttgggggtatttctca

SEQ ID NO: 247950 - DNA, 20 bp, Artificial Sequence
  chemically synthesized
ccaatatagaaataatttgg

SEQ ID NO: 247951 - DNA, 20 bp, Artificial Sequence
  chemically synthesized
accaatatagaaataatttg

SEQ ID NO: 247952 - DNA, 20 bp, Artificial Sequence
  chemically synthesized
caccaatatagaaataattt

SEQ ID NO: 247953 - DNA, 20 bp, Artificial Sequence
  chemically synthesized
tcaccaatatagaaataatt

SEQ ID NO: 247954 - DNA, 20 bp, Artificial Sequence
  chemically synthesized
cccccaaattatttctatat

SEQ ID NO: 247955 - DNA, 20 bp, Artificial Sequence
  chemically synthesized
gtcttttactatcaccaata

SEQ ID NO: 247956 - DNA, 20 bp, Artificial Sequence
  chemically synthesized
aattatttctatattggtga

SEQ ID NO: 247957 - DNA, 20 bp, Artificial Sequence
  chemically synthesized
ttctatattggtgatagtaa

SEQ ID NO: 247958 - DNA, 20 bp, Artificial Sequence
  chemically synthesized
tgatagtaaaagacaaattc

SEQ ID NO: 247959 - DNA, 20 bp, Artificial Sequence
  chemically synthesized
tcaagtattttatgtcgttc

SEQ ID NO: 247960 - DNA, 20 bp, Artificial Sequence
  chemically synthesized
ttttatgtcgttcaagaaat

SEQ ID NO: 247961 - DNA, 20 bp, Artificial Sequence
  chemically synthesized
gttcaagaaattggcttgtg

SEQ ID NO: 247962 - DNA, 20 bp, Artificial Sequence
  chemically synthesized
ttcaagaaattggcttgtgt

SEQ ID NO: 247963 - DNA, 20 bp, Artificial Sequence
  chemically synthesized
tcacgtgcacaatcctacac

SEQ ID NO: 247964 - DNA, 20 bp, Artificial Sequence
  chemically synthesized
aaattagaagtggaaattaa

SEQ ID NO: 247965 - DNA, 20 bp, Artificial Sequence
  chemically synthesized
aaaattagaagtggaaatta

SEQ ID NO: 247966 - DNA, 20 bp, Artificial Sequence
  chemically synthesized
gttagtgacaaaattagaag

SEQ ID NO: 247967 - DNA, 20 bp, Artificial Sequence
  chemically synthesized
acagttagtgacaaaattag

SEQ ID NO: 247968 - DNA, 20 bp, Artificial Sequence
  chemically synthesized
ataacagttagtgacaaaat

SEQ ID NO: 247969 - DNA, 20 bp, Artificial Sequence
  chemically synthesized
taagtgtgattcataacagt

SEQ ID NO: 247970 - DNA, 20 bp, Artificial Sequence
  chemically synthesized
tttttaagtgtgattcataa

SEQ ID NO: 247971 - DNA, 20 bp, Artificial Sequence
  chemically synthesized
atagccatggtttgtttttt

SEQ ID NO: 247972 - DNA, 20 bp, Artificial Sequence
  chemically synthesized
cacacttaaaaaacaaacca

SEQ ID NO: 247973 - DNA, 20 bp, Artificial Sequence
  chemically synthesized
ctttaaaaagatcatagcca

SEQ ID NO: 247974 - DNA, 20 bp, Artificial Sequence
  chemically synthesized
ttacagctttaaaaagatca

SEQ ID NO: 247975 - DNA, 20 bp, Artificial Sequence
  chemically synthesized
ccatggctatgatcttttta

SEQ ID NO: 247976 - DNA, 20 bp, Artificial Sequence
  chemically synthesized
tcttgctttacagctttaaa

SEQ ID NO: 247977 - DNA, 20 bp, Artificial Sequence
  chemically synthesized
atgatctttttaaagctgta

SEQ ID NO: 247978 - DNA, 20 bp, Artificial Sequence
  chemically synthesized
tctttttaaagctgtaaagc

SEQ ID NO: 247979 - DNA, 20 bp, Artificial Sequence
  chemically synthesized
aattattgagtcttgcttta

SEQ ID NO: 247980 - DNA, 20 bp, Artificial Sequence
  chemically synthesized
ggttagctctgtgaattatt

SEQ ID NO: 247981 - DNA, 20 bp, Artificial Sequence
  chemically synthesized
aagcaagactcaataattca

SEQ ID NO: 247982 - DNA, 20 bp, Artificial Sequence
  chemically synthesized
gcaagactcaataattcaca

SEQ ID NO: 247983 - DNA, 20 bp, Artificial Sequence
  chemically synthesized
ataattcacagagctaacca

SEQ ID NO: 247984 - DNA, 20 bp, Artificial Sequence
  chemically synthesized
taattcacagagctaaccaa

SEQ ID NO: 247985 - DNA, 20 bp, Artificial Sequence
  chemically synthesized
cctatgtactcacctttggt

SEQ ID NO: 247986 - DNA, 20 bp, Artificial Sequence
  chemically synthesized
tcacagagctaaccaaaggt

SEQ ID NO: 247987 - DNA, 20 bp, Artificial Sequence
  chemically synthesized
tattcctatgtactcacctt

SEQ ID NO: 247988 - DNA, 20 bp, Artificial Sequence
  chemically synthesized
gctaaccaaaggtgagtaca

SEQ ID NO: 247989 - DNA, 20 bp, Artificial Sequence
  chemically synthesized
ctaaccaaaggtgagtacat

SEQ ID NO: 247990 - DNA, 20 bp, Artificial Sequence
  chemically synthesized
gtgagtacataggaatatca

SEQ ID NO: 247991 - DNA, 20 bp, Artificial Sequence
  chemically synthesized
tgagtacataggaatatcaa

SEQ ID NO: 247992 - DNA, 20 bp, Artificial Sequence
  chemically synthesized
ggaatatcaaaggtatacat

SEQ ID NO: 247993 - DNA, 20 bp, Artificial Sequence
  chemically synthesized
tcaaaggtatacattagcaa

SEQ ID NO: 247994 - DNA, 20 bp, Artificial Sequence
  chemically synthesized
acattagcaaaagattaaac

SEQ ID NO: 247995 - DNA, 20 bp, Artificial Sequence
  chemically synthesized
tagcaaaagattaaacaagt

SEQ ID NO: 247996 - DNA, 20 bp, Artificial Sequence
  chemically synthesized
gattaaacaagtaagtcaat

SEQ ID NO: 247997 - DNA, 20 bp, Artificial Sequence
  chemically synthesized
attaaacaagtaagtcaata

SEQ ID NO: 247998 - DNA, 20 bp, Artificial Sequence
  chemically synthesized
aaacaagtaagtcaataagg

SEQ ID NO: 247999 - DNA, 20 bp, Artificial Sequence
  chemically synthesized
gtaagtcaataaggaagaaa

SEQ ID NO: 248000 - DNA, 20 bp, Artificial Sequence
  chemically synthesized
gtcaataaggaagaaataga

SEQ ID NO: 248001 - DNA, 20 bp, Artificial Sequence
  chemically synthesized
aaggaagaaatagaaagaca

SEQ ID NO: 248002 - DNA, 20 bp, Artificial Sequence
  chemically synthesized
atagaaagacacagccacac

SEQ ID NO: 248003 - DNA, 20 bp, Artificial Sequence
  chemically synthesized
tttgtattctgaggcttgtg

SEQ ID NO: 248004 - DNA, 20 bp, Artificial Sequence
  chemically synthesized
agacacagccacacaagcct

SEQ ID NO: 248005 - DNA, 20 bp, Artificial Sequence
  chemically synthesized
ccatcagcttttgtattctg

SEQ ID NO: 248006 - DNA, 20 bp, Artificial Sequence
  chemically synthesized
accatcagcttttgtattct

SEQ ID NO: 248007 - DNA, 20 bp, Artificial Sequence
  chemically synthesized
acacaagcctcagaatacaa

SEQ ID NO: 248008 - DNA, 20 bp, Artificial Sequence
  chemically synthesized
cctcagaatacaaaagctga

SEQ ID NO: 248009 - DNA, 20 bp, Artificial Sequence
  chemically synthesized
tctggatcctgattcaccat

SEQ ID NO: 248010 - DNA, 20 bp, Artificial Sequence
  chemically synthesized
tacaaaagctgatggtgaat

SEQ ID NO: 248011 - DNA, 20 bp, Artificial Sequence
  chemically synthesized
acaaaagctgatggtgaatc

SEQ ID NO: 248012 - DNA, 20 bp, Artificial Sequence
  chemically synthesized
gctgatggtgaatcaggatc

SEQ ID NO: 248013 - DNA, 20 bp, Artificial Sequence
  chemically synthesized
tgatggtgaatcaggatcca

SEQ ID NO: 248014 - DNA, 20 bp, Artificial Sequence
  chemically synthesized
gatggtgaatcaggatccag

SEQ ID NO: 248015 - DNA, 20 bp, Artificial Sequence
  chemically synthesized
ttctgactcctgcattcctc

SEQ ID NO: 248016 - DNA, 20 bp, Artificial Sequence
  chemically synthesized
aatcaggatccagaggaatg

SEQ ID NO: 248017 - DNA, 20 bp, Artificial Sequence
  chemically synthesized
atcaggatccagaggaatgc

SEQ ID NO: 248018 - DNA, 20 bp, Artificial Sequence
  chemically synthesized
caggatccagaggaatgcag

SEQ ID NO: 248019 - DNA, 20 bp, Artificial Sequence
  chemically synthesized
atccagaggaatgcaggagt

SEQ ID NO: 248020 - DNA, 20 bp, Artificial Sequence
  chemically synthesized
gaggaatgcaggagtcagaa

SEQ ID NO: 248021 - DNA, 20 bp, Artificial Sequence
  chemically synthesized
agaaaagtaacacaaatacg

SEQ ID NO: 248022 - DNA, 20 bp, Artificial Sequence
  chemically synthesized
aaagtaacacaaatacgcag

SEQ ID NO: 248023 - DNA, 20 bp, Artificial Sequence
  chemically synthesized
agtaacacaaatacgcagaa

SEQ ID NO: 248024 - DNA, 20 bp, Artificial Sequence
  chemically synthesized
caaatacgcagaagagtgac

SEQ ID NO: 248025 - DNA, 20 bp, Artificial Sequence
  chemically synthesized
tacgcagaagagtgaccagc

SEQ ID NO: 248026 - DNA, 20 bp, Artificial Sequence
  chemically synthesized
cagaagagtgaccagctgga

SEQ ID NO: 248027 - DNA, 20 bp, Artificial Sequence
  chemically synthesized
agaagagtgaccagctggat

SEQ ID NO: 248028 - DNA, 20 bp, Artificial Sequence
  chemically synthesized
actgcacttccctatccagc

SEQ ID NO: 248029 - DNA, 20 bp, Artificial Sequence
  chemically synthesized
gaagagtgaccagctggata

SEQ ID NO: 248030 - DNA, 20 bp, Artificial Sequence
  chemically synthesized
gagtgaccagctggataggg

SEQ ID NO: 248031 - DNA, 20 bp, Artificial Sequence
  chemically synthesized
ggccactgcacttccctatc

SEQ ID NO: 248032 - DNA, 20 bp, Artificial Sequence
  chemically synthesized
accagctggatagggaagtg

SEQ ID NO: 248033 - DNA, 20 bp, Artificial Sequence
  chemically synthesized
agctggatagggaagtgcag

SEQ ID NO: 248034 - DNA, 20 bp, Artificial Sequence
  chemically synthesized
ggaagtgcagtggcccttgc

SEQ ID NO: 248035 - DNA, 20 bp, Artificial Sequence
  chemically synthesized
gaagtgcagtggcccttgct

SEQ ID NO: 248036 - DNA, 20 bp, Artificial Sequence
  chemically synthesized
aagtgcagtggcccttgcta

SEQ ID NO: 248037 - DNA, 20 bp, Artificial Sequence
  chemically synthesized
gggcattattaccctagcaa

SEQ ID NO: 248038 - DNA, 20 bp, Artificial Sequence
  chemically synthesized
ggggcattattaccctagca

SEQ ID NO: 248039 - DNA, 20 bp, Artificial Sequence
  chemically synthesized
aggggcattattaccctagc

SEQ ID NO: 248040 - DNA, 20 bp, Artificial Sequence
  chemically synthesized
agggaggggcattattaccc

SEQ ID NO: 248041 - DNA, 20 bp, Artificial Sequence
  chemically synthesized
tctgtggcaatgtgagggag

SEQ ID NO: 248042 - DNA, 20 bp, Artificial Sequence
  chemically synthesized
atctgtggcaatgtgaggga

SEQ ID NO: 248043 - DNA, 20 bp, Artificial Sequence
  chemically synthesized
gatctgtggcaatgtgaggg

SEQ ID NO: 248044 - DNA, 20 bp, Artificial Sequence
  chemically synthesized
ggatctgtggcaatgtgagg

SEQ ID NO: 248045 - DNA, 20 bp, Artificial Sequence
  chemically synthesized
ctggatctgtggcaatgtga

SEQ ID NO: 248046 - DNA, 20 bp, Artificial Sequence
  chemically synthesized
cctggatctgtggcaatgtg

SEQ ID NO: 248047 - DNA, 20 bp, Artificial Sequence
  chemically synthesized
acctggatctgtggcaatgt

SEQ ID NO: 248048 - DNA, 20 bp, Artificial Sequence
  chemically synthesized
gcccctccctcacattgcca

SEQ ID NO: 248049 - DNA, 20 bp, Artificial Sequence
  chemically synthesized
ccctcacattgccacagatc

SEQ ID NO: 248050 - DNA, 20 bp, Artificial Sequence
  chemically synthesized
cctcacattgccacagatcc

SEQ ID NO: 248051 - DNA, 20 bp, Artificial Sequence
  chemically synthesized
gtgagctccacctggatctg

SEQ ID NO: 248052 - DNA, 20 bp, Artificial Sequence
  chemically synthesized
cacattgccacagatccagg

SEQ ID NO: 248053 - DNA, 20 bp, Artificial Sequence
  chemically synthesized
cattgccacagatccaggtg

SEQ ID NO: 248054 - DNA, 20 bp, Artificial Sequence
  chemically synthesized
gataatgggtgagctccacc

SEQ ID NO: 248055 - DNA, 20 bp, Artificial Sequence
  chemically synthesized
ccaggcccaagataatgggt

SEQ ID NO: 248056 - DNA, 20 bp, Artificial Sequence
  chemically synthesized
gtggagctcacccattatct

SEQ ID NO: 248057 - DNA, 20 bp, Artificial Sequence
  chemically synthesized
gtgtccaggcccaagataat

SEQ ID NO: 248058 - DNA, 20 bp, Artificial Sequence
  chemically synthesized
tggagctcacccattatctt

SEQ ID NO: 248059 - DNA, 20 bp, Artificial Sequence
  chemically synthesized
agtgtccaggcccaagataa

SEQ ID NO: 248060 - DNA, 20 bp, Artificial Sequence
  chemically synthesized
ctcacccattatcttgggcc

SEQ ID NO: 248061 - DNA, 20 bp, Artificial Sequence
  chemically synthesized
accctggagtgtccaggccc

SEQ ID NO: 248062 - DNA, 20 bp, Artificial Sequence
  chemically synthesized
cagagtaccctggagtgtcc

SEQ ID NO: 248063 - DNA, 20 bp, Artificial Sequence
  chemically synthesized
tatcttgggcctggacactc

SEQ ID NO: 248064 - DNA, 20 bp, Artificial Sequence
  chemically synthesized
ccagagtaccctggagtgtc

SEQ ID NO: 248065 - DNA, 20 bp, Artificial Sequence
  chemically synthesized
atcttgggcctggacactcc

SEQ ID NO: 248066 - DNA, 20 bp, Artificial Sequence
  chemically synthesized
tcttgggcctggacactcca

SEQ ID NO: 248067 - DNA, 20 bp, Artificial Sequence
  chemically synthesized
acatcaaccagagtaccctg

SEQ ID NO: 248068 - DNA, 20 bp, Artificial Sequence
  chemically synthesized
ggacatcaaccagagtaccc

SEQ ID NO: 248069 - DNA, 20 bp, Artificial Sequence
  chemically synthesized
ctggacactccagggtactc

SEQ ID NO: 248070 - DNA, 20 bp, Artificial Sequence
  chemically synthesized
cggctgtaggacatcaacca

SEQ ID NO: 248071 - DNA, 20 bp, Artificial Sequence
  chemically synthesized
tccggctgtaggacatcaac

SEQ ID NO: 248072 - DNA, 20 bp, Artificial Sequence
  chemically synthesized
gtactctggttgatgtccta

SEQ ID NO: 248073 - DNA, 20 bp, Artificial Sequence
  chemically synthesized
tctggttgatgtcctacagc

SEQ ID NO: 248074 - DNA, 20 bp, Artificial Sequence
  chemically synthesized
gacatgcagtttccggctgt

SEQ ID NO: 248075 - DNA, 20 bp, Artificial Sequence
  chemically synthesized
agacatgcagtttccggctg

SEQ ID NO: 248076 - DNA, 20 bp, Artificial Sequence
  chemically synthesized
aggctaagacatgcagtttc

SEQ ID NO: 248077 - DNA, 20 bp, Artificial Sequence
  chemically synthesized
cagccggaaactgcatgtct

SEQ ID NO: 248078 - DNA, 20 bp, Artificial Sequence
  chemically synthesized
agactttaggctaagacatg

SEQ ID NO: 248079 - DNA, 20 bp, Artificial Sequence
  chemically synthesized
aaactgcatgtcttagccta

SEQ ID NO: 248080 - DNA, 20 bp, Artificial Sequence
  chemically synthesized
tcaaagatagactttaggct

SEQ ID NO: 248081 - DNA, 20 bp, Artificial Sequence
  chemically synthesized
ctgcgtcaaagatagacttt

SEQ ID NO: 248082 - DNA, 20 bp, Artificial Sequence
  chemically synthesized
tctgcgtcaaagatagactt

SEQ ID NO: 248083 - DNA, 20 bp, Artificial Sequence
  chemically synthesized
tactttttctgcgtcaaaga

SEQ ID NO: 248084 - DNA, 20 bp, Artificial Sequence
  chemically synthesized
cctaaagtctatctttgacg

SEQ ID NO: 248085 - DNA, 20 bp, Artificial Sequence
  chemically synthesized
tagctactttttctgcgtca

SEQ ID NO: 248086 - DNA, 20 bp, Artificial Sequence
  chemically synthesized
gtctatctttgacgcagaaa

SEQ ID NO: 248087 - DNA, 20 bp, Artificial Sequence
  chemically synthesized
tatctttgacgcagaaaaag

SEQ ID NO: 248088 - DNA, 20 bp, Artificial Sequence
  chemically synthesized
cctgtttttgcatgtggttg

SEQ ID NO: 248089 - DNA, 20 bp, Artificial Sequence
  chemically synthesized
ttccaacctgtttttgcatg

SEQ ID NO: 248090 - DNA, 20 bp, Artificial Sequence
  chemically synthesized
gctacaaccacatgcaaaaa

SEQ ID NO: 248091 - DNA, 20 bp, Artificial Sequence
  chemically synthesized
ctacaaccacatgcaaaaac

SEQ ID NO: 248092 - DNA, 20 bp, Artificial Sequence
  chemically synthesized
aaccacatgcaaaaacaggt

SEQ ID NO: 248093 - DNA, 20 bp, Artificial Sequence
  chemically synthesized
cacatgcaaaaacaggttgg

SEQ ID NO: 248094 - DNA, 20 bp, Artificial Sequence
  chemically synthesized
atgcaaaaacaggttggaag

SEQ ID NO: 248095 - DNA, 20 bp, Artificial Sequence
  chemically synthesized
aacaggttggaagtagttgc

SEQ ID NO: 248096 - DNA, 20 bp, Artificial Sequence
  chemically synthesized
caggttggaagtagttgcaa

SEQ ID NO: 248097 - DNA, 20 bp, Artificial Sequence
  chemically synthesized
aggttggaagtagttgcaag

SEQ ID NO: 248098 - DNA, 20 bp, Artificial Sequence
  chemically synthesized
aagggccgctcagggtgtca

SEQ ID NO: 248099 - DNA, 20 bp, Artificial Sequence
  chemically synthesized
aaagggccgctcagggtgtc

SEQ ID NO: 248100 - DNA, 20 bp, Artificial Sequence
  chemically synthesized
aattaataccctgacaccct

SEQ ID NO: 248101 - DNA, 20 bp, Artificial Sequence
  chemically synthesized
taaagggccgctcagggtgt

SEQ ID NO: 248102 - DNA, 20 bp, Artificial Sequence
  chemically synthesized
taataccctgacaccctgag

SEQ ID NO: 248103 - DNA, 20 bp, Artificial Sequence
  chemically synthesized
cacttttaaagggccgctca

SEQ ID NO: 248104 - DNA, 20 bp, Artificial Sequence
  chemically synthesized
tcacttttaaagggccgctc

SEQ ID NO: 248105 - DNA, 20 bp, Artificial Sequence
  chemically synthesized
gtcacttttaaagggccgct

SEQ ID NO: 248106 - DNA, 20 bp, Artificial Sequence
  chemically synthesized
caccctgagcggccctttaa

SEQ ID NO: 248107 - DNA, 20 bp, Artificial Sequence
  chemically synthesized
tcttgttagtcacttttaaa

SEQ ID NO: 248108 - DNA, 20 bp, Artificial Sequence
  chemically synthesized
ctcttgttagtcacttttaa

SEQ ID NO: 248109 - DNA, 20 bp, Artificial Sequence
  chemically synthesized
actcttgttagtcactttta

SEQ ID NO: 248110 - DNA, 20 bp, Artificial Sequence
  chemically synthesized
gccctttaaaagtgactaac

SEQ ID NO: 248111 - DNA, 20 bp, Artificial Sequence
  chemically synthesized
cctttaaaagtgactaacaa

SEQ ID NO: 248112 - DNA, 20 bp, Artificial Sequence
  chemically synthesized
gtttatatttcaactcttgt

SEQ ID NO: 248113 - DNA, 20 bp, Artificial Sequence
  chemically synthesized
gagttgaaatataaacacct

SEQ ID NO: 248114 - DNA, 20 bp, Artificial Sequence
  chemically synthesized
tagacaaggtgcaggagctg

SEQ ID NO: 248115 - DNA, 20 bp, Artificial Sequence
  chemically synthesized
ttagacaaggtgcaggagct

SEQ ID NO: 248116 - DNA, 20 bp, Artificial Sequence
  chemically synthesized
ttatcttagacaaggtgcag

SEQ ID NO: 248117 - DNA, 20 bp, Artificial Sequence
  chemically synthesized
agttatcttagacaaggtgc

SEQ ID NO: 248118 - DNA, 20 bp, Artificial Sequence
  chemically synthesized
gagttatcttagacaaggtg

SEQ ID NO: 248119 - DNA, 20 bp, Artificial Sequence
  chemically synthesized
tcagctcctgcaccttgtct

SEQ ID NO: 248120 - DNA, 20 bp, Artificial Sequence
  chemically synthesized
tctcagagttatcttagaca

SEQ ID NO: 248121 - DNA, 20 bp, Artificial Sequence
  chemically synthesized
gtctcagagttatcttagac

SEQ ID NO: 248122 - DNA, 20 bp, Artificial Sequence
  chemically synthesized
cacttgtctcagagttatct

SEQ ID NO: 248123 - DNA, 20 bp, Artificial Sequence
  chemically synthesized
accttgtctaagataactct

SEQ ID NO: 248124 - DNA, 20 bp, Artificial Sequence
  chemically synthesized
gtctaagataactctgagac

SEQ ID NO: 248125 - DNA, 20 bp, Artificial Sequence
  chemically synthesized
ggcataaaacacttgtctca

SEQ ID NO: 248126 - DNA, 20 bp, Artificial Sequence
  chemically synthesized
aaggcataaaacacttgtct

SEQ ID NO: 248127 - DNA, 20 bp, Artificial Sequence
  chemically synthesized
acaagtgttttatgccttcc

SEQ ID NO: 248128 - DNA, 20 bp, Artificial Sequence
  chemically synthesized
tccctggagaaagtctggga

SEQ ID NO: 248129 - DNA, 20 bp, Artificial Sequence
  chemically synthesized
ttccctggagaaagtctggg

SEQ ID NO: 248130 - DNA, 20 bp, Artificial Sequence
  chemically synthesized
taattccctggagaaagtct

SEQ ID NO: 248131 - DNA, 20 bp, Artificial Sequence
  chemically synthesized
ttaattccctggagaaagtc

SEQ ID NO: 248132 - DNA, 20 bp, Artificial Sequence
  chemically synthesized
atgccttcccagactttctc

SEQ ID NO: 248133 - DNA, 20 bp, Artificial Sequence
  chemically synthesized
tgccttcccagactttctcc

SEQ ID NO: 248134 - DNA, 20 bp, Artificial Sequence
  chemically synthesized
gccttcccagactttctcca

SEQ ID NO: 248135 - DNA, 20 bp, Artificial Sequence
  chemically synthesized
agggcttaattccctggaga

SEQ ID NO: 248136 - DNA, 20 bp, Artificial Sequence
  chemically synthesized
aactagggcttaattccctg

SEQ ID NO: 248137 - DNA, 20 bp, Artificial Sequence
  chemically synthesized
cagactttctccagggaatt

SEQ ID NO: 248138 - DNA, 20 bp, Artificial Sequence
  chemically synthesized
agaactagggcttaattccc

SEQ ID NO: 248139 - DNA, 20 bp, Artificial Sequence
  chemically synthesized
ttctccagggaattaagccc

SEQ ID NO: 248140 - DNA, 20 bp, Artificial Sequence
  chemically synthesized
aaacaccactgtgagaacta

SEQ ID NO: 248141 - DNA, 20 bp, Artificial Sequence
  chemically synthesized
caaacaccactgtgagaact

SEQ ID NO: 248142 - DNA, 20 bp, Artificial Sequence
  chemically synthesized
gaattaagccctagttctca

SEQ ID NO: 248143 - DNA, 20 bp, Artificial Sequence
  chemically synthesized
ccaaacaccactgtgagaac

SEQ ID NO: 248144 - DNA, 20 bp, Artificial Sequence
  chemically synthesized
ttaagccctagttctcacag

SEQ ID NO: 248145 - DNA, 20 bp, Artificial Sequence
  chemically synthesized
atcaagccaaacaccactgt

SEQ ID NO: 248146 - DNA, 20 bp, Artificial Sequence
  chemically synthesized
ctagttctcacagtggtgtt

SEQ ID NO: 248147 - DNA, 20 bp, Artificial Sequence
  chemically synthesized
cctgtaaagagtatgttatc

SEQ ID NO: 248148 - DNA, 20 bp, Artificial Sequence
  chemically synthesized
gcttgataacatactcttta

SEQ ID NO: 248149 - DNA, 20 bp, Artificial Sequence
  chemically synthesized
cttgataacatactctttac

SEQ ID NO: 248150 - DNA, 20 bp, Artificial Sequence
  chemically synthesized
aagagaaagcaacctgtaaa

SEQ ID NO: 248151 - DNA, 20 bp, Artificial Sequence
  chemically synthesized
ttaagagaaagcaacctgta

SEQ ID NO: 248152 - DNA, 20 bp, Artificial Sequence
  chemically synthesized
gttgtgagaaagttaagaga

SEQ ID NO: 248153 - DNA, 20 bp, Artificial Sequence
  chemically synthesized
tggagttgtgagaaagttaa

SEQ ID NO: 248154 - DNA, 20 bp, Artificial Sequence
  chemically synthesized
gttggagttgtgagaaagtt

SEQ ID NO: 248155 - DNA, 20 bp, Artificial Sequence
  chemically synthesized
aggatgttggagttgtgaga

SEQ ID NO: 248156 - DNA, 20 bp, Artificial Sequence
  chemically synthesized
tggtaggatgttggagttgt

SEQ ID NO: 248157 - DNA, 20 bp, Artificial Sequence
  chemically synthesized
gaagctgtggtaggatgttg

SEQ ID NO: 248158 - DNA, 20 bp, Artificial Sequence
  chemically synthesized
aggaagctgtggtaggatgt

SEQ ID NO: 248159 - DNA, 20 bp, Artificial Sequence
  chemically synthesized
acaactccaacatcctacca

SEQ ID NO: 248160 - DNA, 20 bp, Artificial Sequence
  chemically synthesized
tgattctaggaagctgtggt

SEQ ID NO: 248161 - DNA, 20 bp, Artificial Sequence
  chemically synthesized
gtgattctaggaagctgtgg

SEQ ID NO: 248162 - DNA, 20 bp, Artificial Sequence
  chemically synthesized
gcagtgattctaggaagctg

SEQ ID NO: 248163 - DNA, 20 bp, Artificial Sequence
  chemically synthesized
aacatcctaccacagcttcc

SEQ ID NO: 248164 - DNA, 20 bp, Artificial Sequence
  chemically synthesized
ctttgggcagtgattctagg

SEQ ID NO: 248165 - DNA, 20 bp, Artificial Sequence
  chemically synthesized
tttctttgggcagtgattct

SEQ ID NO: 248166 - DNA, 20 bp, Artificial Sequence
  chemically synthesized
gtttctttgggcagtgattc

SEQ ID NO: 248167 - DNA, 20 bp, Artificial Sequence
  chemically synthesized
cttcctagaatcactgccca

SEQ ID NO: 248168 - DNA, 20 bp, Artificial Sequence
  chemically synthesized
gttcaaatagtttctttggg

SEQ ID NO: 248169 - DNA, 20 bp, Artificial Sequence
  chemically synthesized
tgagttcaaatagtttcttt

SEQ ID NO: 248170 - DNA, 20 bp, Artificial Sequence
  chemically synthesized
gtgagttcaaatagtttctt

SEQ ID NO: 248171 - DNA, 20 bp, Artificial Sequence
  chemically synthesized
gacaaggatgtgagttcaaa

SEQ ID NO: 248172 - DNA, 20 bp, Artificial Sequence
  chemically synthesized
aaatcctgagacaaggatgt

SEQ ID NO: 248173 - DNA, 20 bp, Artificial Sequence
  chemically synthesized
ttgaactcacatccttgtct

SEQ ID NO: 248174 - DNA, 20 bp, Artificial Sequence
  chemically synthesized
tgaactcacatccttgtctc

SEQ ID NO: 248175 - DNA, 20 bp, Artificial Sequence
  chemically synthesized
cataagcaaatcctgagaca

SEQ ID NO: 248176 - DNA, 20 bp, Artificial Sequence
  chemically synthesized
acataagcaaatcctgagac

SEQ ID NO: 248177 - DNA, 20 bp, Artificial Sequence
  chemically synthesized
ttcttacataagcaaatcct

SEQ ID NO: 248178 - DNA, 20 bp, Artificial Sequence
  chemically synthesized
gtctcaggatttgcttatgt

SEQ ID NO: 248179 - DNA, 20 bp, Artificial Sequence
  chemically synthesized
ctcagtttgggttcttacat

SEQ ID NO: 248180 - DNA, 20 bp, Artificial Sequence
  chemically synthesized
cttatgtaagaacccaaact

SEQ ID NO: 248181 - DNA, 20 bp, Artificial Sequence
  chemically synthesized
cattatgagtgtctcagttt

SEQ ID NO: 248182 - DNA, 20 bp, Artificial Sequence
  chemically synthesized
gcattatgagtgtctcagtt

SEQ ID NO: 248183 - DNA, 20 bp, Artificial Sequence
  chemically synthesized
ttcttgcattatgagtgtct

SEQ ID NO: 248184 - DNA, 20 bp, Artificial Sequence
  chemically synthesized
aactgagacactcataatgc

SEQ ID NO: 248185 - DNA, 20 bp, Artificial Sequence
  chemically synthesized
aatataaattcttgcattat

SEQ ID NO: 248186 - DNA, 20 bp, Artificial Sequence
  chemically synthesized
agaatttatattattaatac

SEQ ID NO: 248187 - DNA, 20 bp, Artificial Sequence
  chemically synthesized
ccatgcttaaggattgattc

SEQ ID NO: 248188 - DNA, 20 bp, Artificial Sequence
  chemically synthesized
taataccagaatcaatcctt

SEQ ID NO: 248189 - DNA, 20 bp, Artificial Sequence
  chemically synthesized
ccagaatcaatccttaagca

SEQ ID NO: 248190 - DNA, 20 bp, Artificial Sequence
  chemically synthesized
tgtcaaactagccatgctta

SEQ ID NO: 248191 - DNA, 20 bp, Artificial Sequence
  chemically synthesized
gtgtcaaactagccatgctt

SEQ ID NO: 248192 - DNA, 20 bp, Artificial Sequence
  chemically synthesized
aatcaatccttaagcatggc

SEQ ID NO: 248193 - DNA, 20 bp, Artificial Sequence
  chemically synthesized
ctctatgtagagtgtcaaac

SEQ ID NO: 248194 - DNA, 20 bp, Artificial Sequence
  chemically synthesized
ggctagtttgacactctaca

SEQ ID NO: 248195 - DNA, 20 bp, Artificial Sequence
  chemically synthesized
ctagtttgacactctacata

SEQ ID NO: 248196 - DNA, 20 bp, Artificial Sequence
  chemically synthesized
tagtttgacactctacatag

SEQ ID NO: 248197 - DNA, 20 bp, Artificial Sequence
  chemically synthesized
cttttccttacctctatgta

SEQ ID NO: 248198 - DNA, 20 bp, Artificial Sequence
  chemically synthesized
tgcttttccttacctctatg

SEQ ID NO: 248199 - DNA, 20 bp, Artificial Sequence
  chemically synthesized
ttgacactctacatagaggt

SEQ ID NO: 248200 - DNA, 20 bp, Artificial Sequence
  chemically synthesized
tgacactctacatagaggta

SEQ ID NO: 248201 - DNA, 20 bp, Artificial Sequence
  chemically synthesized
ctctacatagaggtaaggaa

SEQ ID NO: 248202 - DNA, 20 bp, Artificial Sequence
  chemically synthesized
ggtaaggaaaagcacttaac

SEQ ID NO: 248203 - DNA, 20 bp, Artificial Sequence
  chemically synthesized
taaggaaaagcacttaactg

SEQ ID NO: 248204 - DNA, 20 bp, Artificial Sequence
  chemically synthesized
gtgaattttctgctccagtt

SEQ ID NO: 248205 - DNA, 20 bp, Artificial Sequence
  chemically synthesized
ggaaaagcacttaactggag

SEQ ID NO: 248206 - DNA, 20 bp, Artificial Sequence
  chemically synthesized
aatgagtgaattttctgctc

SEQ ID NO: 248207 - DNA, 20 bp, Artificial Sequence
  chemically synthesized
tattcatttttcaaaagaat

SEQ ID NO: 248208 - DNA, 20 bp, Artificial Sequence
  chemically synthesized
gtaccttattcatttttcaa

SEQ ID NO: 248209 - DNA, 20 bp, Artificial Sequence
  chemically synthesized
cattcttttgaaaaatgaat

SEQ ID NO: 248210 - DNA, 20 bp, Artificial Sequence
  chemically synthesized
attcttttgaaaaatgaata

SEQ ID NO: 248211 - DNA, 20 bp, Artificial Sequence
  chemically synthesized
tcactctctattacaaaaaa

SEQ ID NO: 248212 - DNA, 20 bp, Artificial Sequence
  chemically synthesized
actcactctctattacaaaa

SEQ ID NO: 248213 - DNA, 20 bp, Artificial Sequence
  chemically synthesized
taaggtactcttttttgtaa

SEQ ID NO: 248214 - DNA, 20 bp, Artificial Sequence
  chemically synthesized
aggtactcttttttgtaata

SEQ ID NO: 248215 - DNA, 20 bp, Artificial Sequence
  chemically synthesized
gtactcttttttgtaataga

SEQ ID NO: 248216 - DNA, 20 bp, Artificial Sequence
  chemically synthesized
tcttttttgtaatagagagt

SEQ ID NO: 248217 - DNA, 20 bp, Artificial Sequence
  chemically synthesized
gtaatagagagtgagtgtaa

SEQ ID NO: 248218 - DNA, 20 bp, Artificial Sequence
  chemically synthesized
taatagagagtgagtgtaat

SEQ ID NO: 248219 - DNA, 20 bp, Artificial Sequence
  chemically synthesized
agagtgagtgtaatgggata

SEQ ID NO: 248220 - DNA, 20 bp, Artificial Sequence
  chemically synthesized
tgggatacagacatacctaa

SEQ ID NO: 248221 - DNA, 20 bp, Artificial Sequence
  chemically synthesized
gatacagacatacctaatag

SEQ ID NO: 248222 - DNA, 20 bp, Artificial Sequence
  chemically synthesized
tctactgtaacactactatt

SEQ ID NO: 248223 - DNA, 20 bp, Artificial Sequence
  chemically synthesized
atctactgtaacactactat

SEQ ID NO: 248224 - DNA, 20 bp, Artificial Sequence
  chemically synthesized
catacctaatagtagtgtta

SEQ ID NO: 248225 - DNA, 20 bp, Artificial Sequence
  chemically synthesized
acctaatagtagtgttacag

SEQ ID NO: 248226 - DNA, 20 bp, Artificial Sequence
  chemically synthesized
aatagtagtgttacagtaga

SEQ ID NO: 248227 - DNA, 20 bp, Artificial Sequence
  chemically synthesized
gtagtgttacagtagatagc

SEQ ID NO: 248228 - DNA, 20 bp, Artificial Sequence
  chemically synthesized
tgttacagtagatagctagt

SEQ ID NO: 248229 - DNA, 20 bp, Artificial Sequence
  chemically synthesized
ctaccctgctcatatctgac

SEQ ID NO: 248230 - DNA, 20 bp, Artificial Sequence
  chemically synthesized
gtagatagctagtcagatat

SEQ ID NO: 248231 - DNA, 20 bp, Artificial Sequence
  chemically synthesized
gatagctagtcagatatgag

SEQ ID NO: 248232 - DNA, 20 bp, Artificial Sequence
  chemically synthesized
atagctagtcagatatgagc

SEQ ID NO: 248233 - DNA, 20 bp, Artificial Sequence
  chemically synthesized
tagctagtcagatatgagca

SEQ ID NO: 248234 - DNA, 20 bp, Artificial Sequence
  chemically synthesized
ctagtcagatatgagcaggg

SEQ ID NO: 248235 - DNA, 20 bp, Artificial Sequence
  chemically synthesized
tagtcagatatgagcagggt

SEQ ID NO: 248236 - DNA, 20 bp, Artificial Sequence
  chemically synthesized
gtcagatatgagcagggtag

SEQ ID NO: 248237 - DNA, 20 bp, Artificial Sequence
  chemically synthesized
gttggggtggcgggggtggg

SEQ ID NO: 248238 - DNA, 20 bp, Artificial Sequence
  chemically synthesized
ggttggggtggcgggggtgg

SEQ ID NO: 248239 - DNA, 20 bp, Artificial Sequence
  chemically synthesized
tggttggggtggcgggggtg

SEQ ID NO: 248240 - DNA, 20 bp, Artificial Sequence
  chemically synthesized
ctggttggggtggcgggggt

SEQ ID NO: 248241 - DNA, 20 bp, Artificial Sequence
  chemically synthesized
cctggttggggtggcggggg

SEQ ID NO: 248242 - DNA, 20 bp, Artificial Sequence
  chemically synthesized
attcctggttggggtggcgg

SEQ ID NO: 248243 - DNA, 20 bp, Artificial Sequence
  chemically synthesized
cattcctggttggggtggcg

SEQ ID NO: 248244 - DNA, 20 bp, Artificial Sequence
  chemically synthesized
acattcctggttggggtggc

SEQ ID NO: 248245 - DNA, 20 bp, Artificial Sequence
  chemically synthesized
gacattcctggttggggtgg

SEQ ID NO: 248246 - DNA, 20 bp, Artificial Sequence
  chemically synthesized
cccacccccgccaccccaac

SEQ ID NO: 248247 - DNA, 20 bp, Artificial Sequence
  chemically synthesized
cctgacattcctggttgggg

SEQ ID NO: 248248 - DNA, 20 bp, Artificial Sequence
  chemically synthesized
ccacccccgccaccccaacc

SEQ ID NO: 248249 - DNA, 20 bp, Artificial Sequence
  chemically synthesized
ttgcctgacattcctggttg

SEQ ID NO: 248250 - DNA, 20 bp, Artificial Sequence
  chemically synthesized
gttgcctgacattcctggtt

SEQ ID NO: 248251 - DNA, 20 bp, Artificial Sequence
  chemically synthesized
ggttgcctgacattcctggt

SEQ ID NO: 248252 - DNA, 20 bp, Artificial Sequence
  chemically synthesized
gccaccccaaccaggaatgt

SEQ ID NO: 248253 - DNA, 20 bp, Artificial Sequence
  chemically synthesized
tgatggttgcctgacattcc

SEQ ID NO: 248254 - DNA, 20 bp, Artificial Sequence
  chemically synthesized
ccaccccaaccaggaatgtc

SEQ ID NO: 248255 - DNA, 20 bp, Artificial Sequence
  chemically synthesized
aggaatgtcaggcaaccatc

SEQ ID NO: 248256 - DNA, 20 bp, Artificial Sequence
  chemically synthesized
cctgactgaccatcacttga

SEQ ID NO: 248257 - DNA, 20 bp, Artificial Sequence
  chemically synthesized
gtcaggcaaccatcaagtga

SEQ ID NO: 248258 - DNA, 20 bp, Artificial Sequence
  chemically synthesized
ggcaaccatcaagtgatggt

SEQ ID NO: 248259 - DNA, 20 bp, Artificial Sequence
  chemically synthesized
accatcaagtgatggtcagt

SEQ ID NO: 248260 - DNA, 20 bp, Artificial Sequence
  chemically synthesized
ccatcaagtgatggtcagtc

SEQ ID NO: 248261 - DNA, 20 bp, Artificial Sequence
  chemically synthesized
tcaagtgatggtcagtcagg

SEQ ID NO: 248262 - DNA, 20 bp, Artificial Sequence
  chemically synthesized
caattattattttaaagaca

SEQ ID NO: 248263 - DNA, 20 bp, Artificial Sequence
  chemically synthesized
tgtgaccaattattatttta

SEQ ID NO: 248264 - DNA, 20 bp, Artificial Sequence
  chemically synthesized
tgtgtctttaaaataataat

SEQ ID NO: 248265 - DNA, 20 bp, Artificial Sequence
  chemically synthesized
tttaaaataataattggtca

SEQ ID NO: 248266 - DNA, 20 bp, Artificial Sequence
  chemically synthesized
taattggtcacagccaatac

SEQ ID NO: 248267 - DNA, 20 bp, Artificial Sequence
  chemically synthesized
aattggtcacagccaatacc

SEQ ID NO: 248268 - DNA, 20 bp, Artificial Sequence
  chemically synthesized
attggtcacagccaatacca

SEQ ID NO: 248269 - DNA, 20 bp, Artificial Sequence
  chemically synthesized
agactgcctttccctggtat

SEQ ID NO: 248270 - DNA, 20 bp, Artificial Sequence
  chemically synthesized
gtcacagccaataccaggga

SEQ ID NO: 248271 - DNA, 20 bp, Artificial Sequence
  chemically synthesized
tcacagccaataccagggaa

SEQ ID NO: 248272 - DNA, 20 bp, Artificial Sequence
  chemically synthesized
attgggagactgcctttccc

SEQ ID NO: 248273 - DNA, 20 bp, Artificial Sequence
  chemically synthesized
cagccaataccagggaaagg

SEQ ID NO: 248274 - DNA, 20 bp, Artificial Sequence
  chemically synthesized
agggaaaggcagtctcccaa

SEQ ID NO: 248275 - DNA, 20 bp, Artificial Sequence
  chemically synthesized
caggtgtttttatctattgg

SEQ ID NO: 248276 - DNA, 20 bp, Artificial Sequence
  chemically synthesized
ttcaggtgtttttatctatt

SEQ ID NO: 248277 - DNA, 20 bp, Artificial Sequence
  chemically synthesized
tttcaggtgtttttatctat

SEQ ID NO: 248278 - DNA, 20 bp, Artificial Sequence
  chemically synthesized
tagataaaaacacctgaaat

SEQ ID NO: 248279 - DNA, 20 bp, Artificial Sequence
  chemically synthesized
agctgctgatcaccaatttc

SEQ ID NO: 248280 - DNA, 20 bp, Artificial Sequence
  chemically synthesized
aagctgctgatcaccaattt

SEQ ID NO: 248281 - DNA, 20 bp, Artificial Sequence
  chemically synthesized
aaacacctgaaattggtgat

SEQ ID NO: 248282 - DNA, 20 bp, Artificial Sequence
  chemically synthesized
cacctgaaattggtgatcag

SEQ ID NO: 248283 - DNA, 20 bp, Artificial Sequence
  chemically synthesized
gtgatcagcagcttcccgat

SEQ ID NO: 248284 - DNA, 20 bp, Artificial Sequence
  chemically synthesized
actcctgcgatcttatcggg

SEQ ID NO: 248285 - DNA, 20 bp, Artificial Sequence
  chemically synthesized
ccaactcctgcgatcttatc

SEQ ID NO: 248286 - DNA, 20 bp, Artificial Sequence
  chemically synthesized
cccaactcctgcgatcttat

SEQ ID NO: 248287 - DNA, 20 bp, Artificial Sequence
  chemically synthesized
gcagcttcccgataagatcg

SEQ ID NO: 248288 - DNA, 20 bp, Artificial Sequence
  chemically synthesized
cagcttcccgataagatcgc

SEQ ID NO: 248289 - DNA, 20 bp, Artificial Sequence
  chemically synthesized
gcttcccgataagatcgcag

SEQ ID NO: 248290 - DNA, 20 bp, Artificial Sequence
  chemically synthesized
cccgataagatcgcaggagt

SEQ ID NO: 248291 - DNA, 20 bp, Artificial Sequence
  chemically synthesized
ccgataagatcgcaggagtt

SEQ ID NO: 248292 - DNA, 20 bp, Artificial Sequence
  chemically synthesized
gatcgcaggagttgggcaaa

SEQ ID NO: 248293 - DNA, 20 bp, Artificial Sequence
  chemically synthesized
atcgcaggagttgggcaaat

SEQ ID NO: 248294 - DNA, 20 bp, Artificial Sequence
  chemically synthesized
gcctcttagtgcgcacgcgg

SEQ ID NO: 248295 - DNA, 20 bp, Artificial Sequence
  chemically synthesized
ttgcctcttagtgcgcacgc

SEQ ID NO: 248296 - DNA, 20 bp, Artificial Sequence
  chemically synthesized
tttgcctcttagtgcgcacg

SEQ ID NO: 248297 - DNA, 20 bp, Artificial Sequence
  chemically synthesized
tgggctcccgcgtgcgcact

SEQ ID NO: 248298 - DNA, 20 bp, Artificial Sequence
  chemically synthesized
ggctcccgcgtgcgcactaa

SEQ ID NO: 248299 - DNA, 20 bp, Artificial Sequence
  chemically synthesized
gctcccgcgtgcgcactaag

SEQ ID NO: 248300 - DNA, 20 bp, Artificial Sequence
  chemically synthesized
cactatgacattttgcctct

SEQ ID NO: 248301 - DNA, 20 bp, Artificial Sequence
  chemically synthesized
cactaagaggcaaaatgtca

SEQ ID NO: 248302 - DNA, 20 bp, Artificial Sequence
  chemically synthesized
gcaaaatgtcatagtgtaac

SEQ ID NO: 248303 - DNA, 20 bp, Artificial Sequence
  chemically synthesized
tccagaggaaggtcgtatac

SEQ ID NO: 248304 - DNA, 20 bp, Artificial Sequence
  chemically synthesized
actggtatacgaccttcctc

SEQ ID NO: 248305 - DNA, 20 bp, Artificial Sequence
  chemically synthesized
agtcaagtgtttccagagga

SEQ ID NO: 248306 - DNA, 20 bp, Artificial Sequence
  chemically synthesized
cagtcaagtgtttccagagg

SEQ ID NO: 248307 - DNA, 20 bp, Artificial Sequence
  chemically synthesized
taccagtcaagtgtttccag

SEQ ID NO: 248308 - DNA, 20 bp, Artificial Sequence
  chemically synthesized
ttaccagtcaagtgtttcca

SEQ ID NO: 248309 - DNA, 20 bp, Artificial Sequence
  chemically synthesized
ccttaccagtcaagtgtttc

SEQ ID NO: 248310 - DNA, 20 bp, Artificial Sequence
  chemically synthesized
ttcctctggaaacacttgac

SEQ ID NO: 248311 - DNA, 20 bp, Artificial Sequence
  chemically synthesized
tctggaaacacttgactggt

SEQ ID NO: 248312 - DNA, 20 bp, Artificial Sequence
  chemically synthesized
gaggtgttcccttaccagtc

SEQ ID NO: 248313 - DNA, 20 bp, Artificial Sequence
  chemically synthesized
ctggaaacacttgactggta

SEQ ID NO: 248314 - DNA, 20 bp, Artificial Sequence
  chemically synthesized
tggaaacacttgactggtaa

SEQ ID NO: 248315 - DNA, 20 bp, Artificial Sequence
  chemically synthesized
ttcaagaggtgttcccttac

SEQ ID NO: 248316 - DNA, 20 bp, Artificial Sequence
  chemically synthesized
ttactggagttgtattcaag

SEQ ID NO: 248317 - DNA, 20 bp, Artificial Sequence
  chemically synthesized
tttactggagttgtattcaa

SEQ ID NO: 248318 - DNA, 20 bp, Artificial Sequence
  chemically synthesized
tatttactggagttgtattc

SEQ ID NO: 248319 - DNA, 20 bp, Artificial Sequence
  chemically synthesized
acacctcttgaatacaactc

SEQ ID NO: 248320 - DNA, 20 bp, Artificial Sequence
  chemically synthesized
catgcacggtgtatttactg

SEQ ID NO: 248321 - DNA, 20 bp, Artificial Sequence
  chemically synthesized
agcatgcacggtgtatttac

SEQ ID NO: 248322 - DNA, 20 bp, Artificial Sequence
  chemically synthesized
acttgggaggggagcatgca

SEQ ID NO: 248323 - DNA, 20 bp, Artificial Sequence
  chemically synthesized
accgtgcatgctcccctccc

SEQ ID NO: 248324 - DNA, 20 bp, Artificial Sequence
  chemically synthesized
tctgctgacacttgggaggg

SEQ ID NO: 248325 - DNA, 20 bp, Artificial Sequence
  chemically synthesized
ggtctgctgacacttgggag

SEQ ID NO: 248326 - DNA, 20 bp, Artificial Sequence
  chemically synthesized
tggtctgctgacacttggga

SEQ ID NO: 248327 - DNA, 20 bp, Artificial Sequence
  chemically synthesized
gtggtctgctgacacttggg

SEQ ID NO: 248328 - DNA, 20 bp, Artificial Sequence
  chemically synthesized
agtggtctgctgacacttgg

SEQ ID NO: 248329 - DNA, 20 bp, Artificial Sequence
  chemically synthesized
catgctcccctcccaagtgt

SEQ ID NO: 248330 - DNA, 20 bp, Artificial Sequence
  chemically synthesized
acagtggtctgctgacactt

SEQ ID NO: 248331 - DNA, 20 bp, Artificial Sequence
  chemically synthesized
cacagtggtctgctgacact

SEQ ID NO: 248332 - DNA, 20 bp, Artificial Sequence
  chemically synthesized
gctcccctcccaagtgtcag

SEQ ID NO: 248333 - DNA, 20 bp, Artificial Sequence
  chemically synthesized
ggggctatctgcatgcacag

SEQ ID NO: 248334 - DNA, 20 bp, Artificial Sequence
  chemically synthesized
tcagcagaccactgtgcatg

SEQ ID NO: 248335 - DNA, 20 bp, Artificial Sequence
  chemically synthesized
tagggggctatctgcatgca

SEQ ID NO: 248336 - DNA, 20 bp, Artificial Sequence
  chemically synthesized
cagaccactgtgcatgcaga

SEQ ID NO: 248337 - DNA, 20 bp, Artificial Sequence
  chemically synthesized
aattcttcccttggggtagg

SEQ ID NO: 248338 - DNA, 20 bp, Artificial Sequence
  chemically synthesized
tgcagatagccccctacccc

SEQ ID NO: 248339 - DNA, 20 bp, Artificial Sequence
  chemically synthesized
caattcttcccttggggtag

SEQ ID NO: 248340 - DNA, 20 bp, Artificial Sequence
  chemically synthesized
gcagatagccccctacccca

SEQ ID NO: 248341 - DNA, 20 bp, Artificial Sequence
  chemically synthesized
ccaattcttcccttggggta

SEQ ID NO: 248342 - DNA, 20 bp, Artificial Sequence
  chemically synthesized
cagatagccccctaccccaa

SEQ ID NO: 248343 - DNA, 20 bp, Artificial Sequence
  chemically synthesized
cccaattcttcccttggggt

SEQ ID NO: 248344 - DNA, 20 bp, Artificial Sequence
  chemically synthesized
ccccaattcttcccttgggg

SEQ ID NO: 248345 - DNA, 20 bp, Artificial Sequence
  chemically synthesized
atagccccctaccccaaggg

SEQ ID NO: 248346 - DNA, 20 bp, Artificial Sequence
  chemically synthesized
tctccccaattcttcccttg

SEQ ID NO: 248347 - DNA, 20 bp, Artificial Sequence
  chemically synthesized
ttctccccaattcttccctt

SEQ ID NO: 248348 - DNA, 20 bp, Artificial Sequence
  chemically synthesized
cttctccccaattcttccct

SEQ ID NO: 248349 - DNA, 20 bp, Artificial Sequence
  chemically synthesized
ccctaccccaagggaagaat

SEQ ID NO: 248350 - DNA, 20 bp, Artificial Sequence
  chemically synthesized
cctaccccaagggaagaatt

SEQ ID NO: 248351 - DNA, 20 bp, Artificial Sequence
  chemically synthesized
ctaccccaagggaagaattg

SEQ ID NO: 248352 - DNA, 20 bp, Artificial Sequence
  chemically synthesized
accccaagggaagaattggg

SEQ ID NO: 248353 - DNA, 20 bp, Artificial Sequence
  chemically synthesized
ccaagggaagaattggggag

SEQ ID NO: 248354 - DNA, 20 bp, Artificial Sequence
  chemically synthesized
caagggaagaattggggaga

SEQ ID NO: 248355 - DNA, 20 bp, Artificial Sequence
  chemically synthesized
gaattggggagaaggtatat

SEQ ID NO: 248356 - DNA, 20 bp, Artificial Sequence
  chemically synthesized
ggagaaggtatataagacca

SEQ ID NO: 248357 - DNA, 20 bp, Artificial Sequence
  chemically synthesized
gaaggtatataagaccatgg

SEQ ID NO: 248358 - DNA, 20 bp, Artificial Sequence
  chemically synthesized
tgtattttggcatacttcca

SEQ ID NO: 248359 - DNA, 20 bp, Artificial Sequence
  chemically synthesized
tgatttatggttttgtattt

SEQ ID NO: 248360 - DNA, 20 bp, Artificial Sequence
  chemically synthesized
aaatacaaaaccataaatca

SEQ ID NO: 248361 - DNA, 20 bp, Artificial Sequence
  chemically synthesized
cctgtttgaactttgattta

SEQ ID NO: 248362 - DNA, 20 bp, Artificial Sequence
  chemically synthesized
accataaatcaaagttcaaa

SEQ ID NO: 248363 - DNA, 20 bp, Artificial Sequence
  chemically synthesized
ccataaatcaaagttcaaac

SEQ ID NO: 248364 - DNA, 20 bp, Artificial Sequence
  chemically synthesized
agtgggcgacttgagatatt

SEQ ID NO: 248365 - DNA, 20 bp, Artificial Sequence
  chemically synthesized
aacaggacacttaatatctc

SEQ ID NO: 248366 - DNA, 20 bp, Artificial Sequence
  chemically synthesized
gggggccaagtgggcgactt

SEQ ID NO: 248367 - DNA, 20 bp, Artificial Sequence
  chemically synthesized
aatatctcaagtcgcccact

SEQ ID NO: 248368 - DNA, 20 bp, Artificial Sequence
  chemically synthesized
catctggaagggggccaagt

SEQ ID NO: 248369 - DNA, 20 bp, Artificial Sequence
  chemically synthesized
acatctggaagggggccaag

SEQ ID NO: 248370 - DNA, 20 bp, Artificial Sequence
  chemically synthesized
agtacatctggaagggggcc

SEQ ID NO: 248371 - DNA, 20 bp, Artificial Sequence
  chemically synthesized
tcgcccacttggcccccttc

SEQ ID NO: 248372 - DNA, 20 bp, Artificial Sequence
  chemically synthesized
aataaagtacatctggaagg

SEQ ID NO: 248373 - DNA, 20 bp, Artificial Sequence
  chemically synthesized
aaataaagtacatctggaag

SEQ ID NO: 248374 - DNA, 20 bp, Artificial Sequence
  chemically synthesized
gaaataaagtacatctggaa

SEQ ID NO: 248375 - DNA, 20 bp, Artificial Sequence
  chemically synthesized
ggaaataaagtacatctgga

SEQ ID NO: 248376 - DNA, 20 bp, Artificial Sequence
  chemically synthesized
aggaaataaagtacatctgg

SEQ ID NO: 248377 - DNA, 20 bp, Artificial Sequence
  chemically synthesized
gaaaggaaataaagtacatc

SEQ ID NO: 248378 - DNA, 20 bp, Artificial Sequence
  chemically synthesized
agcagaaatgaaaggaaata

SEQ ID NO: 248379 - DNA, 20 bp, Artificial Sequence
  chemically synthesized
aactttagagcagaaatgaa

SEQ ID NO: 248380 - DNA, 20 bp, Artificial Sequence
  chemically synthesized
aaactttagagcagaaatga

SEQ ID NO: 248381 - DNA, 20 bp, Artificial Sequence
  chemically synthesized
ttcctttcatttctgctcta

SEQ ID NO: 248382 - DNA, 20 bp, Artificial Sequence
  chemically synthesized
tttatttaaaaactttagag

SEQ ID NO: 248383 - DNA, 20 bp, Artificial Sequence
  chemically synthesized
aagtttatttaaaaacttta

SEQ ID NO: 248384 - DNA, 20 bp, Artificial Sequence
  chemically synthesized
gaaagtttatttaaaaactt

SEQ ID NO: 248385 - DNA, 20 bp, Artificial Sequence
  chemically synthesized
aagtgttagagcaggaatga

SEQ ID NO: 248386 - DNA, 20 bp, Artificial Sequence
  chemically synthesized
actgaggcaagtgttagagc

SEQ ID NO: 248387 - DNA, 20 bp, Artificial Sequence
  chemically synthesized
gactgaggcaagtgttagag

SEQ ID NO: 248388 - DNA, 20 bp, Artificial Sequence
  chemically synthesized
agagactgaggcaagtgtta

SEQ ID NO: 248389 - DNA, 20 bp, Artificial Sequence
  chemically synthesized
gaagagactgaggcaagtgt

SEQ ID NO: 248390 - DNA, 20 bp, Artificial Sequence
  chemically synthesized
tcctgctctaacacttgcct

SEQ ID NO: 248391 - DNA, 20 bp, Artificial Sequence
  chemically synthesized
gcagaagaagagactgaggc

SEQ ID NO: 248392 - DNA, 20 bp, Artificial Sequence
  chemically synthesized
taaggcagaagaagagactg

SEQ ID NO: 248393 - DNA, 20 bp, Artificial Sequence
  chemically synthesized
ataaggcagaagaagagact

SEQ ID NO: 248394 - DNA, 20 bp, Artificial Sequence
  chemically synthesized
ggaggcataaggcagaagaa

SEQ ID NO: 248395 - DNA, 20 bp, Artificial Sequence
  chemically synthesized
aaggaggcataaggcagaag

SEQ ID NO: 248396 - DNA, 20 bp, Artificial Sequence
  chemically synthesized
accaaggaggcataaggcag

SEQ ID NO: 248397 - DNA, 20 bp, Artificial Sequence
  chemically synthesized
tcgaccaaggaggcataagg

SEQ ID NO: 248398 - DNA, 20 bp, Artificial Sequence
  chemically synthesized
aattcgaccaaggaggcata

SEQ ID NO: 248399 - DNA, 20 bp, Artificial Sequence
  chemically synthesized
gaattcgaccaaggaggcat

SEQ ID NO: 248400 - DNA, 20 bp, Artificial Sequence
  chemically synthesized
tcttctgccttatgcctcct

SEQ ID NO: 248401 - DNA, 20 bp, Artificial Sequence
  chemically synthesized
aagaaagaattcgaccaagg

SEQ ID NO: 248402 - DNA, 20 bp, Artificial Sequence
  chemically synthesized
gaagaaagaattcgaccaag

SEQ ID NO: 248403 - DNA, 20 bp, Artificial Sequence
  chemically synthesized
cagaagaaagaattcgacca

SEQ ID NO: 248404 - DNA, 20 bp, Artificial Sequence
  chemically synthesized
tcagaagaaagaattcgacc

SEQ ID NO: 248405 - DNA, 20 bp, Artificial Sequence
  chemically synthesized
ttggtcgaattctttcttct

SEQ ID NO: 248406 - DNA, 20 bp, Artificial Sequence
  chemically synthesized
tggtcgaattctttcttctg

SEQ ID NO: 248407 - DNA, 20 bp, Artificial Sequence
  chemically synthesized
attcatgcctcctcagaaga

SEQ ID NO: 248408 - DNA, 20 bp, Artificial Sequence
  chemically synthesized
gtcgaattctttcttctgag

SEQ ID NO: 248409 - DNA, 20 bp, Artificial Sequence
  chemically synthesized
tcgaattctttcttctgagg

SEQ ID NO: 248410 - DNA, 20 bp, Artificial Sequence
  chemically synthesized
cttaattcatgcctcctcag

SEQ ID NO: 248411 - DNA, 20 bp, Artificial Sequence
  chemically synthesized
aaccttaattcatgcctcct

SEQ ID NO: 248412 - DNA, 20 bp, Artificial Sequence
  chemically synthesized
cttctgaggaggcatgaatt

SEQ ID NO: 248413 - DNA, 20 bp, Artificial Sequence
  chemically synthesized
ttctgaggaggcatgaatta

SEQ ID NO: 248414 - DNA, 20 bp, Artificial Sequence
  chemically synthesized
ggcatgaattaaggttgctg

SEQ ID NO: 248415 - DNA, 20 bp, Artificial Sequence
  chemically synthesized
agtgaatccatacgggtctt

SEQ ID NO: 248416 - DNA, 20 bp, Artificial Sequence
  chemically synthesized
aaggttgctgaagacccgta

SEQ ID NO: 248417 - DNA, 20 bp, Artificial Sequence
  chemically synthesized
tactggcagtgaatccatac

SEQ ID NO: 248418 - DNA, 20 bp, Artificial Sequence
  chemically synthesized
ttactggcagtgaatccata

SEQ ID NO: 248419 - DNA, 20 bp, Artificial Sequence
  chemically synthesized
gacccgtatggattcactgc

SEQ ID NO: 248420 - DNA, 20 bp, Artificial Sequence
  chemically synthesized
tatggattcactgccagtaa

SEQ ID NO: 248421 - DNA, 20 bp, Artificial Sequence
  chemically synthesized
ctctctcctcctgttactgg

SEQ ID NO: 248422 - DNA, 20 bp, Artificial Sequence
  chemically synthesized
atggattcactgccagtaac

SEQ ID NO: 248423 - DNA, 20 bp, Artificial Sequence
  chemically synthesized
ggattcactgccagtaacag

SEQ ID NO: 248424 - DNA, 20 bp, Artificial Sequence
  chemically synthesized
actctctctcctcctgttac

SEQ ID NO: 248425 - DNA, 20 bp, Artificial Sequence
  chemically synthesized
gattcactgccagtaacagg

SEQ ID NO: 248426 - DNA, 20 bp, Artificial Sequence
  chemically synthesized
ttcactgccagtaacaggag

SEQ ID NO: 248427 - DNA, 20 bp, Artificial Sequence
  chemically synthesized
cactgccagtaacaggagga

SEQ ID NO: 248428 - DNA, 20 bp, Artificial Sequence
  chemically synthesized
ctgccagtaacaggaggaga

SEQ ID NO: 248429 - DNA, 20 bp, Artificial Sequence
  chemically synthesized
gccagtaacaggaggagaga

SEQ ID NO: 248430 - DNA, 20 bp, Artificial Sequence
  chemically synthesized
attattatataccgactata

SEQ ID NO: 248431 - DNA, 20 bp, Artificial Sequence
  chemically synthesized
aaggtcacttactatatagt

SEQ ID NO: 248432 - DNA, 20 bp, Artificial Sequence
  chemically synthesized
ttatataccgactatatagt

SEQ ID NO: 248433 - DNA, 20 bp, Artificial Sequence
  chemically synthesized
gagtaaggtcacttactata

SEQ ID NO: 248434 - DNA, 20 bp, Artificial Sequence
  chemically synthesized
atggtgagccggaatgagta

SEQ ID NO: 248435 - DNA, 20 bp, Artificial Sequence
  chemically synthesized
gatggtgagccggaatgagt

SEQ ID NO: 248436 - DNA, 20 bp, Artificial Sequence
  chemically synthesized
gtaagtgaccttactcattc

SEQ ID NO: 248437 - DNA, 20 bp, Artificial Sequence
  chemically synthesized
ttgtgatggtgagccggaat

SEQ ID NO: 248438 - DNA, 20 bp, Artificial Sequence
  chemically synthesized
ctcatattgtgatggtgagc

SEQ ID NO: 248439 - DNA, 20 bp, Artificial Sequence
  chemically synthesized
aatactcatattgtgatggt

SEQ ID NO: 248440 - DNA, 20 bp, Artificial Sequence
  chemically synthesized
ccctaatactcatattgtga

SEQ ID NO: 248441 - DNA, 20 bp, Artificial Sequence
  chemically synthesized
ccggctcaccatcacaatat

SEQ ID NO: 248442 - DNA, 20 bp, Artificial Sequence
  chemically synthesized
caccatcacaatatgagtat

SEQ ID NO: 248443 - DNA, 20 bp, Artificial Sequence
  chemically synthesized
accatcacaatatgagtatt

SEQ ID NO: 248444 - DNA, 20 bp, Artificial Sequence
  chemically synthesized
ccatcacaatatgagtatta

SEQ ID NO: 248445 - DNA, 20 bp, Artificial Sequence
  chemically synthesized
aatatgagtattagggttca

SEQ ID NO: 248446 - DNA, 20 bp, Artificial Sequence
  chemically synthesized
atatgagtattagggttcaa

SEQ ID NO: 248447 - DNA, 20 bp, Artificial Sequence
  chemically synthesized
agtattagggttcaaaggac

SEQ ID NO: 248448 - DNA, 20 bp, Artificial Sequence
  chemically synthesized
aagagatttacatttcataa

SEQ ID NO: 248449 - DNA, 20 bp, Artificial Sequence
  chemically synthesized
attttaattctttatattaa

SEQ ID NO: 248450 - DNA, 20 bp, Artificial Sequence
  chemically synthesized
aatgtaaatctcttaatata

SEQ ID NO: 248451 - DNA, 20 bp, Artificial Sequence
  chemically synthesized
ttattttaattctttatatt

SEQ ID NO: 248452 - DNA, 20 bp, Artificial Sequence
  chemically synthesized
aaagaattaaaataatatcc

SEQ ID NO: 248453 - DNA, 20 bp, Artificial Sequence
  chemically synthesized
ttaaaataatatccaagtat

SEQ ID NO: 248454 - DNA, 20 bp, Artificial Sequence
  chemically synthesized
tttatttagaatctaatact

SEQ ID NO: 248455 - DNA, 20 bp, Artificial Sequence
  chemically synthesized
tagttttaaaagtatttatt

SEQ ID NO: 248456 - DNA, 20 bp, Artificial Sequence
  chemically synthesized
taaataaatacttttaaaac

SEQ ID NO: 248457 - DNA, 20 bp, Artificial Sequence
  chemically synthesized
cttgtaataactagttttaa

SEQ ID NO: 248458 - DNA, 20 bp, Artificial Sequence
  chemically synthesized
agatacagtcttgtaataac

SEQ ID NO: 248459 - DNA, 20 bp, Artificial Sequence
  chemically synthesized
cttttaaaactagttattac

SEQ ID NO: 248460 - DNA, 20 bp, Artificial Sequence
  chemically synthesized
aacctgtttgtgattagata

SEQ ID NO: 248461 - DNA, 20 bp, Artificial Sequence
  chemically synthesized
aataaaaacctgtttgtgat

SEQ ID NO: 248462 - DNA, 20 bp, Artificial Sequence
  chemically synthesized
agactgtatctaatcacaaa

SEQ ID NO: 248463 - DNA, 20 bp, Artificial Sequence
  chemically synthesized
gactgtatctaatcacaaac

SEQ ID NO: 248464 - DNA, 20 bp, Artificial Sequence
  chemically synthesized
tttcagcagcttgagatagt

SEQ ID NO: 248465 - DNA, 20 bp, Artificial Sequence
  chemically synthesized
tttgtttttctcactatctc

SEQ ID NO: 248466 - DNA, 20 bp, Artificial Sequence
  chemically synthesized
tttgtttcagcagcttgaga

SEQ ID NO: 248467 - DNA, 20 bp, Artificial Sequence
  chemically synthesized
taaatttgtttcagcagctt

SEQ ID NO: 248468 - DNA, 20 bp, Artificial Sequence
  chemically synthesized
ctccattaaatttgtttcag

SEQ ID NO: 248469 - DNA, 20 bp, Artificial Sequence
  chemically synthesized
ggactccattaaatttgttt

SEQ ID NO: 248470 - DNA, 20 bp, Artificial Sequence
  chemically synthesized
agctgctgaaacaaatttaa

SEQ ID NO: 248471 - DNA, 20 bp, Artificial Sequence
  chemically synthesized
ctgctgaaacaaatttaatg

SEQ ID NO: 248472 - DNA, 20 bp, Artificial Sequence
  chemically synthesized
cagaattcagtgatgaggga

SEQ ID NO: 248473 - DNA, 20 bp, Artificial Sequence
  chemically synthesized
acagaattcagtgatgaggg

SEQ ID NO: 248474 - DNA, 20 bp, Artificial Sequence
  chemically synthesized
tctacagaattcagtgatga

SEQ ID NO: 248475 - DNA, 20 bp, Artificial Sequence
  chemically synthesized
atctacagaattcagtgatg

SEQ ID NO: 248476 - DNA, 20 bp, Artificial Sequence
  chemically synthesized
aatctacagaattcagtgat

SEQ ID NO: 248477 - DNA, 20 bp, Artificial Sequence
  chemically synthesized
tccctcatcactgaattctg

SEQ ID NO: 248478 - DNA, 20 bp, Artificial Sequence
  chemically synthesized
aaagaaaaatctacagaatt

SEQ ID NO: 248479 - DNA, 20 bp, Artificial Sequence
  chemically synthesized
acaactgaaagaaaaatcta

SEQ ID NO: 248480 - DNA, 20 bp, Artificial Sequence
  chemically synthesized
aattctgtagatttttcttt

SEQ ID NO: 248481 - DNA, 20 bp, Artificial Sequence
  chemically synthesized
cattattttcttacaactga

SEQ ID NO: 248482 - DNA, 20 bp, Artificial Sequence
  chemically synthesized
tagatttttctttcagttgt

SEQ ID NO: 248483 - DNA, 20 bp, Artificial Sequence
  chemically synthesized
agccaacatcttcaaaagga

SEQ ID NO: 248484 - DNA, 20 bp, Artificial Sequence
  chemically synthesized
aaaataatgctttccttttg

SEQ ID NO: 248485 - DNA, 20 bp, Artificial Sequence
  chemically synthesized
tccaagccaacatcttcaaa

SEQ ID NO: 248486 - DNA, 20 bp, Artificial Sequence
  chemically synthesized
atccaagccaacatcttcaa

SEQ ID NO: 248487 - DNA, 20 bp, Artificial Sequence
  chemically synthesized
tgctttccttttgaagatgt

SEQ ID NO: 248488 - DNA, 20 bp, Artificial Sequence
  chemically synthesized
tccttttgaagatgttggct

SEQ ID NO: 248489 - DNA, 20 bp, Artificial Sequence
  chemically synthesized
ttgaagatgttggcttggat

SEQ ID NO: 248490 - DNA, 20 bp, Artificial Sequence
  chemically synthesized
ataaagcatttttctaatcc

SEQ ID NO: 248491 - DNA, 20 bp, Artificial Sequence
  chemically synthesized
ttagaaaaatgctttattat

SEQ ID NO: 248492 - DNA, 20 bp, Artificial Sequence
  chemically synthesized
gctttgcaatactcataata

SEQ ID NO: 248493 - DNA, 20 bp, Artificial Sequence
  chemically synthesized
gctttattatgagtattgca

SEQ ID NO: 248494 - DNA, 20 bp, Artificial Sequence
  chemically synthesized
gtctagctgtggtaaataag

SEQ ID NO: 248495 - DNA, 20 bp, Artificial Sequence
  chemically synthesized
tctgtctagctgtggtaaat

SEQ ID NO: 248496 - DNA, 20 bp, Artificial Sequence
  chemically synthesized
gcaaagctacttatttacca

SEQ ID NO: 248497 - DNA, 20 bp, Artificial Sequence
  chemically synthesized
agctacttatttaccacagc

SEQ ID NO: 248498 - DNA, 20 bp, Artificial Sequence
  chemically synthesized
aaagagtctctgtctagctg

SEQ ID NO: 248499 - DNA, 20 bp, Artificial Sequence
  chemically synthesized
acttatttaccacagctaga

SEQ ID NO: 248500 - DNA, 20 bp, Artificial Sequence
  chemically synthesized
ttatttaccacagctagaca

SEQ ID NO: 248501 - DNA, 20 bp, Artificial Sequence
  chemically synthesized
agtaagaaagagtctctgtc

SEQ ID NO: 248502 - DNA, 20 bp, Artificial Sequence
  chemically synthesized
ctgcatgacaaagtaagaaa

SEQ ID NO: 248503 - DNA, 20 bp, Artificial Sequence
  chemically synthesized
agctgcatgacaaagtaaga

SEQ ID NO: 248504 - DNA, 20 bp, Artificial Sequence
  chemically synthesized
aagcagctgcatgacaaagt

SEQ ID NO: 248505 - DNA, 20 bp, Artificial Sequence
  chemically synthesized
ctctttcttactttgtcatg

SEQ ID NO: 248506 - DNA, 20 bp, Artificial Sequence
  chemically synthesized
aaacaagcagctgcatgaca

SEQ ID NO: 248507 - DNA, 20 bp, Artificial Sequence
  chemically synthesized
aaaatttgtttaaaaacaag

SEQ ID NO: 248508 - DNA, 20 bp, Artificial Sequence
  chemically synthesized
ggcaaaatttgtttaaaaac

SEQ ID NO: 248509 - DNA, 20 bp, Artificial Sequence
  chemically synthesized
gtttttaaacaaattttgcc

SEQ ID NO: 248510 - DNA, 20 bp, Artificial Sequence
  chemically synthesized
ttttaaacaaattttgccaa

SEQ ID NO: 248511 - DNA, 20 bp, Artificial Sequence
  chemically synthesized
accatctggtttatgtctct

SEQ ID NO: 248512 - DNA, 20 bp, Artificial Sequence
  chemically synthesized
ttttgccaagagacataaac

SEQ ID NO: 248513 - DNA, 20 bp, Artificial Sequence
  chemically synthesized
gccaagagacataaaccaga

SEQ ID NO: 248514 - DNA, 20 bp, Artificial Sequence
  chemically synthesized
tacccttgaagaagaccatc

SEQ ID NO: 248515 - DNA, 20 bp, Artificial Sequence
  chemically synthesized
taaaccagatggtcttcttc

SEQ ID NO: 248516 - DNA, 20 bp, Artificial Sequence
  chemically synthesized
aaaccagatggtcttcttca

SEQ ID NO: 248517 - DNA, 20 bp, Artificial Sequence
  chemically synthesized
aaccagatggtcttcttcaa

SEQ ID NO: 248518 - DNA, 20 bp, Artificial Sequence
  chemically synthesized
ctcacaggatacccttgaag

SEQ ID NO: 248519 - DNA, 20 bp, Artificial Sequence
  chemically synthesized
cagctcacaggatacccttg

SEQ ID NO: 248520 - DNA, 20 bp, Artificial Sequence
  chemically synthesized
cttcttcaagggtatcctgt

SEQ ID NO: 248521 - DNA, 20 bp, Artificial Sequence
  chemically synthesized
agctgactatcacagctcac

SEQ ID NO: 248522 - DNA, 20 bp, Artificial Sequence
  chemically synthesized
aagctgactatcacagctca

SEQ ID NO: 248523 - DNA, 20 bp, Artificial Sequence
  chemically synthesized
gggtatcctgtgagctgtga

SEQ ID NO: 248524 - DNA, 20 bp, Artificial Sequence
  chemically synthesized
atcctgtgagctgtgatagt

SEQ ID NO: 248525 - DNA, 20 bp, Artificial Sequence
  chemically synthesized
ctaccataagctgactatca

SEQ ID NO: 248526 - DNA, 20 bp, Artificial Sequence
  chemically synthesized
gagctgtgatagtcagctta

SEQ ID NO: 248527 - DNA, 20 bp, Artificial Sequence
  chemically synthesized
ctgtgatagtcagcttatgg

SEQ ID NO: 248528 - DNA, 20 bp, Artificial Sequence
  chemically synthesized
ctgctgctcaaaactaccat

SEQ ID NO: 248529 - DNA, 20 bp, Artificial Sequence
  chemically synthesized
agtcagcttatggtagtttt

SEQ ID NO: 248530 - DNA, 20 bp, Artificial Sequence
  chemically synthesized
cagcttatggtagttttgag

SEQ ID NO: 248531 - DNA, 20 bp, Artificial Sequence
  chemically synthesized
cttatggtagttttgagcag

SEQ ID NO: 248532 - DNA, 20 bp, Artificial Sequence
  chemically synthesized
tggtagttttgagcagcaga

SEQ ID NO: 248533 - DNA, 20 bp, Artificial Sequence
  chemically synthesized
agttttgagcagcagacagc

SEQ ID NO: 248534 - DNA, 20 bp, Artificial Sequence
  chemically synthesized
gttttgagcagcagacagct

SEQ ID NO: 248535 - DNA, 20 bp, Artificial Sequence
  chemically synthesized
gagcagcagacagctgggta

SEQ ID NO: 248536 - DNA, 20 bp, Artificial Sequence
  chemically synthesized
gcatcatgactttccatacc

SEQ ID NO: 248537 - DNA, 20 bp, Artificial Sequence
  chemically synthesized
agcagacagctgggtatgga

SEQ ID NO: 248538 - DNA, 20 bp, Artificial Sequence
  chemically synthesized
tggaaagtcatgatgctatt

SEQ ID NO: 248539 - DNA, 20 bp, Artificial Sequence
  chemically synthesized
ttggtagttggatttccaaa

SEQ ID NO: 248540 - DNA, 20 bp, Artificial Sequence
  chemically synthesized
tatttggaaatccaactacc

SEQ ID NO: 248541 - DNA, 20 bp, Artificial Sequence
  chemically synthesized
gcttcagcacacttggtagt

SEQ ID NO: 248542 - DNA, 20 bp, Artificial Sequence
  chemically synthesized
ttgtgcttcagcacacttgg

SEQ ID NO: 248543 - DNA, 20 bp, Artificial Sequence
  chemically synthesized
tccttgtgcttcagcacact

SEQ ID NO: 248544 - DNA, 20 bp, Artificial Sequence
  chemically synthesized
tccaactaccaagtgtgctg

SEQ ID NO: 248545 - DNA, 20 bp, Artificial Sequence
  chemically synthesized
taccaagtgtgctgaagcac

SEQ ID NO: 248546 - DNA, 20 bp, Artificial Sequence
  chemically synthesized
accaagtgtgctgaagcaca

SEQ ID NO: 248547 - DNA, 20 bp, Artificial Sequence
  chemically synthesized
ttgagaatctccttgtgctt

SEQ ID NO: 248548 - DNA, 20 bp, Artificial Sequence
  chemically synthesized
caagtgtgctgaagcacaag

SEQ ID NO: 248549 - DNA, 20 bp, Artificial Sequence
  chemically synthesized
tgaagcacaaggagattctc

SEQ ID NO: 248550 - DNA, 20 bp, Artificial Sequence
  chemically synthesized
gcacaaggagattctcaagt

SEQ ID NO: 248551 - DNA, 20 bp, Artificial Sequence
  chemically synthesized
attttattatttactgactt

SEQ ID NO: 248552 - DNA, 20 bp, Artificial Sequence
  chemically synthesized
aataataaaattgtgactta

SEQ ID NO: 248553 - DNA, 20 bp, Artificial Sequence
  chemically synthesized
agaatactgaaacaaacttt

SEQ ID NO: 248554 - DNA, 20 bp, Artificial Sequence
  chemically synthesized
ttgtgacttaaagtttgttt

SEQ ID NO: 248555 - DNA, 20 bp, Artificial Sequence
  chemically synthesized
gtttcagtattctattttta

SEQ ID NO: 248556 - DNA, 20 bp, Artificial Sequence
  chemically synthesized
tttcagtattctatttttac

SEQ ID NO: 248557 - DNA, 20 bp, Artificial Sequence
  chemically synthesized
gttaatgccccctgtaaaaa

SEQ ID NO: 248558 - DNA, 20 bp, Artificial Sequence
  chemically synthesized
ttcagtattctatttttaca

SEQ ID NO: 248559 - DNA, 20 bp, Artificial Sequence
  chemically synthesized
tcagtattctatttttacag

SEQ ID NO: 248560 - DNA, 20 bp, Artificial Sequence
  chemically synthesized
cagtattctatttttacagg

SEQ ID NO: 248561 - DNA, 20 bp, Artificial Sequence
  chemically synthesized
aagtaatattataaagcata

SEQ ID NO: 248562 - DNA, 20 bp, Artificial Sequence
  chemically synthesized
cccagaaaagtaatattata

SEQ ID NO: 248563 - DNA, 20 bp, Artificial Sequence
  chemically synthesized
gctttataatattacttttc

SEQ ID NO: 248564 - DNA, 20 bp, Artificial Sequence
  chemically synthesized
ctttataatattacttttct

SEQ ID NO: 248565 - DNA, 20 bp, Artificial Sequence
  chemically synthesized
tacttttattttacccagaa

SEQ ID NO: 248566 - DNA, 20 bp, Artificial Sequence
  chemically synthesized
tggggtacttttattttacc

SEQ ID NO: 248567 - DNA, 20 bp, Artificial Sequence
  chemically synthesized
tacttttctgggtaaaataa

SEQ ID NO: 248568 - DNA, 20 bp, Artificial Sequence
  chemically synthesized
ctttctaattcaatgtgttg

SEQ ID NO: 248569 - DNA, 20 bp, Artificial Sequence
  chemically synthesized
tctttctaattcaatgtgtt

SEQ ID NO: 248570 - DNA, 20 bp, Artificial Sequence
  chemically synthesized
ttctttctaattcaatgtgt

SEQ ID NO: 248571 - DNA, 20 bp, Artificial Sequence
  chemically synthesized
agtaccccaacacattgaat

SEQ ID NO: 248572 - DNA, 20 bp, Artificial Sequence
  chemically synthesized
ccccaacacattgaattaga

SEQ ID NO: 248573 - DNA, 20 bp, Artificial Sequence
  chemically synthesized
ttctgaatccattttttcac

SEQ ID NO: 248574 - DNA, 20 bp, Artificial Sequence
  chemically synthesized
aaagaaaacttgtgaaaaaa

SEQ ID NO: 248575 - DNA, 20 bp, Artificial Sequence
  chemically synthesized
aacttgtgaaaaaatggatt

SEQ ID NO: 248576 - DNA, 20 bp, Artificial Sequence
  chemically synthesized
tggattcagaatacctttcc

SEQ ID NO: 248577 - DNA, 20 bp, Artificial Sequence
  chemically synthesized
attcagaatacctttccaag

SEQ ID NO: 248578 - DNA, 20 bp, Artificial Sequence
  chemically synthesized
tttgttgatcccacttggaa

SEQ ID NO: 248579 - DNA, 20 bp, Artificial Sequence
  chemically synthesized
ttcagaatacctttccaagt

SEQ ID NO: 248580 - DNA, 20 bp, Artificial Sequence
  chemically synthesized
atttgttgatcccacttgga

SEQ ID NO: 248581 - DNA, 20 bp, Artificial Sequence
  chemically synthesized
tacaatttgttgatcccact

SEQ ID NO: 248582 - DNA, 20 bp, Artificial Sequence
  chemically synthesized
aagtgggatcaacaaattgt

SEQ ID NO: 248583 - DNA, 20 bp, Artificial Sequence
  chemically synthesized
gggatcaacaaattgtaagt

SEQ ID NO: 248584 - DNA, 20 bp, Artificial Sequence
  chemically synthesized
ggatcaacaaattgtaagtt

SEQ ID NO: 248585 - DNA, 20 bp, Artificial Sequence
  chemically synthesized
ttgtaagttgggctttctaa

SEQ ID NO: 248586 - DNA, 20 bp, Artificial Sequence
  chemically synthesized
gtaagttgggctttctaaca

SEQ ID NO: 248587 - DNA, 20 bp, Artificial Sequence
  chemically synthesized
acacagacaactctgttaga

SEQ ID NO: 248588 - DNA, 20 bp, Artificial Sequence
  chemically synthesized
taaaacacagacaactctgt

SEQ ID NO: 248589 - DNA, 20 bp, Artificial Sequence
  chemically synthesized
taaacatttttgataaaaca

SEQ ID NO: 248590 - DNA, 20 bp, Artificial Sequence
  chemically synthesized
attctagtagaattttatta

SEQ ID NO: 248591 - DNA, 20 bp, Artificial Sequence
  chemically synthesized
atactgtaataaaattctac

SEQ ID NO: 248592 - DNA, 20 bp, Artificial Sequence
  chemically synthesized
gtaataaaattctactagaa

SEQ ID NO: 248593 - DNA, 20 bp, Artificial Sequence
  chemically synthesized
gaaataccacaccattctag

SEQ ID NO: 248594 - DNA, 20 bp, Artificial Sequence
  chemically synthesized
cttgaaataccacaccattc

SEQ ID NO: 248595 - DNA, 20 bp, Artificial Sequence
  chemically synthesized
aaaattctactagaatggtg

SEQ ID NO: 248596 - DNA, 20 bp, Artificial Sequence
  chemically synthesized
ctagaatggtgtggtatttc

SEQ ID NO: 248597 - DNA, 20 bp, Artificial Sequence
  chemically synthesized
ggtgtggtatttcaagttgc

SEQ ID NO: 248598 - DNA, 20 bp, Artificial Sequence
  chemically synthesized
gtatttcaagttgcaagtct

SEQ ID NO: 248599 - DNA, 20 bp, Artificial Sequence
  chemically synthesized
cactactacaaaacagaact

SEQ ID NO: 248600 - DNA, 20 bp, Artificial Sequence
  chemically synthesized
caagtctcagttctgttttg

SEQ ID NO: 248601 - DNA, 20 bp, Artificial Sequence
  chemically synthesized
tgtataacactactacaaaa

SEQ ID NO: 248602 - DNA, 20 bp, Artificial Sequence
  chemically synthesized
gtctcagttctgttttgtag

SEQ ID NO: 248603 - DNA, 20 bp, Artificial Sequence
  chemically synthesized
tgaacccatttcaagagtgt

SEQ ID NO: 248604 - DNA, 20 bp, Artificial Sequence
  chemically synthesized
gtgaacccatttcaagagtg

SEQ ID NO: 248605 - DNA, 20 bp, Artificial Sequence
  chemically synthesized
atacacccacactcttgaaa

SEQ ID NO: 248606 - DNA, 20 bp, Artificial Sequence
  chemically synthesized
tacacccacactcttgaaat

SEQ ID NO: 248607 - DNA, 20 bp, Artificial Sequence
  chemically synthesized
agttagtgaacccatttcaa

SEQ ID NO: 248608 - DNA, 20 bp, Artificial Sequence
  chemically synthesized
gcagttagtgaacccatttc

SEQ ID NO: 248609 - DNA, 20 bp, Artificial Sequence
  chemically synthesized
aaatgggttcactaactgcc

SEQ ID NO: 248610 - DNA, 20 bp, Artificial Sequence
  chemically synthesized
agagaaatacacttggcagt

SEQ ID NO: 248611 - DNA, 20 bp, Artificial Sequence
  chemically synthesized
ggatagagaaatacacttgg

SEQ ID NO: 248612 - DNA, 20 bp, Artificial Sequence
  chemically synthesized
cagggatagagaaatacact

SEQ ID NO: 248613 - DNA, 20 bp, Artificial Sequence
  chemically synthesized
atatccaaagatcagggata

SEQ ID NO: 248614 - DNA, 20 bp, Artificial Sequence
  chemically synthesized
gcatatccaaagatcaggga

SEQ ID NO: 248615 - DNA, 20 bp, Artificial Sequence
  chemically synthesized
atttctctatccctgatctt

SEQ ID NO: 248616 - DNA, 20 bp, Artificial Sequence
  chemically synthesized
cgtggcatatccaaagatca

SEQ ID NO: 248617 - DNA, 20 bp, Artificial Sequence
  chemically synthesized
acgtggcatatccaaagatc

SEQ ID NO: 248618 - DNA, 20 bp, Artificial Sequence
  chemically synthesized
cacgtggcatatccaaagat

SEQ ID NO: 248619 - DNA, 20 bp, Artificial Sequence
  chemically synthesized
caagtcacgtggcatatcca

SEQ ID NO: 248620 - DNA, 20 bp, Artificial Sequence
  chemically synthesized
aattgtcaaagcaagtcacg

SEQ ID NO: 248621 - DNA, 20 bp, Artificial Sequence
  chemically synthesized
ccatagtcaattgtcaaagc

SEQ ID NO: 248622 - DNA, 20 bp, Artificial Sequence
  chemically synthesized
ccatccatagtcaattgtca

SEQ ID NO: 248623 - DNA, 20 bp, Artificial Sequence
  chemically synthesized
cttgctttgacaattgacta

SEQ ID NO: 248624 - DNA, 20 bp, Artificial Sequence
  chemically synthesized
ctttgacaattgactatgga

SEQ ID NO: 248625 - DNA, 20 bp, Artificial Sequence
  chemically synthesized
tgacaattgactatggatgg

SEQ ID NO: 248626 - DNA, 20 bp, Artificial Sequence
  chemically synthesized
agcgttctctcttccatcca

SEQ ID NO: 248627 - DNA, 20 bp, Artificial Sequence
  chemically synthesized
acaattgactatggatggaa

SEQ ID NO: 248628 - DNA, 20 bp, Artificial Sequence
  chemically synthesized
aattgactatggatggaaga

SEQ ID NO: 248629 - DNA, 20 bp, Artificial Sequence
  chemically synthesized
atggatggaagagagaacgc

SEQ ID NO: 248630 - DNA, 20 bp, Artificial Sequence
  chemically synthesized
ttaagacccagatttataac

SEQ ID NO: 248631 - DNA, 20 bp, Artificial Sequence
  chemically synthesized
gagaacgctagttataaatc

SEQ ID NO: 248632 - DNA, 20 bp, Artificial Sequence
  chemically synthesized
agaacgctagttataaatct

SEQ ID NO: 248633 - DNA, 20 bp, Artificial Sequence
  chemically synthesized
tagttataaatctgggtctt

SEQ ID NO: 248634 - DNA, 20 bp, Artificial Sequence
  chemically synthesized
acatgatggttcttaagacc

SEQ ID NO: 248635 - DNA, 20 bp, Artificial Sequence
  chemically synthesized
agaaacacatgatggttctt

SEQ ID NO: 248636 - DNA, 20 bp, Artificial Sequence
  chemically synthesized
gggtaagcagaaacacatga

SEQ ID NO: 248637 - DNA, 20 bp, Artificial Sequence
  chemically synthesized
aaagatctcagaagggtaag

SEQ ID NO: 248638 - DNA, 20 bp, Artificial Sequence
  chemically synthesized
tctaaagatctcagaagggt

SEQ ID NO: 248639 - DNA, 20 bp, Artificial Sequence
  chemically synthesized
gtgtttctgcttacccttct

SEQ ID NO: 248640 - DNA, 20 bp, Artificial Sequence
  chemically synthesized
gagttctaaagatctcagaa

SEQ ID NO: 248641 - DNA, 20 bp, Artificial Sequence
  chemically synthesized
tgagttctaaagatctcaga

SEQ ID NO: 248642 - DNA, 20 bp, Artificial Sequence
  chemically synthesized
ctgagttctaaagatctcag

SEQ ID NO: 248643 - DNA, 20 bp, Artificial Sequence
  chemically synthesized
gcttacccttctgagatctt

SEQ ID NO: 248644 - DNA, 20 bp, Artificial Sequence
  chemically synthesized
tggctgagttctaaagatct

SEQ ID NO: 248645 - DNA, 20 bp, Artificial Sequence
  chemically synthesized
cttctgagatctttagaact

SEQ ID NO: 248646 - DNA, 20 bp, Artificial Sequence
  chemically synthesized
tcctccatggctgagttcta

SEQ ID NO: 248647 - DNA, 20 bp, Artificial Sequence
  chemically synthesized
agatctttagaactcagcca

SEQ ID NO: 248648 - DNA, 20 bp, Artificial Sequence
  chemically synthesized
atctttagaactcagccatg

SEQ ID NO: 248649 - DNA, 20 bp, Artificial Sequence
  chemically synthesized
gggcacattcctccatggct

SEQ ID NO: 248650 - DNA, 20 bp, Artificial Sequence
  chemically synthesized
tctttagaactcagccatgg

SEQ ID NO: 248651 - DNA, 20 bp, Artificial Sequence
  chemically synthesized
atttggggcacattcctcca

SEQ ID NO: 248652 - DNA, 20 bp, Artificial Sequence
  chemically synthesized
ggaatggcagtagatatttg

SEQ ID NO: 248653 - DNA, 20 bp, Artificial Sequence
  chemically synthesized
tggaatggcagtagatattt

SEQ ID NO: 248654 - DNA, 20 bp, Artificial Sequence
  chemically synthesized
ctggaatggcagtagatatt

SEQ ID NO: 248655 - DNA, 20 bp, Artificial Sequence
  chemically synthesized
ggctcaagctggaatggcag

SEQ ID NO: 248656 - DNA, 20 bp, Artificial Sequence
  chemically synthesized
ccaaatatctactgccattc

SEQ ID NO: 248657 - DNA, 20 bp, Artificial Sequence
  chemically synthesized
tggggctcaagctggaatgg

SEQ ID NO: 248658 - DNA, 20 bp, Artificial Sequence
  chemically synthesized
ttctggggctcaagctggaa

SEQ ID NO: 248659 - DNA, 20 bp, Artificial Sequence
  chemically synthesized
atctactgccattccagctt

SEQ ID NO: 248660 - DNA, 20 bp, Artificial Sequence
  chemically synthesized
tctcattctggggctcaagc

SEQ ID NO: 248661 - DNA, 20 bp, Artificial Sequence
  chemically synthesized
tgccattccagcttgagccc

SEQ ID NO: 248662 - DNA, 20 bp, Artificial Sequence
  chemically synthesized
tgtgtctcattctggggctc

SEQ ID NO: 248663 - DNA, 20 bp, Artificial Sequence
  chemically synthesized
tccagcttgagccccagaat

SEQ ID NO: 248664 - DNA, 20 bp, Artificial Sequence
  chemically synthesized
gatctatgtgtctcattctg

SEQ ID NO: 248665 - DNA, 20 bp, Artificial Sequence
  chemically synthesized
tgatctatgtgtctcattct

SEQ ID NO: 248666 - DNA, 20 bp, Artificial Sequence
  chemically synthesized
ctgatctatgtgtctcattc

SEQ ID NO: 248667 - DNA, 20 bp, Artificial Sequence
  chemically synthesized
gagccccagaatgagacaca

SEQ ID NO: 248668 - DNA, 20 bp, Artificial Sequence
  chemically synthesized
ccagaatgagacacatagat

SEQ ID NO: 248669 - DNA, 20 bp, Artificial Sequence
  chemically synthesized
acacatagatcagacatgtt

SEQ ID NO: 248670 - DNA, 20 bp, Artificial Sequence
  chemically synthesized
agacatgtttggtcaaccta

SEQ ID NO: 248671 - DNA, 20 bp, Artificial Sequence
  chemically synthesized
atgtttggtcaacctacagt

SEQ ID NO: 248672 - DNA, 20 bp, Artificial Sequence
  chemically synthesized
ctgattcagaatctgactgt

SEQ ID NO: 248673 - DNA, 20 bp, Artificial Sequence
  chemically synthesized
tctgattcagaatctgactg

SEQ ID NO: 248674 - DNA, 20 bp, Artificial Sequence
  chemically synthesized
cctacagtcagattctgaat

SEQ ID NO: 248675 - DNA, 20 bp, Artificial Sequence
  chemically synthesized
tacagtcagattctgaatca

SEQ ID NO: 248676 - DNA, 20 bp, Artificial Sequence
  chemically synthesized
actttgagtaatctctgatt

SEQ ID NO: 248677 - DNA, 20 bp, Artificial Sequence
  chemically synthesized
tctgaatcagagattactca

SEQ ID NO: 248678 - DNA, 20 bp, Artificial Sequence
  chemically synthesized
gaatcagagattactcaaag

SEQ ID NO: 248679 - DNA, 20 bp, Artificial Sequence
  chemically synthesized
aatcagagattactcaaagt

SEQ ID NO: 248680 - DNA, 20 bp, Artificial Sequence
  chemically synthesized
catattcacaggcctacttt

SEQ ID NO: 248681 - DNA, 20 bp, Artificial Sequence
  chemically synthesized
gcacttatcctcatattcac

SEQ ID NO: 248682 - DNA, 20 bp, Artificial Sequence
  chemically synthesized
caaagtaggcctgtgaatat

SEQ ID NO: 248683 - DNA, 20 bp, Artificial Sequence
  chemically synthesized
agcacttatcctcatattca

SEQ ID NO: 248684 - DNA, 20 bp, Artificial Sequence
  chemically synthesized
aaagtaggcctgtgaatatg

SEQ ID NO: 248685 - DNA, 20 bp, Artificial Sequence
  chemically synthesized
aggcctgtgaatatgaggat

SEQ ID NO: 248686 - DNA, 20 bp, Artificial Sequence
  chemically synthesized
gcataccccaaaagaacaat

SEQ ID NO: 248687 - DNA, 20 bp, Artificial Sequence
  chemically synthesized
ataagtgcttattgttcttt

SEQ ID NO: 248688 - DNA, 20 bp, Artificial Sequence
  chemically synthesized
taagtgcttattgttctttt

SEQ ID NO: 248689 - DNA, 20 bp, Artificial Sequence
  chemically synthesized
aagtgcttattgttcttttg

SEQ ID NO: 248690 - DNA, 20 bp, Artificial Sequence
  chemically synthesized
gtgtgacaagcataccccaa

SEQ ID NO: 248691 - DNA, 20 bp, Artificial Sequence
  chemically synthesized
tttggggtatgcttgtcaca

SEQ ID NO: 248692 - DNA, 20 bp, Artificial Sequence
  chemically synthesized
ccacaataatgctgtgtgac

SEQ ID NO: 248693 - DNA, 20 bp, Artificial Sequence
  chemically synthesized
cttgtcacacagcattattg

SEQ ID NO: 248694 - DNA, 20 bp, Artificial Sequence
  chemically synthesized
acacagcattattgtggttg

SEQ ID NO: 248695 - DNA, 20 bp, Artificial Sequence
  chemically synthesized
caaagtcaatcaatattagt

SEQ ID NO: 248696 - DNA, 20 bp, Artificial Sequence
  chemically synthesized
tcaccaaagtcaatcaatat

SEQ ID NO: 248697 - DNA, 20 bp, Artificial Sequence
  chemically synthesized
tgactaatattgattgactt

SEQ ID NO: 248698 - DNA, 20 bp, Artificial Sequence
  chemically synthesized
taatattgattgactttggt

SEQ ID NO: 248699 - DNA, 20 bp, Artificial Sequence
  chemically synthesized
aatattgattgactttggtg

SEQ ID NO: 248700 - DNA, 20 bp, Artificial Sequence
  chemically synthesized
atattgattgactttggtga

SEQ ID NO: 248701 - DNA, 20 bp, Artificial Sequence
  chemically synthesized
tgtttattgggccctcacca

SEQ ID NO: 248702 - DNA, 20 bp, Artificial Sequence
  chemically synthesized
tttggtgagggcccaataaa

SEQ ID NO: 248703 - DNA, 20 bp, Artificial Sequence
  chemically synthesized
acccaaggtagctgtttatt

SEQ ID NO: 248704 - DNA, 20 bp, Artificial Sequence
  chemically synthesized
gacccaaggtagctgtttat

SEQ ID NO: 248705 - DNA, 20 bp, Artificial Sequence
  chemically synthesized
ggcccaataaacagctacct

SEQ ID NO: 248706 - DNA, 20 bp, Artificial Sequence
  chemically synthesized
gcccaataaacagctacctt

SEQ ID NO: 248707 - DNA, 20 bp, Artificial Sequence
  chemically synthesized
aatgtaggagtgacccaagg

SEQ ID NO: 248708 - DNA, 20 bp, Artificial Sequence
  chemically synthesized
agtaatgtaggagtgaccca

SEQ ID NO: 248709 - DNA, 20 bp, Artificial Sequence
  chemically synthesized
cagtaatgtaggagtgaccc

SEQ ID NO: 248710 - DNA, 20 bp, Artificial Sequence
  chemically synthesized
cctatctctcagtaatgtag

SEQ ID NO: 248711 - DNA, 20 bp, Artificial Sequence
  chemically synthesized
cccctatctctcagtaatgt

SEQ ID NO: 248712 - DNA, 20 bp, Artificial Sequence
  chemically synthesized
tgggtcactcctacattact

SEQ ID NO: 248713 - DNA, 20 bp, Artificial Sequence
  chemically synthesized
tcccctatctctcagtaatg

SEQ ID NO: 248714 - DNA, 20 bp, Artificial Sequence
  chemically synthesized
ggtcactcctacattactga

SEQ ID NO: 248715 - DNA, 20 bp, Artificial Sequence
  chemically synthesized
actcctacattactgagaga

SEQ ID NO: 248716 - DNA, 20 bp, Artificial Sequence
  chemically synthesized
ctcctacattactgagagat

SEQ ID NO: 248717 - DNA, 20 bp, Artificial Sequence
  chemically synthesized
tcctacattactgagagata

SEQ ID NO: 248718 - DNA, 20 bp, Artificial Sequence
  chemically synthesized
attttctttcccctatctct

SEQ ID NO: 248719 - DNA, 20 bp, Artificial Sequence
  chemically synthesized
cctacattactgagagatag

SEQ ID NO: 248720 - DNA, 20 bp, Artificial Sequence
  chemically synthesized
cattactgagagatagggga

SEQ ID NO: 248721 - DNA, 20 bp, Artificial Sequence
  chemically synthesized
agagataggggaaagaaaat

SEQ ID NO: 248722 - DNA, 20 bp, Artificial Sequence
  chemically synthesized
agaaaatgagataaaaataa

SEQ ID NO: 248723 - DNA, 20 bp, Artificial Sequence
  chemically synthesized
aatgagataaaaataaaagt

SEQ ID NO: 248724 - DNA, 20 bp, Artificial Sequence
  chemically synthesized
gtagcatcctgataaggacg

SEQ ID NO: 248725 - DNA, 20 bp, Artificial Sequence
  chemically synthesized
gttagcatctacgtccttat

SEQ ID NO: 248726 - DNA, 20 bp, Artificial Sequence
  chemically synthesized
ttagcatctacgtccttatc

SEQ ID NO: 248727 - DNA, 20 bp, Artificial Sequence
  chemically synthesized
aaaatagtagcatcctgata

SEQ ID NO: 248728 - DNA, 20 bp, Artificial Sequence
  chemically synthesized
taaaatagtagcatcctgat

SEQ ID NO: 248729 - DNA, 20 bp, Artificial Sequence
  chemically synthesized
gggtaccttccataaaatag

SEQ ID NO: 248730 - DNA, 20 bp, Artificial Sequence
  chemically synthesized
atcaggatgctactatttta

SEQ ID NO: 248731 - DNA, 20 bp, Artificial Sequence
  chemically synthesized
tttgggtaccttccataaaa

SEQ ID NO: 248732 - DNA, 20 bp, Artificial Sequence
  chemically synthesized
aggatgctactattttatgg

SEQ ID NO: 248733 - DNA, 20 bp, Artificial Sequence
  chemically synthesized
ggatgctactattttatgga

SEQ ID NO: 248734 - DNA, 20 bp, Artificial Sequence
  chemically synthesized
tattttatggaaggtaccca

SEQ ID NO: 248735 - DNA, 20 bp, Artificial Sequence
  chemically synthesized
tataattctggaatttcttt

SEQ ID NO: 248736 - DNA, 20 bp, Artificial Sequence
  chemically synthesized
atataattctggaatttctt

SEQ ID NO: 248737 - DNA, 20 bp, Artificial Sequence
  chemically synthesized
gaaggtacccaaagaaattc

SEQ ID NO: 248738 - DNA, 20 bp, Artificial Sequence
  chemically synthesized
aatcatcagagatataattc

SEQ ID NO: 248739 - DNA, 20 bp, Artificial Sequence
  chemically synthesized
aaggaattttggaatcatca

SEQ ID NO: 248740 - DNA, 20 bp, Artificial Sequence
  chemically synthesized
tgaaggaattttggaatcat

SEQ ID NO: 248741 - DNA, 20 bp, Artificial Sequence
  chemically synthesized
cctttgttttgaaggaattt

SEQ ID NO: 248742 - DNA, 20 bp, Artificial Sequence
  chemically synthesized
gtctgtgtcctttgttttga

SEQ ID NO: 248743 - DNA, 20 bp, Artificial Sequence
  chemically synthesized
tccaaaattccttcaaaaca

SEQ ID NO: 248744 - DNA, 20 bp, Artificial Sequence
  chemically synthesized
agtctgtgtcctttgttttg

SEQ ID NO: 248745 - DNA, 20 bp, Artificial Sequence
  chemically synthesized
ccaaaattccttcaaaacaa

SEQ ID NO: 248746 - DNA, 20 bp, Artificial Sequence
  chemically synthesized
ttccttcaaaacaaaggaca

SEQ ID NO: 248747 - DNA, 20 bp, Artificial Sequence
  chemically synthesized
tcaaaacaaaggacacagac

SEQ ID NO: 248748 - DNA, 20 bp, Artificial Sequence
  chemically synthesized
cttgaaaaccaaggatggtc

SEQ ID NO: 248749 - DNA, 20 bp, Artificial Sequence
  chemically synthesized
gacacagactggaccatcct

SEQ ID NO: 248750 - DNA, 20 bp, Artificial Sequence
  chemically synthesized
tagtacttgaaaaccaagga

SEQ ID NO: 248751 - DNA, 20 bp, Artificial Sequence
  chemically synthesized
agcatagtacttgaaaacca

SEQ ID NO: 248752 - DNA, 20 bp, Artificial Sequence
  chemically synthesized
ctggaccatccttggttttc

SEQ ID NO: 248753 - DNA, 20 bp, Artificial Sequence
  chemically synthesized
tagcatagtacttgaaaacc

SEQ ID NO: 248754 - DNA, 20 bp, Artificial Sequence
  chemically synthesized
taatattcaaaattatagca

SEQ ID NO: 248755 - DNA, 20 bp, Artificial Sequence
  chemically synthesized
ttctgtaatattcaaaatta

SEQ ID NO: 248756 - DNA, 20 bp, Artificial Sequence
  chemically synthesized
tgctataattttgaatatta

SEQ ID NO: 248757 - DNA, 20 bp, Artificial Sequence
  chemically synthesized
ataattttgaatattacaga

SEQ ID NO: 248758 - DNA, 20 bp, Artificial Sequence
  chemically synthesized
tttgaatattacagaaagac

SEQ ID NO: 248759 - DNA, 20 bp, Artificial Sequence
  chemically synthesized
tattacagaaagacaagtga

SEQ ID NO: 248760 - DNA, 20 bp, Artificial Sequence
  chemically synthesized
aaagacaagtgaaagaactg

SEQ ID NO: 248761 - DNA, 20 bp, Artificial Sequence
  chemically synthesized
gacaagtgaaagaactgaag

SEQ ID NO: 248762 - DNA, 20 bp, Artificial Sequence
  chemically synthesized
tgcttttttagtttcttctt

SEQ ID NO: 248763 - DNA, 20 bp, Artificial Sequence
  chemically synthesized
aactgaagaagaaactaaaa

SEQ ID NO: 248764 - DNA, 20 bp, Artificial Sequence
  chemically synthesized
tttgtcttgaaatgcttttt

SEQ ID NO: 248765 - DNA, 20 bp, Artificial Sequence
  chemically synthesized
agaaactaaaaaagcatttc

SEQ ID NO: 248766 - DNA, 20 bp, Artificial Sequence
  chemically synthesized
aaaaagcatttcaagacaaa

SEQ ID NO: 248767 - DNA, 20 bp, Artificial Sequence
  chemically synthesized
aactatctttgttcataaaa

SEQ ID NO: 248768 - DNA, 20 bp, Artificial Sequence
  chemically synthesized
aaactatctttgttcataaa

SEQ ID NO: 248769 - DNA, 20 bp, Artificial Sequence
  chemically synthesized
aatttgcctttttatgaaca

SEQ ID NO: 248770 - DNA, 20 bp, Artificial Sequence
  chemically synthesized
tgcctttttatgaacaaaga

SEQ ID NO: 248771 - DNA, 20 bp, Artificial Sequence
  chemically synthesized
tcaaacatataaattactca

SEQ ID NO: 248772 - DNA, 20 bp, Artificial Sequence
  chemically synthesized
caaacatataaattactcaa

SEQ ID NO: 248773 - DNA, 20 bp, Artificial Sequence
  chemically synthesized
atataaattactcaaaggct

SEQ ID NO: 248774 - DNA, 20 bp, Artificial Sequence
  chemically synthesized
tttgaaaattcttagccttt

SEQ ID NO: 248775 - DNA, 20 bp, Artificial Sequence
  chemically synthesized
gatgcacatttgaaaattct

SEQ ID NO: 248776 - DNA, 20 bp, Artificial Sequence
  chemically synthesized
acttgtaggaaatgacaatt

SEQ ID NO: 248777 - DNA, 20 bp, Artificial Sequence
  chemically synthesized
tctaaattgtcatttcctac

SEQ ID NO: 248778 - DNA, 20 bp, Artificial Sequence
  chemically synthesized
tagtatggctagatacttgt

SEQ ID NO: 248779 - DNA, 20 bp, Artificial Sequence
  chemically synthesized
ctagtatggctagatacttg

SEQ ID NO: 248780 - DNA, 20 bp, Artificial Sequence
  chemically synthesized
tgtcatttcctacaagtatc

SEQ ID NO: 248781 - DNA, 20 bp, Artificial Sequence
  chemically synthesized
ctacaagtatctagccatac

SEQ ID NO: 248782 - DNA, 20 bp, Artificial Sequence
  chemically synthesized
ttgtagtttcctagtatggc

SEQ ID NO: 248783 - DNA, 20 bp, Artificial Sequence
  chemically synthesized
tacaagtatctagccatact

SEQ ID NO: 248784 - DNA, 20 bp, Artificial Sequence
  chemically synthesized
ttctttgtagtttcctagta

SEQ ID NO: 248785 - DNA, 20 bp, Artificial Sequence
  chemically synthesized
aaatattctttgtagtttcc

SEQ ID NO: 248786 - DNA, 20 bp, Artificial Sequence
  chemically synthesized
agccatactaggaaactaca

SEQ ID NO: 248787 - DNA, 20 bp, Artificial Sequence
  chemically synthesized
aagttttaaaatattctttg

SEQ ID NO: 248788 - DNA, 20 bp, Artificial Sequence
  chemically synthesized
atattttaaaacttgtattt

SEQ ID NO: 248789 - DNA, 20 bp, Artificial Sequence
  chemically synthesized
tattttaaaacttgtatttc

SEQ ID NO: 248790 - DNA, 20 bp, Artificial Sequence
  chemically synthesized
gagatttctgcctgaaatac

SEQ ID NO: 248791 - DNA, 20 bp, Artificial Sequence
  chemically synthesized
tttaaaacttgtatttcagg

SEQ ID NO: 248792 - DNA, 20 bp, Artificial Sequence
  chemically synthesized
ccacagatgtggttttttga

SEQ ID NO: 248793 - DNA, 20 bp, Artificial Sequence
  chemically synthesized
agccacagatgtggtttttt

SEQ ID NO: 248794 - DNA, 20 bp, Artificial Sequence
  chemically synthesized
ctctcaaaaaaccacatctg

SEQ ID NO: 248795 - DNA, 20 bp, Artificial Sequence
  chemically synthesized
cccattacaagccacagatg

SEQ ID NO: 248796 - DNA, 20 bp, Artificial Sequence
  chemically synthesized
aaactgcccattacaagcca

SEQ ID NO: 248797 - DNA, 20 bp, Artificial Sequence
  chemically synthesized
accacatctgtggcttgtaa

SEQ ID NO: 248798 - DNA, 20 bp, Artificial Sequence
  chemically synthesized
ccacatctgtggcttgtaat

SEQ ID NO: 248799 - DNA, 20 bp, Artificial Sequence
  chemically synthesized
aagggaaaactgcccattac

SEQ ID NO: 248800 - DNA, 20 bp, Artificial Sequence
  chemically synthesized
catctgtggcttgtaatggg

SEQ ID NO: 248801 - DNA, 20 bp, Artificial Sequence
  chemically synthesized
gtaatgggcagttttccctt

SEQ ID NO: 248802 - DNA, 20 bp, Artificial Sequence
  chemically synthesized
gaaaatatcagtgttctcaa

SEQ ID NO: 248803 - DNA, 20 bp, Artificial Sequence
  chemically synthesized
tgaaaatatcagtgttctca

SEQ ID NO: 248804 - DNA, 20 bp, Artificial Sequence
  chemically synthesized
ttgaaaatatcagtgttctc

SEQ ID NO: 248805 - DNA, 20 bp, Artificial Sequence
  chemically synthesized
caaattcctcttgaaaatat

SEQ ID NO: 248806 - DNA, 20 bp, Artificial Sequence
  chemically synthesized
ttgagaacactgatattttc

SEQ ID NO: 248807 - DNA, 20 bp, Artificial Sequence
  chemically synthesized
gagaacactgatattttcaa

SEQ ID NO: 248808 - DNA, 20 bp, Artificial Sequence
  chemically synthesized
agaacactgatattttcaag

SEQ ID NO: 248809 - DNA, 20 bp, Artificial Sequence
  chemically synthesized
gatattttcaagaggaattt

SEQ ID NO: 248810 - DNA, 20 bp, Artificial Sequence
  chemically synthesized
gaggaatttgagactatcca

SEQ ID NO: 248811 - DNA, 20 bp, Artificial Sequence
  chemically synthesized
agttttagtttatccgtgga

SEQ ID NO: 248812 - DNA, 20 bp, Artificial Sequence
  chemically synthesized
tattagttttagtttatccg

SEQ ID NO: 248813 - DNA, 20 bp, Artificial Sequence
  chemically synthesized
aattattttcatattagttt

SEQ ID NO: 248814 - DNA, 20 bp, Artificial Sequence
  chemically synthesized
cacaagaattattttcatat

SEQ ID NO: 248815 - DNA, 20 bp, Artificial Sequence
  chemically synthesized
gcctgtaaggcaattttcac

SEQ ID NO: 248816 - DNA, 20 bp, Artificial Sequence
  chemically synthesized
ttcttgtgaaaattgcctta

SEQ ID NO: 248817 - DNA, 20 bp, Artificial Sequence
  chemically synthesized
tcttgtgaaaattgccttac

SEQ ID NO: 248818 - DNA, 20 bp, Artificial Sequence
  chemically synthesized
gtgaaaattgccttacaggc

SEQ ID NO: 248819 - DNA, 20 bp, Artificial Sequence
  chemically synthesized
gttgcaaattcttgcctgta

SEQ ID NO: 248820 - DNA, 20 bp, Artificial Sequence
  chemically synthesized
agttgcaaattcttgcctgt

SEQ ID NO: 248821 - DNA, 20 bp, Artificial Sequence
  chemically synthesized
gcaagaatttgcaactttca

SEQ ID NO: 248822 - DNA, 20 bp, Artificial Sequence
  chemically synthesized
caagaatttgcaactttcat

SEQ ID NO: 248823 - DNA, 20 bp, Artificial Sequence
  chemically synthesized
aagaatttgcaactttcata

SEQ ID NO: 248824 - DNA, 20 bp, Artificial Sequence
  chemically synthesized
aaaatctgtttaccctatga

SEQ ID NO: 248825 - DNA, 20 bp, Artificial Sequence
  chemically synthesized
tgcaactttcatagggtaaa

SEQ ID NO: 248826 - DNA, 20 bp, Artificial Sequence
  chemically synthesized
atagggtaaacagattttta

SEQ ID NO: 248827 - DNA, 20 bp, Artificial Sequence
  chemically synthesized
taaacagatttttaaagcgt

SEQ ID NO: 248828 - DNA, 20 bp, Artificial Sequence
  chemically synthesized
aattgtgacaaacatcctcc

SEQ ID NO: 248829 - DNA, 20 bp, Artificial Sequence
  chemically synthesized
tgacaaacatcctcctagaa

SEQ ID NO: 248830 - DNA, 20 bp, Artificial Sequence
  chemically synthesized
gtttcaccttctattctagg

SEQ ID NO: 248831 - DNA, 20 bp, Artificial Sequence
  chemically synthesized
tgtttcaccttctattctag

SEQ ID NO: 248832 - DNA, 20 bp, Artificial Sequence
  chemically synthesized
caaacatcctcctagaatag

SEQ ID NO: 248833 - DNA, 20 bp, Artificial Sequence
  chemically synthesized
cttgtttcaccttctattct

SEQ ID NO: 248834 - DNA, 20 bp, Artificial Sequence
  chemically synthesized
aaacatcctcctagaataga

SEQ ID NO: 248835 - DNA, 20 bp, Artificial Sequence
  chemically synthesized
gcttgtttcaccttctattc

SEQ ID NO: 248836 - DNA, 20 bp, Artificial Sequence
  chemically synthesized
cctagaatagaaggtgaaac

SEQ ID NO: 248837 - DNA, 20 bp, Artificial Sequence
  chemically synthesized
gaatagaaggtgaaacaagc

SEQ ID NO: 248838 - DNA, 20 bp, Artificial Sequence
  chemically synthesized
agaaggtgaaacaagcaagt

SEQ ID NO: 248839 - DNA, 20 bp, Artificial Sequence
  chemically synthesized
aggtgaaacaagcaagtaag

SEQ ID NO: 248840 - DNA, 20 bp, Artificial Sequence
  chemically synthesized
aaacaagcaagtaagcagac

SEQ ID NO: 248841 - DNA, 20 bp, Artificial Sequence
  chemically synthesized
aagcaagtaagcagacaagc

SEQ ID NO: 248842 - DNA, 20 bp, Artificial Sequence
  chemically synthesized
aagtaagcagacaagcaagc

SEQ ID NO: 248843 - DNA, 20 bp, Artificial Sequence
  chemically synthesized
caagcaagcaaacctttcac

SEQ ID NO: 248844 - DNA, 20 bp, Artificial Sequence
  chemically synthesized
cagtataacattctggtgaa

SEQ ID NO: 248845 - DNA, 20 bp, Artificial Sequence
  chemically synthesized
tcagtataacattctggtga

SEQ ID NO: 248846 - DNA, 20 bp, Artificial Sequence
  chemically synthesized
ctaaagtcagtataacattc

SEQ ID NO: 248847 - DNA, 20 bp, Artificial Sequence
  chemically synthesized
ccagaatgttatactgactt

SEQ ID NO: 248848 - DNA, 20 bp, Artificial Sequence
  chemically synthesized
tatccattagtcactaaagt

SEQ ID NO: 248849 - DNA, 20 bp, Artificial Sequence
  chemically synthesized
aatatatccattagtcacta

SEQ ID NO: 248850 - DNA, 20 bp, Artificial Sequence
  chemically synthesized
atactgactttagtgactaa

SEQ ID NO: 248851 - DNA, 20 bp, Artificial Sequence
  chemically synthesized
atagagaaaaatatatccat

SEQ ID NO: 248852 - DNA, 20 bp, Artificial Sequence
  chemically synthesized
atggatatatttttctctat

SEQ ID NO: 248853 - DNA, 20 bp, Artificial Sequence
  chemically synthesized
ggatatatttttctctatga

SEQ ID NO: 248854 - DNA, 20 bp, Artificial Sequence
  chemically synthesized
tacatgaacagtctctcata

SEQ ID NO: 248855 - DNA, 20 bp, Artificial Sequence
  chemically synthesized
gatacatgaacagtctctca

SEQ ID NO: 248856 - DNA, 20 bp, Artificial Sequence
  chemically synthesized
gggaattggagatacatgaa

SEQ ID NO: 248857 - DNA, 20 bp, Artificial Sequence
  chemically synthesized
tttttctaattagggaattg

SEQ ID NO: 248858 - DNA, 20 bp, Artificial Sequence
  chemically synthesized
tgtttttctaattagggaat

SEQ ID NO: 248859 - DNA, 20 bp, Artificial Sequence
  chemically synthesized
tgtatctccaattccctaat

SEQ ID NO: 248860 - DNA, 20 bp, Artificial Sequence
  chemically synthesized
gatatatgtttttctaatta

SEQ ID NO: 248861 - DNA, 20 bp, Artificial Sequence
  chemically synthesized
ggatatatgtttttctaatt

SEQ ID NO: 248862 - DNA, 20 bp, Artificial Sequence
  chemically synthesized
tggatatatgtttttctaat

SEQ ID NO: 248863 - DNA, 20 bp, Artificial Sequence
  chemically synthesized
taattagaaaaacatatatc

SEQ ID NO: 248864 - DNA, 20 bp, Artificial Sequence
  chemically synthesized
aattagaaaaacatatatcc

SEQ ID NO: 248865 - DNA, 20 bp, Artificial Sequence
  chemically synthesized
aaaaacatatatccaggtct

SEQ ID NO: 248866 - DNA, 20 bp, Artificial Sequence
  chemically synthesized
atataaaataatctaagacc

SEQ ID NO: 248867 - DNA, 20 bp, Artificial Sequence
  chemically synthesized
agcaatatataaaataatct

SEQ ID NO: 248868 - DNA, 20 bp, Artificial Sequence
  chemically synthesized
atgacttttaggtgtggata

SEQ ID NO: 248869 - DNA, 20 bp, Artificial Sequence
  chemically synthesized
attgctgtatccacacctaa

SEQ ID NO: 248870 - DNA, 20 bp, Artificial Sequence
  chemically synthesized
caaatcatgacttttaggtg

SEQ ID NO: 248871 - DNA, 20 bp, Artificial Sequence
  chemically synthesized
aaggtcaaatcatgactttt

SEQ ID NO: 248872 - DNA, 20 bp, Artificial Sequence
  chemically synthesized
taaggtcaaatcatgacttt

SEQ ID NO: 248873 - DNA, 20 bp, Artificial Sequence
  chemically synthesized
taaaagtcatgatttgacct

SEQ ID NO: 248874 - DNA, 20 bp, Artificial Sequence
  chemically synthesized
gtcatgatttgaccttagta

SEQ ID NO: 248875 - DNA, 20 bp, Artificial Sequence
  chemically synthesized
cctttcatttcgctatacta

SEQ ID NO: 248876 - DNA, 20 bp, Artificial Sequence
  chemically synthesized
tcctttcatttcgctatact

SEQ ID NO: 248877 - DNA, 20 bp, Artificial Sequence
  chemically synthesized
accttagtatagcgaaatga

SEQ ID NO: 248878 - DNA, 20 bp, Artificial Sequence
  chemically synthesized
ccttagtatagcgaaatgaa

SEQ ID NO: 248879 - DNA, 20 bp, Artificial Sequence
  chemically synthesized
agcgaaatgaaaggaaatat

SEQ ID NO: 248880 - DNA, 20 bp, Artificial Sequence
  chemically synthesized
gcgaaatgaaaggaaatata

SEQ ID NO: 248881 - DNA, 20 bp, Artificial Sequence
  chemically synthesized
ttcaataaattattaatgca

SEQ ID NO: 248882 - DNA, 20 bp, Artificial Sequence
  chemically synthesized
attcaataaattattaatgc

SEQ ID NO: 248883 - DNA, 20 bp, Artificial Sequence
  chemically synthesized
tattcaataaattattaatg

SEQ ID NO: 248884 - DNA, 20 bp, Artificial Sequence
  chemically synthesized
atttattgaatacactatga

SEQ ID NO: 248885 - DNA, 20 bp, Artificial Sequence
  chemically synthesized
cagaatctccatttccatca

SEQ ID NO: 248886 - DNA, 20 bp, Artificial Sequence
  chemically synthesized
tgaatacactatgatggaaa

SEQ ID NO: 248887 - DNA, 20 bp, Artificial Sequence
  chemically synthesized
aatacactatgatggaaatg

SEQ ID NO: 248888 - DNA, 20 bp, Artificial Sequence
  chemically synthesized
aatggagattctgttaacca

SEQ ID NO: 248889 - DNA, 20 bp, Artificial Sequence
  chemically synthesized
ttgagaaactctttggttaa

SEQ ID NO: 248890 - DNA, 20 bp, Artificial Sequence
  chemically synthesized
tggagattctgttaaccaaa

SEQ ID NO: 248891 - DNA, 20 bp, Artificial Sequence
  chemically synthesized
aagtttcttgagaaactctt

SEQ ID NO: 248892 - DNA, 20 bp, Artificial Sequence
  chemically synthesized
tgttaaccaaagagtttctc

SEQ ID NO: 248893 - DNA, 20 bp, Artificial Sequence
  chemically synthesized
ctagaatgaataagtttctt

SEQ ID NO: 248894 - DNA, 20 bp, Artificial Sequence
  chemically synthesized
tgtaatattctagaatgaat

SEQ ID NO: 248895 - DNA, 20 bp, Artificial Sequence
  chemically synthesized
ctcaagaaacttattcattc

SEQ ID NO: 248896 - DNA, 20 bp, Artificial Sequence
  chemically synthesized
actcaaaagctgtaatattc

SEQ ID NO: 248897 - DNA, 20 bp, Artificial Sequence
  chemically synthesized
ttattcattctagaatatta

SEQ ID NO: 248898 - DNA, 20 bp, Artificial Sequence
  chemically synthesized
tctagaatattacagctttt

SEQ ID NO: 248899 - DNA, 20 bp, Artificial Sequence
  chemically synthesized
gaatattacagcttttgagt

SEQ ID NO: 248900 - DNA, 20 bp, Artificial Sequence
  chemically synthesized
ataataagcttctcactcaa

SEQ ID NO: 248901 - DNA, 20 bp, Artificial Sequence
  chemically synthesized
tattacagcttttgagtgag

SEQ ID NO: 248902 - DNA, 20 bp, Artificial Sequence
  chemically synthesized
agcccttaaatgtatataat

SEQ ID NO: 248903 - DNA, 20 bp, Artificial Sequence
  chemically synthesized
gaagcttattatatacattt

SEQ ID NO: 248904 - DNA, 20 bp, Artificial Sequence
  chemically synthesized
aagcttattatatacattta

SEQ ID NO: 248905 - DNA, 20 bp, Artificial Sequence
  chemically synthesized
agcttattatatacatttaa

SEQ ID NO: 248906 - DNA, 20 bp, Artificial Sequence
  chemically synthesized
catgttaatattttattgat

SEQ ID NO: 248907 - DNA, 20 bp, Artificial Sequence
  chemically synthesized
aatgcagtatggtttcatgt

SEQ ID NO: 248908 - DNA, 20 bp, Artificial Sequence
  chemically synthesized
cccctaagtggaatgcagta

SEQ ID NO: 248909 - DNA, 20 bp, Artificial Sequence
  chemically synthesized
tgtcacccctaagtggaatg

SEQ ID NO: 248910 - DNA, 20 bp, Artificial Sequence
  chemically synthesized
aaaccatactgcattccact

SEQ ID NO: 248911 - DNA, 20 bp, Artificial Sequence
  chemically synthesized
aaccatactgcattccactt

SEQ ID NO: 248912 - DNA, 20 bp, Artificial Sequence
  chemically synthesized
accatactgcattccactta

SEQ ID NO: 248913 - DNA, 20 bp, Artificial Sequence
  chemically synthesized
ccatactgcattccacttag

SEQ ID NO: 248914 - DNA, 20 bp, Artificial Sequence
  chemically synthesized
taccttttgtcacccctaag

SEQ ID NO: 248915 - DNA, 20 bp, Artificial Sequence
  chemically synthesized
atataccttttgtcacccct

SEQ ID NO: 248916 - DNA, 20 bp, Artificial Sequence
  chemically synthesized
attccacttaggggtgacaa

SEQ ID NO: 248917 - DNA, 20 bp, Artificial Sequence
  chemically synthesized
ttccacttaggggtgacaaa

SEQ ID NO: 248918 - DNA, 20 bp, Artificial Sequence
  chemically synthesized
taggggtgacaaaaggtata

SEQ ID NO: 248919 - DNA, 20 bp, Artificial Sequence
  chemically synthesized
gtgacaaaaggtatatagta

SEQ ID NO: 248920 - DNA, 20 bp, Artificial Sequence
  chemically synthesized
tactttttcctacagggaag

SEQ ID NO: 248921 - DNA, 20 bp, Artificial Sequence
  chemically synthesized
atagtacagcctcttccctg

SEQ ID NO: 248922 - DNA, 20 bp, Artificial Sequence
  chemically synthesized
gtactttttcctacagggaa

SEQ ID NO: 248923 - DNA, 20 bp, Artificial Sequence
  chemically synthesized
tagtacagcctcttccctgt

SEQ ID NO: 248924 - DNA, 20 bp, Artificial Sequence
  chemically synthesized
gagtactttttcctacaggg

SEQ ID NO: 248925 - DNA, 20 bp, Artificial Sequence
  chemically synthesized
gtggagtactttttcctaca

SEQ ID NO: 248926 - DNA, 20 bp, Artificial Sequence
  chemically synthesized
agtggagtactttttcctac

SEQ ID NO: 248927 - DNA, 20 bp, Artificial Sequence
  chemically synthesized
agcctcttccctgtaggaaa

SEQ ID NO: 248928 - DNA, 20 bp, Artificial Sequence
  chemically synthesized
cagtggagtactttttccta

SEQ ID NO: 248929 - DNA, 20 bp, Artificial Sequence
  chemically synthesized
ggaaaaagtactccactgaa

SEQ ID NO: 248930 - DNA, 20 bp, Artificial Sequence
  chemically synthesized
caacatgttaccattcagtg

SEQ ID NO: 248931 - DNA, 20 bp, Artificial Sequence
  chemically synthesized
tgcaacatgttaccattcag

SEQ ID NO: 248932 - DNA, 20 bp, Artificial Sequence
  chemically synthesized
gtttgcaacatgttaccatt

SEQ ID NO: 248933 - DNA, 20 bp, Artificial Sequence
  chemically synthesized
gaatggtaacatgttgcaaa

SEQ ID NO: 248934 - DNA, 20 bp, Artificial Sequence
  chemically synthesized
catgttgcaaacagctatgt

SEQ ID NO: 248935 - DNA, 20 bp, Artificial Sequence
  chemically synthesized
atgagtttatatgtcttaca

SEQ ID NO: 248936 - DNA, 20 bp, Artificial Sequence
  chemically synthesized
atcttacaggttattatcat

SEQ ID NO: 248937 - DNA, 20 bp, Artificial Sequence
  chemically synthesized
aactcatgataataacctgt

SEQ ID NO: 248938 - DNA, 20 bp, Artificial Sequence
  chemically synthesized
tgtttacctatttatcttac

SEQ ID NO: 248939 - DNA, 20 bp, Artificial Sequence
  chemically synthesized
ctgtttacctatttatctta

SEQ ID NO: 248940 - DNA, 20 bp, Artificial Sequence
  chemically synthesized
ataataacctgtaagataaa

SEQ ID NO: 248941 - DNA, 20 bp, Artificial Sequence
  chemically synthesized
taataacctgtaagataaat

SEQ ID NO: 248942 - DNA, 20 bp, Artificial Sequence
  chemically synthesized
ctgtaagataaataggtaaa

SEQ ID NO: 248943 - DNA, 20 bp, Artificial Sequence
  chemically synthesized
gtaagataaataggtaaaca

SEQ ID NO: 248944 - DNA, 20 bp, Artificial Sequence
  chemically synthesized
aagataaataggtaaacaga

SEQ ID NO: 248945 - DNA, 20 bp, Artificial Sequence
  chemically synthesized
aacagagagttctatgaatc

SEQ ID NO: 248946 - DNA, 20 bp, Artificial Sequence
  chemically synthesized
tattccattgtctggattca

SEQ ID NO: 248947 - DNA, 20 bp, Artificial Sequence
  chemically synthesized
agttctatgaatccagacaa

SEQ ID NO: 248948 - DNA, 20 bp, Artificial Sequence
  chemically synthesized
tgatcaattattccattgtc

SEQ ID NO: 248949 - DNA, 20 bp, Artificial Sequence
  chemically synthesized
agacaatggaataattgatc

SEQ ID NO: 248950 - DNA, 20 bp, Artificial Sequence
  chemically synthesized
atggaataattgatcaagaa

SEQ ID NO: 248951 - DNA, 20 bp, Artificial Sequence
  chemically synthesized
ggaataattgatcaagaaca

SEQ ID NO: 248952 - DNA, 20 bp, Artificial Sequence
  chemically synthesized
ataattgatcaagaacagag

SEQ ID NO: 248953 - DNA, 20 bp, Artificial Sequence
  chemically synthesized
taattgatcaagaacagaga

SEQ ID NO: 248954 - DNA, 20 bp, Artificial Sequence
  chemically synthesized
caagaacagagaaggattcc

SEQ ID NO: 248955 - DNA, 20 bp, Artificial Sequence
  chemically synthesized
agaacagagaaggattccaa

SEQ ID NO: 248956 - DNA, 20 bp, Artificial Sequence
  chemically synthesized
gaacagagaaggattccaag

SEQ ID NO: 248957 - DNA, 20 bp, Artificial Sequence
  chemically synthesized
cagagaaggattccaagagg

SEQ ID NO: 248958 - DNA, 20 bp, Artificial Sequence
  chemically synthesized
tcagtgcaaataccacctct

SEQ ID NO: 248959 - DNA, 20 bp, Artificial Sequence
  chemically synthesized
cctacacaccattcagcatt

SEQ ID NO: 248960 - DNA, 20 bp, Artificial Sequence
  chemically synthesized
tatttgcactgaatgctgaa

SEQ ID NO: 248961 - DNA, 20 bp, Artificial Sequence
  chemically synthesized
gcaaattcctacacaccatt

SEQ ID NO: 248962 - DNA, 20 bp, Artificial Sequence
  chemically synthesized
actgaatgctgaatggtgtg

SEQ ID NO: 248963 - DNA, 20 bp, Artificial Sequence
  chemically synthesized
ctgaatgctgaatggtgtgt

SEQ ID NO: 248964 - DNA, 20 bp, Artificial Sequence
  chemically synthesized
atggtgtgtaggaatttgct

SEQ ID NO: 248965 - DNA, 20 bp, Artificial Sequence
  chemically synthesized
tggtgtgtaggaatttgcta

SEQ ID NO: 248966 - DNA, 20 bp, Artificial Sequence
  chemically synthesized
gtgtgtaggaatttgctaag

SEQ ID NO: 248967 - DNA, 20 bp, Artificial Sequence
  chemically synthesized
gtaggaatttgctaaggagc

SEQ ID NO: 248968 - DNA, 20 bp, Artificial Sequence
  chemically synthesized
aggagtcctgacttgctcct

SEQ ID NO: 248969 - DNA, 20 bp, Artificial Sequence
  chemically synthesized
gaatttgctaaggagcaagt

SEQ ID NO: 248970 - DNA, 20 bp, Artificial Sequence
  chemically synthesized
aatttgctaaggagcaagtc

SEQ ID NO: 248971 - DNA, 20 bp, Artificial Sequence
  chemically synthesized
ggagcaagtcaggactcctc

SEQ ID NO: 248972 - DNA, 20 bp, Artificial Sequence
  chemically synthesized
gattttctgatgtgcttgag

SEQ ID NO: 248973 - DNA, 20 bp, Artificial Sequence
  chemically synthesized
aggattttctgatgtgcttg

SEQ ID NO: 248974 - DNA, 20 bp, Artificial Sequence
  chemically synthesized
aaggattttctgatgtgctt

SEQ ID NO: 248975 - DNA, 20 bp, Artificial Sequence
  chemically synthesized
tcaggactcctcaagcacat

SEQ ID NO: 248976 - DNA, 20 bp, Artificial Sequence
  chemically synthesized
ttagcaaagccaagtggtaa

SEQ ID NO: 248977 - DNA, 20 bp, Artificial Sequence
  chemically synthesized
tcagaaaatcctttaccact

SEQ ID NO: 248978 - DNA, 20 bp, Artificial Sequence
  chemically synthesized
cttagcaaagccaagtggta

SEQ ID NO: 248979 - DNA, 20 bp, Artificial Sequence
  chemically synthesized
agatgcttagcaaagccaag

SEQ ID NO: 248980 - DNA, 20 bp, Artificial Sequence
  chemically synthesized
acaagatgcttagcaaagcc

SEQ ID NO: 248981 - DNA, 20 bp, Artificial Sequence
  chemically synthesized
ctttaccacttggctttgct

SEQ ID NO: 248982 - DNA, 20 bp, Artificial Sequence
  chemically synthesized
tcattacaagatgcttagca

SEQ ID NO: 248983 - DNA, 20 bp, Artificial Sequence
  chemically synthesized
gtaattcattacaagatgct

SEQ ID NO: 248984 - DNA, 20 bp, Artificial Sequence
  chemically synthesized
aatggattgtaattcattac

SEQ ID NO: 248985 - DNA, 20 bp, Artificial Sequence
  chemically synthesized
ttcgagatcagtagcagaaa

SEQ ID NO: 248986 - DNA, 20 bp, Artificial Sequence
  chemically synthesized
tttatgttcgagatcagtag

SEQ ID NO: 248987 - DNA, 20 bp, Artificial Sequence
  chemically synthesized
atctttatgttcgagatcag

SEQ ID NO: 248988 - DNA, 20 bp, Artificial Sequence
  chemically synthesized
gatatctttatgttcgagat

SEQ ID NO: 248989 - DNA, 20 bp, Artificial Sequence
  chemically synthesized
tgctactgatctcgaacata

SEQ ID NO: 248990 - DNA, 20 bp, Artificial Sequence
  chemically synthesized
aaggtgatatctttatgttc

SEQ ID NO: 248991 - DNA, 20 bp, Artificial Sequence
  chemically synthesized
aaagatgtttaaatttttga

SEQ ID NO: 248992 - DNA, 20 bp, Artificial Sequence
  chemically synthesized
aaaagatgtttaaatttttg

SEQ ID NO: 248993 - DNA, 20 bp, Artificial Sequence
  chemically synthesized
aaaatttaaacatcttttta

SEQ ID NO: 248994 - DNA, 20 bp, Artificial Sequence
  chemically synthesized
caagaccaaagtactttaaa

SEQ ID NO: 248995 - DNA, 20 bp, Artificial Sequence
  chemically synthesized
aacatctttttaaagtactt

SEQ ID NO: 248996 - DNA, 20 bp, Artificial Sequence
  chemically synthesized
aagtctcatatacaagacca

SEQ ID NO: 248997 - DNA, 20 bp, Artificial Sequence
  chemically synthesized
agtactttggtcttgtatat

SEQ ID NO: 248998 - DNA, 20 bp, Artificial Sequence
  chemically synthesized
ctttttaaagtctcatatac

SEQ ID NO: 248999 - DNA, 20 bp, Artificial Sequence
  chemically synthesized
cttgtatatgagactttaaa

SEQ ID NO: 249000 - DNA, 20 bp, Artificial Sequence
  chemically synthesized
atacgtataatgacttttta

SEQ ID NO: 249001 - DNA, 20 bp, Artificial Sequence
  chemically synthesized
tccagatctatagacatcag

SEQ ID NO: 249002 - DNA, 20 bp, Artificial Sequence
  chemically synthesized
gttgtttctactgatgtcta

SEQ ID NO: 249003 - DNA, 20 bp, Artificial Sequence
  chemically synthesized
ccttccagatctatagacat

SEQ ID NO: 249004 - DNA, 20 bp, Artificial Sequence
  chemically synthesized
tctactgatgtctatagatc

SEQ ID NO: 249005 - DNA, 20 bp, Artificial Sequence
  chemically synthesized
tgttcttccttccagatcta

SEQ ID NO: 249006 - DNA, 20 bp, Artificial Sequence
  chemically synthesized
actgatgtctatagatctgg

SEQ ID NO: 249007 - DNA, 20 bp, Artificial Sequence
  chemically synthesized
ctgatgtctatagatctgga

SEQ ID NO: 249008 - DNA, 20 bp, Artificial Sequence
  chemically synthesized
atgtctatagatctggaagg

SEQ ID NO: 249009 - DNA, 20 bp, Artificial Sequence
  chemically synthesized
aaggattatgttcttccttc

SEQ ID NO: 249010 - DNA, 20 bp, Artificial Sequence
  chemically synthesized
gaaggaagaacataatcctt

SEQ ID NO: 249011 - DNA, 20 bp, Artificial Sequence
  chemically synthesized
agaacataatccttgagcat

SEQ ID NO: 249012 - DNA, 20 bp, Artificial Sequence
  chemically synthesized
cataggatttcttatgctca

SEQ ID NO: 249013 - DNA, 20 bp, Artificial Sequence
  chemically synthesized
acataggatttcttatgctc

SEQ ID NO: 249014 - DNA, 20 bp, Artificial Sequence
  chemically synthesized
gcctccatggcatttcacat

SEQ ID NO: 249015 - DNA, 20 bp, Artificial Sequence
  chemically synthesized
tgcctccatggcatttcaca

SEQ ID NO: 249016 - DNA, 20 bp, Artificial Sequence
  chemically synthesized
aaatcctatgtgaaatgcca

SEQ ID NO: 249017 - DNA, 20 bp, Artificial Sequence
  chemically synthesized
atcctatgtgaaatgccatg

SEQ ID NO: 249018 - DNA, 20 bp, Artificial Sequence
  chemically synthesized
tcctatgtgaaatgccatgg

SEQ ID NO: 249019 - DNA, 20 bp, Artificial Sequence
  chemically synthesized
tatgtgaaatgccatggagg

SEQ ID NO: 249020 - DNA, 20 bp, Artificial Sequence
  chemically synthesized
atgtgaaatgccatggaggc

SEQ ID NO: 249021 - DNA, 20 bp, Artificial Sequence
  chemically synthesized
cactacatagcctgcctcca

SEQ ID NO: 249022 - DNA, 20 bp, Artificial Sequence
  chemically synthesized
tgccatggaggcaggctatg

SEQ ID NO: 249023 - DNA, 20 bp, Artificial Sequence
  chemically synthesized
catggaggcaggctatgtag

SEQ ID NO: 249024 - DNA, 20 bp, Artificial Sequence
  chemically synthesized
atgaattcttttccactaca

SEQ ID NO: 249025 - DNA, 20 bp, Artificial Sequence
  chemically synthesized
aggcaggctatgtagtggaa

SEQ ID NO: 249026 - DNA, 20 bp, Artificial Sequence
  chemically synthesized
agtggaaaagaattcataac

SEQ ID NO: 249027 - DNA, 20 bp, Artificial Sequence
  chemically synthesized
gtggaaaagaattcataact

SEQ ID NO: 249028 - DNA, 20 bp, Artificial Sequence
  chemically synthesized
tggaaaagaattcataactg

SEQ ID NO: 249029 - DNA, 20 bp, Artificial Sequence
  chemically synthesized
cagagtctatatcgtgaccc

SEQ ID NO: 249030 - DNA, 20 bp, Artificial Sequence
  chemically synthesized
tcataactggggtcacgata

SEQ ID NO: 249031 - DNA, 20 bp, Artificial Sequence
  chemically synthesized
tggggtcacgatatagactc

SEQ ID NO: 249032 - DNA, 20 bp, Artificial Sequence
  chemically synthesized
cacacatgaagtatgtgcca

SEQ ID NO: 249033 - DNA, 20 bp, Artificial Sequence
  chemically synthesized
ctcacacatgaagtatgtgc

SEQ ID NO: 249034 - DNA, 20 bp, Artificial Sequence
  chemically synthesized
ctggcacatacttcatgtgt

SEQ ID NO: 249035 - DNA, 20 bp, Artificial Sequence
  chemically synthesized
ttgtcttaagctcacacatg

SEQ ID NO: 249036 - DNA, 20 bp, Artificial Sequence
  chemically synthesized
catacttcatgtgtgagctt

SEQ ID NO: 249037 - DNA, 20 bp, Artificial Sequence
  chemically synthesized
ttagaataaataattgtctt

SEQ ID NO: 249038 - DNA, 20 bp, Artificial Sequence
  chemically synthesized
agacgaataattttgagttt

SEQ ID NO: 249039 - DNA, 20 bp, Artificial Sequence
  chemically synthesized
ttttagagacgaataatttt

SEQ ID NO: 249040 - DNA, 20 bp, Artificial Sequence
  chemically synthesized
aattattcgtctctaaaatt

SEQ ID NO: 249041 - DNA, 20 bp, Artificial Sequence
  chemically synthesized
tcaagagaaccttaatttta

SEQ ID NO: 249042 - DNA, 20 bp, Artificial Sequence
  chemically synthesized
attattcgtctctaaaatta

SEQ ID NO: 249043 - DNA, 20 bp, Artificial Sequence
  chemically synthesized
tctcaagagaaccttaattt

SEQ ID NO: 249044 - DNA, 20 bp, Artificial Sequence
  chemically synthesized
tctaaaattaaggttctctt

SEQ ID NO: 249045 - DNA, 20 bp, Artificial Sequence
  chemically synthesized
atatatcatttcattctcaa

SEQ ID NO: 249046 - DNA, 20 bp, Artificial Sequence
  chemically synthesized
acatatatcatttcattctc

SEQ ID NO: 249047 - DNA, 20 bp, Artificial Sequence
  chemically synthesized
gagaatgaaatgatatatgt

SEQ ID NO: 249048 - DNA, 20 bp, Artificial Sequence
  chemically synthesized
agaatgaaatgatatatgta

SEQ ID NO: 249049 - DNA, 20 bp, Artificial Sequence
  chemically synthesized
atgtgccaggcatgggttca

SEQ ID NO: 249050 - DNA, 20 bp, Artificial Sequence
  chemically synthesized
ctatgtgccaggcatgggtt

SEQ ID NO: 249051 - DNA, 20 bp, Artificial Sequence
  chemically synthesized
taaggctctgaacccatgcc

SEQ ID NO: 249052 - DNA, 20 bp, Artificial Sequence
  chemically synthesized
cacacctatgtgccaggcat

SEQ ID NO: 249053 - DNA, 20 bp, Artificial Sequence
  chemically synthesized
gcacacctatgtgccaggca

SEQ ID NO: 249054 - DNA, 20 bp, Artificial Sequence
  chemically synthesized
ctgaacccatgcctggcaca

SEQ ID NO: 249055 - DNA, 20 bp, Artificial Sequence
  chemically synthesized
tgaacccatgcctggcacat

SEQ ID NO: 249056 - DNA, 20 bp, Artificial Sequence
  chemically synthesized
tttaggcacacctatgtgcc

SEQ ID NO: 249057 - DNA, 20 bp, Artificial Sequence
  chemically synthesized
ttttaggcacacctatgtgc

SEQ ID NO: 249058 - DNA, 20 bp, Artificial Sequence
  chemically synthesized
acataggtgtgcctaaaaat

SEQ ID NO: 249059 - DNA, 20 bp, Artificial Sequence
  chemically synthesized
agataaaagagcttattttt

SEQ ID NO: 249060 - DNA, 20 bp, Artificial Sequence
  chemically synthesized
aagataaaagagcttatttt

SEQ ID NO: 249061 - DNA, 20 bp, Artificial Sequence
  chemically synthesized
ggaccttgcataagataaaa

SEQ ID NO: 249062 - DNA, 20 bp, Artificial Sequence
  chemically synthesized
atggaccttgcataagataa

SEQ ID NO: 249063 - DNA, 20 bp, Artificial Sequence
  chemically synthesized
taagctcttttatcttatgc

SEQ ID NO: 249064 - DNA, 20 bp, Artificial Sequence
  chemically synthesized
aagctcttttatcttatgca

SEQ ID NO: 249065 - DNA, 20 bp, Artificial Sequence
  chemically synthesized
acgtaggatggaccttgcat

SEQ ID NO: 249066 - DNA, 20 bp, Artificial Sequence
  chemically synthesized
ctttttctggacacgtagga

SEQ ID NO: 249067 - DNA, 20 bp, Artificial Sequence
  chemically synthesized
caaggtccatcctacgtgtc

SEQ ID NO: 249068 - DNA, 20 bp, Artificial Sequence
  chemically synthesized
attactttttctggacacgt

SEQ ID NO: 249069 - DNA, 20 bp, Artificial Sequence
  chemically synthesized
cattactttttctggacacg

SEQ ID NO: 249070 - DNA, 20 bp, Artificial Sequence
  chemically synthesized
ccatcctacgtgtccagaaa

SEQ ID NO: 249071 - DNA, 20 bp, Artificial Sequence
  chemically synthesized
tttcaagacattactttttc

SEQ ID NO: 249072 - DNA, 20 bp, Artificial Sequence
  chemically synthesized
aaagtaatgtcttgaaattt

SEQ ID NO: 249073 - DNA, 20 bp, Artificial Sequence
  chemically synthesized
tgacaatgtactgaaatttc

SEQ ID NO: 249074 - DNA, 20 bp, Artificial Sequence
  chemically synthesized
tcagtacattgtcataatat

SEQ ID NO: 249075 - DNA, 20 bp, Artificial Sequence
  chemically synthesized
cataatatcagctttaaact

SEQ ID NO: 249076 - DNA, 20 bp, Artificial Sequence
  chemically synthesized
ataatatcagctttaaactt

SEQ ID NO: 249077 - DNA, 20 bp, Artificial Sequence
  chemically synthesized
aaaacaaggacctaagttta

SEQ ID NO: 249078 - DNA, 20 bp, Artificial Sequence
  chemically synthesized
ccactataaaacaaggacct

SEQ ID NO: 249079 - DNA, 20 bp, Artificial Sequence
  chemically synthesized
aaacttaggtccttgtttta

SEQ ID NO: 249080 - DNA, 20 bp, Artificial Sequence
  chemically synthesized
tgactaaccactataaaaca

SEQ ID NO: 249081 - DNA, 20 bp, Artificial Sequence
  chemically synthesized
ctgactaaccactataaaac

SEQ ID NO: 249082 - DNA, 20 bp, Artificial Sequence
  chemically synthesized
cttaggtccttgttttatag

SEQ ID NO: 249083 - DNA, 20 bp, Artificial Sequence
  chemically synthesized
ggtccttgttttatagtggt

SEQ ID NO: 249084 - DNA, 20 bp, Artificial Sequence
  chemically synthesized
cttgttttatagtggttagt

SEQ ID NO: 249085 - DNA, 20 bp, Artificial Sequence
  chemically synthesized
atagtggttagtcagtgaat

SEQ ID NO: 249086 - DNA, 20 bp, Artificial Sequence
  chemically synthesized
tggttagtcagtgaattagt

SEQ ID NO: 249087 - DNA, 20 bp, Artificial Sequence
  chemically synthesized
gttacctaaatttaattagc

SEQ ID NO: 249088 - DNA, 20 bp, Artificial Sequence
  chemically synthesized
ataagttacctaaatttaat

SEQ ID NO: 249089 - DNA, 20 bp, Artificial Sequence
  chemically synthesized
caaaacttgctaattaaatt

SEQ ID NO: 249090 - DNA, 20 bp, Artificial Sequence
  chemically synthesized
aaaacttgctaattaaattt

SEQ ID NO: 249091 - DNA, 20 bp, Artificial Sequence
  chemically synthesized
agttggatcctaagttatat

SEQ ID NO: 249092 - DNA, 20 bp, Artificial Sequence
  chemically synthesized
tttaggtaacttatataact

SEQ ID NO: 249093 - DNA, 20 bp, Artificial Sequence
  chemically synthesized
ttaggtaacttatataactt

SEQ ID NO: 249094 - DNA, 20 bp, Artificial Sequence
  chemically synthesized
ttttactaaagttggatcct

SEQ ID NO: 249095 - DNA, 20 bp, Artificial Sequence
  chemically synthesized
tataacttaggatccaactt

SEQ ID NO: 249096 - DNA, 20 bp, Artificial Sequence
  chemically synthesized
ttcctaaattttactaaagt

SEQ ID NO: 249097 - DNA, 20 bp, Artificial Sequence
  chemically synthesized
tgctttcctaaattttacta

SEQ ID NO: 249098 - DNA, 20 bp, Artificial Sequence
  chemically synthesized
gatccaactttagtaaaatt

SEQ ID NO: 249099 - DNA, 20 bp, Artificial Sequence
  chemically synthesized
atccaactttagtaaaattt

SEQ ID NO: 249100 - DNA, 20 bp, Artificial Sequence
  chemically synthesized
aactttagtaaaatttagga

SEQ ID NO: 249101 - DNA, 20 bp, Artificial Sequence
  chemically synthesized
agtaaaatttaggaaagcat

SEQ ID NO: 249102 - DNA, 20 bp, Artificial Sequence
  chemically synthesized
taggaaagcattagccctct

SEQ ID NO: 249103 - DNA, 20 bp, Artificial Sequence
  chemically synthesized
gaaagcattagccctctaag

SEQ ID NO: 249104 - DNA, 20 bp, Artificial Sequence
  chemically synthesized
aaagcattagccctctaagt

SEQ ID NO: 249105 - DNA, 20 bp, Artificial Sequence
  chemically synthesized
tcatagcgctcctacttaga

SEQ ID NO: 249106 - DNA, 20 bp, Artificial Sequence
  chemically synthesized
gtcatagcgctcctacttag

SEQ ID NO: 249107 - DNA, 20 bp, Artificial Sequence
  chemically synthesized
agcattagccctctaagtag

SEQ ID NO: 249108 - DNA, 20 bp, Artificial Sequence
  chemically synthesized
tgtcatagcgctcctactta

SEQ ID NO: 249109 - DNA, 20 bp, Artificial Sequence
  chemically synthesized
gttgtcatagcgctcctact

SEQ ID NO: 249110 - DNA, 20 bp, Artificial Sequence
  chemically synthesized
aatggagaatttggttgtca

SEQ ID NO: 249111 - DNA, 20 bp, Artificial Sequence
  chemically synthesized
aatgtgagaaatggagaatt

SEQ ID NO: 249112 - DNA, 20 bp, Artificial Sequence
  chemically synthesized
cttaggaaatgtgagaaatg

SEQ ID NO: 249113 - DNA, 20 bp, Artificial Sequence
  chemically synthesized
tgcttaggaaatgtgagaaa

SEQ ID NO: 249114 - DNA, 20 bp, Artificial Sequence
  chemically synthesized
agctactgcttaggaaatgt

SEQ ID NO: 249115 - DNA, 20 bp, Artificial Sequence
  chemically synthesized
ctccatttctcacatttcct

SEQ ID NO: 249116 - DNA, 20 bp, Artificial Sequence
  chemically synthesized
catttctcacatttcctaag

SEQ ID NO: 249117 - DNA, 20 bp, Artificial Sequence
  chemically synthesized
ttctcacatttcctaagcag

SEQ ID NO: 249118 - DNA, 20 bp, Artificial Sequence
  chemically synthesized
ttagatttaagctactgctt

SEQ ID NO: 249119 - DNA, 20 bp, Artificial Sequence
  chemically synthesized
cttagatttaagctactgct

SEQ ID NO: 249120 - DNA, 20 bp, Artificial Sequence
  chemically synthesized
ctaagcagtagcttaaatct

SEQ ID NO: 249121 - DNA, 20 bp, Artificial Sequence
  chemically synthesized
cttttgtctgacttagattt

SEQ ID NO: 249122 - DNA, 20 bp, Artificial Sequence
  chemically synthesized
gcagtagcttaaatctaagt

SEQ ID NO: 249123 - DNA, 20 bp, Artificial Sequence
  chemically synthesized
tcatcaacttttgtctgact

SEQ ID NO: 249124 - DNA, 20 bp, Artificial Sequence
  chemically synthesized
cttaaatctaagtcagacaa

SEQ ID NO: 249125 - DNA, 20 bp, Artificial Sequence
  chemically synthesized
tcagacaaaagttgatgaat

SEQ ID NO: 249126 - DNA, 20 bp, Artificial Sequence
  chemically synthesized
gatgaatgagaaattacttt

SEQ ID NO: 249127 - DNA, 20 bp, Artificial Sequence
  chemically synthesized
tctgtttctccatattctca

SEQ ID NO: 249128 - DNA, 20 bp, Artificial Sequence
  chemically synthesized
gagaaattactttgagaata

SEQ ID NO: 249129 - DNA, 20 bp, Artificial Sequence
  chemically synthesized
gaaattactttgagaatatg

SEQ ID NO: 249130 - DNA, 20 bp, Artificial Sequence
  chemically synthesized
actttgagaatatggagaaa

SEQ ID NO: 249131 - DNA, 20 bp, Artificial Sequence
  chemically synthesized
ttgagaatatggagaaacag

SEQ ID NO: 249132 - DNA, 20 bp, Artificial Sequence
  chemically synthesized
gagaatatggagaaacagaa

SEQ ID NO: 249133 - DNA, 20 bp, Artificial Sequence
  chemically synthesized
aatatggagaaacagaagag

SEQ ID NO: 249134 - DNA, 20 bp, Artificial Sequence
  chemically synthesized
atatggagaaacagaagagt

SEQ ID NO: 249135 - DNA, 20 bp, Artificial Sequence
  chemically synthesized
gaaacagaagagtaggtacc

SEQ ID NO: 249136 - DNA, 20 bp, Artificial Sequence
  chemically synthesized
aaacagaagagtaggtacct

SEQ ID NO: 249137 - DNA, 20 bp, Artificial Sequence
  chemically synthesized
aacagaagagtaggtaccta

SEQ ID NO: 249138 - DNA, 20 bp, Artificial Sequence
  chemically synthesized
gaagttttcatcatttccct

SEQ ID NO: 249139 - DNA, 20 bp, Artificial Sequence
  chemically synthesized
agaagttttcatcatttccc

SEQ ID NO: 249140 - DNA, 20 bp, Artificial Sequence
  chemically synthesized
ttctgccaatataagagtag

SEQ ID NO: 249141 - DNA, 20 bp, Artificial Sequence
  chemically synthesized
aaattctgccaatataagag

SEQ ID NO: 249142 - DNA, 20 bp, Artificial Sequence
  chemically synthesized
gaaaacttctactcttatat

SEQ ID NO: 249143 - DNA, 20 bp, Artificial Sequence
  chemically synthesized
actaaattctgccaatataa

SEQ ID NO: 249144 - DNA, 20 bp, Artificial Sequence
  chemically synthesized
aacttctactcttatattgg

SEQ ID NO: 249145 - DNA, 20 bp, Artificial Sequence
  chemically synthesized
ttactaaattctgccaatat

SEQ ID NO: 249146 - DNA, 20 bp, Artificial Sequence
  chemically synthesized
actcttatattggcagaatt

SEQ ID NO: 249147 - DNA, 20 bp, Artificial Sequence
  chemically synthesized
ttatattggcagaatttagt

SEQ ID NO: 249148 - DNA, 20 bp, Artificial Sequence
  chemically synthesized
attggcagaatttagtaagc

SEQ ID NO: 249149 - DNA, 20 bp, Artificial Sequence
  chemically synthesized
tggcagaatttagtaagcca

SEQ ID NO: 249150 - DNA, 20 bp, Artificial Sequence
  chemically synthesized
agaatttagtaagccagagt

SEQ ID NO: 249151 - DNA, 20 bp, Artificial Sequence
  chemically synthesized
attcagcccgcatcttactc

SEQ ID NO: 249152 - DNA, 20 bp, Artificial Sequence
  chemically synthesized
tagtaagccagagtaagatg

SEQ ID NO: 249153 - DNA, 20 bp, Artificial Sequence
  chemically synthesized
agtaagccagagtaagatgc

SEQ ID NO: 249154 - DNA, 20 bp, Artificial Sequence
  chemically synthesized
gagtaagatgcgggctgaat

SEQ ID NO: 249155 - DNA, 20 bp, Artificial Sequence
  chemically synthesized
gtaagatgcgggctgaatca

SEQ ID NO: 249156 - DNA, 20 bp, Artificial Sequence
  chemically synthesized
taattttatgaactctgatt

SEQ ID NO: 249157 - DNA, 20 bp, Artificial Sequence
  chemically synthesized
tgaatcagagttcataaaat

SEQ ID NO: 249158 - DNA, 20 bp, Artificial Sequence
  chemically synthesized
gaatcagagttcataaaatt

SEQ ID NO: 249159 - DNA, 20 bp, Artificial Sequence
  chemically synthesized
cagagttcataaaattagga

SEQ ID NO: 249160 - DNA, 20 bp, Artificial Sequence
  chemically synthesized
aaaattaggaaagaaaaaaa

SEQ ID NO: 249161 - DNA, 20 bp, Artificial Sequence
  chemically synthesized
aaattaggaaagaaaaaaaa

SEQ ID NO: 249162 - DNA, 20 bp, Artificial Sequence
  chemically synthesized
aattaggaaagaaaaaaaaa

SEQ ID NO: 249163 - DNA, 20 bp, Artificial Sequence
  chemically synthesized
taggaaagaaaaaaaaaggg

SEQ ID NO: 249164 - DNA, 20 bp, Artificial Sequence
  chemically synthesized
aggaaagaaaaaaaaaggga

SEQ ID NO: 249165 - DNA, 20 bp, Artificial Sequence
  chemically synthesized
ggaaagaaaaaaaaagggaa

SEQ ID NO: 249166 - DNA, 20 bp, Artificial Sequence
  chemically synthesized
aaaaagggaagggttaacta

SEQ ID NO: 249167 - DNA, 20 bp, Artificial Sequence
  chemically synthesized
ggaagggttaactaaagaca

SEQ ID NO: 249168 - DNA, 20 bp, Artificial Sequence
  chemically synthesized
aaaaagggcaactttgtctt

SEQ ID NO: 249169 - DNA, 20 bp, Artificial Sequence
  chemically synthesized
ccctaagaagagtgtaaaaa

SEQ ID NO: 249170 - DNA, 20 bp, Artificial Sequence
  chemically synthesized
gccctaagaagagtgtaaaa

SEQ ID NO: 249171 - DNA, 20 bp, Artificial Sequence
  chemically synthesized
agccctaagaagagtgtaaa

SEQ ID NO: 249172 - DNA, 20 bp, Artificial Sequence
  chemically synthesized
tgccctttttacactcttct

SEQ ID NO: 249173 - DNA, 20 bp, Artificial Sequence
  chemically synthesized
gccctttttacactcttctt

SEQ ID NO: 249174 - DNA, 20 bp, Artificial Sequence
  chemically synthesized
ccctttttacactcttctta

SEQ ID NO: 249175 - DNA, 20 bp, Artificial Sequence
  chemically synthesized
tatttaaggagccctaagaa

SEQ ID NO: 249176 - DNA, 20 bp, Artificial Sequence
  chemically synthesized
tttatttaaggagccctaag

SEQ ID NO: 249177 - DNA, 20 bp, Artificial Sequence
  chemically synthesized
tgttttatttaaggagccct

SEQ ID NO: 249178 - DNA, 20 bp, Artificial Sequence
  chemically synthesized
tttgttttgttttatttaag

SEQ ID NO: 249179 - DNA, 20 bp, Artificial Sequence
  chemically synthesized
gttttgttttgttttattta

SEQ ID NO: 249180 - DNA, 20 bp, Artificial Sequence
  chemically synthesized
tgttttgttttgttttattt

SEQ ID NO: 249181 - DNA, 20 bp, Artificial Sequence
  chemically synthesized
caaaacaaaacaaaacaaaa

SEQ ID NO: 249182 - DNA, 20 bp, Artificial Sequence
  chemically synthesized
aaaacaaaacaaaacaaaac

SEQ ID NO: 249183 - DNA, 20 bp, Artificial Sequence
  chemically synthesized
aacaaaacaaaacaaaacag

SEQ ID NO: 249184 - DNA, 20 bp, Artificial Sequence
  chemically synthesized
aaacaaaacaaaacaggagc

SEQ ID NO: 249185 - DNA, 20 bp, Artificial Sequence
  chemically synthesized
aacaaaacaaaacaggagcc

SEQ ID NO: 249186 - DNA, 20 bp, Artificial Sequence
  chemically synthesized
aacaaaacaggagccgggtg

SEQ ID NO: 249187 - DNA, 20 bp, Artificial Sequence
  chemically synthesized
aaaacaggagccgggtgcag

SEQ ID NO: 249188 - DNA, 20 bp, Artificial Sequence
  chemically synthesized
cagaggcacaccactgcacc

SEQ ID NO: 249189 - DNA, 20 bp, Artificial Sequence
  chemically synthesized
ctgagaagatgggattacag

SEQ ID NO: 249190 - DNA, 20 bp, Artificial Sequence
  chemically synthesized
tctgagaagatgggattaca

SEQ ID NO: 249191 - DNA, 20 bp, Artificial Sequence
  chemically synthesized
cttctgagaagatgggatta

SEQ ID NO: 249192 - DNA, 20 bp, Artificial Sequence
  chemically synthesized
cctctgtaatcccatcttct

SEQ ID NO: 249193 - DNA, 20 bp, Artificial Sequence
  chemically synthesized
cctcagccttctgagaagat

SEQ ID NO: 249194 - DNA, 20 bp, Artificial Sequence
  chemically synthesized
acctcagccttctgagaaga

SEQ ID NO: 249195 - DNA, 20 bp, Artificial Sequence
  chemically synthesized
ctgtaatcccatcttctcag

SEQ ID NO: 249196 - DNA, 20 bp, Artificial Sequence
  chemically synthesized
tgtaatcccatcttctcaga

SEQ ID NO: 249197 - DNA, 20 bp, Artificial Sequence
  chemically synthesized
tcccacctcagccttctgag

SEQ ID NO: 249198 - DNA, 20 bp, Artificial Sequence
  chemically synthesized
tcctcccacctcagccttct

SEQ ID NO: 249199 - DNA, 20 bp, Artificial Sequence
  chemically synthesized
tcccatcttctcagaaggct

SEQ ID NO: 249200 - DNA, 20 bp, Artificial Sequence
  chemically synthesized
cccatcttctcagaaggctg

SEQ ID NO: 249201 - DNA, 20 bp, Artificial Sequence
  chemically synthesized
atcttctcagaaggctgagg

SEQ ID NO: 249202 - DNA, 20 bp, Artificial Sequence
  chemically synthesized
tcttctcagaaggctgaggt

SEQ ID NO: 249203 - DNA, 20 bp, Artificial Sequence
  chemically synthesized
ttctcagaaggctgaggtgg

SEQ ID NO: 249204 - DNA, 20 bp, Artificial Sequence
  chemically synthesized
tctcagaaggctgaggtggg

SEQ ID NO: 249205 - DNA, 20 bp, Artificial Sequence
  chemically synthesized
atgaagtaatcctcccacct

SEQ ID NO: 249206 - DNA, 20 bp, Artificial Sequence
  chemically synthesized
ggtgggaggattacttcatc

SEQ ID NO: 249207 - DNA, 20 bp, Artificial Sequence
  chemically synthesized
gtgggaggattacttcatcc

SEQ ID NO: 249208 - DNA, 20 bp, Artificial Sequence
  chemically synthesized
tgggaggattacttcatcca

SEQ ID NO: 249209 - DNA, 20 bp, Artificial Sequence
  chemically synthesized
ggtctcaaactccctggatg

SEQ ID NO: 249210 - DNA, 20 bp, Artificial Sequence
  chemically synthesized
ggaggattacttcatccagg

SEQ ID NO: 249211 - DNA, 20 bp, Artificial Sequence
  chemically synthesized
ggggctggtctcaaactccc

SEQ ID NO: 249212 - DNA, 20 bp, Artificial Sequence
  chemically synthesized
ttacttcatccagggagttt

SEQ ID NO: 249213 - DNA, 20 bp, Artificial Sequence
  chemically synthesized
tcatccagggagtttgagac

SEQ ID NO: 249214 - DNA, 20 bp, Artificial Sequence
  chemically synthesized
agggagtttgagaccagccc

SEQ ID NO: 249215 - DNA, 20 bp, Artificial Sequence
  chemically synthesized
agtgagagtgttgctggggc

SEQ ID NO: 249216 - DNA, 20 bp, Artificial Sequence
  chemically synthesized
tttgagtgagagtgttgctg

SEQ ID NO: 249217 - DNA, 20 bp, Artificial Sequence
  chemically synthesized
ttttgagtgagagtgttgct

SEQ ID NO: 249218 - DNA, 20 bp, Artificial Sequence
  chemically synthesized
tttttgagtgagagtgttgc

SEQ ID NO: 249219 - DNA, 20 bp, Artificial Sequence
  chemically synthesized
atttatttttttttgagtga

SEQ ID NO: 249220 - DNA, 20 bp, Artificial Sequence
  chemically synthesized
ttatttatttttttttgagt

SEQ ID NO: 249221 - DNA, 20 bp, Artificial Sequence
  chemically synthesized
ttacttatttattttttttt

SEQ ID NO: 249222 - DNA, 20 bp, Artificial Sequence
  chemically synthesized
tcactcaaaaaaaaataaat

SEQ ID NO: 249223 - DNA, 20 bp, Artificial Sequence
  chemically synthesized
aaaaaaaaataaataagtaa

SEQ ID NO: 249224 - DNA, 20 bp, Artificial Sequence
  chemically synthesized
tcaacatgtatatttaaaaa

SEQ ID NO: 249225 - DNA, 20 bp, Artificial Sequence
  chemically synthesized
cttcaacatgtatatttaaa

SEQ ID NO: 249226 - DNA, 20 bp, Artificial Sequence
  chemically synthesized
ctttttaaatatacatgttg

SEQ ID NO: 249227 - DNA, 20 bp, Artificial Sequence
  chemically synthesized
atatacatgttgaagactgt

SEQ ID NO: 249228 - DNA, 20 bp, Artificial Sequence
  chemically synthesized
gaatattggaagagaactaa

SEQ ID NO: 249229 - DNA, 20 bp, Artificial Sequence
  chemically synthesized
aaaaaaaaagaatattggaa

SEQ ID NO: 249230 - DNA, 20 bp, Artificial Sequence
  chemically synthesized
aaaaaaaaaaagaatattgg

SEQ ID NO: 249231 - DNA, 20 bp, Artificial Sequence
  chemically synthesized
gaaaaaaaaaaaaagaatat

SEQ ID NO: 249232 - DNA, 20 bp, Artificial Sequence
  chemically synthesized
tcagtcatgaaaaaaaaaaa

SEQ ID NO: 249233 - DNA, 20 bp, Artificial Sequence
  chemically synthesized
ttttttttttcatgactgaa

SEQ ID NO: 249234 - DNA, 20 bp, Artificial Sequence
  chemically synthesized
gtgctctgctaaaaactgtt

SEQ ID NO: 249235 - DNA, 20 bp, Artificial Sequence
  chemically synthesized
tttcatgactgaacagtttt

SEQ ID NO: 249236 - DNA, 20 bp, Artificial Sequence
  chemically synthesized
catgactgaacagtttttag

SEQ ID NO: 249237 - DNA, 20 bp, Artificial Sequence
  chemically synthesized
tgactgaacagtttttagca

SEQ ID NO: 249238 - DNA, 20 bp, Artificial Sequence
  chemically synthesized
tgtgaaataaacacatttcc

SEQ ID NO: 249239 - DNA, 20 bp, Artificial Sequence
  chemically synthesized
tctaagctgcaagtggggct

SEQ ID NO: 249240 - DNA, 20 bp, Artificial Sequence
  chemically synthesized
atctaagctgcaagtggggc

SEQ ID NO: 249241 - DNA, 20 bp, Artificial Sequence
  chemically synthesized
acatttcccagccccacttg

SEQ ID NO: 249242 - DNA, 20 bp, Artificial Sequence
  chemically synthesized
ccacatctaagctgcaagtg

SEQ ID NO: 249243 - DNA, 20 bp, Artificial Sequence
  chemically synthesized
gccacatctaagctgcaagt

SEQ ID NO: 249244 - DNA, 20 bp, Artificial Sequence
  chemically synthesized
ggccacatctaagctgcaag

SEQ ID NO: 249245 - DNA, 20 bp, Artificial Sequence
  chemically synthesized
tcccagccccacttgcagct

SEQ ID NO: 249246 - DNA, 20 bp, Artificial Sequence
  chemically synthesized
catggccacatctaagctgc

SEQ ID NO: 249247 - DNA, 20 bp, Artificial Sequence
  chemically synthesized
ccccacttgcagcttagatg

SEQ ID NO: 249248 - DNA, 20 bp, Artificial Sequence
  chemically synthesized
tctgtcacatggccacatct

SEQ ID NO: 249249 - DNA, 20 bp, Artificial Sequence
  chemically synthesized
gcttagatgtggccatgtga

SEQ ID NO: 249250 - DNA, 20 bp, Artificial Sequence
  chemically synthesized
ttggccagatgtctgtcaca

SEQ ID NO: 249251 - DNA, 20 bp, Artificial Sequence
  chemically synthesized
gtggccatgtgacagacatc

SEQ ID NO: 249252 - DNA, 20 bp, Artificial Sequence
  chemically synthesized
tgacagacatctggccaatg

SEQ ID NO: 249253 - DNA, 20 bp, Artificial Sequence
  chemically synthesized
tccacttacgcttcattggc

SEQ ID NO: 249254 - DNA, 20 bp, Artificial Sequence
  chemically synthesized
tatttccacttacgcttcat

SEQ ID NO: 249255 - DNA, 20 bp, Artificial Sequence
  chemically synthesized
acatctggccaatgaagcgt

SEQ ID NO: 249256 - DNA, 20 bp, Artificial Sequence
  chemically synthesized
tctggccaatgaagcgtaag

SEQ ID NO: 249257 - DNA, 20 bp, Artificial Sequence
  chemically synthesized
gcgtaagtggaaatataaca

SEQ ID NO: 249258 - DNA, 20 bp, Artificial Sequence
  chemically synthesized
taagtggaaatataacatgg

SEQ ID NO: 249259 - DNA, 20 bp, Artificial Sequence
  chemically synthesized
cttttagggaagtttcgtgg

SEQ ID NO: 249260 - DNA, 20 bp, Artificial Sequence
  chemically synthesized
gtcttttagggaagtttcgt

SEQ ID NO: 249261 - DNA, 20 bp, Artificial Sequence
  chemically synthesized
tgtcttttagggaagtttcg

SEQ ID NO: 249262 - DNA, 20 bp, Artificial Sequence
  chemically synthesized
ctcccacgaaacttccctaa

SEQ ID NO: 249263 - DNA, 20 bp, Artificial Sequence
  chemically synthesized
ataccaattgtcttttaggg

SEQ ID NO: 249264 - DNA, 20 bp, Artificial Sequence
  chemically synthesized
tgcataccaattgtctttta

SEQ ID NO: 249265 - DNA, 20 bp, Artificial Sequence
  chemically synthesized
gtgcataccaattgtctttt

SEQ ID NO: 249266 - DNA, 20 bp, Artificial Sequence
  chemically synthesized
ggtgcataccaattgtcttt

SEQ ID NO: 249267 - DNA, 20 bp, Artificial Sequence
  chemically synthesized
aaacttccctaaaagacaat

SEQ ID NO: 249268 - DNA, 20 bp, Artificial Sequence
  chemically synthesized
aggccagaagaagggtcaaa

SEQ ID NO: 249269 - DNA, 20 bp, Artificial Sequence
  chemically synthesized
aaggccagaagaagggtcaa

SEQ ID NO: 249270 - DNA, 20 bp, Artificial Sequence
  chemically synthesized
gaaggccagaagaagggtca

SEQ ID NO: 249271 - DNA, 20 bp, Artificial Sequence
  chemically synthesized
gcaccctttgacccttcttc

SEQ ID NO: 249272 - DNA, 20 bp, Artificial Sequence
  chemically synthesized
atgtaagaaggccagaagaa

SEQ ID NO: 249273 - DNA, 20 bp, Artificial Sequence
  chemically synthesized
gatgtaagaaggccagaaga

SEQ ID NO: 249274 - DNA, 20 bp, Artificial Sequence
  chemically synthesized
ggatgtaagaaggccagaag

SEQ ID NO: 249275 - DNA, 20 bp, Artificial Sequence
  chemically synthesized
gaaggatgtaagaaggccag

SEQ ID NO: 249276 - DNA, 20 bp, Artificial Sequence
  chemically synthesized
caagaaggatgtaagaaggc

SEQ ID NO: 249277 - DNA, 20 bp, Artificial Sequence
  chemically synthesized
attccaagaaggatgtaaga

SEQ ID NO: 249278 - DNA, 20 bp, Artificial Sequence
  chemically synthesized
cattccaagaaggatgtaag

SEQ ID NO: 249279 - DNA, 20 bp, Artificial Sequence
  chemically synthesized
ccacattccaagaaggatgt

SEQ ID NO: 249280 - DNA, 20 bp, Artificial Sequence
  chemically synthesized
tggccttcttacatccttct

SEQ ID NO: 249281 - DNA, 20 bp, Artificial Sequence
  chemically synthesized
atgacatccacattccaaga

SEQ ID NO: 249282 - DNA, 20 bp, Artificial Sequence
  chemically synthesized
catgacatccacattccaag

SEQ ID NO: 249283 - DNA, 20 bp, Artificial Sequence
  chemically synthesized
cttacatccttcttggaatg

SEQ ID NO: 249284 - DNA, 20 bp, Artificial Sequence
  chemically synthesized
tctcatgacatccacattcc

SEQ ID NO: 249285 - DNA, 20 bp, Artificial Sequence
  chemically synthesized
tcttggaatgtggatgtcat

SEQ ID NO: 249286 - DNA, 20 bp, Artificial Sequence
  chemically synthesized
ttggaatgtggatgtcatga

SEQ ID NO: 249287 - DNA, 20 bp, Artificial Sequence
  chemically synthesized
catccacatgttgcaagatg

SEQ ID NO: 249288 - DNA, 20 bp, Artificial Sequence
  chemically synthesized
ttcatccacatgttgcaaga

SEQ ID NO: 249289 - DNA, 20 bp, Artificial Sequence
  chemically synthesized
gaatttcatccacatgttgc

SEQ ID NO: 249290 - DNA, 20 bp, Artificial Sequence
  chemically synthesized
gagctccatcttgcaacatg

SEQ ID NO: 249291 - DNA, 20 bp, Artificial Sequence
  chemically synthesized
catgtggatgaaattccacc

SEQ ID NO: 249292 - DNA, 20 bp, Artificial Sequence
  chemically synthesized
ggatgaaattccaccaagta

SEQ ID NO: 249293 - DNA, 20 bp, Artificial Sequence
  chemically synthesized
agtgagttatctttacttgg

SEQ ID NO: 249294 - DNA, 20 bp, Artificial Sequence
  chemically synthesized
ctgagtgagttatctttact

SEQ ID NO: 249295 - DNA, 20 bp, Artificial Sequence
  chemically synthesized
ccaagtaaagataactcact

SEQ ID NO: 249296 - DNA, 20 bp, Artificial Sequence
  chemically synthesized
agtaaagataactcactcag

SEQ ID NO: 249297 - DNA, 20 bp, Artificial Sequence
  chemically synthesized
atttctgttttctactgagt

SEQ ID NO: 249298 - DNA, 20 bp, Artificial Sequence
  chemically synthesized
gctcatttctgttttctact

SEQ ID NO: 249299 - DNA, 20 bp, Artificial Sequence
  chemically synthesized
ataactcactcagtagaaaa

SEQ ID NO: 249300 - DNA, 20 bp, Artificial Sequence
  chemically synthesized
actcagtagaaaacagaaat

SEQ ID NO: 249301 - DNA, 20 bp, Artificial Sequence
  chemically synthesized
cagtagaaaacagaaatgag

SEQ ID NO: 249302 - DNA, 20 bp, Artificial Sequence
  chemically synthesized
agtagaaaacagaaatgagc

SEQ ID NO: 249303 - DNA, 20 bp, Artificial Sequence
  chemically synthesized
gtagaaaacagaaatgagcg

SEQ ID NO: 249304 - DNA, 20 bp, Artificial Sequence
  chemically synthesized
tgcagccaaggcagatatgt

SEQ ID NO: 249305 - DNA, 20 bp, Artificial Sequence
  chemically synthesized
cggggccaacatatctgcct

SEQ ID NO: 249306 - DNA, 20 bp, Artificial Sequence
  chemically synthesized
ctggaagtttgcagccaagg

SEQ ID NO: 249307 - DNA, 20 bp, Artificial Sequence
  chemically synthesized
accctggaagtttgcagcca

SEQ ID NO: 249308 - DNA, 20 bp, Artificial Sequence
  chemically synthesized
aaccctggaagtttgcagcc

SEQ ID NO: 249309 - DNA, 20 bp, Artificial Sequence
  chemically synthesized
tgaaaaaccctggaagtttg

SEQ ID NO: 249310 - DNA, 20 bp, Artificial Sequence
  chemically synthesized
ctgccttggctgcaaacttc

SEQ ID NO: 249311 - DNA, 20 bp, Artificial Sequence
  chemically synthesized
tgccttggctgcaaacttcc

SEQ ID NO: 249312 - DNA, 20 bp, Artificial Sequence
  chemically synthesized
gccttggctgcaaacttcca

SEQ ID NO: 249313 - DNA, 20 bp, Artificial Sequence
  chemically synthesized
tttctcctgaaaaaccctgg

SEQ ID NO: 249314 - DNA, 20 bp, Artificial Sequence
  chemically synthesized
ttctttctcctgaaaaaccc

SEQ ID NO: 249315 - DNA, 20 bp, Artificial Sequence
  chemically synthesized
tgcaaacttccagggttttt

SEQ ID NO: 249316 - DNA, 20 bp, Artificial Sequence
  chemically synthesized
gcaaacttccagggtttttc

SEQ ID NO: 249317 - DNA, 20 bp, Artificial Sequence
  chemically synthesized
aaacttccagggtttttcag

SEQ ID NO: 249318 - DNA, 20 bp, Artificial Sequence
  chemically synthesized
ttccagggtttttcaggaga

SEQ ID NO: 249319 - DNA, 20 bp, Artificial Sequence
  chemically synthesized
ggtttttcaggagaaagaaa

SEQ ID NO: 249320 - DNA, 20 bp, Artificial Sequence
  chemically synthesized
gtttttcaggagaaagaaat

SEQ ID NO: 249321 - DNA, 20 bp, Artificial Sequence
  chemically synthesized
aaatgacttaaataaaagag

SEQ ID NO: 249322 - DNA, 20 bp, Artificial Sequence
  chemically synthesized
tagaaatgacttaaataaaa

SEQ ID NO: 249323 - DNA, 20 bp, Artificial Sequence
  chemically synthesized
aataggcttctcttttattt

SEQ ID NO: 249324 - DNA, 20 bp, Artificial Sequence
  chemically synthesized
ggtagaaatgacttaaataa

SEQ ID NO: 249325 - DNA, 20 bp, Artificial Sequence
  chemically synthesized
atttaagtcatttctacctt

SEQ ID NO: 249326 - DNA, 20 bp, Artificial Sequence
  chemically synthesized
agtgttacagaagctcaagg

SEQ ID NO: 249327 - DNA, 20 bp, Artificial Sequence
  chemically synthesized
ctaagtgttacagaagctca

SEQ ID NO: 249328 - DNA, 20 bp, Artificial Sequence
  chemically synthesized
gctaagtgttacagaagctc

SEQ ID NO: 249329 - DNA, 20 bp, Artificial Sequence
  chemically synthesized
gctttggctaagtgttacag

SEQ ID NO: 249330 - DNA, 20 bp, Artificial Sequence
  chemically synthesized
ccttgagcttctgtaacact

SEQ ID NO: 249331 - DNA, 20 bp, Artificial Sequence
  chemically synthesized
tttgctttggctaagtgtta

SEQ ID NO: 249332 - DNA, 20 bp, Artificial Sequence
  chemically synthesized
gcttctgtaacacttagcca

SEQ ID NO: 249333 - DNA, 20 bp, Artificial Sequence
  chemically synthesized
aattataatttgctttggct

SEQ ID NO: 249334 - DNA, 20 bp, Artificial Sequence
  chemically synthesized
ttatcaattataatttgctt

SEQ ID NO: 249335 - DNA, 20 bp, Artificial Sequence
  chemically synthesized
aaattataattgataaaata

SEQ ID NO: 249336 - DNA, 20 bp, Artificial Sequence
  chemically synthesized
attataattgataaaataaa

SEQ ID NO: 249337 - DNA, 20 bp, Artificial Sequence
  chemically synthesized
tataattgataaaataaaga

SEQ ID NO: 249338 - DNA, 20 bp, Artificial Sequence
  chemically synthesized
gataaaataaagagagtttc

SEQ ID NO: 249339 - DNA, 20 bp, Artificial Sequence
  chemically synthesized
ataaaataaagagagtttct

SEQ ID NO: 249340 - DNA, 20 bp, Artificial Sequence
  chemically synthesized
ataaagagagtttctgggaa

SEQ ID NO: 249341 - DNA, 20 bp, Artificial Sequence
  chemically synthesized
tgtgctaaatgtacttttcc

SEQ ID NO: 249342 - DNA, 20 bp, Artificial Sequence
  chemically synthesized
gtttctgggaaaagtacatt

SEQ ID NO: 249343 - DNA, 20 bp, Artificial Sequence
  chemically synthesized
tgggaaaagtacatttagca

SEQ ID NO: 249344 - DNA, 20 bp, Artificial Sequence
  chemically synthesized
tttagcacagttttatttta

SEQ ID NO: 249345 - DNA, 20 bp, Artificial Sequence
  chemically synthesized
ctggaatagatgagttttaa

SEQ ID NO: 249346 - DNA, 20 bp, Artificial Sequence
  chemically synthesized
tttctctacctggaatagat

SEQ ID NO: 249347 - DNA, 20 bp, Artificial Sequence
  chemically synthesized
cttttaaaactcatctattc

SEQ ID NO: 249348 - DNA, 20 bp, Artificial Sequence
  chemically synthesized
ttttaaaactcatctattcc

SEQ ID NO: 249349 - DNA, 20 bp, Artificial Sequence
  chemically synthesized
taaaactcatctattccagg

SEQ ID NO: 249350 - DNA, 20 bp, Artificial Sequence
  chemically synthesized
cattttttctctacctggaa

SEQ ID NO: 249351 - DNA, 20 bp, Artificial Sequence
  chemically synthesized
aaactcatctattccaggta

SEQ ID NO: 249352 - DNA, 20 bp, Artificial Sequence
  chemically synthesized
atatgcattttttctctacc

SEQ ID NO: 249353 - DNA, 20 bp, Artificial Sequence
  chemically synthesized
gtagagaaaaaatgcatatt

SEQ ID NO: 249354 - DNA, 20 bp, Artificial Sequence
  chemically synthesized
agagaaaaaatgcatattta

SEQ ID NO: 249355 - DNA, 20 bp, Artificial Sequence
  chemically synthesized
gaaaaaatgcatatttagag

SEQ ID NO: 249356 - DNA, 20 bp, Artificial Sequence
  chemically synthesized
aaaaaatgcatatttagaga

SEQ ID NO: 249357 - DNA, 20 bp, Artificial Sequence
  chemically synthesized
aaaaatgcatatttagagaa

SEQ ID NO: 249358 - DNA, 20 bp, Artificial Sequence
  chemically synthesized
atttgtgaaatgacaaaacc

SEQ ID NO: 249359 - DNA, 20 bp, Artificial Sequence
  chemically synthesized
tttattcattgtgtatttct

SEQ ID NO: 249360 - DNA, 20 bp, Artificial Sequence
  chemically synthesized
caagaaatacacaatgaata

SEQ ID NO: 249361 - DNA, 20 bp, Artificial Sequence
  chemically synthesized
ataaagtcaaatattaatat

SEQ ID NO: 249362 - DNA, 20 bp, Artificial Sequence
  chemically synthesized
ttaatatcagcctccaaaat

SEQ ID NO: 249363 - DNA, 20 bp, Artificial Sequence
  chemically synthesized
taggactagcctcattttgg

SEQ ID NO: 249364 - DNA, 20 bp, Artificial Sequence
  chemically synthesized
taatatcagcctccaaaatg

SEQ ID NO: 249365 - DNA, 20 bp, Artificial Sequence
  chemically synthesized
ataggactagcctcattttg

SEQ ID NO: 249366 - DNA, 20 bp, Artificial Sequence
  chemically synthesized
ccataggactagcctcattt

SEQ ID NO: 249367 - DNA, 20 bp, Artificial Sequence
  chemically synthesized
atcagcctccaaaatgaggc

SEQ ID NO: 249368 - DNA, 20 bp, Artificial Sequence
  chemically synthesized
ccaaaatgaggctagtccta

SEQ ID NO: 249369 - DNA, 20 bp, Artificial Sequence
  chemically synthesized
aaattttgtgtccataggac

SEQ ID NO: 249370 - DNA, 20 bp, Artificial Sequence
  chemically synthesized
gaaagaaattttgtgtccat

SEQ ID NO: 249371 - DNA, 20 bp, Artificial Sequence
  chemically synthesized
agaaagaaattttgtgtcca

SEQ ID NO: 249372 - DNA, 20 bp, Artificial Sequence
  chemically synthesized
cacaaaatttctttctgtat

SEQ ID NO: 249373 - DNA, 20 bp, Artificial Sequence
  chemically synthesized
gaaaaagactctaatacaga

SEQ ID NO: 249374 - DNA, 20 bp, Artificial Sequence
  chemically synthesized
caaaatttctttctgtatta

SEQ ID NO: 249375 - DNA, 20 bp, Artificial Sequence
  chemically synthesized
aaaggaaaaagactctaata

SEQ ID NO: 249376 - DNA, 20 bp, Artificial Sequence
  chemically synthesized
tttattattgtcaaaggaaa

SEQ ID NO: 249377 - DNA, 20 bp, Artificial Sequence
  chemically synthesized
aacatttttattattgtcaa

SEQ ID NO: 249378 - DNA, 20 bp, Artificial Sequence
  chemically synthesized
aaacatttttattattgtca

SEQ ID NO: 249379 - DNA, 20 bp, Artificial Sequence
  chemically synthesized
caataataaaaatgtttatt

SEQ ID NO: 249380 - DNA, 20 bp, Artificial Sequence
  chemically synthesized
aaaatgtttatttagataac

SEQ ID NO: 249381 - DNA, 20 bp, Artificial Sequence
  chemically synthesized
atgtttatttagataacaag

SEQ ID NO: 249382 - DNA, 20 bp, Artificial Sequence
  chemically synthesized
tgtttatttagataacaagc

SEQ ID NO: 249383 - DNA, 20 bp, Artificial Sequence
  chemically synthesized
agataacaagcaggcaaata

SEQ ID NO: 249384 - DNA, 20 bp, Artificial Sequence
  chemically synthesized
cttgttcttcagtatatgag

SEQ ID NO: 249385 - DNA, 20 bp, Artificial Sequence
  chemically synthesized
tcttgttcttcagtatatga

SEQ ID NO: 249386 - DNA, 20 bp, Artificial Sequence
  chemically synthesized
ttcttgttcttcagtatatg

SEQ ID NO: 249387 - DNA, 20 bp, Artificial Sequence
  chemically synthesized
attcttgttcttcagtatat

SEQ ID NO: 249388 - DNA, 20 bp, Artificial Sequence
  chemically synthesized
tacagtcccctcatatactg

SEQ ID NO: 249389 - DNA, 20 bp, Artificial Sequence
  chemically synthesized
cccctcatatactgaagaac

SEQ ID NO: 249390 - DNA, 20 bp, Artificial Sequence
  chemically synthesized
catagatgattcttgttctt

SEQ ID NO: 249391 - DNA, 20 bp, Artificial Sequence
  chemically synthesized
tgaagaacaagaatcatcta

SEQ ID NO: 249392 - DNA, 20 bp, Artificial Sequence
  chemically synthesized
gaacaagaatcatctatggt

SEQ ID NO: 249393 - DNA, 20 bp, Artificial Sequence
  chemically synthesized
aacaagaatcatctatggtg

SEQ ID NO: 249394 - DNA, 20 bp, Artificial Sequence
  chemically synthesized
aagcattttcatcctcacca

SEQ ID NO: 249395 - DNA, 20 bp, Artificial Sequence
  chemically synthesized
ttcccaggatagttgtatac

SEQ ID NO: 249396 - DNA, 20 bp, Artificial Sequence
  chemically synthesized
atgcttgtatacaactatcc

SEQ ID NO: 249397 - DNA, 20 bp, Artificial Sequence
  chemically synthesized
tgcttgtatacaactatcct

SEQ ID NO: 249398 - DNA, 20 bp, Artificial Sequence
  chemically synthesized
aacatttttgtttcccagga

SEQ ID NO: 249399 - DNA, 20 bp, Artificial Sequence
  chemically synthesized
attgaacatttttgtttccc

SEQ ID NO: 249400 - DNA, 20 bp, Artificial Sequence
  chemically synthesized
aattgaacatttttgtttcc

SEQ ID NO: 249401 - DNA, 20 bp, Artificial Sequence
  chemically synthesized
caaaaatgttcaattacttt

SEQ ID NO: 249402 - DNA, 20 bp, Artificial Sequence
  chemically synthesized
tgttcaattactttgagaaa

SEQ ID NO: 249403 - DNA, 20 bp, Artificial Sequence
  chemically synthesized
tatccccagtctttttctca

SEQ ID NO: 249404 - DNA, 20 bp, Artificial Sequence
  chemically synthesized
aattactttgagaaaaagac

SEQ ID NO: 249405 - DNA, 20 bp, Artificial Sequence
  chemically synthesized
attactttgagaaaaagact

SEQ ID NO: 249406 - DNA, 20 bp, Artificial Sequence
  chemically synthesized
ttactttgagaaaaagactg

SEQ ID NO: 249407 - DNA, 20 bp, Artificial Sequence
  chemically synthesized
tagccatagatcaatatccc

SEQ ID NO: 249408 - DNA, 20 bp, Artificial Sequence
  chemically synthesized
agactggggatattgatcta

SEQ ID NO: 249409 - DNA, 20 bp, Artificial Sequence
  chemically synthesized
cataatctcagagttagcca

SEQ ID NO: 249410 - DNA, 20 bp, Artificial Sequence
  chemically synthesized
attgatctatggctaactct

SEQ ID NO: 249411 - DNA, 20 bp, Artificial Sequence
  chemically synthesized
aattcacataatctcagagt

SEQ ID NO: 249412 - DNA, 20 bp, Artificial Sequence
  chemically synthesized
ataaaattcacataatctca

SEQ ID NO: 249413 - DNA, 20 bp, Artificial Sequence
  chemically synthesized
atataaaattcacataatct

SEQ ID NO: 249414 - DNA, 20 bp, Artificial Sequence
  chemically synthesized
gattatgtgaattttatatc

SEQ ID NO: 249415 - DNA, 20 bp, Artificial Sequence
  chemically synthesized
tcttcagataagaaattgac

SEQ ID NO: 249416 - DNA, 20 bp, Artificial Sequence
  chemically synthesized
tctagtcaatttcttatctg

SEQ ID NO: 249417 - DNA, 20 bp, Artificial Sequence
  chemically synthesized
gtttaaaactttcttcagat

SEQ ID NO: 249418 - DNA, 20 bp, Artificial Sequence
  chemically synthesized
gtcaatttcttatctgaaga

SEQ ID NO: 249419 - DNA, 20 bp, Artificial Sequence
  chemically synthesized
ggttagtttaaaactttctt

SEQ ID NO: 249420 - DNA, 20 bp, Artificial Sequence
  chemically synthesized
aaagttttaaactaacctct

SEQ ID NO: 249421 - DNA, 20 bp, Artificial Sequence
  chemically synthesized
ttcacagttcacttagaggt

SEQ ID NO: 249422 - DNA, 20 bp, Artificial Sequence
  chemically synthesized
aatcttcacagttcacttag

SEQ ID NO: 249423 - DNA, 20 bp, Artificial Sequence
  chemically synthesized
aaatcttcacagttcactta

SEQ ID NO: 249424 - DNA, 20 bp, Artificial Sequence
  chemically synthesized
ataaatcttcacagttcact

SEQ ID NO: 249425 - DNA, 20 bp, Artificial Sequence
  chemically synthesized
taacctctaagtgaactgtg

SEQ ID NO: 249426 - DNA, 20 bp, Artificial Sequence
  chemically synthesized
cagattcttataaatcttca

SEQ ID NO: 249427 - DNA, 20 bp, Artificial Sequence
  chemically synthesized
agtgaactgtgaagatttat

SEQ ID NO: 249428 - DNA, 20 bp, Artificial Sequence
  chemically synthesized
ccttatatcttcaacatttt

SEQ ID NO: 249429 - DNA, 20 bp, Artificial Sequence
  chemically synthesized
ataagaatctgaaaatgttg

SEQ ID NO: 249430 - DNA, 20 bp, Artificial Sequence
  chemically synthesized
tctgaaaatgttgaagatat

SEQ ID NO: 249431 - DNA, 20 bp, Artificial Sequence
  chemically synthesized
ctgaaaatgttgaagatata

SEQ ID NO: 249432 - DNA, 20 bp, Artificial Sequence
  chemically synthesized
agatataaggcaaatgatcc

SEQ ID NO: 249433 - DNA, 20 bp, Artificial Sequence
  chemically synthesized
aaggcaaatgatcctggatg

SEQ ID NO: 249434 - DNA, 20 bp, Artificial Sequence
  chemically synthesized
ttatgatcaccgcttcatcc

SEQ ID NO: 249435 - DNA, 20 bp, Artificial Sequence
  chemically synthesized
gcaaatgatcctggatgaag

SEQ ID NO: 249436 - DNA, 20 bp, Artificial Sequence
  chemically synthesized
tttatgatcaccgcttcatc

SEQ ID NO: 249437 - DNA, 20 bp, Artificial Sequence
  chemically synthesized
gatgaagcggtgatcataaa

SEQ ID NO: 249438 - DNA, 20 bp, Artificial Sequence
  chemically synthesized
caaagcacttaagagttgca

SEQ ID NO: 249439 - DNA, 20 bp, Artificial Sequence
  chemically synthesized
ttcaaagcacttaagagttg

SEQ ID NO: 249440 - DNA, 20 bp, Artificial Sequence
  chemically synthesized
caaatcactctgcaactctt

SEQ ID NO: 249441 - DNA, 20 bp, Artificial Sequence
  chemically synthesized
ttatagttcaaagcacttaa

SEQ ID NO: 249442 - DNA, 20 bp, Artificial Sequence
  chemically synthesized
atttatagttcaaagcactt

SEQ ID NO: 249443 - DNA, 20 bp, Artificial Sequence
  chemically synthesized
atattcctatttatagttca

SEQ ID NO: 249444 - DNA, 20 bp, Artificial Sequence
  chemically synthesized
taagtgctttgaactataaa

SEQ ID NO: 249445 - DNA, 20 bp, Artificial Sequence
  chemically synthesized
aagtgctttgaactataaat

SEQ ID NO: 249446 - DNA, 20 bp, Artificial Sequence
  chemically synthesized
cttctgcatattcctattta

SEQ ID NO: 249447 - DNA, 20 bp, Artificial Sequence
  chemically synthesized
gaactataaataggaatatg

SEQ ID NO: 249448 - DNA, 20 bp, Artificial Sequence
  chemically synthesized
ctataaataggaatatgcag

SEQ ID NO: 249449 - DNA, 20 bp, Artificial Sequence
  chemically synthesized
aataggaatatgcagaagat

SEQ ID NO: 249450 - DNA, 20 bp, Artificial Sequence
  chemically synthesized
atatgcagaagataagctga

SEQ ID NO: 249451 - DNA, 20 bp, Artificial Sequence
  chemically synthesized
tatgcagaagataagctgat

SEQ ID NO: 249452 - DNA, 20 bp, Artificial Sequence
  chemically synthesized
gcagaagataagctgatggg

SEQ ID NO: 249453 - DNA, 20 bp, Artificial Sequence
  chemically synthesized
agaagtttgtttctgcccat

SEQ ID NO: 249454 - DNA, 20 bp, Artificial Sequence
  chemically synthesized
ttttgaaatgcattaaatag

SEQ ID NO: 249455 - DNA, 20 bp, Artificial Sequence
  chemically synthesized
gctttttgaaatgcattaaa

SEQ ID NO: 249456 - DNA, 20 bp, Artificial Sequence
  chemically synthesized
tctatttaatgcatttcaaa

SEQ ID NO: 249457 - DNA, 20 bp, Artificial Sequence
  chemically synthesized
gttgtatttattaagtgaaa

SEQ ID NO: 249458 - DNA, 20 bp, Artificial Sequence
  chemically synthesized
ttgttgtatttattaagtga

SEQ ID NO: 249459 - DNA, 20 bp, Artificial Sequence
  chemically synthesized
gaaaatttgttgtatttatt

SEQ ID NO: 249460 - DNA, 20 bp, Artificial Sequence
  chemically synthesized
ggtggtgaaagaatttaaag

SEQ ID NO: 249461 - DNA, 20 bp, Artificial Sequence
  chemically synthesized
gcaggtggtgaaagaattta

SEQ ID NO: 249462 - DNA, 20 bp, Artificial Sequence
  chemically synthesized
ttgttaagagcaggtggtga

SEQ ID NO: 249463 - DNA, 20 bp, Artificial Sequence
  chemically synthesized
tcttagttgttaagagcagg

SEQ ID NO: 249464 - DNA, 20 bp, Artificial Sequence
  chemically synthesized
aattcttagttgttaagagc

SEQ ID NO: 249465 - DNA, 20 bp, Artificial Sequence
  chemically synthesized
gaattcttagttgttaagag

SEQ ID NO: 249466 - DNA, 20 bp, Artificial Sequence
  chemically synthesized
tctgaattcttagttgttaa

SEQ ID NO: 249467 - DNA, 20 bp, Artificial Sequence
  chemically synthesized
accacctgctcttaacaact

SEQ ID NO: 249468 - DNA, 20 bp, Artificial Sequence
  chemically synthesized
cttctgaattcttagttgtt

SEQ ID NO: 249469 - DNA, 20 bp, Artificial Sequence
  chemically synthesized
gctcttaacaactaagaatt

SEQ ID NO: 249470 - DNA, 20 bp, Artificial Sequence
  chemically synthesized
tataatttcttctgaattct

SEQ ID NO: 249471 - DNA, 20 bp, Artificial Sequence
  chemically synthesized
cttaacaactaagaattcag

SEQ ID NO: 249472 - DNA, 20 bp, Artificial Sequence
  chemically synthesized
aattatatttaaaactaaac

SEQ ID NO: 249473 - DNA, 20 bp, Artificial Sequence
  chemically synthesized
attatatttaaaactaaaca

SEQ ID NO: 249474 - DNA, 20 bp, Artificial Sequence
  chemically synthesized
ttcatttacatttccttgtt

SEQ ID NO: 249475 - DNA, 20 bp, Artificial Sequence
  chemically synthesized
taaacaaggaaatgtaaatg

SEQ ID NO: 249476 - DNA, 20 bp, Artificial Sequence
  chemically synthesized
aaacaaggaaatgtaaatga

SEQ ID NO: 249477 - DNA, 20 bp, Artificial Sequence
  chemically synthesized
aaggaaatgtaaatgaaggc

SEQ ID NO: 249478 - DNA, 20 bp, Artificial Sequence
  chemically synthesized
aatgtaaatgaaggctagtt

SEQ ID NO: 249479 - DNA, 20 bp, Artificial Sequence
  chemically synthesized
tctaaattagatatctaaac

SEQ ID NO: 249480 - DNA, 20 bp, Artificial Sequence
  chemically synthesized
gctagtttagatatctaatt

SEQ ID NO: 249481 - DNA, 20 bp, Artificial Sequence
  chemically synthesized
gtttagatatctaatttaga

SEQ ID NO: 249482 - DNA, 20 bp, Artificial Sequence
  chemically synthesized
gcacactataccgtctaaat

SEQ ID NO: 249483 - DNA, 20 bp, Artificial Sequence
  chemically synthesized
gatatctaatttagacggta

SEQ ID NO: 249484 - DNA, 20 bp, Artificial Sequence
  chemically synthesized
agacggtatagtgtgctgaa

SEQ ID NO: 249485 - DNA, 20 bp, Artificial Sequence
  chemically synthesized
tttaaaaaacatgaaccatt

SEQ ID NO: 249486 - DNA, 20 bp, Artificial Sequence
  chemically synthesized
tgaatggttcatgtttttta

SEQ ID NO: 249487 - DNA, 20 bp, Artificial Sequence
  chemically synthesized
aatggttcatgttttttaaa

SEQ ID NO: 249488 - DNA, 20 bp, Artificial Sequence
  chemically synthesized
gttttttaaagagtttcaat

SEQ ID NO: 249489 - DNA, 20 bp, Artificial Sequence
  chemically synthesized
gagtttcaataagtcacaat

SEQ ID NO: 249490 - DNA, 20 bp, Artificial Sequence
  chemically synthesized
tcaataagtcacaataagat

SEQ ID NO: 249491 - DNA, 20 bp, Artificial Sequence
  chemically synthesized
gaatattattcattgataat

SEQ ID NO: 249492 - DNA, 20 bp, Artificial Sequence
  chemically synthesized
attgataattggtttgttgt

SEQ ID NO: 249493 - DNA, 20 bp, Artificial Sequence
  chemically synthesized
ttgataattggtttgttgta

SEQ ID NO: 249494 - DNA, 20 bp, Artificial Sequence
  chemically synthesized
gataattggtttgttgtaag

SEQ ID NO: 249495 - DNA, 20 bp, Artificial Sequence
  chemically synthesized
gttgtaaggagacgctttga

SEQ ID NO: 249496 - DNA, 20 bp, Artificial Sequence
  chemically synthesized
taatgtatattggactatca

SEQ ID NO: 249497 - DNA, 20 bp, Artificial Sequence
  chemically synthesized
atgaggtatttaatgtatat

SEQ ID NO: 249498 - DNA, 20 bp, Artificial Sequence
  chemically synthesized
cccatatagttggtgtcatg

SEQ ID NO: 249499 - DNA, 20 bp, Artificial Sequence
  chemically synthesized
ccccatatagttggtgtcat

SEQ ID NO: 249500 - DNA, 20 bp, Artificial Sequence
  chemically synthesized
acctcatgacaccaactata

SEQ ID NO: 249501 - DNA, 20 bp, Artificial Sequence
  chemically synthesized
cctcatgacaccaactatat

SEQ ID NO: 249502 - DNA, 20 bp, Artificial Sequence
  chemically synthesized
aaagattaaccccatatagt

SEQ ID NO: 249503 - DNA, 20 bp, Artificial Sequence
  chemically synthesized
ctcatgacaccaactatatg

SEQ ID NO: 249504 - DNA, 20 bp, Artificial Sequence
  chemically synthesized
tgcaaaagattaaccccata

SEQ ID NO: 249505 - DNA, 20 bp, Artificial Sequence
  chemically synthesized
tatatggggttaatcttttg

SEQ ID NO: 249506 - DNA, 20 bp, Artificial Sequence
  chemically synthesized
ggcaaagctttaaactgcaa

SEQ ID NO: 249507 - DNA, 20 bp, Artificial Sequence
  chemically synthesized
ggttaatcttttgcagttta

SEQ ID NO: 249508 - DNA, 20 bp, Artificial Sequence
  chemically synthesized
gcagtttaaagctttgcctc

SEQ ID NO: 249509 - DNA, 20 bp, Artificial Sequence
  chemically synthesized
aagttttactaccagaggca

SEQ ID NO: 249510 - DNA, 20 bp, Artificial Sequence
  chemically synthesized
gtttaaagctttgcctctgg

SEQ ID NO: 249511 - DNA, 20 bp, Artificial Sequence
  chemically synthesized
catggaagttttactaccag

SEQ ID NO: 249512 - DNA, 20 bp, Artificial Sequence
  chemically synthesized
acatggaagttttactacca

SEQ ID NO: 249513 - DNA, 20 bp, Artificial Sequence
  chemically synthesized
ttacatggaagttttactac

SEQ ID NO: 249514 - DNA, 20 bp, Artificial Sequence
  chemically synthesized
tattgatgccaattacatgg

SEQ ID NO: 249515 - DNA, 20 bp, Artificial Sequence
  chemically synthesized
tagtaaaacttccatgtaat

SEQ ID NO: 249516 - DNA, 20 bp, Artificial Sequence
  chemically synthesized
gactattgatgccaattaca

SEQ ID NO: 249517 - DNA, 20 bp, Artificial Sequence
  chemically synthesized
ttccatgtaattggcatcaa

SEQ ID NO: 249518 - DNA, 20 bp, Artificial Sequence
  chemically synthesized
tcaaatcacacaattcattt

SEQ ID NO: 249519 - DNA, 20 bp, Artificial Sequence
  chemically synthesized
caaatcacacaattcatttt

SEQ ID NO: 249520 - DNA, 20 bp, Artificial Sequence
  chemically synthesized
cacaattcattttgggttgc

SEQ ID NO: 249521 - DNA, 20 bp, Artificial Sequence
  chemically synthesized
acaattcattttgggttgct

SEQ ID NO: 249522 - DNA, 20 bp, Artificial Sequence
  chemically synthesized
attcattttgggttgctggg

SEQ ID NO: 249523 - DNA, 20 bp, Artificial Sequence
  chemically synthesized
gaggagattttgtttccacc

SEQ ID NO: 249524 - DNA, 20 bp, Artificial Sequence
  chemically synthesized
gaaacaaaatctcctctatt

SEQ ID NO: 249525 - DNA, 20 bp, Artificial Sequence
  chemically synthesized
tgattgtgagccaaatagag

SEQ ID NO: 249526 - DNA, 20 bp, Artificial Sequence
  chemically synthesized
agtgattgtgagccaaatag

SEQ ID NO: 249527 - DNA, 20 bp, Artificial Sequence
  chemically synthesized
gagtgattgtgagccaaata

SEQ ID NO: 249528 - DNA, 20 bp, Artificial Sequence
  chemically synthesized
gagagtgattgtgagccaaa

SEQ ID NO: 249529 - DNA, 20 bp, Artificial Sequence
  chemically synthesized
accactgagagagtgattgt

SEQ ID NO: 249530 - DNA, 20 bp, Artificial Sequence
  chemically synthesized
ttggctcacaatcactctct

SEQ ID NO: 249531 - DNA, 20 bp, Artificial Sequence
  chemically synthesized
gctcacaatcactctctcag

SEQ ID NO: 249532 - DNA, 20 bp, Artificial Sequence
  chemically synthesized
cattttgcacaccactgaga

SEQ ID NO: 249533 - DNA, 20 bp, Artificial Sequence
  chemically synthesized
tgcattttgcacaccactga

SEQ ID NO: 249534 - DNA, 20 bp, Artificial Sequence
  chemically synthesized
attgcattttgcacaccact

SEQ ID NO: 249535 - DNA, 20 bp, Artificial Sequence
  chemically synthesized
ggtgtgcaaaatgcaatgac

SEQ ID NO: 249536 - DNA, 20 bp, Artificial Sequence
  chemically synthesized
tgcaaaatgcaatgactggc

SEQ ID NO: 249537 - DNA, 20 bp, Artificial Sequence
  chemically synthesized
tgtaaatatcattcactggc

SEQ ID NO: 249538 - DNA, 20 bp, Artificial Sequence
  chemically synthesized
ctattgtaaatatcattcac

SEQ ID NO: 249539 - DNA, 20 bp, Artificial Sequence
  chemically synthesized
ccagtgaatgatatttacaa

SEQ ID NO: 249540 - DNA, 20 bp, Artificial Sequence
  chemically synthesized
tgaatgatatttacaatagc

SEQ ID NO: 249541 - DNA, 20 bp, Artificial Sequence
  chemically synthesized
gaatgatatttacaatagct

SEQ ID NO: 249542 - DNA, 20 bp, Artificial Sequence
  chemically synthesized
aatgatatttacaatagcta

SEQ ID NO: 249543 - DNA, 20 bp, Artificial Sequence
  chemically synthesized
gtataatctaagataatccc

SEQ ID NO: 249544 - DNA, 20 bp, Artificial Sequence
  chemically synthesized
acaatagctagggattatct

SEQ ID NO: 249545 - DNA, 20 bp, Artificial Sequence
  chemically synthesized
tgctgaaggctgtataatct

SEQ ID NO: 249546 - DNA, 20 bp, Artificial Sequence
  chemically synthesized
agggattatcttagattata

SEQ ID NO: 249547 - DNA, 20 bp, Artificial Sequence
  chemically synthesized
atcttagattatacagcctt

SEQ ID NO: 249548 - DNA, 20 bp, Artificial Sequence
  chemically synthesized
ttagattatacagccttcag

SEQ ID NO: 249549 - DNA, 20 bp, Artificial Sequence
  chemically synthesized
agtgtttatgtttctgctga

SEQ ID NO: 249550 - DNA, 20 bp, Artificial Sequence
  chemically synthesized
aagtgtttatgtttctgctg

SEQ ID NO: 249551 - DNA, 20 bp, Artificial Sequence
  chemically synthesized
cagaaacataaacacttgaa

SEQ ID NO: 249552 - DNA, 20 bp, Artificial Sequence
  chemically synthesized
gaaacataaacacttgaaca

SEQ ID NO: 249553 - DNA, 20 bp, Artificial Sequence
  chemically synthesized
tatttcacactgctctgttc

SEQ ID NO: 249554 - DNA, 20 bp, Artificial Sequence
  chemically synthesized
acataaacacttgaacagag

SEQ ID NO: 249555 - DNA, 20 bp, Artificial Sequence
  chemically synthesized
ttgaacagagcagtgtgaaa

SEQ ID NO: 249556 - DNA, 20 bp, Artificial Sequence
  chemically synthesized
aacagagcagtgtgaaatag

SEQ ID NO: 249557 - DNA, 20 bp, Artificial Sequence
  chemically synthesized
gagcagtgtgaaatagaaga

SEQ ID NO: 249558 - DNA, 20 bp, Artificial Sequence
  chemically synthesized
gtgaaatagaagatagtgtg

SEQ ID NO: 249559 - DNA, 20 bp, Artificial Sequence
  chemically synthesized
tgaaatagaagatagtgtgt

SEQ ID NO: 249560 - DNA, 20 bp, Artificial Sequence
  chemically synthesized
aaatagaagatagtgtgtgg

SEQ ID NO: 249561 - DNA, 20 bp, Artificial Sequence
  chemically synthesized
aatagaagatagtgtgtggg

SEQ ID NO: 249562 - DNA, 20 bp, Artificial Sequence
  chemically synthesized
tagaagatagtgtgtgggag

SEQ ID NO: 249563 - DNA, 20 bp, Artificial Sequence
  chemically synthesized
agaagatagtgtgtgggagg

SEQ ID NO: 249564 - DNA, 20 bp, Artificial Sequence
  chemically synthesized
gatagtgtgtgggaggaggc

SEQ ID NO: 249565 - DNA, 20 bp, Artificial Sequence
  chemically synthesized
ttcttgtatatttcagatta

SEQ ID NO: 249566 - DNA, 20 bp, Artificial Sequence
  chemically synthesized
tcttcttgtatatttcagat

SEQ ID NO: 249567 - DNA, 20 bp, Artificial Sequence
  chemically synthesized
aagtttcttcttgtatattt

SEQ ID NO: 249568 - DNA, 20 bp, Artificial Sequence
  chemically synthesized
agctctaatctgaaatatac

SEQ ID NO: 249569 - DNA, 20 bp, Artificial Sequence
  chemically synthesized
tctaatctgaaatatacaag

SEQ ID NO: 249570 - DNA, 20 bp, Artificial Sequence
  chemically synthesized
tacaagaagaaacttacata

SEQ ID NO: 249571 - DNA, 20 bp, Artificial Sequence
  chemically synthesized
ctgtcttttttgccatatgt

SEQ ID NO: 249572 - DNA, 20 bp, Artificial Sequence
  chemically synthesized
gaaacttacatatggcaaaa

SEQ ID NO: 249573 - DNA, 20 bp, Artificial Sequence
  chemically synthesized
cttacatatggcaaaaaaga

SEQ ID NO: 249574 - DNA, 20 bp, Artificial Sequence
  chemically synthesized
atggcaaaaaagacagtata

SEQ ID NO: 249575 - DNA, 20 bp, Artificial Sequence
  chemically synthesized
ggcaaaaaagacagtatata

SEQ ID NO: 249576 - DNA, 20 bp, Artificial Sequence
  chemically synthesized
gcaaaaaagacagtatatag

SEQ ID NO: 249577 - DNA, 20 bp, Artificial Sequence
  chemically synthesized
tatatagaggctacgcttga

SEQ ID NO: 249578 - DNA, 20 bp, Artificial Sequence
  chemically synthesized
taatctccctccatcaagcg

SEQ ID NO: 249579 - DNA, 20 bp, Artificial Sequence
  chemically synthesized
tatagaggctacgcttgatg

SEQ ID NO: 249580 - DNA, 20 bp, Artificial Sequence
  chemically synthesized
atagaggctacgcttgatgg

SEQ ID NO: 249581 - DNA, 20 bp, Artificial Sequence
  chemically synthesized
tagaggctacgcttgatgga

SEQ ID NO: 249582 - DNA, 20 bp, Artificial Sequence
  chemically synthesized
tattataatctccctccatc

SEQ ID NO: 249583 - DNA, 20 bp, Artificial Sequence
  chemically synthesized
gaggctacgcttgatggagg

SEQ ID NO: 249584 - DNA, 20 bp, Artificial Sequence
  chemically synthesized
agggagattataataaatga

SEQ ID NO: 249585 - DNA, 20 bp, Artificial Sequence
  chemically synthesized
ataataaatgacagattaat

SEQ ID NO: 249586 - DNA, 20 bp, Artificial Sequence
  chemically synthesized
tcataaacttcgagaaaaac

SEQ ID NO: 249587 - DNA, 20 bp, Artificial Sequence
  chemically synthesized
aatgagacttgtttttctcg

SEQ ID NO: 249588 - DNA, 20 bp, Artificial Sequence
  chemically synthesized
aataaaccatcataaacttc

SEQ ID NO: 249589 - DNA, 20 bp, Artificial Sequence
  chemically synthesized
gtttttctcgaagtttatga

SEQ ID NO: 249590 - DNA, 20 bp, Artificial Sequence
  chemically synthesized
agtttatgatggtttatttc

SEQ ID NO: 249591 - DNA, 20 bp, Artificial Sequence
  chemically synthesized
catcaacttggcatgtatgc

SEQ ID NO: 249592 - DNA, 20 bp, Artificial Sequence
  chemically synthesized
ttatttctggcatacatgcc

SEQ ID NO: 249593 - DNA, 20 bp, Artificial Sequence
  chemically synthesized
ataatttgatagcatcaact

SEQ ID NO: 249594 - DNA, 20 bp, Artificial Sequence
  chemically synthesized
taatgaacactataatttga

SEQ ID NO: 249595 - DNA, 20 bp, Artificial Sequence
  chemically synthesized
aagttgatgctatcaaatta

SEQ ID NO: 249596 - DNA, 20 bp, Artificial Sequence
  chemically synthesized
atacgacttgatgataataa

SEQ ID NO: 249597 - DNA, 20 bp, Artificial Sequence
  chemically synthesized
tcattaccattattatcatc

SEQ ID NO: 249598 - DNA, 20 bp, Artificial Sequence
  chemically synthesized
atgcccagtagagtgcacat

SEQ ID NO: 249599 - DNA, 20 bp, Artificial Sequence
  chemically synthesized
attaccaatgtgcactctac

SEQ ID NO: 249600 - DNA, 20 bp, Artificial Sequence
  chemically synthesized
ttaccaatgtgcactctact

SEQ ID NO: 249601 - DNA, 20 bp, Artificial Sequence
  chemically synthesized
tgtatatataatgcccagta

SEQ ID NO: 249602 - DNA, 20 bp, Artificial Sequence
  chemically synthesized
cttgtatatataatgcccag

SEQ ID NO: 249603 - DNA, 20 bp, Artificial Sequence
  chemically synthesized
ttgcttgtatatataatgcc

SEQ ID NO: 249604 - DNA, 20 bp, Artificial Sequence
  chemically synthesized
ctactgggcattatatatac

SEQ ID NO: 249605 - DNA, 20 bp, Artificial Sequence
  chemically synthesized
ttatatatacaagcaaaatt

SEQ ID NO: 249606 - DNA, 20 bp, Artificial Sequence
  chemically synthesized
tatatatacaagcaaaattc

SEQ ID NO: 249607 - DNA, 20 bp, Artificial Sequence
  chemically synthesized
atatacaagcaaaattcagg

SEQ ID NO: 249608 - DNA, 20 bp, Artificial Sequence
  chemically synthesized
ttttattggttgttgaatgt

SEQ ID NO: 249609 - DNA, 20 bp, Artificial Sequence
  chemically synthesized
tttggtctgatttattttat

SEQ ID NO: 249610 - DNA, 20 bp, Artificial Sequence
  chemically synthesized
caacaaccaataaaataaat

SEQ ID NO: 249611 - DNA, 20 bp, Artificial Sequence
  chemically synthesized
caataaaataaatcagacca

SEQ ID NO: 249612 - DNA, 20 bp, Artificial Sequence
  chemically synthesized
ataaatcagaccaaagattg

SEQ ID NO: 249613 - DNA, 20 bp, Artificial Sequence
  chemically synthesized
ctacatatgtctacaatctt

SEQ ID NO: 249614 - DNA, 20 bp, Artificial Sequence
  chemically synthesized
ccaaagattgtagacatatg

SEQ ID NO: 249615 - DNA, 20 bp, Artificial Sequence
  chemically synthesized
caaagattgtagacatatgt

SEQ ID NO: 249616 - DNA, 20 bp, Artificial Sequence
  chemically synthesized
aagattgtagacatatgtag

SEQ ID NO: 249617 - DNA, 20 bp, Artificial Sequence
  chemically synthesized
gattgtagacatatgtagga

SEQ ID NO: 249618 - DNA, 20 bp, Artificial Sequence
  chemically synthesized
gacatatgtaggagagcgta

SEQ ID NO: 249619 - DNA, 20 bp, Artificial Sequence
  chemically synthesized
taggagagcgtatagtgcac

SEQ ID NO: 249620 - DNA, 20 bp, Artificial Sequence
  chemically synthesized
tagtgcacaagatactcaaa

SEQ ID NO: 249621 - DNA, 20 bp, Artificial Sequence
  chemically synthesized
gtgcacaagatactcaaatg

SEQ ID NO: 249622 - DNA, 20 bp, Artificial Sequence
  chemically synthesized
ctttaagtttttctccattt

SEQ ID NO: 249623 - DNA, 20 bp, Artificial Sequence
  chemically synthesized
ctcaaatggagaaaaactta

SEQ ID NO: 249624 - DNA, 20 bp, Artificial Sequence
  chemically synthesized
tcaaatggagaaaaacttaa

SEQ ID NO: 249625 - DNA, 20 bp, Artificial Sequence
  chemically synthesized
aaaatttatttttaaccttt

SEQ ID NO: 249626 - DNA, 20 bp, Artificial Sequence
  chemically synthesized
aataaatttttaaatacttt

SEQ ID NO: 249627 - DNA, 20 bp, Artificial Sequence
  chemically synthesized
ccagttcacctaaacactga

SEQ ID NO: 249628 - DNA, 20 bp, Artificial Sequence
  chemically synthesized
ttttaaatactttcagtgtt

SEQ ID NO: 249629 - DNA, 20 bp, Artificial Sequence
  chemically synthesized
tttaaatactttcagtgttt

SEQ ID NO: 249630 - DNA, 20 bp, Artificial Sequence
  chemically synthesized
ctttcagtgtttaggtgaac

SEQ ID NO: 249631 - DNA, 20 bp, Artificial Sequence
  chemically synthesized
cagtgtttaggtgaactggt

SEQ ID NO: 249632 - DNA, 20 bp, Artificial Sequence
  chemically synthesized
tgacacaccaaaacacttac

SEQ ID NO: 249633 - DNA, 20 bp, Artificial Sequence
  chemically synthesized
aggtgaactggtaagtgttt

SEQ ID NO: 249634 - DNA, 20 bp, Artificial Sequence
  chemically synthesized
tggtaagtgttttggtgtgt

SEQ ID NO: 249635 - DNA, 20 bp, Artificial Sequence
  chemically synthesized
gttttggtgtgtcagtttat

SEQ ID NO: 249636 - DNA, 20 bp, Artificial Sequence
  chemically synthesized
gtagttcccttagatatagc

SEQ ID NO: 249637 - DNA, 20 bp, Artificial Sequence
  chemically synthesized
gaacattgcttgctatatct

SEQ ID NO: 249638 - DNA, 20 bp, Artificial Sequence
  chemically synthesized
aacattgcttgctatatcta

SEQ ID NO: 249639 - DNA, 20 bp, Artificial Sequence
  chemically synthesized
acattgcttgctatatctaa

SEQ ID NO: 249640 - DNA, 20 bp, Artificial Sequence
  chemically synthesized
ataagtagttcccttagata

SEQ ID NO: 249641 - DNA, 20 bp, Artificial Sequence
  chemically synthesized
taatgaataagtagttccct

SEQ ID NO: 249642 - DNA, 20 bp, Artificial Sequence
  chemically synthesized
ttaagaaaataatgaataag

SEQ ID NO: 249643 - DNA, 20 bp, Artificial Sequence
  chemically synthesized
tttttaagaaaataatgaat

SEQ ID NO: 249644 - DNA, 20 bp, Artificial Sequence
  chemically synthesized
gttggatagaattcattttt

SEQ ID NO: 249645 - DNA, 20 bp, Artificial Sequence
  chemically synthesized
aaaaatgaattctatccaac

SEQ ID NO: 249646 - DNA, 20 bp, Artificial Sequence
  chemically synthesized
ttactaagtaactagttgga

SEQ ID NO: 249647 - DNA, 20 bp, Artificial Sequence
  chemically synthesized
tgatttactaagtaactagt

SEQ ID NO: 249648 - DNA, 20 bp, Artificial Sequence
  chemically synthesized
attctatccaactagttact

SEQ ID NO: 249649 - DNA, 20 bp, Artificial Sequence
  chemically synthesized
atcatgatttactaagtaac

SEQ ID NO: 249650 - DNA, 20 bp, Artificial Sequence
  chemically synthesized
tttgaaaatcatgatttact

SEQ ID NO: 249651 - DNA, 20 bp, Artificial Sequence
  chemically synthesized
ttagtaaatcatgattttca

SEQ ID NO: 249652 - DNA, 20 bp, Artificial Sequence
  chemically synthesized
gtaaatcatgattttcaaag

SEQ ID NO: 249653 - DNA, 20 bp, Artificial Sequence
  chemically synthesized
tgattttcaaagaagatctt

SEQ ID NO: 249654 - DNA, 20 bp, Artificial Sequence
  chemically synthesized
gattttcaaagaagatcttg

SEQ ID NO: 249655 - DNA, 20 bp, Artificial Sequence
  chemically synthesized
attttcaaagaagatcttga

SEQ ID NO: 249656 - DNA, 20 bp, Artificial Sequence
  chemically synthesized
ctgttctggtttttaccctc

SEQ ID NO: 249657 - DNA, 20 bp, Artificial Sequence
  chemically synthesized
aagatcttgagggtaaaaac

SEQ ID NO: 249658 - DNA, 20 bp, Artificial Sequence
  chemically synthesized
cttgagggtaaaaaccagaa

SEQ ID NO: 249659 - DNA, 20 bp, Artificial Sequence
  chemically synthesized
tatggggaaatgttctgttc

SEQ ID NO: 249660 - DNA, 20 bp, Artificial Sequence
  chemically synthesized
tgttgaaaccatggtttatg

SEQ ID NO: 249661 - DNA, 20 bp, Artificial Sequence
  chemically synthesized
ttgttgaaaccatggtttat

SEQ ID NO: 249662 - DNA, 20 bp, Artificial Sequence
  chemically synthesized
gaacatttccccataaacca

SEQ ID NO: 249663 - DNA, 20 bp, Artificial Sequence
  chemically synthesized
attgttgaaaccatggttta

SEQ ID NO: 249664 - DNA, 20 bp, Artificial Sequence
  chemically synthesized
tttttgaattgttgaaacca

SEQ ID NO: 249665 - DNA, 20 bp, Artificial Sequence
  chemically synthesized
atggtttcaacaattcaaaa

SEQ ID NO: 249666 - DNA, 20 bp, Artificial Sequence
  chemically synthesized
tttcaacaattcaaaaaagt

SEQ ID NO: 249667 - DNA, 20 bp, Artificial Sequence
  chemically synthesized
aacaattcaaaaaagtgaga

SEQ ID NO: 249668 - DNA, 20 bp, Artificial Sequence
  chemically synthesized
caattcaaaaaagtgagacg

SEQ ID NO: 249669 - DNA, 20 bp, Artificial Sequence
  chemically synthesized
ttcaaaaaagtgagacggag

SEQ ID NO: 249670 - DNA, 20 bp, Artificial Sequence
  chemically synthesized
aaagtgagacggagtggtgc

SEQ ID NO: 249671 - DNA, 20 bp, Artificial Sequence
  chemically synthesized
gacggagtggtgcaagatgt

SEQ ID NO: 249672 - DNA, 20 bp, Artificial Sequence
  chemically synthesized
agtggtgcaagatgtcagaa

SEQ ID NO: 249673 - DNA, 20 bp, Artificial Sequence
  chemically synthesized
ggtgcaagatgtcagaatag

SEQ ID NO: 249674 - DNA, 20 bp, Artificial Sequence
  chemically synthesized
gtgagggagattagttatat

SEQ ID NO: 249675 - DNA, 20 bp, Artificial Sequence
  chemically synthesized
agtgagggagattagttata

SEQ ID NO: 249676 - DNA, 20 bp, Artificial Sequence
  chemically synthesized
gatgtttcagtgagggagat

SEQ ID NO: 249677 - DNA, 20 bp, Artificial Sequence
  chemically synthesized
aatttgatgtttcagtgagg

SEQ ID NO: 249678 - DNA, 20 bp, Artificial Sequence
  chemically synthesized
acaatttgatgtttcagtga

SEQ ID NO: 249679 - DNA, 20 bp, Artificial Sequence
  chemically synthesized
tacaatttgatgtttcagtg

SEQ ID NO: 249680 - DNA, 20 bp, Artificial Sequence
  chemically synthesized
ttacaatttgatgtttcagt

SEQ ID NO: 249681 - DNA, 20 bp, Artificial Sequence
  chemically synthesized
gttgttacaatttgatgttt

SEQ ID NO: 249682 - DNA, 20 bp, Artificial Sequence
  chemically synthesized
catcaaattgtaacaactat

SEQ ID NO: 249683 - DNA, 20 bp, Artificial Sequence
  chemically synthesized
caaattgtaacaactatgag

SEQ ID NO: 249684 - DNA, 20 bp, Artificial Sequence
  chemically synthesized
agtgcttttctgtctgctca

SEQ ID NO: 249685 - DNA, 20 bp, Artificial Sequence
  chemically synthesized
ttgtaacaactatgagcaga

SEQ ID NO: 249686 - DNA, 20 bp, Artificial Sequence
  chemically synthesized
acaactatgagcagacagaa

SEQ ID NO: 249687 - DNA, 20 bp, Artificial Sequence
  chemically synthesized
agacagaaaagcactgtcac

SEQ ID NO: 249688 - DNA, 20 bp, Artificial Sequence
  chemically synthesized
ctggtttttggttctggtga

SEQ ID NO: 249689 - DNA, 20 bp, Artificial Sequence
  chemically synthesized
ccgtacctggtttttggttc

SEQ ID NO: 249690 - DNA, 20 bp, Artificial Sequence
  chemically synthesized
ctgtcaccagaaccaaaaac

SEQ ID NO: 249691 - DNA, 20 bp, Artificial Sequence
  chemically synthesized
tgtcaccagaaccaaaaacc

SEQ ID NO: 249692 - DNA, 20 bp, Artificial Sequence
  chemically synthesized
atgattccgtacctggtttt

SEQ ID NO: 249693 - DNA, 20 bp, Artificial Sequence
  chemically synthesized
ccagaaccaaaaaccaggta

SEQ ID NO: 249694 - DNA, 20 bp, Artificial Sequence
  chemically synthesized
aggtaccatgattccgtacc

SEQ ID NO: 249695 - DNA, 20 bp, Artificial Sequence
  chemically synthesized
aaaaaccaggtacggaatca

SEQ ID NO: 249696 - DNA, 20 bp, Artificial Sequence
  chemically synthesized
aggtacggaatcatggtacc

SEQ ID NO: 249697 - DNA, 20 bp, Artificial Sequence
  chemically synthesized
agcaagatgaagttaaaacc

SEQ ID NO: 249698 - DNA, 20 bp, Artificial Sequence
  chemically synthesized
tagcaagatgaagttaaaac

SEQ ID NO: 249699 - DNA, 20 bp, Artificial Sequence
  chemically synthesized
atgcctcttttagcaagatg

SEQ ID NO: 249700 - DNA, 20 bp, Artificial Sequence
  chemically synthesized
ttttaacttcatcttgctaa

SEQ ID NO: 249701 - DNA, 20 bp, Artificial Sequence
  chemically synthesized
ttaacttcatcttgctaaaa

SEQ ID NO: 249702 - DNA, 20 bp, Artificial Sequence
  chemically synthesized
tcctcaatgcctcttttagc

SEQ ID NO: 249703 - DNA, 20 bp, Artificial Sequence
  chemically synthesized
taacttcatcttgctaaaag

SEQ ID NO: 249704 - DNA, 20 bp, Artificial Sequence
  chemically synthesized
cctttcctcaatgcctcttt

SEQ ID NO: 249705 - DNA, 20 bp, Artificial Sequence
  chemically synthesized
atcttgctaaaagaggcatt

SEQ ID NO: 249706 - DNA, 20 bp, Artificial Sequence
  chemically synthesized
tcttgctaaaagaggcattg

SEQ ID NO: 249707 - DNA, 20 bp, Artificial Sequence
  chemically synthesized
gctaaaagaggcattgagga

SEQ ID NO: 249708 - DNA, 20 bp, Artificial Sequence
  chemically synthesized
ctaaaagaggcattgaggaa

SEQ ID NO: 249709 - DNA, 20 bp, Artificial Sequence
  chemically synthesized
aaagaggcattgaggaaagg

SEQ ID NO: 249710 - DNA, 20 bp, Artificial Sequence
  chemically synthesized
aagaggcattgaggaaaggc

SEQ ID NO: 249711 - DNA, 20 bp, Artificial Sequence
  chemically synthesized
gaggcattgaggaaaggcag

SEQ ID NO: 249712 - DNA, 20 bp, Artificial Sequence
  chemically synthesized
ttgaggaaaggcaggagaca

SEQ ID NO: 249713 - DNA, 20 bp, Artificial Sequence
  chemically synthesized
aggtgtggtgttggtgattc

SEQ ID NO: 249714 - DNA, 20 bp, Artificial Sequence
  chemically synthesized
tgattgggaaggtgtggtgt

SEQ ID NO: 249715 - DNA, 20 bp, Artificial Sequence
  chemically synthesized
gctgggtgattgggaaggtg

SEQ ID NO: 249716 - DNA, 20 bp, Artificial Sequence
  chemically synthesized
ccagtgctgggtgattggga

SEQ ID NO: 249717 - DNA, 20 bp, Artificial Sequence
  chemically synthesized
tccagtgctgggtgattggg

SEQ ID NO: 249718 - DNA, 20 bp, Artificial Sequence
  chemically synthesized
accacaccttcccaatcacc

SEQ ID NO: 249719 - DNA, 20 bp, Artificial Sequence
  chemically synthesized
acgtccagtgctgggtgatt

SEQ ID NO: 249720 - DNA, 20 bp, Artificial Sequence
  chemically synthesized
cacgtccagtgctgggtgat

SEQ ID NO: 249721 - DNA, 20 bp, Artificial Sequence
  chemically synthesized
ccttcccaatcacccagcac

SEQ ID NO: 249722 - DNA, 20 bp, Artificial Sequence
  chemically synthesized
tgcactgcacgtccagtgct

SEQ ID NO: 249723 - DNA, 20 bp, Artificial Sequence
  chemically synthesized
ctgcactgcacgtccagtgc

SEQ ID NO: 249724 - DNA, 20 bp, Artificial Sequence
  chemically synthesized
atcacccagcactggacgtg

SEQ ID NO: 249725 - DNA, 20 bp, Artificial Sequence
  chemically synthesized
ccctctctgcactgcacgtc

SEQ ID NO: 249726 - DNA, 20 bp, Artificial Sequence
  chemically synthesized
ccagcactggacgtgcagtg

SEQ ID NO: 249727 - DNA, 20 bp, Artificial Sequence
  chemically synthesized
agcactggacgtgcagtgca

SEQ ID NO: 249728 - DNA, 20 bp, Artificial Sequence
  chemically synthesized
cactggacgtgcagtgcaga

SEQ ID NO: 249729 - DNA, 20 bp, Artificial Sequence
  chemically synthesized
actggacgtgcagtgcagag

SEQ ID NO: 249730 - DNA, 20 bp, Artificial Sequence
  chemically synthesized
ctggacgtgcagtgcagaga

SEQ ID NO: 249731 - DNA, 20 bp, Artificial Sequence
  chemically synthesized
ctgtcccttccaaaagtgca

SEQ ID NO: 249732 - DNA, 20 bp, Artificial Sequence
  chemically synthesized
agagggaatctttgcacttt

SEQ ID NO: 249733 - DNA, 20 bp, Artificial Sequence
  chemically synthesized
gggaatctttgcacttttgg

SEQ ID NO: 249734 - DNA, 20 bp, Artificial Sequence
  chemically synthesized
ggaatctttgcacttttgga

SEQ ID NO: 249735 - DNA, 20 bp, Artificial Sequence
  chemically synthesized
gaatctttgcacttttggaa

SEQ ID NO: 249736 - DNA, 20 bp, Artificial Sequence
  chemically synthesized
agctgtactgtcccttccaa

SEQ ID NO: 249737 - DNA, 20 bp, Artificial Sequence
  chemically synthesized
ctttgcacttttggaaggga

SEQ ID NO: 249738 - DNA, 20 bp, Artificial Sequence
  chemically synthesized
cacttttggaagggacagta

SEQ ID NO: 249739 - DNA, 20 bp, Artificial Sequence
  chemically synthesized
ggaagggacagtacagctac

SEQ ID NO: 249740 - DNA, 20 bp, Artificial Sequence
  chemically synthesized
gaagggacagtacagctact

SEQ ID NO: 249741 - DNA, 20 bp, Artificial Sequence
  chemically synthesized
aagggacagtacagctactg

SEQ ID NO: 249742 - DNA, 20 bp, Artificial Sequence
  chemically synthesized
agggacagtacagctactgg

SEQ ID NO: 249743 - DNA, 20 bp, Artificial Sequence
  chemically synthesized
ttcaatgtaaagtcccccag

SEQ ID NO: 249744 - DNA, 20 bp, Artificial Sequence
  chemically synthesized
tagttcaatgtaaagtcccc

SEQ ID NO: 249745 - DNA, 20 bp, Artificial Sequence
  chemically synthesized
acagcagttagttcaatgta

SEQ ID NO: 249746 - DNA, 20 bp, Artificial Sequence
  chemically synthesized
tactgtgacagcacagcagt

SEQ ID NO: 249747 - DNA, 20 bp, Artificial Sequence
  chemically synthesized
tctctactgtgacagcacag

SEQ ID NO: 249748 - DNA, 20 bp, Artificial Sequence
  chemically synthesized
ttttctctactgtgacagca

SEQ ID NO: 249749 - DNA, 20 bp, Artificial Sequence
  chemically synthesized
aactaactgctgtgctgtca

SEQ ID NO: 249750 - DNA, 20 bp, Artificial Sequence
  chemically synthesized
taactgctgtgctgtcacag

SEQ ID NO: 249751 - DNA, 20 bp, Artificial Sequence
  chemically synthesized
ggcttttttctctactgtga

SEQ ID NO: 249752 - DNA, 20 bp, Artificial Sequence
  chemically synthesized
actgctgtgctgtcacagta

SEQ ID NO: 249753 - DNA, 20 bp, Artificial Sequence
  chemically synthesized
tgctgtcacagtagagaaaa

SEQ ID NO: 249754 - DNA, 20 bp, Artificial Sequence
  chemically synthesized
agtagagaaaaaagccatgc

SEQ ID NO: 249755 - DNA, 20 bp, Artificial Sequence
  chemically synthesized
ggcactgactgaggccagca

SEQ ID NO: 249756 - DNA, 20 bp, Artificial Sequence
  chemically synthesized
gaaaaaagccatgctggcct

SEQ ID NO: 249757 - DNA, 20 bp, Artificial Sequence
  chemically synthesized
gcacaggcactgactgaggc

SEQ ID NO: 249758 - DNA, 20 bp, Artificial Sequence
  chemically synthesized
aaagccatgctggcctcagt

SEQ ID NO: 249759 - DNA, 20 bp, Artificial Sequence
  chemically synthesized
ccgtgcacaggcactgactg

SEQ ID NO: 249760 - DNA, 20 bp, Artificial Sequence
  chemically synthesized
tccgtgcacaggcactgact

SEQ ID NO: 249761 - DNA, 20 bp, Artificial Sequence
  chemically synthesized
cctcagtcagtgcctgtgca

SEQ ID NO: 249762 - DNA, 20 bp, Artificial Sequence
  chemically synthesized
tcagtcagtgcctgtgcacg

SEQ ID NO: 249763 - DNA, 20 bp, Artificial Sequence
  chemically synthesized
caaatattccctccgtgcac

SEQ ID NO: 249764 - DNA, 20 bp, Artificial Sequence
  chemically synthesized
cagtcagtgcctgtgcacgg

SEQ ID NO: 249765 - DNA, 20 bp, Artificial Sequence
  chemically synthesized
tcaaatattccctccgtgca

SEQ ID NO: 249766 - DNA, 20 bp, Artificial Sequence
  chemically synthesized
agtcagtgcctgtgcacgga

SEQ ID NO: 249767 - DNA, 20 bp, Artificial Sequence
  chemically synthesized
cacggagggaatatttgaac

SEQ ID NO: 249768 - DNA, 20 bp, Artificial Sequence
  chemically synthesized
gggaatatttgaactagccc

SEQ ID NO: 249769 - DNA, 20 bp, Artificial Sequence
  chemically synthesized
gattcccttctggctggggc

SEQ ID NO: 249770 - DNA, 20 bp, Artificial Sequence
  chemically synthesized
atatttgaactagccccagc

SEQ ID NO: 249771 - DNA, 20 bp, Artificial Sequence
  chemically synthesized
tttgaactagccccagccag

SEQ ID NO: 249772 - DNA, 20 bp, Artificial Sequence
  chemically synthesized
gggcgattcccttctggctg

SEQ ID NO: 249773 - DNA, 20 bp, Artificial Sequence
  chemically synthesized
ttgaactagccccagccaga

SEQ ID NO: 249774 - DNA, 20 bp, Artificial Sequence
  chemically synthesized
tgggcgattcccttctggct

SEQ ID NO: 249775 - DNA, 20 bp, Artificial Sequence
  chemically synthesized
tgaactagccccagccagaa

SEQ ID NO: 249776 - DNA, 20 bp, Artificial Sequence
  chemically synthesized
atgggcgattcccttctggc

SEQ ID NO: 249777 - DNA, 20 bp, Artificial Sequence
  chemically synthesized
tgggatgggcgattcccttc

SEQ ID NO: 249778 - DNA, 20 bp, Artificial Sequence
  chemically synthesized
cagaagggaatcgcccatcc

SEQ ID NO: 249779 - DNA, 20 bp, Artificial Sequence
  chemically synthesized
aagggaatcgcccatcccag

SEQ ID NO: 249780 - DNA, 20 bp, Artificial Sequence
  chemically synthesized
tgagttctgactgctgggat

SEQ ID NO: 249781 - DNA, 20 bp, Artificial Sequence
  chemically synthesized
ttgagttctgactgctggga

SEQ ID NO: 249782 - DNA, 20 bp, Artificial Sequence
  chemically synthesized
gaatcgcccatcccagcagt

SEQ ID NO: 249783 - DNA, 20 bp, Artificial Sequence
  chemically synthesized
aaacttgagttctgactgct

SEQ ID NO: 249784 - DNA, 20 bp, Artificial Sequence
  chemically synthesized
gaaacttgagttctgactgc

SEQ ID NO: 249785 - DNA, 20 bp, Artificial Sequence
  chemically synthesized
catcccagcagtcagaactc

SEQ ID NO: 249786 - DNA, 20 bp, Artificial Sequence
  chemically synthesized
tgaggcttgccaagaaactt

SEQ ID NO: 249787 - DNA, 20 bp, Artificial Sequence
  chemically synthesized
cagtcagaactcaagtttct

SEQ ID NO: 249788 - DNA, 20 bp, Artificial Sequence
  chemically synthesized
cagaactcaagtttcttggc

SEQ ID NO: 249789 - DNA, 20 bp, Artificial Sequence
  chemically synthesized
ccacaatggtgaggcttgcc

SEQ ID NO: 249790 - DNA, 20 bp, Artificial Sequence
  chemically synthesized
cactttggcccacaatggtg

SEQ ID NO: 249791 - DNA, 20 bp, Artificial Sequence
  chemically synthesized
cttggcaagcctcaccattg

SEQ ID NO: 249792 - DNA, 20 bp, Artificial Sequence
  chemically synthesized
gcactttggcccacaatggt

SEQ ID NO: 249793 - DNA, 20 bp, Artificial Sequence
  chemically synthesized
ttggcaagcctcaccattgt

SEQ ID NO: 249794 - DNA, 20 bp, Artificial Sequence
  chemically synthesized
cagagcactttggcccacaa

SEQ ID NO: 249795 - DNA, 20 bp, Artificial Sequence
  chemically synthesized
agcctcaccattgtgggcca

SEQ ID NO: 249796 - DNA, 20 bp, Artificial Sequence
  chemically synthesized
cctgggactccagagcactt

SEQ ID NO: 249797 - DNA, 20 bp, Artificial Sequence
  chemically synthesized
cattgtgggccaaagtgctc

SEQ ID NO: 249798 - DNA, 20 bp, Artificial Sequence
  chemically synthesized
ttgtgggccaaagtgctctg

SEQ ID NO: 249799 - DNA, 20 bp, Artificial Sequence
  chemically synthesized
caggtttacctgggactcca

SEQ ID NO: 249800 - DNA, 20 bp, Artificial Sequence
  chemically synthesized
gccaaagtgctctggagtcc

SEQ ID NO: 249801 - DNA, 20 bp, Artificial Sequence
  chemically synthesized
ccaaagtgctctggagtccc

SEQ ID NO: 249802 - DNA, 20 bp, Artificial Sequence
  chemically synthesized
ctcaggtttacctgggactc

SEQ ID NO: 249803 - DNA, 20 bp, Artificial Sequence
  chemically synthesized
actgcctctcaggtttacct

SEQ ID NO: 249804 - DNA, 20 bp, Artificial Sequence
  chemically synthesized
gactgcctctcaggtttacc

SEQ ID NO: 249805 - DNA, 20 bp, Artificial Sequence
  chemically synthesized
ctggagtcccaggtaaacct

SEQ ID NO: 249806 - DNA, 20 bp, Artificial Sequence
  chemically synthesized
ggagtcccaggtaaacctga

SEQ ID NO: 249807 - DNA, 20 bp, Artificial Sequence
  chemically synthesized
gagtcccaggtaaacctgag

SEQ ID NO: 249808 - DNA, 20 bp, Artificial Sequence
  chemically synthesized
tcccaggtaaacctgagagg

SEQ ID NO: 249809 - DNA, 20 bp, Artificial Sequence
  chemically synthesized
tgtgtcccagactgcctctc

SEQ ID NO: 249810 - DNA, 20 bp, Artificial Sequence
  chemically synthesized
gtgtgtcccagactgcctct

SEQ ID NO: 249811 - DNA, 20 bp, Artificial Sequence
  chemically synthesized
ggtaaacctgagaggcagtc

SEQ ID NO: 249812 - DNA, 20 bp, Artificial Sequence
  chemically synthesized
gtaaacctgagaggcagtct

SEQ ID NO: 249813 - DNA, 20 bp, Artificial Sequence
  chemically synthesized
gaattgcagttcgtgtgtcc

SEQ ID NO: 249814 - DNA, 20 bp, Artificial Sequence
  chemically synthesized
gacacacgaactgcaattcc

SEQ ID NO: 249815 - DNA, 20 bp, Artificial Sequence
  chemically synthesized
tagaagttatctaggaattg

SEQ ID NO: 249816 - DNA, 20 bp, Artificial Sequence
  chemically synthesized
gctatgactagaagttatct

SEQ ID NO: 249817 - DNA, 20 bp, Artificial Sequence
  chemically synthesized
ggctatgactagaagttatc

SEQ ID NO: 249818 - DNA, 20 bp, Artificial Sequence
  chemically synthesized
tgcaattcctagataacttc

SEQ ID NO: 249819 - DNA, 20 bp, Artificial Sequence
  chemically synthesized
tcctagataacttctagtca

SEQ ID NO: 249820 - DNA, 20 bp, Artificial Sequence
  chemically synthesized
ttagcccaggctatgactag

SEQ ID NO: 249821 - DNA, 20 bp, Artificial Sequence
  chemically synthesized
ctcttagcccaggctatgac

SEQ ID NO: 249822 - DNA, 20 bp, Artificial Sequence
  chemically synthesized
gataacttctagtcatagcc

SEQ ID NO: 249823 - DNA, 20 bp, Artificial Sequence
  chemically synthesized
ataacttctagtcatagcct

SEQ ID NO: 249824 - DNA, 20 bp, Artificial Sequence
  chemically synthesized
ttctagtcatagcctgggct

SEQ ID NO: 249825 - DNA, 20 bp, Artificial Sequence
  chemically synthesized
ctagtcatagcctgggctaa

SEQ ID NO: 249826 - DNA, 20 bp, Artificial Sequence
  chemically synthesized
agtcctctagctcttagccc

SEQ ID NO: 249827 - DNA, 20 bp, Artificial Sequence
  chemically synthesized
tagtcctctagctcttagcc

SEQ ID NO: 249828 - DNA, 20 bp, Artificial Sequence
  chemically synthesized
tcatagcctgggctaagagc

SEQ ID NO: 249829 - DNA, 20 bp, Artificial Sequence
  chemically synthesized
atagcctgggctaagagcta

SEQ ID NO: 249830 - DNA, 20 bp, Artificial Sequence
  chemically synthesized
caccctagtcctctagctct

SEQ ID NO: 249831 - DNA, 20 bp, Artificial Sequence
  chemically synthesized
tagcctgggctaagagctag

SEQ ID NO: 249832 - DNA, 20 bp, Artificial Sequence
  chemically synthesized
tgggctaagagctagaggac

SEQ ID NO: 249833 - DNA, 20 bp, Artificial Sequence
  chemically synthesized
gggctaagagctagaggact

SEQ ID NO: 249834 - DNA, 20 bp, Artificial Sequence
  chemically synthesized
cacatgccaccctagtcctc

SEQ ID NO: 249835 - DNA, 20 bp, Artificial Sequence
  chemically synthesized
ggctaagagctagaggacta

SEQ ID NO: 249836 - DNA, 20 bp, Artificial Sequence
  chemically synthesized
taagagctagaggactaggg

SEQ ID NO: 249837 - DNA, 20 bp, Artificial Sequence
  chemically synthesized
ccctaggtcacatgccaccc

SEQ ID NO: 249838 - DNA, 20 bp, Artificial Sequence
  chemically synthesized
gactagggtggcatgtgacc

SEQ ID NO: 249839 - DNA, 20 bp, Artificial Sequence
  chemically synthesized
actagggtggcatgtgacct

SEQ ID NO: 249840 - DNA, 20 bp, Artificial Sequence
  chemically synthesized
ctagggtggcatgtgaccta

SEQ ID NO: 249841 - DNA, 20 bp, Artificial Sequence
  chemically synthesized
agggtggcatgtgacctagg

SEQ ID NO: 249842 - DNA, 20 bp, Artificial Sequence
  chemically synthesized
atgccagctggtgtctccct

SEQ ID NO: 249843 - DNA, 20 bp, Artificial Sequence
  chemically synthesized
catgccagctggtgtctccc

SEQ ID NO: 249844 - DNA, 20 bp, Artificial Sequence
  chemically synthesized
catgtgacctagggagacac

SEQ ID NO: 249845 - DNA, 20 bp, Artificial Sequence
  chemically synthesized
tgacctagggagacaccagc

SEQ ID NO: 249846 - DNA, 20 bp, Artificial Sequence
  chemically synthesized
tagggagacaccagctggca

SEQ ID NO: 249847 - DNA, 20 bp, Artificial Sequence
  chemically synthesized
actcccttagccatgccagc

SEQ ID NO: 249848 - DNA, 20 bp, Artificial Sequence
  chemically synthesized
aagcactcccttagccatgc

SEQ ID NO: 249849 - DNA, 20 bp, Artificial Sequence
  chemically synthesized
agacaccagctggcatggct

SEQ ID NO: 249850 - DNA, 20 bp, Artificial Sequence
  chemically synthesized
gacaccagctggcatggcta

SEQ ID NO: 249851 - DNA, 20 bp, Artificial Sequence
  chemically synthesized
acaccagctggcatggctaa

SEQ ID NO: 249852 - DNA, 20 bp, Artificial Sequence
  chemically synthesized
accagctggcatggctaagg

SEQ ID NO: 249853 - DNA, 20 bp, Artificial Sequence
  chemically synthesized
gaatggtgcaagcactccct

SEQ ID NO: 249854 - DNA, 20 bp, Artificial Sequence
  chemically synthesized
aggtgggggaggaatggtgc

SEQ ID NO: 249855 - DNA, 20 bp, Artificial Sequence
  chemically synthesized
tgcttgaggtgggggaggaa

SEQ ID NO: 249856 - DNA, 20 bp, Artificial Sequence
  chemically synthesized
tgcactgcttgaggtggggg

SEQ ID NO: 249857 - DNA, 20 bp, Artificial Sequence
  chemically synthesized
ctgcactgcttgaggtgggg

SEQ ID NO: 249858 - DNA, 20 bp, Artificial Sequence
  chemically synthesized
caccattcctcccccacctc

SEQ ID NO: 249859 - DNA, 20 bp, Artificial Sequence
  chemically synthesized
ggctgcactgcttgaggtgg

SEQ ID NO: 249860 - DNA, 20 bp, Artificial Sequence
  chemically synthesized
gggctgcactgcttgaggtg

SEQ ID NO: 249861 - DNA, 20 bp, Artificial Sequence
  chemically synthesized
tgggctgcactgcttgaggt

SEQ ID NO: 249862 - DNA, 20 bp, Artificial Sequence
  chemically synthesized
cattcctcccccacctcaag

SEQ ID NO: 249863 - DNA, 20 bp, Artificial Sequence
  chemically synthesized
gtgggctgcactgcttgagg

SEQ ID NO: 249864 - DNA, 20 bp, Artificial Sequence
  chemically synthesized
actgtgggctgcactgcttg

SEQ ID NO: 249865 - DNA, 20 bp, Artificial Sequence
  chemically synthesized
tactgtgggctgcactgctt

SEQ ID NO: 249866 - DNA, 20 bp, Artificial Sequence
  chemically synthesized
ctcccccacctcaagcagtg

SEQ ID NO: 249867 - DNA, 20 bp, Artificial Sequence
  chemically synthesized
acctcaagcagtgcagccca

SEQ ID NO: 249868 - DNA, 20 bp, Artificial Sequence
  chemically synthesized
ggagtcacttttgttactgt

SEQ ID NO: 249869 - DNA, 20 bp, Artificial Sequence
  chemically synthesized
aggagtcacttttgttactg

SEQ ID NO: 249870 - DNA, 20 bp, Artificial Sequence
  chemically synthesized
agtgcagcccacagtaacaa

SEQ ID NO: 249871 - DNA, 20 bp, Artificial Sequence
  chemically synthesized
tctccttaagcaaaagtaag

SEQ ID NO: 249872 - DNA, 20 bp, Artificial Sequence
  chemically synthesized
cctctccttaagcaaaagta

SEQ ID NO: 249873 - DNA, 20 bp, Artificial Sequence
  chemically synthesized
tcctctccttaagcaaaagt

SEQ ID NO: 249874 - DNA, 20 bp, Artificial Sequence
  chemically synthesized
gtgactccttacttttgctt

SEQ ID NO: 249875 - DNA, 20 bp, Artificial Sequence
  chemically synthesized
tgactccttacttttgctta

SEQ ID NO: 249876 - DNA, 20 bp, Artificial Sequence
  chemically synthesized
actctcctctccttaagcaa

SEQ ID NO: 249877 - DNA, 20 bp, Artificial Sequence
  chemically synthesized
actccttacttttgcttaag

SEQ ID NO: 249878 - DNA, 20 bp, Artificial Sequence
  chemically synthesized
tccttacttttgcttaagga

SEQ ID NO: 249879 - DNA, 20 bp, Artificial Sequence
  chemically synthesized
ccttacttttgcttaaggag

SEQ ID NO: 249880 - DNA, 20 bp, Artificial Sequence
  chemically synthesized
cttttcactctcctctcctt

SEQ ID NO: 249881 - DNA, 20 bp, Artificial Sequence
  chemically synthesized
ttacttttgcttaaggagag

SEQ ID NO: 249882 - DNA, 20 bp, Artificial Sequence
  chemically synthesized
acttttgcttaaggagagga

SEQ ID NO: 249883 - DNA, 20 bp, Artificial Sequence
  chemically synthesized
cttaaggagaggagagtgaa

SEQ ID NO: 249884 - DNA, 20 bp, Artificial Sequence
  chemically synthesized
ggagaggagagtgaaaagta

SEQ ID NO: 249885 - DNA, 20 bp, Artificial Sequence
  chemically synthesized
agaggagagtgaaaagtaaa

SEQ ID NO: 249886 - DNA, 20 bp, Artificial Sequence
  chemically synthesized
gaggagagtgaaaagtaaag

SEQ ID NO: 249887 - DNA, 20 bp, Artificial Sequence
  chemically synthesized
ctggtatccaagatgcaaga

SEQ ID NO: 249888 - DNA, 20 bp, Artificial Sequence
  chemically synthesized
gaggattctgtcttgcatct

SEQ ID NO: 249889 - DNA, 20 bp, Artificial Sequence
  chemically synthesized
taagctggtatccaagatgc

SEQ ID NO: 249890 - DNA, 20 bp, Artificial Sequence
  chemically synthesized
ctgtcttgcatcttggatac

SEQ ID NO: 249891 - DNA, 20 bp, Artificial Sequence
  chemically synthesized
ctgtgactaagctggtatcc

SEQ ID NO: 249892 - DNA, 20 bp, Artificial Sequence
  chemically synthesized
ttgcatcttggataccagct

SEQ ID NO: 249893 - DNA, 20 bp, Artificial Sequence
  chemically synthesized
ctatcctactgtgactaagc

SEQ ID NO: 249894 - DNA, 20 bp, Artificial Sequence
  chemically synthesized
cttggataccagcttagtca

SEQ ID NO: 249895 - DNA, 20 bp, Artificial Sequence
  chemically synthesized
tgccctatcctactgtgact

SEQ ID NO: 249896 - DNA, 20 bp, Artificial Sequence
  chemically synthesized
ggataccagcttagtcacag

SEQ ID NO: 249897 - DNA, 20 bp, Artificial Sequence
  chemically synthesized
gataccagcttagtcacagt

SEQ ID NO: 249898 - DNA, 20 bp, Artificial Sequence
  chemically synthesized
ccagcttagtcacagtagga

SEQ ID NO: 249899 - DNA, 20 bp, Artificial Sequence
  chemically synthesized
cagcttagtcacagtaggat

SEQ ID NO: 249900 - DNA, 20 bp, Artificial Sequence
  chemically synthesized
agcttagtcacagtaggata

SEQ ID NO: 249901 - DNA, 20 bp, Artificial Sequence
  chemically synthesized
gtcacagtaggatagggcac

SEQ ID NO: 249902 - DNA, 20 bp, Artificial Sequence
  chemically synthesized
cagtaggatagggcactgga

SEQ ID NO: 249903 - DNA, 20 bp, Artificial Sequence
  chemically synthesized
tgggtcctcacaacactgtc

SEQ ID NO: 249904 - DNA, 20 bp, Artificial Sequence
  chemically synthesized
agggcactggacagtgttgt

SEQ ID NO: 249905 - DNA, 20 bp, Artificial Sequence
  chemically synthesized
gggcactggacagtgttgtg

SEQ ID NO: 249906 - DNA, 20 bp, Artificial Sequence
  chemically synthesized
gtgttgtgaggacccatttc

SEQ ID NO: 249907 - DNA, 20 bp, Artificial Sequence
  chemically synthesized
tgttgtgaggacccatttct

SEQ ID NO: 249908 - DNA, 20 bp, Artificial Sequence
  chemically synthesized
caggagctgagcctagaaat

SEQ ID NO: 249909 - DNA, 20 bp, Artificial Sequence
  chemically synthesized
ccaggagctgagcctagaaa

SEQ ID NO: 249910 - DNA, 20 bp, Artificial Sequence
  chemically synthesized
tgaggacccatttctaggct

SEQ ID NO: 249911 - DNA, 20 bp, Artificial Sequence
  chemically synthesized
tgttgtccaggagctgagcc

SEQ ID NO: 249912 - DNA, 20 bp, Artificial Sequence
  chemically synthesized
ccatttctaggctcagctcc

SEQ ID NO: 249913 - DNA, 20 bp, Artificial Sequence
  chemically synthesized
gagagtgttgtccaggagct

SEQ ID NO: 249914 - DNA, 20 bp, Artificial Sequence
  chemically synthesized
gattggagagtgttgtccag

SEQ ID NO: 249915 - DNA, 20 bp, Artificial Sequence
  chemically synthesized
ttgattggagagtgttgtcc

SEQ ID NO: 249916 - DNA, 20 bp, Artificial Sequence
  chemically synthesized
cttgattggagagtgttgtc

SEQ ID NO: 249917 - DNA, 20 bp, Artificial Sequence
  chemically synthesized
ctggacaacactctccaatc

SEQ ID NO: 249918 - DNA, 20 bp, Artificial Sequence
  chemically synthesized
ctgtatctctcttgattgga

SEQ ID NO: 249919 - DNA, 20 bp, Artificial Sequence
  chemically synthesized
ggacaacactctccaatcaa

SEQ ID NO: 249920 - DNA, 20 bp, Artificial Sequence
  chemically synthesized
cactgtatctctcttgattg

SEQ ID NO: 249921 - DNA, 20 bp, Artificial Sequence
  chemically synthesized
acaacactctccaatcaaga

SEQ ID NO: 249922 - DNA, 20 bp, Artificial Sequence
  chemically synthesized
gacactgtatctctcttgat

SEQ ID NO: 249923 - DNA, 20 bp, Artificial Sequence
  chemically synthesized
ctctccaatcaagagagata

SEQ ID NO: 249924 - DNA, 20 bp, Artificial Sequence
  chemically synthesized
gagagatacagtgtctcgac

SEQ ID NO: 249925 - DNA, 20 bp, Artificial Sequence
  chemically synthesized
agagatacagtgtctcgacc

SEQ ID NO: 249926 - DNA, 20 bp, Artificial Sequence
  chemically synthesized
gtgagccaccatgcctggtc

SEQ ID NO: 249927 - DNA, 20 bp, Artificial Sequence
  chemically synthesized
tacagtgtctcgaccaggca

SEQ ID NO: 249928 - DNA, 20 bp, Artificial Sequence
  chemically synthesized
agtgtctcgaccaggcatgg

SEQ ID NO: 249929 - DNA, 20 bp, Artificial Sequence
  chemically synthesized
caggcgtgagccaccatgcc

SEQ ID NO: 249930 - DNA, 20 bp, Artificial Sequence
  chemically synthesized
agtgctaggattacaggcgt

SEQ ID NO: 249931 - DNA, 20 bp, Artificial Sequence
  chemically synthesized
gtggctcacgcctgtaatcc

SEQ ID NO: 249932 - DNA, 20 bp, Artificial Sequence
  chemically synthesized
tcccaaagtgctaggattac

SEQ ID NO: 249933 - DNA, 20 bp, Artificial Sequence
  chemically synthesized
ctcccaaagtgctaggatta

SEQ ID NO: 249934 - DNA, 20 bp, Artificial Sequence
  chemically synthesized
cgcctgtaatcctagcactt

SEQ ID NO: 249935 - DNA, 20 bp, Artificial Sequence
  chemically synthesized
cttcggcctcccaaagtgct

SEQ ID NO: 249936 - DNA, 20 bp, Artificial Sequence
  chemically synthesized
gcctgtaatcctagcacttt

SEQ ID NO: 249937 - DNA, 20 bp, Artificial Sequence
  chemically synthesized
acttcggcctcccaaagtgc

SEQ ID NO: 249938 - DNA, 20 bp, Artificial Sequence
  chemically synthesized
ctgtaatcctagcactttgg

SEQ ID NO: 249939 - DNA, 20 bp, Artificial Sequence
  chemically synthesized
tgtaatcctagcactttggg

SEQ ID NO: 249940 - DNA, 20 bp, Artificial Sequence
  chemically synthesized
ccacctacttcggcctccca

SEQ ID NO: 249941 - DNA, 20 bp, Artificial Sequence
  chemically synthesized
cctagcactttgggaggccg

SEQ ID NO: 249942 - DNA, 20 bp, Artificial Sequence
  chemically synthesized
agcactttgggaggccgaag

SEQ ID NO: 249943 - DNA, 20 bp, Artificial Sequence
  chemically synthesized
gcactttgggaggccgaagt

SEQ ID NO: 249944 - DNA, 20 bp, Artificial Sequence
  chemically synthesized
ctttgggaggccgaagtagg

SEQ ID NO: 249945 - DNA, 20 bp, Artificial Sequence
  chemically synthesized
ctcaagtgatccacctactt

SEQ ID NO: 249946 - DNA, 20 bp, Artificial Sequence
  chemically synthesized
ccgaagtaggtggatcactt

SEQ ID NO: 249947 - DNA, 20 bp, Artificial Sequence
  chemically synthesized
cgaagtaggtggatcacttg

SEQ ID NO: 249948 - DNA, 20 bp, Artificial Sequence
  chemically synthesized
gtaggtggatcacttgaggt

SEQ ID NO: 249949 - DNA, 20 bp, Artificial Sequence
  chemically synthesized
taggtggatcacttgaggtc

SEQ ID NO: 249950 - DNA, 20 bp, Artificial Sequence
  chemically synthesized
ggtctcgaactcctgacctc

SEQ ID NO: 249951 - DNA, 20 bp, Artificial Sequence
  chemically synthesized
ggtggatcacttgaggtcag

SEQ ID NO: 249952 - DNA, 20 bp, Artificial Sequence
  chemically synthesized
tcacttgaggtcaggagttc

SEQ ID NO: 249953 - DNA, 20 bp, Artificial Sequence
  chemically synthesized
tgaggtcaggagttcgagac

SEQ ID NO: 249954 - DNA, 20 bp, Artificial Sequence
  chemically synthesized
tcaggagttcgagaccagcc

SEQ ID NO: 249955 - DNA, 20 bp, Artificial Sequence
  chemically synthesized
tttcatgatgttggccaggc

SEQ ID NO: 249956 - DNA, 20 bp, Artificial Sequence
  chemically synthesized
ggggtttcatgatgttggcc

SEQ ID NO: 249957 - DNA, 20 bp, Artificial Sequence
  chemically synthesized
tggggtttcatgatgttggc

SEQ ID NO: 249958 - DNA, 20 bp, Artificial Sequence
  chemically synthesized
gagttggggtttcatgatgt

SEQ ID NO: 249959 - DNA, 20 bp, Artificial Sequence
  chemically synthesized
ttgtatttttagtagagttg

SEQ ID NO: 249960 - DNA, 20 bp, Artificial Sequence
  chemically synthesized
tttgtatttttagtagagtt

SEQ ID NO: 249961 - DNA, 20 bp, Artificial Sequence
  chemically synthesized
ttttgtatttttagtagagt

SEQ ID NO: 249962 - DNA, 20 bp, Artificial Sequence
  chemically synthesized
taatttttgtatttttagta

SEQ ID NO: 249963 - DNA, 20 bp, Artificial Sequence
  chemically synthesized
gctaatttttgtatttttag

SEQ ID NO: 249964 - DNA, 20 bp, Artificial Sequence
  chemically synthesized
gtggctaatttttgtatttt

SEQ ID NO: 249965 - DNA, 20 bp, Artificial Sequence
  chemically synthesized
tctactaaaaatacaaaaat

SEQ ID NO: 249966 - DNA, 20 bp, Artificial Sequence
  chemically synthesized
cagtcacccacaatcacgcg

SEQ ID NO: 249967 - DNA, 20 bp, Artificial Sequence
  chemically synthesized
aaattagccacgcgtgattg

SEQ ID NO: 249968 - DNA, 20 bp, Artificial Sequence
  chemically synthesized
aattagccacgcgtgattgt

SEQ ID NO: 249969 - DNA, 20 bp, Artificial Sequence
  chemically synthesized
attgtgggtgactgtaatct

SEQ ID NO: 249970 - DNA, 20 bp, Artificial Sequence
  chemically synthesized
cccccaagaggctgagatta

SEQ ID NO: 249971 - DNA, 20 bp, Artificial Sequence
  chemically synthesized
tgactgtaatctcagcctct

SEQ ID NO: 249972 - DNA, 20 bp, Artificial Sequence
  chemically synthesized
ccttagccccccaagaggct

SEQ ID NO: 249973 - DNA, 20 bp, Artificial Sequence
  chemically synthesized
gactgtaatctcagcctctt

SEQ ID NO: 249974 - DNA, 20 bp, Artificial Sequence
  chemically synthesized
actgtaatctcagcctcttg

SEQ ID NO: 249975 - DNA, 20 bp, Artificial Sequence
  chemically synthesized
ctgtaatctcagcctcttgg

SEQ ID NO: 249976 - DNA, 20 bp, Artificial Sequence
  chemically synthesized
tgtaatctcagcctcttggg

SEQ ID NO: 249977 - DNA, 20 bp, Artificial Sequence
  chemically synthesized
ttgtgccttagccccccaag

SEQ ID NO: 249978 - DNA, 20 bp, Artificial Sequence
  chemically synthesized
cttgtgccttagccccccaa

SEQ ID NO: 249979 - DNA, 20 bp, Artificial Sequence
  chemically synthesized
ttcttgtgccttagcccccc

SEQ ID NO: 249980 - DNA, 20 bp, Artificial Sequence
  chemically synthesized
tctcagcctcttggggggct

SEQ ID NO: 249981 - DNA, 20 bp, Artificial Sequence
  chemically synthesized
ctcagcctcttggggggcta

SEQ ID NO: 249982 - DNA, 20 bp, Artificial Sequence
  chemically synthesized
ctcttggggggctaaggcac

SEQ ID NO: 249983 - DNA, 20 bp, Artificial Sequence
  chemically synthesized
ttcaagagattcttgtgcct

SEQ ID NO: 249984 - DNA, 20 bp, Artificial Sequence
  chemically synthesized
gcacaagaatctcttgaacc

SEQ ID NO: 249985 - DNA, 20 bp, Artificial Sequence
  chemically synthesized
cctccgcctcctgggttcaa

SEQ ID NO: 249986 - DNA, 20 bp, Artificial Sequence
  chemically synthesized
cacaagaatctcttgaaccc

SEQ ID NO: 249987 - DNA, 20 bp, Artificial Sequence
  chemically synthesized
aacctccgcctcctgggttc

SEQ ID NO: 249988 - DNA, 20 bp, Artificial Sequence
  chemically synthesized
caagaatctcttgaacccag

SEQ ID NO: 249989 - DNA, 20 bp, Artificial Sequence
  chemically synthesized
aagaatctcttgaacccagg

SEQ ID NO: 249990 - DNA, 20 bp, Artificial Sequence
  chemically synthesized
aatctcttgaacccaggagg

SEQ ID NO: 249991 - DNA, 20 bp, Artificial Sequence
  chemically synthesized
cgctgcaacctccgcctcct

SEQ ID NO: 249992 - DNA, 20 bp, Artificial Sequence
  chemically synthesized
tctcttgaacccaggaggcg

SEQ ID NO: 249993 - DNA, 20 bp, Artificial Sequence
  chemically synthesized
tcgctgcaacctccgcctcc

SEQ ID NO: 249994 - DNA, 20 bp, Artificial Sequence
  chemically synthesized
ctcttgaacccaggaggcgg

SEQ ID NO: 249995 - DNA, 20 bp, Artificial Sequence
  chemically synthesized
aacccaggaggcggaggttg

SEQ ID NO: 249996 - DNA, 20 bp, Artificial Sequence
  chemically synthesized
ggcggaggttgcagcgaact

SEQ ID NO: 249997 - DNA, 20 bp, Artificial Sequence
  chemically synthesized
ggagtgctgtgacaggatct

SEQ ID NO: 249998 - DNA, 20 bp, Artificial Sequence
  chemically synthesized
agcgaactgagatcctgtca

SEQ ID NO: 249999 - DNA, 20 bp, Artificial Sequence
  chemically synthesized
ccaggctggagtgctgtgac

SEQ ID NO: 250000 - DNA, 20 bp, Artificial Sequence
  chemically synthesized
cccaggctggagtgctgtga

SEQ ID NO: 250001 - DNA, 20 bp, Artificial Sequence
  chemically synthesized
gagatcctgtcacagcactc

SEQ ID NO: 250002 - DNA, 20 bp, Artificial Sequence
  chemically synthesized
cctgtcacagcactccagcc

SEQ ID NO: 250003 - DNA, 20 bp, Artificial Sequence
  chemically synthesized
ctgtcacagcactccagcct

SEQ ID NO: 250004 - DNA, 20 bp, Artificial Sequence
  chemically synthesized
tcactctgttgcccaggctg

SEQ ID NO: 250005 - DNA, 20 bp, Artificial Sequence
  chemically synthesized
tctcactctgttgcccaggc

SEQ ID NO: 250006 - DNA, 20 bp, Artificial Sequence
  chemically synthesized
cagcactccagcctgggcaa

SEQ ID NO: 250007 - DNA, 20 bp, Artificial Sequence
  chemically synthesized
agcatctcactctgttgccc

SEQ ID NO: 250008 - DNA, 20 bp, Artificial Sequence
  chemically synthesized
gcactccagcctgggcaaca

SEQ ID NO: 250009 - DNA, 20 bp, Artificial Sequence
  chemically synthesized
cagcatctcactctgttgcc

SEQ ID NO: 250010 - DNA, 20 bp, Artificial Sequence
  chemically synthesized
tccagcctgggcaacagagt

SEQ ID NO: 250011 - DNA, 20 bp, Artificial Sequence
  chemically synthesized
acagagtgagatgctgtctc

SEQ ID NO: 250012 - DNA, 20 bp, Artificial Sequence
  chemically synthesized
ttttcttttctttcttgaga

SEQ ID NO: 250013 - DNA, 20 bp, Artificial Sequence
  chemically synthesized
agtgagatgctgtctcaaga

SEQ ID NO: 250014 - DNA, 20 bp, Artificial Sequence
  chemically synthesized
tttcttttcttttctttctt

SEQ ID NO: 250015 - DNA, 20 bp, Artificial Sequence
  chemically synthesized
gatgctgtctcaagaaagaa

SEQ ID NO: 250016 - DNA, 20 bp, Artificial Sequence
  chemically synthesized
tgtctcaagaaagaaaagaa

SEQ ID NO: 250017 - DNA, 20 bp, Artificial Sequence
  chemically synthesized
tcaagaaagaaaagaaaaga

SEQ ID NO: 250018 - DNA, 20 bp, Artificial Sequence
  chemically synthesized
gaaagaaaagaaaagaaaga

SEQ ID NO: 250019 - DNA, 20 bp, Artificial Sequence
  chemically synthesized
gaaaagaaaagaaagaaaga

SEQ ID NO: 250020 - DNA, 20 bp, Artificial Sequence
  chemically synthesized
agaaagaaagatagaaaaaa

SEQ ID NO: 250021 - DNA, 20 bp, Artificial Sequence
  chemically synthesized
aaagaaagatagaaaaaaaa

SEQ ID NO: 250022 - DNA, 20 bp, Artificial Sequence
  chemically synthesized
agaaagatagaaaaaaaaga

SEQ ID NO: 250023 - DNA, 20 bp, Artificial Sequence
  chemically synthesized
aaagatagaaaaaaaagaga

SEQ ID NO: 250024 - DNA, 20 bp, Artificial Sequence
  chemically synthesized
gatagaaaaaaaagagagag

SEQ ID NO: 250025 - DNA, 20 bp, Artificial Sequence
  chemically synthesized
aaaaaaaagagagagaagaa

SEQ ID NO: 250026 - DNA, 20 bp, Artificial Sequence
  chemically synthesized
aaagagagagaagaaaagaa

SEQ ID NO: 250027 - DNA, 20 bp, Artificial Sequence
  chemically synthesized
agaagaaaagaaaagaaaaa

SEQ ID NO: 250028 - DNA, 20 bp, Artificial Sequence
  chemically synthesized
aaagaaaagaaaaatagata

SEQ ID NO: 250029 - DNA, 20 bp, Artificial Sequence
  chemically synthesized
aaatagatacagtgtctgaa

SEQ ID NO: 250030 - DNA, 20 bp, Artificial Sequence
  chemically synthesized
gtcttattttttcatccatt

SEQ ID NO: 250031 - DNA, 20 bp, Artificial Sequence
  chemically synthesized
gtctgaatggatgaaaaaat

SEQ ID NO: 250032 - DNA, 20 bp, Artificial Sequence
  chemically synthesized
cttgaggtcaacacaaaatt

SEQ ID NO: 250033 - DNA, 20 bp, Artificial Sequence
  chemically synthesized
tcttgaggtcaacacaaaat

SEQ ID NO: 250034 - DNA, 20 bp, Artificial Sequence
  chemically synthesized
cccaattttgtgttgacctc

SEQ ID NO: 250035 - DNA, 20 bp, Artificial Sequence
  chemically synthesized
aattttgtgttgacctcaag

SEQ ID NO: 250036 - DNA, 20 bp, Artificial Sequence
  chemically synthesized
taggtgaagagtgcttcttg

SEQ ID NO: 250037 - DNA, 20 bp, Artificial Sequence
  chemically synthesized
ataggtgaagagtgcttctt

SEQ ID NO: 250038 - DNA, 20 bp, Artificial Sequence
  chemically synthesized
tgtgtagctttataggtgaa

SEQ ID NO: 250039 - DNA, 20 bp, Artificial Sequence
  chemically synthesized
tgtgtgtagctttataggtg

SEQ ID NO: 250040 - DNA, 20 bp, Artificial Sequence
  chemically synthesized
agaagcactcttcacctata

SEQ ID NO: 250041 - DNA, 20 bp, Artificial Sequence
  chemically synthesized
cagtctgtgtgtagctttat

SEQ ID NO: 250042 - DNA, 20 bp, Artificial Sequence
  chemically synthesized
ccagtctgtgtgtagcttta

SEQ ID NO: 250043 - DNA, 20 bp, Artificial Sequence
  chemically synthesized
ttcacctataaagctacaca

SEQ ID NO: 250044 - DNA, 20 bp, Artificial Sequence
  chemically synthesized
ctttatttccagtctgtgtg

SEQ ID NO: 250045 - DNA, 20 bp, Artificial Sequence
  chemically synthesized
ctataaagctacacacagac

SEQ ID NO: 250046 - DNA, 20 bp, Artificial Sequence
  chemically synthesized
ctacacacagactggaaata

SEQ ID NO: 250047 - DNA, 20 bp, Artificial Sequence
  chemically synthesized
tacacacagactggaaataa

SEQ ID NO: 250048 - DNA, 20 bp, Artificial Sequence
  chemically synthesized
tttttccatccctttatttc

SEQ ID NO: 250049 - DNA, 20 bp, Artificial Sequence
  chemically synthesized
acacacagactggaaataaa

SEQ ID NO: 250050 - DNA, 20 bp, Artificial Sequence
  chemically synthesized
acagactggaaataaaggga

SEQ ID NO: 250051 - DNA, 20 bp, Artificial Sequence
  chemically synthesized
tggaaataaagggatggaaa

SEQ ID NO: 250052 - DNA, 20 bp, Artificial Sequence
  chemically synthesized
aaaaagatattccatgccaa

SEQ ID NO: 250053 - DNA, 20 bp, Artificial Sequence
  chemically synthesized
tgtttgggtttccattggca

SEQ ID NO: 250054 - DNA, 20 bp, Artificial Sequence
  chemically synthesized
agctatgtttgggtttccat

SEQ ID NO: 250055 - DNA, 20 bp, Artificial Sequence
  chemically synthesized
tgccaatggaaacccaaaca

SEQ ID NO: 250056 - DNA, 20 bp, Artificial Sequence
  chemically synthesized
gagctagtccagctatgttt

SEQ ID NO: 250057 - DNA, 20 bp, Artificial Sequence
  chemically synthesized
agagctagtccagctatgtt

SEQ ID NO: 250058 - DNA, 20 bp, Artificial Sequence
  chemically synthesized
aatggaaacccaaacatagc

SEQ ID NO: 250059 - DNA, 20 bp, Artificial Sequence
  chemically synthesized
aaacccaaacatagctggac

SEQ ID NO: 250060 - DNA, 20 bp, Artificial Sequence
  chemically synthesized
tgatataagtagagctagtc

SEQ ID NO: 250061 - DNA, 20 bp, Artificial Sequence
  chemically synthesized
tggtctgatataagtagagc

SEQ ID NO: 250062 - DNA, 20 bp, Artificial Sequence
  chemically synthesized
gatttggtctgatataagta

SEQ ID NO: 250063 - DNA, 20 bp, Artificial Sequence
  chemically synthesized
tggactagctctacttatat

SEQ ID NO: 250064 - DNA, 20 bp, Artificial Sequence
  chemically synthesized
tcgatttggtctgatataag

SEQ ID NO: 250065 - DNA, 20 bp, Artificial Sequence
  chemically synthesized
atatcgatttggtctgatat

SEQ ID NO: 250066 - DNA, 20 bp, Artificial Sequence
  chemically synthesized
tttttgtcctgatatcgatt

SEQ ID NO: 250067 - DNA, 20 bp, Artificial Sequence
  chemically synthesized
atatcagaccaaatcgatat

SEQ ID NO: 250068 - DNA, 20 bp, Artificial Sequence
  chemically synthesized
tatcagaccaaatcgatatc

SEQ ID NO: 250069 - DNA, 20 bp, Artificial Sequence
  chemically synthesized
gatatcaggacaaaaactgt

SEQ ID NO: 250070 - DNA, 20 bp, Artificial Sequence
  chemically synthesized
atcaggacaaaaactgtaag

SEQ ID NO: 250071 - DNA, 20 bp, Artificial Sequence
  chemically synthesized
caggacaaaaactgtaagaa

SEQ ID NO: 250072 - DNA, 20 bp, Artificial Sequence
  chemically synthesized
accttctttgtctcttctta

SEQ ID NO: 250073 - DNA, 20 bp, Artificial Sequence
  chemically synthesized
aaaaactgtaagaagagaca

SEQ ID NO: 250074 - DNA, 20 bp, Artificial Sequence
  chemically synthesized
aactgtaagaagagacaaag

SEQ ID NO: 250075 - DNA, 20 bp, Artificial Sequence
  chemically synthesized
actgtaagaagagacaaaga

SEQ ID NO: 250076 - DNA, 20 bp, Artificial Sequence
  chemically synthesized
aggtcattatataatgacaa

SEQ ID NO: 250077 - DNA, 20 bp, Artificial Sequence
  chemically synthesized
ggtcattatataatgacaaa

SEQ ID NO: 250078 - DNA, 20 bp, Artificial Sequence
  chemically synthesized
gtcattatataatgacaaaa

SEQ ID NO: 250079 - DNA, 20 bp, Artificial Sequence
  chemically synthesized
taatgacaaaagggtcaatt

SEQ ID NO: 250080 - DNA, 20 bp, Artificial Sequence
  chemically synthesized
caaaagggtcaattcagcaa

SEQ ID NO: 250081 - DNA, 20 bp, Artificial Sequence
  chemically synthesized
aaaagggtcaattcagcaac

SEQ ID NO: 250082 - DNA, 20 bp, Artificial Sequence
  chemically synthesized
attatatatgcactcaacac

SEQ ID NO: 250083 - DNA, 20 bp, Artificial Sequence
  chemically synthesized
tatatatgcactcaacactg

SEQ ID NO: 250084 - DNA, 20 bp, Artificial Sequence
  chemically synthesized
tatatatatactccagtgtt

SEQ ID NO: 250085 - DNA, 20 bp, Artificial Sequence
  chemically synthesized
tgctttatatatatatactc

SEQ ID NO: 250086 - DNA, 20 bp, Artificial Sequence
  chemically synthesized
cactggagtatatatatata

SEQ ID NO: 250087 - DNA, 20 bp, Artificial Sequence
  chemically synthesized
agcaaatatatatacaacac

SEQ ID NO: 250088 - DNA, 20 bp, Artificial Sequence
  chemically synthesized
caaatatatatacaacactg

SEQ ID NO: 250089 - DNA, 20 bp, Artificial Sequence
  chemically synthesized
atatatacaacactggagta

SEQ ID NO: 250090 - DNA, 20 bp, Artificial Sequence
  chemically synthesized
tgctttatatatctgtactc

SEQ ID NO: 250091 - DNA, 20 bp, Artificial Sequence
  chemically synthesized
cactggagtacagatatata

SEQ ID NO: 250092 - DNA, 20 bp, Artificial Sequence
  chemically synthesized
atataaagcaaatattattc

SEQ ID NO: 250093 - DNA, 20 bp, Artificial Sequence
  chemically synthesized
aagcaaatattattcgagct

SEQ ID NO: 250094 - DNA, 20 bp, Artificial Sequence
  chemically synthesized
agcaaatattattcgagctc

SEQ ID NO: 250095 - DNA, 20 bp, Artificial Sequence
  chemically synthesized
caaatattattcgagctcag

SEQ ID NO: 250096 - DNA, 20 bp, Artificial Sequence
  chemically synthesized
aatattattcgagctcagga

SEQ ID NO: 250097 - DNA, 20 bp, Artificial Sequence
  chemically synthesized
tattattcgagctcaggaga

SEQ ID NO: 250098 - DNA, 20 bp, Artificial Sequence
  chemically synthesized
ttgaggtctttctctctcct

SEQ ID NO: 250099 - DNA, 20 bp, Artificial Sequence
  chemically synthesized
attcgagctcaggagagaga

SEQ ID NO: 250100 - DNA, 20 bp, Artificial Sequence
  chemically synthesized
ctcctgctgttattgtattg

SEQ ID NO: 250101 - DNA, 20 bp, Artificial Sequence
  chemically synthesized
gctcctgctgttattgtatt

SEQ ID NO: 250102 - DNA, 20 bp, Artificial Sequence
  chemically synthesized
gaaagacctcaatacaataa

SEQ ID NO: 250103 - DNA, 20 bp, Artificial Sequence
  chemically synthesized
agacctcaatacaataacag

SEQ ID NO: 250104 - DNA, 20 bp, Artificial Sequence
  chemically synthesized
gacctcaatacaataacagc

SEQ ID NO: 250105 - DNA, 20 bp, Artificial Sequence
  chemically synthesized
cctcaatacaataacagcag

SEQ ID NO: 250106 - DNA, 20 bp, Artificial Sequence
  chemically synthesized
gttgaaagtggggttgttga

SEQ ID NO: 250107 - DNA, 20 bp, Artificial Sequence
  chemically synthesized
tgttgaaagtggggttgttg

SEQ ID NO: 250108 - DNA, 20 bp, Artificial Sequence
  chemically synthesized
tctgcccaatgttgaaagtg

SEQ ID NO: 250109 - DNA, 20 bp, Artificial Sequence
  chemically synthesized
atctgcccaatgttgaaagt

SEQ ID NO: 250110 - DNA, 20 bp, Artificial Sequence
  chemically synthesized
gatctgcccaatgttgaaag

SEQ ID NO: 250111 - DNA, 20 bp, Artificial Sequence
  chemically synthesized
aacaaccccactttcaacat

SEQ ID NO: 250112 - DNA, 20 bp, Artificial Sequence
  chemically synthesized
ggagatctgcccaatgttga

SEQ ID NO: 250113 - DNA, 20 bp, Artificial Sequence
  chemically synthesized
acaaccccactttcaacatt

SEQ ID NO: 250114 - DNA, 20 bp, Artificial Sequence
  chemically synthesized
accccactttcaacattggg

SEQ ID NO: 250115 - DNA, 20 bp, Artificial Sequence
  chemically synthesized
tcaacattgggcagatctcc

SEQ ID NO: 250116 - DNA, 20 bp, Artificial Sequence
  chemically synthesized
cattgggcagatctcccaga

SEQ ID NO: 250117 - DNA, 20 bp, Artificial Sequence
  chemically synthesized
ttggttgagcttctgtctgg

SEQ ID NO: 250118 - DNA, 20 bp, Artificial Sequence
  chemically synthesized
tgggcagatctcccagacag

SEQ ID NO: 250119 - DNA, 20 bp, Artificial Sequence
  chemically synthesized
ctttggttgagcttctgtct

SEQ ID NO: 250120 - DNA, 20 bp, Artificial Sequence
  chemically synthesized
actttggttgagcttctgtc

SEQ ID NO: 250121 - DNA, 20 bp, Artificial Sequence
  chemically synthesized
cccagacagaagctcaacca

SEQ ID NO: 250122 - DNA, 20 bp, Artificial Sequence
  chemically synthesized
ccaatgttactactttggtt

SEQ ID NO: 250123 - DNA, 20 bp, Artificial Sequence
  chemically synthesized
agacagaagctcaaccaaag

SEQ ID NO: 250124 - DNA, 20 bp, Artificial Sequence
  chemically synthesized
taagtccaatgttactactt

SEQ ID NO: 250125 - DNA, 20 bp, Artificial Sequence
  chemically synthesized
ctcaaccaaagtagtaacat

SEQ ID NO: 250126 - DNA, 20 bp, Artificial Sequence
  chemically synthesized
tttattctatagtgcagatt

SEQ ID NO: 250127 - DNA, 20 bp, Artificial Sequence
  chemically synthesized
attggacttaatctgcacta

SEQ ID NO: 250128 - DNA, 20 bp, Artificial Sequence
  chemically synthesized
gatccatttattctatagtg

SEQ ID NO: 250129 - DNA, 20 bp, Artificial Sequence
  chemically synthesized
tattagatccatttattcta

SEQ ID NO: 250130 - DNA, 20 bp, Artificial Sequence
  chemically synthesized
aatctgcactatagaataaa

SEQ ID NO: 250131 - DNA, 20 bp, Artificial Sequence
  chemically synthesized
ataaatggatctaatattta

SEQ ID NO: 250132 - DNA, 20 bp, Artificial Sequence
  chemically synthesized
attaaatgtcctgtaaatat

SEQ ID NO: 250133 - DNA, 20 bp, Artificial Sequence
  chemically synthesized
taaatggatctaatatttac

SEQ ID NO: 250134 - DNA, 20 bp, Artificial Sequence
  chemically synthesized
tacaggacatttaattcaat

SEQ ID NO: 250135 - DNA, 20 bp, Artificial Sequence
  chemically synthesized
gacatttaattcaatgagtg

SEQ ID NO: 250136 - DNA, 20 bp, Artificial Sequence
  chemically synthesized
agaatacacattcttcttct

SEQ ID NO: 250137 - DNA, 20 bp, Artificial Sequence
  chemically synthesized
ataatctgtgtgctgagaag

SEQ ID NO: 250138 - DNA, 20 bp, Artificial Sequence
  chemically synthesized
ataataatctgtgtgctgag

SEQ ID NO: 250139 - DNA, 20 bp, Artificial Sequence
  chemically synthesized
acattcttcttctcagcaca

SEQ ID NO: 250140 - DNA, 20 bp, Artificial Sequence
  chemically synthesized
ttgataataatctgtgtgct

SEQ ID NO: 250141 - DNA, 20 bp, Artificial Sequence
  chemically synthesized
cagcacacagattattatca

SEQ ID NO: 250142 - DNA, 20 bp, Artificial Sequence
  chemically synthesized
acacagattattatcaaaga

SEQ ID NO: 250143 - DNA, 20 bp, Artificial Sequence
  chemically synthesized
attatcaaagatagaccaca

SEQ ID NO: 250144 - DNA, 20 bp, Artificial Sequence
  chemically synthesized
atcaaagatagaccacacag

SEQ ID NO: 250145 - DNA, 20 bp, Artificial Sequence
  chemically synthesized
tcaaagatagaccacacagt

SEQ ID NO: 250146 - DNA, 20 bp, Artificial Sequence
  chemically synthesized
tgcttttgtgacctactgtg

SEQ ID NO: 250147 - DNA, 20 bp, Artificial Sequence
  chemically synthesized
gaccacacagtaggtcacaa

SEQ ID NO: 250148 - DNA, 20 bp, Artificial Sequence
  chemically synthesized
cacacagtaggtcacaaaag

SEQ ID NO: 250149 - DNA, 20 bp, Artificial Sequence
  chemically synthesized
caaaagcagtcttaaaaatt

SEQ ID NO: 250150 - DNA, 20 bp, Artificial Sequence
  chemically synthesized
ttcattgttactgaattttt

SEQ ID NO: 250151 - DNA, 20 bp, Artificial Sequence
  chemically synthesized
agtaacaatgaaataatatc

SEQ ID NO: 250152 - DNA, 20 bp, Artificial Sequence
  chemically synthesized
tcattccattgtggtcagag

SEQ ID NO: 250153 - DNA, 20 bp, Artificial Sequence
  chemically synthesized
gtctcattccattgtggtca

SEQ ID NO: 250154 - DNA, 20 bp, Artificial Sequence
  chemically synthesized
agcatcttctctgaccacaa

SEQ ID NO: 250155 - DNA, 20 bp, Artificial Sequence
  chemically synthesized
tagtctcattccattgtggt

SEQ ID NO: 250156 - DNA, 20 bp, Artificial Sequence
  chemically synthesized
tttctagtctcattccattg

SEQ ID NO: 250157 - DNA, 20 bp, Artificial Sequence
  chemically synthesized
ttctctgaccacaatggaat

SEQ ID NO: 250158 - DNA, 20 bp, Artificial Sequence
  chemically synthesized
tgaccacaatggaatgagac

SEQ ID NO: 250159 - DNA, 20 bp, Artificial Sequence
  chemically synthesized
aattcctcattgttgatttc

SEQ ID NO: 250160 - DNA, 20 bp, Artificial Sequence
  chemically synthesized
tgagactagaaatcaacaat

SEQ ID NO: 250161 - DNA, 20 bp, Artificial Sequence
  chemically synthesized
gagactagaaatcaacaatg

SEQ ID NO: 250162 - DNA, 20 bp, Artificial Sequence
  chemically synthesized
aaatcaacaatgaggaattt

SEQ ID NO: 250163 - DNA, 20 bp, Artificial Sequence
  chemically synthesized
tcaacaatgaggaattttgg

SEQ ID NO: 250164 - DNA, 20 bp, Artificial Sequence
  chemically synthesized
ttaacttccatgtgtttgta

SEQ ID NO: 250165 - DNA, 20 bp, Artificial Sequence
  chemically synthesized
ttggaagctatacaaacaca

SEQ ID NO: 250166 - DNA, 20 bp, Artificial Sequence
  chemically synthesized
gaagctatacaaacacatgg

SEQ ID NO: 250167 - DNA, 20 bp, Artificial Sequence
  chemically synthesized
tagacccagtggtcatttag

SEQ ID NO: 250168 - DNA, 20 bp, Artificial Sequence
  chemically synthesized
tcatagacccagtggtcatt

SEQ ID NO: 250169 - DNA, 20 bp, Artificial Sequence
  chemically synthesized
atatgctactaaatgaccac

SEQ ID NO: 250170 - DNA, 20 bp, Artificial Sequence
  chemically synthesized
tatgctactaaatgaccact

SEQ ID NO: 250171 - DNA, 20 bp, Artificial Sequence
  chemically synthesized
taatttcttcatagacccag

SEQ ID NO: 250172 - DNA, 20 bp, Artificial Sequence
  chemically synthesized
tcttaatttcttcatagacc

SEQ ID NO: 250173 - DNA, 20 bp, Artificial Sequence
  chemically synthesized
aaatgaccactgggtctatg

SEQ ID NO: 250174 - DNA, 20 bp, Artificial Sequence
  chemically synthesized
tttccttcttaatttcttca

SEQ ID NO: 250175 - DNA, 20 bp, Artificial Sequence
  chemically synthesized
actgggtctatgaagaaatt

SEQ ID NO: 250176 - DNA, 20 bp, Artificial Sequence
  chemically synthesized
gggtctatgaagaaattaag

SEQ ID NO: 250177 - DNA, 20 bp, Artificial Sequence
  chemically synthesized
ggtctatgaagaaattaaga

SEQ ID NO: 250178 - DNA, 20 bp, Artificial Sequence
  chemically synthesized
ggtttttctttcattttttg

SEQ ID NO: 250179 - DNA, 20 bp, Artificial Sequence
  chemically synthesized
aaaatgtcttcaaaaaatga

SEQ ID NO: 250180 - DNA, 20 bp, Artificial Sequence
  chemically synthesized
atcccataggttttggtatg

SEQ ID NO: 250181 - DNA, 20 bp, Artificial Sequence
  chemically synthesized
aaaccacataccaaaaccta

SEQ ID NO: 250182 - DNA, 20 bp, Artificial Sequence
  chemically synthesized
ttgctgtatcccataggttt

SEQ ID NO: 250183 - DNA, 20 bp, Artificial Sequence
  chemically synthesized
aaccacataccaaaacctat

SEQ ID NO: 250184 - DNA, 20 bp, Artificial Sequence
  chemically synthesized
ctagttttgctgtatcccat

SEQ ID NO: 250185 - DNA, 20 bp, Artificial Sequence
  chemically synthesized
ataccaaaacctatgggata

SEQ ID NO: 250186 - DNA, 20 bp, Artificial Sequence
  chemically synthesized
actagttttgctgtatccca

SEQ ID NO: 250187 - DNA, 20 bp, Artificial Sequence
  chemically synthesized
cctatgggatacagcaaaac

SEQ ID NO: 250188 - DNA, 20 bp, Artificial Sequence
  chemically synthesized
gatacagcaaaactagtact

SEQ ID NO: 250189 - DNA, 20 bp, Artificial Sequence
  chemically synthesized
tacagcaaaactagtactaa

SEQ ID NO: 250190 - DNA, 20 bp, Artificial Sequence
  chemically synthesized
gtaaatttctctcttagtac

SEQ ID NO: 250191 - DNA, 20 bp, Artificial Sequence
  chemically synthesized
cagcaaaactagtactaaga

SEQ ID NO: 250192 - DNA, 20 bp, Artificial Sequence
  chemically synthesized
acagctgtaaatttctctct

SEQ ID NO: 250193 - DNA, 20 bp, Artificial Sequence
  chemically synthesized
agtactaagagagaaattta

SEQ ID NO: 250194 - DNA, 20 bp, Artificial Sequence
  chemically synthesized
aagagagaaatttacagctg

SEQ ID NO: 250195 - DNA, 20 bp, Artificial Sequence
  chemically synthesized
agagagaaatttacagctgt

SEQ ID NO: 250196 - DNA, 20 bp, Artificial Sequence
  chemically synthesized
ttttttgatagaagcaccta

SEQ ID NO: 250197 - DNA, 20 bp, Artificial Sequence
  chemically synthesized
gtttttttcttttttgatag

SEQ ID NO: 250198 - DNA, 20 bp, Artificial Sequence
  chemically synthesized
tgtaggtgcttctatcaaaa

SEQ ID NO: 250199 - DNA, 20 bp, Artificial Sequence
  chemically synthesized
gaagtttttttcttttttga

SEQ ID NO: 250200 - DNA, 20 bp, Artificial Sequence
  chemically synthesized
attgttaggtgatttatttg

SEQ ID NO: 250201 - DNA, 20 bp, Artificial Sequence
  chemically synthesized
ggtctttaagttgcattgtt

SEQ ID NO: 250202 - DNA, 20 bp, Artificial Sequence
  chemically synthesized
aggtctttaagttgcattgt

SEQ ID NO: 250203 - DNA, 20 bp, Artificial Sequence
  chemically synthesized
tcacctaacaatgcaactta

SEQ ID NO: 250204 - DNA, 20 bp, Artificial Sequence
  chemically synthesized
aacaatgcaacttaaagacc

SEQ ID NO: 250205 - DNA, 20 bp, Artificial Sequence
  chemically synthesized
tcctgcttgtctaggtcttt

SEQ ID NO: 250206 - DNA, 20 bp, Artificial Sequence
  chemically synthesized
tgcaacttaaagacctagac

SEQ ID NO: 250207 - DNA, 20 bp, Artificial Sequence
  chemically synthesized
aacttaaagacctagacaag

SEQ ID NO: 250208 - DNA, 20 bp, Artificial Sequence
  chemically synthesized
cgatttgctcctgcttgtct

SEQ ID NO: 250209 - DNA, 20 bp, Artificial Sequence
  chemically synthesized
acttaaagacctagacaagc

SEQ ID NO: 250210 - DNA, 20 bp, Artificial Sequence
  chemically synthesized
tcgatttgctcctgcttgtc

SEQ ID NO: 250211 - DNA, 20 bp, Artificial Sequence
  chemically synthesized
ttaaagacctagacaagcag

SEQ ID NO: 250212 - DNA, 20 bp, Artificial Sequence
  chemically synthesized
gagcaaatcgaacccaaaat

SEQ ID NO: 250213 - DNA, 20 bp, Artificial Sequence
  chemically synthesized
ttctttcttccactaatttt

SEQ ID NO: 250214 - DNA, 20 bp, Artificial Sequence
  chemically synthesized
caaatcgaacccaaaattag

SEQ ID NO: 250215 - DNA, 20 bp, Artificial Sequence
  chemically synthesized
tttctttcttccactaattt

SEQ ID NO: 250216 - DNA, 20 bp, Artificial Sequence
  chemically synthesized
atcgaacccaaaattagtgg

SEQ ID NO: 250217 - DNA, 20 bp, Artificial Sequence
  chemically synthesized
aacccaaaattagtggaaga

SEQ ID NO: 250218 - DNA, 20 bp, Artificial Sequence
  chemically synthesized
agtggaagaaagaaataata

SEQ ID NO: 250219 - DNA, 20 bp, Artificial Sequence
  chemically synthesized
aagaaagaaataataaagat

SEQ ID NO: 250220 - DNA, 20 bp, Artificial Sequence
  chemically synthesized
gaaagaaataataaagatca

SEQ ID NO: 250221 - DNA, 20 bp, Artificial Sequence
  chemically synthesized
agaaataataaagatcagag

SEQ ID NO: 250222 - DNA, 20 bp, Artificial Sequence
  chemically synthesized
aaataaatgactttgtaata

SEQ ID NO: 250223 - DNA, 20 bp, Artificial Sequence
  chemically synthesized
tgtatgttttctttattaca

SEQ ID NO: 250224 - DNA, 20 bp, Artificial Sequence
  chemically synthesized
taataaagaaaacatacaaa

SEQ ID NO: 250225 - DNA, 20 bp, Artificial Sequence
  chemically synthesized
caaaaagtcaacaaaacgaa

SEQ ID NO: 250226 - DNA, 20 bp, Artificial Sequence
  chemically synthesized
aagtcaacaaaacgaaaagt

SEQ ID NO: 250227 - DNA, 20 bp, Artificial Sequence
  chemically synthesized
cgaaaagttggtttattgaa

SEQ ID NO: 250228 - DNA, 20 bp, Artificial Sequence
  chemically synthesized
gaaaagttggtttattgaaa

SEQ ID NO: 250229 - DNA, 20 bp, Artificial Sequence
  chemically synthesized
aaacaaaattgacaaatctt

SEQ ID NO: 250230 - DNA, 20 bp, Artificial Sequence
  chemically synthesized
aaaattgacaaatcttgagc

SEQ ID NO: 250231 - DNA, 20 bp, Artificial Sequence
  chemically synthesized
tttcttcattagtctggctc

SEQ ID NO: 250232 - DNA, 20 bp, Artificial Sequence
  chemically synthesized
cccttttttcttcattagtc

SEQ ID NO: 250233 - DNA, 20 bp, Artificial Sequence
  chemically synthesized
aatcttgagccagactaatg

SEQ ID NO: 250234 - DNA, 20 bp, Artificial Sequence
  chemically synthesized
cttctcccttttttcttcat

SEQ ID NO: 250235 - DNA, 20 bp, Artificial Sequence
  chemically synthesized
agccagactaatgaagaaaa

SEQ ID NO: 250236 - DNA, 20 bp, Artificial Sequence
  chemically synthesized
gccagactaatgaagaaaaa

SEQ ID NO: 250237 - DNA, 20 bp, Artificial Sequence
  chemically synthesized
ccagactaatgaagaaaaaa

SEQ ID NO: 250238 - DNA, 20 bp, Artificial Sequence
  chemically synthesized
agactaatgaagaaaaaagg

SEQ ID NO: 250239 - DNA, 20 bp, Artificial Sequence
  chemically synthesized
ctaatgaagaaaaaagggag

SEQ ID NO: 250240 - DNA, 20 bp, Artificial Sequence
  chemically synthesized
aaaagggagaagacccaaat

SEQ ID NO: 250241 - DNA, 20 bp, Artificial Sequence
  chemically synthesized
atttctgattttacttattt

SEQ ID NO: 250242 - DNA, 20 bp, Artificial Sequence
  chemically synthesized
catttctgattttacttatt

SEQ ID NO: 250243 - DNA, 20 bp, Artificial Sequence
  chemically synthesized
aagacccaaataagtaaaat

SEQ ID NO: 250244 - DNA, 20 bp, Artificial Sequence
  chemically synthesized
aaataagtaaaatcagaaat

SEQ ID NO: 250245 - DNA, 20 bp, Artificial Sequence
  chemically synthesized
aagtaaaatcagaaatgaga

SEQ ID NO: 250246 - DNA, 20 bp, Artificial Sequence
  chemically synthesized
agtaaaatcagaaatgagaa

SEQ ID NO: 250247 - DNA, 20 bp, Artificial Sequence
  chemically synthesized
taaaatcagaaatgagaaag

SEQ ID NO: 250248 - DNA, 20 bp, Artificial Sequence
  chemically synthesized
ggagatattacaattaatac

SEQ ID NO: 250249 - DNA, 20 bp, Artificial Sequence
  chemically synthesized
aatgagcctttgaatttatc

SEQ ID NO: 250250 - DNA, 20 bp, Artificial Sequence
  chemically synthesized
attaataccagataaattca

SEQ ID NO: 250251 - DNA, 20 bp, Artificial Sequence
  chemically synthesized
ttaataccagataaattcaa

SEQ ID NO: 250252 - DNA, 20 bp, Artificial Sequence
  chemically synthesized
agataaattcaaaggctcat

SEQ ID NO: 250253 - DNA, 20 bp, Artificial Sequence
  chemically synthesized
taaattcaaaggctcattag

SEQ ID NO: 250254 - DNA, 20 bp, Artificial Sequence
  chemically synthesized
tgctcatagtagccactaat

SEQ ID NO: 250255 - DNA, 20 bp, Artificial Sequence
  chemically synthesized
ggctcattagtggctactat

SEQ ID NO: 250256 - DNA, 20 bp, Artificial Sequence
  chemically synthesized
tggcatatagttgctcatag

SEQ ID NO: 250257 - DNA, 20 bp, Artificial Sequence
  chemically synthesized
tgttggcatatagttgctca

SEQ ID NO: 250258 - DNA, 20 bp, Artificial Sequence
  chemically synthesized
tttttcaatttgttggcata

SEQ ID NO: 250259 - DNA, 20 bp, Artificial Sequence
  chemically synthesized
ctctagatttttcaatttgt

SEQ ID NO: 250260 - DNA, 20 bp, Artificial Sequence
  chemically synthesized
tgccaacaaattgaaaaatc

SEQ ID NO: 250261 - DNA, 20 bp, Artificial Sequence
  chemically synthesized
ccaacaaattgaaaaatcta

SEQ ID NO: 250262 - DNA, 20 bp, Artificial Sequence
  chemically synthesized
caacaaattgaaaaatctag

SEQ ID NO: 250263 - DNA, 20 bp, Artificial Sequence
  chemically synthesized
attgaaaaatctagaggtaa

SEQ ID NO: 250264 - DNA, 20 bp, Artificial Sequence
  chemically synthesized
aggaatttatccattacctc

SEQ ID NO: 250265 - DNA, 20 bp, Artificial Sequence
  chemically synthesized
agaggtaatggataaattcc

SEQ ID NO: 250266 - DNA, 20 bp, Artificial Sequence
  chemically synthesized
ttggtaggttgtatgtgtct

SEQ ID NO: 250267 - DNA, 20 bp, Artificial Sequence
  chemically synthesized
cttggtaggttgtatgtgtc

SEQ ID NO: 250268 - DNA, 20 bp, Artificial Sequence
  chemically synthesized
ctagacacatacaacctacc

SEQ ID NO: 250269 - DNA, 20 bp, Artificial Sequence
  chemically synthesized
ctttatggtttaatcttggt

SEQ ID NO: 250270 - DNA, 20 bp, Artificial Sequence
  chemically synthesized
tctttatggtttaatcttgg

SEQ ID NO: 250271 - DNA, 20 bp, Artificial Sequence
  chemically synthesized
atttctttatggtttaatct

SEQ ID NO: 250272 - DNA, 20 bp, Artificial Sequence
  chemically synthesized
cctaccaagattaaaccata

SEQ ID NO: 250273 - DNA, 20 bp, Artificial Sequence
  chemically synthesized
tcaggttttggatttcttta

SEQ ID NO: 250274 - DNA, 20 bp, Artificial Sequence
  chemically synthesized
ttactggtccgttcaggttt

SEQ ID NO: 250275 - DNA, 20 bp, Artificial Sequence
  chemically synthesized
aaagaaatccaaaacctgaa

SEQ ID NO: 250276 - DNA, 20 bp, Artificial Sequence
  chemically synthesized
tactcgttactggtccgttc

SEQ ID NO: 250277 - DNA, 20 bp, Artificial Sequence
  chemically synthesized
aatccaaaacctgaacggac

SEQ ID NO: 250278 - DNA, 20 bp, Artificial Sequence
  chemically synthesized
ttactcgttactggtccgtt

SEQ ID NO: 250279 - DNA, 20 bp, Artificial Sequence
  chemically synthesized
aacctgaacggaccagtaac

SEQ ID NO: 250280 - DNA, 20 bp, Artificial Sequence
  chemically synthesized
tcagttgtgttactcgttac

SEQ ID NO: 250281 - DNA, 20 bp, Artificial Sequence
  chemically synthesized
agtaacgagtaacacaactg

SEQ ID NO: 250282 - DNA, 20 bp, Artificial Sequence
  chemically synthesized
gagtaacacaactgaagcct

SEQ ID NO: 250283 - DNA, 20 bp, Artificial Sequence
  chemically synthesized
gggagagtttactaaggctt

SEQ ID NO: 250284 - DNA, 20 bp, Artificial Sequence
  chemically synthesized
tttactgggagagtttacta

SEQ ID NO: 250285 - DNA, 20 bp, Artificial Sequence
  chemically synthesized
ctttactgggagagtttact

SEQ ID NO: 250286 - DNA, 20 bp, Artificial Sequence
  chemically synthesized
gaagccttagtaaactctcc

SEQ ID NO: 250287 - DNA, 20 bp, Artificial Sequence
  chemically synthesized
caagcttttctttactggga

SEQ ID NO: 250288 - DNA, 20 bp, Artificial Sequence
  chemically synthesized
cttagtaaactctcccagta

SEQ ID NO: 250289 - DNA, 20 bp, Artificial Sequence
  chemically synthesized
cccaagcttttctttactgg

SEQ ID NO: 250290 - DNA, 20 bp, Artificial Sequence
  chemically synthesized
gtcccaagcttttctttact

SEQ ID NO: 250291 - DNA, 20 bp, Artificial Sequence
  chemically synthesized
ggtcccaagcttttctttac

SEQ ID NO: 250292 - DNA, 20 bp, Artificial Sequence
  chemically synthesized
taaactctcccagtaaagaa

SEQ ID NO: 250293 - DNA, 20 bp, Artificial Sequence
  chemically synthesized
tctcccagtaaagaaaagct

SEQ ID NO: 250294 - DNA, 20 bp, Artificial Sequence
  chemically synthesized
ctcccagtaaagaaaagctt

SEQ ID NO: 250295 - DNA, 20 bp, Artificial Sequence
  chemically synthesized
cagtgcagccatcgggtccc

SEQ ID NO: 250296 - DNA, 20 bp, Artificial Sequence
  chemically synthesized
aagaaaagcttgggacccga

SEQ ID NO: 250297 - DNA, 20 bp, Artificial Sequence
  chemically synthesized
agttcagcagtgcagccatc

SEQ ID NO: 250298 - DNA, 20 bp, Artificial Sequence
  chemically synthesized
gagttcagcagtgcagccat

SEQ ID NO: 250299 - DNA, 20 bp, Artificial Sequence
  chemically synthesized
catggtagagttcagcagtg

SEQ ID NO: 250300 - DNA, 20 bp, Artificial Sequence
  chemically synthesized
tatcacatggtagagttcag

SEQ ID NO: 250301 - DNA, 20 bp, Artificial Sequence
  chemically synthesized
atttatcacatggtagagtt

SEQ ID NO: 250302 - DNA, 20 bp, Artificial Sequence
  chemically synthesized
tcaatatttatcacatggta

SEQ ID NO: 250303 - DNA, 20 bp, Artificial Sequence
  chemically synthesized
catcaatatttatcacatgg

SEQ ID NO: 250304 - DNA, 20 bp, Artificial Sequence
  chemically synthesized
ttgcatcaatatttatcaca

SEQ ID NO: 250305 - DNA, 20 bp, Artificial Sequence
  chemically synthesized
atattgatgcaaaattgatg

SEQ ID NO: 250306 - DNA, 20 bp, Artificial Sequence
  chemically synthesized
attgatgcaaaattgatgca

SEQ ID NO: 250307 - DNA, 20 bp, Artificial Sequence
  chemically synthesized
caaaattgatgcagagtgaa

SEQ ID NO: 250308 - DNA, 20 bp, Artificial Sequence
  chemically synthesized
aaaattgatgcagagtgaac

SEQ ID NO: 250309 - DNA, 20 bp, Artificial Sequence
  chemically synthesized
tgaacaggcaacctacaaaa

SEQ ID NO: 250310 - DNA, 20 bp, Artificial Sequence
  chemically synthesized
gaacaggcaacctacaaaat

SEQ ID NO: 250311 - DNA, 20 bp, Artificial Sequence
  chemically synthesized
aaaattttctcccattttgt

SEQ ID NO: 250312 - DNA, 20 bp, Artificial Sequence
  chemically synthesized
gaaaattttctcccattttg

SEQ ID NO: 250313 - DNA, 20 bp, Artificial Sequence
  chemically synthesized
acaggcaacctacaaaatgg

SEQ ID NO: 250314 - DNA, 20 bp, Artificial Sequence
  chemically synthesized
tagccctttgtcagatgagt

SEQ ID NO: 250315 - DNA, 20 bp, Artificial Sequence
  chemically synthesized
ttagccctttgtcagatgag

SEQ ID NO: 250316 - DNA, 20 bp, Artificial Sequence
  chemically synthesized
atattagccctttgtcagat

SEQ ID NO: 250317 - DNA, 20 bp, Artificial Sequence
  chemically synthesized
cgcaacctactcatctgaca

SEQ ID NO: 250318 - DNA, 20 bp, Artificial Sequence
  chemically synthesized
gcaacctactcatctgacaa

SEQ ID NO: 250319 - DNA, 20 bp, Artificial Sequence
  chemically synthesized
caacctactcatctgacaaa

SEQ ID NO: 250320 - DNA, 20 bp, Artificial Sequence
  chemically synthesized
tctggatattagccctttgt

SEQ ID NO: 250321 - DNA, 20 bp, Artificial Sequence
  chemically synthesized
tctgacaaagggctaatatc

SEQ ID NO: 250322 - DNA, 20 bp, Artificial Sequence
  chemically synthesized
tcattgtagattctggatat

SEQ ID NO: 250323 - DNA, 20 bp, Artificial Sequence
  chemically synthesized
tttgagttcattgtagattc

SEQ ID NO: 250324 - DNA, 20 bp, Artificial Sequence
  chemically synthesized
acgtttgtttgagttcattg

SEQ ID NO: 250325 - DNA, 20 bp, Artificial Sequence
  chemically synthesized
tttttcttgtacgtttgttt

SEQ ID NO: 250326 - DNA, 20 bp, Artificial Sequence
  chemically synthesized
atgaactcaaacaaacgtac

SEQ ID NO: 250327 - DNA, 20 bp, Artificial Sequence
  chemically synthesized
aaacaaacaaccccatcaaa

SEQ ID NO: 250328 - DNA, 20 bp, Artificial Sequence
  chemically synthesized
ccttcacccactttttgatg

SEQ ID NO: 250329 - DNA, 20 bp, Artificial Sequence
  chemically synthesized
tccttcacccactttttgat

SEQ ID NO: 250330 - DNA, 20 bp, Artificial Sequence
  chemically synthesized
gtccttcacccactttttga

SEQ ID NO: 250331 - DNA, 20 bp, Artificial Sequence
  chemically synthesized
caaacaaccccatcaaaaag

SEQ ID NO: 250332 - DNA, 20 bp, Artificial Sequence
  chemically synthesized
aaacaaccccatcaaaaagt

SEQ ID NO: 250333 - DNA, 20 bp, Artificial Sequence
  chemically synthesized
accccatcaaaaagtgggtg

SEQ ID NO: 250334 - DNA, 20 bp, Artificial Sequence
  chemically synthesized
ccccatcaaaaagtgggtga

SEQ ID NO: 250335 - DNA, 20 bp, Artificial Sequence
  chemically synthesized
aagtgggtgaaggacatgaa

SEQ ID NO: 250336 - DNA, 20 bp, Artificial Sequence
  chemically synthesized
catgaacagacacttctcaa

SEQ ID NO: 250337 - DNA, 20 bp, Artificial Sequence
  chemically synthesized
cataaatgtcttcttttgag

SEQ ID NO: 250338 - DNA, 20 bp, Artificial Sequence
  chemically synthesized
gaacagacacttctcaaaag

SEQ ID NO: 250339 - DNA, 20 bp, Artificial Sequence
  chemically synthesized
ctgcataaatgtcttctttt

SEQ ID NO: 250340 - DNA, 20 bp, Artificial Sequence
  chemically synthesized
ctcaaaagaagacatttatg

SEQ ID NO: 250341 - DNA, 20 bp, Artificial Sequence
  chemically synthesized
gcattttttcatgtgttttt

SEQ ID NO: 250342 - DNA, 20 bp, Artificial Sequence
  chemically synthesized
ctctgatggccagtgatggt

SEQ ID NO: 250343 - DNA, 20 bp, Artificial Sequence
  chemically synthesized
gaaaaaatgctcaccatcac

SEQ ID NO: 250344 - DNA, 20 bp, Artificial Sequence
  chemically synthesized
agttctctgatggccagtga

SEQ ID NO: 250345 - DNA, 20 bp, Artificial Sequence
  chemically synthesized
tgctcaccatcactggccat

SEQ ID NO: 250346 - DNA, 20 bp, Artificial Sequence
  chemically synthesized
ctcaccatcactggccatca

SEQ ID NO: 250347 - DNA, 20 bp, Artificial Sequence
  chemically synthesized
atttgcagttctctgatggc

SEQ ID NO: 250348 - DNA, 20 bp, Artificial Sequence
  chemically synthesized
tttgatttgcagttctctga

SEQ ID NO: 250349 - DNA, 20 bp, Artificial Sequence
  chemically synthesized
cgttaatccattttgatttg

SEQ ID NO: 250350 - DNA, 20 bp, Artificial Sequence
  chemically synthesized
cagagaactgcaaatcaaaa

SEQ ID NO: 250351 - DNA, 20 bp, Artificial Sequence
  chemically synthesized
tggattaacgactaaaatct

SEQ ID NO: 250352 - DNA, 20 bp, Artificial Sequence
  chemically synthesized
tagtttgaggtcttagattt

SEQ ID NO: 250353 - DNA, 20 bp, Artificial Sequence
  chemically synthesized
agtttcttagtttgaggtct

SEQ ID NO: 250354 - DNA, 20 bp, Artificial Sequence
  chemically synthesized
aaaatctaagacctcaaact

SEQ ID NO: 250355 - DNA, 20 bp, Artificial Sequence
  chemically synthesized
tgtagtagtttcttagtttg

SEQ ID NO: 250356 - DNA, 20 bp, Artificial Sequence
  chemically synthesized
ttgtagtagtttcttagttt

SEQ ID NO: 250357 - DNA, 20 bp, Artificial Sequence
  chemically synthesized
gtttccttgtagtagtttct

SEQ ID NO: 250358 - DNA, 20 bp, Artificial Sequence
  chemically synthesized
tcaaactaagaaactactac

SEQ ID NO: 250359 - DNA, 20 bp, Artificial Sequence
  chemically synthesized
caaactaagaaactactaca

SEQ ID NO: 250360 - DNA, 20 bp, Artificial Sequence
  chemically synthesized
tctccaatgtttccttgtag

SEQ ID NO: 250361 - DNA, 20 bp, Artificial Sequence
  chemically synthesized
gtttctccaatgtttccttg

SEQ ID NO: 250362 - DNA, 20 bp, Artificial Sequence
  chemically synthesized
aaactactacaaggaaacat

SEQ ID NO: 250363 - DNA, 20 bp, Artificial Sequence
  chemically synthesized
actactacaaggaaacattg

SEQ ID NO: 250364 - DNA, 20 bp, Artificial Sequence
  chemically synthesized
gaaacattggagaaactctc

SEQ ID NO: 250365 - DNA, 20 bp, Artificial Sequence
  chemically synthesized
aaacattggagaaactctcc

SEQ ID NO: 250366 - DNA, 20 bp, Artificial Sequence
  chemically synthesized
acccagacagatatcctgga

SEQ ID NO: 250367 - DNA, 20 bp, Artificial Sequence
  chemically synthesized
ttacccagacagatatcctg

SEQ ID NO: 250368 - DNA, 20 bp, Artificial Sequence
  chemically synthesized
ttttacccagacagatatcc

SEQ ID NO: 250369 - DNA, 20 bp, Artificial Sequence
  chemically synthesized
aactctccaggatatctgtc

SEQ ID NO: 250370 - DNA, 20 bp, Artificial Sequence
  chemically synthesized
actctccaggatatctgtct

SEQ ID NO: 250371 - DNA, 20 bp, Artificial Sequence
  chemically synthesized
caagatttgttttacccaga

SEQ ID NO: 250372 - DNA, 20 bp, Artificial Sequence
  chemically synthesized
tactcaagatttgttttacc

SEQ ID NO: 250373 - DNA, 20 bp, Artificial Sequence
  chemically synthesized
gtctgggtaaaacaaatctt

SEQ ID NO: 250374 - DNA, 20 bp, Artificial Sequence
  chemically synthesized
gtgcttataggatattactc

SEQ ID NO: 250375 - DNA, 20 bp, Artificial Sequence
  chemically synthesized
aatcttgagtaatatcctat

SEQ ID NO: 250376 - DNA, 20 bp, Artificial Sequence
  chemically synthesized
tgagtaatatcctataagca

SEQ ID NO: 250377 - DNA, 20 bp, Artificial Sequence
  chemically synthesized
cttttgttgcctgtgcttat

SEQ ID NO: 250378 - DNA, 20 bp, Artificial Sequence
  chemically synthesized
gagtaatatcctataagcac

SEQ ID NO: 250379 - DNA, 20 bp, Artificial Sequence
  chemically synthesized
gcttttgttgcctgtgctta

SEQ ID NO: 250380 - DNA, 20 bp, Artificial Sequence
  chemically synthesized
cctataagcacaggcaacaa

SEQ ID NO: 250381 - DNA, 20 bp, Artificial Sequence
  chemically synthesized
acaggcaacaaaagcaaaaa

SEQ ID NO: 250382 - DNA, 20 bp, Artificial Sequence
  chemically synthesized
caaaagcaaaaatagacaaa

SEQ ID NO: 250383 - DNA, 20 bp, Artificial Sequence
  chemically synthesized
atagacaaatggatcacatc

SEQ ID NO: 250384 - DNA, 20 bp, Artificial Sequence
  chemically synthesized
atggatcacatcaagttaaa

SEQ ID NO: 250385 - DNA, 20 bp, Artificial Sequence
  chemically synthesized
caagttaaaaagctcctccg

SEQ ID NO: 250386 - DNA, 20 bp, Artificial Sequence
  chemically synthesized
ttgattgtttcactgcggag

SEQ ID NO: 250387 - DNA, 20 bp, Artificial Sequence
  chemically synthesized
tattgattgtttcactgcgg

SEQ ID NO: 250388 - DNA, 20 bp, Artificial Sequence
  chemically synthesized
ttattgattgtttcactgcg

SEQ ID NO: 250389 - DNA, 20 bp, Artificial Sequence
  chemically synthesized
ctttattgattgtttcactg

SEQ ID NO: 250390 - DNA, 20 bp, Artificial Sequence
  chemically synthesized
ccgcagtgaaacaatcaata

SEQ ID NO: 250391 - DNA, 20 bp, Artificial Sequence
  chemically synthesized
gtgaaacaatcaataaagtg

SEQ ID NO: 250392 - DNA, 20 bp, Artificial Sequence
  chemically synthesized
gaaacaatcaataaagtgaa

SEQ ID NO: 250393 - DNA, 20 bp, Artificial Sequence
  chemically synthesized
taaagtgaagagacaaccaa

SEQ ID NO: 250394 - DNA, 20 bp, Artificial Sequence
  chemically synthesized
gtgaagagacaaccaacaga

SEQ ID NO: 250395 - DNA, 20 bp, Artificial Sequence
  chemically synthesized
tgaagagacaaccaacagaa

SEQ ID NO: 250396 - DNA, 20 bp, Artificial Sequence
  chemically synthesized
gaagagacaaccaacagaaa

SEQ ID NO: 250397 - DNA, 20 bp, Artificial Sequence
  chemically synthesized
aatattttctccctttctgt

SEQ ID NO: 250398 - DNA, 20 bp, Artificial Sequence
  chemically synthesized
agagacaaccaacagaaagg

SEQ ID NO: 250399 - DNA, 20 bp, Artificial Sequence
  chemically synthesized
ttgcaaattacccatctcac

SEQ ID NO: 250400 - DNA, 20 bp, Artificial Sequence
  chemically synthesized
ttattaatcccttgtgagat

SEQ ID NO: 250401 - DNA, 20 bp, Artificial Sequence
  chemically synthesized
tgcaaattacccatctcaca

SEQ ID NO: 250402 - DNA, 20 bp, Artificial Sequence
  chemically synthesized
gttattaatcccttgtgaga

SEQ ID NO: 250403 - DNA, 20 bp, Artificial Sequence
  chemically synthesized
gcaaattacccatctcacaa

SEQ ID NO: 250404 - DNA, 20 bp, Artificial Sequence
  chemically synthesized
tctggttattaatcccttgt

SEQ ID NO: 250405 - DNA, 20 bp, Artificial Sequence
  chemically synthesized
tctcacaagggattaataac

SEQ ID NO: 250406 - DNA, 20 bp, Artificial Sequence
  chemically synthesized
ttttaactccttatatattc

SEQ ID NO: 250407 - DNA, 20 bp, Artificial Sequence
  chemically synthesized
gattaataaccagaatatat

SEQ ID NO: 250408 - DNA, 20 bp, Artificial Sequence
  chemically synthesized
attaataaccagaatatata

SEQ ID NO: 250409 - DNA, 20 bp, Artificial Sequence
  chemically synthesized
taataaccagaatatataag

SEQ ID NO: 250410 - DNA, 20 bp, Artificial Sequence
  chemically synthesized
aaggagttaaaacaactcta

SEQ ID NO: 250411 - DNA, 20 bp, Artificial Sequence
  chemically synthesized
aggagttaaaacaactctat

SEQ ID NO: 250412 - DNA, 20 bp, Artificial Sequence
  chemically synthesized
ttattagactttttcctata

SEQ ID NO: 250413 - DNA, 20 bp, Artificial Sequence
  chemically synthesized
taaaacaactctataggaaa

SEQ ID NO: 250414 - DNA, 20 bp, Artificial Sequence
  chemically synthesized
aattattagactttttccta

SEQ ID NO: 250415 - DNA, 20 bp, Artificial Sequence
  chemically synthesized
ataggaaaaagtctaataat

SEQ ID NO: 250416 - DNA, 20 bp, Artificial Sequence
  chemically synthesized
ctattttctgatctaattat

SEQ ID NO: 250417 - DNA, 20 bp, Artificial Sequence
  chemically synthesized
aaaaagtctaataattagat

SEQ ID NO: 250418 - DNA, 20 bp, Artificial Sequence
  chemically synthesized
ctaataattagatcagaaaa

SEQ ID NO: 250419 - DNA, 20 bp, Artificial Sequence
  chemically synthesized
ttagatcagaaaatagacaa

SEQ ID NO: 250420 - DNA, 20 bp, Artificial Sequence
  chemically synthesized
aaatagacaaaagattcgaa

SEQ ID NO: 250421 - DNA, 20 bp, Artificial Sequence
  chemically synthesized
aatagacaaaagattcgaat

SEQ ID NO: 250422 - DNA, 20 bp, Artificial Sequence
  chemically synthesized
ttcgaataggcatttctcaa

SEQ ID NO: 250423 - DNA, 20 bp, Artificial Sequence
  chemically synthesized
gaataggcatttctcaaaag

SEQ ID NO: 250424 - DNA, 20 bp, Artificial Sequence
  chemically synthesized
ccatttgtatgtcttctttt

SEQ ID NO: 250425 - DNA, 20 bp, Artificial Sequence
  chemically synthesized
ctcaaaagaagacatacaaa

SEQ ID NO: 250426 - DNA, 20 bp, Artificial Sequence
  chemically synthesized
gaagacatacaaatggcaaa

SEQ ID NO: 250427 - DNA, 20 bp, Artificial Sequence
  chemically synthesized
aagacatacaaatggcaaac

SEQ ID NO: 250428 - DNA, 20 bp, Artificial Sequence
  chemically synthesized
caggtgtatcaaaatatgct

SEQ ID NO: 250429 - DNA, 20 bp, Artificial Sequence
  chemically synthesized
ctgtgatgattagtgatgct

SEQ ID NO: 250430 - DNA, 20 bp, Artificial Sequence
  chemically synthesized
ctcagcatcactaatcatca

SEQ ID NO: 250431 - DNA, 20 bp, Artificial Sequence
  chemically synthesized
ctttgtatttctgtgatgat

SEQ ID NO: 250432 - DNA, 20 bp, Artificial Sequence
  chemically synthesized
ctaatcatcacagaaataca

SEQ ID NO: 250433 - DNA, 20 bp, Artificial Sequence
  chemically synthesized
aatacaaagcaaaactacaa

SEQ ID NO: 250434 - DNA, 20 bp, Artificial Sequence
  chemically synthesized
atacaaagcaaaactacaat

SEQ ID NO: 250435 - DNA, 20 bp, Artificial Sequence
  chemically synthesized
ggtgagagaatatcccattg

SEQ ID NO: 250436 - DNA, 20 bp, Artificial Sequence
  chemically synthesized
tgtcgttttaattggggtga

SEQ ID NO: 250437 - DNA, 20 bp, Artificial Sequence
  chemically synthesized
tatgtcgttttaattggggt

SEQ ID NO: 250438 - DNA, 20 bp, Artificial Sequence
  chemically synthesized
tggatatgtcgttttaattg

SEQ ID NO: 250439 - DNA, 20 bp, Artificial Sequence
  chemically synthesized
ttggatatgtcgttttaatt

SEQ ID NO: 250440 - DNA, 20 bp, Artificial Sequence
  chemically synthesized
tttggatatgtcgttttaat

SEQ ID NO: 250441 - DNA, 20 bp, Artificial Sequence
  chemically synthesized
aattaaaacgacatatccaa

SEQ ID NO: 250442 - DNA, 20 bp, Artificial Sequence
  chemically synthesized
aaaacgacatatccaaaaga

SEQ ID NO: 250443 - DNA, 20 bp, Artificial Sequence
  chemically synthesized
aaacgacatatccaaaagac

SEQ ID NO: 250444 - DNA, 20 bp, Artificial Sequence
  chemically synthesized
atttgtaattgcctgtcttt

SEQ ID NO: 250445 - DNA, 20 bp, Artificial Sequence
  chemically synthesized
agacaggcaattacaaatgc

SEQ ID NO: 250446 - DNA, 20 bp, Artificial Sequence
  chemically synthesized
acaggcaattacaaatgctg

SEQ ID NO: 250447 - DNA, 20 bp, Artificial Sequence
  chemically synthesized
aggcaattacaaatgctgga

SEQ ID NO: 250448 - DNA, 20 bp, Artificial Sequence
  chemically synthesized
gcaattacaaatgctggaga

SEQ ID NO: 250449 - DNA, 20 bp, Artificial Sequence
  chemically synthesized
ccttttcttcacactctctc

SEQ ID NO: 250450 - DNA, 20 bp, Artificial Sequence
  chemically synthesized
caaatgctggagagagtgtg

SEQ ID NO: 250451 - DNA, 20 bp, Artificial Sequence
  chemically synthesized
gctggagagagtgtgaagaa

SEQ ID NO: 250452 - DNA, 20 bp, Artificial Sequence
  chemically synthesized
ctggagagagtgtgaagaaa

SEQ ID NO: 250453 - DNA, 20 bp, Artificial Sequence
  chemically synthesized
tggagagagtgtgaagaaaa

SEQ ID NO: 250454 - DNA, 20 bp, Artificial Sequence
  chemically synthesized
ggagagagtgtgaagaaaag

SEQ ID NO: 250455 - DNA, 20 bp, Artificial Sequence
  chemically synthesized
ttcctgccaacagtgtacag

SEQ ID NO: 250456 - DNA, 20 bp, Artificial Sequence
  chemically synthesized
cattcctgccaacagtgtac

SEQ ID NO: 250457 - DNA, 20 bp, Artificial Sequence
  chemically synthesized
acattcctgccaacagtgta

SEQ ID NO: 250458 - DNA, 20 bp, Artificial Sequence
  chemically synthesized
aggggactcctgtacactgt

SEQ ID NO: 250459 - DNA, 20 bp, Artificial Sequence
  chemically synthesized
ggactcctgtacactgttgg

SEQ ID NO: 250460 - DNA, 20 bp, Artificial Sequence
  chemically synthesized
gactcctgtacactgttggc

SEQ ID NO: 250461 - DNA, 20 bp, Artificial Sequence
  chemically synthesized
ctaatttacattcctgccaa

SEQ ID NO: 250462 - DNA, 20 bp, Artificial Sequence
  chemically synthesized
ctgttggcaggaatgtaaat

SEQ ID NO: 250463 - DNA, 20 bp, Artificial Sequence
  chemically synthesized
gtaaattagtacaaccaaaa

SEQ ID NO: 250464 - DNA, 20 bp, Artificial Sequence
  chemically synthesized
aaattagtacaaccaaaatg

SEQ ID NO: 250465 - DNA, 20 bp, Artificial Sequence
  chemically synthesized
ctccaaactattctccattt

SEQ ID NO: 250466 - DNA, 20 bp, Artificial Sequence
  chemically synthesized
agtacaaccaaaatggagaa

SEQ ID NO: 250467 - DNA, 20 bp, Artificial Sequence
  chemically synthesized
aaccaaaatggagaatagtt

SEQ ID NO: 250468 - DNA, 20 bp, Artificial Sequence
  chemically synthesized
ccaaaatggagaatagtttg

SEQ ID NO: 250469 - DNA, 20 bp, Artificial Sequence
  chemically synthesized
caaaatggagaatagtttgg

SEQ ID NO: 250470 - DNA, 20 bp, Artificial Sequence
  chemically synthesized
agaatagtttggaggttcct

SEQ ID NO: 250471 - DNA, 20 bp, Artificial Sequence
  chemically synthesized
agccctgtttttagtttctg

SEQ ID NO: 250472 - DNA, 20 bp, Artificial Sequence
  chemically synthesized
tagccctgtttttagtttct

SEQ ID NO: 250473 - DNA, 20 bp, Artificial Sequence
  chemically synthesized
ggttcctcagaaactaaaaa

SEQ ID NO: 250474 - DNA, 20 bp, Artificial Sequence
  chemically synthesized
gttcctcagaaactaaaaac

SEQ ID NO: 250475 - DNA, 20 bp, Artificial Sequence
  chemically synthesized
ttcctcagaaactaaaaaca

SEQ ID NO: 250476 - DNA, 20 bp, Artificial Sequence
  chemically synthesized
tcatatggtagccctgtttt

SEQ ID NO: 250477 - DNA, 20 bp, Artificial Sequence
  chemically synthesized
gggattgctggatcatatgg

SEQ ID NO: 250478 - DNA, 20 bp, Artificial Sequence
  chemically synthesized
aacagggctaccatatgatc

SEQ ID NO: 250479 - DNA, 20 bp, Artificial Sequence
  chemically synthesized
agtgggattgctggatcata

SEQ ID NO: 250480 - DNA, 20 bp, Artificial Sequence
  chemically synthesized
atacccagcagtgggattgc

SEQ ID NO: 250481 - DNA, 20 bp, Artificial Sequence
  chemically synthesized
tgatccagcaatcccactgc

SEQ ID NO: 250482 - DNA, 20 bp, Artificial Sequence
  chemically synthesized
gatccagcaatcccactgct

SEQ ID NO: 250483 - DNA, 20 bp, Artificial Sequence
  chemically synthesized
tgggatatatacccagcagt

SEQ ID NO: 250484 - DNA, 20 bp, Artificial Sequence
  chemically synthesized
ttgggatatatacccagcag

SEQ ID NO: 250485 - DNA, 20 bp, Artificial Sequence
  chemically synthesized
tctttgggatatatacccag

SEQ ID NO: 250486 - DNA, 20 bp, Artificial Sequence
  chemically synthesized
ctttctttgggatatatacc

SEQ ID NO: 250487 - DNA, 20 bp, Artificial Sequence
  chemically synthesized
actgctgggtatatatccca

SEQ ID NO: 250488 - DNA, 20 bp, Artificial Sequence
  chemically synthesized
ctgggtatatatcccaaaga

SEQ ID NO: 250489 - DNA, 20 bp, Artificial Sequence
  chemically synthesized
tatactgatttgctttcttt

SEQ ID NO: 250490 - DNA, 20 bp, Artificial Sequence
  chemically synthesized
atatactgatttgctttctt

SEQ ID NO: 250491 - DNA, 20 bp, Artificial Sequence
  chemically synthesized
atatcccaaagaaagcaaat

SEQ ID NO: 250492 - DNA, 20 bp, Artificial Sequence
  chemically synthesized
gaaagcaaatcagtatatca

SEQ ID NO: 250493 - DNA, 20 bp, Artificial Sequence
  chemically synthesized
aagcaaatcagtatatcaaa

SEQ ID NO: 250494 - DNA, 20 bp, Artificial Sequence
  chemically synthesized
cttcaacaaacgtgggagta

SEQ ID NO: 250495 - DNA, 20 bp, Artificial Sequence
  chemically synthesized
cagtgcttcaacaaacgtgg

SEQ ID NO: 250496 - DNA, 20 bp, Artificial Sequence
  chemically synthesized
aacagtgcttcaacaaacgt

SEQ ID NO: 250497 - DNA, 20 bp, Artificial Sequence
  chemically synthesized
gaacagtgcttcaacaaacg

SEQ ID NO: 250498 - DNA, 20 bp, Artificial Sequence
  chemically synthesized
ctgtactcccacgtttgttg

SEQ ID NO: 250499 - DNA, 20 bp, Artificial Sequence
  chemically synthesized
tgttgaagcactgttcataa

SEQ ID NO: 250500 - DNA, 20 bp, Artificial Sequence
  chemically synthesized
caaatcttggctattatgaa

SEQ ID NO: 250501 - DNA, 20 bp, Artificial Sequence
  chemically synthesized
aagcactgttcataatagcc

SEQ ID NO: 250502 - DNA, 20 bp, Artificial Sequence
  chemically synthesized
tgttcataatagccaagatt

SEQ ID NO: 250503 - DNA, 20 bp, Artificial Sequence
  chemically synthesized
ctcaggttgcttccaaatct

SEQ ID NO: 250504 - DNA, 20 bp, Artificial Sequence
  chemically synthesized
tcataatagccaagatttgg

SEQ ID NO: 250505 - DNA, 20 bp, Artificial Sequence
  chemically synthesized
ccaagatttggaagcaacct

SEQ ID NO: 250506 - DNA, 20 bp, Artificial Sequence
  chemically synthesized
tcatctcttgatggacgctc

SEQ ID NO: 250507 - DNA, 20 bp, Artificial Sequence
  chemically synthesized
ttcatctcttgatggacgct

SEQ ID NO: 250508 - DNA, 20 bp, Artificial Sequence
  chemically synthesized
aagcaacctgagcgtccatc

SEQ ID NO: 250509 - DNA, 20 bp, Artificial Sequence
  chemically synthesized
gcaacctgagcgtccatcaa

SEQ ID NO: 250510 - DNA, 20 bp, Artificial Sequence
  chemically synthesized
tttgtccattcatctcttga

SEQ ID NO: 250511 - DNA, 20 bp, Artificial Sequence
  chemically synthesized
agcgtccatcaagagatgaa

SEQ ID NO: 250512 - DNA, 20 bp, Artificial Sequence
  chemically synthesized
catcaagagatgaatggaca

SEQ ID NO: 250513 - DNA, 20 bp, Artificial Sequence
  chemically synthesized
aatgtgatacatatacgtaa

SEQ ID NO: 250514 - DNA, 20 bp, Artificial Sequence
  chemically synthesized
tgtgatacatatacgtaata

SEQ ID NO: 250515 - DNA, 20 bp, Artificial Sequence
  chemically synthesized
atacgtaatagagtactatt

SEQ ID NO: 250516 - DNA, 20 bp, Artificial Sequence
  chemically synthesized
tcattctttttatggctgaa

SEQ ID NO: 250517 - DNA, 20 bp, Artificial Sequence
  chemically synthesized
gagtactattcagccataaa

SEQ ID NO: 250518 - DNA, 20 bp, Artificial Sequence
  chemically synthesized
aaaggatctcattcttttta

SEQ ID NO: 250519 - DNA, 20 bp, Artificial Sequence
  chemically synthesized
tattcagccataaaaagaat

SEQ ID NO: 250520 - DNA, 20 bp, Artificial Sequence
  chemically synthesized
tccatgatgttgcaaatgaa

SEQ ID NO: 250521 - DNA, 20 bp, Artificial Sequence
  chemically synthesized
atccatgatgttgcaaatga

SEQ ID NO: 250522 - DNA, 20 bp, Artificial Sequence
  chemically synthesized
tcctttcatttgcaacatca

SEQ ID NO: 250523 - DNA, 20 bp, Artificial Sequence
  chemically synthesized
ttcatttgcaacatcatgga

SEQ ID NO: 250524 - DNA, 20 bp, Artificial Sequence
  chemically synthesized
tgcaacatcatggatggaac

SEQ ID NO: 250525 - DNA, 20 bp, Artificial Sequence
  chemically synthesized
caacatcatggatggaactg

SEQ ID NO: 250526 - DNA, 20 bp, Artificial Sequence
  chemically synthesized
aacatcatggatggaactgg

SEQ ID NO: 250527 - DNA, 20 bp, Artificial Sequence
  chemically synthesized
tcatttaacacaatgacctc

SEQ ID NO: 250528 - DNA, 20 bp, Artificial Sequence
  chemically synthesized
gtcattgtgttaaatgaaat

SEQ ID NO: 250529 - DNA, 20 bp, Artificial Sequence
  chemically synthesized
ttgtgttaaatgaaataagc

SEQ ID NO: 250530 - DNA, 20 bp, Artificial Sequence
  chemically synthesized
tgtgttaaatgaaataagcc

SEQ ID NO: 250531 - DNA, 20 bp, Artificial Sequence
  chemically synthesized
taaatgaaataagccaggca

SEQ ID NO: 250532 - DNA, 20 bp, Artificial Sequence
  chemically synthesized
gatgtttgtctttctgtgcc

SEQ ID NO: 250533 - DNA, 20 bp, Artificial Sequence
  chemically synthesized
tgaaataagccaggcacaga

SEQ ID NO: 250534 - DNA, 20 bp, Artificial Sequence
  chemically synthesized
tttacctgccacaaataaat

SEQ ID NO: 250535 - DNA, 20 bp, Artificial Sequence
  chemically synthesized
cacacgttctcatttatttg

SEQ ID NO: 250536 - DNA, 20 bp, Artificial Sequence
  chemically synthesized
acgttctcatttatttgtgg

SEQ ID NO: 250537 - DNA, 20 bp, Artificial Sequence
  chemically synthesized
cgttctcatttatttgtggc

SEQ ID NO: 250538 - DNA, 20 bp, Artificial Sequence
  chemically synthesized
aatcaaaacaactgaacact

SEQ ID NO: 250539 - DNA, 20 bp, Artificial Sequence
  chemically synthesized
accctctatctccaagtgtt

SEQ ID NO: 250540 - DNA, 20 bp, Artificial Sequence
  chemically synthesized
tcaaaacaactgaacacttg

SEQ ID NO: 250541 - DNA, 20 bp, Artificial Sequence
  chemically synthesized
aacaactgaacacttggaga

SEQ ID NO: 250542 - DNA, 20 bp, Artificial Sequence
  chemically synthesized
caactgaacacttggagata

SEQ ID NO: 250543 - DNA, 20 bp, Artificial Sequence
  chemically synthesized
tccttccaccctctatctcc

SEQ ID NO: 250544 - DNA, 20 bp, Artificial Sequence
  chemically synthesized
aactgaacacttggagatag

SEQ ID NO: 250545 - DNA, 20 bp, Artificial Sequence
  chemically synthesized
actgaacacttggagataga

SEQ ID NO: 250546 - DNA, 20 bp, Artificial Sequence
  chemically synthesized
gaacacttggagatagaggg

SEQ ID NO: 250547 - DNA, 20 bp, Artificial Sequence
  chemically synthesized
cacttggagatagagggtgg

SEQ ID NO: 250548 - DNA, 20 bp, Artificial Sequence
  chemically synthesized
acttggagatagagggtgga

SEQ ID NO: 250549 - DNA, 20 bp, Artificial Sequence
  chemically synthesized
ggagatagagggtggaagga

SEQ ID NO: 250550 - DNA, 20 bp, Artificial Sequence
  chemically synthesized
gagggtggaaggatggttac

SEQ ID NO: 250551 - DNA, 20 bp, Artificial Sequence
  chemically synthesized
gggtggaaggatggttacca

SEQ ID NO: 250552 - DNA, 20 bp, Artificial Sequence
  chemically synthesized
ggtggaaggatggttaccag

SEQ ID NO: 250553 - DNA, 20 bp, Artificial Sequence
  chemically synthesized
ccactacccttcacagcctc

SEQ ID NO: 250554 - DNA, 20 bp, Artificial Sequence
  chemically synthesized
gatggttaccagaggctgtg

SEQ ID NO: 250555 - DNA, 20 bp, Artificial Sequence
  chemically synthesized
atggttaccagaggctgtga

SEQ ID NO: 250556 - DNA, 20 bp, Artificial Sequence
  chemically synthesized
tggttaccagaggctgtgaa

SEQ ID NO: 250557 - DNA, 20 bp, Artificial Sequence
  chemically synthesized
ttaccagaggctgtgaaggg

SEQ ID NO: 250558 - DNA, 20 bp, Artificial Sequence
  chemically synthesized
aacccccccactacccttca

SEQ ID NO: 250559 - DNA, 20 bp, Artificial Sequence
  chemically synthesized
ccagaggctgtgaagggtag

SEQ ID NO: 250560 - DNA, 20 bp, Artificial Sequence
  chemically synthesized
cagaggctgtgaagggtagt

SEQ ID NO: 250561 - DNA, 20 bp, Artificial Sequence
  chemically synthesized
agaggctgtgaagggtagtg

SEQ ID NO: 250562 - DNA, 20 bp, Artificial Sequence
  chemically synthesized
gaggctgtgaagggtagtgg

SEQ ID NO: 250563 - DNA, 20 bp, Artificial Sequence
  chemically synthesized
aggctgtgaagggtagtggg

SEQ ID NO: 250564 - DNA, 20 bp, Artificial Sequence
  chemically synthesized
ggctgtgaagggtagtgggg

SEQ ID NO: 250565 - DNA, 20 bp, Artificial Sequence
  chemically synthesized
tgaagggtagtgggggggtt

SEQ ID NO: 250566 - DNA, 20 bp, Artificial Sequence
  chemically synthesized
gaagggtagtgggggggttg

SEQ ID NO: 250567 - DNA, 20 bp, Artificial Sequence
  chemically synthesized
aagggtagtgggggggttga

SEQ ID NO: 250568 - DNA, 20 bp, Artificial Sequence
  chemically synthesized
agggtagtgggggggttgag

SEQ ID NO: 250569 - DNA, 20 bp, Artificial Sequence
  chemically synthesized
gggtagtgggggggttgagg

SEQ ID NO: 250570 - DNA, 20 bp, Artificial Sequence
  chemically synthesized
gtagtgggggggttgagggg

SEQ ID NO: 250571 - DNA, 20 bp, Artificial Sequence
  chemically synthesized
tagtgggggggttgaggggg

SEQ ID NO: 250572 - DNA, 20 bp, Artificial Sequence
  chemically synthesized
ggttgagggggaggttgaaa

SEQ ID NO: 250573 - DNA, 20 bp, Artificial Sequence
  chemically synthesized
gggaggttgaaatggttact

SEQ ID NO: 250574 - DNA, 20 bp, Artificial Sequence
  chemically synthesized
ttctaactattttttgtacc

SEQ ID NO: 250575 - DNA, 20 bp, Artificial Sequence
  chemically synthesized
tggttacttggtacaaaaaa

SEQ ID NO: 250576 - DNA, 20 bp, Artificial Sequence
  chemically synthesized
tacttggtacaaaaaatagt

SEQ ID NO: 250577 - DNA, 20 bp, Artificial Sequence
  chemically synthesized
tggtacaaaaaatagttaga

SEQ ID NO: 250578 - DNA, 20 bp, Artificial Sequence
  chemically synthesized
ttgtgctagcaaatagtagg

SEQ ID NO: 250579 - DNA, 20 bp, Artificial Sequence
  chemically synthesized
ctgttgtgctagcaaatagt

SEQ ID NO: 250580 - DNA, 20 bp, Artificial Sequence
  chemically synthesized
cctgttgtgctagcaaatag

SEQ ID NO: 250581 - DNA, 20 bp, Artificial Sequence
  chemically synthesized
gaacaccacctactatttgc

SEQ ID NO: 250582 - DNA, 20 bp, Artificial Sequence
  chemically synthesized
caccctgttgtgctagcaaa

SEQ ID NO: 250583 - DNA, 20 bp, Artificial Sequence
  chemically synthesized
cctactatttgctagcacaa

SEQ ID NO: 250584 - DNA, 20 bp, Artificial Sequence
  chemically synthesized
ctactatttgctagcacaac

SEQ ID NO: 250585 - DNA, 20 bp, Artificial Sequence
  chemically synthesized
ctatagtcaccctgttgtgc

SEQ ID NO: 250586 - DNA, 20 bp, Artificial Sequence
  chemically synthesized
tactatttgctagcacaaca

SEQ ID NO: 250587 - DNA, 20 bp, Artificial Sequence
  chemically synthesized
ctagcacaacagggtgacta

SEQ ID NO: 250588 - DNA, 20 bp, Artificial Sequence
  chemically synthesized
caattaaattgttttgacta

SEQ ID NO: 250589 - DNA, 20 bp, Artificial Sequence
  chemically synthesized
attattctttgttttacaaa

SEQ ID NO: 250590 - DNA, 20 bp, Artificial Sequence
  chemically synthesized
attttactgtttgtaaaaca

SEQ ID NO: 250591 - DNA, 20 bp, Artificial Sequence
  chemically synthesized
aaaacaaagaataattgctt

SEQ ID NO: 250592 - DNA, 20 bp, Artificial Sequence
  chemically synthesized
aaacaaagaataattgcttg

SEQ ID NO: 250593 - DNA, 20 bp, Artificial Sequence
  chemically synthesized
aacaaagaataattgcttga

SEQ ID NO: 250594 - DNA, 20 bp, Artificial Sequence
  chemically synthesized
acaaagaataattgcttgag

SEQ ID NO: 250595 - DNA, 20 bp, Artificial Sequence
  chemically synthesized
aatgggatgttcatcccctc

SEQ ID NO: 250596 - DNA, 20 bp, Artificial Sequence
  chemically synthesized
atgcaagtatcatggaaaat

SEQ ID NO: 250597 - DNA, 20 bp, Artificial Sequence
  chemically synthesized
catgcaagtatcatggaaaa

SEQ ID NO: 250598 - DNA, 20 bp, Artificial Sequence
  chemically synthesized
atataggcatgcaagtatca

SEQ ID NO: 250599 - DNA, 20 bp, Artificial Sequence
  chemically synthesized
atgttttgatataggcatgc

SEQ ID NO: 250600 - DNA, 20 bp, Artificial Sequence
  chemically synthesized
tacatgagatgttttgatat

SEQ ID NO: 250601 - DNA, 20 bp, Artificial Sequence
  chemically synthesized
gtacatgagatgttttgata

SEQ ID NO: 250602 - DNA, 20 bp, Artificial Sequence
  chemically synthesized
tatatatatatggggtacat

SEQ ID NO: 250603 - DNA, 20 bp, Artificial Sequence
  chemically synthesized
ggggtacatatatatatatg

SEQ ID NO: 250604 - DNA, 20 bp, Artificial Sequence
  chemically synthesized
tggggtacatatatatatat

SEQ ID NO: 250605 - DNA, 20 bp, Artificial Sequence
  chemically synthesized
gtggggtacatatatatata

SEQ ID NO: 250606 - DNA, 20 bp, Artificial Sequence
  chemically synthesized
tatatatgtgtatatatgtg

SEQ ID NO: 250607 - DNA, 20 bp, Artificial Sequence
  chemically synthesized
atatatatgtgtatatatgt

SEQ ID NO: 250608 - DNA, 20 bp, Artificial Sequence
  chemically synthesized
catatatatgtgtatatatg

SEQ ID NO: 250609 - DNA, 20 bp, Artificial Sequence
  chemically synthesized
tgtggggtacatatatatat

SEQ ID NO: 250610 - DNA, 20 bp, Artificial Sequence
  chemically synthesized
atgtggggtacatatatata

SEQ ID NO: 250611 - DNA, 20 bp, Artificial Sequence
  chemically synthesized
ggtacatatatatatatgtg

SEQ ID NO: 250612 - DNA, 20 bp, Artificial Sequence
  chemically synthesized
gggtacatatatatatatgt

SEQ ID NO: 250613 - DNA, 20 bp, Artificial Sequence
  chemically synthesized
ggggtacatatatatatatg

SEQ ID NO: 250614 - DNA, 20 bp, Artificial Sequence
  chemically synthesized
ggggtacatatatatatgtg

SEQ ID NO: 250615 - DNA, 20 bp, Artificial Sequence
  chemically synthesized
tggggtacatatatatatgt

SEQ ID NO: 250616 - DNA, 20 bp, Artificial Sequence
  chemically synthesized
gtggggtacatatatatatg

SEQ ID NO: 250617 - DNA, 20 bp, Artificial Sequence
  chemically synthesized
gtggggtatatatatatgtg

SEQ ID NO: 250618 - DNA, 20 bp, Artificial Sequence
  chemically synthesized
tgtggggtatatatatatgt

SEQ ID NO: 250619 - DNA, 20 bp, Artificial Sequence
  chemically synthesized
atgtggggtatatatatatg

SEQ ID NO: 250620 - DNA, 20 bp, Artificial Sequence
  chemically synthesized
atacatagtgtatatatgtg

SEQ ID NO: 250621 - DNA, 20 bp, Artificial Sequence
  chemically synthesized
catacatagtgtatatatgt

SEQ ID NO: 250622 - DNA, 20 bp, Artificial Sequence
  chemically synthesized
acatacatagtgtatatatg

SEQ ID NO: 250623 - DNA, 20 bp, Artificial Sequence
  chemically synthesized
tatgtatatacacacataca

SEQ ID NO: 250624 - DNA, 20 bp, Artificial Sequence
  chemically synthesized
tatgtatgtgtgtatataca

SEQ ID NO: 250625 - DNA, 20 bp, Artificial Sequence
  chemically synthesized
aaacatatactatatataaa

SEQ ID NO: 250626 - DNA, 20 bp, Artificial Sequence
  chemically synthesized
atagtaaatctatttatata

SEQ ID NO: 250627 - DNA, 20 bp, Artificial Sequence
  chemically synthesized
atatagtatatgtttatata

SEQ ID NO: 250628 - DNA, 20 bp, Artificial Sequence
  chemically synthesized
tatatgtgtgtttatatata

SEQ ID NO: 250629 - DNA, 20 bp, Artificial Sequence
  chemically synthesized
agtatatatatatatatata

SEQ ID NO: 250630 - DNA, 20 bp, Artificial Sequence
  chemically synthesized
ttttaacgtttgtgggtaca

SEQ ID NO: 250631 - DNA, 20 bp, Artificial Sequence
  chemically synthesized
atgttatttttaacgtttgt

SEQ ID NO: 250632 - DNA, 20 bp, Artificial Sequence
  chemically synthesized
aatgttatttttaacgtttg

SEQ ID NO: 250633 - DNA, 20 bp, Artificial Sequence
  chemically synthesized
aacgttaaaaataacattta

SEQ ID NO: 250634 - DNA, 20 bp, Artificial Sequence
  chemically synthesized
taaagataaaaaattttgaa

SEQ ID NO: 250635 - DNA, 20 bp, Artificial Sequence
  chemically synthesized
agataaaaaattttgaaaag

SEQ ID NO: 250636 - DNA, 20 bp, Artificial Sequence
  chemically synthesized
tttgaaaagtggaacataaa

SEQ ID NO: 250637 - DNA, 20 bp, Artificial Sequence
  chemically synthesized
gatacagtagacagacagag

SEQ ID NO: 250638 - DNA, 20 bp, Artificial Sequence
  chemically synthesized
gaagatacagtagacagaca

SEQ ID NO: 250639 - DNA, 20 bp, Artificial Sequence
  chemically synthesized
aagaagatacagtagacaga

SEQ ID NO: 250640 - DNA, 20 bp, Artificial Sequence
  chemically synthesized
gcagaagaagatacagtaga

SEQ ID NO: 250641 - DNA, 20 bp, Artificial Sequence
  chemically synthesized
caatgcagaagaagatacag

SEQ ID NO: 250642 - DNA, 20 bp, Artificial Sequence
  chemically synthesized
ggacaatgcagaagaagata

SEQ ID NO: 250643 - DNA, 20 bp, Artificial Sequence
  chemically synthesized
tcatggggacaatgcagaag

SEQ ID NO: 250644 - DNA, 20 bp, Artificial Sequence
  chemically synthesized
cagtcatggggacaatgcag

SEQ ID NO: 250645 - DNA, 20 bp, Artificial Sequence
  chemically synthesized
attcagtcatggggacaatg

SEQ ID NO: 250646 - DNA, 20 bp, Artificial Sequence
  chemically synthesized
atcccgtggattcagtcatg

SEQ ID NO: 250647 - DNA, 20 bp, Artificial Sequence
  chemically synthesized
aatcccgtggattcagtcat

SEQ ID NO: 250648 - DNA, 20 bp, Artificial Sequence
  chemically synthesized
gaatcccgtggattcagtca

SEQ ID NO: 250649 - DNA, 20 bp, Artificial Sequence
  chemically synthesized
tgtccccatgactgaatcca

SEQ ID NO: 250650 - DNA, 20 bp, Artificial Sequence
  chemically synthesized
gtccccatgactgaatccac

SEQ ID NO: 250651 - DNA, 20 bp, Artificial Sequence
  chemically synthesized
agaaaggaatcccgtggatt

SEQ ID NO: 250652 - DNA, 20 bp, Artificial Sequence
  chemically synthesized
actggaagaaaggaatcccg

SEQ ID NO: 250653 - DNA, 20 bp, Artificial Sequence
  chemically synthesized
tccacgggattcctttcttc

SEQ ID NO: 250654 - DNA, 20 bp, Artificial Sequence
  chemically synthesized
tgttttactgactggaagaa

SEQ ID NO: 250655 - DNA, 20 bp, Artificial Sequence
  chemically synthesized
ctgttttactgactggaaga

SEQ ID NO: 250656 - DNA, 20 bp, Artificial Sequence
  chemically synthesized
cgggattcctttcttccagt

SEQ ID NO: 250657 - DNA, 20 bp, Artificial Sequence
  chemically synthesized
gccactgttttactgactgg

SEQ ID NO: 250658 - DNA, 20 bp, Artificial Sequence
  chemically synthesized
atggccactgttttactgac

SEQ ID NO: 250659 - DNA, 20 bp, Artificial Sequence
  chemically synthesized
ctttcttccagtcagtaaaa

SEQ ID NO: 250660 - DNA, 20 bp, Artificial Sequence
  chemically synthesized
tcttccagtcagtaaaacag

SEQ ID NO: 250661 - DNA, 20 bp, Artificial Sequence
  chemically synthesized
agtcagtaaaacagtggcca

SEQ ID NO: 250662 - DNA, 20 bp, Artificial Sequence
  chemically synthesized
gtaaaacagtggccatggaa

SEQ ID NO: 250663 - DNA, 20 bp, Artificial Sequence
  chemically synthesized
taaaacagtggccatggaat

SEQ ID NO: 250664 - DNA, 20 bp, Artificial Sequence
  chemically synthesized
gttgttcatatcctattcca

SEQ ID NO: 250665 - DNA, 20 bp, Artificial Sequence
  chemically synthesized
aggatatgaacaactttctt

SEQ ID NO: 250666 - DNA, 20 bp, Artificial Sequence
  chemically synthesized
agcaagtcctgaacttaaga

SEQ ID NO: 250667 - DNA, 20 bp, Artificial Sequence
  chemically synthesized
atgaacaactttcttaagtt

SEQ ID NO: 250668 - DNA, 20 bp, Artificial Sequence
  chemically synthesized
tgaacaactttcttaagttc

SEQ ID NO: 250669 - DNA, 20 bp, Artificial Sequence
  chemically synthesized
aacaagcaagtcctgaactt

SEQ ID NO: 250670 - DNA, 20 bp, Artificial Sequence
  chemically synthesized
gtaaggggtaaaaaacaagc

SEQ ID NO: 250671 - DNA, 20 bp, Artificial Sequence
  chemically synthesized
ggaagtaaggggtaaaaaac

SEQ ID NO: 250672 - DNA, 20 bp, Artificial Sequence
  chemically synthesized
tggtagaattaggaagtaag

SEQ ID NO: 250673 - DNA, 20 bp, Artificial Sequence
  chemically synthesized
ttggtagaattaggaagtaa

SEQ ID NO: 250674 - DNA, 20 bp, Artificial Sequence
  chemically synthesized
cttggtagaattaggaagta

SEQ ID NO: 250675 - DNA, 20 bp, Artificial Sequence
  chemically synthesized
gcttggtagaattaggaagt

SEQ ID NO: 250676 - DNA, 20 bp, Artificial Sequence
  chemically synthesized
ctgagcttggtagaattagg

SEQ ID NO: 250677 - DNA, 20 bp, Artificial Sequence
  chemically synthesized
tttctgagcttggtagaatt

SEQ ID NO: 250678 - DNA, 20 bp, Artificial Sequence
  chemically synthesized
gtttctgagcttggtagaat

SEQ ID NO: 250679 - DNA, 20 bp, Artificial Sequence
  chemically synthesized
ccttacttcctaattctacc

SEQ ID NO: 250680 - DNA, 20 bp, Artificial Sequence
  chemically synthesized
cttcctaattctaccaagct

SEQ ID NO: 250681 - DNA, 20 bp, Artificial Sequence
  chemically synthesized
ctgttggtttctgagcttgg

SEQ ID NO: 250682 - DNA, 20 bp, Artificial Sequence
  chemically synthesized
ttactgttggtttctgagct

SEQ ID NO: 250683 - DNA, 20 bp, Artificial Sequence
  chemically synthesized
aatacttactgttggtttct

SEQ ID NO: 250684 - DNA, 20 bp, Artificial Sequence
  chemically synthesized
ctaccaagctcagaaaccaa

SEQ ID NO: 250685 - DNA, 20 bp, Artificial Sequence
  chemically synthesized
caagctcagaaaccaacagt

SEQ ID NO: 250686 - DNA, 20 bp, Artificial Sequence
  chemically synthesized
caatacaaaatacttactgt

SEQ ID NO: 250687 - DNA, 20 bp, Artificial Sequence
  chemically synthesized
caacagtaagtattttgtat

SEQ ID NO: 250688 - DNA, 20 bp, Artificial Sequence
  chemically synthesized
ttggcacatatacctatacc

SEQ ID NO: 250689 - DNA, 20 bp, Artificial Sequence
  chemically synthesized
tggcacatatacctatacct

SEQ ID NO: 250690 - DNA, 20 bp, Artificial Sequence
  chemically synthesized
tcattccacaacccaggtat

SEQ ID NO: 250691 - DNA, 20 bp, Artificial Sequence
  chemically synthesized
ttcattccacaacccaggta

SEQ ID NO: 250692 - DNA, 20 bp, Artificial Sequence
  chemically synthesized
atatacctatacctgggttg

SEQ ID NO: 250693 - DNA, 20 bp, Artificial Sequence
  chemically synthesized
ggatcttcattccacaaccc

SEQ ID NO: 250694 - DNA, 20 bp, Artificial Sequence
  chemically synthesized
tggatcttcattccacaacc

SEQ ID NO: 250695 - DNA, 20 bp, Artificial Sequence
  chemically synthesized
tatacctgggttgtggaatg

SEQ ID NO: 250696 - DNA, 20 bp, Artificial Sequence
  chemically synthesized
tgggttgtggaatgaagatc

SEQ ID NO: 250697 - DNA, 20 bp, Artificial Sequence
  chemically synthesized
tgaagatttttatgcaagac

SEQ ID NO: 250698 - DNA, 20 bp, Artificial Sequence
  chemically synthesized
atatttgaagatttttatgc

SEQ ID NO: 250699 - DNA, 20 bp, Artificial Sequence
  chemically synthesized
tgcataaaaatcttcaaata

SEQ ID NO: 250700 - DNA, 20 bp, Artificial Sequence
  chemically synthesized
attaatctctaccatatttg

SEQ ID NO: 250701 - DNA, 20 bp, Artificial Sequence
  chemically synthesized
ataaaaatcttcaaatatgg

SEQ ID NO: 250702 - DNA, 20 bp, Artificial Sequence
  chemically synthesized
aaaaatcttcaaatatggta

SEQ ID NO: 250703 - DNA, 20 bp, Artificial Sequence
  chemically synthesized
atatggtagagattaattct

SEQ ID NO: 250704 - DNA, 20 bp, Artificial Sequence
  chemically synthesized
aaggattatcattgcagtct

SEQ ID NO: 250705 - DNA, 20 bp, Artificial Sequence
  chemically synthesized
ctcacgaaggattatcattg

SEQ ID NO: 250706 - DNA, 20 bp, Artificial Sequence
  chemically synthesized
ctgcaatgataatccttcgt

SEQ ID NO: 250707 - DNA, 20 bp, Artificial Sequence
  chemically synthesized
aggatgctgacaactcacga

SEQ ID NO: 250708 - DNA, 20 bp, Artificial Sequence
  chemically synthesized
caggatgctgacaactcacg

SEQ ID NO: 250709 - DNA, 20 bp, Artificial Sequence
  chemically synthesized
gataatccttcgtgagttgt

SEQ ID NO: 250710 - DNA, 20 bp, Artificial Sequence
  chemically synthesized
gatacatgataagcacatac

SEQ ID NO: 250711 - DNA, 20 bp, Artificial Sequence
  chemically synthesized
agatacatgataagcacata

SEQ ID NO: 250712 - DNA, 20 bp, Artificial Sequence
  chemically synthesized
tagttgggaagatacatgat

SEQ ID NO: 250713 - DNA, 20 bp, Artificial Sequence
  chemically synthesized
caatgccatatgtagttggg

SEQ ID NO: 250714 - DNA, 20 bp, Artificial Sequence
  chemically synthesized
tcacaatgccatatgtagtt

SEQ ID NO: 250715 - DNA, 20 bp, Artificial Sequence
  chemically synthesized
gtcacaatgccatatgtagt

SEQ ID NO: 250716 - DNA, 20 bp, Artificial Sequence
  chemically synthesized
tgtatcttcccaactacata

SEQ ID NO: 250717 - DNA, 20 bp, Artificial Sequence
  chemically synthesized
atttgtcacaatgccatatg

SEQ ID NO: 250718 - DNA, 20 bp, Artificial Sequence
  chemically synthesized
acatatggcattgtgacaaa

SEQ ID NO: 250719 - DNA, 20 bp, Artificial Sequence
  chemically synthesized
tatggcattgtgacaaatag

SEQ ID NO: 250720 - DNA, 20 bp, Artificial Sequence
  chemically synthesized
tggcattgtgacaaatagaa

SEQ ID NO: 250721 - DNA, 20 bp, Artificial Sequence
  chemically synthesized
ggcattgtgacaaatagaag

SEQ ID NO: 250722 - DNA, 20 bp, Artificial Sequence
  chemically synthesized
ttcagctatagcagcattag

SEQ ID NO: 250723 - DNA, 20 bp, Artificial Sequence
  chemically synthesized
acattcagctatagcagcat

SEQ ID NO: 250724 - DNA, 20 bp, Artificial Sequence
  chemically synthesized
agaggctgctaatgctgcta

SEQ ID NO: 250725 - DNA, 20 bp, Artificial Sequence
  chemically synthesized
aatgagacattcagctatag

SEQ ID NO: 250726 - DNA, 20 bp, Artificial Sequence
  chemically synthesized
ctaaatgagacattcagcta

SEQ ID NO: 250727 - DNA, 20 bp, Artificial Sequence
  chemically synthesized
ttgttcctaaatgagacatt

SEQ ID NO: 250728 - DNA, 20 bp, Artificial Sequence
  chemically synthesized
ctatagctgaatgtctcatt

SEQ ID NO: 250729 - DNA, 20 bp, Artificial Sequence
  chemically synthesized
tatagctgaatgtctcattt

SEQ ID NO: 250730 - DNA, 20 bp, Artificial Sequence
  chemically synthesized
agaattgtttgttcctaaat

SEQ ID NO: 250731 - DNA, 20 bp, Artificial Sequence
  chemically synthesized
catttaggaacaaacaattc

SEQ ID NO: 250732 - DNA, 20 bp, Artificial Sequence
  chemically synthesized
aggaacaaacaattctggaa

SEQ ID NO: 250733 - DNA, 20 bp, Artificial Sequence
  chemically synthesized
gcataatctgggagcttttc

SEQ ID NO: 250734 - DNA, 20 bp, Artificial Sequence
  chemically synthesized
aacaattctggaaaagctcc

SEQ ID NO: 250735 - DNA, 20 bp, Artificial Sequence
  chemically synthesized
gggacagatgcataatctgg

SEQ ID NO: 250736 - DNA, 20 bp, Artificial Sequence
  chemically synthesized
gagggacagatgcataatct

SEQ ID NO: 250737 - DNA, 20 bp, Artificial Sequence
  chemically synthesized
agagggacagatgcataatc

SEQ ID NO: 250738 - DNA, 20 bp, Artificial Sequence
  chemically synthesized
agattatgcatctgtccctc

SEQ ID NO: 250739 - DNA, 20 bp, Artificial Sequence
  chemically synthesized
taaagtggaagctagaggga

SEQ ID NO: 250740 - DNA, 20 bp, Artificial Sequence
  chemically synthesized
cttttaaagtggaagctaga

SEQ ID NO: 250741 - DNA, 20 bp, Artificial Sequence
  chemically synthesized
tcttttaaagtggaagctag

SEQ ID NO: 250742 - DNA, 20 bp, Artificial Sequence
  chemically synthesized
atcttttaaagtggaagcta

SEQ ID NO: 250743 - DNA, 20 bp, Artificial Sequence
  chemically synthesized
ttatcttttaaagtggaagc

SEQ ID NO: 250744 - DNA, 20 bp, Artificial Sequence
  chemically synthesized
aattttatcttttaaagtgg

SEQ ID NO: 250745 - DNA, 20 bp, Artificial Sequence
  chemically synthesized
ccctctagcttccactttaa

SEQ ID NO: 250746 - DNA, 20 bp, Artificial Sequence
  chemically synthesized
tagaattttatcttttaaag

SEQ ID NO: 250747 - DNA, 20 bp, Artificial Sequence
  chemically synthesized
ctatagaattttatctttta

SEQ ID NO: 250748 - DNA, 20 bp, Artificial Sequence
  chemically synthesized
ctttaaaagataaaattcta

SEQ ID NO: 250749 - DNA, 20 bp, Artificial Sequence
  chemically synthesized
taatcctcacgttatcacta

SEQ ID NO: 250750 - DNA, 20 bp, Artificial Sequence
  chemically synthesized
aaattctatagtgataacgt

SEQ ID NO: 250751 - DNA, 20 bp, Artificial Sequence
  chemically synthesized
aattctatagtgataacgtg

SEQ ID NO: 250752 - DNA, 20 bp, Artificial Sequence
  chemically synthesized
tatagtgataacgtgaggat

SEQ ID NO: 250753 - DNA, 20 bp, Artificial Sequence
  chemically synthesized
ttacccatataaggaaagaa

SEQ ID NO: 250754 - DNA, 20 bp, Artificial Sequence
  chemically synthesized
tcacattacccatataagga

SEQ ID NO: 250755 - DNA, 20 bp, Artificial Sequence
  chemically synthesized
tatactattctttccttata

SEQ ID NO: 250756 - DNA, 20 bp, Artificial Sequence
  chemically synthesized
atactattctttccttatat

SEQ ID NO: 250757 - DNA, 20 bp, Artificial Sequence
  chemically synthesized
aacctcacattacccatata

SEQ ID NO: 250758 - DNA, 20 bp, Artificial Sequence
  chemically synthesized
taacctcacattacccatat

SEQ ID NO: 250759 - DNA, 20 bp, Artificial Sequence
  chemically synthesized
tttccttatatgggtaatgt

SEQ ID NO: 250760 - DNA, 20 bp, Artificial Sequence
  chemically synthesized
ttccttatatgggtaatgtg

SEQ ID NO: 250761 - DNA, 20 bp, Artificial Sequence
  chemically synthesized
ttttctttcatgtcaaggta

SEQ ID NO: 250762 - DNA, 20 bp, Artificial Sequence
  chemically synthesized
attttctttcatgtcaaggt

SEQ ID NO: 250763 - DNA, 20 bp, Artificial Sequence
  chemically synthesized
aataattttctttcatgtca

SEQ ID NO: 250764 - DNA, 20 bp, Artificial Sequence
  chemically synthesized
atttccttaccttgacatga

SEQ ID NO: 250765 - DNA, 20 bp, Artificial Sequence
  chemically synthesized
aaataattttctttcatgtc

SEQ ID NO: 250766 - DNA, 20 bp, Artificial Sequence
  chemically synthesized
aaattatttattgaatgtct

SEQ ID NO: 250767 - DNA, 20 bp, Artificial Sequence
  chemically synthesized
ttatttattgaatgtctcag

SEQ ID NO: 250768 - DNA, 20 bp, Artificial Sequence
  chemically synthesized
ttattgaatgtctcagtaga

SEQ ID NO: 250769 - DNA, 20 bp, Artificial Sequence
  chemically synthesized
tcagttgtaatctttctact

SEQ ID NO: 250770 - DNA, 20 bp, Artificial Sequence
  chemically synthesized
tcagtagaaagattacaact

SEQ ID NO: 250771 - DNA, 20 bp, Artificial Sequence
  chemically synthesized
tagaaagattacaactgaga

SEQ ID NO: 250772 - DNA, 20 bp, Artificial Sequence
  chemically synthesized
ctgataagaatttgctatct

SEQ ID NO: 250773 - DNA, 20 bp, Artificial Sequence
  chemically synthesized
ctgagatagcaaattcttat

SEQ ID NO: 250774 - DNA, 20 bp, Artificial Sequence
  chemically synthesized
tcctaatgtgagtttctgat

SEQ ID NO: 250775 - DNA, 20 bp, Artificial Sequence
  chemically synthesized
ttcttatcagaaactcacat

SEQ ID NO: 250776 - DNA, 20 bp, Artificial Sequence
  chemically synthesized
tcttatcagaaactcacatt

SEQ ID NO: 250777 - DNA, 20 bp, Artificial Sequence
  chemically synthesized
tgcaagcccattcctaatgt

SEQ ID NO: 250778 - DNA, 20 bp, Artificial Sequence
  chemically synthesized
tcagaaactcacattaggaa

SEQ ID NO: 250779 - DNA, 20 bp, Artificial Sequence
  chemically synthesized
cagaaactcacattaggaat

SEQ ID NO: 250780 - DNA, 20 bp, Artificial Sequence
  chemically synthesized
tcacattaggaatgggcttg

SEQ ID NO: 250781 - DNA, 20 bp, Artificial Sequence
  chemically synthesized
gaatgagcatgcaattctgc

SEQ ID NO: 250782 - DNA, 20 bp, Artificial Sequence
  chemically synthesized
gtattcagacagtagggaat

SEQ ID NO: 250783 - DNA, 20 bp, Artificial Sequence
  chemically synthesized
gtctctgtattcagacagta

SEQ ID NO: 250784 - DNA, 20 bp, Artificial Sequence
  chemically synthesized
cgtctctgtattcagacagt

SEQ ID NO: 250785 - DNA, 20 bp, Artificial Sequence
  chemically synthesized
tcgtctctgtattcagacag

SEQ ID NO: 250786 - DNA, 20 bp, Artificial Sequence
  chemically synthesized
taatcgtctctgtattcaga

SEQ ID NO: 250787 - DNA, 20 bp, Artificial Sequence
  chemically synthesized
cattccctactgtctgaata

SEQ ID NO: 250788 - DNA, 20 bp, Artificial Sequence
  chemically synthesized
ttccctactgtctgaataca

SEQ ID NO: 250789 - DNA, 20 bp, Artificial Sequence
  chemically synthesized
tccctaatcgtctctgtatt

SEQ ID NO: 250790 - DNA, 20 bp, Artificial Sequence
  chemically synthesized
tgtctgaatacagagacgat

SEQ ID NO: 250791 - DNA, 20 bp, Artificial Sequence
  chemically synthesized
gtctgaatacagagacgatt

SEQ ID NO: 250792 - DNA, 20 bp, Artificial Sequence
  chemically synthesized
tctgaatacagagacgatta

SEQ ID NO: 250793 - DNA, 20 bp, Artificial Sequence
  chemically synthesized
ataaatcagattcgaagaga

SEQ ID NO: 250794 - DNA, 20 bp, Artificial Sequence
  chemically synthesized
ccaaataaatcagattcgaa

SEQ ID NO: 250795 - DNA, 20 bp, Artificial Sequence
  chemically synthesized
aaccaaataaatcagattcg

SEQ ID NO: 250796 - DNA, 20 bp, Artificial Sequence
  chemically synthesized
ctcttcgaatctgatttatt

SEQ ID NO: 250797 - DNA, 20 bp, Artificial Sequence
  chemically synthesized
ggagtagaaaccaaataaat

SEQ ID NO: 250798 - DNA, 20 bp, Artificial Sequence
  chemically synthesized
gaaaggagagaaaacaggag

SEQ ID NO: 250799 - DNA, 20 bp, Artificial Sequence
  chemically synthesized
aacgaaaggagagaaaacag

SEQ ID NO: 250800 - DNA, 20 bp, Artificial Sequence
  chemically synthesized
gaaacgaaaggagagaaaac

SEQ ID NO: 250801 - DNA, 20 bp, Artificial Sequence
  chemically synthesized
agaaacgaaaggagagaaaa

SEQ ID NO: 250802 - DNA, 20 bp, Artificial Sequence
  chemically synthesized
aaatgaaagaaacgaaagga

SEQ ID NO: 250803 - DNA, 20 bp, Artificial Sequence
  chemically synthesized
gaaaatgaaagaaacgaaag

SEQ ID NO: 250804 - DNA, 20 bp, Artificial Sequence
  chemically synthesized
gagaaaatgaaagaaacgaa

SEQ ID NO: 250805 - DNA, 20 bp, Artificial Sequence
  chemically synthesized
tgagaaaatgaaagaaacga

SEQ ID NO: 250806 - DNA, 20 bp, Artificial Sequence
  chemically synthesized
gaagaaaaatgagaaaatga

SEQ ID NO: 250807 - DNA, 20 bp, Artificial Sequence
  chemically synthesized
tgtgctacatgaagaaaaat

SEQ ID NO: 250808 - DNA, 20 bp, Artificial Sequence
  chemically synthesized
ttttctcatttttcttcatg

SEQ ID NO: 250809 - DNA, 20 bp, Artificial Sequence
  chemically synthesized
gctgccatttgtgctacatg

SEQ ID NO: 250810 - DNA, 20 bp, Artificial Sequence
  chemically synthesized
ttttcttcatgtagcacaaa

SEQ ID NO: 250811 - DNA, 20 bp, Artificial Sequence
  chemically synthesized
tcttcatgtagcacaaatgg

SEQ ID NO: 250812 - DNA, 20 bp, Artificial Sequence
  chemically synthesized
catgtagcacaaatggcagc

SEQ ID NO: 250813 - DNA, 20 bp, Artificial Sequence
  chemically synthesized
tgtagcacaaatggcagcca

SEQ ID NO: 250814 - DNA, 20 bp, Artificial Sequence
  chemically synthesized
attaaagcactcacaggctc

SEQ ID NO: 250815 - DNA, 20 bp, Artificial Sequence
  chemically synthesized
aaatggcagccagagcctgt

SEQ ID NO: 250816 - DNA, 20 bp, Artificial Sequence
  chemically synthesized
tgcagcattaaagcactcac

SEQ ID NO: 250817 - DNA, 20 bp, Artificial Sequence
  chemically synthesized
ctgcagcattaaagcactca

SEQ ID NO: 250818 - DNA, 20 bp, Artificial Sequence
  chemically synthesized
gcagtaagcctgcagcatta

SEQ ID NO: 250819 - DNA, 20 bp, Artificial Sequence
  chemically synthesized
ctgtgagtgctttaatgctg

SEQ ID NO: 250820 - DNA, 20 bp, Artificial Sequence
  chemically synthesized
tgtgagtgctttaatgctgc

SEQ ID NO: 250821 - DNA, 20 bp, Artificial Sequence
  chemically synthesized
ttctcatagcagtaagcctg

SEQ ID NO: 250822 - DNA, 20 bp, Artificial Sequence
  chemically synthesized
tgttcagttctcatagcagt

SEQ ID NO: 250823 - DNA, 20 bp, Artificial Sequence
  chemically synthesized
tgctgcaggcttactgctat

SEQ ID NO: 250824 - DNA, 20 bp, Artificial Sequence
  chemically synthesized
ccattgttcagttctcatag

SEQ ID NO: 250825 - DNA, 20 bp, Artificial Sequence
  chemically synthesized
tctccattgttcagttctca

SEQ ID NO: 250826 - DNA, 20 bp, Artificial Sequence
  chemically synthesized
ctgctatgagaactgaacaa

SEQ ID NO: 250827 - DNA, 20 bp, Artificial Sequence
  chemically synthesized
gctatgagaactgaacaatg

SEQ ID NO: 250828 - DNA, 20 bp, Artificial Sequence
  chemically synthesized
ccagggatttctccattgtt

SEQ ID NO: 250829 - DNA, 20 bp, Artificial Sequence
  chemically synthesized
ctgaacaatggagaaatccc

SEQ ID NO: 250830 - DNA, 20 bp, Artificial Sequence
  chemically synthesized
tgaacaatggagaaatccct

SEQ ID NO: 250831 - DNA, 20 bp, Artificial Sequence
  chemically synthesized
gaacaatggagaaatccctg

SEQ ID NO: 250832 - DNA, 20 bp, Artificial Sequence
  chemically synthesized
caatggagaaatccctgggg

SEQ ID NO: 250833 - DNA, 20 bp, Artificial Sequence
  chemically synthesized
agttggaagctgcttcccca

SEQ ID NO: 250834 - DNA, 20 bp, Artificial Sequence
  chemically synthesized
tggagaaatccctggggaag

SEQ ID NO: 250835 - DNA, 20 bp, Artificial Sequence
  chemically synthesized
cagttggaagctgcttcccc

SEQ ID NO: 250836 - DNA, 20 bp, Artificial Sequence
  chemically synthesized
acagttggaagctgcttccc

SEQ ID NO: 250837 - DNA, 20 bp, Artificial Sequence
  chemically synthesized
gctgagggtgggacagttgg

SEQ ID NO: 250838 - DNA, 20 bp, Artificial Sequence
  chemically synthesized
gatgctgagggtgggacagt

SEQ ID NO: 250839 - DNA, 20 bp, Artificial Sequence
  chemically synthesized
ttaggatgctgagggtggga

SEQ ID NO: 250840 - DNA, 20 bp, Artificial Sequence
  chemically synthesized
gcttccaactgtcccaccct

SEQ ID NO: 250841 - DNA, 20 bp, Artificial Sequence
  chemically synthesized
gtcattaggatgctgagggt

SEQ ID NO: 250842 - DNA, 20 bp, Artificial Sequence
  chemically synthesized
ggtcattaggatgctgaggg

SEQ ID NO: 250843 - DNA, 20 bp, Artificial Sequence
  chemically synthesized
acaggtcattaggatgctga

SEQ ID NO: 250844 - DNA, 20 bp, Artificial Sequence
  chemically synthesized
cacaggtcattaggatgctg

SEQ ID NO: 250845 - DNA, 20 bp, Artificial Sequence
  chemically synthesized
ccacaggtcattaggatgct

SEQ ID NO: 250846 - DNA, 20 bp, Artificial Sequence
  chemically synthesized
ccacagttccacaggtcatt

SEQ ID NO: 250847 - DNA, 20 bp, Artificial Sequence
  chemically synthesized
accacagttccacaggtcat

SEQ ID NO: 250848 - DNA, 20 bp, Artificial Sequence
  chemically synthesized
ctcagcatcctaatgacctg

SEQ ID NO: 250849 - DNA, 20 bp, Artificial Sequence
  chemically synthesized
ttctggaaccacagttccac

SEQ ID NO: 250850 - DNA, 20 bp, Artificial Sequence
  chemically synthesized
attctggaaccacagttcca

SEQ ID NO: 250851 - DNA, 20 bp, Artificial Sequence
  chemically synthesized
cctaatgacctgtggaactg

SEQ ID NO: 250852 - DNA, 20 bp, Artificial Sequence
  chemically synthesized
gacctgtggaactgtggttc

SEQ ID NO: 250853 - DNA, 20 bp, Artificial Sequence
  chemically synthesized
tcaccaccattctggaacca

SEQ ID NO: 250854 - DNA, 20 bp, Artificial Sequence
  chemically synthesized
gtggaactgtggttccagaa

SEQ ID NO: 250855 - DNA, 20 bp, Artificial Sequence
  chemically synthesized
gaactgtggttccagaatgg

SEQ ID NO: 250856 - DNA, 20 bp, Artificial Sequence
  chemically synthesized
caaatttatcaccaccattc

SEQ ID NO: 250857 - DNA, 20 bp, Artificial Sequence
  chemically synthesized
cagaatggtggtgataaatt

SEQ ID NO: 250858 - DNA, 20 bp, Artificial Sequence
  chemically synthesized
tttggaaaatactttctcta

SEQ ID NO: 250859 - DNA, 20 bp, Artificial Sequence
  chemically synthesized
gggcactactgctttagaga

SEQ ID NO: 250860 - DNA, 20 bp, Artificial Sequence
  chemically synthesized
ggaaaatactttctctaaag

SEQ ID NO: 250861 - DNA, 20 bp, Artificial Sequence
  chemically synthesized
atgtgggcactactgcttta

SEQ ID NO: 250862 - DNA, 20 bp, Artificial Sequence
  chemically synthesized
aaatactttctctaaagcag

SEQ ID NO: 250863 - DNA, 20 bp, Artificial Sequence
  chemically synthesized
atatgtgggcactactgctt

SEQ ID NO: 250864 - DNA, 20 bp, Artificial Sequence
  chemically synthesized
agcctgtcagataaatatgt

SEQ ID NO: 250865 - DNA, 20 bp, Artificial Sequence
  chemically synthesized
cagcctgtcagataaatatg

SEQ ID NO: 250866 - DNA, 20 bp, Artificial Sequence
  chemically synthesized
gtgcccacatatttatctga

SEQ ID NO: 250867 - DNA, 20 bp, Artificial Sequence
  chemically synthesized
tgcccacatatttatctgac

SEQ ID NO: 250868 - DNA, 20 bp, Artificial Sequence
  chemically synthesized
aattgcccagtacagcctgt

SEQ ID NO: 250869 - DNA, 20 bp, Artificial Sequence
  chemically synthesized
atttatctgacaggctgtac

SEQ ID NO: 250870 - DNA, 20 bp, Artificial Sequence
  chemically synthesized
tttatctgacaggctgtact

SEQ ID NO: 250871 - DNA, 20 bp, Artificial Sequence
  chemically synthesized
cattttataattgcccagta

SEQ ID NO: 250872 - DNA, 20 bp, Artificial Sequence
  chemically synthesized
ctgaacattttataattgcc

SEQ ID NO: 250873 - DNA, 20 bp, Artificial Sequence
  chemically synthesized
ctgggcaattataaaatgtt

SEQ ID NO: 250874 - DNA, 20 bp, Artificial Sequence
  chemically synthesized
tgggcaattataaaatgttc

SEQ ID NO: 250875 - DNA, 20 bp, Artificial Sequence
  chemically synthesized
gggcaattataaaatgttca

SEQ ID NO: 250876 - DNA, 20 bp, Artificial Sequence
  chemically synthesized
ggcaattataaaatgttcag

SEQ ID NO: 250877 - DNA, 20 bp, Artificial Sequence
  chemically synthesized
ataaaatgttcaggggtcca

SEQ ID NO: 250878 - DNA, 20 bp, Artificial Sequence
  chemically synthesized
ctatttttggcatttcacca

SEQ ID NO: 250879 - DNA, 20 bp, Artificial Sequence
  chemically synthesized
ccatggtgaaatgccaaaaa

SEQ ID NO: 250880 - DNA, 20 bp, Artificial Sequence
  chemically synthesized
ataccgcattgttctatttt

SEQ ID NO: 250881 - DNA, 20 bp, Artificial Sequence
  chemically synthesized
atgccaaaaatagaacaatg

SEQ ID NO: 250882 - DNA, 20 bp, Artificial Sequence
  chemically synthesized
aatgcggtatgcttttccta

SEQ ID NO: 250883 - DNA, 20 bp, Artificial Sequence
  chemically synthesized
agaaggtgtagctttaggaa

SEQ ID NO: 250884 - DNA, 20 bp, Artificial Sequence
  chemically synthesized
aataaagaaggtgtagcttt

SEQ ID NO: 250885 - DNA, 20 bp, Artificial Sequence
  chemically synthesized
taataaagaaggtgtagctt

SEQ ID NO: 250886 - DNA, 20 bp, Artificial Sequence
  chemically synthesized
ttgttttaataaagaaggtg

SEQ ID NO: 250887 - DNA, 20 bp, Artificial Sequence
  chemically synthesized
cataattgttttaataaaga

SEQ ID NO: 250888 - DNA, 20 bp, Artificial Sequence
  chemically synthesized
tcataattgttttaataaag

SEQ ID NO: 250889 - DNA, 20 bp, Artificial Sequence
  chemically synthesized
aaatcataattgttttaata

SEQ ID NO: 250890 - DNA, 20 bp, Artificial Sequence
  chemically synthesized
tatgtactttaagtacagga

SEQ ID NO: 250891 - DNA, 20 bp, Artificial Sequence
  chemically synthesized
atatgtactttaagtacagg

SEQ ID NO: 250892 - DNA, 20 bp, Artificial Sequence
  chemically synthesized
aatatgtactttaagtacag

SEQ ID NO: 250893 - DNA, 20 bp, Artificial Sequence
  chemically synthesized
ttatgtccctcctgtactta

SEQ ID NO: 250894 - DNA, 20 bp, Artificial Sequence
  chemically synthesized
taaatatgtactttaagtac

SEQ ID NO: 250895 - DNA, 20 bp, Artificial Sequence
  chemically synthesized
ataaatatgtactttaagta

SEQ ID NO: 250896 - DNA, 20 bp, Artificial Sequence
  chemically synthesized
aaataataaatatgtacttt

SEQ ID NO: 250897 - DNA, 20 bp, Artificial Sequence
  chemically synthesized
atttattatttttaaaatgt

SEQ ID NO: 250898 - DNA, 20 bp, Artificial Sequence
  chemically synthesized
taaaatgtaagtataaattt

SEQ ID NO: 250899 - DNA, 20 bp, Artificial Sequence
  chemically synthesized
tgtaagtataaattttagtt

SEQ ID NO: 250900 - DNA, 20 bp, Artificial Sequence
  chemically synthesized
gtataaattttagttcagtc

SEQ ID NO: 250901 - DNA, 20 bp, Artificial Sequence
  chemically synthesized
acacatttctgtgtgaatgc

SEQ ID NO: 250902 - DNA, 20 bp, Artificial Sequence
  chemically synthesized
agttcagtccagcattcaca

SEQ ID NO: 250903 - DNA, 20 bp, Artificial Sequence
  chemically synthesized
cagaaatgtgtacacatcac

SEQ ID NO: 250904 - DNA, 20 bp, Artificial Sequence
  chemically synthesized
gtgtacacatcacaagtgta

SEQ ID NO: 250905 - DNA, 20 bp, Artificial Sequence
  chemically synthesized
gtttcctttagggaagttta

SEQ ID NO: 250906 - DNA, 20 bp, Artificial Sequence
  chemically synthesized
tggttccataaacttcccta

SEQ ID NO: 250907 - DNA, 20 bp, Artificial Sequence
  chemically synthesized
ggttccataaacttccctaa

SEQ ID NO: 250908 - DNA, 20 bp, Artificial Sequence
  chemically synthesized
ttgatgtgtttcctttaggg

SEQ ID NO: 250909 - DNA, 20 bp, Artificial Sequence
  chemically synthesized
gcattgatgtgtttccttta

SEQ ID NO: 250910 - DNA, 20 bp, Artificial Sequence
  chemically synthesized
tgcattgatgtgtttccttt

SEQ ID NO: 250911 - DNA, 20 bp, Artificial Sequence
  chemically synthesized
ttgcattgatgtgtttcctt

SEQ ID NO: 250912 - DNA, 20 bp, Artificial Sequence
  chemically synthesized
taaaggaaacacatcaatgc

SEQ ID NO: 250913 - DNA, 20 bp, Artificial Sequence
  chemically synthesized
aggaaacacatcaatgcaag

SEQ ID NO: 250914 - DNA, 20 bp, Artificial Sequence
  chemically synthesized
atgcaagcagcatccacatc

SEQ ID NO: 250915 - DNA, 20 bp, Artificial Sequence
  chemically synthesized
taatgttttgtttcttgatg

SEQ ID NO: 250916 - DNA, 20 bp, Artificial Sequence
  chemically synthesized
tcaagaaacaaaacattacc

SEQ ID NO: 250917 - DNA, 20 bp, Artificial Sequence
  chemically synthesized
acaaaacattacccagtccc

SEQ ID NO: 250918 - DNA, 20 bp, Artificial Sequence
  chemically synthesized
gaagcaggcttctagggact

SEQ ID NO: 250919 - DNA, 20 bp, Artificial Sequence
  chemically synthesized
tgaagcaggcttctagggac

SEQ ID NO: 250920 - DNA, 20 bp, Artificial Sequence
  chemically synthesized
aaacattacccagtccctag

SEQ ID NO: 250921 - DNA, 20 bp, Artificial Sequence
  chemically synthesized
agggctgaagcaggcttcta

SEQ ID NO: 250922 - DNA, 20 bp, Artificial Sequence
  chemically synthesized
aagggctgaagcaggcttct

SEQ ID NO: 250923 - DNA, 20 bp, Artificial Sequence
  chemically synthesized
caagggctgaagcaggcttc

SEQ ID NO: 250924 - DNA, 20 bp, Artificial Sequence
  chemically synthesized
cagtccctagaagcctgctt

SEQ ID NO: 250925 - DNA, 20 bp, Artificial Sequence
  chemically synthesized
tgattaacaagggctgaagc

SEQ ID NO: 250926 - DNA, 20 bp, Artificial Sequence
  chemically synthesized
gtgattaacaagggctgaag

SEQ ID NO: 250927 - DNA, 20 bp, Artificial Sequence
  chemically synthesized
gttgtgattaacaagggctg

SEQ ID NO: 250928 - DNA, 20 bp, Artificial Sequence
  chemically synthesized
ttgtgagttgtgattaacaa

SEQ ID NO: 250929 - DNA, 20 bp, Artificial Sequence
  chemically synthesized
tttgtgagttgtgattaaca

SEQ ID NO: 250930 - DNA, 20 bp, Artificial Sequence
  chemically synthesized
ctttgtgagttgtgattaac

SEQ ID NO: 250931 - DNA, 20 bp, Artificial Sequence
  chemically synthesized
cttgttaatcacaactcaca

SEQ ID NO: 250932 - DNA, 20 bp, Artificial Sequence
  chemically synthesized
ttgttaatcacaactcacaa

SEQ ID NO: 250933 - DNA, 20 bp, Artificial Sequence
  chemically synthesized
cagataggagttacctttgt

SEQ ID NO: 250934 - DNA, 20 bp, Artificial Sequence
  chemically synthesized
ggagtttagaggtcagatag

SEQ ID NO: 250935 - DNA, 20 bp, Artificial Sequence
  chemically synthesized
ttggagtttagaggtcagat

SEQ ID NO: 250936 - DNA, 20 bp, Artificial Sequence
  chemically synthesized
tttggagtttagaggtcaga

SEQ ID NO: 250937 - DNA, 20 bp, Artificial Sequence
  chemically synthesized
gcactttggagtttagaggt

SEQ ID NO: 250938 - DNA, 20 bp, Artificial Sequence
  chemically synthesized
ttaggcactttggagtttag

SEQ ID NO: 250939 - DNA, 20 bp, Artificial Sequence
  chemically synthesized
attaggcactttggagttta

SEQ ID NO: 250940 - DNA, 20 bp, Artificial Sequence
  chemically synthesized
tatctgacctctaaactcca

SEQ ID NO: 250941 - DNA, 20 bp, Artificial Sequence
  chemically synthesized
aaattaggcactttggagtt

SEQ ID NO: 250942 - DNA, 20 bp, Artificial Sequence
  chemically synthesized
ctaaaaaattaggcactttg

SEQ ID NO: 250943 - DNA, 20 bp, Artificial Sequence
  chemically synthesized
aactaaaaaattaggcactt

SEQ ID NO: 250944 - DNA, 20 bp, Artificial Sequence
  chemically synthesized
ctccaaagtgcctaattttt

SEQ ID NO: 250945 - DNA, 20 bp, Artificial Sequence
  chemically synthesized
ttatatgaaactaaaaaatt

SEQ ID NO: 250946 - DNA, 20 bp, Artificial Sequence
  chemically synthesized
attatatgaaactaaaaaat

SEQ ID NO: 250947 - DNA, 20 bp, Artificial Sequence
  chemically synthesized
aattttttagtttcatataa

SEQ ID NO: 250948 - DNA, 20 bp, Artificial Sequence
  chemically synthesized
tttcatataatagattcata

SEQ ID NO: 250949 - DNA, 20 bp, Artificial Sequence
  chemically synthesized
atataatagattcatacagt

SEQ ID NO: 250950 - DNA, 20 bp, Artificial Sequence
  chemically synthesized
ataaagtaagtcagaaataa

SEQ ID NO: 250951 - DNA, 20 bp, Artificial Sequence
  chemically synthesized
gtataaagtaagtcagaaat

SEQ ID NO: 250952 - DNA, 20 bp, Artificial Sequence
  chemically synthesized
cagtgttgtataaagtaagt

SEQ ID NO: 250953 - DNA, 20 bp, Artificial Sequence
  chemically synthesized
aacacagtgttgtataaagt

SEQ ID NO: 250954 - DNA, 20 bp, Artificial Sequence
  chemically synthesized
tatgaacacagtgttgtata

SEQ ID NO: 250955 - DNA, 20 bp, Artificial Sequence
  chemically synthesized
tgaaaaataaaatatgaaca

SEQ ID NO: 250956 - DNA, 20 bp, Artificial Sequence
  chemically synthesized
aataatatttcataaaataa

SEQ ID NO: 250957 - DNA, 20 bp, Artificial Sequence
  chemically synthesized
taataatatttcataaaata

SEQ ID NO: 250958 - DNA, 20 bp, Artificial Sequence
  chemically synthesized
ttttatgaaatattattaat

SEQ ID NO: 250959 - DNA, 20 bp, Artificial Sequence
  chemically synthesized
aattagagaaagaagtataa

SEQ ID NO: 250960 - DNA, 20 bp, Artificial Sequence
  chemically synthesized
aaattagagaaagaagtata

SEQ ID NO: 250961 - DNA, 20 bp, Artificial Sequence
  chemically synthesized
aaaattagagaaagaagtat

SEQ ID NO: 250962 - DNA, 20 bp, Artificial Sequence
  chemically synthesized
tctaaaaaaattagagaaag

SEQ ID NO: 250963 - DNA, 20 bp, Artificial Sequence
  chemically synthesized
acctctaaaaaaattagaga

SEQ ID NO: 250964 - DNA, 20 bp, Artificial Sequence
  chemically synthesized
agaaacctctaaaaaaatta

SEQ ID NO: 250965 - DNA, 20 bp, Artificial Sequence
  chemically synthesized
acttctttctctaatttttt

SEQ ID NO: 250966 - DNA, 20 bp, Artificial Sequence
  chemically synthesized
aaagaaacctctaaaaaaat

SEQ ID NO: 250967 - DNA, 20 bp, Artificial Sequence
  chemically synthesized
ttctttctctaattttttta

SEQ ID NO: 250968 - DNA, 20 bp, Artificial Sequence
  chemically synthesized
tctttctctaatttttttag

SEQ ID NO: 250969 - DNA, 20 bp, Artificial Sequence
  chemically synthesized
ttacatttctatagcaaaaa

SEQ ID NO: 250970 - DNA, 20 bp, Artificial Sequence
  chemically synthesized
agaggtttctttttttgcta

SEQ ID NO: 250971 - DNA, 20 bp, Artificial Sequence
  chemically synthesized
tctatattattacatttcta

SEQ ID NO: 250972 - DNA, 20 bp, Artificial Sequence
  chemically synthesized
gctatagaaatgtaataata

SEQ ID NO: 250973 - DNA, 20 bp, Artificial Sequence
  chemically synthesized
aatatagaaataaatactct

SEQ ID NO: 250974 - DNA, 20 bp, Artificial Sequence
  chemically synthesized
taaaatagacatgagactaa

SEQ ID NO: 250975 - DNA, 20 bp, Artificial Sequence
  chemically synthesized
tgtaaaatagacatgagact

SEQ ID NO: 250976 - DNA, 20 bp, Artificial Sequence
  chemically synthesized
atatgatgtaaaatagacat

SEQ ID NO: 250977 - DNA, 20 bp, Artificial Sequence
  chemically synthesized
gctttagatatgatgtaaaa

SEQ ID NO: 250978 - DNA, 20 bp, Artificial Sequence
  chemically synthesized
tctattttacatcatatcta

SEQ ID NO: 250979 - DNA, 20 bp, Artificial Sequence
  chemically synthesized
tttacatcatatctaaagct

SEQ ID NO: 250980 - DNA, 20 bp, Artificial Sequence
  chemically synthesized
ttcaagatggttctgagctt

SEQ ID NO: 250981 - DNA, 20 bp, Artificial Sequence
  chemically synthesized
gttaaattcaagatggttct

SEQ ID NO: 250982 - DNA, 20 bp, Artificial Sequence
  chemically synthesized
ataagtagttaaattcaaga

SEQ ID NO: 250983 - DNA, 20 bp, Artificial Sequence
  chemically synthesized
ccatataagtagttaaattc

SEQ ID NO: 250984 - DNA, 20 bp, Artificial Sequence
  chemically synthesized
cttgaatttaactacttata

SEQ ID NO: 250985 - DNA, 20 bp, Artificial Sequence
  chemically synthesized
ttgaatttaactacttatat

SEQ ID NO: 250986 - DNA, 20 bp, Artificial Sequence
  chemically synthesized
gacttacccacccatataag

SEQ ID NO: 250987 - DNA, 20 bp, Artificial Sequence
  chemically synthesized
aatttaactacttatatggg

SEQ ID NO: 250988 - DNA, 20 bp, Artificial Sequence
  chemically synthesized
gttgacttacccacccatat

SEQ ID NO: 250989 - DNA, 20 bp, Artificial Sequence
  chemically synthesized
atttaactacttatatgggt

SEQ ID NO: 250990 - DNA, 20 bp, Artificial Sequence
  chemically synthesized
aactacttatatgggtgggt

SEQ ID NO: 250991 - DNA, 20 bp, Artificial Sequence
  chemically synthesized
tctacttagtcagatatgtt

SEQ ID NO: 250992 - DNA, 20 bp, Artificial Sequence
  chemically synthesized
ttctacttagtcagatatgt

SEQ ID NO: 250993 - DNA, 20 bp, Artificial Sequence
  chemically synthesized
tcaacccaacatatctgact

SEQ ID NO: 250994 - DNA, 20 bp, Artificial Sequence
  chemically synthesized
acccaacatatctgactaag

SEQ ID NO: 250995 - DNA, 20 bp, Artificial Sequence
  chemically synthesized
ttcttggaattctacttagt

SEQ ID NO: 250996 - DNA, 20 bp, Artificial Sequence
  chemically synthesized
ttccttcttggaattctact

SEQ ID NO: 250997 - DNA, 20 bp, Artificial Sequence
  chemically synthesized
atctgactaagtagaattcc

SEQ ID NO: 250998 - DNA, 20 bp, Artificial Sequence
  chemically synthesized
tgactaagtagaattccaag

SEQ ID NO: 250999 - DNA, 20 bp, Artificial Sequence
  chemically synthesized
gactaagtagaattccaaga

SEQ ID NO: 251000 - DNA, 20 bp, Artificial Sequence
  chemically synthesized
taaaatcagtatttccttct

SEQ ID NO: 251001 - DNA, 20 bp, Artificial Sequence
  chemically synthesized
agaaagtaatgttttaaaat

SEQ ID NO: 251002 - DNA, 20 bp, Artificial Sequence
  chemically synthesized
gtccctgtcaaacatcaaga

SEQ ID NO: 251003 - DNA, 20 bp, Artificial Sequence
  chemically synthesized
caaggtccctgtcaaacatc

SEQ ID NO: 251004 - DNA, 20 bp, Artificial Sequence
  chemically synthesized
attactttcttgatgtttga

SEQ ID NO: 251005 - DNA, 20 bp, Artificial Sequence
  chemically synthesized
ttactttcttgatgtttgac

SEQ ID NO: 251006 - DNA, 20 bp, Artificial Sequence
  chemically synthesized
tactttcttgatgtttgaca

SEQ ID NO: 251007 - DNA, 20 bp, Artificial Sequence
  chemically synthesized
ggcattattgtgtaacaaca

SEQ ID NO: 251008 - DNA, 20 bp, Artificial Sequence
  chemically synthesized
tggcattattgtgtaacaac

SEQ ID NO: 251009 - DNA, 20 bp, Artificial Sequence
  chemically synthesized
tacacaataatgccatctta

SEQ ID NO: 251010 - DNA, 20 bp, Artificial Sequence
  chemically synthesized
attgctgtacagccataaga

SEQ ID NO: 251011 - DNA, 20 bp, Artificial Sequence
  chemically synthesized
acaaattgctgtacagccat

SEQ ID NO: 251012 - DNA, 20 bp, Artificial Sequence
  chemically synthesized
aatgccatcttatggctgta

SEQ ID NO: 251013 - DNA, 20 bp, Artificial Sequence
  chemically synthesized
ctagactacaaattgctgta

SEQ ID NO: 251014 - DNA, 20 bp, Artificial Sequence
  chemically synthesized
tatggctgtacagcaatttg

SEQ ID NO: 251015 - DNA, 20 bp, Artificial Sequence
  chemically synthesized
ctgtacagcaatttgtagtc

SEQ ID NO: 251016 - DNA, 20 bp, Artificial Sequence
  chemically synthesized
atcaaaatgaaggcagtttc

SEQ ID NO: 251017 - DNA, 20 bp, Artificial Sequence
  chemically synthesized
tgctatcatcaaaatgaagg

SEQ ID NO: 251018 - DNA, 20 bp, Artificial Sequence
  chemically synthesized
aaatgctatcatcaaaatga

SEQ ID NO: 251019 - DNA, 20 bp, Artificial Sequence
  chemically synthesized
caaatgctatcatcaaaatg

SEQ ID NO: 251020 - DNA, 20 bp, Artificial Sequence
  chemically synthesized
aactgccttcattttgatga

SEQ ID NO: 251021 - DNA, 20 bp, Artificial Sequence
  chemically synthesized
caaagactaagagggtagaa

SEQ ID NO: 251022 - DNA, 20 bp, Artificial Sequence
  chemically synthesized
tttgaactgttctaccctct

SEQ ID NO: 251023 - DNA, 20 bp, Artificial Sequence
  chemically synthesized
cttcccaaagactaagaggg

SEQ ID NO: 251024 - DNA, 20 bp, Artificial Sequence
  chemically synthesized
tgacttcccaaagactaaga

SEQ ID NO: 251025 - DNA, 20 bp, Artificial Sequence
  chemically synthesized
atgacttcccaaagactaag

SEQ ID NO: 251026 - DNA, 20 bp, Artificial Sequence
  chemically synthesized
aatgacttcccaaagactaa

SEQ ID NO: 251027 - DNA, 20 bp, Artificial Sequence
  chemically synthesized
tgttctaccctcttagtctt

SEQ ID NO: 251028 - DNA, 20 bp, Artificial Sequence
  chemically synthesized
gttctaccctcttagtcttt

SEQ ID NO: 251029 - DNA, 20 bp, Artificial Sequence
  chemically synthesized
aaaatgacttcccaaagact

SEQ ID NO: 251030 - DNA, 20 bp, Artificial Sequence
  chemically synthesized
ctaccctcttagtctttggg

SEQ ID NO: 251031 - DNA, 20 bp, Artificial Sequence
  chemically synthesized
ttttagaaaatgacttccca

SEQ ID NO: 251032 - DNA, 20 bp, Artificial Sequence
  chemically synthesized
tttgggaagtcattttctaa

SEQ ID NO: 251033 - DNA, 20 bp, Artificial Sequence
  chemically synthesized
gggaagtcattttctaaaag

SEQ ID NO: 251034 - DNA, 20 bp, Artificial Sequence
  chemically synthesized
ggaagtcattttctaaaagt

SEQ ID NO: 251035 - DNA, 20 bp, Artificial Sequence
  chemically synthesized
tagtgagtgtttcccacttt

SEQ ID NO: 251036 - DNA, 20 bp, Artificial Sequence
  chemically synthesized
aagtgggaaacactcactaa

SEQ ID NO: 251037 - DNA, 20 bp, Artificial Sequence
  chemically synthesized
ctatcctgtaagccattagt

SEQ ID NO: 251038 - DNA, 20 bp, Artificial Sequence
  chemically synthesized
tttactatcctgtaagccat

SEQ ID NO: 251039 - DNA, 20 bp, Artificial Sequence
  chemically synthesized
aaacactcactaatggctta

SEQ ID NO: 251040 - DNA, 20 bp, Artificial Sequence
  chemically synthesized
aacactcactaatggcttac

SEQ ID NO: 251041 - DNA, 20 bp, Artificial Sequence
  chemically synthesized
ctcactaatggcttacagga

SEQ ID NO: 251042 - DNA, 20 bp, Artificial Sequence
  chemically synthesized
taccatctttactatcctgt

SEQ ID NO: 251043 - DNA, 20 bp, Artificial Sequence
  chemically synthesized
taatggcttacaggatagta

SEQ ID NO: 251044 - DNA, 20 bp, Artificial Sequence
  chemically synthesized
ggcttacaggatagtaaaga

SEQ ID NO: 251045 - DNA, 20 bp, Artificial Sequence
  chemically synthesized
caggatagtaaagatggtat

SEQ ID NO: 251046 - DNA, 20 bp, Artificial Sequence
  chemically synthesized
atagtaaagatggtatcaga

SEQ ID NO: 251047 - DNA, 20 bp, Artificial Sequence
  chemically synthesized
cagaaagaaactaacgacaa

SEQ ID NO: 251048 - DNA, 20 bp, Artificial Sequence
  chemically synthesized
atgttatactctattgtcgt

SEQ ID NO: 251049 - DNA, 20 bp, Artificial Sequence
  chemically synthesized
gaaagaaactaacgacaata

SEQ ID NO: 251050 - DNA, 20 bp, Artificial Sequence
  chemically synthesized
agagtataacatctgacatt

SEQ ID NO: 251051 - DNA, 20 bp, Artificial Sequence
  chemically synthesized
aagaagggcctactaaatgt

SEQ ID NO: 251052 - DNA, 20 bp, Artificial Sequence
  chemically synthesized
gtataacatctgacatttag

SEQ ID NO: 251053 - DNA, 20 bp, Artificial Sequence
  chemically synthesized
tataacatctgacatttagt

SEQ ID NO: 251054 - DNA, 20 bp, Artificial Sequence
  chemically synthesized
acatttagtaggcccttctt

SEQ ID NO: 251055 - DNA, 20 bp, Artificial Sequence
  chemically synthesized
tttcaatgaacacttaagaa

SEQ ID NO: 251056 - DNA, 20 bp, Artificial Sequence
  chemically synthesized
ctttcaatgaacacttaaga

SEQ ID NO: 251057 - DNA, 20 bp, Artificial Sequence
  chemically synthesized
tctttcaatgaacacttaag

SEQ ID NO: 251058 - DNA, 20 bp, Artificial Sequence
  chemically synthesized
tcttctttcaatgaacactt

SEQ ID NO: 251059 - DNA, 20 bp, Artificial Sequence
  chemically synthesized
ccttcttaagtgttcattga

SEQ ID NO: 251060 - DNA, 20 bp, Artificial Sequence
  chemically synthesized
tcttaagtgttcattgaaag

SEQ ID NO: 251061 - DNA, 20 bp, Artificial Sequence
  chemically synthesized
agtgttcattgaaagaagaa

SEQ ID NO: 251062 - DNA, 20 bp, Artificial Sequence
  chemically synthesized
tgttcattgaaagaagaaaa

SEQ ID NO: 251063 - DNA, 20 bp, Artificial Sequence
  chemically synthesized
tatctgggattagagaaaca

SEQ ID NO: 251064 - DNA, 20 bp, Artificial Sequence
  chemically synthesized
gagctttgtttctctaatcc

SEQ ID NO: 251065 - DNA, 20 bp, Artificial Sequence
  chemically synthesized
ataagatctatctgggatta

SEQ ID NO: 251066 - DNA, 20 bp, Artificial Sequence
  chemically synthesized
acataagatctatctgggat

SEQ ID NO: 251067 - DNA, 20 bp, Artificial Sequence
  chemically synthesized
tttgtttctctaatcccaga

SEQ ID NO: 251068 - DNA, 20 bp, Artificial Sequence
  chemically synthesized
aatttacataagatctatct

SEQ ID NO: 251069 - DNA, 20 bp, Artificial Sequence
  chemically synthesized
gaatttacataagatctatc

SEQ ID NO: 251070 - DNA, 20 bp, Artificial Sequence
  chemically synthesized
taaaaacaaagaatttacat

SEQ ID NO: 251071 - DNA, 20 bp, Artificial Sequence
  chemically synthesized
ataggaaacatgtaaaaaca

SEQ ID NO: 251072 - DNA, 20 bp, Artificial Sequence
  chemically synthesized
ttgtttttacatgtttccta

SEQ ID NO: 251073 - DNA, 20 bp, Artificial Sequence
  chemically synthesized
tgtttttacatgtttcctat

SEQ ID NO: 251074 - DNA, 20 bp, Artificial Sequence
  chemically synthesized
tgcttataaaatatacctat

SEQ ID NO: 251075 - DNA, 20 bp, Artificial Sequence
  chemically synthesized
ctgcttataaaatataccta

SEQ ID NO: 251076 - DNA, 20 bp, Artificial Sequence
  chemically synthesized
ttcctataggtatattttat

SEQ ID NO: 251077 - DNA, 20 bp, Artificial Sequence
  chemically synthesized
ctataggtatattttataag

SEQ ID NO: 251078 - DNA, 20 bp, Artificial Sequence
  chemically synthesized
aggtatattttataagcagt

SEQ ID NO: 251079 - DNA, 20 bp, Artificial Sequence
  chemically synthesized
gttttcattgattttcgggt

SEQ ID NO: 251080 - DNA, 20 bp, Artificial Sequence
  chemically synthesized
agttttcattgattttcggg

SEQ ID NO: 251081 - DNA, 20 bp, Artificial Sequence
  chemically synthesized
ttcagttttcattgattttc

SEQ ID NO: 251082 - DNA, 20 bp, Artificial Sequence
  chemically synthesized
attcagttttcattgatttt

SEQ ID NO: 251083 - DNA, 20 bp, Artificial Sequence
  chemically synthesized
aaatcaatgaaaactgaatt

SEQ ID NO: 251084 - DNA, 20 bp, Artificial Sequence
  chemically synthesized
tcaatgaaaactgaatttag

SEQ ID NO: 251085 - DNA, 20 bp, Artificial Sequence
  chemically synthesized
attaatattactgctaaatt

SEQ ID NO: 251086 - DNA, 20 bp, Artificial Sequence
  chemically synthesized
agtaatattaatttcccaaa

SEQ ID NO: 251087 - DNA, 20 bp, Artificial Sequence
  chemically synthesized
agattactagttaacttttt

SEQ ID NO: 251088 - DNA, 20 bp, Artificial Sequence
  chemically synthesized
aagattactagttaactttt

SEQ ID NO: 251089 - DNA, 20 bp, Artificial Sequence
  chemically synthesized
taatttcccaaaaagttaac

SEQ ID NO: 251090 - DNA, 20 bp, Artificial Sequence
  chemically synthesized
atgcctatatgtaagattac

SEQ ID NO: 251091 - DNA, 20 bp, Artificial Sequence
  chemically synthesized
ttaactagtaatcttacata

SEQ ID NO: 251092 - DNA, 20 bp, Artificial Sequence
  chemically synthesized
taactagtaatcttacatat

SEQ ID NO: 251093 - DNA, 20 bp, Artificial Sequence
  chemically synthesized
ggatagatatgcctatatgt

SEQ ID NO: 251094 - DNA, 20 bp, Artificial Sequence
  chemically synthesized
aagcaccatgaacgtatgga

SEQ ID NO: 251095 - DNA, 20 bp, Artificial Sequence
  chemically synthesized
ccacaagcaccatgaacgta

SEQ ID NO: 251096 - DNA, 20 bp, Artificial Sequence
  chemically synthesized
catatctatccatacgttca

SEQ ID NO: 251097 - DNA, 20 bp, Artificial Sequence
  chemically synthesized
ccatacgttcatggtgcttg

SEQ ID NO: 251098 - DNA, 20 bp, Artificial Sequence
  chemically synthesized
acagtcaacagtaaatccac

SEQ ID NO: 251099 - DNA, 20 bp, Artificial Sequence
  chemically synthesized
ctaacagtcaacacagtcaa

SEQ ID NO: 251100 - DNA, 20 bp, Artificial Sequence
  chemically synthesized
ttgttcactaacagtcaaca

SEQ ID NO: 251101 - DNA, 20 bp, Artificial Sequence
  chemically synthesized
ctgttgactgtgttgactgt

SEQ ID NO: 251102 - DNA, 20 bp, Artificial Sequence
  chemically synthesized
acattctgattgttcactaa

SEQ ID NO: 251103 - DNA, 20 bp, Artificial Sequence
  chemically synthesized
gttgactgttagtgaacaat

SEQ ID NO: 251104 - DNA, 20 bp, Artificial Sequence
  chemically synthesized
atcagaatgtccgtgaaaat

SEQ ID NO: 251105 - DNA, 20 bp, Artificial Sequence
  chemically synthesized
tattaaaagccttattttca

SEQ ID NO: 251106 - DNA, 20 bp, Artificial Sequence
  chemically synthesized
tcagaatgtccgtgaaaata

SEQ ID NO: 251107 - DNA, 20 bp, Artificial Sequence
  chemically synthesized
acacatcatcaaagtattaa

SEQ ID NO: 251108 - DNA, 20 bp, Artificial Sequence
  chemically synthesized
caacaagttacacatcatca

SEQ ID NO: 251109 - DNA, 20 bp, Artificial Sequence
  chemically synthesized
ttgatgatgtgtaacttgtt

SEQ ID NO: 251110 - DNA, 20 bp, Artificial Sequence
  chemically synthesized
atttcaacatgtatctcaac

SEQ ID NO: 251111 - DNA, 20 bp, Artificial Sequence
  chemically synthesized
atacattgtctttcagcaaa

SEQ ID NO: 251112 - DNA, 20 bp, Artificial Sequence
  chemically synthesized
gttgaaattctatttgctga

SEQ ID NO: 251113 - DNA, 20 bp, Artificial Sequence
  chemically synthesized
tgcttccatacattgtcttt

SEQ ID NO: 251114 - DNA, 20 bp, Artificial Sequence
  chemically synthesized
atttgctgaaagacaatgta

SEQ ID NO: 251115 - DNA, 20 bp, Artificial Sequence
  chemically synthesized
tgctgaaagacaatgtatgg

SEQ ID NO: 251116 - DNA, 20 bp, Artificial Sequence
  chemically synthesized
tgaaagacaatgtatggaag

SEQ ID NO: 251117 - DNA, 20 bp, Artificial Sequence
  chemically synthesized
gaaagacaatgtatggaagc

SEQ ID NO: 251118 - DNA, 20 bp, Artificial Sequence
  chemically synthesized
atgtatggaagcaggtatgt

SEQ ID NO: 251119 - DNA, 20 bp, Artificial Sequence
  chemically synthesized
aggtatgttagataatgaat

SEQ ID NO: 251120 - DNA, 20 bp, Artificial Sequence
  chemically synthesized
tatgttagataatgaatgag

SEQ ID NO: 251121 - DNA, 20 bp, Artificial Sequence
  chemically synthesized
atgaatgagcagtcataaat

SEQ ID NO: 251122 - DNA, 20 bp, Artificial Sequence
  chemically synthesized
tgagcagtcataaattagtc

SEQ ID NO: 251123 - DNA, 20 bp, Artificial Sequence
  chemically synthesized
caggaagatatttaaaaagc

SEQ ID NO: 251124 - DNA, 20 bp, Artificial Sequence
  chemically synthesized
agaacaggaagatatttaaa

SEQ ID NO: 251125 - DNA, 20 bp, Artificial Sequence
  chemically synthesized
acgctttagatgagaacagg

SEQ ID NO: 251126 - DNA, 20 bp, Artificial Sequence
  chemically synthesized
attacgctttagatgagaac

SEQ ID NO: 251127 - DNA, 20 bp, Artificial Sequence
  chemically synthesized
cattacgctttagatgagaa

SEQ ID NO: 251128 - DNA, 20 bp, Artificial Sequence
  chemically synthesized
tatcttcctgttctcatcta

SEQ ID NO: 251129 - DNA, 20 bp, Artificial Sequence
  chemically synthesized
acagacattacgctttagat

SEQ ID NO: 251130 - DNA, 20 bp, Artificial Sequence
  chemically synthesized
gtaaaacagacattacgctt

SEQ ID NO: 251131 - DNA, 20 bp, Artificial Sequence
  chemically synthesized
ttaaatgtcataaggtaaaa

SEQ ID NO: 251132 - DNA, 20 bp, Artificial Sequence
  chemically synthesized
catctctattaaatgtcata

SEQ ID NO: 251133 - DNA, 20 bp, Artificial Sequence
  chemically synthesized
tcatctctattaaatgtcat

SEQ ID NO: 251134 - DNA, 20 bp, Artificial Sequence
  chemically synthesized
ttttaccttatgacatttaa

SEQ ID NO: 251135 - DNA, 20 bp, Artificial Sequence
  chemically synthesized
ttaccttatgacatttaata

SEQ ID NO: 251136 - DNA, 20 bp, Artificial Sequence
  chemically synthesized
tttaatagagatgactgaac

SEQ ID NO: 251137 - DNA, 20 bp, Artificial Sequence
  chemically synthesized
acatctgcgtatttctcgtt

SEQ ID NO: 251138 - DNA, 20 bp, Artificial Sequence
  chemically synthesized
atgactgaacgagaaatacg

SEQ ID NO: 251139 - DNA, 20 bp, Artificial Sequence
  chemically synthesized
aaatacgcagatgtactatt

SEQ ID NO: 251140 - DNA, 20 bp, Artificial Sequence
  chemically synthesized
ttgcctaagcacatactaaa

SEQ ID NO: 251141 - DNA, 20 bp, Artificial Sequence
  chemically synthesized
tgtactatttagtatgtgct

SEQ ID NO: 251142 - DNA, 20 bp, Artificial Sequence
  chemically synthesized
gtactatttagtatgtgctt

SEQ ID NO: 251143 - DNA, 20 bp, Artificial Sequence
  chemically synthesized
tatttagtatgtgcttaggc

SEQ ID NO: 251144 - DNA, 20 bp, Artificial Sequence
  chemically synthesized
agatgttatgtgacttgcct

SEQ ID NO: 251145 - DNA, 20 bp, Artificial Sequence
  chemically synthesized
cacataacatctttgaaata

SEQ ID NO: 251146 - DNA, 20 bp, Artificial Sequence
  chemically synthesized
agggagaaaactatatttca

SEQ ID NO: 251147 - DNA, 20 bp, Artificial Sequence
  chemically synthesized
tgcttcattattttataagg

SEQ ID NO: 251148 - DNA, 20 bp, Artificial Sequence
  chemically synthesized
cctgcttcattattttataa

SEQ ID NO: 251149 - DNA, 20 bp, Artificial Sequence
  chemically synthesized
ccctgcttcattattttata

SEQ ID NO: 251150 - DNA, 20 bp, Artificial Sequence
  chemically synthesized
gccctgcttcattattttat

SEQ ID NO: 251151 - DNA, 20 bp, Artificial Sequence
  chemically synthesized
ttctcccttataaaataatg

SEQ ID NO: 251152 - DNA, 20 bp, Artificial Sequence
  chemically synthesized
tcccttataaaataatgaag

SEQ ID NO: 251153 - DNA, 20 bp, Artificial Sequence
  chemically synthesized
cccttataaaataatgaagc

SEQ ID NO: 251154 - DNA, 20 bp, Artificial Sequence
  chemically synthesized
ccttataaaataatgaagca

SEQ ID NO: 251155 - DNA, 20 bp, Artificial Sequence
  chemically synthesized
tgaagcagggcaaaaccact

SEQ ID NO: 251156 - DNA, 20 bp, Artificial Sequence
  chemically synthesized
gaagcagggcaaaaccacta

SEQ ID NO: 251157 - DNA, 20 bp, Artificial Sequence
  chemically synthesized
acagctagaaaatgccttag

SEQ ID NO: 251158 - DNA, 20 bp, Artificial Sequence
  chemically synthesized
tttacagctagaaaatgcct

SEQ ID NO: 251159 - DNA, 20 bp, Artificial Sequence
  chemically synthesized
aaaaccactaaggcattttc

SEQ ID NO: 251160 - DNA, 20 bp, Artificial Sequence
  chemically synthesized
taacaggattgttttacagc

SEQ ID NO: 251161 - DNA, 20 bp, Artificial Sequence
  chemically synthesized
tttataacaggattgtttta

SEQ ID NO: 251162 - DNA, 20 bp, Artificial Sequence
  chemically synthesized
gatagttaataatttataac

SEQ ID NO: 251163 - DNA, 20 bp, Artificial Sequence
  chemically synthesized
agatagttaataatttataa

SEQ ID NO: 251164 - DNA, 20 bp, Artificial Sequence
  chemically synthesized
ataattcaaattattagaga

SEQ ID NO: 251165 - DNA, 20 bp, Artificial Sequence
  chemically synthesized
aaccataattcaaattatta

SEQ ID NO: 251166 - DNA, 20 bp, Artificial Sequence
  chemically synthesized
tgaaccataattcaaattat

SEQ ID NO: 251167 - DNA, 20 bp, Artificial Sequence
  chemically synthesized
atctctaataatttgaatta

SEQ ID NO: 251168 - DNA, 20 bp, Artificial Sequence
  chemically synthesized
taataatttgaattatggtt

SEQ ID NO: 251169 - DNA, 20 bp, Artificial Sequence
  chemically synthesized
tcctacagtggaagggggga

SEQ ID NO: 251170 - DNA, 20 bp, Artificial Sequence
  chemically synthesized
cttcctacagtggaaggggg

SEQ ID NO: 251171 - DNA, 20 bp, Artificial Sequence
  chemically synthesized
ctcttcctacagtggaaggg

SEQ ID NO: 251172 - DNA, 20 bp, Artificial Sequence
  chemically synthesized
actcttcctacagtggaagg

SEQ ID NO: 251173 - DNA, 20 bp, Artificial Sequence
  chemically synthesized
gactcttcctacagtggaag

SEQ ID NO: 251174 - DNA, 20 bp, Artificial Sequence
  chemically synthesized
agactcttcctacagtggaa

SEQ ID NO: 251175 - DNA, 20 bp, Artificial Sequence
  chemically synthesized
atctctccccccttccactg

SEQ ID NO: 251176 - DNA, 20 bp, Artificial Sequence
  chemically synthesized
tagactcttcctacagtgga

SEQ ID NO: 251177 - DNA, 20 bp, Artificial Sequence
  chemically synthesized
tctctccccccttccactgt

SEQ ID NO: 251178 - DNA, 20 bp, Artificial Sequence
  chemically synthesized
gtagactcttcctacagtgg

SEQ ID NO: 251179 - DNA, 20 bp, Artificial Sequence
  chemically synthesized
ctccccccttccactgtagg

SEQ ID NO: 251180 - DNA, 20 bp, Artificial Sequence
  chemically synthesized
aaagtagactcttcctacag

SEQ ID NO: 251181 - DNA, 20 bp, Artificial Sequence
  chemically synthesized
ccccccttccactgtaggaa

SEQ ID NO: 251182 - DNA, 20 bp, Artificial Sequence
  chemically synthesized
gagaaagtagactcttccta

SEQ ID NO: 251183 - DNA, 20 bp, Artificial Sequence
  chemically synthesized
acatcaatagaatgagaaag

SEQ ID NO: 251184 - DNA, 20 bp, Artificial Sequence
  chemically synthesized
ctgacatcaatagaatgaga

SEQ ID NO: 251185 - DNA, 20 bp, Artificial Sequence
  chemically synthesized
aaatctgacatcaatagaat

SEQ ID NO: 251186 - DNA, 20 bp, Artificial Sequence
  chemically synthesized
ctttctcattctattgatgt

SEQ ID NO: 251187 - DNA, 20 bp, Artificial Sequence
  chemically synthesized
gttgccaaatctgacatcaa

SEQ ID NO: 251188 - DNA, 20 bp, Artificial Sequence
  chemically synthesized
cattctattgatgtcagatt

SEQ ID NO: 251189 - DNA, 20 bp, Artificial Sequence
  chemically synthesized
tttggcaacgtaatttgctt

SEQ ID NO: 251190 - DNA, 20 bp, Artificial Sequence
  chemically synthesized
cactgacatttgattggcca

SEQ ID NO: 251191 - DNA, 20 bp, Artificial Sequence
  chemically synthesized
gaagttcactgacatttgat

SEQ ID NO: 251192 - DNA, 20 bp, Artificial Sequence
  chemically synthesized
tgctttggccaatcaaatgt

SEQ ID NO: 251193 - DNA, 20 bp, Artificial Sequence
  chemically synthesized
tcaaatgtcagtgaacttca

SEQ ID NO: 251194 - DNA, 20 bp, Artificial Sequence
  chemically synthesized
caaatgtcagtgaacttcac

SEQ ID NO: 251195 - DNA, 20 bp, Artificial Sequence
  chemically synthesized
aatgtcagtgaacttcacag

SEQ ID NO: 251196 - DNA, 20 bp, Artificial Sequence
  chemically synthesized
tcatggcctctgctcctgtg

SEQ ID NO: 251197 - DNA, 20 bp, Artificial Sequence
  chemically synthesized
gtcagtgaacttcacaggag

SEQ ID NO: 251198 - DNA, 20 bp, Artificial Sequence
  chemically synthesized
cagtgaacttcacaggagca

SEQ ID NO: 251199 - DNA, 20 bp, Artificial Sequence
  chemically synthesized
agtgaacttcacaggagcag

SEQ ID NO: 251200 - DNA, 20 bp, Artificial Sequence
  chemically synthesized
ttcacaggagcagaggccat

SEQ ID NO: 251201 - DNA, 20 bp, Artificial Sequence
  chemically synthesized
aaacctcccaagaacactca

SEQ ID NO: 251202 - DNA, 20 bp, Artificial Sequence
  chemically synthesized
gcagaggccatgagtgttct

SEQ ID NO: 251203 - DNA, 20 bp, Artificial Sequence
  chemically synthesized
cagaggccatgagtgttctt

SEQ ID NO: 251204 - DNA, 20 bp, Artificial Sequence
  chemically synthesized
gaggccatgagtgttcttgg

SEQ ID NO: 251205 - DNA, 20 bp, Artificial Sequence
  chemically synthesized
aggccatgagtgttcttggg

SEQ ID NO: 251206 - DNA, 20 bp, Artificial Sequence
  chemically synthesized
agtataaacctaaacctccc

SEQ ID NO: 251207 - DNA, 20 bp, Artificial Sequence
  chemically synthesized
atgagtgttcttgggaggtt

SEQ ID NO: 251208 - DNA, 20 bp, Artificial Sequence
  chemically synthesized
tgagtgttcttgggaggttt

SEQ ID NO: 251209 - DNA, 20 bp, Artificial Sequence
  chemically synthesized
ggaggtttaggtttatactt

SEQ ID NO: 251210 - DNA, 20 bp, Artificial Sequence
  chemically synthesized
taggtttatactttggtgac

SEQ ID NO: 251211 - DNA, 20 bp, Artificial Sequence
  chemically synthesized
gttttcatgaccagtcacca

SEQ ID NO: 251212 - DNA, 20 bp, Artificial Sequence
  chemically synthesized
cagtgacatgttttcatgac

SEQ ID NO: 251213 - DNA, 20 bp, Artificial Sequence
  chemically synthesized
ctggacctaagatgaagggt

SEQ ID NO: 251214 - DNA, 20 bp, Artificial Sequence
  chemically synthesized
atgtcactgacccttcatct

SEQ ID NO: 251215 - DNA, 20 bp, Artificial Sequence
  chemically synthesized
tgctctggacctaagatgaa

SEQ ID NO: 251216 - DNA, 20 bp, Artificial Sequence
  chemically synthesized
tgtcactgacccttcatctt

SEQ ID NO: 251217 - DNA, 20 bp, Artificial Sequence
  chemically synthesized
ttgctctggacctaagatga

SEQ ID NO: 251218 - DNA, 20 bp, Artificial Sequence
  chemically synthesized
tttgctctggacctaagatg

SEQ ID NO: 251219 - DNA, 20 bp, Artificial Sequence
  chemically synthesized
ctgacccttcatcttaggtc

SEQ ID NO: 251220 - DNA, 20 bp, Artificial Sequence
  chemically synthesized
gacccttcatcttaggtcca

SEQ ID NO: 251221 - DNA, 20 bp, Artificial Sequence
  chemically synthesized
tatgtctttgctctggacct

SEQ ID NO: 251222 - DNA, 20 bp, Artificial Sequence
  chemically synthesized
ttcatcttaggtccagagca

SEQ ID NO: 251223 - DNA, 20 bp, Artificial Sequence
  chemically synthesized
tgctatatatgtctttgctc

SEQ ID NO: 251224 - DNA, 20 bp, Artificial Sequence
  chemically synthesized
gtccagagcaaagacatata

SEQ ID NO: 251225 - DNA, 20 bp, Artificial Sequence
  chemically synthesized
cagagcaaagacatatatag

SEQ ID NO: 251226 - DNA, 20 bp, Artificial Sequence
  chemically synthesized
ccatgatgcatgttggatta

SEQ ID NO: 251227 - DNA, 20 bp, Artificial Sequence
  chemically synthesized
tccatgatgcatgttggatt

SEQ ID NO: 251228 - DNA, 20 bp, Artificial Sequence
  chemically synthesized
ctaggttccatgatgcatgt

SEQ ID NO: 251229 - DNA, 20 bp, Artificial Sequence
  chemically synthesized
ccttaatccaacatgcatca

SEQ ID NO: 251230 - DNA, 20 bp, Artificial Sequence
  chemically synthesized
ccaacatgcatcatggaacc

SEQ ID NO: 251231 - DNA, 20 bp, Artificial Sequence
  chemically synthesized
agatgtgggttagtagagct

SEQ ID NO: 251232 - DNA, 20 bp, Artificial Sequence
  chemically synthesized
aagatgtgggttagtagagc

SEQ ID NO: 251233 - DNA, 20 bp, Artificial Sequence
  chemically synthesized
cttcaagatgtgggttagta

SEQ ID NO: 251234 - DNA, 20 bp, Artificial Sequence
  chemically synthesized
tgcttcaagatgtgggttag

SEQ ID NO: 251235 - DNA, 20 bp, Artificial Sequence
  chemically synthesized
ctctgcttcaagatgtgggt

SEQ ID NO: 251236 - DNA, 20 bp, Artificial Sequence
  chemically synthesized
gaagctctgcttcaagatgt

SEQ ID NO: 251237 - DNA, 20 bp, Artificial Sequence
  chemically synthesized
ctctactaacccacatcttg

SEQ ID NO: 251238 - DNA, 20 bp, Artificial Sequence
  chemically synthesized
ggaagctctgcttcaagatg

SEQ ID NO: 251239 - DNA, 20 bp, Artificial Sequence
  chemically synthesized
tactaacccacatcttgaag

SEQ ID NO: 251240 - DNA, 20 bp, Artificial Sequence
  chemically synthesized
ctaacccacatcttgaagca

SEQ ID NO: 251241 - DNA, 20 bp, Artificial Sequence
  chemically synthesized
tggccgggaagctctgcttc

SEQ ID NO: 251242 - DNA, 20 bp, Artificial Sequence
  chemically synthesized
catcttgaagcagagcttcc

SEQ ID NO: 251243 - DNA, 20 bp, Artificial Sequence
  chemically synthesized
tgaagcagagcttcccggcc

SEQ ID NO: 251244 - DNA, 20 bp, Artificial Sequence
  chemically synthesized
ctcagctgggcttggccggg

SEQ ID NO: 251245 - DNA, 20 bp, Artificial Sequence
  chemically synthesized
tgactcagctgggcttggcc

SEQ ID NO: 251246 - DNA, 20 bp, Artificial Sequence
  chemically synthesized
ctgactcagctgggcttggc

SEQ ID NO: 251247 - DNA, 20 bp, Artificial Sequence
  chemically synthesized
cagagcttcccggccaagcc

SEQ ID NO: 251248 - DNA, 20 bp, Artificial Sequence
  chemically synthesized
ttgactgactcagctgggct

SEQ ID NO: 251249 - DNA, 20 bp, Artificial Sequence
  chemically synthesized
cttcccggccaagcccagct

SEQ ID NO: 251250 - DNA, 20 bp, Artificial Sequence
  chemically synthesized
gtaccttgactgactcagct

SEQ ID NO: 251251 - DNA, 20 bp, Artificial Sequence
  chemically synthesized
ccggccaagcccagctgagt

SEQ ID NO: 251252 - DNA, 20 bp, Artificial Sequence
  chemically synthesized
tgtaccttgactgactcagc

SEQ ID NO: 251253 - DNA, 20 bp, Artificial Sequence
  chemically synthesized
tacttgtaccttgactgact

SEQ ID NO: 251254 - DNA, 20 bp, Artificial Sequence
  chemically synthesized
caagcccagctgagtcagtc

SEQ ID NO: 251255 - DNA, 20 bp, Artificial Sequence
  chemically synthesized
aagcccagctgagtcagtca

SEQ ID NO: 251256 - DNA, 20 bp, Artificial Sequence
  chemically synthesized
agctgagtcagtcaaggtac

SEQ ID NO: 251257 - DNA, 20 bp, Artificial Sequence
  chemically synthesized
caaggtacaagtaacctaaa

SEQ ID NO: 251258 - DNA, 20 bp, Artificial Sequence
  chemically synthesized
gtacaagtaacctaaacagc

SEQ ID NO: 251259 - DNA, 20 bp, Artificial Sequence
  chemically synthesized
acaggcatttctggctgttt

SEQ ID NO: 251260 - DNA, 20 bp, Artificial Sequence
  chemically synthesized
aacaggcatttctggctgtt

SEQ ID NO: 251261 - DNA, 20 bp, Artificial Sequence
  chemically synthesized
ctgaaaacaacaggcatttc

SEQ ID NO: 251262 - DNA, 20 bp, Artificial Sequence
  chemically synthesized
acttgctgactgaaaacaac

SEQ ID NO: 251263 - DNA, 20 bp, Artificial Sequence
  chemically synthesized
ccagaaatgcctgttgtttt

SEQ ID NO: 251264 - DNA, 20 bp, Artificial Sequence
  chemically synthesized
aacttgctgactgaaaacaa

SEQ ID NO: 251265 - DNA, 20 bp, Artificial Sequence
  chemically synthesized
aaatgcctgttgttttcagt

SEQ ID NO: 251266 - DNA, 20 bp, Artificial Sequence
  chemically synthesized
gcctgttgttttcagtcagc

SEQ ID NO: 251267 - DNA, 20 bp, Artificial Sequence
  chemically synthesized
tgttttcagtcagcaagttc

SEQ ID NO: 251268 - DNA, 20 bp, Artificial Sequence
  chemically synthesized
gttttcagtcagcaagttct

SEQ ID NO: 251269 - DNA, 20 bp, Artificial Sequence
  chemically synthesized
ttttcagtcagcaagttcta

SEQ ID NO: 251270 - DNA, 20 bp, Artificial Sequence
  chemically synthesized
tgctgtgacacaaatcaccc

SEQ ID NO: 251271 - DNA, 20 bp, Artificial Sequence
  chemically synthesized
ttctagggtgatttgtgtca

SEQ ID NO: 251272 - DNA, 20 bp, Artificial Sequence
  chemically synthesized
tttgtgtcacagcattattg

SEQ ID NO: 251273 - DNA, 20 bp, Artificial Sequence
  chemically synthesized
tcacagcattattgcggtca

SEQ ID NO: 251274 - DNA, 20 bp, Artificial Sequence
  chemically synthesized
tggtacatgtatggtagtat

SEQ ID NO: 251275 - DNA, 20 bp, Artificial Sequence
  chemically synthesized
cttaaatggtacatgtatgg

SEQ ID NO: 251276 - DNA, 20 bp, Artificial Sequence
  chemically synthesized
tttcttaaatggtacatgta

SEQ ID NO: 251277 - DNA, 20 bp, Artificial Sequence
  chemically synthesized
ctaccatacatgtaccattt

SEQ ID NO: 251278 - DNA, 20 bp, Artificial Sequence
  chemically synthesized
atattggtatttttcttaaa

SEQ ID NO: 251279 - DNA, 20 bp, Artificial Sequence
  chemically synthesized
atttaagaaaaataccaata

SEQ ID NO: 251280 - DNA, 20 bp, Artificial Sequence
  chemically synthesized
gctagtaagaagggctatat

SEQ ID NO: 251281 - DNA, 20 bp, Artificial Sequence
  chemically synthesized
accaatatagcccttcttac

SEQ ID NO: 251282 - DNA, 20 bp, Artificial Sequence
  chemically synthesized
taaatttgagctagtaagaa

SEQ ID NO: 251283 - DNA, 20 bp, Artificial Sequence
  chemically synthesized
ataaatttgagctagtaaga

SEQ ID NO: 251284 - DNA, 20 bp, Artificial Sequence
  chemically synthesized
aataaatttgagctagtaag

SEQ ID NO: 251285 - DNA, 20 bp, Artificial Sequence
  chemically synthesized
caaaataaatttgagctagt

SEQ ID NO: 251286 - DNA, 20 bp, Artificial Sequence
  chemically synthesized
aaatcaaaataaatttgagc

SEQ ID NO: 251287 - DNA, 20 bp, Artificial Sequence
  chemically synthesized
ggttaaatcaaaataaattt

SEQ ID NO: 251288 - DNA, 20 bp, Artificial Sequence
  chemically synthesized
tattttgatttaacccaaat

SEQ ID NO: 251289 - DNA, 20 bp, Artificial Sequence
  chemically synthesized
gttttttagtaagccaattt

SEQ ID NO: 251290 - DNA, 20 bp, Artificial Sequence
  chemically synthesized
agttttttagtaagccaatt

SEQ ID NO: 251291 - DNA, 20 bp, Artificial Sequence
  chemically synthesized
aatctgctgagttttttagt

SEQ ID NO: 251292 - DNA, 20 bp, Artificial Sequence
  chemically synthesized
aattggcttactaaaaaact

SEQ ID NO: 251293 - DNA, 20 bp, Artificial Sequence
  chemically synthesized
caaaaatctgctgagttttt

SEQ ID NO: 251294 - DNA, 20 bp, Artificial Sequence
  chemically synthesized
tggcttactaaaaaactcag

SEQ ID NO: 251295 - DNA, 20 bp, Artificial Sequence
  chemically synthesized
gttctcaacaaaaatctgct

SEQ ID NO: 251296 - DNA, 20 bp, Artificial Sequence
  chemically synthesized
aaactcagcagatttttgtt

SEQ ID NO: 251297 - DNA, 20 bp, Artificial Sequence
  chemically synthesized
tttgttgagaacaccacatg

SEQ ID NO: 251298 - DNA, 20 bp, Artificial Sequence
  chemically synthesized
ttgttgagaacaccacatga

SEQ ID NO: 251299 - DNA, 20 bp, Artificial Sequence
  chemically synthesized
tgttcagtacagccttcatg

SEQ ID NO: 251300 - DNA, 20 bp, Artificial Sequence
  chemically synthesized
gaatacacaaatgttcagta

SEQ ID NO: 251301 - DNA, 20 bp, Artificial Sequence
  chemically synthesized
ttcctgaatacacaaatgtt

SEQ ID NO: 251302 - DNA, 20 bp, Artificial Sequence
  chemically synthesized
gtactgaacatttgtgtatt

SEQ ID NO: 251303 - DNA, 20 bp, Artificial Sequence
  chemically synthesized
tactgaacatttgtgtattc

SEQ ID NO: 251304 - DNA, 20 bp, Artificial Sequence
  chemically synthesized
tttgtgtattcaggaatgca

SEQ ID NO: 251305 - DNA, 20 bp, Artificial Sequence
  chemically synthesized
gaatccttggagagatttag

SEQ ID NO: 251306 - DNA, 20 bp, Artificial Sequence
  chemically synthesized
cttgaatccttggagagatt

SEQ ID NO: 251307 - DNA, 20 bp, Artificial Sequence
  chemically synthesized
catagcttctaaatctctcc

SEQ ID NO: 251308 - DNA, 20 bp, Artificial Sequence
  chemically synthesized
atagcttctaaatctctcca

SEQ ID NO: 251309 - DNA, 20 bp, Artificial Sequence
  chemically synthesized
tagattcttgaatccttgga

SEQ ID NO: 251310 - DNA, 20 bp, Artificial Sequence
  chemically synthesized
ggtagattcttgaatccttg

SEQ ID NO: 251311 - DNA, 20 bp, Artificial Sequence
  chemically synthesized
ctaaatctctccaaggattc

SEQ ID NO: 251312 - DNA, 20 bp, Artificial Sequence
  chemically synthesized
atggtagattcttgaatcct

SEQ ID NO: 251313 - DNA, 20 bp, Artificial Sequence
  chemically synthesized
tactaagtcccatacaatgg

SEQ ID NO: 251314 - DNA, 20 bp, Artificial Sequence
  chemically synthesized
ttcaagaatctaccattgta

SEQ ID NO: 251315 - DNA, 20 bp, Artificial Sequence
  chemically synthesized
tcaagaatctaccattgtat

SEQ ID NO: 251316 - DNA, 20 bp, Artificial Sequence
  chemically synthesized
tcctactaagtcccatacaa

SEQ ID NO: 251317 - DNA, 20 bp, Artificial Sequence
  chemically synthesized
atctaccattgtatgggact

SEQ ID NO: 251318 - DNA, 20 bp, Artificial Sequence
  chemically synthesized
taccattgtatgggacttag

SEQ ID NO: 251319 - DNA, 20 bp, Artificial Sequence
  chemically synthesized
accattgtatgggacttagt

SEQ ID NO: 251320 - DNA, 20 bp, Artificial Sequence
  chemically synthesized
tcaacacctcgtgtcctact

SEQ ID NO: 251321 - DNA, 20 bp, Artificial Sequence
  chemically synthesized
tatgggacttagtaggacac

SEQ ID NO: 251322 - DNA, 20 bp, Artificial Sequence
  chemically synthesized
atgggacttagtaggacacg

SEQ ID NO: 251323 - DNA, 20 bp, Artificial Sequence
  chemically synthesized
tttgttcttcattgtagtgg

SEQ ID NO: 251324 - DNA, 20 bp, Artificial Sequence
  chemically synthesized
gaatttgttcttcattgtag

SEQ ID NO: 251325 - DNA, 20 bp, Artificial Sequence
  chemically synthesized
tgttgactgccactacaatg

SEQ ID NO: 251326 - DNA, 20 bp, Artificial Sequence
  chemically synthesized
gctgaatttgttcttcattg

SEQ ID NO: 251327 - DNA, 20 bp, Artificial Sequence
  chemically synthesized
actacaatgaagaacaaatt

SEQ ID NO: 251328 - DNA, 20 bp, Artificial Sequence
  chemically synthesized
cagagatcagggaaaataaa

SEQ ID NO: 251329 - DNA, 20 bp, Artificial Sequence
  chemically synthesized
tatttattttccctgatctc

SEQ ID NO: 251330 - DNA, 20 bp, Artificial Sequence
  chemically synthesized
gttcttattgccagagatca

SEQ ID NO: 251331 - DNA, 20 bp, Artificial Sequence
  chemically synthesized
ggttcttattgccagagatc

SEQ ID NO: 251332 - DNA, 20 bp, Artificial Sequence
  chemically synthesized
aggttcttattgccagagat

SEQ ID NO: 251333 - DNA, 20 bp, Artificial Sequence
  chemically synthesized
tttccctgatctctggcaat

SEQ ID NO: 251334 - DNA, 20 bp, Artificial Sequence
  chemically synthesized
gaactaggttcttattgcca

SEQ ID NO: 251335 - DNA, 20 bp, Artificial Sequence
  chemically synthesized
cagaactaggttcttattgc

SEQ ID NO: 251336 - DNA, 20 bp, Artificial Sequence
  chemically synthesized
gatctctggcaataagaacc

SEQ ID NO: 251337 - DNA, 20 bp, Artificial Sequence
  chemically synthesized
gcaataagaacctagttctg

SEQ ID NO: 251338 - DNA, 20 bp, Artificial Sequence
  chemically synthesized
caggtttaggccacagaact

SEQ ID NO: 251339 - DNA, 20 bp, Artificial Sequence
  chemically synthesized
acaggtttaggccacagaac

SEQ ID NO: 251340 - DNA, 20 bp, Artificial Sequence
  chemically synthesized
tacaatacaggtttaggcca

SEQ ID NO: 251341 - DNA, 20 bp, Artificial Sequence
  chemically synthesized
tgctgttacaatacaggttt

SEQ ID NO: 251342 - DNA, 20 bp, Artificial Sequence
  chemically synthesized
ctgctgttacaatacaggtt

SEQ ID NO: 251343 - DNA, 20 bp, Artificial Sequence
  chemically synthesized
gatgactgctgttacaatac

SEQ ID NO: 251344 - DNA, 20 bp, Artificial Sequence
  chemically synthesized
tgatgactgctgttacaata

SEQ ID NO: 251345 - DNA, 20 bp, Artificial Sequence
  chemically synthesized
ggcctaaacctgtattgtaa

SEQ ID NO: 251346 - DNA, 20 bp, Artificial Sequence
  chemically synthesized
ctaaacctgtattgtaacag

SEQ ID NO: 251347 - DNA, 20 bp, Artificial Sequence
  chemically synthesized
taacagcagtcatcaatcta

SEQ ID NO: 251348 - DNA, 20 bp, Artificial Sequence
  chemically synthesized
ctggaattgctgatgggcca

SEQ ID NO: 251349 - DNA, 20 bp, Artificial Sequence
  chemically synthesized
gtcatcaatctatggcccat

SEQ ID NO: 251350 - DNA, 20 bp, Artificial Sequence
  chemically synthesized
ggcaggctggaattgctgat

SEQ ID NO: 251351 - DNA, 20 bp, Artificial Sequence
  chemically synthesized
tggcaggctggaattgctga

SEQ ID NO: 251352 - DNA, 20 bp, Artificial Sequence
  chemically synthesized
ctatggcccatcagcaattc

SEQ ID NO: 251353 - DNA, 20 bp, Artificial Sequence
  chemically synthesized
taccaaggcagatggcaggc

SEQ ID NO: 251354 - DNA, 20 bp, Artificial Sequence
  chemically synthesized
tatttaccaaggcagatggc

SEQ ID NO: 251355 - DNA, 20 bp, Artificial Sequence
  chemically synthesized
ttatttaccaaggcagatgg

SEQ ID NO: 251356 - DNA, 20 bp, Artificial Sequence
  chemically synthesized
ttccagcctgccatctgcct

SEQ ID NO: 251357 - DNA, 20 bp, Artificial Sequence
  chemically synthesized
actttatttaccaaggcaga

SEQ ID NO: 251358 - DNA, 20 bp, Artificial Sequence
  chemically synthesized
taaaactttatttaccaagg

SEQ ID NO: 251359 - DNA, 20 bp, Artificial Sequence
  chemically synthesized
aaataaaactttatttacca

SEQ ID NO: 251360 - DNA, 20 bp, Artificial Sequence
  chemically synthesized
taaataaaactttatttacc

SEQ ID NO: 251361 - DNA, 20 bp, Artificial Sequence
  chemically synthesized
gccatctgccttggtaaata

SEQ ID NO: 251362 - DNA, 20 bp, Artificial Sequence
  chemically synthesized
atgtataatatataaatgga

SEQ ID NO: 251363 - DNA, 20 bp, Artificial Sequence
  chemically synthesized
aaccatgtataatatataaa

SEQ ID NO: 251364 - DNA, 20 bp, Artificial Sequence
  chemically synthesized
atccatttatatattataca

SEQ ID NO: 251365 - DNA, 20 bp, Artificial Sequence
  chemically synthesized
tggtttttttcaccctaaaa

SEQ ID NO: 251366 - DNA, 20 bp, Artificial Sequence
  chemically synthesized
tactcaactctgctgtttta

SEQ ID NO: 251367 - DNA, 20 bp, Artificial Sequence
  chemically synthesized
tttttttcaccctaaaacag

SEQ ID NO: 251368 - DNA, 20 bp, Artificial Sequence
  chemically synthesized
ctactcaactctgctgtttt

SEQ ID NO: 251369 - DNA, 20 bp, Artificial Sequence
  chemically synthesized
actactcaactctgctgttt

SEQ ID NO: 251370 - DNA, 20 bp, Artificial Sequence
  chemically synthesized
tttttcaccctaaaacagca

SEQ ID NO: 251371 - DNA, 20 bp, Artificial Sequence
  chemically synthesized
caccctaaaacagcagagtt

SEQ ID NO: 251372 - DNA, 20 bp, Artificial Sequence
  chemically synthesized
cctaaaacagcagagttgag

SEQ ID NO: 251373 - DNA, 20 bp, Artificial Sequence
  chemically synthesized
gcagagttgagtagttgtga

SEQ ID NO: 251374 - DNA, 20 bp, Artificial Sequence
  chemically synthesized
agagttgagtagttgtgaca

SEQ ID NO: 251375 - DNA, 20 bp, Artificial Sequence
  chemically synthesized
ttttgtccctgcaggtcatg

SEQ ID NO: 251376 - DNA, 20 bp, Artificial Sequence
  chemically synthesized
gacagagactacatgacctg

SEQ ID NO: 251377 - DNA, 20 bp, Artificial Sequence
  chemically synthesized
acagagactacatgacctgc

SEQ ID NO: 251378 - DNA, 20 bp, Artificial Sequence
  chemically synthesized
cagagactacatgacctgca

SEQ ID NO: 251379 - DNA, 20 bp, Artificial Sequence
  chemically synthesized
gtcgatatttttgtccctgc

SEQ ID NO: 251380 - DNA, 20 bp, Artificial Sequence
  chemically synthesized
agtcgatatttttgtccctg

SEQ ID NO: 251381 - DNA, 20 bp, Artificial Sequence
  chemically synthesized
tttttctgtaaaggggcagt

SEQ ID NO: 251382 - DNA, 20 bp, Artificial Sequence
  chemically synthesized
tatttttttctgtaaagggg

SEQ ID NO: 251383 - DNA, 20 bp, Artificial Sequence
  chemically synthesized
atcgactaactgccccttta

SEQ ID NO: 251384 - DNA, 20 bp, Artificial Sequence
  chemically synthesized
ggatatttttttctgtaaag

SEQ ID NO: 251385 - DNA, 20 bp, Artificial Sequence
  chemically synthesized
tggatatttttttctgtaaa

SEQ ID NO: 251386 - DNA, 20 bp, Artificial Sequence
  chemically synthesized
atggatatttttttctgtaa

SEQ ID NO: 251387 - DNA, 20 bp, Artificial Sequence
  chemically synthesized
gatggatatttttttctgta

SEQ ID NO: 251388 - DNA, 20 bp, Artificial Sequence
  chemically synthesized
agcatctgatagtcagagga

SEQ ID NO: 251389 - DNA, 20 bp, Artificial Sequence
  chemically synthesized
cagaagcatctgatagtcag

SEQ ID NO: 251390 - DNA, 20 bp, Artificial Sequence
  chemically synthesized
aatatccatcctctgactat

SEQ ID NO: 251391 - DNA, 20 bp, Artificial Sequence
  chemically synthesized
gcagaagcatctgatagtca

SEQ ID NO: 251392 - DNA, 20 bp, Artificial Sequence
  chemically synthesized
tggcagaagcatctgatagt

SEQ ID NO: 251393 - DNA, 20 bp, Artificial Sequence
  chemically synthesized
tctctggcagaagcatctga

SEQ ID NO: 251394 - DNA, 20 bp, Artificial Sequence
  chemically synthesized
tgactatcagatgcttctgc

SEQ ID NO: 251395 - DNA, 20 bp, Artificial Sequence
  chemically synthesized
actatcagatgcttctgcca

SEQ ID NO: 251396 - DNA, 20 bp, Artificial Sequence
  chemically synthesized
acaactagggtctctggcag

SEQ ID NO: 251397 - DNA, 20 bp, Artificial Sequence
  chemically synthesized
tctacaactagggtctctgg

SEQ ID NO: 251398 - DNA, 20 bp, Artificial Sequence
  chemically synthesized
gatgcttctgccagagaccc

SEQ ID NO: 251399 - DNA, 20 bp, Artificial Sequence
  chemically synthesized
cattctacaactagggtctc

SEQ ID NO: 251400 - DNA, 20 bp, Artificial Sequence
  chemically synthesized
tctgccagagaccctagttg

SEQ ID NO: 251401 - DNA, 20 bp, Artificial Sequence
  chemically synthesized
tgtcgctcattctacaacta

SEQ ID NO: 251402 - DNA, 20 bp, Artificial Sequence
  chemically synthesized
gtgtcgctcattctacaact

SEQ ID NO: 251403 - DNA, 20 bp, Artificial Sequence
  chemically synthesized
tgtgtcgctcattctacaac

SEQ ID NO: 251404 - DNA, 20 bp, Artificial Sequence
  chemically synthesized
agagaccctagttgtagaat

SEQ ID NO: 251405 - DNA, 20 bp, Artificial Sequence
  chemically synthesized
gttgtagaatgagcgacaca

SEQ ID NO: 251406 - DNA, 20 bp, Artificial Sequence
  chemically synthesized
tagaatgagcgacacacagc

SEQ ID NO: 251407 - DNA, 20 bp, Artificial Sequence
  chemically synthesized
cacagcaagaataaataatt

SEQ ID NO: 251408 - DNA, 20 bp, Artificial Sequence
  chemically synthesized
ctatcgtcactgcaaaaaaa

SEQ ID NO: 251409 - DNA, 20 bp, Artificial Sequence
  chemically synthesized
atttagatactttttttttg

SEQ ID NO: 251410 - DNA, 20 bp, Artificial Sequence
  chemically synthesized
ctttttttttgcagtgacga

SEQ ID NO: 251411 - DNA, 20 bp, Artificial Sequence
  chemically synthesized
ttttttgcagtgacgatagc

SEQ ID NO: 251412 - DNA, 20 bp, Artificial Sequence
  chemically synthesized
tgacgatagcaagcaatgtc

SEQ ID NO: 251413 - DNA, 20 bp, Artificial Sequence
  chemically synthesized
gcaagcaatgtccagtgcaa

SEQ ID NO: 251414 - DNA, 20 bp, Artificial Sequence
  chemically synthesized
taccaggagcaccattgcac

SEQ ID NO: 251415 - DNA, 20 bp, Artificial Sequence
  chemically synthesized
gtccagtgcaatggtgctcc

SEQ ID NO: 251416 - DNA, 20 bp, Artificial Sequence
  chemically synthesized
gtgcaatggtgctcctggta

SEQ ID NO: 251417 - DNA, 20 bp, Artificial Sequence
  chemically synthesized
agagtccattgctttaccag

SEQ ID NO: 251418 - DNA, 20 bp, Artificial Sequence
  chemically synthesized
ccagagtccattgctttacc

SEQ ID NO: 251419 - DNA, 20 bp, Artificial Sequence
  chemically synthesized
gccagagtccattgctttac

SEQ ID NO: 251420 - DNA, 20 bp, Artificial Sequence
  chemically synthesized
tggtgctcctggtaaagcaa

SEQ ID NO: 251421 - DNA, 20 bp, Artificial Sequence
  chemically synthesized
cctggtaaagcaatggactc

SEQ ID NO: 251422 - DNA, 20 bp, Artificial Sequence
  chemically synthesized
attattttgctgtcatgcca

SEQ ID NO: 251423 - DNA, 20 bp, Artificial Sequence
  chemically synthesized
agcaatggactctggcatga

SEQ ID NO: 251424 - DNA, 20 bp, Artificial Sequence
  chemically synthesized
gaattattttgctgtcatgc

SEQ ID NO: 251425 - DNA, 20 bp, Artificial Sequence
  chemically synthesized
ggcatgacagcaaaataatt

SEQ ID NO: 251426 - DNA, 20 bp, Artificial Sequence
  chemically synthesized
aataattcagatttacctca

SEQ ID NO: 251427 - DNA, 20 bp, Artificial Sequence
  chemically synthesized
atatctactatcaagctatg

SEQ ID NO: 251428 - DNA, 20 bp, Artificial Sequence
  chemically synthesized
tatatctactatcaagctat

SEQ ID NO: 251429 - DNA, 20 bp, Artificial Sequence
  chemically synthesized
agatttacctcatagcttga

SEQ ID NO: 251430 - DNA, 20 bp, Artificial Sequence
  chemically synthesized
tttacctcatagcttgatag

SEQ ID NO: 251431 - DNA, 20 bp, Artificial Sequence
  chemically synthesized
tccagaatatatctactatc

SEQ ID NO: 251432 - DNA, 20 bp, Artificial Sequence
  chemically synthesized
gcttgatagtagatatattc

SEQ ID NO: 251433 - DNA, 20 bp, Artificial Sequence
  chemically synthesized
gtagatatattctggatgcc

SEQ ID NO: 251434 - DNA, 20 bp, Artificial Sequence
  chemically synthesized
ggaagagcaggctaggcatc

SEQ ID NO: 251435 - DNA, 20 bp, Artificial Sequence
  chemically synthesized
ctataaaggaagagcaggct

SEQ ID NO: 251436 - DNA, 20 bp, Artificial Sequence
  chemically synthesized
actataaaggaagagcaggc

SEQ ID NO: 251437 - DNA, 20 bp, Artificial Sequence
  chemically synthesized
agaaactataaaggaagagc

SEQ ID NO: 251438 - DNA, 20 bp, Artificial Sequence
  chemically synthesized
cagaaactataaaggaagag

SEQ ID NO: 251439 - DNA, 20 bp, Artificial Sequence
  chemically synthesized
gggcagaaactataaaggaa

SEQ ID NO: 251440 - DNA, 20 bp, Artificial Sequence
  chemically synthesized
cctagcctgctcttccttta

SEQ ID NO: 251441 - DNA, 20 bp, Artificial Sequence
  chemically synthesized
atgggcagaaactataaagg

SEQ ID NO: 251442 - DNA, 20 bp, Artificial Sequence
  chemically synthesized
acaatgggcagaaactataa

SEQ ID NO: 251443 - DNA, 20 bp, Artificial Sequence
  chemically synthesized
aacaatgggcagaaactata

SEQ ID NO: 251444 - DNA, 20 bp, Artificial Sequence
  chemically synthesized
gagctaggtttaacaatggg

SEQ ID NO: 251445 - DNA, 20 bp, Artificial Sequence
  chemically synthesized
tgagagctaggtttaacaat

SEQ ID NO: 251446 - DNA, 20 bp, Artificial Sequence
  chemically synthesized
ctgagagctaggtttaacaa

SEQ ID NO: 251447 - DNA, 20 bp, Artificial Sequence
  chemically synthesized
tttctgcccattgttaaacc

SEQ ID NO: 251448 - DNA, 20 bp, Artificial Sequence
  chemically synthesized
ccattgttaaacctagctct

SEQ ID NO: 251449 - DNA, 20 bp, Artificial Sequence
  chemically synthesized
cattgttaaacctagctctc

SEQ ID NO: 251450 - DNA, 20 bp, Artificial Sequence
  chemically synthesized
aataggaaagcctgagagct

SEQ ID NO: 251451 - DNA, 20 bp, Artificial Sequence
  chemically synthesized
caataggaaagcctgagagc

SEQ ID NO: 251452 - DNA, 20 bp, Artificial Sequence
  chemically synthesized
gaatcaataggaaagcctga

SEQ ID NO: 251453 - DNA, 20 bp, Artificial Sequence
  chemically synthesized
tggaatcaataggaaagcct

SEQ ID NO: 251454 - DNA, 20 bp, Artificial Sequence
  chemically synthesized
acctcatggaatcaatagga

SEQ ID NO: 251455 - DNA, 20 bp, Artificial Sequence
  chemically synthesized
agatacctcatggaatcaat

SEQ ID NO: 251456 - DNA, 20 bp, Artificial Sequence
  chemically synthesized
cagatacctcatggaatcaa

SEQ ID NO: 251457 - DNA, 20 bp, Artificial Sequence
  chemically synthesized
ggctttcctattgattccat

SEQ ID NO: 251458 - DNA, 20 bp, Artificial Sequence
  chemically synthesized
gctttcctattgattccatg

SEQ ID NO: 251459 - DNA, 20 bp, Artificial Sequence
  chemically synthesized
gaaggatatcagatacctca

SEQ ID NO: 251460 - DNA, 20 bp, Artificial Sequence
  chemically synthesized
ataaattactagaaggatat

SEQ ID NO: 251461 - DNA, 20 bp, Artificial Sequence
  chemically synthesized
tgaggtatctgatatccttc

SEQ ID NO: 251462 - DNA, 20 bp, Artificial Sequence
  chemically synthesized
gaattatataaattactaga

SEQ ID NO: 251463 - DNA, 20 bp, Artificial Sequence
  chemically synthesized
agaattatataaattactag

SEQ ID NO: 251464 - DNA, 20 bp, Artificial Sequence
  chemically synthesized
ggtagaattatataaattac

SEQ ID NO: 251465 - DNA, 20 bp, Artificial Sequence
  chemically synthesized
aatttatataattctaccta

SEQ ID NO: 251466 - DNA, 20 bp, Artificial Sequence
  chemically synthesized
gtgactctagttactttagg

SEQ ID NO: 251467 - DNA, 20 bp, Artificial Sequence
  chemically synthesized
aaagtgactctagttacttt

SEQ ID NO: 251468 - DNA, 20 bp, Artificial Sequence
  chemically synthesized
ataattctacctaaagtaac

SEQ ID NO: 251469 - DNA, 20 bp, Artificial Sequence
  chemically synthesized
gaaagtgactctagttactt

SEQ ID NO: 251470 - DNA, 20 bp, Artificial Sequence
  chemically synthesized
aattctacctaaagtaacta

SEQ ID NO: 251471 - DNA, 20 bp, Artificial Sequence
  chemically synthesized
caactaacagaaagtgactc

SEQ ID NO: 251472 - DNA, 20 bp, Artificial Sequence
  chemically synthesized
taactagagtcactttctgt

SEQ ID NO: 251473 - DNA, 20 bp, Artificial Sequence
  chemically synthesized
tctgagttacaactaacaga

SEQ ID NO: 251474 - DNA, 20 bp, Artificial Sequence
  chemically synthesized
aggttctgagttacaactaa

SEQ ID NO: 251475 - DNA, 20 bp, Artificial Sequence
  chemically synthesized
actttctgttagttgtaact

SEQ ID NO: 251476 - DNA, 20 bp, Artificial Sequence
  chemically synthesized
tatagaccattcaaggttct

SEQ ID NO: 251477 - DNA, 20 bp, Artificial Sequence
  chemically synthesized
ttgtaactcagaaccttgaa

SEQ ID NO: 251478 - DNA, 20 bp, Artificial Sequence
  chemically synthesized
caaggtctatagaccattca

SEQ ID NO: 251479 - DNA, 20 bp, Artificial Sequence
  chemically synthesized
tcaaggtctatagaccattc

SEQ ID NO: 251480 - DNA, 20 bp, Artificial Sequence
  chemically synthesized
tcagaaccttgaatggtcta

SEQ ID NO: 251481 - DNA, 20 bp, Artificial Sequence
  chemically synthesized
ggggaataagtcaaggtcta

SEQ ID NO: 251482 - DNA, 20 bp, Artificial Sequence
  chemically synthesized
taagaatggggaataagtca

SEQ ID NO: 251483 - DNA, 20 bp, Artificial Sequence
  chemically synthesized
ctaagaatggggaataagtc

SEQ ID NO: 251484 - DNA, 20 bp, Artificial Sequence
  chemically synthesized
tcttactaagaatggggaat

SEQ ID NO: 251485 - DNA, 20 bp, Artificial Sequence
  chemically synthesized
cttgacttattccccattct

SEQ ID NO: 251486 - DNA, 20 bp, Artificial Sequence
  chemically synthesized
aagctatcttactaagaatg

SEQ ID NO: 251487 - DNA, 20 bp, Artificial Sequence
  chemically synthesized
gaagctatcttactaagaat

SEQ ID NO: 251488 - DNA, 20 bp, Artificial Sequence
  chemically synthesized
tgaagctatcttactaagaa

SEQ ID NO: 251489 - DNA, 20 bp, Artificial Sequence
  chemically synthesized
acttattccccattcttagt

SEQ ID NO: 251490 - DNA, 20 bp, Artificial Sequence
  chemically synthesized
attccccattcttagtaaga

SEQ ID NO: 251491 - DNA, 20 bp, Artificial Sequence
  chemically synthesized
tggaatgaagctatcttact

SEQ ID NO: 251492 - DNA, 20 bp, Artificial Sequence
  chemically synthesized
gatccctggggaatggaatg

SEQ ID NO: 251493 - DNA, 20 bp, Artificial Sequence
  chemically synthesized
gatagcttcattccattccc

SEQ ID NO: 251494 - DNA, 20 bp, Artificial Sequence
  chemically synthesized
atagcttcattccattcccc

SEQ ID NO: 251495 - DNA, 20 bp, Artificial Sequence
  chemically synthesized
tagcttcattccattcccca

SEQ ID NO: 251496 - DNA, 20 bp, Artificial Sequence
  chemically synthesized
agaacaagatccctggggaa

SEQ ID NO: 251497 - DNA, 20 bp, Artificial Sequence
  chemically synthesized
gggcaagaacaagatccctg

SEQ ID NO: 251498 - DNA, 20 bp, Artificial Sequence
  chemically synthesized
agggcaagaacaagatccct

SEQ ID NO: 251499 - DNA, 20 bp, Artificial Sequence
  chemically synthesized
gagggcaagaacaagatccc

SEQ ID NO: 251500 - DNA, 20 bp, Artificial Sequence
  chemically synthesized
ctgtacaagagggcaagaac

SEQ ID NO: 251501 - DNA, 20 bp, Artificial Sequence
  chemically synthesized
ctggagctgtacaagagggc

SEQ ID NO: 251502 - DNA, 20 bp, Artificial Sequence
  chemically synthesized
cttgttcttgccctcttgta

SEQ ID NO: 251503 - DNA, 20 bp, Artificial Sequence
  chemically synthesized
tagactggagctgtacaaga

SEQ ID NO: 251504 - DNA, 20 bp, Artificial Sequence
  chemically synthesized
atagactggagctgtacaag

SEQ ID NO: 251505 - DNA, 20 bp, Artificial Sequence
  chemically synthesized
gatagactggagctgtacaa

SEQ ID NO: 251506 - DNA, 20 bp, Artificial Sequence
  chemically synthesized
ttgatagactggagctgtac

SEQ ID NO: 251507 - DNA, 20 bp, Artificial Sequence
  chemically synthesized
cttgccctcttgtacagctc

SEQ ID NO: 251508 - DNA, 20 bp, Artificial Sequence
  chemically synthesized
aaataagggttgatagactg

SEQ ID NO: 251509 - DNA, 20 bp, Artificial Sequence
  chemically synthesized
taaaataagggttgatagac

SEQ ID NO: 251510 - DNA, 20 bp, Artificial Sequence
  chemically synthesized
gccagtaaaataagggttga

SEQ ID NO: 251511 - DNA, 20 bp, Artificial Sequence
  chemically synthesized
acaaccagccagtaaaataa

SEQ ID NO: 251512 - DNA, 20 bp, Artificial Sequence
  chemically synthesized
cacaaccagccagtaaaata

SEQ ID NO: 251513 - DNA, 20 bp, Artificial Sequence
  chemically synthesized
tctatcaacccttattttac

SEQ ID NO: 251514 - DNA, 20 bp, Artificial Sequence
  chemically synthesized
gcacaaccagccagtaaaat

SEQ ID NO: 251515 - DNA, 20 bp, Artificial Sequence
  chemically synthesized
tcaacccttattttactggc

SEQ ID NO: 251516 - DNA, 20 bp, Artificial Sequence
  chemically synthesized
agagaaaaggcacaaccagc

SEQ ID NO: 251517 - DNA, 20 bp, Artificial Sequence
  chemically synthesized
ttggagagaaaaggcacaac

SEQ ID NO: 251518 - DNA, 20 bp, Artificial Sequence
  chemically synthesized
ttcacagtcttggagagaaa

SEQ ID NO: 251519 - DNA, 20 bp, Artificial Sequence
  chemically synthesized
cttcacagtcttggagagaa

SEQ ID NO: 251520 - DNA, 20 bp, Artificial Sequence
  chemically synthesized
tggttgtgccttttctctcc

SEQ ID NO: 251521 - DNA, 20 bp, Artificial Sequence
  chemically synthesized
aagagcttcacagtcttgga

SEQ ID NO: 251522 - DNA, 20 bp, Artificial Sequence
  chemically synthesized
tgaagagcttcacagtcttg

SEQ ID NO: 251523 - DNA, 20 bp, Artificial Sequence
  chemically synthesized
tttgaagagcttcacagtct

SEQ ID NO: 251524 - DNA, 20 bp, Artificial Sequence
  chemically synthesized
cttttctctccaagactgtg

SEQ ID NO: 251525 - DNA, 20 bp, Artificial Sequence
  chemically synthesized
ccctgctttgaagagcttca

SEQ ID NO: 251526 - DNA, 20 bp, Artificial Sequence
  chemically synthesized
caagactgtgaagctcttca

SEQ ID NO: 251527 - DNA, 20 bp, Artificial Sequence
  chemically synthesized
gactgtgaagctcttcaaag

SEQ ID NO: 251528 - DNA, 20 bp, Artificial Sequence
  chemically synthesized
gactcagtccctgctttgaa

SEQ ID NO: 251529 - DNA, 20 bp, Artificial Sequence
  chemically synthesized
actgtgaagctcttcaaagc

SEQ ID NO: 251530 - DNA, 20 bp, Artificial Sequence
  chemically synthesized
ctgtgaagctcttcaaagca

SEQ ID NO: 251531 - DNA, 20 bp, Artificial Sequence
  chemically synthesized
tagactcagtccctgctttg

SEQ ID NO: 251532 - DNA, 20 bp, Artificial Sequence
  chemically synthesized
agctcttcaaagcagggact

SEQ ID NO: 251533 - DNA, 20 bp, Artificial Sequence
  chemically synthesized
acagagagaagaattagact

SEQ ID NO: 251534 - DNA, 20 bp, Artificial Sequence
  chemically synthesized
agaactacagagagaagaat

SEQ ID NO: 251535 - DNA, 20 bp, Artificial Sequence
  chemically synthesized
gagtctaattcttctctctg

SEQ ID NO: 251536 - DNA, 20 bp, Artificial Sequence
  chemically synthesized
tccctgagaactacagagag

SEQ ID NO: 251537 - DNA, 20 bp, Artificial Sequence
  chemically synthesized
atttccctgagaactacaga

SEQ ID NO: 251538 - DNA, 20 bp, Artificial Sequence
  chemically synthesized
aaatttccctgagaactaca

SEQ ID NO: 251539 - DNA, 20 bp, Artificial Sequence
  chemically synthesized
attcttctctctgtagttct

SEQ ID NO: 251540 - DNA, 20 bp, Artificial Sequence
  chemically synthesized
tcaaatttccctgagaacta

SEQ ID NO: 251541 - DNA, 20 bp, Artificial Sequence
  chemically synthesized
ttcttctctctgtagttctc

SEQ ID NO: 251542 - DNA, 20 bp, Artificial Sequence
  chemically synthesized
tcttctctctgtagttctca

SEQ ID NO: 251543 - DNA, 20 bp, Artificial Sequence
  chemically synthesized
acatgctttcaaatttccct

SEQ ID NO: 251544 - DNA, 20 bp, Artificial Sequence
  chemically synthesized
tagttctcagggaaatttga

SEQ ID NO: 251545 - DNA, 20 bp, Artificial Sequence
  chemically synthesized
agggaaatttgaaagcatgt

SEQ ID NO: 251546 - DNA, 20 bp, Artificial Sequence
  chemically synthesized
agcatgtaagaatgaattaa

SEQ ID NO: 251547 - DNA, 20 bp, Artificial Sequence
  chemically synthesized
ttaacagatatcatgactat

SEQ ID NO: 251548 - DNA, 20 bp, Artificial Sequence
  chemically synthesized
tggtgatcttatggttctga

SEQ ID NO: 251549 - DNA, 20 bp, Artificial Sequence
  chemically synthesized
atcatgactatcagaaccat

SEQ ID NO: 251550 - DNA, 20 bp, Artificial Sequence
  chemically synthesized
tgatgaaaatggtgatctta

SEQ ID NO: 251551 - DNA, 20 bp, Artificial Sequence
  chemically synthesized
ggcaattttgatgatgaaaa

SEQ ID NO: 251552 - DNA, 20 bp, Artificial Sequence
  chemically synthesized
gataatggctcagttaaggt

SEQ ID NO: 251553 - DNA, 20 bp, Artificial Sequence
  chemically synthesized
caaaattgccaaccttaact

SEQ ID NO: 251554 - DNA, 20 bp, Artificial Sequence
  chemically synthesized
acacgataatggctcagtta

SEQ ID NO: 251555 - DNA, 20 bp, Artificial Sequence
  chemically synthesized
aacacgataatggctcagtt

SEQ ID NO: 251556 - DNA, 20 bp, Artificial Sequence
  chemically synthesized
gcttaaacacgataatggct

SEQ ID NO: 251557 - DNA, 20 bp, Artificial Sequence
  chemically synthesized
gggttgcttaaacacgataa

SEQ ID NO: 251558 - DNA, 20 bp, Artificial Sequence
  chemically synthesized
actgagccattatcgtgttt

SEQ ID NO: 251559 - DNA, 20 bp, Artificial Sequence
  chemically synthesized
tcgtgtttaagcaacccact

SEQ ID NO: 251560 - DNA, 20 bp, Artificial Sequence
  chemically synthesized
atatatgtggggagcttagt

SEQ ID NO: 251561 - DNA, 20 bp, Artificial Sequence
  chemically synthesized
aatatatgtggggagcttag

SEQ ID NO: 251562 - DNA, 20 bp, Artificial Sequence
  chemically synthesized
cacaatatatgtggggagct

SEQ ID NO: 251563 - DNA, 20 bp, Artificial Sequence
  chemically synthesized
tctgacacaatatatgtggg

SEQ ID NO: 251564 - DNA, 20 bp, Artificial Sequence
  chemically synthesized
tatctgacacaatatatgtg

SEQ ID NO: 251565 - DNA, 20 bp, Artificial Sequence
  chemically synthesized
ttatctgacacaatatatgt

SEQ ID NO: 251566 - DNA, 20 bp, Artificial Sequence
  chemically synthesized
attatctgacacaatatatg

SEQ ID NO: 251567 - DNA, 20 bp, Artificial Sequence
  chemically synthesized
gctccccacatatattgtgt

SEQ ID NO: 251568 - DNA, 20 bp, Artificial Sequence
  chemically synthesized
tatgtcacagggttgttatg

SEQ ID NO: 251569 - DNA, 20 bp, Artificial Sequence
  chemically synthesized
ctatgtcacagggttgttat

SEQ ID NO: 251570 - DNA, 20 bp, Artificial Sequence
  chemically synthesized
ctcataacaaccctgtgaca

SEQ ID NO: 251571 - DNA, 20 bp, Artificial Sequence
  chemically synthesized
agaatagtgtctatgtcaca

SEQ ID NO: 251572 - DNA, 20 bp, Artificial Sequence
  chemically synthesized
aagaatagtgtctatgtcac

SEQ ID NO: 251573 - DNA, 20 bp, Artificial Sequence
  chemically synthesized
taagaatagtgtctatgtca

SEQ ID NO: 251574 - DNA, 20 bp, Artificial Sequence
  chemically synthesized
tgtataaaataggataagaa

SEQ ID NO: 251575 - DNA, 20 bp, Artificial Sequence
  chemically synthesized
tctgatgtataaaataggat

SEQ ID NO: 251576 - DNA, 20 bp, Artificial Sequence
  chemically synthesized
acatttctgatgtataaaat

SEQ ID NO: 251577 - DNA, 20 bp, Artificial Sequence
  chemically synthesized
tacatttctgatgtataaaa

SEQ ID NO: 251578 - DNA, 20 bp, Artificial Sequence
  chemically synthesized
tcttatcctattttatacat

SEQ ID NO: 251579 - DNA, 20 bp, Artificial Sequence
  chemically synthesized
ttttatacatcagaaatgta

SEQ ID NO: 251580 - DNA, 20 bp, Artificial Sequence
  chemically synthesized
ttatacatcagaaatgtatg

SEQ ID NO: 251581 - DNA, 20 bp, Artificial Sequence
  chemically synthesized
tacatcagaaatgtatggag

SEQ ID NO: 251582 - DNA, 20 bp, Artificial Sequence
  chemically synthesized
atcagaaatgtatggagcag

SEQ ID NO: 251583 - DNA, 20 bp, Artificial Sequence
  chemically synthesized
atgtatggagcagaagattt

SEQ ID NO: 251584 - DNA, 20 bp, Artificial Sequence
  chemically synthesized
gtatggagcagaagatttaa

SEQ ID NO: 251585 - DNA, 20 bp, Artificial Sequence
  chemically synthesized
aagatttaagagacttgctc

SEQ ID NO: 251586 - DNA, 20 bp, Artificial Sequence
  chemically synthesized
agatttaagagacttgctca

SEQ ID NO: 251587 - DNA, 20 bp, Artificial Sequence
  chemically synthesized
gatttaagagacttgctcaa

SEQ ID NO: 251588 - DNA, 20 bp, Artificial Sequence
  chemically synthesized
ctatctatgtgcccttgagc

SEQ ID NO: 251589 - DNA, 20 bp, Artificial Sequence
  chemically synthesized
tctgctatctatgtgccctt

SEQ ID NO: 251590 - DNA, 20 bp, Artificial Sequence
  chemically synthesized
gagacttgctcaagggcaca

SEQ ID NO: 251591 - DNA, 20 bp, Artificial Sequence
  chemically synthesized
cttgctcaagggcacataga

SEQ ID NO: 251592 - DNA, 20 bp, Artificial Sequence
  chemically synthesized
gctcaagggcacatagatag

SEQ ID NO: 251593 - DNA, 20 bp, Artificial Sequence
  chemically synthesized
aagggcacatagatagcaga

SEQ ID NO: 251594 - DNA, 20 bp, Artificial Sequence
  chemically synthesized
agggcacatagatagcagaa

SEQ ID NO: 251595 - DNA, 20 bp, Artificial Sequence
  chemically synthesized
cacatagatagcagaaaggc

SEQ ID NO: 251596 - DNA, 20 bp, Artificial Sequence
  chemically synthesized
tccaacccgttttggaattc

SEQ ID NO: 251597 - DNA, 20 bp, Artificial Sequence
  chemically synthesized
gaaaggccagaattccaaaa

SEQ ID NO: 251598 - DNA, 20 bp, Artificial Sequence
  chemically synthesized
aaaggccagaattccaaaac

SEQ ID NO: 251599 - DNA, 20 bp, Artificial Sequence
  chemically synthesized
tctagagttccaacccgttt

SEQ ID NO: 251600 - DNA, 20 bp, Artificial Sequence
  chemically synthesized
gccagaattccaaaacgggt

SEQ ID NO: 251601 - DNA, 20 bp, Artificial Sequence
  chemically synthesized
tccaaaacgggttggaactc

SEQ ID NO: 251602 - DNA, 20 bp, Artificial Sequence
  chemically synthesized
caaaacgggttggaactcta

SEQ ID NO: 251603 - DNA, 20 bp, Artificial Sequence
  chemically synthesized
gcttataagcacaggctcta

SEQ ID NO: 251604 - DNA, 20 bp, Artificial Sequence
  chemically synthesized
ttgcttataagcacaggctc

SEQ ID NO: 251605 - DNA, 20 bp, Artificial Sequence
  chemically synthesized
aagtaattgcttataagcac

SEQ ID NO: 251606 - DNA, 20 bp, Artificial Sequence
  chemically synthesized
actctagagcctgtgcttat

SEQ ID NO: 251607 - DNA, 20 bp, Artificial Sequence
  chemically synthesized
taagtaattgcttataagca

SEQ ID NO: 251608 - DNA, 20 bp, Artificial Sequence
  chemically synthesized
tgttttaagtaattgcttat

SEQ ID NO: 251609 - DNA, 20 bp, Artificial Sequence
  chemically synthesized
ttataagcaattacttaaaa

SEQ ID NO: 251610 - DNA, 20 bp, Artificial Sequence
  chemically synthesized
tctcagatacaaactgtttt

SEQ ID NO: 251611 - DNA, 20 bp, Artificial Sequence
  chemically synthesized
acttaaaacagtttgtatct

SEQ ID NO: 251612 - DNA, 20 bp, Artificial Sequence
  chemically synthesized
tatgacttttagtacaatct

SEQ ID NO: 251613 - DNA, 20 bp, Artificial Sequence
  chemically synthesized
tgtatctgagattgtactaa

SEQ ID NO: 251614 - DNA, 20 bp, Artificial Sequence
  chemically synthesized
tgagattgtactaaaagtca

SEQ ID NO: 251615 - DNA, 20 bp, Artificial Sequence
  chemically synthesized
gttaaatttcctatgacttt

SEQ ID NO: 251616 - DNA, 20 bp, Artificial Sequence
  chemically synthesized
gagattgtactaaaagtcat

SEQ ID NO: 251617 - DNA, 20 bp, Artificial Sequence
  chemically synthesized
aaaagtcataggaaatttaa

SEQ ID NO: 251618 - DNA, 20 bp, Artificial Sequence
  chemically synthesized
attctataggaattggtcag

SEQ ID NO: 251619 - DNA, 20 bp, Artificial Sequence
  chemically synthesized
acattctataggaattggtc

SEQ ID NO: 251620 - DNA, 20 bp, Artificial Sequence
  chemically synthesized
gacattctataggaattggt

SEQ ID NO: 251621 - DNA, 20 bp, Artificial Sequence
  chemically synthesized
cagctcctgaccaattccta

SEQ ID NO: 251622 - DNA, 20 bp, Artificial Sequence
  chemically synthesized
cattgacattctataggaat

SEQ ID NO: 251623 - DNA, 20 bp, Artificial Sequence
  chemically synthesized
tacttccattgacattctat

SEQ ID NO: 251624 - DNA, 20 bp, Artificial Sequence
  chemically synthesized
gtacttccattgacattcta

SEQ ID NO: 251625 - DNA, 20 bp, Artificial Sequence
  chemically synthesized
caattcctatagaatgtcaa

SEQ ID NO: 251626 - DNA, 20 bp, Artificial Sequence
  chemically synthesized
ttcctatagaatgtcaatgg

SEQ ID NO: 251627 - DNA, 20 bp, Artificial Sequence
  chemically synthesized
ggaagtacaatttcaacctc

SEQ ID NO: 251628 - DNA, 20 bp, Artificial Sequence
  chemically synthesized
tacaatttcaacctctggat

SEQ ID NO: 251629 - DNA, 20 bp, Artificial Sequence
  chemically synthesized
acaatttcaacctctggata

SEQ ID NO: 251630 - DNA, 20 bp, Artificial Sequence
  chemically synthesized
tccaccctgtccttatccag

SEQ ID NO: 251631 - DNA, 20 bp, Artificial Sequence
  chemically synthesized
atccaccctgtccttatcca

SEQ ID NO: 251632 - DNA, 20 bp, Artificial Sequence
  chemically synthesized
agatccaccctgtccttatc

SEQ ID NO: 251633 - DNA, 20 bp, Artificial Sequence
  chemically synthesized
tttcaacctctggataagga

SEQ ID NO: 251634 - DNA, 20 bp, Artificial Sequence
  chemically synthesized
ttcaacctctggataaggac

SEQ ID NO: 251635 - DNA, 20 bp, Artificial Sequence
  chemically synthesized
tcaacctctggataaggaca

SEQ ID NO: 251636 - DNA, 20 bp, Artificial Sequence
  chemically synthesized
acctctggataaggacaggg

SEQ ID NO: 251637 - DNA, 20 bp, Artificial Sequence
  chemically synthesized
taaggacagggtggatctat

SEQ ID NO: 251638 - DNA, 20 bp, Artificial Sequence
  chemically synthesized
aaggacagggtggatctatt

SEQ ID NO: 251639 - DNA, 20 bp, Artificial Sequence
  chemically synthesized
aggacagggtggatctattg

SEQ ID NO: 251640 - DNA, 20 bp, Artificial Sequence
  chemically synthesized
cagggtggatctattggggc

SEQ ID NO: 251641 - DNA, 20 bp, Artificial Sequence
  chemically synthesized
tagagtttctctagccccaa

SEQ ID NO: 251642 - DNA, 20 bp, Artificial Sequence
  chemically synthesized
gggtggatctattggggcta

SEQ ID NO: 251643 - DNA, 20 bp, Artificial Sequence
  chemically synthesized
gacaaaggatagagtttctc

SEQ ID NO: 251644 - DNA, 20 bp, Artificial Sequence
  chemically synthesized
tctggttttgacaaaggata

SEQ ID NO: 251645 - DNA, 20 bp, Artificial Sequence
  chemically synthesized
tttctggttttgacaaagga

SEQ ID NO: 251646 - DNA, 20 bp, Artificial Sequence
  chemically synthesized
gacttttctggttttgacaa

SEQ ID NO: 251647 - DNA, 20 bp, Artificial Sequence
  chemically synthesized
ggacttttctggttttgaca

SEQ ID NO: 251648 - DNA, 20 bp, Artificial Sequence
  chemically synthesized
actctatcctttgtcaaaac

SEQ ID NO: 251649 - DNA, 20 bp, Artificial Sequence
  chemically synthesized
atcctttgtcaaaaccagaa

SEQ ID NO: 251650 - DNA, 20 bp, Artificial Sequence
  chemically synthesized
cccaactctgaggacttttc

SEQ ID NO: 251651 - DNA, 20 bp, Artificial Sequence
  chemically synthesized
gtcaaaaccagaaaagtcct

SEQ ID NO: 251652 - DNA, 20 bp, Artificial Sequence
  chemically synthesized
caaaaccagaaaagtcctca

SEQ ID NO: 251653 - DNA, 20 bp, Artificial Sequence
  chemically synthesized
accagaaaagtcctcagagt

SEQ ID NO: 251654 - DNA, 20 bp, Artificial Sequence
  chemically synthesized
ccagaaaagtcctcagagtt

SEQ ID NO: 251655 - DNA, 20 bp, Artificial Sequence
  chemically synthesized
gaaatctcaccccaactctg

SEQ ID NO: 251656 - DNA, 20 bp, Artificial Sequence
  chemically synthesized
cagaaaagtcctcagagttg

SEQ ID NO: 251657 - DNA, 20 bp, Artificial Sequence
  chemically synthesized
tgaaatctcaccccaactct

SEQ ID NO: 251658 - DNA, 20 bp, Artificial Sequence
  chemically synthesized
aaagtcctcagagttggggt

SEQ ID NO: 251659 - DNA, 20 bp, Artificial Sequence
  chemically synthesized
tcagagttggggtgagattt

SEQ ID NO: 251660 - DNA, 20 bp, Artificial Sequence
  chemically synthesized
gatttcagcgaccctctctg

SEQ ID NO: 251661 - DNA, 20 bp, Artificial Sequence
  chemically synthesized
ctaacgccattccacagaga

SEQ ID NO: 251662 - DNA, 20 bp, Artificial Sequence
  chemically synthesized
actaacgccattccacagag

SEQ ID NO: 251663 - DNA, 20 bp, Artificial Sequence
  chemically synthesized
cactaacgccattccacaga

SEQ ID NO: 251664 - DNA, 20 bp, Artificial Sequence
  chemically synthesized
cagcgaccctctctgtggaa

SEQ ID NO: 251665 - DNA, 20 bp, Artificial Sequence
  chemically synthesized
aacactaacgccattccaca

SEQ ID NO: 251666 - DNA, 20 bp, Artificial Sequence
  chemically synthesized
gaaacactaacgccattcca

SEQ ID NO: 251667 - DNA, 20 bp, Artificial Sequence
  chemically synthesized
ccctctctgtggaatggcgt

SEQ ID NO: 251668 - DNA, 20 bp, Artificial Sequence
  chemically synthesized
tggcgttagtgtttctgttt

SEQ ID NO: 251669 - DNA, 20 bp, Artificial Sequence
  chemically synthesized
accttcaccttagacttaaa

SEQ ID NO: 251670 - DNA, 20 bp, Artificial Sequence
  chemically synthesized
tagtgtttctgtttaagtct

SEQ ID NO: 251671 - DNA, 20 bp, Artificial Sequence
  chemically synthesized
agtgtttctgtttaagtcta

SEQ ID NO: 251672 - DNA, 20 bp, Artificial Sequence
  chemically synthesized
ttctgtttaagtctaaggtg

SEQ ID NO: 251673 - DNA, 20 bp, Artificial Sequence
  chemically synthesized
tctgtttaagtctaaggtga

SEQ ID NO: 251674 - DNA, 20 bp, Artificial Sequence
  chemically synthesized
ctttcagtttaccttcacct

SEQ ID NO: 251675 - DNA, 20 bp, Artificial Sequence
  chemically synthesized
ctaaggtgaaggtaaactga

SEQ ID NO: 251676 - DNA, 20 bp, Artificial Sequence
  chemically synthesized
taaggtgaaggtaaactgaa

SEQ ID NO: 251677 - DNA, 20 bp, Artificial Sequence
  chemically synthesized
aaggtgaaggtaaactgaaa

SEQ ID NO: 251678 - DNA, 20 bp, Artificial Sequence
  chemically synthesized
tcatatggacatttcccttt

SEQ ID NO: 251679 - DNA, 20 bp, Artificial Sequence
  chemically synthesized
agggaaatgtccatatgacc

SEQ ID NO: 251680 - DNA, 20 bp, Artificial Sequence
  chemically synthesized
tcccttctcactgggtcata

SEQ ID NO: 251681 - DNA, 20 bp, Artificial Sequence
  chemically synthesized
aaatgtccatatgacccagt

SEQ ID NO: 251682 - DNA, 20 bp, Artificial Sequence
  chemically synthesized
tgtccatatgacccagtgag

SEQ ID NO: 251683 - DNA, 20 bp, Artificial Sequence
  chemically synthesized
gtccatatgacccagtgaga

SEQ ID NO: 251684 - DNA, 20 bp, Artificial Sequence
  chemically synthesized
ccaggtattcccttctcact

SEQ ID NO: 251685 - DNA, 20 bp, Artificial Sequence
  chemically synthesized
tccatatgacccagtgagaa

SEQ ID NO: 251686 - DNA, 20 bp, Artificial Sequence
  chemically synthesized
tccaggtattcccttctcac

SEQ ID NO: 251687 - DNA, 20 bp, Artificial Sequence
  chemically synthesized
cccagtgagaagggaatacc

SEQ ID NO: 251688 - DNA, 20 bp, Artificial Sequence
  chemically synthesized
taatttttggcaaatgatcc

SEQ ID NO: 251689 - DNA, 20 bp, Artificial Sequence
  chemically synthesized
gtaatttttggcaaatgatc

SEQ ID NO: 251690 - DNA, 20 bp, Artificial Sequence
  chemically synthesized
ctttactcatgagtaatttt

SEQ ID NO: 251691 - DNA, 20 bp, Artificial Sequence
  chemically synthesized
atttgccaaaaattactcat

SEQ ID NO: 251692 - DNA, 20 bp, Artificial Sequence
  chemically synthesized
ccaaaaattactcatgagta

SEQ ID NO: 251693 - DNA, 20 bp, Artificial Sequence
  chemically synthesized
ttctcctccgctttactcat

SEQ ID NO: 251694 - DNA, 20 bp, Artificial Sequence
  chemically synthesized
aaaattactcatgagtaaag

SEQ ID NO: 251695 - DNA, 20 bp, Artificial Sequence
  chemically synthesized
aattactcatgagtaaagcg

SEQ ID NO: 251696 - DNA, 20 bp, Artificial Sequence
  chemically synthesized
attactcatgagtaaagcgg

SEQ ID NO: 251697 - DNA, 20 bp, Artificial Sequence
  chemically synthesized
tactcatgagtaaagcggag

SEQ ID NO: 251698 - DNA, 20 bp, Artificial Sequence
  chemically synthesized
agcggaggagaaacctcaaa

SEQ ID NO: 251699 - DNA, 20 bp, Artificial Sequence
  chemically synthesized
ggaggagaaacctcaaaaag

SEQ ID NO: 251700 - DNA, 20 bp, Artificial Sequence
  chemically synthesized
ataacgctttctgctttttg

SEQ ID NO: 251701 - DNA, 20 bp, Artificial Sequence
  chemically synthesized
aataacgctttctgcttttt

SEQ ID NO: 251702 - DNA, 20 bp, Artificial Sequence
  chemically synthesized
gagaaacctcaaaaagcaga

SEQ ID NO: 251703 - DNA, 20 bp, Artificial Sequence
  chemically synthesized
agaaagcgttatttctactt

SEQ ID NO: 251704 - DNA, 20 bp, Artificial Sequence
  chemically synthesized
ctaccagttttgcactaaag

SEQ ID NO: 251705 - DNA, 20 bp, Artificial Sequence
  chemically synthesized
cacctaccagttttgcacta

SEQ ID NO: 251706 - DNA, 20 bp, Artificial Sequence
  chemically synthesized
tttctactttagtgcaaaac

SEQ ID NO: 251707 - DNA, 20 bp, Artificial Sequence
  chemically synthesized
ctactttagtgcaaaactgg

SEQ ID NO: 251708 - DNA, 20 bp, Artificial Sequence
  chemically synthesized
tactttagtgcaaaactggt

SEQ ID NO: 251709 - DNA, 20 bp, Artificial Sequence
  chemically synthesized
gtgcttctatatacacctac

SEQ ID NO: 251710 - DNA, 20 bp, Artificial Sequence
  chemically synthesized
gcaaaactggtaggtgtata

SEQ ID NO: 251711 - DNA, 20 bp, Artificial Sequence
  chemically synthesized
aaactggtaggtgtatatag

SEQ ID NO: 251712 - DNA, 20 bp, Artificial Sequence
  chemically synthesized
ggtaggtgtatatagaagca

SEQ ID NO: 251713 - DNA, 20 bp, Artificial Sequence
  chemically synthesized
tatagaagcacagtaatcac

SEQ ID NO: 251714 - DNA, 20 bp, Artificial Sequence
  chemically synthesized
acagtaatcactggctatcc

SEQ ID NO: 251715 - DNA, 20 bp, Artificial Sequence
  chemically synthesized
gttgaggtttcttggatagc

SEQ ID NO: 251716 - DNA, 20 bp, Artificial Sequence
  chemically synthesized
gaccgttgaggtttcttgga

SEQ ID NO: 251717 - DNA, 20 bp, Artificial Sequence
  chemically synthesized
taaggaccgttgaggtttct

SEQ ID NO: 251718 - DNA, 20 bp, Artificial Sequence
  chemically synthesized
ggctatccaagaaacctcaa

SEQ ID NO: 251719 - DNA, 20 bp, Artificial Sequence
  chemically synthesized
ccatcccctaaggaccgttg

SEQ ID NO: 251720 - DNA, 20 bp, Artificial Sequence
  chemically synthesized
accatcccctaaggaccgtt

SEQ ID NO: 251721 - DNA, 20 bp, Artificial Sequence
  chemically synthesized
caagaaacctcaacggtcct

SEQ ID NO: 251722 - DNA, 20 bp, Artificial Sequence
  chemically synthesized
aagaaacctcaacggtcctt

SEQ ID NO: 251723 - DNA, 20 bp, Artificial Sequence
  chemically synthesized
agaaacctcaacggtcctta

SEQ ID NO: 251724 - DNA, 20 bp, Artificial Sequence
  chemically synthesized
gaaacctcaacggtccttag

SEQ ID NO: 251725 - DNA, 20 bp, Artificial Sequence
  chemically synthesized
cctcaacggtccttagggga

SEQ ID NO: 251726 - DNA, 20 bp, Artificial Sequence
  chemically synthesized
gccacccacaccatccccta

SEQ ID NO: 251727 - DNA, 20 bp, Artificial Sequence
  chemically synthesized
ggccacccacaccatcccct

SEQ ID NO: 251728 - DNA, 20 bp, Artificial Sequence
  chemically synthesized
acggtccttaggggatggtg

SEQ ID NO: 251729 - DNA, 20 bp, Artificial Sequence
  chemically synthesized
cggtccttaggggatggtgt

SEQ ID NO: 251730 - DNA, 20 bp, Artificial Sequence
  chemically synthesized
tccttaggggatggtgtggg

SEQ ID NO: 251731 - DNA, 20 bp, Artificial Sequence
  chemically synthesized
aggggatggtgtgggtggcc

SEQ ID NO: 251732 - DNA, 20 bp, Artificial Sequence
  chemically synthesized
gtgttttctccaagcattct

SEQ ID NO: 251733 - DNA, 20 bp, Artificial Sequence
  chemically synthesized
tgtgggtggcctagaatgct

SEQ ID NO: 251734 - DNA, 20 bp, Artificial Sequence
  chemically synthesized
agtgttttctccaagcattc

SEQ ID NO: 251735 - DNA, 20 bp, Artificial Sequence
  chemically synthesized
tgggtggcctagaatgcttg

SEQ ID NO: 251736 - DNA, 20 bp, Artificial Sequence
  chemically synthesized
ttatagtcagtgttttctcc

SEQ ID NO: 251737 - DNA, 20 bp, Artificial Sequence
  chemically synthesized
ttggagaaaacactgactat

SEQ ID NO: 251738 - DNA, 20 bp, Artificial Sequence
  chemically synthesized
ctggtttgtcttcttatagt

SEQ ID NO: 251739 - DNA, 20 bp, Artificial Sequence
  chemically synthesized
gagaaaacactgactataag

SEQ ID NO: 251740 - DNA, 20 bp, Artificial Sequence
  chemically synthesized
ccctctggtttgtcttctta

SEQ ID NO: 251741 - DNA, 20 bp, Artificial Sequence
  chemically synthesized
ctgactataagaagacaaac

SEQ ID NO: 251742 - DNA, 20 bp, Artificial Sequence
  chemically synthesized
gactataagaagacaaacca

SEQ ID NO: 251743 - DNA, 20 bp, Artificial Sequence
  chemically synthesized
actataagaagacaaaccag

SEQ ID NO: 251744 - DNA, 20 bp, Artificial Sequence
  chemically synthesized
ctataagaagacaaaccaga

SEQ ID NO: 251745 - DNA, 20 bp, Artificial Sequence
  chemically synthesized
tataagaagacaaaccagag

SEQ ID NO: 251746 - DNA, 20 bp, Artificial Sequence
  chemically synthesized
ataagaagacaaaccagagg

SEQ ID NO: 251747 - DNA, 20 bp, Artificial Sequence
  chemically synthesized
agaagacaaaccagaggggg

SEQ ID NO: 251748 - DNA, 20 bp, Artificial Sequence
  chemically synthesized
ttgggaagttcttccccctc

SEQ ID NO: 251749 - DNA, 20 bp, Artificial Sequence
  chemically synthesized
cagagggggaagaacttccc

SEQ ID NO: 251750 - DNA, 20 bp, Artificial Sequence
  chemically synthesized
gagggggaagaacttcccaa

SEQ ID NO: 251751 - DNA, 20 bp, Artificial Sequence
  chemically synthesized
atgttcattccactcttggg

SEQ ID NO: 251752 - DNA, 20 bp, Artificial Sequence
  chemically synthesized
ggggaagaacttcccaagag

SEQ ID NO: 251753 - DNA, 20 bp, Artificial Sequence
  chemically synthesized
gggatgttcattccactctt

SEQ ID NO: 251754 - DNA, 20 bp, Artificial Sequence
  chemically synthesized
tgggatgttcattccactct

SEQ ID NO: 251755 - DNA, 20 bp, Artificial Sequence
  chemically synthesized
gagtggaatgaacatcccaa

SEQ ID NO: 251756 - DNA, 20 bp, Artificial Sequence
  chemically synthesized
ggaatgaacatcccaaaaga

SEQ ID NO: 251757 - DNA, 20 bp, Artificial Sequence
  chemically synthesized
cagtttcattaccatctttt

SEQ ID NO: 251758 - DNA, 20 bp, Artificial Sequence
  chemically synthesized
tcagtttcattaccatcttt

SEQ ID NO: 251759 - DNA, 20 bp, Artificial Sequence
  chemically synthesized
ggtaatgaaactgacatcat

SEQ ID NO: 251760 - DNA, 20 bp, Artificial Sequence
  chemically synthesized
gcgggctactccaatgatgt

SEQ ID NO: 251761 - DNA, 20 bp, Artificial Sequence
  chemically synthesized
taatgaaactgacatcattg

SEQ ID NO: 251762 - DNA, 20 bp, Artificial Sequence
  chemically synthesized
tgaaactgacatcattggag

SEQ ID NO: 251763 - DNA, 20 bp, Artificial Sequence
  chemically synthesized
gacatcattggagtagcccg

SEQ ID NO: 251764 - DNA, 20 bp, Artificial Sequence
  chemically synthesized
catcattggagtagcccgca

SEQ ID NO: 251765 - DNA, 20 bp, Artificial Sequence
  chemically synthesized
gagacattatgaggctctgc

SEQ ID NO: 251766 - DNA, 20 bp, Artificial Sequence
  chemically synthesized
tgagacattatgaggctctg

SEQ ID NO: 251767 - DNA, 20 bp, Artificial Sequence
  chemically synthesized
tttcacattgagacattatg

SEQ ID NO: 251768 - DNA, 20 bp, Artificial Sequence
  chemically synthesized
atttcacattgagacattat

SEQ ID NO: 251769 - DNA, 20 bp, Artificial Sequence
  chemically synthesized
ttctcccagcatttcacatt

SEQ ID NO: 251770 - DNA, 20 bp, Artificial Sequence
  chemically synthesized
aatgtctcaatgtgaaatgc

SEQ ID NO: 251771 - DNA, 20 bp, Artificial Sequence
  chemically synthesized
atgtctcaatgtgaaatgct

SEQ ID NO: 251772 - DNA, 20 bp, Artificial Sequence
  chemically synthesized
gtctcaatgtgaaatgctgg

SEQ ID NO: 251773 - DNA, 20 bp, Artificial Sequence
  chemically synthesized
caatgtgaaatgctgggaga

SEQ ID NO: 251774 - DNA, 20 bp, Artificial Sequence
  chemically synthesized
caccatggtgtactttctcc

SEQ ID NO: 251775 - DNA, 20 bp, Artificial Sequence
  chemically synthesized
tgctgggagaaagtacacca

SEQ ID NO: 251776 - DNA, 20 bp, Artificial Sequence
  chemically synthesized
tgggagaaagtacaccatgg

SEQ ID NO: 251777 - DNA, 20 bp, Artificial Sequence
  chemically synthesized
ataaacttatatcgccacca

SEQ ID NO: 251778 - DNA, 20 bp, Artificial Sequence
  chemically synthesized
gtacaccatggtggcgatat

SEQ ID NO: 251779 - DNA, 20 bp, Artificial Sequence
  chemically synthesized
atatttttgttaatttattt

SEQ ID NO: 251780 - DNA, 20 bp, Artificial Sequence
  chemically synthesized
atttttgttaatttatttta

SEQ ID NO: 251781 - DNA, 20 bp, Artificial Sequence
  chemically synthesized
ttttgttaatttattttaga

SEQ ID NO: 251782 - DNA, 20 bp, Artificial Sequence
  chemically synthesized
ttgttaatttattttagaga

SEQ ID NO: 251783 - DNA, 20 bp, Artificial Sequence
  chemically synthesized
tttagagagagtctgttact

SEQ ID NO: 251784 - DNA, 20 bp, Artificial Sequence
  chemically synthesized
ttagagagagtctgttactc

SEQ ID NO: 251785 - DNA, 20 bp, Artificial Sequence
  chemically synthesized
ctgtactacagcctgagtaa

SEQ ID NO: 251786 - DNA, 20 bp, Artificial Sequence
  chemically synthesized
agagtctgttactcaggctg

SEQ ID NO: 251787 - DNA, 20 bp, Artificial Sequence
  chemically synthesized
gtgccactgtactacagcct

SEQ ID NO: 251788 - DNA, 20 bp, Artificial Sequence
  chemically synthesized
ctgttactcaggctgtagta

SEQ ID NO: 251789 - DNA, 20 bp, Artificial Sequence
  chemically synthesized
atgattgtgccactgtacta

SEQ ID NO: 251790 - DNA, 20 bp, Artificial Sequence
  chemically synthesized
ttactcaggctgtagtacag

SEQ ID NO: 251791 - DNA, 20 bp, Artificial Sequence
  chemically synthesized
gtagtacagtggcacaatca

SEQ ID NO: 251792 - DNA, 20 bp, Artificial Sequence
  chemically synthesized
agtggcacaatcatggctcg

SEQ ID NO: 251793 - DNA, 20 bp, Artificial Sequence
  chemically synthesized
ggcacaatcatggctcgtgg

SEQ ID NO: 251794 - DNA, 20 bp, Artificial Sequence
  chemically synthesized
caggaattcaaggctgccac

SEQ ID NO: 251795 - DNA, 20 bp, Artificial Sequence
  chemically synthesized
cacttgagcccaggaattca

SEQ ID NO: 251796 - DNA, 20 bp, Artificial Sequence
  chemically synthesized
tcgtggcagccttgaattcc

SEQ ID NO: 251797 - DNA, 20 bp, Artificial Sequence
  chemically synthesized
tcacttgagcccaggaattc

SEQ ID NO: 251798 - DNA, 20 bp, Artificial Sequence
  chemically synthesized
cgtggcagccttgaattcct

SEQ ID NO: 251799 - DNA, 20 bp, Artificial Sequence
  chemically synthesized
agccttgaattcctgggctc

SEQ ID NO: 251800 - DNA, 20 bp, Artificial Sequence
  chemically synthesized
caggagggtcacttgagccc

SEQ ID NO: 251801 - DNA, 20 bp, Artificial Sequence
  chemically synthesized
gcaggagggtcacttgagcc

SEQ ID NO: 251802 - DNA, 20 bp, Artificial Sequence
  chemically synthesized
ctgaggcaggagggtcactt

SEQ ID NO: 251803 - DNA, 20 bp, Artificial Sequence
  chemically synthesized
tttgggaggctgaggcagga

SEQ ID NO: 251804 - DNA, 20 bp, Artificial Sequence
  chemically synthesized
ctcaagtgaccctcctgcct

SEQ ID NO: 251805 - DNA, 20 bp, Artificial Sequence
  chemically synthesized
ctttgggaggctgaggcagg

SEQ ID NO: 251806 - DNA, 20 bp, Artificial Sequence
  chemically synthesized
gctttgggaggctgaggcag

SEQ ID NO: 251807 - DNA, 20 bp, Artificial Sequence
  chemically synthesized
gtgctttgggaggctgaggc

SEQ ID NO: 251808 - DNA, 20 bp, Artificial Sequence
  chemically synthesized
tgtgctttgggaggctgagg

SEQ ID NO: 251809 - DNA, 20 bp, Artificial Sequence
  chemically synthesized
ccctgtgctttgggaggctg

SEQ ID NO: 251810 - DNA, 20 bp, Artificial Sequence
  chemically synthesized
tccctgtgctttgggaggct

SEQ ID NO: 251811 - DNA, 20 bp, Artificial Sequence
  chemically synthesized
cctcctgcctcagcctccca

SEQ ID NO: 251812 - DNA, 20 bp, Artificial Sequence
  chemically synthesized
tgtaatccctgtgctttggg

SEQ ID NO: 251813 - DNA, 20 bp, Artificial Sequence
  chemically synthesized
ctgtaatccctgtgctttgg

SEQ ID NO: 251814 - DNA, 20 bp, Artificial Sequence
  chemically synthesized
tgcctcagcctcccaaagca

SEQ ID NO: 251815 - DNA, 20 bp, Artificial Sequence
  chemically synthesized
gcctcagcctcccaaagcac

SEQ ID NO: 251816 - DNA, 20 bp, Artificial Sequence
  chemically synthesized
gcctgtaatccctgtgcttt

SEQ ID NO: 251817 - DNA, 20 bp, Artificial Sequence
  chemically synthesized
cctcagcctcccaaagcaca

SEQ ID NO: 251818 - DNA, 20 bp, Artificial Sequence
  chemically synthesized
tgcctgtaatccctgtgctt

SEQ ID NO: 251819 - DNA, 20 bp, Artificial Sequence
  chemically synthesized
ctcccaaagcacagggatta

SEQ ID NO: 251820 - DNA, 20 bp, Artificial Sequence
  chemically synthesized
tcccaaagcacagggattac

SEQ ID NO: 251821 - DNA, 20 bp, Artificial Sequence
  chemically synthesized
agcacagggattacaggcat

SEQ ID NO: 251822 - DNA, 20 bp, Artificial Sequence
  chemically synthesized
aacttaaacttataaaatgg

SEQ ID NO: 251823 - DNA, 20 bp, Artificial Sequence
  chemically synthesized
ggcatgagccaccattttat

SEQ ID NO: 251824 - DNA, 20 bp, Artificial Sequence
  chemically synthesized
acaaacttaaacttataaaa

SEQ ID NO: 251825 - DNA, 20 bp, Artificial Sequence
  chemically synthesized
agccaccattttataagttt

SEQ ID NO: 251826 - DNA, 20 bp, Artificial Sequence
  chemically synthesized
taagtttaagtttgtatttg

SEQ ID NO: 251827 - DNA, 20 bp, Artificial Sequence
  chemically synthesized
ttgtatttgtagcatataca

SEQ ID NO: 251828 - DNA, 20 bp, Artificial Sequence
  chemically synthesized
gtatttgtagcatatacaca

SEQ ID NO: 251829 - DNA, 20 bp, Artificial Sequence
  chemically synthesized
tttgtagcatatacacagag

SEQ ID NO: 251830 - DNA, 20 bp, Artificial Sequence
  chemically synthesized
agcatatacacagagtggct

SEQ ID NO: 251831 - DNA, 20 bp, Artificial Sequence
  chemically synthesized
ttgataaaggcaaagaaact

SEQ ID NO: 251832 - DNA, 20 bp, Artificial Sequence
  chemically synthesized
agccaggcttgataaaggca

SEQ ID NO: 251833 - DNA, 20 bp, Artificial Sequence
  chemically synthesized
tgagtttctttgcctttatc

SEQ ID NO: 251834 - DNA, 20 bp, Artificial Sequence
  chemically synthesized
tccaaagccaggcttgataa

SEQ ID NO: 251835 - DNA, 20 bp, Artificial Sequence
  chemically synthesized
atccaaagccaggcttgata

SEQ ID NO: 251836 - DNA, 20 bp, Artificial Sequence
  chemically synthesized
ttctttgcctttatcaagcc

SEQ ID NO: 251837 - DNA, 20 bp, Artificial Sequence
  chemically synthesized
gcctttatcaagcctggctt

SEQ ID NO: 251838 - DNA, 20 bp, Artificial Sequence
  chemically synthesized
gtcccacagtatccaaagcc

SEQ ID NO: 251839 - DNA, 20 bp, Artificial Sequence
  chemically synthesized
ggtcccacagtatccaaagc

SEQ ID NO: 251840 - DNA, 20 bp, Artificial Sequence
  chemically synthesized
agctggtcccacagtatcca

SEQ ID NO: 251841 - DNA, 20 bp, Artificial Sequence
  chemically synthesized
aagcctggctttggatactg

SEQ ID NO: 251842 - DNA, 20 bp, Artificial Sequence
  chemically synthesized
agcctggctttggatactgt

SEQ ID NO: 251843 - DNA, 20 bp, Artificial Sequence
  chemically synthesized
ggctttggatactgtgggac

SEQ ID NO: 251844 - DNA, 20 bp, Artificial Sequence
  chemically synthesized
cttgaaaatagctggtccca

SEQ ID NO: 251845 - DNA, 20 bp, Artificial Sequence
  chemically synthesized
tcaacttccttgaaaatagc

SEQ ID NO: 251846 - DNA, 20 bp, Artificial Sequence
  chemically synthesized
ctgtgggaccagctattttc

SEQ ID NO: 251847 - DNA, 20 bp, Artificial Sequence
  chemically synthesized
tgtgggaccagctattttca

SEQ ID NO: 251848 - DNA, 20 bp, Artificial Sequence
  chemically synthesized
tatctcaacttccttgaaaa

SEQ ID NO: 251849 - DNA, 20 bp, Artificial Sequence
  chemically synthesized
gggaccagctattttcaagg

SEQ ID NO: 251850 - DNA, 20 bp, Artificial Sequence
  chemically synthesized
cagctattttcaaggaagtt

SEQ ID NO: 251851 - DNA, 20 bp, Artificial Sequence
  chemically synthesized
aacaaaacaaaacaaaaaaa

SEQ ID NO: 251852 - DNA, 20 bp, Artificial Sequence
  chemically synthesized
tgttttgttttgttttgttt

SEQ ID NO: 251853 - DNA, 20 bp, Artificial Sequence
  chemically synthesized
ttgttttgttttgtttgaga

SEQ ID NO: 251854 - DNA, 20 bp, Artificial Sequence
  chemically synthesized
gttttgttttgtttgagacg

SEQ ID NO: 251855 - DNA, 20 bp, Artificial Sequence
  chemically synthesized
ccagcctgggtgacagagca

SEQ ID NO: 251856 - DNA, 20 bp, Artificial Sequence
  chemically synthesized
tccagcctgggtgacagagc

SEQ ID NO: 251857 - DNA, 20 bp, Artificial Sequence
  chemically synthesized
cggagccttgctctgtcacc

SEQ ID NO: 251858 - DNA, 20 bp, Artificial Sequence
  chemically synthesized
gcattccagcctgggtgaca

SEQ ID NO: 251859 - DNA, 20 bp, Artificial Sequence
  chemically synthesized
ggagccttgctctgtcaccc

SEQ ID NO: 251860 - DNA, 20 bp, Artificial Sequence
  chemically synthesized
ctgcattccagcctgggtga

SEQ ID NO: 251861 - DNA, 20 bp, Artificial Sequence
  chemically synthesized
ccttgctctgtcacccaggc

SEQ ID NO: 251862 - DNA, 20 bp, Artificial Sequence
  chemically synthesized
ccaccactgcattccagcct

SEQ ID NO: 251863 - DNA, 20 bp, Artificial Sequence
  chemically synthesized
tccaccactgcattccagcc

SEQ ID NO: 251864 - DNA, 20 bp, Artificial Sequence
  chemically synthesized
ctgtcacccaggctggaatg

SEQ ID NO: 251865 - DNA, 20 bp, Artificial Sequence
  chemically synthesized
ccaaatccaccactgcattc

SEQ ID NO: 251866 - DNA, 20 bp, Artificial Sequence
  chemically synthesized
tcacccaggctggaatgcag

SEQ ID NO: 251867 - DNA, 20 bp, Artificial Sequence
  chemically synthesized
cccaggctggaatgcagtgg

SEQ ID NO: 251868 - DNA, 20 bp, Artificial Sequence
  chemically synthesized
ctggaatgcagtggtggatt

SEQ ID NO: 251869 - DNA, 20 bp, Artificial Sequence
  chemically synthesized
tggaatgcagtggtggattt

SEQ ID NO: 251870 - DNA, 20 bp, Artificial Sequence
  chemically synthesized
tggtggatttgggctcactg

SEQ ID NO: 251871 - DNA, 20 bp, Artificial Sequence
  chemically synthesized
caggaggcagaggctgcagt

SEQ ID NO: 251872 - DNA, 20 bp, Artificial Sequence
  chemically synthesized
aacccaggaggcagaggctg

SEQ ID NO: 251873 - DNA, 20 bp, Artificial Sequence
  chemically synthesized
cccttgaacccaggaggcag

SEQ ID NO: 251874 - DNA, 20 bp, Artificial Sequence
  chemically synthesized
tcactgcagcctctgcctcc

SEQ ID NO: 251875 - DNA, 20 bp, Artificial Sequence
  chemically synthesized
tcccttgaacccaggaggca

SEQ ID NO: 251876 - DNA, 20 bp, Artificial Sequence
  chemically synthesized
cactgcagcctctgcctcct

SEQ ID NO: 251877 - DNA, 20 bp, Artificial Sequence
  chemically synthesized
aatcccttgaacccaggagg

SEQ ID NO: 251878 - DNA, 20 bp, Artificial Sequence
  chemically synthesized
gagaatcccttgaacccagg

SEQ ID NO: 251879 - DNA, 20 bp, Artificial Sequence
  chemically synthesized
ggagaatcccttgaacccag

SEQ ID NO: 251880 - DNA, 20 bp, Artificial Sequence
  chemically synthesized
agcctctgcctcctgggttc

SEQ ID NO: 251881 - DNA, 20 bp, Artificial Sequence
  chemically synthesized
gcctctgcctcctgggttca

SEQ ID NO: 251882 - DNA, 20 bp, Artificial Sequence
  chemically synthesized
caggagaatcccttgaaccc

SEQ ID NO: 251883 - DNA, 20 bp, Artificial Sequence
  chemically synthesized
cctctgcctcctgggttcaa

SEQ ID NO: 251884 - DNA, 20 bp, Artificial Sequence
  chemically synthesized
gcaggagaatcccttgaacc

SEQ ID NO: 251885 - DNA, 20 bp, Artificial Sequence
  chemically synthesized
ttcaagggattctcctgcct

SEQ ID NO: 251886 - DNA, 20 bp, Artificial Sequence
  chemically synthesized
tactcgggaggctgaggcag

SEQ ID NO: 251887 - DNA, 20 bp, Artificial Sequence
  chemically synthesized
gctactcgggaggctgaggc

SEQ ID NO: 251888 - DNA, 20 bp, Artificial Sequence
  chemically synthesized
agctactcgggaggctgagg

SEQ ID NO: 251889 - DNA, 20 bp, Artificial Sequence
  chemically synthesized
cccagctactcgggaggctg

SEQ ID NO: 251890 - DNA, 20 bp, Artificial Sequence
  chemically synthesized
tcccagctactcgggaggct

SEQ ID NO: 251891 - DNA, 20 bp, Artificial Sequence
  chemically synthesized
ttctcctgcctcagcctccc

SEQ ID NO: 251892 - DNA, 20 bp, Artificial Sequence
  chemically synthesized
tcctgcctcagcctcccgag

SEQ ID NO: 251893 - DNA, 20 bp, Artificial Sequence
  chemically synthesized
tgtagtcccagctactcggg

SEQ ID NO: 251894 - DNA, 20 bp, Artificial Sequence
  chemically synthesized
ttgtagtcccagctactcgg

SEQ ID NO: 251895 - DNA, 20 bp, Artificial Sequence
  chemically synthesized
gcctcagcctcccgagtagc

SEQ ID NO: 251896 - DNA, 20 bp, Artificial Sequence
  chemically synthesized
gcttgtagtcccagctactc

SEQ ID NO: 251897 - DNA, 20 bp, Artificial Sequence
  chemically synthesized
cctcagcctcccgagtagct

SEQ ID NO: 251898 - DNA, 20 bp, Artificial Sequence
  chemically synthesized
cgcttgtagtcccagctact

SEQ ID NO: 251899 - DNA, 20 bp, Artificial Sequence
  chemically synthesized
tcccgagtagctgggactac

SEQ ID NO: 251900 - DNA, 20 bp, Artificial Sequence
  chemically synthesized
gtggcatgcgcttgtagtcc

SEQ ID NO: 251901 - DNA, 20 bp, Artificial Sequence
  chemically synthesized
tgcgtggtggcatgcgcttg

SEQ ID NO: 251902 - DNA, 20 bp, Artificial Sequence
  chemically synthesized
caagcgcatgccaccacgca

SEQ ID NO: 251903 - DNA, 20 bp, Artificial Sequence
  chemically synthesized
caaaaatgacctgtgcgtgg

SEQ ID NO: 251904 - DNA, 20 bp, Artificial Sequence
  chemically synthesized
aagcgcatgccaccacgcac

SEQ ID NO: 251905 - DNA, 20 bp, Artificial Sequence
  chemically synthesized
atacaaaaatgacctgtgcg

SEQ ID NO: 251906 - DNA, 20 bp, Artificial Sequence
  chemically synthesized
ggtcatttttgtatttttaa

SEQ ID NO: 251907 - DNA, 20 bp, Artificial Sequence
  chemically synthesized
tcatttttgtatttttaatg

SEQ ID NO: 251908 - DNA, 20 bp, Artificial Sequence
  chemically synthesized
tttgtatttttaatggagac

SEQ ID NO: 251909 - DNA, 20 bp, Artificial Sequence
  chemically synthesized
ttgtatttttaatggagaca

SEQ ID NO: 251910 - DNA, 20 bp, Artificial Sequence
  chemically synthesized
gagacaaggtttcaccatgt

SEQ ID NO: 251911 - DNA, 20 bp, Artificial Sequence
  chemically synthesized
caaggtttcaccatgttggc

SEQ ID NO: 251912 - DNA, 20 bp, Artificial Sequence
  chemically synthesized
cgagaccagcctggccaaca

SEQ ID NO: 251913 - DNA, 20 bp, Artificial Sequence
  chemically synthesized
aaggtttcaccatgttggcc

SEQ ID NO: 251914 - DNA, 20 bp, Artificial Sequence
  chemically synthesized
tttcaccatgttggccaggc

SEQ ID NO: 251915 - DNA, 20 bp, Artificial Sequence
  chemically synthesized
tcaggagtccgagaccagcc

SEQ ID NO: 251916 - DNA, 20 bp, Artificial Sequence
  chemically synthesized
catgttggccaggctggtct

SEQ ID NO: 251917 - DNA, 20 bp, Artificial Sequence
  chemically synthesized
tgaggtcaggagtccgagac

SEQ ID NO: 251918 - DNA, 20 bp, Artificial Sequence
  chemically synthesized
tcatttgaggtcaggagtcc

SEQ ID NO: 251919 - DNA, 20 bp, Artificial Sequence
  chemically synthesized
ggcacatcatttgaggtcag

SEQ ID NO: 251920 - DNA, 20 bp, Artificial Sequence
  chemically synthesized
cgggcacatcatttgaggtc

SEQ ID NO: 251921 - DNA, 20 bp, Artificial Sequence
  chemically synthesized
gcgggcacatcatttgaggt

SEQ ID NO: 251922 - DNA, 20 bp, Artificial Sequence
  chemically synthesized
caaggcgggcacatcatttg

SEQ ID NO: 251923 - DNA, 20 bp, Artificial Sequence
  chemically synthesized
ccaaggcgggcacatcattt

SEQ ID NO: 251924 - DNA, 20 bp, Artificial Sequence
  chemically synthesized
ctcaaatgatgtgcccgcct

SEQ ID NO: 251925 - DNA, 20 bp, Artificial Sequence
  chemically synthesized
gcactttgggagtccaaggc

SEQ ID NO: 251926 - DNA, 20 bp, Artificial Sequence
  chemically synthesized
agcactttgggagtccaagg

SEQ ID NO: 251927 - DNA, 20 bp, Artificial Sequence
  chemically synthesized
cccagcactttgggagtcca

SEQ ID NO: 251928 - DNA, 20 bp, Artificial Sequence
  chemically synthesized
tcccagcactttgggagtcc

SEQ ID NO: 251929 - DNA, 20 bp, Artificial Sequence
  chemically synthesized
gtgcccgccttggactccca

SEQ ID NO: 251930 - DNA, 20 bp, Artificial Sequence
  chemically synthesized
ctgtaatcccagcactttgg

SEQ ID NO: 251931 - DNA, 20 bp, Artificial Sequence
  chemically synthesized
gccttggactcccaaagtgc

SEQ ID NO: 251932 - DNA, 20 bp, Artificial Sequence
  chemically synthesized
gtctgtaatcccagcacttt

SEQ ID NO: 251933 - DNA, 20 bp, Artificial Sequence
  chemically synthesized
ccttggactcccaaagtgct

SEQ ID NO: 251934 - DNA, 20 bp, Artificial Sequence
  chemically synthesized
tgtctgtaatcccagcactt

SEQ ID NO: 251935 - DNA, 20 bp, Artificial Sequence
  chemically synthesized
ctcccaaagtgctgggatta

SEQ ID NO: 251936 - DNA, 20 bp, Artificial Sequence
  chemically synthesized
gtggctcatgtctgtaatcc

SEQ ID NO: 251937 - DNA, 20 bp, Artificial Sequence
  chemically synthesized
agtgctgggattacagacat

SEQ ID NO: 251938 - DNA, 20 bp, Artificial Sequence
  chemically synthesized
accttccagggcaggtgcgg

SEQ ID NO: 251939 - DNA, 20 bp, Artificial Sequence
  chemically synthesized
tgcaccttccagggcaggtg

SEQ ID NO: 251940 - DNA, 20 bp, Artificial Sequence
  chemically synthesized
atgagccaccgcacctgccc

SEQ ID NO: 251941 - DNA, 20 bp, Artificial Sequence
  chemically synthesized
agccaccgcacctgccctgg

SEQ ID NO: 251942 - DNA, 20 bp, Artificial Sequence
  chemically synthesized
ctcactgcaccttccagggc

SEQ ID NO: 251943 - DNA, 20 bp, Artificial Sequence
  chemically synthesized
gccaccgcacctgccctgga

SEQ ID NO: 251944 - DNA, 20 bp, Artificial Sequence
  chemically synthesized
tctcactgcaccttccaggg

SEQ ID NO: 251945 - DNA, 20 bp, Artificial Sequence
  chemically synthesized
ttatctcactgcaccttcca

SEQ ID NO: 251946 - DNA, 20 bp, Artificial Sequence
  chemically synthesized
tttatctcactgcaccttcc

SEQ ID NO: 251947 - DNA, 20 bp, Artificial Sequence
  chemically synthesized
cgcacctgccctggaaggtg

SEQ ID NO: 251948 - DNA, 20 bp, Artificial Sequence
  chemically synthesized
atttatctcactgcaccttc

SEQ ID NO: 251949 - DNA, 20 bp, Artificial Sequence
  chemically synthesized
cctgccctggaaggtgcagt

SEQ ID NO: 251950 - DNA, 20 bp, Artificial Sequence
  chemically synthesized
aaggtgcagtgagataaatc

SEQ ID NO: 251951 - DNA, 20 bp, Artificial Sequence
  chemically synthesized
gtgcagtgagataaatctgg

SEQ ID NO: 251952 - DNA, 20 bp, Artificial Sequence
  chemically synthesized
ttcccctttggatagtctac

SEQ ID NO: 251953 - DNA, 20 bp, Artificial Sequence
  chemically synthesized
taaatctggtagactatcca

SEQ ID NO: 251954 - DNA, 20 bp, Artificial Sequence
  chemically synthesized
aaatctggtagactatccaa

SEQ ID NO: 251955 - DNA, 20 bp, Artificial Sequence
  chemically synthesized
aatctggtagactatccaaa

SEQ ID NO: 251956 - DNA, 20 bp, Artificial Sequence
  chemically synthesized
atctggtagactatccaaag

SEQ ID NO: 251957 - DNA, 20 bp, Artificial Sequence
  chemically synthesized
gagaatatttcccctttgga

SEQ ID NO: 251958 - DNA, 20 bp, Artificial Sequence
  chemically synthesized
acctgagaatatttcccctt

SEQ ID NO: 251959 - DNA, 20 bp, Artificial Sequence
  chemically synthesized
atccaaaggggaaatattct

SEQ ID NO: 251960 - DNA, 20 bp, Artificial Sequence
  chemically synthesized
tccaaaggggaaatattctc

SEQ ID NO: 251961 - DNA, 20 bp, Artificial Sequence
  chemically synthesized
ggggaaatattctcaggttt

SEQ ID NO: 251962 - DNA, 20 bp, Artificial Sequence
  chemically synthesized
aagcctcctctccgaaacct

SEQ ID NO: 251963 - DNA, 20 bp, Artificial Sequence
  chemically synthesized
ggaaatattctcaggtttcg

SEQ ID NO: 251964 - DNA, 20 bp, Artificial Sequence
  chemically synthesized
aaatattctcaggtttcgga

SEQ ID NO: 251965 - DNA, 20 bp, Artificial Sequence
  chemically synthesized
aatattctcaggtttcggag

SEQ ID NO: 251966 - DNA, 20 bp, Artificial Sequence
  chemically synthesized
tattctcaggtttcggagag

SEQ ID NO: 251967 - DNA, 20 bp, Artificial Sequence
  chemically synthesized
attctcaggtttcggagagg

SEQ ID NO: 251968 - DNA, 20 bp, Artificial Sequence
  chemically synthesized
aggtttcggagaggaggctt

SEQ ID NO: 251969 - DNA, 20 bp, Artificial Sequence
  chemically synthesized
tcggagaggaggcttgagtc

SEQ ID NO: 251970 - DNA, 20 bp, Artificial Sequence
  chemically synthesized
tgttcaatgtgtctggactc

SEQ ID NO: 251971 - DNA, 20 bp, Artificial Sequence
  chemically synthesized
aagtgggtgttcaatgtgtc

SEQ ID NO: 251972 - DNA, 20 bp, Artificial Sequence
  chemically synthesized
tatagtgctgagcacaaagt

SEQ ID NO: 251973 - DNA, 20 bp, Artificial Sequence
  chemically synthesized
atatagtgctgagcacaaag

SEQ ID NO: 251974 - DNA, 20 bp, Artificial Sequence
  chemically synthesized
ttgaacacccactttgtgct

SEQ ID NO: 251975 - DNA, 20 bp, Artificial Sequence
  chemically synthesized
ctgatatagtgctgagcaca

SEQ ID NO: 251976 - DNA, 20 bp, Artificial Sequence
  chemically synthesized
ctcaggactgatatagtgct

SEQ ID NO: 251977 - DNA, 20 bp, Artificial Sequence
  chemically synthesized
ctttgtgctcagcactatat

SEQ ID NO: 251978 - DNA, 20 bp, Artificial Sequence
  chemically synthesized
ttatatgctcaggactgata

SEQ ID NO: 251979 - DNA, 20 bp, Artificial Sequence
  chemically synthesized
ctcagcactatatcagtcct

SEQ ID NO: 251980 - DNA, 20 bp, Artificial Sequence
  chemically synthesized
tttatttgtgttatatgctc

SEQ ID NO: 251981 - DNA, 20 bp, Artificial Sequence
  chemically synthesized
ttttatttgtgttatatgct

SEQ ID NO: 251982 - DNA, 20 bp, Artificial Sequence
  chemically synthesized
catataacacaaataaaaca

SEQ ID NO: 251983 - DNA, 20 bp, Artificial Sequence
  chemically synthesized
cacaagctccttatagaaaa

SEQ ID NO: 251984 - DNA, 20 bp, Artificial Sequence
  chemically synthesized
aaaacatagcccttttctat

SEQ ID NO: 251985 - DNA, 20 bp, Artificial Sequence
  chemically synthesized
acacaagctccttatagaaa

SEQ ID NO: 251986 - DNA, 20 bp, Artificial Sequence
  chemically synthesized
aaacatagcccttttctata

SEQ ID NO: 251987 - DNA, 20 bp, Artificial Sequence
  chemically synthesized
cacacaagctccttatagaa

SEQ ID NO: 251988 - DNA, 20 bp, Artificial Sequence
  chemically synthesized
acatagcccttttctataag

SEQ ID NO: 251989 - DNA, 20 bp, Artificial Sequence
  chemically synthesized
cctcccacacaagctcctta

SEQ ID NO: 251990 - DNA, 20 bp, Artificial Sequence
  chemically synthesized
ttttctataaggagcttgtg

SEQ ID NO: 251991 - DNA, 20 bp, Artificial Sequence
  chemically synthesized
tttctataaggagcttgtgt

SEQ ID NO: 251992 - DNA, 20 bp, Artificial Sequence
  chemically synthesized
tctataaggagcttgtgtgg

SEQ ID NO: 251993 - DNA, 20 bp, Artificial Sequence
  chemically synthesized
ctataaggagcttgtgtggg

SEQ ID NO: 251994 - DNA, 20 bp, Artificial Sequence
  chemically synthesized
tacttttctgcctcccacac

SEQ ID NO: 251995 - DNA, 20 bp, Artificial Sequence
  chemically synthesized
taaggagcttgtgtgggagg

SEQ ID NO: 251996 - DNA, 20 bp, Artificial Sequence
  chemically synthesized
agcttgtgtgggaggcagaa

SEQ ID NO: 251997 - DNA, 20 bp, Artificial Sequence
  chemically synthesized
acaaattgattactatgtgt

SEQ ID NO: 251998 - DNA, 20 bp, Artificial Sequence
  chemically synthesized
caaattgattactatgtgtt

SEQ ID NO: 251999 - DNA, 20 bp, Artificial Sequence
  chemically synthesized
tgctcctaaaacctaacaca

SEQ ID NO: 252000 - DNA, 20 bp, Artificial Sequence
  chemically synthesized
gattactatgtgttaggttt

SEQ ID NO: 252001 - DNA, 20 bp, Artificial Sequence
  chemically synthesized
attactatgtgttaggtttt

SEQ ID NO: 252002 - DNA, 20 bp, Artificial Sequence
  chemically synthesized
tactatgtgttaggttttag

SEQ ID NO: 252003 - DNA, 20 bp, Artificial Sequence
  chemically synthesized
tatgtgttaggttttaggag

SEQ ID NO: 252004 - DNA, 20 bp, Artificial Sequence
  chemically synthesized
atgtgttaggttttaggagc

SEQ ID NO: 252005 - DNA, 20 bp, Artificial Sequence
  chemically synthesized
ggttttaggagcaggcacat

SEQ ID NO: 252006 - DNA, 20 bp, Artificial Sequence
  chemically synthesized
atcagatcatatattctaca

SEQ ID NO: 252007 - DNA, 20 bp, Artificial Sequence
  chemically synthesized
agatcatatattctacacgg

SEQ ID NO: 252008 - DNA, 20 bp, Artificial Sequence
  chemically synthesized
cagacttggtggctaccgtg

SEQ ID NO: 252009 - DNA, 20 bp, Artificial Sequence
  chemically synthesized
tattctacacggtagccacc

SEQ ID NO: 252010 - DNA, 20 bp, Artificial Sequence
  chemically synthesized
tacacggtagccaccaagtc

SEQ ID NO: 252011 - DNA, 20 bp, Artificial Sequence
  chemically synthesized
tgtaaattttccagacttgg

SEQ ID NO: 252012 - DNA, 20 bp, Artificial Sequence
  chemically synthesized
atttgtaaattttccagact

SEQ ID NO: 252013 - DNA, 20 bp, Artificial Sequence
  chemically synthesized
ttatgcatttgtaaattttc

SEQ ID NO: 252014 - DNA, 20 bp, Artificial Sequence
  chemically synthesized
taaatgatgaaacaatatcc

SEQ ID NO: 252015 - DNA, 20 bp, Artificial Sequence
  chemically synthesized
tgaaacaatatccaagtttc

SEQ ID NO: 252016 - DNA, 20 bp, Artificial Sequence
  chemically synthesized
gctcctaacatctggaaact

SEQ ID NO: 252017 - DNA, 20 bp, Artificial Sequence
  chemically synthesized
atatccaagtttccagatgt

SEQ ID NO: 252018 - DNA, 20 bp, Artificial Sequence
  chemically synthesized
tatccaagtttccagatgtt

SEQ ID NO: 252019 - DNA, 20 bp, Artificial Sequence
  chemically synthesized
tattagtcgctcctaacatc

SEQ ID NO: 252020 - DNA, 20 bp, Artificial Sequence
  chemically synthesized
tccaagtttccagatgttag

SEQ ID NO: 252021 - DNA, 20 bp, Artificial Sequence
  chemically synthesized
cagatgttaggagcgactaa

SEQ ID NO: 252022 - DNA, 20 bp, Artificial Sequence
  chemically synthesized
ttaggagcgactaatagttt

SEQ ID NO: 252023 - DNA, 20 bp, Artificial Sequence
  chemically synthesized
tctagaaatcctaaaactat

SEQ ID NO: 252024 - DNA, 20 bp, Artificial Sequence
  chemically synthesized
taggagcgactaatagtttt

SEQ ID NO: 252025 - DNA, 20 bp, Artificial Sequence
  chemically synthesized
actaatagttttaggatttc

SEQ ID NO: 252026 - DNA, 20 bp, Artificial Sequence
  chemically synthesized
agttttaggatttctagaaa

SEQ ID NO: 252027 - DNA, 20 bp, Artificial Sequence
  chemically synthesized
cttcagatgttgtctttttc

SEQ ID NO: 252028 - DNA, 20 bp, Artificial Sequence
  chemically synthesized
ctagaaaaagacaacatctg

SEQ ID NO: 252029 - DNA, 20 bp, Artificial Sequence
  chemically synthesized
aaaaagacaacatctgaagt

SEQ ID NO: 252030 - DNA, 20 bp, Artificial Sequence
  chemically synthesized
ctgttcttcaggtctcactt

SEQ ID NO: 252031 - DNA, 20 bp, Artificial Sequence
  chemically synthesized
aacatctgaagtgagacctg

SEQ ID NO: 252032 - DNA, 20 bp, Artificial Sequence
  chemically synthesized
ctgaagtgagacctgaagaa

SEQ ID NO: 252033 - DNA, 20 bp, Artificial Sequence
  chemically synthesized
tgaagtgagacctgaagaac

SEQ ID NO: 252034 - DNA, 20 bp, Artificial Sequence
  chemically synthesized
ctctgacctgcctgttcttc

SEQ ID NO: 252035 - DNA, 20 bp, Artificial Sequence
  chemically synthesized
cctctgacctgcctgttctt

SEQ ID NO: 252036 - DNA, 20 bp, Artificial Sequence
  chemically synthesized
agtgagacctgaagaacagg

SEQ ID NO: 252037 - DNA, 20 bp, Artificial Sequence
  chemically synthesized
gtgagacctgaagaacaggc

SEQ ID NO: 252038 - DNA, 20 bp, Artificial Sequence
  chemically synthesized
gacctgaagaacaggcaggt

SEQ ID NO: 252039 - DNA, 20 bp, Artificial Sequence
  chemically synthesized
cctgaagaacaggcaggtca

SEQ ID NO: 252040 - DNA, 20 bp, Artificial Sequence
  chemically synthesized
ctgaagaacaggcaggtcag

SEQ ID NO: 252041 - DNA, 20 bp, Artificial Sequence
  chemically synthesized
tgaagaacaggcaggtcaga

SEQ ID NO: 252042 - DNA, 20 bp, Artificial Sequence
  chemically synthesized
aagaacaggcaggtcagagg

SEQ ID NO: 252043 - DNA, 20 bp, Artificial Sequence
  chemically synthesized
cagagggagtacaaaacact

SEQ ID NO: 252044 - DNA, 20 bp, Artificial Sequence
  chemically synthesized
agagggagtacaaaacactt

SEQ ID NO: 252045 - DNA, 20 bp, Artificial Sequence
  chemically synthesized
aaatcaatttgcagatgccc

SEQ ID NO: 252046 - DNA, 20 bp, Artificial Sequence
  chemically synthesized
agcgatattaaatcaatttg

SEQ ID NO: 252047 - DNA, 20 bp, Artificial Sequence
  chemically synthesized
gcaaattgatttaatatcgc

SEQ ID NO: 252048 - DNA, 20 bp, Artificial Sequence
  chemically synthesized
aagcccctccaattatgttc

SEQ ID NO: 252049 - DNA, 20 bp, Artificial Sequence
  chemically synthesized
taatatcgctagaacataat

SEQ ID NO: 252050 - DNA, 20 bp, Artificial Sequence
  chemically synthesized
atatcgctagaacataattg

SEQ ID NO: 252051 - DNA, 20 bp, Artificial Sequence
  chemically synthesized
tatcgctagaacataattgg

SEQ ID NO: 252052 - DNA, 20 bp, Artificial Sequence
  chemically synthesized
atcgctagaacataattgga

SEQ ID NO: 252053 - DNA, 20 bp, Artificial Sequence
  chemically synthesized
tcgctagaacataattggag

SEQ ID NO: 252054 - DNA, 20 bp, Artificial Sequence
  chemically synthesized
ataattggaggggcttgcta

SEQ ID NO: 252055 - DNA, 20 bp, Artificial Sequence
  chemically synthesized
taattggaggggcttgctat

SEQ ID NO: 252056 - DNA, 20 bp, Artificial Sequence
  chemically synthesized
aattggaggggcttgctata

SEQ ID NO: 252057 - DNA, 20 bp, Artificial Sequence
  chemically synthesized
cttcgtgcctgccctatagc

SEQ ID NO: 252058 - DNA, 20 bp, Artificial Sequence
  chemically synthesized
tggaggggcttgctataggg

SEQ ID NO: 252059 - DNA, 20 bp, Artificial Sequence
  chemically synthesized
ggaggggcttgctatagggc

SEQ ID NO: 252060 - DNA, 20 bp, Artificial Sequence
  chemically synthesized
atttcttcgtgcctgcccta

SEQ ID NO: 252061 - DNA, 20 bp, Artificial Sequence
  chemically synthesized
cttgctatagggcaggcacg

SEQ ID NO: 252062 - DNA, 20 bp, Artificial Sequence
  chemically synthesized
tagggcaggcacgaagaaat

SEQ ID NO: 252063 - DNA, 20 bp, Artificial Sequence
  chemically synthesized
ggcaggcacgaagaaataag

SEQ ID NO: 252064 - DNA, 20 bp, Artificial Sequence
  chemically synthesized
ggcacgaagaaataagcagt

SEQ ID NO: 252065 - DNA, 20 bp, Artificial Sequence
  chemically synthesized
gcacgaagaaataagcagtg

SEQ ID NO: 252066 - DNA, 20 bp, Artificial Sequence
  chemically synthesized
aaataagcagtgaggctgac

SEQ ID NO: 252067 - DNA, 20 bp, Artificial Sequence
  chemically synthesized
attgtgcaaaattatctggt

SEQ ID NO: 252068 - DNA, 20 bp, Artificial Sequence
  chemically synthesized
cttaattgtgcaaaattatc

SEQ ID NO: 252069 - DNA, 20 bp, Artificial Sequence
  chemically synthesized
ccagataattttgcacaatt

SEQ ID NO: 252070 - DNA, 20 bp, Artificial Sequence
  chemically synthesized
cagataattttgcacaatta

SEQ ID NO: 252071 - DNA, 20 bp, Artificial Sequence
  chemically synthesized
gataattttgcacaattaag

SEQ ID NO: 252072 - DNA, 20 bp, Artificial Sequence
  chemically synthesized
attttgcacaattaaggagt

SEQ ID NO: 252073 - DNA, 20 bp, Artificial Sequence
  chemically synthesized
ttttgcacaattaaggagtc

SEQ ID NO: 252074 - DNA, 20 bp, Artificial Sequence
  chemically synthesized
tttgcacaattaaggagtca

SEQ ID NO: 252075 - DNA, 20 bp, Artificial Sequence
  chemically synthesized
ggagtcagggtttcattctc

SEQ ID NO: 252076 - DNA, 20 bp, Artificial Sequence
  chemically synthesized
gagtcagggtttcattctca

SEQ ID NO: 252077 - DNA, 20 bp, Artificial Sequence
  chemically synthesized
agtcagggtttcattctcaa

SEQ ID NO: 252078 - DNA, 20 bp, Artificial Sequence
  chemically synthesized
tactataatctcattccctt

SEQ ID NO: 252079 - DNA, 20 bp, Artificial Sequence
  chemically synthesized
ggtttcattctcaagggaat

SEQ ID NO: 252080 - DNA, 20 bp, Artificial Sequence
  chemically synthesized
ttctcaagggaatgagatta

SEQ ID NO: 252081 - DNA, 20 bp, Artificial Sequence
  chemically synthesized
ggaatgagattatagtacca

SEQ ID NO: 252082 - DNA, 20 bp, Artificial Sequence
  chemically synthesized
tttctaaagtgtaagagctt

SEQ ID NO: 252083 - DNA, 20 bp, Artificial Sequence
  chemically synthesized
gtcatttttctaaagtgtaa

SEQ ID NO: 252084 - DNA, 20 bp, Artificial Sequence
  chemically synthesized
gtaccaaagctcttacactt

SEQ ID NO: 252085 - DNA, 20 bp, Artificial Sequence
  chemically synthesized
ccgtcatttttctaaagtgt

SEQ ID NO: 252086 - DNA, 20 bp, Artificial Sequence
  chemically synthesized
cagtggccgtcatttttcta

SEQ ID NO: 252087 - DNA, 20 bp, Artificial Sequence
  chemically synthesized
cttacactttagaaaaatga

SEQ ID NO: 252088 - DNA, 20 bp, Artificial Sequence
  chemically synthesized
agaaaaatgacggccactga

SEQ ID NO: 252089 - DNA, 20 bp, Artificial Sequence
  chemically synthesized
tgttctcaacgatctttcag

SEQ ID NO: 252090 - DNA, 20 bp, Artificial Sequence
  chemically synthesized
ctttgttctcaacgatcttt

SEQ ID NO: 252091 - DNA, 20 bp, Artificial Sequence
  chemically synthesized
acggccactgaaagatcgtt

SEQ ID NO: 252092 - DNA, 20 bp, Artificial Sequence
  chemically synthesized
ctgaaagatcgttgagaaca

SEQ ID NO: 252093 - DNA, 20 bp, Artificial Sequence
  chemically synthesized
aaagatcgttgagaacaaag

SEQ ID NO: 252094 - DNA, 20 bp, Artificial Sequence
  chemically synthesized
agatcgttgagaacaaagtg

SEQ ID NO: 252095 - DNA, 20 bp, Artificial Sequence
  chemically synthesized
caaagtggagataatcactt

SEQ ID NO: 252096 - DNA, 20 bp, Artificial Sequence
  chemically synthesized
gcattaatctcagttgtctc

SEQ ID NO: 252097 - DNA, 20 bp, Artificial Sequence
  chemically synthesized
gataatcacttgagacaact

SEQ ID NO: 252098 - DNA, 20 bp, Artificial Sequence
  chemically synthesized
gagatttctagcattaatct

SEQ ID NO: 252099 - DNA, 20 bp, Artificial Sequence
  chemically synthesized
gagacaactgagattaatgc

SEQ ID NO: 252100 - DNA, 20 bp, Artificial Sequence
  chemically synthesized
ggcacctaaagagagatttc

SEQ ID NO: 252101 - DNA, 20 bp, Artificial Sequence
  chemically synthesized
taatgctagaaatctctctt

SEQ ID NO: 252102 - DNA, 20 bp, Artificial Sequence
  chemically synthesized
aatgctagaaatctctcttt

SEQ ID NO: 252103 - DNA, 20 bp, Artificial Sequence
  chemically synthesized
ctacatcaggcacctaaaga

SEQ ID NO: 252104 - DNA, 20 bp, Artificial Sequence
  chemically synthesized
tactacatcaggcacctaaa

SEQ ID NO: 252105 - DNA, 20 bp, Artificial Sequence
  chemically synthesized
tttactacatcaggcaccta

SEQ ID NO: 252106 - DNA, 20 bp, Artificial Sequence
  chemically synthesized
ctctctttaggtgcctgatg

SEQ ID NO: 252107 - DNA, 20 bp, Artificial Sequence
  chemically synthesized
agttcttggtttactacatc

SEQ ID NO: 252108 - DNA, 20 bp, Artificial Sequence
  chemically synthesized
tagttcttggtttactacat

SEQ ID NO: 252109 - DNA, 20 bp, Artificial Sequence
  chemically synthesized
ggtgcctgatgtagtaaacc

SEQ ID NO: 252110 - DNA, 20 bp, Artificial Sequence
  chemically synthesized
tttactcctattttagttct

SEQ ID NO: 252111 - DNA, 20 bp, Artificial Sequence
  chemically synthesized
tagtaaaccaagaactaaaa

SEQ ID NO: 252112 - DNA, 20 bp, Artificial Sequence
  chemically synthesized
agtaaaccaagaactaaaat

SEQ ID NO: 252113 - DNA, 20 bp, Artificial Sequence
  chemically synthesized
taaaccaagaactaaaatag

SEQ ID NO: 252114 - DNA, 20 bp, Artificial Sequence
  chemically synthesized
aaccatctttactcctattt

SEQ ID NO: 252115 - DNA, 20 bp, Artificial Sequence
  chemically synthesized
caagaactaaaataggagta

SEQ ID NO: 252116 - DNA, 20 bp, Artificial Sequence
  chemically synthesized
aactaaaataggagtaaaga

SEQ ID NO: 252117 - DNA, 20 bp, Artificial Sequence
  chemically synthesized
aaaataggagtaaagatggt

SEQ ID NO: 252118 - DNA, 20 bp, Artificial Sequence
  chemically synthesized
ggagtaaagatggttagaaa

SEQ ID NO: 252119 - DNA, 20 bp, Artificial Sequence
  chemically synthesized
taaagatggttagaaatgga

SEQ ID NO: 252120 - DNA, 20 bp, Artificial Sequence
  chemically synthesized
ggttagaaatggacagatgt

SEQ ID NO: 252121 - DNA, 20 bp, Artificial Sequence
  chemically synthesized
ttagaaatggacagatgtaa

SEQ ID NO: 252122 - DNA, 20 bp, Artificial Sequence
  chemically synthesized
gacagatgtaagagatacca

SEQ ID NO: 252123 - DNA, 20 bp, Artificial Sequence
  chemically synthesized
cagatgtaagagataccatg

SEQ ID NO: 252124 - DNA, 20 bp, Artificial Sequence
  chemically synthesized
agatgtaagagataccatgg

SEQ ID NO: 252125 - DNA, 20 bp, Artificial Sequence
  chemically synthesized
ataattatagggaacctcca

SEQ ID NO: 252126 - DNA, 20 bp, Artificial Sequence
  chemically synthesized
tcattcgtctaataattata

SEQ ID NO: 252127 - DNA, 20 bp, Artificial Sequence
  chemically synthesized
atcattcgtctaataattat

SEQ ID NO: 252128 - DNA, 20 bp, Artificial Sequence
  chemically synthesized
tggaggttccctataattat

SEQ ID NO: 252129 - DNA, 20 bp, Artificial Sequence
  chemically synthesized
aatcattcgtctaataatta

SEQ ID NO: 252130 - DNA, 20 bp, Artificial Sequence
  chemically synthesized
cgaatgatttgatttcctct

SEQ ID NO: 252131 - DNA, 20 bp, Artificial Sequence
  chemically synthesized
ggcttcttaattattctcag

SEQ ID NO: 252132 - DNA, 20 bp, Artificial Sequence
  chemically synthesized
aggcttcttaattattctca

SEQ ID NO: 252133 - DNA, 20 bp, Artificial Sequence
  chemically synthesized
gtaggcttcttaattattct

SEQ ID NO: 252134 - DNA, 20 bp, Artificial Sequence
  chemically synthesized
gatttcctctgagaataatt

SEQ ID NO: 252135 - DNA, 20 bp, Artificial Sequence
  chemically synthesized
ttcctctgagaataattaag

SEQ ID NO: 252136 - DNA, 20 bp, Artificial Sequence
  chemically synthesized
ataattaagaagcctacctt

SEQ ID NO: 252137 - DNA, 20 bp, Artificial Sequence
  chemically synthesized
taattaagaagcctaccttg

SEQ ID NO: 252138 - DNA, 20 bp, Artificial Sequence
  chemically synthesized
gaagtctttatcctcaaggt

SEQ ID NO: 252139 - DNA, 20 bp, Artificial Sequence
  chemically synthesized
agaagtctttatcctcaagg

SEQ ID NO: 252140 - DNA, 20 bp, Artificial Sequence
  chemically synthesized
ttcagaagtctttatcctca

SEQ ID NO: 252141 - DNA, 20 bp, Artificial Sequence
  chemically synthesized
agaagcctaccttgaggata

SEQ ID NO: 252142 - DNA, 20 bp, Artificial Sequence
  chemically synthesized
tttcagaagtctttatcctc

SEQ ID NO: 252143 - DNA, 20 bp, Artificial Sequence
  chemically synthesized
cttaaagtgattcatttcag

SEQ ID NO: 252144 - DNA, 20 bp, Artificial Sequence
  chemically synthesized
cagcttaaagtgattcattt

SEQ ID NO: 252145 - DNA, 20 bp, Artificial Sequence
  chemically synthesized
cttctgaaatgaatcacttt

SEQ ID NO: 252146 - DNA, 20 bp, Artificial Sequence
  chemically synthesized
taaagttctctaacagctta

SEQ ID NO: 252147 - DNA, 20 bp, Artificial Sequence
  chemically synthesized
aatgaatcactttaagctgt

SEQ ID NO: 252148 - DNA, 20 bp, Artificial Sequence
  chemically synthesized
tgaatcactttaagctgtta

SEQ ID NO: 252149 - DNA, 20 bp, Artificial Sequence
  chemically synthesized
aaagtaataaagttctctaa

SEQ ID NO: 252150 - DNA, 20 bp, Artificial Sequence
  chemically synthesized
tttttagattaaaagtaata

SEQ ID NO: 252151 - DNA, 20 bp, Artificial Sequence
  chemically synthesized
cttttacatttttagattaa

SEQ ID NO: 252152 - DNA, 20 bp, Artificial Sequence
  chemically synthesized
tactctttcttttacatttt

SEQ ID NO: 252153 - DNA, 20 bp, Artificial Sequence
  chemically synthesized
cttttaatctaaaaatgtaa

SEQ ID NO: 252154 - DNA, 20 bp, Artificial Sequence
  chemically synthesized
taatctaaaaatgtaaaaga

SEQ ID NO: 252155 - DNA, 20 bp, Artificial Sequence
  chemically synthesized
atctaaaaatgtaaaagaaa

SEQ ID NO: 252156 - DNA, 20 bp, Artificial Sequence
  chemically synthesized
tagcttcacatcacaagaag

SEQ ID NO: 252157 - DNA, 20 bp, Artificial Sequence
  chemically synthesized
atttagcttcacatcacaag

SEQ ID NO: 252158 - DNA, 20 bp, Artificial Sequence
  chemically synthesized
attatttagcttcacatcac

SEQ ID NO: 252159 - DNA, 20 bp, Artificial Sequence
  chemically synthesized
aatccacttcttgtgatgtg

SEQ ID NO: 252160 - DNA, 20 bp, Artificial Sequence
  chemically synthesized
agaaattcaattacattatt

SEQ ID NO: 252161 - DNA, 20 bp, Artificial Sequence
  chemically synthesized
ttgacttaattggggggtgg

SEQ ID NO: 252162 - DNA, 20 bp, Artificial Sequence
  chemically synthesized
ctgttgacttaattgggggg

SEQ ID NO: 252163 - DNA, 20 bp, Artificial Sequence
  chemically synthesized
atttctgccaccccccaatt

SEQ ID NO: 252164 - DNA, 20 bp, Artificial Sequence
  chemically synthesized
tagctgttgacttaattggg

SEQ ID NO: 252165 - DNA, 20 bp, Artificial Sequence
  chemically synthesized
ttagctgttgacttaattgg

SEQ ID NO: 252166 - DNA, 20 bp, Artificial Sequence
  chemically synthesized
tttagctgttgacttaattg

SEQ ID NO: 252167 - DNA, 20 bp, Artificial Sequence
  chemically synthesized
atttagctgttgacttaatt

SEQ ID NO: 252168 - DNA, 20 bp, Artificial Sequence
  chemically synthesized
tatttagctgttgacttaat

SEQ ID NO: 252169 - DNA, 20 bp, Artificial Sequence
  chemically synthesized
ccaccccccaattaagtcaa

SEQ ID NO: 252170 - DNA, 20 bp, Artificial Sequence
  chemically synthesized
tttatcttaattgaaatatt

SEQ ID NO: 252171 - DNA, 20 bp, Artificial Sequence
  chemically synthesized
aacagctaaatatttcaatt

SEQ ID NO: 252172 - DNA, 20 bp, Artificial Sequence
  chemically synthesized
aatatttcaattaagataaa

SEQ ID NO: 252173 - DNA, 20 bp, Artificial Sequence
  chemically synthesized
tttgccatggggaatttgtt

SEQ ID NO: 252174 - DNA, 20 bp, Artificial Sequence
  chemically synthesized
tcaacttaacaaattcccca

SEQ ID NO: 252175 - DNA, 20 bp, Artificial Sequence
  chemically synthesized
ccacatttttttttgccatg

SEQ ID NO: 252176 - DNA, 20 bp, Artificial Sequence
  chemically synthesized
cccacatttttttttgccat

SEQ ID NO: 252177 - DNA, 20 bp, Artificial Sequence
  chemically synthesized
ccccacatttttttttgcca

SEQ ID NO: 252178 - DNA, 20 bp, Artificial Sequence
  chemically synthesized
ccccatggcaaaaaaaaatg

SEQ ID NO: 252179 - DNA, 20 bp, Artificial Sequence
  chemically synthesized
cccatggcaaaaaaaaatgt

SEQ ID NO: 252180 - DNA, 20 bp, Artificial Sequence
  chemically synthesized
ccatggcaaaaaaaaatgtg

SEQ ID NO: 252181 - DNA, 20 bp, Artificial Sequence
  chemically synthesized
catggcaaaaaaaaatgtgg

SEQ ID NO: 252182 - DNA, 20 bp, Artificial Sequence
  chemically synthesized
tggcaaaaaaaaatgtgggg

SEQ ID NO: 252183 - DNA, 20 bp, Artificial Sequence
  chemically synthesized
ggcaaaaaaaaatgtggggg

SEQ ID NO: 252184 - DNA, 20 bp, Artificial Sequence
  chemically synthesized
gcaaaaaaaaatgtggggga

SEQ ID NO: 252185 - DNA, 20 bp, Artificial Sequence
  chemically synthesized
atgtgggggagggtaatgca

SEQ ID NO: 252186 - DNA, 20 bp, Artificial Sequence
  chemically synthesized
ggagggtaatgcaaagtgta

SEQ ID NO: 252187 - DNA, 20 bp, Artificial Sequence
  chemically synthesized
tcatttatttatattttgga

SEQ ID NO: 252188 - DNA, 20 bp, Artificial Sequence
  chemically synthesized
ttcatttatttatattttgg

SEQ ID NO: 252189 - DNA, 20 bp, Artificial Sequence
  chemically synthesized
tttcatttatttatattttg

SEQ ID NO: 252190 - DNA, 20 bp, Artificial Sequence
  chemically synthesized
attttcatttatttatattt

SEQ ID NO: 252191 - DNA, 20 bp, Artificial Sequence
  chemically synthesized
aaaatcaatttttttattga

SEQ ID NO: 252192 - DNA, 20 bp, Artificial Sequence
  chemically synthesized
aaatcaatttttttattgat

SEQ ID NO: 252193 - DNA, 20 bp, Artificial Sequence
  chemically synthesized
tcaatttttttattgatagg

SEQ ID NO: 252194 - DNA, 20 bp, Artificial Sequence
  chemically synthesized
tattttaaacatgttaatct

SEQ ID NO: 252195 - DNA, 20 bp, Artificial Sequence
  chemically synthesized
atttataggagtttgatact

SEQ ID NO: 252196 - DNA, 20 bp, Artificial Sequence
  chemically synthesized
ctgtatctacaaatttatag

SEQ ID NO: 252197 - DNA, 20 bp, Artificial Sequence
  chemically synthesized
atctgtatctacaaatttat

SEQ ID NO: 252198 - DNA, 20 bp, Artificial Sequence
  chemically synthesized
aatctgtatctacaaattta

SEQ ID NO: 252199 - DNA, 20 bp, Artificial Sequence
  chemically synthesized
atcaaactcctataaatttg

SEQ ID NO: 252200 - DNA, 20 bp, Artificial Sequence
  chemically synthesized
ctcctataaatttgtagata

SEQ ID NO: 252201 - DNA, 20 bp, Artificial Sequence
  chemically synthesized
tgtagatacagatttgacta

SEQ ID NO: 252202 - DNA, 20 bp, Artificial Sequence
  chemically synthesized
cgatataacatatttatctt

SEQ ID NO: 252203 - DNA, 20 bp, Artificial Sequence
  chemically synthesized
ttatatcgaacaactgttta

SEQ ID NO: 252204 - DNA, 20 bp, Artificial Sequence
  chemically synthesized
gggcattgaggtgctataaa

SEQ ID NO: 252205 - DNA, 20 bp, Artificial Sequence
  chemically synthesized
taaatcagattggggcattg

SEQ ID NO: 252206 - DNA, 20 bp, Artificial Sequence
  chemically synthesized
gtaaatcagattggggcatt

SEQ ID NO: 252207 - DNA, 20 bp, Artificial Sequence
  chemically synthesized
ggtaatcgtaaatcagattg

SEQ ID NO: 252208 - DNA, 20 bp, Artificial Sequence
  chemically synthesized
aggtaatcgtaaatcagatt

SEQ ID NO: 252209 - DNA, 20 bp, Artificial Sequence
  chemically synthesized
caggtaatcgtaaatcagat

SEQ ID NO: 252210 - DNA, 20 bp, Artificial Sequence
  chemically synthesized
aatttcaggtaatcgtaaat

SEQ ID NO: 252211 - DNA, 20 bp, Artificial Sequence
  chemically synthesized
tttacgattacctgaaattt

SEQ ID NO: 252212 - DNA, 20 bp, Artificial Sequence
  chemically synthesized
attatatcttctaaaatttc

SEQ ID NO: 252213 - DNA, 20 bp, Artificial Sequence
  chemically synthesized
cattatatcttctaaaattt

SEQ ID NO: 252214 - DNA, 20 bp, Artificial Sequence
  chemically synthesized
acgattacctgaaattttag

SEQ ID NO: 252215 - DNA, 20 bp, Artificial Sequence
  chemically synthesized
ttaaatttagcgttatgttg

SEQ ID NO: 252216 - DNA, 20 bp, Artificial Sequence
  chemically synthesized
aaattattcagtattaaatt

SEQ ID NO: 252217 - DNA, 20 bp, Artificial Sequence
  chemically synthesized
gctgaactgtagaaattatt

SEQ ID NO: 252218 - DNA, 20 bp, Artificial Sequence
  chemically synthesized
ttaatactgaataatttcta

SEQ ID NO: 252219 - DNA, 20 bp, Artificial Sequence
  chemically synthesized
actgaataatttctacagtt

SEQ ID NO: 252220 - DNA, 20 bp, Artificial Sequence
  chemically synthesized
cagacaaatgagctgaactg

SEQ ID NO: 252221 - DNA, 20 bp, Artificial Sequence
  chemically synthesized
gatgaacaattcagacaaat

SEQ ID NO: 252222 - DNA, 20 bp, Artificial Sequence
  chemically synthesized
acaaataatgatgaacaatt

SEQ ID NO: 252223 - DNA, 20 bp, Artificial Sequence
  chemically synthesized
tgaaaaatggtaagtaaaat

SEQ ID NO: 252224 - DNA, 20 bp, Artificial Sequence
  chemically synthesized
cactctcattgaaaaatggt

SEQ ID NO: 252225 - DNA, 20 bp, Artificial Sequence
  chemically synthesized
gtatcactctcattgaaaaa

SEQ ID NO: 252226 - DNA, 20 bp, Artificial Sequence
  chemically synthesized
tttacttaccatttttcaat

SEQ ID NO: 252227 - DNA, 20 bp, Artificial Sequence
  chemically synthesized
tacttaccatttttcaatga

SEQ ID NO: 252228 - DNA, 20 bp, Artificial Sequence
  chemically synthesized
gaaaaaagacagggaaaaag

SEQ ID NO: 252229 - DNA, 20 bp, Artificial Sequence
  chemically synthesized
atggaaaaaagacagggaaa

SEQ ID NO: 252230 - DNA, 20 bp, Artificial Sequence
  chemically synthesized
ccctccatggaaaaaagaca

SEQ ID NO: 252231 - DNA, 20 bp, Artificial Sequence
  chemically synthesized
accctccatggaaaaaagac

SEQ ID NO: 252232 - DNA, 20 bp, Artificial Sequence
  chemically synthesized
taccctccatggaaaaaaga

SEQ ID NO: 252233 - DNA, 20 bp, Artificial Sequence
  chemically synthesized
ttttccctgtcttttttcca

SEQ ID NO: 252234 - DNA, 20 bp, Artificial Sequence
  chemically synthesized
tcagtaccctccatggaaaa

SEQ ID NO: 252235 - DNA, 20 bp, Artificial Sequence
  chemically synthesized
ttccctgtcttttttccatg

SEQ ID NO: 252236 - DNA, 20 bp, Artificial Sequence
  chemically synthesized
tccctgtcttttttccatgg

SEQ ID NO: 252237 - DNA, 20 bp, Artificial Sequence
  chemically synthesized
ccctgtcttttttccatgga

SEQ ID NO: 252238 - DNA, 20 bp, Artificial Sequence
  chemically synthesized
atttatttcagtaccctcca

SEQ ID NO: 252239 - DNA, 20 bp, Artificial Sequence
  chemically synthesized
gggaactgtagaatttattt

SEQ ID NO: 252240 - DNA, 20 bp, Artificial Sequence
  chemically synthesized
gggtactgaaataaattcta

SEQ ID NO: 252241 - DNA, 20 bp, Artificial Sequence
  chemically synthesized
gatttgttttcagggaactg

SEQ ID NO: 252242 - DNA, 20 bp, Artificial Sequence
  chemically synthesized
gcagaaatgatttgttttca

SEQ ID NO: 252243 - DNA, 20 bp, Artificial Sequence
  chemically synthesized
tgcagaaatgatttgttttc

SEQ ID NO: 252244 - DNA, 20 bp, Artificial Sequence
  chemically synthesized
ttgcagaaatgatttgtttt

SEQ ID NO: 252245 - DNA, 20 bp, Artificial Sequence
  chemically synthesized
tgaaaacaaatcatttctgc

SEQ ID NO: 252246 - DNA, 20 bp, Artificial Sequence
  chemically synthesized
tatatttttcttgatacttg

SEQ ID NO: 252247 - DNA, 20 bp, Artificial Sequence
  chemically synthesized
aaatcatttctgcaagtatc

SEQ ID NO: 252248 - DNA, 20 bp, Artificial Sequence
  chemically synthesized
gtacaaggaccgacaagggt

SEQ ID NO: 252249 - DNA, 20 bp, Artificial Sequence
  chemically synthesized
tatgtgttacctacccttgt

SEQ ID NO: 252250 - DNA, 20 bp, Artificial Sequence
  chemically synthesized
tgtacaaggaccgacaaggg

SEQ ID NO: 252251 - DNA, 20 bp, Artificial Sequence
  chemically synthesized
aaatgtacaaggaccgacaa

SEQ ID NO: 252252 - DNA, 20 bp, Artificial Sequence
  chemically synthesized
aaaatgtacaaggaccgaca

SEQ ID NO: 252253 - DNA, 20 bp, Artificial Sequence
  chemically synthesized
caaaatgtacaaggaccgac

SEQ ID NO: 252254 - DNA, 20 bp, Artificial Sequence
  chemically synthesized
aaaagttaacaaaatgtaca

SEQ ID NO: 252255 - DNA, 20 bp, Artificial Sequence
  chemically synthesized
aaaaagttaacaaaatgtac

SEQ ID NO: 252256 - DNA, 20 bp, Artificial Sequence
  chemically synthesized
gcttgatttccaatgggaaa

SEQ ID NO: 252257 - DNA, 20 bp, Artificial Sequence
  chemically synthesized
ttttgttaactttttcccat

SEQ ID NO: 252258 - DNA, 20 bp, Artificial Sequence
  chemically synthesized
ctcccagcttgatttccaat

SEQ ID NO: 252259 - DNA, 20 bp, Artificial Sequence
  chemically synthesized
tctcccagcttgatttccaa

SEQ ID NO: 252260 - DNA, 20 bp, Artificial Sequence
  chemically synthesized
actttttcccattggaaatc

SEQ ID NO: 252261 - DNA, 20 bp, Artificial Sequence
  chemically synthesized
tttcccattggaaatcaagc

SEQ ID NO: 252262 - DNA, 20 bp, Artificial Sequence
  chemically synthesized
ttcccattggaaatcaagct

SEQ ID NO: 252263 - DNA, 20 bp, Artificial Sequence
  chemically synthesized
cccattggaaatcaagctgg

SEQ ID NO: 252264 - DNA, 20 bp, Artificial Sequence
  chemically synthesized
cattggaaatcaagctggga

SEQ ID NO: 252265 - DNA, 20 bp, Artificial Sequence
  chemically synthesized
ttggaaatcaagctgggaga

SEQ ID NO: 252266 - DNA, 20 bp, Artificial Sequence
  chemically synthesized
agctacaggaagctctctcc

SEQ ID NO: 252267 - DNA, 20 bp, Artificial Sequence
  chemically synthesized
agctgggagagagcttcctg

SEQ ID NO: 252268 - DNA, 20 bp, Artificial Sequence
  chemically synthesized
ggaaagggtgaagctacagg

SEQ ID NO: 252269 - DNA, 20 bp, Artificial Sequence
  chemically synthesized
tgtggaaagggtgaagctac

SEQ ID NO: 252270 - DNA, 20 bp, Artificial Sequence
  chemically synthesized
ctgtggaaagggtgaagcta

SEQ ID NO: 252271 - DNA, 20 bp, Artificial Sequence
  chemically synthesized
caacgcctgtggaaagggtg

SEQ ID NO: 252272 - DNA, 20 bp, Artificial Sequence
  chemically synthesized
ctgtagcttcaccctttcca

SEQ ID NO: 252273 - DNA, 20 bp, Artificial Sequence
  chemically synthesized
tgtagcttcaccctttccac

SEQ ID NO: 252274 - DNA, 20 bp, Artificial Sequence
  chemically synthesized
aagtgcaacgcctgtggaaa

SEQ ID NO: 252275 - DNA, 20 bp, Artificial Sequence
  chemically synthesized
aaagtgcaacgcctgtggaa

SEQ ID NO: 252276 - DNA, 20 bp, Artificial Sequence
  chemically synthesized
caaagtgcaacgcctgtgga

SEQ ID NO: 252277 - DNA, 20 bp, Artificial Sequence
  chemically synthesized
attgcaaagtgcaacgcctg

SEQ ID NO: 252278 - DNA, 20 bp, Artificial Sequence
  chemically synthesized
aagaagacagcagcattgca

SEQ ID NO: 252279 - DNA, 20 bp, Artificial Sequence
  chemically synthesized
tattcatagcaagaagacag

SEQ ID NO: 252280 - DNA, 20 bp, Artificial Sequence
  chemically synthesized
cattattcatagcaagaaga

SEQ ID NO: 252281 - DNA, 20 bp, Artificial Sequence
  chemically synthesized
ttgacattattcatagcaag

SEQ ID NO: 252282 - DNA, 20 bp, Artificial Sequence
  chemically synthesized
ggattgacattattcatagc

SEQ ID NO: 252283 - DNA, 20 bp, Artificial Sequence
  chemically synthesized
ggtcggattgacattattca

SEQ ID NO: 252284 - DNA, 20 bp, Artificial Sequence
  chemically synthesized
gaataatgtcaatccgacct

SEQ ID NO: 252285 - DNA, 20 bp, Artificial Sequence
  chemically synthesized
gtctacaacaaagctcaggt

SEQ ID NO: 252286 - DNA, 20 bp, Artificial Sequence
  chemically synthesized
gatagtctacaacaaagctc

SEQ ID NO: 252287 - DNA, 20 bp, Artificial Sequence
  chemically synthesized
agatagtctacaacaaagct

SEQ ID NO: 252288 - DNA, 20 bp, Artificial Sequence
  chemically synthesized
atccgacctgagctttgttg

SEQ ID NO: 252289 - DNA, 20 bp, Artificial Sequence
  chemically synthesized
ataaaagatagtctacaaca

SEQ ID NO: 252290 - DNA, 20 bp, Artificial Sequence
  chemically synthesized
atattacagaatataaaaga

SEQ ID NO: 252291 - DNA, 20 bp, Artificial Sequence
  chemically synthesized
ttttatattacagaatataa

SEQ ID NO: 252292 - DNA, 20 bp, Artificial Sequence
  chemically synthesized
gttttaaaatttttatatta

SEQ ID NO: 252293 - DNA, 20 bp, Artificial Sequence
  chemically synthesized
gtaatataaaaattttaaaa

SEQ ID NO: 252294 - DNA, 20 bp, Artificial Sequence
  chemically synthesized
aaaacagtaaaaaaatgaat

SEQ ID NO: 252295 - DNA, 20 bp, Artificial Sequence
  chemically synthesized
aaaaatgaattagctgtcta

SEQ ID NO: 252296 - DNA, 20 bp, Artificial Sequence
  chemically synthesized
tatttttctctttctataga

SEQ ID NO: 252297 - DNA, 20 bp, Artificial Sequence
  chemically synthesized
atgaattagctgtctataga

SEQ ID NO: 252298 - DNA, 20 bp, Artificial Sequence
  chemically synthesized
gaattagctgtctatagaaa

SEQ ID NO: 252299 - DNA, 20 bp, Artificial Sequence
  chemically synthesized
tatatatttttctctttcta

SEQ ID NO: 252300 - DNA, 20 bp, Artificial Sequence
  chemically synthesized
atatatatatacaaatccca

SEQ ID NO: 252301 - DNA, 20 bp, Artificial Sequence
  chemically synthesized
tatatatatacaaatcccaa

SEQ ID NO: 252302 - DNA, 20 bp, Artificial Sequence
  chemically synthesized
atatatacaaatcccaaagg

SEQ ID NO: 252303 - DNA, 20 bp, Artificial Sequence
  chemically synthesized
caacaccatttgctaccttt

SEQ ID NO: 252304 - DNA, 20 bp, Artificial Sequence
  chemically synthesized
gcaacaccatttgctacctt

SEQ ID NO: 252305 - DNA, 20 bp, Artificial Sequence
  chemically synthesized
caaatcccaaaggtagcaaa

SEQ ID NO: 252306 - DNA, 20 bp, Artificial Sequence
  chemically synthesized
actttaaaaagtcaataatt

SEQ ID NO: 252307 - DNA, 20 bp, Artificial Sequence
  chemically synthesized
tcttaattattgacttttta

SEQ ID NO: 252308 - DNA, 20 bp, Artificial Sequence
  chemically synthesized
tcatggttattaactttaaa

SEQ ID NO: 252309 - DNA, 20 bp, Artificial Sequence
  chemically synthesized
ttttaaagttaataaccatg

SEQ ID NO: 252310 - DNA, 20 bp, Artificial Sequence
  chemically synthesized
aagttaataaccatgaagtc

SEQ ID NO: 252311 - DNA, 20 bp, Artificial Sequence
  chemically synthesized
gtcaaagtcactggacttca

SEQ ID NO: 252312 - DNA, 20 bp, Artificial Sequence
  chemically synthesized
tttgaacatgtcaaagtcac

SEQ ID NO: 252313 - DNA, 20 bp, Artificial Sequence
  chemically synthesized
tattgaatttgaacatgtca

SEQ ID NO: 252314 - DNA, 20 bp, Artificial Sequence
  chemically synthesized
tttgacatgttcaaattcaa

SEQ ID NO: 252315 - DNA, 20 bp, Artificial Sequence
  chemically synthesized
ttgacatgttcaaattcaat

SEQ ID NO: 252316 - DNA, 20 bp, Artificial Sequence
  chemically synthesized
caaattcaataggtaaatca

SEQ ID NO: 252317 - DNA, 20 bp, Artificial Sequence
  chemically synthesized
taaatcacagacctcatcct

SEQ ID NO: 252318 - DNA, 20 bp, Artificial Sequence
  chemically synthesized
cgatccactctctcaggatg

SEQ ID NO: 252319 - DNA, 20 bp, Artificial Sequence
  chemically synthesized
aatcacagacctcatcctga

SEQ ID NO: 252320 - DNA, 20 bp, Artificial Sequence
  chemically synthesized
gcgatccactctctcaggat

SEQ ID NO: 252321 - DNA, 20 bp, Artificial Sequence
  chemically synthesized
tcacagacctcatcctgaga

SEQ ID NO: 252322 - DNA, 20 bp, Artificial Sequence
  chemically synthesized
cagacctcatcctgagagag

SEQ ID NO: 252323 - DNA, 20 bp, Artificial Sequence
  chemically synthesized
agggagcgatccactctctc

SEQ ID NO: 252324 - DNA, 20 bp, Artificial Sequence
  chemically synthesized
tagggagcgatccactctct

SEQ ID NO: 252325 - DNA, 20 bp, Artificial Sequence
  chemically synthesized
aggcagttttaagatgtagg

SEQ ID NO: 252326 - DNA, 20 bp, Artificial Sequence
  chemically synthesized
gaaggcagttttaagatgta

SEQ ID NO: 252327 - DNA, 20 bp, Artificial Sequence
  chemically synthesized
tgaaggcagttttaagatgt

SEQ ID NO: 252328 - DNA, 20 bp, Artificial Sequence
  chemically synthesized
atgaaggcagttttaagatg

SEQ ID NO: 252329 - DNA, 20 bp, Artificial Sequence
  chemically synthesized
agccaaatgaaggcagtttt

SEQ ID NO: 252330 - DNA, 20 bp, Artificial Sequence
  chemically synthesized
atacagaagccaaatgaagg

SEQ ID NO: 252331 - DNA, 20 bp, Artificial Sequence
  chemically synthesized
atcttaaaactgccttcatt

SEQ ID NO: 252332 - DNA, 20 bp, Artificial Sequence
  chemically synthesized
aggatacagaagccaaatga

SEQ ID NO: 252333 - DNA, 20 bp, Artificial Sequence
  chemically synthesized
caggatacagaagccaaatg

SEQ ID NO: 252334 - DNA, 20 bp, Artificial Sequence
  chemically synthesized
cagaagaggtcaggatacag

SEQ ID NO: 252335 - DNA, 20 bp, Artificial Sequence
  chemically synthesized
aagcagaagaggtcaggata

SEQ ID NO: 252336 - DNA, 20 bp, Artificial Sequence
  chemically synthesized
aaaggaaagcagaagaggtc

SEQ ID NO: 252337 - DNA, 20 bp, Artificial Sequence
  chemically synthesized
caaaggaaagcagaagaggt

SEQ ID NO: 252338 - DNA, 20 bp, Artificial Sequence
  chemically synthesized
ccagcaaaggaaagcagaag

SEQ ID NO: 252339 - DNA, 20 bp, Artificial Sequence
  chemically synthesized
tccagcaaaggaaagcagaa

SEQ ID NO: 252340 - DNA, 20 bp, Artificial Sequence
  chemically synthesized
gatccagcaaaggaaagcag

SEQ ID NO: 252341 - DNA, 20 bp, Artificial Sequence
  chemically synthesized
aaggatccagcaaaggaaag

SEQ ID NO: 252342 - DNA, 20 bp, Artificial Sequence
  chemically synthesized
gagaaggatccagcaaagga

SEQ ID NO: 252343 - DNA, 20 bp, Artificial Sequence
  chemically synthesized
cctcttctgctttcctttgc

SEQ ID NO: 252344 - DNA, 20 bp, Artificial Sequence
  chemically synthesized
ggatgagaaggatccagcaa

SEQ ID NO: 252345 - DNA, 20 bp, Artificial Sequence
  chemically synthesized
aggatgagaaggatccagca

SEQ ID NO: 252346 - DNA, 20 bp, Artificial Sequence
  chemically synthesized
agatcaggatgagaaggatc

SEQ ID NO: 252347 - DNA, 20 bp, Artificial Sequence
  chemically synthesized
atattaagatcaggatgaga

SEQ ID NO: 252348 - DNA, 20 bp, Artificial Sequence
  chemically synthesized
aatattaagatcaggatgag

SEQ ID NO: 252349 - DNA, 20 bp, Artificial Sequence
  chemically synthesized
tctaatattaagatcaggat

SEQ ID NO: 252350 - DNA, 20 bp, Artificial Sequence
  chemically synthesized
agcactctaatattaagatc

SEQ ID NO: 252351 - DNA, 20 bp, Artificial Sequence
  chemically synthesized
gagcactctaatattaagat

SEQ ID NO: 252352 - DNA, 20 bp, Artificial Sequence
  chemically synthesized
tctcatcctgatcttaatat

SEQ ID NO: 252353 - DNA, 20 bp, Artificial Sequence
  chemically synthesized
tcatcctgatcttaatatta

SEQ ID NO: 252354 - DNA, 20 bp, Artificial Sequence
  chemically synthesized
agtcagagcactctaatatt

SEQ ID NO: 252355 - DNA, 20 bp, Artificial Sequence
  chemically synthesized
aatattagagtgctctgact

SEQ ID NO: 252356 - DNA, 20 bp, Artificial Sequence
  chemically synthesized
gaagtgcaaatactgagtca

SEQ ID NO: 252357 - DNA, 20 bp, Artificial Sequence
  chemically synthesized
aagaagtgcaaatactgagt

SEQ ID NO: 252358 - DNA, 20 bp, Artificial Sequence
  chemically synthesized
agaaaagaagtgcaaatact

SEQ ID NO: 252359 - DNA, 20 bp, Artificial Sequence
  chemically synthesized
ttatggacagagaagaaaag

SEQ ID NO: 252360 - DNA, 20 bp, Artificial Sequence
  chemically synthesized
ggattatggacagagaagaa

SEQ ID NO: 252361 - DNA, 20 bp, Artificial Sequence
  chemically synthesized
gggatggattatggacagag

SEQ ID NO: 252362 - DNA, 20 bp, Artificial Sequence
  chemically synthesized
aatgggatggattatggaca

SEQ ID NO: 252363 - DNA, 20 bp, Artificial Sequence
  chemically synthesized
caaatgggatggattatgga

SEQ ID NO: 252364 - DNA, 20 bp, Artificial Sequence
  chemically synthesized
agaacaaatgggatggatta

SEQ ID NO: 252365 - DNA, 20 bp, Artificial Sequence
  chemically synthesized
aattatgagaacaaatggga

SEQ ID NO: 252366 - DNA, 20 bp, Artificial Sequence
  chemically synthesized
ttaaaattatgagaacaaat

SEQ ID NO: 252367 - DNA, 20 bp, Artificial Sequence
  chemically synthesized
tttaaaattatgagaacaaa

SEQ ID NO: 252368 - DNA, 20 bp, Artificial Sequence
  chemically synthesized
tataagatatttaaaattat

SEQ ID NO: 252369 - DNA, 20 bp, Artificial Sequence
  chemically synthesized
taattttaaatatcttatat

SEQ ID NO: 252370 - DNA, 20 bp, Artificial Sequence
  chemically synthesized
tgggtgtcattgtcttatat

SEQ ID NO: 252371 - DNA, 20 bp, Artificial Sequence
  chemically synthesized
cgggcttgagatacacattt

SEQ ID NO: 252372 - DNA, 20 bp, Artificial Sequence
  chemically synthesized
ccgggcttgagatacacatt

SEQ ID NO: 252373 - DNA, 20 bp, Artificial Sequence
  chemically synthesized
gacacccaaatgtgtatctc

SEQ ID NO: 252374 - DNA, 20 bp, Artificial Sequence
  chemically synthesized
ccaaatgtgtatctcaagcc

SEQ ID NO: 252375 - DNA, 20 bp, Artificial Sequence
  chemically synthesized
cggaggagatgtccgggctt

SEQ ID NO: 252376 - DNA, 20 bp, Artificial Sequence
  chemically synthesized
ggagttcggaggagatgtcc

SEQ ID NO: 252377 - DNA, 20 bp, Artificial Sequence
  chemically synthesized
tggagttcggaggagatgtc

SEQ ID NO: 252378 - DNA, 20 bp, Artificial Sequence
  chemically synthesized
tgttagactggagttcggag

SEQ ID NO: 252379 - DNA, 20 bp, Artificial Sequence
  chemically synthesized
tttgttagactggagttcgg

SEQ ID NO: 252380 - DNA, 20 bp, Artificial Sequence
  chemically synthesized
cggacatctcctccgaactc

SEQ ID NO: 252381 - DNA, 20 bp, Artificial Sequence
  chemically synthesized
atttgttagactggagttcg

SEQ ID NO: 252382 - DNA, 20 bp, Artificial Sequence
  chemically synthesized
gcatttgttagactggagtt

SEQ ID NO: 252383 - DNA, 20 bp, Artificial Sequence
  chemically synthesized
aattagcatttgttagactg

SEQ ID NO: 252384 - DNA, 20 bp, Artificial Sequence
  chemically synthesized
gaaattagcatttgttagac

SEQ ID NO: 252385 - DNA, 20 bp, Artificial Sequence
  chemically synthesized
gttgagaaattagcatttgt

SEQ ID NO: 252386 - DNA, 20 bp, Artificial Sequence
  chemically synthesized
acctccaagtgttgagaaat

SEQ ID NO: 252387 - DNA, 20 bp, Artificial Sequence
  chemically synthesized
aatgctaatttctcaacact

SEQ ID NO: 252388 - DNA, 20 bp, Artificial Sequence
  chemically synthesized
tcgtgagacctccaagtgtt

SEQ ID NO: 252389 - DNA, 20 bp, Artificial Sequence
  chemically synthesized
tgctaatttctcaacacttg

SEQ ID NO: 252390 - DNA, 20 bp, Artificial Sequence
  chemically synthesized
gctaatttctcaacacttgg

SEQ ID NO: 252391 - DNA, 20 bp, Artificial Sequence
  chemically synthesized
gaaagtctcgtgagacctcc

SEQ ID NO: 252392 - DNA, 20 bp, Artificial Sequence
  chemically synthesized
tcaacacttggaggtctcac

SEQ ID NO: 252393 - DNA, 20 bp, Artificial Sequence
  chemically synthesized
attaagtttgaaagtctcgt

SEQ ID NO: 252394 - DNA, 20 bp, Artificial Sequence
  chemically synthesized
ttgcgtcatattaagtttga

SEQ ID NO: 252395 - DNA, 20 bp, Artificial Sequence
  chemically synthesized
aattttgtttgcgtcatatt

SEQ ID NO: 252396 - DNA, 20 bp, Artificial Sequence
  chemically synthesized
aaggattaggaaatgcagtt

SEQ ID NO: 252397 - DNA, 20 bp, Artificial Sequence
  chemically synthesized
atgagaaggattaggaaatg

SEQ ID NO: 252398 - DNA, 20 bp, Artificial Sequence
  chemically synthesized
tctatgggatgagaaggatt

SEQ ID NO: 252399 - DNA, 20 bp, Artificial Sequence
  chemically synthesized
atctatgggatgagaaggat

SEQ ID NO: 252400 - DNA, 20 bp, Artificial Sequence
  chemically synthesized
agggaatctatgggatgaga

SEQ ID NO: 252401 - DNA, 20 bp, Artificial Sequence
  chemically synthesized
gagggaatctatgggatgag

SEQ ID NO: 252402 - DNA, 20 bp, Artificial Sequence
  chemically synthesized
tcctaatccttctcatccca

SEQ ID NO: 252403 - DNA, 20 bp, Artificial Sequence
  chemically synthesized
aatgagggaatctatgggat

SEQ ID NO: 252404 - DNA, 20 bp, Artificial Sequence
  chemically synthesized
actgaaatgagggaatctat

SEQ ID NO: 252405 - DNA, 20 bp, Artificial Sequence
  chemically synthesized
tactgaaatgagggaatcta

SEQ ID NO: 252406 - DNA, 20 bp, Artificial Sequence
  chemically synthesized
tcccatagattccctcattt

SEQ ID NO: 252407 - DNA, 20 bp, Artificial Sequence
  chemically synthesized
attgccatttactgaaatga

SEQ ID NO: 252408 - DNA, 20 bp, Artificial Sequence
  chemically synthesized
aattgccatttactgaaatg

SEQ ID NO: 252409 - DNA, 20 bp, Artificial Sequence
  chemically synthesized
taattgccatttactgaaat

SEQ ID NO: 252410 - DNA, 20 bp, Artificial Sequence
  chemically synthesized
gattccctcatttcagtaaa

SEQ ID NO: 252411 - DNA, 20 bp, Artificial Sequence
  chemically synthesized
tactataattcaattgaaat

SEQ ID NO: 252412 - DNA, 20 bp, Artificial Sequence
  chemically synthesized
tactgatttcaattgaatta

SEQ ID NO: 252413 - DNA, 20 bp, Artificial Sequence
  chemically synthesized
taattcaattaacaattact

SEQ ID NO: 252414 - DNA, 20 bp, Artificial Sequence
  chemically synthesized
ggctccaaagttgtcaatct

SEQ ID NO: 252415 - DNA, 20 bp, Artificial Sequence
  chemically synthesized
attactcagattgacaactt

SEQ ID NO: 252416 - DNA, 20 bp, Artificial Sequence
  chemically synthesized
tactcagattgacaactttg

SEQ ID NO: 252417 - DNA, 20 bp, Artificial Sequence
  chemically synthesized
aaaaattaaggatggctcca

SEQ ID NO: 252418 - DNA, 20 bp, Artificial Sequence
  chemically synthesized
gagactgaaaaaattaagga

SEQ ID NO: 252419 - DNA, 20 bp, Artificial Sequence
  chemically synthesized
actggagactgaaaaaatta

SEQ ID NO: 252420 - DNA, 20 bp, Artificial Sequence
  chemically synthesized
tactggagactgaaaaaatt

SEQ ID NO: 252421 - DNA, 20 bp, Artificial Sequence
  chemically synthesized
ggagccatccttaatttttt

SEQ ID NO: 252422 - DNA, 20 bp, Artificial Sequence
  chemically synthesized
tccttaattttttcagtctc

SEQ ID NO: 252423 - DNA, 20 bp, Artificial Sequence
  chemically synthesized
gcccaataatttgaatactg

SEQ ID NO: 252424 - DNA, 20 bp, Artificial Sequence
  chemically synthesized
ttgcccaataatttgaatac

SEQ ID NO: 252425 - DNA, 20 bp, Artificial Sequence
  chemically synthesized
gtctccagtattcaaattat

SEQ ID NO: 252426 - DNA, 20 bp, Artificial Sequence
  chemically synthesized
tctccagtattcaaattatt

SEQ ID NO: 252427 - DNA, 20 bp, Artificial Sequence
  chemically synthesized
aaattattgggcaaatgttt

SEQ ID NO: 252428 - DNA, 20 bp, Artificial Sequence
  chemically synthesized
aaatgttttggcttgacttt

SEQ ID NO: 252429 - DNA, 20 bp, Artificial Sequence
  chemically synthesized
aatgttttggcttgactttc

SEQ ID NO: 252430 - DNA, 20 bp, Artificial Sequence
  chemically synthesized
ctgcatatgtcctgaaagtc

SEQ ID NO: 252431 - DNA, 20 bp, Artificial Sequence
  chemically synthesized
aaattctgcatatgtcctga

SEQ ID NO: 252432 - DNA, 20 bp, Artificial Sequence
  chemically synthesized
cttgactttcaggacatatg

SEQ ID NO: 252433 - DNA, 20 bp, Artificial Sequence
  chemically synthesized
gcaagaaaggtagtgagaag

SEQ ID NO: 252434 - DNA, 20 bp, Artificial Sequence
  chemically synthesized
gtagcaagaaaggtagtgag

SEQ ID NO: 252435 - DNA, 20 bp, Artificial Sequence
  chemically synthesized
tctgtagcaagaaaggtagt

SEQ ID NO: 252436 - DNA, 20 bp, Artificial Sequence
  chemically synthesized
cagatctgtagcaagaaagg

SEQ ID NO: 252437 - DNA, 20 bp, Artificial Sequence
  chemically synthesized
tatcagatctgtagcaagaa

SEQ ID NO: 252438 - DNA, 20 bp, Artificial Sequence
  chemically synthesized
ctatcagatctgtagcaaga

SEQ ID NO: 252439 - DNA, 20 bp, Artificial Sequence
  chemically synthesized
tctcactacctttcttgcta

SEQ ID NO: 252440 - DNA, 20 bp, Artificial Sequence
  chemically synthesized
gcttctatcagatctgtagc

SEQ ID NO: 252441 - DNA, 20 bp, Artificial Sequence
  chemically synthesized
aatagcttctatcagatctg

SEQ ID NO: 252442 - DNA, 20 bp, Artificial Sequence
  chemically synthesized
ctttcttgctacagatctga

SEQ ID NO: 252443 - DNA, 20 bp, Artificial Sequence
  chemically synthesized
tcttgctacagatctgatag

SEQ ID NO: 252444 - DNA, 20 bp, Artificial Sequence
  chemically synthesized
gagacaataatagcttctat

SEQ ID NO: 252445 - DNA, 20 bp, Artificial Sequence
  chemically synthesized
acccagatgagagacaataa

SEQ ID NO: 252446 - DNA, 20 bp, Artificial Sequence
  chemically synthesized
agctattattgtctctcatc

SEQ ID NO: 252447 - DNA, 20 bp, Artificial Sequence
  chemically synthesized
gctattattgtctctcatct

SEQ ID NO: 252448 - DNA, 20 bp, Artificial Sequence
  chemically synthesized
tagttctataacccagatga

SEQ ID NO: 252449 - DNA, 20 bp, Artificial Sequence
  chemically synthesized
ggtagttctataacccagat

SEQ ID NO: 252450 - DNA, 20 bp, Artificial Sequence
  chemically synthesized
attgtctctcatctgggtta

SEQ ID NO: 252451 - DNA, 20 bp, Artificial Sequence
  chemically synthesized
agataggtagttctataacc

SEQ ID NO: 252452 - DNA, 20 bp, Artificial Sequence
  chemically synthesized
aagaggaccatttagatagg

SEQ ID NO: 252453 - DNA, 20 bp, Artificial Sequence
  chemically synthesized
tatagaactacctatctaaa

SEQ ID NO: 252454 - DNA, 20 bp, Artificial Sequence
  chemically synthesized
agcaagaggaccatttagat

SEQ ID NO: 252455 - DNA, 20 bp, Artificial Sequence
  chemically synthesized
aagcaagaggaccatttaga

SEQ ID NO: 252456 - DNA, 20 bp, Artificial Sequence
  chemically synthesized
gcggaagcaagaggaccatt

SEQ ID NO: 252457 - DNA, 20 bp, Artificial Sequence
  chemically synthesized
ggggaaagagcggaagcaag

SEQ ID NO: 252458 - DNA, 20 bp, Artificial Sequence
  chemically synthesized
gggggaaagagcggaagcaa

SEQ ID NO: 252459 - DNA, 20 bp, Artificial Sequence
  chemically synthesized
aggggggaaagagcggaagc

SEQ ID NO: 252460 - DNA, 20 bp, Artificial Sequence
  chemically synthesized
cagtaggggggaaagagcgg

SEQ ID NO: 252461 - DNA, 20 bp, Artificial Sequence
  chemically synthesized
atccagtaggggggaaagag

SEQ ID NO: 252462 - DNA, 20 bp, Artificial Sequence
  chemically synthesized
attatccagtaggggggaaa

SEQ ID NO: 252463 - DNA, 20 bp, Artificial Sequence
  chemically synthesized
gaattatccagtagggggga

SEQ ID NO: 252464 - DNA, 20 bp, Artificial Sequence
  chemically synthesized
ttccgctctttcccccctac

SEQ ID NO: 252465 - DNA, 20 bp, Artificial Sequence
  chemically synthesized
tggagaattatccagtaggg

SEQ ID NO: 252466 - DNA, 20 bp, Artificial Sequence
  chemically synthesized
gtggagaattatccagtagg

SEQ ID NO: 252467 - DNA, 20 bp, Artificial Sequence
  chemically synthesized
tgtggagaattatccagtag

SEQ ID NO: 252468 - DNA, 20 bp, Artificial Sequence
  chemically synthesized
gtgtggagaattatccagta

SEQ ID NO: 252469 - DNA, 20 bp, Artificial Sequence
  chemically synthesized
tgtgtggagaattatccagt

SEQ ID NO: 252470 - DNA, 20 bp, Artificial Sequence
  chemically synthesized
ttgtgtggagaattatccag

SEQ ID NO: 252471 - DNA, 20 bp, Artificial Sequence
  chemically synthesized
ctcttgtgtggagaattatc

SEQ ID NO: 252472 - DNA, 20 bp, Artificial Sequence
  chemically synthesized
tactggataattctccacac

SEQ ID NO: 252473 - DNA, 20 bp, Artificial Sequence
  chemically synthesized
ctggataattctccacacaa

SEQ ID NO: 252474 - DNA, 20 bp, Artificial Sequence
  chemically synthesized
atcttttcggctcttgtgtg

SEQ ID NO: 252475 - DNA, 20 bp, Artificial Sequence
  chemically synthesized
gaatcttttcggctcttgtg

SEQ ID NO: 252476 - DNA, 20 bp, Artificial Sequence
  chemically synthesized
ttctccacacaagagccgaa

SEQ ID NO: 252477 - DNA, 20 bp, Artificial Sequence
  chemically synthesized
atgttttaaaagaatctttt

SEQ ID NO: 252478 - DNA, 20 bp, Artificial Sequence
  chemically synthesized
tgatcccaattatgttttaa

SEQ ID NO: 252479 - DNA, 20 bp, Artificial Sequence
  chemically synthesized
agattcttttaaaacataat

SEQ ID NO: 252480 - DNA, 20 bp, Artificial Sequence
  chemically synthesized
gattcttttaaaacataatt

SEQ ID NO: 252481 - DNA, 20 bp, Artificial Sequence
  chemically synthesized
ccagaagattttgagcagag

SEQ ID NO: 252482 - DNA, 20 bp, Artificial Sequence
  chemically synthesized
caccagaagattttgagcag

SEQ ID NO: 252483 - DNA, 20 bp, Artificial Sequence
  chemically synthesized
ccaccagaagattttgagca

SEQ ID NO: 252484 - DNA, 20 bp, Artificial Sequence
  chemically synthesized
agccaccagaagattttgag

SEQ ID NO: 252485 - DNA, 20 bp, Artificial Sequence
  chemically synthesized
aagagccaccagaagatttt

SEQ ID NO: 252486 - DNA, 20 bp, Artificial Sequence
  chemically synthesized
ctcctctgctcaaaatcttc

SEQ ID NO: 252487 - DNA, 20 bp, Artificial Sequence
  chemically synthesized
ctctgctcaaaatcttctgg

SEQ ID NO: 252488 - DNA, 20 bp, Artificial Sequence
  chemically synthesized
ctgtgatgaagagccaccag

SEQ ID NO: 252489 - DNA, 20 bp, Artificial Sequence
  chemically synthesized
actctgtgatgaagagccac

SEQ ID NO: 252490 - DNA, 20 bp, Artificial Sequence
  chemically synthesized
cttctggtggctcttcatca

SEQ ID NO: 252491 - DNA, 20 bp, Artificial Sequence
  chemically synthesized
tgattgaactctgtgatgaa

SEQ ID NO: 252492 - DNA, 20 bp, Artificial Sequence
  chemically synthesized
tctggtggctcttcatcaca

SEQ ID NO: 252493 - DNA, 20 bp, Artificial Sequence
  chemically synthesized
tgtgattgaactctgtgatg

SEQ ID NO: 252494 - DNA, 20 bp, Artificial Sequence
  chemically synthesized
ttcatcacagagttcaatca

SEQ ID NO: 252495 - DNA, 20 bp, Artificial Sequence
  chemically synthesized
tcaatcacagccaatttcaa

SEQ ID NO: 252496 - DNA, 20 bp, Artificial Sequence
  chemically synthesized
ttcatgtaggcttttgaaat

SEQ ID NO: 252497 - DNA, 20 bp, Artificial Sequence
  chemically synthesized
agaataattatttttcatgt

SEQ ID NO: 252498 - DNA, 20 bp, Artificial Sequence
  chemically synthesized
aagaataattatttttcatg

SEQ ID NO: 252499 - DNA, 20 bp, Artificial Sequence
  chemically synthesized
ttatttgtataaagtgttgc

SEQ ID NO: 252500 - DNA, 20 bp, Artificial Sequence
  chemically synthesized
ttggcctgattatttgtata

SEQ ID NO: 252501 - DNA, 20 bp, Artificial Sequence
  chemically synthesized
caacactttatacaaataat

SEQ ID NO: 252502 - DNA, 20 bp, Artificial Sequence
  chemically synthesized
aacactttatacaaataatc

SEQ ID NO: 252503 - DNA, 20 bp, Artificial Sequence
  chemically synthesized
tttatacaaataatcaggcc

SEQ ID NO: 252504 - DNA, 20 bp, Artificial Sequence
  chemically synthesized
ctgatttgctttattatact

SEQ ID NO: 252505 - DNA, 20 bp, Artificial Sequence
  chemically synthesized
taatcaggccaagtataata

SEQ ID NO: 252506 - DNA, 20 bp, Artificial Sequence
  chemically synthesized
ccaagtataataaagcaaat

SEQ ID NO: 252507 - DNA, 20 bp, Artificial Sequence
  chemically synthesized
tactaaagatggatcatcat

SEQ ID NO: 252508 - DNA, 20 bp, Artificial Sequence
  chemically synthesized
ttactaaagatggatcatca

SEQ ID NO: 252509 - DNA, 20 bp, Artificial Sequence
  chemically synthesized
gtcctatgatgatccatctt

SEQ ID NO: 252510 - DNA, 20 bp, Artificial Sequence
  chemically synthesized
tctcccatttttactaaaga

SEQ ID NO: 252511 - DNA, 20 bp, Artificial Sequence
  chemically synthesized
ccagtctcccatttttacta

SEQ ID NO: 252512 - DNA, 20 bp, Artificial Sequence
  chemically synthesized
tgatccatctttagtaaaaa

SEQ ID NO: 252513 - DNA, 20 bp, Artificial Sequence
  chemically synthesized
gatccatctttagtaaaaat

SEQ ID NO: 252514 - DNA, 20 bp, Artificial Sequence
  chemically synthesized
tccatctttagtaaaaatgg

SEQ ID NO: 252515 - DNA, 20 bp, Artificial Sequence
  chemically synthesized
ctttagtaaaaatgggagac

SEQ ID NO: 252516 - DNA, 20 bp, Artificial Sequence
  chemically synthesized
ttagtaaaaatgggagactg

SEQ ID NO: 252517 - DNA, 20 bp, Artificial Sequence
  chemically synthesized
agtaaaaatgggagactgga

SEQ ID NO: 252518 - DNA, 20 bp, Artificial Sequence
  chemically synthesized
taaaaatgggagactggaga

SEQ ID NO: 252519 - DNA, 20 bp, Artificial Sequence
  chemically synthesized
acataatttttttctctctc

SEQ ID NO: 252520 - DNA, 20 bp, Artificial Sequence
  chemically synthesized
agagaaaaaaattatgtttt

SEQ ID NO: 252521 - DNA, 20 bp, Artificial Sequence
  chemically synthesized
aaattatgttttaagaacta

SEQ ID NO: 252522 - DNA, 20 bp, Artificial Sequence
  chemically synthesized
gactaataacaggtgtacca

SEQ ID NO: 252523 - DNA, 20 bp, Artificial Sequence
  chemically synthesized
aactatggtacacctgttat

SEQ ID NO: 252524 - DNA, 20 bp, Artificial Sequence
  chemically synthesized
cagctgacgagactaataac

SEQ ID NO: 252525 - DNA, 20 bp, Artificial Sequence
  chemically synthesized
acagctgacgagactaataa

SEQ ID NO: 252526 - DNA, 20 bp, Artificial Sequence
  chemically synthesized
acacctgttattagtctcgt

SEQ ID NO: 252527 - DNA, 20 bp, Artificial Sequence
  chemically synthesized
aaaactcaaaaacagctgac

SEQ ID NO: 252528 - DNA, 20 bp, Artificial Sequence
  chemically synthesized
tagtctcgtcagctgttttt

SEQ ID NO: 252529 - DNA, 20 bp, Artificial Sequence
  chemically synthesized
tgcaggaaaaaactcaaaaa

SEQ ID NO: 252530 - DNA, 20 bp, Artificial Sequence
  chemically synthesized
ttgagttttttcctgcaata

SEQ ID NO: 252531 - DNA, 20 bp, Artificial Sequence
  chemically synthesized
gcaggatcagtctatattgc

SEQ ID NO: 252532 - DNA, 20 bp, Artificial Sequence
  chemically synthesized
agcaggatcagtctatattg

SEQ ID NO: 252533 - DNA, 20 bp, Artificial Sequence
  chemically synthesized
ttcacaggaataagcaggat

SEQ ID NO: 252534 - DNA, 20 bp, Artificial Sequence
  chemically synthesized
gcaggttcacaggaataagc

SEQ ID NO: 252535 - DNA, 20 bp, Artificial Sequence
  chemically synthesized
ggcaggttcacaggaataag

SEQ ID NO: 252536 - DNA, 20 bp, Artificial Sequence
  chemically synthesized
actggcaggttcacaggaat

SEQ ID NO: 252537 - DNA, 20 bp, Artificial Sequence
  chemically synthesized
gagatcactggcaggttcac

SEQ ID NO: 252538 - DNA, 20 bp, Artificial Sequence
  chemically synthesized
agagatcactggcaggttca

SEQ ID NO: 252539 - DNA, 20 bp, Artificial Sequence
  chemically synthesized
gcttattcctgtgaacctgc

SEQ ID NO: 252540 - DNA, 20 bp, Artificial Sequence
  chemically synthesized
tgcagtcagagatcactggc

SEQ ID NO: 252541 - DNA, 20 bp, Artificial Sequence
  chemically synthesized
gtgcagtcagagatcactgg

SEQ ID NO: 252542 - DNA, 20 bp, Artificial Sequence
  chemically synthesized
gaggtgcagtcagagatcac

SEQ ID NO: 252543 - DNA, 20 bp, Artificial Sequence
  chemically synthesized
tttcttctgaggtgcagtca

SEQ ID NO: 252544 - DNA, 20 bp, Artificial Sequence
  chemically synthesized
tgtttcttctgaggtgcagt

SEQ ID NO: 252545 - DNA, 20 bp, Artificial Sequence
  chemically synthesized
agtgatctctgactgcacct

SEQ ID NO: 252546 - DNA, 20 bp, Artificial Sequence
  chemically synthesized
ttcttgtttcttctgaggtg

SEQ ID NO: 252547 - DNA, 20 bp, Artificial Sequence
  chemically synthesized
gatctctgactgcacctcag

SEQ ID NO: 252548 - DNA, 20 bp, Artificial Sequence
  chemically synthesized
catccttcttgtttcttctg

SEQ ID NO: 252549 - DNA, 20 bp, Artificial Sequence
  chemically synthesized
ccatccttcttgtttcttct

SEQ ID NO: 252550 - DNA, 20 bp, Artificial Sequence
  chemically synthesized
gactgcacctcagaagaaac

SEQ ID NO: 252551 - DNA, 20 bp, Artificial Sequence
  chemically synthesized
tgcacctcagaagaaacaag

SEQ ID NO: 252552 - DNA, 20 bp, Artificial Sequence
  chemically synthesized
gcacctcagaagaaacaaga

SEQ ID NO: 252553 - DNA, 20 bp, Artificial Sequence
  chemically synthesized
ctcagaagaaacaagaagga

SEQ ID NO: 252554 - DNA, 20 bp, Artificial Sequence
  chemically synthesized
tcagaagaaacaagaaggat

SEQ ID NO: 252555 - DNA, 20 bp, Artificial Sequence
  chemically synthesized
ggatgggtaatataaaaacc

SEQ ID NO: 252556 - DNA, 20 bp, Artificial Sequence
  chemically synthesized
ggtaatataaaaacctggat

SEQ ID NO: 252557 - DNA, 20 bp, Artificial Sequence
  chemically synthesized
cagaattagaatactgatcc

SEQ ID NO: 252558 - DNA, 20 bp, Artificial Sequence
  chemically synthesized
ccagaattagaatactgatc

SEQ ID NO: 252559 - DNA, 20 bp, Artificial Sequence
  chemically synthesized
ctggatcagtattctaattc

SEQ ID NO: 252560 - DNA, 20 bp, Artificial Sequence
  chemically synthesized
tggatcagtattctaattct

SEQ ID NO: 252561 - DNA, 20 bp, Artificial Sequence
  chemically synthesized
ttccaatacatgcccagaat

SEQ ID NO: 252562 - DNA, 20 bp, Artificial Sequence
  chemically synthesized
agctgattccaatacatgcc

SEQ ID NO: 252563 - DNA, 20 bp, Artificial Sequence
  chemically synthesized
ttctaattctgggcatgtat

SEQ ID NO: 252564 - DNA, 20 bp, Artificial Sequence
  chemically synthesized
ttctgggcatgtattggaat

SEQ ID NO: 252565 - DNA, 20 bp, Artificial Sequence
  chemically synthesized
gggcatgtattggaatcagc

SEQ ID NO: 252566 - DNA, 20 bp, Artificial Sequence
  chemically synthesized
catgtattggaatcagctag

SEQ ID NO: 252567 - DNA, 20 bp, Artificial Sequence
  chemically synthesized
ccaaagtgatgtggggctgc

SEQ ID NO: 252568 - DNA, 20 bp, Artificial Sequence
  chemically synthesized
gttggaaccaaagtgatgtg

SEQ ID NO: 252569 - DNA, 20 bp, Artificial Sequence
  chemically synthesized
tgttggaaccaaagtgatgt

SEQ ID NO: 252570 - DNA, 20 bp, Artificial Sequence
  chemically synthesized
ctgttggaaccaaagtgatg

SEQ ID NO: 252571 - DNA, 20 bp, Artificial Sequence
  chemically synthesized
ctagcagccccacatcactt

SEQ ID NO: 252572 - DNA, 20 bp, Artificial Sequence
  chemically synthesized
ctgggcagctgttggaacca

SEQ ID NO: 252573 - DNA, 20 bp, Artificial Sequence
  chemically synthesized
ccacatcactttggttccaa

SEQ ID NO: 252574 - DNA, 20 bp, Artificial Sequence
  chemically synthesized
tccgtgaactgggcagctgt

SEQ ID NO: 252575 - DNA, 20 bp, Artificial Sequence
  chemically synthesized
ctttggttccaacagctgcc

SEQ ID NO: 252576 - DNA, 20 bp, Artificial Sequence
  chemically synthesized
aaggctttccgtgaactggg

SEQ ID NO: 252577 - DNA, 20 bp, Artificial Sequence
  chemically synthesized
tccaacagctgcccagttca

SEQ ID NO: 252578 - DNA, 20 bp, Artificial Sequence
  chemically synthesized
tagaaggctttccgtgaact

SEQ ID NO: 252579 - DNA, 20 bp, Artificial Sequence
  chemically synthesized
ttagaaggctttccgtgaac

SEQ ID NO: 252580 - DNA, 20 bp, Artificial Sequence
  chemically synthesized
acagctgcccagttcacgga

SEQ ID NO: 252581 - DNA, 20 bp, Artificial Sequence
  chemically synthesized
tcacggaaagccttctaatt

SEQ ID NO: 252582 - DNA, 20 bp, Artificial Sequence
  chemically synthesized
cccaagtaaactaaattaga

SEQ ID NO: 252583 - DNA, 20 bp, Artificial Sequence
  chemically synthesized
tcccaagtaaactaaattag

SEQ ID NO: 252584 - DNA, 20 bp, Artificial Sequence
  chemically synthesized
ttatcccaagtaaactaaat

SEQ ID NO: 252585 - DNA, 20 bp, Artificial Sequence
  chemically synthesized
gccttctaatttagtttact

SEQ ID NO: 252586 - DNA, 20 bp, Artificial Sequence
  chemically synthesized
ccttctaatttagtttactt

SEQ ID NO: 252587 - DNA, 20 bp, Artificial Sequence
  chemically synthesized
acaataagtaaaattatccc

SEQ ID NO: 252588 - DNA, 20 bp, Artificial Sequence
  chemically synthesized
ccacaacagtaaaacacaat

SEQ ID NO: 252589 - DNA, 20 bp, Artificial Sequence
  chemically synthesized
cttattgtgttttactgttg

SEQ ID NO: 252590 - DNA, 20 bp, Artificial Sequence
  chemically synthesized
acagcaaatatattccacaa

SEQ ID NO: 252591 - DNA, 20 bp, Artificial Sequence
  chemically synthesized
ttcctatacaaaaagtaaaa

SEQ ID NO: 252592 - DNA, 20 bp, Artificial Sequence
  chemically synthesized
ttgctgttttactttttgta

SEQ ID NO: 252593 - DNA, 20 bp, Artificial Sequence
  chemically synthesized
tgctgttttactttttgtat

SEQ ID NO: 252594 - DNA, 20 bp, Artificial Sequence
  chemically synthesized
attctgcattcctatacaaa

SEQ ID NO: 252595 - DNA, 20 bp, Artificial Sequence
  chemically synthesized
ttactttttgtataggaatg

SEQ ID NO: 252596 - DNA, 20 bp, Artificial Sequence
  chemically synthesized
tttgtataggaatgcagaat

SEQ ID NO: 252597 - DNA, 20 bp, Artificial Sequence
  chemically synthesized
aatctaagaaaacattgagt

SEQ ID NO: 252598 - DNA, 20 bp, Artificial Sequence
  chemically synthesized
tttcaatctaagaaaacatt

SEQ ID NO: 252599 - DNA, 20 bp, Artificial Sequence
  chemically synthesized
aagcttactcaatgttttct

SEQ ID NO: 252600 - DNA, 20 bp, Artificial Sequence
  chemically synthesized
gattagtaagttttcaatct

SEQ ID NO: 252601 - DNA, 20 bp, Artificial Sequence
  chemically synthesized
gtgatatctggaagattagt

SEQ ID NO: 252602 - DNA, 20 bp, Artificial Sequence
  chemically synthesized
ttgaaaacttactaatcttc

SEQ ID NO: 252603 - DNA, 20 bp, Artificial Sequence
  chemically synthesized
aatggtgatatctggaagat

SEQ ID NO: 252604 - DNA, 20 bp, Artificial Sequence
  chemically synthesized
tgataaatggtgatatctgg

SEQ ID NO: 252605 - DNA, 20 bp, Artificial Sequence
  chemically synthesized
aactgataaatggtgatatc

SEQ ID NO: 252606 - DNA, 20 bp, Artificial Sequence
  chemically synthesized
ttccagatatcaccatttat

SEQ ID NO: 252607 - DNA, 20 bp, Artificial Sequence
  chemically synthesized
ggccattcataactgataaa

SEQ ID NO: 252608 - DNA, 20 bp, Artificial Sequence
  chemically synthesized
caccatttatcagttatgaa

SEQ ID NO: 252609 - DNA, 20 bp, Artificial Sequence
  chemically synthesized
agttatgaatggccctcacc

SEQ ID NO: 252610 - DNA, 20 bp, Artificial Sequence
  chemically synthesized
agcaagcatcagcttggtga

SEQ ID NO: 252611 - DNA, 20 bp, Artificial Sequence
  chemically synthesized
cagcaagcatcagcttggtg

SEQ ID NO: 252612 - DNA, 20 bp, Artificial Sequence
  chemically synthesized
tcagcaagcatcagcttggt

SEQ ID NO: 252613 - DNA, 20 bp, Artificial Sequence
  chemically synthesized
tcagtcagcaagcatcagct

SEQ ID NO: 252614 - DNA, 20 bp, Artificial Sequence
  chemically synthesized
ggagctcagtcagcaagcat

SEQ ID NO: 252615 - DNA, 20 bp, Artificial Sequence
  chemically synthesized
caagctgatgcttgctgact

SEQ ID NO: 252616 - DNA, 20 bp, Artificial Sequence
  chemically synthesized
tagagaggagctcagtcagc

SEQ ID NO: 252617 - DNA, 20 bp, Artificial Sequence
  chemically synthesized
agggtagagaggagctcagt

SEQ ID NO: 252618 - DNA, 20 bp, Artificial Sequence
  chemically synthesized
attcagggtagagaggagct

SEQ ID NO: 252619 - DNA, 20 bp, Artificial Sequence
  chemically synthesized
cttgtattcagggtagagag

SEQ ID NO: 252620 - DNA, 20 bp, Artificial Sequence
  chemically synthesized
ctcttgtattcagggtagag

SEQ ID NO: 252621 - DNA, 20 bp, Artificial Sequence
  chemically synthesized
tctcttgtattcagggtaga

SEQ ID NO: 252622 - DNA, 20 bp, Artificial Sequence
  chemically synthesized
ggtctcttgtattcagggta

SEQ ID NO: 252623 - DNA, 20 bp, Artificial Sequence
  chemically synthesized
agggtctcttgtattcaggg

SEQ ID NO: 252624 - DNA, 20 bp, Artificial Sequence
  chemically synthesized
ctcctctctaccctgaatac

SEQ ID NO: 252625 - DNA, 20 bp, Artificial Sequence
  chemically synthesized
attagggtctcttgtattca

SEQ ID NO: 252626 - DNA, 20 bp, Artificial Sequence
  chemically synthesized
tattagggtctcttgtattc

SEQ ID NO: 252627 - DNA, 20 bp, Artificial Sequence
  chemically synthesized
cctctctaccctgaatacaa

SEQ ID NO: 252628 - DNA, 20 bp, Artificial Sequence
  chemically synthesized
ctattagggtctcttgtatt

SEQ ID NO: 252629 - DNA, 20 bp, Artificial Sequence
  chemically synthesized
ctgaatacaagagaccctaa

SEQ ID NO: 252630 - DNA, 20 bp, Artificial Sequence
  chemically synthesized
atacaagagaccctaatagt

SEQ ID NO: 252631 - DNA, 20 bp, Artificial Sequence
  chemically synthesized
atatttctgcctaactatta

SEQ ID NO: 252632 - DNA, 20 bp, Artificial Sequence
  chemically synthesized
tacaagagaccctaatagtt

SEQ ID NO: 252633 - DNA, 20 bp, Artificial Sequence
  chemically synthesized
gatatttctgcctaactatt

SEQ ID NO: 252634 - DNA, 20 bp, Artificial Sequence
  chemically synthesized
tgatatttctgcctaactat

SEQ ID NO: 252635 - DNA, 20 bp, Artificial Sequence
  chemically synthesized
aagagaccctaatagttagg

SEQ ID NO: 252636 - DNA, 20 bp, Artificial Sequence
  chemically synthesized
gaaatatcatcacccatatt

SEQ ID NO: 252637 - DNA, 20 bp, Artificial Sequence
  chemically synthesized
aacttcttcaggctgaatat

SEQ ID NO: 252638 - DNA, 20 bp, Artificial Sequence
  chemically synthesized
taacttcttcaggctgaata

SEQ ID NO: 252639 - DNA, 20 bp, Artificial Sequence
  chemically synthesized
catcacccatattcagcctg

SEQ ID NO: 252640 - DNA, 20 bp, Artificial Sequence
  chemically synthesized
cacccatattcagcctgaag

SEQ ID NO: 252641 - DNA, 20 bp, Artificial Sequence
  chemically synthesized
acatcttctgtaacttcttc

SEQ ID NO: 252642 - DNA, 20 bp, Artificial Sequence
  chemically synthesized
tacatcttctgtaacttctt

SEQ ID NO: 252643 - DNA, 20 bp, Artificial Sequence
  chemically synthesized
tattcagcctgaagaagtta

SEQ ID NO: 252644 - DNA, 20 bp, Artificial Sequence
  chemically synthesized
tcagcctgaagaagttacag

SEQ ID NO: 252645 - DNA, 20 bp, Artificial Sequence
  chemically synthesized
cttaggattaagtagtagaa

SEQ ID NO: 252646 - DNA, 20 bp, Artificial Sequence
  chemically synthesized
ccttaggattaagtagtaga

SEQ ID NO: 252647 - DNA, 20 bp, Artificial Sequence
  chemically synthesized
cccttaggattaagtagtag

SEQ ID NO: 252648 - DNA, 20 bp, Artificial Sequence
  chemically synthesized
ttacccttaggattaagtag

SEQ ID NO: 252649 - DNA, 20 bp, Artificial Sequence
  chemically synthesized
gagttacccttaggattaag

SEQ ID NO: 252650 - DNA, 20 bp, Artificial Sequence
  chemically synthesized
cccttctactacttaatcct

SEQ ID NO: 252651 - DNA, 20 bp, Artificial Sequence
  chemically synthesized
ccttctactacttaatccta

SEQ ID NO: 252652 - DNA, 20 bp, Artificial Sequence
  chemically synthesized
gtagagttacccttaggatt

SEQ ID NO: 252653 - DNA, 20 bp, Artificial Sequence
  chemically synthesized
cttctactacttaatcctaa

SEQ ID NO: 252654 - DNA, 20 bp, Artificial Sequence
  chemically synthesized
agggtagtagagttaccctt

SEQ ID NO: 252655 - DNA, 20 bp, Artificial Sequence
  chemically synthesized
aagggtagtagagttaccct

SEQ ID NO: 252656 - DNA, 20 bp, Artificial Sequence
  chemically synthesized
ccttaatcctaagggtagta

SEQ ID NO: 252657 - DNA, 20 bp, Artificial Sequence
  chemically synthesized
aagggtaactctactaccct

SEQ ID NO: 252658 - DNA, 20 bp, Artificial Sequence
  chemically synthesized
acccttaatcctaagggtag

SEQ ID NO: 252659 - DNA, 20 bp, Artificial Sequence
  chemically synthesized
agggtaactctactaccctt

SEQ ID NO: 252660 - DNA, 20 bp, Artificial Sequence
  chemically synthesized
ggaacccttaatcctaaggg

SEQ ID NO: 252661 - DNA, 20 bp, Artificial Sequence
  chemically synthesized
aagggaacccttaatcctaa

SEQ ID NO: 252662 - DNA, 20 bp, Artificial Sequence
  chemically synthesized
actctactacccttaggatt

SEQ ID NO: 252663 - DNA, 20 bp, Artificial Sequence
  chemically synthesized
caagggaacccttaatccta

SEQ ID NO: 252664 - DNA, 20 bp, Artificial Sequence
  chemically synthesized
ctctactacccttaggatta

SEQ ID NO: 252665 - DNA, 20 bp, Artificial Sequence
  chemically synthesized
acaagggaacccttaatcct

SEQ ID NO: 252666 - DNA, 20 bp, Artificial Sequence
  chemically synthesized
tctactacccttaggattaa

SEQ ID NO: 252667 - DNA, 20 bp, Artificial Sequence
  chemically synthesized
gattaagggttcccttgtaa

SEQ ID NO: 252668 - DNA, 20 bp, Artificial Sequence
  chemically synthesized
ttcccctctttcttttacaa

SEQ ID NO: 252669 - DNA, 20 bp, Artificial Sequence
  chemically synthesized
tttcccctctttcttttaca

SEQ ID NO: 252670 - DNA, 20 bp, Artificial Sequence
  chemically synthesized
atttcccctctttcttttac

SEQ ID NO: 252671 - DNA, 20 bp, Artificial Sequence
  chemically synthesized
aagggttcccttgtaaaaga

SEQ ID NO: 252672 - DNA, 20 bp, Artificial Sequence
  chemically synthesized
gggttcccttgtaaaagaaa

SEQ ID NO: 252673 - DNA, 20 bp, Artificial Sequence
  chemically synthesized
ggttcccttgtaaaagaaag

SEQ ID NO: 252674 - DNA, 20 bp, Artificial Sequence
  chemically synthesized
gttcccttgtaaaagaaaga

SEQ ID NO: 252675 - DNA, 20 bp, Artificial Sequence
  chemically synthesized
ttcccttgtaaaagaaagag

SEQ ID NO: 252676 - DNA, 20 bp, Artificial Sequence
  chemically synthesized
aagaaagaggggaaatatgt

SEQ ID NO: 252677 - DNA, 20 bp, Artificial Sequence
  chemically synthesized
gaaagaggggaaatatgtca

SEQ ID NO: 252678 - DNA, 20 bp, Artificial Sequence
  chemically synthesized
aaagaggggaaatatgtcag

SEQ ID NO: 252679 - DNA, 20 bp, Artificial Sequence
  chemically synthesized
tatgtcagaggcgttcgaac

SEQ ID NO: 252680 - DNA, 20 bp, Artificial Sequence
  chemically synthesized
tattcaagatggagttgttc

SEQ ID NO: 252681 - DNA, 20 bp, Artificial Sequence
  chemically synthesized
cccagcccctattcaagatg

SEQ ID NO: 252682 - DNA, 20 bp, Artificial Sequence
  chemically synthesized
tagaacaactccatcttgaa

SEQ ID NO: 252683 - DNA, 20 bp, Artificial Sequence
  chemically synthesized
tacccagcccctattcaaga

SEQ ID NO: 252684 - DNA, 20 bp, Artificial Sequence
  chemically synthesized
agaacaactccatcttgaat

SEQ ID NO: 252685 - DNA, 20 bp, Artificial Sequence
  chemically synthesized
gaacaactccatcttgaata

SEQ ID NO: 252686 - DNA, 20 bp, Artificial Sequence
  chemically synthesized
aacaactccatcttgaatag

SEQ ID NO: 252687 - DNA, 20 bp, Artificial Sequence
  chemically synthesized
attttacccagcccctattc

SEQ ID NO: 252688 - DNA, 20 bp, Artificial Sequence
  chemically synthesized
actccatcttgaataggggc

SEQ ID NO: 252689 - DNA, 20 bp, Artificial Sequence
  chemically synthesized
ctccatcttgaataggggct

SEQ ID NO: 252690 - DNA, 20 bp, Artificial Sequence
  chemically synthesized
ggtctcagccttattttacc

SEQ ID NO: 252691 - DNA, 20 bp, Artificial Sequence
  chemically synthesized
gaataggggctgggtaaaat

SEQ ID NO: 252692 - DNA, 20 bp, Artificial Sequence
  chemically synthesized
aataggggctgggtaaaata

SEQ ID NO: 252693 - DNA, 20 bp, Artificial Sequence
  chemically synthesized
gggctgggtaaaataaggct

SEQ ID NO: 252694 - DNA, 20 bp, Artificial Sequence
  chemically synthesized
gaatgcagcccagtaggtct

SEQ ID NO: 252695 - DNA, 20 bp, Artificial Sequence
  chemically synthesized
aaaataaggctgagacctac

SEQ ID NO: 252696 - DNA, 20 bp, Artificial Sequence
  chemically synthesized
aaataaggctgagacctact

SEQ ID NO: 252697 - DNA, 20 bp, Artificial Sequence
  chemically synthesized
tcctgggaatgcagcccagt

SEQ ID NO: 252698 - DNA, 20 bp, Artificial Sequence
  chemically synthesized
ctcctgggaatgcagcccag

SEQ ID NO: 252699 - DNA, 20 bp, Artificial Sequence
  chemically synthesized
aacctcctgggaatgcagcc

SEQ ID NO: 252700 - DNA, 20 bp, Artificial Sequence
  chemically synthesized
gacctactgggctgcattcc

SEQ ID NO: 252701 - DNA, 20 bp, Artificial Sequence
  chemically synthesized
acctactgggctgcattccc

SEQ ID NO: 252702 - DNA, 20 bp, Artificial Sequence
  chemically synthesized
tgcccaacctcctgggaatg

SEQ ID NO: 252703 - DNA, 20 bp, Artificial Sequence
  chemically synthesized
ctactgggctgcattcccag

SEQ ID NO: 252704 - DNA, 20 bp, Artificial Sequence
  chemically synthesized
tactgggctgcattcccagg

SEQ ID NO: 252705 - DNA, 20 bp, Artificial Sequence
  chemically synthesized
gggctgcattcccaggaggt

SEQ ID NO: 252706 - DNA, 20 bp, Artificial Sequence
  chemically synthesized
ctaagaatgcccaacctcct

SEQ ID NO: 252707 - DNA, 20 bp, Artificial Sequence
  chemically synthesized
ggctgcattcccaggaggtt

SEQ ID NO: 252708 - DNA, 20 bp, Artificial Sequence
  chemically synthesized
actaagaatgcccaacctcc

SEQ ID NO: 252709 - DNA, 20 bp, Artificial Sequence
  chemically synthesized
cccaggaggttgggcattct

SEQ ID NO: 252710 - DNA, 20 bp, Artificial Sequence
  chemically synthesized
aggttgggcattcttagtca

SEQ ID NO: 252711 - DNA, 20 bp, Artificial Sequence
  chemically synthesized
ggttgggcattcttagtcac

SEQ ID NO: 252712 - DNA, 20 bp, Artificial Sequence
  chemically synthesized
tcttatctcatcctgtgact

SEQ ID NO: 252713 - DNA, 20 bp, Artificial Sequence
  chemically synthesized
ggcattcttagtcacaggat

SEQ ID NO: 252714 - DNA, 20 bp, Artificial Sequence
  chemically synthesized
tcttagtcacaggatgagat

SEQ ID NO: 252715 - DNA, 20 bp, Artificial Sequence
  chemically synthesized
ttagtcacaggatgagataa

SEQ ID NO: 252716 - DNA, 20 bp, Artificial Sequence
  chemically synthesized
tagtcacaggatgagataag

SEQ ID NO: 252717 - DNA, 20 bp, Artificial Sequence
  chemically synthesized
cacaggatgagataagaggc

SEQ ID NO: 252718 - DNA, 20 bp, Artificial Sequence
  chemically synthesized
atgagataagaggccagaac

SEQ ID NO: 252719 - DNA, 20 bp, Artificial Sequence
  chemically synthesized
ttgtgacccgtatcttgttc

SEQ ID NO: 252720 - DNA, 20 bp, Artificial Sequence
  chemically synthesized
taagaggccagaacaagata

SEQ ID NO: 252721 - DNA, 20 bp, Artificial Sequence
  chemically synthesized
aagaggccagaacaagatac

SEQ ID NO: 252722 - DNA, 20 bp, Artificial Sequence
  chemically synthesized
agaacaagatacgggtcaca

SEQ ID NO: 252723 - DNA, 20 bp, Artificial Sequence
  chemically synthesized
agcaacctgctttatcagca

SEQ ID NO: 252724 - DNA, 20 bp, Artificial Sequence
  chemically synthesized
tcacaaagaccttgctgata

SEQ ID NO: 252725 - DNA, 20 bp, Artificial Sequence
  chemically synthesized
cagcaacctgctttatcagc

SEQ ID NO: 252726 - DNA, 20 bp, Artificial Sequence
  chemically synthesized
caaagaccttgctgataaag

SEQ ID NO: 252727 - DNA, 20 bp, Artificial Sequence
  chemically synthesized
aaagaccttgctgataaagc

SEQ ID NO: 252728 - DNA, 20 bp, Artificial Sequence
  chemically synthesized
tttacagcaacctgctttat

SEQ ID NO: 252729 - DNA, 20 bp, Artificial Sequence
  chemically synthesized
taaagcaggttgctgtaaat

SEQ ID NO: 252730 - DNA, 20 bp, Artificial Sequence
  chemically synthesized
ggttttgactagcttattta

SEQ ID NO: 252731 - DNA, 20 bp, Artificial Sequence
  chemically synthesized
gcaggttgctgtaaataagc

SEQ ID NO: 252732 - DNA, 20 bp, Artificial Sequence
  chemically synthesized
tggttttggtgggttttgac

SEQ ID NO: 252733 - DNA, 20 bp, Artificial Sequence
  chemically synthesized
ttcaccagcttggttttggt

SEQ ID NO: 252734 - DNA, 20 bp, Artificial Sequence
  chemically synthesized
tttcaccagcttggttttgg

SEQ ID NO: 252735 - DNA, 20 bp, Artificial Sequence
  chemically synthesized
agtcaaaacccaccaaaacc

SEQ ID NO: 252736 - DNA, 20 bp, Artificial Sequence
  chemically synthesized
ttttttcaccagcttggttt

SEQ ID NO: 252737 - DNA, 20 bp, Artificial Sequence
  chemically synthesized
aaaacccaccaaaaccaagc

SEQ ID NO: 252738 - DNA, 20 bp, Artificial Sequence
  chemically synthesized
ggtcacttttttcaccagct

SEQ ID NO: 252739 - DNA, 20 bp, Artificial Sequence
  chemically synthesized
caaaaccaagctggtgaaaa

SEQ ID NO: 252740 - DNA, 20 bp, Artificial Sequence
  chemically synthesized
ccagaggtcacttttttcac

SEQ ID NO: 252741 - DNA, 20 bp, Artificial Sequence
  chemically synthesized
ctggtgaaaaaagtgacctc

SEQ ID NO: 252742 - DNA, 20 bp, Artificial Sequence
  chemically synthesized
tgagcagtgagaaggaccag

SEQ ID NO: 252743 - DNA, 20 bp, Artificial Sequence
  chemically synthesized
atgagcagtgagaaggacca

SEQ ID NO: 252744 - DNA, 20 bp, Artificial Sequence
  chemically synthesized
taatgagcagtgagaaggac

SEQ ID NO: 252745 - DNA, 20 bp, Artificial Sequence
  chemically synthesized
gtgtataatgagcagtgaga

SEQ ID NO: 252746 - DNA, 20 bp, Artificial Sequence
  chemically synthesized
agtgtataatgagcagtgag

SEQ ID NO: 252747 - DNA, 20 bp, Artificial Sequence
  chemically synthesized
attagtgtataatgagcagt

SEQ ID NO: 252748 - DNA, 20 bp, Artificial Sequence
  chemically synthesized
tataattagtgtataatgag

SEQ ID NO: 252749 - DNA, 20 bp, Artificial Sequence
  chemically synthesized
cattataattagtgtataat

SEQ ID NO: 252750 - DNA, 20 bp, Artificial Sequence
  chemically synthesized
gcctgctaatgcattataat

SEQ ID NO: 252751 - DNA, 20 bp, Artificial Sequence
  chemically synthesized
atacactaattataatgcat

SEQ ID NO: 252752 - DNA, 20 bp, Artificial Sequence
  chemically synthesized
cactaattataatgcattag

SEQ ID NO: 252753 - DNA, 20 bp, Artificial Sequence
  chemically synthesized
actaattataatgcattagc

SEQ ID NO: 252754 - DNA, 20 bp, Artificial Sequence
  chemically synthesized
ataatgcattagcaggctaa

SEQ ID NO: 252755 - DNA, 20 bp, Artificial Sequence
  chemically synthesized
gcactgctaggagtgtcttt

SEQ ID NO: 252756 - DNA, 20 bp, Artificial Sequence
  chemically synthesized
agcaggctaaaagacactcc

SEQ ID NO: 252757 - DNA, 20 bp, Artificial Sequence
  chemically synthesized
aggctaaaagacactcctag

SEQ ID NO: 252758 - DNA, 20 bp, Artificial Sequence
  chemically synthesized
acctgtcatggcactgctag

SEQ ID NO: 252759 - DNA, 20 bp, Artificial Sequence
  chemically synthesized
taacctgtcatggcactgct

SEQ ID NO: 252760 - DNA, 20 bp, Artificial Sequence
  chemically synthesized
gtaacctgtcatggcactgc

SEQ ID NO: 252761 - DNA, 20 bp, Artificial Sequence
  chemically synthesized
cactcctagcagtgccatga

SEQ ID NO: 252762 - DNA, 20 bp, Artificial Sequence
  chemically synthesized
actcctagcagtgccatgac

SEQ ID NO: 252763 - DNA, 20 bp, Artificial Sequence
  chemically synthesized
catgcatttgtaacctgtca

SEQ ID NO: 252764 - DNA, 20 bp, Artificial Sequence
  chemically synthesized
catgacaggttacaaatgca

SEQ ID NO: 252765 - DNA, 20 bp, Artificial Sequence
  chemically synthesized
tacaaatgcatggcaatgtc

SEQ ID NO: 252766 - DNA, 20 bp, Artificial Sequence
  chemically synthesized
aaatgcatggcaatgtcaag

SEQ ID NO: 252767 - DNA, 20 bp, Artificial Sequence
  chemically synthesized
tgtcaagaagttacccaata

SEQ ID NO: 252768 - DNA, 20 bp, Artificial Sequence
  chemically synthesized
ctcccattttagaccatatt

SEQ ID NO: 252769 - DNA, 20 bp, Artificial Sequence
  chemically synthesized
tctcccattttagaccatat

SEQ ID NO: 252770 - DNA, 20 bp, Artificial Sequence
  chemically synthesized
ttacccaatatggtctaaaa

SEQ ID NO: 252771 - DNA, 20 bp, Artificial Sequence
  chemically synthesized
tacccaatatggtctaaaat

SEQ ID NO: 252772 - DNA, 20 bp, Artificial Sequence
  chemically synthesized
cccaatatggtctaaaatgg

SEQ ID NO: 252773 - DNA, 20 bp, Artificial Sequence
  chemically synthesized
actgagggtttctcccattt

SEQ ID NO: 252774 - DNA, 20 bp, Artificial Sequence
  chemically synthesized
tctaaaatgggagaaaccct

SEQ ID NO: 252775 - DNA, 20 bp, Artificial Sequence
  chemically synthesized
atgggagaaaccctcagttc

SEQ ID NO: 252776 - DNA, 20 bp, Artificial Sequence
  chemically synthesized
tcagcaattcctagaactga

SEQ ID NO: 252777 - DNA, 20 bp, Artificial Sequence
  chemically synthesized
tgggagaaaccctcagttct

SEQ ID NO: 252778 - DNA, 20 bp, Artificial Sequence
  chemically synthesized
gtcagcaattcctagaactg

SEQ ID NO: 252779 - DNA, 20 bp, Artificial Sequence
  chemically synthesized
agtcagcaattcctagaact

SEQ ID NO: 252780 - DNA, 20 bp, Artificial Sequence
  chemically synthesized
gaaaaggagtcagcaattcc

SEQ ID NO: 252781 - DNA, 20 bp, Artificial Sequence
  chemically synthesized
agttttctgggaaaaggagt

SEQ ID NO: 252782 - DNA, 20 bp, Artificial Sequence
  chemically synthesized
gaattgctgactccttttcc

SEQ ID NO: 252783 - DNA, 20 bp, Artificial Sequence
  chemically synthesized
catgagttttctgggaaaag

SEQ ID NO: 252784 - DNA, 20 bp, Artificial Sequence
  chemically synthesized
ttcatgagttttctgggaaa

SEQ ID NO: 252785 - DNA, 20 bp, Artificial Sequence
  chemically synthesized
attcatgagttttctgggaa

SEQ ID NO: 252786 - DNA, 20 bp, Artificial Sequence
  chemically synthesized
ggattattcatgagttttct

SEQ ID NO: 252787 - DNA, 20 bp, Artificial Sequence
  chemically synthesized
tggattattcatgagttttc

SEQ ID NO: 252788 - DNA, 20 bp, Artificial Sequence
  chemically synthesized
acaaggggtggattattcat

SEQ ID NO: 252789 - DNA, 20 bp, Artificial Sequence
  chemically synthesized
attatatgctaaacaagggg

SEQ ID NO: 252790 - DNA, 20 bp, Artificial Sequence
  chemically synthesized
tgaataatccaccccttgtt

SEQ ID NO: 252791 - DNA, 20 bp, Artificial Sequence
  chemically synthesized
ttgattatatgctaaacaag

SEQ ID NO: 252792 - DNA, 20 bp, Artificial Sequence
  chemically synthesized
cttgattatatgctaaacaa

SEQ ID NO: 252793 - DNA, 20 bp, Artificial Sequence
  chemically synthesized
tcttgattatatgctaaaca

SEQ ID NO: 252794 - DNA, 20 bp, Artificial Sequence
  chemically synthesized
ttcttgattatatgctaaac

SEQ ID NO: 252795 - DNA, 20 bp, Artificial Sequence
  chemically synthesized
cccttgtttagcatataatc

SEQ ID NO: 252796 - DNA, 20 bp, Artificial Sequence
  chemically synthesized
tataatcaagaaataactac

SEQ ID NO: 252797 - DNA, 20 bp, Artificial Sequence
  chemically synthesized
tgcttgactcaggatacttg

SEQ ID NO: 252798 - DNA, 20 bp, Artificial Sequence
  chemically synthesized
gaaataactacaagtatcct

SEQ ID NO: 252799 - DNA, 20 bp, Artificial Sequence
  chemically synthesized
aactacaagtatcctgagtc

SEQ ID NO: 252800 - DNA, 20 bp, Artificial Sequence
  chemically synthesized
tggcatgggctgcttgactc

SEQ ID NO: 252801 - DNA, 20 bp, Artificial Sequence
  chemically synthesized
tacaagtatcctgagtcaag

SEQ ID NO: 252802 - DNA, 20 bp, Artificial Sequence
  chemically synthesized
gtggcatgggctgcttgact

SEQ ID NO: 252803 - DNA, 20 bp, Artificial Sequence
  chemically synthesized
cgtaggcagtgcagtggcat

SEQ ID NO: 252804 - DNA, 20 bp, Artificial Sequence
  chemically synthesized
ccgtaggcagtgcagtggca

SEQ ID NO: 252805 - DNA, 20 bp, Artificial Sequence
  chemically synthesized
ccactccgtaggcagtgcag

SEQ ID NO: 252806 - DNA, 20 bp, Artificial Sequence
  chemically synthesized
tggccactccgtaggcagtg

SEQ ID NO: 252807 - DNA, 20 bp, Artificial Sequence
  chemically synthesized
ccatgccactgcactgccta

SEQ ID NO: 252808 - DNA, 20 bp, Artificial Sequence
  chemically synthesized
atgccactgcactgcctacg

SEQ ID NO: 252809 - DNA, 20 bp, Artificial Sequence
  chemically synthesized
aagaatggccactccgtagg

SEQ ID NO: 252810 - DNA, 20 bp, Artificial Sequence
  chemically synthesized
ccactgcactgcctacggag

SEQ ID NO: 252811 - DNA, 20 bp, Artificial Sequence
  chemically synthesized
ataaagaatggccactccgt

SEQ ID NO: 252812 - DNA, 20 bp, Artificial Sequence
  chemically synthesized
aataaagaatggccactccg

SEQ ID NO: 252813 - DNA, 20 bp, Artificial Sequence
  chemically synthesized
gaaagtaaaggaataaagaa

SEQ ID NO: 252814 - DNA, 20 bp, Artificial Sequence
  chemically synthesized
attaagaaagtaaaggaata

SEQ ID NO: 252815 - DNA, 20 bp, Artificial Sequence
  chemically synthesized
caagtttattaagaaagtaa

SEQ ID NO: 252816 - DNA, 20 bp, Artificial Sequence
  chemically synthesized
gcaagtttattaagaaagta

SEQ ID NO: 252817 - DNA, 20 bp, Artificial Sequence
  chemically synthesized
taaaagcaagtttattaaga

SEQ ID NO: 252818 - DNA, 20 bp, Artificial Sequence
  chemically synthesized
aaagtaaaagcaagtttatt

SEQ ID NO: 252819 - DNA, 20 bp, Artificial Sequence
  chemically synthesized
tttttaaaaaaagtaaaagc

SEQ ID NO: 252820 - DNA, 20 bp, Artificial Sequence
  chemically synthesized
tgcttttttaaaaaaagtaa

SEQ ID NO: 252821 - DNA, 20 bp, Artificial Sequence
  chemically synthesized
agattatgcttttttaaaaa

SEQ ID NO: 252822 - DNA, 20 bp, Artificial Sequence
  chemically synthesized
tgcttttactttttttaaaa

SEQ ID NO: 252823 - DNA, 20 bp, Artificial Sequence
  chemically synthesized
gagatttataggtcatagtg

SEQ ID NO: 252824 - DNA, 20 bp, Artificial Sequence
  chemically synthesized
atgtagagatttataggtca

SEQ ID NO: 252825 - DNA, 20 bp, Artificial Sequence
  chemically synthesized
caagtcatgtagagatttat

SEQ ID NO: 252826 - DNA, 20 bp, Artificial Sequence
  chemically synthesized
ccaagtcatgtagagattta

SEQ ID NO: 252827 - DNA, 20 bp, Artificial Sequence
  chemically synthesized
gtatacaaccaagtcatgta

SEQ ID NO: 252828 - DNA, 20 bp, Artificial Sequence
  chemically synthesized
ctataaatctctacatgact

SEQ ID NO: 252829 - DNA, 20 bp, Artificial Sequence
  chemically synthesized
tagtatacaaccaagtcatg

SEQ ID NO: 252830 - DNA, 20 bp, Artificial Sequence
  chemically synthesized
atggtaggtagtatacaacc

SEQ ID NO: 252831 - DNA, 20 bp, Artificial Sequence
  chemically synthesized
gatgagcttggaatggtagg

SEQ ID NO: 252832 - DNA, 20 bp, Artificial Sequence
  chemically synthesized
agagatgagcttggaatggt

SEQ ID NO: 252833 - DNA, 20 bp, Artificial Sequence
  chemically synthesized
tgtatactacctaccattcc

SEQ ID NO: 252834 - DNA, 20 bp, Artificial Sequence
  chemically synthesized
aagagatgagcttggaatgg

SEQ ID NO: 252835 - DNA, 20 bp, Artificial Sequence
  chemically synthesized
gggaagagatgagcttggaa

SEQ ID NO: 252836 - DNA, 20 bp, Artificial Sequence
  chemically synthesized
agactgggaagagatgagct

SEQ ID NO: 252837 - DNA, 20 bp, Artificial Sequence
  chemically synthesized
tgaagagactgggaagagat

SEQ ID NO: 252838 - DNA, 20 bp, Artificial Sequence
  chemically synthesized
attccaagctcatctcttcc

SEQ ID NO: 252839 - DNA, 20 bp, Artificial Sequence
  chemically synthesized
gactatgaagagactgggaa

SEQ ID NO: 252840 - DNA, 20 bp, Artificial Sequence
  chemically synthesized
tggactatgaagagactggg

SEQ ID NO: 252841 - DNA, 20 bp, Artificial Sequence
  chemically synthesized
ttgtggactatgaagagact

SEQ ID NO: 252842 - DNA, 20 bp, Artificial Sequence
  chemically synthesized
gttgtggactatgaagagac

SEQ ID NO: 252843 - DNA, 20 bp, Artificial Sequence
  chemically synthesized
atctcttcccagtctcttca

SEQ ID NO: 252844 - DNA, 20 bp, Artificial Sequence
  chemically synthesized
gaagtgttgtggactatgaa

SEQ ID NO: 252845 - DNA, 20 bp, Artificial Sequence
  chemically synthesized
gtgaagtgttgtggactatg

SEQ ID NO: 252846 - DNA, 20 bp, Artificial Sequence
  chemically synthesized
ctaatgagggtgaagtgttg

SEQ ID NO: 252847 - DNA, 20 bp, Artificial Sequence
  chemically synthesized
caataaacctaatgagggtg

SEQ ID NO: 252848 - DNA, 20 bp, Artificial Sequence
  chemically synthesized
ccacaacacttcaccctcat

SEQ ID NO: 252849 - DNA, 20 bp, Artificial Sequence
  chemically synthesized
cacaacacttcaccctcatt

SEQ ID NO: 252850 - DNA, 20 bp, Artificial Sequence
  chemically synthesized
taatgcaataaacctaatga

SEQ ID NO: 252851 - DNA, 20 bp, Artificial Sequence
  chemically synthesized
gtaatgcaataaacctaatg

SEQ ID NO: 252852 - DNA, 20 bp, Artificial Sequence
  chemically synthesized
agtaatgcaataaacctaat

SEQ ID NO: 252853 - DNA, 20 bp, Artificial Sequence
  chemically synthesized
ttaggtttattgcattactt

SEQ ID NO: 252854 - DNA, 20 bp, Artificial Sequence
  chemically synthesized
agaatgtagttgttatactc

SEQ ID NO: 252855 - DNA, 20 bp, Artificial Sequence
  chemically synthesized
gaaatcttgaagcaagaatg

SEQ ID NO: 252856 - DNA, 20 bp, Artificial Sequence
  chemically synthesized
aacaactacattcttgcttc

SEQ ID NO: 252857 - DNA, 20 bp, Artificial Sequence
  chemically synthesized
aagggcagaaatcttgaagc

SEQ ID NO: 252858 - DNA, 20 bp, Artificial Sequence
  chemically synthesized
cagcaagggcagaaatcttg

SEQ ID NO: 252859 - DNA, 20 bp, Artificial Sequence
  chemically synthesized
ggcaggtagaacagcaaggg

SEQ ID NO: 252860 - DNA, 20 bp, Artificial Sequence
  chemically synthesized
tttggcaggtagaacagcaa

SEQ ID NO: 252861 - DNA, 20 bp, Artificial Sequence
  chemically synthesized
ttttggcaggtagaacagca

SEQ ID NO: 252862 - DNA, 20 bp, Artificial Sequence
  chemically synthesized
tttttggcaggtagaacagc

SEQ ID NO: 252863 - DNA, 20 bp, Artificial Sequence
  chemically synthesized
actatttttggcaggtagaa

SEQ ID NO: 252864 - DNA, 20 bp, Artificial Sequence
  chemically synthesized
ggaaaactatttttggcagg

SEQ ID NO: 252865 - DNA, 20 bp, Artificial Sequence
  chemically synthesized
ttaggaaaactatttttggc

SEQ ID NO: 252866 - DNA, 20 bp, Artificial Sequence
  chemically synthesized
gctgttctacctgccaaaaa

SEQ ID NO: 252867 - DNA, 20 bp, Artificial Sequence
  chemically synthesized
gttaggaaaactatttttgg

SEQ ID NO: 252868 - DNA, 20 bp, Artificial Sequence
  chemically synthesized
tgggttaggaaaactatttt

SEQ ID NO: 252869 - DNA, 20 bp, Artificial Sequence
  chemically synthesized
cactgatagaaatgtgggtt

SEQ ID NO: 252870 - DNA, 20 bp, Artificial Sequence
  chemically synthesized
ccactgatagaaatgtgggt

SEQ ID NO: 252871 - DNA, 20 bp, Artificial Sequence
  chemically synthesized
ggaaccactgatagaaatgt

SEQ ID NO: 252872 - DNA, 20 bp, Artificial Sequence
  chemically synthesized
gggaaccactgatagaaatg

SEQ ID NO: 252873 - DNA, 20 bp, Artificial Sequence
  chemically synthesized
ttcctaacccacatttctat

SEQ ID NO: 252874 - DNA, 20 bp, Artificial Sequence
  chemically synthesized
ctaacccacatttctatcag

SEQ ID NO: 252875 - DNA, 20 bp, Artificial Sequence
  chemically synthesized
agaagtaagggaaccactga

SEQ ID NO: 252876 - DNA, 20 bp, Artificial Sequence
  chemically synthesized
ttaacgtgagaaagaagtaa

SEQ ID NO: 252877 - DNA, 20 bp, Artificial Sequence
  chemically synthesized
tttaacgtgagaaagaagta

SEQ ID NO: 252878 - DNA, 20 bp, Artificial Sequence
  chemically synthesized
ctttaacgtgagaaagaagt

SEQ ID NO: 252879 - DNA, 20 bp, Artificial Sequence
  chemically synthesized
gcccctttaacgtgagaaag

SEQ ID NO: 252880 - DNA, 20 bp, Artificial Sequence
  chemically synthesized
aaggcccctttaacgtgaga

SEQ ID NO: 252881 - DNA, 20 bp, Artificial Sequence
  chemically synthesized
cttacttctttctcacgtta

SEQ ID NO: 252882 - DNA, 20 bp, Artificial Sequence
  chemically synthesized
ttacttctttctcacgttaa

SEQ ID NO: 252883 - DNA, 20 bp, Artificial Sequence
  chemically synthesized
agagaaggcccctttaacgt

SEQ ID NO: 252884 - DNA, 20 bp, Artificial Sequence
  chemically synthesized
tacttctttctcacgttaaa

SEQ ID NO: 252885 - DNA, 20 bp, Artificial Sequence
  chemically synthesized
acttctttctcacgttaaag

SEQ ID NO: 252886 - DNA, 20 bp, Artificial Sequence
  chemically synthesized
ttaaaatagagtagtagaga

SEQ ID NO: 252887 - DNA, 20 bp, Artificial Sequence
  chemically synthesized
tttaaaatagagtagtagag

SEQ ID NO: 252888 - DNA, 20 bp, Artificial Sequence
  chemically synthesized
ctatttaaaatagagtagta

SEQ ID NO: 252889 - DNA, 20 bp, Artificial Sequence
  chemically synthesized
tgctatttaaaatagagtag

SEQ ID NO: 252890 - DNA, 20 bp, Artificial Sequence
  chemically synthesized
tggtgctatttaaaatagag

SEQ ID NO: 252891 - DNA, 20 bp, Artificial Sequence
  chemically synthesized
tgctggtgctatttaaaata

SEQ ID NO: 252892 - DNA, 20 bp, Artificial Sequence
  chemically synthesized
ctctactactctattttaaa

SEQ ID NO: 252893 - DNA, 20 bp, Artificial Sequence
  chemically synthesized
attgctggtgctatttaaaa

SEQ ID NO: 252894 - DNA, 20 bp, Artificial Sequence
  chemically synthesized
tactctattttaaatagcac

SEQ ID NO: 252895 - DNA, 20 bp, Artificial Sequence
  chemically synthesized
caggaataaagagtgattgc

SEQ ID NO: 252896 - DNA, 20 bp, Artificial Sequence
  chemically synthesized
agagtaatgccaggaataaa

SEQ ID NO: 252897 - DNA, 20 bp, Artificial Sequence
  chemically synthesized
cagcaatcactctttattcc

SEQ ID NO: 252898 - DNA, 20 bp, Artificial Sequence
  chemically synthesized
gaagagtaatgccaggaata

SEQ ID NO: 252899 - DNA, 20 bp, Artificial Sequence
  chemically synthesized
gaaaagggaagagtaatgcc

SEQ ID NO: 252900 - DNA, 20 bp, Artificial Sequence
  chemically synthesized
agaaaagggaagagtaatgc

SEQ ID NO: 252901 - DNA, 20 bp, Artificial Sequence
  chemically synthesized
gtactataaagaaaagggaa

SEQ ID NO: 252902 - DNA, 20 bp, Artificial Sequence
  chemically synthesized
aagtactataaagaaaaggg

SEQ ID NO: 252903 - DNA, 20 bp, Artificial Sequence
  chemically synthesized
aataagtactataaagaaaa

SEQ ID NO: 252904 - DNA, 20 bp, Artificial Sequence
  chemically synthesized
taataagtactataaagaaa

SEQ ID NO: 252905 - DNA, 20 bp, Artificial Sequence
  chemically synthesized
ttactcttcccttttcttta

SEQ ID NO: 252906 - DNA, 20 bp, Artificial Sequence
  chemically synthesized
gtaataagtactataaagaa

SEQ ID NO: 252907 - DNA, 20 bp, Artificial Sequence
  chemically synthesized
tgttagtaataagtactata

SEQ ID NO: 252908 - DNA, 20 bp, Artificial Sequence
  chemically synthesized
tatattttaatgttagtaat

SEQ ID NO: 252909 - DNA, 20 bp, Artificial Sequence
  chemically synthesized
cttgatatatattttaatgt

SEQ ID NO: 252910 - DNA, 20 bp, Artificial Sequence
  chemically synthesized
ctaacattaaaatatatatc

SEQ ID NO: 252911 - DNA, 20 bp, Artificial Sequence
  chemically synthesized
acattaaaatatatatcaag

SEQ ID NO: 252912 - DNA, 20 bp, Artificial Sequence
  chemically synthesized
taaaatatatatcaagtagc

SEQ ID NO: 252913 - DNA, 20 bp, Artificial Sequence
  chemically synthesized
ttcaaattagtggtatatac

SEQ ID NO: 252914 - DNA, 20 bp, Artificial Sequence
  chemically synthesized
agtcatagatttcaaattag

SEQ ID NO: 252915 - DNA, 20 bp, Artificial Sequence
  chemically synthesized
tgtagtcatagatttcaaat

SEQ ID NO: 252916 - DNA, 20 bp, Artificial Sequence
  chemically synthesized
taatttgaaatctatgacta

SEQ ID NO: 252917 - DNA, 20 bp, Artificial Sequence
  chemically synthesized
aatttgaaatctatgactac

SEQ ID NO: 252918 - DNA, 20 bp, Artificial Sequence
  chemically synthesized
taacaacatccctgtagtca

SEQ ID NO: 252919 - DNA, 20 bp, Artificial Sequence
  chemically synthesized
atttgaaatctatgactaca

SEQ ID NO: 252920 - DNA, 20 bp, Artificial Sequence
  chemically synthesized
aacagataacaacatccctg

SEQ ID NO: 252921 - DNA, 20 bp, Artificial Sequence
  chemically synthesized
acagggatgttgttatctgt

SEQ ID NO: 252922 - DNA, 20 bp, Artificial Sequence
  chemically synthesized
cagggatgttgttatctgtt

SEQ ID NO: 252923 - DNA, 20 bp, Artificial Sequence
  chemically synthesized
tttgagctttggaagcccaa

SEQ ID NO: 252924 - DNA, 20 bp, Artificial Sequence
  chemically synthesized
tgttatctgttgggcttcca

SEQ ID NO: 252925 - DNA, 20 bp, Artificial Sequence
  chemically synthesized
agcacaggtttgagctttgg

SEQ ID NO: 252926 - DNA, 20 bp, Artificial Sequence
  chemically synthesized
ccaagcacaggtttgagctt

SEQ ID NO: 252927 - DNA, 20 bp, Artificial Sequence
  chemically synthesized
catgtgccaagcacaggttt

SEQ ID NO: 252928 - DNA, 20 bp, Artificial Sequence
  chemically synthesized
ccaaagctcaaacctgtgct

SEQ ID NO: 252929 - DNA, 20 bp, Artificial Sequence
  chemically synthesized
atctatcatgtgccaagcac

SEQ ID NO: 252930 - DNA, 20 bp, Artificial Sequence
  chemically synthesized
catctatcatgtgccaagca

SEQ ID NO: 252931 - DNA, 20 bp, Artificial Sequence
  chemically synthesized
tttgccatctatcatgtgcc

SEQ ID NO: 252932 - DNA, 20 bp, Artificial Sequence
  chemically synthesized
aacctgtgcttggcacatga

SEQ ID NO: 252933 - DNA, 20 bp, Artificial Sequence
  chemically synthesized
tgtgcttggcacatgataga

SEQ ID NO: 252934 - DNA, 20 bp, Artificial Sequence
  chemically synthesized
tggcacatgatagatggcaa

SEQ ID NO: 252935 - DNA, 20 bp, Artificial Sequence
  chemically synthesized
tattcatttattcaacaaaa

SEQ ID NO: 252936 - DNA, 20 bp, Artificial Sequence
  chemically synthesized
ttttttgttgaataaatgaa

SEQ ID NO: 252937 - DNA, 20 bp, Artificial Sequence
  chemically synthesized
ttgttgaataaatgaataga

SEQ ID NO: 252938 - DNA, 20 bp, Artificial Sequence
  chemically synthesized
acattatggattaaatttat

SEQ ID NO: 252939 - DNA, 20 bp, Artificial Sequence
  chemically synthesized
aacattatggattaaattta

SEQ ID NO: 252940 - DNA, 20 bp, Artificial Sequence
  chemically synthesized
agaatataaacaaaacatta

SEQ ID NO: 252941 - DNA, 20 bp, Artificial Sequence
  chemically synthesized
tttgtttatattctatttaa

SEQ ID NO: 252942 - DNA, 20 bp, Artificial Sequence
  chemically synthesized
tttgtgatttttccgttaaa

SEQ ID NO: 252943 - DNA, 20 bp, Artificial Sequence
  chemically synthesized
gaaaaatcacaaaccacaaa

SEQ ID NO: 252944 - DNA, 20 bp, Artificial Sequence
  chemically synthesized
aaaaatcacaaaccacaaat

SEQ ID NO: 252945 - DNA, 20 bp, Artificial Sequence
  chemically synthesized
cttcccgtataacccatttg

SEQ ID NO: 252946 - DNA, 20 bp, Artificial Sequence
  chemically synthesized
caaaccacaaatgggttata

SEQ ID NO: 252947 - DNA, 20 bp, Artificial Sequence
  chemically synthesized
aaaccacaaatgggttatac

SEQ ID NO: 252948 - DNA, 20 bp, Artificial Sequence
  chemically synthesized
ccacaaatgggttatacggg

SEQ ID NO: 252949 - DNA, 20 bp, Artificial Sequence
  chemically synthesized
aaatgggttatacgggaaga

SEQ ID NO: 252950 - DNA, 20 bp, Artificial Sequence
  chemically synthesized
ttattgagaataaatatgtt

SEQ ID NO: 252951 - DNA, 20 bp, Artificial Sequence
  chemically synthesized
tagtttttagcaaatttatt

SEQ ID NO: 252952 - DNA, 20 bp, Artificial Sequence
  chemically synthesized
aatagccagaatgtagtttt

SEQ ID NO: 252953 - DNA, 20 bp, Artificial Sequence
  chemically synthesized
atttgctaaaaactacattc

SEQ ID NO: 252954 - DNA, 20 bp, Artificial Sequence
  chemically synthesized
taggaagaatagccagaatg

SEQ ID NO: 252955 - DNA, 20 bp, Artificial Sequence
  chemically synthesized
ttcgtactaggaagaatagc

SEQ ID NO: 252956 - DNA, 20 bp, Artificial Sequence
  chemically synthesized
tacattctggctattcttcc

SEQ ID NO: 252957 - DNA, 20 bp, Artificial Sequence
  chemically synthesized
aaaattcgtactaggaagaa

SEQ ID NO: 252958 - DNA, 20 bp, Artificial Sequence
  chemically synthesized
ataacaaaattcgtactagg

SEQ ID NO: 252959 - DNA, 20 bp, Artificial Sequence
  chemically synthesized
aaaataacaaaattcgtact

SEQ ID NO: 252960 - DNA, 20 bp, Artificial Sequence
  chemically synthesized
caaaataacaaaattcgtac

SEQ ID NO: 252961 - DNA, 20 bp, Artificial Sequence
  chemically synthesized
agtggaccttatgtataatt

SEQ ID NO: 252962 - DNA, 20 bp, Artificial Sequence
  chemically synthesized
tgatcatctaaattatacat

SEQ ID NO: 252963 - DNA, 20 bp, Artificial Sequence
  chemically synthesized
gatcatctaaattatacata

SEQ ID NO: 252964 - DNA, 20 bp, Artificial Sequence
  chemically synthesized
aattatacataaggtccact

SEQ ID NO: 252965 - DNA, 20 bp, Artificial Sequence
  chemically synthesized
actcaataaattttgctcag

SEQ ID NO: 252966 - DNA, 20 bp, Artificial Sequence
  chemically synthesized
agaactcaataaattttgct

SEQ ID NO: 252967 - DNA, 20 bp, Artificial Sequence
  chemically synthesized
tccactgagcaaaatttatt

SEQ ID NO: 252968 - DNA, 20 bp, Artificial Sequence
  chemically synthesized
tattgctccttacacatggg

SEQ ID NO: 252969 - DNA, 20 bp, Artificial Sequence
  chemically synthesized
attgagttcttcccatgtgt

SEQ ID NO: 252970 - DNA, 20 bp, Artificial Sequence
  chemically synthesized
ttgagttcttcccatgtgta

SEQ ID NO: 252971 - DNA, 20 bp, Artificial Sequence
  chemically synthesized
ctatattgctccttacacat

SEQ ID NO: 252972 - DNA, 20 bp, Artificial Sequence
  chemically synthesized
gctatattgctccttacaca

SEQ ID NO: 252973 - DNA, 20 bp, Artificial Sequence
  chemically synthesized
gagttcttcccatgtgtaag

SEQ ID NO: 252974 - DNA, 20 bp, Artificial Sequence
  chemically synthesized
cccatgtgtaaggagcaata

SEQ ID NO: 252975 - DNA, 20 bp, Artificial Sequence
  chemically synthesized
atgtgtaaggagcaatatag

SEQ ID NO: 252976 - DNA, 20 bp, Artificial Sequence
  chemically synthesized
ggagcaatatagcagaaaca

SEQ ID NO: 252977 - DNA, 20 bp, Artificial Sequence
  chemically synthesized
gagcaatatagcagaaacaa

SEQ ID NO: 252978 - DNA, 20 bp, Artificial Sequence
  chemically synthesized
caatatagcagaaacaaagg

SEQ ID NO: 252979 - DNA, 20 bp, Artificial Sequence
  chemically synthesized
aatatagcagaaacaaaggt

SEQ ID NO: 252980 - DNA, 20 bp, Artificial Sequence
  chemically synthesized
aaacaaaggtgggtgaaaca

SEQ ID NO: 252981 - DNA, 20 bp, Artificial Sequence
  chemically synthesized
aaggtgggtgaaacacagtt

SEQ ID NO: 252982 - DNA, 20 bp, Artificial Sequence
  chemically synthesized
acacagtttagtttgccttt

SEQ ID NO: 252983 - DNA, 20 bp, Artificial Sequence
  chemically synthesized
cagtttagtttgcctttaag

SEQ ID NO: 252984 - DNA, 20 bp, Artificial Sequence
  chemically synthesized
acctacttaaaacttcttaa

SEQ ID NO: 252985 - DNA, 20 bp, Artificial Sequence
  chemically synthesized
aacctacttaaaacttctta

SEQ ID NO: 252986 - DNA, 20 bp, Artificial Sequence
  chemically synthesized
gtttgcctttaagaagtttt

SEQ ID NO: 252987 - DNA, 20 bp, Artificial Sequence
  chemically synthesized
tgcctttaagaagttttaag

SEQ ID NO: 252988 - DNA, 20 bp, Artificial Sequence
  chemically synthesized
gcctttaagaagttttaagt

SEQ ID NO: 252989 - DNA, 20 bp, Artificial Sequence
  chemically synthesized
gttttaagtaggttttattg

SEQ ID NO: 252990 - DNA, 20 bp, Artificial Sequence
  chemically synthesized
ttaagtaggttttattgtag

SEQ ID NO: 252991 - DNA, 20 bp, Artificial Sequence
  chemically synthesized
gtaggttttattgtagtagt

SEQ ID NO: 252992 - DNA, 20 bp, Artificial Sequence
  chemically synthesized
gttttattgtagtagtaaga

SEQ ID NO: 252993 - DNA, 20 bp, Artificial Sequence
  chemically synthesized
ttttattgtagtagtaagaa

SEQ ID NO: 252994 - DNA, 20 bp, Artificial Sequence
  chemically synthesized
tgtagtagtaagaaaggata

SEQ ID NO: 252995 - DNA, 20 bp, Artificial Sequence
  chemically synthesized
gtaagaaaggatatggtttg

SEQ ID NO: 252996 - DNA, 20 bp, Artificial Sequence
  chemically synthesized
ggatatggtttgaagaattg

SEQ ID NO: 252997 - DNA, 20 bp, Artificial Sequence
  chemically synthesized
agaattgaagaaaaaaatcc

SEQ ID NO: 252998 - DNA, 20 bp, Artificial Sequence
  chemically synthesized
tgaagaaaaaaatccaagta

SEQ ID NO: 252999 - DNA, 20 bp, Artificial Sequence
  chemically synthesized
agaaaaaaatccaagtatag

SEQ ID NO: 253000 - DNA, 20 bp, Artificial Sequence
  chemically synthesized
ccagctaaggcttctatact

SEQ ID NO: 253001 - DNA, 20 bp, Artificial Sequence
  chemically synthesized
aaatccaagtatagaagcct

SEQ ID NO: 253002 - DNA, 20 bp, Artificial Sequence
  chemically synthesized
ccaagtatagaagccttagc

SEQ ID NO: 253003 - DNA, 20 bp, Artificial Sequence
  chemically synthesized
tccttcttctcatccagcta

SEQ ID NO: 253004 - DNA, 20 bp, Artificial Sequence
  chemically synthesized
ttccttcttctcatccagct

SEQ ID NO: 253005 - DNA, 20 bp, Artificial Sequence
  chemically synthesized
tatagaagccttagctggat

SEQ ID NO: 253006 - DNA, 20 bp, Artificial Sequence
  chemically synthesized
agaagccttagctggatgag

SEQ ID NO: 253007 - DNA, 20 bp, Artificial Sequence
  chemically synthesized
atttcttccttcttctcatc

SEQ ID NO: 253008 - DNA, 20 bp, Artificial Sequence
  chemically synthesized
agccttagctggatgagaag

SEQ ID NO: 253009 - DNA, 20 bp, Artificial Sequence
  chemically synthesized
gccttagctggatgagaaga

SEQ ID NO: 253010 - DNA, 20 bp, Artificial Sequence
  chemically synthesized
ttagctggatgagaagaagg

SEQ ID NO: 253011 - DNA, 20 bp, Artificial Sequence
  chemically synthesized
gatgagaagaaggaagaaat

SEQ ID NO: 253012 - DNA, 20 bp, Artificial Sequence
  chemically synthesized
aaggaagaaatgagtgttcc

SEQ ID NO: 253013 - DNA, 20 bp, Artificial Sequence
  chemically synthesized
gaagaaatgagtgttccaag

SEQ ID NO: 253014 - DNA, 20 bp, Artificial Sequence
  chemically synthesized
agaaaatgtttggtaccact

SEQ ID NO: 253015 - DNA, 20 bp, Artificial Sequence
  chemically synthesized
tctaacttctagaaaatgtt

SEQ ID NO: 253016 - DNA, 20 bp, Artificial Sequence
  chemically synthesized
aagtggtaccaaacattttc

SEQ ID NO: 253017 - DNA, 20 bp, Artificial Sequence
  chemically synthesized
tggtaccaaacattttctag

SEQ ID NO: 253018 - DNA, 20 bp, Artificial Sequence
  chemically synthesized
accaaacattttctagaagt

SEQ ID NO: 253019 - DNA, 20 bp, Artificial Sequence
  chemically synthesized
caaacattttctagaagtta

SEQ ID NO: 253020 - DNA, 20 bp, Artificial Sequence
  chemically synthesized
tacatgttttctctaacttc

SEQ ID NO: 253021 - DNA, 20 bp, Artificial Sequence
  chemically synthesized
gaaaacatgtatcatatatt

SEQ ID NO: 253022 - DNA, 20 bp, Artificial Sequence
  chemically synthesized
atgtatcatatatttggtca

SEQ ID NO: 253023 - DNA, 20 bp, Artificial Sequence
  chemically synthesized
tgtatcatatatttggtcat

SEQ ID NO: 253024 - DNA, 20 bp, Artificial Sequence
  chemically synthesized
catatatttggtcataggct

SEQ ID NO: 253025 - DNA, 20 bp, Artificial Sequence
  chemically synthesized
atatatttggtcataggctc

SEQ ID NO: 253026 - DNA, 20 bp, Artificial Sequence
  chemically synthesized
atttggtcataggctcagga

SEQ ID NO: 253027 - DNA, 20 bp, Artificial Sequence
  chemically synthesized
ttcttcgtgaattctttcct

SEQ ID NO: 253028 - DNA, 20 bp, Artificial Sequence
  chemically synthesized
ggctcaggaaagaattcacg

SEQ ID NO: 253029 - DNA, 20 bp, Artificial Sequence
  chemically synthesized
tcaggaaagaattcacgaag

SEQ ID NO: 253030 - DNA, 20 bp, Artificial Sequence
  chemically synthesized
caggaaagaattcacgaaga

SEQ ID NO: 253031 - DNA, 20 bp, Artificial Sequence
  chemically synthesized
cacgaagaaggtgcaaattg

SEQ ID NO: 253032 - DNA, 20 bp, Artificial Sequence
  chemically synthesized
gaagaaggtgcaaattgcag

SEQ ID NO: 253033 - DNA, 20 bp, Artificial Sequence
  chemically synthesized
aaattgcagtagacatatct

SEQ ID NO: 253034 - DNA, 20 bp, Artificial Sequence
  chemically synthesized
ttgcagtagacatatctgag

SEQ ID NO: 253035 - DNA, 20 bp, Artificial Sequence
  chemically synthesized
cagtagacatatctgagtag

SEQ ID NO: 253036 - DNA, 20 bp, Artificial Sequence
  chemically synthesized
ttcttcccacttctactact

SEQ ID NO: 253037 - DNA, 20 bp, Artificial Sequence
  chemically synthesized
tagacatatctgagtagtag

SEQ ID NO: 253038 - DNA, 20 bp, Artificial Sequence
  chemically synthesized
acatatctgagtagtagaag

SEQ ID NO: 253039 - DNA, 20 bp, Artificial Sequence
  chemically synthesized
catatctgagtagtagaagt

SEQ ID NO: 253040 - DNA, 20 bp, Artificial Sequence
  chemically synthesized
atctgagtagtagaagtggg

SEQ ID NO: 253041 - DNA, 20 bp, Artificial Sequence
  chemically synthesized
agtagaagtgggaagaacat

SEQ ID NO: 253042 - DNA, 20 bp, Artificial Sequence
  chemically synthesized
tagaagtgggaagaacatta

SEQ ID NO: 253043 - DNA, 20 bp, Artificial Sequence
  chemically synthesized
agtgggaagaacattagagc

SEQ ID NO: 253044 - DNA, 20 bp, Artificial Sequence
  chemically synthesized
gggaagaacattagagctag

SEQ ID NO: 253045 - DNA, 20 bp, Artificial Sequence
  chemically synthesized
ggaagaacattagagctagt

SEQ ID NO: 253046 - DNA, 20 bp, Artificial Sequence
  chemically synthesized
tttgcgtgtgtgttacctac

SEQ ID NO: 253047 - DNA, 20 bp, Artificial Sequence
  chemically synthesized
tagtaggtaacacacacgca

SEQ ID NO: 253048 - DNA, 20 bp, Artificial Sequence
  chemically synthesized
aggtaacacacacgcaaagc

SEQ ID NO: 253049 - DNA, 20 bp, Artificial Sequence
  chemically synthesized
ggtaacacacacgcaaagct

SEQ ID NO: 253050 - DNA, 20 bp, Artificial Sequence
  chemically synthesized
cacacgcaaagctaggtaac

SEQ ID NO: 253051 - DNA, 20 bp, Artificial Sequence
  chemically synthesized
atatgactgcgcttgttacc

SEQ ID NO: 253052 - DNA, 20 bp, Artificial Sequence
  chemically synthesized
gcaaagctaggtaacaagcg

SEQ ID NO: 253053 - DNA, 20 bp, Artificial Sequence
  chemically synthesized
gtaacaagcgcagtcatatt

SEQ ID NO: 253054 - DNA, 20 bp, Artificial Sequence
  chemically synthesized
gtcatatttggctgcctttt

SEQ ID NO: 253055 - DNA, 20 bp, Artificial Sequence
  chemically synthesized
cttctatgttactgaaaagg

SEQ ID NO: 253056 - DNA, 20 bp, Artificial Sequence
  chemically synthesized
aagcttctatgttactgaaa

SEQ ID NO: 253057 - DNA, 20 bp, Artificial Sequence
  chemically synthesized
taagcttctatgttactgaa

SEQ ID NO: 253058 - DNA, 20 bp, Artificial Sequence
  chemically synthesized
tggctgccttttcagtaaca

SEQ ID NO: 253059 - DNA, 20 bp, Artificial Sequence
  chemically synthesized
ctgccttttcagtaacatag

SEQ ID NO: 253060 - DNA, 20 bp, Artificial Sequence
  chemically synthesized
ttttcagtaacatagaagct

SEQ ID NO: 253061 - DNA, 20 bp, Artificial Sequence
  chemically synthesized
tttcagtaacatagaagctt

SEQ ID NO: 253062 - DNA, 20 bp, Artificial Sequence
  chemically synthesized
ttcagtaacatagaagctta

SEQ ID NO: 253063 - DNA, 20 bp, Artificial Sequence
  chemically synthesized
tcagtaacatagaagcttag

SEQ ID NO: 253064 - DNA, 20 bp, Artificial Sequence
  chemically synthesized
gtaacatagaagcttagggg

SEQ ID NO: 253065 - DNA, 20 bp, Artificial Sequence
  chemically synthesized
ttcatgccccatcttcccct

SEQ ID NO: 253066 - DNA, 20 bp, Artificial Sequence
  chemically synthesized
catagaagcttaggggaaga

SEQ ID NO: 253067 - DNA, 20 bp, Artificial Sequence
  chemically synthesized
atagaagcttaggggaagat

SEQ ID NO: 253068 - DNA, 20 bp, Artificial Sequence
  chemically synthesized
tagaagcttaggggaagatg

SEQ ID NO: 253069 - DNA, 20 bp, Artificial Sequence
  chemically synthesized
ggggaagatggggcatgaaa

SEQ ID NO: 253070 - DNA, 20 bp, Artificial Sequence
  chemically synthesized
ggaagatggggcatgaaaca

SEQ ID NO: 253071 - DNA, 20 bp, Artificial Sequence
  chemically synthesized
gaagatggggcatgaaacag

SEQ ID NO: 253072 - DNA, 20 bp, Artificial Sequence
  chemically synthesized
tggggcatgaaacagaggct

SEQ ID NO: 253073 - DNA, 20 bp, Artificial Sequence
  chemically synthesized
ggggcatgaaacagaggctg

SEQ ID NO: 253074 - DNA, 20 bp, Artificial Sequence
  chemically synthesized
agcacattattgaacatcct

SEQ ID NO: 253075 - DNA, 20 bp, Artificial Sequence
  chemically synthesized
gaattttctgttgagattca

SEQ ID NO: 253076 - DNA, 20 bp, Artificial Sequence
  chemically synthesized
taatgtgctttgaatctcaa

SEQ ID NO: 253077 - DNA, 20 bp, Artificial Sequence
  chemically synthesized
tacaggcagaattttctgtt

SEQ ID NO: 253078 - DNA, 20 bp, Artificial Sequence
  chemically synthesized
attagctactgaagtacagg

SEQ ID NO: 253079 - DNA, 20 bp, Artificial Sequence
  chemically synthesized
agaaaattctgcctgtactt

SEQ ID NO: 253080 - DNA, 20 bp, Artificial Sequence
  chemically synthesized
cccattagctactgaagtac

SEQ ID NO: 253081 - DNA, 20 bp, Artificial Sequence
  chemically synthesized
ccccattagctactgaagta

SEQ ID NO: 253082 - DNA, 20 bp, Artificial Sequence
  chemically synthesized
aaattctgcctgtacttcag

SEQ ID NO: 253083 - DNA, 20 bp, Artificial Sequence
  chemically synthesized
tagttccccattagctactg

SEQ ID NO: 253084 - DNA, 20 bp, Artificial Sequence
  chemically synthesized
gcctgtacttcagtagctaa

SEQ ID NO: 253085 - DNA, 20 bp, Artificial Sequence
  chemically synthesized
cctgtacttcagtagctaat

SEQ ID NO: 253086 - DNA, 20 bp, Artificial Sequence
  chemically synthesized
ctgtacttcagtagctaatg

SEQ ID NO: 253087 - DNA, 20 bp, Artificial Sequence
  chemically synthesized
taaaaatcatagttccccat

SEQ ID NO: 253088 - DNA, 20 bp, Artificial Sequence
  chemically synthesized
tgataactttttaaaaatca

SEQ ID NO: 253089 - DNA, 20 bp, Artificial Sequence
  chemically synthesized
ggggaactatgatttttaaa

SEQ ID NO: 253090 - DNA, 20 bp, Artificial Sequence
  chemically synthesized
ttaaaaagttatcattatgt

SEQ ID NO: 253091 - DNA, 20 bp, Artificial Sequence
  chemically synthesized
aagatttcaaatatatttga

SEQ ID NO: 253092 - DNA, 20 bp, Artificial Sequence
  chemically synthesized
atttcaaatatatttgaaag

SEQ ID NO: 253093 - DNA, 20 bp, Artificial Sequence
  chemically synthesized
tttcaaatatatttgaaagt

SEQ ID NO: 253094 - DNA, 20 bp, Artificial Sequence
  chemically synthesized
aagtaggaaaataatacaaa

SEQ ID NO: 253095 - DNA, 20 bp, Artificial Sequence
  chemically synthesized
actggattatagggttatgg

SEQ ID NO: 253096 - DNA, 20 bp, Artificial Sequence
  chemically synthesized
gcactggattatagggttat

SEQ ID NO: 253097 - DNA, 20 bp, Artificial Sequence
  chemically synthesized
ggcactggattatagggtta

SEQ ID NO: 253098 - DNA, 20 bp, Artificial Sequence
  chemically synthesized
gctcccataaccctataatc

SEQ ID NO: 253099 - DNA, 20 bp, Artificial Sequence
  chemically synthesized
acagttggcactggattata

SEQ ID NO: 253100 - DNA, 20 bp, Artificial Sequence
  chemically synthesized
aacagttggcactggattat

SEQ ID NO: 253101 - DNA, 20 bp, Artificial Sequence
  chemically synthesized
taacagttggcactggatta

SEQ ID NO: 253102 - DNA, 20 bp, Artificial Sequence
  chemically synthesized
ggagtcataacagttggcac

SEQ ID NO: 253103 - DNA, 20 bp, Artificial Sequence
  chemically synthesized
gtccatggagtcataacagt

SEQ ID NO: 253104 - DNA, 20 bp, Artificial Sequence
  chemically synthesized
gattgtccatggagtcataa

SEQ ID NO: 253105 - DNA, 20 bp, Artificial Sequence
  chemically synthesized
tgccaactgttatgactcca

SEQ ID NO: 253106 - DNA, 20 bp, Artificial Sequence
  chemically synthesized
gagtgggtggattgtccatg

SEQ ID NO: 253107 - DNA, 20 bp, Artificial Sequence
  chemically synthesized
gtgagtgggtggattgtcca

SEQ ID NO: 253108 - DNA, 20 bp, Artificial Sequence
  chemically synthesized
tagttgaagaggtgagtggg

SEQ ID NO: 253109 - DNA, 20 bp, Artificial Sequence
  chemically synthesized
atctagttgaagaggtgagt

SEQ ID NO: 253110 - DNA, 20 bp, Artificial Sequence
  chemically synthesized
aatctagttgaagaggtgag

SEQ ID NO: 253111 - DNA, 20 bp, Artificial Sequence
  chemically synthesized
aataatctagttgaagaggt

SEQ ID NO: 253112 - DNA, 20 bp, Artificial Sequence
  chemically synthesized
cacccactcacctcttcaac

SEQ ID NO: 253113 - DNA, 20 bp, Artificial Sequence
  chemically synthesized
tcagaataatctagttgaag

SEQ ID NO: 253114 - DNA, 20 bp, Artificial Sequence
  chemically synthesized
ttcagaataatctagttgaa

SEQ ID NO: 253115 - DNA, 20 bp, Artificial Sequence
  chemically synthesized
gtttcagaataatctagttg

SEQ ID NO: 253116 - DNA, 20 bp, Artificial Sequence
  chemically synthesized
cagtttgtttcagaataatc

SEQ ID NO: 253117 - DNA, 20 bp, Artificial Sequence
  chemically synthesized
aataatatatcagtttgttt

SEQ ID NO: 253118 - DNA, 20 bp, Artificial Sequence
  chemically synthesized
ttatggagaaaataatatat

SEQ ID NO: 253119 - DNA, 20 bp, Artificial Sequence
  chemically synthesized
aaaatgctgaagtatttatg

SEQ ID NO: 253120 - DNA, 20 bp, Artificial Sequence
  chemically synthesized
gaaaaatgctgaagtattta

SEQ ID NO: 253121 - DNA, 20 bp, Artificial Sequence
  chemically synthesized
tattttctccataaatactt

SEQ ID NO: 253122 - DNA, 20 bp, Artificial Sequence
  chemically synthesized
tcagcaagagaaaaatgctg

SEQ ID NO: 253123 - DNA, 20 bp, Artificial Sequence
  chemically synthesized
atgagagaatatttcagcaa

SEQ ID NO: 253124 - DNA, 20 bp, Artificial Sequence
  chemically synthesized
tcatgagagaatatttcagc

SEQ ID NO: 253125 - DNA, 20 bp, Artificial Sequence
  chemically synthesized
gttctcatgagagaatattt

SEQ ID NO: 253126 - DNA, 20 bp, Artificial Sequence
  chemically synthesized
ttgctgaaatattctctcat

SEQ ID NO: 253127 - DNA, 20 bp, Artificial Sequence
  chemically synthesized
tccgaaaaaagttctcatga

SEQ ID NO: 253128 - DNA, 20 bp, Artificial Sequence
  chemically synthesized
tttccgaaaaaagttctcat

SEQ ID NO: 253129 - DNA, 20 bp, Artificial Sequence
  chemically synthesized
tctctcatgagaactttttt

SEQ ID NO: 253130 - DNA, 20 bp, Artificial Sequence
  chemically synthesized
atatatgtactttccgaaaa

SEQ ID NO: 253131 - DNA, 20 bp, Artificial Sequence
  chemically synthesized
tcatgagaacttttttcgga

SEQ ID NO: 253132 - DNA, 20 bp, Artificial Sequence
  chemically synthesized
taagactgtaggtgtgttaa

SEQ ID NO: 253133 - DNA, 20 bp, Artificial Sequence
  chemically synthesized
taataccattaacacaccta

SEQ ID NO: 253134 - DNA, 20 bp, Artificial Sequence
  chemically synthesized
tgaacttttgttaagactgt

SEQ ID NO: 253135 - DNA, 20 bp, Artificial Sequence
  chemically synthesized
atgaacttttgttaagactg

SEQ ID NO: 253136 - DNA, 20 bp, Artificial Sequence
  chemically synthesized
cacacctacagtcttaacaa

SEQ ID NO: 253137 - DNA, 20 bp, Artificial Sequence
  chemically synthesized
tcaattaatgaacttttgtt

SEQ ID NO: 253138 - DNA, 20 bp, Artificial Sequence
  chemically synthesized
aaaagttcattaattgaatc

SEQ ID NO: 253139 - DNA, 20 bp, Artificial Sequence
  chemically synthesized
cattaattgaatcaagtatc

SEQ ID NO: 253140 - DNA, 20 bp, Artificial Sequence
  chemically synthesized
gctcaaatgtgaatagcaac

SEQ ID NO: 253141 - DNA, 20 bp, Artificial Sequence
  chemically synthesized
cacttcagctcaaatgtgaa

SEQ ID NO: 253142 - DNA, 20 bp, Artificial Sequence
  chemically synthesized
tctagttgctattcacattt

SEQ ID NO: 253143 - DNA, 20 bp, Artificial Sequence
  chemically synthesized
tgctattcacatttgagctg

SEQ ID NO: 253144 - DNA, 20 bp, Artificial Sequence
  chemically synthesized
tattcacatttgagctgaag

SEQ ID NO: 253145 - DNA, 20 bp, Artificial Sequence
  chemically synthesized
attcacatttgagctgaagt

SEQ ID NO: 253146 - DNA, 20 bp, Artificial Sequence
  chemically synthesized
cacatttgagctgaagtggg

SEQ ID NO: 253147 - DNA, 20 bp, Artificial Sequence
  chemically synthesized
cctaaacttccttcccactt

SEQ ID NO: 253148 - DNA, 20 bp, Artificial Sequence
  chemically synthesized
acatttgagctgaagtggga

SEQ ID NO: 253149 - DNA, 20 bp, Artificial Sequence
  chemically synthesized
tttgagctgaagtgggaagg

SEQ ID NO: 253150 - DNA, 20 bp, Artificial Sequence
  chemically synthesized
gctgaagtgggaaggaagtt

SEQ ID NO: 253151 - DNA, 20 bp, Artificial Sequence
  chemically synthesized
ctgaagtgggaaggaagttt

SEQ ID NO: 253152 - DNA, 20 bp, Artificial Sequence
  chemically synthesized
gggaaggaagtttaggaaaa

SEQ ID NO: 253153 - DNA, 20 bp, Artificial Sequence
  chemically synthesized
ggaagtttaggaaaacagct

SEQ ID NO: 253154 - DNA, 20 bp, Artificial Sequence
  chemically synthesized
agtttaggaaaacagctcag

SEQ ID NO: 253155 - DNA, 20 bp, Artificial Sequence
  chemically synthesized
cacagtcactgaattctgct

SEQ ID NO: 253156 - DNA, 20 bp, Artificial Sequence
  chemically synthesized
gaaaacagctcagcagaatt

SEQ ID NO: 253157 - DNA, 20 bp, Artificial Sequence
  chemically synthesized
agaattcagtgactgtgtgt

SEQ ID NO: 253158 - DNA, 20 bp, Artificial Sequence
  chemically synthesized
gaattcagtgactgtgtgtt

SEQ ID NO: 253159 - DNA, 20 bp, Artificial Sequence
  chemically synthesized
cctcttcttcacccaacaca

SEQ ID NO: 253160 - DNA, 20 bp, Artificial Sequence
  chemically synthesized
cagtgactgtgtgttgggtg

SEQ ID NO: 253161 - DNA, 20 bp, Artificial Sequence
  chemically synthesized
tgactgtgtgttgggtgaag

SEQ ID NO: 253162 - DNA, 20 bp, Artificial Sequence
  chemically synthesized
actgtgtgttgggtgaagaa

SEQ ID NO: 253163 - DNA, 20 bp, Artificial Sequence
  chemically synthesized
ctgtgtgttgggtgaagaag

SEQ ID NO: 253164 - DNA, 20 bp, Artificial Sequence
  chemically synthesized
tgtgttgggtgaagaagagg

SEQ ID NO: 253165 - DNA, 20 bp, Artificial Sequence
  chemically synthesized
agaagaggaagaacttgaat

SEQ ID NO: 253166 - DNA, 20 bp, Artificial Sequence
  chemically synthesized
cagatacctaagactcattc

SEQ ID NO: 253167 - DNA, 20 bp, Artificial Sequence
  chemically synthesized
ggaagaacttgaatgagtct

SEQ ID NO: 253168 - DNA, 20 bp, Artificial Sequence
  chemically synthesized
gaagaacttgaatgagtctt

SEQ ID NO: 253169 - DNA, 20 bp, Artificial Sequence
  chemically synthesized
ttgaatgagtcttaggtatc

SEQ ID NO: 253170 - DNA, 20 bp, Artificial Sequence
  chemically synthesized
gatgcccaggccagatacct

SEQ ID NO: 253171 - DNA, 20 bp, Artificial Sequence
  chemically synthesized
tgagtcttaggtatctggcc

SEQ ID NO: 253172 - DNA, 20 bp, Artificial Sequence
  chemically synthesized
gagtcttaggtatctggcct

SEQ ID NO: 253173 - DNA, 20 bp, Artificial Sequence
  chemically synthesized
aatcatgtggatgcccaggc

SEQ ID NO: 253174 - DNA, 20 bp, Artificial Sequence
  chemically synthesized
cacaaatcatgtggatgccc

SEQ ID NO: 253175 - DNA, 20 bp, Artificial Sequence
  chemically synthesized
ccacaaatcatgtggatgcc

SEQ ID NO: 253176 - DNA, 20 bp, Artificial Sequence
  chemically synthesized
caatgacaccacaaatcatg

SEQ ID NO: 253177 - DNA, 20 bp, Artificial Sequence
  chemically synthesized
ctgggcatccacatgatttg

SEQ ID NO: 253178 - DNA, 20 bp, Artificial Sequence
  chemically synthesized
cacatgatttgtggtgtcat

SEQ ID NO: 253179 - DNA, 20 bp, Artificial Sequence
  chemically synthesized
acatgatttgtggtgtcatt

SEQ ID NO: 253180 - DNA, 20 bp, Artificial Sequence
  chemically synthesized
tttgtggtgtcattgggtaa

SEQ ID NO: 253181 - DNA, 20 bp, Artificial Sequence
  chemically synthesized
ttgtggtgtcattgggtaac

SEQ ID NO: 253182 - DNA, 20 bp, Artificial Sequence
  chemically synthesized
gtcattgggtaacaggattt

SEQ ID NO: 253183 - DNA, 20 bp, Artificial Sequence
  chemically synthesized
ttgggtaacaggatttcaga

SEQ ID NO: 253184 - DNA, 20 bp, Artificial Sequence
  chemically synthesized
aacaggatttcagacagatg

SEQ ID NO: 253185 - DNA, 20 bp, Artificial Sequence
  chemically synthesized
caggatttcagacagatgaa

SEQ ID NO: 253186 - DNA, 20 bp, Artificial Sequence
  chemically synthesized
aggatttcagacagatgaag

SEQ ID NO: 253187 - DNA, 20 bp, Artificial Sequence
  chemically synthesized
agacagatgaagaggttcca

SEQ ID NO: 253188 - DNA, 20 bp, Artificial Sequence
  chemically synthesized
catacacaagcatgtaacca

SEQ ID NO: 253189 - DNA, 20 bp, Artificial Sequence
  chemically synthesized
tcacttatgcacacatacac

SEQ ID NO: 253190 - DNA, 20 bp, Artificial Sequence
  chemically synthesized
atgcttgtgtatgtgtgcat

SEQ ID NO: 253191 - DNA, 20 bp, Artificial Sequence
  chemically synthesized
tgtatgtgtgcataagtgat

SEQ ID NO: 253192 - DNA, 20 bp, Artificial Sequence
  chemically synthesized
ataagtgatcagttcaattt

SEQ ID NO: 253193 - DNA, 20 bp, Artificial Sequence
  chemically synthesized
gatcagttcaattttggaca

SEQ ID NO: 253194 - DNA, 20 bp, Artificial Sequence
  chemically synthesized
ttggacatggtcattctgaa

SEQ ID NO: 253195 - DNA, 20 bp, Artificial Sequence
  chemically synthesized
ttgatgcctcaaaggctttt

SEQ ID NO: 253196 - DNA, 20 bp, Artificial Sequence
  chemically synthesized
ggtcattctgaaaagccttt

SEQ ID NO: 253197 - DNA, 20 bp, Artificial Sequence
  chemically synthesized
gtcattctgaaaagcctttg

SEQ ID NO: 253198 - DNA, 20 bp, Artificial Sequence
  chemically synthesized
tctacagtttgatgcctcaa

SEQ ID NO: 253199 - DNA, 20 bp, Artificial Sequence
  chemically synthesized
atctacagtttgatgcctca

SEQ ID NO: 253200 - DNA, 20 bp, Artificial Sequence
  chemically synthesized
gcctttgaggcatcaaactg

SEQ ID NO: 253201 - DNA, 20 bp, Artificial Sequence
  chemically synthesized
aactgcctctggaacatcta

SEQ ID NO: 253202 - DNA, 20 bp, Artificial Sequence
  chemically synthesized
gcatcaaactgtagatgttc

SEQ ID NO: 253203 - DNA, 20 bp, Artificial Sequence
  chemically synthesized
atcaaactgtagatgttcca

SEQ ID NO: 253204 - DNA, 20 bp, Artificial Sequence
  chemically synthesized
tcaaactgtagatgttccag

SEQ ID NO: 253205 - DNA, 20 bp, Artificial Sequence
  chemically synthesized
aactgtagatgttccagagg

SEQ ID NO: 253206 - DNA, 20 bp, Artificial Sequence
  chemically synthesized
aatctgatttcaactgcctc

SEQ ID NO: 253207 - DNA, 20 bp, Artificial Sequence
  chemically synthesized
gttccagaggcagttgaaat

SEQ ID NO: 253208 - DNA, 20 bp, Artificial Sequence
  chemically synthesized
ggcagttgaaatcagatttt

SEQ ID NO: 253209 - DNA, 20 bp, Artificial Sequence
  chemically synthesized
agttgaaatcagattttgag

SEQ ID NO: 253210 - DNA, 20 bp, Artificial Sequence
  chemically synthesized
ttgaaatcagattttgagaa

SEQ ID NO: 253211 - DNA, 20 bp, Artificial Sequence
  chemically synthesized
tgaaatcagattttgagaag

SEQ ID NO: 253212 - DNA, 20 bp, Artificial Sequence
  chemically synthesized
aaatcagattttgagaagag

SEQ ID NO: 253213 - DNA, 20 bp, Artificial Sequence
  chemically synthesized
cagattttgagaagaggagt

SEQ ID NO: 253214 - DNA, 20 bp, Artificial Sequence
  chemically synthesized
ttttgagaagaggagtaaga

SEQ ID NO: 253215 - DNA, 20 bp, Artificial Sequence
  chemically synthesized
tgagaagaggagtaagatgg

SEQ ID NO: 253216 - DNA, 20 bp, Artificial Sequence
  chemically synthesized
gagaagaggagtaagatggc

SEQ ID NO: 253217 - DNA, 20 bp, Artificial Sequence
  chemically synthesized
agaagaggagtaagatggca

SEQ ID NO: 253218 - DNA, 20 bp, Artificial Sequence
  chemically synthesized
gtaagatggcagggattgct

SEQ ID NO: 253219 - DNA, 20 bp, Artificial Sequence
  chemically synthesized
atgtgaaaatatgtatggct

SEQ ID NO: 253220 - DNA, 20 bp, Artificial Sequence
  chemically synthesized
tccaaatgtgaaaatatgta

SEQ ID NO: 253221 - DNA, 20 bp, Artificial Sequence
  chemically synthesized
gccatacatattttcacatt

SEQ ID NO: 253222 - DNA, 20 bp, Artificial Sequence
  chemically synthesized
tattttcacatttggataca

SEQ ID NO: 253223 - DNA, 20 bp, Artificial Sequence
  chemically synthesized
tcacatttggatacatggac

SEQ ID NO: 253224 - DNA, 20 bp, Artificial Sequence
  chemically synthesized
cacatttggatacatggact

SEQ ID NO: 253225 - DNA, 20 bp, Artificial Sequence
  chemically synthesized
aactctttgctcagaaagcc

SEQ ID NO: 253226 - DNA, 20 bp, Artificial Sequence
  chemically synthesized
atacatggactaggctttct

SEQ ID NO: 253227 - DNA, 20 bp, Artificial Sequence
  chemically synthesized
actacaactctttgctcaga

SEQ ID NO: 253228 - DNA, 20 bp, Artificial Sequence
  chemically synthesized
tggactaggctttctgagca

SEQ ID NO: 253229 - DNA, 20 bp, Artificial Sequence
  chemically synthesized
gactaggctttctgagcaaa

SEQ ID NO: 253230 - DNA, 20 bp, Artificial Sequence
  chemically synthesized
agttactacaactctttgct

SEQ ID NO: 253231 - DNA, 20 bp, Artificial Sequence
  chemically synthesized
gctttctgagcaaagagttg

SEQ ID NO: 253232 - DNA, 20 bp, Artificial Sequence
  chemically synthesized
gagttgtagtaactgtctta

SEQ ID NO: 253233 - DNA, 20 bp, Artificial Sequence
  chemically synthesized
agttgtagtaactgtcttaa

SEQ ID NO: 253234 - DNA, 20 bp, Artificial Sequence
  chemically synthesized
gttgtagtaactgtcttaaa

SEQ ID NO: 253235 - DNA, 20 bp, Artificial Sequence
  chemically synthesized
cattcagtcaccctttaaga

SEQ ID NO: 253236 - DNA, 20 bp, Artificial Sequence
  chemically synthesized
ttgccattcagtcacccttt

SEQ ID NO: 253237 - DNA, 20 bp, Artificial Sequence
  chemically synthesized
tgtcttaaagggtgactgaa

SEQ ID NO: 253238 - DNA, 20 bp, Artificial Sequence
  chemically synthesized
ttaaagggtgactgaatggc

SEQ ID NO: 253239 - DNA, 20 bp, Artificial Sequence
  chemically synthesized
tccaaggtacgcttgccatt

SEQ ID NO: 253240 - DNA, 20 bp, Artificial Sequence
  chemically synthesized
actgaatggcaagcgtacct

SEQ ID NO: 253241 - DNA, 20 bp, Artificial Sequence
  chemically synthesized
tgaatggcaagcgtaccttg

SEQ ID NO: 253242 - DNA, 20 bp, Artificial Sequence
  chemically synthesized
ggcaagcgtaccttggagtt

SEQ ID NO: 253243 - DNA, 20 bp, Artificial Sequence
  chemically synthesized
gagcaatgcactaaactcca

SEQ ID NO: 253244 - DNA, 20 bp, Artificial Sequence
  chemically synthesized
agagcaatgcactaaactcc

SEQ ID NO: 253245 - DNA, 20 bp, Artificial Sequence
  chemically synthesized
tggagtttagtgcattgctc

SEQ ID NO: 253246 - DNA, 20 bp, Artificial Sequence
  chemically synthesized
gagtttagtgcattgctctg

SEQ ID NO: 253247 - DNA, 20 bp, Artificial Sequence
  chemically synthesized
gtttagtgcattgctctgga

SEQ ID NO: 253248 - DNA, 20 bp, Artificial Sequence
  chemically synthesized
aaagtttttaaatctctcca

SEQ ID NO: 253249 - DNA, 20 bp, Artificial Sequence
  chemically synthesized
taaaagtttttaaatctctc

SEQ ID NO: 253250 - DNA, 20 bp, Artificial Sequence
  chemically synthesized
caaagggctcttggagataa

SEQ ID NO: 253251 - DNA, 20 bp, Artificial Sequence
  chemically synthesized
atttaaaaacttttatctcc

SEQ ID NO: 253252 - DNA, 20 bp, Artificial Sequence
  chemically synthesized
ttaaaaacttttatctccaa

SEQ ID NO: 253253 - DNA, 20 bp, Artificial Sequence
  chemically synthesized
atgtaatcaaagggctcttg

SEQ ID NO: 253254 - DNA, 20 bp, Artificial Sequence
  chemically synthesized
aaatgtaatcaaagggctct

SEQ ID NO: 253255 - DNA, 20 bp, Artificial Sequence
  chemically synthesized
taagttgaaatgtaatcaaa

SEQ ID NO: 253256 - DNA, 20 bp, Artificial Sequence
  chemically synthesized
ataagttgaaatgtaatcaa

SEQ ID NO: 253257 - DNA, 20 bp, Artificial Sequence
  chemically synthesized
tataagttgaaatgtaatca

SEQ ID NO: 253258 - DNA, 20 bp, Artificial Sequence
  chemically synthesized
gtctattatttttggaatat

SEQ ID NO: 253259 - DNA, 20 bp, Artificial Sequence
  chemically synthesized
aacttatattccaaaaataa

SEQ ID NO: 253260 - DNA, 20 bp, Artificial Sequence
  chemically synthesized
tgatctaggtctattatttt

SEQ ID NO: 253261 - DNA, 20 bp, Artificial Sequence
  chemically synthesized
tattccaaaaataatagacc

SEQ ID NO: 253262 - DNA, 20 bp, Artificial Sequence
  chemically synthesized
aaataatagacctagatcat

SEQ ID NO: 253263 - DNA, 20 bp, Artificial Sequence
  chemically synthesized
gggctataaaccaatgatct

SEQ ID NO: 253264 - DNA, 20 bp, Artificial Sequence
  chemically synthesized
tgggctataaaccaatgatc

SEQ ID NO: 253265 - DNA, 20 bp, Artificial Sequence
  chemically synthesized
agacctagatcattggttta

SEQ ID NO: 253266 - DNA, 20 bp, Artificial Sequence
  chemically synthesized
tagatcattggtttatagcc

SEQ ID NO: 253267 - DNA, 20 bp, Artificial Sequence
  chemically synthesized
gatcattggtttatagccca

SEQ ID NO: 253268 - DNA, 20 bp, Artificial Sequence
  chemically synthesized
ttggtttatagcccagagca

SEQ ID NO: 253269 - DNA, 20 bp, Artificial Sequence
  chemically synthesized
gaagacagagactttgctct

SEQ ID NO: 253270 - DNA, 20 bp, Artificial Sequence
  chemically synthesized
ggaagacagagactttgctc

SEQ ID NO: 253271 - DNA, 20 bp, Artificial Sequence
  chemically synthesized
gacagacatacaggaagaca

SEQ ID NO: 253272 - DNA, 20 bp, Artificial Sequence
  chemically synthesized
gagacagacatacaggaaga

SEQ ID NO: 253273 - DNA, 20 bp, Artificial Sequence
  chemically synthesized
gagagagacagacatacagg

SEQ ID NO: 253274 - DNA, 20 bp, Artificial Sequence
  chemically synthesized
agtgagagagacagacatac

SEQ ID NO: 253275 - DNA, 20 bp, Artificial Sequence
  chemically synthesized
aagtgagagagacagacata

SEQ ID NO: 253276 - DNA, 20 bp, Artificial Sequence
  chemically synthesized
aggagagaaagtgagagaga

SEQ ID NO: 253277 - DNA, 20 bp, Artificial Sequence
  chemically synthesized
caggaggagagaaagtgaga

SEQ ID NO: 253278 - DNA, 20 bp, Artificial Sequence
  chemically synthesized
atcaggaggagagaaagtga

SEQ ID NO: 253279 - DNA, 20 bp, Artificial Sequence
  chemically synthesized
gtatcaggaggagagaaagt

SEQ ID NO: 253280 - DNA, 20 bp, Artificial Sequence
  chemically synthesized
tgatgtatcaggaggagaga

SEQ ID NO: 253281 - DNA, 20 bp, Artificial Sequence
  chemically synthesized
cacctgatgtatcaggagga

SEQ ID NO: 253282 - DNA, 20 bp, Artificial Sequence
  chemically synthesized
agcacctgatgtatcaggag

SEQ ID NO: 253283 - DNA, 20 bp, Artificial Sequence
  chemically synthesized
agagcacctgatgtatcagg

SEQ ID NO: 253284 - DNA, 20 bp, Artificial Sequence
  chemically synthesized
tagagcacctgatgtatcag

SEQ ID NO: 253285 - DNA, 20 bp, Artificial Sequence
  chemically synthesized
tttctctcctcctgatacat

SEQ ID NO: 253286 - DNA, 20 bp, Artificial Sequence
  chemically synthesized
tatagagcacctgatgtatc

SEQ ID NO: 253287 - DNA, 20 bp, Artificial Sequence
  chemically synthesized
ttctctcctcctgatacatc

SEQ ID NO: 253288 - DNA, 20 bp, Artificial Sequence
  chemically synthesized
atatagagcacctgatgtat

SEQ ID NO: 253289 - DNA, 20 bp, Artificial Sequence
  chemically synthesized
tggatcttggagattatata

SEQ ID NO: 253290 - DNA, 20 bp, Artificial Sequence
  chemically synthesized
tgtggatcttggagattata

SEQ ID NO: 253291 - DNA, 20 bp, Artificial Sequence
  chemically synthesized
aggtgctctatataatctcc

SEQ ID NO: 253292 - DNA, 20 bp, Artificial Sequence
  chemically synthesized
tcccagaattgtggatcttg

SEQ ID NO: 253293 - DNA, 20 bp, Artificial Sequence
  chemically synthesized
aatcccagaattgtggatct

SEQ ID NO: 253294 - DNA, 20 bp, Artificial Sequence
  chemically synthesized
atctccaagatccacaattc

SEQ ID NO: 253295 - DNA, 20 bp, Artificial Sequence
  chemically synthesized
tctccaagatccacaattct

SEQ ID NO: 253296 - DNA, 20 bp, Artificial Sequence
  chemically synthesized
ggagagaaatcccagaattg

SEQ ID NO: 253297 - DNA, 20 bp, Artificial Sequence
  chemically synthesized
gtagtacaggagagaaatcc

SEQ ID NO: 253298 - DNA, 20 bp, Artificial Sequence
  chemically synthesized
gcaggggttgtagtacagga

SEQ ID NO: 253299 - DNA, 20 bp, Artificial Sequence
  chemically synthesized
gtgcaggggttgtagtacag

SEQ ID NO: 253300 - DNA, 20 bp, Artificial Sequence
  chemically synthesized
gagtgcaggggttgtagtac

SEQ ID NO: 253301 - DNA, 20 bp, Artificial Sequence
  chemically synthesized
tgagtgcaggggttgtagta

SEQ ID NO: 253302 - DNA, 20 bp, Artificial Sequence
  chemically synthesized
atctgtgagtgcaggggttg

SEQ ID NO: 253303 - DNA, 20 bp, Artificial Sequence
  chemically synthesized
atgtttatctgtgagtgcag

SEQ ID NO: 253304 - DNA, 20 bp, Artificial Sequence
  chemically synthesized
gatgtttatctgtgagtgca

SEQ ID NO: 253305 - DNA, 20 bp, Artificial Sequence
  chemically synthesized
tactacaacccctgcactca

SEQ ID NO: 253306 - DNA, 20 bp, Artificial Sequence
  chemically synthesized
agatgtttatctgtgagtgc

SEQ ID NO: 253307 - DNA, 20 bp, Artificial Sequence
  chemically synthesized
aagatgtttatctgtgagtg

SEQ ID NO: 253308 - DNA, 20 bp, Artificial Sequence
  chemically synthesized
agggcaagatgtttatctgt

SEQ ID NO: 253309 - DNA, 20 bp, Artificial Sequence
  chemically synthesized
acagataaacatcttgccct

SEQ ID NO: 253310 - DNA, 20 bp, Artificial Sequence
  chemically synthesized
actcaaaagcatctcagggc

SEQ ID NO: 253311 - DNA, 20 bp, Artificial Sequence
  chemically synthesized
aattactcaaaagcatctca

SEQ ID NO: 253312 - DNA, 20 bp, Artificial Sequence
  chemically synthesized
taattactcaaaagcatctc

SEQ ID NO: 253313 - DNA, 20 bp, Artificial Sequence
  chemically synthesized
ttaattactcaaaagcatct

SEQ ID NO: 253314 - DNA, 20 bp, Artificial Sequence
  chemically synthesized
tcttgccctgagatgctttt

SEQ ID NO: 253315 - DNA, 20 bp, Artificial Sequence
  chemically synthesized
atacatcattaattactcaa

SEQ ID NO: 253316 - DNA, 20 bp, Artificial Sequence
  chemically synthesized
taatgatgtattctctcatc

SEQ ID NO: 253317 - DNA, 20 bp, Artificial Sequence
  chemically synthesized
atgatgtattctctcatcca

SEQ ID NO: 253318 - DNA, 20 bp, Artificial Sequence
  chemically synthesized
aacataagatctctggatga

SEQ ID NO: 253319 - DNA, 20 bp, Artificial Sequence
  chemically synthesized
gaaacataagatctctggat

SEQ ID NO: 253320 - DNA, 20 bp, Artificial Sequence
  chemically synthesized
gtcaggaaacataagatctc

SEQ ID NO: 253321 - DNA, 20 bp, Artificial Sequence
  chemically synthesized
tttatctagtcaggaaacat

SEQ ID NO: 253322 - DNA, 20 bp, Artificial Sequence
  chemically synthesized
gagatcttatgtttcctgac

SEQ ID NO: 253323 - DNA, 20 bp, Artificial Sequence
  chemically synthesized
aaatttatatttatctagtc

SEQ ID NO: 253324 - DNA, 20 bp, Artificial Sequence
  chemically synthesized
aaaatttatatttatctagt

SEQ ID NO: 253325 - DNA, 20 bp, Artificial Sequence
  chemically synthesized
tgttaaaatttatatttatc

SEQ ID NO: 253326 - DNA, 20 bp, Artificial Sequence
  chemically synthesized
aattttaacaaatatcaaca

SEQ ID NO: 253327 - DNA, 20 bp, Artificial Sequence
  chemically synthesized
attttaacaaatatcaacaa

SEQ ID NO: 253328 - DNA, 20 bp, Artificial Sequence
  chemically synthesized
ttttaacaaatatcaacaaa

SEQ ID NO: 253329 - DNA, 20 bp, Artificial Sequence
  chemically synthesized
catctcaaaaaaaaaaaaaa

SEQ ID NO: 253330 - DNA, 20 bp, Artificial Sequence
  chemically synthesized
attctttttttttttttttt

SEQ ID NO: 253331 - DNA, 20 bp, Artificial Sequence
  chemically synthesized
ttttttttttttttttgaga

SEQ ID NO: 253332 - DNA, 20 bp, Artificial Sequence
  chemically synthesized
ttttttttttttttgagatg

SEQ ID NO: 253333 - DNA, 20 bp, Artificial Sequence
  chemically synthesized
tttttttttgagatggagtc

SEQ ID NO: 253334 - DNA, 20 bp, Artificial Sequence
  chemically synthesized
tccagcctgggtgacagagc

SEQ ID NO: 253335 - DNA, 20 bp, Artificial Sequence
  chemically synthesized
tggagtctagctctgtcacc

SEQ ID NO: 253336 - DNA, 20 bp, Artificial Sequence
  chemically synthesized
gcactccagcctgggtgaca

SEQ ID NO: 253337 - DNA, 20 bp, Artificial Sequence
  chemically synthesized
ggagtctagctctgtcaccc

SEQ ID NO: 253338 - DNA, 20 bp, Artificial Sequence
  chemically synthesized
ctgcactccagcctgggtga

SEQ ID NO: 253339 - DNA, 20 bp, Artificial Sequence
  chemically synthesized
tctagctctgtcacccaggc

SEQ ID NO: 253340 - DNA, 20 bp, Artificial Sequence
  chemically synthesized
tagctctgtcacccaggctg

SEQ ID NO: 253341 - DNA, 20 bp, Artificial Sequence
  chemically synthesized
agaccactgcactccagcct

SEQ ID NO: 253342 - DNA, 20 bp, Artificial Sequence
  chemically synthesized
cagaccactgcactccagcc

SEQ ID NO: 253343 - DNA, 20 bp, Artificial Sequence
  chemically synthesized
ctgtcacccaggctggagtg

SEQ ID NO: 253344 - DNA, 20 bp, Artificial Sequence
  chemically synthesized
tagatcagaccactgcactc

SEQ ID NO: 253345 - DNA, 20 bp, Artificial Sequence
  chemically synthesized
tcacccaggctggagtgcag

SEQ ID NO: 253346 - DNA, 20 bp, Artificial Sequence
  chemically synthesized
tggagtgcagtggtctgatc

SEQ ID NO: 253347 - DNA, 20 bp, Artificial Sequence
  chemically synthesized
ggagtgcagtggtctgatct

SEQ ID NO: 253348 - DNA, 20 bp, Artificial Sequence
  chemically synthesized
agcttgcagtgagcctagat

SEQ ID NO: 253349 - DNA, 20 bp, Artificial Sequence
  chemically synthesized
ggcggagcttgcagtgagcc

SEQ ID NO: 253350 - DNA, 20 bp, Artificial Sequence
  chemically synthesized
gtctgatctaggctcactgc

SEQ ID NO: 253351 - DNA, 20 bp, Artificial Sequence
  chemically synthesized
cgggaggcggagcttgcagt

SEQ ID NO: 253352 - DNA, 20 bp, Artificial Sequence
  chemically synthesized
aacccgggaggcggagcttg

SEQ ID NO: 253353 - DNA, 20 bp, Artificial Sequence
  chemically synthesized
tcactgcaagctccgcctcc

SEQ ID NO: 253354 - DNA, 20 bp, Artificial Sequence
  chemically synthesized
gtaagtaaacccgggaggcg

SEQ ID NO: 253355 - DNA, 20 bp, Artificial Sequence
  chemically synthesized
cactgcaagctccgcctccc

SEQ ID NO: 253356 - DNA, 20 bp, Artificial Sequence
  chemically synthesized
gtgtaagtaaacccgggagg

SEQ ID NO: 253357 - DNA, 20 bp, Artificial Sequence
  chemically synthesized
atggtgtaagtaaacccggg

SEQ ID NO: 253358 - DNA, 20 bp, Artificial Sequence
  chemically synthesized
aatggtgtaagtaaacccgg

SEQ ID NO: 253359 - DNA, 20 bp, Artificial Sequence
  chemically synthesized
agaatggtgtaagtaaaccc

SEQ ID NO: 253360 - DNA, 20 bp, Artificial Sequence
  chemically synthesized
gagaatggtgtaagtaaacc

SEQ ID NO: 253361 - DNA, 20 bp, Artificial Sequence
  chemically synthesized
ctgaggcaagagaatggtgt

SEQ ID NO: 253362 - DNA, 20 bp, Artificial Sequence
  chemically synthesized
aggaggctgaggcaagagaa

SEQ ID NO: 253363 - DNA, 20 bp, Artificial Sequence
  chemically synthesized
cttacaccattctcttgcct

SEQ ID NO: 253364 - DNA, 20 bp, Artificial Sequence
  chemically synthesized
tcgggaggaggctgaggcaa

SEQ ID NO: 253365 - DNA, 20 bp, Artificial Sequence
  chemically synthesized
actcgggaggaggctgaggc

SEQ ID NO: 253366 - DNA, 20 bp, Artificial Sequence
  chemically synthesized
agctactcgggaggaggctg

SEQ ID NO: 253367 - DNA, 20 bp, Artificial Sequence
  chemically synthesized
cagctactcgggaggaggct

SEQ ID NO: 253368 - DNA, 20 bp, Artificial Sequence
  chemically synthesized
tcttgcctcagcctcctccc

SEQ ID NO: 253369 - DNA, 20 bp, Artificial Sequence
  chemically synthesized
agtcccagctactcgggagg

SEQ ID NO: 253370 - DNA, 20 bp, Artificial Sequence
  chemically synthesized
tagtcccagctactcgggag

SEQ ID NO: 253371 - DNA, 20 bp, Artificial Sequence
  chemically synthesized
tgcctcagcctcctcccgag

SEQ ID NO: 253372 - DNA, 20 bp, Artificial Sequence
  chemically synthesized
tatagtcccagctactcggg

SEQ ID NO: 253373 - DNA, 20 bp, Artificial Sequence
  chemically synthesized
ctatagtcccagctactcgg

SEQ ID NO: 253374 - DNA, 20 bp, Artificial Sequence
  chemically synthesized
tcagcctcctcccgagtagc

SEQ ID NO: 253375 - DNA, 20 bp, Artificial Sequence
  chemically synthesized
gcctatagtcccagctactc

SEQ ID NO: 253376 - DNA, 20 bp, Artificial Sequence
  chemically synthesized
cagcctcctcccgagtagct

SEQ ID NO: 253377 - DNA, 20 bp, Artificial Sequence
  chemically synthesized
cgcctatagtcccagctact

SEQ ID NO: 253378 - DNA, 20 bp, Artificial Sequence
  chemically synthesized
ctcccgagtagctgggacta

SEQ ID NO: 253379 - DNA, 20 bp, Artificial Sequence
  chemically synthesized
tcccgagtagctgggactat

SEQ ID NO: 253380 - DNA, 20 bp, Artificial Sequence
  chemically synthesized
gtggtgggcgcctatagtcc

SEQ ID NO: 253381 - DNA, 20 bp, Artificial Sequence
  chemically synthesized
ggcgtggtggtgggcgccta

SEQ ID NO: 253382 - DNA, 20 bp, Artificial Sequence
  chemically synthesized
aattagccaggcgtggtggt

SEQ ID NO: 253383 - DNA, 20 bp, Artificial Sequence
  chemically synthesized
aaattagccaggcgtggtgg

SEQ ID NO: 253384 - DNA, 20 bp, Artificial Sequence
  chemically synthesized
taggcgcccaccaccacgcc

SEQ ID NO: 253385 - DNA, 20 bp, Artificial Sequence
  chemically synthesized
aaaaaattagccaggcgtgg

SEQ ID NO: 253386 - DNA, 20 bp, Artificial Sequence
  chemically synthesized
tacaaaaaattagccaggcg

SEQ ID NO: 253387 - DNA, 20 bp, Artificial Sequence
  chemically synthesized
aaagatacaaaaaattagcc

SEQ ID NO: 253388 - DNA, 20 bp, Artificial Sequence
  chemically synthesized
taaagatacaaaaaattagc

SEQ ID NO: 253389 - DNA, 20 bp, Artificial Sequence
  chemically synthesized
ctactaaagatacaaaaaat

SEQ ID NO: 253390 - DNA, 20 bp, Artificial Sequence
  chemically synthesized
tggctaattttttgtatctt

SEQ ID NO: 253391 - DNA, 20 bp, Artificial Sequence
  chemically synthesized
ctaattttttgtatctttag

SEQ ID NO: 253392 - DNA, 20 bp, Artificial Sequence
  chemically synthesized
aattttttgtatctttagta

SEQ ID NO: 253393 - DNA, 20 bp, Artificial Sequence
  chemically synthesized
gtgaaaccccgtctctacta

SEQ ID NO: 253394 - DNA, 20 bp, Artificial Sequence
  chemically synthesized
ttttgtatctttagtagaga

SEQ ID NO: 253395 - DNA, 20 bp, Artificial Sequence
  chemically synthesized
tttgtatctttagtagagac

SEQ ID NO: 253396 - DNA, 20 bp, Artificial Sequence
  chemically synthesized
ttgtatctttagtagagacg

SEQ ID NO: 253397 - DNA, 20 bp, Artificial Sequence
  chemically synthesized
gagacggggtttcaccgtgt

SEQ ID NO: 253398 - DNA, 20 bp, Artificial Sequence
  chemically synthesized
cggggtttcaccgtgttagc

SEQ ID NO: 253399 - DNA, 20 bp, Artificial Sequence
  chemically synthesized
cgagaccatcctggctaaca

SEQ ID NO: 253400 - DNA, 20 bp, Artificial Sequence
  chemically synthesized
ggggtttcaccgtgttagcc

SEQ ID NO: 253401 - DNA, 20 bp, Artificial Sequence
  chemically synthesized
tttcaccgtgttagccagga

SEQ ID NO: 253402 - DNA, 20 bp, Artificial Sequence
  chemically synthesized
tcaggagatcgagaccatcc

SEQ ID NO: 253403 - DNA, 20 bp, Artificial Sequence
  chemically synthesized
gatcacgaggtcaggagatc

SEQ ID NO: 253404 - DNA, 20 bp, Artificial Sequence
  chemically synthesized
cgggtggatcacgaggtcag

SEQ ID NO: 253405 - DNA, 20 bp, Artificial Sequence
  chemically synthesized
ggcgggtggatcacgaggtc

SEQ ID NO: 253406 - DNA, 20 bp, Artificial Sequence
  chemically synthesized
aggcgggtggatcacgaggt

SEQ ID NO: 253407 - DNA, 20 bp, Artificial Sequence
  chemically synthesized
gctgaggcgggtggatcacg

SEQ ID NO: 253408 - DNA, 20 bp, Artificial Sequence
  chemically synthesized
ggctgaggcgggtggatcac

SEQ ID NO: 253409 - DNA, 20 bp, Artificial Sequence
  chemically synthesized
acctcgtgatccacccgcct

SEQ ID NO: 253410 - DNA, 20 bp, Artificial Sequence
  chemically synthesized
ttttgggaggctgaggcggg

SEQ ID NO: 253411 - DNA, 20 bp, Artificial Sequence
  chemically synthesized
ttgttttgggaggctgaggc

SEQ ID NO: 253412 - DNA, 20 bp, Artificial Sequence
  chemically synthesized
tttgttttgggaggctgagg

SEQ ID NO: 253413 - DNA, 20 bp, Artificial Sequence
  chemically synthesized
ccctttgttttgggaggctg

SEQ ID NO: 253414 - DNA, 20 bp, Artificial Sequence
  chemically synthesized
tccctttgttttgggaggct

SEQ ID NO: 253415 - DNA, 20 bp, Artificial Sequence
  chemically synthesized
aatattccctttgttttggg

SEQ ID NO: 253416 - DNA, 20 bp, Artificial Sequence
  chemically synthesized
gaatattccctttgttttgg

SEQ ID NO: 253417 - DNA, 20 bp, Artificial Sequence
  chemically synthesized
cgcctcagcctcccaaaaca

SEQ ID NO: 253418 - DNA, 20 bp, Artificial Sequence
  chemically synthesized
gcctcagcctcccaaaacaa

SEQ ID NO: 253419 - DNA, 20 bp, Artificial Sequence
  chemically synthesized
aagaatattccctttgtttt

SEQ ID NO: 253420 - DNA, 20 bp, Artificial Sequence
  chemically synthesized
cctcagcctcccaaaacaaa

SEQ ID NO: 253421 - DNA, 20 bp, Artificial Sequence
  chemically synthesized
caagaatattccctttgttt

SEQ ID NO: 253422 - DNA, 20 bp, Artificial Sequence
  chemically synthesized
aattttgactgaaaataggc

SEQ ID NO: 253423 - DNA, 20 bp, Artificial Sequence
  chemically synthesized
ggaatattcttgcctatttt

SEQ ID NO: 253424 - DNA, 20 bp, Artificial Sequence
  chemically synthesized
tcccaattttgactgaaaat

SEQ ID NO: 253425 - DNA, 20 bp, Artificial Sequence
  chemically synthesized
ttcccaattttgactgaaaa

SEQ ID NO: 253426 - DNA, 20 bp, Artificial Sequence
  chemically synthesized
tgcctattttcagtcaaaat

SEQ ID NO: 253427 - DNA, 20 bp, Artificial Sequence
  chemically synthesized
gcctattttcagtcaaaatt

SEQ ID NO: 253428 - DNA, 20 bp, Artificial Sequence
  chemically synthesized
tattttcagtcaaaattggg

SEQ ID NO: 253429 - DNA, 20 bp, Artificial Sequence
  chemically synthesized
gaagcattttaatcatttgt

SEQ ID NO: 253430 - DNA, 20 bp, Artificial Sequence
  chemically synthesized
cattttaatcatttgtaagt

SEQ ID NO: 253431 - DNA, 20 bp, Artificial Sequence
  chemically synthesized
ttttaatcatttgtaagttg

SEQ ID NO: 253432 - DNA, 20 bp, Artificial Sequence
  chemically synthesized
ttgtaagttggagactgtgt

SEQ ID NO: 253433 - DNA, 20 bp, Artificial Sequence
  chemically synthesized
aagttggagactgtgttaga

SEQ ID NO: 253434 - DNA, 20 bp, Artificial Sequence
  chemically synthesized
cagtcactccctatctaaca

SEQ ID NO: 253435 - DNA, 20 bp, Artificial Sequence
  chemically synthesized
agttggagactgtgttagat

SEQ ID NO: 253436 - DNA, 20 bp, Artificial Sequence
  chemically synthesized
gttggagactgtgttagata

SEQ ID NO: 253437 - DNA, 20 bp, Artificial Sequence
  chemically synthesized
tggagactgtgttagatagg

SEQ ID NO: 253438 - DNA, 20 bp, Artificial Sequence
  chemically synthesized
gaaagctgtacgatcagcag

SEQ ID NO: 253439 - DNA, 20 bp, Artificial Sequence
  chemically synthesized
ctggaaagctgtacgatcag

SEQ ID NO: 253440 - DNA, 20 bp, Artificial Sequence
  chemically synthesized
agtgactgctgctgatcgta

SEQ ID NO: 253441 - DNA, 20 bp, Artificial Sequence
  chemically synthesized
catctggaaagctgtacgat

SEQ ID NO: 253442 - DNA, 20 bp, Artificial Sequence
  chemically synthesized
ctgctgatcgtacagctttc

SEQ ID NO: 253443 - DNA, 20 bp, Artificial Sequence
  chemically synthesized
ttcagagcccgtcatctgga

SEQ ID NO: 253444 - DNA, 20 bp, Artificial Sequence
  chemically synthesized
tcgtacagctttccagatga

SEQ ID NO: 253445 - DNA, 20 bp, Artificial Sequence
  chemically synthesized
cgtacagctttccagatgac

SEQ ID NO: 253446 - DNA, 20 bp, Artificial Sequence
  chemically synthesized
tttcttcagagcccgtcatc

SEQ ID NO: 253447 - DNA, 20 bp, Artificial Sequence
  chemically synthesized
tttccagatgacgggctctg

SEQ ID NO: 253448 - DNA, 20 bp, Artificial Sequence
  chemically synthesized
tgattgtgaagttttcttca

SEQ ID NO: 253449 - DNA, 20 bp, Artificial Sequence
  chemically synthesized
tctgattgtgaagttttctt

SEQ ID NO: 253450 - DNA, 20 bp, Artificial Sequence
  chemically synthesized
tctgaagaaaacttcacaat

SEQ ID NO: 253451 - DNA, 20 bp, Artificial Sequence
  chemically synthesized
tgtttccctctctgattgtg

SEQ ID NO: 253452 - DNA, 20 bp, Artificial Sequence
  chemically synthesized
tgaagaaaacttcacaatca

SEQ ID NO: 253453 - DNA, 20 bp, Artificial Sequence
  chemically synthesized
aagaaaacttcacaatcaga

SEQ ID NO: 253454 - DNA, 20 bp, Artificial Sequence
  chemically synthesized
agaaaacttcacaatcagag

SEQ ID NO: 253455 - DNA, 20 bp, Artificial Sequence
  chemically synthesized
gaaaacttcacaatcagaga

SEQ ID NO: 253456 - DNA, 20 bp, Artificial Sequence
  chemically synthesized
ttcacaatcagagagggaaa

SEQ ID NO: 253457 - DNA, 20 bp, Artificial Sequence
  chemically synthesized
tcacaatcagagagggaaac

SEQ ID NO: 253458 - DNA, 20 bp, Artificial Sequence
  chemically synthesized
aatcagagagggaaacagga

SEQ ID NO: 253459 - DNA, 20 bp, Artificial Sequence
  chemically synthesized
cagagagggaaacaggaaag

SEQ ID NO: 253460 - DNA, 20 bp, Artificial Sequence
  chemically synthesized
aagaagttaacaataaaact

SEQ ID NO: 253461 - DNA, 20 bp, Artificial Sequence
  chemically synthesized
gaagttaacaataaaactta

SEQ ID NO: 253462 - DNA, 20 bp, Artificial Sequence
  chemically synthesized
aagttaacaataaaacttag

SEQ ID NO: 253463 - DNA, 20 bp, Artificial Sequence
  chemically synthesized
aataaggcagaaaatcctct

SEQ ID NO: 253464 - DNA, 20 bp, Artificial Sequence
  chemically synthesized
cgtgaaatcttagaataagg

SEQ ID NO: 253465 - DNA, 20 bp, Artificial Sequence
  chemically synthesized
aggattttctgccttattct

SEQ ID NO: 253466 - DNA, 20 bp, Artificial Sequence
  chemically synthesized
aaacgtgaaatcttagaata

SEQ ID NO: 253467 - DNA, 20 bp, Artificial Sequence
  chemically synthesized
caaacgtgaaatcttagaat

SEQ ID NO: 253468 - DNA, 20 bp, Artificial Sequence
  chemically synthesized
ggaccacaaacgtgaaatct

SEQ ID NO: 253469 - DNA, 20 bp, Artificial Sequence
  chemically synthesized
attctaagatttcacgtttg

SEQ ID NO: 253470 - DNA, 20 bp, Artificial Sequence
  chemically synthesized
atttcacgtttgtggtccac

SEQ ID NO: 253471 - DNA, 20 bp, Artificial Sequence
  chemically synthesized
tttcacgtttgtggtccacg

SEQ ID NO: 253472 - DNA, 20 bp, Artificial Sequence
  chemically synthesized
ttgctcaaggcaagtcctcg

SEQ ID NO: 253473 - DNA, 20 bp, Artificial Sequence
  chemically synthesized
ggtccacgaggacttgcctt

SEQ ID NO: 253474 - DNA, 20 bp, Artificial Sequence
  chemically synthesized
gcttagttcttgctcaaggc

SEQ ID NO: 253475 - DNA, 20 bp, Artificial Sequence
  chemically synthesized
cacgaggacttgccttgagc

SEQ ID NO: 253476 - DNA, 20 bp, Artificial Sequence
  chemically synthesized
ttcagcttagttcttgctca

SEQ ID NO: 253477 - DNA, 20 bp, Artificial Sequence
  chemically synthesized
cttcagcttagttcttgctc

SEQ ID NO: 253478 - DNA, 20 bp, Artificial Sequence
  chemically synthesized
acttgccttgagcaagaact

SEQ ID NO: 253479 - DNA, 20 bp, Artificial Sequence
  chemically synthesized
cttgagcaagaactaagctg

SEQ ID NO: 253480 - DNA, 20 bp, Artificial Sequence
  chemically synthesized
tgagcaagaactaagctgaa

SEQ ID NO: 253481 - DNA, 20 bp, Artificial Sequence
  chemically synthesized
tctcacctgcctcttcagct

SEQ ID NO: 253482 - DNA, 20 bp, Artificial Sequence
  chemically synthesized
gagcaagaactaagctgaag

SEQ ID NO: 253483 - DNA, 20 bp, Artificial Sequence
  chemically synthesized
caagaactaagctgaagagg

SEQ ID NO: 253484 - DNA, 20 bp, Artificial Sequence
  chemically synthesized
aagaactaagctgaagaggc

SEQ ID NO: 253485 - DNA, 20 bp, Artificial Sequence
  chemically synthesized
tgtagtctcacctgcctctt

SEQ ID NO: 253486 - DNA, 20 bp, Artificial Sequence
  chemically synthesized
actaagctgaagaggcaggt

SEQ ID NO: 253487 - DNA, 20 bp, Artificial Sequence
  chemically synthesized
tgaagaggcaggtgagacta

SEQ ID NO: 253488 - DNA, 20 bp, Artificial Sequence
  chemically synthesized
tttacaactgacattatctg

SEQ ID NO: 253489 - DNA, 20 bp, Artificial Sequence
  chemically synthesized
ggtgagactacagataatgt

SEQ ID NO: 253490 - DNA, 20 bp, Artificial Sequence
  chemically synthesized
acagataatgtcagttgtaa

SEQ ID NO: 253491 - DNA, 20 bp, Artificial Sequence
  chemically synthesized
cagataatgtcagttgtaaa

SEQ ID NO: 253492 - DNA, 20 bp, Artificial Sequence
  chemically synthesized
atgtcagttgtaaaaggtaa

SEQ ID NO: 253493 - DNA, 20 bp, Artificial Sequence
  chemically synthesized
gtaaaagtcaatgcttacaa

SEQ ID NO: 253494 - DNA, 20 bp, Artificial Sequence
  chemically synthesized
taaaagtcaatgcttacaat

SEQ ID NO: 253495 - DNA, 20 bp, Artificial Sequence
  chemically synthesized
ttttataaggttcccattgt

SEQ ID NO: 253496 - DNA, 20 bp, Artificial Sequence
  chemically synthesized
tacaatgggaaccttataaa

SEQ ID NO: 253497 - DNA, 20 bp, Artificial Sequence
  chemically synthesized
gaacacagttgctttttata

SEQ ID NO: 253498 - DNA, 20 bp, Artificial Sequence
  chemically synthesized
agaacacagttgctttttat

SEQ ID NO: 253499 - DNA, 20 bp, Artificial Sequence
  chemically synthesized
ataaataagacacgagaaca

SEQ ID NO: 253500 - DNA, 20 bp, Artificial Sequence
  chemically synthesized
tgagctgataaataagacac

SEQ ID NO: 253501 - DNA, 20 bp, Artificial Sequence
  chemically synthesized
tgttctcgtgtcttatttat

SEQ ID NO: 253502 - DNA, 20 bp, Artificial Sequence
  chemically synthesized
ctgttgctgagctgataaat

SEQ ID NO: 253503 - DNA, 20 bp, Artificial Sequence
  chemically synthesized
tcgtgtcttatttatcagct

SEQ ID NO: 253504 - DNA, 20 bp, Artificial Sequence
  chemically synthesized
cttatttatcagctcagcaa

SEQ ID NO: 253505 - DNA, 20 bp, Artificial Sequence
  chemically synthesized
ttatttatcagctcagcaac

SEQ ID NO: 253506 - DNA, 20 bp, Artificial Sequence
  chemically synthesized
ttgtatcttatcctgttgct

SEQ ID NO: 253507 - DNA, 20 bp, Artificial Sequence
  chemically synthesized
tatcagctcagcaacaggat

SEQ ID NO: 253508 - DNA, 20 bp, Artificial Sequence
  chemically synthesized
agcaacaggataagatacaa

SEQ ID NO: 253509 - DNA, 20 bp, Artificial Sequence
  chemically synthesized
aggataagatacaatggtta

SEQ ID NO: 253510 - DNA, 20 bp, Artificial Sequence
  chemically synthesized
ggataagatacaatggttat

SEQ ID NO: 253511 - DNA, 20 bp, Artificial Sequence
  chemically synthesized
acaatggttatgggtgatgt

SEQ ID NO: 253512 - DNA, 20 bp, Artificial Sequence
  chemically synthesized
tgggtgatgtgagtgaattt

SEQ ID NO: 253513 - DNA, 20 bp, Artificial Sequence
  chemically synthesized
ggtgatgtgagtgaatttca

SEQ ID NO: 253514 - DNA, 20 bp, Artificial Sequence
  chemically synthesized
atgtgagtgaatttcagaga

SEQ ID NO: 253515 - DNA, 20 bp, Artificial Sequence
  chemically synthesized
tgagtgaatttcagagaaag

SEQ ID NO: 253516 - DNA, 20 bp, Artificial Sequence
  chemically synthesized
gagtgaatttcagagaaaga

SEQ ID NO: 253517 - DNA, 20 bp, Artificial Sequence
  chemically synthesized
tgtttttaaaataaaatttc

SEQ ID NO: 253518 - DNA, 20 bp, Artificial Sequence
  chemically synthesized
gtttttaaaataaaatttca

SEQ ID NO: 253519 - DNA, 20 bp, Artificial Sequence
  chemically synthesized
aatttcaaggcattctcttc

SEQ ID NO: 253520 - DNA, 20 bp, Artificial Sequence
  chemically synthesized
aaggtgtacatagactggaa

SEQ ID NO: 253521 - DNA, 20 bp, Artificial Sequence
  chemically synthesized
acaaggtgtacatagactgg

SEQ ID NO: 253522 - DNA, 20 bp, Artificial Sequence
  chemically synthesized
atcacaaggtgtacatagac

SEQ ID NO: 253523 - DNA, 20 bp, Artificial Sequence
  chemically synthesized
tttccatcacaaggtgtaca

SEQ ID NO: 253524 - DNA, 20 bp, Artificial Sequence
  chemically synthesized
agtctatgtacaccttgtga

SEQ ID NO: 253525 - DNA, 20 bp, Artificial Sequence
  chemically synthesized
aatgaaagctttccatcaca

SEQ ID NO: 253526 - DNA, 20 bp, Artificial Sequence
  chemically synthesized
taatgaaagctttccatcac

SEQ ID NO: 253527 - DNA, 20 bp, Artificial Sequence
  chemically synthesized
tatgtacaccttgtgatgga

SEQ ID NO: 253528 - DNA, 20 bp, Artificial Sequence
  chemically synthesized
cgaaacaaaagaaataatga

SEQ ID NO: 253529 - DNA, 20 bp, Artificial Sequence
  chemically synthesized
taaattgaggtgcgaaacaa

SEQ ID NO: 253530 - DNA, 20 bp, Artificial Sequence
  chemically synthesized
ttttccacagagttaaattg

SEQ ID NO: 253531 - DNA, 20 bp, Artificial Sequence
  chemically synthesized
tttttccacagagttaaatt

SEQ ID NO: 253532 - DNA, 20 bp, Artificial Sequence
  chemically synthesized
cgcacctcaatttaactctg

SEQ ID NO: 253533 - DNA, 20 bp, Artificial Sequence
  chemically synthesized
agataagtactttttccaca

SEQ ID NO: 253534 - DNA, 20 bp, Artificial Sequence
  chemically synthesized
tcaatttaactctgtggaaa

SEQ ID NO: 253535 - DNA, 20 bp, Artificial Sequence
  chemically synthesized
tcagataagtactttttcca

SEQ ID NO: 253536 - DNA, 20 bp, Artificial Sequence
  chemically synthesized
tggaaaaagtacttatctga

SEQ ID NO: 253537 - DNA, 20 bp, Artificial Sequence
  chemically synthesized
ggaaaaagtacttatctgac

SEQ ID NO: 253538 - DNA, 20 bp, Artificial Sequence
  chemically synthesized
taatacctgacctgtcagat

SEQ ID NO: 253539 - DNA, 20 bp, Artificial Sequence
  chemically synthesized
aaagtacttatctgacaggt

SEQ ID NO: 253540 - DNA, 20 bp, Artificial Sequence
  chemically synthesized
aagtacttatctgacaggtc

SEQ ID NO: 253541 - DNA, 20 bp, Artificial Sequence
  chemically synthesized
tatggtaatacctgacctgt

SEQ ID NO: 253542 - DNA, 20 bp, Artificial Sequence
  chemically synthesized
ggtcaggtattaccatacaa

SEQ ID NO: 253543 - DNA, 20 bp, Artificial Sequence
  chemically synthesized
ggcttgttctttcttttgta

SEQ ID NO: 253544 - DNA, 20 bp, Artificial Sequence
  chemically synthesized
aggtattaccatacaaaaga

SEQ ID NO: 253545 - DNA, 20 bp, Artificial Sequence
  chemically synthesized
taccatacaaaagaaagaac

SEQ ID NO: 253546 - DNA, 20 bp, Artificial Sequence
  chemically synthesized
aaagaaagaacaagccaaca

SEQ ID NO: 253547 - DNA, 20 bp, Artificial Sequence
  chemically synthesized
ttctcagattgtttctgtgt

SEQ ID NO: 253548 - DNA, 20 bp, Artificial Sequence
  chemically synthesized
agccaacacagaaacaatct

SEQ ID NO: 253549 - DNA, 20 bp, Artificial Sequence
  chemically synthesized
cctccagataagtaaattct

SEQ ID NO: 253550 - DNA, 20 bp, Artificial Sequence
  chemically synthesized
aatctgagaatttacttatc

SEQ ID NO: 253551 - DNA, 20 bp, Artificial Sequence
  chemically synthesized
tctgagaatttacttatctg

SEQ ID NO: 253552 - DNA, 20 bp, Artificial Sequence
  chemically synthesized
ctgagaatttacttatctgg

SEQ ID NO: 253553 - DNA, 20 bp, Artificial Sequence
  chemically synthesized
taacctgcattcctccagat

SEQ ID NO: 253554 - DNA, 20 bp, Artificial Sequence
  chemically synthesized
agttttaacctgcattcctc

SEQ ID NO: 253555 - DNA, 20 bp, Artificial Sequence
  chemically synthesized
tttacttatctggaggaatg

SEQ ID NO: 253556 - DNA, 20 bp, Artificial Sequence
  chemically synthesized
ttacttatctggaggaatgc

SEQ ID NO: 253557 - DNA, 20 bp, Artificial Sequence
  chemically synthesized
tgcaggttaaaactgtcttt

SEQ ID NO: 253558 - DNA, 20 bp, Artificial Sequence
  chemically synthesized
tatgtgaaattgctaaaaga

SEQ ID NO: 253559 - DNA, 20 bp, Artificial Sequence
  chemically synthesized
tctctatgtgaaattgctaa

SEQ ID NO: 253560 - DNA, 20 bp, Artificial Sequence
  chemically synthesized
tgtcttttagcaatttcaca

SEQ ID NO: 253561 - DNA, 20 bp, Artificial Sequence
  chemically synthesized
tcttttagcaatttcacata

SEQ ID NO: 253562 - DNA, 20 bp, Artificial Sequence
  chemically synthesized
aatttcacatagagaattga

SEQ ID NO: 253563 - DNA, 20 bp, Artificial Sequence
  chemically synthesized
catagagaattgatagtcat

SEQ ID NO: 253564 - DNA, 20 bp, Artificial Sequence
  chemically synthesized
gaatgtgtgtgatgttgaat

SEQ ID NO: 253565 - DNA, 20 bp, Artificial Sequence
  chemically synthesized
tgtgtgatgttgaataagac

SEQ ID NO: 253566 - DNA, 20 bp, Artificial Sequence
  chemically synthesized
gtgtgatgttgaataagact

SEQ ID NO: 253567 - DNA, 20 bp, Artificial Sequence
  chemically synthesized
tgtgatgttgaataagacta

SEQ ID NO: 253568 - DNA, 20 bp, Artificial Sequence
  chemically synthesized
atgttgaataagactaggga

SEQ ID NO: 253569 - DNA, 20 bp, Artificial Sequence
  chemically synthesized
ctgagcaatctgaccatccc

SEQ ID NO: 253570 - DNA, 20 bp, Artificial Sequence
  chemically synthesized
tgaataagactagggatggt

SEQ ID NO: 253571 - DNA, 20 bp, Artificial Sequence
  chemically synthesized
ctagggatggtcagattgct

SEQ ID NO: 253572 - DNA, 20 bp, Artificial Sequence
  chemically synthesized
tagggatggtcagattgctc

SEQ ID NO: 253573 - DNA, 20 bp, Artificial Sequence
  chemically synthesized
gatggtcagattgctcagga

SEQ ID NO: 253574 - DNA, 20 bp, Artificial Sequence
  chemically synthesized
atggtcagattgctcaggaa

SEQ ID NO: 253575 - DNA, 20 bp, Artificial Sequence
  chemically synthesized
tcaccctaaacacctttcct

SEQ ID NO: 253576 - DNA, 20 bp, Artificial Sequence
  chemically synthesized
gattgctcaggaaaggtgtt

SEQ ID NO: 253577 - DNA, 20 bp, Artificial Sequence
  chemically synthesized
attgctcaggaaaggtgttt

SEQ ID NO: 253578 - DNA, 20 bp, Artificial Sequence
  chemically synthesized
ttgctcaggaaaggtgttta

SEQ ID NO: 253579 - DNA, 20 bp, Artificial Sequence
  chemically synthesized
ggaaaggtgtttagggtgaa

SEQ ID NO: 253580 - DNA, 20 bp, Artificial Sequence
  chemically synthesized
aaaggtgtttagggtgaaaa

SEQ ID NO: 253581 - DNA, 20 bp, Artificial Sequence
  chemically synthesized
gtgtttagggtgaaaagagt

SEQ ID NO: 253582 - DNA, 20 bp, Artificial Sequence
  chemically synthesized
tttagggtgaaaagagtgag

SEQ ID NO: 253583 - DNA, 20 bp, Artificial Sequence
  chemically synthesized
gggtgaaaagagtgagaaga

SEQ ID NO: 253584 - DNA, 20 bp, Artificial Sequence
  chemically synthesized
ggtgaaaagagtgagaagaa

SEQ ID NO: 253585 - DNA, 20 bp, Artificial Sequence
  chemically synthesized
gaaaagagtgagaagaaagg

SEQ ID NO: 253586 - DNA, 20 bp, Artificial Sequence
  chemically synthesized
gtgagaagaaaggtagcata

SEQ ID NO: 253587 - DNA, 20 bp, Artificial Sequence
  chemically synthesized
agcataaagatgaacctatg

SEQ ID NO: 253588 - DNA, 20 bp, Artificial Sequence
  chemically synthesized
taaagatgaacctatgtgga

SEQ ID NO: 253589 - DNA, 20 bp, Artificial Sequence
  chemically synthesized
tctgcccatgctttccacat

SEQ ID NO: 253590 - DNA, 20 bp, Artificial Sequence
  chemically synthesized
ctctgcccatgctttccaca

SEQ ID NO: 253591 - DNA, 20 bp, Artificial Sequence
  chemically synthesized
atgaacctatgtggaaagca

SEQ ID NO: 253592 - DNA, 20 bp, Artificial Sequence
  chemically synthesized
tgaacctatgtggaaagcat

SEQ ID NO: 253593 - DNA, 20 bp, Artificial Sequence
  chemically synthesized
acctatgtggaaagcatggg

SEQ ID NO: 253594 - DNA, 20 bp, Artificial Sequence
  chemically synthesized
ctatgtggaaagcatgggca

SEQ ID NO: 253595 - DNA, 20 bp, Artificial Sequence
  chemically synthesized
tatgtggaaagcatgggcag

SEQ ID NO: 253596 - DNA, 20 bp, Artificial Sequence
  chemically synthesized
gtggaaagcatgggcagagg

SEQ ID NO: 253597 - DNA, 20 bp, Artificial Sequence
  chemically synthesized
tggaaagcatgggcagagga

SEQ ID NO: 253598 - DNA, 20 bp, Artificial Sequence
  chemically synthesized
gaaagcatgggcagaggaag

SEQ ID NO: 253599 - DNA, 20 bp, Artificial Sequence
  chemically synthesized
catgggcagaggaaggagat

SEQ ID NO: 253600 - DNA, 20 bp, Artificial Sequence
  chemically synthesized
gaaggagatgagtatcccta

SEQ ID NO: 253601 - DNA, 20 bp, Artificial Sequence
  chemically synthesized
ctgatgactattattcttta

SEQ ID NO: 253602 - DNA, 20 bp, Artificial Sequence
  chemically synthesized
tctgatgactattattcttt

SEQ ID NO: 253603 - DNA, 20 bp, Artificial Sequence
  chemically synthesized
gtctgatgactattattctt

SEQ ID NO: 253604 - DNA, 20 bp, Artificial Sequence
  chemically synthesized
tgagtatccctaaagaataa

SEQ ID NO: 253605 - DNA, 20 bp, Artificial Sequence
  chemically synthesized
ccctaaagaataatagtcat

SEQ ID NO: 253606 - DNA, 20 bp, Artificial Sequence
  chemically synthesized
agaataatagtcatcagacc

SEQ ID NO: 253607 - DNA, 20 bp, Artificial Sequence
  chemically synthesized
gaataatagtcatcagaccc

SEQ ID NO: 253608 - DNA, 20 bp, Artificial Sequence
  chemically synthesized
taatagtcatcagacccagg

SEQ ID NO: 253609 - DNA, 20 bp, Artificial Sequence
  chemically synthesized
atagtcatcagacccaggaa

SEQ ID NO: 253610 - DNA, 20 bp, Artificial Sequence
  chemically synthesized
ctccttctggttctcttcct

SEQ ID NO: 253611 - DNA, 20 bp, Artificial Sequence
  chemically synthesized
cctccttctggttctcttcc

SEQ ID NO: 253612 - DNA, 20 bp, Artificial Sequence
  chemically synthesized
atcagacccaggaagagaac

SEQ ID NO: 253613 - DNA, 20 bp, Artificial Sequence
  chemically synthesized
agacccaggaagagaaccag

SEQ ID NO: 253614 - DNA, 20 bp, Artificial Sequence
  chemically synthesized
gacccaggaagagaaccaga

SEQ ID NO: 253615 - DNA, 20 bp, Artificial Sequence
  chemically synthesized
cccaggaagagaaccagaag

SEQ ID NO: 253616 - DNA, 20 bp, Artificial Sequence
  chemically synthesized
ccaggaagagaaccagaagg

SEQ ID NO: 253617 - DNA, 20 bp, Artificial Sequence
  chemically synthesized
caggaagagaaccagaagga

SEQ ID NO: 253618 - DNA, 20 bp, Artificial Sequence
  chemically synthesized
gacaactccctccctccttc

SEQ ID NO: 253619 - DNA, 20 bp, Artificial Sequence
  chemically synthesized
ggaagagaaccagaaggagg

SEQ ID NO: 253620 - DNA, 20 bp, Artificial Sequence
  chemically synthesized
gaagagaaccagaaggaggg

SEQ ID NO: 253621 - DNA, 20 bp, Artificial Sequence
  chemically synthesized
aagagaaccagaaggaggga

SEQ ID NO: 253622 - DNA, 20 bp, Artificial Sequence
  chemically synthesized
gagaaccagaaggagggagg

SEQ ID NO: 253623 - DNA, 20 bp, Artificial Sequence
  chemically synthesized
ggagggagggagttgtcaac

SEQ ID NO: 253624 - DNA, 20 bp, Artificial Sequence
  chemically synthesized
ggagggagttgtcaacaagt

SEQ ID NO: 253625 - DNA, 20 bp, Artificial Sequence
  chemically synthesized
agttgtcaacaagtcagatg

SEQ ID NO: 253626 - DNA, 20 bp, Artificial Sequence
  chemically synthesized
gtcaacaagtcagatgcagc

SEQ ID NO: 253627 - DNA, 20 bp, Artificial Sequence
  chemically synthesized
tcaacaagtcagatgcagcc

SEQ ID NO: 253628 - DNA, 20 bp, Artificial Sequence
  chemically synthesized
aagtcagatgcagccaggac

SEQ ID NO: 253629 - DNA, 20 bp, Artificial Sequence
  chemically synthesized
agtcagatgcagccaggacc

SEQ ID NO: 253630 - DNA, 20 bp, Artificial Sequence
  chemically synthesized
tcagatgcagccaggaccag

SEQ ID NO: 253631 - DNA, 20 bp, Artificial Sequence
  chemically synthesized
tgacttttccctcctggtcc

SEQ ID NO: 253632 - DNA, 20 bp, Artificial Sequence
  chemically synthesized
cagatgcagccaggaccagg

SEQ ID NO: 253633 - DNA, 20 bp, Artificial Sequence
  chemically synthesized
agatgcagccaggaccagga

SEQ ID NO: 253634 - DNA, 20 bp, Artificial Sequence
  chemically synthesized
ccgagctgacttttccctcc

SEQ ID NO: 253635 - DNA, 20 bp, Artificial Sequence
  chemically synthesized
cagccaggaccaggagggaa

SEQ ID NO: 253636 - DNA, 20 bp, Artificial Sequence
  chemically synthesized
caggaccaggagggaaaagt

SEQ ID NO: 253637 - DNA, 20 bp, Artificial Sequence
  chemically synthesized
ccaggagggaaaagtcagct

SEQ ID NO: 253638 - DNA, 20 bp, Artificial Sequence
  chemically synthesized
caggagggaaaagtcagctc

SEQ ID NO: 253639 - DNA, 20 bp, Artificial Sequence
  chemically synthesized
aatgacctcctaaattgccc

SEQ ID NO: 253640 - DNA, 20 bp, Artificial Sequence
  chemically synthesized
aaaagtcagctcgggcaatt

SEQ ID NO: 253641 - DNA, 20 bp, Artificial Sequence
  chemically synthesized
aaagtcagctcgggcaattt

SEQ ID NO: 253642 - DNA, 20 bp, Artificial Sequence
  chemically synthesized
agtcagctcgggcaatttag

SEQ ID NO: 253643 - DNA, 20 bp, Artificial Sequence
  chemically synthesized
gtcagctcgggcaatttagg

SEQ ID NO: 253644 - DNA, 20 bp, Artificial Sequence
  chemically synthesized
cgggcaatttaggaggtcat

SEQ ID NO: 253645 - DNA, 20 bp, Artificial Sequence
  chemically synthesized
aggtcattggtgatcttatc

SEQ ID NO: 253646 - DNA, 20 bp, Artificial Sequence
  chemically synthesized
gtcattggtgatcttatcga

SEQ ID NO: 253647 - DNA, 20 bp, Artificial Sequence
  chemically synthesized
atgctgttgttgctctcgat

SEQ ID NO: 253648 - DNA, 20 bp, Artificial Sequence
  chemically synthesized
gatcttatcgagagcaacaa

SEQ ID NO: 253649 - DNA, 20 bp, Artificial Sequence
  chemically synthesized
cgagagcaacaacagcatgt

SEQ ID NO: 253650 - DNA, 20 bp, Artificial Sequence
  chemically synthesized
gagcaacaacagcatgttgg

SEQ ID NO: 253651 - DNA, 20 bp, Artificial Sequence
  chemically synthesized
caacaacagcatgttggaag

SEQ ID NO: 253652 - DNA, 20 bp, Artificial Sequence
  chemically synthesized
ggaagtggaaaacataaatg

SEQ ID NO: 253653 - DNA, 20 bp, Artificial Sequence
  chemically synthesized
gaagtggaaaacataaatgt

SEQ ID NO: 253654 - DNA, 20 bp, Artificial Sequence
  chemically synthesized
gtggaaaacataaatgtagg

SEQ ID NO: 253655 - DNA, 20 bp, Artificial Sequence
  chemically synthesized
aaacataaatgtaggcagac

SEQ ID NO: 253656 - DNA, 20 bp, Artificial Sequence
  chemically synthesized
gatgacagcaaaagacagtc

SEQ ID NO: 253657 - DNA, 20 bp, Artificial Sequence
  chemically synthesized
aagatgatgacagcaaaaga

SEQ ID NO: 253658 - DNA, 20 bp, Artificial Sequence
  chemically synthesized
gtgaaagatgatgacagcaa

SEQ ID NO: 253659 - DNA, 20 bp, Artificial Sequence
  chemically synthesized
tttatagtgaaagatgatga

SEQ ID NO: 253660 - DNA, 20 bp, Artificial Sequence
  chemically synthesized
tattttctattttatagtga

SEQ ID NO: 253661 - DNA, 20 bp, Artificial Sequence
  chemically synthesized
catcatctttcactataaaa

SEQ ID NO: 253662 - DNA, 20 bp, Artificial Sequence
  chemically synthesized
caaagctattttctatttta

SEQ ID NO: 253663 - DNA, 20 bp, Artificial Sequence
  chemically synthesized
tttcactataaaatagaaaa

SEQ ID NO: 253664 - DNA, 20 bp, Artificial Sequence
  chemically synthesized
gcatactgcaatgtcgtaca

SEQ ID NO: 253665 - DNA, 20 bp, Artificial Sequence
  chemically synthesized
aatagctttgtacgacattg

SEQ ID NO: 253666 - DNA, 20 bp, Artificial Sequence
  chemically synthesized
caagcctctgatgtcaaata

SEQ ID NO: 253667 - DNA, 20 bp, Artificial Sequence
  chemically synthesized
cagtatgctgtatttgacat

SEQ ID NO: 253668 - DNA, 20 bp, Artificial Sequence
  chemically synthesized
gtatgctgtatttgacatca

SEQ ID NO: 253669 - DNA, 20 bp, Artificial Sequence
  chemically synthesized
tatgctgtatttgacatcag

SEQ ID NO: 253670 - DNA, 20 bp, Artificial Sequence
  chemically synthesized
gaaacttttcttcaataagc

SEQ ID NO: 253671 - DNA, 20 bp, Artificial Sequence
  chemically synthesized
catcagaggcttgcttattg

SEQ ID NO: 253672 - DNA, 20 bp, Artificial Sequence
  chemically synthesized
atatgaaacttttcttcaat

SEQ ID NO: 253673 - DNA, 20 bp, Artificial Sequence
  chemically synthesized
gaggcttgcttattgaagaa

SEQ ID NO: 253674 - DNA, 20 bp, Artificial Sequence
  chemically synthesized
aacagtttctgttttattat

SEQ ID NO: 253675 - DNA, 20 bp, Artificial Sequence
  chemically synthesized
aaacaaaactcataataaaa

SEQ ID NO: 253676 - DNA, 20 bp, Artificial Sequence
  chemically synthesized
cataataaaacagaaactgt

SEQ ID NO: 253677 - DNA, 20 bp, Artificial Sequence
  chemically synthesized
gcagtgagcatagtatccaa

SEQ ID NO: 253678 - DNA, 20 bp, Artificial Sequence
  chemically synthesized
catcacccaggcagtgagca

SEQ ID NO: 253679 - DNA, 20 bp, Artificial Sequence
  chemically synthesized
tggatactatgctcactgcc

SEQ ID NO: 253680 - DNA, 20 bp, Artificial Sequence
  chemically synthesized
ggatactatgctcactgcct

SEQ ID NO: 253681 - DNA, 20 bp, Artificial Sequence
  chemically synthesized
gaccccatcacccaggcagt

SEQ ID NO: 253682 - DNA, 20 bp, Artificial Sequence
  chemically synthesized
gaatgaccccatcacccagg

SEQ ID NO: 253683 - DNA, 20 bp, Artificial Sequence
  chemically synthesized
tatgctcactgcctgggtga

SEQ ID NO: 253684 - DNA, 20 bp, Artificial Sequence
  chemically synthesized
atgctcactgcctgggtgat

SEQ ID NO: 253685 - DNA, 20 bp, Artificial Sequence
  chemically synthesized
tatgaatgaccccatcaccc

SEQ ID NO: 253686 - DNA, 20 bp, Artificial Sequence
  chemically synthesized
tgctcactgcctgggtgatg

SEQ ID NO: 253687 - DNA, 20 bp, Artificial Sequence
  chemically synthesized
atatgaatgaccccatcacc

SEQ ID NO: 253688 - DNA, 20 bp, Artificial Sequence
  chemically synthesized
gtcattcatatcccaaatct

SEQ ID NO: 253689 - DNA, 20 bp, Artificial Sequence
  chemically synthesized
attgtttgatgctgagattt

SEQ ID NO: 253690 - DNA, 20 bp, Artificial Sequence
  chemically synthesized
tattgtttgatgctgagatt

SEQ ID NO: 253691 - DNA, 20 bp, Artificial Sequence
  chemically synthesized
tggatatattgtttgatgct

SEQ ID NO: 253692 - DNA, 20 bp, Artificial Sequence
  chemically synthesized
acatgtgcaggtttgttaca

SEQ ID NO: 253693 - DNA, 20 bp, Artificial Sequence
  chemically synthesized
agattcaggaatacatgtgc

SEQ ID NO: 253694 - DNA, 20 bp, Artificial Sequence
  chemically synthesized
tagattcaggaatacatgtg

SEQ ID NO: 253695 - DNA, 20 bp, Artificial Sequence
  chemically synthesized
ttcaagtgtattttagattc

SEQ ID NO: 253696 - DNA, 20 bp, Artificial Sequence
  chemically synthesized
tttcaagtgtattttagatt

SEQ ID NO: 253697 - DNA, 20 bp, Artificial Sequence
  chemically synthesized
ttataatttcaagtgtattt

SEQ ID NO: 253698 - DNA, 20 bp, Artificial Sequence
  chemically synthesized
atctcttttattataatttc

SEQ ID NO: 253699 - DNA, 20 bp, Artificial Sequence
  chemically synthesized
tacacttgaaattataataa

SEQ ID NO: 253700 - DNA, 20 bp, Artificial Sequence
  chemically synthesized
cacttgaaattataataaaa

SEQ ID NO: 253701 - DNA, 20 bp, Artificial Sequence
  chemically synthesized
ttataataaaagagatacaa

SEQ ID NO: 253702 - DNA, 20 bp, Artificial Sequence
  chemically synthesized
gcttttagggcattaataac

SEQ ID NO: 253703 - DNA, 20 bp, Artificial Sequence
  chemically synthesized
ggcttttagggcattaataa

SEQ ID NO: 253704 - DNA, 20 bp, Artificial Sequence
  chemically synthesized
acctgttattaatgccctaa

SEQ ID NO: 253705 - DNA, 20 bp, Artificial Sequence
  chemically synthesized
cttgagttcaatggctttta

SEQ ID NO: 253706 - DNA, 20 bp, Artificial Sequence
  chemically synthesized
gcttgagttcaatggctttt

SEQ ID NO: 253707 - DNA, 20 bp, Artificial Sequence
  chemically synthesized
cgcttgagttcaatggcttt

SEQ ID NO: 253708 - DNA, 20 bp, Artificial Sequence
  chemically synthesized
agagatacgcttgagttcaa

SEQ ID NO: 253709 - DNA, 20 bp, Artificial Sequence
  chemically synthesized
ccctaaaagccattgaactc

SEQ ID NO: 253710 - DNA, 20 bp, Artificial Sequence
  chemically synthesized
ataatactagagatacgctt

SEQ ID NO: 253711 - DNA, 20 bp, Artificial Sequence
  chemically synthesized
attgaactcaagcgtatctc

SEQ ID NO: 253712 - DNA, 20 bp, Artificial Sequence
  chemically synthesized
aaagtaaagaaataatacta

SEQ ID NO: 253713 - DNA, 20 bp, Artificial Sequence
  chemically synthesized
taaaagtaaagaaataatac

SEQ ID NO: 253714 - DNA, 20 bp, Artificial Sequence
  chemically synthesized
ctaccaggtaaataaaagta

SEQ ID NO: 253715 - DNA, 20 bp, Artificial Sequence
  chemically synthesized
aaattctaccaggtaaataa

SEQ ID NO: 253716 - DNA, 20 bp, Artificial Sequence
  chemically synthesized
tttctttacttttatttacc

SEQ ID NO: 253717 - DNA, 20 bp, Artificial Sequence
  chemically synthesized
ctttacttttatttacctgg

SEQ ID NO: 253718 - DNA, 20 bp, Artificial Sequence
  chemically synthesized
gatggtagtaaaattctacc

SEQ ID NO: 253719 - DNA, 20 bp, Artificial Sequence
  chemically synthesized
agatggtagtaaaattctac

SEQ ID NO: 253720 - DNA, 20 bp, Artificial Sequence
  chemically synthesized
ttggagccatcagaagatgg

SEQ ID NO: 253721 - DNA, 20 bp, Artificial Sequence
  chemically synthesized
ggcttggagccatcagaaga

SEQ ID NO: 253722 - DNA, 20 bp, Artificial Sequence
  chemically synthesized
attttactaccatcttctga

SEQ ID NO: 253723 - DNA, 20 bp, Artificial Sequence
  chemically synthesized
tccaggcttggagccatcag

SEQ ID NO: 253724 - DNA, 20 bp, Artificial Sequence
  chemically synthesized
gactccaggcttggagccat

SEQ ID NO: 253725 - DNA, 20 bp, Artificial Sequence
  chemically synthesized
taccatcttctgatggctcc

SEQ ID NO: 253726 - DNA, 20 bp, Artificial Sequence
  chemically synthesized
tcttctgatggctccaagcc

SEQ ID NO: 253727 - DNA, 20 bp, Artificial Sequence
  chemically synthesized
cacccaagactccaggcttg

SEQ ID NO: 253728 - DNA, 20 bp, Artificial Sequence
  chemically synthesized
ttctgatggctccaagcctg

SEQ ID NO: 253729 - DNA, 20 bp, Artificial Sequence
  chemically synthesized
tccacccaagactccaggct

SEQ ID NO: 253730 - DNA, 20 bp, Artificial Sequence
  chemically synthesized
tggctccaagcctggagtct

SEQ ID NO: 253731 - DNA, 20 bp, Artificial Sequence
  chemically synthesized
aacattccacccaagactcc

SEQ ID NO: 253732 - DNA, 20 bp, Artificial Sequence
  chemically synthesized
ggctccaagcctggagtctt

SEQ ID NO: 253733 - DNA, 20 bp, Artificial Sequence
  chemically synthesized
aaacattccacccaagactc

SEQ ID NO: 253734 - DNA, 20 bp, Artificial Sequence
  chemically synthesized
tccaagcctggagtcttggg

SEQ ID NO: 253735 - DNA, 20 bp, Artificial Sequence
  chemically synthesized
tagccctaaacattccaccc

SEQ ID NO: 253736 - DNA, 20 bp, Artificial Sequence
  chemically synthesized
ggagtcttgggtggaatgtt

SEQ ID NO: 253737 - DNA, 20 bp, Artificial Sequence
  chemically synthesized
gagtcttgggtggaatgttt

SEQ ID NO: 253738 - DNA, 20 bp, Artificial Sequence
  chemically synthesized
agtcttgggtggaatgttta

SEQ ID NO: 253739 - DNA, 20 bp, Artificial Sequence
  chemically synthesized
aatgtttagggctactccgc

SEQ ID NO: 253740 - DNA, 20 bp, Artificial Sequence
  chemically synthesized
acctaatcaggctagcggag

SEQ ID NO: 253741 - DNA, 20 bp, Artificial Sequence
  chemically synthesized
ctgacctaatcaggctagcg

SEQ ID NO: 253742 - DNA, 20 bp, Artificial Sequence
  chemically synthesized
acctgacctaatcaggctag

SEQ ID NO: 253743 - DNA, 20 bp, Artificial Sequence
  chemically synthesized
ggctactccgctagcctgat

SEQ ID NO: 253744 - DNA, 20 bp, Artificial Sequence
  chemically synthesized
ggtacctgacctaatcaggc

SEQ ID NO: 253745 - DNA, 20 bp, Artificial Sequence
  chemically synthesized
gctactccgctagcctgatt

SEQ ID NO: 253746 - DNA, 20 bp, Artificial Sequence
  chemically synthesized
ttctggtacctgacctaatc

SEQ ID NO: 253747 - DNA, 20 bp, Artificial Sequence
  chemically synthesized
ctccgctagcctgattaggt

SEQ ID NO: 253748 - DNA, 20 bp, Artificial Sequence
  chemically synthesized
tttctggtacctgacctaat

SEQ ID NO: 253749 - DNA, 20 bp, Artificial Sequence
  chemically synthesized
tccgctagcctgattaggtc

SEQ ID NO: 253750 - DNA, 20 bp, Artificial Sequence
  chemically synthesized
agcctgattaggtcaggtac

SEQ ID NO: 253751 - DNA, 20 bp, Artificial Sequence
  chemically synthesized
gatatgttggtgcacgtttc

SEQ ID NO: 253752 - DNA, 20 bp, Artificial Sequence
  chemically synthesized
aagcagccaagaagatatgt

SEQ ID NO: 253753 - DNA, 20 bp, Artificial Sequence
  chemically synthesized
cgtgcaccaacatatcttct

SEQ ID NO: 253754 - DNA, 20 bp, Artificial Sequence
  chemically synthesized
agttaacagaagcagccaag

SEQ ID NO: 253755 - DNA, 20 bp, Artificial Sequence
  chemically synthesized
gcaagttaacagaagcagcc

SEQ ID NO: 253756 - DNA, 20 bp, Artificial Sequence
  chemically synthesized
gtcaggcaagttaacagaag

SEQ ID NO: 253757 - DNA, 20 bp, Artificial Sequence
  chemically synthesized
caggtcaggcaagttaacag

SEQ ID NO: 253758 - DNA, 20 bp, Artificial Sequence
  chemically synthesized
gcccaggtcaggcaagttaa

SEQ ID NO: 253759 - DNA, 20 bp, Artificial Sequence
  chemically synthesized
tcaggctgcccaggtcaggc

SEQ ID NO: 253760 - DNA, 20 bp, Artificial Sequence
  chemically synthesized
ttctgttaacttgcctgacc

SEQ ID NO: 253761 - DNA, 20 bp, Artificial Sequence
  chemically synthesized
tctgttaacttgcctgacct

SEQ ID NO: 253762 - DNA, 20 bp, Artificial Sequence
  chemically synthesized
gaaatcaggctgcccaggtc

SEQ ID NO: 253763 - DNA, 20 bp, Artificial Sequence
  chemically synthesized
gttaacttgcctgacctggg

SEQ ID NO: 253764 - DNA, 20 bp, Artificial Sequence
  chemically synthesized
tgaaatcaggctgcccaggt

SEQ ID NO: 253765 - DNA, 20 bp, Artificial Sequence
  chemically synthesized
cttgtgaaatcaggctgccc

SEQ ID NO: 253766 - DNA, 20 bp, Artificial Sequence
  chemically synthesized
acttgtgaaatcaggctgcc

SEQ ID NO: 253767 - DNA, 20 bp, Artificial Sequence
  chemically synthesized
aatcaagtacttgtgaaatc

SEQ ID NO: 253768 - DNA, 20 bp, Artificial Sequence
  chemically synthesized
cctgggcagcctgatttcac

SEQ ID NO: 253769 - DNA, 20 bp, Artificial Sequence
  chemically synthesized
gaatcaagtacttgtgaaat

SEQ ID NO: 253770 - DNA, 20 bp, Artificial Sequence
  chemically synthesized
aaagaattcagagttgaatc

SEQ ID NO: 253771 - DNA, 20 bp, Artificial Sequence
  chemically synthesized
cagtgacttaaaagaattca

SEQ ID NO: 253772 - DNA, 20 bp, Artificial Sequence
  chemically synthesized
gacagtgacttaaaagaatt

SEQ ID NO: 253773 - DNA, 20 bp, Artificial Sequence
  chemically synthesized
attcaactctgaattctttt

SEQ ID NO: 253774 - DNA, 20 bp, Artificial Sequence
  chemically synthesized
tgatggagacagtgacttaa

SEQ ID NO: 253775 - DNA, 20 bp, Artificial Sequence
  chemically synthesized
ccaagcaagaatgatggaga

SEQ ID NO: 253776 - DNA, 20 bp, Artificial Sequence
  chemically synthesized
gcagccaagcaagaatgatg

SEQ ID NO: 253777 - DNA, 20 bp, Artificial Sequence
  chemically synthesized
tggcagccaagcaagaatga

SEQ ID NO: 253778 - DNA, 20 bp, Artificial Sequence
  chemically synthesized
ctgtctccatcattcttgct

SEQ ID NO: 253779 - DNA, 20 bp, Artificial Sequence
  chemically synthesized
cattggactggcagccaagc

SEQ ID NO: 253780 - DNA, 20 bp, Artificial Sequence
  chemically synthesized
catcattcttgcttggctgc

SEQ ID NO: 253781 - DNA, 20 bp, Artificial Sequence
  chemically synthesized
ttgccattggactggcagcc

SEQ ID NO: 253782 - DNA, 20 bp, Artificial Sequence
  chemically synthesized
tatctttgccattggactgg

SEQ ID NO: 253783 - DNA, 20 bp, Artificial Sequence
  chemically synthesized
ttgcttggctgccagtccaa

SEQ ID NO: 253784 - DNA, 20 bp, Artificial Sequence
  chemically synthesized
atgtatctttgccattggac

SEQ ID NO: 253785 - DNA, 20 bp, Artificial Sequence
  chemically synthesized
tggctgccagtccaatggca

SEQ ID NO: 253786 - DNA, 20 bp, Artificial Sequence
  chemically synthesized
gagttatgtatctttgccat

SEQ ID NO: 253787 - DNA, 20 bp, Artificial Sequence
  chemically synthesized
caaagatacataactctgcc

SEQ ID NO: 253788 - DNA, 20 bp, Artificial Sequence
  chemically synthesized
atcaggtggaggacttggca

SEQ ID NO: 253789 - DNA, 20 bp, Artificial Sequence
  chemically synthesized
gtatcaggtggaggacttgg

SEQ ID NO: 253790 - DNA, 20 bp, Artificial Sequence
  chemically synthesized
ttggtatcaggtggaggact

SEQ ID NO: 253791 - DNA, 20 bp, Artificial Sequence
  chemically synthesized
ggagtcttggtatcaggtgg

SEQ ID NO: 253792 - DNA, 20 bp, Artificial Sequence
  chemically synthesized
tggagtcttggtatcaggtg

SEQ ID NO: 253793 - DNA, 20 bp, Artificial Sequence
  chemically synthesized
gctggagtcttggtatcagg

SEQ ID NO: 253794 - DNA, 20 bp, Artificial Sequence
  chemically synthesized
caagtcctccacctgatacc

SEQ ID NO: 253795 - DNA, 20 bp, Artificial Sequence
  chemically synthesized
tcagctggagtcttggtatc

SEQ ID NO: 253796 - DNA, 20 bp, Artificial Sequence
  chemically synthesized
ttcagctggagtcttggtat

SEQ ID NO: 253797 - DNA, 20 bp, Artificial Sequence
  chemically synthesized
tccacctgataccaagactc

SEQ ID NO: 253798 - DNA, 20 bp, Artificial Sequence
  chemically synthesized
ctttcattcagctggagtct

SEQ ID NO: 253799 - DNA, 20 bp, Artificial Sequence
  chemically synthesized
atcagcctttcattcagctg

SEQ ID NO: 253800 - DNA, 20 bp, Artificial Sequence
  chemically synthesized
taatcagcctttcattcagc

SEQ ID NO: 253801 - DNA, 20 bp, Artificial Sequence
  chemically synthesized
ccaagactccagctgaatga

SEQ ID NO: 253802 - DNA, 20 bp, Artificial Sequence
  chemically synthesized
caagactccagctgaatgaa

SEQ ID NO: 253803 - DNA, 20 bp, Artificial Sequence
  chemically synthesized
taagtaatcagcctttcatt

SEQ ID NO: 253804 - DNA, 20 bp, Artificial Sequence
  chemically synthesized
ccaatgtgaatttaagtaat

SEQ ID NO: 253805 - DNA, 20 bp, Artificial Sequence
  chemically synthesized
tggttgcccaatgtgaattt

SEQ ID NO: 253806 - DNA, 20 bp, Artificial Sequence
  chemically synthesized
ctgattacttaaattcacat

SEQ ID NO: 253807 - DNA, 20 bp, Artificial Sequence
  chemically synthesized
tgattacttaaattcacatt

SEQ ID NO: 253808 - DNA, 20 bp, Artificial Sequence
  chemically synthesized
tatgtactaacaaatgtgat

SEQ ID NO: 253809 - DNA, 20 bp, Artificial Sequence
  chemically synthesized
gggcaaccaatcacatttgt

SEQ ID NO: 253810 - DNA, 20 bp, Artificial Sequence
  chemically synthesized
caatcacatttgttagtaca

SEQ ID NO: 253811 - DNA, 20 bp, Artificial Sequence
  chemically synthesized
tcacatttgttagtacatag

SEQ ID NO: 253812 - DNA, 20 bp, Artificial Sequence
  chemically synthesized
cacatttgttagtacatagc

SEQ ID NO: 253813 - DNA, 20 bp, Artificial Sequence
  chemically synthesized
gctatgcatttaaagggttt

SEQ ID NO: 253814 - DNA, 20 bp, Artificial Sequence
  chemically synthesized
agctatgcatttaaagggtt

SEQ ID NO: 253815 - DNA, 20 bp, Artificial Sequence
  chemically synthesized
cttacagctatgcatttaaa

SEQ ID NO: 253816 - DNA, 20 bp, Artificial Sequence
  chemically synthesized
gcttacagctatgcatttaa

SEQ ID NO: 253817 - DNA, 20 bp, Artificial Sequence
  chemically synthesized
tgcttacagctatgcattta

SEQ ID NO: 253818 - DNA, 20 bp, Artificial Sequence
  chemically synthesized
gcccaaaccctttaaatgca

SEQ ID NO: 253819 - DNA, 20 bp, Artificial Sequence
  chemically synthesized
ccctttaaatgcatagctgt

SEQ ID NO: 253820 - DNA, 20 bp, Artificial Sequence
  chemically synthesized
tttttctccatgggtgctta

SEQ ID NO: 253821 - DNA, 20 bp, Artificial Sequence
  chemically synthesized
tgcatagctgtaagcaccca

SEQ ID NO: 253822 - DNA, 20 bp, Artificial Sequence
  chemically synthesized
catagctgtaagcacccatg

SEQ ID NO: 253823 - DNA, 20 bp, Artificial Sequence
  chemically synthesized
ccttgaatgtttttctccat

SEQ ID NO: 253824 - DNA, 20 bp, Artificial Sequence
  chemically synthesized
cccttgaatgtttttctcca

SEQ ID NO: 253825 - DNA, 20 bp, Artificial Sequence
  chemically synthesized
acccatggagaaaaacattc

SEQ ID NO: 253826 - DNA, 20 bp, Artificial Sequence
  chemically synthesized
cccatggagaaaaacattca

SEQ ID NO: 253827 - DNA, 20 bp, Artificial Sequence
  chemically synthesized
ccatggagaaaaacattcaa

SEQ ID NO: 253828 - DNA, 20 bp, Artificial Sequence
  chemically synthesized
tggagaaaaacattcaaggg

SEQ ID NO: 253829 - DNA, 20 bp, Artificial Sequence
  chemically synthesized
gagaaaaacattcaagggaa

SEQ ID NO: 253830 - DNA, 20 bp, Artificial Sequence
  chemically synthesized
aacattcaagggaagagata

SEQ ID NO: 253831 - DNA, 20 bp, Artificial Sequence
  chemically synthesized
acattcaagggaagagataa

SEQ ID NO: 253832 - DNA, 20 bp, Artificial Sequence
  chemically synthesized
agataaaggatcttccccat

SEQ ID NO: 253833 - DNA, 20 bp, Artificial Sequence
  chemically synthesized
acttttatatgctgatgggg

SEQ ID NO: 253834 - DNA, 20 bp, Artificial Sequence
  chemically synthesized
ataacttttatatgctgatg

SEQ ID NO: 253835 - DNA, 20 bp, Artificial Sequence
  chemically synthesized
gataacttttatatgctgat

SEQ ID NO: 253836 - DNA, 20 bp, Artificial Sequence
  chemically synthesized
ggataacttttatatgctga

SEQ ID NO: 253837 - DNA, 20 bp, Artificial Sequence
  chemically synthesized
tcttccccatcagcatataa

SEQ ID NO: 253838 - DNA, 20 bp, Artificial Sequence
  chemically synthesized
atcagcatataaaagttatc

SEQ ID NO: 253839 - DNA, 20 bp, Artificial Sequence
  chemically synthesized
atataaaagttatccagtta

SEQ ID NO: 253840 - DNA, 20 bp, Artificial Sequence
  chemically synthesized
taccatatcaaagccataac

SEQ ID NO: 253841 - DNA, 20 bp, Artificial Sequence
  chemically synthesized
atccagttatggctttgata

SEQ ID NO: 253842 - DNA, 20 bp, Artificial Sequence
  chemically synthesized
aacacacgcataccatatca

SEQ ID NO: 253843 - DNA, 20 bp, Artificial Sequence
  chemically synthesized
tgtgtgtatgtatactctct

SEQ ID NO: 253844 - DNA, 20 bp, Artificial Sequence
  chemically synthesized
gtgtgtatgtatactctctg

SEQ ID NO: 253845 - DNA, 20 bp, Artificial Sequence
  chemically synthesized
tgcaagctcaaatcctcaga

SEQ ID NO: 253846 - DNA, 20 bp, Artificial Sequence
  chemically synthesized
tttgcaagctcaaatcctca

SEQ ID NO: 253847 - DNA, 20 bp, Artificial Sequence
  chemically synthesized
tgtatactctctgaggattt

SEQ ID NO: 253848 - DNA, 20 bp, Artificial Sequence
  chemically synthesized
gctttgcaagctcaaatcct

SEQ ID NO: 253849 - DNA, 20 bp, Artificial Sequence
  chemically synthesized
tctgaggatttgagcttgca

SEQ ID NO: 253850 - DNA, 20 bp, Artificial Sequence
  chemically synthesized
ttaaaatcaggaagctttgc

SEQ ID NO: 253851 - DNA, 20 bp, Artificial Sequence
  chemically synthesized
agactcagattaaaatcagg

SEQ ID NO: 253852 - DNA, 20 bp, Artificial Sequence
  chemically synthesized
cagagactcagattaaaatc

SEQ ID NO: 253853 - DNA, 20 bp, Artificial Sequence
  chemically synthesized
ccagagactcagattaaaat

SEQ ID NO: 253854 - DNA, 20 bp, Artificial Sequence
  chemically synthesized
aagcttcctgattttaatct

SEQ ID NO: 253855 - DNA, 20 bp, Artificial Sequence
  chemically synthesized
ctgattttaatctgagtctc

SEQ ID NO: 253856 - DNA, 20 bp, Artificial Sequence
  chemically synthesized
tgattttaatctgagtctct

SEQ ID NO: 253857 - DNA, 20 bp, Artificial Sequence
  chemically synthesized
ttggtagctccccagagact

SEQ ID NO: 253858 - DNA, 20 bp, Artificial Sequence
  chemically synthesized
gattttaatctgagtctctg

SEQ ID NO: 253859 - DNA, 20 bp, Artificial Sequence
  chemically synthesized
ttttaatctgagtctctggg

SEQ ID NO: 253860 - DNA, 20 bp, Artificial Sequence
  chemically synthesized
aaagaattggtagctcccca

SEQ ID NO: 253861 - DNA, 20 bp, Artificial Sequence
  chemically synthesized
ccaaagaattggtagctccc

SEQ ID NO: 253862 - DNA, 20 bp, Artificial Sequence
  chemically synthesized
acagcattccaaagaattgg

SEQ ID NO: 253863 - DNA, 20 bp, Artificial Sequence
  chemically synthesized
ctggggagctaccaattctt

SEQ ID NO: 253864 - DNA, 20 bp, Artificial Sequence
  chemically synthesized
gctacagcattccaaagaat

SEQ ID NO: 253865 - DNA, 20 bp, Artificial Sequence
  chemically synthesized
agcaatgctacagcattcca

SEQ ID NO: 253866 - DNA, 20 bp, Artificial Sequence
  chemically synthesized
accaattctttggaatgctg

SEQ ID NO: 253867 - DNA, 20 bp, Artificial Sequence
  chemically synthesized
cttgatgctgagcaatgcta

SEQ ID NO: 253868 - DNA, 20 bp, Artificial Sequence
  chemically synthesized
tggaatgctgtagcattgct

SEQ ID NO: 253869 - DNA, 20 bp, Artificial Sequence
  chemically synthesized
ctgtagcattgctcagcatc

SEQ ID NO: 253870 - DNA, 20 bp, Artificial Sequence
  chemically synthesized
accgttcataacttgatgct

SEQ ID NO: 253871 - DNA, 20 bp, Artificial Sequence
  chemically synthesized
gctcagcatcaagttatgaa

SEQ ID NO: 253872 - DNA, 20 bp, Artificial Sequence
  chemically synthesized
catcaagttatgaacggttt

SEQ ID NO: 253873 - DNA, 20 bp, Artificial Sequence
  chemically synthesized
acggttttagcaatgctgta

SEQ ID NO: 253874 - DNA, 20 bp, Artificial Sequence
  chemically synthesized
cgcgttagtaacatgctgta

SEQ ID NO: 253875 - DNA, 20 bp, Artificial Sequence
  chemically synthesized
tgtacagcatgttactaacg

SEQ ID NO: 253876 - DNA, 20 bp, Artificial Sequence
  chemically synthesized
gtacagcatgttactaacgc

SEQ ID NO: 253877 - DNA, 20 bp, Artificial Sequence
  chemically synthesized
gatagaaagttttcccgcgt

SEQ ID NO: 253878 - DNA, 20 bp, Artificial Sequence
  chemically synthesized
cttttctcctttaagataga

SEQ ID NO: 253879 - DNA, 20 bp, Artificial Sequence
  chemically synthesized
cgggaaaactttctatctta

SEQ ID NO: 253880 - DNA, 20 bp, Artificial Sequence
  chemically synthesized
gggaaaactttctatcttaa

SEQ ID NO: 253881 - DNA, 20 bp, Artificial Sequence
  chemically synthesized
tttgcttttctcctttaaga

SEQ ID NO: 253882 - DNA, 20 bp, Artificial Sequence
  chemically synthesized
gaaaactttctatcttaaag

SEQ ID NO: 253883 - DNA, 20 bp, Artificial Sequence
  chemically synthesized
gctttttgcttttctccttt

SEQ ID NO: 253884 - DNA, 20 bp, Artificial Sequence
  chemically synthesized
ctttctatcttaaaggagaa

SEQ ID NO: 253885 - DNA, 20 bp, Artificial Sequence
  chemically synthesized
tcttaaaggagaaaagcaaa

SEQ ID NO: 253886 - DNA, 20 bp, Artificial Sequence
  chemically synthesized
gaaaagcaaaaagcaaaaac

SEQ ID NO: 253887 - DNA, 20 bp, Artificial Sequence
  chemically synthesized
aaaagcaaaaagcaaaaact

SEQ ID NO: 253888 - DNA, 20 bp, Artificial Sequence
  chemically synthesized
aaagcaaaaagcaaaaactg

SEQ ID NO: 253889 - DNA, 20 bp, Artificial Sequence
  chemically synthesized
gcaaaaagcaaaaactgggg

SEQ ID NO: 253890 - DNA, 20 bp, Artificial Sequence
  chemically synthesized
caaaaagcaaaaactggggc

SEQ ID NO: 253891 - DNA, 20 bp, Artificial Sequence
  chemically synthesized
aaaaagcaaaaactggggca

SEQ ID NO: 253892 - DNA, 20 bp, Artificial Sequence
  chemically synthesized
aaaagcaaaaactggggcag

SEQ ID NO: 253893 - DNA, 20 bp, Artificial Sequence
  chemically synthesized
gagtgtgacatcccctgccc

SEQ ID NO: 253894 - DNA, 20 bp, Artificial Sequence
  chemically synthesized
gcaggggatgtcacactccc

SEQ ID NO: 253895 - DNA, 20 bp, Artificial Sequence
  chemically synthesized
ctattatctagatatccagg

SEQ ID NO: 253896 - DNA, 20 bp, Artificial Sequence
  chemically synthesized
agctattatctagatatcca

SEQ ID NO: 253897 - DNA, 20 bp, Artificial Sequence
  chemically synthesized
tgtcacactccctggatatc

SEQ ID NO: 253898 - DNA, 20 bp, Artificial Sequence
  chemically synthesized
gagctattatctagatatcc

SEQ ID NO: 253899 - DNA, 20 bp, Artificial Sequence
  chemically synthesized
ggagctattatctagatatc

SEQ ID NO: 253900 - DNA, 20 bp, Artificial Sequence
  chemically synthesized
ctccctggatatctagataa

SEQ ID NO: 253901 - DNA, 20 bp, Artificial Sequence
  chemically synthesized
tgcaccaaggagctattatc

SEQ ID NO: 253902 - DNA, 20 bp, Artificial Sequence
  chemically synthesized
atatctagataatagctcct

SEQ ID NO: 253903 - DNA, 20 bp, Artificial Sequence
  chemically synthesized
ttctctgagaatgcaccaag

SEQ ID NO: 253904 - DNA, 20 bp, Artificial Sequence
  chemically synthesized
cattctctgagaatgcacca

SEQ ID NO: 253905 - DNA, 20 bp, Artificial Sequence
  chemically synthesized
gcattctctgagaatgcacc

SEQ ID NO: 253906 - DNA, 20 bp, Artificial Sequence
  chemically synthesized
atagctccttggtgcattct

SEQ ID NO: 253907 - DNA, 20 bp, Artificial Sequence
  chemically synthesized
agctccttggtgcattctca

SEQ ID NO: 253908 - DNA, 20 bp, Artificial Sequence
  chemically synthesized
caattttgacagcattctct

SEQ ID NO: 253909 - DNA, 20 bp, Artificial Sequence
  chemically synthesized
tcagagaatgctgtcaaaat

SEQ ID NO: 253910 - DNA, 20 bp, Artificial Sequence
  chemically synthesized
tggactccagccaattttga

SEQ ID NO: 253911 - DNA, 20 bp, Artificial Sequence
  chemically synthesized
agaatgctgtcaaaattggc

SEQ ID NO: 253912 - DNA, 20 bp, Artificial Sequence
  chemically synthesized
aatgctgtcaaaattggctg

SEQ ID NO: 253913 - DNA, 20 bp, Artificial Sequence
  chemically synthesized
tgtcaaaattggctggagtc

SEQ ID NO: 253914 - DNA, 20 bp, Artificial Sequence
  chemically synthesized
gtcaaaattggctggagtcc

SEQ ID NO: 253915 - DNA, 20 bp, Artificial Sequence
  chemically synthesized
aggatgtatttcctggactc

SEQ ID NO: 253916 - DNA, 20 bp, Artificial Sequence
  chemically synthesized
tttaaaaaggatgtatttcc

SEQ ID NO: 253917 - DNA, 20 bp, Artificial Sequence
  chemically synthesized
caggaaatacatccttttta

SEQ ID NO: 253918 - DNA, 20 bp, Artificial Sequence
  chemically synthesized
tatgtgcagggactttaaaa

SEQ ID NO: 253919 - DNA, 20 bp, Artificial Sequence
  chemically synthesized
atatgtgcagggactttaaa

SEQ ID NO: 253920 - DNA, 20 bp, Artificial Sequence
  chemically synthesized
tgaggacacgaatatgtgca

SEQ ID NO: 253921 - DNA, 20 bp, Artificial Sequence
  chemically synthesized
ttgaggacacgaatatgtgc

SEQ ID NO: 253922 - DNA, 20 bp, Artificial Sequence
  chemically synthesized
cttgaggacacgaatatgtg

SEQ ID NO: 253923 - DNA, 20 bp, Artificial Sequence
  chemically synthesized
ctgcacatattcgtgtcctc

SEQ ID NO: 253924 - DNA, 20 bp, Artificial Sequence
  chemically synthesized
tgcacatattcgtgtcctca

SEQ ID NO: 253925 - DNA, 20 bp, Artificial Sequence
  chemically synthesized
tttctgtgtgcagtgccttg

SEQ ID NO: 253926 - DNA, 20 bp, Artificial Sequence
  chemically synthesized
ttttctgtgtgcagtgcctt

SEQ ID NO: 253927 - DNA, 20 bp, Artificial Sequence
  chemically synthesized
tgtcctcaaggcactgcaca

SEQ ID NO: 253928 - DNA, 20 bp, Artificial Sequence
  chemically synthesized
acataccatttttctgtgtg

SEQ ID NO: 253929 - DNA, 20 bp, Artificial Sequence
  chemically synthesized
aggcactgcacacagaaaaa

SEQ ID NO: 253930 - DNA, 20 bp, Artificial Sequence
  chemically synthesized
gaaaaatggtatgtgcacca

SEQ ID NO: 253931 - DNA, 20 bp, Artificial Sequence
  chemically synthesized
aagtgctacagcattttctt

SEQ ID NO: 253932 - DNA, 20 bp, Artificial Sequence
  chemically synthesized
gtgcaccaaagaaaatgctg

SEQ ID NO: 253933 - DNA, 20 bp, Artificial Sequence
  chemically synthesized
ttaaactatggaaagtgcta

SEQ ID NO: 253934 - DNA, 20 bp, Artificial Sequence
  chemically synthesized
aaatgctgtagcactttcca

SEQ ID NO: 253935 - DNA, 20 bp, Artificial Sequence
  chemically synthesized
ctctgactttaaactatgga

SEQ ID NO: 253936 - DNA, 20 bp, Artificial Sequence
  chemically synthesized
gtagcactttccatagttta

SEQ ID NO: 253937 - DNA, 20 bp, Artificial Sequence
  chemically synthesized
tcatctctgactttaaacta

SEQ ID NO: 253938 - DNA, 20 bp, Artificial Sequence
  chemically synthesized
cactttccatagtttaaagt

SEQ ID NO: 253939 - DNA, 20 bp, Artificial Sequence
  chemically synthesized
ctttccatagtttaaagtca

SEQ ID NO: 253940 - DNA, 20 bp, Artificial Sequence
  chemically synthesized
catagtttaaagtcagagat

SEQ ID NO: 253941 - DNA, 20 bp, Artificial Sequence
  chemically synthesized
gtcagagatgagatctctga

SEQ ID NO: 253942 - DNA, 20 bp, Artificial Sequence
  chemically synthesized
aaaatagtaaaatactatca

SEQ ID NO: 253943 - DNA, 20 bp, Artificial Sequence
  chemically synthesized
ctaaaatagtaaaatactat

SEQ ID NO: 253944 - DNA, 20 bp, Artificial Sequence
  chemically synthesized
ctgatagtattttactattt

SEQ ID NO: 253945 - DNA, 20 bp, Artificial Sequence
  chemically synthesized
tatttctagacaaactaaaa

SEQ ID NO: 253946 - DNA, 20 bp, Artificial Sequence
  chemically synthesized
ttttactattttagtttgtc

SEQ ID NO: 253947 - DNA, 20 bp, Artificial Sequence
  chemically synthesized
attttagtttgtctagaaat

SEQ ID NO: 253948 - DNA, 20 bp, Artificial Sequence
  chemically synthesized
ctataaagatcacttatttc

SEQ ID NO: 253949 - DNA, 20 bp, Artificial Sequence
  chemically synthesized
ctagaaataagtgatcttta

SEQ ID NO: 253950 - DNA, 20 bp, Artificial Sequence
  chemically synthesized
ttagagggtcagaaactata

SEQ ID NO: 253951 - DNA, 20 bp, Artificial Sequence
  chemically synthesized
tggcttcctttttagagggt

SEQ ID NO: 253952 - DNA, 20 bp, Artificial Sequence
  chemically synthesized
atagtttctgaccctctaaa

SEQ ID NO: 253953 - DNA, 20 bp, Artificial Sequence
  chemically synthesized
tagtttctgaccctctaaaa

SEQ ID NO: 253954 - DNA, 20 bp, Artificial Sequence
  chemically synthesized
actatggcttcctttttaga

SEQ ID NO: 253955 - DNA, 20 bp, Artificial Sequence
  chemically synthesized
gactatggcttcctttttag

SEQ ID NO: 253956 - DNA, 20 bp, Artificial Sequence
  chemically synthesized
ggactatggcttccttttta

SEQ ID NO: 253957 - DNA, 20 bp, Artificial Sequence
  chemically synthesized
tttctgaccctctaaaaagg

SEQ ID NO: 253958 - DNA, 20 bp, Artificial Sequence
  chemically synthesized
agggactatggcttcctttt

SEQ ID NO: 253959 - DNA, 20 bp, Artificial Sequence
  chemically synthesized
accctctaaaaaggaagcca

SEQ ID NO: 253960 - DNA, 20 bp, Artificial Sequence
  chemically synthesized
atagcaactacaagggacta

SEQ ID NO: 253961 - DNA, 20 bp, Artificial Sequence
  chemically synthesized
aaggaagccatagtcccttg

SEQ ID NO: 253962 - DNA, 20 bp, Artificial Sequence
  chemically synthesized
tatcgccatagcaactacaa

SEQ ID NO: 253963 - DNA, 20 bp, Artificial Sequence
  chemically synthesized
atatcgccatagcaactaca

SEQ ID NO: 253964 - DNA, 20 bp, Artificial Sequence
  chemically synthesized
tatatcgccatagcaactac

SEQ ID NO: 253965 - DNA, 20 bp, Artificial Sequence
  chemically synthesized
atagtcccttgtagttgcta

SEQ ID NO: 253966 - DNA, 20 bp, Artificial Sequence
  chemically synthesized
tagggatgtttatatcgcca

SEQ ID NO: 253967 - DNA, 20 bp, Artificial Sequence
  chemically synthesized
tatggcgatataaacatccc

SEQ ID NO: 253968 - DNA, 20 bp, Artificial Sequence
  chemically synthesized
tatattctatagtgattcta

SEQ ID NO: 253969 - DNA, 20 bp, Artificial Sequence
  chemically synthesized
ctatattctatagtgattct

SEQ ID NO: 253970 - DNA, 20 bp, Artificial Sequence
  chemically synthesized
gctatattctatagtgattc

SEQ ID NO: 253971 - DNA, 20 bp, Artificial Sequence
  chemically synthesized
aaacatccctagaatcacta

SEQ ID NO: 253972 - DNA, 20 bp, Artificial Sequence
  chemically synthesized
cctagaatcactatagaata

SEQ ID NO: 253973 - DNA, 20 bp, Artificial Sequence
  chemically synthesized
aatagaaatgctatattcta

SEQ ID NO: 253974 - DNA, 20 bp, Artificial Sequence
  chemically synthesized
gaactattcagggagagaaa

SEQ ID NO: 253975 - DNA, 20 bp, Artificial Sequence
  chemically synthesized
gataaggaactattcaggga

SEQ ID NO: 253976 - DNA, 20 bp, Artificial Sequence
  chemically synthesized
tttctatttctctccctgaa

SEQ ID NO: 253977 - DNA, 20 bp, Artificial Sequence
  chemically synthesized
aagataaggaactattcagg

SEQ ID NO: 253978 - DNA, 20 bp, Artificial Sequence
  chemically synthesized
ataagataaggaactattca

SEQ ID NO: 253979 - DNA, 20 bp, Artificial Sequence
  chemically synthesized
gataagataaggaactattc

SEQ ID NO: 253980 - DNA, 20 bp, Artificial Sequence
  chemically synthesized
agataagataaggaactatt

SEQ ID NO: 253981 - DNA, 20 bp, Artificial Sequence
  chemically synthesized
tcatattttcagataagata

SEQ ID NO: 253982 - DNA, 20 bp, Artificial Sequence
  chemically synthesized
atcatattttcagataagat

SEQ ID NO: 253983 - DNA, 20 bp, Artificial Sequence
  chemically synthesized
ttgacatcatattttcagat

SEQ ID NO: 253984 - DNA, 20 bp, Artificial Sequence
  chemically synthesized
tcattttgacatcatatttt

SEQ ID NO: 253985 - DNA, 20 bp, Artificial Sequence
  chemically synthesized
aatatgatgtcaaaatgata

SEQ ID NO: 253986 - DNA, 20 bp, Artificial Sequence
  chemically synthesized
atgataaagtaccaactttt

SEQ ID NO: 253987 - DNA, 20 bp, Artificial Sequence
  chemically synthesized
aagggatttgactaaaaagt

SEQ ID NO: 253988 - DNA, 20 bp, Artificial Sequence
  chemically synthesized
taagaagggatttgactaaa

SEQ ID NO: 253989 - DNA, 20 bp, Artificial Sequence
  chemically synthesized
gggcatgtcaaaattaagaa

SEQ ID NO: 253990 - DNA, 20 bp, Artificial Sequence
  chemically synthesized
ggggcatgtcaaaattaaga

SEQ ID NO: 253991 - DNA, 20 bp, Artificial Sequence
  chemically synthesized
aggggcatgtcaaaattaag

SEQ ID NO: 253992 - DNA, 20 bp, Artificial Sequence
  chemically synthesized
cataggggcatgtcaaaatt

SEQ ID NO: 253993 - DNA, 20 bp, Artificial Sequence
  chemically synthesized
gtgaagtggtcaattcatag

SEQ ID NO: 253994 - DNA, 20 bp, Artificial Sequence
  chemically synthesized
agtgaagtggtcaattcata

SEQ ID NO: 253995 - DNA, 20 bp, Artificial Sequence
  chemically synthesized
tagtgaagtggtcaattcat

SEQ ID NO: 253996 - DNA, 20 bp, Artificial Sequence
  chemically synthesized
atagtgaagtggtcaattca

SEQ ID NO: 253997 - DNA, 20 bp, Artificial Sequence
  chemically synthesized
atttcagcggaatagtgaag

SEQ ID NO: 253998 - DNA, 20 bp, Artificial Sequence
  chemically synthesized
agaatttcagcggaatagtg

SEQ ID NO: 253999 - DNA, 20 bp, Artificial Sequence
  chemically synthesized
cttacagaatttcagcggaa

SEQ ID NO: 254000 - DNA, 20 bp, Artificial Sequence
  chemically synthesized
aacatcttacagaatttcag

SEQ ID NO: 254001 - DNA, 20 bp, Artificial Sequence
  chemically synthesized
ataaacatcttacagaattt

SEQ ID NO: 254002 - DNA, 20 bp, Artificial Sequence
  chemically synthesized
ctattccgctgaaattctgt

SEQ ID NO: 254003 - DNA, 20 bp, Artificial Sequence
  chemically synthesized
ggccaaaaataaacatctta

SEQ ID NO: 254004 - DNA, 20 bp, Artificial Sequence
  chemically synthesized
ttctgtaagatgtttatttt

SEQ ID NO: 254005 - DNA, 20 bp, Artificial Sequence
  chemically synthesized
atttccttttgcagaaagag

SEQ ID NO: 254006 - DNA, 20 bp, Artificial Sequence
  chemically synthesized
agaatttccttttgcagaaa

SEQ ID NO: 254007 - DNA, 20 bp, Artificial Sequence
  chemically synthesized
tttggccactctttctgcaa

SEQ ID NO: 254008 - DNA, 20 bp, Artificial Sequence
  chemically synthesized
ttagaatttccttttgcaga

SEQ ID NO: 254009 - DNA, 20 bp, Artificial Sequence
  chemically synthesized
ttggccactctttctgcaaa

SEQ ID NO: 254010 - DNA, 20 bp, Artificial Sequence
  chemically synthesized
atatttagaatttccttttg

SEQ ID NO: 254011 - DNA, 20 bp, Artificial Sequence
  chemically synthesized
attccatttgtatgtatatt

SEQ ID NO: 254012 - DNA, 20 bp, Artificial Sequence
  chemically synthesized
attctaaatatacatacaaa

SEQ ID NO: 254013 - DNA, 20 bp, Artificial Sequence
  chemically synthesized
aatggaattttaatttctga

SEQ ID NO: 254014 - DNA, 20 bp, Artificial Sequence
  chemically synthesized
atggaattttaatttctgaa

SEQ ID NO: 254015 - DNA, 20 bp, Artificial Sequence
  chemically synthesized
attcgtgtacagatgccttt

SEQ ID NO: 254016 - DNA, 20 bp, Artificial Sequence
  chemically synthesized
gagttgtataaattcgtgta

SEQ ID NO: 254017 - DNA, 20 bp, Artificial Sequence
  chemically synthesized
tacacgaatttatacaactc

SEQ ID NO: 254018 - DNA, 20 bp, Artificial Sequence
  chemically synthesized
ttttaaaatattaaggactc

SEQ ID NO: 254019 - DNA, 20 bp, Artificial Sequence
  chemically synthesized
tatcctattttaaaatatta

SEQ ID NO: 254020 - DNA, 20 bp, Artificial Sequence
  chemically synthesized
atatcctattttaaaatatt

SEQ ID NO: 254021 - DNA, 20 bp, Artificial Sequence
  chemically synthesized
gagtccttaatattttaaaa

SEQ ID NO: 254022 - DNA, 20 bp, Artificial Sequence
  chemically synthesized
agtccttaatattttaaaat

SEQ ID NO: 254023 - DNA, 20 bp, Artificial Sequence
  chemically synthesized
atatttgcatctctgattca

SEQ ID NO: 254024 - DNA, 20 bp, Artificial Sequence
  chemically synthesized
ttattggagactgtgaatca

SEQ ID NO: 254025 - DNA, 20 bp, Artificial Sequence
  chemically synthesized
acttattggagactgtgaat

SEQ ID NO: 254026 - DNA, 20 bp, Artificial Sequence
  chemically synthesized
tctgattcacagtctccaat

SEQ ID NO: 254027 - DNA, 20 bp, Artificial Sequence
  chemically synthesized
gggtcttctttaacttattg

SEQ ID NO: 254028 - DNA, 20 bp, Artificial Sequence
  chemically synthesized
cagggtcttctttaacttat

SEQ ID NO: 254029 - DNA, 20 bp, Artificial Sequence
  chemically synthesized
tcacagtctccaataagtta

SEQ ID NO: 254030 - DNA, 20 bp, Artificial Sequence
  chemically synthesized
cagtctccaataagttaaag

SEQ ID NO: 254031 - DNA, 20 bp, Artificial Sequence
  chemically synthesized
ctattcacagtgcataatca

SEQ ID NO: 254032 - DNA, 20 bp, Artificial Sequence
  chemically synthesized
tctattcacagtgcataatc

SEQ ID NO: 254033 - DNA, 20 bp, Artificial Sequence
  chemically synthesized
ctctattcacagtgcataat

SEQ ID NO: 254034 - DNA, 20 bp, Artificial Sequence
  chemically synthesized
ccctgattatgcactgtgaa

SEQ ID NO: 254035 - DNA, 20 bp, Artificial Sequence
  chemically synthesized
ctgattatgcactgtgaata

SEQ ID NO: 254036 - DNA, 20 bp, Artificial Sequence
  chemically synthesized
atctaatttttctctattca

SEQ ID NO: 254037 - DNA, 20 bp, Artificial Sequence
  chemically synthesized
cactgtgaatagagaaaaat

SEQ ID NO: 254038 - DNA, 20 bp, Artificial Sequence
  chemically synthesized
gtgaatagagaaaaattaga

SEQ ID NO: 254039 - DNA, 20 bp, Artificial Sequence
  chemically synthesized
tagagaaaaattagatagca

SEQ ID NO: 254040 - DNA, 20 bp, Artificial Sequence
  chemically synthesized
agcacagtaacttttacaac

SEQ ID NO: 254041 - DNA, 20 bp, Artificial Sequence
  chemically synthesized
atttcatctgccggttgtaa

SEQ ID NO: 254042 - DNA, 20 bp, Artificial Sequence
  chemically synthesized
acagtaacttttacaaccgg

SEQ ID NO: 254043 - DNA, 20 bp, Artificial Sequence
  chemically synthesized
ggtatctggatttcatctgc

SEQ ID NO: 254044 - DNA, 20 bp, Artificial Sequence
  chemically synthesized
tacaaccggcagatgaaatc

SEQ ID NO: 254045 - DNA, 20 bp, Artificial Sequence
  chemically synthesized
ttttccttactttaggtatc

SEQ ID NO: 254046 - DNA, 20 bp, Artificial Sequence
  chemically synthesized
agatgaaatccagataccta

SEQ ID NO: 254047 - DNA, 20 bp, Artificial Sequence
  chemically synthesized
gaaatccagatacctaaagt

SEQ ID NO: 254048 - DNA, 20 bp, Artificial Sequence
  chemically synthesized
aaatccagatacctaaagta

SEQ ID NO: 254049 - DNA, 20 bp, Artificial Sequence
  chemically synthesized
tttctgcttttccttacttt

SEQ ID NO: 254050 - DNA, 20 bp, Artificial Sequence
  chemically synthesized
atttctgcttttccttactt

SEQ ID NO: 254051 - DNA, 20 bp, Artificial Sequence
  chemically synthesized
cagatacctaaagtaaggaa

SEQ ID NO: 254052 - DNA, 20 bp, Artificial Sequence
  chemically synthesized
atacctaaagtaaggaaaag

SEQ ID NO: 254053 - DNA, 20 bp, Artificial Sequence
  chemically synthesized
aaggaaaagcagaaatctat

SEQ ID NO: 254054 - DNA, 20 bp, Artificial Sequence
  chemically synthesized
aattgaagccacatggctta

SEQ ID NO: 254055 - DNA, 20 bp, Artificial Sequence
  chemically synthesized
gcagaaatctataagccatg

SEQ ID NO: 254056 - DNA, 20 bp, Artificial Sequence
  chemically synthesized
ataaatgaattgaagccaca

SEQ ID NO: 254057 - DNA, 20 bp, Artificial Sequence
  chemically synthesized
tcaaacagataaatgaattg

SEQ ID NO: 254058 - DNA, 20 bp, Artificial Sequence
  chemically synthesized
aattcatttatctgtttgaa

SEQ ID NO: 254059 - DNA, 20 bp, Artificial Sequence
  chemically synthesized
taaacaataagcttttcaaa

SEQ ID NO: 254060 - DNA, 20 bp, Artificial Sequence
  chemically synthesized
taaacacttatttaaacaat

SEQ ID NO: 254061 - DNA, 20 bp, Artificial Sequence
  chemically synthesized
gaaaagcttattgtttaaat

SEQ ID NO: 254062 - DNA, 20 bp, Artificial Sequence
  chemically synthesized
ataagtgtttattgataata

SEQ ID NO: 254063 - DNA, 20 bp, Artificial Sequence
  chemically synthesized
tgataatacagacataatat

SEQ ID NO: 254064 - DNA, 20 bp, Artificial Sequence
  chemically synthesized
ataatatcagcctcaaatgt

SEQ ID NO: 254065 - DNA, 20 bp, Artificial Sequence
  chemically synthesized
attttcatatctcacatttg

SEQ ID NO: 254066 - DNA, 20 bp, Artificial Sequence
  chemically synthesized
tattttcatatctcacattt

SEQ ID NO: 254067 - DNA, 20 bp, Artificial Sequence
  chemically synthesized
aaatgtgagatatgaaaata

SEQ ID NO: 254068 - DNA, 20 bp, Artificial Sequence
  chemically synthesized
agggagagactcacatttta

SEQ ID NO: 254069 - DNA, 20 bp, Artificial Sequence
  chemically synthesized
aaataaagactttaaaatgt

SEQ ID NO: 254070 - DNA, 20 bp, Artificial Sequence
  chemically synthesized
aaaatgtgagtctctccctt

SEQ ID NO: 254071 - DNA, 20 bp, Artificial Sequence
  chemically synthesized
ccaattatcttcttaaggga

SEQ ID NO: 254072 - DNA, 20 bp, Artificial Sequence
  chemically synthesized
atgtgagtctctcccttaag

SEQ ID NO: 254073 - DNA, 20 bp, Artificial Sequence
  chemically synthesized
aaccaattatcttcttaagg

SEQ ID NO: 254074 - DNA, 20 bp, Artificial Sequence
  chemically synthesized
aaaaccaattatcttcttaa

SEQ ID NO: 254075 - DNA, 20 bp, Artificial Sequence
  chemically synthesized
aaaaaccaattatcttctta

SEQ ID NO: 254076 - DNA, 20 bp, Artificial Sequence
  chemically synthesized
taaaaaccaattatcttctt

SEQ ID NO: 254077 - DNA, 20 bp, Artificial Sequence
  chemically synthesized
ctctcccttaagaagataat

SEQ ID NO: 254078 - DNA, 20 bp, Artificial Sequence
  chemically synthesized
aagaagataattggttttta

SEQ ID NO: 254079 - DNA, 20 bp, Artificial Sequence
  chemically synthesized
agaagataattggtttttaa

SEQ ID NO: 254080 - DNA, 20 bp, Artificial Sequence
  chemically synthesized
aagataattggtttttaaag

SEQ ID NO: 254081 - DNA, 20 bp, Artificial Sequence
  chemically synthesized
gtttttaaaggagacacata

SEQ ID NO: 254082 - DNA, 20 bp, Artificial Sequence
  chemically synthesized
ccacaacacttgaataaaca

SEQ ID NO: 254083 - DNA, 20 bp, Artificial Sequence
  chemically synthesized
taaaaatgctttgtttattc

SEQ ID NO: 254084 - DNA, 20 bp, Artificial Sequence
  chemically synthesized
ctttgtttattcaagtgttg

SEQ ID NO: 254085 - DNA, 20 bp, Artificial Sequence
  chemically synthesized
ttgtttattcaagtgttgtg

SEQ ID NO: 254086 - DNA, 20 bp, Artificial Sequence
  chemically synthesized
tgtggagtatgtgtctttaa

SEQ ID NO: 254087 - DNA, 20 bp, Artificial Sequence
  chemically synthesized
gtggagtatgtgtctttaac

SEQ ID NO: 254088 - DNA, 20 bp, Artificial Sequence
  chemically synthesized
cttctccttttatcctgtta

SEQ ID NO: 254089 - DNA, 20 bp, Artificial Sequence
  chemically synthesized
atgtgtctttaacaggataa

SEQ ID NO: 254090 - DNA, 20 bp, Artificial Sequence
  chemically synthesized
tgtgtctttaacaggataaa

SEQ ID NO: 254091 - DNA, 20 bp, Artificial Sequence
  chemically synthesized
tgtctttaacaggataaaag

SEQ ID NO: 254092 - DNA, 20 bp, Artificial Sequence
  chemically synthesized
ctttaacaggataaaaggag

SEQ ID NO: 254093 - DNA, 20 bp, Artificial Sequence
  chemically synthesized
aacaggataaaaggagaagc

SEQ ID NO: 254094 - DNA, 20 bp, Artificial Sequence
  chemically synthesized
caggataaaaggagaagcca

SEQ ID NO: 254095 - DNA, 20 bp, Artificial Sequence
  chemically synthesized
aaaggagaagccagagaata

SEQ ID NO: 254096 - DNA, 20 bp, Artificial Sequence
  chemically synthesized
gataaattttctgtattctc

SEQ ID NO: 254097 - DNA, 20 bp, Artificial Sequence
  chemically synthesized
gagaatacagaaaatttatc

SEQ ID NO: 254098 - DNA, 20 bp, Artificial Sequence
  chemically synthesized
agaatacagaaaatttatct

SEQ ID NO: 254099 - DNA, 20 bp, Artificial Sequence
  chemically synthesized
taggtcccttgtttgtttcc

SEQ ID NO: 254100 - DNA, 20 bp, Artificial Sequence
  chemically synthesized
aatttatctaggaaacaaac

SEQ ID NO: 254101 - DNA, 20 bp, Artificial Sequence
  chemically synthesized
atttatctaggaaacaaaca

SEQ ID NO: 254102 - DNA, 20 bp, Artificial Sequence
  chemically synthesized
tttatctaggaaacaaacaa

SEQ ID NO: 254103 - DNA, 20 bp, Artificial Sequence
  chemically synthesized
aaactgattagttggcaaat

SEQ ID NO: 254104 - DNA, 20 bp, Artificial Sequence
  chemically synthesized
taaactgattagttggcaaa

SEQ ID NO: 254105 - DNA, 20 bp, Artificial Sequence
  chemically synthesized
ggacctatttgccaactaat

SEQ ID NO: 254106 - DNA, 20 bp, Artificial Sequence
  chemically synthesized
tttatcttaaactgattagt

SEQ ID NO: 254107 - DNA, 20 bp, Artificial Sequence
  chemically synthesized
tacctttatcttaaactgat

SEQ ID NO: 254108 - DNA, 20 bp, Artificial Sequence
  chemically synthesized
atttgccaactaatcagttt

SEQ ID NO: 254109 - DNA, 20 bp, Artificial Sequence
  chemically synthesized
caactaatcagtttaagata

SEQ ID NO: 254110 - DNA, 20 bp, Artificial Sequence
  chemically synthesized
aactaatcagtttaagataa

SEQ ID NO: 254111 - DNA, 20 bp, Artificial Sequence
  chemically synthesized
cagtttaagataaaggtatg

SEQ ID NO: 254112 - DNA, 20 bp, Artificial Sequence
  chemically synthesized
aaagaatggagcatagttaa

SEQ ID NO: 254113 - DNA, 20 bp, Artificial Sequence
  chemically synthesized
taaagaatggagcatagtta

SEQ ID NO: 254114 - DNA, 20 bp, Artificial Sequence
  chemically synthesized
ataaagaatggagcatagtt

SEQ ID NO: 254115 - DNA, 20 bp, Artificial Sequence
  chemically synthesized
ttatgataaagaatggagca

SEQ ID NO: 254116 - DNA, 20 bp, Artificial Sequence
  chemically synthesized
atcccttatgataaagaatg

SEQ ID NO: 254117 - DNA, 20 bp, Artificial Sequence
  chemically synthesized
ctatcccttatgataaagaa

SEQ ID NO: 254118 - DNA, 20 bp, Artificial Sequence
  chemically synthesized
tatgctccattctttatcat

SEQ ID NO: 254119 - DNA, 20 bp, Artificial Sequence
  chemically synthesized
atgctccattctttatcata

SEQ ID NO: 254120 - DNA, 20 bp, Artificial Sequence
  chemically synthesized
gaagtctatcccttatgata

SEQ ID NO: 254121 - DNA, 20 bp, Artificial Sequence
  chemically synthesized
tgctccattctttatcataa

SEQ ID NO: 254122 - DNA, 20 bp, Artificial Sequence
  chemically synthesized
ccattctttatcataaggga

SEQ ID NO: 254123 - DNA, 20 bp, Artificial Sequence
  chemically synthesized
gaagaaaaactaaacagtag

SEQ ID NO: 254124 - DNA, 20 bp, Artificial Sequence
  chemically synthesized
agggatagacttctactgtt

SEQ ID NO: 254125 - DNA, 20 bp, Artificial Sequence
  chemically synthesized
atggaagaaaaactaaacag

SEQ ID NO: 254126 - DNA, 20 bp, Artificial Sequence
  chemically synthesized
taaatggaagaaaaactaaa

SEQ ID NO: 254127 - DNA, 20 bp, Artificial Sequence
  chemically synthesized
tgtcactttacattaaatgg

SEQ ID NO: 254128 - DNA, 20 bp, Artificial Sequence
  chemically synthesized
agttgtcactttacattaaa

SEQ ID NO: 254129 - DNA, 20 bp, Artificial Sequence
  chemically synthesized
tttttcttccatttaatgta

SEQ ID NO: 254130 - DNA, 20 bp, Artificial Sequence
  chemically synthesized
aatctttgacagcaagggag

SEQ ID NO: 254131 - DNA, 20 bp, Artificial Sequence
  chemically synthesized
gaaaatctttgacagcaagg

SEQ ID NO: 254132 - DNA, 20 bp, Artificial Sequence
  chemically synthesized
atgaaaatctttgacagcaa

SEQ ID NO: 254133 - DNA, 20 bp, Artificial Sequence
  chemically synthesized
aatgaaaatctttgacagca

SEQ ID NO: 254134 - DNA, 20 bp, Artificial Sequence
  chemically synthesized
caactactcccttgctgtca

SEQ ID NO: 254135 - DNA, 20 bp, Artificial Sequence
  chemically synthesized
caatgaaaatctttgacagc

SEQ ID NO: 254136 - DNA, 20 bp, Artificial Sequence
  chemically synthesized
tctgcaatgaaaatctttga

SEQ ID NO: 254137 - DNA, 20 bp, Artificial Sequence
  chemically synthesized
gctgtcaaagattttcattg

SEQ ID NO: 254138 - DNA, 20 bp, Artificial Sequence
  chemically synthesized
tgtcaaagattttcattgca

SEQ ID NO: 254139 - DNA, 20 bp, Artificial Sequence
  chemically synthesized
accatttagatggtaaaggc

SEQ ID NO: 254140 - DNA, 20 bp, Artificial Sequence
  chemically synthesized
taccatttagatggtaaagg

SEQ ID NO: 254141 - DNA, 20 bp, Artificial Sequence
  chemically synthesized
gtttaccatttagatggtaa

SEQ ID NO: 254142 - DNA, 20 bp, Artificial Sequence
  chemically synthesized
agtttaccatttagatggta

SEQ ID NO: 254143 - DNA, 20 bp, Artificial Sequence
  chemically synthesized
gcctgcctttaccatctaaa

SEQ ID NO: 254144 - DNA, 20 bp, Artificial Sequence
  chemically synthesized
acataagtttaccatttaga

SEQ ID NO: 254145 - DNA, 20 bp, Artificial Sequence
  chemically synthesized
atacacataagtttaccatt

SEQ ID NO: 254146 - DNA, 20 bp, Artificial Sequence
  chemically synthesized
actttgacatttatacacat

SEQ ID NO: 254147 - DNA, 20 bp, Artificial Sequence
  chemically synthesized
acttatgtgtataaatgtca

SEQ ID NO: 254148 - DNA, 20 bp, Artificial Sequence
  chemically synthesized
tatgtgtataaatgtcaaag

SEQ ID NO: 254149 - DNA, 20 bp, Artificial Sequence
  chemically synthesized
aaatgtcaaagtagatattg

SEQ ID NO: 254150 - DNA, 20 bp, Artificial Sequence
  chemically synthesized
agtagatattgcagaacctg

SEQ ID NO: 254151 - DNA, 20 bp, Artificial Sequence
  chemically synthesized
tagatattgcagaacctgaa

SEQ ID NO: 254152 - DNA, 20 bp, Artificial Sequence
  chemically synthesized
cccctactctagttctcttc

SEQ ID NO: 254153 - DNA, 20 bp, Artificial Sequence
  chemically synthesized
tcccctactctagttctctt

SEQ ID NO: 254154 - DNA, 20 bp, Artificial Sequence
  chemically synthesized
ttgcagaacctgaagagaac

SEQ ID NO: 254155 - DNA, 20 bp, Artificial Sequence
  chemically synthesized
gcagaacctgaagagaacta

SEQ ID NO: 254156 - DNA, 20 bp, Artificial Sequence
  chemically synthesized
gaacctgaagagaactagag

SEQ ID NO: 254157 - DNA, 20 bp, Artificial Sequence
  chemically synthesized
aacctgaagagaactagagt

SEQ ID NO: 254158 - DNA, 20 bp, Artificial Sequence
  chemically synthesized
acctgaagagaactagagta

SEQ ID NO: 254159 - DNA, 20 bp, Artificial Sequence
  chemically synthesized
cctgaagagaactagagtag

SEQ ID NO: 254160 - DNA, 20 bp, Artificial Sequence
  chemically synthesized
gatattactctcccctactc

SEQ ID NO: 254161 - DNA, 20 bp, Artificial Sequence
  chemically synthesized
tgaagagaactagagtaggg

SEQ ID NO: 254162 - DNA, 20 bp, Artificial Sequence
  chemically synthesized
aagagaactagagtagggga

SEQ ID NO: 254163 - DNA, 20 bp, Artificial Sequence
  chemically synthesized
taacagtaagttcaatttgt

SEQ ID NO: 254164 - DNA, 20 bp, Artificial Sequence
  chemically synthesized
catcaaaagtgattaacagt

SEQ ID NO: 254165 - DNA, 20 bp, Artificial Sequence
  chemically synthesized
ctttcatcaaaagtgattaa

SEQ ID NO: 254166 - DNA, 20 bp, Artificial Sequence
  chemically synthesized
ctgttaatcacttttgatga

SEQ ID NO: 254167 - DNA, 20 bp, Artificial Sequence
  chemically synthesized
tttaagtttactttcatcaa

SEQ ID NO: 254168 - DNA, 20 bp, Artificial Sequence
  chemically synthesized
aaacttcagtaaattatttt

SEQ ID NO: 254169 - DNA, 20 bp, Artificial Sequence
  chemically synthesized
aaacttaaaataatttactg

SEQ ID NO: 254170 - DNA, 20 bp, Artificial Sequence
  chemically synthesized
caaaaatatatttaaaactt

SEQ ID NO: 254171 - DNA, 20 bp, Artificial Sequence
  chemically synthesized
taaatatatttttgtaccta

SEQ ID NO: 254172 - DNA, 20 bp, Artificial Sequence
  chemically synthesized
atatttttgtacctatagca

SEQ ID NO: 254173 - DNA, 20 bp, Artificial Sequence
  chemically synthesized
gaagcaacgagctttgctat

SEQ ID NO: 254174 - DNA, 20 bp, Artificial Sequence
  chemically synthesized
ggaagcaacgagctttgcta

SEQ ID NO: 254175 - DNA, 20 bp, Artificial Sequence
  chemically synthesized
cacagtattcgggaagcaac

SEQ ID NO: 254176 - DNA, 20 bp, Artificial Sequence
  chemically synthesized
cacttttcacagtattcggg

SEQ ID NO: 254177 - DNA, 20 bp, Artificial Sequence
  chemically synthesized
tggcacttttcacagtattc

SEQ ID NO: 254178 - DNA, 20 bp, Artificial Sequence
  chemically synthesized
ttggcacttttcacagtatt

SEQ ID NO: 254179 - DNA, 20 bp, Artificial Sequence
  chemically synthesized
tgcttcccgaatactgtgaa

SEQ ID NO: 254180 - DNA, 20 bp, Artificial Sequence
  chemically synthesized
tagaactttggcacttttca

SEQ ID NO: 254181 - DNA, 20 bp, Artificial Sequence
  chemically synthesized
gaatactgtgaaaagtgcca

SEQ ID NO: 254182 - DNA, 20 bp, Artificial Sequence
  chemically synthesized
tattttaaataatagaactt

SEQ ID NO: 254183 - DNA, 20 bp, Artificial Sequence
  chemically synthesized
ccggctgctattttaaataa

SEQ ID NO: 254184 - DNA, 20 bp, Artificial Sequence
  chemically synthesized
caaagttctattatttaaaa

SEQ ID NO: 254185 - DNA, 20 bp, Artificial Sequence
  chemically synthesized
agttctattatttaaaatag

SEQ ID NO: 254186 - DNA, 20 bp, Artificial Sequence
  chemically synthesized
ctattatttaaaatagcagc

SEQ ID NO: 254187 - DNA, 20 bp, Artificial Sequence
  chemically synthesized
tattatttaaaatagcagcc

SEQ ID NO: 254188 - DNA, 20 bp, Artificial Sequence
  chemically synthesized
tttaaaatagcagccgggcg

SEQ ID NO: 254189 - DNA, 20 bp, Artificial Sequence
  chemically synthesized
aaaatagcagccgggcgcgg

SEQ ID NO: 254190 - DNA, 20 bp, Artificial Sequence
  chemically synthesized
caggcgtgagccaccgcgcc

SEQ ID NO: 254191 - DNA, 20 bp, Artificial Sequence
  chemically synthesized
agtgctgggattacaggcgt

SEQ ID NO: 254192 - DNA, 20 bp, Artificial Sequence
  chemically synthesized
gtggctcacgcctgtaatcc

SEQ ID NO: 254193 - DNA, 20 bp, Artificial Sequence
  chemically synthesized
tcccaaagtgctgggattac

SEQ ID NO: 254194 - DNA, 20 bp, Artificial Sequence
  chemically synthesized
ctcccaaagtgctgggatta

SEQ ID NO: 254195 - DNA, 20 bp, Artificial Sequence
  chemically synthesized
cgcctgtaatcccagcactt

SEQ ID NO: 254196 - DNA, 20 bp, Artificial Sequence
  chemically synthesized
cctcggcctcccaaagtgct

SEQ ID NO: 254197 - DNA, 20 bp, Artificial Sequence
  chemically synthesized
gcctgtaatcccagcacttt

SEQ ID NO: 254198 - DNA, 20 bp, Artificial Sequence
  chemically synthesized
acctcggcctcccaaagtgc

SEQ ID NO: 254199 - DNA, 20 bp, Artificial Sequence
  chemically synthesized
ctgtaatcccagcactttgg

SEQ ID NO: 254200 - DNA, 20 bp, Artificial Sequence
  chemically synthesized
tgtaatcccagcactttggg

SEQ ID NO: 254201 - DNA, 20 bp, Artificial Sequence
  chemically synthesized
ccacctacctcggcctccca

SEQ ID NO: 254202 - DNA, 20 bp, Artificial Sequence
  chemically synthesized
tcccagcactttgggaggcc

SEQ ID NO: 254203 - DNA, 20 bp, Artificial Sequence
  chemically synthesized
cccagcactttgggaggccg

SEQ ID NO: 254204 - DNA, 20 bp, Artificial Sequence
  chemically synthesized
agcactttgggaggccgagg

SEQ ID NO: 254205 - DNA, 20 bp, Artificial Sequence
  chemically synthesized
gcactttgggaggccgaggt

SEQ ID NO: 254206 - DNA, 20 bp, Artificial Sequence
  chemically synthesized
ctttgggaggccgaggtagg

SEQ ID NO: 254207 - DNA, 20 bp, Artificial Sequence
  chemically synthesized
ctaaagtgatccacctacct

SEQ ID NO: 254208 - DNA, 20 bp, Artificial Sequence
  chemically synthesized
ccgaggtaggtggatcactt

SEQ ID NO: 254209 - DNA, 20 bp, Artificial Sequence
  chemically synthesized
cgaggtaggtggatcacttt

SEQ ID NO: 254210 - DNA, 20 bp, Artificial Sequence
  chemically synthesized
gtaggtggatcactttagga

SEQ ID NO: 254211 - DNA, 20 bp, Artificial Sequence
  chemically synthesized
taggtggatcactttaggac

SEQ ID NO: 254212 - DNA, 20 bp, Artificial Sequence
  chemically synthesized
ggtctcgaactcctgtccta

SEQ ID NO: 254213 - DNA, 20 bp, Artificial Sequence
  chemically synthesized
ggtggatcactttaggacag

SEQ ID NO: 254214 - DNA, 20 bp, Artificial Sequence
  chemically synthesized
tcactttaggacaggagttc

SEQ ID NO: 254215 - DNA, 20 bp, Artificial Sequence
  chemically synthesized
ttaggacaggagttcgagac

SEQ ID NO: 254216 - DNA, 20 bp, Artificial Sequence
  chemically synthesized
gtttcacatgttggtcaggc

SEQ ID NO: 254217 - DNA, 20 bp, Artificial Sequence
  chemically synthesized
cagggtttcacatgttggtc

SEQ ID NO: 254218 - DNA, 20 bp, Artificial Sequence
  chemically synthesized
acagggtttcacatgttggt

SEQ ID NO: 254219 - DNA, 20 bp, Artificial Sequence
  chemically synthesized
agagacagggtttcacatgt

SEQ ID NO: 254220 - DNA, 20 bp, Artificial Sequence
  chemically synthesized
ttgtatttttagtagagaca

SEQ ID NO: 254221 - DNA, 20 bp, Artificial Sequence
  chemically synthesized
tttgtatttttagtagagac

SEQ ID NO: 254222 - DNA, 20 bp, Artificial Sequence
  chemically synthesized
gtttgtatttttagtagaga

SEQ ID NO: 254223 - DNA, 20 bp, Artificial Sequence
  chemically synthesized
gaatgtttgtatttttagta

SEQ ID NO: 254224 - DNA, 20 bp, Artificial Sequence
  chemically synthesized
gtgaatgtttgtatttttag

SEQ ID NO: 254225 - DNA, 20 bp, Artificial Sequence
  chemically synthesized
ctggtgaatgtttgtatttt

SEQ ID NO: 254226 - DNA, 20 bp, Artificial Sequence
  chemically synthesized
ctaaaaatacaaacattcac

SEQ ID NO: 254227 - DNA, 20 bp, Artificial Sequence
  chemically synthesized
taaaaatacaaacattcacc

SEQ ID NO: 254228 - DNA, 20 bp, Artificial Sequence
  chemically synthesized
atacaaacattcaccaggtg

SEQ ID NO: 254229 - DNA, 20 bp, Artificial Sequence
  chemically synthesized
caaacattcaccaggtgtgg

SEQ ID NO: 254230 - DNA, 20 bp, Artificial Sequence
  chemically synthesized
caggcgcccaccgccacacc

SEQ ID NO: 254231 - DNA, 20 bp, Artificial Sequence
  chemically synthesized
acattcaccaggtgtggcgg

SEQ ID NO: 254232 - DNA, 20 bp, Artificial Sequence
  chemically synthesized
cattcaccaggtgtggcggt

SEQ ID NO: 254233 - DNA, 20 bp, Artificial Sequence
  chemically synthesized
gcggtgggcgcctgtaatcc

SEQ ID NO: 254234 - DNA, 20 bp, Artificial Sequence
  chemically synthesized
tcccaagtagctgggattac

SEQ ID NO: 254235 - DNA, 20 bp, Artificial Sequence
  chemically synthesized
ctcccaagtagctgggatta

SEQ ID NO: 254236 - DNA, 20 bp, Artificial Sequence
  chemically synthesized
cgcctgtaatcccagctact

SEQ ID NO: 254237 - DNA, 20 bp, Artificial Sequence
  chemically synthesized
ccttagcctcccaagtagct

SEQ ID NO: 254238 - DNA, 20 bp, Artificial Sequence
  chemically synthesized
gcctgtaatcccagctactt

SEQ ID NO: 254239 - DNA, 20 bp, Artificial Sequence
  chemically synthesized
accttagcctcccaagtagc

SEQ ID NO: 254240 - DNA, 20 bp, Artificial Sequence
  chemically synthesized
ctgtaatcccagctacttgg

SEQ ID NO: 254241 - DNA, 20 bp, Artificial Sequence
  chemically synthesized
tgtaatcccagctacttggg

SEQ ID NO: 254242 - DNA, 20 bp, Artificial Sequence
  chemically synthesized
tcctaccttagcctcccaag

SEQ ID NO: 254243 - DNA, 20 bp, Artificial Sequence
  chemically synthesized
ttctcctaccttagcctccc

SEQ ID NO: 254244 - DNA, 20 bp, Artificial Sequence
  chemically synthesized
tcccagctacttgggaggct

SEQ ID NO: 254245 - DNA, 20 bp, Artificial Sequence
  chemically synthesized
cccagctacttgggaggcta

SEQ ID NO: 254246 - DNA, 20 bp, Artificial Sequence
  chemically synthesized
agctacttgggaggctaagg

SEQ ID NO: 254247 - DNA, 20 bp, Artificial Sequence
  chemically synthesized
gctacttgggaggctaaggt

SEQ ID NO: 254248 - DNA, 20 bp, Artificial Sequence
  chemically synthesized
tacttgggaggctaaggtag

SEQ ID NO: 254249 - DNA, 20 bp, Artificial Sequence
  chemically synthesized
gtcaagtgattctcctacct

SEQ ID NO: 254250 - DNA, 20 bp, Artificial Sequence
  chemically synthesized
gtaggagaatcacttgaccc

SEQ ID NO: 254251 - DNA, 20 bp, Artificial Sequence
  chemically synthesized
taggagaatcacttgacccc

SEQ ID NO: 254252 - DNA, 20 bp, Artificial Sequence
  chemically synthesized
aacctccgcttcctggggtc

SEQ ID NO: 254253 - DNA, 20 bp, Artificial Sequence
  chemically synthesized
gagaatcacttgaccccagg

SEQ ID NO: 254254 - DNA, 20 bp, Artificial Sequence
  chemically synthesized
aatcacttgaccccaggaag

SEQ ID NO: 254255 - DNA, 20 bp, Artificial Sequence
  chemically synthesized
actgcaacctccgcttcctg

SEQ ID NO: 254256 - DNA, 20 bp, Artificial Sequence
  chemically synthesized
cactgcaacctccgcttcct

SEQ ID NO: 254257 - DNA, 20 bp, Artificial Sequence
  chemically synthesized
tcacttgaccccaggaagcg

SEQ ID NO: 254258 - DNA, 20 bp, Artificial Sequence
  chemically synthesized
tcactgcaacctccgcttcc

SEQ ID NO: 254259 - DNA, 20 bp, Artificial Sequence
  chemically synthesized
cacttgaccccaggaagcgg

SEQ ID NO: 254260 - DNA, 20 bp, Artificial Sequence
  chemically synthesized
accccaggaagcggaggttg

SEQ ID NO: 254261 - DNA, 20 bp, Artificial Sequence
  chemically synthesized
caggaagcggaggttgcagt

SEQ ID NO: 254262 - DNA, 20 bp, Artificial Sequence
  chemically synthesized
agcggaggttgcagtgagcc

SEQ ID NO: 254263 - DNA, 20 bp, Artificial Sequence
  chemically synthesized
ggagtgcggtggcacagtct

SEQ ID NO: 254264 - DNA, 20 bp, Artificial Sequence
  chemically synthesized
caggctggagtgcggtggca

SEQ ID NO: 254265 - DNA, 20 bp, Artificial Sequence
  chemically synthesized
ttgcccaggctggagtgcgg

SEQ ID NO: 254266 - DNA, 20 bp, Artificial Sequence
  chemically synthesized
gagactgtgccaccgcactc

SEQ ID NO: 254267 - DNA, 20 bp, Artificial Sequence
  chemically synthesized
ttgttgcccaggctggagtg

SEQ ID NO: 254268 - DNA, 20 bp, Artificial Sequence
  chemically synthesized
tgtgccaccgcactccagcc

SEQ ID NO: 254269 - DNA, 20 bp, Artificial Sequence
  chemically synthesized
gtgccaccgcactccagcct

SEQ ID NO: 254270 - DNA, 20 bp, Artificial Sequence
  chemically synthesized
cactcttgttgcccaggctg

SEQ ID NO: 254271 - DNA, 20 bp, Artificial Sequence
  chemically synthesized
ttcactcttgttgcccaggc

SEQ ID NO: 254272 - DNA, 20 bp, Artificial Sequence
  chemically synthesized
cgcactccagcctgggcaac

SEQ ID NO: 254273 - DNA, 20 bp, Artificial Sequence
  chemically synthesized
gagtttcactcttgttgccc

SEQ ID NO: 254274 - DNA, 20 bp, Artificial Sequence
  chemically synthesized
agagtttcactcttgttgcc

SEQ ID NO: 254275 - DNA, 20 bp, Artificial Sequence
  chemically synthesized
cactccagcctgggcaacaa

SEQ ID NO: 254276 - DNA, 20 bp, Artificial Sequence
  chemically synthesized
tttaattgtttattgagaca

SEQ ID NO: 254277 - DNA, 20 bp, Artificial Sequence
  chemically synthesized
tgtttaattgtttattgaga

SEQ ID NO: 254278 - DNA, 20 bp, Artificial Sequence
  chemically synthesized
tgtttgtttaattgtttatt

SEQ ID NO: 254279 - DNA, 20 bp, Artificial Sequence
  chemically synthesized
ccacagagacgggacagagg

SEQ ID NO: 254280 - DNA, 20 bp, Artificial Sequence
  chemically synthesized
tgaccacagagacgggacag

SEQ ID NO: 254281 - DNA, 20 bp, Artificial Sequence
  chemically synthesized
atgaccacagagacgggaca

SEQ ID NO: 254282 - DNA, 20 bp, Artificial Sequence
  chemically synthesized
gaatgaccacagagacggga

SEQ ID NO: 254283 - DNA, 20 bp, Artificial Sequence
  chemically synthesized
cttcctctgtcccgtctctg

SEQ ID NO: 254284 - DNA, 20 bp, Artificial Sequence
  chemically synthesized
aattgaatgaccacagagac

SEQ ID NO: 254285 - DNA, 20 bp, Artificial Sequence
  chemically synthesized
gaattgaatgaccacagaga

SEQ ID NO: 254286 - DNA, 20 bp, Artificial Sequence
  chemically synthesized
ggctgaattgaatgaccaca

SEQ ID NO: 254287 - DNA, 20 bp, Artificial Sequence
  chemically synthesized
atggctgaattgaatgacca

SEQ ID NO: 254288 - DNA, 20 bp, Artificial Sequence
  chemically synthesized
gtctctgtggtcattcaatt

SEQ ID NO: 254289 - DNA, 20 bp, Artificial Sequence
  chemically synthesized
ggatgttgaagatgaagaaa

SEQ ID NO: 254290 - DNA, 20 bp, Artificial Sequence
  chemically synthesized
gtaattggatgttgaagatg

SEQ ID NO: 254291 - DNA, 20 bp, Artificial Sequence
  chemically synthesized
tatttagtaattggatgttg

SEQ ID NO: 254292 - DNA, 20 bp, Artificial Sequence
  chemically synthesized
agacatccttatttagtaat

SEQ ID NO: 254293 - DNA, 20 bp, Artificial Sequence
  chemically synthesized
tcaacatccaattactaaat

SEQ ID NO: 254294 - DNA, 20 bp, Artificial Sequence
  chemically synthesized
caacatccaattactaaata

SEQ ID NO: 254295 - DNA, 20 bp, Artificial Sequence
  chemically synthesized
aaattatagacatccttatt

SEQ ID NO: 254296 - DNA, 20 bp, Artificial Sequence
  chemically synthesized
gcaaagacacttgtaaatta

SEQ ID NO: 254297 - DNA, 20 bp, Artificial Sequence
  chemically synthesized
taaggatgtctataatttac

SEQ ID NO: 254298 - DNA, 20 bp, Artificial Sequence
  chemically synthesized
aggtatgaaataagggagca

SEQ ID NO: 254299 - DNA, 20 bp, Artificial Sequence
  chemically synthesized
tttctaggtatgaaataagg

SEQ ID NO: 254300 - DNA, 20 bp, Artificial Sequence
  chemically synthesized
tatttctaggtatgaaataa

SEQ ID NO: 254301 - DNA, 20 bp, Artificial Sequence
  chemically synthesized
ttatttctaggtatgaaata

SEQ ID NO: 254302 - DNA, 20 bp, Artificial Sequence
  chemically synthesized
cttatttctaggtatgaaat

SEQ ID NO: 254303 - DNA, 20 bp, Artificial Sequence
  chemically synthesized
ttgctcccttatttcatacc

SEQ ID NO: 254304 - DNA, 20 bp, Artificial Sequence
  chemically synthesized
cttatttcatacctagaaat

SEQ ID NO: 254305 - DNA, 20 bp, Artificial Sequence
  chemically synthesized
gtatatgtgagcttatttct

SEQ ID NO: 254306 - DNA, 20 bp, Artificial Sequence
  chemically synthesized
ggtatatgtgagcttatttc

SEQ ID NO: 254307 - DNA, 20 bp, Artificial Sequence
  chemically synthesized
agatttgtgaaggtatatgt

SEQ ID NO: 254308 - DNA, 20 bp, Artificial Sequence
  chemically synthesized
aaagagttgtagatttgtga

SEQ ID NO: 254309 - DNA, 20 bp, Artificial Sequence
  chemically synthesized
gaaagagttgtagatttgtg

SEQ ID NO: 254310 - DNA, 20 bp, Artificial Sequence
  chemically synthesized
taaaatcttggaaagagttg

SEQ ID NO: 254311 - DNA, 20 bp, Artificial Sequence
  chemically synthesized
acaaatctacaactctttcc

SEQ ID NO: 254312 - DNA, 20 bp, Artificial Sequence
  chemically synthesized
attatttaaaatcttggaaa

SEQ ID NO: 254313 - DNA, 20 bp, Artificial Sequence
  chemically synthesized
atattatttaaaatcttgga

SEQ ID NO: 254314 - DNA, 20 bp, Artificial Sequence
  chemically synthesized
ggacatattatttaaaatct

SEQ ID NO: 254315 - DNA, 20 bp, Artificial Sequence
  chemically synthesized
tttaaataatatgtccactg

SEQ ID NO: 254316 - DNA, 20 bp, Artificial Sequence
  chemically synthesized
ttaaataatatgtccactgt

SEQ ID NO: 254317 - DNA, 20 bp, Artificial Sequence
  chemically synthesized
tttgtatatacatcccacag

SEQ ID NO: 254318 - DNA, 20 bp, Artificial Sequence
  chemically synthesized
atgtttgtatatacatccca

SEQ ID NO: 254319 - DNA, 20 bp, Artificial Sequence
  chemically synthesized
atgtatatacaaacattaat

SEQ ID NO: 254320 - DNA, 20 bp, Artificial Sequence
  chemically synthesized
ctgttaaacagaagacaaat

SEQ ID NO: 254321 - DNA, 20 bp, Artificial Sequence
  chemically synthesized
gaggaaaaactgttaaacag

SEQ ID NO: 254322 - DNA, 20 bp, Artificial Sequence
  chemically synthesized
ctaatttgtcttctgtttaa

SEQ ID NO: 254323 - DNA, 20 bp, Artificial Sequence
  chemically synthesized
actgaggaaaaactgttaaa

SEQ ID NO: 254324 - DNA, 20 bp, Artificial Sequence
  chemically synthesized
tctgtttaacagtttttcct

SEQ ID NO: 254325 - DNA, 20 bp, Artificial Sequence
  chemically synthesized
gatgtaaaattttattactg

SEQ ID NO: 254326 - DNA, 20 bp, Artificial Sequence
  chemically synthesized
tgatgtaaaattttattact

SEQ ID NO: 254327 - DNA, 20 bp, Artificial Sequence
  chemically synthesized
tcagtaataaaattttacat

SEQ ID NO: 254328 - DNA, 20 bp, Artificial Sequence
  chemically synthesized
gtaataaaattttacatcag

SEQ ID NO: 254329 - DNA, 20 bp, Artificial Sequence
  chemically synthesized
aattttacatcagaagttgt

SEQ ID NO: 254330 - DNA, 20 bp, Artificial Sequence
  chemically synthesized
agaagttgtgagtgttctct

SEQ ID NO: 254331 - DNA, 20 bp, Artificial Sequence
  chemically synthesized
taattgaaatttttgactga

SEQ ID NO: 254332 - DNA, 20 bp, Artificial Sequence
  chemically synthesized
tctaattgaaatttttgact

SEQ ID NO: 254333 - DNA, 20 bp, Artificial Sequence
  chemically synthesized
tctcagtcaaaaatttcaat

SEQ ID NO: 254334 - DNA, 20 bp, Artificial Sequence
  chemically synthesized
caaaaatttcaattagaaaa

SEQ ID NO: 254335 - DNA, 20 bp, Artificial Sequence
  chemically synthesized
ttgaaattttatttcatttg

SEQ ID NO: 254336 - DNA, 20 bp, Artificial Sequence
  chemically synthesized
ataaaatttcaaatgtataa

SEQ ID NO: 254337 - DNA, 20 bp, Artificial Sequence
  chemically synthesized
tttcaaatgtataaaagcat

SEQ ID NO: 254338 - DNA, 20 bp, Artificial Sequence
  chemically synthesized
aaaagcataagttaaaatat

SEQ ID NO: 254339 - DNA, 20 bp, Artificial Sequence
  chemically synthesized
ataatatgaaattgttgttt

SEQ ID NO: 254340 - DNA, 20 bp, Artificial Sequence
  chemically synthesized
taatatgaaattgttgtttc

SEQ ID NO: 254341 - DNA, 20 bp, Artificial Sequence
  chemically synthesized
aatatgaaattgttgtttca

SEQ ID NO: 254342 - DNA, 20 bp, Artificial Sequence
  chemically synthesized
aatactgaagtcattttcag

SEQ ID NO: 254343 - DNA, 20 bp, Artificial Sequence
  chemically synthesized
aaatactgaagtcattttca

SEQ ID NO: 254344 - DNA, 20 bp, Artificial Sequence
  chemically synthesized
gaaatactgaagtcattttc

SEQ ID NO: 254345 - DNA, 20 bp, Artificial Sequence
  chemically synthesized
cgaaatactgaagtcatttt

SEQ ID NO: 254346 - DNA, 20 bp, Artificial Sequence
  chemically synthesized
ttttcccctgaaaatgactt

SEQ ID NO: 254347 - DNA, 20 bp, Artificial Sequence
  chemically synthesized
agaatatcatcgaaatactg

SEQ ID NO: 254348 - DNA, 20 bp, Artificial Sequence
  chemically synthesized
tcagtatttcgatgatattc

SEQ ID NO: 254349 - DNA, 20 bp, Artificial Sequence
  chemically synthesized
aagttcaatatatttcaaac

SEQ ID NO: 254350 - DNA, 20 bp, Artificial Sequence
  chemically synthesized
atcacttcttttaaaaaata

SEQ ID NO: 254351 - DNA, 20 bp, Artificial Sequence
  chemically synthesized
tattgaactttattttttaa

SEQ ID NO: 254352 - DNA, 20 bp, Artificial Sequence
  chemically synthesized
tgaactttattttttaaaag

SEQ ID NO: 254353 - DNA, 20 bp, Artificial Sequence
  chemically synthesized
gtgataaaattgctttctaa

SEQ ID NO: 254354 - DNA, 20 bp, Artificial Sequence
  chemically synthesized
aaaactgagaaaccattaga

SEQ ID NO: 254355 - DNA, 20 bp, Artificial Sequence
  chemically synthesized
aatgaaaactgagaaaccat

SEQ ID NO: 254356 - DNA, 20 bp, Artificial Sequence
  chemically synthesized
attgctttctaatggtttct

SEQ ID NO: 254357 - DNA, 20 bp, Artificial Sequence
  chemically synthesized
ccttcagagaaatgaaaact

SEQ ID NO: 254358 - DNA, 20 bp, Artificial Sequence
  chemically synthesized
tctcagttttcatttctctg

SEQ ID NO: 254359 - DNA, 20 bp, Artificial Sequence
  chemically synthesized
ctcagttttcatttctctga

SEQ ID NO: 254360 - DNA, 20 bp, Artificial Sequence
  chemically synthesized
ctgctaatgttagtccttca

SEQ ID NO: 254361 - DNA, 20 bp, Artificial Sequence
  chemically synthesized
gtctgctaatgttagtcctt

SEQ ID NO: 254362 - DNA, 20 bp, Artificial Sequence
  chemically synthesized
tttctctgaaggactaacat

SEQ ID NO: 254363 - DNA, 20 bp, Artificial Sequence
  chemically synthesized
ctctgaaggactaacattag

SEQ ID NO: 254364 - DNA, 20 bp, Artificial Sequence
  chemically synthesized
ttccagctgtctgctaatgt

SEQ ID NO: 254365 - DNA, 20 bp, Artificial Sequence
  chemically synthesized
gaaggactaacattagcaga

SEQ ID NO: 254366 - DNA, 20 bp, Artificial Sequence
  chemically synthesized
gactaacattagcagacagc

SEQ ID NO: 254367 - DNA, 20 bp, Artificial Sequence
  chemically synthesized
taacattagcagacagctgg

SEQ ID NO: 254368 - DNA, 20 bp, Artificial Sequence
  chemically synthesized
atgtgaattataagtgcttc

SEQ ID NO: 254369 - DNA, 20 bp, Artificial Sequence
  chemically synthesized
tggttaaaaatgtgaattat

SEQ ID NO: 254370 - DNA, 20 bp, Artificial Sequence
  chemically synthesized
tttccttcaggaaataaata

SEQ ID NO: 254371 - DNA, 20 bp, Artificial Sequence
  chemically synthesized
ttaaccatatttatttcctg

SEQ ID NO: 254372 - DNA, 20 bp, Artificial Sequence
  chemically synthesized
taaccatatttatttcctga

SEQ ID NO: 254373 - DNA, 20 bp, Artificial Sequence
  chemically synthesized
agtgaataggaatttccttc

SEQ ID NO: 254374 - DNA, 20 bp, Artificial Sequence
  chemically synthesized
gagtgaataggaatttcctt

SEQ ID NO: 254375 - DNA, 20 bp, Artificial Sequence
  chemically synthesized
ctattactaagtgagtgaat

SEQ ID NO: 254376 - DNA, 20 bp, Artificial Sequence
  chemically synthesized
gctattactaagtgagtgaa

SEQ ID NO: 254377 - DNA, 20 bp, Artificial Sequence
  chemically synthesized
gaaattcctattcactcact

SEQ ID NO: 254378 - DNA, 20 bp, Artificial Sequence
  chemically synthesized
tggggaagctattactaagt

SEQ ID NO: 254379 - DNA, 20 bp, Artificial Sequence
  chemically synthesized
cctattcactcacttagtaa

SEQ ID NO: 254380 - DNA, 20 bp, Artificial Sequence
  chemically synthesized
gaaatggggaagctattact

SEQ ID NO: 254381 - DNA, 20 bp, Artificial Sequence
  chemically synthesized
gagggaaagatgaaatgggg

SEQ ID NO: 254382 - DNA, 20 bp, Artificial Sequence
  chemically synthesized
aaggagggaaagatgaaatg

SEQ ID NO: 254383 - DNA, 20 bp, Artificial Sequence
  chemically synthesized
caaggagggaaagatgaaat

SEQ ID NO: 254384 - DNA, 20 bp, Artificial Sequence
  chemically synthesized
ccaaggagggaaagatgaaa

SEQ ID NO: 254385 - DNA, 20 bp, Artificial Sequence
  chemically synthesized
tgaatcctgccaaggaggga

SEQ ID NO: 254386 - DNA, 20 bp, Artificial Sequence
  chemically synthesized
ccatttcatctttccctcct

SEQ ID NO: 254387 - DNA, 20 bp, Artificial Sequence
  chemically synthesized
tttcatctttccctccttgg

SEQ ID NO: 254388 - DNA, 20 bp, Artificial Sequence
  chemically synthesized
gtactgaatcctgccaagga

SEQ ID NO: 254389 - DNA, 20 bp, Artificial Sequence
  chemically synthesized
ttcatctttccctccttggc

SEQ ID NO: 254390 - DNA, 20 bp, Artificial Sequence
  chemically synthesized
tgtactgaatcctgccaagg

SEQ ID NO: 254391 - DNA, 20 bp, Artificial Sequence
  chemically synthesized
ctgtactgaatcctgccaag

SEQ ID NO: 254392 - DNA, 20 bp, Artificial Sequence
  chemically synthesized
aactgtactgaatcctgcca

SEQ ID NO: 254393 - DNA, 20 bp, Artificial Sequence
  chemically synthesized
taactgtactgaatcctgcc

SEQ ID NO: 254394 - DNA, 20 bp, Artificial Sequence
  chemically synthesized
tttccctccttggcaggatt

SEQ ID NO: 254395 - DNA, 20 bp, Artificial Sequence
  chemically synthesized
ctccttggcaggattcagta

SEQ ID NO: 254396 - DNA, 20 bp, Artificial Sequence
  chemically synthesized
ttggcaggattcagtacagt

SEQ ID NO: 254397 - DNA, 20 bp, Artificial Sequence
  chemically synthesized
tggcaggattcagtacagtt

SEQ ID NO: 254398 - DNA, 20 bp, Artificial Sequence
  chemically synthesized
ggattcagtacagttaggca

SEQ ID NO: 254399 - DNA, 20 bp, Artificial Sequence
  chemically synthesized
taggcacagttttcatcata

SEQ ID NO: 254400 - DNA, 20 bp, Artificial Sequence
  chemically synthesized
cagttttcatcatacagacc

SEQ ID NO: 254401 - DNA, 20 bp, Artificial Sequence
  chemically synthesized
tagttaaaactagtgtggct

SEQ ID NO: 254402 - DNA, 20 bp, Artificial Sequence
  chemically synthesized
tcatacagacctagccacac

SEQ ID NO: 254403 - DNA, 20 bp, Artificial Sequence
  chemically synthesized
ctagttaaaactagtgtggc

SEQ ID NO: 254404 - DNA, 20 bp, Artificial Sequence
  chemically synthesized
attactagttaaaactagtg

SEQ ID NO: 254405 - DNA, 20 bp, Artificial Sequence
  chemically synthesized
atagtattactagttaaaac

SEQ ID NO: 254406 - DNA, 20 bp, Artificial Sequence
  chemically synthesized
ctagccacactagttttaac

SEQ ID NO: 254407 - DNA, 20 bp, Artificial Sequence
  chemically synthesized
aacctagaagatagtattac

SEQ ID NO: 254408 - DNA, 20 bp, Artificial Sequence
  chemically synthesized
taactagtaatactatcttc

SEQ ID NO: 254409 - DNA, 20 bp, Artificial Sequence
  chemically synthesized
aactagtaatactatcttct

SEQ ID NO: 254410 - DNA, 20 bp, Artificial Sequence
  chemically synthesized
agagagagaaacctagaaga

SEQ ID NO: 254411 - DNA, 20 bp, Artificial Sequence
  chemically synthesized
acacagagagagaaacctag

SEQ ID NO: 254412 - DNA, 20 bp, Artificial Sequence
  chemically synthesized
cagacacagagagagaaacc

SEQ ID NO: 254413 - DNA, 20 bp, Artificial Sequence
  chemically synthesized
gtagctgtcagacacagaga

SEQ ID NO: 254414 - DNA, 20 bp, Artificial Sequence
  chemically synthesized
atgtagctgtcagacacaga

SEQ ID NO: 254415 - DNA, 20 bp, Artificial Sequence
  chemically synthesized
cgatgtagctgtcagacaca

SEQ ID NO: 254416 - DNA, 20 bp, Artificial Sequence
  chemically synthesized
gtttctctctctgtgtctga

SEQ ID NO: 254417 - DNA, 20 bp, Artificial Sequence
  chemically synthesized
agcgatgtagctgtcagaca

SEQ ID NO: 254418 - DNA, 20 bp, Artificial Sequence
  chemically synthesized
gaatacagcgatgtagctgt

SEQ ID NO: 254419 - DNA, 20 bp, Artificial Sequence
  chemically synthesized
aatgaatgaatacagcgatg

SEQ ID NO: 254420 - DNA, 20 bp, Artificial Sequence
  chemically synthesized
cttgagttaatgaatgaata

SEQ ID NO: 254421 - DNA, 20 bp, Artificial Sequence
  chemically synthesized
ctgtattcattcattaactc

SEQ ID NO: 254422 - DNA, 20 bp, Artificial Sequence
  chemically synthesized
tttttcaacaaatatttctt

SEQ ID NO: 254423 - DNA, 20 bp, Artificial Sequence
  chemically synthesized
ttgttgaaaaaacctaccat

SEQ ID NO: 254424 - DNA, 20 bp, Artificial Sequence
  chemically synthesized
aaatatgactgtctcatggt

SEQ ID NO: 254425 - DNA, 20 bp, Artificial Sequence
  chemically synthesized
aaaatatgactgtctcatgg

SEQ ID NO: 254426 - DNA, 20 bp, Artificial Sequence
  chemically synthesized
tgaaaaaacctaccatgaga

SEQ ID NO: 254427 - DNA, 20 bp, Artificial Sequence
  chemically synthesized
aataaaatatgactgtctca

SEQ ID NO: 254428 - DNA, 20 bp, Artificial Sequence
  chemically synthesized
tattatttatttatttattt

SEQ ID NO: 254429 - DNA, 20 bp, Artificial Sequence
  chemically synthesized
ttatttatttatttattttg

SEQ ID NO: 254430 - DNA, 20 bp, Artificial Sequence
  chemically synthesized
ttatttatttattttggaga

SEQ ID NO: 254431 - DNA, 20 bp, Artificial Sequence
  chemically synthesized
atttatttattttggagaca

SEQ ID NO: 254432 - DNA, 20 bp, Artificial Sequence
  chemically synthesized
tccagcctgggtgacagagt

SEQ ID NO: 254433 - DNA, 20 bp, Artificial Sequence
  chemically synthesized
cagagtctcactctgtcacc

SEQ ID NO: 254434 - DNA, 20 bp, Artificial Sequence
  chemically synthesized
gcattccagcctgggtgaca

SEQ ID NO: 254435 - DNA, 20 bp, Artificial Sequence
  chemically synthesized
agagtctcactctgtcaccc

SEQ ID NO: 254436 - DNA, 20 bp, Artificial Sequence
  chemically synthesized
ctgcattccagcctgggtga

SEQ ID NO: 254437 - DNA, 20 bp, Artificial Sequence
  chemically synthesized
tctcactctgtcacccaggc

SEQ ID NO: 254438 - DNA, 20 bp, Artificial Sequence
  chemically synthesized
gcgccactgcattccagcct

SEQ ID NO: 254439 - DNA, 20 bp, Artificial Sequence
  chemically synthesized
tgcgccactgcattccagcc

SEQ ID NO: 254440 - DNA, 20 bp, Artificial Sequence
  chemically synthesized
ctgtcacccaggctggaatg

SEQ ID NO: 254441 - DNA, 20 bp, Artificial Sequence
  chemically synthesized
gagattgcgccactgcattc

SEQ ID NO: 254442 - DNA, 20 bp, Artificial Sequence
  chemically synthesized
tcacccaggctggaatgcag

SEQ ID NO: 254443 - DNA, 20 bp, Artificial Sequence
  chemically synthesized
ggtggaggttgcagtgaaca

SEQ ID NO: 254444 - DNA, 20 bp, Artificial Sequence
  chemically synthesized
gaggtggaggttgcagtgaa

SEQ ID NO: 254445 - DNA, 20 bp, Artificial Sequence
  chemically synthesized
aacctgggaggtggaggttg

SEQ ID NO: 254446 - DNA, 20 bp, Artificial Sequence
  chemically synthesized
tgcttgaacctgggaggtgg

SEQ ID NO: 254447 - DNA, 20 bp, Artificial Sequence
  chemically synthesized
tcactgcaacctccacctcc

SEQ ID NO: 254448 - DNA, 20 bp, Artificial Sequence
  chemically synthesized
ttgcttgaacctgggaggtg

SEQ ID NO: 254449 - DNA, 20 bp, Artificial Sequence
  chemically synthesized
cactgcaacctccacctccc

SEQ ID NO: 254450 - DNA, 20 bp, Artificial Sequence
  chemically synthesized
aattgcttgaacctgggagg

SEQ ID NO: 254451 - DNA, 20 bp, Artificial Sequence
  chemically synthesized
gagaattgcttgaacctggg

SEQ ID NO: 254452 - DNA, 20 bp, Artificial Sequence
  chemically synthesized
ggagaattgcttgaacctgg

SEQ ID NO: 254453 - DNA, 20 bp, Artificial Sequence
  chemically synthesized
aacctccacctcccaggttc

SEQ ID NO: 254454 - DNA, 20 bp, Artificial Sequence
  chemically synthesized
caggagaattgcttgaacct

SEQ ID NO: 254455 - DNA, 20 bp, Artificial Sequence
  chemically synthesized
gcaggagaattgcttgaacc

SEQ ID NO: 254456 - DNA, 20 bp, Artificial Sequence
  chemically synthesized
ttcaagcaattctcctgcct

SEQ ID NO: 254457 - DNA, 20 bp, Artificial Sequence
  chemically synthesized
tactcgggaggctgaggcag

SEQ ID NO: 254458 - DNA, 20 bp, Artificial Sequence
  chemically synthesized
gctactcgggaggctgaggc

SEQ ID NO: 254459 - DNA, 20 bp, Artificial Sequence
  chemically synthesized
agctactcgggaggctgagg

SEQ ID NO: 254460 - DNA, 20 bp, Artificial Sequence
  chemically synthesized
cccagctactcgggaggctg

SEQ ID NO: 254461 - DNA, 20 bp, Artificial Sequence
  chemically synthesized
tcccagctactcgggaggct

SEQ ID NO: 254462 - DNA, 20 bp, Artificial Sequence
  chemically synthesized
ttctcctgcctcagcctccc

SEQ ID NO: 254463 - DNA, 20 bp, Artificial Sequence
  chemically synthesized
tcctgcctcagcctcccgag

SEQ ID NO: 254464 - DNA, 20 bp, Artificial Sequence
  chemically synthesized
tgtaatcccagctactcggg

SEQ ID NO: 254465 - DNA, 20 bp, Artificial Sequence
  chemically synthesized
ctgtaatcccagctactcgg

SEQ ID NO: 254466 - DNA, 20 bp, Artificial Sequence
  chemically synthesized
gcctcagcctcccgagtagc

SEQ ID NO: 254467 - DNA, 20 bp, Artificial Sequence
  chemically synthesized
gcctgtaatcccagctactc

SEQ ID NO: 254468 - DNA, 20 bp, Artificial Sequence
  chemically synthesized
cctcagcctcccgagtagct

SEQ ID NO: 254469 - DNA, 20 bp, Artificial Sequence
  chemically synthesized
cgcctgtaatcccagctact

SEQ ID NO: 254470 - DNA, 20 bp, Artificial Sequence
  chemically synthesized
ctcccgagtagctgggatta

SEQ ID NO: 254471 - DNA, 20 bp, Artificial Sequence
  chemically synthesized
tcccgagtagctgggattac

SEQ ID NO: 254472 - DNA, 20 bp, Artificial Sequence
  chemically synthesized
gtggcgggcgcctgtaatcc

SEQ ID NO: 254473 - DNA, 20 bp, Artificial Sequence
  chemically synthesized
aattagccgggcatggtggc

SEQ ID NO: 254474 - DNA, 20 bp, Artificial Sequence
  chemically synthesized
aaattagccgggcatggtgg

SEQ ID NO: 254475 - DNA, 20 bp, Artificial Sequence
  chemically synthesized
caggcgcccgccaccatgcc

SEQ ID NO: 254476 - DNA, 20 bp, Artificial Sequence
  chemically synthesized
aaaaaattagccgggcatgg

SEQ ID NO: 254477 - DNA, 20 bp, Artificial Sequence
  chemically synthesized
tacaaaaaattagccgggca

SEQ ID NO: 254478 - DNA, 20 bp, Artificial Sequence
  chemically synthesized
aaaaatacaaaaaattagcc

SEQ ID NO: 254479 - DNA, 20 bp, Artificial Sequence
  chemically synthesized
taaaaatacaaaaaattagc

SEQ ID NO: 254480 - DNA, 20 bp, Artificial Sequence
  chemically synthesized
ctactaaaaatacaaaaaat

SEQ ID NO: 254481 - DNA, 20 bp, Artificial Sequence
  chemically synthesized
cggctaattttttgtatttt

SEQ ID NO: 254482 - DNA, 20 bp, Artificial Sequence
  chemically synthesized
ctaattttttgtatttttag

SEQ ID NO: 254483 - DNA, 20 bp, Artificial Sequence
  chemically synthesized
aattttttgtatttttagta

SEQ ID NO: 254484 - DNA, 20 bp, Artificial Sequence
  chemically synthesized
tttgtatttttagtagagat

SEQ ID NO: 254485 - DNA, 20 bp, Artificial Sequence
  chemically synthesized
ttgtatttttagtagagatc

SEQ ID NO: 254486 - DNA, 20 bp, Artificial Sequence
  chemically synthesized
gagatcgggttccattacgt

SEQ ID NO: 254487 - DNA, 20 bp, Artificial Sequence
  chemically synthesized
taccagcctggccaacgtaa

SEQ ID NO: 254488 - DNA, 20 bp, Artificial Sequence
  chemically synthesized
tcgggttccattacgttggc

SEQ ID NO: 254489 - DNA, 20 bp, Artificial Sequence
  chemically synthesized
cgggttccattacgttggcc

SEQ ID NO: 254490 - DNA, 20 bp, Artificial Sequence
  chemically synthesized
ttccattacgttggccaggc

SEQ ID NO: 254491 - DNA, 20 bp, Artificial Sequence
  chemically synthesized
tcaggagttcaataccagcc

SEQ ID NO: 254492 - DNA, 20 bp, Artificial Sequence
  chemically synthesized
cagggtcaggagttcaatac

SEQ ID NO: 254493 - DNA, 20 bp, Artificial Sequence
  chemically synthesized
gcgggtgaccacagggtcag

SEQ ID NO: 254494 - DNA, 20 bp, Artificial Sequence
  chemically synthesized
gtattgaactcctgaccctg

SEQ ID NO: 254495 - DNA, 20 bp, Artificial Sequence
  chemically synthesized
aggcgggtgaccacagggtc

SEQ ID NO: 254496 - DNA, 20 bp, Artificial Sequence
  chemically synthesized
aaggcgggtgaccacagggt

SEQ ID NO: 254497 - DNA, 20 bp, Artificial Sequence
  chemically synthesized
ggccaaggcgggtgaccaca

SEQ ID NO: 254498 - DNA, 20 bp, Artificial Sequence
  chemically synthesized
aggccaaggcgggtgaccac

SEQ ID NO: 254499 - DNA, 20 bp, Artificial Sequence
  chemically synthesized
gaggccaaggcgggtgacca

SEQ ID NO: 254500 - DNA, 20 bp, Artificial Sequence
  chemically synthesized
gaccctgtggtcacccgcct

SEQ ID NO: 254501 - DNA, 20 bp, Artificial Sequence
  chemically synthesized
gcactttgggaggccaaggc

SEQ ID NO: 254502 - DNA, 20 bp, Artificial Sequence
  chemically synthesized
agcactttgggaggccaagg

SEQ ID NO: 254503 - DNA, 20 bp, Artificial Sequence
  chemically synthesized
cccagcactttgggaggcca

SEQ ID NO: 254504 - DNA, 20 bp, Artificial Sequence
  chemically synthesized
tcccagcactttgggaggcc

SEQ ID NO: 254505 - DNA, 20 bp, Artificial Sequence
  chemically synthesized
tcacccgccttggcctccca

SEQ ID NO: 254506 - DNA, 20 bp, Artificial Sequence
  chemically synthesized
tgtaatcccagcactttggg

SEQ ID NO: 254507 - DNA, 20 bp, Artificial Sequence
  chemically synthesized
ctgtaatcccagcactttgg

SEQ ID NO: 254508 - DNA, 20 bp, Artificial Sequence
  chemically synthesized
gccttggcctcccaaagtgc

SEQ ID NO: 254509 - DNA, 20 bp, Artificial Sequence
  chemically synthesized
gcctgtaatcccagcacttt

SEQ ID NO: 254510 - DNA, 20 bp, Artificial Sequence
  chemically synthesized
ccttggcctcccaaagtgct

SEQ ID NO: 254511 - DNA, 20 bp, Artificial Sequence
  chemically synthesized
cgcctgtaatcccagcactt

SEQ ID NO: 254512 - DNA, 20 bp, Artificial Sequence
  chemically synthesized
ctcccaaagtgctgggatta

SEQ ID NO: 254513 - DNA, 20 bp, Artificial Sequence
  chemically synthesized
tcccaaagtgctgggattac

SEQ ID NO: 254514 - DNA, 20 bp, Artificial Sequence
  chemically synthesized
gtggctcacgcctgtaatcc

SEQ ID NO: 254515 - DNA, 20 bp, Artificial Sequence
  chemically synthesized
agtgctgggattacaggcgt

SEQ ID NO: 254516 - DNA, 20 bp, Artificial Sequence
  chemically synthesized
caggcgtgagccaccgcgcc

SEQ ID NO: 254517 - DNA, 20 bp, Artificial Sequence
  chemically synthesized
ctgtctcaggctgggcgcgg

SEQ ID NO: 254518 - DNA, 20 bp, Artificial Sequence
  chemically synthesized
tgactgtctcaggctgggcg

SEQ ID NO: 254519 - DNA, 20 bp, Artificial Sequence
  chemically synthesized
tgagccaccgcgcccagcct

SEQ ID NO: 254520 - DNA, 20 bp, Artificial Sequence
  chemically synthesized
atatatgactgtctcaggct

SEQ ID NO: 254521 - DNA, 20 bp, Artificial Sequence
  chemically synthesized
aatatatgactgtctcaggc

SEQ ID NO: 254522 - DNA, 20 bp, Artificial Sequence
  chemically synthesized
ccaccgcgcccagcctgaga

SEQ ID NO: 254523 - DNA, 20 bp, Artificial Sequence
  chemically synthesized
atataatatatgactgtctc

SEQ ID NO: 254524 - DNA, 20 bp, Artificial Sequence
  chemically synthesized
gatataatatatgactgtct

SEQ ID NO: 254525 - DNA, 20 bp, Artificial Sequence
  chemically synthesized
gacagtcatatattatatct

SEQ ID NO: 254526 - DNA, 20 bp, Artificial Sequence
  chemically synthesized
acagtcatatattatatctt

SEQ ID NO: 254527 - DNA, 20 bp, Artificial Sequence
  chemically synthesized
tggatcactagtatataccc

SEQ ID NO: 254528 - DNA, 20 bp, Artificial Sequence
  chemically synthesized
attatatcttgggtatatac

SEQ ID NO: 254529 - DNA, 20 bp, Artificial Sequence
  chemically synthesized
ttgggtatatactagtgatc

SEQ ID NO: 254530 - DNA, 20 bp, Artificial Sequence
  chemically synthesized
gcttttgctttctggatcac

SEQ ID NO: 254531 - DNA, 20 bp, Artificial Sequence
  chemically synthesized
gtatatactagtgatccaga

SEQ ID NO: 254532 - DNA, 20 bp, Artificial Sequence
  chemically synthesized
agagcggggcttttgctttc

SEQ ID NO: 254533 - DNA, 20 bp, Artificial Sequence
  chemically synthesized
actagtgatccagaaagcaa

SEQ ID NO: 254534 - DNA, 20 bp, Artificial Sequence
  chemically synthesized
aaagcaaaagccccgctctc

SEQ ID NO: 254535 - DNA, 20 bp, Artificial Sequence
  chemically synthesized
aggtgagattccagagagcg

SEQ ID NO: 254536 - DNA, 20 bp, Artificial Sequence
  chemically synthesized
aaggtgagattccagagagc

SEQ ID NO: 254537 - DNA, 20 bp, Artificial Sequence
  chemically synthesized
gaaggtgagattccagagag

SEQ ID NO: 254538 - DNA, 20 bp, Artificial Sequence
  chemically synthesized
gtagaaggtgagattccaga

SEQ ID NO: 254539 - DNA, 20 bp, Artificial Sequence
  chemically synthesized
ctgtagaaggtgagattcca

SEQ ID NO: 254540 - DNA, 20 bp, Artificial Sequence
  chemically synthesized
tcctgtagaaggtgagattc

SEQ ID NO: 254541 - DNA, 20 bp, Artificial Sequence
  chemically synthesized
tttattctcctgtagaaggt

SEQ ID NO: 254542 - DNA, 20 bp, Artificial Sequence
  chemically synthesized
ctctggaatctcaccttcta

SEQ ID NO: 254543 - DNA, 20 bp, Artificial Sequence
  chemically synthesized
tctggaatctcaccttctac

SEQ ID NO: 254544 - DNA, 20 bp, Artificial Sequence
  chemically synthesized
tggaatctcaccttctacag

SEQ ID NO: 254545 - DNA, 20 bp, Artificial Sequence
  chemically synthesized
ttactttattctcctgtaga

SEQ ID NO: 254546 - DNA, 20 bp, Artificial Sequence
  chemically synthesized
tttactttattctcctgtag

SEQ ID NO: 254547 - DNA, 20 bp, Artificial Sequence
  chemically synthesized
ttgtttactttattctcctg

SEQ ID NO: 254548 - DNA, 20 bp, Artificial Sequence
  chemically synthesized
tcaccttctacaggagaata

SEQ ID NO: 254549 - DNA, 20 bp, Artificial Sequence
  chemically synthesized
aggagaataaagtaaacaaa

SEQ ID NO: 254550 - DNA, 20 bp, Artificial Sequence
  chemically synthesized
gagaataaagtaaacaaata

SEQ ID NO: 254551 - DNA, 20 bp, Artificial Sequence
  chemically synthesized
atctaactgagtatatagtt

SEQ ID NO: 254552 - DNA, 20 bp, Artificial Sequence
  chemically synthesized
aaatgactaaactatatact

SEQ ID NO: 254553 - DNA, 20 bp, Artificial Sequence
  chemically synthesized
ccactatctaactgagtata

SEQ ID NO: 254554 - DNA, 20 bp, Artificial Sequence
  chemically synthesized
gactaaactatatactcagt

SEQ ID NO: 254555 - DNA, 20 bp, Artificial Sequence
  chemically synthesized
aaactatatactcagttaga

SEQ ID NO: 254556 - DNA, 20 bp, Artificial Sequence
  chemically synthesized
cacttaaccactatctaact

SEQ ID NO: 254557 - DNA, 20 bp, Artificial Sequence
  chemically synthesized
ctatatactcagttagatag

SEQ ID NO: 254558 - DNA, 20 bp, Artificial Sequence
  chemically synthesized
tactcagttagatagtggtt

SEQ ID NO: 254559 - DNA, 20 bp, Artificial Sequence
  chemically synthesized
ttagatagtggttaagtgct

SEQ ID NO: 254560 - DNA, 20 bp, Artificial Sequence
  chemically synthesized
tagatagtggttaagtgctg

SEQ ID NO: 254561 - DNA, 20 bp, Artificial Sequence
  chemically synthesized
gatagtggttaagtgctgag

SEQ ID NO: 254562 - DNA, 20 bp, Artificial Sequence
  chemically synthesized
cctgctttagttttgctcct

SEQ ID NO: 254563 - DNA, 20 bp, Artificial Sequence
  chemically synthesized
agtgctgaggagcaaaacta

SEQ ID NO: 254564 - DNA, 20 bp, Artificial Sequence
  chemically synthesized
gctgaggagcaaaactaaag

SEQ ID NO: 254565 - DNA, 20 bp, Artificial Sequence
  chemically synthesized
ctgaggagcaaaactaaagc

SEQ ID NO: 254566 - DNA, 20 bp, Artificial Sequence
  chemically synthesized
tgaggagcaaaactaaagca

SEQ ID NO: 254567 - DNA, 20 bp, Artificial Sequence
  chemically synthesized
catttcttccttccctgctt

SEQ ID NO: 254568 - DNA, 20 bp, Artificial Sequence
  chemically synthesized
ggagcaaaactaaagcaggg

SEQ ID NO: 254569 - DNA, 20 bp, Artificial Sequence
  chemically synthesized
gagcaaaactaaagcaggga

SEQ ID NO: 254570 - DNA, 20 bp, Artificial Sequence
  chemically synthesized
caaaactaaagcagggaagg

SEQ ID NO: 254571 - DNA, 20 bp, Artificial Sequence
  chemically synthesized
aagcagggaaggaagaaatg

SEQ ID NO: 254572 - DNA, 20 bp, Artificial Sequence
  chemically synthesized
agcagggaaggaagaaatga

SEQ ID NO: 254573 - DNA, 20 bp, Artificial Sequence
  chemically synthesized
gaaggaagaaatgaaggata

SEQ ID NO: 254574 - DNA, 20 bp, Artificial Sequence
  chemically synthesized
ggaagaaatgaaggataaag

SEQ ID NO: 254575 - DNA, 20 bp, Artificial Sequence
  chemically synthesized
gaagaaatgaaggataaagt

SEQ ID NO: 254576 - DNA, 20 bp, Artificial Sequence
  chemically synthesized
aagaaatgaaggataaagtg

SEQ ID NO: 254577 - DNA, 20 bp, Artificial Sequence
  chemically synthesized
agaaatgaaggataaagtgg

SEQ ID NO: 254578 - DNA, 20 bp, Artificial Sequence
  chemically synthesized
atgaaggataaagtgggggt

SEQ ID NO: 254579 - DNA, 20 bp, Artificial Sequence
  chemically synthesized
taaagtgggggtcagaattt

SEQ ID NO: 254580 - DNA, 20 bp, Artificial Sequence
  chemically synthesized
aaagtgggggtcagaatttt

SEQ ID NO: 254581 - DNA, 20 bp, Artificial Sequence
  chemically synthesized
tgggggtcagaattttaggt

SEQ ID NO: 254582 - DNA, 20 bp, Artificial Sequence
  chemically synthesized
ggggtcagaattttaggtaa

SEQ ID NO: 254583 - DNA, 20 bp, Artificial Sequence
  chemically synthesized
gggtcagaattttaggtaag

SEQ ID NO: 254584 - DNA, 20 bp, Artificial Sequence
  chemically synthesized
ggtcagaattttaggtaaga

SEQ ID NO: 254585 - DNA, 20 bp, Artificial Sequence
  chemically synthesized
gtcagaattttaggtaagag

SEQ ID NO: 254586 - DNA, 20 bp, Artificial Sequence
  chemically synthesized
gaattttaggtaagaggggt

SEQ ID NO: 254587 - DNA, 20 bp, Artificial Sequence
  chemically synthesized
aattttaggtaagaggggtc

SEQ ID NO: 254588 - DNA, 20 bp, Artificial Sequence
  chemically synthesized
attttaggtaagaggggtcg

SEQ ID NO: 254589 - DNA, 20 bp, Artificial Sequence
  chemically synthesized
ttaggtaagaggggtcgggg

SEQ ID NO: 254590 - DNA, 20 bp, Artificial Sequence
  chemically synthesized
ggggtcggggaagaccttac

SEQ ID NO: 254591 - DNA, 20 bp, Artificial Sequence
  chemically synthesized
gggtcggggaagaccttacc

SEQ ID NO: 254592 - DNA, 20 bp, Artificial Sequence
  chemically synthesized
tcggggaagaccttaccagg

SEQ ID NO: 254593 - DNA, 20 bp, Artificial Sequence
  chemically synthesized
taaaaactgccttcctggta

SEQ ID NO: 254594 - DNA, 20 bp, Artificial Sequence
  chemically synthesized
cggggaagaccttaccagga

SEQ ID NO: 254595 - DNA, 20 bp, Artificial Sequence
  chemically synthesized
ttaaaaactgccttcctggt

SEQ ID NO: 254596 - DNA, 20 bp, Artificial Sequence
  chemically synthesized
ggaagaccttaccaggaagg

SEQ ID NO: 254597 - DNA, 20 bp, Artificial Sequence
  chemically synthesized
ttacttaaaaactgccttcc

SEQ ID NO: 254598 - DNA, 20 bp, Artificial Sequence
  chemically synthesized
ttaccaggaaggcagttttt

SEQ ID NO: 254599 - DNA, 20 bp, Artificial Sequence
  chemically synthesized
aggaaggcagtttttaagta

SEQ ID NO: 254600 - DNA, 20 bp, Artificial Sequence
  chemically synthesized
agtttttaagtaaagatctg

SEQ ID NO: 254601 - DNA, 20 bp, Artificial Sequence
  chemically synthesized
gtttttaagtaaagatctga

SEQ ID NO: 254602 - DNA, 20 bp, Artificial Sequence
  chemically synthesized
gttaatttctgcatttcctt

SEQ ID NO: 254603 - DNA, 20 bp, Artificial Sequence
  chemically synthesized
gtaaagatctgaaggaaatg

SEQ ID NO: 254604 - DNA, 20 bp, Artificial Sequence
  chemically synthesized
atgcagaaattaaccattga

SEQ ID NO: 254605 - DNA, 20 bp, Artificial Sequence
  chemically synthesized
tctcatgatttttctttcaa

SEQ ID NO: 254606 - DNA, 20 bp, Artificial Sequence
  chemically synthesized
accattgaaagaaaaatcat

SEQ ID NO: 254607 - DNA, 20 bp, Artificial Sequence
  chemically synthesized
aaatcatgagaataatattc

SEQ ID NO: 254608 - DNA, 20 bp, Artificial Sequence
  chemically synthesized
catgagaataatattccaga

SEQ ID NO: 254609 - DNA, 20 bp, Artificial Sequence
  chemically synthesized
atgagaataatattccagac

SEQ ID NO: 254610 - DNA, 20 bp, Artificial Sequence
  chemically synthesized
ttatacttgctttacctgtc

SEQ ID NO: 254611 - DNA, 20 bp, Artificial Sequence
  chemically synthesized
aataatattccagacaggta

SEQ ID NO: 254612 - DNA, 20 bp, Artificial Sequence
  chemically synthesized
atattccagacaggtaaagc

SEQ ID NO: 254613 - DNA, 20 bp, Artificial Sequence
  chemically synthesized
cagacaggtaaagcaagtat

SEQ ID NO: 254614 - DNA, 20 bp, Artificial Sequence
  chemically synthesized
agacaggtaaagcaagtata

SEQ ID NO: 254615 - DNA, 20 bp, Artificial Sequence
  chemically synthesized
gacaggtaaagcaagtataa

SEQ ID NO: 254616 - DNA, 20 bp, Artificial Sequence
  chemically synthesized
aagtataagggccctgacac

SEQ ID NO: 254617 - DNA, 20 bp, Artificial Sequence
  chemically synthesized
ccaggcacattccagtgtca

SEQ ID NO: 254618 - DNA, 20 bp, Artificial Sequence
  chemically synthesized
tccaggcacattccagtgtc

SEQ ID NO: 254619 - DNA, 20 bp, Artificial Sequence
  chemically synthesized
ctccaggcacattccagtgt

SEQ ID NO: 254620 - DNA, 20 bp, Artificial Sequence
  chemically synthesized
ccactcctccaggcacattc

SEQ ID NO: 254621 - DNA, 20 bp, Artificial Sequence
  chemically synthesized
ccctgacactggaatgtgcc

SEQ ID NO: 254622 - DNA, 20 bp, Artificial Sequence
  chemically synthesized
ctgacactggaatgtgcctg

SEQ ID NO: 254623 - DNA, 20 bp, Artificial Sequence
  chemically synthesized
tgacactggaatgtgcctgg

SEQ ID NO: 254624 - DNA, 20 bp, Artificial Sequence
  chemically synthesized
acactggaatgtgcctggag

SEQ ID NO: 254625 - DNA, 20 bp, Artificial Sequence
  chemically synthesized
ctggaatgtgcctggaggag

SEQ ID NO: 254626 - DNA, 20 bp, Artificial Sequence
  chemically synthesized
tgttccttggccactcctcc

SEQ ID NO: 254627 - DNA, 20 bp, Artificial Sequence
  chemically synthesized
atgttccttggccactcctc

SEQ ID NO: 254628 - DNA, 20 bp, Artificial Sequence
  chemically synthesized
atgtgcctggaggagtggcc

SEQ ID NO: 254629 - DNA, 20 bp, Artificial Sequence
  chemically synthesized
tgtgcctggaggagtggcca

SEQ ID NO: 254630 - DNA, 20 bp, Artificial Sequence
  chemically synthesized
ggaggagtggccaaggaaca

SEQ ID NO: 254631 - DNA, 20 bp, Artificial Sequence
  chemically synthesized
atcacttcctccatgttcct

SEQ ID NO: 254632 - DNA, 20 bp, Artificial Sequence
  chemically synthesized
aggagtggccaaggaacatg

SEQ ID NO: 254633 - DNA, 20 bp, Artificial Sequence
  chemically synthesized
ggagtggccaaggaacatgg

SEQ ID NO: 254634 - DNA, 20 bp, Artificial Sequence
  chemically synthesized
gtggccaaggaacatggagg

SEQ ID NO: 254635 - DNA, 20 bp, Artificial Sequence
  chemically synthesized
gaacatggaggaagtgatta

SEQ ID NO: 254636 - DNA, 20 bp, Artificial Sequence
  chemically synthesized
atggaggaagtgattatggc

SEQ ID NO: 254637 - DNA, 20 bp, Artificial Sequence
  chemically synthesized
ggaggaagtgattatggctg

SEQ ID NO: 254638 - DNA, 20 bp, Artificial Sequence
  chemically synthesized
agtcgctagctcatacactc

SEQ ID NO: 254639 - DNA, 20 bp, Artificial Sequence
  chemically synthesized
tgattatggctggagtgtat

SEQ ID NO: 254640 - DNA, 20 bp, Artificial Sequence
  chemically synthesized
tatggctggagtgtatgagc

SEQ ID NO: 254641 - DNA, 20 bp, Artificial Sequence
  chemically synthesized
gatatttctctggtagtcgc

SEQ ID NO: 254642 - DNA, 20 bp, Artificial Sequence
  chemically synthesized
gtgtatgagctagcgactac

SEQ ID NO: 254643 - DNA, 20 bp, Artificial Sequence
  chemically synthesized
gtatgagctagcgactacca

SEQ ID NO: 254644 - DNA, 20 bp, Artificial Sequence
  chemically synthesized
attctctgatatttctctgg

SEQ ID NO: 254645 - DNA, 20 bp, Artificial Sequence
  chemically synthesized
cccattctctgatatttctc

SEQ ID NO: 254646 - DNA, 20 bp, Artificial Sequence
  chemically synthesized
agcgactaccagagaaatat

SEQ ID NO: 254647 - DNA, 20 bp, Artificial Sequence
  chemically synthesized
cgactaccagagaaatatca

SEQ ID NO: 254648 - DNA, 20 bp, Artificial Sequence
  chemically synthesized
accagagaaatatcagagaa

SEQ ID NO: 254649 - DNA, 20 bp, Artificial Sequence
  chemically synthesized
ccagagaaatatcagagaat

SEQ ID NO: 254650 - DNA, 20 bp, Artificial Sequence
  chemically synthesized
cagagaaatatcagagaatg

SEQ ID NO: 254651 - DNA, 20 bp, Artificial Sequence
  chemically synthesized
agaaatatcagagaatgggg

SEQ ID NO: 254652 - DNA, 20 bp, Artificial Sequence
  chemically synthesized
gaaatatcagagaatggggt

SEQ ID NO: 254653 - DNA, 20 bp, Artificial Sequence
  chemically synthesized
aatggggtgggtaacccatg

SEQ ID NO: 254654 - DNA, 20 bp, Artificial Sequence
  chemically synthesized
atggggtgggtaacccatga

SEQ ID NO: 254655 - DNA, 20 bp, Artificial Sequence
  chemically synthesized
atgttcataagtaccttcat

SEQ ID NO: 254656 - DNA, 20 bp, Artificial Sequence
  chemically synthesized
tatgttcataagtaccttca

SEQ ID NO: 254657 - DNA, 20 bp, Artificial Sequence
  chemically synthesized
agggaagtccttatgttcat

SEQ ID NO: 254658 - DNA, 20 bp, Artificial Sequence
  chemically synthesized
atgaaggtacttatgaacat

SEQ ID NO: 254659 - DNA, 20 bp, Artificial Sequence
  chemically synthesized
tgaaggtacttatgaacata

SEQ ID NO: 254660 - DNA, 20 bp, Artificial Sequence
  chemically synthesized
ccccctcaaagtaaacaggg

SEQ ID NO: 254661 - DNA, 20 bp, Artificial Sequence
  chemically synthesized
catccccctcaaagtaaaca

SEQ ID NO: 254662 - DNA, 20 bp, Artificial Sequence
  chemically synthesized
ccatccccctcaaagtaaac

SEQ ID NO: 254663 - DNA, 20 bp, Artificial Sequence
  chemically synthesized
cccatccccctcaaagtaaa

SEQ ID NO: 254664 - DNA, 20 bp, Artificial Sequence
  chemically synthesized
aggacttccctgtttacttt

SEQ ID NO: 254665 - DNA, 20 bp, Artificial Sequence
  chemically synthesized
ggacttccctgtttactttg

SEQ ID NO: 254666 - DNA, 20 bp, Artificial Sequence
  chemically synthesized
gacttccctgtttactttga

SEQ ID NO: 254667 - DNA, 20 bp, Artificial Sequence
  chemically synthesized
acttccctgtttactttgag

SEQ ID NO: 254668 - DNA, 20 bp, Artificial Sequence
  chemically synthesized
cttccctgtttactttgagg

SEQ ID NO: 254669 - DNA, 20 bp, Artificial Sequence
  chemically synthesized
aatgctccccatccccctca

SEQ ID NO: 254670 - DNA, 20 bp, Artificial Sequence
  chemically synthesized
cctgtttactttgaggggga

SEQ ID NO: 254671 - DNA, 20 bp, Artificial Sequence
  chemically synthesized
ctgtttactttgagggggat

SEQ ID NO: 254672 - DNA, 20 bp, Artificial Sequence
  chemically synthesized
tgtttactttgagggggatg

SEQ ID NO: 254673 - DNA, 20 bp, Artificial Sequence
  chemically synthesized
tttactttgagggggatggg

SEQ ID NO: 254674 - DNA, 20 bp, Artificial Sequence
  chemically synthesized
ttgagggggatggggagcat

SEQ ID NO: 254675 - DNA, 20 bp, Artificial Sequence
  chemically synthesized
tgagggggatggggagcatt

SEQ ID NO: 254676 - DNA, 20 bp, Artificial Sequence
  chemically synthesized
gagggggatggggagcattg

SEQ ID NO: 254677 - DNA, 20 bp, Artificial Sequence
  chemically synthesized
agggggatggggagcattgg

SEQ ID NO: 254678 - DNA, 20 bp, Artificial Sequence
  chemically synthesized
ggagcattgggggttttgaa

SEQ ID NO: 254679 - DNA, 20 bp, Artificial Sequence
  chemically synthesized
gcattgggggttttgaacag

SEQ ID NO: 254680 - DNA, 20 bp, Artificial Sequence
  chemically synthesized
ttgggggttttgaacagaag

SEQ ID NO: 254681 - DNA, 20 bp, Artificial Sequence
  chemically synthesized
gggttttgaacagaagcaga

SEQ ID NO: 254682 - DNA, 20 bp, Artificial Sequence
  chemically synthesized
ggttttgaacagaagcagaa

SEQ ID NO: 254683 - DNA, 20 bp, Artificial Sequence
  chemically synthesized
gttttgaacagaagcagaaa

SEQ ID NO: 254684 - DNA, 20 bp, Artificial Sequence
  chemically synthesized
ttttgaacagaagcagaaag

SEQ ID NO: 254685 - DNA, 20 bp, Artificial Sequence
  chemically synthesized
tttgaacagaagcagaaagg

SEQ ID NO: 254686 - DNA, 20 bp, Artificial Sequence
  chemically synthesized
tacctatttaaatggaaagt

SEQ ID NO: 254687 - DNA, 20 bp, Artificial Sequence
  chemically synthesized
gagatacctatttaaatgga

SEQ ID NO: 254688 - DNA, 20 bp, Artificial Sequence
  chemically synthesized
aatctgactttccatttaaa

SEQ ID NO: 254689 - DNA, 20 bp, Artificial Sequence
  chemically synthesized
atctgactttccatttaaat

SEQ ID NO: 254690 - DNA, 20 bp, Artificial Sequence
  chemically synthesized
gccagagatacctatttaaa

SEQ ID NO: 254691 - DNA, 20 bp, Artificial Sequence
  chemically synthesized
tccatttaaataggtatctc

SEQ ID NO: 254692 - DNA, 20 bp, Artificial Sequence
  chemically synthesized
tttaaataggtatctctggc

SEQ ID NO: 254693 - DNA, 20 bp, Artificial Sequence
  chemically synthesized
tactgtcaatatactagcca

SEQ ID NO: 254694 - DNA, 20 bp, Artificial Sequence
  chemically synthesized
tctactgtcaatatactagc

SEQ ID NO: 254695 - DNA, 20 bp, Artificial Sequence
  chemically synthesized
agactctactgtcaatatac

SEQ ID NO: 254696 - DNA, 20 bp, Artificial Sequence
  chemically synthesized
atctctggctagtatattga

SEQ ID NO: 254697 - DNA, 20 bp, Artificial Sequence
  chemically synthesized
tctggctagtatattgacag

SEQ ID NO: 254698 - DNA, 20 bp, Artificial Sequence
  chemically synthesized
tggctagtatattgacagta

SEQ ID NO: 254699 - DNA, 20 bp, Artificial Sequence
  chemically synthesized
tatattgacagtagagtcta

SEQ ID NO: 254700 - DNA, 20 bp, Artificial Sequence
  chemically synthesized
atattgacagtagagtctac

SEQ ID NO: 254701 - DNA, 20 bp, Artificial Sequence
  chemically synthesized
tattgacagtagagtctaca

SEQ ID NO: 254702 - DNA, 20 bp, Artificial Sequence
  chemically synthesized
attgacagtagagtctacag

SEQ ID NO: 254703 - DNA, 20 bp, Artificial Sequence
  chemically synthesized
tgacagtagagtctacaggg

SEQ ID NO: 254704 - DNA, 20 bp, Artificial Sequence
  chemically synthesized
cctcattgccttctcccctg

SEQ ID NO: 254705 - DNA, 20 bp, Artificial Sequence
  chemically synthesized
cagtagagtctacaggggag

SEQ ID NO: 254706 - DNA, 20 bp, Artificial Sequence
  chemically synthesized
agtagagtctacaggggaga

SEQ ID NO: 254707 - DNA, 20 bp, Artificial Sequence
  chemically synthesized
tctacaggggagaaggcaat

SEQ ID NO: 254708 - DNA, 20 bp, Artificial Sequence
  chemically synthesized
ctacaggggagaaggcaatg

SEQ ID NO: 254709 - DNA, 20 bp, Artificial Sequence
  chemically synthesized
tacaggggagaaggcaatga

SEQ ID NO: 254710 - DNA, 20 bp, Artificial Sequence
  chemically synthesized
acaggggagaaggcaatgag

SEQ ID NO: 254711 - DNA, 20 bp, Artificial Sequence
  chemically synthesized
caggggagaaggcaatgagg

SEQ ID NO: 254712 - DNA, 20 bp, Artificial Sequence
  chemically synthesized
atgagggggaaacttgttaa

SEQ ID NO: 254713 - DNA, 20 bp, Artificial Sequence
  chemically synthesized
gattgcagttgtctattaac

SEQ ID NO: 254714 - DNA, 20 bp, Artificial Sequence
  chemically synthesized
atctccagcatggatgattg

SEQ ID NO: 254715 - DNA, 20 bp, Artificial Sequence
  chemically synthesized
acaactgcaatcatccatgc

SEQ ID NO: 254716 - DNA, 20 bp, Artificial Sequence
  chemically synthesized
aactgcaatcatccatgctg

SEQ ID NO: 254717 - DNA, 20 bp, Artificial Sequence
  chemically synthesized
aagcaccatcatctccagca

SEQ ID NO: 254718 - DNA, 20 bp, Artificial Sequence
  chemically synthesized
atcatccatgctggagatga

SEQ ID NO: 254719 - DNA, 20 bp, Artificial Sequence
  chemically synthesized
atccaaagcaccatcatctc

SEQ ID NO: 254720 - DNA, 20 bp, Artificial Sequence
  chemically synthesized
tgctggagatgatggtgctt

SEQ ID NO: 254721 - DNA, 20 bp, Artificial Sequence
  chemically synthesized
gagatgatggtgctttggat

SEQ ID NO: 254722 - DNA, 20 bp, Artificial Sequence
  chemically synthesized
gatgatggtgctttggatca

SEQ ID NO: 254723 - DNA, 20 bp, Artificial Sequence
  chemically synthesized
cctgcctccactctgatcca

SEQ ID NO: 254724 - DNA, 20 bp, Artificial Sequence
  chemically synthesized
gatggtgctttggatcagag

SEQ ID NO: 254725 - DNA, 20 bp, Artificial Sequence
  chemically synthesized
tggtgctttggatcagagtg

SEQ ID NO: 254726 - DNA, 20 bp, Artificial Sequence
  chemically synthesized
ggtgctttggatcagagtgg

SEQ ID NO: 254727 - DNA, 20 bp, Artificial Sequence
  chemically synthesized
gctttggatcagagtggagg

SEQ ID NO: 254728 - DNA, 20 bp, Artificial Sequence
  chemically synthesized
ctttggatcagagtggaggc

SEQ ID NO: 254729 - DNA, 20 bp, Artificial Sequence
  chemically synthesized
tttggatcagagtggaggca

SEQ ID NO: 254730 - DNA, 20 bp, Artificial Sequence
  chemically synthesized
gtggaggcagggttgaattc

SEQ ID NO: 254731 - DNA, 20 bp, Artificial Sequence
  chemically synthesized
ttctgcctttacaatgtatc

SEQ ID NO: 254732 - DNA, 20 bp, Artificial Sequence
  chemically synthesized
tgaattccggatacattgta

SEQ ID NO: 254733 - DNA, 20 bp, Artificial Sequence
  chemically synthesized
gaattccggatacattgtaa

SEQ ID NO: 254734 - DNA, 20 bp, Artificial Sequence
  chemically synthesized
ttccggatacattgtaaagg

SEQ ID NO: 254735 - DNA, 20 bp, Artificial Sequence
  chemically synthesized
cattgtaaaggcagaatcct

SEQ ID NO: 254736 - DNA, 20 bp, Artificial Sequence
  chemically synthesized
attgtaaaggcagaatcctt

SEQ ID NO: 254737 - DNA, 20 bp, Artificial Sequence
  chemically synthesized
aaggcagaatccttaggatt

SEQ ID NO: 254738 - DNA, 20 bp, Artificial Sequence
  chemically synthesized
taattggccaccaaatccta

SEQ ID NO: 254739 - DNA, 20 bp, Artificial Sequence
  chemically synthesized
gtaattggccaccaaatcct

SEQ ID NO: 254740 - DNA, 20 bp, Artificial Sequence
  chemically synthesized
gcagaatccttaggatttgg

SEQ ID NO: 254741 - DNA, 20 bp, Artificial Sequence
  chemically synthesized
tctaccaacacacatgtaat

SEQ ID NO: 254742 - DNA, 20 bp, Artificial Sequence
  chemically synthesized
gtggccaattacatgtgtgt

SEQ ID NO: 254743 - DNA, 20 bp, Artificial Sequence
  chemically synthesized
gccaattacatgtgtgttgg

SEQ ID NO: 254744 - DNA, 20 bp, Artificial Sequence
  chemically synthesized
caattacatgtgtgttggta

SEQ ID NO: 254745 - DNA, 20 bp, Artificial Sequence
  chemically synthesized
tacatgtgtgttggtagaga

SEQ ID NO: 254746 - DNA, 20 bp, Artificial Sequence
  chemically synthesized
acatgtgtgttggtagagaa

SEQ ID NO: 254747 - DNA, 20 bp, Artificial Sequence
  chemically synthesized
tgttggtagagaaaggcctt

SEQ ID NO: 254748 - DNA, 20 bp, Artificial Sequence
  chemically synthesized
gttggtagagaaaggcctta

SEQ ID NO: 254749 - DNA, 20 bp, Artificial Sequence
  chemically synthesized
aattcttcatgttatcctta

SEQ ID NO: 254750 - DNA, 20 bp, Artificial Sequence
  chemically synthesized
aaattcttcatgttatcctt

SEQ ID NO: 254751 - DNA, 20 bp, Artificial Sequence
  chemically synthesized
aaggccttaaggataacatg

SEQ ID NO: 254752 - DNA, 20 bp, Artificial Sequence
  chemically synthesized
aaggataacatgaagaattt

SEQ ID NO: 254753 - DNA, 20 bp, Artificial Sequence
  chemically synthesized
taacatgaagaattttggca

SEQ ID NO: 254754 - DNA, 20 bp, Artificial Sequence
  chemically synthesized
tgaagaattttggcacagac

SEQ ID NO: 254755 - DNA, 20 bp, Artificial Sequence
  chemically synthesized
agaattttggcacagacaag

SEQ ID NO: 254756 - DNA, 20 bp, Artificial Sequence
  chemically synthesized
ggcacagacaagtggaataa

SEQ ID NO: 254757 - DNA, 20 bp, Artificial Sequence
  chemically synthesized
cacagacaagtggaataatg

SEQ ID NO: 254758 - DNA, 20 bp, Artificial Sequence
  chemically synthesized
aatggagttgccattaacta

SEQ ID NO: 254759 - DNA, 20 bp, Artificial Sequence
  chemically synthesized
gttttctacactatagttaa

SEQ ID NO: 254760 - DNA, 20 bp, Artificial Sequence
  chemically synthesized
agttgccattaactatagtg

SEQ ID NO: 254761 - DNA, 20 bp, Artificial Sequence
  chemically synthesized
tcctgcagttttctacacta

SEQ ID NO: 254762 - DNA, 20 bp, Artificial Sequence
  chemically synthesized
aactatagtgtagaaaactg

SEQ ID NO: 254763 - DNA, 20 bp, Artificial Sequence
  chemically synthesized
actatagtgtagaaaactgc

SEQ ID NO: 254764 - DNA, 20 bp, Artificial Sequence
  chemically synthesized
tatagtgtagaaaactgcag

SEQ ID NO: 254765 - DNA, 20 bp, Artificial Sequence
  chemically synthesized
atagtgtagaaaactgcagg

SEQ ID NO: 254766 - DNA, 20 bp, Artificial Sequence
  chemically synthesized
accctaaccttatcctcctg

SEQ ID NO: 254767 - DNA, 20 bp, Artificial Sequence
  chemically synthesized
gtagaaaactgcaggaggat

SEQ ID NO: 254768 - DNA, 20 bp, Artificial Sequence
  chemically synthesized
tagaaaactgcaggaggata

SEQ ID NO: 254769 - DNA, 20 bp, Artificial Sequence
  chemically synthesized
aaactgcaggaggataaggt

SEQ ID NO: 254770 - DNA, 20 bp, Artificial Sequence
  chemically synthesized
aactgcaggaggataaggtt

SEQ ID NO: 254771 - DNA, 20 bp, Artificial Sequence
  chemically synthesized
actgcaggaggataaggtta

SEQ ID NO: 254772 - DNA, 20 bp, Artificial Sequence
  chemically synthesized
ggaggataaggttagggtgt

SEQ ID NO: 254773 - DNA, 20 bp, Artificial Sequence
  chemically synthesized
gattttaacatgctaaattt

SEQ ID NO: 254774 - DNA, 20 bp, Artificial Sequence
  chemically synthesized
tataataaacatcttaaatt

SEQ ID NO: 254775 - DNA, 20 bp, Artificial Sequence
  chemically synthesized
aagatgtttattatacttct

SEQ ID NO: 254776 - DNA, 20 bp, Artificial Sequence
  chemically synthesized
ccttttatatattcacttag

SEQ ID NO: 254777 - DNA, 20 bp, Artificial Sequence
  chemically synthesized
atgccttttatatattcact

SEQ ID NO: 254778 - DNA, 20 bp, Artificial Sequence
  chemically synthesized
acttctaagtgaatatataa

SEQ ID NO: 254779 - DNA, 20 bp, Artificial Sequence
  chemically synthesized
cttctaagtgaatatataaa

SEQ ID NO: 254780 - DNA, 20 bp, Artificial Sequence
  chemically synthesized
tatatatatatgtcatgatt

SEQ ID NO: 254781 - DNA, 20 bp, Artificial Sequence
  chemically synthesized
atatatatatgtcatgattc

SEQ ID NO: 254782 - DNA, 20 bp, Artificial Sequence
  chemically synthesized
atatatatgtcatgattcag

SEQ ID NO: 254783 - DNA, 20 bp, Artificial Sequence
  chemically synthesized
atatatgtcatgattcagga

SEQ ID NO: 254784 - DNA, 20 bp, Artificial Sequence
  chemically synthesized
tatatgtcatgattcaggag

SEQ ID NO: 254785 - DNA, 20 bp, Artificial Sequence
  chemically synthesized
ttcaggagaggaatcttgac

SEQ ID NO: 254786 - DNA, 20 bp, Artificial Sequence
  chemically synthesized
caggagaggaatcttgacta

SEQ ID NO: 254787 - DNA, 20 bp, Artificial Sequence
  chemically synthesized
tcaaatttatatctctagtc

SEQ ID NO: 254788 - DNA, 20 bp, Artificial Sequence
  chemically synthesized
gactctcaaatttatatctc

SEQ ID NO: 254789 - DNA, 20 bp, Artificial Sequence
  chemically synthesized
ttgactagagatataaattt

SEQ ID NO: 254790 - DNA, 20 bp, Artificial Sequence
  chemically synthesized
gactagagatataaatttga

SEQ ID NO: 254791 - DNA, 20 bp, Artificial Sequence
  chemically synthesized
gatataaatttgagagtcac

SEQ ID NO: 254792 - DNA, 20 bp, Artificial Sequence
  chemically synthesized
atataaatttgagagtcact

SEQ ID NO: 254793 - DNA, 20 bp, Artificial Sequence
  chemically synthesized
tataaatttgagagtcacta

SEQ ID NO: 254794 - DNA, 20 bp, Artificial Sequence
  chemically synthesized
ataaatttgagagtcactag

SEQ ID NO: 254795 - DNA, 20 bp, Artificial Sequence
  chemically synthesized
aagagattaaaaattacccc

SEQ ID NO: 254796 - DNA, 20 bp, Artificial Sequence
  chemically synthesized
ttttctgagcaagtttggaa

SEQ ID NO: 254797 - DNA, 20 bp, Artificial Sequence
  chemically synthesized
tattttctgagcaagtttgg

SEQ ID NO: 254798 - DNA, 20 bp, Artificial Sequence
  chemically synthesized
cagtattttctgagcaagtt

SEQ ID NO: 254799 - DNA, 20 bp, Artificial Sequence
  chemically synthesized
taatctcttccaaacttgct

SEQ ID NO: 254800 - DNA, 20 bp, Artificial Sequence
  chemically synthesized
aacatcagtattttctgagc

SEQ ID NO: 254801 - DNA, 20 bp, Artificial Sequence
  chemically synthesized
gcaaaacatcagtattttct

SEQ ID NO: 254802 - DNA, 20 bp, Artificial Sequence
  chemically synthesized
aagggaatatagcaaaacat

SEQ ID NO: 254803 - DNA, 20 bp, Artificial Sequence
  chemically synthesized
agaggtctggaaagggaata

SEQ ID NO: 254804 - DNA, 20 bp, Artificial Sequence
  chemically synthesized
gttttgctatattccctttc

SEQ ID NO: 254805 - DNA, 20 bp, Artificial Sequence
  chemically synthesized
gaagaaaagaggtctggaaa

SEQ ID NO: 254806 - DNA, 20 bp, Artificial Sequence
  chemically synthesized
ggaagaaaagaggtctggaa

SEQ ID NO: 254807 - DNA, 20 bp, Artificial Sequence
  chemically synthesized
tggaagaaaagaggtctgga

SEQ ID NO: 254808 - DNA, 20 bp, Artificial Sequence
  chemically synthesized
ggtttggaagaaaagaggtc

SEQ ID NO: 254809 - DNA, 20 bp, Artificial Sequence
  chemically synthesized
ggttgggtttggaagaaaag

SEQ ID NO: 254810 - DNA, 20 bp, Artificial Sequence
  chemically synthesized
gggttgggtttggaagaaaa

SEQ ID NO: 254811 - DNA, 20 bp, Artificial Sequence
  chemically synthesized
cagggttgggtttggaagaa

SEQ ID NO: 254812 - DNA, 20 bp, Artificial Sequence
  chemically synthesized
gtctacagggttgggtttgg

SEQ ID NO: 254813 - DNA, 20 bp, Artificial Sequence
  chemically synthesized
attgtctacagggttgggtt

SEQ ID NO: 254814 - DNA, 20 bp, Artificial Sequence
  chemically synthesized
ttcttccaaacccaaccctg

SEQ ID NO: 254815 - DNA, 20 bp, Artificial Sequence
  chemically synthesized
ctaagattgtctacagggtt

SEQ ID NO: 254816 - DNA, 20 bp, Artificial Sequence
  chemically synthesized
gctaagattgtctacagggt

SEQ ID NO: 254817 - DNA, 20 bp, Artificial Sequence
  chemically synthesized
aatggctaagattgtctaca

SEQ ID NO: 254818 - DNA, 20 bp, Artificial Sequence
  chemically synthesized
aaatggctaagattgtctac

SEQ ID NO: 254819 - DNA, 20 bp, Artificial Sequence
  chemically synthesized
gaaatggctaagattgtcta

SEQ ID NO: 254820 - DNA, 20 bp, Artificial Sequence
  chemically synthesized
cccaaccctgtagacaatct

SEQ ID NO: 254821 - DNA, 20 bp, Artificial Sequence
  chemically synthesized
tttaagtgatagaaatggct

SEQ ID NO: 254822 - DNA, 20 bp, Artificial Sequence
  chemically synthesized
tttgatttaagtgatagaaa

SEQ ID NO: 254823 - DNA, 20 bp, Artificial Sequence
  chemically synthesized
tcaaagtttgatttaagtga

SEQ ID NO: 254824 - DNA, 20 bp, Artificial Sequence
  chemically synthesized
tttgtgtcaaagtttgattt

SEQ ID NO: 254825 - DNA, 20 bp, Artificial Sequence
  chemically synthesized
ttaaatcaaactttgacaca

SEQ ID NO: 254826 - DNA, 20 bp, Artificial Sequence
  chemically synthesized
aataaaattcctttgtgtca

SEQ ID NO: 254827 - DNA, 20 bp, Artificial Sequence
  chemically synthesized
taaatcaaactttgacacaa

SEQ ID NO: 254828 - DNA, 20 bp, Artificial Sequence
  chemically synthesized
tgacacaaaggaattttatt

SEQ ID NO: 254829 - DNA, 20 bp, Artificial Sequence
  chemically synthesized
gacacaaaggaattttattt

SEQ ID NO: 254830 - DNA, 20 bp, Artificial Sequence
  chemically synthesized
acacaaaggaattttattta

SEQ ID NO: 254831 - DNA, 20 bp, Artificial Sequence
  chemically synthesized
cacaaaggaattttatttag

SEQ ID NO: 254832 - DNA, 20 bp, Artificial Sequence
  chemically synthesized
caaaggaattttatttaggg

SEQ ID NO: 254833 - DNA, 20 bp, Artificial Sequence
  chemically synthesized
aaaggaattttatttagggg

SEQ ID NO: 254834 - DNA, 20 bp, Artificial Sequence
  chemically synthesized
ggaattttatttaggggagg

SEQ ID NO: 254835 - DNA, 20 bp, Artificial Sequence
  chemically synthesized
gaattttatttaggggaggt

SEQ ID NO: 254836 - DNA, 20 bp, Artificial Sequence
  chemically synthesized
tttatttaggggaggtggga

SEQ ID NO: 254837 - DNA, 20 bp, Artificial Sequence
  chemically synthesized
ttatttaggggaggtgggaa

SEQ ID NO: 254838 - DNA, 20 bp, Artificial Sequence
  chemically synthesized
tatttaggggaggtgggaaa

SEQ ID NO: 254839 - DNA, 20 bp, Artificial Sequence
  chemically synthesized
atttaggggaggtgggaaag

SEQ ID NO: 254840 - DNA, 20 bp, Artificial Sequence
  chemically synthesized
ggggaggtgggaaaggggat

SEQ ID NO: 254841 - DNA, 20 bp, Artificial Sequence
  chemically synthesized
aaggggataagaaaaatgtc

SEQ ID NO: 254842 - DNA, 20 bp, Artificial Sequence
  chemically synthesized
ggataagaaaaatgtcaagt

SEQ ID NO: 254843 - DNA, 20 bp, Artificial Sequence
  chemically synthesized
gataagaaaaatgtcaagtt

SEQ ID NO: 254844 - DNA, 20 bp, Artificial Sequence
  chemically synthesized
taagaaaaatgtcaagttgg

SEQ ID NO: 254845 - DNA, 20 bp, Artificial Sequence
  chemically synthesized
aaaatgtcaagttgggagca

SEQ ID NO: 254846 - DNA, 20 bp, Artificial Sequence
  chemically synthesized
gagcatagattcactgctgc

SEQ ID NO: 254847 - DNA, 20 bp, Artificial Sequence
  chemically synthesized
agcatagattcactgctgct

SEQ ID NO: 254848 - DNA, 20 bp, Artificial Sequence
  chemically synthesized
gcatagattcactgctgctg

SEQ ID NO: 254849 - DNA, 20 bp, Artificial Sequence
  chemically synthesized
tctctgttgggccccagcag

SEQ ID NO: 254850 - DNA, 20 bp, Artificial Sequence
  chemically synthesized
ccttctctgttgggccccag

SEQ ID NO: 254851 - DNA, 20 bp, Artificial Sequence
  chemically synthesized
gtgccttctctgttgggccc

SEQ ID NO: 254852 - DNA, 20 bp, Artificial Sequence
  chemically synthesized
tcactgctgctggggcccaa

SEQ ID NO: 254853 - DNA, 20 bp, Artificial Sequence
  chemically synthesized
actgctgctggggcccaaca

SEQ ID NO: 254854 - DNA, 20 bp, Artificial Sequence
  chemically synthesized
gctgctggggcccaacagag

SEQ ID NO: 254855 - DNA, 20 bp, Artificial Sequence
  chemically synthesized
tgctgggtgccttctctgtt

SEQ ID NO: 254856 - DNA, 20 bp, Artificial Sequence
  chemically synthesized
ctgctggggcccaacagaga

SEQ ID NO: 254857 - DNA, 20 bp, Artificial Sequence
  chemically synthesized
ctgctgggtgccttctctgt

SEQ ID NO: 254858 - DNA, 20 bp, Artificial Sequence
  chemically synthesized
ggcccaacagagaaggcacc

SEQ ID NO: 254859 - DNA, 20 bp, Artificial Sequence
  chemically synthesized
ccaacagagaaggcacccag

SEQ ID NO: 254860 - DNA, 20 bp, Artificial Sequence
  chemically synthesized
caacagagaaggcacccagc

SEQ ID NO: 254861 - DNA, 20 bp, Artificial Sequence
  chemically synthesized
acagagaaggcacccagcag

SEQ ID NO: 254862 - DNA, 20 bp, Artificial Sequence
  chemically synthesized
cagagaaggcacccagcagg

SEQ ID NO: 254863 - DNA, 20 bp, Artificial Sequence
  chemically synthesized
gctaactccctcctcctgct

SEQ ID NO: 254864 - DNA, 20 bp, Artificial Sequence
  chemically synthesized
gagaaggcacccagcaggag

SEQ ID NO: 254865 - DNA, 20 bp, Artificial Sequence
  chemically synthesized
ggctaactccctcctcctgc

SEQ ID NO: 254866 - DNA, 20 bp, Artificial Sequence
  chemically synthesized
agaaggcacccagcaggagg

SEQ ID NO: 254867 - DNA, 20 bp, Artificial Sequence
  chemically synthesized
gaaggcacccagcaggagga

SEQ ID NO: 254868 - DNA, 20 bp, Artificial Sequence
  chemically synthesized
aggcacccagcaggaggagg

SEQ ID NO: 254869 - DNA, 20 bp, Artificial Sequence
  chemically synthesized
acccagcaggaggagggagt

SEQ ID NO: 254870 - DNA, 20 bp, Artificial Sequence
  chemically synthesized
ggagggagttagccctttga

SEQ ID NO: 254871 - DNA, 20 bp, Artificial Sequence
  chemically synthesized
aagcagaatcaaccatcaaa

SEQ ID NO: 254872 - DNA, 20 bp, Artificial Sequence
  chemically synthesized
taagcagaatcaaccatcaa

SEQ ID NO: 254873 - DNA, 20 bp, Artificial Sequence
  chemically synthesized
ttaagcagaatcaaccatca

SEQ ID NO: 254874 - DNA, 20 bp, Artificial Sequence
  chemically synthesized
tttgatggttgattctgctt

SEQ ID NO: 254875 - DNA, 20 bp, Artificial Sequence
  chemically synthesized
ttgatggttgattctgctta

SEQ ID NO: 254876 - DNA, 20 bp, Artificial Sequence
  chemically synthesized
caccttgatgtagccttaag

SEQ ID NO: 254877 - DNA, 20 bp, Artificial Sequence
  chemically synthesized
aaacaccttgatgtagcctt

SEQ ID NO: 254878 - DNA, 20 bp, Artificial Sequence
  chemically synthesized
attctgcttaaggctacatc

SEQ ID NO: 254879 - DNA, 20 bp, Artificial Sequence
  chemically synthesized
ttctgcttaaggctacatca

SEQ ID NO: 254880 - DNA, 20 bp, Artificial Sequence
  chemically synthesized
atccccaaaacaccttgatg

SEQ ID NO: 254881 - DNA, 20 bp, Artificial Sequence
  chemically synthesized
aaggctacatcaaggtgttt

SEQ ID NO: 254882 - DNA, 20 bp, Artificial Sequence
  chemically synthesized
aggctacatcaaggtgtttt

SEQ ID NO: 254883 - DNA, 20 bp, Artificial Sequence
  chemically synthesized
ggctacatcaaggtgttttg

SEQ ID NO: 254884 - DNA, 20 bp, Artificial Sequence
  chemically synthesized
tcaaggtgttttggggataa

SEQ ID NO: 254885 - DNA, 20 bp, Artificial Sequence
  chemically synthesized
tttggggataacagaaatcg

SEQ ID NO: 254886 - DNA, 20 bp, Artificial Sequence
  chemically synthesized
ggggataacagaaatcgaag

SEQ ID NO: 254887 - DNA, 20 bp, Artificial Sequence
  chemically synthesized
ataacagaaatcgaagaagc

SEQ ID NO: 254888 - DNA, 20 bp, Artificial Sequence
  chemically synthesized
acagaaatcgaagaagctag

SEQ ID NO: 254889 - DNA, 20 bp, Artificial Sequence
  chemically synthesized
aaatcgaagaagctagaaga

SEQ ID NO: 254890 - DNA, 20 bp, Artificial Sequence
  chemically synthesized
tttttccctgtactttcttc

SEQ ID NO: 254891 - DNA, 20 bp, Artificial Sequence
  chemically synthesized
gaagaagctagaagaaagta

SEQ ID NO: 254892 - DNA, 20 bp, Artificial Sequence
  chemically synthesized
aagaagctagaagaaagtac

SEQ ID NO: 254893 - DNA, 20 bp, Artificial Sequence
  chemically synthesized
agaagctagaagaaagtaca

SEQ ID NO: 254894 - DNA, 20 bp, Artificial Sequence
  chemically synthesized
aaagtacagggaaaaaattc

SEQ ID NO: 254895 - DNA, 20 bp, Artificial Sequence
  chemically synthesized
agggaaaaaattcaagtcta

SEQ ID NO: 254896 - DNA, 20 bp, Artificial Sequence
  chemically synthesized
gggaaaaaattcaagtctac

SEQ ID NO: 254897 - DNA, 20 bp, Artificial Sequence
  chemically synthesized
aaaaattcaagtctacaggt

SEQ ID NO: 254898 - DNA, 20 bp, Artificial Sequence
  chemically synthesized
tctgactgtctaccaacctg

SEQ ID NO: 254899 - DNA, 20 bp, Artificial Sequence
  chemically synthesized
aattcaagtctacaggttgg

SEQ ID NO: 254900 - DNA, 20 bp, Artificial Sequence
  chemically synthesized
caagtctacaggttggtaga

SEQ ID NO: 254901 - DNA, 20 bp, Artificial Sequence
  chemically synthesized
tctacaggttggtagacagt

SEQ ID NO: 254902 - DNA, 20 bp, Artificial Sequence
  chemically synthesized
tacaggttggtagacagtca

SEQ ID NO: 254903 - DNA, 20 bp, Artificial Sequence
  chemically synthesized
ggtagacagtcagagactct

SEQ ID NO: 254904 - DNA, 20 bp, Artificial Sequence
  chemically synthesized
caccatggcaacagaaccaa

SEQ ID NO: 254905 - DNA, 20 bp, Artificial Sequence
  chemically synthesized
cccaccatggcaacagaacc

SEQ ID NO: 254906 - DNA, 20 bp, Artificial Sequence
  chemically synthesized
gactcttggttctgttgcca

SEQ ID NO: 254907 - DNA, 20 bp, Artificial Sequence
  chemically synthesized
atataatcccaccatggcaa

SEQ ID NO: 254908 - DNA, 20 bp, Artificial Sequence
  chemically synthesized
tcttggttctgttgccatgg

SEQ ID NO: 254909 - DNA, 20 bp, Artificial Sequence
  chemically synthesized
cttggttctgttgccatggt

SEQ ID NO: 254910 - DNA, 20 bp, Artificial Sequence
  chemically synthesized
aggtgtatataatcccacca

SEQ ID NO: 254911 - DNA, 20 bp, Artificial Sequence
  chemically synthesized
gtgggattatatacaccttc

SEQ ID NO: 254912 - DNA, 20 bp, Artificial Sequence
  chemically synthesized
ttaaggaaaggttttctgga

SEQ ID NO: 254913 - DNA, 20 bp, Artificial Sequence
  chemically synthesized
gttaaggaaaggttttctgg

SEQ ID NO: 254914 - DNA, 20 bp, Artificial Sequence
  chemically synthesized
ttggttaaggaaaggttttc

SEQ ID NO: 254915 - DNA, 20 bp, Artificial Sequence
  chemically synthesized
tactctgattggttaaggaa

SEQ ID NO: 254916 - DNA, 20 bp, Artificial Sequence
  chemically synthesized
atactctgattggttaagga

SEQ ID NO: 254917 - DNA, 20 bp, Artificial Sequence
  chemically synthesized
ataaatactctgattggtta

SEQ ID NO: 254918 - DNA, 20 bp, Artificial Sequence
  chemically synthesized
aaaacctttccttaaccaat

SEQ ID NO: 254919 - DNA, 20 bp, Artificial Sequence
  chemically synthesized
aataaatactctgattggtt

SEQ ID NO: 254920 - DNA, 20 bp, Artificial Sequence
  chemically synthesized
aacctttccttaaccaatca

SEQ ID NO: 254921 - DNA, 20 bp, Artificial Sequence
  chemically synthesized
agttaaataaatactctgat

SEQ ID NO: 254922 - DNA, 20 bp, Artificial Sequence
  chemically synthesized
aatcagagtatttatttaac

SEQ ID NO: 254923 - DNA, 20 bp, Artificial Sequence
  chemically synthesized
agagtatttatttaactaga

SEQ ID NO: 254924 - DNA, 20 bp, Artificial Sequence
  chemically synthesized
tcccgatacatatttctatc

SEQ ID NO: 254925 - DNA, 20 bp, Artificial Sequence
  chemically synthesized
aactagatagaaatatgtat

SEQ ID NO: 254926 - DNA, 20 bp, Artificial Sequence
  chemically synthesized
actagatagaaatatgtatc

SEQ ID NO: 254927 - DNA, 20 bp, Artificial Sequence
  chemically synthesized
gaaatatgtatcgggaaatc

SEQ ID NO: 254928 - DNA, 20 bp, Artificial Sequence
  chemically synthesized
tgttagtgcaaaatgtggac

SEQ ID NO: 254929 - DNA, 20 bp, Artificial Sequence
  chemically synthesized
tcctgtgttagtgcaaaatg

SEQ ID NO: 254930 - DNA, 20 bp, Artificial Sequence
  chemically synthesized
gtccacattttgcactaaca

SEQ ID NO: 254931 - DNA, 20 bp, Artificial Sequence
  chemically synthesized
tccacattttgcactaacac

SEQ ID NO: 254932 - DNA, 20 bp, Artificial Sequence
  chemically synthesized
gatcacccattttcctgtgt

SEQ ID NO: 254933 - DNA, 20 bp, Artificial Sequence
  chemically synthesized
tttgcactaacacaggaaaa

SEQ ID NO: 254934 - DNA, 20 bp, Artificial Sequence
  chemically synthesized
ttgcactaacacaggaaaat

SEQ ID NO: 254935 - DNA, 20 bp, Artificial Sequence
  chemically synthesized
acacaggaaaatgggtgatc

SEQ ID NO: 254936 - DNA, 20 bp, Artificial Sequence
  chemically synthesized
cacaggaaaatgggtgatct

SEQ ID NO: 254937 - DNA, 20 bp, Artificial Sequence
  chemically synthesized
aaatgggtgatctaggatgt

SEQ ID NO: 254938 - DNA, 20 bp, Artificial Sequence
  chemically synthesized
aatgggtgatctaggatgtt

SEQ ID NO: 254939 - DNA, 20 bp, Artificial Sequence
  chemically synthesized
tcaggagatgcccaacatcc

SEQ ID NO: 254940 - DNA, 20 bp, Artificial Sequence
  chemically synthesized
taggatgttgggcatctcct

SEQ ID NO: 254941 - DNA, 20 bp, Artificial Sequence
  chemically synthesized
cattattaaagttcactcag

SEQ ID NO: 254942 - DNA, 20 bp, Artificial Sequence
  chemically synthesized
ctcattattaaagttcactc

SEQ ID NO: 254943 - DNA, 20 bp, Artificial Sequence
  chemically synthesized
tctcattattaaagttcact

SEQ ID NO: 254944 - DNA, 20 bp, Artificial Sequence
  chemically synthesized
cctgagtgaactttaataat

SEQ ID NO: 254945 - DNA, 20 bp, Artificial Sequence
  chemically synthesized
taccaggactctcattatta

SEQ ID NO: 254946 - DNA, 20 bp, Artificial Sequence
  chemically synthesized
tgagtgaactttaataatga

SEQ ID NO: 254947 - DNA, 20 bp, Artificial Sequence
  chemically synthesized
aactttaataatgagagtcc

SEQ ID NO: 254948 - DNA, 20 bp, Artificial Sequence
  chemically synthesized
taataatgagagtcctggta

SEQ ID NO: 254949 - DNA, 20 bp, Artificial Sequence
  chemically synthesized
cttgattcagtagctgtacc

SEQ ID NO: 254950 - DNA, 20 bp, Artificial Sequence
  chemically synthesized
ccttgattcagtagctgtac

SEQ ID NO: 254951 - DNA, 20 bp, Artificial Sequence
  chemically synthesized
cctggtacagctactgaatc

SEQ ID NO: 254952 - DNA, 20 bp, Artificial Sequence
  chemically synthesized
aaaccatacccttgattcag

SEQ ID NO: 254953 - DNA, 20 bp, Artificial Sequence
  chemically synthesized
ctggtacagctactgaatca

SEQ ID NO: 254954 - DNA, 20 bp, Artificial Sequence
  chemically synthesized
tggtacagctactgaatcaa

SEQ ID NO: 254955 - DNA, 20 bp, Artificial Sequence
  chemically synthesized
tataaaccatacccttgatt

SEQ ID NO: 254956 - DNA, 20 bp, Artificial Sequence
  chemically synthesized
cagctactgaatcaagggta

SEQ ID NO: 254957 - DNA, 20 bp, Artificial Sequence
  chemically synthesized
caagggtatggtttataaat

SEQ ID NO: 254958 - DNA, 20 bp, Artificial Sequence
  chemically synthesized
gtatggtttataaatcggtc

SEQ ID NO: 254959 - DNA, 20 bp, Artificial Sequence
  chemically synthesized
atatttgtgttcagcatagc

SEQ ID NO: 254960 - DNA, 20 bp, Artificial Sequence
  chemically synthesized
ggagatatttgtgttcagca

SEQ ID NO: 254961 - DNA, 20 bp, Artificial Sequence
  chemically synthesized
agtaaggagatatttgtgtt

SEQ ID NO: 254962 - DNA, 20 bp, Artificial Sequence
  chemically synthesized
gagataaaacaataagtaag

SEQ ID NO: 254963 - DNA, 20 bp, Artificial Sequence
  chemically synthesized
aagagataaaacaataagta

SEQ ID NO: 254964 - DNA, 20 bp, Artificial Sequence
  chemically synthesized
aaagagataaaacaataagt

SEQ ID NO: 254965 - DNA, 20 bp, Artificial Sequence
  chemically synthesized
aaataaagagataaaacaat

SEQ ID NO: 254966 - DNA, 20 bp, Artificial Sequence
  chemically synthesized
tggacacaaggaaaaataaa

SEQ ID NO: 254967 - DNA, 20 bp, Artificial Sequence
  chemically synthesized
attggacacaaggaaaaata

SEQ ID NO: 254968 - DNA, 20 bp, Artificial Sequence
  chemically synthesized
ggcaggataaattggacaca

SEQ ID NO: 254969 - DNA, 20 bp, Artificial Sequence
  chemically synthesized
tggcaggataaattggacac

SEQ ID NO: 254970 - DNA, 20 bp, Artificial Sequence
  chemically synthesized
cttaaaatggcaggataaat

SEQ ID NO: 254971 - DNA, 20 bp, Artificial Sequence
  chemically synthesized
gggataatccttaaaatggc

SEQ ID NO: 254972 - DNA, 20 bp, Artificial Sequence
  chemically synthesized
ccaatttatcctgccatttt

SEQ ID NO: 254973 - DNA, 20 bp, Artificial Sequence
  chemically synthesized
agggataatccttaaaatgg

SEQ ID NO: 254974 - DNA, 20 bp, Artificial Sequence
  chemically synthesized
caatttatcctgccatttta

SEQ ID NO: 254975 - DNA, 20 bp, Artificial Sequence
  chemically synthesized
gtcagggataatccttaaaa

SEQ ID NO: 254976 - DNA, 20 bp, Artificial Sequence
  chemically synthesized
tcatggatggattttggtca

SEQ ID NO: 254977 - DNA, 20 bp, Artificial Sequence
  chemically synthesized
atcatggatggattttggtc

SEQ ID NO: 254978 - DNA, 20 bp, Artificial Sequence
  chemically synthesized
catcatggatggattttggt

SEQ ID NO: 254979 - DNA, 20 bp, Artificial Sequence
  chemically synthesized
atgtcatcatggatggattt

SEQ ID NO: 254980 - DNA, 20 bp, Artificial Sequence
  chemically synthesized
aagctatatgtcatcatgga

SEQ ID NO: 254981 - DNA, 20 bp, Artificial Sequence
  chemically synthesized
caaaaagctatatgtcatca

SEQ ID NO: 254982 - DNA, 20 bp, Artificial Sequence
  chemically synthesized
aatccatccatgatgacata

SEQ ID NO: 254983 - DNA, 20 bp, Artificial Sequence
  chemically synthesized
catgatgacatatagctttt

SEQ ID NO: 254984 - DNA, 20 bp, Artificial Sequence
  chemically synthesized
tgggcttgaaagtgtccaaa

SEQ ID NO: 254985 - DNA, 20 bp, Artificial Sequence
  chemically synthesized
atagctttttggacactttc

SEQ ID NO: 254986 - DNA, 20 bp, Artificial Sequence
  chemically synthesized
gggctaaaagatgggcttga

SEQ ID NO: 254987 - DNA, 20 bp, Artificial Sequence
  chemically synthesized
acactttcaagcccatcttt

SEQ ID NO: 254988 - DNA, 20 bp, Artificial Sequence
  chemically synthesized
aaaaagatgggctaaaagat

SEQ ID NO: 254989 - DNA, 20 bp, Artificial Sequence
  chemically synthesized
aaaaaagatgggctaaaaga

SEQ ID NO: 254990 - DNA, 20 bp, Artificial Sequence
  chemically synthesized
tggaaaaaaagatgggctaa

SEQ ID NO: 254991 - DNA, 20 bp, Artificial Sequence
  chemically synthesized
tttttcctggaaaaaaagat

SEQ ID NO: 254992 - DNA, 20 bp, Artificial Sequence
  chemically synthesized
ttttttcctggaaaaaaaga

SEQ ID NO: 254993 - DNA, 20 bp, Artificial Sequence
  chemically synthesized
ttttagcccatctttttttc

SEQ ID NO: 254994 - DNA, 20 bp, Artificial Sequence
  chemically synthesized
tttagcccatctttttttcc

SEQ ID NO: 254995 - DNA, 20 bp, Artificial Sequence
  chemically synthesized
tcttttttttcctggaaaaa

SEQ ID NO: 254996 - DNA, 20 bp, Artificial Sequence
  chemically synthesized
cagttttttcttttttttcc

SEQ ID NO: 254997 - DNA, 20 bp, Artificial Sequence
  chemically synthesized
tctttttttccaggaaaaaa

SEQ ID NO: 254998 - DNA, 20 bp, Artificial Sequence
  chemically synthesized
caggaaaaaaaagaaaaaac

SEQ ID NO: 254999 - DNA, 20 bp, Artificial Sequence
  chemically synthesized
aaaagaaaaaactggattca

SEQ ID NO: 255000 - DNA, 20 bp, Artificial Sequence
  chemically synthesized
ttggataaaaactgtgaatc

SEQ ID NO: 255001 - DNA, 20 bp, Artificial Sequence
  chemically synthesized
aaagcactaggaaatcaagt

SEQ ID NO: 255002 - DNA, 20 bp, Artificial Sequence
  chemically synthesized
ttttatccaacttgatttcc

SEQ ID NO: 255003 - DNA, 20 bp, Artificial Sequence
  chemically synthesized
tggcaaagcactaggaaatc

SEQ ID NO: 255004 - DNA, 20 bp, Artificial Sequence
  chemically synthesized
gtctctgctggcaaagcact

SEQ ID NO: 255005 - DNA, 20 bp, Artificial Sequence
  chemically synthesized
tgtctctgctggcaaagcac

SEQ ID NO: 255006 - DNA, 20 bp, Artificial Sequence
  chemically synthesized
ttgatttcctagtgctttgc

SEQ ID NO: 255007 - DNA, 20 bp, Artificial Sequence
  chemically synthesized
atttcctagtgctttgccag

SEQ ID NO: 255008 - DNA, 20 bp, Artificial Sequence
  chemically synthesized
ttcaagtgtctctgctggca

SEQ ID NO: 255009 - DNA, 20 bp, Artificial Sequence
  chemically synthesized
ttcctagtgctttgccagca

SEQ ID NO: 255010 - DNA, 20 bp, Artificial Sequence
  chemically synthesized
atcctttcaagtgtctctgc

SEQ ID NO: 255011 - DNA, 20 bp, Artificial Sequence
  chemically synthesized
ttgccagcagagacacttga

SEQ ID NO: 255012 - DNA, 20 bp, Artificial Sequence
  chemically synthesized
tgccagcagagacacttgaa

SEQ ID NO: 255013 - DNA, 20 bp, Artificial Sequence
  chemically synthesized
ttcactttgattatcctttc

SEQ ID NO: 255014 - DNA, 20 bp, Artificial Sequence
  chemically synthesized
gacacttgaaaggataatca

SEQ ID NO: 255015 - DNA, 20 bp, Artificial Sequence
  chemically synthesized
gataatcaaagtgaataaca

SEQ ID NO: 255016 - DNA, 20 bp, Artificial Sequence
  chemically synthesized
tcaaagtgaataacaaagtg

SEQ ID NO: 255017 - DNA, 20 bp, Artificial Sequence
  chemically synthesized
caaagtgaataacaaagtga

SEQ ID NO: 255018 - DNA, 20 bp, Artificial Sequence
  chemically synthesized
tgtgtctgaagaataacaaa

SEQ ID NO: 255019 - DNA, 20 bp, Artificial Sequence
  chemically synthesized
gatgtgtctgaagaataaca

SEQ ID NO: 255020 - DNA, 20 bp, Artificial Sequence
  chemically synthesized
ttaatctctttgttattctt

SEQ ID NO: 255021 - DNA, 20 bp, Artificial Sequence
  chemically synthesized
gtatcagaaggatgtgtctg

SEQ ID NO: 255022 - DNA, 20 bp, Artificial Sequence
  chemically synthesized
aaaaaaaaaattgtatcaga

SEQ ID NO: 255023 - DNA, 20 bp, Artificial Sequence
  chemically synthesized
aaaaaaaaaaattgtatcag

SEQ ID NO: 255024 - DNA, 20 bp, Artificial Sequence
  chemically synthesized
aaaaaaaaaaaaaattgtat

SEQ ID NO: 255025 - DNA, 20 bp, Artificial Sequence
  chemically synthesized
taaagatacaaagtcagtaa

SEQ ID NO: 255026 - DNA, 20 bp, Artificial Sequence
  chemically synthesized
ttaaagatacaaagtcagta

SEQ ID NO: 255027 - DNA, 20 bp, Artificial Sequence
  chemically synthesized
gttaaagatacaaagtcagt

SEQ ID NO: 255028 - DNA, 20 bp, Artificial Sequence
  chemically synthesized
caaagttaaagatacaaagt

SEQ ID NO: 255029 - DNA, 20 bp, Artificial Sequence
  chemically synthesized
ttttcaaagttaaagataca

SEQ ID NO: 255030 - DNA, 20 bp, Artificial Sequence
  chemically synthesized
agaaaatgttttcaaagtta

SEQ ID NO: 255031 - DNA, 20 bp, Artificial Sequence
  chemically synthesized
tgatgcagaaaatgttttca

SEQ ID NO: 255032 - DNA, 20 bp, Artificial Sequence
  chemically synthesized
ttgaaaacattttctgcatc

SEQ ID NO: 255033 - DNA, 20 bp, Artificial Sequence
  chemically synthesized
cgctatacagtttcttgatg

SEQ ID NO: 255034 - DNA, 20 bp, Artificial Sequence
  chemically synthesized
ttctgcatcaagaaactgta

SEQ ID NO: 255035 - DNA, 20 bp, Artificial Sequence
  chemically synthesized
catcaagaaactgtatagcg

SEQ ID NO: 255036 - DNA, 20 bp, Artificial Sequence
  chemically synthesized
ctcttaagcactacgctata

SEQ ID NO: 255037 - DNA, 20 bp, Artificial Sequence
  chemically synthesized
aactgtatagcgtagtgctt

SEQ ID NO: 255038 - DNA, 20 bp, Artificial Sequence
  chemically synthesized
ctgtatagcgtagtgcttaa

SEQ ID NO: 255039 - DNA, 20 bp, Artificial Sequence
  chemically synthesized
tatagcgtagtgcttaagag

SEQ ID NO: 255040 - DNA, 20 bp, Artificial Sequence
  chemically synthesized
gctccagagtttctgctctt

SEQ ID NO: 255041 - DNA, 20 bp, Artificial Sequence
  chemically synthesized
gtgcttaagagcagaaactc

SEQ ID NO: 255042 - DNA, 20 bp, Artificial Sequence
  chemically synthesized
gcttaagagcagaaactctg

SEQ ID NO: 255043 - DNA, 20 bp, Artificial Sequence
  chemically synthesized
ctctggatgttcaagctcca

SEQ ID NO: 255044 - DNA, 20 bp, Artificial Sequence
  chemically synthesized
cactctggatgttcaagctc

SEQ ID NO: 255045 - DNA, 20 bp, Artificial Sequence
  chemically synthesized
aactctggagcttgaacatc

SEQ ID NO: 255046 - DNA, 20 bp, Artificial Sequence
  chemically synthesized
aagtcccactctggatgttc

SEQ ID NO: 255047 - DNA, 20 bp, Artificial Sequence
  chemically synthesized
ctctggagcttgaacatcca

SEQ ID NO: 255048 - DNA, 20 bp, Artificial Sequence
  chemically synthesized
tggagcttgaacatccagag

SEQ ID NO: 255049 - DNA, 20 bp, Artificial Sequence
  chemically synthesized
ggagcttgaacatccagagt

SEQ ID NO: 255050 - DNA, 20 bp, Artificial Sequence
  chemically synthesized
tcatagttgaagtcccactc

SEQ ID NO: 255051 - DNA, 20 bp, Artificial Sequence
  chemically synthesized
atttttaaatatcatagttg

SEQ ID NO: 255052 - DNA, 20 bp, Artificial Sequence
  chemically synthesized
gagatcatttttaaatatca

SEQ ID NO: 255053 - DNA, 20 bp, Artificial Sequence
  chemically synthesized
atttaaaaatgatctcacct

SEQ ID NO: 255054 - DNA, 20 bp, Artificial Sequence
  chemically synthesized
gttaagtgacttgctcaggt

SEQ ID NO: 255055 - DNA, 20 bp, Artificial Sequence
  chemically synthesized
aaaaatgatctcacctgagc

SEQ ID NO: 255056 - DNA, 20 bp, Artificial Sequence
  chemically synthesized
agcagttaagtgacttgctc

SEQ ID NO: 255057 - DNA, 20 bp, Artificial Sequence
  chemically synthesized
gagcagttaagtgacttgct

SEQ ID NO: 255058 - DNA, 20 bp, Artificial Sequence
  chemically synthesized
gagcaagtcacttaactgct

SEQ ID NO: 255059 - DNA, 20 bp, Artificial Sequence
  chemically synthesized
aacggaggtcctgagcagtt

SEQ ID NO: 255060 - DNA, 20 bp, Artificial Sequence
  chemically synthesized
agcaagtcacttaactgctc

SEQ ID NO: 255061 - DNA, 20 bp, Artificial Sequence
  chemically synthesized
ggagaaacggaggtcctgag

SEQ ID NO: 255062 - DNA, 20 bp, Artificial Sequence
  chemically synthesized
gatggagaaacggaggtcct

SEQ ID NO: 255063 - DNA, 20 bp, Artificial Sequence
  chemically synthesized
atactcagatggagaaacgg

SEQ ID NO: 255064 - DNA, 20 bp, Artificial Sequence
  chemically synthesized
catactcagatggagaaacg

SEQ ID NO: 255065 - DNA, 20 bp, Artificial Sequence
  chemically synthesized
cccatactcagatggagaaa

SEQ ID NO: 255066 - DNA, 20 bp, Artificial Sequence
  chemically synthesized
ggacctccgtttctccatct

SEQ ID NO: 255067 - DNA, 20 bp, Artificial Sequence
  chemically synthesized
attatacccatactcagatg

SEQ ID NO: 255068 - DNA, 20 bp, Artificial Sequence
  chemically synthesized
ttattatacccatactcaga

SEQ ID NO: 255069 - DNA, 20 bp, Artificial Sequence
  chemically synthesized
tccgtttctccatctgagta

SEQ ID NO: 255070 - DNA, 20 bp, Artificial Sequence
  chemically synthesized
ccgtttctccatctgagtat

SEQ ID NO: 255071 - DNA, 20 bp, Artificial Sequence
  chemically synthesized
tgtattattatacccatact

SEQ ID NO: 255072 - DNA, 20 bp, Artificial Sequence
  chemically synthesized
tgagtatgggtataataata

SEQ ID NO: 255073 - DNA, 20 bp, Artificial Sequence
  chemically synthesized
taataatacagccttccttg

SEQ ID NO: 255074 - DNA, 20 bp, Artificial Sequence
  chemically synthesized
aataatacagccttccttgt

SEQ ID NO: 255075 - DNA, 20 bp, Artificial Sequence
  chemically synthesized
tcataacagccctacaagga

SEQ ID NO: 255076 - DNA, 20 bp, Artificial Sequence
  chemically synthesized
ataatacagccttccttgta

SEQ ID NO: 255077 - DNA, 20 bp, Artificial Sequence
  chemically synthesized
atcataacagccctacaagg

SEQ ID NO: 255078 - DNA, 20 bp, Artificial Sequence
  chemically synthesized
gtcatcataacagccctaca

SEQ ID NO: 255079 - DNA, 20 bp, Artificial Sequence
  chemically synthesized
ggtcatcataacagccctac

SEQ ID NO: 255080 - DNA, 20 bp, Artificial Sequence
  chemically synthesized
aacttgtatggtcatcataa

SEQ ID NO: 255081 - DNA, 20 bp, Artificial Sequence
  chemically synthesized
ggctgttatgatgaccatac

SEQ ID NO: 255082 - DNA, 20 bp, Artificial Sequence
  chemically synthesized
aacacttagagtaacttgta

SEQ ID NO: 255083 - DNA, 20 bp, Artificial Sequence
  chemically synthesized
atgaccatacaagttactct

SEQ ID NO: 255084 - DNA, 20 bp, Artificial Sequence
  chemically synthesized
ggacacattctaaacactta

SEQ ID NO: 255085 - DNA, 20 bp, Artificial Sequence
  chemically synthesized
tacaagttactctaagtgtt

SEQ ID NO: 255086 - DNA, 20 bp, Artificial Sequence
  chemically synthesized
caggacacattctaaacact

SEQ ID NO: 255087 - DNA, 20 bp, Artificial Sequence
  chemically synthesized
taagtgtttagaatgtgtcc

SEQ ID NO: 255088 - DNA, 20 bp, Artificial Sequence
  chemically synthesized
acagttattatttttgtgcc

SEQ ID NO: 255089 - DNA, 20 bp, Artificial Sequence
  chemically synthesized
gacagttattatttttgtgc

SEQ ID NO: 255090 - DNA, 20 bp, Artificial Sequence
  chemically synthesized
ggcacaaaaataataactgt

SEQ ID NO: 255091 - DNA, 20 bp, Artificial Sequence
  chemically synthesized
atcttgaatgtaatagctga

SEQ ID NO: 255092 - DNA, 20 bp, Artificial Sequence
  chemically synthesized
tggactaatcttgaatgtaa

SEQ ID NO: 255093 - DNA, 20 bp, Artificial Sequence
  chemically synthesized
aactgtcagctattacattc

SEQ ID NO: 255094 - DNA, 20 bp, Artificial Sequence
  chemically synthesized
tcagctattacattcaagat

SEQ ID NO: 255095 - DNA, 20 bp, Artificial Sequence
  chemically synthesized
tattacattcaagattagtc

SEQ ID NO: 255096 - DNA, 20 bp, Artificial Sequence
  chemically synthesized
ttcaagattagtccagattc

SEQ ID NO: 255097 - DNA, 20 bp, Artificial Sequence
  chemically synthesized
gtgtgaatataactggaatc

SEQ ID NO: 255098 - DNA, 20 bp, Artificial Sequence
  chemically synthesized
gcttgaggtgtgaatataac

SEQ ID NO: 255099 - DNA, 20 bp, Artificial Sequence
  chemically synthesized
tccagttatattcacacctc

SEQ ID NO: 255100 - DNA, 20 bp, Artificial Sequence
  chemically synthesized
ttatattcacacctcaagct

SEQ ID NO: 255101 - DNA, 20 bp, Artificial Sequence
  chemically synthesized
tatattcacacctcaagcta

SEQ ID NO: 255102 - DNA, 20 bp, Artificial Sequence
  chemically synthesized
gaggaggaatccttagcttg

SEQ ID NO: 255103 - DNA, 20 bp, Artificial Sequence
  chemically synthesized
agaggaggaatccttagctt

SEQ ID NO: 255104 - DNA, 20 bp, Artificial Sequence
  chemically synthesized
ttttatagaggaggaatcct

SEQ ID NO: 255105 - DNA, 20 bp, Artificial Sequence
  chemically synthesized
taggaggaattttatagagg

SEQ ID NO: 255106 - DNA, 20 bp, Artificial Sequence
  chemically synthesized
ctaggaggaattttatagag

SEQ ID NO: 255107 - DNA, 20 bp, Artificial Sequence
  chemically synthesized
aactaggaggaattttatag

SEQ ID NO: 255108 - DNA, 20 bp, Artificial Sequence
  chemically synthesized
aaactaggaggaattttata

SEQ ID NO: 255109 - DNA, 20 bp, Artificial Sequence
  chemically synthesized
agaaactaggaggaatttta

SEQ ID NO: 255110 - DNA, 20 bp, Artificial Sequence
  chemically synthesized
ctcctctataaaattcctcc

SEQ ID NO: 255111 - DNA, 20 bp, Artificial Sequence
  chemically synthesized
cacaaaaagcagaaactagg

SEQ ID NO: 255112 - DNA, 20 bp, Artificial Sequence
  chemically synthesized
gcacaaaaagcagaaactag

SEQ ID NO: 255113 - DNA, 20 bp, Artificial Sequence
  chemically synthesized
cagcacaaaaagcagaaact

SEQ ID NO: 255114 - DNA, 20 bp, Artificial Sequence
  chemically synthesized
gcagcacaaaaagcagaaac

SEQ ID NO: 255115 - DNA, 20 bp, Artificial Sequence
  chemically synthesized
gaagaaagcagcacaaaaag

SEQ ID NO: 255116 - DNA, 20 bp, Artificial Sequence
  chemically synthesized
aaagaagaaagcagcacaaa

SEQ ID NO: 255117 - DNA, 20 bp, Artificial Sequence
  chemically synthesized
aaatcatgaaaagaagaaag

SEQ ID NO: 255118 - DNA, 20 bp, Artificial Sequence
  chemically synthesized
ctgaaatcatgaaaagaaga

SEQ ID NO: 255119 - DNA, 20 bp, Artificial Sequence
  chemically synthesized
gtaactgaaatcatgaaaag

SEQ ID NO: 255120 - DNA, 20 bp, Artificial Sequence
  chemically synthesized
agtgtaactgaaatcatgaa

SEQ ID NO: 255121 - DNA, 20 bp, Artificial Sequence
  chemically synthesized
ctttcttcttttcatgattt

SEQ ID NO: 255122 - DNA, 20 bp, Artificial Sequence
  chemically synthesized
agcaaaaatatataagacat

SEQ ID NO: 255123 - DNA, 20 bp, Artificial Sequence
  chemically synthesized
tcatccaagcaaaaatatat

SEQ ID NO: 255124 - DNA, 20 bp, Artificial Sequence
  chemically synthesized
atgtcttatatatttttgct

SEQ ID NO: 255125 - DNA, 20 bp, Artificial Sequence
  chemically synthesized
agacattaaggacatcatcc

SEQ ID NO: 255126 - DNA, 20 bp, Artificial Sequence
  chemically synthesized
agagagtaataaagacatta

SEQ ID NO: 255127 - DNA, 20 bp, Artificial Sequence
  chemically synthesized
tagagagtaataaagacatt

SEQ ID NO: 255128 - DNA, 20 bp, Artificial Sequence
  chemically synthesized
aaacaagttagagagtaata

SEQ ID NO: 255129 - DNA, 20 bp, Artificial Sequence
  chemically synthesized
agttatacaaacaagttaga

SEQ ID NO: 255130 - DNA, 20 bp, Artificial Sequence
  chemically synthesized
atagttatacaaacaagtta

SEQ ID NO: 255131 - DNA, 20 bp, Artificial Sequence
  chemically synthesized
ttatagttatacaaacaagt

SEQ ID NO: 255132 - DNA, 20 bp, Artificial Sequence
  chemically synthesized
catattatagttatacaaac

SEQ ID NO: 255133 - DNA, 20 bp, Artificial Sequence
  chemically synthesized
attattgaatatacatatta

SEQ ID NO: 255134 - DNA, 20 bp, Artificial Sequence
  chemically synthesized
tcaataatgttatcaactac

SEQ ID NO: 255135 - DNA, 20 bp, Artificial Sequence
  chemically synthesized
aataatgttatcaactacca

SEQ ID NO: 255136 - DNA, 20 bp, Artificial Sequence
  chemically synthesized
gaataatccttgtactctgg

SEQ ID NO: 255137 - DNA, 20 bp, Artificial Sequence
  chemically synthesized
gttatcaactaccagagtac

SEQ ID NO: 255138 - DNA, 20 bp, Artificial Sequence
  chemically synthesized
ttatcaactaccagagtaca

SEQ ID NO: 255139 - DNA, 20 bp, Artificial Sequence
  chemically synthesized
aaggaataatccttgtactc

SEQ ID NO: 255140 - DNA, 20 bp, Artificial Sequence
  chemically synthesized
aagataagaaagaaatatta

SEQ ID NO: 255141 - DNA, 20 bp, Artificial Sequence
  chemically synthesized
aaagataagaaagaaatatt

SEQ ID NO: 255142 - DNA, 20 bp, Artificial Sequence
  chemically synthesized
taacattctaaaagataaga

SEQ ID NO: 255143 - DNA, 20 bp, Artificial Sequence
  chemically synthesized
aatatttctttcttatcttt

SEQ ID NO: 255144 - DNA, 20 bp, Artificial Sequence
  chemically synthesized
tgcttaacattctaaaagat

SEQ ID NO: 255145 - DNA, 20 bp, Artificial Sequence
  chemically synthesized
tgctatgcttaacattctaa

SEQ ID NO: 255146 - DNA, 20 bp, Artificial Sequence
  chemically synthesized
ttcttatcttttagaatgtt

SEQ ID NO: 255147 - DNA, 20 bp, Artificial Sequence
  chemically synthesized
atcttttagaatgttaagca

SEQ ID NO: 255148 - DNA, 20 bp, Artificial Sequence
  chemically synthesized
aatgttaagcatagcacttg

SEQ ID NO: 255149 - DNA, 20 bp, Artificial Sequence
  chemically synthesized
cagatatttattaatgctac

SEQ ID NO: 255150 - DNA, 20 bp, Artificial Sequence
  chemically synthesized
aactttttacttcaagtcaa

SEQ ID NO: 255151 - DNA, 20 bp, Artificial Sequence
  chemically synthesized
aataaatatctgttgacttg

SEQ ID NO: 255152 - DNA, 20 bp, Artificial Sequence
  chemically synthesized
tcaactcaactttttacttc

SEQ ID NO: 255153 - DNA, 20 bp, Artificial Sequence
  chemically synthesized
atctgttgacttgaagtaaa

SEQ ID NO: 255154 - DNA, 20 bp, Artificial Sequence
  chemically synthesized
ttgacttgaagtaaaaagtt

SEQ ID NO: 255155 - DNA, 20 bp, Artificial Sequence
  chemically synthesized
caaattggattttcataagc

SEQ ID NO: 255156 - DNA, 20 bp, Artificial Sequence
  chemically synthesized
aattcaaattggattttcat

SEQ ID NO: 255157 - DNA, 20 bp, Artificial Sequence
  chemically synthesized
ttcaatgattgaattcaaat

SEQ ID NO: 255158 - DNA, 20 bp, Artificial Sequence
  chemically synthesized
aattcaatcattgaacctct

SEQ ID NO: 255159 - DNA, 20 bp, Artificial Sequence
  chemically synthesized
aacagagtaacaaatcttag

SEQ ID NO: 255160 - DNA, 20 bp, Artificial Sequence
  chemically synthesized
gaacagagtaacaaatctta

SEQ ID NO: 255161 - DNA, 20 bp, Artificial Sequence
  chemically synthesized
ttgaacagagtaacaaatct

SEQ ID NO: 255162 - DNA, 20 bp, Artificial Sequence
  chemically synthesized
ctatctacaatggttgaaca

SEQ ID NO: 255163 - DNA, 20 bp, Artificial Sequence
  chemically synthesized
atctatctacaatggttgaa

SEQ ID NO: 255164 - DNA, 20 bp, Artificial Sequence
  chemically synthesized
gttactctgttcaaccattg

SEQ ID NO: 255165 - DNA, 20 bp, Artificial Sequence
  chemically synthesized
ctctgttcaaccattgtaga

SEQ ID NO: 255166 - DNA, 20 bp, Artificial Sequence
  chemically synthesized
acctgaatatctatctacaa

SEQ ID NO: 255167 - DNA, 20 bp, Artificial Sequence
  chemically synthesized
aaccattgtagatagatatt

SEQ ID NO: 255168 - DNA, 20 bp, Artificial Sequence
  chemically synthesized
accattgtagatagatattc

SEQ ID NO: 255169 - DNA, 20 bp, Artificial Sequence
  chemically synthesized
tgtagatagatattcaggta

SEQ ID NO: 255170 - DNA, 20 bp, Artificial Sequence
  chemically synthesized
gatagatattcaggtatggt

SEQ ID NO: 255171 - DNA, 20 bp, Artificial Sequence
  chemically synthesized
attcaggtatggtcagacgt

SEQ ID NO: 255172 - DNA, 20 bp, Artificial Sequence
  chemically synthesized
atggtcagacgtgagctatt

SEQ ID NO: 255173 - DNA, 20 bp, Artificial Sequence
  chemically synthesized
tggtcagacgtgagctattc

SEQ ID NO: 255174 - DNA, 20 bp, Artificial Sequence
  chemically synthesized
taaacaaggaattacctgaa

SEQ ID NO: 255175 - DNA, 20 bp, Artificial Sequence
  chemically synthesized
aaagtaaagtagaataaaca

SEQ ID NO: 255176 - DNA, 20 bp, Artificial Sequence
  chemically synthesized
aaaagtaaagtagaataaac

SEQ ID NO: 255177 - DNA, 20 bp, Artificial Sequence
  chemically synthesized
aatgtcttgtaaaagtaaag

SEQ ID NO: 255178 - DNA, 20 bp, Artificial Sequence
  chemically synthesized
gctaatgtcttgtaaaagta

SEQ ID NO: 255179 - DNA, 20 bp, Artificial Sequence
  chemically synthesized
ttattctactttacttttac

SEQ ID NO: 255180 - DNA, 20 bp, Artificial Sequence
  chemically synthesized
caacagctaatgtcttgtaa

SEQ ID NO: 255181 - DNA, 20 bp, Artificial Sequence
  chemically synthesized
actttacttttacaagacat

SEQ ID NO: 255182 - DNA, 20 bp, Artificial Sequence
  chemically synthesized
acaagacattagctgttgaa

SEQ ID NO: 255183 - DNA, 20 bp, Artificial Sequence
  chemically synthesized
acttctattccactgttcaa

SEQ ID NO: 255184 - DNA, 20 bp, Artificial Sequence
  chemically synthesized
agacattagctgttgaacag

SEQ ID NO: 255185 - DNA, 20 bp, Artificial Sequence
  chemically synthesized
ttagctgttgaacagtggaa

SEQ ID NO: 255186 - DNA, 20 bp, Artificial Sequence
  chemically synthesized
gctgttgaacagtggaatag

SEQ ID NO: 255187 - DNA, 20 bp, Artificial Sequence
  chemically synthesized
actcagccaggaaatgcatg

SEQ ID NO: 255188 - DNA, 20 bp, Artificial Sequence
  chemically synthesized
agaagtccacatgcatttcc

SEQ ID NO: 255189 - DNA, 20 bp, Artificial Sequence
  chemically synthesized
tccacatgcatttcctggct

SEQ ID NO: 255190 - DNA, 20 bp, Artificial Sequence
  chemically synthesized
aaccataaggaaactcagcc

SEQ ID NO: 255191 - DNA, 20 bp, Artificial Sequence
  chemically synthesized
aaaccataaggaaactcagc

SEQ ID NO: 255192 - DNA, 20 bp, Artificial Sequence
  chemically synthesized
gaggaaaccataaggaaact

SEQ ID NO: 255193 - DNA, 20 bp, Artificial Sequence
  chemically synthesized
ttcctggctgagtttcctta

SEQ ID NO: 255194 - DNA, 20 bp, Artificial Sequence
  chemically synthesized
tgtgctgtgaggaaaccata

SEQ ID NO: 255195 - DNA, 20 bp, Artificial Sequence
  chemically synthesized
atgtgctgtgaggaaaccat

SEQ ID NO: 255196 - DNA, 20 bp, Artificial Sequence
  chemically synthesized
gtttccttatggtttcctca

SEQ ID NO: 255197 - DNA, 20 bp, Artificial Sequence
  chemically synthesized
tagatatctaatgtgctgtg

SEQ ID NO: 255198 - DNA, 20 bp, Artificial Sequence
  chemically synthesized
ttagatatctaatgtgctgt

SEQ ID NO: 255199 - DNA, 20 bp, Artificial Sequence
  chemically synthesized
atggtttcctcacagcacat

SEQ ID NO: 255200 - DNA, 20 bp, Artificial Sequence
  chemically synthesized
tcacagcacattagatatct

SEQ ID NO: 255201 - DNA, 20 bp, Artificial Sequence
  chemically synthesized
acattagatatctaagaaaa

SEQ ID NO: 255202 - DNA, 20 bp, Artificial Sequence
  chemically synthesized
tgaataaaggacttttttct

SEQ ID NO: 255203 - DNA, 20 bp, Artificial Sequence
  chemically synthesized
taagaaaaaagtcctttatt

SEQ ID NO: 255204 - DNA, 20 bp, Artificial Sequence
  chemically synthesized
gcaggtgtaattctgaataa

SEQ ID NO: 255205 - DNA, 20 bp, Artificial Sequence
  chemically synthesized
ggcaggtgtaattctgaata

SEQ ID NO: 255206 - DNA, 20 bp, Artificial Sequence
  chemically synthesized
tggcatctggagaaatgggc

SEQ ID NO: 255207 - DNA, 20 bp, Artificial Sequence
  chemically synthesized
gtggcatctggagaaatggg

SEQ ID NO: 255208 - DNA, 20 bp, Artificial Sequence
  chemically synthesized
attacacctgcccatttctc

SEQ ID NO: 255209 - DNA, 20 bp, Artificial Sequence
  chemically synthesized
tctgtggcatctggagaaat

SEQ ID NO: 255210 - DNA, 20 bp, Artificial Sequence
  chemically synthesized
ctctgtggcatctggagaaa

SEQ ID NO: 255211 - DNA, 20 bp, Artificial Sequence
  chemically synthesized
ttgatgctctgtggcatctg

SEQ ID NO: 255212 - DNA, 20 bp, Artificial Sequence
  chemically synthesized
gcccatttctccagatgcca

SEQ ID NO: 255213 - DNA, 20 bp, Artificial Sequence
  chemically synthesized
tgttgatgctctgtggcatc

SEQ ID NO: 255214 - DNA, 20 bp, Artificial Sequence
  chemically synthesized
ccatttctccagatgccaca

SEQ ID NO: 255215 - DNA, 20 bp, Artificial Sequence
  chemically synthesized
ttgttcttgttgatgctctg

SEQ ID NO: 255216 - DNA, 20 bp, Artificial Sequence
  chemically synthesized
agatgccacagagcatcaac

SEQ ID NO: 255217 - DNA, 20 bp, Artificial Sequence
  chemically synthesized
agagcatcaacaagaacaaa

SEQ ID NO: 255218 - DNA, 20 bp, Artificial Sequence
  chemically synthesized
acttggatcagtaaagtgca

SEQ ID NO: 255219 - DNA, 20 bp, Artificial Sequence
  chemically synthesized
cacttggatcagtaaagtgc

SEQ ID NO: 255220 - DNA, 20 bp, Artificial Sequence
  chemically synthesized
acacttggatcagtaaagtg

SEQ ID NO: 255221 - DNA, 20 bp, Artificial Sequence
  chemically synthesized
gagaaacacttggatcagta

SEQ ID NO: 255222 - DNA, 20 bp, Artificial Sequence
  chemically synthesized
accctgcactttactgatcc

SEQ ID NO: 255223 - DNA, 20 bp, Artificial Sequence
  chemically synthesized
tatctgagaaacacttggat

SEQ ID NO: 255224 - DNA, 20 bp, Artificial Sequence
  chemically synthesized
cattttatctgagaaacact

SEQ ID NO: 255225 - DNA, 20 bp, Artificial Sequence
  chemically synthesized
ttactgatccaagtgtttct

SEQ ID NO: 255226 - DNA, 20 bp, Artificial Sequence
  chemically synthesized
ggactagaatcattttatct

SEQ ID NO: 255227 - DNA, 20 bp, Artificial Sequence
  chemically synthesized
tttctcagataaaatgattc

SEQ ID NO: 255228 - DNA, 20 bp, Artificial Sequence
  chemically synthesized
ataaaatgattctagtccat

SEQ ID NO: 255229 - DNA, 20 bp, Artificial Sequence
  chemically synthesized
tttacttagtgctgatggac

SEQ ID NO: 255230 - DNA, 20 bp, Artificial Sequence
  chemically synthesized
ttcaatttacttagtgctga

SEQ ID NO: 255231 - DNA, 20 bp, Artificial Sequence
  chemically synthesized
gattctagtccatcagcact

SEQ ID NO: 255232 - DNA, 20 bp, Artificial Sequence
  chemically synthesized
aaaattgttttcaatttact

SEQ ID NO: 255233 - DNA, 20 bp, Artificial Sequence
  chemically synthesized
taaattgaaaacaattttac

SEQ ID NO: 255234 - DNA, 20 bp, Artificial Sequence
  chemically synthesized
tgtacgtatcataaaaggac

SEQ ID NO: 255235 - DNA, 20 bp, Artificial Sequence
  chemically synthesized
caaaatgtacgtatcataaa

SEQ ID NO: 255236 - DNA, 20 bp, Artificial Sequence
  chemically synthesized
acaaaatgtacgtatcataa

SEQ ID NO: 255237 - DNA, 20 bp, Artificial Sequence
  chemically synthesized
tgatacgtacattttgtgtt

SEQ ID NO: 255238 - DNA, 20 bp, Artificial Sequence
  chemically synthesized
gattttctgtaaaatgattt

SEQ ID NO: 255239 - DNA, 20 bp, Artificial Sequence
  chemically synthesized
ggattttctgtaaaatgatt

SEQ ID NO: 255240 - DNA, 20 bp, Artificial Sequence
  chemically synthesized
acatcgcctaaatcatttta

SEQ ID NO: 255241 - DNA, 20 bp, Artificial Sequence
  chemically synthesized
cattttacagaaaatccaaa

SEQ ID NO: 255242 - DNA, 20 bp, Artificial Sequence
  chemically synthesized
tgtgagtcaatttttctatt

SEQ ID NO: 255243 - DNA, 20 bp, Artificial Sequence
  chemically synthesized
gaaaaattgactcacatgca

SEQ ID NO: 255244 - DNA, 20 bp, Artificial Sequence
  chemically synthesized
accccctttgccatgcatgt

SEQ ID NO: 255245 - DNA, 20 bp, Artificial Sequence
  chemically synthesized
attgactcacatgcatggca

SEQ ID NO: 255246 - DNA, 20 bp, Artificial Sequence
  chemically synthesized
ttgactcacatgcatggcaa

SEQ ID NO: 255247 - DNA, 20 bp, Artificial Sequence
  chemically synthesized
tgactcacatgcatggcaaa

SEQ ID NO: 255248 - DNA, 20 bp, Artificial Sequence
  chemically synthesized
gactcacatgcatggcaaag

SEQ ID NO: 255249 - DNA, 20 bp, Artificial Sequence
  chemically synthesized
actcacatgcatggcaaagg

SEQ ID NO: 255250 - DNA, 20 bp, Artificial Sequence
  chemically synthesized
gcatggcaaagggggtttta

SEQ ID NO: 255251 - DNA, 20 bp, Artificial Sequence
  chemically synthesized
tggcaaagggggttttatag

SEQ ID NO: 255252 - DNA, 20 bp, Artificial Sequence
  chemically synthesized
aaagggggttttatagaagt

SEQ ID NO: 255253 - DNA, 20 bp, Artificial Sequence
  chemically synthesized
agaagtaagtacttttctct

SEQ ID NO: 255254 - DNA, 20 bp, Artificial Sequence
  chemically synthesized
tatattttgaactaagagaa

SEQ ID NO: 255255 - DNA, 20 bp, Artificial Sequence
  chemically synthesized
tgccatatattttgaactaa

SEQ ID NO: 255256 - DNA, 20 bp, Artificial Sequence
  chemically synthesized
aatgccatatattttgaact

SEQ ID NO: 255257 - DNA, 20 bp, Artificial Sequence
  chemically synthesized
ttctcttagttcaaaatata

SEQ ID NO: 255258 - DNA, 20 bp, Artificial Sequence
  chemically synthesized
ctctaagaaatttgggatca

SEQ ID NO: 255259 - DNA, 20 bp, Artificial Sequence
  chemically synthesized
atcctgactctaagaaattt

SEQ ID NO: 255260 - DNA, 20 bp, Artificial Sequence
  chemically synthesized
ttctatgatcccaaatttct

SEQ ID NO: 255261 - DNA, 20 bp, Artificial Sequence
  chemically synthesized
tatcctgactctaagaaatt

SEQ ID NO: 255262 - DNA, 20 bp, Artificial Sequence
  chemically synthesized
ctatgatcccaaatttctta

SEQ ID NO: 255263 - DNA, 20 bp, Artificial Sequence
  chemically synthesized
gatcccaaatttcttagagt

SEQ ID NO: 255264 - DNA, 20 bp, Artificial Sequence
  chemically synthesized
atcccaaatttcttagagtc

SEQ ID NO: 255265 - DNA, 20 bp, Artificial Sequence
  chemically synthesized
ctaaagcgtatcctgactct

SEQ ID NO: 255266 - DNA, 20 bp, Artificial Sequence
  chemically synthesized
cttagagtcaggatacgctt

SEQ ID NO: 255267 - DNA, 20 bp, Artificial Sequence
  chemically synthesized
tgctgagtcacacaacacta

SEQ ID NO: 255268 - DNA, 20 bp, Artificial Sequence
  chemically synthesized
cgctttagtgttgtgtgact

SEQ ID NO: 255269 - DNA, 20 bp, Artificial Sequence
  chemically synthesized
tttagtgttgtgtgactcag

SEQ ID NO: 255270 - DNA, 20 bp, Artificial Sequence
  chemically synthesized
tagtgttgtgtgactcagca

SEQ ID NO: 255271 - DNA, 20 bp, Artificial Sequence
  chemically synthesized
agtgttgtgtgactcagcag

SEQ ID NO: 255272 - DNA, 20 bp, Artificial Sequence
  chemically synthesized
tgttgtgtgactcagcagag

SEQ ID NO: 255273 - DNA, 20 bp, Artificial Sequence
  chemically synthesized
ctacctggccctcctctgct

SEQ ID NO: 255274 - DNA, 20 bp, Artificial Sequence
  chemically synthesized
gttgtgtgactcagcagagg

SEQ ID NO: 255275 - DNA, 20 bp, Artificial Sequence
  chemically synthesized
ttgtgtgactcagcagagga

SEQ ID NO: 255276 - DNA, 20 bp, Artificial Sequence
  chemically synthesized
gtgactcagcagaggagggc

SEQ ID NO: 255277 - DNA, 20 bp, Artificial Sequence
  chemically synthesized
tgactcagcagaggagggcc

SEQ ID NO: 255278 - DNA, 20 bp, Artificial Sequence
  chemically synthesized
ctcagcagaggagggccagg

SEQ ID NO: 255279 - DNA, 20 bp, Artificial Sequence
  chemically synthesized
tcagcagaggagggccaggt

SEQ ID NO: 255280 - DNA, 20 bp, Artificial Sequence
  chemically synthesized
tttcctccataaaacctacc

SEQ ID NO: 255281 - DNA, 20 bp, Artificial Sequence
  chemically synthesized
ggagggccaggtaggtttta

SEQ ID NO: 255282 - DNA, 20 bp, Artificial Sequence
  chemically synthesized
agggccaggtaggttttatg

SEQ ID NO: 255283 - DNA, 20 bp, Artificial Sequence
  chemically synthesized
gggccaggtaggttttatgg

SEQ ID NO: 255284 - DNA, 20 bp, Artificial Sequence
  chemically synthesized
tttatggaggaaaaattcca

SEQ ID NO: 255285 - DNA, 20 bp, Artificial Sequence
  chemically synthesized
cttggattgttgtattgctt

SEQ ID NO: 255286 - DNA, 20 bp, Artificial Sequence
  chemically synthesized
ccaaagcaatacaacaatcc

SEQ ID NO: 255287 - DNA, 20 bp, Artificial Sequence
  chemically synthesized
atcagtttttgaggttttct

SEQ ID NO: 255288 - DNA, 20 bp, Artificial Sequence
  chemically synthesized
ttggtgatcatcagtttttg

SEQ ID NO: 255289 - DNA, 20 bp, Artificial Sequence
  chemically synthesized
attggtgatcatcagttttt

SEQ ID NO: 255290 - DNA, 20 bp, Artificial Sequence
  chemically synthesized
ttccattcattggtgatcat

SEQ ID NO: 255291 - DNA, 20 bp, Artificial Sequence
  chemically synthesized
aactgatgatcaccaatgaa

SEQ ID NO: 255292 - DNA, 20 bp, Artificial Sequence
  chemically synthesized
aaaaagcatattccattcat

SEQ ID NO: 255293 - DNA, 20 bp, Artificial Sequence
  chemically synthesized
gtataacatgaattttaaaa

SEQ ID NO: 255294 - DNA, 20 bp, Artificial Sequence
  chemically synthesized
catatgtaaatagaattaaa

SEQ ID NO: 255295 - DNA, 20 bp, Artificial Sequence
  chemically synthesized
ctcatgattgcatatgtaaa

SEQ ID NO: 255296 - DNA, 20 bp, Artificial Sequence
  chemically synthesized
ctatttacatatgcaatcat

SEQ ID NO: 255297 - DNA, 20 bp, Artificial Sequence
  chemically synthesized
ttttcatttatcaaaataat

SEQ ID NO: 255298 - DNA, 20 bp, Artificial Sequence
  chemically synthesized
tattttgataaatgaaaatt

SEQ ID NO: 255299 - DNA, 20 bp, Artificial Sequence
  chemically synthesized
aaaatttagtataaatgatt

SEQ ID NO: 255300 - DNA, 20 bp, Artificial Sequence
  chemically synthesized
taaatgattaagcaacttca

SEQ ID NO: 255301 - DNA, 20 bp, Artificial Sequence
  chemically synthesized
aaatgattaagcaacttcat

SEQ ID NO: 255302 - DNA, 20 bp, Artificial Sequence
  chemically synthesized
tgattaagcaacttcatagg

SEQ ID NO: 255303 - DNA, 20 bp, Artificial Sequence
  chemically synthesized
atgtatggtagctacctatg

SEQ ID NO: 255304 - DNA, 20 bp, Artificial Sequence
  chemically synthesized
ttatattttatcatgtatgg

SEQ ID NO: 255305 - DNA, 20 bp, Artificial Sequence
  chemically synthesized
tgattatattttatcatgta

SEQ ID NO: 255306 - DNA, 20 bp, Artificial Sequence
  chemically synthesized
tcatcaatattaatttttgc

SEQ ID NO: 255307 - DNA, 20 bp, Artificial Sequence
  chemically synthesized
gtcatcaatattaatttttg

SEQ ID NO: 255308 - DNA, 20 bp, Artificial Sequence
  chemically synthesized
gcaaaaattaatattgatga

SEQ ID NO: 255309 - DNA, 20 bp, Artificial Sequence
  chemically synthesized
ttgatgacagtaaactattt

SEQ ID NO: 255310 - DNA, 20 bp, Artificial Sequence
  chemically synthesized
tgttttctgttttaccaaaa

SEQ ID NO: 255311 - DNA, 20 bp, Artificial Sequence
  chemically synthesized
agtaaactattttggtaaaa

SEQ ID NO: 255312 - DNA, 20 bp, Artificial Sequence
  chemically synthesized
ggtaaaacagaaaacatatt

SEQ ID NO: 255313 - DNA, 20 bp, Artificial Sequence
  chemically synthesized
gtattagttatatataaaac

SEQ ID NO: 255314 - DNA, 20 bp, Artificial Sequence
  chemically synthesized
agtattagttatatataaaa

SEQ ID NO: 255315 - DNA, 20 bp, Artificial Sequence
  chemically synthesized
ttccccaacatcagaagtat

SEQ ID NO: 255316 - DNA, 20 bp, Artificial Sequence
  chemically synthesized
ataactaatacttctgatgt

SEQ ID NO: 255317 - DNA, 20 bp, Artificial Sequence
  chemically synthesized
gcacatttccccaacatcag

SEQ ID NO: 255318 - DNA, 20 bp, Artificial Sequence
  chemically synthesized
taactaatacttctgatgtt

SEQ ID NO: 255319 - DNA, 20 bp, Artificial Sequence
  chemically synthesized
aactaatacttctgatgttg

SEQ ID NO: 255320 - DNA, 20 bp, Artificial Sequence
  chemically synthesized
aaagcacatttccccaacat

SEQ ID NO: 255321 - DNA, 20 bp, Artificial Sequence
  chemically synthesized
gtgtaaaacaatatgatgga

SEQ ID NO: 255322 - DNA, 20 bp, Artificial Sequence
  chemically synthesized
ccctgtgtaaaacaatatga

SEQ ID NO: 255323 - DNA, 20 bp, Artificial Sequence
  chemically synthesized
ttccatcatattgttttaca

SEQ ID NO: 255324 - DNA, 20 bp, Artificial Sequence
  chemically synthesized
tccatcatattgttttacac

SEQ ID NO: 255325 - DNA, 20 bp, Artificial Sequence
  chemically synthesized
ccatcatattgttttacaca

SEQ ID NO: 255326 - DNA, 20 bp, Artificial Sequence
  chemically synthesized
catcatattgttttacacag

SEQ ID NO: 255327 - DNA, 20 bp, Artificial Sequence
  chemically synthesized
atattgttttacacagggga

SEQ ID NO: 255328 - DNA, 20 bp, Artificial Sequence
  chemically synthesized
gttttacacaggggacagaa

SEQ ID NO: 255329 - DNA, 20 bp, Artificial Sequence
  chemically synthesized
tacagaacaattgtatgaaa

SEQ ID NO: 255330 - DNA, 20 bp, Artificial Sequence
  chemically synthesized
ggtacagaacaattgtatga

SEQ ID NO: 255331 - DNA, 20 bp, Artificial Sequence
  chemically synthesized
tagatgtatgcatttgggta

SEQ ID NO: 255332 - DNA, 20 bp, Artificial Sequence
  chemically synthesized
ttttttagatgtatgcattt

SEQ ID NO: 255333 - DNA, 20 bp, Artificial Sequence
  chemically synthesized
tttttttagatgtatgcatt

SEQ ID NO: 255334 - DNA, 20 bp, Artificial Sequence
  chemically synthesized
ctttcttttttttttttttt

SEQ ID NO: 255335 - DNA, 20 bp, Artificial Sequence
  chemically synthesized
acatctaaaaaaaaaaaaaa

SEQ ID NO: 255336 - DNA, 20 bp, Artificial Sequence
  chemically synthesized
ctaaaaaaaaaaaaaaaaga

SEQ ID NO: 255337 - DNA, 20 bp, Artificial Sequence
  chemically synthesized
aaaaaaaaaaaaagaaagaa

SEQ ID NO: 255338 - DNA, 20 bp, Artificial Sequence
  chemically synthesized
gaaagaaaagaaataaacaa

SEQ ID NO: 255339 - DNA, 20 bp, Artificial Sequence
  chemically synthesized
aaagaaaagaaataaacaaa

SEQ ID NO: 255340 - DNA, 20 bp, Artificial Sequence
  chemically synthesized
aataaacaaaaggcatgata

SEQ ID NO: 255341 - DNA, 20 bp, Artificial Sequence
  chemically synthesized
ataaacaaaaggcatgatat

SEQ ID NO: 255342 - DNA, 20 bp, Artificial Sequence
  chemically synthesized
aaacaaaaggcatgatatgg

SEQ ID NO: 255343 - DNA, 20 bp, Artificial Sequence
  chemically synthesized
caaaaggcatgatatgggag

SEQ ID NO: 255344 - DNA, 20 bp, Artificial Sequence
  chemically synthesized
aaaaggcatgatatgggagc

SEQ ID NO: 255345 - DNA, 20 bp, Artificial Sequence
  chemically synthesized
aggcatgatatgggagcagg

SEQ ID NO: 255346 - DNA, 20 bp, Artificial Sequence
  chemically synthesized
gtaaacattgagtagagtgt

SEQ ID NO: 255347 - DNA, 20 bp, Artificial Sequence
  chemically synthesized
aaaaaggtaaacattgagta

SEQ ID NO: 255348 - DNA, 20 bp, Artificial Sequence
  chemically synthesized
ccaaaaaggtaaacattgag

SEQ ID NO: 255349 - DNA, 20 bp, Artificial Sequence
  chemically synthesized
cttccaaaaaggtaaacatt

SEQ ID NO: 255350 - DNA, 20 bp, Artificial Sequence
  chemically synthesized
ctactcaatgtttacctttt

SEQ ID NO: 255351 - DNA, 20 bp, Artificial Sequence
  chemically synthesized
ctcaatgtttacctttttgg

SEQ ID NO: 255352 - DNA, 20 bp, Artificial Sequence
  chemically synthesized
aatctatggagcttccaaaa

SEQ ID NO: 255353 - DNA, 20 bp, Artificial Sequence
  chemically synthesized
aaatctatggagcttccaaa

SEQ ID NO: 255354 - DNA, 20 bp, Artificial Sequence
  chemically synthesized
ttacctttttggaagctcca

SEQ ID NO: 255355 - DNA, 20 bp, Artificial Sequence
  chemically synthesized
tatcagtaaggaaatctatg

SEQ ID NO: 255356 - DNA, 20 bp, Artificial Sequence
  chemically synthesized
gttatcagtaaggaaatcta

SEQ ID NO: 255357 - DNA, 20 bp, Artificial Sequence
  chemically synthesized
attaaatagtgttatcagta

SEQ ID NO: 255358 - DNA, 20 bp, Artificial Sequence
  chemically synthesized
aattaaatagtgttatcagt

SEQ ID NO: 255359 - DNA, 20 bp, Artificial Sequence
  chemically synthesized
caaaaattaaatagtgttat

SEQ ID NO: 255360 - DNA, 20 bp, Artificial Sequence
  chemically synthesized
aaccacaggcaaaaattaaa

SEQ ID NO: 255361 - DNA, 20 bp, Artificial Sequence
  chemically synthesized
cactatttaatttttgcctg

SEQ ID NO: 255362 - DNA, 20 bp, Artificial Sequence
  chemically synthesized
tttaatttttgcctgtggtt

SEQ ID NO: 255363 - DNA, 20 bp, Artificial Sequence
  chemically synthesized
aatttaatttgccaaaccac

SEQ ID NO: 255364 - DNA, 20 bp, Artificial Sequence
  chemically synthesized
aaatttaatttgccaaacca

SEQ ID NO: 255365 - DNA, 20 bp, Artificial Sequence
  chemically synthesized
gtggtttggcaaattaaatt

SEQ ID NO: 255366 - DNA, 20 bp, Artificial Sequence
  chemically synthesized
tggtttggcaaattaaattt

SEQ ID NO: 255367 - DNA, 20 bp, Artificial Sequence
  chemically synthesized
ggcaaattaaatttgggaat

SEQ ID NO: 255368 - DNA, 20 bp, Artificial Sequence
  chemically synthesized
tgtaaatcacgtatgattaa

SEQ ID NO: 255369 - DNA, 20 bp, Artificial Sequence
  chemically synthesized
taatcatacgtgatttacaa

SEQ ID NO: 255370 - DNA, 20 bp, Artificial Sequence
  chemically synthesized
catacgtgatttacaacaga

SEQ ID NO: 255371 - DNA, 20 bp, Artificial Sequence
  chemically synthesized
catcctgatggaaaaaaaac

SEQ ID NO: 255372 - DNA, 20 bp, Artificial Sequence
  chemically synthesized
agttcttgttttttttccat

SEQ ID NO: 255373 - DNA, 20 bp, Artificial Sequence
  chemically synthesized
gttcttgttttttttccatc

SEQ ID NO: 255374 - DNA, 20 bp, Artificial Sequence
  chemically synthesized
tatatcattaaacatcctga

SEQ ID NO: 255375 - DNA, 20 bp, Artificial Sequence
  chemically synthesized
taatgatatatattaatatt

SEQ ID NO: 255376 - DNA, 20 bp, Artificial Sequence
  chemically synthesized
atatattaatattcagaaat

SEQ ID NO: 255377 - DNA, 20 bp, Artificial Sequence
  chemically synthesized
tattaatattcagaaataag

SEQ ID NO: 255378 - DNA, 20 bp, Artificial Sequence
  chemically synthesized
tattcagaaataagcagact

SEQ ID NO: 255379 - DNA, 20 bp, Artificial Sequence
  chemically synthesized
attcagaaataagcagactt

SEQ ID NO: 255380 - DNA, 20 bp, Artificial Sequence
  chemically synthesized
aaataagcagacttgggtac

SEQ ID NO: 255381 - DNA, 20 bp, Artificial Sequence
  chemically synthesized
taatacaatgacttgtaccc

SEQ ID NO: 255382 - DNA, 20 bp, Artificial Sequence
  chemically synthesized
aagtcattgtattaaactat

SEQ ID NO: 255383 - DNA, 20 bp, Artificial Sequence
  chemically synthesized
taaatattggcaatatctta

SEQ ID NO: 255384 - DNA, 20 bp, Artificial Sequence
  chemically synthesized
ctttcaaaaggtttaaatat

SEQ ID NO: 255385 - DNA, 20 bp, Artificial Sequence
  chemically synthesized
ccaatatttaaaccttttga

SEQ ID NO: 255386 - DNA, 20 bp, Artificial Sequence
  chemically synthesized
gaattgtcaagtctttcaaa

SEQ ID NO: 255387 - DNA, 20 bp, Artificial Sequence
  chemically synthesized
tgaattgtcaagtctttcaa

SEQ ID NO: 255388 - DNA, 20 bp, Artificial Sequence
  chemically synthesized
attgaaccttatgaattgtc

SEQ ID NO: 255389 - DNA, 20 bp, Artificial Sequence
  chemically synthesized
tgaaagacttgacaattcat

SEQ ID NO: 255390 - DNA, 20 bp, Artificial Sequence
  chemically synthesized
gaaagacttgacaattcata

SEQ ID NO: 255391 - DNA, 20 bp, Artificial Sequence
  chemically synthesized
tgacaattcataaggttcaa

SEQ ID NO: 255392 - DNA, 20 bp, Artificial Sequence
  chemically synthesized
attcataaggttcaatggaa

SEQ ID NO: 255393 - DNA, 20 bp, Artificial Sequence
  chemically synthesized
ttataattttaatatgttca

SEQ ID NO: 255394 - DNA, 20 bp, Artificial Sequence
  chemically synthesized
ttcatggttacaaatttaac

SEQ ID NO: 255395 - DNA, 20 bp, Artificial Sequence
  chemically synthesized
tcatggttacaaatttaacc

SEQ ID NO: 255396 - DNA, 20 bp, Artificial Sequence
  chemically synthesized
atggttacaaatttaaccag

SEQ ID NO: 255397 - DNA, 20 bp, Artificial Sequence
  chemically synthesized
agtttgtatttattttctcc

SEQ ID NO: 255398 - DNA, 20 bp, Artificial Sequence
  chemically synthesized
cctttgccatttaaaaaagt

SEQ ID NO: 255399 - DNA, 20 bp, Artificial Sequence
  chemically synthesized
tacaaactaacttttttaaa

SEQ ID NO: 255400 - DNA, 20 bp, Artificial Sequence
  chemically synthesized
ctttcctttgccatttaaaa

SEQ ID NO: 255401 - DNA, 20 bp, Artificial Sequence
  chemically synthesized
actaacttttttaaatggca

SEQ ID NO: 255402 - DNA, 20 bp, Artificial Sequence
  chemically synthesized
ctaacttttttaaatggcaa

SEQ ID NO: 255403 - DNA, 20 bp, Artificial Sequence
  chemically synthesized
cttttttaaatggcaaagga

SEQ ID NO: 255404 - DNA, 20 bp, Artificial Sequence
  chemically synthesized
caacaaaaaataaacaacaa

SEQ ID NO: 255405 - DNA, 20 bp, Artificial Sequence
  chemically synthesized
aaacaacaaaagcaaatttc

SEQ ID NO: 255406 - DNA, 20 bp, Artificial Sequence
  chemically synthesized
aagcaaatttcaagactcca

SEQ ID NO: 255407 - DNA, 20 bp, Artificial Sequence
  chemically synthesized
tttttctcttttttgctttg

SEQ ID NO: 255408 - DNA, 20 bp, Artificial Sequence
  chemically synthesized
tttttttctcttttttgctt

SEQ ID NO: 255409 - DNA, 20 bp, Artificial Sequence
  chemically synthesized
ttcaagactccaaagcaaaa

SEQ ID NO: 255410 - DNA, 20 bp, Artificial Sequence
  chemically synthesized
caagactccaaagcaaaaaa

SEQ ID NO: 255411 - DNA, 20 bp, Artificial Sequence
  chemically synthesized
gcaaagaatgatttaatcag

SEQ ID NO: 255412 - DNA, 20 bp, Artificial Sequence
  chemically synthesized
taagcaaagaatgatttaat

SEQ ID NO: 255413 - DNA, 20 bp, Artificial Sequence
  chemically synthesized
tgattaaatcattctttgct

SEQ ID NO: 255414 - DNA, 20 bp, Artificial Sequence
  chemically synthesized
attaaatcattctttgctta

SEQ ID NO: 255415 - DNA, 20 bp, Artificial Sequence
  chemically synthesized
aaatattgaaactctaagca

SEQ ID NO: 255416 - DNA, 20 bp, Artificial Sequence
  chemically synthesized
ttgaaaaatattgaaactct

SEQ ID NO: 255417 - DNA, 20 bp, Artificial Sequence
  chemically synthesized
tttttcaataatttttgtca

SEQ ID NO: 255418 - DNA, 20 bp, Artificial Sequence
  chemically synthesized
cattgttctaattgtgagtt

SEQ ID NO: 255419 - DNA, 20 bp, Artificial Sequence
  chemically synthesized
catggttctgaactcacaat

SEQ ID NO: 255420 - DNA, 20 bp, Artificial Sequence
  chemically synthesized
aaacccattgttctaattgt

SEQ ID NO: 255421 - DNA, 20 bp, Artificial Sequence
  chemically synthesized
tgaactcacaattagaacaa

SEQ ID NO: 255422 - DNA, 20 bp, Artificial Sequence
  chemically synthesized
gaactcacaattagaacaat

SEQ ID NO: 255423 - DNA, 20 bp, Artificial Sequence
  chemically synthesized
caattagaacaatgggtttt

SEQ ID NO: 255424 - DNA, 20 bp, Artificial Sequence
  chemically synthesized
tgggttttaagttactgaac

SEQ ID NO: 255425 - DNA, 20 bp, Artificial Sequence
  chemically synthesized
tattttttccatttctagtt

SEQ ID NO: 255426 - DNA, 20 bp, Artificial Sequence
  chemically synthesized
ttaagttactgaactagaaa

SEQ ID NO: 255427 - DNA, 20 bp, Artificial Sequence
  chemically synthesized
tgatttattttttccatttc

SEQ ID NO: 255428 - DNA, 20 bp, Artificial Sequence
  chemically synthesized
ataaatcaacacatttcata

SEQ ID NO: 255429 - DNA, 20 bp, Artificial Sequence
  chemically synthesized
cacatttcataaagaaacta

SEQ ID NO: 255430 - DNA, 20 bp, Artificial Sequence
  chemically synthesized
tgttgttttattttgggctt

SEQ ID NO: 255431 - DNA, 20 bp, Artificial Sequence
  chemically synthesized
tttaattgttgttttatttt

SEQ ID NO: 255432 - DNA, 20 bp, Artificial Sequence
  chemically synthesized
ttttaattgttgttttattt

SEQ ID NO: 255433 - DNA, 20 bp, Artificial Sequence
  chemically synthesized
ataaaacaacaattaaaacc

SEQ ID NO: 255434 - DNA, 20 bp, Artificial Sequence
  chemically synthesized
aacaacaattaaaaccaagc

SEQ ID NO: 255435 - DNA, 20 bp, Artificial Sequence
  chemically synthesized
gaggatgctgttttctagct

SEQ ID NO: 255436 - DNA, 20 bp, Artificial Sequence
  chemically synthesized
attaaaaccaagctagaaaa

SEQ ID NO: 255437 - DNA, 20 bp, Artificial Sequence
  chemically synthesized
aagaagaggatgctgttttc

SEQ ID NO: 255438 - DNA, 20 bp, Artificial Sequence
  chemically synthesized
agaaaacagcatcctcttct

SEQ ID NO: 255439 - DNA, 20 bp, Artificial Sequence
  chemically synthesized
ccataacttttaccaagaag

SEQ ID NO: 255440 - DNA, 20 bp, Artificial Sequence
  chemically synthesized
accataacttttaccaagaa

SEQ ID NO: 255441 - DNA, 20 bp, Artificial Sequence
  chemically synthesized
gtaccataacttttaccaag

SEQ ID NO: 255442 - DNA, 20 bp, Artificial Sequence
  chemically synthesized
cagcatcctcttcttggtaa

SEQ ID NO: 255443 - DNA, 20 bp, Artificial Sequence
  chemically synthesized
tgtgtaccataacttttacc

SEQ ID NO: 255444 - DNA, 20 bp, Artificial Sequence
  chemically synthesized
cctcttcttggtaaaagtta

SEQ ID NO: 255445 - DNA, 20 bp, Artificial Sequence
  chemically synthesized
ttggtaaaagttatggtaca

SEQ ID NO: 255446 - DNA, 20 bp, Artificial Sequence
  chemically synthesized
agttatggtacacagaatct

SEQ ID NO: 255447 - DNA, 20 bp, Artificial Sequence
  chemically synthesized
atgcaactctaaattattcc

SEQ ID NO: 255448 - DNA, 20 bp, Artificial Sequence
  chemically synthesized
cacagaatcttggaataatt

SEQ ID NO: 255449 - DNA, 20 bp, Artificial Sequence
  chemically synthesized
cagaatcttggaataattta

SEQ ID NO: 255450 - DNA, 20 bp, Artificial Sequence
  chemically synthesized
gagttgcatttctgcacctc

SEQ ID NO: 255451 - DNA, 20 bp, Artificial Sequence
  chemically synthesized
tgtatatttatcttgaggtg

SEQ ID NO: 255452 - DNA, 20 bp, Artificial Sequence
  chemically synthesized
tttattgtatatttatcttg

SEQ ID NO: 255453 - DNA, 20 bp, Artificial Sequence
  chemically synthesized
ctttattgtatatttatctt

SEQ ID NO: 255454 - DNA, 20 bp, Artificial Sequence
  chemically synthesized
ctcaagataaatatacaata

SEQ ID NO: 255455 - DNA, 20 bp, Artificial Sequence
  chemically synthesized
agataaatatacaataaagt

SEQ ID NO: 255456 - DNA, 20 bp, Artificial Sequence
  chemically synthesized
tttattcttctatttattta

SEQ ID NO: 255457 - DNA, 20 bp, Artificial Sequence
  chemically synthesized
tgttttataccttaaataaa

SEQ ID NO: 255458 - DNA, 20 bp, Artificial Sequence
  chemically synthesized
ttttattcttctatttattt

SEQ ID NO: 255459 - DNA, 20 bp, Artificial Sequence
  chemically synthesized
tttataccttaaataaatag

SEQ ID NO: 255460 - DNA, 20 bp, Artificial Sequence
  chemically synthesized
taaaaaaattactcctgaat

SEQ ID NO: 255461 - DNA, 20 bp, Artificial Sequence
  chemically synthesized
gctagttgttacttattcag

SEQ ID NO: 255462 - DNA, 20 bp, Artificial Sequence
  chemically synthesized
aggctagttgttacttattc

SEQ ID NO: 255463 - DNA, 20 bp, Artificial Sequence
  chemically synthesized
gaggctagttgttacttatt

SEQ ID NO: 255464 - DNA, 20 bp, Artificial Sequence
  chemically synthesized
actcctgaataagtaacaac

SEQ ID NO: 255465 - DNA, 20 bp, Artificial Sequence
  chemically synthesized
gaataagtaacaactagcct

SEQ ID NO: 255466 - DNA, 20 bp, Artificial Sequence
  chemically synthesized
gccatgtgtatttccgaggc

SEQ ID NO: 255467 - DNA, 20 bp, Artificial Sequence
  chemically synthesized
gggggccatgtgtatttccg

SEQ ID NO: 255468 - DNA, 20 bp, Artificial Sequence
  chemically synthesized
cgggggccatgtgtatttcc

SEQ ID NO: 255469 - DNA, 20 bp, Artificial Sequence
  chemically synthesized
actagcctcggaaatacaca

SEQ ID NO: 255470 - DNA, 20 bp, Artificial Sequence
  chemically synthesized
gtagaaacattataagacgg

SEQ ID NO: 255471 - DNA, 20 bp, Artificial Sequence
  chemically synthesized
agtagaaacattataagacg

SEQ ID NO: 255472 - DNA, 20 bp, Artificial Sequence
  chemically synthesized
aagtagaaacattataagac

SEQ ID NO: 255473 - DNA, 20 bp, Artificial Sequence
  chemically synthesized
taagtagaaacattataaga

SEQ ID NO: 255474 - DNA, 20 bp, Artificial Sequence
  chemically synthesized
tcactaagtagaaacattat

SEQ ID NO: 255475 - DNA, 20 bp, Artificial Sequence
  chemically synthesized
cgtcttataatgtttctact

SEQ ID NO: 255476 - DNA, 20 bp, Artificial Sequence
  chemically synthesized
aaagttgaaaaatcactaag

SEQ ID NO: 255477 - DNA, 20 bp, Artificial Sequence
  chemically synthesized
cctaaagttgaaaaatcact

SEQ ID NO: 255478 - DNA, 20 bp, Artificial Sequence
  chemically synthesized
acttagtgatttttcaactt

SEQ ID NO: 255479 - DNA, 20 bp, Artificial Sequence
  chemically synthesized
cttagtgatttttcaacttt

SEQ ID NO: 255480 - DNA, 20 bp, Artificial Sequence
  chemically synthesized
ttagtgatttttcaacttta

SEQ ID NO: 255481 - DNA, 20 bp, Artificial Sequence
  chemically synthesized
gtgatttttcaactttaggg

SEQ ID NO: 255482 - DNA, 20 bp, Artificial Sequence
  chemically synthesized
atcactttctcaccacccta

SEQ ID NO: 255483 - DNA, 20 bp, Artificial Sequence
  chemically synthesized
tttttcaactttagggtggt

SEQ ID NO: 255484 - DNA, 20 bp, Artificial Sequence
  chemically synthesized
tcaactttagggtggtgaga

SEQ ID NO: 255485 - DNA, 20 bp, Artificial Sequence
  chemically synthesized
attcattcgaaaccatactt

SEQ ID NO: 255486 - DNA, 20 bp, Artificial Sequence
  chemically synthesized
gtgaatactatactgaagta

SEQ ID NO: 255487 - DNA, 20 bp, Artificial Sequence
  chemically synthesized
ttcgaaaccatacttcagta

SEQ ID NO: 255488 - DNA, 20 bp, Artificial Sequence
  chemically synthesized
atttagtgaatactatactg

SEQ ID NO: 255489 - DNA, 20 bp, Artificial Sequence
  chemically synthesized
gttgaatatctcattcaatt

SEQ ID NO: 255490 - DNA, 20 bp, Artificial Sequence
  chemically synthesized
tagtattcactaaattgaat

SEQ ID NO: 255491 - DNA, 20 bp, Artificial Sequence
  chemically synthesized
acaagacctattttatagta

SEQ ID NO: 255492 - DNA, 20 bp, Artificial Sequence
  chemically synthesized
ttcaacactttactataaaa

SEQ ID NO: 255493 - DNA, 20 bp, Artificial Sequence
  chemically synthesized
tcaacactttactataaaat

SEQ ID NO: 255494 - DNA, 20 bp, Artificial Sequence
  chemically synthesized
agaacacaagacctatttta

SEQ ID NO: 255495 - DNA, 20 bp, Artificial Sequence
  chemically synthesized
tgcgcaaagtcatagaacac

SEQ ID NO: 255496 - DNA, 20 bp, Artificial Sequence
  chemically synthesized
cctacagttgcgcaaagtca

SEQ ID NO: 255497 - DNA, 20 bp, Artificial Sequence
  chemically synthesized
tgttaacctacagttgcgca

SEQ ID NO: 255498 - DNA, 20 bp, Artificial Sequence
  chemically synthesized
tctatgactttgcgcaactg

SEQ ID NO: 255499 - DNA, 20 bp, Artificial Sequence
  chemically synthesized
ctatgactttgcgcaactgt

SEQ ID NO: 255500 - DNA, 20 bp, Artificial Sequence
  chemically synthesized
tgaacacctatgttaaccta

SEQ ID NO: 255501 - DNA, 20 bp, Artificial Sequence
  chemically synthesized
tgcgcaactgtaggttaaca

SEQ ID NO: 255502 - DNA, 20 bp, Artificial Sequence
  chemically synthesized
gcgcaactgtaggttaacat

SEQ ID NO: 255503 - DNA, 20 bp, Artificial Sequence
  chemically synthesized
tgtaggttaacataggtgtt

SEQ ID NO: 255504 - DNA, 20 bp, Artificial Sequence
  chemically synthesized
taggttaacataggtgttca

SEQ ID NO: 255505 - DNA, 20 bp, Artificial Sequence
  chemically synthesized
taggtgttcagagcatgttt

SEQ ID NO: 255506 - DNA, 20 bp, Artificial Sequence
  chemically synthesized
aggtgttcagagcatgttta

SEQ ID NO: 255507 - DNA, 20 bp, Artificial Sequence
  chemically synthesized
gttcagagcatgtttaaggt

SEQ ID NO: 255508 - DNA, 20 bp, Artificial Sequence
  chemically synthesized
agagcatgtttaaggtaagc

SEQ ID NO: 255509 - DNA, 20 bp, Artificial Sequence
  chemically synthesized
gagcatgtttaaggtaagct

SEQ ID NO: 255510 - DNA, 20 bp, Artificial Sequence
  chemically synthesized
ccaaatatcatggtttagcc

SEQ ID NO: 255511 - DNA, 20 bp, Artificial Sequence
  chemically synthesized
acccaccaaatatcatggtt

SEQ ID NO: 255512 - DNA, 20 bp, Artificial Sequence
  chemically synthesized
ctaggctaaaccatgatatt

SEQ ID NO: 255513 - DNA, 20 bp, Artificial Sequence
  chemically synthesized
acttaacccaccaaatatca

SEQ ID NO: 255514 - DNA, 20 bp, Artificial Sequence
  chemically synthesized
ggctaaaccatgatatttgg

SEQ ID NO: 255515 - DNA, 20 bp, Artificial Sequence
  chemically synthesized
gctaaaccatgatatttggt

SEQ ID NO: 255516 - DNA, 20 bp, Artificial Sequence
  chemically synthesized
accatgatatttggtgggtt

SEQ ID NO: 255517 - DNA, 20 bp, Artificial Sequence
  chemically synthesized
taagttgagaattttgtatg

SEQ ID NO: 255518 - DNA, 20 bp, Artificial Sequence
  chemically synthesized
agataaacccattgtaagtt

SEQ ID NO: 255519 - DNA, 20 bp, Artificial Sequence
  chemically synthesized
acaaaattctcaacttacaa

SEQ ID NO: 255520 - DNA, 20 bp, Artificial Sequence
  chemically synthesized
caaaattctcaacttacaat

SEQ ID NO: 255521 - DNA, 20 bp, Artificial Sequence
  chemically synthesized
tatccagataaacccattgt

SEQ ID NO: 255522 - DNA, 20 bp, Artificial Sequence
  chemically synthesized
caacttacaatgggtttatc

SEQ ID NO: 255523 - DNA, 20 bp, Artificial Sequence
  chemically synthesized
acttgtgatggggttatatc

SEQ ID NO: 255524 - DNA, 20 bp, Artificial Sequence
  chemically synthesized
tctggatataaccccatcac

SEQ ID NO: 255525 - DNA, 20 bp, Artificial Sequence
  chemically synthesized
atgttccttgacttgtgatg

SEQ ID NO: 255526 - DNA, 20 bp, Artificial Sequence
  chemically synthesized
aatgttccttgacttgtgat

SEQ ID NO: 255527 - DNA, 20 bp, Artificial Sequence
  chemically synthesized
gaatgttccttgacttgtga

SEQ ID NO: 255528 - DNA, 20 bp, Artificial Sequence
  chemically synthesized
atataaccccatcacaagtc

SEQ ID NO: 255529 - DNA, 20 bp, Artificial Sequence
  chemically synthesized
tataaccccatcacaagtca

SEQ ID NO: 255530 - DNA, 20 bp, Artificial Sequence
  chemically synthesized
tcaaggaacattctgtacaa

SEQ ID NO: 255531 - DNA, 20 bp, Artificial Sequence
  chemically synthesized
gatcatattcttctattgta

SEQ ID NO: 255532 - DNA, 20 bp, Artificial Sequence
  chemically synthesized
aggaacattctgtacaatag

SEQ ID NO: 255533 - DNA, 20 bp, Artificial Sequence
  chemically synthesized
caatagaagaatatgatcaa

SEQ ID NO: 255534 - DNA, 20 bp, Artificial Sequence
  chemically synthesized
gaatatgatcaaaagtttgt

SEQ ID NO: 255535 - DNA, 20 bp, Artificial Sequence
  chemically synthesized
aaaagtttgtaagatcctct

SEQ ID NO: 255536 - DNA, 20 bp, Artificial Sequence
  chemically synthesized
aaagtttgtaagatcctcta

SEQ ID NO: 255537 - DNA, 20 bp, Artificial Sequence
  chemically synthesized
gtttgtaagatcctctaagg

SEQ ID NO: 255538 - DNA, 20 bp, Artificial Sequence
  chemically synthesized
tttgacaaaatcttccttag

SEQ ID NO: 255539 - DNA, 20 bp, Artificial Sequence
  chemically synthesized
ttttgacaaaatcttcctta

SEQ ID NO: 255540 - DNA, 20 bp, Artificial Sequence
  chemically synthesized
gcttttgacaaaatcttcct

SEQ ID NO: 255541 - DNA, 20 bp, Artificial Sequence
  chemically synthesized
tctaaggaagattttgtcaa

SEQ ID NO: 255542 - DNA, 20 bp, Artificial Sequence
  chemically synthesized
gattttgtcaaaagcaaacg

SEQ ID NO: 255543 - DNA, 20 bp, Artificial Sequence
  chemically synthesized
tgtcaaaagcaaacgtggct

SEQ ID NO: 255544 - DNA, 20 bp, Artificial Sequence
  chemically synthesized
taagagaatacatacaagct

SEQ ID NO: 255545 - DNA, 20 bp, Artificial Sequence
  chemically synthesized
taaaataagagaatacatac

SEQ ID NO: 255546 - DNA, 20 bp, Artificial Sequence
  chemically synthesized
ctaaaaaaactttaaaataa

SEQ ID NO: 255547 - DNA, 20 bp, Artificial Sequence
  chemically synthesized
gtatgtattctcttatttta

SEQ ID NO: 255548 - DNA, 20 bp, Artificial Sequence
  chemically synthesized
agctaaaaaaactttaaaat

SEQ ID NO: 255549 - DNA, 20 bp, Artificial Sequence
  chemically synthesized
ctcttattttaaagtttttt

SEQ ID NO: 255550 - DNA, 20 bp, Artificial Sequence
  chemically synthesized
ttttaaagtttttttagctt

SEQ ID NO: 255551 - DNA, 20 bp, Artificial Sequence
  chemically synthesized
cagatgtggcaaatattcta

SEQ ID NO: 255552 - DNA, 20 bp, Artificial Sequence
  chemically synthesized
tttagaatatttgccacatc

SEQ ID NO: 255553 - DNA, 20 bp, Artificial Sequence
  chemically synthesized
cgtaaagttatttccagatg

SEQ ID NO: 255554 - DNA, 20 bp, Artificial Sequence
  chemically synthesized
aatatacgtaaagttatttc

SEQ ID NO: 255555 - DNA, 20 bp, Artificial Sequence
  chemically synthesized
aaccacataaaatatacgta

SEQ ID NO: 255556 - DNA, 20 bp, Artificial Sequence
  chemically synthesized
aactttacgtatattttatg

SEQ ID NO: 255557 - DNA, 20 bp, Artificial Sequence
  chemically synthesized
tgtggttaacattttattta

SEQ ID NO: 255558 - DNA, 20 bp, Artificial Sequence
  chemically synthesized
cattttatttacagtttttt

SEQ ID NO: 255559 - DNA, 20 bp, Artificial Sequence
  chemically synthesized
taatgtttaacacattctta

SEQ ID NO: 255560 - DNA, 20 bp, Artificial Sequence
  chemically synthesized
aatgtttaacacattcttaa

SEQ ID NO: 255561 - DNA, 20 bp, Artificial Sequence
  chemically synthesized
cctaaaaacaaattaccttt

SEQ ID NO: 255562 - DNA, 20 bp, Artificial Sequence
  chemically synthesized
tcttaaaggtaatttgtttt

SEQ ID NO: 255563 - DNA, 20 bp, Artificial Sequence
  chemically synthesized
cttaaaggtaatttgttttt

SEQ ID NO: 255564 - DNA, 20 bp, Artificial Sequence
  chemically synthesized
tgtttttaggatactttacg

SEQ ID NO: 255565 - DNA, 20 bp, Artificial Sequence
  chemically synthesized
aagttataaatttccacgta

SEQ ID NO: 255566 - DNA, 20 bp, Artificial Sequence
  chemically synthesized
gtggaaatttataactttct

SEQ ID NO: 255567 - DNA, 20 bp, Artificial Sequence
  chemically synthesized
aaacatcccaaattctaaga

SEQ ID NO: 255568 - DNA, 20 bp, Artificial Sequence
  chemically synthesized
tttataactttcttagaatt

SEQ ID NO: 255569 - DNA, 20 bp, Artificial Sequence
  chemically synthesized
ttataactttcttagaattt

SEQ ID NO: 255570 - DNA, 20 bp, Artificial Sequence
  chemically synthesized
catcaaacatcccaaattct

SEQ ID NO: 255571 - DNA, 20 bp, Artificial Sequence
  chemically synthesized
agaatttgggatgtttgatg

SEQ ID NO: 255572 - DNA, 20 bp, Artificial Sequence
  chemically synthesized
tgtataattatataaatttc

SEQ ID NO: 255573 - DNA, 20 bp, Artificial Sequence
  chemically synthesized
tatataattatacattttaa

SEQ ID NO: 255574 - DNA, 20 bp, Artificial Sequence
  chemically synthesized
atataattatacattttaac

SEQ ID NO: 255575 - DNA, 20 bp, Artificial Sequence
  chemically synthesized
ttaacaggaattttcctaca

SEQ ID NO: 255576 - DNA, 20 bp, Artificial Sequence
  chemically synthesized
gaaatcatgtacgactgtgt

SEQ ID NO: 255577 - DNA, 20 bp, Artificial Sequence
  chemically synthesized
tgaaatcatgtacgactgtg

SEQ ID NO: 255578 - DNA, 20 bp, Artificial Sequence
  chemically synthesized
actgtactcttgtgaagata

SEQ ID NO: 255579 - DNA, 20 bp, Artificial Sequence
  chemically synthesized
tgatttcactgtatcttcac

SEQ ID NO: 255580 - DNA, 20 bp, Artificial Sequence
  chemically synthesized
atttcactgtatcttcacaa

SEQ ID NO: 255581 - DNA, 20 bp, Artificial Sequence
  chemically synthesized
tactcaactgtactcttgtg

SEQ ID NO: 255582 - DNA, 20 bp, Artificial Sequence
  chemically synthesized
actgtatcttcacaagagta

SEQ ID NO: 255583 - DNA, 20 bp, Artificial Sequence
  chemically synthesized
atcttcacaagagtacagtt

SEQ ID NO: 255584 - DNA, 20 bp, Artificial Sequence
  chemically synthesized
ttcacaagagtacagttgag

SEQ ID NO: 255585 - DNA, 20 bp, Artificial Sequence
  chemically synthesized
tcacaagagtacagttgagt

SEQ ID NO: 255586 - DNA, 20 bp, Artificial Sequence
  chemically synthesized
caagagtacagttgagtagg

SEQ ID NO: 255587 - DNA, 20 bp, Artificial Sequence
  chemically synthesized
aagagtacagttgagtaggc

SEQ ID NO: 255588 - DNA, 20 bp, Artificial Sequence
  chemically synthesized
agagtacagttgagtaggca

SEQ ID NO: 255589 - DNA, 20 bp, Artificial Sequence
  chemically synthesized
gagtacagttgagtaggcag

SEQ ID NO: 255590 - DNA, 20 bp, Artificial Sequence
  chemically synthesized
tacagttgagtaggcagggg

SEQ ID NO: 255591 - DNA, 20 bp, Artificial Sequence
  chemically synthesized
ttttaacgttgaaattaaat

SEQ ID NO: 255592 - DNA, 20 bp, Artificial Sequence
  chemically synthesized
ttaatttcaacgttaaaaaa

SEQ ID NO: 255593 - DNA, 20 bp, Artificial Sequence
  chemically synthesized
taatttcaacgttaaaaaac

SEQ ID NO: 255594 - DNA, 20 bp, Artificial Sequence
  chemically synthesized
gcaagtaacataagatattt

SEQ ID NO: 255595 - DNA, 20 bp, Artificial Sequence
  chemically synthesized
ggcaagtaacataagatatt

SEQ ID NO: 255596 - DNA, 20 bp, Artificial Sequence
  chemically synthesized
tacccttgggcaagtaacat

SEQ ID NO: 255597 - DNA, 20 bp, Artificial Sequence
  chemically synthesized
atatcttatgttacttgccc

SEQ ID NO: 255598 - DNA, 20 bp, Artificial Sequence
  chemically synthesized
tatcttatgttacttgccca

SEQ ID NO: 255599 - DNA, 20 bp, Artificial Sequence
  chemically synthesized
atcttatgttacttgcccaa

SEQ ID NO: 255600 - DNA, 20 bp, Artificial Sequence
  chemically synthesized
tgatagttgtacccttgggc

SEQ ID NO: 255601 - DNA, 20 bp, Artificial Sequence
  chemically synthesized
ttgttgatagttgtaccctt

SEQ ID NO: 255602 - DNA, 20 bp, Artificial Sequence
  chemically synthesized
attgttgatagttgtaccct

SEQ ID NO: 255603 - DNA, 20 bp, Artificial Sequence
  chemically synthesized
agatttaacctgattgttga

SEQ ID NO: 255604 - DNA, 20 bp, Artificial Sequence
  chemically synthesized
agggtacaactatcaacaat

SEQ ID NO: 255605 - DNA, 20 bp, Artificial Sequence
  chemically synthesized
gggtacaactatcaacaatc

SEQ ID NO: 255606 - DNA, 20 bp, Artificial Sequence
  chemically synthesized
caatcaggttaaatctttct

SEQ ID NO: 255607 - DNA, 20 bp, Artificial Sequence
  chemically synthesized
tggaacctgaaaagcttaga

SEQ ID NO: 255608 - DNA, 20 bp, Artificial Sequence
  chemically synthesized
ttaaatctttctaagctttt

SEQ ID NO: 255609 - DNA, 20 bp, Artificial Sequence
  chemically synthesized
gtattggaacctgaaaagct

SEQ ID NO: 255610 - DNA, 20 bp, Artificial Sequence
  chemically synthesized
taaatctttctaagcttttc

SEQ ID NO: 255611 - DNA, 20 bp, Artificial Sequence
  chemically synthesized
gtactgtattggaacctgaa

SEQ ID NO: 255612 - DNA, 20 bp, Artificial Sequence
  chemically synthesized
aagcttttcaggttccaata

SEQ ID NO: 255613 - DNA, 20 bp, Artificial Sequence
  chemically synthesized
agtttagcaaagtactgtat

SEQ ID NO: 255614 - DNA, 20 bp, Artificial Sequence
  chemically synthesized
gtagagtagagagtttagca

SEQ ID NO: 255615 - DNA, 20 bp, Artificial Sequence
  chemically synthesized
aagcagtagagtagagagtt

SEQ ID NO: 255616 - DNA, 20 bp, Artificial Sequence
  chemically synthesized
atgataagcagtagagtaga

SEQ ID NO: 255617 - DNA, 20 bp, Artificial Sequence
  chemically synthesized
ttatgataagcagtagagta

SEQ ID NO: 255618 - DNA, 20 bp, Artificial Sequence
  chemically synthesized
ggttatgataagcagtagag

SEQ ID NO: 255619 - DNA, 20 bp, Artificial Sequence
  chemically synthesized
tgtggttatgataagcagta

SEQ ID NO: 255620 - DNA, 20 bp, Artificial Sequence
  chemically synthesized
tatgtggttatgataagcag

SEQ ID NO: 255621 - DNA, 20 bp, Artificial Sequence
  chemically synthesized
cattatgtggttatgataag

SEQ ID NO: 255622 - DNA, 20 bp, Artificial Sequence
  chemically synthesized
tttcattatgtggttatgat

SEQ ID NO: 255623 - DNA, 20 bp, Artificial Sequence
  chemically synthesized
atcagtgagctttcattatg

SEQ ID NO: 255624 - DNA, 20 bp, Artificial Sequence
  chemically synthesized
ttatcataaccacataatga

SEQ ID NO: 255625 - DNA, 20 bp, Artificial Sequence
  chemically synthesized
ataatgaaagctcactgatg

SEQ ID NO: 255626 - DNA, 20 bp, Artificial Sequence
  chemically synthesized
taacatttttccacatcagt

SEQ ID NO: 255627 - DNA, 20 bp, Artificial Sequence
  chemically synthesized
ttactaacatttttccacat

SEQ ID NO: 255628 - DNA, 20 bp, Artificial Sequence
  chemically synthesized
tcactgatgtggaaaaatgt

SEQ ID NO: 255629 - DNA, 20 bp, Artificial Sequence
  chemically synthesized
agtaatgttttaattatatg

SEQ ID NO: 255630 - DNA, 20 bp, Artificial Sequence
  chemically synthesized
gtaatgttttaattatatgt

SEQ ID NO: 255631 - DNA, 20 bp, Artificial Sequence
  chemically synthesized
atttatgaaaatgtgtgaca

SEQ ID NO: 255632 - DNA, 20 bp, Artificial Sequence
  chemically synthesized
catttatgaaaatgtgtgac

SEQ ID NO: 255633 - DNA, 20 bp, Artificial Sequence
  chemically synthesized
tcatttatgaaaatgtgtga

SEQ ID NO: 255634 - DNA, 20 bp, Artificial Sequence
  chemically synthesized
attttcataaatgattgttt

SEQ ID NO: 255635 - DNA, 20 bp, Artificial Sequence
  chemically synthesized
ataaatgattgttttagatt

SEQ ID NO: 255636 - DNA, 20 bp, Artificial Sequence
  chemically synthesized
agattcagtatatacaaacc

SEQ ID NO: 255637 - DNA, 20 bp, Artificial Sequence
  chemically synthesized
aagcatgaagaaattgttct

SEQ ID NO: 255638 - DNA, 20 bp, Artificial Sequence
  chemically synthesized
taagcatgaagaaattgttc

SEQ ID NO: 255639 - DNA, 20 bp, Artificial Sequence
  chemically synthesized
tctatatgcatataagcatg

SEQ ID NO: 255640 - DNA, 20 bp, Artificial Sequence
  chemically synthesized
ctacaaatctatatgcatat

SEQ ID NO: 255641 - DNA, 20 bp, Artificial Sequence
  chemically synthesized
tcttcatgcttatatgcata

SEQ ID NO: 255642 - DNA, 20 bp, Artificial Sequence
  chemically synthesized
cttatatgcatatagatttg

SEQ ID NO: 255643 - DNA, 20 bp, Artificial Sequence
  chemically synthesized
atttgtagaatgcacatgtc

SEQ ID NO: 255644 - DNA, 20 bp, Artificial Sequence
  chemically synthesized
actcactgagttaaatcatc

SEQ ID NO: 255645 - DNA, 20 bp, Artificial Sequence
  chemically synthesized
catgtctagatgatttaact

SEQ ID NO: 255646 - DNA, 20 bp, Artificial Sequence
  chemically synthesized
tctagatgatttaactcagt

SEQ ID NO: 255647 - DNA, 20 bp, Artificial Sequence
  chemically synthesized
gatgatttaactcagtgagt

SEQ ID NO: 255648 - DNA, 20 bp, Artificial Sequence
  chemically synthesized
atattgtatcctaactcact

SEQ ID NO: 255649 - DNA, 20 bp, Artificial Sequence
  chemically synthesized
atgatttaactcagtgagtt

SEQ ID NO: 255650 - DNA, 20 bp, Artificial Sequence
  chemically synthesized
gagttaggatacaatataaa

SEQ ID NO: 255651 - DNA, 20 bp, Artificial Sequence
  chemically synthesized
ttaggatacaatataaaaag

SEQ ID NO: 255652 - DNA, 20 bp, Artificial Sequence
  chemically synthesized
aatataaaaagaagtaaatt

SEQ ID NO: 255653 - DNA, 20 bp, Artificial Sequence
  chemically synthesized
gtaaatttggttttctcttt

SEQ ID NO: 255654 - DNA, 20 bp, Artificial Sequence
  chemically synthesized
agtaagcgctggtactaaaa

SEQ ID NO: 255655 - DNA, 20 bp, Artificial Sequence
  chemically synthesized
ttggttttctcttttagtac

SEQ ID NO: 255656 - DNA, 20 bp, Artificial Sequence
  chemically synthesized
ttagtaagcgctggtactaa

SEQ ID NO: 255657 - DNA, 20 bp, Artificial Sequence
  chemically synthesized
agggcagtgttagtaagcgc

SEQ ID NO: 255658 - DNA, 20 bp, Artificial Sequence
  chemically synthesized
gaagacagggcagtgttagt

SEQ ID NO: 255659 - DNA, 20 bp, Artificial Sequence
  chemically synthesized
agaagaagacagggcagtgt

SEQ ID NO: 255660 - DNA, 20 bp, Artificial Sequence
  chemically synthesized
tgagatagaagaagacaggg

SEQ ID NO: 255661 - DNA, 20 bp, Artificial Sequence
  chemically synthesized
ctctgagatagaagaagaca

SEQ ID NO: 255662 - DNA, 20 bp, Artificial Sequence
  chemically synthesized
actctgagatagaagaagac

SEQ ID NO: 255663 - DNA, 20 bp, Artificial Sequence
  chemically synthesized
gactctgagatagaagaaga

SEQ ID NO: 255664 - DNA, 20 bp, Artificial Sequence
  chemically synthesized
tgtggactctgagatagaag

SEQ ID NO: 255665 - DNA, 20 bp, Artificial Sequence
  chemically synthesized
tgccctgtcttcttctatct

SEQ ID NO: 255666 - DNA, 20 bp, Artificial Sequence
  chemically synthesized
aggtgtggactctgagatag

SEQ ID NO: 255667 - DNA, 20 bp, Artificial Sequence
  chemically synthesized
ccctgtcttcttctatctca

SEQ ID NO: 255668 - DNA, 20 bp, Artificial Sequence
  chemically synthesized
tgtaggtgtggactctgaga

SEQ ID NO: 255669 - DNA, 20 bp, Artificial Sequence
  chemically synthesized
tacatgtaggtgtggactct

SEQ ID NO: 255670 - DNA, 20 bp, Artificial Sequence
  chemically synthesized
tggtctgatacatgtaggtg

SEQ ID NO: 255671 - DNA, 20 bp, Artificial Sequence
  chemically synthesized
agtgatggtctgatacatgt

SEQ ID NO: 255672 - DNA, 20 bp, Artificial Sequence
  chemically synthesized
gagtccacacctacatgtat

SEQ ID NO: 255673 - DNA, 20 bp, Artificial Sequence
  chemically synthesized
gagtgatggtctgatacatg

SEQ ID NO: 255674 - DNA, 20 bp, Artificial Sequence
  chemically synthesized
tctgttgaattagtgagtga

SEQ ID NO: 255675 - DNA, 20 bp, Artificial Sequence
  chemically synthesized
tgtacatctgttgaattagt

SEQ ID NO: 255676 - DNA, 20 bp, Artificial Sequence
  chemically synthesized
accatcactcactaattcaa

SEQ ID NO: 255677 - DNA, 20 bp, Artificial Sequence
  chemically synthesized
tgaatgtacatctgttgaat

SEQ ID NO: 255678 - DNA, 20 bp, Artificial Sequence
  chemically synthesized
taattcaacagatgtacatt

SEQ ID NO: 255679 - DNA, 20 bp, Artificial Sequence
  chemically synthesized
gatgtacattcagtaccttt

SEQ ID NO: 255680 - DNA, 20 bp, Artificial Sequence
  chemically synthesized
gaacagcacctagcacttaa

SEQ ID NO: 255681 - DNA, 20 bp, Artificial Sequence
  chemically synthesized
cattcagtacctttaagtgc

SEQ ID NO: 255682 - DNA, 20 bp, Artificial Sequence
  chemically synthesized
agaacagcacctagcactta

SEQ ID NO: 255683 - DNA, 20 bp, Artificial Sequence
  chemically synthesized
attcagtacctttaagtgct

SEQ ID NO: 255684 - DNA, 20 bp, Artificial Sequence
  chemically synthesized
agaactcctagaacagcacc

SEQ ID NO: 255685 - DNA, 20 bp, Artificial Sequence
  chemically synthesized
ttaagtgctaggtgctgttc

SEQ ID NO: 255686 - DNA, 20 bp, Artificial Sequence
  chemically synthesized
taagtgctaggtgctgttct

SEQ ID NO: 255687 - DNA, 20 bp, Artificial Sequence
  chemically synthesized
agtgctaggtgctgttctag

SEQ ID NO: 255688 - DNA, 20 bp, Artificial Sequence
  chemically synthesized
tgtatctagaactcctagaa

SEQ ID NO: 255689 - DNA, 20 bp, Artificial Sequence
  chemically synthesized
aggtgctgttctaggagttc

SEQ ID NO: 255690 - DNA, 20 bp, Artificial Sequence
  chemically synthesized
accactgtatctagaactcc

SEQ ID NO: 255691 - DNA, 20 bp, Artificial Sequence
  chemically synthesized
tgttctaggagttctagata

SEQ ID NO: 255692 - DNA, 20 bp, Artificial Sequence
  chemically synthesized
tctaggagttctagatacag

SEQ ID NO: 255693 - DNA, 20 bp, Artificial Sequence
  chemically synthesized
ttttcctccaccactgtatc

SEQ ID NO: 255694 - DNA, 20 bp, Artificial Sequence
  chemically synthesized
aggagttctagatacagtgg

SEQ ID NO: 255695 - DNA, 20 bp, Artificial Sequence
  chemically synthesized
gagttctagatacagtggtg

SEQ ID NO: 255696 - DNA, 20 bp, Artificial Sequence
  chemically synthesized
agttctagatacagtggtgg

SEQ ID NO: 255697 - DNA, 20 bp, Artificial Sequence
  chemically synthesized
ggaggaaaaaaacaacaaac

SEQ ID NO: 255698 - DNA, 20 bp, Artificial Sequence
  chemically synthesized
cagccaccaggaagaaaaat

SEQ ID NO: 255699 - DNA, 20 bp, Artificial Sequence
  chemically synthesized
aagatactaatttttcttcc

SEQ ID NO: 255700 - DNA, 20 bp, Artificial Sequence
  chemically synthesized
atactaatttttcttcctgg

SEQ ID NO: 255701 - DNA, 20 bp, Artificial Sequence
  chemically synthesized
acatacacacagccaccagg

SEQ ID NO: 255702 - DNA, 20 bp, Artificial Sequence
  chemically synthesized
gatacatacacacagccacc

SEQ ID NO: 255703 - DNA, 20 bp, Artificial Sequence
  chemically synthesized
tgatacatacacacagccac

SEQ ID NO: 255704 - DNA, 20 bp, Artificial Sequence
  chemically synthesized
aagaaggtgatacatacaca

SEQ ID NO: 255705 - DNA, 20 bp, Artificial Sequence
  chemically synthesized
cagtgctacatttttcaaga

SEQ ID NO: 255706 - DNA, 20 bp, Artificial Sequence
  chemically synthesized
gcagtgctacatttttcaag

SEQ ID NO: 255707 - DNA, 20 bp, Artificial Sequence
  chemically synthesized
actgcagtgctacatttttc

SEQ ID NO: 255708 - DNA, 20 bp, Artificial Sequence
  chemically synthesized
tatcaccttcttgaaaaatg

SEQ ID NO: 255709 - DNA, 20 bp, Artificial Sequence
  chemically synthesized
tcttgaaaaatgtagcactg

SEQ ID NO: 255710 - DNA, 20 bp, Artificial Sequence
  chemically synthesized
atgtataacccatgtaactg

SEQ ID NO: 255711 - DNA, 20 bp, Artificial Sequence
  chemically synthesized
aatgtagcactgcagttaca

SEQ ID NO: 255712 - DNA, 20 bp, Artificial Sequence
  chemically synthesized
atgtagcactgcagttacat

SEQ ID NO: 255713 - DNA, 20 bp, Artificial Sequence
  chemically synthesized
taaacactatacatgcattt

SEQ ID NO: 255714 - DNA, 20 bp, Artificial Sequence
  chemically synthesized
catatacttaaatgcatgta

SEQ ID NO: 255715 - DNA, 20 bp, Artificial Sequence
  chemically synthesized
aaatgcatgtatagtgttta

SEQ ID NO: 255716 - DNA, 20 bp, Artificial Sequence
  chemically synthesized
aatagtgcctagagttttat

SEQ ID NO: 255717 - DNA, 20 bp, Artificial Sequence
  chemically synthesized
tttatagacttataaaactc

SEQ ID NO: 255718 - DNA, 20 bp, Artificial Sequence
  chemically synthesized
ttatagacttataaaactct

SEQ ID NO: 255719 - DNA, 20 bp, Artificial Sequence
  chemically synthesized
tatgacgacaatagtgccta

SEQ ID NO: 255720 - DNA, 20 bp, Artificial Sequence
  chemically synthesized
aatatgacgacaatagtgcc

SEQ ID NO: 255721 - DNA, 20 bp, Artificial Sequence
  chemically synthesized
ttcccaaaatatgacgacaa

SEQ ID NO: 255722 - DNA, 20 bp, Artificial Sequence
  chemically synthesized
gcactattgtcgtcatattt

SEQ ID NO: 255723 - DNA, 20 bp, Artificial Sequence
  chemically synthesized
cactattgtcgtcatatttt

SEQ ID NO: 255724 - DNA, 20 bp, Artificial Sequence
  chemically synthesized
tattgtcgtcatattttggg

SEQ ID NO: 255725 - DNA, 20 bp, Artificial Sequence
  chemically synthesized
attgtcgtcatattttggga

SEQ ID NO: 255726 - DNA, 20 bp, Artificial Sequence
  chemically synthesized
ttttgggaaggtgaaaataa

SEQ ID NO: 255727 - DNA, 20 bp, Artificial Sequence
  chemically synthesized
aaggtgaaaataatagcttt

SEQ ID NO: 255728 - DNA, 20 bp, Artificial Sequence
  chemically synthesized
gtgaaaataatagctttaag

SEQ ID NO: 255729 - DNA, 20 bp, Artificial Sequence
  chemically synthesized
ctgatacctaaaactgctta

SEQ ID NO: 255730 - DNA, 20 bp, Artificial Sequence
  chemically synthesized
ataatagctttaagcagttt

SEQ ID NO: 255731 - DNA, 20 bp, Artificial Sequence
  chemically synthesized
taatagctttaagcagtttt

SEQ ID NO: 255732 - DNA, 20 bp, Artificial Sequence
  chemically synthesized
ctttaagcagttttaggtat

SEQ ID NO: 255733 - DNA, 20 bp, Artificial Sequence
  chemically synthesized
ttaggtatcagaaatgcctt

SEQ ID NO: 255734 - DNA, 20 bp, Artificial Sequence
  chemically synthesized
ccaagttacaaagtgtctca

SEQ ID NO: 255735 - DNA, 20 bp, Artificial Sequence
  chemically synthesized
accaagttacaaagtgtctc

SEQ ID NO: 255736 - DNA, 20 bp, Artificial Sequence
  chemically synthesized
ccttgagacactttgtaact

SEQ ID NO: 255737 - DNA, 20 bp, Artificial Sequence
  chemically synthesized
cctctgttaaccaagttaca

SEQ ID NO: 255738 - DNA, 20 bp, Artificial Sequence
  chemically synthesized
acactttgtaacttggttaa

SEQ ID NO: 255739 - DNA, 20 bp, Artificial Sequence
  chemically synthesized
tatgtgctcctctgttaacc

SEQ ID NO: 255740 - DNA, 20 bp, Artificial Sequence
  chemically synthesized
actttgtaacttggttaaca

SEQ ID NO: 255741 - DNA, 20 bp, Artificial Sequence
  chemically synthesized
ctttgtaacttggttaacag

SEQ ID NO: 255742 - DNA, 20 bp, Artificial Sequence
  chemically synthesized
ttgtaacttggttaacagag

SEQ ID NO: 255743 - DNA, 20 bp, Artificial Sequence
  chemically synthesized
tccttttttcttagaaatga

SEQ ID NO: 255744 - DNA, 20 bp, Artificial Sequence
  chemically synthesized
agcacataactttcatttct

SEQ ID NO: 255745 - DNA, 20 bp, Artificial Sequence
  chemically synthesized
aactttcatttctaagaaaa

SEQ ID NO: 255746 - DNA, 20 bp, Artificial Sequence
  chemically synthesized
actttcatttctaagaaaaa

SEQ ID NO: 255747 - DNA, 20 bp, Artificial Sequence
  chemically synthesized
tttttctaatccttttttct

SEQ ID NO: 255748 - DNA, 20 bp, Artificial Sequence
  chemically synthesized
catttctaagaaaaaaggat

SEQ ID NO: 255749 - DNA, 20 bp, Artificial Sequence
  chemically synthesized
aaaggattagaaaaacccat

SEQ ID NO: 255750 - DNA, 20 bp, Artificial Sequence
  chemically synthesized
ctgtcacaacagttactaat

SEQ ID NO: 255751 - DNA, 20 bp, Artificial Sequence
  chemically synthesized
gctgtcacaacagttactaa

SEQ ID NO: 255752 - DNA, 20 bp, Artificial Sequence
  chemically synthesized
cccattagtaactgttgtga

SEQ ID NO: 255753 - DNA, 20 bp, Artificial Sequence
  chemically synthesized
cccaacggccgctgtcacaa

SEQ ID NO: 255754 - DNA, 20 bp, Artificial Sequence
  chemically synthesized
attagtaactgttgtgacag

SEQ ID NO: 255755 - DNA, 20 bp, Artificial Sequence
  chemically synthesized
actgttgtgacagcggccgt

SEQ ID NO: 255756 - DNA, 20 bp, Artificial Sequence
  chemically synthesized
ctgttgtgacagcggccgtt

SEQ ID NO: 255757 - DNA, 20 bp, Artificial Sequence
  chemically synthesized
tgttgtgacagcggccgttg

SEQ ID NO: 255758 - DNA, 20 bp, Artificial Sequence
  chemically synthesized
ttgtgacagcggccgttggg

SEQ ID NO: 255759 - DNA, 20 bp, Artificial Sequence
  chemically synthesized
aagatagatctactccccaa

SEQ ID NO: 255760 - DNA, 20 bp, Artificial Sequence
  chemically synthesized
tgacagcggccgttggggag

SEQ ID NO: 255761 - DNA, 20 bp, Artificial Sequence
  chemically synthesized
tctctttttccattttaaga

SEQ ID NO: 255762 - DNA, 20 bp, Artificial Sequence
  chemically synthesized
ggagtagatctatcttaaaa

SEQ ID NO: 255763 - DNA, 20 bp, Artificial Sequence
  chemically synthesized
tatttctctttttccatttt

SEQ ID NO: 255764 - DNA, 20 bp, Artificial Sequence
  chemically synthesized
gatctatcttaaaatggaaa

SEQ ID NO: 255765 - DNA, 20 bp, Artificial Sequence
  chemically synthesized
tctatcttaaaatggaaaaa

SEQ ID NO: 255766 - DNA, 20 bp, Artificial Sequence
  chemically synthesized
taaaatggaaaaagagaaat

SEQ ID NO: 255767 - DNA, 20 bp, Artificial Sequence
  chemically synthesized
aaatggaaaaagagaaataa

SEQ ID NO: 255768 - DNA, 20 bp, Artificial Sequence
  chemically synthesized
aaagagaaataagagaacca

SEQ ID NO: 255769 - DNA, 20 bp, Artificial Sequence
  chemically synthesized
tgaactggagtttgagtctt

SEQ ID NO: 255770 - DNA, 20 bp, Artificial Sequence
  chemically synthesized
agaaccaaagactcaaactc

SEQ ID NO: 255771 - DNA, 20 bp, Artificial Sequence
  chemically synthesized
gtgaaaatgaactggagttt

SEQ ID NO: 255772 - DNA, 20 bp, Artificial Sequence
  chemically synthesized
cagagagtgaaaatgaactg

SEQ ID NO: 255773 - DNA, 20 bp, Artificial Sequence
  chemically synthesized
tccagagagtgaaaatgaac

SEQ ID NO: 255774 - DNA, 20 bp, Artificial Sequence
  chemically synthesized
tccagttcattttcactctc

SEQ ID NO: 255775 - DNA, 20 bp, Artificial Sequence
  chemically synthesized
agataaagacaaattccaga

SEQ ID NO: 255776 - DNA, 20 bp, Artificial Sequence
  chemically synthesized
tcagataaagacaaattcca

SEQ ID NO: 255777 - DNA, 20 bp, Artificial Sequence
  chemically synthesized
tgtcagataaagacaaattc

SEQ ID NO: 255778 - DNA, 20 bp, Artificial Sequence
  chemically synthesized
tggaatttgtctttatctga

SEQ ID NO: 255779 - DNA, 20 bp, Artificial Sequence
  chemically synthesized
ttgcctttatctgtcagata

SEQ ID NO: 255780 - DNA, 20 bp, Artificial Sequence
  chemically synthesized
ttgtctttatctgacagata

SEQ ID NO: 255781 - DNA, 20 bp, Artificial Sequence
  chemically synthesized
agggtgttgcctttatctgt

SEQ ID NO: 255782 - DNA, 20 bp, Artificial Sequence
  chemically synthesized
tgtctttatctgacagataa

SEQ ID NO: 255783 - DNA, 20 bp, Artificial Sequence
  chemically synthesized
gtaagaattagatttatata

SEQ ID NO: 255784 - DNA, 20 bp, Artificial Sequence
  chemically synthesized
tgtaagaattagatttatat

SEQ ID NO: 255785 - DNA, 20 bp, Artificial Sequence
  chemically synthesized
gtgtaagaattagatttata

SEQ ID NO: 255786 - DNA, 20 bp, Artificial Sequence
  chemically synthesized
gatgtgaagagtgtaagaat

SEQ ID NO: 255787 - DNA, 20 bp, Artificial Sequence
  chemically synthesized
ggatgggatgtgaagagtgt

SEQ ID NO: 255788 - DNA, 20 bp, Artificial Sequence
  chemically synthesized
gtagctggatgggatgtgaa

SEQ ID NO: 255789 - DNA, 20 bp, Artificial Sequence
  chemically synthesized
tggtagctggatgggatgtg

SEQ ID NO: 255790 - DNA, 20 bp, Artificial Sequence
  chemically synthesized
tacactcttcacatcccatc

SEQ ID NO: 255791 - DNA, 20 bp, Artificial Sequence
  chemically synthesized
gtagtgcctggtagctggat

SEQ ID NO: 255792 - DNA, 20 bp, Artificial Sequence
  chemically synthesized
tgtagtgcctggtagctgga

SEQ ID NO: 255793 - DNA, 20 bp, Artificial Sequence
  chemically synthesized
ttcacatcccatccagctac

SEQ ID NO: 255794 - DNA, 20 bp, Artificial Sequence
  chemically synthesized
tcacatcccatccagctacc

SEQ ID NO: 255795 - DNA, 20 bp, Artificial Sequence
  chemically synthesized
ttaatgtagtgcctggtagc

SEQ ID NO: 255796 - DNA, 20 bp, Artificial Sequence
  chemically synthesized
gtcattaatgtagtgcctgg

SEQ ID NO: 255797 - DNA, 20 bp, Artificial Sequence
  chemically synthesized
tatgtcattaatgtagtgcc

SEQ ID NO: 255798 - DNA, 20 bp, Artificial Sequence
  chemically synthesized
aattcgatatgtcattaatg

SEQ ID NO: 255799 - DNA, 20 bp, Artificial Sequence
  chemically synthesized
acattaatgacatatcgaat

SEQ ID NO: 255800 - DNA, 20 bp, Artificial Sequence
  chemically synthesized
cattaatgacatatcgaatt

SEQ ID NO: 255801 - DNA, 20 bp, Artificial Sequence
  chemically synthesized
taatgccttttgattgaaca

SEQ ID NO: 255802 - DNA, 20 bp, Artificial Sequence
  chemically synthesized
tgggaactgtgttcaatcaa

SEQ ID NO: 255803 - DNA, 20 bp, Artificial Sequence
  chemically synthesized
gggaactgtgttcaatcaaa

SEQ ID NO: 255804 - DNA, 20 bp, Artificial Sequence
  chemically synthesized
tgttcaatcaaaaggcatta

SEQ ID NO: 255805 - DNA, 20 bp, Artificial Sequence
  chemically synthesized
gcattaaagtacttattaac

SEQ ID NO: 255806 - DNA, 20 bp, Artificial Sequence
  chemically synthesized
cattaaagtacttattaact

SEQ ID NO: 255807 - DNA, 20 bp, Artificial Sequence
  chemically synthesized
ctccgtaaaacctagttaat

SEQ ID NO: 255808 - DNA, 20 bp, Artificial Sequence
  chemically synthesized
tacttattaactaggtttta

SEQ ID NO: 255809 - DNA, 20 bp, Artificial Sequence
  chemically synthesized
tttggaagctccgtaaaacc

SEQ ID NO: 255810 - DNA, 20 bp, Artificial Sequence
  chemically synthesized
cttattaactaggttttacg

SEQ ID NO: 255811 - DNA, 20 bp, Artificial Sequence
  chemically synthesized
ttttacggagcttccaaaaa

SEQ ID NO: 255812 - DNA, 20 bp, Artificial Sequence
  chemically synthesized
aactttttaactttttttgg

SEQ ID NO: 255813 - DNA, 20 bp, Artificial Sequence
  chemically synthesized
aataactttttaactttttt

SEQ ID NO: 255814 - DNA, 20 bp, Artificial Sequence
  chemically synthesized
agcttccaaaaaaagttaaa

SEQ ID NO: 255815 - DNA, 20 bp, Artificial Sequence
  chemically synthesized
aaaagttaaaaagttatttt

SEQ ID NO: 255816 - DNA, 20 bp, Artificial Sequence
  chemically synthesized
agttaaaaagttatttttgg

SEQ ID NO: 255817 - DNA, 20 bp, Artificial Sequence
  chemically synthesized
agttatttttggtggctcta

SEQ ID NO: 255818 - DNA, 20 bp, Artificial Sequence
  chemically synthesized
atttttggtggctctatggt

SEQ ID NO: 255819 - DNA, 20 bp, Artificial Sequence
  chemically synthesized
tttttggtggctctatggta

SEQ ID NO: 255820 - DNA, 20 bp, Artificial Sequence
  chemically synthesized
taaaaggtcaccttaccata

SEQ ID NO: 255821 - DNA, 20 bp, Artificial Sequence
  chemically synthesized
attaaaaggtcaccttacca

SEQ ID NO: 255822 - DNA, 20 bp, Artificial Sequence
  chemically synthesized
accatgaagaaaaaattaaa

SEQ ID NO: 255823 - DNA, 20 bp, Artificial Sequence
  chemically synthesized
aaccatgaagaaaaaattaa

SEQ ID NO: 255824 - DNA, 20 bp, Artificial Sequence
  chemically synthesized
accttttaattttttcttca

SEQ ID NO: 255825 - DNA, 20 bp, Artificial Sequence
  chemically synthesized
catggggacaataaaccatg

SEQ ID NO: 255826 - DNA, 20 bp, Artificial Sequence
  chemically synthesized
atggtttattgtccccatgt

SEQ ID NO: 255827 - DNA, 20 bp, Artificial Sequence
  chemically synthesized
agaaagtgttttctcacatg

SEQ ID NO: 255828 - DNA, 20 bp, Artificial Sequence
  chemically synthesized
tagaaagtgttttctcacat

SEQ ID NO: 255829 - DNA, 20 bp, Artificial Sequence
  chemically synthesized
ttagaaagtgttttctcaca

SEQ ID NO: 255830 - DNA, 20 bp, Artificial Sequence
  chemically synthesized
aatacgtagctgtgtttaga

SEQ ID NO: 255831 - DNA, 20 bp, Artificial Sequence
  chemically synthesized
gagaaaacactttctaaaca

SEQ ID NO: 255832 - DNA, 20 bp, Artificial Sequence
  chemically synthesized
tccaaatacgtagctgtgtt

SEQ ID NO: 255833 - DNA, 20 bp, Artificial Sequence
  chemically synthesized
tctaaacacagctacgtatt

SEQ ID NO: 255834 - DNA, 20 bp, Artificial Sequence
  chemically synthesized
aatattttggtccaaatacg

SEQ ID NO: 255835 - DNA, 20 bp, Artificial Sequence
  chemically synthesized
tcatcctatgaagaatattt

SEQ ID NO: 255836 - DNA, 20 bp, Artificial Sequence
  chemically synthesized
ttggaccaaaatattcttca

SEQ ID NO: 255837 - DNA, 20 bp, Artificial Sequence
  chemically synthesized
tggaccaaaatattcttcat

SEQ ID NO: 255838 - DNA, 20 bp, Artificial Sequence
  chemically synthesized
agacaatgcatcatcctatg

SEQ ID NO: 255839 - DNA, 20 bp, Artificial Sequence
  chemically synthesized
actgattcgttatttatgca

SEQ ID NO: 255840 - DNA, 20 bp, Artificial Sequence
  chemically synthesized
tctttgcataaataacgaat

SEQ ID NO: 255841 - DNA, 20 bp, Artificial Sequence
  chemically synthesized
ataaaaaacgacattataac

SEQ ID NO: 255842 - DNA, 20 bp, Artificial Sequence
  chemically synthesized
aacgacattataactggtcg

SEQ ID NO: 255843 - DNA, 20 bp, Artificial Sequence
  chemically synthesized
ggttgaagctgtgcttcgac

SEQ ID NO: 255844 - DNA, 20 bp, Artificial Sequence
  chemically synthesized
cattataactggtcgaagca

SEQ ID NO: 255845 - DNA, 20 bp, Artificial Sequence
  chemically synthesized
cttttattcacaaacggttg

SEQ ID NO: 255846 - DNA, 20 bp, Artificial Sequence
  chemically synthesized
gttttccttttattcacaaa

SEQ ID NO: 255847 - DNA, 20 bp, Artificial Sequence
  chemically synthesized
cttcaaccgtttgtgaataa

SEQ ID NO: 255848 - DNA, 20 bp, Artificial Sequence
  chemically synthesized
ttcaaccgtttgtgaataaa

SEQ ID NO: 255849 - DNA, 20 bp, Artificial Sequence
  chemically synthesized
gttgcagttaagttgtgggg

SEQ ID NO: 255850 - DNA, 20 bp, Artificial Sequence
  chemically synthesized
agttgcagttaagttgtggg

SEQ ID NO: 255851 - DNA, 20 bp, Artificial Sequence
  chemically synthesized
gaagttgcagttaagttgtg

SEQ ID NO: 255852 - DNA, 20 bp, Artificial Sequence
  chemically synthesized
tgaagttgcagttaagttgt

SEQ ID NO: 255853 - DNA, 20 bp, Artificial Sequence
  chemically synthesized
ttgaagttgcagttaagttg

SEQ ID NO: 255854 - DNA, 20 bp, Artificial Sequence
  chemically synthesized
gaaattttgaagttgcagtt

SEQ ID NO: 255855 - DNA, 20 bp, Artificial Sequence
  chemically synthesized
tggtagaaattttgaagttg

SEQ ID NO: 255856 - DNA, 20 bp, Artificial Sequence
  chemically synthesized
tgaggctggtagaaattttg

SEQ ID NO: 255857 - DNA, 20 bp, Artificial Sequence
  chemically synthesized
tgcaacttcaaaatttctac

SEQ ID NO: 255858 - DNA, 20 bp, Artificial Sequence
  chemically synthesized
cttacaaatcatgaggctgg

SEQ ID NO: 255859 - DNA, 20 bp, Artificial Sequence
  chemically synthesized
aaacttacaaatcatgaggc

SEQ ID NO: 255860 - DNA, 20 bp, Artificial Sequence
  chemically synthesized
attaaaacttacaaatcatg

SEQ ID NO: 255861 - DNA, 20 bp, Artificial Sequence
  chemically synthesized
tattaaaacttacaaatcat

SEQ ID NO: 255862 - DNA, 20 bp, Artificial Sequence
  chemically synthesized
ctaccagcctcatgatttgt

SEQ ID NO: 255863 - DNA, 20 bp, Artificial Sequence
  chemically synthesized
atgatttgtaagttttaata

SEQ ID NO: 255864 - DNA, 20 bp, Artificial Sequence
  chemically synthesized
atttgtaagttttaatatgg

SEQ ID NO: 255865 - DNA, 20 bp, Artificial Sequence
  chemically synthesized
atcgtgtaaagtgtagaaag

SEQ ID NO: 255866 - DNA, 20 bp, Artificial Sequence
  chemically synthesized
cccatcgtgtaaagtgtaga

SEQ ID NO: 255867 - DNA, 20 bp, Artificial Sequence
  chemically synthesized
aatccccatcgtgtaaagtg

SEQ ID NO: 255868 - DNA, 20 bp, Artificial Sequence
  chemically synthesized
gctttctacactttacacga

SEQ ID NO: 255869 - DNA, 20 bp, Artificial Sequence
  chemically synthesized
ttcataatccccatcgtgta

SEQ ID NO: 255870 - DNA, 20 bp, Artificial Sequence
  chemically synthesized
ctttctacactttacacgat

SEQ ID NO: 255871 - DNA, 20 bp, Artificial Sequence
  chemically synthesized
tttctacactttacacgatg

SEQ ID NO: 255872 - DNA, 20 bp, Artificial Sequence
  chemically synthesized
cacgatggggattatgaaaa

SEQ ID NO: 255873 - DNA, 20 bp, Artificial Sequence
  chemically synthesized
gattatgaaaacagtgctgc

SEQ ID NO: 255874 - DNA, 20 bp, Artificial Sequence
  chemically synthesized
attatgaaaacagtgctgct

SEQ ID NO: 255875 - DNA, 20 bp, Artificial Sequence
  chemically synthesized
tatgaaaacagtgctgctgg

SEQ ID NO: 255876 - DNA, 20 bp, Artificial Sequence
  chemically synthesized
tactccttccattctcccag

SEQ ID NO: 255877 - DNA, 20 bp, Artificial Sequence
  chemically synthesized
aaacagtgctgctgggagaa

SEQ ID NO: 255878 - DNA, 20 bp, Artificial Sequence
  chemically synthesized
tcctactccttccattctcc

SEQ ID NO: 255879 - DNA, 20 bp, Artificial Sequence
  chemically synthesized
cagtgctgctgggagaatgg

SEQ ID NO: 255880 - DNA, 20 bp, Artificial Sequence
  chemically synthesized
agtgctgctgggagaatgga

SEQ ID NO: 255881 - DNA, 20 bp, Artificial Sequence
  chemically synthesized
tgctgctgggagaatggaag

SEQ ID NO: 255882 - DNA, 20 bp, Artificial Sequence
  chemically synthesized
tgctgggagaatggaaggag

SEQ ID NO: 255883 - DNA, 20 bp, Artificial Sequence
  chemically synthesized
gctgggagaatggaaggagt

SEQ ID NO: 255884 - DNA, 20 bp, Artificial Sequence
  chemically synthesized
tgggagaatggaaggagtag

SEQ ID NO: 255885 - DNA, 20 bp, Artificial Sequence
  chemically synthesized
ggagtaggagtgcgttctta

SEQ ID NO: 255886 - DNA, 20 bp, Artificial Sequence
  chemically synthesized
actctgctaaaatgtacttt

SEQ ID NO: 255887 - DNA, 20 bp, Artificial Sequence
  chemically synthesized
tgcgttcttaaagtacattt

SEQ ID NO: 255888 - DNA, 20 bp, Artificial Sequence
  chemically synthesized
gttcttaaagtacattttag

SEQ ID NO: 255889 - DNA, 20 bp, Artificial Sequence
  chemically synthesized
tcttaaagtacattttagca

SEQ ID NO: 255890 - DNA, 20 bp, Artificial Sequence
  chemically synthesized
aaagtacattttagcagagt

SEQ ID NO: 255891 - DNA, 20 bp, Artificial Sequence
  chemically synthesized
aagtacattttagcagagtt

SEQ ID NO: 255892 - DNA, 20 bp, Artificial Sequence
  chemically synthesized
gtacattttagcagagttgg

SEQ ID NO: 255893 - DNA, 20 bp, Artificial Sequence
  chemically synthesized
gcagagttgggagtaaattg

SEQ ID NO: 255894 - DNA, 20 bp, Artificial Sequence
  chemically synthesized
gggagtaaattgcagcataa

SEQ ID NO: 255895 - DNA, 20 bp, Artificial Sequence
  chemically synthesized
taaattgcagcataatagtc

SEQ ID NO: 255896 - DNA, 20 bp, Artificial Sequence
  chemically synthesized
aaattgcagcataatagtca

SEQ ID NO: 255897 - DNA, 20 bp, Artificial Sequence
  chemically synthesized
ttgcagcataatagtcaagg

SEQ ID NO: 255898 - DNA, 20 bp, Artificial Sequence
  chemically synthesized
tgcagcataatagtcaaggt

SEQ ID NO: 255899 - DNA, 20 bp, Artificial Sequence
  chemically synthesized
agtcaaggtaggacaactgc

SEQ ID NO: 255900 - DNA, 20 bp, Artificial Sequence
  chemically synthesized
gtcaaggtaggacaactgct

SEQ ID NO: 255901 - DNA, 20 bp, Artificial Sequence
  chemically synthesized
cattattttatcaagcctag

SEQ ID NO: 255902 - DNA, 20 bp, Artificial Sequence
  chemically synthesized
aaccattattttatcaagcc

SEQ ID NO: 255903 - DNA, 20 bp, Artificial Sequence
  chemically synthesized
tccccaaccattattttatc

SEQ ID NO: 255904 - DNA, 20 bp, Artificial Sequence
  chemically synthesized
tgctaggcttgataaaataa

SEQ ID NO: 255905 - DNA, 20 bp, Artificial Sequence
  chemically synthesized
aggcttgataaaataatggt

SEQ ID NO: 255906 - DNA, 20 bp, Artificial Sequence
  chemically synthesized
ggcttgataaaataatggtt

SEQ ID NO: 255907 - DNA, 20 bp, Artificial Sequence
  chemically synthesized
gcttgataaaataatggttg

SEQ ID NO: 255908 - DNA, 20 bp, Artificial Sequence
  chemically synthesized
taaaataatggttggggata

SEQ ID NO: 255909 - DNA, 20 bp, Artificial Sequence
  chemically synthesized
taatggttggggataaagaa

SEQ ID NO: 255910 - DNA, 20 bp, Artificial Sequence
  chemically synthesized
aagaatggataatttcctac

SEQ ID NO: 255911 - DNA, 20 bp, Artificial Sequence
  chemically synthesized
gaatggataatttcctacaa

SEQ ID NO: 255912 - DNA, 20 bp, Artificial Sequence
  chemically synthesized
atggataatttcctacaaga

SEQ ID NO: 255913 - DNA, 20 bp, Artificial Sequence
  chemically synthesized
tttatacaaatctctcttgt

SEQ ID NO: 255914 - DNA, 20 bp, Artificial Sequence
  chemically synthesized
ttttatacaaatctctcttg

SEQ ID NO: 255915 - DNA, 20 bp, Artificial Sequence
  chemically synthesized
gagatttgtataaaatataa

SEQ ID NO: 255916 - DNA, 20 bp, Artificial Sequence
  chemically synthesized
tataaaagaaaactgtaccg

SEQ ID NO: 255917 - DNA, 20 bp, Artificial Sequence
  chemically synthesized
tatttatatgtgcttcggta

SEQ ID NO: 255918 - DNA, 20 bp, Artificial Sequence
  chemically synthesized
gctcatatttatatgtgctt

SEQ ID NO: 255919 - DNA, 20 bp, Artificial Sequence
  chemically synthesized
accgaagcacatataaatat

SEQ ID NO: 255920 - DNA, 20 bp, Artificial Sequence
  chemically synthesized
aagcacatataaatatgagc

SEQ ID NO: 255921 - DNA, 20 bp, Artificial Sequence
  chemically synthesized
agcacatataaatatgagct

SEQ ID NO: 255922 - DNA, 20 bp, Artificial Sequence
  chemically synthesized
tactgcctttcagtcatgcc

SEQ ID NO: 255923 - DNA, 20 bp, Artificial Sequence
  chemically synthesized
tatgagctgggcatgactga

SEQ ID NO: 255924 - DNA, 20 bp, Artificial Sequence
  chemically synthesized
atgagctgggcatgactgaa

SEQ ID NO: 255925 - DNA, 20 bp, Artificial Sequence
  chemically synthesized
agctgggcatgactgaaagg

SEQ ID NO: 255926 - DNA, 20 bp, Artificial Sequence
  chemically synthesized
tatagatatttactgccttt

SEQ ID NO: 255927 - DNA, 20 bp, Artificial Sequence
  chemically synthesized
gtactatagagaagagatta

SEQ ID NO: 255928 - DNA, 20 bp, Artificial Sequence
  chemically synthesized
tatctataatctcttctcta

SEQ ID NO: 255929 - DNA, 20 bp, Artificial Sequence
  chemically synthesized
aagatttgtactatagagaa

SEQ ID NO: 255930 - DNA, 20 bp, Artificial Sequence
  chemically synthesized
aaaagatttgtactatagag

SEQ ID NO: 255931 - DNA, 20 bp, Artificial Sequence
  chemically synthesized
atgaaaagatttgtactata

SEQ ID NO: 255932 - DNA, 20 bp, Artificial Sequence
  chemically synthesized
atatgaaaagatttgtacta

SEQ ID NO: 255933 - DNA, 20 bp, Artificial Sequence
  chemically synthesized
tttcatttgtattatatgaa

SEQ ID NO: 255934 - DNA, 20 bp, Artificial Sequence
  chemically synthesized
aaatgaaaaataatgtacta

SEQ ID NO: 255935 - DNA, 20 bp, Artificial Sequence
  chemically synthesized
tcatgcttaaattatttcca

SEQ ID NO: 255936 - DNA, 20 bp, Artificial Sequence
  chemically synthesized
atgtactatggaaataattt

SEQ ID NO: 255937 - DNA, 20 bp, Artificial Sequence
  chemically synthesized
tttaagcatgatttaaacta

SEQ ID NO: 255938 - DNA, 20 bp, Artificial Sequence
  chemically synthesized
caaatattaatcattaactg

SEQ ID NO: 255939 - DNA, 20 bp, Artificial Sequence
  chemically synthesized
aaaatacacacatttatata

SEQ ID NO: 255940 - DNA, 20 bp, Artificial Sequence
  chemically synthesized
aaatcaatcaaataaatccc

SEQ ID NO: 255941 - DNA, 20 bp, Artificial Sequence
  chemically synthesized
ttcaacagcttatatgactt

SEQ ID NO: 255942 - DNA, 20 bp, Artificial Sequence
  chemically synthesized
cttcaacagcttatatgact

SEQ ID NO: 255943 - DNA, 20 bp, Artificial Sequence
  chemically synthesized
aaataaatcccaagtcatat

SEQ ID NO: 255944 - DNA, 20 bp, Artificial Sequence
  chemically synthesized
ccaagtcatataagctgttg

SEQ ID NO: 255945 - DNA, 20 bp, Artificial Sequence
  chemically synthesized
aatataatttgtttcttcaa

SEQ ID NO: 255946 - DNA, 20 bp, Artificial Sequence
  chemically synthesized
agtttttcaacacatttatt

SEQ ID NO: 255947 - DNA, 20 bp, Artificial Sequence
  chemically synthesized
tggtttctcttagaaaaatt

SEQ ID NO: 255948 - DNA, 20 bp, Artificial Sequence
  chemically synthesized
ttgaaaaactcaatttttct

SEQ ID NO: 255949 - DNA, 20 bp, Artificial Sequence
  chemically synthesized
gaaaaactcaatttttctaa

SEQ ID NO: 255950 - DNA, 20 bp, Artificial Sequence
  chemically synthesized
atgtgatcagtggtttctct

SEQ ID NO: 255951 - DNA, 20 bp, Artificial Sequence
  chemically synthesized
atttgcaataatgtgatcag

SEQ ID NO: 255952 - DNA, 20 bp, Artificial Sequence
  chemically synthesized
aacatttgcaataatgtgat

SEQ ID NO: 255953 - DNA, 20 bp, Artificial Sequence
  chemically synthesized
ttattgcaaatgtttatgta

SEQ ID NO: 255954 - DNA, 20 bp, Artificial Sequence
  chemically synthesized
aatgtttatgtatagttcaa

SEQ ID NO: 255955 - DNA, 20 bp, Artificial Sequence
  chemically synthesized
ttatgtatagttcaaaagat

SEQ ID NO: 255956 - DNA, 20 bp, Artificial Sequence
  chemically synthesized
tcaaaagatcagtttctaca

SEQ ID NO: 255957 - DNA, 20 bp, Artificial Sequence
  chemically synthesized
attaatacattgtgactttg

SEQ ID NO: 255958 - DNA, 20 bp, Artificial Sequence
  chemically synthesized
taacagtttaatgcgtggaa

SEQ ID NO: 255959 - DNA, 20 bp, Artificial Sequence
  chemically synthesized
agttctaacagtttaatgcg

SEQ ID NO: 255960 - DNA, 20 bp, Artificial Sequence
  chemically synthesized
ttttccacgcattaaactgt

SEQ ID NO: 255961 - DNA, 20 bp, Artificial Sequence
  chemically synthesized
taatagtttaatagttctaa

SEQ ID NO: 255962 - DNA, 20 bp, Artificial Sequence
  chemically synthesized
tgaattttctaatagtttaa

SEQ ID NO: 255963 - DNA, 20 bp, Artificial Sequence
  chemically synthesized
tgttagaactattaaactat

SEQ ID NO: 255964 - DNA, 20 bp, Artificial Sequence
  chemically synthesized
attcgagttgaattttctaa

SEQ ID NO: 255965 - DNA, 20 bp, Artificial Sequence
  chemically synthesized
tgcaaatgctttttgaattc

SEQ ID NO: 255966 - DNA, 20 bp, Artificial Sequence
  chemically synthesized
aaattcaactcgaattcaaa

SEQ ID NO: 255967 - DNA, 20 bp, Artificial Sequence
  chemically synthesized
atggatcatataaaatttca

SEQ ID NO: 255968 - DNA, 20 bp, Artificial Sequence
  chemically synthesized
gcaattactctaaataatca

SEQ ID NO: 255969 - DNA, 20 bp, Artificial Sequence
  chemically synthesized
ttatatgatccatgattatt

SEQ ID NO: 255970 - DNA, 20 bp, Artificial Sequence
  chemically synthesized
atatgatccatgattattta

SEQ ID NO: 255971 - DNA, 20 bp, Artificial Sequence
  chemically synthesized
tttaataatattggaataag

SEQ ID NO: 255972 - DNA, 20 bp, Artificial Sequence
  chemically synthesized
atttaataatattggaataa

SEQ ID NO: 255973 - DNA, 20 bp, Artificial Sequence
  chemically synthesized
gtatttaataatattggaat

SEQ ID NO: 255974 - DNA, 20 bp, Artificial Sequence
  chemically synthesized
acaggggtatttaataatat

SEQ ID NO: 255975 - DNA, 20 bp, Artificial Sequence
  chemically synthesized
atatgcatattgtaatacag

SEQ ID NO: 255976 - DNA, 20 bp, Artificial Sequence
  chemically synthesized
tatatgcatattgtaataca

SEQ ID NO: 255977 - DNA, 20 bp, Artificial Sequence
  chemically synthesized
ttatatgcatattgtaatac

SEQ ID NO: 255978 - DNA, 20 bp, Artificial Sequence
  chemically synthesized
tttatatgcatattgtaata

SEQ ID NO: 255979 - DNA, 20 bp, Artificial Sequence
  chemically synthesized
atatgcgtattgtaatacag

SEQ ID NO: 255980 - DNA, 20 bp, Artificial Sequence
  chemically synthesized
tatatgcgtattgtaataca

SEQ ID NO: 255981 - DNA, 20 bp, Artificial Sequence
  chemically synthesized
ttatatgcgtattgtaatac

SEQ ID NO: 255982 - DNA, 20 bp, Artificial Sequence
  chemically synthesized
tttatatgcgtattgtaata

SEQ ID NO: 255983 - DNA, 20 bp, Artificial Sequence
  chemically synthesized
aaatatctgaaggaaaataa

SEQ ID NO: 255984 - DNA, 20 bp, Artificial Sequence
  chemically synthesized
atcgttcttttattttcctt

SEQ ID NO: 255985 - DNA, 20 bp, Artificial Sequence
  chemically synthesized
aatccaaacaaaatatctga

SEQ ID NO: 255986 - DNA, 20 bp, Artificial Sequence
  chemically synthesized
aaatccaaacaaaatatctg

SEQ ID NO: 255987 - DNA, 20 bp, Artificial Sequence
  chemically synthesized
tttccttcagatattttgtt

SEQ ID NO: 255988 - DNA, 20 bp, Artificial Sequence
  chemically synthesized
tttgtttggatttctacata

SEQ ID NO: 255989 - DNA, 20 bp, Artificial Sequence
  chemically synthesized
atagcaagaggcaccatatg

SEQ ID NO: 255990 - DNA, 20 bp, Artificial Sequence
  chemically synthesized
gagaattagataatagcaag

SEQ ID NO: 255991 - DNA, 20 bp, Artificial Sequence
  chemically synthesized
ggagaattagataatagcaa

SEQ ID NO: 255992 - DNA, 20 bp, Artificial Sequence
  chemically synthesized
taggagaattagataatagc

SEQ ID NO: 255993 - DNA, 20 bp, Artificial Sequence
  chemically synthesized
gtattaggagaattagataa

SEQ ID NO: 255994 - DNA, 20 bp, Artificial Sequence
  chemically synthesized
tattctggtattaggagaat

SEQ ID NO: 255995 - DNA, 20 bp, Artificial Sequence
  chemically synthesized
ttatctaattctcctaatac

SEQ ID NO: 255996 - DNA, 20 bp, Artificial Sequence
  chemically synthesized
cttttctattctggtattag

SEQ ID NO: 255997 - DNA, 20 bp, Artificial Sequence
  chemically synthesized
tgcttttctattctggtatt

SEQ ID NO: 255998 - DNA, 20 bp, Artificial Sequence
  chemically synthesized
ctgcttttctattctggtat

SEQ ID NO: 255999 - DNA, 20 bp, Artificial Sequence
  chemically synthesized
taattctcctaataccagaa

SEQ ID NO: 256000 - DNA, 20 bp, Artificial Sequence
  chemically synthesized
aagtgactgcttttctattc

SEQ ID NO: 256001 - DNA, 20 bp, Artificial Sequence
  chemically synthesized
ctcctaataccagaatagaa

SEQ ID NO: 256002 - DNA, 20 bp, Artificial Sequence
  chemically synthesized
ctaataccagaatagaaaag

SEQ ID NO: 256003 - DNA, 20 bp, Artificial Sequence
  chemically synthesized
aaaagcagtcactttgctca

SEQ ID NO: 256004 - DNA, 20 bp, Artificial Sequence
  chemically synthesized
gcaaaattatgccatgagca

SEQ ID NO: 256005 - DNA, 20 bp, Artificial Sequence
  chemically synthesized
tgaaggcaaaattatgccat

SEQ ID NO: 256006 - DNA, 20 bp, Artificial Sequence
  chemically synthesized
aatcccaattagttaaatga

SEQ ID NO: 256007 - DNA, 20 bp, Artificial Sequence
  chemically synthesized
taatcccaattagttaaatg

SEQ ID NO: 256008 - DNA, 20 bp, Artificial Sequence
  chemically synthesized
tttgccttcatttaactaat

SEQ ID NO: 256009 - DNA, 20 bp, Artificial Sequence
  chemically synthesized
ttgccttcatttaactaatt

SEQ ID NO: 256010 - DNA, 20 bp, Artificial Sequence
  chemically synthesized
acaaatttaataatcccaat

SEQ ID NO: 256011 - DNA, 20 bp, Artificial Sequence
  chemically synthesized
ggattattaaatttgtgctt

SEQ ID NO: 256012 - DNA, 20 bp, Artificial Sequence
  chemically synthesized
attattaaatttgtgcttaa

SEQ ID NO: 256013 - DNA, 20 bp, Artificial Sequence
  chemically synthesized
gaatctgtttcacagctctt

SEQ ID NO: 256014 - DNA, 20 bp, Artificial Sequence
  chemically synthesized
tgtgcttaagagctgtgaaa

SEQ ID NO: 256015 - DNA, 20 bp, Artificial Sequence
  chemically synthesized
ctcctctggaatctgtttca

SEQ ID NO: 256016 - DNA, 20 bp, Artificial Sequence
  chemically synthesized
aagagctgtgaaacagattc

SEQ ID NO: 256017 - DNA, 20 bp, Artificial Sequence
  chemically synthesized
gagctgtgaaacagattcca

SEQ ID NO: 256018 - DNA, 20 bp, Artificial Sequence
  chemically synthesized
agctgtgaaacagattccag

SEQ ID NO: 256019 - DNA, 20 bp, Artificial Sequence
  chemically synthesized
ctgtgaaacagattccagag

SEQ ID NO: 256020 - DNA, 20 bp, Artificial Sequence
  chemically synthesized
gaaacagattccagaggaga

SEQ ID NO: 256021 - DNA, 20 bp, Artificial Sequence
  chemically synthesized
tggttaagatctttctcctc

SEQ ID NO: 256022 - DNA, 20 bp, Artificial Sequence
  chemically synthesized
cagaggagaaagatcttaac

SEQ ID NO: 256023 - DNA, 20 bp, Artificial Sequence
  chemically synthesized
agatttttaatacactggtt

SEQ ID NO: 256024 - DNA, 20 bp, Artificial Sequence
  chemically synthesized
aacagagatttttaatacac

SEQ ID NO: 256025 - DNA, 20 bp, Artificial Sequence
  chemically synthesized
gtattaaaaatctctgttgc

SEQ ID NO: 256026 - DNA, 20 bp, Artificial Sequence
  chemically synthesized
ggacaaaagtactggcaaca

SEQ ID NO: 256027 - DNA, 20 bp, Artificial Sequence
  chemically synthesized
agggacaaaagtactggcaa

SEQ ID NO: 256028 - DNA, 20 bp, Artificial Sequence
  chemically synthesized
tgaagtagggacaaaagtac

SEQ ID NO: 256029 - DNA, 20 bp, Artificial Sequence
  chemically synthesized
ttgccttgaagtagggacaa

SEQ ID NO: 256030 - DNA, 20 bp, Artificial Sequence
  chemically synthesized
agtacttttgtccctacttc

SEQ ID NO: 256031 - DNA, 20 bp, Artificial Sequence
  chemically synthesized
gtacttttgtccctacttca

SEQ ID NO: 256032 - DNA, 20 bp, Artificial Sequence
  chemically synthesized
ttcagtcttgccttgaagta

SEQ ID NO: 256033 - DNA, 20 bp, Artificial Sequence
  chemically synthesized
cttcagtcttgccttgaagt

SEQ ID NO: 256034 - DNA, 20 bp, Artificial Sequence
  chemically synthesized
tcttcagtcttgccttgaag

SEQ ID NO: 256035 - DNA, 20 bp, Artificial Sequence
  chemically synthesized
ttttgtccctacttcaaggc

SEQ ID NO: 256036 - DNA, 20 bp, Artificial Sequence
  chemically synthesized
gattcttcagtcttgccttg

SEQ ID NO: 256037 - DNA, 20 bp, Artificial Sequence
  chemically synthesized
cctacttcaaggcaagactg

SEQ ID NO: 256038 - DNA, 20 bp, Artificial Sequence
  chemically synthesized
tattttagtcttcgattctt

SEQ ID NO: 256039 - DNA, 20 bp, Artificial Sequence
  chemically synthesized
aaggcaagactgaagaatcg

SEQ ID NO: 256040 - DNA, 20 bp, Artificial Sequence
  chemically synthesized
agaatcgaagactaaaatat

SEQ ID NO: 256041 - DNA, 20 bp, Artificial Sequence
  chemically synthesized
tatgatttcttctcatattt

SEQ ID NO: 256042 - DNA, 20 bp, Artificial Sequence
  chemically synthesized
atcgaagactaaaatatgag

SEQ ID NO: 256043 - DNA, 20 bp, Artificial Sequence
  chemically synthesized
gaagaaatcatacatctctc

SEQ ID NO: 256044 - DNA, 20 bp, Artificial Sequence
  chemically synthesized
aagaaatcatacatctctca

SEQ ID NO: 256045 - DNA, 20 bp, Artificial Sequence
  chemically synthesized
agaaatcatacatctctcaa

SEQ ID NO: 256046 - DNA, 20 bp, Artificial Sequence
  chemically synthesized
cctagcagaagatcccttga

SEQ ID NO: 256047 - DNA, 20 bp, Artificial Sequence
  chemically synthesized
aacctagcagaagatccctt

SEQ ID NO: 256048 - DNA, 20 bp, Artificial Sequence
  chemically synthesized
tctctcaagggatcttctgc

SEQ ID NO: 256049 - DNA, 20 bp, Artificial Sequence
  chemically synthesized
ctctcaagggatcttctgct

SEQ ID NO: 256050 - DNA, 20 bp, Artificial Sequence
  chemically synthesized
ggtctcgtaaaacctagcag

SEQ ID NO: 256051 - DNA, 20 bp, Artificial Sequence
  chemically synthesized
tttggtctcgtaaaacctag

SEQ ID NO: 256052 - DNA, 20 bp, Artificial Sequence
  chemically synthesized
aactttggtctcgtaaaacc

SEQ ID NO: 256053 - DNA, 20 bp, Artificial Sequence
  chemically synthesized
gatcttctgctaggttttac

SEQ ID NO: 256054 - DNA, 20 bp, Artificial Sequence
  chemically synthesized
tgctaggttttacgagacca

SEQ ID NO: 256055 - DNA, 20 bp, Artificial Sequence
  chemically synthesized
ttggggctgagttagaactt

SEQ ID NO: 256056 - DNA, 20 bp, Artificial Sequence
  chemically synthesized
acgagaccaaagttctaact

SEQ ID NO: 256057 - DNA, 20 bp, Artificial Sequence
  chemically synthesized
cggccgacttggggctgagt

SEQ ID NO: 256058 - DNA, 20 bp, Artificial Sequence
  chemically synthesized
caaagttctaactcagcccc

SEQ ID NO: 256059 - DNA, 20 bp, Artificial Sequence
  chemically synthesized
ttctcggccgacttggggct

SEQ ID NO: 256060 - DNA, 20 bp, Artificial Sequence
  chemically synthesized
gttctaactcagccccaagt

SEQ ID NO: 256061 - DNA, 20 bp, Artificial Sequence
  chemically synthesized
acccattctcggccgacttg

SEQ ID NO: 256062 - DNA, 20 bp, Artificial Sequence
  chemically synthesized
aacccattctcggccgactt

SEQ ID NO: 256063 - DNA, 20 bp, Artificial Sequence
  chemically synthesized
aaacccattctcggccgact

SEQ ID NO: 256064 - DNA, 20 bp, Artificial Sequence
  chemically synthesized
aactcagccccaagtcggcc

SEQ ID NO: 256065 - DNA, 20 bp, Artificial Sequence
  chemically synthesized
agccccaagtcggccgagaa

SEQ ID NO: 256066 - DNA, 20 bp, Artificial Sequence
  chemically synthesized
gccccaagtcggccgagaat

SEQ ID NO: 256067 - DNA, 20 bp, Artificial Sequence
  chemically synthesized
tgtctatgaaaacccattct

SEQ ID NO: 256068 - DNA, 20 bp, Artificial Sequence
  chemically synthesized
cggccgagaatgggttttca

SEQ ID NO: 256069 - DNA, 20 bp, Artificial Sequence
  chemically synthesized
gttttcatagacacatgctt

SEQ ID NO: 256070 - DNA, 20 bp, Artificial Sequence
  chemically synthesized
ctctggtcatacagaaactt

SEQ ID NO: 256071 - DNA, 20 bp, Artificial Sequence
  chemically synthesized
tgcttaagtttctgtatgac

SEQ ID NO: 256072 - DNA, 20 bp, Artificial Sequence
  chemically synthesized
gatatatttctctggtcata

SEQ ID NO: 256073 - DNA, 20 bp, Artificial Sequence
  chemically synthesized
cttaagtttctgtatgacca

SEQ ID NO: 256074 - DNA, 20 bp, Artificial Sequence
  chemically synthesized
agatagcagatatatttctc

SEQ ID NO: 256075 - DNA, 20 bp, Artificial Sequence
  chemically synthesized
tattttgaaattagagatag

SEQ ID NO: 256076 - DNA, 20 bp, Artificial Sequence
  chemically synthesized
aaatattttgaaattagaga

SEQ ID NO: 256077 - DNA, 20 bp, Artificial Sequence
  chemically synthesized
ctggaaatattttgaaatta

SEQ ID NO: 256078 - DNA, 20 bp, Artificial Sequence
  chemically synthesized
ttctggaaatattttgaaat

SEQ ID NO: 256079 - DNA, 20 bp, Artificial Sequence
  chemically synthesized
ctctaatttcaaaatatttc

SEQ ID NO: 256080 - DNA, 20 bp, Artificial Sequence
  chemically synthesized
agtgagagaatgtcagattc

SEQ ID NO: 256081 - DNA, 20 bp, Artificial Sequence
  chemically synthesized
ggtcggtagtgagagaatgt

SEQ ID NO: 256082 - DNA, 20 bp, Artificial Sequence
  chemically synthesized
ttggacttggtcggtagtga

SEQ ID NO: 256083 - DNA, 20 bp, Artificial Sequence
  chemically synthesized
gcttggacttggtcggtagt

SEQ ID NO: 256084 - DNA, 20 bp, Artificial Sequence
  chemically synthesized
acattctctcactaccgacc

SEQ ID NO: 256085 - DNA, 20 bp, Artificial Sequence
  chemically synthesized
ggtggcttggacttggtcgg

SEQ ID NO: 256086 - DNA, 20 bp, Artificial Sequence
  chemically synthesized
gctggtggcttggacttggt

SEQ ID NO: 256087 - DNA, 20 bp, Artificial Sequence
  chemically synthesized
tctcactaccgaccaagtcc

SEQ ID NO: 256088 - DNA, 20 bp, Artificial Sequence
  chemically synthesized
agatgctggtggcttggact

SEQ ID NO: 256089 - DNA, 20 bp, Artificial Sequence
  chemically synthesized
accgaccaagtccaagccac

SEQ ID NO: 256090 - DNA, 20 bp, Artificial Sequence
  chemically synthesized
aaaaagagatgctggtggct

SEQ ID NO: 256091 - DNA, 20 bp, Artificial Sequence
  chemically synthesized
agttgaaaaagagatgctgg

SEQ ID NO: 256092 - DNA, 20 bp, Artificial Sequence
  chemically synthesized
aagagttgaaaaagagatgc

SEQ ID NO: 256093 - DNA, 20 bp, Artificial Sequence
  chemically synthesized
aatcaacaagagttgaaaaa

SEQ ID NO: 256094 - DNA, 20 bp, Artificial Sequence
  chemically synthesized
agaatcaacaagagttgaaa

SEQ ID NO: 256095 - DNA, 20 bp, Artificial Sequence
  chemically synthesized
accaataatagaatcaacaa

SEQ ID NO: 256096 - DNA, 20 bp, Artificial Sequence
  chemically synthesized
ggaccaataatagaatcaac

SEQ ID NO: 256097 - DNA, 20 bp, Artificial Sequence
  chemically synthesized
actcttgttgattctattat

SEQ ID NO: 256098 - DNA, 20 bp, Artificial Sequence
  chemically synthesized
gaactgtaggggaccaataa

SEQ ID NO: 256099 - DNA, 20 bp, Artificial Sequence
  chemically synthesized
attctattattggtccccta

SEQ ID NO: 256100 - DNA, 20 bp, Artificial Sequence
  chemically synthesized
ggttgagagtagaactgtag

SEQ ID NO: 256101 - DNA, 20 bp, Artificial Sequence
  chemically synthesized
gggttgagagtagaactgta

SEQ ID NO: 256102 - DNA, 20 bp, Artificial Sequence
  chemically synthesized
tgggttgagagtagaactgt

SEQ ID NO: 256103 - DNA, 20 bp, Artificial Sequence
  chemically synthesized
ctgggttgagagtagaactg

SEQ ID NO: 256104 - DNA, 20 bp, Artificial Sequence
  chemically synthesized
actggcttctgggttgagag

SEQ ID NO: 256105 - DNA, 20 bp, Artificial Sequence
  chemically synthesized
ctacagttctactctcaacc

SEQ ID NO: 256106 - DNA, 20 bp, Artificial Sequence
  chemically synthesized
cacactggcttctgggttga

SEQ ID NO: 256107 - DNA, 20 bp, Artificial Sequence
  chemically synthesized
cagttctactctcaacccag

SEQ ID NO: 256108 - DNA, 20 bp, Artificial Sequence
  chemically synthesized
atcacactggcttctgggtt

SEQ ID NO: 256109 - DNA, 20 bp, Artificial Sequence
  chemically synthesized
tctactctcaacccagaagc

SEQ ID NO: 256110 - DNA, 20 bp, Artificial Sequence
  chemically synthesized
aaaggatcacactggcttct

SEQ ID NO: 256111 - DNA, 20 bp, Artificial Sequence
  chemically synthesized
aaaaggatcacactggcttc

SEQ ID NO: 256112 - DNA, 20 bp, Artificial Sequence
  chemically synthesized
atgttttaaaaggatcacac

SEQ ID NO: 256113 - DNA, 20 bp, Artificial Sequence
  chemically synthesized
gatctcaatcatgttttaaa

SEQ ID NO: 256114 - DNA, 20 bp, Artificial Sequence
  chemically synthesized
tgatctcaatcatgttttaa

SEQ ID NO: 256115 - DNA, 20 bp, Artificial Sequence
  chemically synthesized
gatccttttaaaacatgatt

SEQ ID NO: 256116 - DNA, 20 bp, Artificial Sequence
  chemically synthesized
taagtttctgagcagttgag

SEQ ID NO: 256117 - DNA, 20 bp, Artificial Sequence
  chemically synthesized
gatcatgccactcaactgct

SEQ ID NO: 256118 - DNA, 20 bp, Artificial Sequence
  chemically synthesized
ttgtaagtttctgagcagtt

SEQ ID NO: 256119 - DNA, 20 bp, Artificial Sequence
  chemically synthesized
agcaattgtaagtttctgag

SEQ ID NO: 256120 - DNA, 20 bp, Artificial Sequence
  chemically synthesized
gagagcaattgtaagtttct

SEQ ID NO: 256121 - DNA, 20 bp, Artificial Sequence
  chemically synthesized
aatgagatgagagcaattgt

SEQ ID NO: 256122 - DNA, 20 bp, Artificial Sequence
  chemically synthesized
gaagattctaaatgagatga

SEQ ID NO: 256123 - DNA, 20 bp, Artificial Sequence
  chemically synthesized
aagaagattctaaatgagat

SEQ ID NO: 256124 - DNA, 20 bp, Artificial Sequence
  chemically synthesized
acaattgctctcatctcatt

SEQ ID NO: 256125 - DNA, 20 bp, Artificial Sequence
  chemically synthesized
ttgtaaagaagattctaaat

SEQ ID NO: 256126 - DNA, 20 bp, Artificial Sequence
  chemically synthesized
cctttggggccattgtaaag

SEQ ID NO: 256127 - DNA, 20 bp, Artificial Sequence
  chemically synthesized
atttagaatcttctttacaa

SEQ ID NO: 256128 - DNA, 20 bp, Artificial Sequence
  chemically synthesized
gggcctttggggccattgta

SEQ ID NO: 256129 - DNA, 20 bp, Artificial Sequence
  chemically synthesized
tcttctttacaatggcccca

SEQ ID NO: 256130 - DNA, 20 bp, Artificial Sequence
  chemically synthesized
cttctttacaatggccccaa

SEQ ID NO: 256131 - DNA, 20 bp, Artificial Sequence
  chemically synthesized
cagattgtggagggcctttg

SEQ ID NO: 256132 - DNA, 20 bp, Artificial Sequence
  chemically synthesized
ccagattgtggagggccttt

SEQ ID NO: 256133 - DNA, 20 bp, Artificial Sequence
  chemically synthesized
tccagattgtggagggcctt

SEQ ID NO: 256134 - DNA, 20 bp, Artificial Sequence
  chemically synthesized
gtgagtgtccagattgtgga

SEQ ID NO: 256135 - DNA, 20 bp, Artificial Sequence
  chemically synthesized
tgtgagtgtccagattgtgg

SEQ ID NO: 256136 - DNA, 20 bp, Artificial Sequence
  chemically synthesized
cccaaaggccctccacaatc

SEQ ID NO: 256137 - DNA, 20 bp, Artificial Sequence
  chemically synthesized
ttgtgagtgtccagattgtg

SEQ ID NO: 256138 - DNA, 20 bp, Artificial Sequence
  chemically synthesized
agttgtgagtgtccagattg

SEQ ID NO: 256139 - DNA, 20 bp, Artificial Sequence
  chemically synthesized
atatgggagttgtgagtgtc

SEQ ID NO: 256140 - DNA, 20 bp, Artificial Sequence
  chemically synthesized
gatgaggatatgggagttgt

SEQ ID NO: 256141 - DNA, 20 bp, Artificial Sequence
  chemically synthesized
agaaagagatgaggatatgg

SEQ ID NO: 256142 - DNA, 20 bp, Artificial Sequence
  chemically synthesized
gtagaaagagatgaggatat

SEQ ID NO: 256143 - DNA, 20 bp, Artificial Sequence
  chemically synthesized
ggtagaaagagatgaggata

SEQ ID NO: 256144 - DNA, 20 bp, Artificial Sequence
  chemically synthesized
tggaagggtagaaagagatg

SEQ ID NO: 256145 - DNA, 20 bp, Artificial Sequence
  chemically synthesized
gtggaagggtagaaagagat

SEQ ID NO: 256146 - DNA, 20 bp, Artificial Sequence
  chemically synthesized
agccagtggaagggtagaaa

SEQ ID NO: 256147 - DNA, 20 bp, Artificial Sequence
  chemically synthesized
caagccagtggaagggtaga

SEQ ID NO: 256148 - DNA, 20 bp, Artificial Sequence
  chemically synthesized
aaaacaagccagtggaaggg

SEQ ID NO: 256149 - DNA, 20 bp, Artificial Sequence
  chemically synthesized
atctctttctacccttccac

SEQ ID NO: 256150 - DNA, 20 bp, Artificial Sequence
  chemically synthesized
agcaaaacaagccagtggaa

SEQ ID NO: 256151 - DNA, 20 bp, Artificial Sequence
  chemically synthesized
aagcaaaacaagccagtgga

SEQ ID NO: 256152 - DNA, 20 bp, Artificial Sequence
  chemically synthesized
gaagcaaaacaagccagtgg

SEQ ID NO: 256153 - DNA, 20 bp, Artificial Sequence
  chemically synthesized
gctgaagcaaaacaagccag

SEQ ID NO: 256154 - DNA, 20 bp, Artificial Sequence
  chemically synthesized
gtggctgaagcaaaacaagc

SEQ ID NO: 256155 - DNA, 20 bp, Artificial Sequence
  chemically synthesized
caaagtggctgaagcaaaac

SEQ ID NO: 256156 - DNA, 20 bp, Artificial Sequence
  chemically synthesized
tccactggcttgttttgctt

SEQ ID NO: 256157 - DNA, 20 bp, Artificial Sequence
  chemically synthesized
caagaaggccaaagtggctg

SEQ ID NO: 256158 - DNA, 20 bp, Artificial Sequence
  chemically synthesized
ttgttttgcttcagccactt

SEQ ID NO: 256159 - DNA, 20 bp, Artificial Sequence
  chemically synthesized
caccaacaagaaggccaaag

SEQ ID NO: 256160 - DNA, 20 bp, Artificial Sequence
  chemically synthesized
aagcaccaacaagaaggcca

SEQ ID NO: 256161 - DNA, 20 bp, Artificial Sequence
  chemically synthesized
agccactttggccttcttgt

SEQ ID NO: 256162 - DNA, 20 bp, Artificial Sequence
  chemically synthesized
ttaatcaagcaccaacaaga

SEQ ID NO: 256163 - DNA, 20 bp, Artificial Sequence
  chemically synthesized
cttaatcaagcaccaacaag

SEQ ID NO: 256164 - DNA, 20 bp, Artificial Sequence
  chemically synthesized
tatcttaatcaagcaccaac

SEQ ID NO: 256165 - DNA, 20 bp, Artificial Sequence
  chemically synthesized
cttcttgttggtgcttgatt

SEQ ID NO: 256166 - DNA, 20 bp, Artificial Sequence
  chemically synthesized
ggactgagcttatcttaatc

SEQ ID NO: 256167 - DNA, 20 bp, Artificial Sequence
  chemically synthesized
tgttggtgcttgattaagat

SEQ ID NO: 256168 - DNA, 20 bp, Artificial Sequence
  chemically synthesized
gtgcttgattaagataagct

SEQ ID NO: 256169 - DNA, 20 bp, Artificial Sequence
  chemically synthesized
agaggcccaaatgtgggact

SEQ ID NO: 256170 - DNA, 20 bp, Artificial Sequence
  chemically synthesized
gataagctcagtcccacatt

SEQ ID NO: 256171 - DNA, 20 bp, Artificial Sequence
  chemically synthesized
ataagctcagtcccacattt

SEQ ID NO: 256172 - DNA, 20 bp, Artificial Sequence
  chemically synthesized
tagagtagaggcccaaatgt

SEQ ID NO: 256173 - DNA, 20 bp, Artificial Sequence
  chemically synthesized
atagagtagaggcccaaatg

SEQ ID NO: 256174 - DNA, 20 bp, Artificial Sequence
  chemically synthesized
gtgtagaggaaatagagtag

SEQ ID NO: 256175 - DNA, 20 bp, Artificial Sequence
  chemically synthesized
tgtgtagaggaaatagagta

SEQ ID NO: 256176 - DNA, 20 bp, Artificial Sequence
  chemically synthesized
tctgtgtagaggaaatagag

SEQ ID NO: 256177 - DNA, 20 bp, Artificial Sequence
  chemically synthesized
gagtctgtgtagaggaaata

SEQ ID NO: 256178 - DNA, 20 bp, Artificial Sequence
  chemically synthesized
tggagtctgtgtagaggaaa

SEQ ID NO: 256179 - DNA, 20 bp, Artificial Sequence
  chemically synthesized
tctactctatttcctctaca

SEQ ID NO: 256180 - DNA, 20 bp, Artificial Sequence
  chemically synthesized
cagccatggagtctgtgtag

SEQ ID NO: 256181 - DNA, 20 bp, Artificial Sequence
  chemically synthesized
tcagccatggagtctgtgta

SEQ ID NO: 256182 - DNA, 20 bp, Artificial Sequence
  chemically synthesized
agtcagccatggagtctgtg

SEQ ID NO: 256183 - DNA, 20 bp, Artificial Sequence
  chemically synthesized
tttcctctacacagactcca

SEQ ID NO: 256184 - DNA, 20 bp, Artificial Sequence
  chemically synthesized
aggtaagggagtcagccatg

SEQ ID NO: 256185 - DNA, 20 bp, Artificial Sequence
  chemically synthesized
gaaggtaagggagtcagcca

SEQ ID NO: 256186 - DNA, 20 bp, Artificial Sequence
  chemically synthesized
ttggaagaaggtaagggagt

SEQ ID NO: 256187 - DNA, 20 bp, Artificial Sequence
  chemically synthesized
aagattggaagaaggtaagg

SEQ ID NO: 256188 - DNA, 20 bp, Artificial Sequence
  chemically synthesized
caaagattggaagaaggtaa

SEQ ID NO: 256189 - DNA, 20 bp, Artificial Sequence
  chemically synthesized
gcaaagattggaagaaggta

SEQ ID NO: 256190 - DNA, 20 bp, Artificial Sequence
  chemically synthesized
agcaaagattggaagaaggt

SEQ ID NO: 256191 - DNA, 20 bp, Artificial Sequence
  chemically synthesized
tttgagcaaagattggaaga

SEQ ID NO: 256192 - DNA, 20 bp, Artificial Sequence
  chemically synthesized
ctttgagcaaagattggaag

SEQ ID NO: 256193 - DNA, 20 bp, Artificial Sequence
  chemically synthesized
gacctttgagcaaagattgg

SEQ ID NO: 256194 - DNA, 20 bp, Artificial Sequence
  chemically synthesized
aatgacctttgagcaaagat

SEQ ID NO: 256195 - DNA, 20 bp, Artificial Sequence
  chemically synthesized
cttcttccaatctttgctca

SEQ ID NO: 256196 - DNA, 20 bp, Artificial Sequence
  chemically synthesized
ttcttccaatctttgctcaa

SEQ ID NO: 256197 - DNA, 20 bp, Artificial Sequence
  chemically synthesized
gtagaaatgacctttgagca

SEQ ID NO: 256198 - DNA, 20 bp, Artificial Sequence
  chemically synthesized
atagggtagaaatgaccttt

SEQ ID NO: 256199 - DNA, 20 bp, Artificial Sequence
  chemically synthesized
aattgccatttcaaataggg

SEQ ID NO: 256200 - DNA, 20 bp, Artificial Sequence
  chemically synthesized
cggaattgccatttcaaata

SEQ ID NO: 256201 - DNA, 20 bp, Artificial Sequence
  chemically synthesized
gcggaattgccatttcaaat

SEQ ID NO: 256202 - DNA, 20 bp, Artificial Sequence
  chemically synthesized
catttctaccctatttgaaa

SEQ ID NO: 256203 - DNA, 20 bp, Artificial Sequence
  chemically synthesized
ggcggaattgccatttcaaa

SEQ ID NO: 256204 - DNA, 20 bp, Artificial Sequence
  chemically synthesized
gtaggtataattgaaagtgg

SEQ ID NO: 256205 - DNA, 20 bp, Artificial Sequence
  chemically synthesized
gacgtaggtataattgaaag

SEQ ID NO: 256206 - DNA, 20 bp, Artificial Sequence
  chemically synthesized
gtagacgtaggtataattga

SEQ ID NO: 256207 - DNA, 20 bp, Artificial Sequence
  chemically synthesized
accactacaggggtagacgt

SEQ ID NO: 256208 - DNA, 20 bp, Artificial Sequence
  chemically synthesized
gaccactacaggggtagacg

SEQ ID NO: 256209 - DNA, 20 bp, Artificial Sequence
  chemically synthesized
tatacctacgtctacccctg

SEQ ID NO: 256210 - DNA, 20 bp, Artificial Sequence
  chemically synthesized
atataggaccactacagggg

SEQ ID NO: 256211 - DNA, 20 bp, Artificial Sequence
  chemically synthesized
acctacgtctacccctgtag

SEQ ID NO: 256212 - DNA, 20 bp, Artificial Sequence
  chemically synthesized
gggatataggaccactacag

SEQ ID NO: 256213 - DNA, 20 bp, Artificial Sequence
  chemically synthesized
ggggatataggaccactaca

SEQ ID NO: 256214 - DNA, 20 bp, Artificial Sequence
  chemically synthesized
aggggatataggaccactac

SEQ ID NO: 256215 - DNA, 20 bp, Artificial Sequence
  chemically synthesized
aaggggatataggaccacta

SEQ ID NO: 256216 - DNA, 20 bp, Artificial Sequence
  chemically synthesized
agaatctgttaaggggatat

SEQ ID NO: 256217 - DNA, 20 bp, Artificial Sequence
  chemically synthesized
cagaatctgttaaggggata

SEQ ID NO: 256218 - DNA, 20 bp, Artificial Sequence
  chemically synthesized
gtggtcctatatccccttaa

SEQ ID NO: 256219 - DNA, 20 bp, Artificial Sequence
  chemically synthesized
aaaaaccagaatctgttaag

SEQ ID NO: 256220 - DNA, 20 bp, Artificial Sequence
  chemically synthesized
aaaaaaccagaatctgttaa

SEQ ID NO: 256221 - DNA, 20 bp, Artificial Sequence
  chemically synthesized
aaaaaaaccagaatctgtta

SEQ ID NO: 256222 - DNA, 20 bp, Artificial Sequence
  chemically synthesized
aaaaaaaaccagaatctgtt

SEQ ID NO: 256223 - DNA, 20 bp, Artificial Sequence
  chemically synthesized
tatatccccttaacagattc

SEQ ID NO: 256224 - DNA, 20 bp, Artificial Sequence
  chemically synthesized
tttgggaaaaaaaaaaaaac

SEQ ID NO: 256225 - DNA, 20 bp, Artificial Sequence
  chemically synthesized
tactaggtgatacgtatttt

SEQ ID NO: 256226 - DNA, 20 bp, Artificial Sequence
  chemically synthesized
ttactaggtgatacgtattt

SEQ ID NO: 256227 - DNA, 20 bp, Artificial Sequence
  chemically synthesized
ttcccaaaatacgtatcacc

SEQ ID NO: 256228 - DNA, 20 bp, Artificial Sequence
  chemically synthesized
agtaaatattgcgtattact

SEQ ID NO: 256229 - DNA, 20 bp, Artificial Sequence
  chemically synthesized
aagtaaatattgcgtattac

SEQ ID NO: 256230 - DNA, 20 bp, Artificial Sequence
  chemically synthesized
agcaaacaaagaaaaatgat

SEQ ID NO: 256231 - DNA, 20 bp, Artificial Sequence
  chemically synthesized
agaatagaagcaagcaaaca

SEQ ID NO: 256232 - DNA, 20 bp, Artificial Sequence
  chemically synthesized
ttgggagacagaatagaagc

SEQ ID NO: 256233 - DNA, 20 bp, Artificial Sequence
  chemically synthesized
aacattgggagacagaatag

SEQ ID NO: 256234 - DNA, 20 bp, Artificial Sequence
  chemically synthesized
tataacattgggagacagaa

SEQ ID NO: 256235 - DNA, 20 bp, Artificial Sequence
  chemically synthesized
tttattataacattgggaga

SEQ ID NO: 256236 - DNA, 20 bp, Artificial Sequence
  chemically synthesized
agcttttattataacattgg

SEQ ID NO: 256237 - DNA, 20 bp, Artificial Sequence
  chemically synthesized
tcagcttttattataacatt

SEQ ID NO: 256238 - DNA, 20 bp, Artificial Sequence
  chemically synthesized
ttcagcttttattataacat

SEQ ID NO: 256239 - DNA, 20 bp, Artificial Sequence
  chemically synthesized
gtctcccaatgttataataa

SEQ ID NO: 256240 - DNA, 20 bp, Artificial Sequence
  chemically synthesized
tgttataataaaagctgaat

SEQ ID NO: 256241 - DNA, 20 bp, Artificial Sequence
  chemically synthesized
gttataataaaagctgaatg

SEQ ID NO: 256242 - DNA, 20 bp, Artificial Sequence
  chemically synthesized
ttataataaaagctgaatga

SEQ ID NO: 256243 - DNA, 20 bp, Artificial Sequence
  chemically synthesized
aacgaatctttgccctcatt

SEQ ID NO: 256244 - DNA, 20 bp, Artificial Sequence
  chemically synthesized
ataaaagctgaatgagggca

SEQ ID NO: 256245 - DNA, 20 bp, Artificial Sequence
  chemically synthesized
gaatgagggcaaagattcgt

SEQ ID NO: 256246 - DNA, 20 bp, Artificial Sequence
  chemically synthesized
gtgcttataaaacagtgaaa

SEQ ID NO: 256247 - DNA, 20 bp, Artificial Sequence
  chemically synthesized
agtctttttcactgttttat

SEQ ID NO: 256248 - DNA, 20 bp, Artificial Sequence
  chemically synthesized
tattctaagtgcttataaaa

SEQ ID NO: 256249 - DNA, 20 bp, Artificial Sequence
  chemically synthesized
ttcactgttttataagcact

SEQ ID NO: 256250 - DNA, 20 bp, Artificial Sequence
  chemically synthesized
tgttttataagcacttagaa

SEQ ID NO: 256251 - DNA, 20 bp, Artificial Sequence
  chemically synthesized
tatgtaccacacactattct

SEQ ID NO: 256252 - DNA, 20 bp, Artificial Sequence
  chemically synthesized
taagcacttagaatagtgtg

SEQ ID NO: 256253 - DNA, 20 bp, Artificial Sequence
  chemically synthesized
aatagtgtgtggtacatact

SEQ ID NO: 256254 - DNA, 20 bp, Artificial Sequence
  chemically synthesized
tagtgtgtggtacatactaa

SEQ ID NO: 256255 - DNA, 20 bp, Artificial Sequence
  chemically synthesized
aaaaatagttattaagctct

SEQ ID NO: 256256 - DNA, 20 bp, Artificial Sequence
  chemically synthesized
atattccaaaaatagttatt

SEQ ID NO: 256257 - DNA, 20 bp, Artificial Sequence
  chemically synthesized
aagagcttaataactatttt

SEQ ID NO: 256258 - DNA, 20 bp, Artificial Sequence
  chemically synthesized
ggattcgtatattccaaaaa

SEQ ID NO: 256259 - DNA, 20 bp, Artificial Sequence
  chemically synthesized
atatacgaatccacattcct

SEQ ID NO: 256260 - DNA, 20 bp, Artificial Sequence
  chemically synthesized
acaagtaaacctaaggaatg

SEQ ID NO: 256261 - DNA, 20 bp, Artificial Sequence
  chemically synthesized
tatacgaatccacattcctt

SEQ ID NO: 256262 - DNA, 20 bp, Artificial Sequence
  chemically synthesized
tgttaggacaagtaaaccta

SEQ ID NO: 256263 - DNA, 20 bp, Artificial Sequence
  chemically synthesized
ttgttaggacaagtaaacct

SEQ ID NO: 256264 - DNA, 20 bp, Artificial Sequence
  chemically synthesized
aaacaaaaaattgttaggac

SEQ ID NO: 256265 - DNA, 20 bp, Artificial Sequence
  chemically synthesized
ttgagaaacaaaaaattgtt

SEQ ID NO: 256266 - DNA, 20 bp, Artificial Sequence
  chemically synthesized
cttgagaaacaaaaaattgt

SEQ ID NO: 256267 - DNA, 20 bp, Artificial Sequence
  chemically synthesized
ctaacaattttttgtttctc

SEQ ID NO: 256268 - DNA, 20 bp, Artificial Sequence
  chemically synthesized
aacaattttttgtttctcaa

SEQ ID NO: 256269 - DNA, 20 bp, Artificial Sequence
  chemically synthesized
aggttttttgcattgctctt

SEQ ID NO: 256270 - DNA, 20 bp, Artificial Sequence
  chemically synthesized
aatgcaaaaaacctgaactc

SEQ ID NO: 256271 - DNA, 20 bp, Artificial Sequence
  chemically synthesized
gttcaagtcctcttgagttc

SEQ ID NO: 256272 - DNA, 20 bp, Artificial Sequence
  chemically synthesized
tgcaaaaaacctgaactcaa

SEQ ID NO: 256273 - DNA, 20 bp, Artificial Sequence
  chemically synthesized
cgttcaagtcctcttgagtt

SEQ ID NO: 256274 - DNA, 20 bp, Artificial Sequence
  chemically synthesized
gcaaaaaacctgaactcaag

SEQ ID NO: 256275 - DNA, 20 bp, Artificial Sequence
  chemically synthesized
caggtcgttcaagtcctctt

SEQ ID NO: 256276 - DNA, 20 bp, Artificial Sequence
  chemically synthesized
agtgtgaagccaggtcgttc

SEQ ID NO: 256277 - DNA, 20 bp, Artificial Sequence
  chemically synthesized
tcaagaggacttgaacgacc

SEQ ID NO: 256278 - DNA, 20 bp, Artificial Sequence
  chemically synthesized
gccaaagatagtgtgaagcc

SEQ ID NO: 256279 - DNA, 20 bp, Artificial Sequence
  chemically synthesized
agccaaagatagtgtgaagc

SEQ ID NO: 256280 - DNA, 20 bp, Artificial Sequence
  chemically synthesized
tataagccaaagatagtgtg

SEQ ID NO: 256281 - DNA, 20 bp, Artificial Sequence
  chemically synthesized
acctggcttcacactatctt

SEQ ID NO: 256282 - DNA, 20 bp, Artificial Sequence
  chemically synthesized
gtgagcttataagccaaaga

SEQ ID NO: 256283 - DNA, 20 bp, Artificial Sequence
  chemically synthesized
ggtagtgagcttataagcca

SEQ ID NO: 256284 - DNA, 20 bp, Artificial Sequence
  chemically synthesized
tcacactatctttggcttat

SEQ ID NO: 256285 - DNA, 20 bp, Artificial Sequence
  chemically synthesized
aaagctggtagtgagcttat

SEQ ID NO: 256286 - DNA, 20 bp, Artificial Sequence
  chemically synthesized
ttggcttataagctcactac

SEQ ID NO: 256287 - DNA, 20 bp, Artificial Sequence
  chemically synthesized
cacaagggaaagctggtagt

SEQ ID NO: 256288 - DNA, 20 bp, Artificial Sequence
  chemically synthesized
agaccacaagggaaagctgg

SEQ ID NO: 256289 - DNA, 20 bp, Artificial Sequence
  chemically synthesized
tcgagaccacaagggaaagc

SEQ ID NO: 256290 - DNA, 20 bp, Artificial Sequence
  chemically synthesized
tcactaccagctttcccttg

SEQ ID NO: 256291 - DNA, 20 bp, Artificial Sequence
  chemically synthesized
aagttcgagaccacaaggga

SEQ ID NO: 256292 - DNA, 20 bp, Artificial Sequence
  chemically synthesized
gttcaagttcgagaccacaa

SEQ ID NO: 256293 - DNA, 20 bp, Artificial Sequence
  chemically synthesized
tgttcaagttcgagaccaca

SEQ ID NO: 256294 - DNA, 20 bp, Artificial Sequence
  chemically synthesized
ttgttcaagttcgagaccac

SEQ ID NO: 256295 - DNA, 20 bp, Artificial Sequence
  chemically synthesized
gacaacccttgttcaagttc

SEQ ID NO: 256296 - DNA, 20 bp, Artificial Sequence
  chemically synthesized
ttgtggtctcgaacttgaac

SEQ ID NO: 256297 - DNA, 20 bp, Artificial Sequence
  chemically synthesized
tgtggtctcgaacttgaaca

SEQ ID NO: 256298 - DNA, 20 bp, Artificial Sequence
  chemically synthesized
gtggtctcgaacttgaacaa

SEQ ID NO: 256299 - DNA, 20 bp, Artificial Sequence
  chemically synthesized
aatagagacaacccttgttc

SEQ ID NO: 256300 - DNA, 20 bp, Artificial Sequence
  chemically synthesized
ttaaataggatcaagaaata

SEQ ID NO: 256301 - DNA, 20 bp, Artificial Sequence
  chemically synthesized
ttttaaataggatcaagaaa

SEQ ID NO: 256302 - DNA, 20 bp, Artificial Sequence
  chemically synthesized
tgtagattttaaataggatc

SEQ ID NO: 256303 - DNA, 20 bp, Artificial Sequence
  chemically synthesized
tcctaatgtagattttaaat

SEQ ID NO: 256304 - DNA, 20 bp, Artificial Sequence
  chemically synthesized
gtcctaatgtagattttaaa

SEQ ID NO: 256305 - DNA, 20 bp, Artificial Sequence
  chemically synthesized
atcctatttaaaatctacat

SEQ ID NO: 256306 - DNA, 20 bp, Artificial Sequence
  chemically synthesized
tcctatttaaaatctacatt

SEQ ID NO: 256307 - DNA, 20 bp, Artificial Sequence
  chemically synthesized
gagacatggtggtcctaatg

SEQ ID NO: 256308 - DNA, 20 bp, Artificial Sequence
  chemically synthesized
ctcacgggtaggagacatgg

SEQ ID NO: 256309 - DNA, 20 bp, Artificial Sequence
  chemically synthesized
aagctcacgggtaggagaca

SEQ ID NO: 256310 - DNA, 20 bp, Artificial Sequence
  chemically synthesized
tgaagaaagctcacgggtag

SEQ ID NO: 256311 - DNA, 20 bp, Artificial Sequence
  chemically synthesized
ccaccatgtctcctacccgt

SEQ ID NO: 256312 - DNA, 20 bp, Artificial Sequence
  chemically synthesized
tatgaagaaagctcacgggt

SEQ ID NO: 256313 - DNA, 20 bp, Artificial Sequence
  chemically synthesized
atatgaagaaagctcacggg

SEQ ID NO: 256314 - DNA, 20 bp, Artificial Sequence
  chemically synthesized
gccatatgaagaaagctcac

SEQ ID NO: 256315 - DNA, 20 bp, Artificial Sequence
  chemically synthesized
ggccatatgaagaaagctca

SEQ ID NO: 256316 - DNA, 20 bp, Artificial Sequence
  chemically synthesized
aaaacgtggccatatgaaga

SEQ ID NO: 256317 - DNA, 20 bp, Artificial Sequence
  chemically synthesized
acccgtgagctttcttcata

SEQ ID NO: 256318 - DNA, 20 bp, Artificial Sequence
  chemically synthesized
atgaaaaacgtggccatatg

SEQ ID NO: 256319 - DNA, 20 bp, Artificial Sequence
  chemically synthesized
caagagggtgatgaaaaacg

SEQ ID NO: 256320 - DNA, 20 bp, Artificial Sequence
  chemically synthesized
cacgtttttcatcaccctct

SEQ ID NO: 256321 - DNA, 20 bp, Artificial Sequence
  chemically synthesized
tatactttgggtaaccaaga

SEQ ID NO: 256322 - DNA, 20 bp, Artificial Sequence
  chemically synthesized
ctatactttgggtaaccaag

SEQ ID NO: 256323 - DNA, 20 bp, Artificial Sequence
  chemically synthesized
gctatactttgggtaaccaa

SEQ ID NO: 256324 - DNA, 20 bp, Artificial Sequence
  chemically synthesized
gtgctatactttgggtaacc

SEQ ID NO: 256325 - DNA, 20 bp, Artificial Sequence
  chemically synthesized
atcaccctcttggttaccca

SEQ ID NO: 256326 - DNA, 20 bp, Artificial Sequence
  chemically synthesized
cctcttggttacccaaagta

SEQ ID NO: 256327 - DNA, 20 bp, Artificial Sequence
  chemically synthesized
aataaaatgtgctatacttt

SEQ ID NO: 256328 - DNA, 20 bp, Artificial Sequence
  chemically synthesized
gaataaaatgtgctatactt

SEQ ID NO: 256329 - DNA, 20 bp, Artificial Sequence
  chemically synthesized
acattttattcattccaaac

SEQ ID NO: 256330 - DNA, 20 bp, Artificial Sequence
  chemically synthesized
cattttattcattccaaaca

SEQ ID NO: 256331 - DNA, 20 bp, Artificial Sequence
  chemically synthesized
tatagtacagatgccttgtt

SEQ ID NO: 256332 - DNA, 20 bp, Artificial Sequence
  chemically synthesized
catcaaaaccaattatagta

SEQ ID NO: 256333 - DNA, 20 bp, Artificial Sequence
  chemically synthesized
caaggcatctgtactataat

SEQ ID NO: 256334 - DNA, 20 bp, Artificial Sequence
  chemically synthesized
tgtctcatcaaaaccaatta

SEQ ID NO: 256335 - DNA, 20 bp, Artificial Sequence
  chemically synthesized
gtactataattggttttgat

SEQ ID NO: 256336 - DNA, 20 bp, Artificial Sequence
  chemically synthesized
atatcaggcacacatcattt

SEQ ID NO: 256337 - DNA, 20 bp, Artificial Sequence
  chemically synthesized
ggaaggaaagaaaaaatatc

SEQ ID NO: 256338 - DNA, 20 bp, Artificial Sequence
  chemically synthesized
tggaaggaaagaaaaaatat

SEQ ID NO: 256339 - DNA, 20 bp, Artificial Sequence
  chemically synthesized
ggaggaaataaatggaagga

SEQ ID NO: 256340 - DNA, 20 bp, Artificial Sequence
  chemically synthesized
acaaggaggaaataaatgga

SEQ ID NO: 256341 - DNA, 20 bp, Artificial Sequence
  chemically synthesized
aacaaggaggaaataaatgg

SEQ ID NO: 256342 - DNA, 20 bp, Artificial Sequence
  chemically synthesized
agaaacaaggaggaaataaa

SEQ ID NO: 256343 - DNA, 20 bp, Artificial Sequence
  chemically synthesized
aaataaggagagaaacaagg

SEQ ID NO: 256344 - DNA, 20 bp, Artificial Sequence
  chemically synthesized
aaaataaggagagaaacaag

SEQ ID NO: 256345 - DNA, 20 bp, Artificial Sequence
  chemically synthesized
ataaaataaggagagaaaca

SEQ ID NO: 256346 - DNA, 20 bp, Artificial Sequence
  chemically synthesized
aataaaataaggagagaaac

SEQ ID NO: 256347 - DNA, 20 bp, Artificial Sequence
  chemically synthesized
gaaaagaaataaaataagga

SEQ ID NO: 256348 - DNA, 20 bp, Artificial Sequence
  chemically synthesized
aagaaaagaaataaaataag

SEQ ID NO: 256349 - DNA, 20 bp, Artificial Sequence
  chemically synthesized
tgaagaaaagaaataaaata

SEQ ID NO: 256350 - DNA, 20 bp, Artificial Sequence
  chemically synthesized
ttgaagaaaagaaataaaat

SEQ ID NO: 256351 - DNA, 20 bp, Artificial Sequence
  chemically synthesized
agggagggagaattgaagaa

SEQ ID NO: 256352 - DNA, 20 bp, Artificial Sequence
  chemically synthesized
gaaggagggagggagaattg

SEQ ID NO: 256353 - DNA, 20 bp, Artificial Sequence
  chemically synthesized
gagtgagggaaggagggagg

SEQ ID NO: 256354 - DNA, 20 bp, Artificial Sequence
  chemically synthesized
gagagtgagggaaggaggga

SEQ ID NO: 256355 - DNA, 20 bp, Artificial Sequence
  chemically synthesized
agagagtgagggaaggaggg

SEQ ID NO: 256356 - DNA, 20 bp, Artificial Sequence
  chemically synthesized
aagagagtgagggaaggagg

SEQ ID NO: 256357 - DNA, 20 bp, Artificial Sequence
  chemically synthesized
gaaagagagtgagggaagga

SEQ ID NO: 256358 - DNA, 20 bp, Artificial Sequence
  chemically synthesized
agaaagagagtgagggaagg

SEQ ID NO: 256359 - DNA, 20 bp, Artificial Sequence
  chemically synthesized
aagaaagagagtgagggaag

SEQ ID NO: 256360 - DNA, 20 bp, Artificial Sequence
  chemically synthesized
ggaagaaagagagtgaggga

SEQ ID NO: 256361 - DNA, 20 bp, Artificial Sequence
  chemically synthesized
aggaagaaagagagtgaggg

SEQ ID NO: 256362 - DNA, 20 bp, Artificial Sequence
  chemically synthesized
gtaaggaagaaagagagtga

SEQ ID NO: 256363 - DNA, 20 bp, Artificial Sequence
  chemically synthesized
agtaaggaagaaagagagtg

SEQ ID NO: 256364 - DNA, 20 bp, Artificial Sequence
  chemically synthesized
aagtaaggaagaaagagagt

SEQ ID NO: 256365 - DNA, 20 bp, Artificial Sequence
  chemically synthesized
gaggaagtaaggaagaaaga

SEQ ID NO: 256366 - DNA, 20 bp, Artificial Sequence
  chemically synthesized
gggaggaagtaaggaagaaa

SEQ ID NO: 256367 - DNA, 20 bp, Artificial Sequence
  chemically synthesized
aagggaggaagtaaggaaga

SEQ ID NO: 256368 - DNA, 20 bp, Artificial Sequence
  chemically synthesized
aaggaagggaggaagtaagg

SEQ ID NO: 256369 - DNA, 20 bp, Artificial Sequence
  chemically synthesized
aggaaggaagggaggaagta

SEQ ID NO: 256370 - DNA, 20 bp, Artificial Sequence
  chemically synthesized
gaggaaggaagggaggaagt

SEQ ID NO: 256371 - DNA, 20 bp, Artificial Sequence
  chemically synthesized
ggaggaggaaggaagggagg

SEQ ID NO: 256372 - DNA, 20 bp, Artificial Sequence
  chemically synthesized
aaaggaggaggaaggaaggg

SEQ ID NO: 256373 - DNA, 20 bp, Artificial Sequence
  chemically synthesized
gaaaggaggaggaaggaagg

SEQ ID NO: 256374 - DNA, 20 bp, Artificial Sequence
  chemically synthesized
ctgaaaggaggaggaaggaa

SEQ ID NO: 256375 - DNA, 20 bp, Artificial Sequence
  chemically synthesized
actgaaaggaggaggaagga

SEQ ID NO: 256376 - DNA, 20 bp, Artificial Sequence
  chemically synthesized
cactgaaaggaggaggaagg

SEQ ID NO: 256377 - DNA, 20 bp, Artificial Sequence
  chemically synthesized
aatcactgaaaggaggagga

SEQ ID NO: 256378 - DNA, 20 bp, Artificial Sequence
  chemically synthesized
aaatcactgaaaggaggagg

SEQ ID NO: 256379 - DNA, 20 bp, Artificial Sequence
  chemically synthesized
ttcaaatcactgaaaggagg

SEQ ID NO: 256380 - DNA, 20 bp, Artificial Sequence
  chemically synthesized
cccttccttcctcctccttt

SEQ ID NO: 256381 - DNA, 20 bp, Artificial Sequence
  chemically synthesized
tttcaaatcactgaaaggag

SEQ ID NO: 256382 - DNA, 20 bp, Artificial Sequence
  chemically synthesized
agtttcaaatcactgaaagg

SEQ ID NO: 256383 - DNA, 20 bp, Artificial Sequence
  chemically synthesized
gagtttcaaatcactgaaag

SEQ ID NO: 256384 - DNA, 20 bp, Artificial Sequence
  chemically synthesized
tggagtttcaaatcactgaa

SEQ ID NO: 256385 - DNA, 20 bp, Artificial Sequence
  chemically synthesized
ctggagtttcaaatcactga

SEQ ID NO: 256386 - DNA, 20 bp, Artificial Sequence
  chemically synthesized
ctttcagtgatttgaaactc

SEQ ID NO: 256387 - DNA, 20 bp, Artificial Sequence
  chemically synthesized
caatattccacattgcactg

SEQ ID NO: 256388 - DNA, 20 bp, Artificial Sequence
  chemically synthesized
ttcaatattccacattgcac

SEQ ID NO: 256389 - DNA, 20 bp, Artificial Sequence
  chemically synthesized
tttgaaactccagtgcaatg

SEQ ID NO: 256390 - DNA, 20 bp, Artificial Sequence
  chemically synthesized
cagtgcaatgtggaatattg

SEQ ID NO: 256391 - DNA, 20 bp, Artificial Sequence
  chemically synthesized
agtgcaatgtggaatattga

SEQ ID NO: 256392 - DNA, 20 bp, Artificial Sequence
  chemically synthesized
gtgcaatgtggaatattgaa

SEQ ID NO: 256393 - DNA, 20 bp, Artificial Sequence
  chemically synthesized
tgtggaatattgaagggatg

SEQ ID NO: 256394 - DNA, 20 bp, Artificial Sequence
  chemically synthesized
gtggaatattgaagggatgt

SEQ ID NO: 256395 - DNA, 20 bp, Artificial Sequence
  chemically synthesized
gaatattgaagggatgtggg

SEQ ID NO: 256396 - DNA, 20 bp, Artificial Sequence
  chemically synthesized
tgaagaacatgaacaagaca

SEQ ID NO: 256397 - DNA, 20 bp, Artificial Sequence
  chemically synthesized
ctgaagaacatgaacaagac

SEQ ID NO: 256398 - DNA, 20 bp, Artificial Sequence
  chemically synthesized
ttcacctgaagaacatgaac

SEQ ID NO: 256399 - DNA, 20 bp, Artificial Sequence
  chemically synthesized
cttgtcttgttcatgttctt

SEQ ID NO: 256400 - DNA, 20 bp, Artificial Sequence
  chemically synthesized
ttgtcttgttcatgttcttc

SEQ ID NO: 256401 - DNA, 20 bp, Artificial Sequence
  chemically synthesized
ttgttcatgttcttcaggtg

SEQ ID NO: 256402 - DNA, 20 bp, Artificial Sequence
  chemically synthesized
gagcagaatgtcttcacctg

SEQ ID NO: 256403 - DNA, 20 bp, Artificial Sequence
  chemically synthesized
tattattctttatggtagag

SEQ ID NO: 256404 - DNA, 20 bp, Artificial Sequence
  chemically synthesized
agacattctgctctaccata

SEQ ID NO: 256405 - DNA, 20 bp, Artificial Sequence
  chemically synthesized
taatattattctttatggta

SEQ ID NO: 256406 - DNA, 20 bp, Artificial Sequence
  chemically synthesized
gctaatattattctttatgg

SEQ ID NO: 256407 - DNA, 20 bp, Artificial Sequence
  chemically synthesized
acagctaatattattcttta

SEQ ID NO: 256408 - DNA, 20 bp, Artificial Sequence
  chemically synthesized
tctaccataaagaataatat

SEQ ID NO: 256409 - DNA, 20 bp, Artificial Sequence
  chemically synthesized
caataatgagaatcaattta

SEQ ID NO: 256410 - DNA, 20 bp, Artificial Sequence
  chemically synthesized
gctttaccttttgcaataat

SEQ ID NO: 256411 - DNA, 20 bp, Artificial Sequence
  chemically synthesized
attgattctcattattgcaa

SEQ ID NO: 256412 - DNA, 20 bp, Artificial Sequence
  chemically synthesized
ttgattctcattattgcaaa

SEQ ID NO: 256413 - DNA, 20 bp, Artificial Sequence
  chemically synthesized
tctcattattgcaaaaggta

SEQ ID NO: 256414 - DNA, 20 bp, Artificial Sequence
  chemically synthesized
ttattgcaaaaggtaaagca

SEQ ID NO: 256415 - DNA, 20 bp, Artificial Sequence
  chemically synthesized
atagttgtcattcttattat

SEQ ID NO: 256416 - DNA, 20 bp, Artificial Sequence
  chemically synthesized
ataagaacatagcttataat

SEQ ID NO: 256417 - DNA, 20 bp, Artificial Sequence
  chemically synthesized
ttaggacaaaaataagaaca

SEQ ID NO: 256418 - DNA, 20 bp, Artificial Sequence
  chemically synthesized
tgaatttttaggacaaaaat

SEQ ID NO: 256419 - DNA, 20 bp, Artificial Sequence
  chemically synthesized
atcaataaatgtgaattttt

SEQ ID NO: 256420 - DNA, 20 bp, Artificial Sequence
  chemically synthesized
tatcaataaatgtgaatttt

SEQ ID NO: 256421 - DNA, 20 bp, Artificial Sequence
  chemically synthesized
aattcacatttattgatacc

SEQ ID NO: 256422 - DNA, 20 bp, Artificial Sequence
  chemically synthesized
attcacatttattgatacca

SEQ ID NO: 256423 - DNA, 20 bp, Artificial Sequence
  chemically synthesized
ttagctgttcaattaggcct

SEQ ID NO: 256424 - DNA, 20 bp, Artificial Sequence
  chemically synthesized
gataccaaggcctaattgaa

SEQ ID NO: 256425 - DNA, 20 bp, Artificial Sequence
  chemically synthesized
gaatccttagctgttcaatt

SEQ ID NO: 256426 - DNA, 20 bp, Artificial Sequence
  chemically synthesized
ggaatccttagctgttcaat

SEQ ID NO: 256427 - DNA, 20 bp, Artificial Sequence
  chemically synthesized
caaggcctaattgaacagct

SEQ ID NO: 256428 - DNA, 20 bp, Artificial Sequence
  chemically synthesized
aaggcctaattgaacagcta

SEQ ID NO: 256429 - DNA, 20 bp, Artificial Sequence
  chemically synthesized
tccctcattcagggaatcct

SEQ ID NO: 256430 - DNA, 20 bp, Artificial Sequence
  chemically synthesized
cagctaaggattccctgaat

SEQ ID NO: 256431 - DNA, 20 bp, Artificial Sequence
  chemically synthesized
agctaaggattccctgaatg

SEQ ID NO: 256432 - DNA, 20 bp, Artificial Sequence
  chemically synthesized
gctaaggattccctgaatga

SEQ ID NO: 256433 - DNA, 20 bp, Artificial Sequence
  chemically synthesized
ttctgctgctccctcattca

SEQ ID NO: 256434 - DNA, 20 bp, Artificial Sequence
  chemically synthesized
attctgctgctccctcattc

SEQ ID NO: 256435 - DNA, 20 bp, Artificial Sequence
  chemically synthesized
taaggattccctgaatgagg

SEQ ID NO: 256436 - DNA, 20 bp, Artificial Sequence
  chemically synthesized
gattctgctgctccctcatt

SEQ ID NO: 256437 - DNA, 20 bp, Artificial Sequence
  chemically synthesized
ggattccctgaatgagggag

SEQ ID NO: 256438 - DNA, 20 bp, Artificial Sequence
  chemically synthesized
ttccctgaatgagggagcag

SEQ ID NO: 256439 - DNA, 20 bp, Artificial Sequence
  chemically synthesized
gggagcagcagaatcacttg

SEQ ID NO: 256440 - DNA, 20 bp, Artificial Sequence
  chemically synthesized
cctttggagtggaattcttc

SEQ ID NO: 256441 - DNA, 20 bp, Artificial Sequence
  chemically synthesized
acttgaagaattccactcca

SEQ ID NO: 256442 - DNA, 20 bp, Artificial Sequence
  chemically synthesized
cttgaagaattccactccaa

SEQ ID NO: 256443 - DNA, 20 bp, Artificial Sequence
  chemically synthesized
aatagttcatgcctttggag

SEQ ID NO: 256444 - DNA, 20 bp, Artificial Sequence
  chemically synthesized
agaaatagttcatgcctttg

SEQ ID NO: 256445 - DNA, 20 bp, Artificial Sequence
  chemically synthesized
ttagaaatagttcatgcctt

SEQ ID NO: 256446 - DNA, 20 bp, Artificial Sequence
  chemically synthesized
caaaggcatgaactatttct

SEQ ID NO: 256447 - DNA, 20 bp, Artificial Sequence
  chemically synthesized
cgtagagaaattcttagaaa

SEQ ID NO: 256448 - DNA, 20 bp, Artificial Sequence
  chemically synthesized
catttacgtagagaaattct

SEQ ID NO: 256449 - DNA, 20 bp, Artificial Sequence
  chemically synthesized
gtgtagttagcatttacgta

SEQ ID NO: 256450 - DNA, 20 bp, Artificial Sequence
  chemically synthesized
ctgtgtagttagcatttacg

SEQ ID NO: 256451 - DNA, 20 bp, Artificial Sequence
  chemically synthesized
ctacgtaaatgctaactaca

SEQ ID NO: 256452 - DNA, 20 bp, Artificial Sequence
  chemically synthesized
tgacatatttactgtgtagt

SEQ ID NO: 256453 - DNA, 20 bp, Artificial Sequence
  chemically synthesized
ataatgacatatttactgtg

SEQ ID NO: 256454 - DNA, 20 bp, Artificial Sequence
  chemically synthesized
tatttatttcaaaaatgtcc

SEQ ID NO: 256455 - DNA, 20 bp, Artificial Sequence
  chemically synthesized
tatttcaaaaatgtcctaga

SEQ ID NO: 256456 - DNA, 20 bp, Artificial Sequence
  chemically synthesized
tttcaaaaatgtcctagata

SEQ ID NO: 256457 - DNA, 20 bp, Artificial Sequence
  chemically synthesized
cttataggggaactctatct

SEQ ID NO: 256458 - DNA, 20 bp, Artificial Sequence
  chemically synthesized
gcttataggggaactctatc

SEQ ID NO: 256459 - DNA, 20 bp, Artificial Sequence
  chemically synthesized
cctagatagagttcccctat

SEQ ID NO: 256460 - DNA, 20 bp, Artificial Sequence
  chemically synthesized
agatagagttcccctataag

SEQ ID NO: 256461 - DNA, 20 bp, Artificial Sequence
  chemically synthesized
gtcttcgaatctgcttatag

SEQ ID NO: 256462 - DNA, 20 bp, Artificial Sequence
  chemically synthesized
tgtcttcgaatctgcttata

SEQ ID NO: 256463 - DNA, 20 bp, Artificial Sequence
  chemically synthesized
ttgtcttcgaatctgcttat

SEQ ID NO: 256464 - DNA, 20 bp, Artificial Sequence
  chemically synthesized
cttgtcttcgaatctgctta

SEQ ID NO: 256465 - DNA, 20 bp, Artificial Sequence
  chemically synthesized
ttcccctataagcagattcg

SEQ ID NO: 256466 - DNA, 20 bp, Artificial Sequence
  chemically synthesized
ctataagcagattcgaagac

SEQ ID NO: 256467 - DNA, 20 bp, Artificial Sequence
  chemically synthesized
tataagcagattcgaagaca

SEQ ID NO: 256468 - DNA, 20 bp, Artificial Sequence
  chemically synthesized
ataagcagattcgaagacaa

SEQ ID NO: 256469 - DNA, 20 bp, Artificial Sequence
  chemically synthesized
tcgaagacaagggatgtctt

SEQ ID NO: 256470 - DNA, 20 bp, Artificial Sequence
  chemically synthesized
cgaagacaagggatgtcttt

SEQ ID NO: 256471 - DNA, 20 bp, Artificial Sequence
  chemically synthesized
acctccttggatcattccca

SEQ ID NO: 256472 - DNA, 20 bp, Artificial Sequence
  chemically synthesized
gatgtctttgggaatgatcc

SEQ ID NO: 256473 - DNA, 20 bp, Artificial Sequence
  chemically synthesized
atgtctttgggaatgatcca

SEQ ID NO: 256474 - DNA, 20 bp, Artificial Sequence
  chemically synthesized
gtctttgggaatgatccaag

SEQ ID NO: 256475 - DNA, 20 bp, Artificial Sequence
  chemically synthesized
tctttgggaatgatccaagg

SEQ ID NO: 256476 - DNA, 20 bp, Artificial Sequence
  chemically synthesized
acactttactagcacctcct

SEQ ID NO: 256477 - DNA, 20 bp, Artificial Sequence
  chemically synthesized
ggaatgatccaaggaggtgc

SEQ ID NO: 256478 - DNA, 20 bp, Artificial Sequence
  chemically synthesized
gatccaaggaggtgctagta

SEQ ID NO: 256479 - DNA, 20 bp, Artificial Sequence
  chemically synthesized
ctaccttacacacactttac

SEQ ID NO: 256480 - DNA, 20 bp, Artificial Sequence
  chemically synthesized
ggtgctagtaaagtgtgtgt

SEQ ID NO: 256481 - DNA, 20 bp, Artificial Sequence
  chemically synthesized
gtgctagtaaagtgtgtgta

SEQ ID NO: 256482 - DNA, 20 bp, Artificial Sequence
  chemically synthesized
ctagtaaagtgtgtgtaagg

SEQ ID NO: 256483 - DNA, 20 bp, Artificial Sequence
  chemically synthesized
tagtaaagtgtgtgtaaggt

SEQ ID NO: 256484 - DNA, 20 bp, Artificial Sequence
  chemically synthesized
aaagtgtgtgtaaggtagga

SEQ ID NO: 256485 - DNA, 20 bp, Artificial Sequence
  chemically synthesized
aagtgtgtgtaaggtaggac

SEQ ID NO: 256486 - DNA, 20 bp, Artificial Sequence
  chemically synthesized
agtgtgtgtaaggtaggaca

SEQ ID NO: 256487 - DNA, 20 bp, Artificial Sequence
  chemically synthesized
tgtgtgtaaggtaggacagg

SEQ ID NO: 256488 - DNA, 20 bp, Artificial Sequence
  chemically synthesized
tgtaaggtaggacagggagc

SEQ ID NO: 256489 - DNA, 20 bp, Artificial Sequence
  chemically synthesized
gcaagtgaaatgtatcctat

SEQ ID NO: 256490 - DNA, 20 bp, Artificial Sequence
  chemically synthesized
caagtgaaatgtatcctatg

SEQ ID NO: 256491 - DNA, 20 bp, Artificial Sequence
  chemically synthesized
gtgaaatgtatcctatgagg

SEQ ID NO: 256492 - DNA, 20 bp, Artificial Sequence
  chemically synthesized
tgaaatgtatcctatgaggc

SEQ ID NO: 256493 - DNA, 20 bp, Artificial Sequence
  chemically synthesized
acagtaaaaacctgcctcat

SEQ ID NO: 256494 - DNA, 20 bp, Artificial Sequence
  chemically synthesized
cacagtaaaaacctgcctca

SEQ ID NO: 256495 - DNA, 20 bp, Artificial Sequence
  chemically synthesized
caggtttttactgtgtgcga

SEQ ID NO: 256496 - DNA, 20 bp, Artificial Sequence
  chemically synthesized
gattaagaccccatcgcaca

SEQ ID NO: 256497 - DNA, 20 bp, Artificial Sequence
  chemically synthesized
aggtttttactgtgtgcgat

SEQ ID NO: 256498 - DNA, 20 bp, Artificial Sequence
  chemically synthesized
ggtttttactgtgtgcgatg

SEQ ID NO: 256499 - DNA, 20 bp, Artificial Sequence
  chemically synthesized
gtgcgatggggtcttaatcc

SEQ ID NO: 256500 - DNA, 20 bp, Artificial Sequence
  chemically synthesized
caaaattctgttccaggatt

SEQ ID NO: 256501 - DNA, 20 bp, Artificial Sequence
  chemically synthesized
atggggtcttaatcctggaa

SEQ ID NO: 256502 - DNA, 20 bp, Artificial Sequence
  chemically synthesized
ctgacccaaaattctgttcc

SEQ ID NO: 256503 - DNA, 20 bp, Artificial Sequence
  chemically synthesized
tctgacccaaaattctgttc

SEQ ID NO: 256504 - DNA, 20 bp, Artificial Sequence
  chemically synthesized
ttaatcctggaacagaattt

SEQ ID NO: 256505 - DNA, 20 bp, Artificial Sequence
  chemically synthesized
taatcctggaacagaatttt

SEQ ID NO: 256506 - DNA, 20 bp, Artificial Sequence
  chemically synthesized
cctggaacagaattttgggt

SEQ ID NO: 256507 - DNA, 20 bp, Artificial Sequence
  chemically synthesized
tggaacagaattttgggtca

SEQ ID NO: 256508 - DNA, 20 bp, Artificial Sequence
  chemically synthesized
tcagagcataaatcatgctt

SEQ ID NO: 256509 - DNA, 20 bp, Artificial Sequence
  chemically synthesized
agagcataaatcatgcttca

SEQ ID NO: 256510 - DNA, 20 bp, Artificial Sequence
  chemically synthesized
cttcagttagggtaactctg

SEQ ID NO: 256511 - DNA, 20 bp, Artificial Sequence
  chemically synthesized
cttcagagttaccctaactg

SEQ ID NO: 256512 - DNA, 20 bp, Artificial Sequence
  chemically synthesized
actcactcattcttcagtta

SEQ ID NO: 256513 - DNA, 20 bp, Artificial Sequence
  chemically synthesized
tactcactcattcttcagtt

SEQ ID NO: 256514 - DNA, 20 bp, Artificial Sequence
  chemically synthesized
ctactcactcattcttcagt

SEQ ID NO: 256515 - DNA, 20 bp, Artificial Sequence
  chemically synthesized
agttaccctaactgaagaat

SEQ ID NO: 256516 - DNA, 20 bp, Artificial Sequence
  chemically synthesized
accactactcactcattctt

SEQ ID NO: 256517 - DNA, 20 bp, Artificial Sequence
  chemically synthesized
accctaactgaagaatgagt

SEQ ID NO: 256518 - DNA, 20 bp, Artificial Sequence
  chemically synthesized
ctaactgaagaatgagtgag

SEQ ID NO: 256519 - DNA, 20 bp, Artificial Sequence
  chemically synthesized
actgaagaatgagtgagtag

SEQ ID NO: 256520 - DNA, 20 bp, Artificial Sequence
  chemically synthesized
tagtggtatttatccaccaa

SEQ ID NO: 256521 - DNA, 20 bp, Artificial Sequence
  chemically synthesized
caataacaaataacttttgg

SEQ ID NO: 256522 - DNA, 20 bp, Artificial Sequence
  chemically synthesized
aaccaataacaaataacttt

SEQ ID NO: 256523 - DNA, 20 bp, Artificial Sequence
  chemically synthesized
caccaaaagttatttgttat

SEQ ID NO: 256524 - DNA, 20 bp, Artificial Sequence
  chemically synthesized
aaagttatttgttattggtt

SEQ ID NO: 256525 - DNA, 20 bp, Artificial Sequence
  chemically synthesized
aagttatttgttattggttg

SEQ ID NO: 256526 - DNA, 20 bp, Artificial Sequence
  chemically synthesized
tgttattggttgaggtttgc

SEQ ID NO: 256527 - DNA, 20 bp, Artificial Sequence
  chemically synthesized
gttattggttgaggtttgct

SEQ ID NO: 256528 - DNA, 20 bp, Artificial Sequence
  chemically synthesized
ttattggttgaggtttgctg

SEQ ID NO: 256529 - DNA, 20 bp, Artificial Sequence
  chemically synthesized
ttgaggtttgctggggaaca

SEQ ID NO: 256530 - DNA, 20 bp, Artificial Sequence
  chemically synthesized
tctgcatcccccgtgttccc

SEQ ID NO: 256531 - DNA, 20 bp, Artificial Sequence
  chemically synthesized
tgaggtttgctggggaacac

SEQ ID NO: 256532 - DNA, 20 bp, Artificial Sequence
  chemically synthesized
gaggtttgctggggaacacg

SEQ ID NO: 256533 - DNA, 20 bp, Artificial Sequence
  chemically synthesized
aggtttgctggggaacacgg

SEQ ID NO: 256534 - DNA, 20 bp, Artificial Sequence
  chemically synthesized
gctggggaacacgggggatg

SEQ ID NO: 256535 - DNA, 20 bp, Artificial Sequence
  chemically synthesized
tcatgagtgtcaggtagtta

SEQ ID NO: 256536 - DNA, 20 bp, Artificial Sequence
  chemically synthesized
caaagctcatgagtgtcagg

SEQ ID NO: 256537 - DNA, 20 bp, Artificial Sequence
  chemically synthesized
aatcaaagctcatgagtgtc

SEQ ID NO: 256538 - DNA, 20 bp, Artificial Sequence
  chemically synthesized
taatcaaagctcatgagtgt

SEQ ID NO: 256539 - DNA, 20 bp, Artificial Sequence
  chemically synthesized
tttaactacctgacactcat

SEQ ID NO: 256540 - DNA, 20 bp, Artificial Sequence
  chemically synthesized
ctctagtaatcaaagctcat

SEQ ID NO: 256541 - DNA, 20 bp, Artificial Sequence
  chemically synthesized
cactcatgagctttgattac

SEQ ID NO: 256542 - DNA, 20 bp, Artificial Sequence
  chemically synthesized
agggctctctctagtaatca

SEQ ID NO: 256543 - DNA, 20 bp, Artificial Sequence
  chemically synthesized
ctcatgagctttgattacta

SEQ ID NO: 256544 - DNA, 20 bp, Artificial Sequence
  chemically synthesized
catgagctttgattactaga

SEQ ID NO: 256545 - DNA, 20 bp, Artificial Sequence
  chemically synthesized
tgagctttgattactagaga

SEQ ID NO: 256546 - DNA, 20 bp, Artificial Sequence
  chemically synthesized
gtttgccttagggctctctc

SEQ ID NO: 256547 - DNA, 20 bp, Artificial Sequence
  chemically synthesized
tgattactagagagagccct

SEQ ID NO: 256548 - DNA, 20 bp, Artificial Sequence
  chemically synthesized
gattactagagagagcccta

SEQ ID NO: 256549 - DNA, 20 bp, Artificial Sequence
  chemically synthesized
gtctctgactgtttgcctta

SEQ ID NO: 256550 - DNA, 20 bp, Artificial Sequence
  chemically synthesized
tgtctctgactgtttgcctt

SEQ ID NO: 256551 - DNA, 20 bp, Artificial Sequence
  chemically synthesized
agagagagccctaaggcaaa

SEQ ID NO: 256552 - DNA, 20 bp, Artificial Sequence
  chemically synthesized
gtgtctctgactgtttgcct

SEQ ID NO: 256553 - DNA, 20 bp, Artificial Sequence
  chemically synthesized
agagccctaaggcaaacagt

SEQ ID NO: 256554 - DNA, 20 bp, Artificial Sequence
  chemically synthesized
agccctaaggcaaacagtca

SEQ ID NO: 256555 - DNA, 20 bp, Artificial Sequence
  chemically synthesized
ggcaaacagtcagagacact

SEQ ID NO: 256556 - DNA, 20 bp, Artificial Sequence
  chemically synthesized
cagtcagagacacttggatc

SEQ ID NO: 256557 - DNA, 20 bp, Artificial Sequence
  chemically synthesized
gactggtagctgccagatcc

SEQ ID NO: 256558 - DNA, 20 bp, Artificial Sequence
  chemically synthesized
tcagagacacttggatctgg

SEQ ID NO: 256559 - DNA, 20 bp, Artificial Sequence
  chemically synthesized
gtactctgactggtagctgc

SEQ ID NO: 256560 - DNA, 20 bp, Artificial Sequence
  chemically synthesized
cacttggatctggcagctac

SEQ ID NO: 256561 - DNA, 20 bp, Artificial Sequence
  chemically synthesized
tggatctggcagctaccagt

SEQ ID NO: 256562 - DNA, 20 bp, Artificial Sequence
  chemically synthesized
gatctggcagctaccagtca

SEQ ID NO: 256563 - DNA, 20 bp, Artificial Sequence
  chemically synthesized
atgccttgtactctgactgg

SEQ ID NO: 256564 - DNA, 20 bp, Artificial Sequence
  chemically synthesized
agcatgccttgtactctgac

SEQ ID NO: 256565 - DNA, 20 bp, Artificial Sequence
  chemically synthesized
gcagctaccagtcagagtac

SEQ ID NO: 256566 - DNA, 20 bp, Artificial Sequence
  chemically synthesized
cagctaccagtcagagtaca

SEQ ID NO: 256567 - DNA, 20 bp, Artificial Sequence
  chemically synthesized
gtcagagtacaaggcatgct

SEQ ID NO: 256568 - DNA, 20 bp, Artificial Sequence
  chemically synthesized
gagtacaaggcatgctgagt

SEQ ID NO: 256569 - DNA, 20 bp, Artificial Sequence
  chemically synthesized
agtacaaggcatgctgagtc

SEQ ID NO: 256570 - DNA, 20 bp, Artificial Sequence
  chemically synthesized
acccatatcatttcctgact

SEQ ID NO: 256571 - DNA, 20 bp, Artificial Sequence
  chemically synthesized
tgctgagtcaggaaatgata

SEQ ID NO: 256572 - DNA, 20 bp, Artificial Sequence
  chemically synthesized
gctgagtcaggaaatgatat

SEQ ID NO: 256573 - DNA, 20 bp, Artificial Sequence
  chemically synthesized
aatgatatgggtgacatccc

SEQ ID NO: 256574 - DNA, 20 bp, Artificial Sequence
  chemically synthesized
tgatatgggtgacatcccaa

SEQ ID NO: 256575 - DNA, 20 bp, Artificial Sequence
  chemically synthesized
ttggaggatgaaacactctt

SEQ ID NO: 256576 - DNA, 20 bp, Artificial Sequence
  chemically synthesized
attggaggatgaaacactct

SEQ ID NO: 256577 - DNA, 20 bp, Artificial Sequence
  chemically synthesized
gaaagcatcagttttattgg

SEQ ID NO: 256578 - DNA, 20 bp, Artificial Sequence
  chemically synthesized
tgaaagcatcagttttattg

SEQ ID NO: 256579 - DNA, 20 bp, Artificial Sequence
  chemically synthesized
actgaaagcatcagttttat

SEQ ID NO: 256580 - DNA, 20 bp, Artificial Sequence
  chemically synthesized
tccaataaaactgatgcttt

SEQ ID NO: 256581 - DNA, 20 bp, Artificial Sequence
  chemically synthesized
cctaattttactgaaagcat

SEQ ID NO: 256582 - DNA, 20 bp, Artificial Sequence
  chemically synthesized
catatgcctaattttactga

SEQ ID NO: 256583 - DNA, 20 bp, Artificial Sequence
  chemically synthesized
actgatgctttcagtaaaat

SEQ ID NO: 256584 - DNA, 20 bp, Artificial Sequence
  chemically synthesized
ctgatgctttcagtaaaatt

SEQ ID NO: 256585 - DNA, 20 bp, Artificial Sequence
  chemically synthesized
tttcagtaaaattaggcata

SEQ ID NO: 256586 - DNA, 20 bp, Artificial Sequence
  chemically synthesized
cacatgatgataaatccttt

SEQ ID NO: 256587 - DNA, 20 bp, Artificial Sequence
  chemically synthesized
gatgataaatcctttcagtt

SEQ ID NO: 256588 - DNA, 20 bp, Artificial Sequence
  chemically synthesized
acttaaaagacttaactgaa

SEQ ID NO: 256589 - DNA, 20 bp, Artificial Sequence
  chemically synthesized
cacttaaaagacttaactga

SEQ ID NO: 256590 - DNA, 20 bp, Artificial Sequence
  chemically synthesized
tcctttcagttaagtctttt

SEQ ID NO: 256591 - DNA, 20 bp, Artificial Sequence
  chemically synthesized
tttcagttaagtcttttaag

SEQ ID NO: 256592 - DNA, 20 bp, Artificial Sequence
  chemically synthesized
agcagaaatgatccacttaa

SEQ ID NO: 256593 - DNA, 20 bp, Artificial Sequence
  chemically synthesized
aagtggatcatttctgcttt

SEQ ID NO: 256594 - DNA, 20 bp, Artificial Sequence
  chemically synthesized
agtggatcatttctgctttt

SEQ ID NO: 256595 - DNA, 20 bp, Artificial Sequence
  chemically synthesized
ttgaaagcttatcctaaaag

SEQ ID NO: 256596 - DNA, 20 bp, Artificial Sequence
  chemically synthesized
atcatttctgcttttaggat

SEQ ID NO: 256597 - DNA, 20 bp, Artificial Sequence
  chemically synthesized
tatttgaaagcttatcctaa

SEQ ID NO: 256598 - DNA, 20 bp, Artificial Sequence
  chemically synthesized
ggagagagttaaatatttga

SEQ ID NO: 256599 - DNA, 20 bp, Artificial Sequence
  chemically synthesized
ttcaaatatttaactctctc

SEQ ID NO: 256600 - DNA, 20 bp, Artificial Sequence
  chemically synthesized
caaatatttaactctctcca

SEQ ID NO: 256601 - DNA, 20 bp, Artificial Sequence
  chemically synthesized
caaaaggttttctctggaga

SEQ ID NO: 256602 - DNA, 20 bp, Artificial Sequence
  chemically synthesized
accaaaaggttttctctgga

SEQ ID NO: 256603 - DNA, 20 bp, Artificial Sequence
  chemically synthesized
ttaccaaaaggttttctctg

SEQ ID NO: 256604 - DNA, 20 bp, Artificial Sequence
  chemically synthesized
aattaccaaaaggttttctc

SEQ ID NO: 256605 - DNA, 20 bp, Artificial Sequence
  chemically synthesized
tctctccagagaaaaccttt

SEQ ID NO: 256606 - DNA, 20 bp, Artificial Sequence
  chemically synthesized
gtaagttttaaattaccaaa

SEQ ID NO: 256607 - DNA, 20 bp, Artificial Sequence
  chemically synthesized
cgtaagttttaaattaccaa

SEQ ID NO: 256608 - DNA, 20 bp, Artificial Sequence
  chemically synthesized
acagaatttcttagcatcgt

SEQ ID NO: 256609 - DNA, 20 bp, Artificial Sequence
  chemically synthesized
aatttaaaacttacgatgct

SEQ ID NO: 256610 - DNA, 20 bp, Artificial Sequence
  chemically synthesized
agcatgaacacagaatttct

SEQ ID NO: 256611 - DNA, 20 bp, Artificial Sequence
  chemically synthesized
ctcatatgaaagcatgaaca

SEQ ID NO: 256612 - DNA, 20 bp, Artificial Sequence
  chemically synthesized
ctgtgttcatgctttcatat

SEQ ID NO: 256613 - DNA, 20 bp, Artificial Sequence
  chemically synthesized
ccttaaagtatctcatatga

SEQ ID NO: 256614 - DNA, 20 bp, Artificial Sequence
  chemically synthesized
gctttcatatgagatacttt

SEQ ID NO: 256615 - DNA, 20 bp, Artificial Sequence
  chemically synthesized
ctttcatatgagatacttta

SEQ ID NO: 256616 - DNA, 20 bp, Artificial Sequence
  chemically synthesized
tcatatgagatactttaagg

SEQ ID NO: 256617 - DNA, 20 bp, Artificial Sequence
  chemically synthesized
catatgagatactttaaggc

SEQ ID NO: 256618 - DNA, 20 bp, Artificial Sequence
  chemically synthesized
aaccgtcaaatcctgcctta

SEQ ID NO: 256619 - DNA, 20 bp, Artificial Sequence
  chemically synthesized
tactttaaggcaggatttga

SEQ ID NO: 256620 - DNA, 20 bp, Artificial Sequence
  chemically synthesized
caggatttgacggtttaaca

SEQ ID NO: 256621 - DNA, 20 bp, Artificial Sequence
  chemically synthesized
ttaacacagtaattatattt

SEQ ID NO: 256622 - DNA, 20 bp, Artificial Sequence
  chemically synthesized
ttaacttgcatttcattttt

SEQ ID NO: 256623 - DNA, 20 bp, Artificial Sequence
  chemically synthesized
ttttcttaaaaatgaaatgc

SEQ ID NO: 256624 - DNA, 20 bp, Artificial Sequence
  chemically synthesized
tgcaattttttggaagttta

SEQ ID NO: 256625 - DNA, 20 bp, Artificial Sequence
  chemically synthesized
attgcaattttttggaagtt

SEQ ID NO: 256626 - DNA, 20 bp, Artificial Sequence
  chemically synthesized
gaagaattgcaattttttgg

SEQ ID NO: 256627 - DNA, 20 bp, Artificial Sequence
  chemically synthesized
ttagaagaattgcaattttt

SEQ ID NO: 256628 - DNA, 20 bp, Artificial Sequence
  chemically synthesized
acaagagtacataattttag

SEQ ID NO: 256629 - DNA, 20 bp, Artificial Sequence
  chemically synthesized
cagacaagagtacataattt

SEQ ID NO: 256630 - DNA, 20 bp, Artificial Sequence
  chemically synthesized
ataatactcataacagacaa

SEQ ID NO: 256631 - DNA, 20 bp, Artificial Sequence
  chemically synthesized
taataatactcataacagac

SEQ ID NO: 256632 - DNA, 20 bp, Artificial Sequence
  chemically synthesized
tatgtactcttgtctgttat

SEQ ID NO: 256633 - DNA, 20 bp, Artificial Sequence
  chemically synthesized
aaagttaataatactcataa

SEQ ID NO: 256634 - DNA, 20 bp, Artificial Sequence
  chemically synthesized
tgtgattgcttatatgtaca

SEQ ID NO: 256635 - DNA, 20 bp, Artificial Sequence
  chemically synthesized
attattaactttgtacatat

SEQ ID NO: 256636 - DNA, 20 bp, Artificial Sequence
  chemically synthesized
aatcaattaactgttaatat

SEQ ID NO: 256637 - DNA, 20 bp, Artificial Sequence
  chemically synthesized
tacttcagagccaatattaa

SEQ ID NO: 256638 - DNA, 20 bp, Artificial Sequence
  chemically synthesized
aactgttaatattggctctg

SEQ ID NO: 256639 - DNA, 20 bp, Artificial Sequence
  chemically synthesized
gttaatattggctctgaagt

SEQ ID NO: 256640 - DNA, 20 bp, Artificial Sequence
  chemically synthesized
atattttctttcttacttca

SEQ ID NO: 256641 - DNA, 20 bp, Artificial Sequence
  chemically synthesized
taatattttctttcttactt

SEQ ID NO: 256642 - DNA, 20 bp, Artificial Sequence
  chemically synthesized
atattggctctgaagtaaga

SEQ ID NO: 256643 - DNA, 20 bp, Artificial Sequence
  chemically synthesized
agaatgagaaacatacacat

SEQ ID NO: 256644 - DNA, 20 bp, Artificial Sequence
  chemically synthesized
aggcagagctagagaagaat

SEQ ID NO: 256645 - DNA, 20 bp, Artificial Sequence
  chemically synthesized
gtatgtttctcattcttctc

SEQ ID NO: 256646 - DNA, 20 bp, Artificial Sequence
  chemically synthesized
tagctaaggcagagctagag

SEQ ID NO: 256647 - DNA, 20 bp, Artificial Sequence
  chemically synthesized
cactagctaaggcagagcta

SEQ ID NO: 256648 - DNA, 20 bp, Artificial Sequence
  chemically synthesized
aacactagctaaggcagagc

SEQ ID NO: 256649 - DNA, 20 bp, Artificial Sequence
  chemically synthesized
attcttctctagctctgcct

SEQ ID NO: 256650 - DNA, 20 bp, Artificial Sequence
  chemically synthesized
caaaaacactagctaaggca

SEQ ID NO: 256651 - DNA, 20 bp, Artificial Sequence
  chemically synthesized
ttctctagctctgccttagc

SEQ ID NO: 256652 - DNA, 20 bp, Artificial Sequence
  chemically synthesized
agcaaaaacactagctaagg

SEQ ID NO: 256653 - DNA, 20 bp, Artificial Sequence
  chemically synthesized
aatagcaaaaacactagcta

SEQ ID NO: 256654 - DNA, 20 bp, Artificial Sequence
  chemically synthesized
taatagcaaaaacactagct

SEQ ID NO: 256655 - DNA, 20 bp, Artificial Sequence
  chemically synthesized
gcatttaatagcaaaaacac

SEQ ID NO: 256656 - DNA, 20 bp, Artificial Sequence
  chemically synthesized
agtgtttttgctattaaatg

SEQ ID NO: 256657 - DNA, 20 bp, Artificial Sequence
  chemically synthesized
atgtggaaatctgcatttaa

SEQ ID NO: 256658 - DNA, 20 bp, Artificial Sequence
  chemically synthesized
cgtatatatatatacatatg

SEQ ID NO: 256659 - DNA, 20 bp, Artificial Sequence
  chemically synthesized
tatgtttgtgtttatctgca

SEQ ID NO: 256660 - DNA, 20 bp, Artificial Sequence
  chemically synthesized
tcatgttgacagagactatg

SEQ ID NO: 256661 - DNA, 20 bp, Artificial Sequence
  chemically synthesized
gctacctaatcatgttgaca

SEQ ID NO: 256662 - DNA, 20 bp, Artificial Sequence
  chemically synthesized
aagctacctaatcatgttga

SEQ ID NO: 256663 - DNA, 20 bp, Artificial Sequence
  chemically synthesized
atagtctctgtcaacatgat

SEQ ID NO: 256664 - DNA, 20 bp, Artificial Sequence
  chemically synthesized
tagtctctgtcaacatgatt

SEQ ID NO: 256665 - DNA, 20 bp, Artificial Sequence
  chemically synthesized
tctctgtcaacatgattagg

SEQ ID NO: 256666 - DNA, 20 bp, Artificial Sequence
  chemically synthesized
aatagatgtattgaattgga

SEQ ID NO: 256667 - DNA, 20 bp, Artificial Sequence
  chemically synthesized
tttcaatagatgtattgaat

SEQ ID NO: 256668 - DNA, 20 bp, Artificial Sequence
  chemically synthesized
aatagcacgtatggtttcaa

SEQ ID NO: 256669 - DNA, 20 bp, Artificial Sequence
  chemically synthesized
tacaactaaaatagcacgta

SEQ ID NO: 256670 - DNA, 20 bp, Artificial Sequence
  chemically synthesized
tgaaaccatacgtgctattt

SEQ ID NO: 256671 - DNA, 20 bp, Artificial Sequence
  chemically synthesized
taaacaaaatacaactaaaa

SEQ ID NO: 256672 - DNA, 20 bp, Artificial Sequence
  chemically synthesized
tattttagttgtattttgtt

SEQ ID NO: 256673 - DNA, 20 bp, Artificial Sequence
  chemically synthesized
ttagttgtattttgtttaga

SEQ ID NO: 256674 - DNA, 20 bp, Artificial Sequence
  chemically synthesized
aataatatgtaatatgttaa

SEQ ID NO: 256675 - DNA, 20 bp, Artificial Sequence
  chemically synthesized
atacatcttttttgaaagtg

SEQ ID NO: 256676 - DNA, 20 bp, Artificial Sequence
  chemically synthesized
gttgtactgcactttcaaaa

SEQ ID NO: 256677 - DNA, 20 bp, Artificial Sequence
  chemically synthesized
ttaacatacatcttttttga

SEQ ID NO: 256678 - DNA, 20 bp, Artificial Sequence
  chemically synthesized
ttcaaaaaagatgtatgtta

SEQ ID NO: 256679 - DNA, 20 bp, Artificial Sequence
  chemically synthesized
aaaagatgtatgttaaagca

SEQ ID NO: 256680 - DNA, 20 bp, Artificial Sequence
  chemically synthesized
aagcacagcaatacttacta

SEQ ID NO: 256681 - DNA, 20 bp, Artificial Sequence
  chemically synthesized
tcaaattacagaactatagt

SEQ ID NO: 256682 - DNA, 20 bp, Artificial Sequence
  chemically synthesized
tgaatcaaattacagaacta

SEQ ID NO: 256683 - DNA, 20 bp, Artificial Sequence
  chemically synthesized
gatatgcatgaatcaaatta

SEQ ID NO: 256684 - DNA, 20 bp, Artificial Sequence
  chemically synthesized
tttgattcatgcatatctgt

SEQ ID NO: 256685 - DNA, 20 bp, Artificial Sequence
  chemically synthesized
ttgattcatgcatatctgtc

SEQ ID NO: 256686 - DNA, 20 bp, Artificial Sequence
  chemically synthesized
gtggttgattttattcctga

SEQ ID NO: 256687 - DNA, 20 bp, Artificial Sequence
  chemically synthesized
gttgggaaggtttgaaattg

SEQ ID NO: 256688 - DNA, 20 bp, Artificial Sequence
  chemically synthesized
caatttcaaaccttcccaac

SEQ ID NO: 256689 - DNA, 20 bp, Artificial Sequence
  chemically synthesized
tgtacagctgctggttggga

SEQ ID NO: 256690 - DNA, 20 bp, Artificial Sequence
  chemically synthesized
ttgtacagctgctggttggg

SEQ ID NO: 256691 - DNA, 20 bp, Artificial Sequence
  chemically synthesized
tttcaaaccttcccaaccag

SEQ ID NO: 256692 - DNA, 20 bp, Artificial Sequence
  chemically synthesized
aaattgtacagctgctggtt

SEQ ID NO: 256693 - DNA, 20 bp, Artificial Sequence
  chemically synthesized
taaattgtacagctgctggt

SEQ ID NO: 256694 - DNA, 20 bp, Artificial Sequence
  chemically synthesized
tgcataaattgtacagctgc

SEQ ID NO: 256695 - DNA, 20 bp, Artificial Sequence
  chemically synthesized
aaagcagtgcataaattgta

SEQ ID NO: 256696 - DNA, 20 bp, Artificial Sequence
  chemically synthesized
cagtagtaaaaatggaaaag

SEQ ID NO: 256697 - DNA, 20 bp, Artificial Sequence
  chemically synthesized
atccagtagtaaaaatggaa

SEQ ID NO: 256698 - DNA, 20 bp, Artificial Sequence
  chemically synthesized
tcattatccagtagtaaaaa

SEQ ID NO: 256699 - DNA, 20 bp, Artificial Sequence
  chemically synthesized
tgcttttccatttttactac

SEQ ID NO: 256700 - DNA, 20 bp, Artificial Sequence
  chemically synthesized
tcatcattgtcattatccag

SEQ ID NO: 256701 - DNA, 20 bp, Artificial Sequence
  chemically synthesized
cattcatcattgtcattatc

SEQ ID NO: 256702 - DNA, 20 bp, Artificial Sequence
  chemically synthesized
acaatgatgaatgcctttaa

SEQ ID NO: 256703 - DNA, 20 bp, Artificial Sequence
  chemically synthesized
caatgatgaatgcctttaac

SEQ ID NO: 256704 - DNA, 20 bp, Artificial Sequence
  chemically synthesized
gaatatgtatttcctgttaa

SEQ ID NO: 256705 - DNA, 20 bp, Artificial Sequence
  chemically synthesized
tgaatatgtatttcctgtta

SEQ ID NO: 256706 - DNA, 20 bp, Artificial Sequence
  chemically synthesized
ggaaatacatattcactgaa

SEQ ID NO: 256707 - DNA, 20 bp, Artificial Sequence
  chemically synthesized
agttttgagctcagtctttt

SEQ ID NO: 256708 - DNA, 20 bp, Artificial Sequence
  chemically synthesized
acatattcactgaaaagact

SEQ ID NO: 256709 - DNA, 20 bp, Artificial Sequence
  chemically synthesized
aagggggatagttttgagct

SEQ ID NO: 256710 - DNA, 20 bp, Artificial Sequence
  chemically synthesized
ttttgaagggggatagtttt

SEQ ID NO: 256711 - DNA, 20 bp, Artificial Sequence
  chemically synthesized
ttgacttttttgaaggggga

SEQ ID NO: 256712 - DNA, 20 bp, Artificial Sequence
  chemically synthesized
ttcattgacttttttgaagg

SEQ ID NO: 256713 - DNA, 20 bp, Artificial Sequence
  chemically synthesized
cttcattgacttttttgaag

SEQ ID NO: 256714 - DNA, 20 bp, Artificial Sequence
  chemically synthesized
aaaactatcccccttcaaaa

SEQ ID NO: 256715 - DNA, 20 bp, Artificial Sequence
  chemically synthesized
ccttcattgacttttttgaa

SEQ ID NO: 256716 - DNA, 20 bp, Artificial Sequence
  chemically synthesized
accttcattgacttttttga

SEQ ID NO: 256717 - DNA, 20 bp, Artificial Sequence
  chemically synthesized
taccttcattgacttttttg

SEQ ID NO: 256718 - DNA, 20 bp, Artificial Sequence
  chemically synthesized
ccccttcaaaaaagtcaatg

SEQ ID NO: 256719 - DNA, 20 bp, Artificial Sequence
  chemically synthesized
cccttcaaaaaagtcaatga

SEQ ID NO: 256720 - DNA, 20 bp, Artificial Sequence
  chemically synthesized
ttcaaaaaagtcaatgaagg

SEQ ID NO: 256721 - DNA, 20 bp, Artificial Sequence
  chemically synthesized
tcaaaaaagtcaatgaaggt

SEQ ID NO: 256722 - DNA, 20 bp, Artificial Sequence
  chemically synthesized
aaaaagtcaatgaaggtagg

SEQ ID NO: 256723 - DNA, 20 bp, Artificial Sequence
  chemically synthesized
caaatctccagcaggtgaat

SEQ ID NO: 256724 - DNA, 20 bp, Artificial Sequence
  chemically synthesized
acaaatctccagcaggtgaa

SEQ ID NO: 256725 - DNA, 20 bp, Artificial Sequence
  chemically synthesized
taggaagcccattcacctgc

SEQ ID NO: 256726 - DNA, 20 bp, Artificial Sequence
  chemically synthesized
ggaagcccattcacctgctg

SEQ ID NO: 256727 - DNA, 20 bp, Artificial Sequence
  chemically synthesized
tctcccaacaaatctccagc

SEQ ID NO: 256728 - DNA, 20 bp, Artificial Sequence
  chemically synthesized
gtctcccaacaaatctccag

SEQ ID NO: 256729 - DNA, 20 bp, Artificial Sequence
  chemically synthesized
tctgtctcccaacaaatctc

SEQ ID NO: 256730 - DNA, 20 bp, Artificial Sequence
  chemically synthesized
ttcacctgctggagatttgt

SEQ ID NO: 256731 - DNA, 20 bp, Artificial Sequence
  chemically synthesized
tcacctgctggagatttgtt

SEQ ID NO: 256732 - DNA, 20 bp, Artificial Sequence
  chemically synthesized
acctgctggagatttgttgg

SEQ ID NO: 256733 - DNA, 20 bp, Artificial Sequence
  chemically synthesized
gctggagatttgttgggaga

SEQ ID NO: 256734 - DNA, 20 bp, Artificial Sequence
  chemically synthesized
ggagatttgttgggagacag

SEQ ID NO: 256735 - DNA, 20 bp, Artificial Sequence
  chemically synthesized
gagatttgttgggagacaga

SEQ ID NO: 256736 - DNA, 20 bp, Artificial Sequence
  chemically synthesized
tccccataagatacagttgt

SEQ ID NO: 256737 - DNA, 20 bp, Artificial Sequence
  chemically synthesized
atccccataagatacagttg

SEQ ID NO: 256738 - DNA, 20 bp, Artificial Sequence
  chemically synthesized
atgcccacaactgtatctta

SEQ ID NO: 256739 - DNA, 20 bp, Artificial Sequence
  chemically synthesized
ggttgaatccccataagata

SEQ ID NO: 256740 - DNA, 20 bp, Artificial Sequence
  chemically synthesized
tgcccacaactgtatcttat

SEQ ID NO: 256741 - DNA, 20 bp, Artificial Sequence
  chemically synthesized
gcccacaactgtatcttatg

SEQ ID NO: 256742 - DNA, 20 bp, Artificial Sequence
  chemically synthesized
ctaaatggttgaatccccat

SEQ ID NO: 256743 - DNA, 20 bp, Artificial Sequence
  chemically synthesized
cttatggggattcaaccatt

SEQ ID NO: 256744 - DNA, 20 bp, Artificial Sequence
  chemically synthesized
gtagatttaatttagctaaa

SEQ ID NO: 256745 - DNA, 20 bp, Artificial Sequence
  chemically synthesized
gtattattgtagatttaatt

SEQ ID NO: 256746 - DNA, 20 bp, Artificial Sequence
  chemically synthesized
tttataatatggtattattg

SEQ ID NO: 256747 - DNA, 20 bp, Artificial Sequence
  chemically synthesized
gattactgcggtttataata

SEQ ID NO: 256748 - DNA, 20 bp, Artificial Sequence
  chemically synthesized
taataccatattataaaccg

SEQ ID NO: 256749 - DNA, 20 bp, Artificial Sequence
  chemically synthesized
cgtaatagtattgattactg

SEQ ID NO: 256750 - DNA, 20 bp, Artificial Sequence
  chemically synthesized
atagctgatgtcaatcgtaa

SEQ ID NO: 256751 - DNA, 20 bp, Artificial Sequence
  chemically synthesized
aatactattacgattgacat

SEQ ID NO: 256752 - DNA, 20 bp, Artificial Sequence
  chemically synthesized
tgatctatttaatattatta

SEQ ID NO: 256753 - DNA, 20 bp, Artificial Sequence
  chemically synthesized
tcagctataataatattaaa

SEQ ID NO: 256754 - DNA, 20 bp, Artificial Sequence
  chemically synthesized
tataataatattaaatagat

SEQ ID NO: 256755 - DNA, 20 bp, Artificial Sequence
  chemically synthesized
ataataatattaaatagatc

SEQ ID NO: 256756 - DNA, 20 bp, Artificial Sequence
  chemically synthesized
atgaacaaatgattcactgt

SEQ ID NO: 256757 - DNA, 20 bp, Artificial Sequence
  chemically synthesized
caaatgattcactgtgagtg

SEQ ID NO: 256758 - DNA, 20 bp, Artificial Sequence
  chemically synthesized
tagacccttggctacactca

SEQ ID NO: 256759 - DNA, 20 bp, Artificial Sequence
  chemically synthesized
gattcactgtgagtgtagcc

SEQ ID NO: 256760 - DNA, 20 bp, Artificial Sequence
  chemically synthesized
attcactgtgagtgtagcca

SEQ ID NO: 256761 - DNA, 20 bp, Artificial Sequence
  chemically synthesized
ttcactgtgagtgtagccaa

SEQ ID NO: 256762 - DNA, 20 bp, Artificial Sequence
  chemically synthesized
tactcagaatgttagaccct

SEQ ID NO: 256763 - DNA, 20 bp, Artificial Sequence
  chemically synthesized
agccaagggtctaacattct

SEQ ID NO: 256764 - DNA, 20 bp, Artificial Sequence
  chemically synthesized
gcctggcatactcagaatgt

SEQ ID NO: 256765 - DNA, 20 bp, Artificial Sequence
  chemically synthesized
gtctaacattctgagtatgc

SEQ ID NO: 256766 - DNA, 20 bp, Artificial Sequence
  chemically synthesized
acctcttagcctggcatact

SEQ ID NO: 256767 - DNA, 20 bp, Artificial Sequence
  chemically synthesized
tctaacattctgagtatgcc

SEQ ID NO: 256768 - DNA, 20 bp, Artificial Sequence
  chemically synthesized
cattctgagtatgccaggct

SEQ ID NO: 256769 - DNA, 20 bp, Artificial Sequence
  chemically synthesized
ttctgagtatgccaggctaa

SEQ ID NO: 256770 - DNA, 20 bp, Artificial Sequence
  chemically synthesized
tctgagtatgccaggctaag

SEQ ID NO: 256771 - DNA, 20 bp, Artificial Sequence
  chemically synthesized
tgtctccatacctcttagcc

SEQ ID NO: 256772 - DNA, 20 bp, Artificial Sequence
  chemically synthesized
gtatgccaggctaagaggta

SEQ ID NO: 256773 - DNA, 20 bp, Artificial Sequence
  chemically synthesized
aactctgtctccatacctct

SEQ ID NO: 256774 - DNA, 20 bp, Artificial Sequence
  chemically synthesized
atgccaggctaagaggtatg

SEQ ID NO: 256775 - DNA, 20 bp, Artificial Sequence
  chemically synthesized
caggctaagaggtatggaga

SEQ ID NO: 256776 - DNA, 20 bp, Artificial Sequence
  chemically synthesized
ggctaagaggtatggagaca

SEQ ID NO: 256777 - DNA, 20 bp, Artificial Sequence
  chemically synthesized
atggagacagagttattcaa

SEQ ID NO: 256778 - DNA, 20 bp, Artificial Sequence
  chemically synthesized
tggagacagagttattcaat

SEQ ID NO: 256779 - DNA, 20 bp, Artificial Sequence
  chemically synthesized
tattcaatgggcaacttaat

SEQ ID NO: 256780 - DNA, 20 bp, Artificial Sequence
  chemically synthesized
gtagtgaccctgatcttatt

SEQ ID NO: 256781 - DNA, 20 bp, Artificial Sequence
  chemically synthesized
aatgggcaacttaataagat

SEQ ID NO: 256782 - DNA, 20 bp, Artificial Sequence
  chemically synthesized
atgggcaacttaataagatc

SEQ ID NO: 256783 - DNA, 20 bp, Artificial Sequence
  chemically synthesized
tgggcaacttaataagatca

SEQ ID NO: 256784 - DNA, 20 bp, Artificial Sequence
  chemically synthesized
ggacatttggttcaggagag

SEQ ID NO: 256785 - DNA, 20 bp, Artificial Sequence
  chemically synthesized
catggacatttggttcagga

SEQ ID NO: 256786 - DNA, 20 bp, Artificial Sequence
  chemically synthesized
ttcatggacatttggttcag

SEQ ID NO: 256787 - DNA, 20 bp, Artificial Sequence
  chemically synthesized
ggttcatggacatttggttc

SEQ ID NO: 256788 - DNA, 20 bp, Artificial Sequence
  chemically synthesized
aggttcatggacatttggtt

SEQ ID NO: 256789 - DNA, 20 bp, Artificial Sequence
  chemically synthesized
ttcccaggttcatggacatt

SEQ ID NO: 256790 - DNA, 20 bp, Artificial Sequence
  chemically synthesized
gaaccaaatgtccatgaacc

SEQ ID NO: 256791 - DNA, 20 bp, Artificial Sequence
  chemically synthesized
aaccaaatgtccatgaacct

SEQ ID NO: 256792 - DNA, 20 bp, Artificial Sequence
  chemically synthesized
tccattccttcccaggttca

SEQ ID NO: 256793 - DNA, 20 bp, Artificial Sequence
  chemically synthesized
caaatgtccatgaacctggg

SEQ ID NO: 256794 - DNA, 20 bp, Artificial Sequence
  chemically synthesized
aaatgtccatgaacctggga

SEQ ID NO: 256795 - DNA, 20 bp, Artificial Sequence
  chemically synthesized
gctaatatccattccttccc

SEQ ID NO: 256796 - DNA, 20 bp, Artificial Sequence
  chemically synthesized
agctaatatccattccttcc

SEQ ID NO: 256797 - DNA, 20 bp, Artificial Sequence
  chemically synthesized
tccatgaacctgggaaggaa

SEQ ID NO: 256798 - DNA, 20 bp, Artificial Sequence
  chemically synthesized
acctgggaaggaatggatat

SEQ ID NO: 256799 - DNA, 20 bp, Artificial Sequence
  chemically synthesized
aggaatggatattagctcat

SEQ ID NO: 256800 - DNA, 20 bp, Artificial Sequence
  chemically synthesized
ataagtaaattattgccaat

SEQ ID NO: 256801 - DNA, 20 bp, Artificial Sequence
  chemically synthesized
gtgcatcattgtcattcaat

SEQ ID NO: 256802 - DNA, 20 bp, Artificial Sequence
  chemically synthesized
ctcatggcagcatagtttgt

SEQ ID NO: 256803 - DNA, 20 bp, Artificial Sequence
  chemically synthesized
actaagttctcatggcagca

SEQ ID NO: 256804 - DNA, 20 bp, Artificial Sequence
  chemically synthesized
cttacaaactatgctgccat

SEQ ID NO: 256805 - DNA, 20 bp, Artificial Sequence
  chemically synthesized
tattaactaagttctcatgg

SEQ ID NO: 256806 - DNA, 20 bp, Artificial Sequence
  chemically synthesized
ttctattaactaagttctca

SEQ ID NO: 256807 - DNA, 20 bp, Artificial Sequence
  chemically synthesized
actatgctgccatgagaact

SEQ ID NO: 256808 - DNA, 20 bp, Artificial Sequence
  chemically synthesized
tgccatgagaacttagttaa

SEQ ID NO: 256809 - DNA, 20 bp, Artificial Sequence
  chemically synthesized
tgtcattatttctattaact

SEQ ID NO: 256810 - DNA, 20 bp, Artificial Sequence
  chemically synthesized
ttagttaatagaaataatga

SEQ ID NO: 256811 - DNA, 20 bp, Artificial Sequence
  chemically synthesized
tagttaatagaaataatgac

SEQ ID NO: 256812 - DNA, 20 bp, Artificial Sequence
  chemically synthesized
agaaataatgacaggaattc

SEQ ID NO: 256813 - DNA, 20 bp, Artificial Sequence
  chemically synthesized
tgacaggaattctggcatgt

SEQ ID NO: 256814 - DNA, 20 bp, Artificial Sequence
  chemically synthesized
ataaaataaagctgacatgc

SEQ ID NO: 256815 - DNA, 20 bp, Artificial Sequence
  chemically synthesized
cctaatcagttaataaaata

SEQ ID NO: 256816 - DNA, 20 bp, Artificial Sequence
  chemically synthesized
gctttattttattaactgat

SEQ ID NO: 256817 - DNA, 20 bp, Artificial Sequence
  chemically synthesized
ctttattttattaactgatt

SEQ ID NO: 256818 - DNA, 20 bp, Artificial Sequence
  chemically synthesized
atgaagaaaagaaacctaat

SEQ ID NO: 256819 - DNA, 20 bp, Artificial Sequence
  chemically synthesized
cttattggtacaatgaagaa

SEQ ID NO: 256820 - DNA, 20 bp, Artificial Sequence
  chemically synthesized
aatcacttattggtacaatg

SEQ ID NO: 256821 - DNA, 20 bp, Artificial Sequence
  chemically synthesized
cttttcttcattgtaccaat

SEQ ID NO: 256822 - DNA, 20 bp, Artificial Sequence
  chemically synthesized
gtaaaagtcaaatcacttat

SEQ ID NO: 256823 - DNA, 20 bp, Artificial Sequence
  chemically synthesized
tcttattctgtttgaagtaa

SEQ ID NO: 256824 - DNA, 20 bp, Artificial Sequence
  chemically synthesized
gatttgacttttacttcaaa

SEQ ID NO: 256825 - DNA, 20 bp, Artificial Sequence
  chemically synthesized
actgtttcttattctgtttg

SEQ ID NO: 256826 - DNA, 20 bp, Artificial Sequence
  chemically synthesized
acttttacttcaaacagaat

SEQ ID NO: 256827 - DNA, 20 bp, Artificial Sequence
  chemically synthesized
acttcaaacagaataagaaa

SEQ ID NO: 256828 - DNA, 20 bp, Artificial Sequence
  chemically synthesized
ctattccatccatgtcagtg

SEQ ID NO: 256829 - DNA, 20 bp, Artificial Sequence
  chemically synthesized
gaaacagtgccacactgaca

SEQ ID NO: 256830 - DNA, 20 bp, Artificial Sequence
  chemically synthesized
cagtgccacactgacatgga

SEQ ID NO: 256831 - DNA, 20 bp, Artificial Sequence
  chemically synthesized
tggaactattccatccatgt

SEQ ID NO: 256832 - DNA, 20 bp, Artificial Sequence
  chemically synthesized
ccacactgacatggatggaa

SEQ ID NO: 256833 - DNA, 20 bp, Artificial Sequence
  chemically synthesized
tgacatggatggaatagttc

SEQ ID NO: 256834 - DNA, 20 bp, Artificial Sequence
  chemically synthesized
acatggatggaatagttcca

SEQ ID NO: 256835 - DNA, 20 bp, Artificial Sequence
  chemically synthesized
ataagagcttcacagatctc

SEQ ID NO: 256836 - DNA, 20 bp, Artificial Sequence
  chemically synthesized
aatagttccagagatctgtg

SEQ ID NO: 256837 - DNA, 20 bp, Artificial Sequence
  chemically synthesized
acagtaaaataagagcttca

SEQ ID NO: 256838 - DNA, 20 bp, Artificial Sequence
  chemically synthesized
aaaattacacagtaaaataa

SEQ ID NO: 256839 - DNA, 20 bp, Artificial Sequence
  chemically synthesized
ataaaattacacagtaaaat

SEQ ID NO: 256840 - DNA, 20 bp, Artificial Sequence
  chemically synthesized
aaataagctataaaattaca

SEQ ID NO: 256841 - DNA, 20 bp, Artificial Sequence
  chemically synthesized
tattttactgtgtaatttta

SEQ ID NO: 256842 - DNA, 20 bp, Artificial Sequence
  chemically synthesized
atcttaacattatatcaaat

SEQ ID NO: 256843 - DNA, 20 bp, Artificial Sequence
  chemically synthesized
agcttatttgatataatgtt

SEQ ID NO: 256844 - DNA, 20 bp, Artificial Sequence
  chemically synthesized
gatataatgttaagatatta

SEQ ID NO: 256845 - DNA, 20 bp, Artificial Sequence
  chemically synthesized
aatgttaagatattaaagtc

SEQ ID NO: 256846 - DNA, 20 bp, Artificial Sequence
  chemically synthesized
atattaaagtcaagtcactg

SEQ ID NO: 256847 - DNA, 20 bp, Artificial Sequence
  chemically synthesized
aatcggtgttgcagtatctt

SEQ ID NO: 256848 - DNA, 20 bp, Artificial Sequence
  chemically synthesized
tgttttggaaatcggtgttg

SEQ ID NO: 256849 - DNA, 20 bp, Artificial Sequence
  chemically synthesized
tatttgtttgttttggaaat

SEQ ID NO: 256850 - DNA, 20 bp, Artificial Sequence
  chemically synthesized
ataaagctatttgtttgttt

SEQ ID NO: 256851 - DNA, 20 bp, Artificial Sequence
  chemically synthesized
cgatttccaaaacaaacaaa

SEQ ID NO: 256852 - DNA, 20 bp, Artificial Sequence
  chemically synthesized
tatgaatatacaaatggata

SEQ ID NO: 256853 - DNA, 20 bp, Artificial Sequence
  chemically synthesized
tgcctgtatgaatatacaaa

SEQ ID NO: 256854 - DNA, 20 bp, Artificial Sequence
  chemically synthesized
tatccatttgtatattcata

SEQ ID NO: 256855 - DNA, 20 bp, Artificial Sequence
  chemically synthesized
atccatttgtatattcatac

SEQ ID NO: 256856 - DNA, 20 bp, Artificial Sequence
  chemically synthesized
atacaggcaaatgtgtgata

SEQ ID NO: 256857 - DNA, 20 bp, Artificial Sequence
  chemically synthesized
gcaaatgtgtgatatagaat

SEQ ID NO: 256858 - DNA, 20 bp, Artificial Sequence
  chemically synthesized
tgtgatatagaatgagcttc

SEQ ID NO: 256859 - DNA, 20 bp, Artificial Sequence
  chemically synthesized
gtgatatagaatgagcttcc

SEQ ID NO: 256860 - DNA, 20 bp, Artificial Sequence
  chemically synthesized
atactcaaatggtttcctgg

SEQ ID NO: 256861 - DNA, 20 bp, Artificial Sequence
  chemically synthesized
tttatactcaaatggtttcc

SEQ ID NO: 256862 - DNA, 20 bp, Artificial Sequence
  chemically synthesized
gagcttccaggaaaccattt

SEQ ID NO: 256863 - DNA, 20 bp, Artificial Sequence
  chemically synthesized
taaagtattttatactcaaa

SEQ ID NO: 256864 - DNA, 20 bp, Artificial Sequence
  chemically synthesized
catttgagtataaaatactt

SEQ ID NO: 256865 - DNA, 20 bp, Artificial Sequence
  chemically synthesized
tcagcagcacatattagcta

SEQ ID NO: 256866 - DNA, 20 bp, Artificial Sequence
  chemically synthesized
ttgctatcagcagcacatat

SEQ ID NO: 256867 - DNA, 20 bp, Artificial Sequence
  chemically synthesized
tagctaatatgtgctgctga

SEQ ID NO: 256868 - DNA, 20 bp, Artificial Sequence
  chemically synthesized
aaagatgggtttgctatcag

SEQ ID NO: 256869 - DNA, 20 bp, Artificial Sequence
  chemically synthesized
gcaaaagatgggtttgctat

SEQ ID NO: 256870 - DNA, 20 bp, Artificial Sequence
  chemically synthesized
tgtgattataggcaaaagat

SEQ ID NO: 256871 - DNA, 20 bp, Artificial Sequence
  chemically synthesized
atgtgattataggcaaaaga

SEQ ID NO: 256872 - DNA, 20 bp, Artificial Sequence
  chemically synthesized
cagtatgtgattataggcaa

SEQ ID NO: 256873 - DNA, 20 bp, Artificial Sequence
  chemically synthesized
tgcaaacagtatgtgattat

SEQ ID NO: 256874 - DNA, 20 bp, Artificial Sequence
  chemically synthesized
atgcaaacagtatgtgatta

SEQ ID NO: 256875 - DNA, 20 bp, Artificial Sequence
  chemically synthesized
ttggtattttcaaatgcaaa

SEQ ID NO: 256876 - DNA, 20 bp, Artificial Sequence
  chemically synthesized
tgtttgcatttgaaaatacc

SEQ ID NO: 256877 - DNA, 20 bp, Artificial Sequence
  chemically synthesized
catttgaaaataccaagctc

SEQ ID NO: 256878 - DNA, 20 bp, Artificial Sequence
  chemically synthesized
atttgaaaataccaagctct

SEQ ID NO: 256879 - DNA, 20 bp, Artificial Sequence
  chemically synthesized
attatagtatacccagagct

SEQ ID NO: 256880 - DNA, 20 bp, Artificial Sequence
  chemically synthesized
gaaatattatagtataccca

SEQ ID NO: 256881 - DNA, 20 bp, Artificial Sequence
  chemically synthesized
atgaaatattatagtatacc

SEQ ID NO: 256882 - DNA, 20 bp, Artificial Sequence
  chemically synthesized
acactcaaaatgaaatatta

SEQ ID NO: 256883 - DNA, 20 bp, Artificial Sequence
  chemically synthesized
atactataatatttcatttt

SEQ ID NO: 256884 - DNA, 20 bp, Artificial Sequence
  chemically synthesized
gtacgatcatgaaaattatc

SEQ ID NO: 256885 - DNA, 20 bp, Artificial Sequence
  chemically synthesized
acgatcatgaaaattatctg

SEQ ID NO: 256886 - DNA, 20 bp, Artificial Sequence
  chemically synthesized
tgcacataataatgtgtctc

SEQ ID NO: 256887 - DNA, 20 bp, Artificial Sequence
  chemically synthesized
agataaatgaatgtaggatc

SEQ ID NO: 256888 - DNA, 20 bp, Artificial Sequence
  chemically synthesized
gtctgaagataaatgaatgt

SEQ ID NO: 256889 - DNA, 20 bp, Artificial Sequence
  chemically synthesized
tgtctgaagataaatgaatg

SEQ ID NO: 256890 - DNA, 20 bp, Artificial Sequence
  chemically synthesized
atcctacattcatttatctt

SEQ ID NO: 256891 - DNA, 20 bp, Artificial Sequence
  chemically synthesized
atttcagaaggcagtgtctg

SEQ ID NO: 256892 - DNA, 20 bp, Artificial Sequence
  chemically synthesized
aggctatgaatttcagaagg

SEQ ID NO: 256893 - DNA, 20 bp, Artificial Sequence
  chemically synthesized
aataggctatgaatttcaga

SEQ ID NO: 256894 - DNA, 20 bp, Artificial Sequence
  chemically synthesized
aaataggctatgaatttcag

SEQ ID NO: 256895 - DNA, 20 bp, Artificial Sequence
  chemically synthesized
acactgccttctgaaattca

SEQ ID NO: 256896 - DNA, 20 bp, Artificial Sequence
  chemically synthesized
atgaaataggctatgaattt

SEQ ID NO: 256897 - DNA, 20 bp, Artificial Sequence
  chemically synthesized
gcaaataatgatgatgaaat

SEQ ID NO: 256898 - DNA, 20 bp, Artificial Sequence
  chemically synthesized
ggcaaataatgatgatgaaa

SEQ ID NO: 256899 - DNA, 20 bp, Artificial Sequence
  chemically synthesized
catcattatttgccttactt

SEQ ID NO: 256900 - DNA, 20 bp, Artificial Sequence
  chemically synthesized
agttactaaattctcaagta

SEQ ID NO: 256901 - DNA, 20 bp, Artificial Sequence
  chemically synthesized
aagttactaaattctcaagt

SEQ ID NO: 256902 - DNA, 20 bp, Artificial Sequence
  chemically synthesized
atttgccttacttgagaatt

SEQ ID NO: 256903 - DNA, 20 bp, Artificial Sequence
  chemically synthesized
cagcaagttactaaattctc

SEQ ID NO: 256904 - DNA, 20 bp, Artificial Sequence
  chemically synthesized
agaatttagtaacttgctgt

SEQ ID NO: 256905 - DNA, 20 bp, Artificial Sequence
  chemically synthesized
gttttcaaaccaccaacagc

SEQ ID NO: 256906 - DNA, 20 bp, Artificial Sequence
  chemically synthesized
atttagtaacttgctgttgg

SEQ ID NO: 256907 - DNA, 20 bp, Artificial Sequence
  chemically synthesized
agctgttttcaaaccaccaa

SEQ ID NO: 256908 - DNA, 20 bp, Artificial Sequence
  chemically synthesized
tgctgttggtggtttgaaaa

SEQ ID NO: 256909 - DNA, 20 bp, Artificial Sequence
  chemically synthesized
gttggtggtttgaaaacagc

SEQ ID NO: 256910 - DNA, 20 bp, Artificial Sequence
  chemically synthesized
taaaggctaccaacaaaatc

SEQ ID NO: 256911 - DNA, 20 bp, Artificial Sequence
  chemically synthesized
tgaaaacagctggattttgt

SEQ ID NO: 256912 - DNA, 20 bp, Artificial Sequence
  chemically synthesized
aaacagctggattttgttgg

SEQ ID NO: 256913 - DNA, 20 bp, Artificial Sequence
  chemically synthesized
ttttgttggtagcctttaac

SEQ ID NO: 256914 - DNA, 20 bp, Artificial Sequence
  chemically synthesized
tctttataactgccagttaa

SEQ ID NO: 256915 - DNA, 20 bp, Artificial Sequence
  chemically synthesized
tgttggtagcctttaactgg

SEQ ID NO: 256916 - DNA, 20 bp, Artificial Sequence
  chemically synthesized
ttctttataactgccagtta

SEQ ID NO: 256917 - DNA, 20 bp, Artificial Sequence
  chemically synthesized
aatattttctttataactgc

SEQ ID NO: 256918 - DNA, 20 bp, Artificial Sequence
  chemically synthesized
gcctttaactggcagttata

SEQ ID NO: 256919 - DNA, 20 bp, Artificial Sequence
  chemically synthesized
acatatggaataaaattgaa

SEQ ID NO: 256920 - DNA, 20 bp, Artificial Sequence
  chemically synthesized
caattttattccatatgtta

SEQ ID NO: 256921 - DNA, 20 bp, Artificial Sequence
  chemically synthesized
aatacctgtgctataacata

SEQ ID NO: 256922 - DNA, 20 bp, Artificial Sequence
  chemically synthesized
ttattccatatgttatagca

SEQ ID NO: 256923 - DNA, 20 bp, Artificial Sequence
  chemically synthesized
tattccatatgttatagcac

SEQ ID NO: 256924 - DNA, 20 bp, Artificial Sequence
  chemically synthesized
cattttccaaaaagggaaat

SEQ ID NO: 256925 - DNA, 20 bp, Artificial Sequence
  chemically synthesized
aaaaatctaatttccctttt

SEQ ID NO: 256926 - DNA, 20 bp, Artificial Sequence
  chemically synthesized
tctgtttcattttccaaaaa

SEQ ID NO: 256927 - DNA, 20 bp, Artificial Sequence
  chemically synthesized
ttctgtttcattttccaaaa

SEQ ID NO: 256928 - DNA, 20 bp, Artificial Sequence
  chemically synthesized
cttctgtttcattttccaaa

SEQ ID NO: 256929 - DNA, 20 bp, Artificial Sequence
  chemically synthesized
tccctttttggaaaatgaaa

SEQ ID NO: 256930 - DNA, 20 bp, Artificial Sequence
  chemically synthesized
ctttttggaaaatgaaacag

SEQ ID NO: 256931 - DNA, 20 bp, Artificial Sequence
  chemically synthesized
aacagaagtcatccattaac

SEQ ID NO: 256932 - DNA, 20 bp, Artificial Sequence
  chemically synthesized
acagaagtcatccattaact

SEQ ID NO: 256933 - DNA, 20 bp, Artificial Sequence
  chemically synthesized
aacagtttattcctagttaa

SEQ ID NO: 256934 - DNA, 20 bp, Artificial Sequence
  chemically synthesized
atggaagaacagtttattcc

SEQ ID NO: 256935 - DNA, 20 bp, Artificial Sequence
  chemically synthesized
aataaactttgatggaagaa

SEQ ID NO: 256936 - DNA, 20 bp, Artificial Sequence
  chemically synthesized
aataaactgttcttccatca

SEQ ID NO: 256937 - DNA, 20 bp, Artificial Sequence
  chemically synthesized
cagtaaataaactttgatgg

SEQ ID NO: 256938 - DNA, 20 bp, Artificial Sequence
  chemically synthesized
caccagtaaataaactttga

SEQ ID NO: 256939 - DNA, 20 bp, Artificial Sequence
  chemically synthesized
ttccatcaaagtttatttac

SEQ ID NO: 256940 - DNA, 20 bp, Artificial Sequence
  chemically synthesized
catcaaagtttatttactgg

SEQ ID NO: 256941 - DNA, 20 bp, Artificial Sequence
  chemically synthesized
tagggacagaaaggaaccac

SEQ ID NO: 256942 - DNA, 20 bp, Artificial Sequence
  chemically synthesized
tacatgcagtagggacagaa

SEQ ID NO: 256943 - DNA, 20 bp, Artificial Sequence
  chemically synthesized
ttacatgcagtagggacaga

SEQ ID NO: 256944 - DNA, 20 bp, Artificial Sequence
  chemically synthesized
atttttacatgcagtaggga

SEQ ID NO: 256945 - DNA, 20 bp, Artificial Sequence
  chemically synthesized
gatcatttttacatgcagta

SEQ ID NO: 256946 - DNA, 20 bp, Artificial Sequence
  chemically synthesized
tgatcatttttacatgcagt

SEQ ID NO: 256947 - DNA, 20 bp, Artificial Sequence
  chemically synthesized
atgatcatttttacatgcag

SEQ ID NO: 256948 - DNA, 20 bp, Artificial Sequence
  chemically synthesized
aaaatgatcatttttacatg

SEQ ID NO: 256949 - DNA, 20 bp, Artificial Sequence
  chemically synthesized
ttttgtgcatttcttcattt

SEQ ID NO: 256950 - DNA, 20 bp, Artificial Sequence
  chemically synthesized
tttgtgcatttcttcatttt

SEQ ID NO: 256951 - DNA, 20 bp, Artificial Sequence
  chemically synthesized
ttgagagacatcctaaaatg

SEQ ID NO: 256952 - DNA, 20 bp, Artificial Sequence
  chemically synthesized
tcattttaggatgtctctca

SEQ ID NO: 256953 - DNA, 20 bp, Artificial Sequence
  chemically synthesized
tttacaatatttagctttga

SEQ ID NO: 256954 - DNA, 20 bp, Artificial Sequence
  chemically synthesized
attttacaatatttagcttt

SEQ ID NO: 256955 - DNA, 20 bp, Artificial Sequence
  chemically synthesized
aaaatgtattttacaatatt

SEQ ID NO: 256956 - DNA, 20 bp, Artificial Sequence
  chemically synthesized
tagggtagaaagacataagt

SEQ ID NO: 256957 - DNA, 20 bp, Artificial Sequence
  chemically synthesized
aatctagggtagaaagacat

SEQ ID NO: 256958 - DNA, 20 bp, Artificial Sequence
  chemically synthesized
taacttatgtctttctaccc

SEQ ID NO: 256959 - DNA, 20 bp, Artificial Sequence
  chemically synthesized
cttcagaaatctagggtaga

SEQ ID NO: 256960 - DNA, 20 bp, Artificial Sequence
  chemically synthesized
ttggcttcagaaatctaggg

SEQ ID NO: 256961 - DNA, 20 bp, Artificial Sequence
  chemically synthesized
tggttggcttcagaaatcta

SEQ ID NO: 256962 - DNA, 20 bp, Artificial Sequence
  chemically synthesized
gtggttggcttcagaaatct

SEQ ID NO: 256963 - DNA, 20 bp, Artificial Sequence
  chemically synthesized
tgtggttggcttcagaaatc

SEQ ID NO: 256964 - DNA, 20 bp, Artificial Sequence
  chemically synthesized
ctttctaccctagatttctg

SEQ ID NO: 256965 - DNA, 20 bp, Artificial Sequence
  chemically synthesized
cttgatagtgtggttggctt

SEQ ID NO: 256966 - DNA, 20 bp, Artificial Sequence
  chemically synthesized
aaaatacttgatagtgtggt

SEQ ID NO: 256967 - DNA, 20 bp, Artificial Sequence
  chemically synthesized
ctgaagccaaccacactatc

SEQ ID NO: 256968 - DNA, 20 bp, Artificial Sequence
  chemically synthesized
cttaaaaatacttgatagtg

SEQ ID NO: 256969 - DNA, 20 bp, Artificial Sequence
  chemically synthesized
gaattcttaaaaatacttga

SEQ ID NO: 256970 - DNA, 20 bp, Artificial Sequence
  chemically synthesized
ccacactatcaagtattttt

SEQ ID NO: 256971 - DNA, 20 bp, Artificial Sequence
  chemically synthesized
tttttaagaattccatgtga

SEQ ID NO: 256972 - DNA, 20 bp, Artificial Sequence
  chemically synthesized
atggcattttgactttcaca

SEQ ID NO: 256973 - DNA, 20 bp, Artificial Sequence
  chemically synthesized
ttaaattgtatgcatcatga

SEQ ID NO: 256974 - DNA, 20 bp, Artificial Sequence
  chemically synthesized
catcatgatgcatacaattt

SEQ ID NO: 256975 - DNA, 20 bp, Artificial Sequence
  chemically synthesized
acaatttaagtcaattgttc

SEQ ID NO: 256976 - DNA, 20 bp, Artificial Sequence
  chemically synthesized
atactgatcattcatagtgc

SEQ ID NO: 256977 - DNA, 20 bp, Artificial Sequence
  chemically synthesized
gtgatcatactgatcattca

SEQ ID NO: 256978 - DNA, 20 bp, Artificial Sequence
  chemically synthesized
gttctggcactatgaatgat

SEQ ID NO: 256979 - DNA, 20 bp, Artificial Sequence
  chemically synthesized
actttcattcgtattttaca

SEQ ID NO: 256980 - DNA, 20 bp, Artificial Sequence
  chemically synthesized
cactttcattcgtattttac

SEQ ID NO: 256981 - DNA, 20 bp, Artificial Sequence
  chemically synthesized
accttgtaaaatacgaatga

SEQ ID NO: 256982 - DNA, 20 bp, Artificial Sequence
  chemically synthesized
aaatacgaatgaaagtgctt

SEQ ID NO: 256983 - DNA, 20 bp, Artificial Sequence
  chemically synthesized
agtctctgaaggtaaaacca

SEQ ID NO: 256984 - DNA, 20 bp, Artificial Sequence
  chemically synthesized
aagtgctttggttttacctt

SEQ ID NO: 256985 - DNA, 20 bp, Artificial Sequence
  chemically synthesized
gtgctttggttttaccttca

SEQ ID NO: 256986 - DNA, 20 bp, Artificial Sequence
  chemically synthesized
taagcaagaggagtctctga

SEQ ID NO: 256987 - DNA, 20 bp, Artificial Sequence
  chemically synthesized
ttaagcaagaggagtctctg

SEQ ID NO: 256988 - DNA, 20 bp, Artificial Sequence
  chemically synthesized
aagatctctttaagcaagag

SEQ ID NO: 256989 - DNA, 20 bp, Artificial Sequence
  chemically synthesized
tgaagatctctttaagcaag

SEQ ID NO: 256990 - DNA, 20 bp, Artificial Sequence
  chemically synthesized
tcagagactcctcttgctta

SEQ ID NO: 256991 - DNA, 20 bp, Artificial Sequence
  chemically synthesized
ttgaagatctctttaagcaa

SEQ ID NO: 256992 - DNA, 20 bp, Artificial Sequence
  chemically synthesized
agagactcctcttgcttaaa

SEQ ID NO: 256993 - DNA, 20 bp, Artificial Sequence
  chemically synthesized
ctttgaagatctctttaagc

SEQ ID NO: 256994 - DNA, 20 bp, Artificial Sequence
  chemically synthesized
aggactttgaagatctcttt

SEQ ID NO: 256995 - DNA, 20 bp, Artificial Sequence
  chemically synthesized
cttgcttaaagagatcttca

SEQ ID NO: 256996 - DNA, 20 bp, Artificial Sequence
  chemically synthesized
cctctgtgctaaggactttg

SEQ ID NO: 256997 - DNA, 20 bp, Artificial Sequence
  chemically synthesized
aaagagatcttcaaagtcct

SEQ ID NO: 256998 - DNA, 20 bp, Artificial Sequence
  chemically synthesized
gatcttcaaagtccttagca

SEQ ID NO: 256999 - DNA, 20 bp, Artificial Sequence
  chemically synthesized
tcttcaaagtccttagcaca

SEQ ID NO: 257000 - DNA, 20 bp, Artificial Sequence
  chemically synthesized
tgctcctgacctctgtgcta

SEQ ID NO: 257001 - DNA, 20 bp, Artificial Sequence
  chemically synthesized
cttcaaagtccttagcacag

SEQ ID NO: 257002 - DNA, 20 bp, Artificial Sequence
  chemically synthesized
atgctcctgacctctgtgct

SEQ ID NO: 257003 - DNA, 20 bp, Artificial Sequence
  chemically synthesized
aaagtccttagcacagaggt

SEQ ID NO: 257004 - DNA, 20 bp, Artificial Sequence
  chemically synthesized
aagtccttagcacagaggtc

SEQ ID NO: 257005 - DNA, 20 bp, Artificial Sequence
  chemically synthesized
gtccttagcacagaggtcag

SEQ ID NO: 257006 - DNA, 20 bp, Artificial Sequence
  chemically synthesized
gcacagaggtcaggagcatt

SEQ ID NO: 257007 - DNA, 20 bp, Artificial Sequence
  chemically synthesized
cagaggtcaggagcattgag

SEQ ID NO: 257008 - DNA, 20 bp, Artificial Sequence
  chemically synthesized
agaagttgttccacttctaa

SEQ ID NO: 257009 - DNA, 20 bp, Artificial Sequence
  chemically synthesized
ctcacaagccctattagaag

SEQ ID NO: 257010 - DNA, 20 bp, Artificial Sequence
  chemically synthesized
gaagttgttccacttctaat

SEQ ID NO: 257011 - DNA, 20 bp, Artificial Sequence
  chemically synthesized
aagttgttccacttctaata

SEQ ID NO: 257012 - DNA, 20 bp, Artificial Sequence
  chemically synthesized
tgtctcacaagccctattag

SEQ ID NO: 257013 - DNA, 20 bp, Artificial Sequence
  chemically synthesized
tcatgtctcacaagccctat

SEQ ID NO: 257014 - DNA, 20 bp, Artificial Sequence
  chemically synthesized
ccacttctaatagggcttgt

SEQ ID NO: 257015 - DNA, 20 bp, Artificial Sequence
  chemically synthesized
tgaaatcactcatgtctcac

SEQ ID NO: 257016 - DNA, 20 bp, Artificial Sequence
  chemically synthesized
taatagggcttgtgagacat

SEQ ID NO: 257017 - DNA, 20 bp, Artificial Sequence
  chemically synthesized
ttgtgagacatgagtgattt

SEQ ID NO: 257018 - DNA, 20 bp, Artificial Sequence
  chemically synthesized
atgagtgatttcagtcaaat

SEQ ID NO: 257019 - DNA, 20 bp, Artificial Sequence
  chemically synthesized
agtgatttcagtcaaataag

SEQ ID NO: 257020 - DNA, 20 bp, Artificial Sequence
  chemically synthesized
gatttcagtcaaataagtag

SEQ ID NO: 257021 - DNA, 20 bp, Artificial Sequence
  chemically synthesized
atttcagtcaaataagtaga

SEQ ID NO: 257022 - DNA, 20 bp, Artificial Sequence
  chemically synthesized
caaataagtagaaggcacat

SEQ ID NO: 257023 - DNA, 20 bp, Artificial Sequence
  chemically synthesized
aggcacataagaaatttcca

SEQ ID NO: 257024 - DNA, 20 bp, Artificial Sequence
  chemically synthesized
ggcacataagaaatttccaa

SEQ ID NO: 257025 - DNA, 20 bp, Artificial Sequence
  chemically synthesized
gatgactgaagacatgcctt

SEQ ID NO: 257026 - DNA, 20 bp, Artificial Sequence
  chemically synthesized
aatttccaaaggcatgtctt

SEQ ID NO: 257027 - DNA, 20 bp, Artificial Sequence
  chemically synthesized
aacgatgatggtgatgactg

SEQ ID NO: 257028 - DNA, 20 bp, Artificial Sequence
  chemically synthesized
tgtccgtgaagaaacgatga

SEQ ID NO: 257029 - DNA, 20 bp, Artificial Sequence
  chemically synthesized
tcaccatcatcgtttcttca

SEQ ID NO: 257030 - DNA, 20 bp, Artificial Sequence
  chemically synthesized
catcatcgtttcttcacgga

SEQ ID NO: 257031 - DNA, 20 bp, Artificial Sequence
  chemically synthesized
ataccagcacactgtccgtg

SEQ ID NO: 257032 - DNA, 20 bp, Artificial Sequence
  chemically synthesized
tttcttcacggacagtgtgc

SEQ ID NO: 257033 - DNA, 20 bp, Artificial Sequence
  chemically synthesized
tcacggacagtgtgctggta

SEQ ID NO: 257034 - DNA, 20 bp, Artificial Sequence
  chemically synthesized
gttcttttgtatatctatac

SEQ ID NO: 257035 - DNA, 20 bp, Artificial Sequence
  chemically synthesized
gtgctggtatagatatacaa

SEQ ID NO: 257036 - DNA, 20 bp, Artificial Sequence
  chemically synthesized
tacaaaagaacaattttttt

SEQ ID NO: 257037 - DNA, 20 bp, Artificial Sequence
  chemically synthesized
aattttttttagcttcctaa

SEQ ID NO: 257038 - DNA, 20 bp, Artificial Sequence
  chemically synthesized
gaggaggtttcactgttagg

SEQ ID NO: 257039 - DNA, 20 bp, Artificial Sequence
  chemically synthesized
atggaggaggtttcactgtt

SEQ ID NO: 257040 - DNA, 20 bp, Artificial Sequence
  chemically synthesized
aatggaggaggtttcactgt

SEQ ID NO: 257041 - DNA, 20 bp, Artificial Sequence
  chemically synthesized
ctatataaacttaatggagg

SEQ ID NO: 257042 - DNA, 20 bp, Artificial Sequence
  chemically synthesized
acagtgaaacctcctccatt

SEQ ID NO: 257043 - DNA, 20 bp, Artificial Sequence
  chemically synthesized
cctatataaacttaatggag

SEQ ID NO: 257044 - DNA, 20 bp, Artificial Sequence
  chemically synthesized
gacctatataaacttaatgg

SEQ ID NO: 257045 - DNA, 20 bp, Artificial Sequence
  chemically synthesized
agacctatataaacttaatg

SEQ ID NO: 257046 - DNA, 20 bp, Artificial Sequence
  chemically synthesized
tgagacctatataaacttaa

SEQ ID NO: 257047 - DNA, 20 bp, Artificial Sequence
  chemically synthesized
cctcctccattaagtttata

SEQ ID NO: 257048 - DNA, 20 bp, Artificial Sequence
  chemically synthesized
ctcctccattaagtttatat

SEQ ID NO: 257049 - DNA, 20 bp, Artificial Sequence
  chemically synthesized
tttatataggtctcattcta

SEQ ID NO: 257050 - DNA, 20 bp, Artificial Sequence
  chemically synthesized
tcaattgtcagctgtagaat

SEQ ID NO: 257051 - DNA, 20 bp, Artificial Sequence
  chemically synthesized
gtagattcaattgtcagctg

SEQ ID NO: 257052 - DNA, 20 bp, Artificial Sequence
  chemically synthesized
cagtttgtagattcaattgt

SEQ ID NO: 257053 - DNA, 20 bp, Artificial Sequence
  chemically synthesized
tgacaattgaatctacaaac

SEQ ID NO: 257054 - DNA, 20 bp, Artificial Sequence
  chemically synthesized
gacaattgaatctacaaact

SEQ ID NO: 257055 - DNA, 20 bp, Artificial Sequence
  chemically synthesized
tccattttcagcccagtttg

SEQ ID NO: 257056 - DNA, 20 bp, Artificial Sequence
  chemically synthesized
ttttgaatccattttcagcc

SEQ ID NO: 257057 - DNA, 20 bp, Artificial Sequence
  chemically synthesized
tctacaaactgggctgaaaa

SEQ ID NO: 257058 - DNA, 20 bp, Artificial Sequence
  chemically synthesized
tgaggttttgaatccatttt

SEQ ID NO: 257059 - DNA, 20 bp, Artificial Sequence
  chemically synthesized
atggattcaaaacctcacga

SEQ ID NO: 257060 - DNA, 20 bp, Artificial Sequence
  chemically synthesized
ttactagacttaccatcgtg

SEQ ID NO: 257061 - DNA, 20 bp, Artificial Sequence
  chemically synthesized
tttactagacttaccatcgt

SEQ ID NO: 257062 - DNA, 20 bp, Artificial Sequence
  chemically synthesized
attcaaaacctcacgatggt

SEQ ID NO: 257063 - DNA, 20 bp, Artificial Sequence
  chemically synthesized
aaacctcacgatggtaagtc

SEQ ID NO: 257064 - DNA, 20 bp, Artificial Sequence
  chemically synthesized
cgatggtaagtctagtaaaa

SEQ ID NO: 257065 - DNA, 20 bp, Artificial Sequence
  chemically synthesized
ttaataaatcaccgttttac

SEQ ID NO: 257066 - DNA, 20 bp, Artificial Sequence
  chemically synthesized
taacactttctggaaaaagt

SEQ ID NO: 257067 - DNA, 20 bp, Artificial Sequence
  chemically synthesized
aattatatacctactttttc

SEQ ID NO: 257068 - DNA, 20 bp, Artificial Sequence
  chemically synthesized
ttaacactttctggaaaaag

SEQ ID NO: 257069 - DNA, 20 bp, Artificial Sequence
  chemically synthesized
cttttaacactttctggaaa

SEQ ID NO: 257070 - DNA, 20 bp, Artificial Sequence
  chemically synthesized
atatacctactttttccaga

SEQ ID NO: 257071 - DNA, 20 bp, Artificial Sequence
  chemically synthesized
gaaatgcttttaacactttc

SEQ ID NO: 257072 - DNA, 20 bp, Artificial Sequence
  chemically synthesized
ctttttccagaaagtgttaa

SEQ ID NO: 257073 - DNA, 20 bp, Artificial Sequence
  chemically synthesized
tgttaaaagcatttcataat

SEQ ID NO: 257074 - DNA, 20 bp, Artificial Sequence
  chemically synthesized
aataagtgacacacacatat

SEQ ID NO: 257075 - DNA, 20 bp, Artificial Sequence
  chemically synthesized
catattagcaccataaatat

SEQ ID NO: 257076 - DNA, 20 bp, Artificial Sequence
  chemically synthesized
ggtctttcgtcttatattta

SEQ ID NO: 257077 - DNA, 20 bp, Artificial Sequence
  chemically synthesized
gcaccataaatataagacga

SEQ ID NO: 257078 - DNA, 20 bp, Artificial Sequence
  chemically synthesized
aatataagacgaaagaccat

SEQ ID NO: 257079 - DNA, 20 bp, Artificial Sequence
  chemically synthesized
atataagacgaaagaccatg

SEQ ID NO: 257080 - DNA, 20 bp, Artificial Sequence
  chemically synthesized
ctactctccttatgacctca

SEQ ID NO: 257081 - DNA, 20 bp, Artificial Sequence
  chemically synthesized
acgaaagaccatgaggtcat

SEQ ID NO: 257082 - DNA, 20 bp, Artificial Sequence
  chemically synthesized
cgaaagaccatgaggtcata

SEQ ID NO: 257083 - DNA, 20 bp, Artificial Sequence
  chemically synthesized
aaagaccatgaggtcataag

SEQ ID NO: 257084 - DNA, 20 bp, Artificial Sequence
  chemically synthesized
agaccatgaggtcataagga

SEQ ID NO: 257085 - DNA, 20 bp, Artificial Sequence
  chemically synthesized
ccatgaggtcataaggagag

SEQ ID NO: 257086 - DNA, 20 bp, Artificial Sequence
  chemically synthesized
aaggagagtagttttatcct

SEQ ID NO: 257087 - DNA, 20 bp, Artificial Sequence
  chemically synthesized
agtagttttatcctaagaaa

SEQ ID NO: 257088 - DNA, 20 bp, Artificial Sequence
  chemically synthesized
gcaaaaatcgtctttttctt

SEQ ID NO: 257089 - DNA, 20 bp, Artificial Sequence
  chemically synthesized
tgcaaaaatcgtctttttct

SEQ ID NO: 257090 - DNA, 20 bp, Artificial Sequence
  chemically synthesized
aaaaagacgatttttgcaac

SEQ ID NO: 257091 - DNA, 20 bp, Artificial Sequence
  chemically synthesized
agaattagaaatttaaatgc

SEQ ID NO: 257092 - DNA, 20 bp, Artificial Sequence
  chemically synthesized
tgccagttgcaaattagaat

SEQ ID NO: 257093 - DNA, 20 bp, Artificial Sequence
  chemically synthesized
tttaaatgccagttgcaaat

SEQ ID NO: 257094 - DNA, 20 bp, Artificial Sequence
  chemically synthesized
ttctaattctaatttgcaac

SEQ ID NO: 257095 - DNA, 20 bp, Artificial Sequence
  chemically synthesized
aaaattagaattttaaatgc

SEQ ID NO: 257096 - DNA, 20 bp, Artificial Sequence
  chemically synthesized
atttaaaattctaattttcc

SEQ ID NO: 257097 - DNA, 20 bp, Artificial Sequence
  chemically synthesized
atctagatttccaggaaaat

SEQ ID NO: 257098 - DNA, 20 bp, Artificial Sequence
  chemically synthesized
ttctaattttcctggaaatc

SEQ ID NO: 257099 - DNA, 20 bp, Artificial Sequence
  chemically synthesized
aatcccatatctagatttcc

SEQ ID NO: 257100 - DNA, 20 bp, Artificial Sequence
  chemically synthesized
caatcccatatctagatttc

SEQ ID NO: 257101 - DNA, 20 bp, Artificial Sequence
  chemically synthesized
ttttcctggaaatctagata

SEQ ID NO: 257102 - DNA, 20 bp, Artificial Sequence
  chemically synthesized
tttcctggaaatctagatat

SEQ ID NO: 257103 - DNA, 20 bp, Artificial Sequence
  chemically synthesized
ccctcacccaatcccatatc

SEQ ID NO: 257104 - DNA, 20 bp, Artificial Sequence
  chemically synthesized
tggaaatctagatatgggat

SEQ ID NO: 257105 - DNA, 20 bp, Artificial Sequence
  chemically synthesized
ggaaatctagatatgggatt

SEQ ID NO: 257106 - DNA, 20 bp, Artificial Sequence
  chemically synthesized
atctagatatgggattgggt

SEQ ID NO: 257107 - DNA, 20 bp, Artificial Sequence
  chemically synthesized
tctagatatgggattgggtg

SEQ ID NO: 257108 - DNA, 20 bp, Artificial Sequence
  chemically synthesized
ctagatatgggattgggtga

SEQ ID NO: 257109 - DNA, 20 bp, Artificial Sequence
  chemically synthesized
tagatatgggattgggtgag

SEQ ID NO: 257110 - DNA, 20 bp, Artificial Sequence
  chemically synthesized
agatatgggattgggtgagg

SEQ ID NO: 257111 - DNA, 20 bp, Artificial Sequence
  chemically synthesized
gttaggaataaaacagatat

SEQ ID NO: 257112 - DNA, 20 bp, Artificial Sequence
  chemically synthesized
tgcctgtgttaggaataaaa

SEQ ID NO: 257113 - DNA, 20 bp, Artificial Sequence
  chemically synthesized
tatctgttttattcctaaca

SEQ ID NO: 257114 - DNA, 20 bp, Artificial Sequence
  chemically synthesized
atctgttttattcctaacac

SEQ ID NO: 257115 - DNA, 20 bp, Artificial Sequence
  chemically synthesized
acaggaaagttgcctgtgtt

SEQ ID NO: 257116 - DNA, 20 bp, Artificial Sequence
  chemically synthesized
tacaggaaagttgcctgtgt

SEQ ID NO: 257117 - DNA, 20 bp, Artificial Sequence
  chemically synthesized
actttcctatagatacagga

SEQ ID NO: 257118 - DNA, 20 bp, Artificial Sequence
  chemically synthesized
aggcaactttcctgtatcta

SEQ ID NO: 257119 - DNA, 20 bp, Artificial Sequence
  chemically synthesized
gtgaactttcctatagatac

SEQ ID NO: 257120 - DNA, 20 bp, Artificial Sequence
  chemically synthesized
ggcaactttcctgtatctat

SEQ ID NO: 257121 - DNA, 20 bp, Artificial Sequence
  chemically synthesized
agtgaactttcctatagata

SEQ ID NO: 257122 - DNA, 20 bp, Artificial Sequence
  chemically synthesized
actttcctgtatctatagga

SEQ ID NO: 257123 - DNA, 20 bp, Artificial Sequence
  chemically synthesized
tatctcagtgaactttccta

SEQ ID NO: 257124 - DNA, 20 bp, Artificial Sequence
  chemically synthesized
tatctataggaaagttcact

SEQ ID NO: 257125 - DNA, 20 bp, Artificial Sequence
  chemically synthesized
acttcgtatctgttgtatct

SEQ ID NO: 257126 - DNA, 20 bp, Artificial Sequence
  chemically synthesized
gaaagttcactgagatacaa

SEQ ID NO: 257127 - DNA, 20 bp, Artificial Sequence
  chemically synthesized
actgagatacaacagatacg

SEQ ID NO: 257128 - DNA, 20 bp, Artificial Sequence
  chemically synthesized
gagatacaacagatacgaag

SEQ ID NO: 257129 - DNA, 20 bp, Artificial Sequence
  chemically synthesized
tacaacagatacgaagtagt

SEQ ID NO: 257130 - DNA, 20 bp, Artificial Sequence
  chemically synthesized
acaacagatacgaagtagtt

SEQ ID NO: 257131 - DNA, 20 bp, Artificial Sequence
  chemically synthesized
cagatacgaagtagttaggc

SEQ ID NO: 257132 - DNA, 20 bp, Artificial Sequence
  chemically synthesized
cttaatacaaagttacatac

SEQ ID NO: 257133 - DNA, 20 bp, Artificial Sequence
  chemically synthesized
ctggtatgtaactttgtatt

SEQ ID NO: 257134 - DNA, 20 bp, Artificial Sequence
  chemically synthesized
ggagaagagggcttaataca

SEQ ID NO: 257135 - DNA, 20 bp, Artificial Sequence
  chemically synthesized
ctagaatttggaggagaaga

SEQ ID NO: 257136 - DNA, 20 bp, Artificial Sequence
  chemically synthesized
tctagaatttggaggagaag

SEQ ID NO: 257137 - DNA, 20 bp, Artificial Sequence
  chemically synthesized
gtctagaatttggaggagaa

SEQ ID NO: 257138 - DNA, 20 bp, Artificial Sequence
  chemically synthesized
atgtctagaatttggaggag

SEQ ID NO: 257139 - DNA, 20 bp, Artificial Sequence
  chemically synthesized
ctaatgtctagaatttggag

SEQ ID NO: 257140 - DNA, 20 bp, Artificial Sequence
  chemically synthesized
agctaatgtctagaatttgg

SEQ ID NO: 257141 - DNA, 20 bp, Artificial Sequence
  chemically synthesized
ccctcttctcctccaaattc

SEQ ID NO: 257142 - DNA, 20 bp, Artificial Sequence
  chemically synthesized
gagctaatgtctagaatttg

SEQ ID NO: 257143 - DNA, 20 bp, Artificial Sequence
  chemically synthesized
aggagctaatgtctagaatt

SEQ ID NO: 257144 - DNA, 20 bp, Artificial Sequence
  chemically synthesized
ctcctccaaattctagacat

SEQ ID NO: 257145 - DNA, 20 bp, Artificial Sequence
  chemically synthesized
caaaaacaggagctaatgtc

SEQ ID NO: 257146 - DNA, 20 bp, Artificial Sequence
  chemically synthesized
gagactagcaacaaaaacag

SEQ ID NO: 257147 - DNA, 20 bp, Artificial Sequence
  chemically synthesized
aagagactagcaacaaaaac

SEQ ID NO: 257148 - DNA, 20 bp, Artificial Sequence
  chemically synthesized
caagagactagcaacaaaaa

SEQ ID NO: 257149 - DNA, 20 bp, Artificial Sequence
  chemically synthesized
ttagctcctgtttttgttgc

SEQ ID NO: 257150 - DNA, 20 bp, Artificial Sequence
  chemically synthesized
agcttaacttagcaagagac

SEQ ID NO: 257151 - DNA, 20 bp, Artificial Sequence
  chemically synthesized
tttgttgctagtctcttgct

SEQ ID NO: 257152 - DNA, 20 bp, Artificial Sequence
  chemically synthesized
ttagcagcttaacttagcaa

SEQ ID NO: 257153 - DNA, 20 bp, Artificial Sequence
  chemically synthesized
cattagcagcttaacttagc

SEQ ID NO: 257154 - DNA, 20 bp, Artificial Sequence
  chemically synthesized
tgctagtctcttgctaagtt

SEQ ID NO: 257155 - DNA, 20 bp, Artificial Sequence
  chemically synthesized
gcttcattagcagcttaact

SEQ ID NO: 257156 - DNA, 20 bp, Artificial Sequence
  chemically synthesized
gctaagttaagctgctaatg

SEQ ID NO: 257157 - DNA, 20 bp, Artificial Sequence
  chemically synthesized
tcatatagcagcttcattag

SEQ ID NO: 257158 - DNA, 20 bp, Artificial Sequence
  chemically synthesized
tgctcatatagcagcttcat

SEQ ID NO: 257159 - DNA, 20 bp, Artificial Sequence
  chemically synthesized
tgctaatgaagctgctatat

SEQ ID NO: 257160 - DNA, 20 bp, Artificial Sequence
  chemically synthesized
agtcagttctgctcatatag

SEQ ID NO: 257161 - DNA, 20 bp, Artificial Sequence
  chemically synthesized
taatgaagctgctatatgag

SEQ ID NO: 257162 - DNA, 20 bp, Artificial Sequence
  chemically synthesized
cgcagtcagttctgctcata

SEQ ID NO: 257163 - DNA, 20 bp, Artificial Sequence
  chemically synthesized
tatatgagcagaactgactg

SEQ ID NO: 257164 - DNA, 20 bp, Artificial Sequence
  chemically synthesized
taaaatataaattccgcagt

SEQ ID NO: 257165 - DNA, 20 bp, Artificial Sequence
  chemically synthesized
tttttaaaatataaattccg

SEQ ID NO: 257166 - DNA, 20 bp, Artificial Sequence
  chemically synthesized
tgcggaatttatattttaaa

SEQ ID NO: 257167 - DNA, 20 bp, Artificial Sequence
  chemically synthesized
ttatattttaaaaagaactc

SEQ ID NO: 257168 - DNA, 20 bp, Artificial Sequence
  chemically synthesized
ttatatatcaggacattctg

SEQ ID NO: 257169 - DNA, 20 bp, Artificial Sequence
  chemically synthesized
ccttatatatcaggacattc

SEQ ID NO: 257170 - DNA, 20 bp, Artificial Sequence
  chemically synthesized
tccagaatgtcctgatatat

SEQ ID NO: 257171 - DNA, 20 bp, Artificial Sequence
  chemically synthesized
ctagtgctcccttatatatc

SEQ ID NO: 257172 - DNA, 20 bp, Artificial Sequence
  chemically synthesized
ccagaatgtcctgatatata

SEQ ID NO: 257173 - DNA, 20 bp, Artificial Sequence
  chemically synthesized
gctagtgctcccttatatat

SEQ ID NO: 257174 - DNA, 20 bp, Artificial Sequence
  chemically synthesized
cagaatgtcctgatatataa

SEQ ID NO: 257175 - DNA, 20 bp, Artificial Sequence
  chemically synthesized
gaatgtcctgatatataagg

SEQ ID NO: 257176 - DNA, 20 bp, Artificial Sequence
  chemically synthesized
cctgatatataagggagcac

SEQ ID NO: 257177 - DNA, 20 bp, Artificial Sequence
  chemically synthesized
gtaggtgcaagagaagaggc

SEQ ID NO: 257178 - DNA, 20 bp, Artificial Sequence
  chemically synthesized
aagtgtaggtgcaagagaag

SEQ ID NO: 257179 - DNA, 20 bp, Artificial Sequence
  chemically synthesized
aaagtgtaggtgcaagagaa

SEQ ID NO: 257180 - DNA, 20 bp, Artificial Sequence
  chemically synthesized
gaaaagtgtaggtgcaagag

SEQ ID NO: 257181 - DNA, 20 bp, Artificial Sequence
  chemically synthesized
tcagaaaagtgtaggtgcaa

SEQ ID NO: 257182 - DNA, 20 bp, Artificial Sequence
  chemically synthesized
agtcagaaaagtgtaggtgc

SEQ ID NO: 257183 - DNA, 20 bp, Artificial Sequence
  chemically synthesized
gatcccagtcagaaaagtgt

SEQ ID NO: 257184 - DNA, 20 bp, Artificial Sequence
  chemically synthesized
ggatcccagtcagaaaagtg

SEQ ID NO: 257185 - DNA, 20 bp, Artificial Sequence
  chemically synthesized
tgcacctacacttttctgac

SEQ ID NO: 257186 - DNA, 20 bp, Artificial Sequence
  chemically synthesized
cacttggatcccagtcagaa

SEQ ID NO: 257187 - DNA, 20 bp, Artificial Sequence
  chemically synthesized
gcacctacacttttctgact

SEQ ID NO: 257188 - DNA, 20 bp, Artificial Sequence
  chemically synthesized
tctagcacttggatcccagt

SEQ ID NO: 257189 - DNA, 20 bp, Artificial Sequence
  chemically synthesized
cacttttctgactgggatcc

SEQ ID NO: 257190 - DNA, 20 bp, Artificial Sequence
  chemically synthesized
catgtctagcacttggatcc

SEQ ID NO: 257191 - DNA, 20 bp, Artificial Sequence
  chemically synthesized
tctgactgggatccaagtgc

SEQ ID NO: 257192 - DNA, 20 bp, Artificial Sequence
  chemically synthesized
ttctcatcatgtctagcact

SEQ ID NO: 257193 - DNA, 20 bp, Artificial Sequence
  chemically synthesized
ctggaaattctcatcatgtc

SEQ ID NO: 257194 - DNA, 20 bp, Artificial Sequence
  chemically synthesized
atccaagtgctagacatgat

SEQ ID NO: 257195 - DNA, 20 bp, Artificial Sequence
  chemically synthesized
ctagacatgatgagaatttc

SEQ ID NO: 257196 - DNA, 20 bp, Artificial Sequence
  chemically synthesized
atgatgagaatttccagctc

SEQ ID NO: 257197 - DNA, 20 bp, Artificial Sequence
  chemically synthesized
gatgagaatttccagctcca

SEQ ID NO: 257198 - DNA, 20 bp, Artificial Sequence
  chemically synthesized
ctccaaaaggactctggagc

SEQ ID NO: 257199 - DNA, 20 bp, Artificial Sequence
  chemically synthesized
gaaactccaaaaggactctg

SEQ ID NO: 257200 - DNA, 20 bp, Artificial Sequence
  chemically synthesized
gggaaactccaaaaggactc

SEQ ID NO: 257201 - DNA, 20 bp, Artificial Sequence
  chemically synthesized
ttccagctccagagtccttt

SEQ ID NO: 257202 - DNA, 20 bp, Artificial Sequence
  chemically synthesized
ccagctccagagtccttttg

SEQ ID NO: 257203 - DNA, 20 bp, Artificial Sequence
  chemically synthesized
tattactgggaaactccaaa

SEQ ID NO: 257204 - DNA, 20 bp, Artificial Sequence
  chemically synthesized
gtattactgggaaactccaa

SEQ ID NO: 257205 - DNA, 20 bp, Artificial Sequence
  chemically synthesized
agagtccttttggagtttcc

SEQ ID NO: 257206 - DNA, 20 bp, Artificial Sequence
  chemically synthesized
atagggaaagatgtattact

SEQ ID NO: 257207 - DNA, 20 bp, Artificial Sequence
  chemically synthesized
aatagggaaagatgtattac

SEQ ID NO: 257208 - DNA, 20 bp, Artificial Sequence
  chemically synthesized
gctcttataaagaataggga

SEQ ID NO: 257209 - DNA, 20 bp, Artificial Sequence
  chemically synthesized
ttttgctcttataaagaata

SEQ ID NO: 257210 - DNA, 20 bp, Artificial Sequence
  chemically synthesized
tttttgctcttataaagaat

SEQ ID NO: 257211 - DNA, 20 bp, Artificial Sequence
  chemically synthesized
ttttttgctcttataaagaa

SEQ ID NO: 257212 - DNA, 20 bp, Artificial Sequence
  chemically synthesized
catctttccctattctttat

SEQ ID NO: 257213 - DNA, 20 bp, Artificial Sequence
  chemically synthesized
tctttccctattctttataa

SEQ ID NO: 257214 - DNA, 20 bp, Artificial Sequence
  chemically synthesized
atttattttttgctcttata

SEQ ID NO: 257215 - DNA, 20 bp, Artificial Sequence
  chemically synthesized
agcaaaaaataaatactact

SEQ ID NO: 257216 - DNA, 20 bp, Artificial Sequence
  chemically synthesized
aaaaaataaatactacttgg

SEQ ID NO: 257217 - DNA, 20 bp, Artificial Sequence
  chemically synthesized
aaaaataaatactacttggc

SEQ ID NO: 257218 - DNA, 20 bp, Artificial Sequence
  chemically synthesized
ttctgaatttgcctgccaag

SEQ ID NO: 257219 - DNA, 20 bp, Artificial Sequence
  chemically synthesized
tctttctgaatttgcctgcc

SEQ ID NO: 257220 - DNA, 20 bp, Artificial Sequence
  chemically synthesized
tactacttggcaggcaaatt

SEQ ID NO: 257221 - DNA, 20 bp, Artificial Sequence
  chemically synthesized
acttggcaggcaaattcaga

SEQ ID NO: 257222 - DNA, 20 bp, Artificial Sequence
  chemically synthesized
ggcaggcaaattcagaaaga

SEQ ID NO: 257223 - DNA, 20 bp, Artificial Sequence
  chemically synthesized
gtgtagacagaagagagcac

SEQ ID NO: 257224 - DNA, 20 bp, Artificial Sequence
  chemically synthesized
agtgtagacagaagagagca

SEQ ID NO: 257225 - DNA, 20 bp, Artificial Sequence
  chemically synthesized
cctatagtgtagacagaaga

SEQ ID NO: 257226 - DNA, 20 bp, Artificial Sequence
  chemically synthesized
tgcctatagtgtagacagaa

SEQ ID NO: 257227 - DNA, 20 bp, Artificial Sequence
  chemically synthesized
gctgcctatagtgtagacag

SEQ ID NO: 257228 - DNA, 20 bp, Artificial Sequence
  chemically synthesized
tttgctgcctatagtgtaga

SEQ ID NO: 257229 - DNA, 20 bp, Artificial Sequence
  chemically synthesized
gctctcttctgtctacacta

SEQ ID NO: 257230 - DNA, 20 bp, Artificial Sequence
  chemically synthesized
ctctcttctgtctacactat

SEQ ID NO: 257231 - DNA, 20 bp, Artificial Sequence
  chemically synthesized
gaattttgctgcctatagtg

SEQ ID NO: 257232 - DNA, 20 bp, Artificial Sequence
  chemically synthesized
tcttctgtctacactatagg

SEQ ID NO: 257233 - DNA, 20 bp, Artificial Sequence
  chemically synthesized
tacaagaattttgctgccta

SEQ ID NO: 257234 - DNA, 20 bp, Artificial Sequence
  chemically synthesized
gggagaataatttcaattac

SEQ ID NO: 257235 - DNA, 20 bp, Artificial Sequence
  chemically synthesized
attctagacaaagttattgg

SEQ ID NO: 257236 - DNA, 20 bp, Artificial Sequence
  chemically synthesized
caattctagacaaagttatt

SEQ ID NO: 257237 - DNA, 20 bp, Artificial Sequence
  chemically synthesized
tcaattctagacaaagttat

SEQ ID NO: 257238 - DNA, 20 bp, Artificial Sequence
  chemically synthesized
attctcccaataactttgtc

SEQ ID NO: 257239 - DNA, 20 bp, Artificial Sequence
  chemically synthesized
cagttgatcaattctagaca

SEQ ID NO: 257240 - DNA, 20 bp, Artificial Sequence
  chemically synthesized
aggtggcagttgatcaattc

SEQ ID NO: 257241 - DNA, 20 bp, Artificial Sequence
  chemically synthesized
cctcatcaacaggcaggtgg

SEQ ID NO: 257242 - DNA, 20 bp, Artificial Sequence
  chemically synthesized
tgacctcatcaacaggcagg

SEQ ID NO: 257243 - DNA, 20 bp, Artificial Sequence
  chemically synthesized
aggtgacctcatcaacaggc

SEQ ID NO: 257244 - DNA, 20 bp, Artificial Sequence
  chemically synthesized
caggtgacctcatcaacagg

SEQ ID NO: 257245 - DNA, 20 bp, Artificial Sequence
  chemically synthesized
actgccacctgcctgttgat

SEQ ID NO: 257246 - DNA, 20 bp, Artificial Sequence
  chemically synthesized
ctgccacctgcctgttgatg

SEQ ID NO: 257247 - DNA, 20 bp, Artificial Sequence
  chemically synthesized
cctcaggtgacctcatcaac

SEQ ID NO: 257248 - DNA, 20 bp, Artificial Sequence
  chemically synthesized
ccctcaggtgacctcatcaa

SEQ ID NO: 257249 - DNA, 20 bp, Artificial Sequence
  chemically synthesized
gcctgttgatgaggtcacct

SEQ ID NO: 257250 - DNA, 20 bp, Artificial Sequence
  chemically synthesized
cctgttgatgaggtcacctg

SEQ ID NO: 257251 - DNA, 20 bp, Artificial Sequence
  chemically synthesized
ctgttgatgaggtcacctga

SEQ ID NO: 257252 - DNA, 20 bp, Artificial Sequence
  chemically synthesized
accctaccactgaaaccctc

SEQ ID NO: 257253 - DNA, 20 bp, Artificial Sequence
  chemically synthesized
atgaggtcacctgagggttt

SEQ ID NO: 257254 - DNA, 20 bp, Artificial Sequence
  chemically synthesized
gaccctaccactgaaaccct

SEQ ID NO: 257255 - DNA, 20 bp, Artificial Sequence
  chemically synthesized
aggtcacctgagggtttcag

SEQ ID NO: 257256 - DNA, 20 bp, Artificial Sequence
  chemically synthesized
tcacctgagggtttcagtgg

SEQ ID NO: 257257 - DNA, 20 bp, Artificial Sequence
  chemically synthesized
cacctgagggtttcagtggt

SEQ ID NO: 257258 - DNA, 20 bp, Artificial Sequence
  chemically synthesized
acctgagggtttcagtggta

SEQ ID NO: 257259 - DNA, 20 bp, Artificial Sequence
  chemically synthesized
ggtttcagtggtagggtctc

SEQ ID NO: 257260 - DNA, 20 bp, Artificial Sequence
  chemically synthesized
gtttcagtggtagggtctct

SEQ ID NO: 257261 - DNA, 20 bp, Artificial Sequence
  chemically synthesized
tttcagtggtagggtctctg

SEQ ID NO: 257262 - DNA, 20 bp, Artificial Sequence
  chemically synthesized
cagtggtagggtctctgggg

SEQ ID NO: 257263 - DNA, 20 bp, Artificial Sequence
  chemically synthesized
ttatcgtttgtacttcccca

SEQ ID NO: 257264 - DNA, 20 bp, Artificial Sequence
  chemically synthesized
gcttatcgtttgtacttccc

SEQ ID NO: 257265 - DNA, 20 bp, Artificial Sequence
  chemically synthesized
tctggggaagtacaaacgat

SEQ ID NO: 257266 - DNA, 20 bp, Artificial Sequence
  chemically synthesized
aaacgataagcatgctaacg

SEQ ID NO: 257267 - DNA, 20 bp, Artificial Sequence
  chemically synthesized
gcagtaataaatggctacgt

SEQ ID NO: 257268 - DNA, 20 bp, Artificial Sequence
  chemically synthesized
aaaggctgtgcagtaataaa

SEQ ID NO: 257269 - DNA, 20 bp, Artificial Sequence
  chemically synthesized
cgtagccatttattactgca

SEQ ID NO: 257270 - DNA, 20 bp, Artificial Sequence
  chemically synthesized
tgttgtcataaaaggctgtg

SEQ ID NO: 257271 - DNA, 20 bp, Artificial Sequence
  chemically synthesized
aagtatggtgttgtcataaa

SEQ ID NO: 257272 - DNA, 20 bp, Artificial Sequence
  chemically synthesized
taagtatggtgttgtcataa

SEQ ID NO: 257273 - DNA, 20 bp, Artificial Sequence
  chemically synthesized
cattactgcaaaaataagta

SEQ ID NO: 257274 - DNA, 20 bp, Artificial Sequence
  chemically synthesized
caacaccatacttatttttg

SEQ ID NO: 257275 - DNA, 20 bp, Artificial Sequence
  chemically synthesized
tattacattactgcaaaaat

SEQ ID NO: 257276 - DNA, 20 bp, Artificial Sequence
  chemically synthesized
tttgcagtaatgtaatacat

SEQ ID NO: 257277 - DNA, 20 bp, Artificial Sequence
  chemically synthesized
taatgtaatacattggactt

SEQ ID NO: 257278 - DNA, 20 bp, Artificial Sequence
  chemically synthesized
aatgtaatacattggacttt

SEQ ID NO: 257279 - DNA, 20 bp, Artificial Sequence
  chemically synthesized
atgtaatacattggactttg

SEQ ID NO: 257280 - DNA, 20 bp, Artificial Sequence
  chemically synthesized
ggttcagtctagtatcccca

SEQ ID NO: 257281 - DNA, 20 bp, Artificial Sequence
  chemically synthesized
acattggactttggggatac

SEQ ID NO: 257282 - DNA, 20 bp, Artificial Sequence
  chemically synthesized
tctttgtgtggggttcagtc

SEQ ID NO: 257283 - DNA, 20 bp, Artificial Sequence
  chemically synthesized
actcctctttgtgtggggtt

SEQ ID NO: 257284 - DNA, 20 bp, Artificial Sequence
  chemically synthesized
actagactgaaccccacaca

SEQ ID NO: 257285 - DNA, 20 bp, Artificial Sequence
  chemically synthesized
attttactcctctttgtgtg

SEQ ID NO: 257286 - DNA, 20 bp, Artificial Sequence
  chemically synthesized
tagactgaaccccacacaaa

SEQ ID NO: 257287 - DNA, 20 bp, Artificial Sequence
  chemically synthesized
aattttactcctctttgtgt

SEQ ID NO: 257288 - DNA, 20 bp, Artificial Sequence
  chemically synthesized
agactgaaccccacacaaag

SEQ ID NO: 257289 - DNA, 20 bp, Artificial Sequence
  chemically synthesized
aaattttactcctctttgtg

SEQ ID NO: 257290 - DNA, 20 bp, Artificial Sequence
  chemically synthesized
actgaaccccacacaaagag

SEQ ID NO: 257291 - DNA, 20 bp, Artificial Sequence
  chemically synthesized
caaagaggagtaaaatttac

SEQ ID NO: 257292 - DNA, 20 bp, Artificial Sequence
  chemically synthesized
gaggagtaaaatttacaagc

SEQ ID NO: 257293 - DNA, 20 bp, Artificial Sequence
  chemically synthesized
aaaacaaaacataaagtgac

SEQ ID NO: 257294 - DNA, 20 bp, Artificial Sequence
  chemically synthesized
gaaattaaaaacaaaacata

SEQ ID NO: 257295 - DNA, 20 bp, Artificial Sequence
  chemically synthesized
tgtttttaatttctctgacc

SEQ ID NO: 257296 - DNA, 20 bp, Artificial Sequence
  chemically synthesized
gtttttaatttctctgacct

SEQ ID NO: 257297 - DNA, 20 bp, Artificial Sequence
  chemically synthesized
agtatgaaaatcctaggtca

SEQ ID NO: 257298 - DNA, 20 bp, Artificial Sequence
  chemically synthesized
tgagtatgaaaatcctaggt

SEQ ID NO: 257299 - DNA, 20 bp, Artificial Sequence
  chemically synthesized
gaattgagtatgaaaatcct

SEQ ID NO: 257300 - DNA, 20 bp, Artificial Sequence
  chemically synthesized
agaattgagtatgaaaatcc

SEQ ID NO: 257301 - DNA, 20 bp, Artificial Sequence
  chemically synthesized
ttttatatcatgtaagaatt

SEQ ID NO: 257302 - DNA, 20 bp, Artificial Sequence
  chemically synthesized
cttcattttttatatcatgt

SEQ ID NO: 257303 - DNA, 20 bp, Artificial Sequence
  chemically synthesized
cttacatgatataaaaaatg

SEQ ID NO: 257304 - DNA, 20 bp, Artificial Sequence
  chemically synthesized
aaaatgaagtaattctaatt

SEQ ID NO: 257305 - DNA, 20 bp, Artificial Sequence
  chemically synthesized
agtagatgagatatctaaat

SEQ ID NO: 257306 - DNA, 20 bp, Artificial Sequence
  chemically synthesized
ttgctatatcacaagtagat

SEQ ID NO: 257307 - DNA, 20 bp, Artificial Sequence
  chemically synthesized
tgaatttgctatatcacaag

SEQ ID NO: 257308 - DNA, 20 bp, Artificial Sequence
  chemically synthesized
tatctcatctacttgtgata

SEQ ID NO: 257309 - DNA, 20 bp, Artificial Sequence
  chemically synthesized
ctgtgaatttgctatatcac

SEQ ID NO: 257310 - DNA, 20 bp, Artificial Sequence
  chemically synthesized
cttgtgatatagcaaattca

SEQ ID NO: 257311 - DNA, 20 bp, Artificial Sequence
  chemically synthesized
attcacagaattgcacaaat

SEQ ID NO: 257312 - DNA, 20 bp, Artificial Sequence
  chemically synthesized
taaaaggtataattatttaa

SEQ ID NO: 257313 - DNA, 20 bp, Artificial Sequence
  chemically synthesized
aataaaacaaatgttgtaaa

SEQ ID NO: 257314 - DNA, 20 bp, Artificial Sequence
  chemically synthesized
caataaaacaaatgttgtaa

SEQ ID NO: 257315 - DNA, 20 bp, Artificial Sequence
  chemically synthesized
tttgttttattgtgtatatc

SEQ ID NO: 257316 - DNA, 20 bp, Artificial Sequence
  chemically synthesized
ttgttttattgtgtatatct

SEQ ID NO: 257317 - DNA, 20 bp, Artificial Sequence
  chemically synthesized
tgtgtgccatggatttggcc

SEQ ID NO: 257318 - DNA, 20 bp, Artificial Sequence
  chemically synthesized
gtatatctgggccaaatcca

SEQ ID NO: 257319 - DNA, 20 bp, Artificial Sequence
  chemically synthesized
aggaatgtgtgccatggatt

SEQ ID NO: 257320 - DNA, 20 bp, Artificial Sequence
  chemically synthesized
acatgaaggaatgtgtgcca

SEQ ID NO: 257321 - DNA, 20 bp, Artificial Sequence
  chemically synthesized
cattattccattgaacatga

SEQ ID NO: 257322 - DNA, 20 bp, Artificial Sequence
  chemically synthesized
acattattccattgaacatg

SEQ ID NO: 257323 - DNA, 20 bp, Artificial Sequence
  chemically synthesized
acacattccttcatgttcaa

SEQ ID NO: 257324 - DNA, 20 bp, Artificial Sequence
  chemically synthesized
atatccttttaaatgtaaat

SEQ ID NO: 257325 - DNA, 20 bp, Artificial Sequence
  chemically synthesized
tatttctcatttacatttaa

SEQ ID NO: 257326 - DNA, 20 bp, Artificial Sequence
  chemically synthesized
atttctcatttacatttaaa

SEQ ID NO: 257327 - DNA, 20 bp, Artificial Sequence
  chemically synthesized
atttacatttaaaaggatat

SEQ ID NO: 257328 - DNA, 20 bp, Artificial Sequence
  chemically synthesized
taaaaggatattagaaactt

SEQ ID NO: 257329 - DNA, 20 bp, Artificial Sequence
  chemically synthesized
aggatattagaaacttgagc

SEQ ID NO: 257330 - DNA, 20 bp, Artificial Sequence
  chemically synthesized
gatattagaaacttgagcca

SEQ ID NO: 257331 - DNA, 20 bp, Artificial Sequence
  chemically synthesized
tatttatcaaactctggctc

SEQ ID NO: 257332 - DNA, 20 bp, Artificial Sequence
  chemically synthesized
gaattttatttatcaaactc

SEQ ID NO: 257333 - DNA, 20 bp, Artificial Sequence
  chemically synthesized
agagtttgataaataaaatt

SEQ ID NO: 257334 - DNA, 20 bp, Artificial Sequence
  chemically synthesized
aaataaaattcagaatttaa

SEQ ID NO: 257335 - DNA, 20 bp, Artificial Sequence
  chemically synthesized
cagaatttaacagatttctt

SEQ ID NO: 257336 - DNA, 20 bp, Artificial Sequence
  chemically synthesized
agtgaaattaagaatttctt

SEQ ID NO: 257337 - DNA, 20 bp, Artificial Sequence
  chemically synthesized
tatgatgaaatagtgaaatt

SEQ ID NO: 257338 - DNA, 20 bp, Artificial Sequence
  chemically synthesized
gtaaaatgcttatgatgaaa

SEQ ID NO: 257339 - DNA, 20 bp, Artificial Sequence
  chemically synthesized
taatttcactatttcatcat

SEQ ID NO: 257340 - DNA, 20 bp, Artificial Sequence
  chemically synthesized
taagcattttacacatttaa

SEQ ID NO: 257341 - DNA, 20 bp, Artificial Sequence
  chemically synthesized
catttaaaagaaaaataact

SEQ ID NO: 257342 - DNA, 20 bp, Artificial Sequence
  chemically synthesized
ttaaaagaaaaataactcag

SEQ ID NO: 257343 - DNA, 20 bp, Artificial Sequence
  chemically synthesized
taaaagaaaaataactcagc

SEQ ID NO: 257344 - DNA, 20 bp, Artificial Sequence
  chemically synthesized
tcacattcaaatagcctgct

SEQ ID NO: 257345 - DNA, 20 bp, Artificial Sequence
  chemically synthesized
gtgaaaatttcacattcaaa

SEQ ID NO: 257346 - DNA, 20 bp, Artificial Sequence
  chemically synthesized
gattctactgtttaatgtgt

SEQ ID NO: 257347 - DNA, 20 bp, Artificial Sequence
  chemically synthesized
attttcactgacacattaaa

SEQ ID NO: 257348 - DNA, 20 bp, Artificial Sequence
  chemically synthesized
ttcactgacacattaaacag

SEQ ID NO: 257349 - DNA, 20 bp, Artificial Sequence
  chemically synthesized
acattaaacagtagaatcaa

SEQ ID NO: 257350 - DNA, 20 bp, Artificial Sequence
  chemically synthesized
aacagtagaatcaatagcac

SEQ ID NO: 257351 - DNA, 20 bp, Artificial Sequence
  chemically synthesized
atcaatagcacaagtaacac

SEQ ID NO: 257352 - DNA, 20 bp, Artificial Sequence
  chemically synthesized
atgtaatgcgtgcaaaacac

SEQ ID NO: 257353 - DNA, 20 bp, Artificial Sequence
  chemically synthesized
gtgttttgcacgcattacat

SEQ ID NO: 257354 - DNA, 20 bp, Artificial Sequence
  chemically synthesized
tttgcacgcattacattggt

SEQ ID NO: 257355 - DNA, 20 bp, Artificial Sequence
  chemically synthesized
ttttattaagaacaacataa

SEQ ID NO: 257356 - DNA, 20 bp, Artificial Sequence
  chemically synthesized
attaacttgtaaattttatt

SEQ ID NO: 257357 - DNA, 20 bp, Artificial Sequence
  chemically synthesized
ttgttcttaataaaatttac

SEQ ID NO: 257358 - DNA, 20 bp, Artificial Sequence
  chemically synthesized
aataaaatttacaagttaat

SEQ ID NO: 257359 - DNA, 20 bp, Artificial Sequence
  chemically synthesized
ctaacgtgaataagaaagac

SEQ ID NO: 257360 - DNA, 20 bp, Artificial Sequence
  chemically synthesized
agcaactaacgtgaataaga

SEQ ID NO: 257361 - DNA, 20 bp, Artificial Sequence
  chemically synthesized
ttatagcaactaacgtgaat

SEQ ID NO: 257362 - DNA, 20 bp, Artificial Sequence
  chemically synthesized
ctcgtctttcttattcacgt

SEQ ID NO: 257363 - DNA, 20 bp, Artificial Sequence
  chemically synthesized
tatctttactgcaggggtta

SEQ ID NO: 257364 - DNA, 20 bp, Artificial Sequence
  chemically synthesized
gttagttgctataacccctg

SEQ ID NO: 257365 - DNA, 20 bp, Artificial Sequence
  chemically synthesized
tgaagctatctttactgcag

SEQ ID NO: 257366 - DNA, 20 bp, Artificial Sequence
  chemically synthesized
ttgctataacccctgcagta

SEQ ID NO: 257367 - DNA, 20 bp, Artificial Sequence
  chemically synthesized
gtgaagctatctttactgca

SEQ ID NO: 257368 - DNA, 20 bp, Artificial Sequence
  chemically synthesized
tgtgaagctatctttactgc

SEQ ID NO: 257369 - DNA, 20 bp, Artificial Sequence
  chemically synthesized
atgtgaagctatctttactg

SEQ ID NO: 257370 - DNA, 20 bp, Artificial Sequence
  chemically synthesized
tataacccctgcagtaaaga

SEQ ID NO: 257371 - DNA, 20 bp, Artificial Sequence
  chemically synthesized
cgcttgctttagatgatgtg

SEQ ID NO: 257372 - DNA, 20 bp, Artificial Sequence
  chemically synthesized
agatagcttcacatcatcta

SEQ ID NO: 257373 - DNA, 20 bp, Artificial Sequence
  chemically synthesized
agcttcacatcatctaaagc

SEQ ID NO: 257374 - DNA, 20 bp, Artificial Sequence
  chemically synthesized
tataagaaatacgcttgctt

SEQ ID NO: 257375 - DNA, 20 bp, Artificial Sequence
  chemically synthesized
caccattaaataagtattat

SEQ ID NO: 257376 - DNA, 20 bp, Artificial Sequence
  chemically synthesized
ttcttataatacttatttaa

SEQ ID NO: 257377 - DNA, 20 bp, Artificial Sequence
  chemically synthesized
atttaattgcaccattaaat

SEQ ID NO: 257378 - DNA, 20 bp, Artificial Sequence
  chemically synthesized
gtaaaatgtatcattaaagg

SEQ ID NO: 257379 - DNA, 20 bp, Artificial Sequence
  chemically synthesized
ggtgtaaaatgtatcattaa

SEQ ID NO: 257380 - DNA, 20 bp, Artificial Sequence
  chemically synthesized
aggtgtaaaatgtatcatta

SEQ ID NO: 257381 - DNA, 20 bp, Artificial Sequence
  chemically synthesized
atgatacattttacacctgt

SEQ ID NO: 257382 - DNA, 20 bp, Artificial Sequence
  chemically synthesized
tttgttttccaaaaacttac

SEQ ID NO: 257383 - DNA, 20 bp, Artificial Sequence
  chemically synthesized
ctttgttttccaaaaactta

SEQ ID NO: 257384 - DNA, 20 bp, Artificial Sequence
  chemically synthesized
attttacacctgtaagtttt

SEQ ID NO: 257385 - DNA, 20 bp, Artificial Sequence
  chemically synthesized
ctgtaagtttttggaaaaca

SEQ ID NO: 257386 - DNA, 20 bp, Artificial Sequence
  chemically synthesized
tgtaagtttttggaaaacaa

SEQ ID NO: 257387 - DNA, 20 bp, Artificial Sequence
  chemically synthesized
aaaacaaaggtttttgttat

SEQ ID NO: 257388 - DNA, 20 bp, Artificial Sequence
  chemically synthesized
aaacaaaggtttttgttatc

SEQ ID NO: 257389 - DNA, 20 bp, Artificial Sequence
  chemically synthesized
aaggtttttgttatcaggaa

SEQ ID NO: 257390 - DNA, 20 bp, Artificial Sequence
  chemically synthesized
ggtttttgttatcaggaaca

SEQ ID NO: 257391 - DNA, 20 bp, Artificial Sequence
  chemically synthesized
tttgttatcaggaacagagt

SEQ ID NO: 257392 - DNA, 20 bp, Artificial Sequence
  chemically synthesized
gttatcaggaacagagtaag

SEQ ID NO: 257393 - DNA, 20 bp, Artificial Sequence
  chemically synthesized
atcaggaacagagtaagtag

SEQ ID NO: 257394 - DNA, 20 bp, Artificial Sequence
  chemically synthesized
gaacagagtaagtagaagac

SEQ ID NO: 257395 - DNA, 20 bp, Artificial Sequence
  chemically synthesized
agtaagtagaagacaagttg

SEQ ID NO: 257396 - DNA, 20 bp, Artificial Sequence
  chemically synthesized
atttgttttgttgtttaatc

SEQ ID NO: 257397 - DNA, 20 bp, Artificial Sequence
  chemically synthesized
tttgttttgttgtttaatca

SEQ ID NO: 257398 - DNA, 20 bp, Artificial Sequence
  chemically synthesized
ttgttttgttgtttaatcaa

SEQ ID NO: 257399 - DNA, 20 bp, Artificial Sequence
  chemically synthesized
gttttgttgtttaatcaagg

SEQ ID NO: 257400 - DNA, 20 bp, Artificial Sequence
  chemically synthesized
tttaatcaagggagttgttt

SEQ ID NO: 257401 - DNA, 20 bp, Artificial Sequence
  chemically synthesized
caagggagttgtttcagaat

SEQ ID NO: 257402 - DNA, 20 bp, Artificial Sequence
  chemically synthesized
atttttttctaaatattttc

SEQ ID NO: 257403 - DNA, 20 bp, Artificial Sequence
  chemically synthesized
ggacatatcttgaaaatatt

SEQ ID NO: 257404 - DNA, 20 bp, Artificial Sequence
  chemically synthesized
aaaatatttagaaaaaaatc

SEQ ID NO: 257405 - DNA, 20 bp, Artificial Sequence
  chemically synthesized
aaatatttagaaaaaaatct

SEQ ID NO: 257406 - DNA, 20 bp, Artificial Sequence
  chemically synthesized
tatttagaaaaaaatctggg

SEQ ID NO: 257407 - DNA, 20 bp, Artificial Sequence
  chemically synthesized
ctgcttttgttaaggccacc

SEQ ID NO: 257408 - DNA, 20 bp, Artificial Sequence
  chemically synthesized
aatctgggtggccttaacaa

SEQ ID NO: 257409 - DNA, 20 bp, Artificial Sequence
  chemically synthesized
aattcccactgcttttgtta

SEQ ID NO: 257410 - DNA, 20 bp, Artificial Sequence
  chemically synthesized
gaattcccactgcttttgtt

SEQ ID NO: 257411 - DNA, 20 bp, Artificial Sequence
  chemically synthesized
ctgggtggccttaacaaaag

SEQ ID NO: 257412 - DNA, 20 bp, Artificial Sequence
  chemically synthesized
ggtggccttaacaaaagcag

SEQ ID NO: 257413 - DNA, 20 bp, Artificial Sequence
  chemically synthesized
gtggccttaacaaaagcagt

SEQ ID NO: 257414 - DNA, 20 bp, Artificial Sequence
  chemically synthesized
taacaaaagcagtgggaatt

SEQ ID NO: 257415 - DNA, 20 bp, Artificial Sequence
  chemically synthesized
aaagcagtgggaattcagaa

SEQ ID NO: 257416 - DNA, 20 bp, Artificial Sequence
  chemically synthesized
tcttttaagaaaaagtgatg

SEQ ID NO: 257417 - DNA, 20 bp, Artificial Sequence
  chemically synthesized
ttcttttaagaaaaagtgat

SEQ ID NO: 257418 - DNA, 20 bp, Artificial Sequence
  chemically synthesized
attatttttcttttaagaaa

SEQ ID NO: 257419 - DNA, 20 bp, Artificial Sequence
  chemically synthesized
tcctcatcactttttcttaa

SEQ ID NO: 257420 - DNA, 20 bp, Artificial Sequence
  chemically synthesized
cttagaattatttttctttt

SEQ ID NO: 257421 - DNA, 20 bp, Artificial Sequence
  chemically synthesized
cttaaaagaaaaataattct

SEQ ID NO: 257422 - DNA, 20 bp, Artificial Sequence
  chemically synthesized
gaaaatagataaaaacatct

SEQ ID NO: 257423 - DNA, 20 bp, Artificial Sequence
  chemically synthesized
atcaaagaagaatcagaaaa

SEQ ID NO: 257424 - DNA, 20 bp, Artificial Sequence
  chemically synthesized
actacatatcaaagaagaat

SEQ ID NO: 257425 - DNA, 20 bp, Artificial Sequence
  chemically synthesized
gagaaaactacatatcaaag

SEQ ID NO: 257426 - DNA, 20 bp, Artificial Sequence
  chemically synthesized
tctgattcttctttgatatg

SEQ ID NO: 257427 - DNA, 20 bp, Artificial Sequence
  chemically synthesized
actgagaaaactacatatca

SEQ ID NO: 257428 - DNA, 20 bp, Artificial Sequence
  chemically synthesized
tctttgatatgtagttttct

SEQ ID NO: 257429 - DNA, 20 bp, Artificial Sequence
  chemically synthesized
aaatgaaagtaatgaagact

SEQ ID NO: 257430 - DNA, 20 bp, Artificial Sequence
  chemically synthesized
catctcaaatgaaagtaatg

SEQ ID NO: 257431 - DNA, 20 bp, Artificial Sequence
  chemically synthesized
agtcttcattactttcattt

SEQ ID NO: 257432 - DNA, 20 bp, Artificial Sequence
  chemically synthesized
gctgagagcatctcaaatga

SEQ ID NO: 257433 - DNA, 20 bp, Artificial Sequence
  chemically synthesized
actttcatttgagatgctct

SEQ ID NO: 257434 - DNA, 20 bp, Artificial Sequence
  chemically synthesized
tatgaatttaagatagctga

SEQ ID NO: 257435 - DNA, 20 bp, Artificial Sequence
  chemically synthesized
aatatgaatttaagatagct

SEQ ID NO: 257436 - DNA, 20 bp, Artificial Sequence
  chemically synthesized
gcaccaatatgaatttaaga

SEQ ID NO: 257437 - DNA, 20 bp, Artificial Sequence
  chemically synthesized
ttaagcaccaatatgaattt

SEQ ID NO: 257438 - DNA, 20 bp, Artificial Sequence
  chemically synthesized
cagctatcttaaattcatat

SEQ ID NO: 257439 - DNA, 20 bp, Artificial Sequence
  chemically synthesized
ccacaattactatatttatt

SEQ ID NO: 257440 - DNA, 20 bp, Artificial Sequence
  chemically synthesized
atattggtgcttaataaata

SEQ ID NO: 257441 - DNA, 20 bp, Artificial Sequence
  chemically synthesized
cttaataaatatagtaattg

SEQ ID NO: 257442 - DNA, 20 bp, Artificial Sequence
  chemically synthesized
aatatagtaattgtggatta

SEQ ID NO: 257443 - DNA, 20 bp, Artificial Sequence
  chemically synthesized
tagtaattgtggattatagc

SEQ ID NO: 257444 - DNA, 20 bp, Artificial Sequence
  chemically synthesized
aattgtggattatagccagc

SEQ ID NO: 257445 - DNA, 20 bp, Artificial Sequence
  chemically synthesized
catacagctaagtttcttgc

SEQ ID NO: 257446 - DNA, 20 bp, Artificial Sequence
  chemically synthesized
attatagccagcaagaaact

SEQ ID NO: 257447 - DNA, 20 bp, Artificial Sequence
  chemically synthesized
cagcaagaaacttagctgta

SEQ ID NO: 257448 - DNA, 20 bp, Artificial Sequence
  chemically synthesized
ttatatttgaccatacagct

SEQ ID NO: 257449 - DNA, 20 bp, Artificial Sequence
  chemically synthesized
cttcattatatttgaccata

SEQ ID NO: 257450 - DNA, 20 bp, Artificial Sequence
  chemically synthesized
ctgtatggtcaaatataatg

SEQ ID NO: 257451 - DNA, 20 bp, Artificial Sequence
  chemically synthesized
ggtcaaatataatgaagaaa

SEQ ID NO: 257452 - DNA, 20 bp, Artificial Sequence
  chemically synthesized
gacaaaagtgagtatatttt

SEQ ID NO: 257453 - DNA, 20 bp, Artificial Sequence
  chemically synthesized
acaagttagcagacaaaagt

SEQ ID NO: 257454 - DNA, 20 bp, Artificial Sequence
  chemically synthesized
aaatacaagttagcagacaa

SEQ ID NO: 257455 - DNA, 20 bp, Artificial Sequence
  chemically synthesized
ggaagttaaatacaagttag

SEQ ID NO: 257456 - DNA, 20 bp, Artificial Sequence
  chemically synthesized
taaggaagttaaatacaagt

SEQ ID NO: 257457 - DNA, 20 bp, Artificial Sequence
  chemically synthesized
catttaaggaagttaaatac

SEQ ID NO: 257458 - DNA, 20 bp, Artificial Sequence
  chemically synthesized
gtttgaaatttcatttaagg

SEQ ID NO: 257459 - DNA, 20 bp, Artificial Sequence
  chemically synthesized
tgggtttgaaatttcattta

SEQ ID NO: 257460 - DNA, 20 bp, Artificial Sequence
  chemically synthesized
ttgggtttgaaatttcattt

SEQ ID NO: 257461 - DNA, 20 bp, Artificial Sequence
  chemically synthesized
taccaaaatagtcaaaattt

SEQ ID NO: 257462 - DNA, 20 bp, Artificial Sequence
  chemically synthesized
ataccaaaatagtcaaaatt

SEQ ID NO: 257463 - DNA, 20 bp, Artificial Sequence
  chemically synthesized
aacccaaattttgactattt

SEQ ID NO: 257464 - DNA, 20 bp, Artificial Sequence
  chemically synthesized
cctttctgcaaataccaaaa

SEQ ID NO: 257465 - DNA, 20 bp, Artificial Sequence
  chemically synthesized
tttgactattttggtatttg

SEQ ID NO: 257466 - DNA, 20 bp, Artificial Sequence
  chemically synthesized
actattttggtatttgcaga

SEQ ID NO: 257467 - DNA, 20 bp, Artificial Sequence
  chemically synthesized
ctattttggtatttgcagaa

SEQ ID NO: 257468 - DNA, 20 bp, Artificial Sequence
  chemically synthesized
aaggaacgttaaataaaaat

SEQ ID NO: 257469 - DNA, 20 bp, Artificial Sequence
  chemically synthesized
atgagatttgccaatgaatc

SEQ ID NO: 257470 - DNA, 20 bp, Artificial Sequence
  chemically synthesized
agaccagctcctggattcat

SEQ ID NO: 257471 - DNA, 20 bp, Artificial Sequence
  chemically synthesized
tgagatttgccaatgaatcc

SEQ ID NO: 257472 - DNA, 20 bp, Artificial Sequence
  chemically synthesized
agatttgccaatgaatccag

SEQ ID NO: 257473 - DNA, 20 bp, Artificial Sequence
  chemically synthesized
ttgccaatgaatccaggagc

SEQ ID NO: 257474 - DNA, 20 bp, Artificial Sequence
  chemically synthesized
cttttcaaaagaccagctcc

SEQ ID NO: 257475 - DNA, 20 bp, Artificial Sequence
  chemically synthesized
tgttaatcttttcaaaagac

SEQ ID NO: 257476 - DNA, 20 bp, Artificial Sequence
  chemically synthesized
ccaggagctggtcttttgaa

SEQ ID NO: 257477 - DNA, 20 bp, Artificial Sequence
  chemically synthesized
tattttgttaatcttttcaa

SEQ ID NO: 257478 - DNA, 20 bp, Artificial Sequence
  chemically synthesized
ttttgaaaagattaacaaaa

SEQ ID NO: 257479 - DNA, 20 bp, Artificial Sequence
  chemically synthesized
gaaaagattaacaaaataga

SEQ ID NO: 257480 - DNA, 20 bp, Artificial Sequence
  chemically synthesized
taacaaaatagatagaccac

SEQ ID NO: 257481 - DNA, 20 bp, Artificial Sequence
  chemically synthesized
aaaatagatagaccactagc

SEQ ID NO: 257482 - DNA, 20 bp, Artificial Sequence
  chemically synthesized
ttctttattagtctggctag

SEQ ID NO: 257483 - DNA, 20 bp, Artificial Sequence
  chemically synthesized
ttcttctttattagtctggc

SEQ ID NO: 257484 - DNA, 20 bp, Artificial Sequence
  chemically synthesized
tcttttcttctttattagtc

SEQ ID NO: 257485 - DNA, 20 bp, Artificial Sequence
  chemically synthesized
gaccactagccagactaata

SEQ ID NO: 257486 - DNA, 20 bp, Artificial Sequence
  chemically synthesized
cactagccagactaataaag

SEQ ID NO: 257487 - DNA, 20 bp, Artificial Sequence
  chemically synthesized
ttttctcttttcttctttat

SEQ ID NO: 257488 - DNA, 20 bp, Artificial Sequence
  chemically synthesized
gccagactaataaagaagaa

SEQ ID NO: 257489 - DNA, 20 bp, Artificial Sequence
  chemically synthesized
cagactaataaagaagaaaa

SEQ ID NO: 257490 - DNA, 20 bp, Artificial Sequence
  chemically synthesized
taataaagaagaaaagagaa

SEQ ID NO: 257491 - DNA, 20 bp, Artificial Sequence
  chemically synthesized
aagaaaagagaaaagaatca

SEQ ID NO: 257492 - DNA, 20 bp, Artificial Sequence
  chemically synthesized
gaaaagagaaaagaatcaaa

SEQ ID NO: 257493 - DNA, 20 bp, Artificial Sequence
  chemically synthesized
aaaagagaaaagaatcaaag

SEQ ID NO: 257494 - DNA, 20 bp, Artificial Sequence
  chemically synthesized
aggcacaataaaaaatgata

SEQ ID NO: 257495 - DNA, 20 bp, Artificial Sequence
  chemically synthesized
ggcacaataaaaaatgataa

SEQ ID NO: 257496 - DNA, 20 bp, Artificial Sequence
  chemically synthesized
gcacaataaaaaatgataaa

SEQ ID NO: 257497 - DNA, 20 bp, Artificial Sequence
  chemically synthesized
cacaataaaaaatgataaag

SEQ ID NO: 257498 - DNA, 20 bp, Artificial Sequence
  chemically synthesized
ttgtatttctgtgggatcgg

SEQ ID NO: 257499 - DNA, 20 bp, Artificial Sequence
  chemically synthesized
ggatatcaccaccgatccca

SEQ ID NO: 257500 - DNA, 20 bp, Artificial Sequence
  chemically synthesized
agtttgtatttctgtgggat

SEQ ID NO: 257501 - DNA, 20 bp, Artificial Sequence
  chemically synthesized
atggtagtttgtatttctgt

SEQ ID NO: 257502 - DNA, 20 bp, Artificial Sequence
  chemically synthesized
gatggtagtttgtatttctg

SEQ ID NO: 257503 - DNA, 20 bp, Artificial Sequence
  chemically synthesized
acagaaatacaaactaccat

SEQ ID NO: 257504 - DNA, 20 bp, Artificial Sequence
  chemically synthesized
agaaatacaaactaccatca

SEQ ID NO: 257505 - DNA, 20 bp, Artificial Sequence
  chemically synthesized
ttgatagtattctctgatgg

SEQ ID NO: 257506 - DNA, 20 bp, Artificial Sequence
  chemically synthesized
gtgttgatagtattctctga

SEQ ID NO: 257507 - DNA, 20 bp, Artificial Sequence
  chemically synthesized
tatttgcgtagaggtgttga

SEQ ID NO: 257508 - DNA, 20 bp, Artificial Sequence
  chemically synthesized
tttctagtttatttgcgtag

SEQ ID NO: 257509 - DNA, 20 bp, Artificial Sequence
  chemically synthesized
ttttctagtttatttgcgta

SEQ ID NO: 257510 - DNA, 20 bp, Artificial Sequence
  chemically synthesized
gattttctagtttatttgcg

SEQ ID NO: 257511 - DNA, 20 bp, Artificial Sequence
  chemically synthesized
acacctctacgcaaataaac

SEQ ID NO: 257512 - DNA, 20 bp, Artificial Sequence
  chemically synthesized
cgcaaataaactagaaaatc

SEQ ID NO: 257513 - DNA, 20 bp, Artificial Sequence
  chemically synthesized
tccattttttctagattttc

SEQ ID NO: 257514 - DNA, 20 bp, Artificial Sequence
  chemically synthesized
actagaaaatctagaaaaaa

SEQ ID NO: 257515 - DNA, 20 bp, Artificial Sequence
  chemically synthesized
aggaatttatccattttttc

SEQ ID NO: 257516 - DNA, 20 bp, Artificial Sequence
  chemically synthesized
agaaaaaatggataaattcc

SEQ ID NO: 257517 - DNA, 20 bp, Artificial Sequence
  chemically synthesized
ttgggagggtgtatgtgtcc

SEQ ID NO: 257518 - DNA, 20 bp, Artificial Sequence
  chemically synthesized
cttgggagggtgtatgtgtc

SEQ ID NO: 257519 - DNA, 20 bp, Artificial Sequence
  chemically synthesized
ctggacacatacaccctccc

SEQ ID NO: 257520 - DNA, 20 bp, Artificial Sequence
  chemically synthesized
ttcctggtttagtcttggga

SEQ ID NO: 257521 - DNA, 20 bp, Artificial Sequence
  chemically synthesized
cttcctggtttagtcttggg

SEQ ID NO: 257522 - DNA, 20 bp, Artificial Sequence
  chemically synthesized
tcttcctggtttagtcttgg

SEQ ID NO: 257523 - DNA, 20 bp, Artificial Sequence
  chemically synthesized
cttcttcctggtttagtctt

SEQ ID NO: 257524 - DNA, 20 bp, Artificial Sequence
  chemically synthesized
acttcttcctggtttagtct

SEQ ID NO: 257525 - DNA, 20 bp, Artificial Sequence
  chemically synthesized
acaccctcccaagactaaac

SEQ ID NO: 257526 - DNA, 20 bp, Artificial Sequence
  chemically synthesized
caccctcccaagactaaacc

SEQ ID NO: 257527 - DNA, 20 bp, Artificial Sequence
  chemically synthesized
cctcccaagactaaaccagg

SEQ ID NO: 257528 - DNA, 20 bp, Artificial Sequence
  chemically synthesized
gattcaacttcttcctggtt

SEQ ID NO: 257529 - DNA, 20 bp, Artificial Sequence
  chemically synthesized
cccaagactaaaccaggaag

SEQ ID NO: 257530 - DNA, 20 bp, Artificial Sequence
  chemically synthesized
tcagggattcaacttcttcc

SEQ ID NO: 257531 - DNA, 20 bp, Artificial Sequence
  chemically synthesized
gaagaagttgaatccctgaa

SEQ ID NO: 257532 - DNA, 20 bp, Artificial Sequence
  chemically synthesized
acttgttattggtctattca

SEQ ID NO: 257533 - DNA, 20 bp, Artificial Sequence
  chemically synthesized
aacttgttattggtctattc

SEQ ID NO: 257534 - DNA, 20 bp, Artificial Sequence
  chemically synthesized
gaacttgttattggtctatt

SEQ ID NO: 257535 - DNA, 20 bp, Artificial Sequence
  chemically synthesized
tccctgaatagaccaataac

SEQ ID NO: 257536 - DNA, 20 bp, Artificial Sequence
  chemically synthesized
tcaatttcagaacttgttat

SEQ ID NO: 257537 - DNA, 20 bp, Artificial Sequence
  chemically synthesized
caataacaagttctgaaatt

SEQ ID NO: 257538 - DNA, 20 bp, Artificial Sequence
  chemically synthesized
aataacaagttctgaaattg

SEQ ID NO: 257539 - DNA, 20 bp, Artificial Sequence
  chemically synthesized
ggctattactgcctcaattt

SEQ ID NO: 257540 - DNA, 20 bp, Artificial Sequence
  chemically synthesized
aacaagttctgaaattgagg

SEQ ID NO: 257541 - DNA, 20 bp, Artificial Sequence
  chemically synthesized
ttctgaaattgaggcagtaa

SEQ ID NO: 257542 - DNA, 20 bp, Artificial Sequence
  chemically synthesized
tttttttttttttggttcgt

SEQ ID NO: 257543 - DNA, 20 bp, Artificial Sequence
  chemically synthesized
ttttttttttttttggttcg

SEQ ID NO: 257544 - DNA, 20 bp, Artificial Sequence
  chemically synthesized
tttttttttttttttttttt

SEQ ID NO: 257545 - DNA, 20 bp, Artificial Sequence
  chemically synthesized
aaaaaaaaaaaaaaaaaaaa

SEQ ID NO: 257546 - DNA, 20 bp, Artificial Sequence
  chemically synthesized
aaaaaaaaaaaaaaaaagcc

SEQ ID NO: 257547 - DNA, 20 bp, Artificial Sequence
  chemically synthesized
aaaaaaaaaaaaaaaagccc

SEQ ID NO: 257548 - DNA, 20 bp, Artificial Sequence
  chemically synthesized
aaaaaaaaaaagcccaggac

SEQ ID NO: 257549 - DNA, 20 bp, Artificial Sequence
  chemically synthesized
ctgtgaatccgtctggtcct

SEQ ID NO: 257550 - DNA, 20 bp, Artificial Sequence
  chemically synthesized
gctgtgaatccgtctggtcc

SEQ ID NO: 257551 - DNA, 20 bp, Artificial Sequence
  chemically synthesized
aaaaaaagcccaggaccaga

SEQ ID NO: 257552 - DNA, 20 bp, Artificial Sequence
  chemically synthesized
aattcagctgtgaatccgtc

SEQ ID NO: 257553 - DNA, 20 bp, Artificial Sequence
  chemically synthesized
cccaggaccagacggattca

SEQ ID NO: 257554 - DNA, 20 bp, Artificial Sequence
  chemically synthesized
tttgtatctctggtagaatt

SEQ ID NO: 257555 - DNA, 20 bp, Artificial Sequence
  chemically synthesized
gattcacagctgaattctac

SEQ ID NO: 257556 - DNA, 20 bp, Artificial Sequence
  chemically synthesized
ttcacagctgaattctacca

SEQ ID NO: 257557 - DNA, 20 bp, Artificial Sequence
  chemically synthesized
gctcctctttgtatctctgg

SEQ ID NO: 257558 - DNA, 20 bp, Artificial Sequence
  chemically synthesized
ccagctcctctttgtatctc

SEQ ID NO: 257559 - DNA, 20 bp, Artificial Sequence
  chemically synthesized
tgaattctaccagagataca

SEQ ID NO: 257560 - DNA, 20 bp, Artificial Sequence
  chemically synthesized
aattctaccagagatacaaa

SEQ ID NO: 257561 - DNA, 20 bp, Artificial Sequence
  chemically synthesized
attctaccagagatacaaag

SEQ ID NO: 257562 - DNA, 20 bp, Artificial Sequence
  chemically synthesized
tctaccagagatacaaagag

SEQ ID NO: 257563 - DNA, 20 bp, Artificial Sequence
  chemically synthesized
ccagagatacaaagaggagc

SEQ ID NO: 257564 - DNA, 20 bp, Artificial Sequence
  chemically synthesized
agttttagagggaatggtac

SEQ ID NO: 257565 - DNA, 20 bp, Artificial Sequence
  chemically synthesized
tggaatagttttagagggaa

SEQ ID NO: 257566 - DNA, 20 bp, Artificial Sequence
  chemically synthesized
ttgcttggaatagttttaga

SEQ ID NO: 257567 - DNA, 20 bp, Artificial Sequence
  chemically synthesized
attgcttggaatagttttag

SEQ ID NO: 257568 - DNA, 20 bp, Artificial Sequence
  chemically synthesized
tattgcttggaatagtttta

SEQ ID NO: 257569 - DNA, 20 bp, Artificial Sequence
  chemically synthesized
tgtattgcttggaatagttt

SEQ ID NO: 257570 - DNA, 20 bp, Artificial Sequence
  chemically synthesized
attccctctaaaactattcc

SEQ ID NO: 257571 - DNA, 20 bp, Artificial Sequence
  chemically synthesized
ttcttttgtattgcttggaa

SEQ ID NO: 257572 - DNA, 20 bp, Artificial Sequence
  chemically synthesized
ttattttcttttgtattgct

SEQ ID NO: 257573 - DNA, 20 bp, Artificial Sequence
  chemically synthesized
aactattccaagcaatacaa

SEQ ID NO: 257574 - DNA, 20 bp, Artificial Sequence
  chemically synthesized
cctcataaaaagagttaggg

SEQ ID NO: 257575 - DNA, 20 bp, Artificial Sequence
  chemically synthesized
tggcctcataaaaagagtta

SEQ ID NO: 257576 - DNA, 20 bp, Artificial Sequence
  chemically synthesized
ctggcctcataaaaagagtt

SEQ ID NO: 257577 - DNA, 20 bp, Artificial Sequence
  chemically synthesized
gctggcctcataaaaagagt

SEQ ID NO: 257578 - DNA, 20 bp, Artificial Sequence
  chemically synthesized
tcttccctaactctttttat

SEQ ID NO: 257579 - DNA, 20 bp, Artificial Sequence
  chemically synthesized
tgctgctggcctcataaaaa

SEQ ID NO: 257580 - DNA, 20 bp, Artificial Sequence
  chemically synthesized
cttccctaactctttttatg

SEQ ID NO: 257581 - DNA, 20 bp, Artificial Sequence
  chemically synthesized
gatgctgctggcctcataaa

SEQ ID NO: 257582 - DNA, 20 bp, Artificial Sequence
  chemically synthesized
cctaactctttttatgaggc

SEQ ID NO: 257583 - DNA, 20 bp, Artificial Sequence
  chemically synthesized
aactctttttatgaggccag

SEQ ID NO: 257584 - DNA, 20 bp, Artificial Sequence
  chemically synthesized
ttttggtatcaggatgctgc

SEQ ID NO: 257585 - DNA, 20 bp, Artificial Sequence
  chemically synthesized
ctttgccaggttttggtatc

SEQ ID NO: 257586 - DNA, 20 bp, Artificial Sequence
  chemically synthesized
tctttgccaggttttggtat

SEQ ID NO: 257587 - DNA, 20 bp, Artificial Sequence
  chemically synthesized
agcatcctgataccaaaacc

SEQ ID NO: 257588 - DNA, 20 bp, Artificial Sequence
  chemically synthesized
gttgtgtctttgccaggttt

SEQ ID NO: 257589 - DNA, 20 bp, Artificial Sequence
  chemically synthesized
cctgataccaaaacctggca

SEQ ID NO: 257590 - DNA, 20 bp, Artificial Sequence
  chemically synthesized
ttttttgttgtgtctttgcc

SEQ ID NO: 257591 - DNA, 20 bp, Artificial Sequence
  chemically synthesized
cttttttgttgtgtctttgc

SEQ ID NO: 257592 - DNA, 20 bp, Artificial Sequence
  chemically synthesized
ctggcaaagacacaacaaaa

SEQ ID NO: 257593 - DNA, 20 bp, Artificial Sequence
  chemically synthesized
ggtttgccagtattttattg

SEQ ID NO: 257594 - DNA, 20 bp, Artificial Sequence
  chemically synthesized
tggtttgccagtattttatt

SEQ ID NO: 257595 - DNA, 20 bp, Artificial Sequence
  chemically synthesized
gaaaatcctcaataaaatac

SEQ ID NO: 257596 - DNA, 20 bp, Artificial Sequence
  chemically synthesized
tgctactggatttggtttgc

SEQ ID NO: 257597 - DNA, 20 bp, Artificial Sequence
  chemically synthesized
aaatactggcaaaccaaatc

SEQ ID NO: 257598 - DNA, 20 bp, Artificial Sequence
  chemically synthesized
tactggcaaaccaaatccag

SEQ ID NO: 257599 - DNA, 20 bp, Artificial Sequence
  chemically synthesized
ttttaatgtgctactggatt

SEQ ID NO: 257600 - DNA, 20 bp, Artificial Sequence
  chemically synthesized
tatgctttttaatgtgctac

SEQ ID NO: 257601 - DNA, 20 bp, Artificial Sequence
  chemically synthesized
aaatccagtagcacattaaa

SEQ ID NO: 257602 - DNA, 20 bp, Artificial Sequence
  chemically synthesized
tgaagcctacttgattgtga

SEQ ID NO: 257603 - DNA, 20 bp, Artificial Sequence
  chemically synthesized
aaagcatatccatcacaatc

SEQ ID NO: 257604 - DNA, 20 bp, Artificial Sequence
  chemically synthesized
gcatatccatcacaatcaag

SEQ ID NO: 257605 - DNA, 20 bp, Artificial Sequence
  chemically synthesized
catatccatcacaatcaagt

SEQ ID NO: 257606 - DNA, 20 bp, Artificial Sequence
  chemically synthesized
aatcaagtaggcttcatccc

SEQ ID NO: 257607 - DNA, 20 bp, Artificial Sequence
  chemically synthesized
atcaagtaggcttcatccct

SEQ ID NO: 257608 - DNA, 20 bp, Artificial Sequence
  chemically synthesized
agctttgcatcccagggatg

SEQ ID NO: 257609 - DNA, 20 bp, Artificial Sequence
  chemically synthesized
tgaaccagctttgcatccca

SEQ ID NO: 257610 - DNA, 20 bp, Artificial Sequence
  chemically synthesized
ttgaaccagctttgcatccc

SEQ ID NO: 257611 - DNA, 20 bp, Artificial Sequence
  chemically synthesized
ggcttcatccctgggatgca

SEQ ID NO: 257612 - DNA, 20 bp, Artificial Sequence
  chemically synthesized
gttgaaccagctttgcatcc

SEQ ID NO: 257613 - DNA, 20 bp, Artificial Sequence
  chemically synthesized
tcatccctgggatgcaaagc

SEQ ID NO: 257614 - DNA, 20 bp, Artificial Sequence
  chemically synthesized
ttgatttgcgtatgttgaac

SEQ ID NO: 257615 - DNA, 20 bp, Artificial Sequence
  chemically synthesized
attggttctgtttatgtgat

SEQ ID NO: 257616 - DNA, 20 bp, Artificial Sequence
  chemically synthesized
cattggttctgtttatgtga

SEQ ID NO: 257617 - DNA, 20 bp, Artificial Sequence
  chemically synthesized
aatgtaacccatcacataaa

SEQ ID NO: 257618 - DNA, 20 bp, Artificial Sequence
  chemically synthesized
catgtggtttttttggtcat

SEQ ID NO: 257619 - DNA, 20 bp, Artificial Sequence
  chemically synthesized
agataatcatgtggtttttt

SEQ ID NO: 257620 - DNA, 20 bp, Artificial Sequence
  chemically synthesized
catctattgagataatcatg

SEQ ID NO: 257621 - DNA, 20 bp, Artificial Sequence
  chemically synthesized
aaaccacatgattatctcaa

SEQ ID NO: 257622 - DNA, 20 bp, Artificial Sequence
  chemically synthesized
agaccttttctgcatctatt

SEQ ID NO: 257623 - DNA, 20 bp, Artificial Sequence
  chemically synthesized
catgattatctcaatagatg

SEQ ID NO: 257624 - DNA, 20 bp, Artificial Sequence
  chemically synthesized
ttatctcaatagatgcagaa

SEQ ID NO: 257625 - DNA, 20 bp, Artificial Sequence
  chemically synthesized
tatctcaatagatgcagaaa

SEQ ID NO: 257626 - DNA, 20 bp, Artificial Sequence
  chemically synthesized
aatagatgcagaaaaggtct

SEQ ID NO: 257627 - DNA, 20 bp, Artificial Sequence
  chemically synthesized
aaagggtgttgaatttatcc

SEQ ID NO: 257628 - DNA, 20 bp, Artificial Sequence
  chemically synthesized
tgagtgtttttaacatgaaa

SEQ ID NO: 257629 - DNA, 20 bp, Artificial Sequence
  chemically synthesized
ttgagtgtttttaacatgaa

SEQ ID NO: 257630 - DNA, 20 bp, Artificial Sequence
  chemically synthesized
attgagtgtttttaacatga

SEQ ID NO: 257631 - DNA, 20 bp, Artificial Sequence
  chemically synthesized
gttaaaaacactcaataaac

SEQ ID NO: 257632 - DNA, 20 bp, Artificial Sequence
  chemically synthesized
ccatcaataactagtttatt

SEQ ID NO: 257633 - DNA, 20 bp, Artificial Sequence
  chemically synthesized
agatttgtcccatcaataac

SEQ ID NO: 257634 - DNA, 20 bp, Artificial Sequence
  chemically synthesized
ctcaataaactagttattga

SEQ ID NO: 257635 - DNA, 20 bp, Artificial Sequence
  chemically synthesized
tcaataaactagttattgat

SEQ ID NO: 257636 - DNA, 20 bp, Artificial Sequence
  chemically synthesized
taaatagctcttaatatttt

SEQ ID NO: 257637 - DNA, 20 bp, Artificial Sequence
  chemically synthesized
gggacaaatctcaaaatatt

SEQ ID NO: 257638 - DNA, 20 bp, Artificial Sequence
  chemically synthesized
gacaaatctcaaaatattaa

SEQ ID NO: 257639 - DNA, 20 bp, Artificial Sequence
  chemically synthesized
ggctgtgggtttgtcataaa

SEQ ID NO: 257640 - DNA, 20 bp, Artificial Sequence
  chemically synthesized
agctatttatgacaaaccca

SEQ ID NO: 257641 - DNA, 20 bp, Artificial Sequence
  chemically synthesized
atttatgacaaacccacagc

SEQ ID NO: 257642 - DNA, 20 bp, Artificial Sequence
  chemically synthesized
ttcagtatgatactggctgt

SEQ ID NO: 257643 - DNA, 20 bp, Artificial Sequence
  chemically synthesized
attcagtatgatactggctg

SEQ ID NO: 257644 - DNA, 20 bp, Artificial Sequence
  chemically synthesized
ttgcccattcagtatgatac

SEQ ID NO: 257645 - DNA, 20 bp, Artificial Sequence
  chemically synthesized
acagccagtatcatactgaa

SEQ ID NO: 257646 - DNA, 20 bp, Artificial Sequence
  chemically synthesized
cagccagtatcatactgaat

SEQ ID NO: 257647 - DNA, 20 bp, Artificial Sequence
  chemically synthesized
gcttctagcttttgcccatt

SEQ ID NO: 257648 - DNA, 20 bp, Artificial Sequence
  chemically synthesized
gtatcatactgaatgggcaa

SEQ ID NO: 257649 - DNA, 20 bp, Artificial Sequence
  chemically synthesized
catactgaatgggcaaaagc

SEQ ID NO: 257650 - DNA, 20 bp, Artificial Sequence
  chemically synthesized
actgaatgggcaaaagctag

SEQ ID NO: 257651 - DNA, 20 bp, Artificial Sequence
  chemically synthesized
gttttcaaagggaatgcttc

SEQ ID NO: 257652 - DNA, 20 bp, Artificial Sequence
  chemically synthesized
gtcttgtgccagttttcaaa

SEQ ID NO: 257653 - DNA, 20 bp, Artificial Sequence
  chemically synthesized
tgtcttgtgccagttttcaa

SEQ ID NO: 257654 - DNA, 20 bp, Artificial Sequence
  chemically synthesized
gaagcattccctttgaaaac

SEQ ID NO: 257655 - DNA, 20 bp, Artificial Sequence
  chemically synthesized
ttgtcttgtgccagttttca

SEQ ID NO: 257656 - DNA, 20 bp, Artificial Sequence
  chemically synthesized
ttccctttgaaaactggcac

SEQ ID NO: 257657 - DNA, 20 bp, Artificial Sequence
  chemically synthesized
agggcatccttgtcttgtgc

SEQ ID NO: 257658 - DNA, 20 bp, Artificial Sequence
  chemically synthesized
tttgaaaactggcacaagac

SEQ ID NO: 257659 - DNA, 20 bp, Artificial Sequence
  chemically synthesized
ttgaaaactggcacaagaca

SEQ ID NO: 257660 - DNA, 20 bp, Artificial Sequence
  chemically synthesized
tgaataggagtggtgagaga

SEQ ID NO: 257661 - DNA, 20 bp, Artificial Sequence
  chemically synthesized
ttgaataggagtggtgagag

SEQ ID NO: 257662 - DNA, 20 bp, Artificial Sequence
  chemically synthesized
gttgaataggagtggtgaga

SEQ ID NO: 257663 - DNA, 20 bp, Artificial Sequence
  chemically synthesized
atgttgaataggagtggtga

SEQ ID NO: 257664 - DNA, 20 bp, Artificial Sequence
  chemically synthesized
ctatgttgaataggagtggt

SEQ ID NO: 257665 - DNA, 20 bp, Artificial Sequence
  chemically synthesized
aatactatgttgaataggag

SEQ ID NO: 257666 - DNA, 20 bp, Artificial Sequence
  chemically synthesized
tccaatactatgttgaatag

SEQ ID NO: 257667 - DNA, 20 bp, Artificial Sequence
  chemically synthesized
cttccaatactatgttgaat

SEQ ID NO: 257668 - DNA, 20 bp, Artificial Sequence
  chemically synthesized
ctcaccactcctattcaaca

SEQ ID NO: 257669 - DNA, 20 bp, Artificial Sequence
  chemically synthesized
acttccaatactatgttgaa

SEQ ID NO: 257670 - DNA, 20 bp, Artificial Sequence
  chemically synthesized
actcctattcaacatagtat

SEQ ID NO: 257671 - DNA, 20 bp, Artificial Sequence
  chemically synthesized
cctattcaacatagtattgg

SEQ ID NO: 257672 - DNA, 20 bp, Artificial Sequence
  chemically synthesized
caacatagtattggaagtcc

SEQ ID NO: 257673 - DNA, 20 bp, Artificial Sequence
  chemically synthesized
atagtattggaagtcctggc

SEQ ID NO: 257674 - DNA, 20 bp, Artificial Sequence
  chemically synthesized
tagtattggaagtcctggcc

SEQ ID NO: 257675 - DNA, 20 bp, Artificial Sequence
  chemically synthesized
agtattggaagtcctggcca

SEQ ID NO: 257676 - DNA, 20 bp, Artificial Sequence
  chemically synthesized
cttgcctgattgccctggcc

SEQ ID NO: 257677 - DNA, 20 bp, Artificial Sequence
  chemically synthesized
tcttgcctgattgccctggc

SEQ ID NO: 257678 - DNA, 20 bp, Artificial Sequence
  chemically synthesized
gaagtcctggccagggcaat

SEQ ID NO: 257679 - DNA, 20 bp, Artificial Sequence
  chemically synthesized
tttctcttgcctgattgccc

SEQ ID NO: 257680 - DNA, 20 bp, Artificial Sequence
  chemically synthesized
aagtcctggccagggcaatc

SEQ ID NO: 257681 - DNA, 20 bp, Artificial Sequence
  chemically synthesized
cctggccagggcaatcaggc

SEQ ID NO: 257682 - DNA, 20 bp, Artificial Sequence
  chemically synthesized
tggccagggcaatcaggcaa

SEQ ID NO: 257683 - DNA, 20 bp, Artificial Sequence
  chemically synthesized
cagggcaatcaggcaagaga

SEQ ID NO: 257684 - DNA, 20 bp, Artificial Sequence
  chemically synthesized
gcaatcaggcaagagaaaga

SEQ ID NO: 257685 - DNA, 20 bp, Artificial Sequence
  chemically synthesized
tcaggcaagagaaagaaaga

SEQ ID NO: 257686 - DNA, 20 bp, Artificial Sequence
  chemically synthesized
aagaaagaaagatattcaaa

SEQ ID NO: 257687 - DNA, 20 bp, Artificial Sequence
  chemically synthesized
agaaagaaagatattcaaat

SEQ ID NO: 257688 - DNA, 20 bp, Artificial Sequence
  chemically synthesized
aagaaagatattcaaatagg

SEQ ID NO: 257689 - DNA, 20 bp, Artificial Sequence
  chemically synthesized
gaaagatattcaaataggaa

SEQ ID NO: 257690 - DNA, 20 bp, Artificial Sequence
  chemically synthesized
aagatattcaaataggaaga

SEQ ID NO: 257691 - DNA, 20 bp, Artificial Sequence
  chemically synthesized
agatattcaaataggaagag

SEQ ID NO: 257692 - DNA, 20 bp, Artificial Sequence
  chemically synthesized
tattcaaataggaagagagg

SEQ ID NO: 257693 - DNA, 20 bp, Artificial Sequence
  chemically synthesized
agtcaaattatctctgtttg

SEQ ID NO: 257694 - DNA, 20 bp, Artificial Sequence
  chemically synthesized
aatcatgtcatctgcaaaca

SEQ ID NO: 257695 - DNA, 20 bp, Artificial Sequence
  chemically synthesized
acaatcatgtcatctgcaaa

SEQ ID NO: 257696 - DNA, 20 bp, Artificial Sequence
  chemically synthesized
agatgacatgattgtatatt

SEQ ID NO: 257697 - DNA, 20 bp, Artificial Sequence
  chemically synthesized
gtttttgggctgagacgatg

SEQ ID NO: 257698 - DNA, 20 bp, Artificial Sequence
  chemically synthesized
tttagaaaaccccatcgtct

SEQ ID NO: 257699 - DNA, 20 bp, Artificial Sequence
  chemically synthesized
agtttttgggctgagacgat

SEQ ID NO: 257700 - DNA, 20 bp, Artificial Sequence
  chemically synthesized
gagtttttgggctgagacga

SEQ ID NO: 257701 - DNA, 20 bp, Artificial Sequence
  chemically synthesized
gcttaaagagtttttgggct

SEQ ID NO: 257702 - DNA, 20 bp, Artificial Sequence
  chemically synthesized
tatcagcttaaagagttttt

SEQ ID NO: 257703 - DNA, 20 bp, Artificial Sequence
  chemically synthesized
ttatcagcttaaagagtttt

SEQ ID NO: 257704 - DNA, 20 bp, Artificial Sequence
  chemically synthesized
tctcagcccaaaaactcttt

SEQ ID NO: 257705 - DNA, 20 bp, Artificial Sequence
  chemically synthesized
aagttgcttatcagcttaaa

SEQ ID NO: 257706 - DNA, 20 bp, Artificial Sequence
  chemically synthesized
tgaagttgcttatcagctta

SEQ ID NO: 257707 - DNA, 20 bp, Artificial Sequence
  chemically synthesized
caaaaactctttaagctgat

SEQ ID NO: 257708 - DNA, 20 bp, Artificial Sequence
  chemically synthesized
actttgctgaagttgcttat

SEQ ID NO: 257709 - DNA, 20 bp, Artificial Sequence
  chemically synthesized
tttaagctgataagcaactt

SEQ ID NO: 257710 - DNA, 20 bp, Artificial Sequence
  chemically synthesized
gctgataagcaacttcagca

SEQ ID NO: 257711 - DNA, 20 bp, Artificial Sequence
  chemically synthesized
tgtatcctgagactttgctg

SEQ ID NO: 257712 - DNA, 20 bp, Artificial Sequence
  chemically synthesized
aagcaacttcagcaaagtct

SEQ ID NO: 257713 - DNA, 20 bp, Artificial Sequence
  chemically synthesized
agcaacttcagcaaagtctc

SEQ ID NO: 257714 - DNA, 20 bp, Artificial Sequence
  chemically synthesized
gcacgttgattttgtatcct

SEQ ID NO: 257715 - DNA, 20 bp, Artificial Sequence
  chemically synthesized
aatcaacgtgcaaaaatcac

SEQ ID NO: 257716 - DNA, 20 bp, Artificial Sequence
  chemically synthesized
tctgtctgttattggtttat

SEQ ID NO: 257717 - DNA, 20 bp, Artificial Sequence
  chemically synthesized
ctctgtctgttattggttta

SEQ ID NO: 257718 - DNA, 20 bp, Artificial Sequence
  chemically synthesized
gcattcctataaaccaataa

SEQ ID NO: 257719 - DNA, 20 bp, Artificial Sequence
  chemically synthesized
tttggctctctgtctgttat

SEQ ID NO: 257720 - DNA, 20 bp, Artificial Sequence
  chemically synthesized
tcctataaaccaataacaga

SEQ ID NO: 257721 - DNA, 20 bp, Artificial Sequence
  chemically synthesized
ctataaaccaataacagaca

SEQ ID NO: 257722 - DNA, 20 bp, Artificial Sequence
  chemically synthesized
ataaaccaataacagacaga

SEQ ID NO: 257723 - DNA, 20 bp, Artificial Sequence
  chemically synthesized
cagacagagagccaaataat

SEQ ID NO: 257724 - DNA, 20 bp, Artificial Sequence
  chemically synthesized
atgggagttctctcattatt

SEQ ID NO: 257725 - DNA, 20 bp, Artificial Sequence
  chemically synthesized
gacagagagccaaataatga

SEQ ID NO: 257726 - DNA, 20 bp, Artificial Sequence
  chemically synthesized
tttgtagcaatttttaatgg

SEQ ID NO: 257727 - DNA, 20 bp, Artificial Sequence
  chemically synthesized
tctttgtagcaatttttaat

SEQ ID NO: 257728 - DNA, 20 bp, Artificial Sequence
  chemically synthesized
ctctttgtagcaatttttaa

SEQ ID NO: 257729 - DNA, 20 bp, Artificial Sequence
  chemically synthesized
tcccattaaaaattgctaca

SEQ ID NO: 257730 - DNA, 20 bp, Artificial Sequence
  chemically synthesized
ccattaaaaattgctacaaa

SEQ ID NO: 257731 - DNA, 20 bp, Artificial Sequence
  chemically synthesized
taggtattttattctctttg

SEQ ID NO: 257732 - DNA, 20 bp, Artificial Sequence
  chemically synthesized
tacaaagagaataaaatacc

SEQ ID NO: 257733 - DNA, 20 bp, Artificial Sequence
  chemically synthesized
acaaagagaataaaatacct

SEQ ID NO: 257734 - DNA, 20 bp, Artificial Sequence
  chemically synthesized
cccttgcaagttgtattcct

SEQ ID NO: 257735 - DNA, 20 bp, Artificial Sequence
  chemically synthesized
tcccttgcaagttgtattcc

SEQ ID NO: 257736 - DNA, 20 bp, Artificial Sequence
  chemically synthesized
tacctaggaatacaacttgc

SEQ ID NO: 257737 - DNA, 20 bp, Artificial Sequence
  chemically synthesized
acctaggaatacaacttgca

SEQ ID NO: 257738 - DNA, 20 bp, Artificial Sequence
  chemically synthesized
cctaggaatacaacttgcaa

SEQ ID NO: 257739 - DNA, 20 bp, Artificial Sequence
  chemically synthesized
aggcccttcacatcccttgc

SEQ ID NO: 257740 - DNA, 20 bp, Artificial Sequence
  chemically synthesized
tacaacttgcaagggatgtg

SEQ ID NO: 257741 - DNA, 20 bp, Artificial Sequence
  chemically synthesized
acaacttgcaagggatgtga

SEQ ID NO: 257742 - DNA, 20 bp, Artificial Sequence
  chemically synthesized
caacttgcaagggatgtgaa

SEQ ID NO: 257743 - DNA, 20 bp, Artificial Sequence
  chemically synthesized
gggatgtgaagggcctcttc

SEQ ID NO: 257744 - DNA, 20 bp, Artificial Sequence
  chemically synthesized
ggatgtgaagggcctcttca

SEQ ID NO: 257745 - DNA, 20 bp, Artificial Sequence
  chemically synthesized
atgtgaagggcctcttcaag

SEQ ID NO: 257746 - DNA, 20 bp, Artificial Sequence
  chemically synthesized
gtttgtagttctccttgaag

SEQ ID NO: 257747 - DNA, 20 bp, Artificial Sequence
  chemically synthesized
ggtttgtagttctccttgaa

SEQ ID NO: 257748 - DNA, 20 bp, Artificial Sequence
  chemically synthesized
gtggtttgtagttctccttg

SEQ ID NO: 257749 - DNA, 20 bp, Artificial Sequence
  chemically synthesized
tttccttgagcagtggtttg

SEQ ID NO: 257750 - DNA, 20 bp, Artificial Sequence
  chemically synthesized
agaactacaaaccactgctc

SEQ ID NO: 257751 - DNA, 20 bp, Artificial Sequence
  chemically synthesized
gaactacaaaccactgctca

SEQ ID NO: 257752 - DNA, 20 bp, Artificial Sequence
  chemically synthesized
tctcttatttccttgagcag

SEQ ID NO: 257753 - DNA, 20 bp, Artificial Sequence
  chemically synthesized
tcctctcttatttccttgag

SEQ ID NO: 257754 - DNA, 20 bp, Artificial Sequence
  chemically synthesized
gggtcctctcttatttcctt

SEQ ID NO: 257755 - DNA, 20 bp, Artificial Sequence
  chemically synthesized
aaaccactgctcaaggaaat

SEQ ID NO: 257756 - DNA, 20 bp, Artificial Sequence
  chemically synthesized
accactgctcaaggaaataa

SEQ ID NO: 257757 - DNA, 20 bp, Artificial Sequence
  chemically synthesized
cactgctcaaggaaataaga

SEQ ID NO: 257758 - DNA, 20 bp, Artificial Sequence
  chemically synthesized
actgctcaaggaaataagag

SEQ ID NO: 257759 - DNA, 20 bp, Artificial Sequence
  chemically synthesized
taagagaggacccaaacaaa

SEQ ID NO: 257760 - DNA, 20 bp, Artificial Sequence
  chemically synthesized
gaatgtttttccatttgttt

SEQ ID NO: 257761 - DNA, 20 bp, Artificial Sequence
  chemically synthesized
ggaatgtttttccatttgtt

SEQ ID NO: 257762 - DNA, 20 bp, Artificial Sequence
  chemically synthesized
ggaaaaacattccatgctta

SEQ ID NO: 257763 - DNA, 20 bp, Artificial Sequence
  chemically synthesized
attcttcctttccataagca

SEQ ID NO: 257764 - DNA, 20 bp, Artificial Sequence
  chemically synthesized
aaacattccatgcttatgga

SEQ ID NO: 257765 - DNA, 20 bp, Artificial Sequence
  chemically synthesized
aacattccatgcttatggaa

SEQ ID NO: 257766 - DNA, 20 bp, Artificial Sequence
  chemically synthesized
tattgattcttcctttccat

SEQ ID NO: 257767 - DNA, 20 bp, Artificial Sequence
  chemically synthesized
attccatgcttatggaaagg

SEQ ID NO: 257768 - DNA, 20 bp, Artificial Sequence
  chemically synthesized
aagaatcaataacatgaaaa

SEQ ID NO: 257769 - DNA, 20 bp, Artificial Sequence
  chemically synthesized
caataacatgaaaatggcca

SEQ ID NO: 257770 - DNA, 20 bp, Artificial Sequence
  chemically synthesized
ataaattactttgggcgcta

SEQ ID NO: 257771 - DNA, 20 bp, Artificial Sequence
  chemically synthesized
gaaaatggccatagcgccca

SEQ ID NO: 257772 - DNA, 20 bp, Artificial Sequence
  chemically synthesized
ttgaatctataaattacttt

SEQ ID NO: 257773 - DNA, 20 bp, Artificial Sequence
  chemically synthesized
attgaatctataaattactt

SEQ ID NO: 257774 - DNA, 20 bp, Artificial Sequence
  chemically synthesized
atagcgcccaaagtaattta

SEQ ID NO: 257775 - DNA, 20 bp, Artificial Sequence
  chemically synthesized
caatggtagcttgatgggag

SEQ ID NO: 257776 - DNA, 20 bp, Artificial Sequence
  chemically synthesized
gattcaatgctactcccatc

SEQ ID NO: 257777 - DNA, 20 bp, Artificial Sequence
  chemically synthesized
agtcaatggtagcttgatgg

SEQ ID NO: 257778 - DNA, 20 bp, Artificial Sequence
  chemically synthesized
aaagtcaatggtagcttgat

SEQ ID NO: 257779 - DNA, 20 bp, Artificial Sequence
  chemically synthesized
gaaagtcaatggtagcttga

SEQ ID NO: 257780 - DNA, 20 bp, Artificial Sequence
  chemically synthesized
tctgtgaagaaagtcaatgg

SEQ ID NO: 257781 - DNA, 20 bp, Artificial Sequence
  chemically synthesized
aattctgtgaagaaagtcaa

SEQ ID NO: 257782 - DNA, 20 bp, Artificial Sequence
  chemically synthesized
gctaccattgactttcttca

SEQ ID NO: 257783 - DNA, 20 bp, Artificial Sequence
  chemically synthesized
ttgttctaattctgtgaaga

SEQ ID NO: 257784 - DNA, 20 bp, Artificial Sequence
  chemically synthesized
tagtttgttctaattctgtg

SEQ ID NO: 257785 - DNA, 20 bp, Artificial Sequence
  chemically synthesized
attgactttcttcacagaat

SEQ ID NO: 257786 - DNA, 20 bp, Artificial Sequence
  chemically synthesized
gttccatatgaaatgtaaag

SEQ ID NO: 257787 - DNA, 20 bp, Artificial Sequence
  chemically synthesized
ttggttccatatgaaatgta

SEQ ID NO: 257788 - DNA, 20 bp, Artificial Sequence
  chemically synthesized
aaactactttacatttcata

SEQ ID NO: 257789 - DNA, 20 bp, Artificial Sequence
  chemically synthesized
catttcatatggaaccaaaa

SEQ ID NO: 257790 - DNA, 20 bp, Artificial Sequence
  chemically synthesized
atttcatatggaaccaaaaa

SEQ ID NO: 257791 - DNA, 20 bp, Artificial Sequence
  chemically synthesized
tttcatatggaaccaaaaaa

SEQ ID NO: 257792 - DNA, 20 bp, Artificial Sequence
  chemically synthesized
tggctatatgggcccttttt

SEQ ID NO: 257793 - DNA, 20 bp, Artificial Sequence
  chemically synthesized
gaaccaaaaaagggcccata

SEQ ID NO: 257794 - DNA, 20 bp, Artificial Sequence
  chemically synthesized
taggattttcttggctatat

SEQ ID NO: 257795 - DNA, 20 bp, Artificial Sequence
  chemically synthesized
aaaaaagggcccatatagcc

SEQ ID NO: 257796 - DNA, 20 bp, Artificial Sequence
  chemically synthesized
ttaggattttcttggctata

SEQ ID NO: 257797 - DNA, 20 bp, Artificial Sequence
  chemically synthesized
attcttgcttaggattttct

SEQ ID NO: 257798 - DNA, 20 bp, Artificial Sequence
  chemically synthesized
catatagccaagaaaatcct

SEQ ID NO: 257799 - DNA, 20 bp, Artificial Sequence
  chemically synthesized
tagccaagaaaatcctaagc

SEQ ID NO: 257800 - DNA, 20 bp, Artificial Sequence
  chemically synthesized
cagctttgttattcttgctt

SEQ ID NO: 257801 - DNA, 20 bp, Artificial Sequence
  chemically synthesized
ccagctttgttattcttgct

SEQ ID NO: 257802 - DNA, 20 bp, Artificial Sequence
  chemically synthesized
aatcctaagcaagaataaca

SEQ ID NO: 257803 - DNA, 20 bp, Artificial Sequence
  chemically synthesized
ctaagcaagaataacaaagc

SEQ ID NO: 257804 - DNA, 20 bp, Artificial Sequence
  chemically synthesized
aagcaagaataacaaagctg

SEQ ID NO: 257805 - DNA, 20 bp, Artificial Sequence
  chemically synthesized
agcaagaataacaaagctgg

SEQ ID NO: 257806 - DNA, 20 bp, Artificial Sequence
  chemically synthesized
gtcaggtagcgtgatgcctc

SEQ ID NO: 257807 - DNA, 20 bp, Artificial Sequence
  chemically synthesized
tagtatagtttgaagtcagg

SEQ ID NO: 257808 - DNA, 20 bp, Artificial Sequence
  chemically synthesized
ttatagtatagtttgaagtc

SEQ ID NO: 257809 - DNA, 20 bp, Artificial Sequence
  chemically synthesized
attatagtatagtttgaagt

SEQ ID NO: 257810 - DNA, 20 bp, Artificial Sequence
  chemically synthesized
tagcattatagtatagtttg

SEQ ID NO: 257811 - DNA, 20 bp, Artificial Sequence
  chemically synthesized
gttactgtagcattatagta

SEQ ID NO: 257812 - DNA, 20 bp, Artificial Sequence
  chemically synthesized
ttttggttactgtagcatta

SEQ ID NO: 257813 - DNA, 20 bp, Artificial Sequence
  chemically synthesized
caaactatactataatgcta

SEQ ID NO: 257814 - DNA, 20 bp, Artificial Sequence
  chemically synthesized
ataatctgttttggttactg

SEQ ID NO: 257815 - DNA, 20 bp, Artificial Sequence
  chemically synthesized
taatgctacagtaaccaaaa

SEQ ID NO: 257816 - DNA, 20 bp, Artificial Sequence
  chemically synthesized
gctatcagtataatctgttt

SEQ ID NO: 257817 - DNA, 20 bp, Artificial Sequence
  chemically synthesized
accaaaacagattatactga

SEQ ID NO: 257818 - DNA, 20 bp, Artificial Sequence
  chemically synthesized
ctatatatctgttttgctat

SEQ ID NO: 257819 - DNA, 20 bp, Artificial Sequence
  chemically synthesized
agattatactgatagcaaaa

SEQ ID NO: 257820 - DNA, 20 bp, Artificial Sequence
  chemically synthesized
ctgatagcaaaacagatata

SEQ ID NO: 257821 - DNA, 20 bp, Artificial Sequence
  chemically synthesized
aaaacagatatatagaccaa

SEQ ID NO: 257822 - DNA, 20 bp, Artificial Sequence
  chemically synthesized
agatatatagaccaacggaa

SEQ ID NO: 257823 - DNA, 20 bp, Artificial Sequence
  chemically synthesized
aggcctctgttctgttccgt

SEQ ID NO: 257824 - DNA, 20 bp, Artificial Sequence
  chemically synthesized
tatagaccaacggaacagaa

SEQ ID NO: 257825 - DNA, 20 bp, Artificial Sequence
  chemically synthesized
tagaccaacggaacagaaca

SEQ ID NO: 257826 - DNA, 20 bp, Artificial Sequence
  chemically synthesized
agaccaacggaacagaacag

SEQ ID NO: 257827 - DNA, 20 bp, Artificial Sequence
  chemically synthesized
acggaacagaacagaggcct

SEQ ID NO: 257828 - DNA, 20 bp, Artificial Sequence
  chemically synthesized
gatgtgtggtgatatttctg

SEQ ID NO: 257829 - DNA, 20 bp, Artificial Sequence
  chemically synthesized
agatgtgtggtgatatttct

SEQ ID NO: 257830 - DNA, 20 bp, Artificial Sequence
  chemically synthesized
atcagatggttgtagatgtg

SEQ ID NO: 257831 - DNA, 20 bp, Artificial Sequence
  chemically synthesized
tgtcaaagatcagatggttg

SEQ ID NO: 257832 - DNA, 20 bp, Artificial Sequence
  chemically synthesized
caggtttgtcaaagatcaga

SEQ ID NO: 257833 - DNA, 20 bp, Artificial Sequence
  chemically synthesized
ttgtcaggtttgtcaaagat

SEQ ID NO: 257834 - DNA, 20 bp, Artificial Sequence
  chemically synthesized
tgtttttgtcaggtttgtca

SEQ ID NO: 257835 - DNA, 20 bp, Artificial Sequence
  chemically synthesized
ccacattgcttgtttttgtc

SEQ ID NO: 257836 - DNA, 20 bp, Artificial Sequence
  chemically synthesized
tccacattgcttgtttttgt

SEQ ID NO: 257837 - DNA, 20 bp, Artificial Sequence
  chemically synthesized
ttgacaaacctgacaaaaac

SEQ ID NO: 257838 - DNA, 20 bp, Artificial Sequence
  chemically synthesized
cctgacaaaaacaagcaatg

SEQ ID NO: 257839 - DNA, 20 bp, Artificial Sequence
  chemically synthesized
caaaaacaagcaatgtggaa

SEQ ID NO: 257840 - DNA, 20 bp, Artificial Sequence
  chemically synthesized
ccgacaccatttattaaata

SEQ ID NO: 257841 - DNA, 20 bp, Artificial Sequence
  chemically synthesized
cccgacaccatttattaaat

SEQ ID NO: 257842 - DNA, 20 bp, Artificial Sequence
  chemically synthesized
tcccgacaccatttattaaa

SEQ ID NO: 257843 - DNA, 20 bp, Artificial Sequence
  chemically synthesized
aagattccctatttaataaa

SEQ ID NO: 257844 - DNA, 20 bp, Artificial Sequence
  chemically synthesized
ccctatttaataaatggtgt

SEQ ID NO: 257845 - DNA, 20 bp, Artificial Sequence
  chemically synthesized
cctatttaataaatggtgtc

SEQ ID NO: 257846 - DNA, 20 bp, Artificial Sequence
  chemically synthesized
ataaatggtgtcgggaaaac

SEQ ID NO: 257847 - DNA, 20 bp, Artificial Sequence
  chemically synthesized
atggtgtcgggaaaactggc

SEQ ID NO: 257848 - DNA, 20 bp, Artificial Sequence
  chemically synthesized
gttttctgcatatggccagc

SEQ ID NO: 257849 - DNA, 20 bp, Artificial Sequence
  chemically synthesized
ttccgttttctgcatatggc

SEQ ID NO: 257850 - DNA, 20 bp, Artificial Sequence
  chemically synthesized
gaaaactggctggccatatg

SEQ ID NO: 257851 - DNA, 20 bp, Artificial Sequence
  chemically synthesized
tagtttccgttttctgcata

SEQ ID NO: 257852 - DNA, 20 bp, Artificial Sequence
  chemically synthesized
ggctggccatatgcagaaaa

SEQ ID NO: 257853 - DNA, 20 bp, Artificial Sequence
  chemically synthesized
catatgcagaaaacggaaac

SEQ ID NO: 257854 - DNA, 20 bp, Artificial Sequence
  chemically synthesized
taaggtgtaagaaaggggtc

SEQ ID NO: 257855 - DNA, 20 bp, Artificial Sequence
  chemically synthesized
ttgtataaggtgtaagaaag

SEQ ID NO: 257856 - DNA, 20 bp, Artificial Sequence
  chemically synthesized
tttgtataaggtgtaagaaa

SEQ ID NO: 257857 - DNA, 20 bp, Artificial Sequence
  chemically synthesized
ttttgtataaggtgtaagaa

SEQ ID NO: 257858 - DNA, 20 bp, Artificial Sequence
  chemically synthesized
tttttgtataaggtgtaaga

SEQ ID NO: 257859 - DNA, 20 bp, Artificial Sequence
  chemically synthesized
ttaatttttgtataaggtgt

SEQ ID NO: 257860 - DNA, 20 bp, Artificial Sequence
  chemically synthesized
catgagttaatttttgtata

SEQ ID NO: 257861 - DNA, 20 bp, Artificial Sequence
  chemically synthesized
tcatgagttaatttttgtat

SEQ ID NO: 257862 - DNA, 20 bp, Artificial Sequence
  chemically synthesized
atacaaaaattaactcatga

SEQ ID NO: 257863 - DNA, 20 bp, Artificial Sequence
  chemically synthesized
ttaagtctttaatccatcat

SEQ ID NO: 257864 - DNA, 20 bp, Artificial Sequence
  chemically synthesized
aattaactcatgatggatta

SEQ ID NO: 257865 - DNA, 20 bp, Artificial Sequence
  chemically synthesized
tggattaaagacttaaacct

SEQ ID NO: 257866 - DNA, 20 bp, Artificial Sequence
  chemically synthesized
tggtttcaggtcttaggttt

SEQ ID NO: 257867 - DNA, 20 bp, Artificial Sequence
  chemically synthesized
tttttatggtttcaggtctt

SEQ ID NO: 257868 - DNA, 20 bp, Artificial Sequence
  chemically synthesized
gtttttatggtttcaggtct

SEQ ID NO: 257869 - DNA, 20 bp, Artificial Sequence
  chemically synthesized
tctagagtttttatggtttc

SEQ ID NO: 257870 - DNA, 20 bp, Artificial Sequence
  chemically synthesized
ttctagagtttttatggttt

SEQ ID NO: 257871 - DNA, 20 bp, Artificial Sequence
  chemically synthesized
gttttcttctagagttttta

SEQ ID NO: 257872 - DNA, 20 bp, Artificial Sequence
  chemically synthesized
acctgaaaccataaaaactc

SEQ ID NO: 257873 - DNA, 20 bp, Artificial Sequence
  chemically synthesized
tgaaaccataaaaactctag

SEQ ID NO: 257874 - DNA, 20 bp, Artificial Sequence
  chemically synthesized
attgcctaggttttcttcta

SEQ ID NO: 257875 - DNA, 20 bp, Artificial Sequence
  chemically synthesized
gtattgcctaggttttcttc

SEQ ID NO: 257876 - DNA, 20 bp, Artificial Sequence
  chemically synthesized
aaaaactctagaagaaaacc

SEQ ID NO: 257877 - DNA, 20 bp, Artificial Sequence
  chemically synthesized
aaaactctagaagaaaacct

SEQ ID NO: 257878 - DNA, 20 bp, Artificial Sequence
  chemically synthesized
tatcctgaatggtattgcct

SEQ ID NO: 257879 - DNA, 20 bp, Artificial Sequence
  chemically synthesized
gtatcctgaatggtattgcc

SEQ ID NO: 257880 - DNA, 20 bp, Artificial Sequence
  chemically synthesized
aaaacctaggcaataccatt

SEQ ID NO: 257881 - DNA, 20 bp, Artificial Sequence
  chemically synthesized
aaacctaggcaataccattc

SEQ ID NO: 257882 - DNA, 20 bp, Artificial Sequence
  chemically synthesized
gcccatgcctgtatcctgaa

SEQ ID NO: 257883 - DNA, 20 bp, Artificial Sequence
  chemically synthesized
aggcaataccattcaggata

SEQ ID NO: 257884 - DNA, 20 bp, Artificial Sequence
  chemically synthesized
ggcaataccattcaggatac

SEQ ID NO: 257885 - DNA, 20 bp, Artificial Sequence
  chemically synthesized
taccattcaggatacaggca

SEQ ID NO: 257886 - DNA, 20 bp, Artificial Sequence
  chemically synthesized
accattcaggatacaggcat

SEQ ID NO: 257887 - DNA, 20 bp, Artificial Sequence
  chemically synthesized
tcaggatacaggcatgggca

SEQ ID NO: 257888 - DNA, 20 bp, Artificial Sequence
  chemically synthesized
cttttggtgttttagtcatg

SEQ ID NO: 257889 - DNA, 20 bp, Artificial Sequence
  chemically synthesized
tgctgttgcttttggtgttt

SEQ ID NO: 257890 - DNA, 20 bp, Artificial Sequence
  chemically synthesized
cttcatgactaaaacaccaa

SEQ ID NO: 257891 - DNA, 20 bp, Artificial Sequence
  chemically synthesized
gactaaaacaccaaaagcaa

SEQ ID NO: 257892 - DNA, 20 bp, Artificial Sequence
  chemically synthesized
gcttttgttgctgttgcttt

SEQ ID NO: 257893 - DNA, 20 bp, Artificial Sequence
  chemically synthesized
accaaaagcaacagcaacaa

SEQ ID NO: 257894 - DNA, 20 bp, Artificial Sequence
  chemically synthesized
tagatcccatttgtcaattt

SEQ ID NO: 257895 - DNA, 20 bp, Artificial Sequence
  chemically synthesized
caaaagccaaaattgacaaa

SEQ ID NO: 257896 - DNA, 20 bp, Artificial Sequence
  chemically synthesized
aaaagccaaaattgacaaat

SEQ ID NO: 257897 - DNA, 20 bp, Artificial Sequence
  chemically synthesized
gctgtgctcttcagtttaat

SEQ ID NO: 257898 - DNA, 20 bp, Artificial Sequence
  chemically synthesized
aatgggatctaattaaactg

SEQ ID NO: 257899 - DNA, 20 bp, Artificial Sequence
  chemically synthesized
tgggatctaattaaactgaa

SEQ ID NO: 257900 - DNA, 20 bp, Artificial Sequence
  chemically synthesized
tctaattaaactgaagagca

SEQ ID NO: 257901 - DNA, 20 bp, Artificial Sequence
  chemically synthesized
gggtcttttgctgtgctctt

SEQ ID NO: 257902 - DNA, 20 bp, Artificial Sequence
  chemically synthesized
taaactgaagagcacagcaa

SEQ ID NO: 257903 - DNA, 20 bp, Artificial Sequence
  chemically synthesized
acagcaaaagaccctatcat

SEQ ID NO: 257904 - DNA, 20 bp, Artificial Sequence
  chemically synthesized
gcctgttgactctcatgata

SEQ ID NO: 257905 - DNA, 20 bp, Artificial Sequence
  chemically synthesized
agcaaaagaccctatcatga

SEQ ID NO: 257906 - DNA, 20 bp, Artificial Sequence
  chemically synthesized
tgcctgttgactctcatgat

SEQ ID NO: 257907 - DNA, 20 bp, Artificial Sequence
  chemically synthesized
ttgcctgttgactctcatga

SEQ ID NO: 257908 - DNA, 20 bp, Artificial Sequence
  chemically synthesized
gaccctatcatgagagtcaa

SEQ ID NO: 257909 - DNA, 20 bp, Artificial Sequence
  chemically synthesized
accctatcatgagagtcaac

SEQ ID NO: 257910 - DNA, 20 bp, Artificial Sequence
  chemically synthesized
gagagtcaacaggcaaccta

SEQ ID NO: 257911 - DNA, 20 bp, Artificial Sequence
  chemically synthesized
caacaggcaacctacagaat

SEQ ID NO: 257912 - DNA, 20 bp, Artificial Sequence
  chemically synthesized
aaagttttctctcattctgt

SEQ ID NO: 257913 - DNA, 20 bp, Artificial Sequence
  chemically synthesized
aaaagttttctctcattctg

SEQ ID NO: 257914 - DNA, 20 bp, Artificial Sequence
  chemically synthesized
acaggcaacctacagaatga

SEQ ID NO: 257915 - DNA, 20 bp, Artificial Sequence
  chemically synthesized
gtcagatggatagattgcaa

SEQ ID NO: 257916 - DNA, 20 bp, Artificial Sequence
  chemically synthesized
atagccctttgtcagatgga

SEQ ID NO: 257917 - DNA, 20 bp, Artificial Sequence
  chemically synthesized
tgcaatctatccatctgaca

SEQ ID NO: 257918 - DNA, 20 bp, Artificial Sequence
  chemically synthesized
gataatagccctttgtcaga

SEQ ID NO: 257919 - DNA, 20 bp, Artificial Sequence
  chemically synthesized
gcaatctatccatctgacaa

SEQ ID NO: 257920 - DNA, 20 bp, Artificial Sequence
  chemically synthesized
caatctatccatctgacaaa

SEQ ID NO: 257921 - DNA, 20 bp, Artificial Sequence
  chemically synthesized
tctggataatagccctttgt

SEQ ID NO: 257922 - DNA, 20 bp, Artificial Sequence
  chemically synthesized
tctgacaaagggctattatc

SEQ ID NO: 257923 - DNA, 20 bp, Artificial Sequence
  chemically synthesized
tccttatagattctggataa

SEQ ID NO: 257924 - DNA, 20 bp, Artificial Sequence
  chemically synthesized
tttaagttccttatagattc

SEQ ID NO: 257925 - DNA, 20 bp, Artificial Sequence
  chemically synthesized
ggctattatccagaatctat

SEQ ID NO: 257926 - DNA, 20 bp, Artificial Sequence
  chemically synthesized
gctattatccagaatctata

SEQ ID NO: 257927 - DNA, 20 bp, Artificial Sequence
  chemically synthesized
aaatttgtttaagttcctta

SEQ ID NO: 257928 - DNA, 20 bp, Artificial Sequence
  chemically synthesized
tttttcttgtaaatttgttt

SEQ ID NO: 257929 - DNA, 20 bp, Artificial Sequence
  chemically synthesized
aggaacttaaacaaatttac

SEQ ID NO: 257930 - DNA, 20 bp, Artificial Sequence
  chemically synthesized
aacaaatttacaagaaaaaa

SEQ ID NO: 257931 - DNA, 20 bp, Artificial Sequence
  chemically synthesized
caagaaaaaaaagaccccat

SEQ ID NO: 257932 - DNA, 20 bp, Artificial Sequence
  chemically synthesized
aaaaaaaagaccccatcaga

SEQ ID NO: 257933 - DNA, 20 bp, Artificial Sequence
  chemically synthesized
cctttgcccactttctgatg

SEQ ID NO: 257934 - DNA, 20 bp, Artificial Sequence
  chemically synthesized
tcctttgcccactttctgat

SEQ ID NO: 257935 - DNA, 20 bp, Artificial Sequence
  chemically synthesized
atcctttgcccactttctga

SEQ ID NO: 257936 - DNA, 20 bp, Artificial Sequence
  chemically synthesized
aaaaagaccccatcagaaag

SEQ ID NO: 257937 - DNA, 20 bp, Artificial Sequence
  chemically synthesized
aaaagaccccatcagaaagt

SEQ ID NO: 257938 - DNA, 20 bp, Artificial Sequence
  chemically synthesized
accccatcagaaagtgggca

SEQ ID NO: 257939 - DNA, 20 bp, Artificial Sequence
  chemically synthesized
ccccatcagaaagtgggcaa

SEQ ID NO: 257940 - DNA, 20 bp, Artificial Sequence
  chemically synthesized
aagtgggcaaaggatatgaa

SEQ ID NO: 257941 - DNA, 20 bp, Artificial Sequence
  chemically synthesized
tatgaacagacacttcgcaa

SEQ ID NO: 257942 - DNA, 20 bp, Artificial Sequence
  chemically synthesized
cgtaaatgtcttcttttgcg

SEQ ID NO: 257943 - DNA, 20 bp, Artificial Sequence
  chemically synthesized
gaacagacacttcgcaaaag

SEQ ID NO: 257944 - DNA, 20 bp, Artificial Sequence
  chemically synthesized
cgcaaaagaagacatttacg

SEQ ID NO: 257945 - DNA, 20 bp, Artificial Sequence
  chemically synthesized
ggtttttttcttatgtttgt

SEQ ID NO: 257946 - DNA, 20 bp, Artificial Sequence
  chemically synthesized
tttacgcggccaacaaacat

SEQ ID NO: 257947 - DNA, 20 bp, Artificial Sequence
  chemically synthesized
tctaatgaccagtgatgatg

SEQ ID NO: 257948 - DNA, 20 bp, Artificial Sequence
  chemically synthesized
ctctaatgaccagtgatgat

SEQ ID NO: 257949 - DNA, 20 bp, Artificial Sequence
  chemically synthesized
gaaaaaaacctcatcatcac

SEQ ID NO: 257950 - DNA, 20 bp, Artificial Sequence
  chemically synthesized
acctcatcatcactggtcat

SEQ ID NO: 257951 - DNA, 20 bp, Artificial Sequence
  chemically synthesized
ctcatcatcactggtcatta

SEQ ID NO: 257952 - DNA, 20 bp, Artificial Sequence
  chemically synthesized
acttgcatttctctaatgac

SEQ ID NO: 257953 - DNA, 20 bp, Artificial Sequence
  chemically synthesized
actggtcattagagaaatgc

SEQ ID NO: 257954 - DNA, 20 bp, Artificial Sequence
  chemically synthesized
atgcaagtcaaaaccacaac

SEQ ID NO: 257955 - DNA, 20 bp, Artificial Sequence
  chemically synthesized
tgtgagatgctatctcgttg

SEQ ID NO: 257956 - DNA, 20 bp, Artificial Sequence
  chemically synthesized
aagtcaaaaccacaacgaga

SEQ ID NO: 257957 - DNA, 20 bp, Artificial Sequence
  chemically synthesized
aacgagatagcatctcacac

SEQ ID NO: 257958 - DNA, 20 bp, Artificial Sequence
  chemically synthesized
atcgccattctaactggtgt

SEQ ID NO: 257959 - DNA, 20 bp, Artificial Sequence
  chemically synthesized
agatagcatctcacaccagt

SEQ ID NO: 257960 - DNA, 20 bp, Artificial Sequence
  chemically synthesized
gcatctcacaccagttagaa

SEQ ID NO: 257961 - DNA, 20 bp, Artificial Sequence
  chemically synthesized
ttaatgatcgccattctaac

SEQ ID NO: 257962 - DNA, 20 bp, Artificial Sequence
  chemically synthesized
ttagaatggcgatcattaaa

SEQ ID NO: 257963 - DNA, 20 bp, Artificial Sequence
  chemically synthesized
aatggcgatcattaaaaagt

SEQ ID NO: 257964 - DNA, 20 bp, Artificial Sequence
  chemically synthesized
atggcgatcattaaaaagtc

SEQ ID NO: 257965 - DNA, 20 bp, Artificial Sequence
  chemically synthesized
agtcaggaaacaactgatgc

SEQ ID NO: 257966 - DNA, 20 bp, Artificial Sequence
  chemically synthesized
tcaggaaacaactgatgctg

SEQ ID NO: 257967 - DNA, 20 bp, Artificial Sequence
  chemically synthesized
ctccacatcttctccagcat

SEQ ID NO: 257968 - DNA, 20 bp, Artificial Sequence
  chemically synthesized
ggaaacaactgatgctggag

SEQ ID NO: 257969 - DNA, 20 bp, Artificial Sequence
  chemically synthesized
ctatttctccacatcttctc

SEQ ID NO: 257970 - DNA, 20 bp, Artificial Sequence
  chemically synthesized
aactgatgctggagaagatg

SEQ ID NO: 257971 - DNA, 20 bp, Artificial Sequence
  chemically synthesized
ctgatgctggagaagatgtg

SEQ ID NO: 257972 - DNA, 20 bp, Artificial Sequence
  chemically synthesized
ctggagaagatgtggagaaa

SEQ ID NO: 257973 - DNA, 20 bp, Artificial Sequence
  chemically synthesized
tggagaagatgtggagaaat

SEQ ID NO: 257974 - DNA, 20 bp, Artificial Sequence
  chemically synthesized
ctcccaccaacagtgtaaaa

SEQ ID NO: 257975 - DNA, 20 bp, Artificial Sequence
  chemically synthesized
cactcccaccaacagtgtaa

SEQ ID NO: 257976 - DNA, 20 bp, Artificial Sequence
  chemically synthesized
taggaactcttttacactgt

SEQ ID NO: 257977 - DNA, 20 bp, Artificial Sequence
  chemically synthesized
gaactcttttacactgttgg

SEQ ID NO: 257978 - DNA, 20 bp, Artificial Sequence
  chemically synthesized
aactcttttacactgttggt

SEQ ID NO: 257979 - DNA, 20 bp, Artificial Sequence
  chemically synthesized
ctcttttacactgttggtgg

SEQ ID NO: 257980 - DNA, 20 bp, Artificial Sequence
  chemically synthesized
ctaatttacactcccaccaa

SEQ ID NO: 257981 - DNA, 20 bp, Artificial Sequence
  chemically synthesized
ctgttggtgggagtgtaaat

SEQ ID NO: 257982 - DNA, 20 bp, Artificial Sequence
  chemically synthesized
gtaaattagttccaccattg

SEQ ID NO: 257983 - DNA, 20 bp, Artificial Sequence
  chemically synthesized
cacactgtcttccacaatgg

SEQ ID NO: 257984 - DNA, 20 bp, Artificial Sequence
  chemically synthesized
aattagttccaccattgtgg

SEQ ID NO: 257985 - DNA, 20 bp, Artificial Sequence
  chemically synthesized
ctgcacactgtcttccacaa

SEQ ID NO: 257986 - DNA, 20 bp, Artificial Sequence
  chemically synthesized
agttccaccattgtggaaga

SEQ ID NO: 257987 - DNA, 20 bp, Artificial Sequence
  chemically synthesized
ccattgtggaagacagtgtg

SEQ ID NO: 257988 - DNA, 20 bp, Artificial Sequence
  chemically synthesized
agacagtgtgcagattcctc

SEQ ID NO: 257989 - DNA, 20 bp, Artificial Sequence
  chemically synthesized
gacagtgtgcagattcctca

SEQ ID NO: 257990 - DNA, 20 bp, Artificial Sequence
  chemically synthesized
tttctggttctagatccttg

SEQ ID NO: 257991 - DNA, 20 bp, Artificial Sequence
  chemically synthesized
gtgcagattcctcaaggatc

SEQ ID NO: 257992 - DNA, 20 bp, Artificial Sequence
  chemically synthesized
atttctggttctagatcctt

SEQ ID NO: 257993 - DNA, 20 bp, Artificial Sequence
  chemically synthesized
attcctcaaggatctagaac

SEQ ID NO: 257994 - DNA, 20 bp, Artificial Sequence
  chemically synthesized
tcaaatggtatttctggttc

SEQ ID NO: 257995 - DNA, 20 bp, Artificial Sequence
  chemically synthesized
gctgggtcaaatggtatttc

SEQ ID NO: 257996 - DNA, 20 bp, Artificial Sequence
  chemically synthesized
accagaaataccatttgacc

SEQ ID NO: 257997 - DNA, 20 bp, Artificial Sequence
  chemically synthesized
aatgggattgctgggtcaaa

SEQ ID NO: 257998 - DNA, 20 bp, Artificial Sequence
  chemically synthesized
tatccagtaatgggattgct

SEQ ID NO: 257999 - DNA, 20 bp, Artificial Sequence
  chemically synthesized
atatccagtaatgggattgc

SEQ ID NO: 258000 - DNA, 20 bp, Artificial Sequence
  chemically synthesized
tgacccagcaatcccattac

SEQ ID NO: 258001 - DNA, 20 bp, Artificial Sequence
  chemically synthesized
ttgggtatatatccagtaat

SEQ ID NO: 258002 - DNA, 20 bp, Artificial Sequence
  chemically synthesized
tttgggtatatatccagtaa

SEQ ID NO: 258003 - DNA, 20 bp, Artificial Sequence
  chemically synthesized
taatcctttgggtatatatc

SEQ ID NO: 258004 - DNA, 20 bp, Artificial Sequence
  chemically synthesized
cattactggatatataccca

SEQ ID NO: 258005 - DNA, 20 bp, Artificial Sequence
  chemically synthesized
attactggatatatacccaa

SEQ ID NO: 258006 - DNA, 20 bp, Artificial Sequence
  chemically synthesized
aggatgatttataatccttt

SEQ ID NO: 258007 - DNA, 20 bp, Artificial Sequence
  chemically synthesized
taggatgatttataatcctt

SEQ ID NO: 258008 - DNA, 20 bp, Artificial Sequence
  chemically synthesized
ttataaatcatcctactata

SEQ ID NO: 258009 - DNA, 20 bp, Artificial Sequence
  chemically synthesized
tgtgcatgtgtctttatagt

SEQ ID NO: 258010 - DNA, 20 bp, Artificial Sequence
  chemically synthesized
gtgtgcatgtgtctttatag

SEQ ID NO: 258011 - DNA, 20 bp, Artificial Sequence
  chemically synthesized
tacgtgtgcatgtgtcttta

SEQ ID NO: 258012 - DNA, 20 bp, Artificial Sequence
  chemically synthesized
atgcacacgtatgtttattg

SEQ ID NO: 258013 - DNA, 20 bp, Artificial Sequence
  chemically synthesized
tattgcagcactgttcacaa

SEQ ID NO: 258014 - DNA, 20 bp, Artificial Sequence
  chemically synthesized
caattctttgctattgtgaa

SEQ ID NO: 258015 - DNA, 20 bp, Artificial Sequence
  chemically synthesized
cagcactgttcacaatagca

SEQ ID NO: 258016 - DNA, 20 bp, Artificial Sequence
  chemically synthesized
tcactggtgggcatttgggt

SEQ ID NO: 258017 - DNA, 20 bp, Artificial Sequence
  chemically synthesized
tctatcactggtgggcattt

SEQ ID NO: 258018 - DNA, 20 bp, Artificial Sequence
  chemically synthesized
gtctatcactggtgggcatt

SEQ ID NO: 258019 - DNA, 20 bp, Artificial Sequence
  chemically synthesized
caaccaacccaaatgcccac

SEQ ID NO: 258020 - DNA, 20 bp, Artificial Sequence
  chemically synthesized
ttatccagtctatcactggt

SEQ ID NO: 258021 - DNA, 20 bp, Artificial Sequence
  chemically synthesized
acccaaatgcccaccagtga

SEQ ID NO: 258022 - DNA, 20 bp, Artificial Sequence
  chemically synthesized
tttatccagtctatcactgg

SEQ ID NO: 258023 - DNA, 20 bp, Artificial Sequence
  chemically synthesized
ttctttatccagtctatcac

SEQ ID NO: 258024 - DNA, 20 bp, Artificial Sequence
  chemically synthesized
aatgcccaccagtgatagac

SEQ ID NO: 258025 - DNA, 20 bp, Artificial Sequence
  chemically synthesized
caccagtgatagactggata

SEQ ID NO: 258026 - DNA, 20 bp, Artificial Sequence
  chemically synthesized
atgtgtcaattttctttatc

SEQ ID NO: 258027 - DNA, 20 bp, Artificial Sequence
  chemically synthesized
aaattgacacatatacacca

SEQ ID NO: 258028 - DNA, 20 bp, Artificial Sequence
  chemically synthesized
aattgacacatatacaccat

SEQ ID NO: 258029 - DNA, 20 bp, Artificial Sequence
  chemically synthesized
tatggctgcatagtgtccca

SEQ ID NO: 258030 - DNA, 20 bp, Artificial Sequence
  chemically synthesized
atacaccatgggacactatg

SEQ ID NO: 258031 - DNA, 20 bp, Artificial Sequence
  chemically synthesized
cattcttttttatggctgca

SEQ ID NO: 258032 - DNA, 20 bp, Artificial Sequence
  chemically synthesized
gacactatgcagccataaaa

SEQ ID NO: 258033 - DNA, 20 bp, Artificial Sequence
  chemically synthesized
cacgaactcattctttttta

SEQ ID NO: 258034 - DNA, 20 bp, Artificial Sequence
  chemically synthesized
atgcagccataaaaaagaat

SEQ ID NO: 258035 - DNA, 20 bp, Artificial Sequence
  chemically synthesized
gaatgagttcgtgtcctttg

SEQ ID NO: 258036 - DNA, 20 bp, Artificial Sequence
  chemically synthesized
aatgagttcgtgtcctttgc

SEQ ID NO: 258037 - DNA, 20 bp, Artificial Sequence
  chemically synthesized
tttcatccatgttcctgcaa

SEQ ID NO: 258038 - DNA, 20 bp, Artificial Sequence
  chemically synthesized
gtttcatccatgttcctgca

SEQ ID NO: 258039 - DNA, 20 bp, Artificial Sequence
  chemically synthesized
tcgtgtcctttgcaggaaca

SEQ ID NO: 258040 - DNA, 20 bp, Artificial Sequence
  chemically synthesized
tgcaggaacatggatgaaac

SEQ ID NO: 258041 - DNA, 20 bp, Artificial Sequence
  chemically synthesized
ttgctgagaatgacggtttc

SEQ ID NO: 258042 - DNA, 20 bp, Artificial Sequence
  chemically synthesized
aaactagaaaccgtcattct

SEQ ID NO: 258043 - DNA, 20 bp, Artificial Sequence
  chemically synthesized
tgttagtttgctgagaatga

SEQ ID NO: 258044 - DNA, 20 bp, Artificial Sequence
  chemically synthesized
tgttcctgtgttagtttgct

SEQ ID NO: 258045 - DNA, 20 bp, Artificial Sequence
  chemically synthesized
tcattctcagcaaactaaca

SEQ ID NO: 258046 - DNA, 20 bp, Artificial Sequence
  chemically synthesized
cattctcagcaaactaacac

SEQ ID NO: 258047 - DNA, 20 bp, Artificial Sequence
  chemically synthesized
ttggttttctgttcctgtgt

SEQ ID NO: 258048 - DNA, 20 bp, Artificial Sequence
  chemically synthesized
tcagcaaactaacacaggaa

SEQ ID NO: 258049 - DNA, 20 bp, Artificial Sequence
  chemically synthesized
cagtgagaacatgcagtgtt

SEQ ID NO: 258050 - DNA, 20 bp, Artificial Sequence
  chemically synthesized
ccattatcagtgagaacatg

SEQ ID NO: 258051 - DNA, 20 bp, Artificial Sequence
  chemically synthesized
gttcaactcccattatcagt

SEQ ID NO: 258052 - DNA, 20 bp, Artificial Sequence
  chemically synthesized
ctgcatgttctcactgataa

SEQ ID NO: 258053 - DNA, 20 bp, Artificial Sequence
  chemically synthesized
tgcatgttctcactgataat

SEQ ID NO: 258054 - DNA, 20 bp, Artificial Sequence
  chemically synthesized
catgttctcactgataatgg

SEQ ID NO: 258055 - DNA, 20 bp, Artificial Sequence
  chemically synthesized
cattgttcaactcccattat

SEQ ID NO: 258056 - DNA, 20 bp, Artificial Sequence
  chemically synthesized
agttgaacaatgaaaacata

SEQ ID NO: 258057 - DNA, 20 bp, Artificial Sequence
  chemically synthesized
acaatgaaaacatatggccg

SEQ ID NO: 258058 - DNA, 20 bp, Artificial Sequence
  chemically synthesized
caatgaaaacatatggccgc

SEQ ID NO: 258059 - DNA, 20 bp, Artificial Sequence
  chemically synthesized
aatgaaaacatatggccgca

SEQ ID NO: 258060 - DNA, 20 bp, Artificial Sequence
  chemically synthesized
atgaaaacatatggccgcag

SEQ ID NO: 258061 - DNA, 20 bp, Artificial Sequence
  chemically synthesized
cacccgccaacaggcccctg

SEQ ID NO: 258062 - DNA, 20 bp, Artificial Sequence
  chemically synthesized
atatggccgcaggggcctgt

SEQ ID NO: 258063 - DNA, 20 bp, Artificial Sequence
  chemically synthesized
tggccgcaggggcctgttgg

SEQ ID NO: 258064 - DNA, 20 bp, Artificial Sequence
  chemically synthesized
ggccgcaggggcctgttggc

SEQ ID NO: 258065 - DNA, 20 bp, Artificial Sequence
  chemically synthesized
cttgccccccacccgccaac

SEQ ID NO: 258066 - DNA, 20 bp, Artificial Sequence
  chemically synthesized
ccttgccccccacccgccaa

SEQ ID NO: 258067 - DNA, 20 bp, Artificial Sequence
  chemically synthesized
cgcaggggcctgttggcggg

SEQ ID NO: 258068 - DNA, 20 bp, Artificial Sequence
  chemically synthesized
gcaggggcctgttggcgggt

SEQ ID NO: 258069 - DNA, 20 bp, Artificial Sequence
  chemically synthesized
caggggcctgttggcgggtg

SEQ ID NO: 258070 - DNA, 20 bp, Artificial Sequence
  chemically synthesized
aggggcctgttggcgggtgg

SEQ ID NO: 258071 - DNA, 20 bp, Artificial Sequence
  chemically synthesized
ggggcctgttggcgggtggg

SEQ ID NO: 258072 - DNA, 20 bp, Artificial Sequence
  chemically synthesized
cctgttggcgggtggggggc

SEQ ID NO: 258073 - DNA, 20 bp, Artificial Sequence
  chemically synthesized
ctgttggcgggtggggggca

SEQ ID NO: 258074 - DNA, 20 bp, Artificial Sequence
  chemically synthesized
tgttggcgggtggggggcaa

SEQ ID NO: 258075 - DNA, 20 bp, Artificial Sequence
  chemically synthesized
gttggcgggtggggggcaag

SEQ ID NO: 258076 - DNA, 20 bp, Artificial Sequence
  chemically synthesized
tggcgggtggggggcaaggg

SEQ ID NO: 258077 - DNA, 20 bp, Artificial Sequence
  chemically synthesized
ggcgggtggggggcaagggg

SEQ ID NO: 258078 - DNA, 20 bp, Artificial Sequence
  chemically synthesized
gcgggtggggggcaagggga

SEQ ID NO: 258079 - DNA, 20 bp, Artificial Sequence
  chemically synthesized
gtggggggcaaggggaggga

SEQ ID NO: 258080 - DNA, 20 bp, Artificial Sequence
  chemically synthesized
ggcaaggggagggatagcat

SEQ ID NO: 258081 - DNA, 20 bp, Artificial Sequence
  chemically synthesized
gcaaggggagggatagcatt

SEQ ID NO: 258082 - DNA, 20 bp, Artificial Sequence
  chemically synthesized
aaggggagggatagcattag

SEQ ID NO: 258083 - DNA, 20 bp, Artificial Sequence
  chemically synthesized
attaggagaaatacctaatg

SEQ ID NO: 258084 - DNA, 20 bp, Artificial Sequence
  chemically synthesized
atcaacctgtcatctacatt

SEQ ID NO: 258085 - DNA, 20 bp, Artificial Sequence
  chemically synthesized
catcaacctgtcatctacat

SEQ ID NO: 258086 - DNA, 20 bp, Artificial Sequence
  chemically synthesized
gaaatacctaatgtagatga

SEQ ID NO: 258087 - DNA, 20 bp, Artificial Sequence
  chemically synthesized
aaatacctaatgtagatgac

SEQ ID NO: 258088 - DNA, 20 bp, Artificial Sequence
  chemically synthesized
taatgtagatgacaggttga

SEQ ID NO: 258089 - DNA, 20 bp, Artificial Sequence
  chemically synthesized
aatgtagatgacaggttgat

SEQ ID NO: 258090 - DNA, 20 bp, Artificial Sequence
  chemically synthesized
agatgacaggttgatgggtg

SEQ ID NO: 258091 - DNA, 20 bp, Artificial Sequence
  chemically synthesized
atgggtgcagcaaaccacca

SEQ ID NO: 258092 - DNA, 20 bp, Artificial Sequence
  chemically synthesized
taggtatacatgttccgtgg

SEQ ID NO: 258093 - DNA, 20 bp, Artificial Sequence
  chemically synthesized
gcataggtatacatgttccg

SEQ ID NO: 258094 - DNA, 20 bp, Artificial Sequence
  chemically synthesized
aacgtgcaggtttgttgcat

SEQ ID NO: 258095 - DNA, 20 bp, Artificial Sequence
  chemically synthesized
gaacgtgcaggtttgttgca

SEQ ID NO: 258096 - DNA, 20 bp, Artificial Sequence
  chemically synthesized
gatacatgtacagaacgtgc

SEQ ID NO: 258097 - DNA, 20 bp, Artificial Sequence
  chemically synthesized
ggatacatgtacagaacgtg

SEQ ID NO: 258098 - DNA, 20 bp, Artificial Sequence
  chemically synthesized
taagttctgggatacatgta

SEQ ID NO: 258099 - DNA, 20 bp, Artificial Sequence
  chemically synthesized
cacgttctgtacatgtatcc

SEQ ID NO: 258100 - DNA, 20 bp, Artificial Sequence
  chemically synthesized
gtacatgtatcccagaactt

SEQ ID NO: 258101 - DNA, 20 bp, Artificial Sequence
  chemically synthesized
tttaattatacttaagttct

SEQ ID NO: 258102 - DNA, 20 bp, Artificial Sequence
  chemically synthesized
ttttaattatacttaagttc

SEQ ID NO: 258103 - DNA, 20 bp, Artificial Sequence
  chemically synthesized
ttttttttttaattatactt

SEQ ID NO: 258104 - DNA, 20 bp, Artificial Sequence
  chemically synthesized
taagtataattaaaaaaaaa

SEQ ID NO: 258105 - DNA, 20 bp, Artificial Sequence
  chemically synthesized
aaaaaaaagaaaaaatcatt

SEQ ID NO: 258106 - DNA, 20 bp, Artificial Sequence
  chemically synthesized
aaaaaatcattcagtgacac

SEQ ID NO: 258107 - DNA, 20 bp, Artificial Sequence
  chemically synthesized
aatctaatttttattttatc

SEQ ID NO: 258108 - DNA, 20 bp, Artificial Sequence
  chemically synthesized
acactggataaaataaaaat

SEQ ID NO: 258109 - DNA, 20 bp, Artificial Sequence
  chemically synthesized
aaataaaaattagattcact

SEQ ID NO: 258110 - DNA, 20 bp, Artificial Sequence
  chemically synthesized
agcacgaattattattttct

SEQ ID NO: 258111 - DNA, 20 bp, Artificial Sequence
  chemically synthesized
aaaataataattcgtgctct

SEQ ID NO: 258112 - DNA, 20 bp, Artificial Sequence
  chemically synthesized
aataattcgtgctctcagac

SEQ ID NO: 258113 - DNA, 20 bp, Artificial Sequence
  chemically synthesized
gacacagaattctggtctga

SEQ ID NO: 258114 - DNA, 20 bp, Artificial Sequence
  chemically synthesized
gagacacagaattctggtct

SEQ ID NO: 258115 - DNA, 20 bp, Artificial Sequence
  chemically synthesized
tttgctgagacacagaattc

SEQ ID NO: 258116 - DNA, 20 bp, Artificial Sequence
  chemically synthesized
cagaccagaattctgtgtct

SEQ ID NO: 258117 - DNA, 20 bp, Artificial Sequence
  chemically synthesized
ggatcttatttgctgagaca

SEQ ID NO: 258118 - DNA, 20 bp, Artificial Sequence
  chemically synthesized
aattctgtgtctcagcaaat

SEQ ID NO: 258119 - DNA, 20 bp, Artificial Sequence
  chemically synthesized
aacactggatcttatttgct

SEQ ID NO: 258120 - DNA, 20 bp, Artificial Sequence
  chemically synthesized
gtgtctcagcaaataagatc

SEQ ID NO: 258121 - DNA, 20 bp, Artificial Sequence
  chemically synthesized
tttaggactatgattaacac

SEQ ID NO: 258122 - DNA, 20 bp, Artificial Sequence
  chemically synthesized
ataagatccagtgttaatca

SEQ ID NO: 258123 - DNA, 20 bp, Artificial Sequence
  chemically synthesized
tgttaatcatagtcctaaac

SEQ ID NO: 258124 - DNA, 20 bp, Artificial Sequence
  chemically synthesized
gttaatcatagtcctaaacc

SEQ ID NO: 258125 - DNA, 20 bp, Artificial Sequence
  chemically synthesized
ttaatcatagtcctaaacca

SEQ ID NO: 258126 - DNA, 20 bp, Artificial Sequence
  chemically synthesized
cattctttaagccctggttt

SEQ ID NO: 258127 - DNA, 20 bp, Artificial Sequence
  chemically synthesized
acattctttaagccctggtt

SEQ ID NO: 258128 - DNA, 20 bp, Artificial Sequence
  chemically synthesized
tagtcctaaaccagggctta

SEQ ID NO: 258129 - DNA, 20 bp, Artificial Sequence
  chemically synthesized
tgcctacattctttaagccc

SEQ ID NO: 258130 - DNA, 20 bp, Artificial Sequence
  chemically synthesized
gtgtgctgcctacattcttt

SEQ ID NO: 258131 - DNA, 20 bp, Artificial Sequence
  chemically synthesized
aaaccagggcttaaagaatg

SEQ ID NO: 258132 - DNA, 20 bp, Artificial Sequence
  chemically synthesized
aaccagggcttaaagaatgt

SEQ ID NO: 258133 - DNA, 20 bp, Artificial Sequence
  chemically synthesized
cagggcttaaagaatgtagg

SEQ ID NO: 258134 - DNA, 20 bp, Artificial Sequence
  chemically synthesized
gtaggcagcacaccataccc

SEQ ID NO: 258135 - DNA, 20 bp, Artificial Sequence
  chemically synthesized
acagatgagaagccagggta

SEQ ID NO: 258136 - DNA, 20 bp, Artificial Sequence
  chemically synthesized
gcttaacagatgagaagcca

SEQ ID NO: 258137 - DNA, 20 bp, Artificial Sequence
  chemically synthesized
agcttaacagatgagaagcc

SEQ ID NO: 258138 - DNA, 20 bp, Artificial Sequence
  chemically synthesized
aagcttaacagatgagaagc

SEQ ID NO: 258139 - DNA, 20 bp, Artificial Sequence
  chemically synthesized
agagaagcttaacagatgag

SEQ ID NO: 258140 - DNA, 20 bp, Artificial Sequence
  chemically synthesized
accctggcttctcatctgtt

SEQ ID NO: 258141 - DNA, 20 bp, Artificial Sequence
  chemically synthesized
tggagagaagcttaacagat

SEQ ID NO: 258142 - DNA, 20 bp, Artificial Sequence
  chemically synthesized
tcaggtggagagaagcttaa

SEQ ID NO: 258143 - DNA, 20 bp, Artificial Sequence
  chemically synthesized
acatggggtcaggtggagag

SEQ ID NO: 258144 - DNA, 20 bp, Artificial Sequence
  chemically synthesized
gacacatggggtcaggtgga

SEQ ID NO: 258145 - DNA, 20 bp, Artificial Sequence
  chemically synthesized
tagacacatggggtcaggtg

SEQ ID NO: 258146 - DNA, 20 bp, Artificial Sequence
  chemically synthesized
ggtagacacatggggtcagg

SEQ ID NO: 258147 - DNA, 20 bp, Artificial Sequence
  chemically synthesized
tatggtagacacatggggtc

SEQ ID NO: 258148 - DNA, 20 bp, Artificial Sequence
  chemically synthesized
ctatggtagacacatggggt

SEQ ID NO: 258149 - DNA, 20 bp, Artificial Sequence
  chemically synthesized
taatctatggtagacacatg

SEQ ID NO: 258150 - DNA, 20 bp, Artificial Sequence
  chemically synthesized
ataatctatggtagacacat

SEQ ID NO: 258151 - DNA, 20 bp, Artificial Sequence
  chemically synthesized
aataatctatggtagacaca

SEQ ID NO: 258152 - DNA, 20 bp, Artificial Sequence
  chemically synthesized
ctgaccccatgtgtctacca

SEQ ID NO: 258153 - DNA, 20 bp, Artificial Sequence
  chemically synthesized
cggtatataataatctatgg

SEQ ID NO: 258154 - DNA, 20 bp, Artificial Sequence
  chemically synthesized
aatcggtatataataatcta

SEQ ID NO: 258155 - DNA, 20 bp, Artificial Sequence
  chemically synthesized
ctgaagaatatttgttaaat

SEQ ID NO: 258156 - DNA, 20 bp, Artificial Sequence
  chemically synthesized
ccgatttaacaaatattctt

SEQ ID NO: 258157 - DNA, 20 bp, Artificial Sequence
  chemically synthesized
gtttttagtttaatgttctg

SEQ ID NO: 258158 - DNA, 20 bp, Artificial Sequence
  chemically synthesized
agataggtgaaaatggtttt

SEQ ID NO: 258159 - DNA, 20 bp, Artificial Sequence
  chemically synthesized
ctttgaaagataggtgaaaa

SEQ ID NO: 258160 - DNA, 20 bp, Artificial Sequence
  chemically synthesized
agagattttctttgaaagat

SEQ ID NO: 258161 - DNA, 20 bp, Artificial Sequence
  chemically synthesized
ccattttcacctatctttca

SEQ ID NO: 258162 - DNA, 20 bp, Artificial Sequence
  chemically synthesized
aagagattttctttgaaaga

SEQ ID NO: 258163 - DNA, 20 bp, Artificial Sequence
  chemically synthesized
ctaaaagagattttctttga

SEQ ID NO: 258164 - DNA, 20 bp, Artificial Sequence
  chemically synthesized
ctttcaaagaaaatctcttt

SEQ ID NO: 258165 - DNA, 20 bp, Artificial Sequence
  chemically synthesized
tcaaagaaaatctcttttag

SEQ ID NO: 258166 - DNA, 20 bp, Artificial Sequence
  chemically synthesized
cacataacactcttctaaaa

SEQ ID NO: 258167 - DNA, 20 bp, Artificial Sequence
  chemically synthesized
aaagaaaatctcttttagaa

SEQ ID NO: 258168 - DNA, 20 bp, Artificial Sequence
  chemically synthesized
gccacataacactcttctaa

SEQ ID NO: 258169 - DNA, 20 bp, Artificial Sequence
  chemically synthesized
tcttttagaagagtgttatg

SEQ ID NO: 258170 - DNA, 20 bp, Artificial Sequence
  chemically synthesized
agaaaaattggcaatttaaa

SEQ ID NO: 258171 - DNA, 20 bp, Artificial Sequence
  chemically synthesized
atttaaattgccaatttttc

SEQ ID NO: 258172 - DNA, 20 bp, Artificial Sequence
  chemically synthesized
aggatgattaccagaaaaat

SEQ ID NO: 258173 - DNA, 20 bp, Artificial Sequence
  chemically synthesized
gagagtaaaaggatgattac

SEQ ID NO: 258174 - DNA, 20 bp, Artificial Sequence
  chemically synthesized
actcttgtacagagagtaaa

SEQ ID NO: 258175 - DNA, 20 bp, Artificial Sequence
  chemically synthesized
aactcttgtacagagagtaa

SEQ ID NO: 258176 - DNA, 20 bp, Artificial Sequence
  chemically synthesized
catccttttactctctgtac

SEQ ID NO: 258177 - DNA, 20 bp, Artificial Sequence
  chemically synthesized
aaattgaactcttgtacaga

SEQ ID NO: 258178 - DNA, 20 bp, Artificial Sequence
  chemically synthesized
tccttttactctctgtacaa

SEQ ID NO: 258179 - DNA, 20 bp, Artificial Sequence
  chemically synthesized
aaaaattgaactcttgtaca

SEQ ID NO: 258180 - DNA, 20 bp, Artificial Sequence
  chemically synthesized
ttaaaaattgaactcttgta

SEQ ID NO: 258181 - DNA, 20 bp, Artificial Sequence
  chemically synthesized
tgtacaagagttcaattttt

SEQ ID NO: 258182 - DNA, 20 bp, Artificial Sequence
  chemically synthesized
ttcaatttttaagaaaattt

SEQ ID NO: 258183 - DNA, 20 bp, Artificial Sequence
  chemically synthesized
taagaaaattttagatacct

SEQ ID NO: 258184 - DNA, 20 bp, Artificial Sequence
  chemically synthesized
attacaattatttgtcactt

SEQ ID NO: 258185 - DNA, 20 bp, Artificial Sequence
  chemically synthesized
aattacaattatttgtcact

SEQ ID NO: 258186 - DNA, 20 bp, Artificial Sequence
  chemically synthesized
aataattgtaattctgtatc

SEQ ID NO: 258187 - DNA, 20 bp, Artificial Sequence
  chemically synthesized
atgatttctagaaccagata

SEQ ID NO: 258188 - DNA, 20 bp, Artificial Sequence
  chemically synthesized
tgtaattctgtatctggttc

SEQ ID NO: 258189 - DNA, 20 bp, Artificial Sequence
  chemically synthesized
taaaaaatgatttctagaac

SEQ ID NO: 258190 - DNA, 20 bp, Artificial Sequence
  chemically synthesized
agtttgtaaaaaatgatttc

SEQ ID NO: 258191 - DNA, 20 bp, Artificial Sequence
  chemically synthesized
agagcttcttcattatttaa

SEQ ID NO: 258192 - DNA, 20 bp, Artificial Sequence
  chemically synthesized
ttacaaacttttaaataatg

SEQ ID NO: 258193 - DNA, 20 bp, Artificial Sequence
  chemically synthesized
caaacttttaaataatgaag

SEQ ID NO: 258194 - DNA, 20 bp, Artificial Sequence
  chemically synthesized
tatttcgatcaggttaataa

SEQ ID NO: 258195 - DNA, 20 bp, Artificial Sequence
  chemically synthesized
agtatttcgatcaggttaat

SEQ ID NO: 258196 - DNA, 20 bp, Artificial Sequence
  chemically synthesized
cttttaagagtatttcgatc

SEQ ID NO: 258197 - DNA, 20 bp, Artificial Sequence
  chemically synthesized
tcttttaagagtatttcgat

SEQ ID NO: 258198 - DNA, 20 bp, Artificial Sequence
  chemically synthesized
cctgatcgaaatactcttaa

SEQ ID NO: 258199 - DNA, 20 bp, Artificial Sequence
  chemically synthesized
atggctaatatttcttttaa

SEQ ID NO: 258200 - DNA, 20 bp, Artificial Sequence
  chemically synthesized
caatggctaatatttctttt

SEQ ID NO: 258201 - DNA, 20 bp, Artificial Sequence
  chemically synthesized
aatactcttaaaagaaatat

SEQ ID NO: 258202 - DNA, 20 bp, Artificial Sequence
  chemically synthesized
attctcaacctgcagttcaa

SEQ ID NO: 258203 - DNA, 20 bp, Artificial Sequence
  chemically synthesized
aaatattagccattgaactg

SEQ ID NO: 258204 - DNA, 20 bp, Artificial Sequence
  chemically synthesized
aatattagccattgaactgc

SEQ ID NO: 258205 - DNA, 20 bp, Artificial Sequence
  chemically synthesized
tagccattgaactgcaggtt

SEQ ID NO: 258206 - DNA, 20 bp, Artificial Sequence
  chemically synthesized
attagagcattctcaacctg

SEQ ID NO: 258207 - DNA, 20 bp, Artificial Sequence
  chemically synthesized
tcacaatatgcatattatta

SEQ ID NO: 258208 - DNA, 20 bp, Artificial Sequence
  chemically synthesized
aatcacaatatgcatattat

SEQ ID NO: 258209 - DNA, 20 bp, Artificial Sequence
  chemically synthesized
tgcatattgtgattattttc

SEQ ID NO: 258210 - DNA, 20 bp, Artificial Sequence
  chemically synthesized
ttttcaagattgtcacaaat

SEQ ID NO: 258211 - DNA, 20 bp, Artificial Sequence
  chemically synthesized
agattgtcacaaataagcca

SEQ ID NO: 258212 - DNA, 20 bp, Artificial Sequence
  chemically synthesized
attgtcacaaataagccata

SEQ ID NO: 258213 - DNA, 20 bp, Artificial Sequence
  chemically synthesized
tattgacactggttgctcta

SEQ ID NO: 258214 - DNA, 20 bp, Artificial Sequence
  chemically synthesized
caaataagccatagagcaac

SEQ ID NO: 258215 - DNA, 20 bp, Artificial Sequence
  chemically synthesized
ttatttccatgtattgacac

SEQ ID NO: 258216 - DNA, 20 bp, Artificial Sequence
  chemically synthesized
gagcaaccagtgtcaataca

SEQ ID NO: 258217 - DNA, 20 bp, Artificial Sequence
  chemically synthesized
atgccatggctgagcatgta

SEQ ID NO: 258218 - DNA, 20 bp, Artificial Sequence
  chemically synthesized
ggaaataatccctacatgct

SEQ ID NO: 258219 - DNA, 20 bp, Artificial Sequence
  chemically synthesized
catgccatggctgagcatgt

SEQ ID NO: 258220 - DNA, 20 bp, Artificial Sequence
  chemically synthesized
tcatgccatggctgagcatg

SEQ ID NO: 258221 - DNA, 20 bp, Artificial Sequence
  chemically synthesized
aatccctacatgctcagcca

SEQ ID NO: 258222 - DNA, 20 bp, Artificial Sequence
  chemically synthesized
aatgtgttcatgccatggct

SEQ ID NO: 258223 - DNA, 20 bp, Artificial Sequence
  chemically synthesized
tagaaaatgtgttcatgcca

SEQ ID NO: 258224 - DNA, 20 bp, Artificial Sequence
  chemically synthesized
catggcatgaacacattttc

SEQ ID NO: 258225 - DNA, 20 bp, Artificial Sequence
  chemically synthesized
aacacattttctagaacact

SEQ ID NO: 258226 - DNA, 20 bp, Artificial Sequence
  chemically synthesized
tttaatatttctaagtgttc

SEQ ID NO: 258227 - DNA, 20 bp, Artificial Sequence
  chemically synthesized
ataagaattttaatatttct

SEQ ID NO: 258228 - DNA, 20 bp, Artificial Sequence
  chemically synthesized
tagaaatattaaaattctta

SEQ ID NO: 258229 - DNA, 20 bp, Artificial Sequence
  chemically synthesized
tattgattatgttcaaccat

SEQ ID NO: 258230 - DNA, 20 bp, Artificial Sequence
  chemically synthesized
ggttgaacataatcaataaa

SEQ ID NO: 258231 - DNA, 20 bp, Artificial Sequence
  chemically synthesized
gttgaacataatcaataaaa

SEQ ID NO: 258232 - DNA, 20 bp, Artificial Sequence
  chemically synthesized
acataatcaataaaaaggta

SEQ ID NO: 258233 - DNA, 20 bp, Artificial Sequence
  chemically synthesized
aaaggtatagtttattactt

SEQ ID NO: 258234 - DNA, 20 bp, Artificial Sequence
  chemically synthesized
ttctcattcagatttttcta

SEQ ID NO: 258235 - DNA, 20 bp, Artificial Sequence
  chemically synthesized
tactttagaaaaatctgaat

SEQ ID NO: 258236 - DNA, 20 bp, Artificial Sequence
  chemically synthesized
tagaaatgatttttctcatt

SEQ ID NO: 258237 - DNA, 20 bp, Artificial Sequence
  chemically synthesized
taattatcagtagttgagga

SEQ ID NO: 258238 - DNA, 20 bp, Artificial Sequence
  chemically synthesized
tacttaattatcagtagttg

SEQ ID NO: 258239 - DNA, 20 bp, Artificial Sequence
  chemically synthesized
ttacttaattatcagtagtt

SEQ ID NO: 258240 - DNA, 20 bp, Artificial Sequence
  chemically synthesized
aaagattacttaattatcag

SEQ ID NO: 258241 - DNA, 20 bp, Artificial Sequence
  chemically synthesized
atcctcaactactgataatt

SEQ ID NO: 258242 - DNA, 20 bp, Artificial Sequence
  chemically synthesized
ttgaaagattacttaattat

SEQ ID NO: 258243 - DNA, 20 bp, Artificial Sequence
  chemically synthesized
atggaaagaaaaatttttga

SEQ ID NO: 258244 - DNA, 20 bp, Artificial Sequence
  chemically synthesized
taatttatctttataatgga

SEQ ID NO: 258245 - DNA, 20 bp, Artificial Sequence
  chemically synthesized
aaatttttctttccattata

SEQ ID NO: 258246 - DNA, 20 bp, Artificial Sequence
  chemically synthesized
attctaatttatctttataa

SEQ ID NO: 258247 - DNA, 20 bp, Artificial Sequence
  chemically synthesized
tttccattataaagataaat

SEQ ID NO: 258248 - DNA, 20 bp, Artificial Sequence
  chemically synthesized
agaagcatcttagaaattac

SEQ ID NO: 258249 - DNA, 20 bp, Artificial Sequence
  chemically synthesized
gagaagcatcttagaaatta

SEQ ID NO: 258250 - DNA, 20 bp, Artificial Sequence
  chemically synthesized
ttagaatacctgtaatttct

SEQ ID NO: 258251 - DNA, 20 bp, Artificial Sequence
  chemically synthesized
aattgtaatgagaagcatct

SEQ ID NO: 258252 - DNA, 20 bp, Artificial Sequence
  chemically synthesized
ccataggtaattgtaatgag

SEQ ID NO: 258253 - DNA, 20 bp, Artificial Sequence
  chemically synthesized
tgcccataggtaattgtaat

SEQ ID NO: 258254 - DNA, 20 bp, Artificial Sequence
  chemically synthesized
cttctcattacaattaccta

SEQ ID NO: 258255 - DNA, 20 bp, Artificial Sequence
  chemically synthesized
ttctcattacaattacctat

SEQ ID NO: 258256 - DNA, 20 bp, Artificial Sequence
  chemically synthesized
atagctgaactgttgcccat

SEQ ID NO: 258257 - DNA, 20 bp, Artificial Sequence
  chemically synthesized
ttacaattacctatgggcaa

SEQ ID NO: 258258 - DNA, 20 bp, Artificial Sequence
  chemically synthesized
tatagctgaactgttgccca

SEQ ID NO: 258259 - DNA, 20 bp, Artificial Sequence
  chemically synthesized
attacctatgggcaacagtt

SEQ ID NO: 258260 - DNA, 20 bp, Artificial Sequence
  chemically synthesized
cttttagactttataacgta

SEQ ID NO: 258261 - DNA, 20 bp, Artificial Sequence
  chemically synthesized
cagttcagctatacgttata

SEQ ID NO: 258262 - DNA, 20 bp, Artificial Sequence
  chemically synthesized
ctatacgttataaagtctaa

SEQ ID NO: 258263 - DNA, 20 bp, Artificial Sequence
  chemically synthesized
tatacgttataaagtctaaa

SEQ ID NO: 258264 - DNA, 20 bp, Artificial Sequence
  chemically synthesized
aaagtataacattaaccttt

SEQ ID NO: 258265 - DNA, 20 bp, Artificial Sequence
  chemically synthesized
gtcttcattaaatatattta

SEQ ID NO: 258266 - DNA, 20 bp, Artificial Sequence
  chemically synthesized
tactttaaatatatttaatg

SEQ ID NO: 258267 - DNA, 20 bp, Artificial Sequence
  chemically synthesized
ttaaatatatttaatgaaga

SEQ ID NO: 258268 - DNA, 20 bp, Artificial Sequence
  chemically synthesized
aatgaagacggatctattga

SEQ ID NO: 258269 - DNA, 20 bp, Artificial Sequence
  chemically synthesized
caagatagtaaatctttcaa

SEQ ID NO: 258270 - DNA, 20 bp, Artificial Sequence
  chemically synthesized
ctggacactacgtatcaaga

SEQ ID NO: 258271 - DNA, 20 bp, Artificial Sequence
  chemically synthesized
agatttactatcttgatacg

SEQ ID NO: 258272 - DNA, 20 bp, Artificial Sequence
  chemically synthesized
atgactggacactacgtatc

SEQ ID NO: 258273 - DNA, 20 bp, Artificial Sequence
  chemically synthesized
ctatcttgatacgtagtgtc

SEQ ID NO: 258274 - DNA, 20 bp, Artificial Sequence
  chemically synthesized
tacgtagtgtccagtcatca

SEQ ID NO: 258275 - DNA, 20 bp, Artificial Sequence
  chemically synthesized
tgtctgttatctgtgatgac

SEQ ID NO: 258276 - DNA, 20 bp, Artificial Sequence
  chemically synthesized
tgtccagtcatcacagataa

SEQ ID NO: 258277 - DNA, 20 bp, Artificial Sequence
  chemically synthesized
catcacagataacagacact

SEQ ID NO: 258278 - DNA, 20 bp, Artificial Sequence
  chemically synthesized
cacagataacagacactaag

SEQ ID NO: 258279 - DNA, 20 bp, Artificial Sequence
  chemically synthesized
ataacagacactaagtggta

SEQ ID NO: 258280 - DNA, 20 bp, Artificial Sequence
  chemically synthesized
gtcagctgatctgtaccact

SEQ ID NO: 258281 - DNA, 20 bp, Artificial Sequence
  chemically synthesized
agacactaagtggtacagat

SEQ ID NO: 258282 - DNA, 20 bp, Artificial Sequence
  chemically synthesized
agtggtacagatcagctgac

SEQ ID NO: 258283 - DNA, 20 bp, Artificial Sequence
  chemically synthesized
tggtacagatcagctgacta

SEQ ID NO: 258284 - DNA, 20 bp, Artificial Sequence
  chemically synthesized
aacccttagttttctctagt

SEQ ID NO: 258285 - DNA, 20 bp, Artificial Sequence
  chemically synthesized
gatcaacccttagttttctc

SEQ ID NO: 258286 - DNA, 20 bp, Artificial Sequence
  chemically synthesized
tcagctgactagagaaaact

SEQ ID NO: 258287 - DNA, 20 bp, Artificial Sequence
  chemically synthesized
cagctgactagagaaaacta

SEQ ID NO: 258288 - DNA, 20 bp, Artificial Sequence
  chemically synthesized
agctgactagagaaaactaa

SEQ ID NO: 258289 - DNA, 20 bp, Artificial Sequence
  chemically synthesized
aagttcacaggatcaaccct

SEQ ID NO: 258290 - DNA, 20 bp, Artificial Sequence
  chemically synthesized
tatttctcaagaaagttcac

SEQ ID NO: 258291 - DNA, 20 bp, Artificial Sequence
  chemically synthesized
ctatttctcaagaaagttca

SEQ ID NO: 258292 - DNA, 20 bp, Artificial Sequence
  chemically synthesized
ttgatcctgtgaactttctt

SEQ ID NO: 258293 - DNA, 20 bp, Artificial Sequence
  chemically synthesized
aatatttctatttctcaaga

SEQ ID NO: 258294 - DNA, 20 bp, Artificial Sequence
  chemically synthesized
ctgtgaactttcttgagaaa

SEQ ID NO: 258295 - DNA, 20 bp, Artificial Sequence
  chemically synthesized
ttggaatatttctatttctc

SEQ ID NO: 258296 - DNA, 20 bp, Artificial Sequence
  chemically synthesized
gtggtgtcaaaaagttattt

SEQ ID NO: 258297 - DNA, 20 bp, Artificial Sequence
  chemically synthesized
agtttcccagtggtgtcaaa

SEQ ID NO: 258298 - DNA, 20 bp, Artificial Sequence
  chemically synthesized
aaataactttttgacaccac

SEQ ID NO: 258299 - DNA, 20 bp, Artificial Sequence
  chemically synthesized
aataactttttgacaccact

SEQ ID NO: 258300 - DNA, 20 bp, Artificial Sequence
  chemically synthesized
atgagttcacagtttcccag

SEQ ID NO: 258301 - DNA, 20 bp, Artificial Sequence
  chemically synthesized
aaaatgagttcacagtttcc

SEQ ID NO: 258302 - DNA, 20 bp, Artificial Sequence
  chemically synthesized
ttttctagaaaatgagttca

SEQ ID NO: 258303 - DNA, 20 bp, Artificial Sequence
  chemically synthesized
gaaactgtgaactcattttc

SEQ ID NO: 258304 - DNA, 20 bp, Artificial Sequence
  chemically synthesized
cacggaattttctagaaaat

SEQ ID NO: 258305 - DNA, 20 bp, Artificial Sequence
  chemically synthesized
cttaataacacggaattttc

SEQ ID NO: 258306 - DNA, 20 bp, Artificial Sequence
  chemically synthesized
ctagaaaattccgtgttatt

SEQ ID NO: 258307 - DNA, 20 bp, Artificial Sequence
  chemically synthesized
aatattcaaacttaataaca

SEQ ID NO: 258308 - DNA, 20 bp, Artificial Sequence
  chemically synthesized
atcagattgctataataaat

SEQ ID NO: 258309 - DNA, 20 bp, Artificial Sequence
  chemically synthesized
ttgaatattctcatttatta

SEQ ID NO: 258310 - DNA, 20 bp, Artificial Sequence
  chemically synthesized
ttaaacattattgtatatat

SEQ ID NO: 258311 - DNA, 20 bp, Artificial Sequence
  chemically synthesized
atacaataatgtttaatata

SEQ ID NO: 258312 - DNA, 20 bp, Artificial Sequence
  chemically synthesized
tgtatatgaaaattacaaaa

SEQ ID NO: 258313 - DNA, 20 bp, Artificial Sequence
  chemically synthesized
tttttgtaattttcatatac

SEQ ID NO: 258314 - DNA, 20 bp, Artificial Sequence
  chemically synthesized
tttcatatacaagaaactac

SEQ ID NO: 258315 - DNA, 20 bp, Artificial Sequence
  chemically synthesized
tcttttgattcaatttctgg

SEQ ID NO: 258316 - DNA, 20 bp, Artificial Sequence
  chemically synthesized
ttctcttttgattcaatttc

SEQ ID NO: 258317 - DNA, 20 bp, Artificial Sequence
  chemically synthesized
actaccagaaattgaatcaa

SEQ ID NO: 258318 - DNA, 20 bp, Artificial Sequence
  chemically synthesized
taccagaaattgaatcaaaa

SEQ ID NO: 258319 - DNA, 20 bp, Artificial Sequence
  chemically synthesized
aaattgaatcaaaagagaac

SEQ ID NO: 258320 - DNA, 20 bp, Artificial Sequence
  chemically synthesized
tcaaaagagaaccagacatt

SEQ ID NO: 258321 - DNA, 20 bp, Artificial Sequence
  chemically synthesized
aaactagatctccaaatgtc

SEQ ID NO: 258322 - DNA, 20 bp, Artificial Sequence
  chemically synthesized
aaaagagaaccagacatttg

SEQ ID NO: 258323 - DNA, 20 bp, Artificial Sequence
  chemically synthesized
gaaccagacatttggagatc

SEQ ID NO: 258324 - DNA, 20 bp, Artificial Sequence
  chemically synthesized
ttaaggaatagatagcaaac

SEQ ID NO: 258325 - DNA, 20 bp, Artificial Sequence
  chemically synthesized
ctatacttttaaggaataga

SEQ ID NO: 258326 - DNA, 20 bp, Artificial Sequence
  chemically synthesized
aatgctatacttttaaggaa

SEQ ID NO: 258327 - DNA, 20 bp, Artificial Sequence
  chemically synthesized
gtttgctatctattccttaa

SEQ ID NO: 258328 - DNA, 20 bp, Artificial Sequence
  chemically synthesized
ataggaatgctatactttta

SEQ ID NO: 258329 - DNA, 20 bp, Artificial Sequence
  chemically synthesized
ctatctattccttaaaagta

SEQ ID NO: 258330 - DNA, 20 bp, Artificial Sequence
  chemically synthesized
aataggaatgctatactttt

SEQ ID NO: 258331 - DNA, 20 bp, Artificial Sequence
  chemically synthesized
gtatagcattcctattgaca

SEQ ID NO: 258332 - DNA, 20 bp, Artificial Sequence
  chemically synthesized
attcgcatgactgtgtcaat

SEQ ID NO: 258333 - DNA, 20 bp, Artificial Sequence
  chemically synthesized
gattcgcatgactgtgtcaa

SEQ ID NO: 258334 - DNA, 20 bp, Artificial Sequence
  chemically synthesized
cagtcatgcgaatctataat

SEQ ID NO: 258335 - DNA, 20 bp, Artificial Sequence
  chemically synthesized
tggatgtagttttctcatta

SEQ ID NO: 258336 - DNA, 20 bp, Artificial Sequence
  chemically synthesized
tgaaagtcattcaatggatg

SEQ ID NO: 258337 - DNA, 20 bp, Artificial Sequence
  chemically synthesized
ccaaactgaaagtcattcaa

SEQ ID NO: 258338 - DNA, 20 bp, Artificial Sequence
  chemically synthesized
tacatccattgaatgacttt

SEQ ID NO: 258339 - DNA, 20 bp, Artificial Sequence
  chemically synthesized
ccattgaatgactttcagtt

SEQ ID NO: 258340 - DNA, 20 bp, Artificial Sequence
  chemically synthesized
tttttattaaaccaaactga

SEQ ID NO: 258341 - DNA, 20 bp, Artificial Sequence
  chemically synthesized
gtttggtttaataaaaattt

SEQ ID NO: 258342 - DNA, 20 bp, Artificial Sequence
  chemically synthesized
ggtttaataaaaatttcaga

SEQ ID NO: 258343 - DNA, 20 bp, Artificial Sequence
  chemically synthesized
tcagacagttatttaaaaat

SEQ ID NO: 258344 - DNA, 20 bp, Artificial Sequence
  chemically synthesized
tatttaaaaatcagtgtaat

SEQ ID NO: 258345 - DNA, 20 bp, Artificial Sequence
  chemically synthesized
cctggattttgcataaagaa

SEQ ID NO: 258346 - DNA, 20 bp, Artificial Sequence
  chemically synthesized
tacctggattttgcataaag

SEQ ID NO: 258347 - DNA, 20 bp, Artificial Sequence
  chemically synthesized
gagtacctggattttgcata

SEQ ID NO: 258348 - DNA, 20 bp, Artificial Sequence
  chemically synthesized
tctcttctttatgcaaaatc

SEQ ID NO: 258349 - DNA, 20 bp, Artificial Sequence
  chemically synthesized
ctcttctttatgcaaaatcc

SEQ ID NO: 258350 - DNA, 20 bp, Artificial Sequence
  chemically synthesized
gattaatctgaatgagtacc

SEQ ID NO: 258351 - DNA, 20 bp, Artificial Sequence
  chemically synthesized
gcaaaatccaggtactcatt

SEQ ID NO: 258352 - DNA, 20 bp, Artificial Sequence
  chemically synthesized
tgaaaaggattaatctgaat

SEQ ID NO: 258353 - DNA, 20 bp, Artificial Sequence
  chemically synthesized
ttaatgaaattcaaatgaaa

SEQ ID NO: 258354 - DNA, 20 bp, Artificial Sequence
  chemically synthesized
gttaatgaaattcaaatgaa

SEQ ID NO: 258355 - DNA, 20 bp, Artificial Sequence
  chemically synthesized
ggataaaattattcaaggca

SEQ ID NO: 258356 - DNA, 20 bp, Artificial Sequence
  chemically synthesized
aaggataaaattattcaagg

SEQ ID NO: 258357 - DNA, 20 bp, Artificial Sequence
  chemically synthesized
cagaaggataaaattattca

SEQ ID NO: 258358 - DNA, 20 bp, Artificial Sequence
  chemically synthesized
tcagaaggataaaattattc

SEQ ID NO: 258359 - DNA, 20 bp, Artificial Sequence
  chemically synthesized
ttgaataattttatccttct

SEQ ID NO: 258360 - DNA, 20 bp, Artificial Sequence
  chemically synthesized
tgtacacatcagaactcaga

SEQ ID NO: 258361 - DNA, 20 bp, Artificial Sequence
  chemically synthesized
ttgtacacatcagaactcag

SEQ ID NO: 258362 - DNA, 20 bp, Artificial Sequence
  chemically synthesized
gatttgtacacatcagaact

SEQ ID NO: 258363 - DNA, 20 bp, Artificial Sequence
  chemically synthesized
tagacgggatttgtacacat

SEQ ID NO: 258364 - DNA, 20 bp, Artificial Sequence
  chemically synthesized
tgattttcaaaaggttagac

SEQ ID NO: 258365 - DNA, 20 bp, Artificial Sequence
  chemically synthesized
ttgattttcaaaaggttaga

SEQ ID NO: 258366 - DNA, 20 bp, Artificial Sequence
  chemically synthesized
caagttgattttcaaaaggt

SEQ ID NO: 258367 - DNA, 20 bp, Artificial Sequence
  chemically synthesized
aaagcaagttgattttcaaa

SEQ ID NO: 258368 - DNA, 20 bp, Artificial Sequence
  chemically synthesized
aaaagcaagttgattttcaa

SEQ ID NO: 258369 - DNA, 20 bp, Artificial Sequence
  chemically synthesized
taaagaacattaacaaaagc

SEQ ID NO: 258370 - DNA, 20 bp, Artificial Sequence
  chemically synthesized
gtggtaaagaacattaacaa

SEQ ID NO: 258371 - DNA, 20 bp, Artificial Sequence
  chemically synthesized
tataatgatataaggtggta

SEQ ID NO: 258372 - DNA, 20 bp, Artificial Sequence
  chemically synthesized
gtatctataatgatataagg

SEQ ID NO: 258373 - DNA, 20 bp, Artificial Sequence
  chemically synthesized
tgagtatctataatgatata

SEQ ID NO: 258374 - DNA, 20 bp, Artificial Sequence
  chemically synthesized
atgagtatctataatgatat

SEQ ID NO: 258375 - DNA, 20 bp, Artificial Sequence
  chemically synthesized
tttaccaccttatatcatta

SEQ ID NO: 258376 - DNA, 20 bp, Artificial Sequence
  chemically synthesized
tttccttgctaatgatgcat

SEQ ID NO: 258377 - DNA, 20 bp, Artificial Sequence
  chemically synthesized
tatagatactcatgcatcat

SEQ ID NO: 258378 - DNA, 20 bp, Artificial Sequence
  chemically synthesized
gatactcatgcatcattagc

SEQ ID NO: 258379 - DNA, 20 bp, Artificial Sequence
  chemically synthesized
atactcatgcatcattagca

SEQ ID NO: 258380 - DNA, 20 bp, Artificial Sequence
  chemically synthesized
aaaatgaattaatcagatta

SEQ ID NO: 258381 - DNA, 20 bp, Artificial Sequence
  chemically synthesized
aagaaataaaatgaattaat

SEQ ID NO: 258382 - DNA, 20 bp, Artificial Sequence
  chemically synthesized
taaaaatgaaaataaacaca

SEQ ID NO: 258383 - DNA, 20 bp, Artificial Sequence
  chemically synthesized
tatattctttggggtatata

SEQ ID NO: 258384 - DNA, 20 bp, Artificial Sequence
  chemically synthesized
ttttaaccatatatacccca

SEQ ID NO: 258385 - DNA, 20 bp, Artificial Sequence
  chemically synthesized
tgaggctagtatattctttg

SEQ ID NO: 258386 - DNA, 20 bp, Artificial Sequence
  chemically synthesized
atgaggctagtatattcttt

SEQ ID NO: 258387 - DNA, 20 bp, Artificial Sequence
  chemically synthesized
aatgaggctagtatattctt

SEQ ID NO: 258388 - DNA, 20 bp, Artificial Sequence
  chemically synthesized
atataccccaaagaatatac

SEQ ID NO: 258389 - DNA, 20 bp, Artificial Sequence
  chemically synthesized
ttgtttctagaaaatgaggc

SEQ ID NO: 258390 - DNA, 20 bp, Artificial Sequence
  chemically synthesized
aatatactagcctcattttc

SEQ ID NO: 258391 - DNA, 20 bp, Artificial Sequence
  chemically synthesized
ctttttgtttctagaaaatg

SEQ ID NO: 258392 - DNA, 20 bp, Artificial Sequence
  chemically synthesized
tctttttgtttctagaaaat

SEQ ID NO: 258393 - DNA, 20 bp, Artificial Sequence
  chemically synthesized
ttcacatatctttttgtttc

SEQ ID NO: 258394 - DNA, 20 bp, Artificial Sequence
  chemically synthesized
cctcattttctagaaacaaa

SEQ ID NO: 258395 - DNA, 20 bp, Artificial Sequence
  chemically synthesized
agaaacaaaaagatatgtga

SEQ ID NO: 258396 - DNA, 20 bp, Artificial Sequence
  chemically synthesized
aaataaaaataggcatttta

SEQ ID NO: 258397 - DNA, 20 bp, Artificial Sequence
  chemically synthesized
tttcatttttaaataaaaat

SEQ ID NO: 258398 - DNA, 20 bp, Artificial Sequence
  chemically synthesized
ttttcatttttaaataaaaa

SEQ ID NO: 258399 - DNA, 20 bp, Artificial Sequence
  chemically synthesized
tatttttatttaaaaatgaa

SEQ ID NO: 258400 - DNA, 20 bp, Artificial Sequence
  chemically synthesized
tgtgttctataatagtcatt

SEQ ID NO: 258401 - DNA, 20 bp, Artificial Sequence
  chemically synthesized
tcaatgcttaatgactatta

SEQ ID NO: 258402 - DNA, 20 bp, Artificial Sequence
  chemically synthesized
atcataattgtgttctataa

SEQ ID NO: 258403 - DNA, 20 bp, Artificial Sequence
  chemically synthesized
atttgtatgatctaaactta

SEQ ID NO: 258404 - DNA, 20 bp, Artificial Sequence
  chemically synthesized
aactgttttgactttaagtt

SEQ ID NO: 258405 - DNA, 20 bp, Artificial Sequence
  chemically synthesized
cttaaaactgttttgacttt

SEQ ID NO: 258406 - DNA, 20 bp, Artificial Sequence
  chemically synthesized
atctaaacttaaagtcaaaa

SEQ ID NO: 258407 - DNA, 20 bp, Artificial Sequence
  chemically synthesized
cttaaagtcaaaacagtttt

SEQ ID NO: 258408 - DNA, 20 bp, Artificial Sequence
  chemically synthesized
caaaacagttttaagattct

SEQ ID NO: 258409 - DNA, 20 bp, Artificial Sequence
  chemically synthesized
ctgtgcctatttacacagct

SEQ ID NO: 258410 - DNA, 20 bp, Artificial Sequence
  chemically synthesized
aagattctgagctgtgtaaa

SEQ ID NO: 258411 - DNA, 20 bp, Artificial Sequence
  chemically synthesized
agattctgagctgtgtaaat

SEQ ID NO: 258412 - DNA, 20 bp, Artificial Sequence
  chemically synthesized
gatacctgtgcctatttaca

SEQ ID NO: 258413 - DNA, 20 bp, Artificial Sequence
  chemically synthesized
ctgagctgtgtaaataggca

SEQ ID NO: 258414 - DNA, 20 bp, Artificial Sequence
  chemically synthesized
tgagctgtgtaaataggcac

SEQ ID NO: 258415 - DNA, 20 bp, Artificial Sequence
  chemically synthesized
aggcacaggtatcactcaca

SEQ ID NO: 258416 - DNA, 20 bp, Artificial Sequence
  chemically synthesized
aaatgtattcaaaactttgt

SEQ ID NO: 258417 - DNA, 20 bp, Artificial Sequence
  chemically synthesized
ttttcattcatctgaaactt

SEQ ID NO: 258418 - DNA, 20 bp, Artificial Sequence
  chemically synthesized
gaatgtgataacttaagttt

SEQ ID NO: 258419 - DNA, 20 bp, Artificial Sequence
  chemically synthesized
tgaaaagaatgtgataactt

SEQ ID NO: 258420 - DNA, 20 bp, Artificial Sequence
  chemically synthesized
aacaaattttatgtaatgaa

SEQ ID NO: 258421 - DNA, 20 bp, Artificial Sequence
  chemically synthesized
tacataaaatttgtttcttg

SEQ ID NO: 258422 - DNA, 20 bp, Artificial Sequence
  chemically synthesized
acataaaatttgtttcttga

SEQ ID NO: 258423 - DNA, 20 bp, Artificial Sequence
  chemically synthesized
cataaaatttgtttcttgaa

SEQ ID NO: 258424 - DNA, 20 bp, Artificial Sequence
  chemically synthesized
ctttgcagttatggcccttc

SEQ ID NO: 258425 - DNA, 20 bp, Artificial Sequence
  chemically synthesized
gcttttatcctttgcagtta

SEQ ID NO: 258426 - DNA, 20 bp, Artificial Sequence
  chemically synthesized
cttgaagggccataactgca

SEQ ID NO: 258427 - DNA, 20 bp, Artificial Sequence
  chemically synthesized
ttgaagggccataactgcaa

SEQ ID NO: 258428 - DNA, 20 bp, Artificial Sequence
  chemically synthesized
aggattgcttttatcctttg

SEQ ID NO: 258429 - DNA, 20 bp, Artificial Sequence
  chemically synthesized
gccataactgcaaaggataa

SEQ ID NO: 258430 - DNA, 20 bp, Artificial Sequence
  chemically synthesized
tgcaccatttgtttcaaaac

SEQ ID NO: 258431 - DNA, 20 bp, Artificial Sequence
  chemically synthesized
atgcaccatttgtttcaaaa

SEQ ID NO: 258432 - DNA, 20 bp, Artificial Sequence
  chemically synthesized
caatcctgttttgaaacaaa

SEQ ID NO: 258433 - DNA, 20 bp, Artificial Sequence
  chemically synthesized
aacaaatggtgcattatgtc

SEQ ID NO: 258434 - DNA, 20 bp, Artificial Sequence
  chemically synthesized
acaaatggtgcattatgtct

SEQ ID NO: 258435 - DNA, 20 bp, Artificial Sequence
  chemically synthesized
aaacattttgtttaaaaacc

SEQ ID NO: 258436 - DNA, 20 bp, Artificial Sequence
  chemically synthesized
agaagtcttttaaatcatgg

SEQ ID NO: 258437 - DNA, 20 bp, Artificial Sequence
  chemically synthesized
aagaagtcttttaaatcatg

SEQ ID NO: 258438 - DNA, 20 bp, Artificial Sequence
  chemically synthesized
gaaagaagtcttttaaatca

SEQ ID NO: 258439 - DNA, 20 bp, Artificial Sequence
  chemically synthesized
tgttttcctccatgatttaa

SEQ ID NO: 258440 - DNA, 20 bp, Artificial Sequence
  chemically synthesized
aatgcatttaaaggagaaag

SEQ ID NO: 258441 - DNA, 20 bp, Artificial Sequence
  chemically synthesized
ctcaatgcatttaaaggaga

SEQ ID NO: 258442 - DNA, 20 bp, Artificial Sequence
  chemically synthesized
taacctcaatgcatttaaag

SEQ ID NO: 258443 - DNA, 20 bp, Artificial Sequence
  chemically synthesized
agtaacctcaatgcatttaa

SEQ ID NO: 258444 - DNA, 20 bp, Artificial Sequence
  chemically synthesized
cagtaacctcaatgcattta

SEQ ID NO: 258445 - DNA, 20 bp, Artificial Sequence
  chemically synthesized
ctttctcctttaaatgcatt

SEQ ID NO: 258446 - DNA, 20 bp, Artificial Sequence
  chemically synthesized
tttctcctttaaatgcattg

SEQ ID NO: 258447 - DNA, 20 bp, Artificial Sequence
  chemically synthesized
tttaaatgcattgaggttac

SEQ ID NO: 258448 - DNA, 20 bp, Artificial Sequence
  chemically synthesized
ctcataactcataaatgggc

SEQ ID NO: 258449 - DNA, 20 bp, Artificial Sequence
  chemically synthesized
gaggttactggcccatttat

SEQ ID NO: 258450 - DNA, 20 bp, Artificial Sequence
  chemically synthesized
tgacctcataactcataaat

SEQ ID NO: 258451 - DNA, 20 bp, Artificial Sequence
  chemically synthesized
ttgacctcataactcataaa

SEQ ID NO: 258452 - DNA, 20 bp, Artificial Sequence
  chemically synthesized
ctggcccatttatgagttat

SEQ ID NO: 258453 - DNA, 20 bp, Artificial Sequence
  chemically synthesized
tggcccatttatgagttatg

SEQ ID NO: 258454 - DNA, 20 bp, Artificial Sequence
  chemically synthesized
atttatgagttatgaggtca

SEQ ID NO: 258455 - DNA, 20 bp, Artificial Sequence
  chemically synthesized
ttatgaggtcaaagaaactc

SEQ ID NO: 258456 - DNA, 20 bp, Artificial Sequence
  chemically synthesized
tgaggtcaaagaaactcaag

SEQ ID NO: 258457 - DNA, 20 bp, Artificial Sequence
  chemically synthesized
tatagcacatttttcttctt

SEQ ID NO: 258458 - DNA, 20 bp, Artificial Sequence
  chemically synthesized
tgtcataatcatatgtcata

SEQ ID NO: 258459 - DNA, 20 bp, Artificial Sequence
  chemically synthesized
tgagatatatagttattttg

SEQ ID NO: 258460 - DNA, 20 bp, Artificial Sequence
  chemically synthesized
ccatatttatatgagatata

SEQ ID NO: 258461 - DNA, 20 bp, Artificial Sequence
  chemically synthesized
ttcatgtgccatatttatat

SEQ ID NO: 258462 - DNA, 20 bp, Artificial Sequence
  chemically synthesized
ctatatatctcatataaata

SEQ ID NO: 258463 - DNA, 20 bp, Artificial Sequence
  chemically synthesized
aaaatatatcaatgcatcaa

SEQ ID NO: 258464 - DNA, 20 bp, Artificial Sequence
  chemically synthesized
catcaaaagtgtaacaaaaa

SEQ ID NO: 258465 - DNA, 20 bp, Artificial Sequence
  chemically synthesized
actgtttttggtcaagataa

SEQ ID NO: 258466 - DNA, 20 bp, Artificial Sequence
  chemically synthesized
ctattttactgtttttggtc

SEQ ID NO: 258467 - DNA, 20 bp, Artificial Sequence
  chemically synthesized
actattatcttgaccaaaaa

SEQ ID NO: 258468 - DNA, 20 bp, Artificial Sequence
  chemically synthesized
catcactattttactgtttt

SEQ ID NO: 258469 - DNA, 20 bp, Artificial Sequence
  chemically synthesized
cttgaccaaaaacagtaaaa

SEQ ID NO: 258470 - DNA, 20 bp, Artificial Sequence
  chemically synthesized
caaaaacagtaaaatagtga

SEQ ID NO: 258471 - DNA, 20 bp, Artificial Sequence
  chemically synthesized
aaaacagtaaaatagtgatg

SEQ ID NO: 258472 - DNA, 20 bp, Artificial Sequence
  chemically synthesized
caacgcagttaaaaaaaaaa

SEQ ID NO: 258473 - DNA, 20 bp, Artificial Sequence
  chemically synthesized
ccaacgcagttaaaaaaaaa

SEQ ID NO: 258474 - DNA, 20 bp, Artificial Sequence
  chemically synthesized
ctttttttttttaactgcgt

SEQ ID NO: 258475 - DNA, 20 bp, Artificial Sequence
  chemically synthesized
catcttcattaacaccaacg

SEQ ID NO: 258476 - DNA, 20 bp, Artificial Sequence
  chemically synthesized
taactgcgttggtgttaatg

SEQ ID NO: 258477 - DNA, 20 bp, Artificial Sequence
  chemically synthesized
gtgttaatgaagatgaaaat

SEQ ID NO: 258478 - DNA, 20 bp, Artificial Sequence
  chemically synthesized
tgaaaataagcaaatcctca

SEQ ID NO: 258479 - DNA, 20 bp, Artificial Sequence
  chemically synthesized
aataagcaaatcctcaaagt

SEQ ID NO: 258480 - DNA, 20 bp, Artificial Sequence
  chemically synthesized
cattaataaatcttactttg

SEQ ID NO: 258481 - DNA, 20 bp, Artificial Sequence
  chemically synthesized
tcattaataaatcttacttt

SEQ ID NO: 258482 - DNA, 20 bp, Artificial Sequence
  chemically synthesized
agtaagatttattaatgatt

SEQ ID NO: 258483 - DNA, 20 bp, Artificial Sequence
  chemically synthesized
atttattaatgatttagtgt

SEQ ID NO: 258484 - DNA, 20 bp, Artificial Sequence
  chemically synthesized
gctcatagattttcatatta

SEQ ID NO: 258485 - DNA, 20 bp, Artificial Sequence
  chemically synthesized
gctataatatgaaaatctat

SEQ ID NO: 258486 - DNA, 20 bp, Artificial Sequence
  chemically synthesized
tactttcatattatggctca

SEQ ID NO: 258487 - DNA, 20 bp, Artificial Sequence
  chemically synthesized
actgacatactttcatatta

SEQ ID NO: 258488 - DNA, 20 bp, Artificial Sequence
  chemically synthesized
atctatgagccataatatga

SEQ ID NO: 258489 - DNA, 20 bp, Artificial Sequence
  chemically synthesized
gccataatatgaaagtatgt

SEQ ID NO: 258490 - DNA, 20 bp, Artificial Sequence
  chemically synthesized
tccctttgaggaaagataat

SEQ ID NO: 258491 - DNA, 20 bp, Artificial Sequence
  chemically synthesized
tatctgattatctttcctca

SEQ ID NO: 258492 - DNA, 20 bp, Artificial Sequence
  chemically synthesized
atctgattatctttcctcaa

SEQ ID NO: 258493 - DNA, 20 bp, Artificial Sequence
  chemically synthesized
taagaatgtccctttgagga

SEQ ID NO: 258494 - DNA, 20 bp, Artificial Sequence
  chemically synthesized
tctgattatctttcctcaaa

SEQ ID NO: 258495 - DNA, 20 bp, Artificial Sequence
  chemically synthesized
tatttaagaatgtccctttg

SEQ ID NO: 258496 - DNA, 20 bp, Artificial Sequence
  chemically synthesized
atatttaagaatgtcccttt

SEQ ID NO: 258497 - DNA, 20 bp, Artificial Sequence
  chemically synthesized
ttaaataatccataatattt

SEQ ID NO: 258498 - DNA, 20 bp, Artificial Sequence
  chemically synthesized
agggacattcttaaatatta

SEQ ID NO: 258499 - DNA, 20 bp, Artificial Sequence
  chemically synthesized
aaatattatggattatttaa

SEQ ID NO: 258500 - DNA, 20 bp, Artificial Sequence
  chemically synthesized
aatgatatgtaaatccaaaa

SEQ ID NO: 258501 - DNA, 20 bp, Artificial Sequence
  chemically synthesized
atgatatgtaaatccaaaat

SEQ ID NO: 258502 - DNA, 20 bp, Artificial Sequence
  chemically synthesized
taaagcctgcagtcctattt

SEQ ID NO: 258503 - DNA, 20 bp, Artificial Sequence
  chemically synthesized
gtaaatccaaaataggactg

SEQ ID NO: 258504 - DNA, 20 bp, Artificial Sequence
  chemically synthesized
taaatccaaaataggactgc

SEQ ID NO: 258505 - DNA, 20 bp, Artificial Sequence
  chemically synthesized
cagaacctacttaaagcctg

SEQ ID NO: 258506 - DNA, 20 bp, Artificial Sequence
  chemically synthesized
aaaataggactgcaggcttt

SEQ ID NO: 258507 - DNA, 20 bp, Artificial Sequence
  chemically synthesized
ataggactgcaggctttaag

SEQ ID NO: 258508 - DNA, 20 bp, Artificial Sequence
  chemically synthesized
taggactgcaggctttaagt

SEQ ID NO: 258509 - DNA, 20 bp, Artificial Sequence
  chemically synthesized
gacccatcagaacctactta

SEQ ID NO: 258510 - DNA, 20 bp, Artificial Sequence
  chemically synthesized
aggctttaagtaggttctga

SEQ ID NO: 258511 - DNA, 20 bp, Artificial Sequence
  chemically synthesized
ggctttaagtaggttctgat

SEQ ID NO: 258512 - DNA, 20 bp, Artificial Sequence
  chemically synthesized
ccttttcatttatgacccat

SEQ ID NO: 258513 - DNA, 20 bp, Artificial Sequence
  chemically synthesized
tctgatgggtcataaatgaa

SEQ ID NO: 258514 - DNA, 20 bp, Artificial Sequence
  chemically synthesized
ctgatgggtcataaatgaaa

SEQ ID NO: 258515 - DNA, 20 bp, Artificial Sequence
  chemically synthesized
ggtcataaatgaaaaggcaa

SEQ ID NO: 258516 - DNA, 20 bp, Artificial Sequence
  chemically synthesized
gtcataaatgaaaaggcaat

SEQ ID NO: 258517 - DNA, 20 bp, Artificial Sequence
  chemically synthesized
taaatgaaaaggcaatggga

SEQ ID NO: 258518 - DNA, 20 bp, Artificial Sequence
  chemically synthesized
aaaggcaatgggaaagactt

SEQ ID NO: 258519 - DNA, 20 bp, Artificial Sequence
  chemically synthesized
aatgggaaagacttaagtct

SEQ ID NO: 258520 - DNA, 20 bp, Artificial Sequence
  chemically synthesized
gagctacttgtctaagactt

SEQ ID NO: 258521 - DNA, 20 bp, Artificial Sequence
  chemically synthesized
gaaagacttaagtcttagac

SEQ ID NO: 258522 - DNA, 20 bp, Artificial Sequence
  chemically synthesized
agacttaagtcttagacaag

SEQ ID NO: 258523 - DNA, 20 bp, Artificial Sequence
  chemically synthesized
agagacagagctacttgtct

SEQ ID NO: 258524 - DNA, 20 bp, Artificial Sequence
  chemically synthesized
agacaagtagctctgtctct

SEQ ID NO: 258525 - DNA, 20 bp, Artificial Sequence
  chemically synthesized
acttgtggggctaagagaca

SEQ ID NO: 258526 - DNA, 20 bp, Artificial Sequence
  chemically synthesized
agacttgtggggctaagaga

SEQ ID NO: 258527 - DNA, 20 bp, Artificial Sequence
  chemically synthesized
ctgaagacttgtggggctaa

SEQ ID NO: 258528 - DNA, 20 bp, Artificial Sequence
  chemically synthesized
ctctgaagacttgtggggct

SEQ ID NO: 258529 - DNA, 20 bp, Artificial Sequence
  chemically synthesized
gctctgtctcttagccccac

SEQ ID NO: 258530 - DNA, 20 bp, Artificial Sequence
  chemically synthesized
tctttctctgaagacttgtg

SEQ ID NO: 258531 - DNA, 20 bp, Artificial Sequence
  chemically synthesized
gtctttctctgaagacttgt

SEQ ID NO: 258532 - DNA, 20 bp, Artificial Sequence
  chemically synthesized
tgtctttctctgaagacttg

SEQ ID NO: 258533 - DNA, 20 bp, Artificial Sequence
  chemically synthesized
ctcttagccccacaagtctt

SEQ ID NO: 258534 - DNA, 20 bp, Artificial Sequence
  chemically synthesized
cttagccccacaagtcttca

SEQ ID NO: 258535 - DNA, 20 bp, Artificial Sequence
  chemically synthesized
gccccacaagtcttcagaga

SEQ ID NO: 258536 - DNA, 20 bp, Artificial Sequence
  chemically synthesized
aggaaacttgtctttctctg

SEQ ID NO: 258537 - DNA, 20 bp, Artificial Sequence
  chemically synthesized
acaagtcttcagagaaagac

SEQ ID NO: 258538 - DNA, 20 bp, Artificial Sequence
  chemically synthesized
gagaaagacaagtttccttc

SEQ ID NO: 258539 - DNA, 20 bp, Artificial Sequence
  chemically synthesized
agaaagacaagtttccttct

SEQ ID NO: 258540 - DNA, 20 bp, Artificial Sequence
  chemically synthesized
ttactgtaatgattcctaga

SEQ ID NO: 258541 - DNA, 20 bp, Artificial Sequence
  chemically synthesized
attactgtaatgattcctag

SEQ ID NO: 258542 - DNA, 20 bp, Artificial Sequence
  chemically synthesized
tttattactgtaatgattcc

SEQ ID NO: 258543 - DNA, 20 bp, Artificial Sequence
  chemically synthesized
tttccttctaggaatcatta

SEQ ID NO: 258544 - DNA, 20 bp, Artificial Sequence
  chemically synthesized
aatcattacagtaataaaca

SEQ ID NO: 258545 - DNA, 20 bp, Artificial Sequence
  chemically synthesized
ttacagtaataaacaaagtt

SEQ ID NO: 258546 - DNA, 20 bp, Artificial Sequence
  chemically synthesized
acagtaataaacaaagttga

SEQ ID NO: 258547 - DNA, 20 bp, Artificial Sequence
  chemically synthesized
gattttttatttatttctcc

SEQ ID NO: 258548 - DNA, 20 bp, Artificial Sequence
  chemically synthesized
tgcctattataattgtccag

SEQ ID NO: 258549 - DNA, 20 bp, Artificial Sequence
  chemically synthesized
aatgcctattataattgtcc

SEQ ID NO: 258550 - DNA, 20 bp, Artificial Sequence
  chemically synthesized
caatgcctattataattgtc

SEQ ID NO: 258551 - DNA, 20 bp, Artificial Sequence
  chemically synthesized
tttctcctggacaattataa

SEQ ID NO: 258552 - DNA, 20 bp, Artificial Sequence
  chemically synthesized
ttctcctggacaattataat

SEQ ID NO: 258553 - DNA, 20 bp, Artificial Sequence
  chemically synthesized
acaattataataggcattgt

SEQ ID NO: 258554 - DNA, 20 bp, Artificial Sequence
  chemically synthesized
aatgcaaatcacaaacaaat

SEQ ID NO: 258555 - DNA, 20 bp, Artificial Sequence
  chemically synthesized
atgcaaatcacaaacaaatt

SEQ ID NO: 258556 - DNA, 20 bp, Artificial Sequence
  chemically synthesized
attaggcaaaaatattgtat

SEQ ID NO: 258557 - DNA, 20 bp, Artificial Sequence
  chemically synthesized
gcaaaaatattgtattggtc

SEQ ID NO: 258558 - DNA, 20 bp, Artificial Sequence
  chemically synthesized
caaaaatattgtattggtcc

SEQ ID NO: 258559 - DNA, 20 bp, Artificial Sequence
  chemically synthesized
aaaaatattgtattggtcca

SEQ ID NO: 258560 - DNA, 20 bp, Artificial Sequence
  chemically synthesized
ttggggttttttaatcaccc

SEQ ID NO: 258561 - DNA, 20 bp, Artificial Sequence
  chemically synthesized
tttttatgctttattgtttg

SEQ ID NO: 258562 - DNA, 20 bp, Artificial Sequence
  chemically synthesized
gtttttatgctttattgttt

SEQ ID NO: 258563 - DNA, 20 bp, Artificial Sequence
  chemically synthesized
ttaaaaaaccccaaacaata

SEQ ID NO: 258564 - DNA, 20 bp, Artificial Sequence
  chemically synthesized
tgtttttatgctttattgtt

SEQ ID NO: 258565 - DNA, 20 bp, Artificial Sequence
  chemically synthesized
aaaaacaaaacaacatgatg

SEQ ID NO: 258566 - DNA, 20 bp, Artificial Sequence
  chemically synthesized
aaaacaaaacaacatgatgc

SEQ ID NO: 258567 - DNA, 20 bp, Artificial Sequence
  chemically synthesized
caaaacaacatgatgcaggt

SEQ ID NO: 258568 - DNA, 20 bp, Artificial Sequence
  chemically synthesized
acaacatgatgcaggtgaga

SEQ ID NO: 258569 - DNA, 20 bp, Artificial Sequence
  chemically synthesized
caacatgatgcaggtgagac

SEQ ID NO: 258570 - DNA, 20 bp, Artificial Sequence
  chemically synthesized
tgatgcaggtgagacgggta

SEQ ID NO: 258571 - DNA, 20 bp, Artificial Sequence
  chemically synthesized
tatccaaaacagtgacaacg

SEQ ID NO: 258572 - DNA, 20 bp, Artificial Sequence
  chemically synthesized
aatctgcgttgtcactgttt

SEQ ID NO: 258573 - DNA, 20 bp, Artificial Sequence
  chemically synthesized
gccattatatgtatccaaaa

SEQ ID NO: 258574 - DNA, 20 bp, Artificial Sequence
  chemically synthesized
actgttttggatacatataa

SEQ ID NO: 258575 - DNA, 20 bp, Artificial Sequence
  chemically synthesized
atataatggcatgacaataa

SEQ ID NO: 258576 - DNA, 20 bp, Artificial Sequence
  chemically synthesized
tgacaataacagcattctga

SEQ ID NO: 258577 - DNA, 20 bp, Artificial Sequence
  chemically synthesized
cagacaaaacgaagtactgt

SEQ ID NO: 258578 - DNA, 20 bp, Artificial Sequence
  chemically synthesized
tgactaaaacagacaaaacg

SEQ ID NO: 258579 - DNA, 20 bp, Artificial Sequence
  chemically synthesized
gtacttcgttttgtctgttt

SEQ ID NO: 258580 - DNA, 20 bp, Artificial Sequence
  chemically synthesized
acccagtgacttgactaaaa

SEQ ID NO: 258581 - DNA, 20 bp, Artificial Sequence
  chemically synthesized
tcgttttgtctgttttagtc

SEQ ID NO: 258582 - DNA, 20 bp, Artificial Sequence
  chemically synthesized
gtctgttttagtcaagtcac

SEQ ID NO: 258583 - DNA, 20 bp, Artificial Sequence
  chemically synthesized
tctgttttagtcaagtcact

SEQ ID NO: 258584 - DNA, 20 bp, Artificial Sequence
  chemically synthesized
gttttagtcaagtcactggg

SEQ ID NO: 258585 - DNA, 20 bp, Artificial Sequence
  chemically synthesized
tagtcaagtcactgggtaga

SEQ ID NO: 258586 - DNA, 20 bp, Artificial Sequence
  chemically synthesized
ttattcaacatctttctacc

SEQ ID NO: 258587 - DNA, 20 bp, Artificial Sequence
  chemically synthesized
tgttgaataatcaatctaat

SEQ ID NO: 258588 - DNA, 20 bp, Artificial Sequence
  chemically synthesized
accaatatgcttagactcat

SEQ ID NO: 258589 - DNA, 20 bp, Artificial Sequence
  chemically synthesized
ataatcaatctaatgagtct

SEQ ID NO: 258590 - DNA, 20 bp, Artificial Sequence
  chemically synthesized
tctaatgagtctaagcatat

SEQ ID NO: 258591 - DNA, 20 bp, Artificial Sequence
  chemically synthesized
acggtcataaccaatatgct

SEQ ID NO: 258592 - DNA, 20 bp, Artificial Sequence
  chemically synthesized
atattggttatgaccgtgca

SEQ ID NO: 258593 - DNA, 20 bp, Artificial Sequence
  chemically synthesized
attgctattttttctatgca

SEQ ID NO: 258594 - DNA, 20 bp, Artificial Sequence
  chemically synthesized
atgaccgtgcatagaaaaaa

SEQ ID NO: 258595 - DNA, 20 bp, Artificial Sequence
  chemically synthesized
tgcatagaaaaaatagcaat

SEQ ID NO: 258596 - DNA, 20 bp, Artificial Sequence
  chemically synthesized
catagaaaaaatagcaatga

SEQ ID NO: 258597 - DNA, 20 bp, Artificial Sequence
  chemically synthesized
tagaaaaaatagcaatgaga

SEQ ID NO: 258598 - DNA, 20 bp, Artificial Sequence
  chemically synthesized
ggaagggggaaatcacataa

SEQ ID NO: 258599 - DNA, 20 bp, Artificial Sequence
  chemically synthesized
taggaagggggaaatcacat

SEQ ID NO: 258600 - DNA, 20 bp, Artificial Sequence
  chemically synthesized
tagatgatgcaataggaagg

SEQ ID NO: 258601 - DNA, 20 bp, Artificial Sequence
  chemically synthesized
ttagatgatgcaataggaag

SEQ ID NO: 258602 - DNA, 20 bp, Artificial Sequence
  chemically synthesized
tttagatgatgcaataggaa

SEQ ID NO: 258603 - DNA, 20 bp, Artificial Sequence
  chemically synthesized
ttttagatgatgcaatagga

SEQ ID NO: 258604 - DNA, 20 bp, Artificial Sequence
  chemically synthesized
tttttagatgatgcaatagg

SEQ ID NO: 258605 - DNA, 20 bp, Artificial Sequence
  chemically synthesized
aattttttagatgatgcaat

SEQ ID NO: 258606 - DNA, 20 bp, Artificial Sequence
  chemically synthesized
caattttttagatgatgcaa

SEQ ID NO: 258607 - DNA, 20 bp, Artificial Sequence
  chemically synthesized
gcttcacataagcaattttt

SEQ ID NO: 258608 - DNA, 20 bp, Artificial Sequence
  chemically synthesized
tctaaaaaattgcttatgtg

SEQ ID NO: 258609 - DNA, 20 bp, Artificial Sequence
  chemically synthesized
ttggttacatagcttcacat

SEQ ID NO: 258610 - DNA, 20 bp, Artificial Sequence
  chemically synthesized
aggccctttttttggttaca

SEQ ID NO: 258611 - DNA, 20 bp, Artificial Sequence
  chemically synthesized
tgaagctatgtaaccaaaaa

SEQ ID NO: 258612 - DNA, 20 bp, Artificial Sequence
  chemically synthesized
gaagctatgtaaccaaaaaa

SEQ ID NO: 258613 - DNA, 20 bp, Artificial Sequence
  chemically synthesized
aagctatgtaaccaaaaaaa

SEQ ID NO: 258614 - DNA, 20 bp, Artificial Sequence
  chemically synthesized
agatggacaggccctttttt

SEQ ID NO: 258615 - DNA, 20 bp, Artificial Sequence
  chemically synthesized
ataattattctgagatggac

SEQ ID NO: 258616 - DNA, 20 bp, Artificial Sequence
  chemically synthesized
aaaaaagggcctgtccatct

SEQ ID NO: 258617 - DNA, 20 bp, Artificial Sequence
  chemically synthesized
aataattattctgagatgga

SEQ ID NO: 258618 - DNA, 20 bp, Artificial Sequence
  chemically synthesized
tctgaataattattctgaga

SEQ ID NO: 258619 - DNA, 20 bp, Artificial Sequence
  chemically synthesized
tgattctgaataattattct

SEQ ID NO: 258620 - DNA, 20 bp, Artificial Sequence
  chemically synthesized
tccatctcagaataattatt

SEQ ID NO: 258621 - DNA, 20 bp, Artificial Sequence
  chemically synthesized
ttattctttttaaacaaagg

SEQ ID NO: 258622 - DNA, 20 bp, Artificial Sequence
  chemically synthesized
tttattctttttaaacaaag

SEQ ID NO: 258623 - DNA, 20 bp, Artificial Sequence
  chemically synthesized
ttttattctttttaaacaaa

SEQ ID NO: 258624 - DNA, 20 bp, Artificial Sequence
  chemically synthesized
gttttattctttttaaacaa

SEQ ID NO: 258625 - DNA, 20 bp, Artificial Sequence
  chemically synthesized
agttttattctttttaaaca

SEQ ID NO: 258626 - DNA, 20 bp, Artificial Sequence
  chemically synthesized
atttaccccctttgtttaaa

SEQ ID NO: 258627 - DNA, 20 bp, Artificial Sequence
  chemically synthesized
actattttgtgtatgttagt

SEQ ID NO: 258628 - DNA, 20 bp, Artificial Sequence
  chemically synthesized
cttgactattttgtgtatgt

SEQ ID NO: 258629 - DNA, 20 bp, Artificial Sequence
  chemically synthesized
actcactaacatacacaaaa

SEQ ID NO: 258630 - DNA, 20 bp, Artificial Sequence
  chemically synthesized
ctaacatacacaaaatagtc

SEQ ID NO: 258631 - DNA, 20 bp, Artificial Sequence
  chemically synthesized
taacatacacaaaatagtca

SEQ ID NO: 258632 - DNA, 20 bp, Artificial Sequence
  chemically synthesized
atagtcaaggtaaaatatga

SEQ ID NO: 258633 - DNA, 20 bp, Artificial Sequence
  chemically synthesized
aataaataatatgggcataa

SEQ ID NO: 258634 - DNA, 20 bp, Artificial Sequence
  chemically synthesized
aaataaataatatgggcata

SEQ ID NO: 258635 - DNA, 20 bp, Artificial Sequence
  chemically synthesized
ctttagaaaataaataatat

SEQ ID NO: 258636 - DNA, 20 bp, Artificial Sequence
  chemically synthesized
actttagaaaataaataata

SEQ ID NO: 258637 - DNA, 20 bp, Artificial Sequence
  chemically synthesized
cccatattatttattttcta

SEQ ID NO: 258638 - DNA, 20 bp, Artificial Sequence
  chemically synthesized
tattatttattttctaaagt

SEQ ID NO: 258639 - DNA, 20 bp, Artificial Sequence
  chemically synthesized
ttaaaaattaattctaactt

SEQ ID NO: 258640 - DNA, 20 bp, Artificial Sequence
  chemically synthesized
aaagttagaattaattttta

SEQ ID NO: 258641 - DNA, 20 bp, Artificial Sequence
  chemically synthesized
gttagaattaatttttaaag

SEQ ID NO: 258642 - DNA, 20 bp, Artificial Sequence
  chemically synthesized
ttagaattaatttttaaagc

SEQ ID NO: 258643 - DNA, 20 bp, Artificial Sequence
  chemically synthesized
tagaattaatttttaaagca

SEQ ID NO: 258644 - DNA, 20 bp, Artificial Sequence
  chemically synthesized
aattaatttttaaagcaggg

SEQ ID NO: 258645 - DNA, 20 bp, Artificial Sequence
  chemically synthesized
attaatttttaaagcagggc

SEQ ID NO: 258646 - DNA, 20 bp, Artificial Sequence
  chemically synthesized
tttaaagcagggcaggctgt

SEQ ID NO: 258647 - DNA, 20 bp, Artificial Sequence
  chemically synthesized
ctgcatatctttttcgctga

SEQ ID NO: 258648 - DNA, 20 bp, Artificial Sequence
  chemically synthesized
agggcaggctgtcagcgaaa

SEQ ID NO: 258649 - DNA, 20 bp, Artificial Sequence
  chemically synthesized
ctgtcagcgaaaaagatatg

SEQ ID NO: 258650 - DNA, 20 bp, Artificial Sequence
  chemically synthesized
aaaagatatgcagatgatgc

SEQ ID NO: 258651 - DNA, 20 bp, Artificial Sequence
  chemically synthesized
gcagatgatgctggatttgc

SEQ ID NO: 258652 - DNA, 20 bp, Artificial Sequence
  chemically synthesized
tatttaaagactggcaaatc

SEQ ID NO: 258653 - DNA, 20 bp, Artificial Sequence
  chemically synthesized
agcagggtgtatttaaagac

SEQ ID NO: 258654 - DNA, 20 bp, Artificial Sequence
  chemically synthesized
ctagaagcagggtgtattta

SEQ ID NO: 258655 - DNA, 20 bp, Artificial Sequence
  chemically synthesized
ctttaaatacaccctgcttc

SEQ ID NO: 258656 - DNA, 20 bp, Artificial Sequence
  chemically synthesized
tacctggccttctagaagca

SEQ ID NO: 258657 - DNA, 20 bp, Artificial Sequence
  chemically synthesized
atacctggccttctagaagc

SEQ ID NO: 258658 - DNA, 20 bp, Artificial Sequence
  chemically synthesized
taaatacaccctgcttctag

SEQ ID NO: 258659 - DNA, 20 bp, Artificial Sequence
  chemically synthesized
tatacctggccttctagaag

SEQ ID NO: 258660 - DNA, 20 bp, Artificial Sequence
  chemically synthesized
aaatacaccctgcttctaga

SEQ ID NO: 258661 - DNA, 20 bp, Artificial Sequence
  chemically synthesized
atttatacctggccttctag

SEQ ID NO: 258662 - DNA, 20 bp, Artificial Sequence
  chemically synthesized
acaccctgcttctagaaggc

SEQ ID NO: 258663 - DNA, 20 bp, Artificial Sequence
  chemically synthesized
caccctgcttctagaaggcc

SEQ ID NO: 258664 - DNA, 20 bp, Artificial Sequence
  chemically synthesized
actatttatacctggccttc

SEQ ID NO: 258665 - DNA, 20 bp, Artificial Sequence
  chemically synthesized
cataggacactatttatacc

SEQ ID NO: 258666 - DNA, 20 bp, Artificial Sequence
  chemically synthesized
tctagaaggccaggtataaa

SEQ ID NO: 258667 - DNA, 20 bp, Artificial Sequence
  chemically synthesized
ataaatagtgtcctatgtaa

SEQ ID NO: 258668 - DNA, 20 bp, Artificial Sequence
  chemically synthesized
taaatagtgtcctatgtaaa

SEQ ID NO: 258669 - DNA, 20 bp, Artificial Sequence
  chemically synthesized
tctgtccagaccttttacat

SEQ ID NO: 258670 - DNA, 20 bp, Artificial Sequence
  chemically synthesized
gtctgtccagaccttttaca

SEQ ID NO: 258671 - DNA, 20 bp, Artificial Sequence
  chemically synthesized
agtgtcctatgtaaaaggtc

SEQ ID NO: 258672 - DNA, 20 bp, Artificial Sequence
  chemically synthesized
tcctatgtaaaaggtctgga

SEQ ID NO: 258673 - DNA, 20 bp, Artificial Sequence
  chemically synthesized
ggtcaatgagcaggtctgtc

SEQ ID NO: 258674 - DNA, 20 bp, Artificial Sequence
  chemically synthesized
catgaggcaggtcaatgagc

SEQ ID NO: 258675 - DNA, 20 bp, Artificial Sequence
  chemically synthesized
acatgaggcaggtcaatgag

SEQ ID NO: 258676 - DNA, 20 bp, Artificial Sequence
  chemically synthesized
tccacatgaggcaggtcaat

SEQ ID NO: 258677 - DNA, 20 bp, Artificial Sequence
  chemically synthesized
agtcagaatccacatgaggc

SEQ ID NO: 258678 - DNA, 20 bp, Artificial Sequence
  chemically synthesized
gctcattgacctgcctcatg

SEQ ID NO: 258679 - DNA, 20 bp, Artificial Sequence
  chemically synthesized
aagtcagaatccacatgagg

SEQ ID NO: 258680 - DNA, 20 bp, Artificial Sequence
  chemically synthesized
agaaagtcagaatccacatg

SEQ ID NO: 258681 - DNA, 20 bp, Artificial Sequence
  chemically synthesized
tagaaagtcagaatccacat

SEQ ID NO: 258682 - DNA, 20 bp, Artificial Sequence
  chemically synthesized
aatttcatggtgtagaaagt

SEQ ID NO: 258683 - DNA, 20 bp, Artificial Sequence
  chemically synthesized
ggtaaatttcatggtgtaga

SEQ ID NO: 258684 - DNA, 20 bp, Artificial Sequence
  chemically synthesized
attaggtaaatttcatggtg

SEQ ID NO: 258685 - DNA, 20 bp, Artificial Sequence
  chemically synthesized
gaggaattaggtaaatttca

SEQ ID NO: 258686 - DNA, 20 bp, Artificial Sequence
  chemically synthesized
atgaaatttacctaattcct

SEQ ID NO: 258687 - DNA, 20 bp, Artificial Sequence
  chemically synthesized
gagcttggccctgaggaatt

SEQ ID NO: 258688 - DNA, 20 bp, Artificial Sequence
  chemically synthesized
tgaaatttacctaattcctc

SEQ ID NO: 258689 - DNA, 20 bp, Artificial Sequence
  chemically synthesized
tgagcttggccctgaggaat

SEQ ID NO: 258690 - DNA, 20 bp, Artificial Sequence
  chemically synthesized
gaaatttacctaattcctca

SEQ ID NO: 258691 - DNA, 20 bp, Artificial Sequence
  chemically synthesized
ttacctaattcctcagggcc

SEQ ID NO: 258692 - DNA, 20 bp, Artificial Sequence
  chemically synthesized
agtaattgagcttggccctg

SEQ ID NO: 258693 - DNA, 20 bp, Artificial Sequence
  chemically synthesized
tagtaattgagcttggccct

SEQ ID NO: 258694 - DNA, 20 bp, Artificial Sequence
  chemically synthesized
aatttgatagtaattgagct

SEQ ID NO: 258695 - DNA, 20 bp, Artificial Sequence
  chemically synthesized
agcttaatttgatagtaatt

SEQ ID NO: 258696 - DNA, 20 bp, Artificial Sequence
  chemically synthesized
agctcaattactatcaaatt

SEQ ID NO: 258697 - DNA, 20 bp, Artificial Sequence
  chemically synthesized
agtttatcagcttaatttga

SEQ ID NO: 258698 - DNA, 20 bp, Artificial Sequence
  chemically synthesized
attttccagattcagtttat

SEQ ID NO: 258699 - DNA, 20 bp, Artificial Sequence
  chemically synthesized
ttaagctgataaactgaatc

SEQ ID NO: 258700 - DNA, 20 bp, Artificial Sequence
  chemically synthesized
attaacacattttccagatt

SEQ ID NO: 258701 - DNA, 20 bp, Artificial Sequence
  chemically synthesized
taagccattaacacattttc

SEQ ID NO: 258702 - DNA, 20 bp, Artificial Sequence
  chemically synthesized
gaatctggaaaatgtgttaa

SEQ ID NO: 258703 - DNA, 20 bp, Artificial Sequence
  chemically synthesized
gaaaatgtgttaatggctta

SEQ ID NO: 258704 - DNA, 20 bp, Artificial Sequence
  chemically synthesized
aatgtgttaatggcttatag

SEQ ID NO: 258705 - DNA, 20 bp, Artificial Sequence
  chemically synthesized
gaaagactttaaaccactat

SEQ ID NO: 258706 - DNA, 20 bp, Artificial Sequence
  chemically synthesized
taatggcttatagtggttta

SEQ ID NO: 258707 - DNA, 20 bp, Artificial Sequence
  chemically synthesized
aatgttgtcctttgaaacga

SEQ ID NO: 258708 - DNA, 20 bp, Artificial Sequence
  chemically synthesized
gtttaaagtctttcgtttca

SEQ ID NO: 258709 - DNA, 20 bp, Artificial Sequence
  chemically synthesized
tttaaagtctttcgtttcaa

SEQ ID NO: 258710 - DNA, 20 bp, Artificial Sequence
  chemically synthesized
acaacatttgcatttttata

SEQ ID NO: 258711 - DNA, 20 bp, Artificial Sequence
  chemically synthesized
catttttatacagattttca

SEQ ID NO: 258712 - DNA, 20 bp, Artificial Sequence
  chemically synthesized
ttcaaagaattaacataaat

SEQ ID NO: 258713 - DNA, 20 bp, Artificial Sequence
  chemically synthesized
ttagtgactaaaattttatc

SEQ ID NO: 258714 - DNA, 20 bp, Artificial Sequence
  chemically synthesized
ttagtaacttgataaaattt

SEQ ID NO: 258715 - DNA, 20 bp, Artificial Sequence
  chemically synthesized
ttgataaaattttagtcact

SEQ ID NO: 258716 - DNA, 20 bp, Artificial Sequence
  chemically synthesized
aaaattttagtcactaagta

SEQ ID NO: 258717 - DNA, 20 bp, Artificial Sequence
  chemically synthesized
cttctctcacaggccatact

SEQ ID NO: 258718 - DNA, 20 bp, Artificial Sequence
  chemically synthesized
agtcactaagtatggcctgt

SEQ ID NO: 258719 - DNA, 20 bp, Artificial Sequence
  chemically synthesized
tcactaagtatggcctgtga

SEQ ID NO: 258720 - DNA, 20 bp, Artificial Sequence
  chemically synthesized
ctaagtatggcctgtgagag

SEQ ID NO: 258721 - DNA, 20 bp, Artificial Sequence
  chemically synthesized
ttttctttctcttctctcac

SEQ ID NO: 258722 - DNA, 20 bp, Artificial Sequence
  chemically synthesized
cttttctttctcttctctca

SEQ ID NO: 258723 - DNA, 20 bp, Artificial Sequence
  chemically synthesized
aagtatggcctgtgagagaa

SEQ ID NO: 258724 - DNA, 20 bp, Artificial Sequence
  chemically synthesized
atggcctgtgagagaagaga

SEQ ID NO: 258725 - DNA, 20 bp, Artificial Sequence
  chemically synthesized
ctgtgagagaagagaaagaa

SEQ ID NO: 258726 - DNA, 20 bp, Artificial Sequence
  chemically synthesized
tgtgagagaagagaaagaaa

SEQ ID NO: 258727 - DNA, 20 bp, Artificial Sequence
  chemically synthesized
gtgagagaagagaaagaaaa

SEQ ID NO: 258728 - DNA, 20 bp, Artificial Sequence
  chemically synthesized
gaagagaaagaaaagggctt

SEQ ID NO: 258729 - DNA, 20 bp, Artificial Sequence
  chemically synthesized
acttatcttggtggcaacca

SEQ ID NO: 258730 - DNA, 20 bp, Artificial Sequence
  chemically synthesized
aaagggctttggttgccacc

SEQ ID NO: 258731 - DNA, 20 bp, Artificial Sequence
  chemically synthesized
gctttggttgccaccaagat

SEQ ID NO: 258732 - DNA, 20 bp, Artificial Sequence
  chemically synthesized
tgtgttgatacttatcttgg

SEQ ID NO: 258733 - DNA, 20 bp, Artificial Sequence
  chemically synthesized
ttatgtgttgatacttatct

SEQ ID NO: 258734 - DNA, 20 bp, Artificial Sequence
  chemically synthesized
caagataagtatcaacacat

SEQ ID NO: 258735 - DNA, 20 bp, Artificial Sequence
  chemically synthesized
gataagtatcaacacataag

SEQ ID NO: 258736 - DNA, 20 bp, Artificial Sequence
  chemically synthesized
acacataagcagcaatatat

SEQ ID NO: 258737 - DNA, 20 bp, Artificial Sequence
  chemically synthesized
tatataagcaccaacaatca

SEQ ID NO: 258738 - DNA, 20 bp, Artificial Sequence
  chemically synthesized
acaaagcaggccatgattgt

SEQ ID NO: 258739 - DNA, 20 bp, Artificial Sequence
  chemically synthesized
tggagatggttttacaaagc

SEQ ID NO: 258740 - DNA, 20 bp, Artificial Sequence
  chemically synthesized
ttggagatggttttacaaag

SEQ ID NO: 258741 - DNA, 20 bp, Artificial Sequence
  chemically synthesized
tttttggagatggttttaca

SEQ ID NO: 258742 - DNA, 20 bp, Artificial Sequence
  chemically synthesized
tataggttattttttggaga

SEQ ID NO: 258743 - DNA, 20 bp, Artificial Sequence
  chemically synthesized
aatttataggttattttttg

SEQ ID NO: 258744 - DNA, 20 bp, Artificial Sequence
  chemically synthesized
ttaatttataggttattttt

SEQ ID NO: 258745 - DNA, 20 bp, Artificial Sequence
  chemically synthesized
aaccttatctattaatttat

SEQ ID NO: 258746 - DNA, 20 bp, Artificial Sequence
  chemically synthesized
taaccttatctattaattta

SEQ ID NO: 258747 - DNA, 20 bp, Artificial Sequence
  chemically synthesized
aaaaataacctataaattaa

SEQ ID NO: 258748 - DNA, 20 bp, Artificial Sequence
  chemically synthesized
taacctataaattaatagat

SEQ ID NO: 258749 - DNA, 20 bp, Artificial Sequence
  chemically synthesized
aacctataaattaatagata

SEQ ID NO: 258750 - DNA, 20 bp, Artificial Sequence
  chemically synthesized
atagataaggttatacaccc

SEQ ID NO: 258751 - DNA, 20 bp, Artificial Sequence
  chemically synthesized
gctgccttataagttggcta

SEQ ID NO: 258752 - DNA, 20 bp, Artificial Sequence
  chemically synthesized
tgctgccttataagttggct

SEQ ID NO: 258753 - DNA, 20 bp, Artificial Sequence
  chemically synthesized
ttgctgccttataagttggc

SEQ ID NO: 258754 - DNA, 20 bp, Artificial Sequence
  chemically synthesized
atacaccctagccaacttat

SEQ ID NO: 258755 - DNA, 20 bp, Artificial Sequence
  chemically synthesized
tacaccctagccaacttata

SEQ ID NO: 258756 - DNA, 20 bp, Artificial Sequence
  chemically synthesized
ttttttgctgccttataagt

SEQ ID NO: 258757 - DNA, 20 bp, Artificial Sequence
  chemically synthesized
accctagccaacttataagg

SEQ ID NO: 258758 - DNA, 20 bp, Artificial Sequence
  chemically synthesized
tttattttttgctgccttat

SEQ ID NO: 258759 - DNA, 20 bp, Artificial Sequence
  chemically synthesized
aaggcagcaaaaaataaatg

SEQ ID NO: 258760 - DNA, 20 bp, Artificial Sequence
  chemically synthesized
agcaaaaaataaatgcagca

SEQ ID NO: 258761 - DNA, 20 bp, Artificial Sequence
  chemically synthesized
atgcagcaaagactcatgcc

SEQ ID NO: 258762 - DNA, 20 bp, Artificial Sequence
  chemically synthesized
gtatgctaggtactaggcat

SEQ ID NO: 258763 - DNA, 20 bp, Artificial Sequence
  chemically synthesized
aaagactcatgcctagtacc

SEQ ID NO: 258764 - DNA, 20 bp, Artificial Sequence
  chemically synthesized
catactgtatgctaggtact

SEQ ID NO: 258765 - DNA, 20 bp, Artificial Sequence
  chemically synthesized
acatactgtatgctaggtac

SEQ ID NO: 258766 - DNA, 20 bp, Artificial Sequence
  chemically synthesized
catgcctagtacctagcata

SEQ ID NO: 258767 - DNA, 20 bp, Artificial Sequence
  chemically synthesized
ttgataacatactgtatgct

SEQ ID NO: 258768 - DNA, 20 bp, Artificial Sequence
  chemically synthesized
tttgataacatactgtatgc

SEQ ID NO: 258769 - DNA, 20 bp, Artificial Sequence
  chemically synthesized
atgttatcaaaaatatttgt

SEQ ID NO: 258770 - DNA, 20 bp, Artificial Sequence
  chemically synthesized
ggataaattaatgaaaaaac

SEQ ID NO: 258771 - DNA, 20 bp, Artificial Sequence
  chemically synthesized
aaaaacaagtatcaacttaa

SEQ ID NO: 258772 - DNA, 20 bp, Artificial Sequence
  chemically synthesized
aaaacaagtatcaacttaac

SEQ ID NO: 258773 - DNA, 20 bp, Artificial Sequence
  chemically synthesized
tatcttataattatcctgtt

SEQ ID NO: 258774 - DNA, 20 bp, Artificial Sequence
  chemically synthesized
caacttaacaggataattat

SEQ ID NO: 258775 - DNA, 20 bp, Artificial Sequence
  chemically synthesized
ttaacaggataattataaga

SEQ ID NO: 258776 - DNA, 20 bp, Artificial Sequence
  chemically synthesized
ataattataagatagatatg

SEQ ID NO: 258777 - DNA, 20 bp, Artificial Sequence
  chemically synthesized
agatatgtggttacaattgc

SEQ ID NO: 258778 - DNA, 20 bp, Artificial Sequence
  chemically synthesized
gatatgtggttacaattgct

SEQ ID NO: 258779 - DNA, 20 bp, Artificial Sequence
  chemically synthesized
taaattataaatgtaaatcc

SEQ ID NO: 258780 - DNA, 20 bp, Artificial Sequence
  chemically synthesized
ttacatttataatttatatt

SEQ ID NO: 258781 - DNA, 20 bp, Artificial Sequence
  chemically synthesized
tacatttataatttatattt

SEQ ID NO: 258782 - DNA, 20 bp, Artificial Sequence
  chemically synthesized
aatttatatttaggaatatt

SEQ ID NO: 258783 - DNA, 20 bp, Artificial Sequence
  chemically synthesized
aggaatattcagaattcaaa

SEQ ID NO: 258784 - DNA, 20 bp, Artificial Sequence
  chemically synthesized
ggaatattcagaattcaaac

SEQ ID NO: 258785 - DNA, 20 bp, Artificial Sequence
  chemically synthesized
aaagattgcattataaaatg

SEQ ID NO: 258786 - DNA, 20 bp, Artificial Sequence
  chemically synthesized
cttttaaatctatgacaata

SEQ ID NO: 258787 - DNA, 20 bp, Artificial Sequence
  chemically synthesized
taatgcaatctttattgtca

SEQ ID NO: 258788 - DNA, 20 bp, Artificial Sequence
  chemically synthesized
ctttattgtcatagatttaa

SEQ ID NO: 258789 - DNA, 20 bp, Artificial Sequence
  chemically synthesized
tttattgtcatagatttaaa

SEQ ID NO: 258790 - DNA, 20 bp, Artificial Sequence
  chemically synthesized
gaaatgcgacatagtgaaat

SEQ ID NO: 258791 - DNA, 20 bp, Artificial Sequence
  chemically synthesized
tgaattgaagaaatgcgaca

SEQ ID NO: 258792 - DNA, 20 bp, Artificial Sequence
  chemically synthesized
tgtcgcatttcttcaattca

SEQ ID NO: 258793 - DNA, 20 bp, Artificial Sequence
  chemically synthesized
agctaatgtgctatgaattg

SEQ ID NO: 258794 - DNA, 20 bp, Artificial Sequence
  chemically synthesized
ttcttcaattcatagcacat

SEQ ID NO: 258795 - DNA, 20 bp, Artificial Sequence
  chemically synthesized
cacgcatgtacaatagcatg

SEQ ID NO: 258796 - DNA, 20 bp, Artificial Sequence
  chemically synthesized
acctaagcacgcatgtacaa

SEQ ID NO: 258797 - DNA, 20 bp, Artificial Sequence
  chemically synthesized
tgctattgtacatgcgtgct

SEQ ID NO: 258798 - DNA, 20 bp, Artificial Sequence
  chemically synthesized
gctattgtacatgcgtgctt

SEQ ID NO: 258799 - DNA, 20 bp, Artificial Sequence
  chemically synthesized
aaaagacaatttaaggacct

SEQ ID NO: 258800 - DNA, 20 bp, Artificial Sequence
  chemically synthesized
agtaactaaaagacaattta

SEQ ID NO: 258801 - DNA, 20 bp, Artificial Sequence
  chemically synthesized
tagtaactaaaagacaattt

SEQ ID NO: 258802 - DNA, 20 bp, Artificial Sequence
  chemically synthesized
taggtccttaaattgtcttt

SEQ ID NO: 258803 - DNA, 20 bp, Artificial Sequence
  chemically synthesized
tgagtcagattagtaactaa

SEQ ID NO: 258804 - DNA, 20 bp, Artificial Sequence
  chemically synthesized
tcaagtataatgagtcagat

SEQ ID NO: 258805 - DNA, 20 bp, Artificial Sequence
  chemically synthesized
tgtattcaagtataatgagt

SEQ ID NO: 258806 - DNA, 20 bp, Artificial Sequence
  chemically synthesized
tgtttgtattcaagtataat

SEQ ID NO: 258807 - DNA, 20 bp, Artificial Sequence
  chemically synthesized
aattgcttatgtttgtattc

SEQ ID NO: 258808 - DNA, 20 bp, Artificial Sequence
  chemically synthesized
ttatacttgaatacaaacat

SEQ ID NO: 258809 - DNA, 20 bp, Artificial Sequence
  chemically synthesized
acaaacataagcaattattt

SEQ ID NO: 258810 - DNA, 20 bp, Artificial Sequence
  chemically synthesized
caaacataagcaattatttg

SEQ ID NO: 258811 - DNA, 20 bp, Artificial Sequence
  chemically synthesized
ttatttgaggtaatgacata

SEQ ID NO: 258812 - DNA, 20 bp, Artificial Sequence
  chemically synthesized
aatgacatatagacgatatt

SEQ ID NO: 258813 - DNA, 20 bp, Artificial Sequence
  chemically synthesized
atattaagatatactgattt

SEQ ID NO: 258814 - DNA, 20 bp, Artificial Sequence
  chemically synthesized
acccatgaagaagctaaaat

SEQ ID NO: 258815 - DNA, 20 bp, Artificial Sequence
  chemically synthesized
tactgattttagcttcttca

SEQ ID NO: 258816 - DNA, 20 bp, Artificial Sequence
  chemically synthesized
actgattttagcttcttcat

SEQ ID NO: 258817 - DNA, 20 bp, Artificial Sequence
  chemically synthesized
acattatgatacccatgaag

SEQ ID NO: 258818 - DNA, 20 bp, Artificial Sequence
  chemically synthesized
tagacattatgatacccatg

SEQ ID NO: 258819 - DNA, 20 bp, Artificial Sequence
  chemically synthesized
atgggtatcataatgtctat

SEQ ID NO: 258820 - DNA, 20 bp, Artificial Sequence
  chemically synthesized
catacccttcaatttgctaa

SEQ ID NO: 258821 - DNA, 20 bp, Artificial Sequence
  chemically synthesized
taatgtctattagcaaattg

SEQ ID NO: 258822 - DNA, 20 bp, Artificial Sequence
  chemically synthesized
aatgtctattagcaaattga

SEQ ID NO: 258823 - DNA, 20 bp, Artificial Sequence
  chemically synthesized
atgtctattagcaaattgaa

SEQ ID NO: 258824 - DNA, 20 bp, Artificial Sequence
  chemically synthesized
attagcaaattgaagggtat

SEQ ID NO: 258825 - DNA, 20 bp, Artificial Sequence
  chemically synthesized
agcaaattgaagggtatgag

SEQ ID NO: 258826 - DNA, 20 bp, Artificial Sequence
  chemically synthesized
taaaatgattttttgaatac

SEQ ID NO: 258827 - DNA, 20 bp, Artificial Sequence
  chemically synthesized
agtttgggaagagttatcaa

SEQ ID NO: 258828 - DNA, 20 bp, Artificial Sequence
  chemically synthesized
gagtttgggaagagttatca

SEQ ID NO: 258829 - DNA, 20 bp, Artificial Sequence
  chemically synthesized
ttatgagaagagtttgggaa

SEQ ID NO: 258830 - DNA, 20 bp, Artificial Sequence
  chemically synthesized
ttttatgagaagagtttggg

SEQ ID NO: 258831 - DNA, 20 bp, Artificial Sequence
  chemically synthesized
aacttttatgagaagagttt

SEQ ID NO: 258832 - DNA, 20 bp, Artificial Sequence
  chemically synthesized
aaacttttatgagaagagtt

SEQ ID NO: 258833 - DNA, 20 bp, Artificial Sequence
  chemically synthesized
aacgaaaacttttatgagaa

SEQ ID NO: 258834 - DNA, 20 bp, Artificial Sequence
  chemically synthesized
ttcccaaactcttctcataa

SEQ ID NO: 258835 - DNA, 20 bp, Artificial Sequence
  chemically synthesized
taaacgaaaacttttatgag

SEQ ID NO: 258836 - DNA, 20 bp, Artificial Sequence
  chemically synthesized
atgtaaacgaaaacttttat

SEQ ID NO: 258837 - DNA, 20 bp, Artificial Sequence
  chemically synthesized
aaagttttcgtttacatatc

SEQ ID NO: 258838 - DNA, 20 bp, Artificial Sequence
  chemically synthesized
ttaaaataaaaaatatatac

SEQ ID NO: 258839 - DNA, 20 bp, Artificial Sequence
  chemically synthesized
tagtatatattttttatttt

SEQ ID NO: 258840 - DNA, 20 bp, Artificial Sequence
  chemically synthesized
cccaagctgaaattttggaa

SEQ ID NO: 258841 - DNA, 20 bp, Artificial Sequence
  chemically synthesized
tttaagctattccaaaattt

SEQ ID NO: 258842 - DNA, 20 bp, Artificial Sequence
  chemically synthesized
gtattcccaagctgaaattt

SEQ ID NO: 258843 - DNA, 20 bp, Artificial Sequence
  chemically synthesized
gctattccaaaatttcagct

SEQ ID NO: 258844 - DNA, 20 bp, Artificial Sequence
  chemically synthesized
ctattccaaaatttcagctt

SEQ ID NO: 258845 - DNA, 20 bp, Artificial Sequence
  chemically synthesized
ttgctatagcaagtattccc

SEQ ID NO: 258846 - DNA, 20 bp, Artificial Sequence
  chemically synthesized
cagcttgggaatacttgcta

SEQ ID NO: 258847 - DNA, 20 bp, Artificial Sequence
  chemically synthesized
tacaaaaagattgctatagc

SEQ ID NO: 258848 - DNA, 20 bp, Artificial Sequence
  chemically synthesized
aacatacaaaaagattgcta

SEQ ID NO: 258849 - DNA, 20 bp, Artificial Sequence
  chemically synthesized
tttgcttgtcaacatacaaa

SEQ ID NO: 258850 - DNA, 20 bp, Artificial Sequence
  chemically synthesized
caatctttttgtatgttgac

SEQ ID NO: 258851 - DNA, 20 bp, Artificial Sequence
  chemically synthesized
atgtgtgtgaggtggaggga

SEQ ID NO: 258852 - DNA, 20 bp, Artificial Sequence
  chemically synthesized
tatgtgtgtgaggtggaggg

SEQ ID NO: 258853 - DNA, 20 bp, Artificial Sequence
  chemically synthesized
gtatgtgtgtgaggtggagg

SEQ ID NO: 258854 - DNA, 20 bp, Artificial Sequence
  chemically synthesized
aagtatgtgtgtgaggtgga

SEQ ID NO: 258855 - DNA, 20 bp, Artificial Sequence
  chemically synthesized
taagtatgtgtgtgaggtgg

SEQ ID NO: 258856 - DNA, 20 bp, Artificial Sequence
  chemically synthesized
ataagtatgtgtgtgaggtg

SEQ ID NO: 258857 - DNA, 20 bp, Artificial Sequence
  chemically synthesized
gtataagtatgtgtgtgagg

SEQ ID NO: 258858 - DNA, 20 bp, Artificial Sequence
  chemically synthesized
taagtataagtatgtgtgtg

SEQ ID NO: 258859 - DNA, 20 bp, Artificial Sequence
  chemically synthesized
ttaagtataagtatgtgtgt

SEQ ID NO: 258860 - DNA, 20 bp, Artificial Sequence
  chemically synthesized
tttcacactgaattaagtat

SEQ ID NO: 258861 - DNA, 20 bp, Artificial Sequence
  chemically synthesized
acacatacttatacttaatt

SEQ ID NO: 258862 - DNA, 20 bp, Artificial Sequence
  chemically synthesized
ttttattttcacactgaatt

SEQ ID NO: 258863 - DNA, 20 bp, Artificial Sequence
  chemically synthesized
ttaattcagtgtgaaaataa

SEQ ID NO: 258864 - DNA, 20 bp, Artificial Sequence
  chemically synthesized
tgtgaaaataaaagtaacac

SEQ ID NO: 258865 - DNA, 20 bp, Artificial Sequence
  chemically synthesized
aaagtaacacaagaaaaaat

SEQ ID NO: 258866 - DNA, 20 bp, Artificial Sequence
  chemically synthesized
aacacaagaaaaaataagta

SEQ ID NO: 258867 - DNA, 20 bp, Artificial Sequence
  chemically synthesized
caagaaaaaataagtatgga

SEQ ID NO: 258868 - DNA, 20 bp, Artificial Sequence
  chemically synthesized
aaatataactgcagtattta

SEQ ID NO: 258869 - DNA, 20 bp, Artificial Sequence
  chemically synthesized
gaaatataactgcagtattt

SEQ ID NO: 258870 - DNA, 20 bp, Artificial Sequence
  chemically synthesized
tggaaagaccttaaatactg

SEQ ID NO: 258871 - DNA, 20 bp, Artificial Sequence
  chemically synthesized
aggagggtgaaatataactg

SEQ ID NO: 258872 - DNA, 20 bp, Artificial Sequence
  chemically synthesized
aagttaaaagcgatatagga

SEQ ID NO: 258873 - DNA, 20 bp, Artificial Sequence
  chemically synthesized
gaagttaaaagcgatatagg

SEQ ID NO: 258874 - DNA, 20 bp, Artificial Sequence
  chemically synthesized
agaagttaaaagcgatatag

SEQ ID NO: 258875 - DNA, 20 bp, Artificial Sequence
  chemically synthesized
acagaagttaaaagcgatat

SEQ ID NO: 258876 - DNA, 20 bp, Artificial Sequence
  chemically synthesized
aacagaagttaaaagcgata

SEQ ID NO: 258877 - DNA, 20 bp, Artificial Sequence
  chemically synthesized
cacaaggcaacagaagttaa

SEQ ID NO: 258878 - DNA, 20 bp, Artificial Sequence
  chemically synthesized
acagatccacaaggcaacag

SEQ ID NO: 258879 - DNA, 20 bp, Artificial Sequence
  chemically synthesized
ttgacagatccacaaggcaa

SEQ ID NO: 258880 - DNA, 20 bp, Artificial Sequence
  chemically synthesized
ttttaacttctgttgccttg

SEQ ID NO: 258881 - DNA, 20 bp, Artificial Sequence
  chemically synthesized
ctcaagttgacagatccaca

SEQ ID NO: 258882 - DNA, 20 bp, Artificial Sequence
  chemically synthesized
actcaagttgacagatccac

SEQ ID NO: 258883 - DNA, 20 bp, Artificial Sequence
  chemically synthesized
ccttgtggatctgtcaactt

SEQ ID NO: 258884 - DNA, 20 bp, Artificial Sequence
  chemically synthesized
gaaaaatctactcaagttga

SEQ ID NO: 258885 - DNA, 20 bp, Artificial Sequence
  chemically synthesized
tgtggatctgtcaacttgag

SEQ ID NO: 258886 - DNA, 20 bp, Artificial Sequence
  chemically synthesized
ttattctgaaaaatctactc

SEQ ID NO: 258887 - DNA, 20 bp, Artificial Sequence
  chemically synthesized
gtcaacttgagtagattttt

SEQ ID NO: 258888 - DNA, 20 bp, Artificial Sequence
  chemically synthesized
taatatagaaataaaagtgt

SEQ ID NO: 258889 - DNA, 20 bp, Artificial Sequence
  chemically synthesized
caaatgtaatatagaaataa

SEQ ID NO: 258890 - DNA, 20 bp, Artificial Sequence
  chemically synthesized
ggggtgtgacaaatgtaata

SEQ ID NO: 258891 - DNA, 20 bp, Artificial Sequence
  chemically synthesized
attacatttgtcacacccct

SEQ ID NO: 258892 - DNA, 20 bp, Artificial Sequence
  chemically synthesized
tagtgtccacattttctgag

SEQ ID NO: 258893 - DNA, 20 bp, Artificial Sequence
  chemically synthesized
atagtgtccacattttctga

SEQ ID NO: 258894 - DNA, 20 bp, Artificial Sequence
  chemically synthesized
gatagtgtccacattttctg

SEQ ID NO: 258895 - DNA, 20 bp, Artificial Sequence
  chemically synthesized
agatagtgtccacattttct

SEQ ID NO: 258896 - DNA, 20 bp, Artificial Sequence
  chemically synthesized
gtcacacccctcagaaaatg

SEQ ID NO: 258897 - DNA, 20 bp, Artificial Sequence
  chemically synthesized
gaaaatgtggacactatctc

SEQ ID NO: 258898 - DNA, 20 bp, Artificial Sequence
  chemically synthesized
ttgccgcattaatctagaga

SEQ ID NO: 258899 - DNA, 20 bp, Artificial Sequence
  chemically synthesized
tgagttgccgcattaatcta

SEQ ID NO: 258900 - DNA, 20 bp, Artificial Sequence
  chemically synthesized
actgagttgccgcattaatc

SEQ ID NO: 258901 - DNA, 20 bp, Artificial Sequence
  chemically synthesized
acactatctctagattaatg

SEQ ID NO: 258902 - DNA, 20 bp, Artificial Sequence
  chemically synthesized
tctagattaatgcggcaact

SEQ ID NO: 258903 - DNA, 20 bp, Artificial Sequence
  chemically synthesized
catatttagacatagatact

SEQ ID NO: 258904 - DNA, 20 bp, Artificial Sequence
  chemically synthesized
gacacatgcatatttagaca

SEQ ID NO: 258905 - DNA, 20 bp, Artificial Sequence
  chemically synthesized
aattatgacacatgcatatt

SEQ ID NO: 258906 - DNA, 20 bp, Artificial Sequence
  chemically synthesized
gtgtcataattatgtttttc

SEQ ID NO: 258907 - DNA, 20 bp, Artificial Sequence
  chemically synthesized
tgtcataattatgtttttca

SEQ ID NO: 258908 - DNA, 20 bp, Artificial Sequence
  chemically synthesized
cataattatgtttttcaagg

SEQ ID NO: 258909 - DNA, 20 bp, Artificial Sequence
  chemically synthesized
caaggaagtattctcttcat

SEQ ID NO: 258910 - DNA, 20 bp, Artificial Sequence
  chemically synthesized
tcactcgcatttctaatgaa

SEQ ID NO: 258911 - DNA, 20 bp, Artificial Sequence
  chemically synthesized
tatcactcgcatttctaatg

SEQ ID NO: 258912 - DNA, 20 bp, Artificial Sequence
  chemically synthesized
attctcttcattagaaatgc

SEQ ID NO: 258913 - DNA, 20 bp, Artificial Sequence
  chemically synthesized
ttcattagaaatgcgagtga

SEQ ID NO: 258914 - DNA, 20 bp, Artificial Sequence
  chemically synthesized
tagaaatgcgagtgatagta

SEQ ID NO: 258915 - DNA, 20 bp, Artificial Sequence
  chemically synthesized
tataattacactatcccgta

SEQ ID NO: 258916 - DNA, 20 bp, Artificial Sequence
  chemically synthesized
ctaatgactaccatacggga

SEQ ID NO: 258917 - DNA, 20 bp, Artificial Sequence
  chemically synthesized
aattacactatcccgtatgg

SEQ ID NO: 258918 - DNA, 20 bp, Artificial Sequence
  chemically synthesized
gtagctaatgactaccatac

SEQ ID NO: 258919 - DNA, 20 bp, Artificial Sequence
  chemically synthesized
tgtagctaatgactaccata

SEQ ID NO: 258920 - DNA, 20 bp, Artificial Sequence
  chemically synthesized
ctatcccgtatggtagtcat

SEQ ID NO: 258921 - DNA, 20 bp, Artificial Sequence
  chemically synthesized
tacatttctttcgtcaagtg

SEQ ID NO: 258922 - DNA, 20 bp, Artificial Sequence
  chemically synthesized
tcattagctacacttgacga

SEQ ID NO: 258923 - DNA, 20 bp, Artificial Sequence
  chemically synthesized
agatttacatttctttcgtc

SEQ ID NO: 258924 - DNA, 20 bp, Artificial Sequence
  chemically synthesized
gtatttgcttttaaataatt

SEQ ID NO: 258925 - DNA, 20 bp, Artificial Sequence
  chemically synthesized
tgtaaatctaaattatttaa

SEQ ID NO: 258926 - DNA, 20 bp, Artificial Sequence
  chemically synthesized
agcaaatacaattaaaaact

SEQ ID NO: 258927 - DNA, 20 bp, Artificial Sequence
  chemically synthesized
ctagtaaaaacagatgtact

SEQ ID NO: 258928 - DNA, 20 bp, Artificial Sequence
  chemically synthesized
cttagtacatctgtttttac

SEQ ID NO: 258929 - DNA, 20 bp, Artificial Sequence
  chemically synthesized
taaaacatggctagtaaaaa

SEQ ID NO: 258930 - DNA, 20 bp, Artificial Sequence
  chemically synthesized
ctgagaacttaaaacatggc

SEQ ID NO: 258931 - DNA, 20 bp, Artificial Sequence
  chemically synthesized
gtttttactagccatgtttt

SEQ ID NO: 258932 - DNA, 20 bp, Artificial Sequence
  chemically synthesized
gctactgagaacttaaaaca

SEQ ID NO: 258933 - DNA, 20 bp, Artificial Sequence
  chemically synthesized
ctagccatgttttaagttct

SEQ ID NO: 258934 - DNA, 20 bp, Artificial Sequence
  chemically synthesized
gccatgttttaagttctcag

SEQ ID NO: 258935 - DNA, 20 bp, Artificial Sequence
  chemically synthesized
aagtagctattgaggctact

SEQ ID NO: 258936 - DNA, 20 bp, Artificial Sequence
  chemically synthesized
taagttctcagtagcctcaa

SEQ ID NO: 258937 - DNA, 20 bp, Artificial Sequence
  chemically synthesized
gtccaataaagtagctattg

SEQ ID NO: 258938 - DNA, 20 bp, Artificial Sequence
  chemically synthesized
tgtccaataaagtagctatt

SEQ ID NO: 258939 - DNA, 20 bp, Artificial Sequence
  chemically synthesized
agcctcaatagctactttat

SEQ ID NO: 258940 - DNA, 20 bp, Artificial Sequence
  chemically synthesized
atctacactgtccaataaag

SEQ ID NO: 258941 - DNA, 20 bp, Artificial Sequence
  chemically synthesized
tcaatagctactttattgga

SEQ ID NO: 258942 - DNA, 20 bp, Artificial Sequence
  chemically synthesized
tatatctacactgtccaata

SEQ ID NO: 258943 - DNA, 20 bp, Artificial Sequence
  chemically synthesized
agctactttattggacagtg

SEQ ID NO: 258944 - DNA, 20 bp, Artificial Sequence
  chemically synthesized
tttattggacagtgtagata

SEQ ID NO: 258945 - DNA, 20 bp, Artificial Sequence
  chemically synthesized
atagaacattgccatcatct

SEQ ID NO: 258946 - DNA, 20 bp, Artificial Sequence
  chemically synthesized
tatagaactttctgagatga

SEQ ID NO: 258947 - DNA, 20 bp, Artificial Sequence
  chemically synthesized
aacattgccatcatctcaga

SEQ ID NO: 258948 - DNA, 20 bp, Artificial Sequence
  chemically synthesized
actgtcctatagaactttct

SEQ ID NO: 258949 - DNA, 20 bp, Artificial Sequence
  chemically synthesized
catcatctcagaaagttcta

SEQ ID NO: 258950 - DNA, 20 bp, Artificial Sequence
  chemically synthesized
atcatctcagaaagttctat

SEQ ID NO: 258951 - DNA, 20 bp, Artificial Sequence
  chemically synthesized
tctcagaaagttctatagga

SEQ ID NO: 258952 - DNA, 20 bp, Artificial Sequence
  chemically synthesized
tctagattagcactgtccta

SEQ ID NO: 258953 - DNA, 20 bp, Artificial Sequence
  chemically synthesized
tctataggacagtgctaatc

SEQ ID NO: 258954 - DNA, 20 bp, Artificial Sequence
  chemically synthesized
tataggacagtgctaatcta

SEQ ID NO: 258955 - DNA, 20 bp, Artificial Sequence
  chemically synthesized
tgtattgtcattctctagat

SEQ ID NO: 258956 - DNA, 20 bp, Artificial Sequence
  chemically synthesized
taaaatgtattgtcattctc

SEQ ID NO: 258957 - DNA, 20 bp, Artificial Sequence
  chemically synthesized
atgacaatacattttattta

SEQ ID NO: 258958 - DNA, 20 bp, Artificial Sequence
  chemically synthesized
aatacattttatttatagaa

SEQ ID NO: 258959 - DNA, 20 bp, Artificial Sequence
  chemically synthesized
atacattttatttatagaaa

SEQ ID NO: 258960 - DNA, 20 bp, Artificial Sequence
  chemically synthesized
tatagaaaaggttaatacca

SEQ ID NO: 258961 - DNA, 20 bp, Artificial Sequence
  chemically synthesized
aacgattacagaacatactt

SEQ ID NO: 258962 - DNA, 20 bp, Artificial Sequence
  chemically synthesized
agtagaataaaaaacgatta

SEQ ID NO: 258963 - DNA, 20 bp, Artificial Sequence
  chemically synthesized
taatcgttttttattctact

SEQ ID NO: 258964 - DNA, 20 bp, Artificial Sequence
  chemically synthesized
ccctttggacagagactgag

SEQ ID NO: 258965 - DNA, 20 bp, Artificial Sequence
  chemically synthesized
cagccctttggacagagact

SEQ ID NO: 258966 - DNA, 20 bp, Artificial Sequence
  chemically synthesized
ttctactcagtctctgtcca

SEQ ID NO: 258967 - DNA, 20 bp, Artificial Sequence
  chemically synthesized
tctactcagtctctgtccaa

SEQ ID NO: 258968 - DNA, 20 bp, Artificial Sequence
  chemically synthesized
actagacagccctttggaca

SEQ ID NO: 258969 - DNA, 20 bp, Artificial Sequence
  chemically synthesized
ctactcagtctctgtccaaa

SEQ ID NO: 258970 - DNA, 20 bp, Artificial Sequence
  chemically synthesized
gtactagacagccctttgga

SEQ ID NO: 258971 - DNA, 20 bp, Artificial Sequence
  chemically synthesized
ttaagtactagacagccctt

SEQ ID NO: 258972 - DNA, 20 bp, Artificial Sequence
  chemically synthesized
tctctgtccaaagggctgtc

SEQ ID NO: 258973 - DNA, 20 bp, Artificial Sequence
  chemically synthesized
taaccacattaagtactaga

SEQ ID NO: 258974 - DNA, 20 bp, Artificial Sequence
  chemically synthesized
actttaaccacattaagtac

SEQ ID NO: 258975 - DNA, 20 bp, Artificial Sequence
  chemically synthesized
gggctgtctagtacttaatg

SEQ ID NO: 258976 - DNA, 20 bp, Artificial Sequence
  chemically synthesized
taggtaactttaaccacatt

SEQ ID NO: 258977 - DNA, 20 bp, Artificial Sequence
  chemically synthesized
tctagtacttaatgtggtta

SEQ ID NO: 258978 - DNA, 20 bp, Artificial Sequence
  chemically synthesized
tgtggttaaagttacctaat

SEQ ID NO: 258979 - DNA, 20 bp, Artificial Sequence
  chemically synthesized
atattaattgagtgctcatt

SEQ ID NO: 258980 - DNA, 20 bp, Artificial Sequence
  chemically synthesized
aatattaattgagtgctcat

SEQ ID NO: 258981 - DNA, 20 bp, Artificial Sequence
  chemically synthesized
attataaaagaatattaatt

SEQ ID NO: 258982 - DNA, 20 bp, Artificial Sequence
  chemically synthesized
caattaatattcttttataa

SEQ ID NO: 258983 - DNA, 20 bp, Artificial Sequence
  chemically synthesized
ttgtatgattgccattataa

SEQ ID NO: 258984 - DNA, 20 bp, Artificial Sequence
  chemically synthesized
ttttataatggcaatcatac

SEQ ID NO: 258985 - DNA, 20 bp, Artificial Sequence
  chemically synthesized
ataatggcaatcatacaaga

SEQ ID NO: 258986 - DNA, 20 bp, Artificial Sequence
  chemically synthesized
tggcaatcatacaagaaaga

SEQ ID NO: 258987 - DNA, 20 bp, Artificial Sequence
  chemically synthesized
ttttaataagcaatttgaaa

SEQ ID NO: 258988 - DNA, 20 bp, Artificial Sequence
  chemically synthesized
acacattgttatattttaat

SEQ ID NO: 258989 - DNA, 20 bp, Artificial Sequence
  chemically synthesized
agttttcacattatttaaaa

SEQ ID NO: 258990 - DNA, 20 bp, Artificial Sequence
  chemically synthesized
ttttaaataatgtgaaaact

SEQ ID NO: 258991 - DNA, 20 bp, Artificial Sequence
  chemically synthesized
tagaattattcatataatct

SEQ ID NO: 258992 - DNA, 20 bp, Artificial Sequence
  chemically synthesized
tatatgaataattctaatgc

SEQ ID NO: 258993 - DNA, 20 bp, Artificial Sequence
  chemically synthesized
gatagatataataccagcat

SEQ ID NO: 258994 - DNA, 20 bp, Artificial Sequence
  chemically synthesized
ttttctgatagatataatac

SEQ ID NO: 258995 - DNA, 20 bp, Artificial Sequence
  chemically synthesized
aatgctggtattatatctat

SEQ ID NO: 258996 - DNA, 20 bp, Artificial Sequence
  chemically synthesized
aggctacaagtattttctga

SEQ ID NO: 258997 - DNA, 20 bp, Artificial Sequence
  chemically synthesized
tatctatcagaaaatacttg

SEQ ID NO: 258998 - DNA, 20 bp, Artificial Sequence
  chemically synthesized
atcagaaaatacttgtagcc

SEQ ID NO: 258999 - DNA, 20 bp, Artificial Sequence
  chemically synthesized
ttgtgaaaaaactaggctac

SEQ ID NO: 259000 - DNA, 20 bp, Artificial Sequence
  chemically synthesized
attacctttgtgaaaaaact

SEQ ID NO: 259001 - DNA, 20 bp, Artificial Sequence
  chemically synthesized
aattacctttgtgaaaaaac

SEQ ID NO: 259002 - DNA, 20 bp, Artificial Sequence
  chemically synthesized
tgtagcctagttttttcaca

SEQ ID NO: 259003 - DNA, 20 bp, Artificial Sequence
  chemically synthesized
gtagcctagttttttcacaa

SEQ ID NO: 259004 - DNA, 20 bp, Artificial Sequence
  chemically synthesized
gttttttcacaaaggtaatt

SEQ ID NO: 259005 - DNA, 20 bp, Artificial Sequence
  chemically synthesized
tttcacaaaggtaatttaga

SEQ ID NO: 259006 - DNA, 20 bp, Artificial Sequence
  chemically synthesized
ttcacaaaggtaatttagac

SEQ ID NO: 259007 - DNA, 20 bp, Artificial Sequence
  chemically synthesized
acattttagtttggatttag

SEQ ID NO: 259008 - DNA, 20 bp, Artificial Sequence
  chemically synthesized
gtgacattttagtttggatt

SEQ ID NO: 259009 - DNA, 20 bp, Artificial Sequence
  chemically synthesized
caccttgtgacattttagtt

SEQ ID NO: 259010 - DNA, 20 bp, Artificial Sequence
  chemically synthesized
gttttcaccttgtgacattt

SEQ ID NO: 259011 - DNA, 20 bp, Artificial Sequence
  chemically synthesized
aatccaaactaaaatgtcac

SEQ ID NO: 259012 - DNA, 20 bp, Artificial Sequence
  chemically synthesized
atccaaactaaaatgtcaca

SEQ ID NO: 259013 - DNA, 20 bp, Artificial Sequence
  chemically synthesized
agaataataacaaattagtt

SEQ ID NO: 259014 - DNA, 20 bp, Artificial Sequence
  chemically synthesized
gatatagaataataacaaat

SEQ ID NO: 259015 - DNA, 20 bp, Artificial Sequence
  chemically synthesized
tcagtaaaatcaattggata

SEQ ID NO: 259016 - DNA, 20 bp, Artificial Sequence
  chemically synthesized
agcaattcagtaaaatcaat

SEQ ID NO: 259017 - DNA, 20 bp, Artificial Sequence
  chemically synthesized
aatacagtgtattagcaatt

SEQ ID NO: 259018 - DNA, 20 bp, Artificial Sequence
  chemically synthesized
gaaaacaaaatacagtgtat

SEQ ID NO: 259019 - DNA, 20 bp, Artificial Sequence
  chemically synthesized
gtctacctgaaaacaaaata

SEQ ID NO: 259020 - DNA, 20 bp, Artificial Sequence
  chemically synthesized
aatacactgtattttgtttt

SEQ ID NO: 259021 - DNA, 20 bp, Artificial Sequence
  chemically synthesized
atacactgtattttgttttc

SEQ ID NO: 259022 - DNA, 20 bp, Artificial Sequence
  chemically synthesized
cactgtattttgttttcagg

SEQ ID NO: 259023 - DNA, 20 bp, Artificial Sequence
  chemically synthesized
attttgttttcaggtagaca

SEQ ID NO: 259024 - DNA, 20 bp, Artificial Sequence
  chemically synthesized
gtgagattacttacagattt

SEQ ID NO: 259025 - DNA, 20 bp, Artificial Sequence
  chemically synthesized
tagacacagcctaaatctgt

SEQ ID NO: 259026 - DNA, 20 bp, Artificial Sequence
  chemically synthesized
agtgagattacttacagatt

SEQ ID NO: 259027 - DNA, 20 bp, Artificial Sequence
  chemically synthesized
gagttgagtgagattactta

SEQ ID NO: 259028 - DNA, 20 bp, Artificial Sequence
  chemically synthesized
aattatcttcagagttgagt

SEQ ID NO: 259029 - DNA, 20 bp, Artificial Sequence
  chemically synthesized
agtaatctcactcaactctg

SEQ ID NO: 259030 - DNA, 20 bp, Artificial Sequence
  chemically synthesized
aattaattatcttcagagtt

SEQ ID NO: 259031 - DNA, 20 bp, Artificial Sequence
  chemically synthesized
ttttaaattaattatcttca

SEQ ID NO: 259032 - DNA, 20 bp, Artificial Sequence
  chemically synthesized
gtttttaaattaattatctt

SEQ ID NO: 259033 - DNA, 20 bp, Artificial Sequence
  chemically synthesized
tatgtataattcacaataat

SEQ ID NO: 259034 - DNA, 20 bp, Artificial Sequence
  chemically synthesized
ttatgtataattcacaataa

SEQ ID NO: 259035 - DNA, 20 bp, Artificial Sequence
  chemically synthesized
cataatttgcattatttata

SEQ ID NO: 259036 - DNA, 20 bp, Artificial Sequence
  chemically synthesized
ttgcattatttatatggtca

SEQ ID NO: 259037 - DNA, 20 bp, Artificial Sequence
  chemically synthesized
tgtgcatatatataattaat

SEQ ID NO: 259038 - DNA, 20 bp, Artificial Sequence
  chemically synthesized
tttgtgtgtctgtatttgca

SEQ ID NO: 259039 - DNA, 20 bp, Artificial Sequence
  chemically synthesized
tgtacgtgtctgtgcaaata

SEQ ID NO: 259040 - DNA, 20 bp, Artificial Sequence
  chemically synthesized
gcaaatacagacacacaaaa

SEQ ID NO: 259041 - DNA, 20 bp, Artificial Sequence
  chemically synthesized
acacacaaaatagaaatgtt

SEQ ID NO: 259042 - DNA, 20 bp, Artificial Sequence
  chemically synthesized
caaaatagaaatgttgagaa

SEQ ID NO: 259043 - DNA, 20 bp, Artificial Sequence
  chemically synthesized
aaaatagaaatgttgagaat

SEQ ID NO: 259044 - DNA, 20 bp, Artificial Sequence
  chemically synthesized
agaatgggtaaatcacatcg

SEQ ID NO: 259045 - DNA, 20 bp, Artificial Sequence
  chemically synthesized
ggactcagttcaaagtgaaa

SEQ ID NO: 259046 - DNA, 20 bp, Artificial Sequence
  chemically synthesized
tttctgtttcactttgaact

SEQ ID NO: 259047 - DNA, 20 bp, Artificial Sequence
  chemically synthesized
cgttgcatggactcagttca

SEQ ID NO: 259048 - DNA, 20 bp, Artificial Sequence
  chemically synthesized
atcttgacgttgcatggact

SEQ ID NO: 259049 - DNA, 20 bp, Artificial Sequence
  chemically synthesized
gtgattatcttgacgttgca

SEQ ID NO: 259050 - DNA, 20 bp, Artificial Sequence
  chemically synthesized
aactgagtccatgcaacgtc

SEQ ID NO: 259051 - DNA, 20 bp, Artificial Sequence
  chemically synthesized
ttcttctaaattgtagcagt

SEQ ID NO: 259052 - DNA, 20 bp, Artificial Sequence
  chemically synthesized
tatattcttctaaattgtag

SEQ ID NO: 259053 - DNA, 20 bp, Artificial Sequence
  chemically synthesized
cacaactaactgctacaatt

SEQ ID NO: 259054 - DNA, 20 bp, Artificial Sequence
  chemically synthesized
acatatattcttctaaattg

SEQ ID NO: 259055 - DNA, 20 bp, Artificial Sequence
  chemically synthesized
aactaactgctacaatttag

SEQ ID NO: 259056 - DNA, 20 bp, Artificial Sequence
  chemically synthesized
atttagaagaatatatgtat

SEQ ID NO: 259057 - DNA, 20 bp, Artificial Sequence
  chemically synthesized
tttagaagaatatatgtatc

SEQ ID NO: 259058 - DNA, 20 bp, Artificial Sequence
  chemically synthesized
tgtatcaggacctcaaatta

SEQ ID NO: 259059 - DNA, 20 bp, Artificial Sequence
  chemically synthesized
atttttttttccataatttg

SEQ ID NO: 259060 - DNA, 20 bp, Artificial Sequence
  chemically synthesized
aatttttttttccataattt

SEQ ID NO: 259061 - DNA, 20 bp, Artificial Sequence
  chemically synthesized
aattatggaaaaaaaaattg

SEQ ID NO: 259062 - DNA, 20 bp, Artificial Sequence
  chemically synthesized
attatggaaaaaaaaattgc

SEQ ID NO: 259063 - DNA, 20 bp, Artificial Sequence
  chemically synthesized
ggaaaaaaaaattgcaggtg

SEQ ID NO: 259064 - DNA, 20 bp, Artificial Sequence
  chemically synthesized
aaaaaaaaattgcaggtgaa

SEQ ID NO: 259065 - DNA, 20 bp, Artificial Sequence
  chemically synthesized
aaaaaaattgcaggtgaaga

SEQ ID NO: 259066 - DNA, 20 bp, Artificial Sequence
  chemically synthesized
aagagagaatgatgatgaac

SEQ ID NO: 259067 - DNA, 20 bp, Artificial Sequence
  chemically synthesized
acataactttgaaatatcac

SEQ ID NO: 259068 - DNA, 20 bp, Artificial Sequence
  chemically synthesized
gatgaactggtgatatttca

SEQ ID NO: 259069 - DNA, 20 bp, Artificial Sequence
  chemically synthesized
tttcaaagttatgtgtatct

SEQ ID NO: 259070 - DNA, 20 bp, Artificial Sequence
  chemically synthesized
tttctgtctcagatcgtgcc

SEQ ID NO: 259071 - DNA, 20 bp, Artificial Sequence
  chemically synthesized
tgtgtatcttggcacgatct

SEQ ID NO: 259072 - DNA, 20 bp, Artificial Sequence
  chemically synthesized
tatcttggcacgatctgaga

SEQ ID NO: 259073 - DNA, 20 bp, Artificial Sequence
  chemically synthesized
cagatccatcatttctgtct

SEQ ID NO: 259074 - DNA, 20 bp, Artificial Sequence
  chemically synthesized
acgatctgagacagaaatga

SEQ ID NO: 259075 - DNA, 20 bp, Artificial Sequence
  chemically synthesized
gacagaaatgatggatctga

SEQ ID NO: 259076 - DNA, 20 bp, Artificial Sequence
  chemically synthesized
catatatacttgaaaaccat

SEQ ID NO: 259077 - DNA, 20 bp, Artificial Sequence
  chemically synthesized
tgatggatctgatggttttc

SEQ ID NO: 259078 - DNA, 20 bp, Artificial Sequence
  chemically synthesized
atggttttcaagtatatatg

SEQ ID NO: 259079 - DNA, 20 bp, Artificial Sequence
  chemically synthesized
atatatgtggaatgatctgt

SEQ ID NO: 259080 - DNA, 20 bp, Artificial Sequence
  chemically synthesized
atatgtggaatgatctgttg

SEQ ID NO: 259081 - DNA, 20 bp, Artificial Sequence
  chemically synthesized
cttaaatcaatggtctccaa

SEQ ID NO: 259082 - DNA, 20 bp, Artificial Sequence
  chemically synthesized
ctgttggagaccattgattt

SEQ ID NO: 259083 - DNA, 20 bp, Artificial Sequence
  chemically synthesized
aacagatctccttaaatcaa

SEQ ID NO: 259084 - DNA, 20 bp, Artificial Sequence
  chemically synthesized
tgttggagaccattgattta

SEQ ID NO: 259085 - DNA, 20 bp, Artificial Sequence
  chemically synthesized
ttggagaccattgatttaag

SEQ ID NO: 259086 - DNA, 20 bp, Artificial Sequence
  chemically synthesized
gacccccttcttaagtcaaa

SEQ ID NO: 259087 - DNA, 20 bp, Artificial Sequence
  chemically synthesized
taaggagatctgtttgactt

SEQ ID NO: 259088 - DNA, 20 bp, Artificial Sequence
  chemically synthesized
ggagatctgtttgacttaag

SEQ ID NO: 259089 - DNA, 20 bp, Artificial Sequence
  chemically synthesized
gagatctgtttgacttaaga

SEQ ID NO: 259090 - DNA, 20 bp, Artificial Sequence
  chemically synthesized
agatctgtttgacttaagaa

SEQ ID NO: 259091 - DNA, 20 bp, Artificial Sequence
  chemically synthesized
gatctgtttgacttaagaag

SEQ ID NO: 259092 - DNA, 20 bp, Artificial Sequence
  chemically synthesized
atctgtttgacttaagaagg

SEQ ID NO: 259093 - DNA, 20 bp, Artificial Sequence
  chemically synthesized
caggtactgacccccttctt

SEQ ID NO: 259094 - DNA, 20 bp, Artificial Sequence
  chemically synthesized
gtttgacttaagaagggggt

SEQ ID NO: 259095 - DNA, 20 bp, Artificial Sequence
  chemically synthesized
agaagggggtcagtacctgc

SEQ ID NO: 259096 - DNA, 20 bp, Artificial Sequence
  chemically synthesized
cctgcatgaaacaaactagc

SEQ ID NO: 259097 - DNA, 20 bp, Artificial Sequence
  chemically synthesized
gcctgcatgaaacaaactag

SEQ ID NO: 259098 - DNA, 20 bp, Artificial Sequence
  chemically synthesized
aatgcctgcatgaaacaaac

SEQ ID NO: 259099 - DNA, 20 bp, Artificial Sequence
  chemically synthesized
acctgctagtttgtttcatg

SEQ ID NO: 259100 - DNA, 20 bp, Artificial Sequence
  chemically synthesized
cctgctagtttgtttcatgc

SEQ ID NO: 259101 - DNA, 20 bp, Artificial Sequence
  chemically synthesized
ttgtttcatgcaggcattac

SEQ ID NO: 259102 - DNA, 20 bp, Artificial Sequence
  chemically synthesized
gtttcatgcaggcattactg

SEQ ID NO: 259103 - DNA, 20 bp, Artificial Sequence
  chemically synthesized
ttcatgcaggcattactgga

SEQ ID NO: 259104 - DNA, 20 bp, Artificial Sequence
  chemically synthesized
atgcaggcattactggagag

SEQ ID NO: 259105 - DNA, 20 bp, Artificial Sequence
  chemically synthesized
catgtagtacagccactctc

SEQ ID NO: 259106 - DNA, 20 bp, Artificial Sequence
  chemically synthesized
tggagagtggctgtactaca

SEQ ID NO: 259107 - DNA, 20 bp, Artificial Sequence
  chemically synthesized
ctgtcctcaaccatgtagta

SEQ ID NO: 259108 - DNA, 20 bp, Artificial Sequence
  chemically synthesized
agtggctgtactacatggtt

SEQ ID NO: 259109 - DNA, 20 bp, Artificial Sequence
  chemically synthesized
taaggctgtcctcaaccatg

SEQ ID NO: 259110 - DNA, 20 bp, Artificial Sequence
  chemically synthesized
gtggctgtactacatggttg

SEQ ID NO: 259111 - DNA, 20 bp, Artificial Sequence
  chemically synthesized
ctgtactacatggttgagga

SEQ ID NO: 259112 - DNA, 20 bp, Artificial Sequence
  chemically synthesized
atggacaaggggtggaagta

SEQ ID NO: 259113 - DNA, 20 bp, Artificial Sequence
  chemically synthesized
catggacaaggggtggaagt

SEQ ID NO: 259114 - DNA, 20 bp, Artificial Sequence
  chemically synthesized
atctcatggacaaggggtgg

SEQ ID NO: 259115 - DNA, 20 bp, Artificial Sequence
  chemically synthesized
ctgatctcatggacaagggg

SEQ ID NO: 259116 - DNA, 20 bp, Artificial Sequence
  chemically synthesized
tctctgatctcatggacaag

SEQ ID NO: 259117 - DNA, 20 bp, Artificial Sequence
  chemically synthesized
atctctgatctcatggacaa

SEQ ID NO: 259118 - DNA, 20 bp, Artificial Sequence
  chemically synthesized
tacttccaccccttgtccat

SEQ ID NO: 259119 - DNA, 20 bp, Artificial Sequence
  chemically synthesized
catctctgatctcatggaca

SEQ ID NO: 259120 - DNA, 20 bp, Artificial Sequence
  chemically synthesized
acatctctgatctcatggac

SEQ ID NO: 259121 - DNA, 20 bp, Artificial Sequence
  chemically synthesized
ccaccccttgtccatgagat

SEQ ID NO: 259122 - DNA, 20 bp, Artificial Sequence
  chemically synthesized
ggaaaacatctctgatctca

SEQ ID NO: 259123 - DNA, 20 bp, Artificial Sequence
  chemically synthesized
accccttgtccatgagatca

SEQ ID NO: 259124 - DNA, 20 bp, Artificial Sequence
  chemically synthesized
tattcacaaaatttacatat

SEQ ID NO: 259125 - DNA, 20 bp, Artificial Sequence
  chemically synthesized
ctattcacaaaatttacata

SEQ ID NO: 259126 - DNA, 20 bp, Artificial Sequence
  chemically synthesized
ccatatgtaaattttgtgaa

SEQ ID NO: 259127 - DNA, 20 bp, Artificial Sequence
  chemically synthesized
catatgtaaattttgtgaat

SEQ ID NO: 259128 - DNA, 20 bp, Artificial Sequence
  chemically synthesized
taaattttgtgaataggttt

SEQ ID NO: 259129 - DNA, 20 bp, Artificial Sequence
  chemically synthesized
ctgatgaataattatttaac

SEQ ID NO: 259130 - DNA, 20 bp, Artificial Sequence
  chemically synthesized
cttgttaaataattattcat

SEQ ID NO: 259131 - DNA, 20 bp, Artificial Sequence
  chemically synthesized
aacaacaacaacaaaacttc

SEQ ID NO: 259132 - DNA, 20 bp, Artificial Sequence
  chemically synthesized
agaagcaacatggatactgg

SEQ ID NO: 259133 - DNA, 20 bp, Artificial Sequence
  chemically synthesized
ttgagaagcaacatggatac

SEQ ID NO: 259134 - DNA, 20 bp, Artificial Sequence
  chemically synthesized
tgattgattgagaagcaaca

SEQ ID NO: 259135 - DNA, 20 bp, Artificial Sequence
  chemically synthesized
atgcatagtgattgattgag

SEQ ID NO: 259136 - DNA, 20 bp, Artificial Sequence
  chemically synthesized
ttgatgcatagtgattgatt

SEQ ID NO: 259137 - DNA, 20 bp, Artificial Sequence
  chemically synthesized
ggttttgatattttgatgca

SEQ ID NO: 259138 - DNA, 20 bp, Artificial Sequence
  chemically synthesized
tcttggcgcaaatgcagtta

SEQ ID NO: 259139 - DNA, 20 bp, Artificial Sequence
  chemically synthesized
gtcttggcgcaaatgcagtt

SEQ ID NO: 259140 - DNA, 20 bp, Artificial Sequence
  chemically synthesized
aaaatgtcttggcgcaaatg

SEQ ID NO: 259141 - DNA, 20 bp, Artificial Sequence
  chemically synthesized
accttaactgcatttgcgcc

SEQ ID NO: 259142 - DNA, 20 bp, Artificial Sequence
  chemically synthesized
tcaaagaatgtaaaatgtct

SEQ ID NO: 259143 - DNA, 20 bp, Artificial Sequence
  chemically synthesized
acattttacattctttgact

SEQ ID NO: 259144 - DNA, 20 bp, Artificial Sequence
  chemically synthesized
cattttacattctttgactt

SEQ ID NO: 259145 - DNA, 20 bp, Artificial Sequence
  chemically synthesized
tttctctcatgcctaagtca

SEQ ID NO: 259146 - DNA, 20 bp, Artificial Sequence
  chemically synthesized
acattctttgacttaggcat

SEQ ID NO: 259147 - DNA, 20 bp, Artificial Sequence
  chemically synthesized
ctttattttctctcatgcct

SEQ ID NO: 259148 - DNA, 20 bp, Artificial Sequence
  chemically synthesized
attctttgacttaggcatga

SEQ ID NO: 259149 - DNA, 20 bp, Artificial Sequence
  chemically synthesized
cttaggcatgagagaaaata

SEQ ID NO: 259150 - DNA, 20 bp, Artificial Sequence
  chemically synthesized
gcatgagagaaaataaagca

SEQ ID NO: 259151 - DNA, 20 bp, Artificial Sequence
  chemically synthesized
catgagagaaaataaagcaa

SEQ ID NO: 259152 - DNA, 20 bp, Artificial Sequence
  chemically synthesized
aaataaagcaaaggcttttt

SEQ ID NO: 259153 - DNA, 20 bp, Artificial Sequence
  chemically synthesized
taaagcaaaggctttttcag

SEQ ID NO: 259154 - DNA, 20 bp, Artificial Sequence
  chemically synthesized
gccccttgtgtcttctgaaa

SEQ ID NO: 259155 - DNA, 20 bp, Artificial Sequence
  chemically synthesized
aaggctttttcagaagacac

SEQ ID NO: 259156 - DNA, 20 bp, Artificial Sequence
  chemically synthesized
aggctttttcagaagacaca

SEQ ID NO: 259157 - DNA, 20 bp, Artificial Sequence
  chemically synthesized
ggctttttcagaagacacaa

SEQ ID NO: 259158 - DNA, 20 bp, Artificial Sequence
  chemically synthesized
gctttttcagaagacacaag

SEQ ID NO: 259159 - DNA, 20 bp, Artificial Sequence
  chemically synthesized
tttcagaagacacaaggggc

SEQ ID NO: 259160 - DNA, 20 bp, Artificial Sequence
  chemically synthesized
tcagaagacacaaggggctg

SEQ ID NO: 259161 - DNA, 20 bp, Artificial Sequence
  chemically synthesized
agaagacacaaggggctgga

SEQ ID NO: 259162 - DNA, 20 bp, Artificial Sequence
  chemically synthesized
gacacaaggggctggagaga

SEQ ID NO: 259163 - DNA, 20 bp, Artificial Sequence
  chemically synthesized
ctcagctttgtctttctctc

SEQ ID NO: 259164 - DNA, 20 bp, Artificial Sequence
  chemically synthesized
aggggctggagagaaagaca

SEQ ID NO: 259165 - DNA, 20 bp, Artificial Sequence
  chemically synthesized
ctggagagaaagacaaagct

SEQ ID NO: 259166 - DNA, 20 bp, Artificial Sequence
  chemically synthesized
ggagagaaagacaaagctga

SEQ ID NO: 259167 - DNA, 20 bp, Artificial Sequence
  chemically synthesized
atactacttgtatggactct

SEQ ID NO: 259168 - DNA, 20 bp, Artificial Sequence
  chemically synthesized
acaaagctgagagtccatac

SEQ ID NO: 259169 - DNA, 20 bp, Artificial Sequence
  chemically synthesized
aagctgagagtccatacaag

SEQ ID NO: 259170 - DNA, 20 bp, Artificial Sequence
  chemically synthesized
cttctagtatactacttgta

SEQ ID NO: 259171 - DNA, 20 bp, Artificial Sequence
  chemically synthesized
agtccatacaagtagtatac

SEQ ID NO: 259172 - DNA, 20 bp, Artificial Sequence
  chemically synthesized
ccatacaagtagtatactag

SEQ ID NO: 259173 - DNA, 20 bp, Artificial Sequence
  chemically synthesized
aagtagtatactagaagata

SEQ ID NO: 259174 - DNA, 20 bp, Artificial Sequence
  chemically synthesized
aatgtaccttccgtatcttc

SEQ ID NO: 259175 - DNA, 20 bp, Artificial Sequence
  chemically synthesized
tagtatactagaagatacgg

SEQ ID NO: 259176 - DNA, 20 bp, Artificial Sequence
  chemically synthesized
agtatactagaagatacgga

SEQ ID NO: 259177 - DNA, 20 bp, Artificial Sequence
  chemically synthesized
acatttaataaaaataaaat

SEQ ID NO: 259178 - DNA, 20 bp, Artificial Sequence
  chemically synthesized
aataaaattagaaacattaa

SEQ ID NO: 259179 - DNA, 20 bp, Artificial Sequence
  chemically synthesized
ataaaattagaaacattaaa

SEQ ID NO: 259180 - DNA, 20 bp, Artificial Sequence
  chemically synthesized
aaacattaaaaggttaacat

SEQ ID NO: 259181 - DNA, 20 bp, Artificial Sequence
  chemically synthesized
acattaaaaggttaacatta

SEQ ID NO: 259182 - DNA, 20 bp, Artificial Sequence
  chemically synthesized
aaaaggttaacattagagca

SEQ ID NO: 259183 - DNA, 20 bp, Artificial Sequence
  chemically synthesized
ggttaacattagagcacaga

SEQ ID NO: 259184 - DNA, 20 bp, Artificial Sequence
  chemically synthesized
agcacagaaagcctgttacc

SEQ ID NO: 259185 - DNA, 20 bp, Artificial Sequence
  chemically synthesized
ttatttaaaaactaggtaac

SEQ ID NO: 259186 - DNA, 20 bp, Artificial Sequence
  chemically synthesized
gttatttaaaaactaggtaa

SEQ ID NO: 259187 - DNA, 20 bp, Artificial Sequence
  chemically synthesized
tctattgttatttaaaaact

SEQ ID NO: 259188 - DNA, 20 bp, Artificial Sequence
  chemically synthesized
gtctattgttatttaaaaac

SEQ ID NO: 259189 - DNA, 20 bp, Artificial Sequence
  chemically synthesized
acctagtttttaaataacaa

SEQ ID NO: 259190 - DNA, 20 bp, Artificial Sequence
  chemically synthesized
ttaaataacaatagacaact

SEQ ID NO: 259191 - DNA, 20 bp, Artificial Sequence
  chemically synthesized
taacaatagacaacttagaa

SEQ ID NO: 259192 - DNA, 20 bp, Artificial Sequence
  chemically synthesized
acaatagacaacttagaaaa

SEQ ID NO: 259193 - DNA, 20 bp, Artificial Sequence
  chemically synthesized
ccatgatcattctcttttct

SEQ ID NO: 259194 - DNA, 20 bp, Artificial Sequence
  chemically synthesized
cttagaaaagagaatgatca

SEQ ID NO: 259195 - DNA, 20 bp, Artificial Sequence
  chemically synthesized
aagaacccatattttatttt

SEQ ID NO: 259196 - DNA, 20 bp, Artificial Sequence
  chemically synthesized
tcatggctaaaaataaaata

SEQ ID NO: 259197 - DNA, 20 bp, Artificial Sequence
  chemically synthesized
catggctaaaaataaaatat

SEQ ID NO: 259198 - DNA, 20 bp, Artificial Sequence
  chemically synthesized
aataaaatatgggttcttta

SEQ ID NO: 259199 - DNA, 20 bp, Artificial Sequence
  chemically synthesized
acttcttctggttgactgta

SEQ ID NO: 259200 - DNA, 20 bp, Artificial Sequence
  chemically synthesized
atgggttctttacagtcaac

SEQ ID NO: 259201 - DNA, 20 bp, Artificial Sequence
  chemically synthesized
ggttctttacagtcaaccag

SEQ ID NO: 259202 - DNA, 20 bp, Artificial Sequence
  chemically synthesized
tctttacagtcaaccagaag

SEQ ID NO: 259203 - DNA, 20 bp, Artificial Sequence
  chemically synthesized
aaattgtgatatacttcttc

SEQ ID NO: 259204 - DNA, 20 bp, Artificial Sequence
  chemically synthesized
aagaagtatatcacaattta

SEQ ID NO: 259205 - DNA, 20 bp, Artificial Sequence
  chemically synthesized
tatcacaatttaaagacaaa

SEQ ID NO: 259206 - DNA, 20 bp, Artificial Sequence
  chemically synthesized
tagaaataaactgacattaa

SEQ ID NO: 259207 - DNA, 20 bp, Artificial Sequence
  chemically synthesized
tattttttcactattaatgt

SEQ ID NO: 259208 - DNA, 20 bp, Artificial Sequence
  chemically synthesized
gacattaatagtgaaaaaat

SEQ ID NO: 259209 - DNA, 20 bp, Artificial Sequence
  chemically synthesized
cattaatagtgaaaaaataa

SEQ ID NO: 259210 - DNA, 20 bp, Artificial Sequence
  chemically synthesized
tagtgaaaaaataagagact

SEQ ID NO: 259211 - DNA, 20 bp, Artificial Sequence
  chemically synthesized
gtgaaaaaataagagactta

SEQ ID NO: 259212 - DNA, 20 bp, Artificial Sequence
  chemically synthesized
aaaataagagacttagagaa

SEQ ID NO: 259213 - DNA, 20 bp, Artificial Sequence
  chemically synthesized
gtatcttagatctgttctct

SEQ ID NO: 259214 - DNA, 20 bp, Artificial Sequence
  chemically synthesized
gagacttagagaacagatct

SEQ ID NO: 259215 - DNA, 20 bp, Artificial Sequence
  chemically synthesized
tcattgcttaataggtatct

SEQ ID NO: 259216 - DNA, 20 bp, Artificial Sequence
  chemically synthesized
acagatctaagatacctatt

SEQ ID NO: 259217 - DNA, 20 bp, Artificial Sequence
  chemically synthesized
ggtacttatcattgcttaat

SEQ ID NO: 259218 - DNA, 20 bp, Artificial Sequence
  chemically synthesized
tggtacttatcattgcttaa

SEQ ID NO: 259219 - DNA, 20 bp, Artificial Sequence
  chemically synthesized
gatacctattaagcaatgat

SEQ ID NO: 259220 - DNA, 20 bp, Artificial Sequence
  chemically synthesized
tattaagcaatgataagtac

SEQ ID NO: 259221 - DNA, 20 bp, Artificial Sequence
  chemically synthesized
gcaatgataagtaccagaat

SEQ ID NO: 259222 - DNA, 20 bp, Artificial Sequence
  chemically synthesized
tctcttcttttttctcattc

SEQ ID NO: 259223 - DNA, 20 bp, Artificial Sequence
  chemically synthesized
taagtaccagaatgagaaaa

SEQ ID NO: 259224 - DNA, 20 bp, Artificial Sequence
  chemically synthesized
gtaccagaatgagaaaaaag

SEQ ID NO: 259225 - DNA, 20 bp, Artificial Sequence
  chemically synthesized
accagaatgagaaaaaagaa

SEQ ID NO: 259226 - DNA, 20 bp, Artificial Sequence
  chemically synthesized
gaatgagaaaaaagaagaga

SEQ ID NO: 259227 - DNA, 20 bp, Artificial Sequence
  chemically synthesized
tgagaaaaaagaagagatgg

SEQ ID NO: 259228 - DNA, 20 bp, Artificial Sequence
  chemically synthesized
aataattaaaacaatcataa

SEQ ID NO: 259229 - DNA, 20 bp, Artificial Sequence
  chemically synthesized
aatcataatagaaaattttc

SEQ ID NO: 259230 - DNA, 20 bp, Artificial Sequence
  chemically synthesized
tcataatagaaaattttcca

SEQ ID NO: 259231 - DNA, 20 bp, Artificial Sequence
  chemically synthesized
tagaaaattttccagagcta

SEQ ID NO: 259232 - DNA, 20 bp, Artificial Sequence
  chemically synthesized
attaataacttctttagctc

SEQ ID NO: 259233 - DNA, 20 bp, Artificial Sequence
  chemically synthesized
aaaattttccagagctaaag

SEQ ID NO: 259234 - DNA, 20 bp, Artificial Sequence
  chemically synthesized
attaatattaataacttctt

SEQ ID NO: 259235 - DNA, 20 bp, Artificial Sequence
  chemically synthesized
aagaagttattaatattaat

SEQ ID NO: 259236 - DNA, 20 bp, Artificial Sequence
  chemically synthesized
ggttatttaaaacgttaccc

SEQ ID NO: 259237 - DNA, 20 bp, Artificial Sequence
  chemically synthesized
tttaattcttttttgcactt

SEQ ID NO: 259238 - DNA, 20 bp, Artificial Sequence
  chemically synthesized
atttaattcttttttgcact

SEQ ID NO: 259239 - DNA, 20 bp, Artificial Sequence
  chemically synthesized
aacgttacccaagtgcaaaa

SEQ ID NO: 259240 - DNA, 20 bp, Artificial Sequence
  chemically synthesized
agtgcaaaaaagaattaaat

SEQ ID NO: 259241 - DNA, 20 bp, Artificial Sequence
  chemically synthesized
gcaaaaaagaattaaataag

SEQ ID NO: 259242 - DNA, 20 bp, Artificial Sequence
  chemically synthesized
aaaaagaattaaataagtgg

SEQ ID NO: 259243 - DNA, 20 bp, Artificial Sequence
  chemically synthesized
aaaagaattaaataagtggt

SEQ ID NO: 259244 - DNA, 20 bp, Artificial Sequence
  chemically synthesized
gtgggtcacaactgaaatcc

SEQ ID NO: 259245 - DNA, 20 bp, Artificial Sequence
  chemically synthesized
ctcctaaagtgctgggattt

SEQ ID NO: 259246 - DNA, 20 bp, Artificial Sequence
  chemically synthesized
caactgaaatcccagcactt

SEQ ID NO: 259247 - DNA, 20 bp, Artificial Sequence
  chemically synthesized
cctcagcctcctaaagtgct

SEQ ID NO: 259248 - DNA, 20 bp, Artificial Sequence
  chemically synthesized
aactgaaatcccagcacttt

SEQ ID NO: 259249 - DNA, 20 bp, Artificial Sequence
  chemically synthesized
acctcagcctcctaaagtgc

SEQ ID NO: 259250 - DNA, 20 bp, Artificial Sequence
  chemically synthesized
ctgaaatcccagcactttag

SEQ ID NO: 259251 - DNA, 20 bp, Artificial Sequence
  chemically synthesized
tgaaatcccagcactttagg

SEQ ID NO: 259252 - DNA, 20 bp, Artificial Sequence
  chemically synthesized
cttctcacctcagcctccta

SEQ ID NO: 259253 - DNA, 20 bp, Artificial Sequence
  chemically synthesized
tcccagcactttaggaggct

SEQ ID NO: 259254 - DNA, 20 bp, Artificial Sequence
  chemically synthesized
cccagcactttaggaggctg

SEQ ID NO: 259255 - DNA, 20 bp, Artificial Sequence
  chemically synthesized
gcactttaggaggctgaggt

SEQ ID NO: 259256 - DNA, 20 bp, Artificial Sequence
  chemically synthesized
ctttaggaggctgaggtgag

SEQ ID NO: 259257 - DNA, 20 bp, Artificial Sequence
  chemically synthesized
atcaagtaatcttctcacct

SEQ ID NO: 259258 - DNA, 20 bp, Artificial Sequence
  chemically synthesized
gtgagaagattacttgattc

SEQ ID NO: 259259 - DNA, 20 bp, Artificial Sequence
  chemically synthesized
tgagaagattacttgattcc

SEQ ID NO: 259260 - DNA, 20 bp, Artificial Sequence
  chemically synthesized
ggtcttgaactcctggaatc

SEQ ID NO: 259261 - DNA, 20 bp, Artificial Sequence
  chemically synthesized
agaagattacttgattccag

SEQ ID NO: 259262 - DNA, 20 bp, Artificial Sequence
  chemically synthesized
ttacttgattccaggagttc

SEQ ID NO: 259263 - DNA, 20 bp, Artificial Sequence
  chemically synthesized
ccaggctggtcttgaactcc

SEQ ID NO: 259264 - DNA, 20 bp, Artificial Sequence
  chemically synthesized
tgattccaggagttcaagac

SEQ ID NO: 259265 - DNA, 20 bp, Artificial Sequence
  chemically synthesized
ccaggagttcaagaccagcc

SEQ ID NO: 259266 - DNA, 20 bp, Artificial Sequence
  chemically synthesized
caggagttcaagaccagcct

SEQ ID NO: 259267 - DNA, 20 bp, Artificial Sequence
  chemically synthesized
tgtcattatgttgcccaggc

SEQ ID NO: 259268 - DNA, 20 bp, Artificial Sequence
  chemically synthesized
gatgtgtcattatgttgccc

SEQ ID NO: 259269 - DNA, 20 bp, Artificial Sequence
  chemically synthesized
tgatgtgtcattatgttgcc

SEQ ID NO: 259270 - DNA, 20 bp, Artificial Sequence
  chemically synthesized
ttttaaaacatttgtttgta

SEQ ID NO: 259271 - DNA, 20 bp, Artificial Sequence
  chemically synthesized
atttttaaaacatttgtttg

SEQ ID NO: 259272 - DNA, 20 bp, Artificial Sequence
  chemically synthesized
caaacaaatgttttaaaaat

SEQ ID NO: 259273 - DNA, 20 bp, Artificial Sequence
  chemically synthesized
caaatgttttaaaaattagc

SEQ ID NO: 259274 - DNA, 20 bp, Artificial Sequence
  chemically synthesized
ttttaaaaattagccagtca

SEQ ID NO: 259275 - DNA, 20 bp, Artificial Sequence
  chemically synthesized
caggccatcagtaccatgac

SEQ ID NO: 259276 - DNA, 20 bp, Artificial Sequence
  chemically synthesized
ttagccagtcatggtactga

SEQ ID NO: 259277 - DNA, 20 bp, Artificial Sequence
  chemically synthesized
tggctgggactacaggccat

SEQ ID NO: 259278 - DNA, 20 bp, Artificial Sequence
  chemically synthesized
gtcatggtactgatggcctg

SEQ ID NO: 259279 - DNA, 20 bp, Artificial Sequence
  chemically synthesized
gtactgatggcctgtagtcc

SEQ ID NO: 259280 - DNA, 20 bp, Artificial Sequence
  chemically synthesized
tctttagtggctgggactac

SEQ ID NO: 259281 - DNA, 20 bp, Artificial Sequence
  chemically synthesized
ctctttagtggctgggacta

SEQ ID NO: 259282 - DNA, 20 bp, Artificial Sequence
  chemically synthesized
cctcagcctctttagtggct

SEQ ID NO: 259283 - DNA, 20 bp, Artificial Sequence
  chemically synthesized
gcctgtagtcccagccacta

SEQ ID NO: 259284 - DNA, 20 bp, Artificial Sequence
  chemically synthesized
gcctcagcctctttagtggc

SEQ ID NO: 259285 - DNA, 20 bp, Artificial Sequence
  chemically synthesized
ctgtagtcccagccactaaa

SEQ ID NO: 259286 - DNA, 20 bp, Artificial Sequence
  chemically synthesized
tgtagtcccagccactaaag

SEQ ID NO: 259287 - DNA, 20 bp, Artificial Sequence
  chemically synthesized
tattgcctcagcctctttag

SEQ ID NO: 259288 - DNA, 20 bp, Artificial Sequence
  chemically synthesized
tcctattgcctcagcctctt

SEQ ID NO: 259289 - DNA, 20 bp, Artificial Sequence
  chemically synthesized
tcccagccactaaagaggct

SEQ ID NO: 259290 - DNA, 20 bp, Artificial Sequence
  chemically synthesized
cccagccactaaagaggctg

SEQ ID NO: 259291 - DNA, 20 bp, Artificial Sequence
  chemically synthesized
cactaaagaggctgaggcaa

SEQ ID NO: 259292 - DNA, 20 bp, Artificial Sequence
  chemically synthesized
actaaagaggctgaggcaat

SEQ ID NO: 259293 - DNA, 20 bp, Artificial Sequence
  chemically synthesized
ctcaggagatcctattgcct

SEQ ID NO: 259294 - DNA, 20 bp, Artificial Sequence
  chemically synthesized
ctgaggcaataggatctcct

SEQ ID NO: 259295 - DNA, 20 bp, Artificial Sequence
  chemically synthesized
gcaataggatctcctgagcc

SEQ ID NO: 259296 - DNA, 20 bp, Artificial Sequence
  chemically synthesized
ccaccaactcctaggctcag

SEQ ID NO: 259297 - DNA, 20 bp, Artificial Sequence
  chemically synthesized
caataggatctcctgagcct

SEQ ID NO: 259298 - DNA, 20 bp, Artificial Sequence
  chemically synthesized
agccaccaactcctaggctc

SEQ ID NO: 259299 - DNA, 20 bp, Artificial Sequence
  chemically synthesized
ataggatctcctgagcctag

SEQ ID NO: 259300 - DNA, 20 bp, Artificial Sequence
  chemically synthesized
cagccaccaactcctaggct

SEQ ID NO: 259301 - DNA, 20 bp, Artificial Sequence
  chemically synthesized
gatctcctgagcctaggagt

SEQ ID NO: 259302 - DNA, 20 bp, Artificial Sequence
  chemically synthesized
cactgcagccaccaactcct

SEQ ID NO: 259303 - DNA, 20 bp, Artificial Sequence
  chemically synthesized
tcactgcagccaccaactcc

SEQ ID NO: 259304 - DNA, 20 bp, Artificial Sequence
  chemically synthesized
ctcctgagcctaggagttgg

SEQ ID NO: 259305 - DNA, 20 bp, Artificial Sequence
  chemically synthesized
agcctaggagttggtggctg

SEQ ID NO: 259306 - DNA, 20 bp, Artificial Sequence
  chemically synthesized
taggagttggtggctgcagt

SEQ ID NO: 259307 - DNA, 20 bp, Artificial Sequence
  chemically synthesized
gatgcaatcatagctcactg

SEQ ID NO: 259308 - DNA, 20 bp, Artificial Sequence
  chemically synthesized
ggagtgccgcgatgcaatca

SEQ ID NO: 259309 - DNA, 20 bp, Artificial Sequence
  chemically synthesized
agtgagctatgattgcatcg

SEQ ID NO: 259310 - DNA, 20 bp, Artificial Sequence
  chemically synthesized
atgattgcatcgcggcactc

SEQ ID NO: 259311 - DNA, 20 bp, Artificial Sequence
  chemically synthesized
tgcatcgcggcactccagct

SEQ ID NO: 259312 - DNA, 20 bp, Artificial Sequence
  chemically synthesized
gcatcgcggcactccagctt

SEQ ID NO: 259313 - DNA, 20 bp, Artificial Sequence
  chemically synthesized
tcttgctattgcccaagctg

SEQ ID NO: 259314 - DNA, 20 bp, Artificial Sequence
  chemically synthesized
ggtcttgctattgcccaagc

SEQ ID NO: 259315 - DNA, 20 bp, Artificial Sequence
  chemically synthesized
cggcactccagcttgggcaa

SEQ ID NO: 259316 - DNA, 20 bp, Artificial Sequence
  chemically synthesized
acagggtcttgctattgccc

SEQ ID NO: 259317 - DNA, 20 bp, Artificial Sequence
  chemically synthesized
actccagcttgggcaatagc

SEQ ID NO: 259318 - DNA, 20 bp, Artificial Sequence
  chemically synthesized
ttgtttttatttttgagaca

SEQ ID NO: 259319 - DNA, 20 bp, Artificial Sequence
  chemically synthesized
tttgtttttatttttgagac

SEQ ID NO: 259320 - DNA, 20 bp, Artificial Sequence
  chemically synthesized
ttttgtttttatttttgaga

SEQ ID NO: 259321 - DNA, 20 bp, Artificial Sequence
  chemically synthesized
tttattttgtttttattttt

SEQ ID NO: 259322 - DNA, 20 bp, Artificial Sequence
  chemically synthesized
aaataaaataaaataataaa

SEQ ID NO: 259323 - DNA, 20 bp, Artificial Sequence
  chemically synthesized
aataaaataaaataataaac

SEQ ID NO: 259324 - DNA, 20 bp, Artificial Sequence
  chemically synthesized
ataaaataaaataataaaca

SEQ ID NO: 259325 - DNA, 20 bp, Artificial Sequence
  chemically synthesized
ataataaacagggacacatt

SEQ ID NO: 259326 - DNA, 20 bp, Artificial Sequence
  chemically synthesized
tgaagtacagaaatttcatt

SEQ ID NO: 259327 - DNA, 20 bp, Artificial Sequence
  chemically synthesized
ctgtcccatctattgaagta

SEQ ID NO: 259328 - DNA, 20 bp, Artificial Sequence
  chemically synthesized
atgaaatttctgtacttcaa

SEQ ID NO: 259329 - DNA, 20 bp, Artificial Sequence
  chemically synthesized
aatttctgtacttcaataga

SEQ ID NO: 259330 - DNA, 20 bp, Artificial Sequence
  chemically synthesized
gctgtctgtcccatctattg

SEQ ID NO: 259331 - DNA, 20 bp, Artificial Sequence
  chemically synthesized
atttctgtacttcaatagat

SEQ ID NO: 259332 - DNA, 20 bp, Artificial Sequence
  chemically synthesized
ctgtacttcaatagatggga

SEQ ID NO: 259333 - DNA, 20 bp, Artificial Sequence
  chemically synthesized
acttcaatagatgggacaga

SEQ ID NO: 259334 - DNA, 20 bp, Artificial Sequence
  chemically synthesized
gatgggacagacagcaactt

SEQ ID NO: 259335 - DNA, 20 bp, Artificial Sequence
  chemically synthesized
tgggacagacagcaacttta

SEQ ID NO: 259336 - DNA, 20 bp, Artificial Sequence
  chemically synthesized
tttctttctctcaaactcta

SEQ ID NO: 259337 - DNA, 20 bp, Artificial Sequence
  chemically synthesized
agacagcaactttagagttt

SEQ ID NO: 259338 - DNA, 20 bp, Artificial Sequence
  chemically synthesized
acagcaactttagagtttga

SEQ ID NO: 259339 - DNA, 20 bp, Artificial Sequence
  chemically synthesized
caactttagagtttgagaga

SEQ ID NO: 259340 - DNA, 20 bp, Artificial Sequence
  chemically synthesized
agagtttgagagaaagaaaa

SEQ ID NO: 259341 - DNA, 20 bp, Artificial Sequence
  chemically synthesized
gagtttgagagaaagaaaaa

SEQ ID NO: 259342 - DNA, 20 bp, Artificial Sequence
  chemically synthesized
aaatacaaataaatgatact

SEQ ID NO: 259343 - DNA, 20 bp, Artificial Sequence
  chemically synthesized
caaataaatgatacttggac

SEQ ID NO: 259344 - DNA, 20 bp, Artificial Sequence
  chemically synthesized
gtaaagtctgattctagtcc

SEQ ID NO: 259345 - DNA, 20 bp, Artificial Sequence
  chemically synthesized
aatgatacttggactagaat

SEQ ID NO: 259346 - DNA, 20 bp, Artificial Sequence
  chemically synthesized
tccagtgtaaagtctgattc

SEQ ID NO: 259347 - DNA, 20 bp, Artificial Sequence
  chemically synthesized
actagaatcagactttacac

SEQ ID NO: 259348 - DNA, 20 bp, Artificial Sequence
  chemically synthesized
ctactattgtttccagtgta

SEQ ID NO: 259349 - DNA, 20 bp, Artificial Sequence
  chemically synthesized
agactttacactggaaacaa

SEQ ID NO: 259350 - DNA, 20 bp, Artificial Sequence
  chemically synthesized
cttcaagctactattgtttc

SEQ ID NO: 259351 - DNA, 20 bp, Artificial Sequence
  chemically synthesized
ctttacactggaaacaatag

SEQ ID NO: 259352 - DNA, 20 bp, Artificial Sequence
  chemically synthesized
ctggaaacaatagtagcttg

SEQ ID NO: 259353 - DNA, 20 bp, Artificial Sequence
  chemically synthesized
aaacaatagtagcttgaaga

SEQ ID NO: 259354 - DNA, 20 bp, Artificial Sequence
  chemically synthesized
ttcttgtttcaactatcttc

SEQ ID NO: 259355 - DNA, 20 bp, Artificial Sequence
  chemically synthesized
agcttgaagatagttgaaac

SEQ ID NO: 259356 - DNA, 20 bp, Artificial Sequence
  chemically synthesized
tagttgaaacaagaaaacaa

SEQ ID NO: 259357 - DNA, 20 bp, Artificial Sequence
  chemically synthesized
aacaagaaaacaatggaaac

SEQ ID NO: 259358 - DNA, 20 bp, Artificial Sequence
  chemically synthesized
aagaaaacaatggaaactgg

SEQ ID NO: 259359 - DNA, 20 bp, Artificial Sequence
  chemically synthesized
ggttatgaacaattgtcttc

SEQ ID NO: 259360 - DNA, 20 bp, Artificial Sequence
  chemically synthesized
agacaattgttcataaccta

SEQ ID NO: 259361 - DNA, 20 bp, Artificial Sequence
  chemically synthesized
acaattgttcataacctaca

SEQ ID NO: 259362 - DNA, 20 bp, Artificial Sequence
  chemically synthesized
ctttttttagtagtctctgt

SEQ ID NO: 259363 - DNA, 20 bp, Artificial Sequence
  chemically synthesized
tctttttttagtagtctctg

SEQ ID NO: 259364 - DNA, 20 bp, Artificial Sequence
  chemically synthesized
cctacagagactactaaaaa

SEQ ID NO: 259365 - DNA, 20 bp, Artificial Sequence
  chemically synthesized
tatctctcctctttttttag

SEQ ID NO: 259366 - DNA, 20 bp, Artificial Sequence
  chemically synthesized
tacagagactactaaaaaaa

SEQ ID NO: 259367 - DNA, 20 bp, Artificial Sequence
  chemically synthesized
acagagactactaaaaaaag

SEQ ID NO: 259368 - DNA, 20 bp, Artificial Sequence
  chemically synthesized
taatatctctcctctttttt

SEQ ID NO: 259369 - DNA, 20 bp, Artificial Sequence
  chemically synthesized
agagactactaaaaaaagag

SEQ ID NO: 259370 - DNA, 20 bp, Artificial Sequence
  chemically synthesized
agactactaaaaaaagagga

SEQ ID NO: 259371 - DNA, 20 bp, Artificial Sequence
  chemically synthesized
aaaaaagaggagagatatta

SEQ ID NO: 259372 - DNA, 20 bp, Artificial Sequence
  chemically synthesized
atcatgatggatttattgga

SEQ ID NO: 259373 - DNA, 20 bp, Artificial Sequence
  chemically synthesized
agtcatcatgatggatttat

SEQ ID NO: 259374 - DNA, 20 bp, Artificial Sequence
  chemically synthesized
ttgctttgcagtcatcatga

SEQ ID NO: 259375 - DNA, 20 bp, Artificial Sequence
  chemically synthesized
aatccatcatgatgactgca

SEQ ID NO: 259376 - DNA, 20 bp, Artificial Sequence
  chemically synthesized
atcatgatgactgcaaagca

SEQ ID NO: 259377 - DNA, 20 bp, Artificial Sequence
  chemically synthesized
tcgaaatgatctttgctttg

SEQ ID NO: 259378 - DNA, 20 bp, Artificial Sequence
  chemically synthesized
aaagatcatttcgaaaatgc

SEQ ID NO: 259379 - DNA, 20 bp, Artificial Sequence
  chemically synthesized
aagatcatttcgaaaatgca

SEQ ID NO: 259380 - DNA, 20 bp, Artificial Sequence
  chemically synthesized
tcgaaaatgcaaggtttaca

SEQ ID NO: 259381 - DNA, 20 bp, Artificial Sequence
  chemically synthesized
atgtcctcgtaaaaacataa

SEQ ID NO: 259382 - DNA, 20 bp, Artificial Sequence
  chemically synthesized
aatgtcctcgtaaaaacata

SEQ ID NO: 259383 - DNA, 20 bp, Artificial Sequence
  chemically synthesized
tacatcctttatgtttttac

SEQ ID NO: 259384 - DNA, 20 bp, Artificial Sequence
  chemically synthesized
acatcctttatgtttttacg

SEQ ID NO: 259385 - DNA, 20 bp, Artificial Sequence
  chemically synthesized
ttaatttggttggaacacat

SEQ ID NO: 259386 - DNA, 20 bp, Artificial Sequence
  chemically synthesized
tacttcagttttaatttggt

SEQ ID NO: 259387 - DNA, 20 bp, Artificial Sequence
  chemically synthesized
actgtacttcagttttaatt

SEQ ID NO: 259388 - DNA, 20 bp, Artificial Sequence
  chemically synthesized
ttccaaccaaattaaaactg

SEQ ID NO: 259389 - DNA, 20 bp, Artificial Sequence
  chemically synthesized
accaaattaaaactgaagta

SEQ ID NO: 259390 - DNA, 20 bp, Artificial Sequence
  chemically synthesized
acagagggccaactgtactt

SEQ ID NO: 259391 - DNA, 20 bp, Artificial Sequence
  chemically synthesized
aattaaaactgaagtacagt

SEQ ID NO: 259392 - DNA, 20 bp, Artificial Sequence
  chemically synthesized
gtggaacccatggatacaga

SEQ ID NO: 259393 - DNA, 20 bp, Artificial Sequence
  chemically synthesized
tgtggaacccatggatacag

SEQ ID NO: 259394 - DNA, 20 bp, Artificial Sequence
  chemically synthesized
atgtggaacccatggataca

SEQ ID NO: 259395 - DNA, 20 bp, Artificial Sequence
  chemically synthesized
cagttggccctctgtatcca

SEQ ID NO: 259396 - DNA, 20 bp, Artificial Sequence
  chemically synthesized
agttggccctctgtatccat

SEQ ID NO: 259397 - DNA, 20 bp, Artificial Sequence
  chemically synthesized
aaatgtggaacccatggata

SEQ ID NO: 259398 - DNA, 20 bp, Artificial Sequence
  chemically synthesized
atccacaaatgtggaaccca

SEQ ID NO: 259399 - DNA, 20 bp, Artificial Sequence
  chemically synthesized
atccatgggttccacatttg

SEQ ID NO: 259400 - DNA, 20 bp, Artificial Sequence
  chemically synthesized
actggttaaatccacaaatg

SEQ ID NO: 259401 - DNA, 20 bp, Artificial Sequence
  chemically synthesized
tccacatttgtggatttaac

SEQ ID NO: 259402 - DNA, 20 bp, Artificial Sequence
  chemically synthesized
aaatgtgttcgatcgatgac

SEQ ID NO: 259403 - DNA, 20 bp, Artificial Sequence
  chemically synthesized
aacacatttgcaaaaataca

SEQ ID NO: 259404 - DNA, 20 bp, Artificial Sequence
  chemically synthesized
catttgcaaaaatacatgga

SEQ ID NO: 259405 - DNA, 20 bp, Artificial Sequence
  chemically synthesized
gtacatgttcagtgcagaca

SEQ ID NO: 259406 - DNA, 20 bp, Artificial Sequence
  chemically synthesized
atgtctgtacatgttcagtg

SEQ ID NO: 259407 - DNA, 20 bp, Artificial Sequence
  chemically synthesized
taaaaatgtctgtacatgtt

SEQ ID NO: 259408 - DNA, 20 bp, Artificial Sequence
  chemically synthesized
gtgtctgcactgaacatgta

SEQ ID NO: 259409 - DNA, 20 bp, Artificial Sequence
  chemically synthesized
cagtattgtttagggaataa

SEQ ID NO: 259410 - DNA, 20 bp, Artificial Sequence
  chemically synthesized
ttgttatgcagtattgttta

SEQ ID NO: 259411 - DNA, 20 bp, Artificial Sequence
  chemically synthesized
gttgttatgcagtattgttt

SEQ ID NO: 259412 - DNA, 20 bp, Artificial Sequence
  chemically synthesized
agttgttatgcagtattgtt

SEQ ID NO: 259413 - DNA, 20 bp, Artificial Sequence
  chemically synthesized
ctatgtaaatagttgttatg

SEQ ID NO: 259414 - DNA, 20 bp, Artificial Sequence
  chemically synthesized
ctgcataacaactatttaca

SEQ ID NO: 259415 - DNA, 20 bp, Artificial Sequence
  chemically synthesized
caatgtaaatgctatgtaaa

SEQ ID NO: 259416 - DNA, 20 bp, Artificial Sequence
  chemically synthesized
acatagcatttacattgtat

SEQ ID NO: 259417 - DNA, 20 bp, Artificial Sequence
  chemically synthesized
catagcatttacattgtatt

SEQ ID NO: 259418 - DNA, 20 bp, Artificial Sequence
  chemically synthesized
tatcatctctagattattta

SEQ ID NO: 259419 - DNA, 20 bp, Artificial Sequence
  chemically synthesized
attgggtactataaataatc

SEQ ID NO: 259420 - DNA, 20 bp, Artificial Sequence
  chemically synthesized
tgggtactataaataatcta

SEQ ID NO: 259421 - DNA, 20 bp, Artificial Sequence
  chemically synthesized
tgaacacttcatatcatctc

SEQ ID NO: 259422 - DNA, 20 bp, Artificial Sequence
  chemically synthesized
aataatctagagatgatatg

SEQ ID NO: 259423 - DNA, 20 bp, Artificial Sequence
  chemically synthesized
tagagatgatatgaagtgtt

SEQ ID NO: 259424 - DNA, 20 bp, Artificial Sequence
  chemically synthesized
agagatgatatgaagtgttc

SEQ ID NO: 259425 - DNA, 20 bp, Artificial Sequence
  chemically synthesized
agatgatatgaagtgttcag

SEQ ID NO: 259426 - DNA, 20 bp, Artificial Sequence
  chemically synthesized
gatgatatgaagtgttcagg

SEQ ID NO: 259427 - DNA, 20 bp, Artificial Sequence
  chemically synthesized
atgatatgaagtgttcagga

SEQ ID NO: 259428 - DNA, 20 bp, Artificial Sequence
  chemically synthesized
agtgttcaggagggtgtcca

SEQ ID NO: 259429 - DNA, 20 bp, Artificial Sequence
  chemically synthesized
atagtgtttgcatgtaacta

SEQ ID NO: 259430 - DNA, 20 bp, Artificial Sequence
  chemically synthesized
attatttatataaaatggca

SEQ ID NO: 259431 - DNA, 20 bp, Artificial Sequence
  chemically synthesized
ctcaaattatttatataaaa

SEQ ID NO: 259432 - DNA, 20 bp, Artificial Sequence
  chemically synthesized
ccattttatataaataattt

SEQ ID NO: 259433 - DNA, 20 bp, Artificial Sequence
  chemically synthesized
gcattttgatatcaaaattc

SEQ ID NO: 259434 - DNA, 20 bp, Artificial Sequence
  chemically synthesized
tgatatcaaaatgctgaaac

SEQ ID NO: 259435 - DNA, 20 bp, Artificial Sequence
  chemically synthesized
tgtctgtggggcactggttt

SEQ ID NO: 259436 - DNA, 20 bp, Artificial Sequence
  chemically synthesized
cttcagtgtctgtggggcac

SEQ ID NO: 259437 - DNA, 20 bp, Artificial Sequence
  chemically synthesized
atgctgaaaccagtgcccca

SEQ ID NO: 259438 - DNA, 20 bp, Artificial Sequence
  chemically synthesized
gtcatccttcagtgtctgtg

SEQ ID NO: 259439 - DNA, 20 bp, Artificial Sequence
  chemically synthesized
agtcatccttcagtgtctgt

SEQ ID NO: 259440 - DNA, 20 bp, Artificial Sequence
  chemically synthesized
cagtcatccttcagtgtctg

SEQ ID NO: 259441 - DNA, 20 bp, Artificial Sequence
  chemically synthesized
ccagtgccccacagacactg

SEQ ID NO: 259442 - DNA, 20 bp, Artificial Sequence
  chemically synthesized
cagtgccccacagacactga

SEQ ID NO: 259443 - DNA, 20 bp, Artificial Sequence
  chemically synthesized
tttattacacagtcatcctt

SEQ ID NO: 259444 - DNA, 20 bp, Artificial Sequence
  chemically synthesized
tgaaggatgactgtgtaata

SEQ ID NO: 259445 - DNA, 20 bp, Artificial Sequence
  chemically synthesized
gttttgaaatctttattaca

SEQ ID NO: 259446 - DNA, 20 bp, Artificial Sequence
  chemically synthesized
aataaagatttcaaaacaat

SEQ ID NO: 259447 - DNA, 20 bp, Artificial Sequence
  chemically synthesized
tcaaaacaatgagaaataaa

SEQ ID NO: 259448 - DNA, 20 bp, Artificial Sequence
  chemically synthesized
aaataaacggtacaaaaaaa

SEQ ID NO: 259449 - DNA, 20 bp, Artificial Sequence
  chemically synthesized
acggtacaaaaaaacagtga

SEQ ID NO: 259450 - DNA, 20 bp, Artificial Sequence
  chemically synthesized
cggtacaaaaaaacagtgac

SEQ ID NO: 259451 - DNA, 20 bp, Artificial Sequence
  chemically synthesized
atttgaccacaaacgacaca

SEQ ID NO: 259452 - DNA, 20 bp, Artificial Sequence
  chemically synthesized
aatttgaccacaaacgacac

SEQ ID NO: 259453 - DNA, 20 bp, Artificial Sequence
  chemically synthesized
aatacaccttgtgtcgtttg

SEQ ID NO: 259454 - DNA, 20 bp, Artificial Sequence
  chemically synthesized
gtttgtggtcaaattttatg

SEQ ID NO: 259455 - DNA, 20 bp, Artificial Sequence
  chemically synthesized
ggtcaaattttatgaagtga

SEQ ID NO: 259456 - DNA, 20 bp, Artificial Sequence
  chemically synthesized
atgaagtgatagtgtaattt

SEQ ID NO: 259457 - DNA, 20 bp, Artificial Sequence
  chemically synthesized
aataacatgacatcttgaac

SEQ ID NO: 259458 - DNA, 20 bp, Artificial Sequence
  chemically synthesized
gtagtatcacatactagttc

SEQ ID NO: 259459 - DNA, 20 bp, Artificial Sequence
  chemically synthesized
tcacttgtagtatcacatac

SEQ ID NO: 259460 - DNA, 20 bp, Artificial Sequence
  chemically synthesized
gaactagtatgtgatactac

SEQ ID NO: 259461 - DNA, 20 bp, Artificial Sequence
  chemically synthesized
gctactattgttttcacttg

SEQ ID NO: 259462 - DNA, 20 bp, Artificial Sequence
  chemically synthesized
gatactacaagtgaaaacaa

SEQ ID NO: 259463 - DNA, 20 bp, Artificial Sequence
  chemically synthesized
actacaagtgaaaacaatag

SEQ ID NO: 259464 - DNA, 20 bp, Artificial Sequence
  chemically synthesized
caagtgaaaacaatagtagc

SEQ ID NO: 259465 - DNA, 20 bp, Artificial Sequence
  chemically synthesized
aagtgaaaacaatagtagcc

SEQ ID NO: 259466 - DNA, 20 bp, Artificial Sequence
  chemically synthesized
taatttataattttatttcc

SEQ ID NO: 259467 - DNA, 20 bp, Artificial Sequence
  chemically synthesized
ttataaattatttcttttta

SEQ ID NO: 259468 - DNA, 20 bp, Artificial Sequence
  chemically synthesized
tataaattatttctttttaa

SEQ ID NO: 259469 - DNA, 20 bp, Artificial Sequence
  chemically synthesized
caaaggcaaaatcctttaaa

SEQ ID NO: 259470 - DNA, 20 bp, Artificial Sequence
  chemically synthesized
tcctcattattttcaatcaa

SEQ ID NO: 259471 - DNA, 20 bp, Artificial Sequence
  chemically synthesized
ctcctcattattttcaatca

SEQ ID NO: 259472 - DNA, 20 bp, Artificial Sequence
  chemically synthesized
tgcctttgattgaaaataat

SEQ ID NO: 259473 - DNA, 20 bp, Artificial Sequence
  chemically synthesized
gcctttgattgaaaataatg

SEQ ID NO: 259474 - DNA, 20 bp, Artificial Sequence
  chemically synthesized
ctttgattgaaaataatgag

SEQ ID NO: 259475 - DNA, 20 bp, Artificial Sequence
  chemically synthesized
aaaataatgaggagttgact

SEQ ID NO: 259476 - DNA, 20 bp, Artificial Sequence
  chemically synthesized
catcaccaagatgatttact

SEQ ID NO: 259477 - DNA, 20 bp, Artificial Sequence
  chemically synthesized
gttgactaagtaaatcatct

SEQ ID NO: 259478 - DNA, 20 bp, Artificial Sequence
  chemically synthesized
aagtaaatcatcttggtgat

SEQ ID NO: 259479 - DNA, 20 bp, Artificial Sequence
  chemically synthesized
agtaaatcatcttggtgatg

SEQ ID NO: 259480 - DNA, 20 bp, Artificial Sequence
  chemically synthesized
agaacaatgccctcatcacc

SEQ ID NO: 259481 - DNA, 20 bp, Artificial Sequence
  chemically synthesized
gtaaatcatcttggtgatga

SEQ ID NO: 259482 - DNA, 20 bp, Artificial Sequence
  chemically synthesized
gtgttgcgccaaaattaaat

SEQ ID NO: 259483 - DNA, 20 bp, Artificial Sequence
  chemically synthesized
gcattgttcttatttaattt

SEQ ID NO: 259484 - DNA, 20 bp, Artificial Sequence
  chemically synthesized
ttaattttggcgcaacacta

SEQ ID NO: 259485 - DNA, 20 bp, Artificial Sequence
  chemically synthesized
attttatgcctatatttctg

SEQ ID NO: 259486 - DNA, 20 bp, Artificial Sequence
  chemically synthesized
ggcgcaacactacagaaata

SEQ ID NO: 259487 - DNA, 20 bp, Artificial Sequence
  chemically synthesized
gcgcaacactacagaaatat

SEQ ID NO: 259488 - DNA, 20 bp, Artificial Sequence
  chemically synthesized
cataaaattgttgtttaaaa

SEQ ID NO: 259489 - DNA, 20 bp, Artificial Sequence
  chemically synthesized
ataaaattgttgtttaaaat

SEQ ID NO: 259490 - DNA, 20 bp, Artificial Sequence
  chemically synthesized
ttgttgtttaaaatgggaaa

SEQ ID NO: 259491 - DNA, 20 bp, Artificial Sequence
  chemically synthesized
tttaaaatgggaaacagcac

SEQ ID NO: 259492 - DNA, 20 bp, Artificial Sequence
  chemically synthesized
actttgtactatcattttac

SEQ ID NO: 259493 - DNA, 20 bp, Artificial Sequence
  chemically synthesized
aaacagcactagtaaaatga

SEQ ID NO: 259494 - DNA, 20 bp, Artificial Sequence
  chemically synthesized
actagtaaaatgatagtaca

SEQ ID NO: 259495 - DNA, 20 bp, Artificial Sequence
  chemically synthesized
cgcacttataggttatttat

SEQ ID NO: 259496 - DNA, 20 bp, Artificial Sequence
  chemically synthesized
ataacttataaataacctat

SEQ ID NO: 259497 - DNA, 20 bp, Artificial Sequence
  chemically synthesized
ttataaataacctataagtg

SEQ ID NO: 259498 - DNA, 20 bp, Artificial Sequence
  chemically synthesized
gcatctcttcccgcacttat

SEQ ID NO: 259499 - DNA, 20 bp, Artificial Sequence
  chemically synthesized
tataaataacctataagtgc

SEQ ID NO: 259500 - DNA, 20 bp, Artificial Sequence
  chemically synthesized
tgcatctcttcccgcactta

SEQ ID NO: 259501 - DNA, 20 bp, Artificial Sequence
  chemically synthesized
aaataacctataagtgcggg

SEQ ID NO: 259502 - DNA, 20 bp, Artificial Sequence
  chemically synthesized
ataacctataagtgcgggaa

SEQ ID NO: 259503 - DNA, 20 bp, Artificial Sequence
  chemically synthesized
tataagtgcgggaagagatg

SEQ ID NO: 259504 - DNA, 20 bp, Artificial Sequence
  chemically synthesized
aagtgcgggaagagatgcag

SEQ ID NO: 259505 - DNA, 20 bp, Artificial Sequence
  chemically synthesized
gtgcgggaagagatgcagta

SEQ ID NO: 259506 - DNA, 20 bp, Artificial Sequence
  chemically synthesized
ggaagagatgcagtagagtg

SEQ ID NO: 259507 - DNA, 20 bp, Artificial Sequence
  chemically synthesized
agatgcagtagagtgcagtg

SEQ ID NO: 259508 - DNA, 20 bp, Artificial Sequence
  chemically synthesized
tgcagtagagtgcagtgaag

SEQ ID NO: 259509 - DNA, 20 bp, Artificial Sequence
  chemically synthesized
gatgatgaattataaaatta

SEQ ID NO: 259510 - DNA, 20 bp, Artificial Sequence
  chemically synthesized
tgaattataaaattatagac

SEQ ID NO: 259511 - DNA, 20 bp, Artificial Sequence
  chemically synthesized
gaattataaaattatagaca

SEQ ID NO: 259512 - DNA, 20 bp, Artificial Sequence
  chemically synthesized
aattataaaattatagacaa

SEQ ID NO: 259513 - DNA, 20 bp, Artificial Sequence
  chemically synthesized
taaaattatagacaagggat

SEQ ID NO: 259514 - DNA, 20 bp, Artificial Sequence
  chemically synthesized
aaattatagacaagggataa

SEQ ID NO: 259515 - DNA, 20 bp, Artificial Sequence
  chemically synthesized
ttaattccttgtcatattga

SEQ ID NO: 259516 - DNA, 20 bp, Artificial Sequence
  chemically synthesized
ataatgaccatcaatatgac

SEQ ID NO: 259517 - DNA, 20 bp, Artificial Sequence
  chemically synthesized
taatgaccatcaatatgaca

SEQ ID NO: 259518 - DNA, 20 bp, Artificial Sequence
  chemically synthesized
aatatgacaaggaattaaaa

SEQ ID NO: 259519 - DNA, 20 bp, Artificial Sequence
  chemically synthesized
acaaggaattaaaacagaca

SEQ ID NO: 259520 - DNA, 20 bp, Artificial Sequence
  chemically synthesized
attaaaacagacacagttat

SEQ ID NO: 259521 - DNA, 20 bp, Artificial Sequence
  chemically synthesized
taaaacagacacagttataa

SEQ ID NO: 259522 - DNA, 20 bp, Artificial Sequence
  chemically synthesized
taagagttattgtaaaaatg

SEQ ID NO: 259523 - DNA, 20 bp, Artificial Sequence
  chemically synthesized
agttattgtaaaaatgaagt

SEQ ID NO: 259524 - DNA, 20 bp, Artificial Sequence
  chemically synthesized
tggttaaaatgtctcatcta

SEQ ID NO: 259525 - DNA, 20 bp, Artificial Sequence
  chemically synthesized
tagatagttcatctttagat

SEQ ID NO: 259526 - DNA, 20 bp, Artificial Sequence
  chemically synthesized
aatgatagatagttcatctt

SEQ ID NO: 259527 - DNA, 20 bp, Artificial Sequence
  chemically synthesized
gaagatataaaaatgataga

SEQ ID NO: 259528 - DNA, 20 bp, Artificial Sequence
  chemically synthesized
ttatgaagatataaaaatga

SEQ ID NO: 259529 - DNA, 20 bp, Artificial Sequence
  chemically synthesized
tatcatttttatatcttcat

SEQ ID NO: 259530 - DNA, 20 bp, Artificial Sequence
  chemically synthesized
aatacgtgcttgatcttatg

SEQ ID NO: 259531 - DNA, 20 bp, Artificial Sequence
  chemically synthesized
ttttatatcttcataagatc

SEQ ID NO: 259532 - DNA, 20 bp, Artificial Sequence
  chemically synthesized
tcataagatcaagcacgtat

SEQ ID NO: 259533 - DNA, 20 bp, Artificial Sequence
  chemically synthesized
aagatcaagcacgtattggt

SEQ ID NO: 259534 - DNA, 20 bp, Artificial Sequence
  chemically synthesized
gaatatgtgattttttttta

SEQ ID NO: 259535 - DNA, 20 bp, Artificial Sequence
  chemically synthesized
tgatttttttttatagatac

SEQ ID NO: 259536 - DNA, 20 bp, Artificial Sequence
  chemically synthesized
atttttttttatagatacca

SEQ ID NO: 259537 - DNA, 20 bp, Artificial Sequence
  chemically synthesized
tttttttttatagataccag

SEQ ID NO: 259538 - DNA, 20 bp, Artificial Sequence
  chemically synthesized
tttttatagataccagaggc

SEQ ID NO: 259539 - DNA, 20 bp, Artificial Sequence
  chemically synthesized
ttttatagataccagaggct

SEQ ID NO: 259540 - DNA, 20 bp, Artificial Sequence
  chemically synthesized
cctacactcttcccagcctc

SEQ ID NO: 259541 - DNA, 20 bp, Artificial Sequence
  chemically synthesized
tatagataccagaggctggg

SEQ ID NO: 259542 - DNA, 20 bp, Artificial Sequence
  chemically synthesized
tagataccagaggctgggaa

SEQ ID NO: 259543 - DNA, 20 bp, Artificial Sequence
  chemically synthesized
ccgcccacctacactcttcc

SEQ ID NO: 259544 - DNA, 20 bp, Artificial Sequence
  chemically synthesized
accagaggctgggaagagtg

SEQ ID NO: 259545 - DNA, 20 bp, Artificial Sequence
  chemically synthesized
ccagaggctgggaagagtgt

SEQ ID NO: 259546 - DNA, 20 bp, Artificial Sequence
  chemically synthesized
gaggctgggaagagtgtagg

SEQ ID NO: 259547 - DNA, 20 bp, Artificial Sequence
  chemically synthesized
aggctgggaagagtgtaggt

SEQ ID NO: 259548 - DNA, 20 bp, Artificial Sequence
  chemically synthesized
ctgggaagagtgtaggtggg

SEQ ID NO: 259549 - DNA, 20 bp, Artificial Sequence
  chemically synthesized
aagagtgtaggtgggcggaa

SEQ ID NO: 259550 - DNA, 20 bp, Artificial Sequence
  chemically synthesized
agagtgtaggtgggcggaat

SEQ ID NO: 259551 - DNA, 20 bp, Artificial Sequence
  chemically synthesized
gtaggtgggcggaatgggtg

SEQ ID NO: 259552 - DNA, 20 bp, Artificial Sequence
  chemically synthesized
aggtgggcggaatgggtgaa

SEQ ID NO: 259553 - DNA, 20 bp, Artificial Sequence
  chemically synthesized
gtgggcggaatgggtgaaga

SEQ ID NO: 259554 - DNA, 20 bp, Artificial Sequence
  chemically synthesized
cggaatgggtgaagagagat

SEQ ID NO: 259555 - DNA, 20 bp, Artificial Sequence
  chemically synthesized
ggtgaagagagattggttac

SEQ ID NO: 259556 - DNA, 20 bp, Artificial Sequence
  chemically synthesized
gtgaagagagattggttact

SEQ ID NO: 259557 - DNA, 20 bp, Artificial Sequence
  chemically synthesized
gagagattggttactgggta

SEQ ID NO: 259558 - DNA, 20 bp, Artificial Sequence
  chemically synthesized
tgcaactgtatgtccgtacc

SEQ ID NO: 259559 - DNA, 20 bp, Artificial Sequence
  chemically synthesized
ggttactgggtacggacata

SEQ ID NO: 259560 - DNA, 20 bp, Artificial Sequence
  chemically synthesized
ggtacggacatacagttgca

SEQ ID NO: 259561 - DNA, 20 bp, Artificial Sequence
  chemically synthesized
cggacatacagttgcataga

SEQ ID NO: 259562 - DNA, 20 bp, Artificial Sequence
  chemically synthesized
gacatacagttgcatagaaa

SEQ ID NO: 259563 - DNA, 20 bp, Artificial Sequence
  chemically synthesized
tacagttgcatagaaagagt

SEQ ID NO: 259564 - DNA, 20 bp, Artificial Sequence
  chemically synthesized
cctactcttctttcaaacat

SEQ ID NO: 259565 - DNA, 20 bp, Artificial Sequence
  chemically synthesized
gagtaagtgctaatgtttga

SEQ ID NO: 259566 - DNA, 20 bp, Artificial Sequence
  chemically synthesized
taagtgctaatgtttgaaag

SEQ ID NO: 259567 - DNA, 20 bp, Artificial Sequence
  chemically synthesized
agtgctaatgtttgaaagaa

SEQ ID NO: 259568 - DNA, 20 bp, Artificial Sequence
  chemically synthesized
gctaatgtttgaaagaagag

SEQ ID NO: 259569 - DNA, 20 bp, Artificial Sequence
  chemically synthesized
ctaatgtttgaaagaagagt

SEQ ID NO: 259570 - DNA, 20 bp, Artificial Sequence
  chemically synthesized
taatgtttgaaagaagagta

SEQ ID NO: 259571 - DNA, 20 bp, Artificial Sequence
  chemically synthesized
atacaatatattgttgatta

SEQ ID NO: 259572 - DNA, 20 bp, Artificial Sequence
  chemically synthesized
ctctcttctaggtattttga

SEQ ID NO: 259573 - DNA, 20 bp, Artificial Sequence
  chemically synthesized
tcctctcttctaggtatttt

SEQ ID NO: 259574 - DNA, 20 bp, Artificial Sequence
  chemically synthesized
attgtatctctcaaaatacc

SEQ ID NO: 259575 - DNA, 20 bp, Artificial Sequence
  chemically synthesized
gtatctctcaaaatacctag

SEQ ID NO: 259576 - DNA, 20 bp, Artificial Sequence
  chemically synthesized
atctctcaaaatacctagaa

SEQ ID NO: 259577 - DNA, 20 bp, Artificial Sequence
  chemically synthesized
ctctcaaaatacctagaaga

SEQ ID NO: 259578 - DNA, 20 bp, Artificial Sequence
  chemically synthesized
tctcaaaatacctagaagag

SEQ ID NO: 259579 - DNA, 20 bp, Artificial Sequence
  chemically synthesized
tagttcaactcctctcttct

SEQ ID NO: 259580 - DNA, 20 bp, Artificial Sequence
  chemically synthesized
atagttcaactcctctcttc

SEQ ID NO: 259581 - DNA, 20 bp, Artificial Sequence
  chemically synthesized
tcaaaatacctagaagagag

SEQ ID NO: 259582 - DNA, 20 bp, Artificial Sequence
  chemically synthesized
tcatttatatgtgttggaaa

SEQ ID NO: 259583 - DNA, 20 bp, Artificial Sequence
  chemically synthesized
tatttatcatttatatgtgt

SEQ ID NO: 259584 - DNA, 20 bp, Artificial Sequence
  chemically synthesized
catataaatgataaatactt

SEQ ID NO: 259585 - DNA, 20 bp, Artificial Sequence
  chemically synthesized
atgataaatacttgagatga

SEQ ID NO: 259586 - DNA, 20 bp, Artificial Sequence
  chemically synthesized
gttagggtatccatcatctc

SEQ ID NO: 259587 - DNA, 20 bp, Artificial Sequence
  chemically synthesized
tgattaagtcaggatagtta

SEQ ID NO: 259588 - DNA, 20 bp, Artificial Sequence
  chemically synthesized
atgattaagtcaggatagtt

SEQ ID NO: 259589 - DNA, 20 bp, Artificial Sequence
  chemically synthesized
aatgattaagtcaggatagt

SEQ ID NO: 259590 - DNA, 20 bp, Artificial Sequence
  chemically synthesized
gtataatgattaagtcagga

SEQ ID NO: 259591 - DNA, 20 bp, Artificial Sequence
  chemically synthesized
gaatgtataatgattaagtc

SEQ ID NO: 259592 - DNA, 20 bp, Artificial Sequence
  chemically synthesized
agaatgtataatgattaagt

SEQ ID NO: 259593 - DNA, 20 bp, Artificial Sequence
  chemically synthesized
gcatagaatgtataatgatt

SEQ ID NO: 259594 - DNA, 20 bp, Artificial Sequence
  chemically synthesized
cattatacattctatgcatg

SEQ ID NO: 259595 - DNA, 20 bp, Artificial Sequence
  chemically synthesized
gtaatattttgctacatgca

SEQ ID NO: 259596 - DNA, 20 bp, Artificial Sequence
  chemically synthesized
aatattacatgtaccctata

SEQ ID NO: 259597 - DNA, 20 bp, Artificial Sequence
  chemically synthesized
aatatttttacatctttata

SEQ ID NO: 259598 - DNA, 20 bp, Artificial Sequence
  chemically synthesized
aaatatttttacatctttat

SEQ ID NO: 259599 - DNA, 20 bp, Artificial Sequence
  chemically synthesized
caaatatttttacatcttta

SEQ ID NO: 259600 - DNA, 20 bp, Artificial Sequence
  chemically synthesized
agatgtaaaaatatttgcat

SEQ ID NO: 259601 - DNA, 20 bp, Artificial Sequence
  chemically synthesized
aaatatttgcataagttaaa

SEQ ID NO: 259602 - DNA, 20 bp, Artificial Sequence
  chemically synthesized
gttaaaaagacaaaattatc

SEQ ID NO: 259603 - DNA, 20 bp, Artificial Sequence
  chemically synthesized
atggagtgtgcattttaaac

SEQ ID NO: 259604 - DNA, 20 bp, Artificial Sequence
  chemically synthesized
taaaatgcacactccatcta

SEQ ID NO: 259605 - DNA, 20 bp, Artificial Sequence
  chemically synthesized
aaaatgcacactccatctat

SEQ ID NO: 259606 - DNA, 20 bp, Artificial Sequence
  chemically synthesized
ttgtaaacagcctatagatg

SEQ ID NO: 259607 - DNA, 20 bp, Artificial Sequence
  chemically synthesized
tcttgtaaacagcctataga

SEQ ID NO: 259608 - DNA, 20 bp, Artificial Sequence
  chemically synthesized
tgtttcttgtaaacagccta

SEQ ID NO: 259609 - DNA, 20 bp, Artificial Sequence
  chemically synthesized
tccatctataggctgtttac

SEQ ID NO: 259610 - DNA, 20 bp, Artificial Sequence
  chemically synthesized
atttttatgtttcttgtaaa

SEQ ID NO: 259611 - DNA, 20 bp, Artificial Sequence
  chemically synthesized
tacaagaaacataaaaatac

SEQ ID NO: 259612 - DNA, 20 bp, Artificial Sequence
  chemically synthesized
acaagaaacataaaaataca

SEQ ID NO: 259613 - DNA, 20 bp, Artificial Sequence
  chemically synthesized
aggtcacaatgctgcgttaa

SEQ ID NO: 259614 - DNA, 20 bp, Artificial Sequence
  chemically synthesized
tttctaaatcaccattaacg

SEQ ID NO: 259615 - DNA, 20 bp, Artificial Sequence
  chemically synthesized
atgctgcgttaatggtgatt

SEQ ID NO: 259616 - DNA, 20 bp, Artificial Sequence
  chemically synthesized
gactttcactttttaaaaaa

SEQ ID NO: 259617 - DNA, 20 bp, Artificial Sequence
  chemically synthesized
ttagaaaaccattttttaaa

SEQ ID NO: 259618 - DNA, 20 bp, Artificial Sequence
  chemically synthesized
aaccattttttaaaaagtga

SEQ ID NO: 259619 - DNA, 20 bp, Artificial Sequence
  chemically synthesized
ttttaaaaagtgaaagtcac

SEQ ID NO: 259620 - DNA, 20 bp, Artificial Sequence
  chemically synthesized
cacaagaaacataaaaatac

SEQ ID NO: 259621 - DNA, 20 bp, Artificial Sequence
  chemically synthesized
acaagaaacataaaaataca

SEQ ID NO: 259622 - DNA, 20 bp, Artificial Sequence
  chemically synthesized
aggtcacaatgctgcgttaa

SEQ ID NO: 259623 - DNA, 20 bp, Artificial Sequence
  chemically synthesized
tttctaaatcaccattaacg

SEQ ID NO: 259624 - DNA, 20 bp, Artificial Sequence
  chemically synthesized
atgctgcgttaatggtgatt

SEQ ID NO: 259625 - DNA, 20 bp, Artificial Sequence
  chemically synthesized
gactttcactttttaaaaaa

SEQ ID NO: 259626 - DNA, 20 bp, Artificial Sequence
  chemically synthesized
ttagaaaaccattttttaaa

SEQ ID NO: 259627 - DNA, 20 bp, Artificial Sequence
  chemically synthesized
aaccattttttaaaaagtga

SEQ ID NO: 259628 - DNA, 20 bp, Artificial Sequence
  chemically synthesized
aaaagtgaaagtcaaaataa

SEQ ID NO: 259629 - DNA, 20 bp, Artificial Sequence
  chemically synthesized
caaaataatagcatcaaatg

SEQ ID NO: 259630 - DNA, 20 bp, Artificial Sequence
  chemically synthesized
taatagcatcaaatgaagta

SEQ ID NO: 259631 - DNA, 20 bp, Artificial Sequence
  chemically synthesized
catcaaatgaagtatagttc

SEQ ID NO: 259632 - DNA, 20 bp, Artificial Sequence
  chemically synthesized
aagtatagttcaagaccgaa

SEQ ID NO: 259633 - DNA, 20 bp, Artificial Sequence
  chemically synthesized
gagacccatttagtgctttt

SEQ ID NO: 259634 - DNA, 20 bp, Artificial Sequence
  chemically synthesized
caagaccgaaaagcactaaa

SEQ ID NO: 259635 - DNA, 20 bp, Artificial Sequence
  chemically synthesized
aagaccgaaaagcactaaat

SEQ ID NO: 259636 - DNA, 20 bp, Artificial Sequence
  chemically synthesized
atggttctctgagacccatt

SEQ ID NO: 259637 - DNA, 20 bp, Artificial Sequence
  chemically synthesized
gaaaagcactaaatgggtct

SEQ ID NO: 259638 - DNA, 20 bp, Artificial Sequence
  chemically synthesized
aaagcactaaatgggtctca

SEQ ID NO: 259639 - DNA, 20 bp, Artificial Sequence
  chemically synthesized
tgtcattacaatggttctct

SEQ ID NO: 259640 - DNA, 20 bp, Artificial Sequence
  chemically synthesized
tgtgatttttgtcattacaa

SEQ ID NO: 259641 - DNA, 20 bp, Artificial Sequence
  chemically synthesized
aaaaatcacacttcttccca

SEQ ID NO: 259642 - DNA, 20 bp, Artificial Sequence
  chemically synthesized
gactactgtgctttgggaag

SEQ ID NO: 259643 - DNA, 20 bp, Artificial Sequence
  chemically synthesized
aatgactactgtgctttggg

SEQ ID NO: 259644 - DNA, 20 bp, Artificial Sequence
  chemically synthesized
tcacacttcttcccaaagca

SEQ ID NO: 259645 - DNA, 20 bp, Artificial Sequence
  chemically synthesized
attaatgactactgtgcttt

SEQ ID NO: 259646 - DNA, 20 bp, Artificial Sequence
  chemically synthesized
aattaatgactactgtgctt

SEQ ID NO: 259647 - DNA, 20 bp, Artificial Sequence
  chemically synthesized
cacttcttcccaaagcacag

SEQ ID NO: 259648 - DNA, 20 bp, Artificial Sequence
  chemically synthesized
gcacccaattgtttggggca

SEQ ID NO: 259649 - DNA, 20 bp, Artificial Sequence
  chemically synthesized
agaatgcacccaattgtttg

SEQ ID NO: 259650 - DNA, 20 bp, Artificial Sequence
  chemically synthesized
attgctatgccccaaacaat

SEQ ID NO: 259651 - DNA, 20 bp, Artificial Sequence
  chemically synthesized
tagaatgcacccaattgttt

SEQ ID NO: 259652 - DNA, 20 bp, Artificial Sequence
  chemically synthesized
ttgctatgccccaaacaatt

SEQ ID NO: 259653 - DNA, 20 bp, Artificial Sequence
  chemically synthesized
gtagaatgcacccaattgtt

SEQ ID NO: 259654 - DNA, 20 bp, Artificial Sequence
  chemically synthesized
caattgggtgcattctacat

SEQ ID NO: 259655 - DNA, 20 bp, Artificial Sequence
  chemically synthesized
aattgggtgcattctacata

SEQ ID NO: 259656 - DNA, 20 bp, Artificial Sequence
  chemically synthesized
ctagtaatttttaccttatg

SEQ ID NO: 259657 - DNA, 20 bp, Artificial Sequence
  chemically synthesized
ctacataaggtaaaaattac

SEQ ID NO: 259658 - DNA, 20 bp, Artificial Sequence
  chemically synthesized
gtaaaaattactagaaataa

SEQ ID NO: 259659 - DNA, 20 bp, Artificial Sequence
  chemically synthesized
tcatgttctccttttatttc

SEQ ID NO: 259660 - DNA, 20 bp, Artificial Sequence
  chemically synthesized
taaaaattactagaaataaa

SEQ ID NO: 259661 - DNA, 20 bp, Artificial Sequence
  chemically synthesized
aaaattactagaaataaaag

SEQ ID NO: 259662 - DNA, 20 bp, Artificial Sequence
  chemically synthesized
aggagaacatgataaaatca

SEQ ID NO: 259663 - DNA, 20 bp, Artificial Sequence
  chemically synthesized
acatgataaaatcatagctg

SEQ ID NO: 259664 - DNA, 20 bp, Artificial Sequence
  chemically synthesized
gataaaatcatagctgtagt

SEQ ID NO: 259665 - DNA, 20 bp, Artificial Sequence
  chemically synthesized
tgtatgtaaggtaccaacta

SEQ ID NO: 259666 - DNA, 20 bp, Artificial Sequence
  chemically synthesized
ttacagaagagttgtatgta

SEQ ID NO: 259667 - DNA, 20 bp, Artificial Sequence
  chemically synthesized
attacagaagagttgtatgt

SEQ ID NO: 259668 - DNA, 20 bp, Artificial Sequence
  chemically synthesized
taatctaacaaattacagaa

SEQ ID NO: 259669 - DNA, 20 bp, Artificial Sequence
  chemically synthesized
tttaatctaacaaattacag

SEQ ID NO: 259670 - DNA, 20 bp, Artificial Sequence
  chemically synthesized
tattttaatctaacaaatta

SEQ ID NO: 259671 - DNA, 20 bp, Artificial Sequence
  chemically synthesized
acaactcttctgtaatttgt

SEQ ID NO: 259672 - DNA, 20 bp, Artificial Sequence
  chemically synthesized
tgtaatttgttagattaaaa

SEQ ID NO: 259673 - DNA, 20 bp, Artificial Sequence
  chemically synthesized
aaaaaatacaaataaaaaac

SEQ ID NO: 259674 - DNA, 20 bp, Artificial Sequence
  chemically synthesized
atacaaataaaaaacaagaa

SEQ ID NO: 259675 - DNA, 20 bp, Artificial Sequence
  chemically synthesized
acaaataaaaaacaagaata

SEQ ID NO: 259676 - DNA, 20 bp, Artificial Sequence
  chemically synthesized
caaataaaaaacaagaatag

SEQ ID NO: 259677 - DNA, 20 bp, Artificial Sequence
  chemically synthesized
ataaaaaacaagaatagagg

SEQ ID NO: 259678 - DNA, 20 bp, Artificial Sequence
  chemically synthesized
agaggtggtttaaaaccgac

SEQ ID NO: 259679 - DNA, 20 bp, Artificial Sequence
  chemically synthesized
acggattaaatttagcttgt

SEQ ID NO: 259680 - DNA, 20 bp, Artificial Sequence
  chemically synthesized
cacaaaatacggattaaatt

SEQ ID NO: 259681 - DNA, 20 bp, Artificial Sequence
  chemically synthesized
tttccagtgtgcacaaaata

SEQ ID NO: 259682 - DNA, 20 bp, Artificial Sequence
  chemically synthesized
aatccgtattttgtgcacac

SEQ ID NO: 259683 - DNA, 20 bp, Artificial Sequence
  chemically synthesized
tattttgtgcacactggaaa

SEQ ID NO: 259684 - DNA, 20 bp, Artificial Sequence
  chemically synthesized
ataggagaatatgctttttc

SEQ ID NO: 259685 - DNA, 20 bp, Artificial Sequence
  chemically synthesized
ttgatgtcccaagtaaatag

SEQ ID NO: 259686 - DNA, 20 bp, Artificial Sequence
  chemically synthesized
agcatattctcctatttact

SEQ ID NO: 259687 - DNA, 20 bp, Artificial Sequence
  chemically synthesized
ttttgatgtcccaagtaaat

SEQ ID NO: 259688 - DNA, 20 bp, Artificial Sequence
  chemically synthesized
gcatattctcctatttactt

SEQ ID NO: 259689 - DNA, 20 bp, Artificial Sequence
  chemically synthesized
tttttgatgtcccaagtaaa

SEQ ID NO: 259690 - DNA, 20 bp, Artificial Sequence
  chemically synthesized
tatgtaatttttgatgtccc

SEQ ID NO: 259691 - DNA, 20 bp, Artificial Sequence
  chemically synthesized
ttgggacatcaaaaattaca

SEQ ID NO: 259692 - DNA, 20 bp, Artificial Sequence
  chemically synthesized
gggacatcaaaaattacata

SEQ ID NO: 259693 - DNA, 20 bp, Artificial Sequence
  chemically synthesized
gacatcaaaaattacataga

SEQ ID NO: 259694 - DNA, 20 bp, Artificial Sequence
  chemically synthesized
acatcaaaaattacatagag

SEQ ID NO: 259695 - DNA, 20 bp, Artificial Sequence
  chemically synthesized
catagagaggaaacttttaa

SEQ ID NO: 259696 - DNA, 20 bp, Artificial Sequence
  chemically synthesized
tttctttttgatgcttttaa

SEQ ID NO: 259697 - DNA, 20 bp, Artificial Sequence
  chemically synthesized
aaacttttaaaagcatcaaa

SEQ ID NO: 259698 - DNA, 20 bp, Artificial Sequence
  chemically synthesized
ttttaaaagcatcaaaaaga

SEQ ID NO: 259699 - DNA, 20 bp, Artificial Sequence
  chemically synthesized
catcaaaaagaaagatttga

SEQ ID NO: 259700 - DNA, 20 bp, Artificial Sequence
  chemically synthesized
atcaaaaagaaagatttgat

SEQ ID NO: 259701 - DNA, 20 bp, Artificial Sequence
  chemically synthesized
tatattttgattagaaaagg

SEQ ID NO: 259702 - DNA, 20 bp, Artificial Sequence
  chemically synthesized
tattatattttgattagaaa

SEQ ID NO: 259703 - DNA, 20 bp, Artificial Sequence
  chemically synthesized
ttattatattttgattagaa

SEQ ID NO: 259704 - DNA, 20 bp, Artificial Sequence
  chemically synthesized
ctggattattatattttgat

SEQ ID NO: 259705 - DNA, 20 bp, Artificial Sequence
  chemically synthesized
ctaatcaaaatataataatc

SEQ ID NO: 259706 - DNA, 20 bp, Artificial Sequence
  chemically synthesized
aatataataatccagaaatg

SEQ ID NO: 259707 - DNA, 20 bp, Artificial Sequence
  chemically synthesized
ctattattcttctacatttc

SEQ ID NO: 259708 - DNA, 20 bp, Artificial Sequence
  chemically synthesized
ataataatccagaaatgtag

SEQ ID NO: 259709 - DNA, 20 bp, Artificial Sequence
  chemically synthesized
ccagaaatgtagaagaataa

SEQ ID NO: 259710 - DNA, 20 bp, Artificial Sequence
  chemically synthesized
tacattttgattcatcatct

SEQ ID NO: 259711 - DNA, 20 bp, Artificial Sequence
  chemically synthesized
tacattctttgtgaaagtct

SEQ ID NO: 259712 - DNA, 20 bp, Artificial Sequence
  chemically synthesized
catcatctaagactttcaca

SEQ ID NO: 259713 - DNA, 20 bp, Artificial Sequence
  chemically synthesized
atcttatacattctttgtga

SEQ ID NO: 259714 - DNA, 20 bp, Artificial Sequence
  chemically synthesized
gactttcacaaagaatgtat

SEQ ID NO: 259715 - DNA, 20 bp, Artificial Sequence
  chemically synthesized
atgttcccaggtaatgtata

SEQ ID NO: 259716 - DNA, 20 bp, Artificial Sequence
  chemically synthesized
taagatctatatacattacc

SEQ ID NO: 259717 - DNA, 20 bp, Artificial Sequence
  chemically synthesized
aagatctatatacattacct

SEQ ID NO: 259718 - DNA, 20 bp, Artificial Sequence
  chemically synthesized
tcaattagaaacatgttccc

SEQ ID NO: 259719 - DNA, 20 bp, Artificial Sequence
  chemically synthesized
gtcaattagaaacatgttcc

SEQ ID NO: 259720 - DNA, 20 bp, Artificial Sequence
  chemically synthesized
ttttaaatataacagtcaat

SEQ ID NO: 259721 - DNA, 20 bp, Artificial Sequence
  chemically synthesized
gtgtattattttaaatataa

SEQ ID NO: 259722 - DNA, 20 bp, Artificial Sequence
  chemically synthesized
gttatatttaaaataataca

SEQ ID NO: 259723 - DNA, 20 bp, Artificial Sequence
  chemically synthesized
ttaaaataatacacagaata

SEQ ID NO: 259724 - DNA, 20 bp, Artificial Sequence
  chemically synthesized
aaataatacacagaataaag

SEQ ID NO: 259725 - DNA, 20 bp, Artificial Sequence
  chemically synthesized
taaagcagtattttttaaaa

SEQ ID NO: 259726 - DNA, 20 bp, Artificial Sequence
  chemically synthesized
ttaccaatgaatagtatata

SEQ ID NO: 259727 - DNA, 20 bp, Artificial Sequence
  chemically synthesized
tatctatatatactattcat

SEQ ID NO: 259728 - DNA, 20 bp, Artificial Sequence
  chemically synthesized
tgttcattcttaccaatgaa

SEQ ID NO: 259729 - DNA, 20 bp, Artificial Sequence
  chemically synthesized
tatatatactattcattggt

SEQ ID NO: 259730 - DNA, 20 bp, Artificial Sequence
  chemically synthesized
tattcattggtaagaatgaa

SEQ ID NO: 259731 - DNA, 20 bp, Artificial Sequence
  chemically synthesized
tggtaagaatgaacagtata

SEQ ID NO: 259732 - DNA, 20 bp, Artificial Sequence
  chemically synthesized
aatgaacagtatatggaata

SEQ ID NO: 259733 - DNA, 20 bp, Artificial Sequence
  chemically synthesized
agtatatggaatatagtaca

SEQ ID NO: 259734 - DNA, 20 bp, Artificial Sequence
  chemically synthesized
tatatggaatatagtacaaa

SEQ ID NO: 259735 - DNA, 20 bp, Artificial Sequence
  chemically synthesized
tatagtacaaagagatatct

SEQ ID NO: 259736 - DNA, 20 bp, Artificial Sequence
  chemically synthesized
aaaagtctatagtttagtct

SEQ ID NO: 259737 - DNA, 20 bp, Artificial Sequence
  chemically synthesized
agatatctaagactaaacta

SEQ ID NO: 259738 - DNA, 20 bp, Artificial Sequence
  chemically synthesized
tctttaaaaagtctatagtt

SEQ ID NO: 259739 - DNA, 20 bp, Artificial Sequence
  chemically synthesized
tttagtctttaaaaagtcta

SEQ ID NO: 259740 - DNA, 20 bp, Artificial Sequence
  chemically synthesized
actaaactatagacttttta

SEQ ID NO: 259741 - DNA, 20 bp, Artificial Sequence
  chemically synthesized
tctacaatttagtctttaaa

SEQ ID NO: 259742 - DNA, 20 bp, Artificial Sequence
  chemically synthesized
actttttaaagactaaattg

SEQ ID NO: 259743 - DNA, 20 bp, Artificial Sequence
  chemically synthesized
caaaaaaaaagtctacaatt

SEQ ID NO: 259744 - DNA, 20 bp, Artificial Sequence
  chemically synthesized
ccctcactgaagcaaaaaaa

SEQ ID NO: 259745 - DNA, 20 bp, Artificial Sequence
  chemically synthesized
tgtagactttttttttgctt

SEQ ID NO: 259746 - DNA, 20 bp, Artificial Sequence
  chemically synthesized
gactttttttttgcttcagt

SEQ ID NO: 259747 - DNA, 20 bp, Artificial Sequence
  chemically synthesized
actttttttttgcttcagtg

SEQ ID NO: 259748 - DNA, 20 bp, Artificial Sequence
  chemically synthesized
ctttttttttgcttcagtga

SEQ ID NO: 259749 - DNA, 20 bp, Artificial Sequence
  chemically synthesized
tgctgattcctccctcactg

SEQ ID NO: 259750 - DNA, 20 bp, Artificial Sequence
  chemically synthesized
ttttttttgcttcagtgagg

SEQ ID NO: 259751 - DNA, 20 bp, Artificial Sequence
  chemically synthesized
tttttttgcttcagtgaggg

SEQ ID NO: 259752 - DNA, 20 bp, Artificial Sequence
  chemically synthesized
tgcttcagtgagggaggaat

SEQ ID NO: 259753 - DNA, 20 bp, Artificial Sequence
  chemically synthesized
ttcagtgagggaggaatcag

SEQ ID NO: 259754 - DNA, 20 bp, Artificial Sequence
  chemically synthesized
agggaggaatcagcagaatg

SEQ ID NO: 259755 - DNA, 20 bp, Artificial Sequence
  chemically synthesized
atcagcagaatgaagaaatg

SEQ ID NO: 259756 - DNA, 20 bp, Artificial Sequence
  chemically synthesized
cagcagaatgaagaaatgaa

SEQ ID NO: 259757 - DNA, 20 bp, Artificial Sequence
  chemically synthesized
cagaatgaagaaatgaagag

SEQ ID NO: 259758 - DNA, 20 bp, Artificial Sequence
  chemically synthesized
tgaagaaatgaagagtagta

SEQ ID NO: 259759 - DNA, 20 bp, Artificial Sequence
  chemically synthesized
attaatacaaaggtagatta

SEQ ID NO: 259760 - DNA, 20 bp, Artificial Sequence
  chemically synthesized
aattaatacaaaggtagatt

SEQ ID NO: 259761 - DNA, 20 bp, Artificial Sequence
  chemically synthesized
ttaatcaattaatacaaagg

SEQ ID NO: 259762 - DNA, 20 bp, Artificial Sequence
  chemically synthesized
actttaatcaattaatacaa

SEQ ID NO: 259763 - DNA, 20 bp, Artificial Sequence
  chemically synthesized
tactttaatcaattaataca

SEQ ID NO: 259764 - DNA, 20 bp, Artificial Sequence
  chemically synthesized
acctttgtattaattgatta

SEQ ID NO: 259765 - DNA, 20 bp, Artificial Sequence
  chemically synthesized
cgattattttaaatgtattg

SEQ ID NO: 259766 - DNA, 20 bp, Artificial Sequence
  chemically synthesized
atacatttaaaataatcgca

SEQ ID NO: 259767 - DNA, 20 bp, Artificial Sequence
  chemically synthesized
acatttaaaataatcgcaca

SEQ ID NO: 259768 - DNA, 20 bp, Artificial Sequence
  chemically synthesized
aatcgcacagagctctgaac

SEQ ID NO: 259769 - DNA, 20 bp, Artificial Sequence
  chemically synthesized
tactctttagtgctagttca

SEQ ID NO: 259770 - DNA, 20 bp, Artificial Sequence
  chemically synthesized
tctactctttagtgctagtt

SEQ ID NO: 259771 - DNA, 20 bp, Artificial Sequence
  chemically synthesized
agagctctgaactagcacta

SEQ ID NO: 259772 - DNA, 20 bp, Artificial Sequence
  chemically synthesized
ttgcatctactctttagtgc

SEQ ID NO: 259773 - DNA, 20 bp, Artificial Sequence
  chemically synthesized
agctctgaactagcactaaa

SEQ ID NO: 259774 - DNA, 20 bp, Artificial Sequence
  chemically synthesized
tctgaactagcactaaagag

SEQ ID NO: 259775 - DNA, 20 bp, Artificial Sequence
  chemically synthesized
atctatttgcatctactctt

SEQ ID NO: 259776 - DNA, 20 bp, Artificial Sequence
  chemically synthesized
cactaaagagtagatgcaaa

SEQ ID NO: 259777 - DNA, 20 bp, Artificial Sequence
  chemically synthesized
agagtagatgcaaatagata

SEQ ID NO: 259778 - DNA, 20 bp, Artificial Sequence
  chemically synthesized
tgcaaatagatacagatttc

SEQ ID NO: 259779 - DNA, 20 bp, Artificial Sequence
  chemically synthesized
gcaaatagatacagatttca

SEQ ID NO: 259780 - DNA, 20 bp, Artificial Sequence
  chemically synthesized
tacagatttcaaggtaaatt

SEQ ID NO: 259781 - DNA, 20 bp, Artificial Sequence
  chemically synthesized
actgataaatatgttatgta

SEQ ID NO: 259782 - DNA, 20 bp, Artificial Sequence
  chemically synthesized
tctttacataacatatttat

SEQ ID NO: 259783 - DNA, 20 bp, Artificial Sequence
  chemically synthesized
ttacataacatatttatcag

SEQ ID NO: 259784 - DNA, 20 bp, Artificial Sequence
  chemically synthesized
tacataacatatttatcagt

SEQ ID NO: 259785 - DNA, 20 bp, Artificial Sequence
  chemically synthesized
aacatatttatcagtaggca

SEQ ID NO: 259786 - DNA, 20 bp, Artificial Sequence
  chemically synthesized
acaataaagtcaattagagg

SEQ ID NO: 259787 - DNA, 20 bp, Artificial Sequence
  chemically synthesized
aacaataaagtcaattagag

SEQ ID NO: 259788 - DNA, 20 bp, Artificial Sequence
  chemically synthesized
gaacaataaagtcaattaga

SEQ ID NO: 259789 - DNA, 20 bp, Artificial Sequence
  chemically synthesized
tgaacaataaagtcaattag

SEQ ID NO: 259790 - DNA, 20 bp, Artificial Sequence
  chemically synthesized
atgaacaataaagtcaatta

SEQ ID NO: 259791 - DNA, 20 bp, Artificial Sequence
  chemically synthesized
ttatgaacaataaagtcaat

SEQ ID NO: 259792 - DNA, 20 bp, Artificial Sequence
  chemically synthesized
gaagtctattatgaacaata

SEQ ID NO: 259793 - DNA, 20 bp, Artificial Sequence
  chemically synthesized
attgactttattgttcataa

SEQ ID NO: 259794 - DNA, 20 bp, Artificial Sequence
  chemically synthesized
ctgcagcttgaatagaagtg

SEQ ID NO: 259795 - DNA, 20 bp, Artificial Sequence
  chemically synthesized
aatagacttcacttctattc

SEQ ID NO: 259796 - DNA, 20 bp, Artificial Sequence
  chemically synthesized
ccttcctgcagcttgaatag

SEQ ID NO: 259797 - DNA, 20 bp, Artificial Sequence
  chemically synthesized
atgccttcctgcagcttgaa

SEQ ID NO: 259798 - DNA, 20 bp, Artificial Sequence
  chemically synthesized
cttcacttctattcaagctg

SEQ ID NO: 259799 - DNA, 20 bp, Artificial Sequence
  chemically synthesized
ttcacttctattcaagctgc

SEQ ID NO: 259800 - DNA, 20 bp, Artificial Sequence
  chemically synthesized
acttctattcaagctgcagg

SEQ ID NO: 259801 - DNA, 20 bp, Artificial Sequence
  chemically synthesized
cttctattcaagctgcagga

SEQ ID NO: 259802 - DNA, 20 bp, Artificial Sequence
  chemically synthesized
tagtagtacatgccttcctg

SEQ ID NO: 259803 - DNA, 20 bp, Artificial Sequence
  chemically synthesized
ggaaggcatgtactactaat

SEQ ID NO: 259804 - DNA, 20 bp, Artificial Sequence
  chemically synthesized
taatattgggagccaattag

SEQ ID NO: 259805 - DNA, 20 bp, Artificial Sequence
  chemically synthesized
ccataatattgggagccaat

SEQ ID NO: 259806 - DNA, 20 bp, Artificial Sequence
  chemically synthesized
ctatgcttccataatattgg

SEQ ID NO: 259807 - DNA, 20 bp, Artificial Sequence
  chemically synthesized
ctaattggctcccaatatta

SEQ ID NO: 259808 - DNA, 20 bp, Artificial Sequence
  chemically synthesized
gtctatgcttccataatatt

SEQ ID NO: 259809 - DNA, 20 bp, Artificial Sequence
  chemically synthesized
agtctatgcttccataatat

SEQ ID NO: 259810 - DNA, 20 bp, Artificial Sequence
  chemically synthesized
attggctcccaatattatgg

SEQ ID NO: 259811 - DNA, 20 bp, Artificial Sequence
  chemically synthesized
ctcccaatattatggaagca

SEQ ID NO: 259812 - DNA, 20 bp, Artificial Sequence
  chemically synthesized
atattatggaagcatagact

SEQ ID NO: 259813 - DNA, 20 bp, Artificial Sequence
  chemically synthesized
ctcccttctgaattttgtct

SEQ ID NO: 259814 - DNA, 20 bp, Artificial Sequence
  chemically synthesized
gcatagactaagacaaaatt

SEQ ID NO: 259815 - DNA, 20 bp, Artificial Sequence
  chemically synthesized
tagactaagacaaaattcag

SEQ ID NO: 259816 - DNA, 20 bp, Artificial Sequence
  chemically synthesized
agactaagacaaaattcaga

SEQ ID NO: 259817 - DNA, 20 bp, Artificial Sequence
  chemically synthesized
gactaagacaaaattcagaa

SEQ ID NO: 259818 - DNA, 20 bp, Artificial Sequence
  chemically synthesized
ctaagacaaaattcagaagg

SEQ ID NO: 259819 - DNA, 20 bp, Artificial Sequence
  chemically synthesized
aaattcagaagggagaatga

SEQ ID NO: 259820 - DNA, 20 bp, Artificial Sequence
  chemically synthesized
aggggcaccaatatggtttt

SEQ ID NO: 259821 - DNA, 20 bp, Artificial Sequence
  chemically synthesized
gaggggcaccaatatggttt

SEQ ID NO: 259822 - DNA, 20 bp, Artificial Sequence
  chemically synthesized
atcatcacctaaaaccatat

SEQ ID NO: 259823 - DNA, 20 bp, Artificial Sequence
  chemically synthesized
tgcagtgaggggcaccaata

SEQ ID NO: 259824 - DNA, 20 bp, Artificial Sequence
  chemically synthesized
tcaattgggtatgcagtgag

SEQ ID NO: 259825 - DNA, 20 bp, Artificial Sequence
  chemically synthesized
gtcaattgggtatgcagtga

SEQ ID NO: 259826 - DNA, 20 bp, Artificial Sequence
  chemically synthesized
tgtcaattgggtatgcagtg

SEQ ID NO: 259827 - DNA, 20 bp, Artificial Sequence
  chemically synthesized
ctgtcaattgggtatgcagt

SEQ ID NO: 259828 - DNA, 20 bp, Artificial Sequence
  chemically synthesized
tcttctgtcaattgggtatg

SEQ ID NO: 259829 - DNA, 20 bp, Artificial Sequence
  chemically synthesized
ctcactgcatacccaattga

SEQ ID NO: 259830 - DNA, 20 bp, Artificial Sequence
  chemically synthesized
ccacgactcttctgtcaatt

SEQ ID NO: 259831 - DNA, 20 bp, Artificial Sequence
  chemically synthesized
gccacgactcttctgtcaat

SEQ ID NO: 259832 - DNA, 20 bp, Artificial Sequence
  chemically synthesized
actgcatacccaattgacag

SEQ ID NO: 259833 - DNA, 20 bp, Artificial Sequence
  chemically synthesized
tgcatacccaattgacagaa

SEQ ID NO: 259834 - DNA, 20 bp, Artificial Sequence
  chemically synthesized
cccaattgacagaagagtcg

SEQ ID NO: 259835 - DNA, 20 bp, Artificial Sequence
  chemically synthesized
ttgacagaagagtcgtggca

SEQ ID NO: 259836 - DNA, 20 bp, Artificial Sequence
  chemically synthesized
agaagagtcgtggcaaagac

SEQ ID NO: 259837 - DNA, 20 bp, Artificial Sequence
  chemically synthesized
agagtcgtggcaaagactag

SEQ ID NO: 259838 - DNA, 20 bp, Artificial Sequence
  chemically synthesized
tcatgggcaacagcagccac

SEQ ID NO: 259839 - DNA, 20 bp, Artificial Sequence
  chemically synthesized
ctttacttcatgggcaacag

SEQ ID NO: 259840 - DNA, 20 bp, Artificial Sequence
  chemically synthesized
tctctttacttcatgggcaa

SEQ ID NO: 259841 - DNA, 20 bp, Artificial Sequence
  chemically synthesized
agtggctgctgttgcccatg

SEQ ID NO: 259842 - DNA, 20 bp, Artificial Sequence
  chemically synthesized
aataattctctttacttcat

SEQ ID NO: 259843 - DNA, 20 bp, Artificial Sequence
  chemically synthesized
ctgctgttgcccatgaagta

SEQ ID NO: 259844 - DNA, 20 bp, Artificial Sequence
  chemically synthesized
aaataattctctttacttca

SEQ ID NO: 259845 - DNA, 20 bp, Artificial Sequence
  chemically synthesized
gctgttgcccatgaagtaaa

SEQ ID NO: 259846 - DNA, 20 bp, Artificial Sequence
  chemically synthesized
gaagtaaagagaattatttt

SEQ ID NO: 259847 - DNA, 20 bp, Artificial Sequence
  chemically synthesized
aagtaaagagaattattttt

SEQ ID NO: 259848 - DNA, 20 bp, Artificial Sequence
  chemically synthesized
agaattatttttaggtgcct

SEQ ID NO: 259849 - DNA, 20 bp, Artificial Sequence
  chemically synthesized
tcctcatctccaggaatctc

SEQ ID NO: 259850 - DNA, 20 bp, Artificial Sequence
  chemically synthesized
ttttaggtgcctgagattcc

SEQ ID NO: 259851 - DNA, 20 bp, Artificial Sequence
  chemically synthesized
ttcctcatctccaggaatct

SEQ ID NO: 259852 - DNA, 20 bp, Artificial Sequence
  chemically synthesized
ttaggtgcctgagattcctg

SEQ ID NO: 259853 - DNA, 20 bp, Artificial Sequence
  chemically synthesized
tgcctgagattcctggagat

SEQ ID NO: 259854 - DNA, 20 bp, Artificial Sequence
  chemically synthesized
gcctgagattcctggagatg

SEQ ID NO: 259855 - DNA, 20 bp, Artificial Sequence
  chemically synthesized
tgttaaatttcctcatctcc

SEQ ID NO: 259856 - DNA, 20 bp, Artificial Sequence
  chemically synthesized
ctgttaaatttcctcatctc

SEQ ID NO: 259857 - DNA, 20 bp, Artificial Sequence
  chemically synthesized
ctggagatgaggaaatttaa

SEQ ID NO: 259858 - DNA, 20 bp, Artificial Sequence
  chemically synthesized
tgaggaaatttaacagccaa

SEQ ID NO: 259859 - DNA, 20 bp, Artificial Sequence
  chemically synthesized
ataagagtgctattagccat

SEQ ID NO: 259860 - DNA, 20 bp, Artificial Sequence
  chemically synthesized
atttaacagccaatggctaa

SEQ ID NO: 259861 - DNA, 20 bp, Artificial Sequence
  chemically synthesized
ctgtcacataagagtgctat

SEQ ID NO: 259862 - DNA, 20 bp, Artificial Sequence
  chemically synthesized
tattggatgctgtcacataa

SEQ ID NO: 259863 - DNA, 20 bp, Artificial Sequence
  chemically synthesized
ctaatagcactcttatgtga

SEQ ID NO: 259864 - DNA, 20 bp, Artificial Sequence
  chemically synthesized
agtattggatgctgtcacat

SEQ ID NO: 259865 - DNA, 20 bp, Artificial Sequence
  chemically synthesized
aattaaaatatatcgagtat

SEQ ID NO: 259866 - DNA, 20 bp, Artificial Sequence
  chemically synthesized
aagatcaattaaaatatatc

SEQ ID NO: 259867 - DNA, 20 bp, Artificial Sequence
  chemically synthesized
gatatattttaattgatctt

SEQ ID NO: 259868 - DNA, 20 bp, Artificial Sequence
  chemically synthesized
aaaaaaaaaattgagtactt

SEQ ID NO: 259869 - DNA, 20 bp, Artificial Sequence
  chemically synthesized
aaaaaaaaaaaaaaaaaatt

SEQ ID NO: 259870 - DNA, 20 bp, Artificial Sequence
  chemically synthesized
tttttttttttttttttttt

SEQ ID NO: 259871 - DNA, 20 bp, Artificial Sequence
  chemically synthesized
ttttttttttttttttgaga

SEQ ID NO: 259872 - DNA, 20 bp, Artificial Sequence
  chemically synthesized
ttttttttttttttgagacg

SEQ ID NO: 259873 - DNA, 20 bp, Artificial Sequence
  chemically synthesized
tccagcctgggcaacagagc

SEQ ID NO: 259874 - DNA, 20 bp, Artificial Sequence
  chemically synthesized
cggagtctcgctctgttgcc

SEQ ID NO: 259875 - DNA, 20 bp, Artificial Sequence
  chemically synthesized
gcactccagcctgggcaaca

SEQ ID NO: 259876 - DNA, 20 bp, Artificial Sequence
  chemically synthesized
ggagtctcgctctgttgccc

SEQ ID NO: 259877 - DNA, 20 bp, Artificial Sequence
  chemically synthesized
ctgcactccagcctgggcaa

SEQ ID NO: 259878 - DNA, 20 bp, Artificial Sequence
  chemically synthesized
tctcgctctgttgcccaggc

SEQ ID NO: 259879 - DNA, 20 bp, Artificial Sequence
  chemically synthesized
tcgctctgttgcccaggctg

SEQ ID NO: 259880 - DNA, 20 bp, Artificial Sequence
  chemically synthesized
aagccactgcactccagcct

SEQ ID NO: 259881 - DNA, 20 bp, Artificial Sequence
  chemically synthesized
caagccactgcactccagcc

SEQ ID NO: 259882 - DNA, 20 bp, Artificial Sequence
  chemically synthesized
ctgttgcccaggctggagtg

SEQ ID NO: 259883 - DNA, 20 bp, Artificial Sequence
  chemically synthesized
gagatcaagccactgcactc

SEQ ID NO: 259884 - DNA, 20 bp, Artificial Sequence
  chemically synthesized
ttgcccaggctggagtgcag

SEQ ID NO: 259885 - DNA, 20 bp, Artificial Sequence
  chemically synthesized
ggagtgcagtggcttgatct

SEQ ID NO: 259886 - DNA, 20 bp, Artificial Sequence
  chemically synthesized
gtttgcagtgagccgagatc

SEQ ID NO: 259887 - DNA, 20 bp, Artificial Sequence
  chemically synthesized
agtgtagtttgcagtgagcc

SEQ ID NO: 259888 - DNA, 20 bp, Artificial Sequence
  chemically synthesized
tgggaagtgtagtttgcagt

SEQ ID NO: 259889 - DNA, 20 bp, Artificial Sequence
  chemically synthesized
aacctgggaagtgtagtttg

SEQ ID NO: 259890 - DNA, 20 bp, Artificial Sequence
  chemically synthesized
tcactgcaaactacacttcc

SEQ ID NO: 259891 - DNA, 20 bp, Artificial Sequence
  chemically synthesized
taaattgaacctgggaagtg

SEQ ID NO: 259892 - DNA, 20 bp, Artificial Sequence
  chemically synthesized
cactgcaaactacacttccc

SEQ ID NO: 259893 - DNA, 20 bp, Artificial Sequence
  chemically synthesized
gcttataaattgaacctggg

SEQ ID NO: 259894 - DNA, 20 bp, Artificial Sequence
  chemically synthesized
gttgcttataaattgaacct

SEQ ID NO: 259895 - DNA, 20 bp, Artificial Sequence
  chemically synthesized
agttgcttataaattgaacc

SEQ ID NO: 259896 - DNA, 20 bp, Artificial Sequence
  chemically synthesized
acttcccaggttcaatttat

SEQ ID NO: 259897 - DNA, 20 bp, Artificial Sequence
  chemically synthesized
ttataagcaactaattaaat

SEQ ID NO: 259898 - DNA, 20 bp, Artificial Sequence
  chemically synthesized
attagtgatacttatttaat

SEQ ID NO: 259899 - DNA, 20 bp, Artificial Sequence
  chemically synthesized
attaaataagtatcactaat

SEQ ID NO: 259900 - DNA, 20 bp, Artificial Sequence
  chemically synthesized
ggcttgggtatttttctcat

SEQ ID NO: 259901 - DNA, 20 bp, Artificial Sequence
  chemically synthesized
cactaatgagaaaaataccc

SEQ ID NO: 259902 - DNA, 20 bp, Artificial Sequence
  chemically synthesized
tgagaaaaatacccaagcca

SEQ ID NO: 259903 - DNA, 20 bp, Artificial Sequence
  chemically synthesized
ctaaatgtttactttggctt

SEQ ID NO: 259904 - DNA, 20 bp, Artificial Sequence
  chemically synthesized
gctaaatgtttactttggct

SEQ ID NO: 259905 - DNA, 20 bp, Artificial Sequence
  chemically synthesized
ccttagctaaatgtttactt

SEQ ID NO: 259906 - DNA, 20 bp, Artificial Sequence
  chemically synthesized
cccaagccaaagtaaacatt

SEQ ID NO: 259907 - DNA, 20 bp, Artificial Sequence
  chemically synthesized
gccaaagtaaacatttagct

SEQ ID NO: 259908 - DNA, 20 bp, Artificial Sequence
  chemically synthesized
ccaaagtaaacatttagcta

SEQ ID NO: 259909 - DNA, 20 bp, Artificial Sequence
  chemically synthesized
tttatggattacaatatcct

SEQ ID NO: 259910 - DNA, 20 bp, Artificial Sequence
  chemically synthesized
aacaaaaagttgtattttta

SEQ ID NO: 259911 - DNA, 20 bp, Artificial Sequence
  chemically synthesized
tcatttcaaatgcaaacaaa

SEQ ID NO: 259912 - DNA, 20 bp, Artificial Sequence
  chemically synthesized
atacatggggagaattgaag

SEQ ID NO: 259913 - DNA, 20 bp, Artificial Sequence
  chemically synthesized
caaatacatggggagaattg

SEQ ID NO: 259914 - DNA, 20 bp, Artificial Sequence
  chemically synthesized
agtgacttcaaatacatggg

SEQ ID NO: 259915 - DNA, 20 bp, Artificial Sequence
  chemically synthesized
aaagtgacttcaaatacatg

SEQ ID NO: 259916 - DNA, 20 bp, Artificial Sequence
  chemically synthesized
caaagtgacttcaaatacat

SEQ ID NO: 259917 - DNA, 20 bp, Artificial Sequence
  chemically synthesized
gcaaagtgacttcaaataca

SEQ ID NO: 259918 - DNA, 20 bp, Artificial Sequence
  chemically synthesized
caattctccccatgtatttg

SEQ ID NO: 259919 - DNA, 20 bp, Artificial Sequence
  chemically synthesized
gtatttgaagtcactttgct

SEQ ID NO: 259920 - DNA, 20 bp, Artificial Sequence
  chemically synthesized
gaaaacttttcagcttagca

SEQ ID NO: 259921 - DNA, 20 bp, Artificial Sequence
  chemically synthesized
agtcactttgctaagctgaa

SEQ ID NO: 259922 - DNA, 20 bp, Artificial Sequence
  chemically synthesized
aagaggaaaacttttcagct

SEQ ID NO: 259923 - DNA, 20 bp, Artificial Sequence
  chemically synthesized
ggccaaagaggaaaactttt

SEQ ID NO: 259924 - DNA, 20 bp, Artificial Sequence
  chemically synthesized
agctgaaaagttttcctctt

SEQ ID NO: 259925 - DNA, 20 bp, Artificial Sequence
  chemically synthesized
tctaatgtgccaggccaaag

SEQ ID NO: 259926 - DNA, 20 bp, Artificial Sequence
  chemically synthesized
aaaagttttcctctttggcc

SEQ ID NO: 259927 - DNA, 20 bp, Artificial Sequence
  chemically synthesized
gtctaatgtgccaggccaaa

SEQ ID NO: 259928 - DNA, 20 bp, Artificial Sequence
  chemically synthesized
tggtctaatgtgccaggcca

SEQ ID NO: 259929 - DNA, 20 bp, Artificial Sequence
  chemically synthesized
tcctctttggcctggcacat

SEQ ID NO: 259930 - DNA, 20 bp, Artificial Sequence
  chemically synthesized
taaagatggtctaatgtgcc

SEQ ID NO: 259931 - DNA, 20 bp, Artificial Sequence
  chemically synthesized
ataaagatggtctaatgtgc

SEQ ID NO: 259932 - DNA, 20 bp, Artificial Sequence
  chemically synthesized
taagggcatggaaataaaga

SEQ ID NO: 259933 - DNA, 20 bp, Artificial Sequence
  chemically synthesized
aagttaagggcatggaaata

SEQ ID NO: 259934 - DNA, 20 bp, Artificial Sequence
  chemically synthesized
gtcccttcaagttaagggca

SEQ ID NO: 259935 - DNA, 20 bp, Artificial Sequence
  chemically synthesized
ttagtgtcccttcaagttaa

SEQ ID NO: 259936 - DNA, 20 bp, Artificial Sequence
  chemically synthesized
atttccatgcccttaacttg

SEQ ID NO: 259937 - DNA, 20 bp, Artificial Sequence
  chemically synthesized
attagtgtcccttcaagtta

SEQ ID NO: 259938 - DNA, 20 bp, Artificial Sequence
  chemically synthesized
tttccatgcccttaacttga

SEQ ID NO: 259939 - DNA, 20 bp, Artificial Sequence
  chemically synthesized
cattagtgtcccttcaagtt

SEQ ID NO: 259940 - DNA, 20 bp, Artificial Sequence
  chemically synthesized
ttccatgcccttaacttgaa

SEQ ID NO: 259941 - DNA, 20 bp, Artificial Sequence
  chemically synthesized
aatgtcattagtgtcccttc

SEQ ID NO: 259942 - DNA, 20 bp, Artificial Sequence
  chemically synthesized
tcagtatatcacaatgtcat

SEQ ID NO: 259943 - DNA, 20 bp, Artificial Sequence
  chemically synthesized
acattgtgatatactgataa

SEQ ID NO: 259944 - DNA, 20 bp, Artificial Sequence
  chemically synthesized
aattttgtaaatactgttat

SEQ ID NO: 259945 - DNA, 20 bp, Artificial Sequence
  chemically synthesized
cttgttatttggaattaggt

SEQ ID NO: 259946 - DNA, 20 bp, Artificial Sequence
  chemically synthesized
caaacttgttatttggaatt

SEQ ID NO: 259947 - DNA, 20 bp, Artificial Sequence
  chemically synthesized
tcaaacttgttatttggaat

SEQ ID NO: 259948 - DNA, 20 bp, Artificial Sequence
  chemically synthesized
ctgacctaattccaaataac

SEQ ID NO: 259949 - DNA, 20 bp, Artificial Sequence
  chemically synthesized
taactctcaaacttgttatt

SEQ ID NO: 259950 - DNA, 20 bp, Artificial Sequence
  chemically synthesized
taattccaaataacaagttt

SEQ ID NO: 259951 - DNA, 20 bp, Artificial Sequence
  chemically synthesized
attccaaataacaagtttga

SEQ ID NO: 259952 - DNA, 20 bp, Artificial Sequence
  chemically synthesized
tcaaagaagaatagaatgca

SEQ ID NO: 259953 - DNA, 20 bp, Artificial Sequence
  chemically synthesized
ttcaaagaagaatagaatgc

SEQ ID NO: 259954 - DNA, 20 bp, Artificial Sequence
  chemically synthesized
tttcaaagaagaatagaatg

SEQ ID NO: 259955 - DNA, 20 bp, Artificial Sequence
  chemically synthesized
gtgcatatttcaaagaagaa

SEQ ID NO: 259956 - DNA, 20 bp, Artificial Sequence
  chemically synthesized
ttgttgtgcatatttcaaag

SEQ ID NO: 259957 - DNA, 20 bp, Artificial Sequence
  chemically synthesized
aaattgttgtgcatatttca

SEQ ID NO: 259958 - DNA, 20 bp, Artificial Sequence
  chemically synthesized
aactgcctgctttttattgc

SEQ ID NO: 259959 - DNA, 20 bp, Artificial Sequence
  chemically synthesized
tttcatatacctgcaataaa

SEQ ID NO: 259960 - DNA, 20 bp, Artificial Sequence
  chemically synthesized
taactgcctgctttttattg

SEQ ID NO: 259961 - DNA, 20 bp, Artificial Sequence
  chemically synthesized
catatacctgcaataaaaag

SEQ ID NO: 259962 - DNA, 20 bp, Artificial Sequence
  chemically synthesized
atatacctgcaataaaaagc

SEQ ID NO: 259963 - DNA, 20 bp, Artificial Sequence
  chemically synthesized
tacctgcaataaaaagcagg

SEQ ID NO: 259964 - DNA, 20 bp, Artificial Sequence
  chemically synthesized
cagttaaaaaaacacaactt

SEQ ID NO: 259965 - DNA, 20 bp, Artificial Sequence
  chemically synthesized
agttaaaaaaacacaacttt

SEQ ID NO: 259966 - DNA, 20 bp, Artificial Sequence
  chemically synthesized
atcttttagtcgagttccta

SEQ ID NO: 259967 - DNA, 20 bp, Artificial Sequence
  chemically synthesized
aactttaggaactcgactaa

SEQ ID NO: 259968 - DNA, 20 bp, Artificial Sequence
  chemically synthesized
ttattctccatcttttagtc

SEQ ID NO: 259969 - DNA, 20 bp, Artificial Sequence
  chemically synthesized
ttaggaactcgactaaaaga

SEQ ID NO: 259970 - DNA, 20 bp, Artificial Sequence
  chemically synthesized
aggaactcgactaaaagatg

SEQ ID NO: 259971 - DNA, 20 bp, Artificial Sequence
  chemically synthesized
gtaggttattctccatcttt

SEQ ID NO: 259972 - DNA, 20 bp, Artificial Sequence
  chemically synthesized
atcaagattatgatttttgt

SEQ ID NO: 259973 - DNA, 20 bp, Artificial Sequence
  chemically synthesized
catcaagattatgatttttg

SEQ ID NO: 259974 - DNA, 20 bp, Artificial Sequence
  chemically synthesized
acaaaaatcataatcttgat

SEQ ID NO: 259975 - DNA, 20 bp, Artificial Sequence
  chemically synthesized
aaatgcctgctgaactcatc

SEQ ID NO: 259976 - DNA, 20 bp, Artificial Sequence
  chemically synthesized
aatcataatcttgatgagtt

SEQ ID NO: 259977 - DNA, 20 bp, Artificial Sequence
  chemically synthesized
cataatcttgatgagttcag

SEQ ID NO: 259978 - DNA, 20 bp, Artificial Sequence
  chemically synthesized
ataatcttgatgagttcagc

SEQ ID NO: 259979 - DNA, 20 bp, Artificial Sequence
  chemically synthesized
ttcagcaggcatttttttca

SEQ ID NO: 259980 - DNA, 20 bp, Artificial Sequence
  chemically synthesized
aggcatttttttcaaagcca

SEQ ID NO: 259981 - DNA, 20 bp, Artificial Sequence
  chemically synthesized
ggcatttttttcaaagccaa

SEQ ID NO: 259982 - DNA, 20 bp, Artificial Sequence
  chemically synthesized
acttagcaaaatatgtcctt

SEQ ID NO: 259983 - DNA, 20 bp, Artificial Sequence
  chemically synthesized
gccaaaggacatattttgct

SEQ ID NO: 259984 - DNA, 20 bp, Artificial Sequence
  chemically synthesized
tttacatctattaagttact

SEQ ID NO: 259985 - DNA, 20 bp, Artificial Sequence
  chemically synthesized
tattttgctaagtaacttaa

SEQ ID NO: 259986 - DNA, 20 bp, Artificial Sequence
  chemically synthesized
atttgctatttacatctatt

SEQ ID NO: 259987 - DNA, 20 bp, Artificial Sequence
  chemically synthesized
agtaacttaatagatgtaaa

SEQ ID NO: 259988 - DNA, 20 bp, Artificial Sequence
  chemically synthesized
tgtaaatagcaaataacata

SEQ ID NO: 259989 - DNA, 20 bp, Artificial Sequence
  chemically synthesized
atagcaaataacatatagca

SEQ ID NO: 259990 - DNA, 20 bp, Artificial Sequence
  chemically synthesized
tatagcatagctacataaat

SEQ ID NO: 259991 - DNA, 20 bp, Artificial Sequence
  chemically synthesized
tacacatatgcttatttatg

SEQ ID NO: 259992 - DNA, 20 bp, Artificial Sequence
  chemically synthesized
tacatttatgtgtgcctatg

SEQ ID NO: 259993 - DNA, 20 bp, Artificial Sequence
  chemically synthesized
atttacatctgaggctgcat

SEQ ID NO: 259994 - DNA, 20 bp, Artificial Sequence
  chemically synthesized
tatttacatctgaggctgca

SEQ ID NO: 259995 - DNA, 20 bp, Artificial Sequence
  chemically synthesized
tatgtgtgcctatgcagcct

SEQ ID NO: 259996 - DNA, 20 bp, Artificial Sequence
  chemically synthesized
tatctctatatttacatctg

SEQ ID NO: 259997 - DNA, 20 bp, Artificial Sequence
  chemically synthesized
atatctctatatttacatct

SEQ ID NO: 259998 - DNA, 20 bp, Artificial Sequence
  chemically synthesized
tgcagcctcagatgtaaata

SEQ ID NO: 259999 - DNA, 20 bp, Artificial Sequence
  chemically synthesized
cagcctcagatgtaaatata

SEQ ID NO: 260000 - DNA, 20 bp, Artificial Sequence
  chemically synthesized
agatgtaaatatagagatat

SEQ ID NO: 260001 - DNA, 20 bp, Artificial Sequence
  chemically synthesized
gtaaatatagagatataagt

SEQ ID NO: 260002 - DNA, 20 bp, Artificial Sequence
  chemically synthesized
atatagagatataagttagc

SEQ ID NO: 260003 - DNA, 20 bp, Artificial Sequence
  chemically synthesized
tagagatataagttagctgg

SEQ ID NO: 260004 - DNA, 20 bp, Artificial Sequence
  chemically synthesized
agatataagttagctggtgg

SEQ ID NO: 260005 - DNA, 20 bp, Artificial Sequence
  chemically synthesized
tataagttagctggtggcag

SEQ ID NO: 260006 - DNA, 20 bp, Artificial Sequence
  chemically synthesized
aaatcacataccactgccac

SEQ ID NO: 260007 - DNA, 20 bp, Artificial Sequence
  chemically synthesized
ggtggcagtggtatgtgatt

SEQ ID NO: 260008 - DNA, 20 bp, Artificial Sequence
  chemically synthesized
gtggcagtggtatgtgattt

SEQ ID NO: 260009 - DNA, 20 bp, Artificial Sequence
  chemically synthesized
gcagtggtatgtgatttagg

SEQ ID NO: 260010 - DNA, 20 bp, Artificial Sequence
  chemically synthesized
cataatgccatatggcatat

SEQ ID NO: 260011 - DNA, 20 bp, Artificial Sequence
  chemically synthesized
taggaagctaatatgccata

SEQ ID NO: 260012 - DNA, 20 bp, Artificial Sequence
  chemically synthesized
gtttaatacataatgccata

SEQ ID NO: 260013 - DNA, 20 bp, Artificial Sequence
  chemically synthesized
gtattaaacacttttgcaca

SEQ ID NO: 260014 - DNA, 20 bp, Artificial Sequence
  chemically synthesized
aatatcttacctatgtgcaa

SEQ ID NO: 260015 - DNA, 20 bp, Artificial Sequence
  chemically synthesized
tattaaacacttttgcacat

SEQ ID NO: 260016 - DNA, 20 bp, Artificial Sequence
  chemically synthesized
aaacacttttgcacataggt

SEQ ID NO: 260017 - DNA, 20 bp, Artificial Sequence
  chemically synthesized
tgcacataggtaagatatta

SEQ ID NO: 260018 - DNA, 20 bp, Artificial Sequence
  chemically synthesized
ggtaagatattaaagatcct

SEQ ID NO: 260019 - DNA, 20 bp, Artificial Sequence
  chemically synthesized
gtaagatattaaagatcctt

SEQ ID NO: 260020 - DNA, 20 bp, Artificial Sequence
  chemically synthesized
gatattaaagatccttgggc

SEQ ID NO: 260021 - DNA, 20 bp, Artificial Sequence
  chemically synthesized
atattaaagatccttgggct

SEQ ID NO: 260022 - DNA, 20 bp, Artificial Sequence
  chemically synthesized
gagccatggcgcccagccca

SEQ ID NO: 260023 - DNA, 20 bp, Artificial Sequence
  chemically synthesized
tgagccatggcgcccagccc

SEQ ID NO: 260024 - DNA, 20 bp, Artificial Sequence
  chemically synthesized
gatccttgggctgggcgcca

SEQ ID NO: 260025 - DNA, 20 bp, Artificial Sequence
  chemically synthesized
ctggtgtgagccatggcgcc

SEQ ID NO: 260026 - DNA, 20 bp, Artificial Sequence
  chemically synthesized
gggattactggtgtgagcca

SEQ ID NO: 260027 - DNA, 20 bp, Artificial Sequence
  chemically synthesized
ctgggcgccatggctcacac

SEQ ID NO: 260028 - DNA, 20 bp, Artificial Sequence
  chemically synthesized
agtgctgggattactggtgt

SEQ ID NO: 260029 - DNA, 20 bp, Artificial Sequence
  chemically synthesized
atggctcacaccagtaatcc

SEQ ID NO: 260030 - DNA, 20 bp, Artificial Sequence
  chemically synthesized
tcccaaagtgctgggattac

SEQ ID NO: 260031 - DNA, 20 bp, Artificial Sequence
  chemically synthesized
caccagtaatcccagcactt

SEQ ID NO: 260032 - DNA, 20 bp, Artificial Sequence
  chemically synthesized
cctcggcctcccaaagtgct

SEQ ID NO: 260033 - DNA, 20 bp, Artificial Sequence
  chemically synthesized
accagtaatcccagcacttt

SEQ ID NO: 260034 - DNA, 20 bp, Artificial Sequence
  chemically synthesized
gcctcggcctcccaaagtgc

SEQ ID NO: 260035 - DNA, 20 bp, Artificial Sequence
  chemically synthesized
cagtaatcccagcactttgg

SEQ ID NO: 260036 - DNA, 20 bp, Artificial Sequence
  chemically synthesized
agtaatcccagcactttggg

SEQ ID NO: 260037 - DNA, 20 bp, Artificial Sequence
  chemically synthesized
ctgcctgcctcggcctccca

SEQ ID NO: 260038 - DNA, 20 bp, Artificial Sequence
  chemically synthesized
tcccagcactttgggaggcc

SEQ ID NO: 260039 - DNA, 20 bp, Artificial Sequence
  chemically synthesized
cccagcactttgggaggccg

SEQ ID NO: 260040 - DNA, 20 bp, Artificial Sequence
  chemically synthesized
agcactttgggaggccgagg

SEQ ID NO: 260041 - DNA, 20 bp, Artificial Sequence
  chemically synthesized
gcactttgggaggccgaggc

SEQ ID NO: 260042 - DNA, 20 bp, Artificial Sequence
  chemically synthesized
ctttgggaggccgaggcagg

SEQ ID NO: 260043 - DNA, 20 bp, Artificial Sequence
  chemically synthesized
ctcaaatgatctgcctgcct

SEQ ID NO: 260044 - DNA, 20 bp, Artificial Sequence
  chemically synthesized
ccgaggcaggcagatcattt

SEQ ID NO: 260045 - DNA, 20 bp, Artificial Sequence
  chemically synthesized
cgaggcaggcagatcatttg

SEQ ID NO: 260046 - DNA, 20 bp, Artificial Sequence
  chemically synthesized
gcaggcagatcatttgaggt

SEQ ID NO: 260047 - DNA, 20 bp, Artificial Sequence
  chemically synthesized
caggcagatcatttgaggtc

SEQ ID NO: 260048 - DNA, 20 bp, Artificial Sequence
  chemically synthesized
ggcagatcatttgaggtcag

SEQ ID NO: 260049 - DNA, 20 bp, Artificial Sequence
  chemically synthesized
tcatttgaggtcaggagttc

SEQ ID NO: 260050 - DNA, 20 bp, Artificial Sequence
  chemically synthesized
tgaggtcaggagttcaagac

SEQ ID NO: 260051 - DNA, 20 bp, Artificial Sequence
  chemically synthesized
tcaggagttcaagacaagcc

SEQ ID NO: 260052 - DNA, 20 bp, Artificial Sequence
  chemically synthesized
agggtttcaccatgttgtcc

SEQ ID NO: 260053 - DNA, 20 bp, Artificial Sequence
  chemically synthesized
caagacaagcctggacaaca

SEQ ID NO: 260054 - DNA, 20 bp, Artificial Sequence
  chemically synthesized
cagggtttcaccatgttgtc

SEQ ID NO: 260055 - DNA, 20 bp, Artificial Sequence
  chemically synthesized
ttatttttttagtacagaca

SEQ ID NO: 260056 - DNA, 20 bp, Artificial Sequence
  chemically synthesized
tttatttttttagtacagac

SEQ ID NO: 260057 - DNA, 20 bp, Artificial Sequence
  chemically synthesized
ttttatttttttagtacaga

SEQ ID NO: 260058 - DNA, 20 bp, Artificial Sequence
  chemically synthesized
atttttttatttttttagta

SEQ ID NO: 260059 - DNA, 20 bp, Artificial Sequence
  chemically synthesized
ggctaatttttttatttttt

SEQ ID NO: 260060 - DNA, 20 bp, Artificial Sequence
  chemically synthesized
tactaaaaaaataaaaaaat

SEQ ID NO: 260061 - DNA, 20 bp, Artificial Sequence
  chemically synthesized
aaaaaaataaaaaaattagc

SEQ ID NO: 260062 - DNA, 20 bp, Artificial Sequence
  chemically synthesized
aaaaaataaaaaaattagcc

SEQ ID NO: 260063 - DNA, 20 bp, Artificial Sequence
  chemically synthesized
aaaaaattagccaggcgtga

SEQ ID NO: 260064 - DNA, 20 bp, Artificial Sequence
  chemically synthesized
caggcaaccgccatcacgcc

SEQ ID NO: 260065 - DNA, 20 bp, Artificial Sequence
  chemically synthesized
aaattagccaggcgtgatgg

SEQ ID NO: 260066 - DNA, 20 bp, Artificial Sequence
  chemically synthesized
atggcggttgcctgtaatcc

SEQ ID NO: 260067 - DNA, 20 bp, Artificial Sequence
  chemically synthesized
tccagagttgctgggattac

SEQ ID NO: 260068 - DNA, 20 bp, Artificial Sequence
  chemically synthesized
ctccagagttgctgggatta

SEQ ID NO: 260069 - DNA, 20 bp, Artificial Sequence
  chemically synthesized
cctcaacctccagagttgct

SEQ ID NO: 260070 - DNA, 20 bp, Artificial Sequence
  chemically synthesized
gcctgtaatcccagcaactc

SEQ ID NO: 260071 - DNA, 20 bp, Artificial Sequence
  chemically synthesized
gcctcaacctccagagttgc

SEQ ID NO: 260072 - DNA, 20 bp, Artificial Sequence
  chemically synthesized
ctgtaatcccagcaactctg

SEQ ID NO: 260073 - DNA, 20 bp, Artificial Sequence
  chemically synthesized
tgtaatcccagcaactctgg

SEQ ID NO: 260074 - DNA, 20 bp, Artificial Sequence
  chemically synthesized
ttctcctgcctcaacctcca

SEQ ID NO: 260075 - DNA, 20 bp, Artificial Sequence
  chemically synthesized
tcccagcaactctggaggtt

SEQ ID NO: 260076 - DNA, 20 bp, Artificial Sequence
  chemically synthesized
cccagcaactctggaggttg

SEQ ID NO: 260077 - DNA, 20 bp, Artificial Sequence
  chemically synthesized
gattctcctgcctcaacctc

SEQ ID NO: 260078 - DNA, 20 bp, Artificial Sequence
  chemically synthesized
agcaactctggaggttgagg

SEQ ID NO: 260079 - DNA, 20 bp, Artificial Sequence
  chemically synthesized
gcaactctggaggttgaggc

SEQ ID NO: 260080 - DNA, 20 bp, Artificial Sequence
  chemically synthesized
aactctggaggttgaggcag

SEQ ID NO: 260081 - DNA, 20 bp, Artificial Sequence
  chemically synthesized
gcaggagaatcacttgaacc

SEQ ID NO: 260082 - DNA, 20 bp, Artificial Sequence
  chemically synthesized
caggagaatcacttgaacct

SEQ ID NO: 260083 - DNA, 20 bp, Artificial Sequence
  chemically synthesized
accctctgtctcccaggttc

SEQ ID NO: 260084 - DNA, 20 bp, Artificial Sequence
  chemically synthesized
ggagaatcacttgaacctgg

SEQ ID NO: 260085 - DNA, 20 bp, Artificial Sequence
  chemically synthesized
aatcacttgaacctgggaga

SEQ ID NO: 260086 - DNA, 20 bp, Artificial Sequence
  chemically synthesized
cactgcaccctctgtctccc

SEQ ID NO: 260087 - DNA, 20 bp, Artificial Sequence
  chemically synthesized
tcacttgaacctgggagaca

SEQ ID NO: 260088 - DNA, 20 bp, Artificial Sequence
  chemically synthesized
tcactgcaccctctgtctcc

SEQ ID NO: 260089 - DNA, 20 bp, Artificial Sequence
  chemically synthesized
cacttgaacctgggagacag

SEQ ID NO: 260090 - DNA, 20 bp, Artificial Sequence
  chemically synthesized
acttgaacctgggagacaga

SEQ ID NO: 260091 - DNA, 20 bp, Artificial Sequence
  chemically synthesized
aacctgggagacagagggtg

SEQ ID NO: 260092 - DNA, 20 bp, Artificial Sequence
  chemically synthesized
tgggagacagagggtgcagt

SEQ ID NO: 260093 - DNA, 20 bp, Artificial Sequence
  chemically synthesized
gacagagggtgcagtgagcc

SEQ ID NO: 260094 - DNA, 20 bp, Artificial Sequence
  chemically synthesized
ggagtgcagtggcatgatct

SEQ ID NO: 260095 - DNA, 20 bp, Artificial Sequence
  chemically synthesized
tcacccaggctggagtgcag

SEQ ID NO: 260096 - DNA, 20 bp, Artificial Sequence
  chemically synthesized
gagatcatgccactgcactc

SEQ ID NO: 260097 - DNA, 20 bp, Artificial Sequence
  chemically synthesized
ctgtcacccaggctggagtg

SEQ ID NO: 260098 - DNA, 20 bp, Artificial Sequence
  chemically synthesized
catgccactgcactccagcc

SEQ ID NO: 260099 - DNA, 20 bp, Artificial Sequence
  chemically synthesized
atgccactgcactccagcct

SEQ ID NO: 260100 - DNA, 20 bp, Artificial Sequence
  chemically synthesized
tcaccctgtcacccaggctg

SEQ ID NO: 260101 - DNA, 20 bp, Artificial Sequence
  chemically synthesized
tctcaccctgtcacccaggc

SEQ ID NO: 260102 - DNA, 20 bp, Artificial Sequence
  chemically synthesized
ctgcactccagcctgggtga

SEQ ID NO: 260103 - DNA, 20 bp, Artificial Sequence
  chemically synthesized
tgcactccagcctgggtgac

SEQ ID NO: 260104 - DNA, 20 bp, Artificial Sequence
  chemically synthesized
agattctcaccctgtcaccc

SEQ ID NO: 260105 - DNA, 20 bp, Artificial Sequence
  chemically synthesized
gcactccagcctgggtgaca

SEQ ID NO: 260106 - DNA, 20 bp, Artificial Sequence
  chemically synthesized
cagattctcaccctgtcacc

SEQ ID NO: 260107 - DNA, 20 bp, Artificial Sequence
  chemically synthesized
tccagcctgggtgacagggt

SEQ ID NO: 260108 - DNA, 20 bp, Artificial Sequence
  chemically synthesized
ctttttttttttttttgaga

SEQ ID NO: 260109 - DNA, 20 bp, Artificial Sequence
  chemically synthesized
aatacttttttttttttttt

SEQ ID NO: 260110 - DNA, 20 bp, Artificial Sequence
  chemically synthesized
ctgtctcaaaaaaaaaaaaa

SEQ ID NO: 260111 - DNA, 20 bp, Artificial Sequence
  chemically synthesized
aatagtttattcatatagtt

SEQ ID NO: 260112 - DNA, 20 bp, Artificial Sequence
  chemically synthesized
caatagtttattcatatagt

SEQ ID NO: 260113 - DNA, 20 bp, Artificial Sequence
  chemically synthesized
atttcaatagtttattcata

SEQ ID NO: 260114 - DNA, 20 bp, Artificial Sequence
  chemically synthesized
ggataatttaattatttcaa

SEQ ID NO: 260115 - DNA, 20 bp, Artificial Sequence
  chemically synthesized
gaaataattaaattatccat

SEQ ID NO: 260116 - DNA, 20 bp, Artificial Sequence
  chemically synthesized
tttatttcattttatactta

SEQ ID NO: 260117 - DNA, 20 bp, Artificial Sequence
  chemically synthesized
agagagagagaacagataat

SEQ ID NO: 260118 - DNA, 20 bp, Artificial Sequence
  chemically synthesized
agggagacagagagagagaa

SEQ ID NO: 260119 - DNA, 20 bp, Artificial Sequence
  chemically synthesized
gaggaagggagacagagaga

SEQ ID NO: 260120 - DNA, 20 bp, Artificial Sequence
  chemically synthesized
tggaggaagggagacagaga

SEQ ID NO: 260121 - DNA, 20 bp, Artificial Sequence
  chemically synthesized
gatggaggaagggagacaga

SEQ ID NO: 260122 - DNA, 20 bp, Artificial Sequence
  chemically synthesized
gggatggaggaagggagaca

SEQ ID NO: 260123 - DNA, 20 bp, Artificial Sequence
  chemically synthesized
gagggatggaggaagggaga

SEQ ID NO: 260124 - DNA, 20 bp, Artificial Sequence
  chemically synthesized
gagggagggatggaggaagg

SEQ ID NO: 260125 - DNA, 20 bp, Artificial Sequence
  chemically synthesized
gagagggagggatggaggaa

SEQ ID NO: 260126 - DNA, 20 bp, Artificial Sequence
  chemically synthesized
agagagggagggatggagga

SEQ ID NO: 260127 - DNA, 20 bp, Artificial Sequence
  chemically synthesized
gagagagggagggatggagg

SEQ ID NO: 260128 - DNA, 20 bp, Artificial Sequence
  chemically synthesized
gatgagagagggagggatgg

SEQ ID NO: 260129 - DNA, 20 bp, Artificial Sequence
  chemically synthesized
agatgagagagggagggatg

SEQ ID NO: 260130 - DNA, 20 bp, Artificial Sequence
  chemically synthesized
acagatgagagagggaggga

SEQ ID NO: 260131 - DNA, 20 bp, Artificial Sequence
  chemically synthesized
caacacagatgagagaggga

SEQ ID NO: 260132 - DNA, 20 bp, Artificial Sequence
  chemically synthesized
gcaacacagatgagagaggg

SEQ ID NO: 260133 - DNA, 20 bp, Artificial Sequence
  chemically synthesized
ggcaacacagatgagagagg

SEQ ID NO: 260134 - DNA, 20 bp, Artificial Sequence
  chemically synthesized
agggcaacacagatgagaga

SEQ ID NO: 260135 - DNA, 20 bp, Artificial Sequence
  chemically synthesized
cagggcaacacagatgagag

SEQ ID NO: 260136 - DNA, 20 bp, Artificial Sequence
  chemically synthesized
acagggcaacacagatgaga

SEQ ID NO: 260137 - DNA, 20 bp, Artificial Sequence
  chemically synthesized
gcacagggcaacacagatga

SEQ ID NO: 260138 - DNA, 20 bp, Artificial Sequence
  chemically synthesized
tagcacagggcaacacagat

SEQ ID NO: 260139 - DNA, 20 bp, Artificial Sequence
  chemically synthesized
taatttagcacagggcaaca

SEQ ID NO: 260140 - DNA, 20 bp, Artificial Sequence
  chemically synthesized
tggggaaataatttagcaca

SEQ ID NO: 260141 - DNA, 20 bp, Artificial Sequence
  chemically synthesized
ttggggaaataatttagcac

SEQ ID NO: 260142 - DNA, 20 bp, Artificial Sequence
  chemically synthesized
tttggggaaataatttagca

SEQ ID NO: 260143 - DNA, 20 bp, Artificial Sequence
  chemically synthesized
catagtttggggaaataatt

SEQ ID NO: 260144 - DNA, 20 bp, Artificial Sequence
  chemically synthesized
atatatggactcatagtttg

SEQ ID NO: 260145 - DNA, 20 bp, Artificial Sequence
  chemically synthesized
aaattatttccccaaactat

SEQ ID NO: 260146 - DNA, 20 bp, Artificial Sequence
  chemically synthesized
tatatatggactcatagttt

SEQ ID NO: 260147 - DNA, 20 bp, Artificial Sequence
  chemically synthesized
atatatatggactcatagtt

SEQ ID NO: 260148 - DNA, 20 bp, Artificial Sequence
  chemically synthesized
aacctatatatatggactca

SEQ ID NO: 260149 - DNA, 20 bp, Artificial Sequence
  chemically synthesized
aaactatgagtccatatata

SEQ ID NO: 260150 - DNA, 20 bp, Artificial Sequence
  chemically synthesized
aactatgagtccatatatat

SEQ ID NO: 260151 - DNA, 20 bp, Artificial Sequence
  chemically synthesized
tgaaaaagaacctatatata

SEQ ID NO: 260152 - DNA, 20 bp, Artificial Sequence
  chemically synthesized
cagcctcgagtaaggtgaaa

SEQ ID NO: 260153 - DNA, 20 bp, Artificial Sequence
  chemically synthesized
ggttctttttcaccttactc

SEQ ID NO: 260154 - DNA, 20 bp, Artificial Sequence
  chemically synthesized
gttctttttcaccttactcg

SEQ ID NO: 260155 - DNA, 20 bp, Artificial Sequence
  chemically synthesized
aatagctgcagcctcgagta

SEQ ID NO: 260156 - DNA, 20 bp, Artificial Sequence
  chemically synthesized
taatagctgcagcctcgagt

SEQ ID NO: 260157 - DNA, 20 bp, Artificial Sequence
  chemically synthesized
tttcaccttactcgaggctg

SEQ ID NO: 260158 - DNA, 20 bp, Artificial Sequence
  chemically synthesized
gagataatagctgcagcctc

SEQ ID NO: 260159 - DNA, 20 bp, Artificial Sequence
  chemically synthesized
gaaacaggagataatagctg

SEQ ID NO: 260160 - DNA, 20 bp, Artificial Sequence
  chemically synthesized
atgactgaaacaggagataa

SEQ ID NO: 260161 - DNA, 20 bp, Artificial Sequence
  chemically synthesized
gcagctattatctcctgttt

SEQ ID NO: 260162 - DNA, 20 bp, Artificial Sequence
  chemically synthesized
ggaataaatgactgaaacag

SEQ ID NO: 260163 - DNA, 20 bp, Artificial Sequence
  chemically synthesized
aaggaataaatgactgaaac

SEQ ID NO: 260164 - DNA, 20 bp, Artificial Sequence
  chemically synthesized
gaaggaataaatgactgaaa

SEQ ID NO: 260165 - DNA, 20 bp, Artificial Sequence
  chemically synthesized
tgaagtcaaaatgggacaga

SEQ ID NO: 260166 - DNA, 20 bp, Artificial Sequence
  chemically synthesized
ttgaagtcaaaatgggacag

SEQ ID NO: 260167 - DNA, 20 bp, Artificial Sequence
  chemically synthesized
gctttgaagtcaaaatggga

SEQ ID NO: 260168 - DNA, 20 bp, Artificial Sequence
  chemically synthesized
agtagctttgaagtcaaaat

SEQ ID NO: 260169 - DNA, 20 bp, Artificial Sequence
  chemically synthesized
tagtagctttgaagtcaaaa

SEQ ID NO: 260170 - DNA, 20 bp, Artificial Sequence
  chemically synthesized
tctgtcccattttgacttca

SEQ ID NO: 260171 - DNA, 20 bp, Artificial Sequence
  chemically synthesized
ttgtgcccctagtagctttg

SEQ ID NO: 260172 - DNA, 20 bp, Artificial Sequence
  chemically synthesized
cattttgacttcaaagctac

SEQ ID NO: 260173 - DNA, 20 bp, Artificial Sequence
  chemically synthesized
attttgacttcaaagctact

SEQ ID NO: 260174 - DNA, 20 bp, Artificial Sequence
  chemically synthesized
ttttgacttcaaagctacta

SEQ ID NO: 260175 - DNA, 20 bp, Artificial Sequence
  chemically synthesized
tttgacttcaaagctactag

SEQ ID NO: 260176 - DNA, 20 bp, Artificial Sequence
  chemically synthesized
ttttttttttgtgcccctag

SEQ ID NO: 260177 - DNA, 20 bp, Artificial Sequence
  chemically synthesized
tctttttttttttgtgcccc

SEQ ID NO: 260178 - DNA, 20 bp, Artificial Sequence
  chemically synthesized
actaggggcacaaaaaaaaa

SEQ ID NO: 260179 - DNA, 20 bp, Artificial Sequence
  chemically synthesized
taggggcacaaaaaaaaaaa

SEQ ID NO: 260180 - DNA, 20 bp, Artificial Sequence
  chemically synthesized
aaaaaaaaaaagagataatt

SEQ ID NO: 260181 - DNA, 20 bp, Artificial Sequence
  chemically synthesized
aaagagataattaagtttat

SEQ ID NO: 260182 - DNA, 20 bp, Artificial Sequence
  chemically synthesized
aaattttgctttgattaaag

SEQ ID NO: 260183 - DNA, 20 bp, Artificial Sequence
  chemically synthesized
aaaattttgctttgattaaa

SEQ ID NO: 260184 - DNA, 20 bp, Artificial Sequence
  chemically synthesized
tagaattacctctttaatca

SEQ ID NO: 260185 - DNA, 20 bp, Artificial Sequence
  chemically synthesized
taaaaattttgctttgatta

SEQ ID NO: 260186 - DNA, 20 bp, Artificial Sequence
  chemically synthesized
tttttaaaaaatctccaaaa

SEQ ID NO: 260187 - DNA, 20 bp, Artificial Sequence
  chemically synthesized
ttttaaaaaatctccaaaaa

SEQ ID NO: 260188 - DNA, 20 bp, Artificial Sequence
  chemically synthesized
aatttccaaatccttttttg

SEQ ID NO: 260189 - DNA, 20 bp, Artificial Sequence
  chemically synthesized
tgaatttccaaatccttttt

SEQ ID NO: 260190 - DNA, 20 bp, Artificial Sequence
  chemically synthesized
aaaatctccaaaaaaggatt

SEQ ID NO: 260191 - DNA, 20 bp, Artificial Sequence
  chemically synthesized
ttcatttcataatgaaatat

SEQ ID NO: 260192 - DNA, 20 bp, Artificial Sequence
  chemically synthesized
tttcataatgaaatataagt

SEQ ID NO: 260193 - DNA, 20 bp, Artificial Sequence
  chemically synthesized
aatgaaatataagtaagctt

SEQ ID NO: 260194 - DNA, 20 bp, Artificial Sequence
  chemically synthesized
tttaaggttcatgaaatcca

SEQ ID NO: 260195 - DNA, 20 bp, Artificial Sequence
  chemically synthesized
ttcccaaaattgatttttta

SEQ ID NO: 260196 - DNA, 20 bp, Artificial Sequence
  chemically synthesized
attcccaaaattgatttttt

SEQ ID NO: 260197 - DNA, 20 bp, Artificial Sequence
  chemically synthesized
gaaccttaaaaaatcaattt

SEQ ID NO: 260198 - DNA, 20 bp, Artificial Sequence
  chemically synthesized
aaccttaaaaaatcaatttt

SEQ ID NO: 260199 - DNA, 20 bp, Artificial Sequence
  chemically synthesized
aaaaatcaattttgggaatc

SEQ ID NO: 260200 - DNA, 20 bp, Artificial Sequence
  chemically synthesized
aaatcaattttgggaatcga

SEQ ID NO: 260201 - DNA, 20 bp, Artificial Sequence
  chemically synthesized
aatcaattttgggaatcgag

SEQ ID NO: 260202 - DNA, 20 bp, Artificial Sequence
  chemically synthesized
caggaatggagtagaacaaa

SEQ ID NO: 260203 - DNA, 20 bp, Artificial Sequence
  chemically synthesized
tcaggaatggagtagaacaa

SEQ ID NO: 260204 - DNA, 20 bp, Artificial Sequence
  chemically synthesized
gccaagagtcaggaatggag

SEQ ID NO: 260205 - DNA, 20 bp, Artificial Sequence
  chemically synthesized
acagccaagagtcaggaatg

SEQ ID NO: 260206 - DNA, 20 bp, Artificial Sequence
  chemically synthesized
acacagccaagagtcaggaa

SEQ ID NO: 260207 - DNA, 20 bp, Artificial Sequence
  chemically synthesized
tctactccattcctgactct

SEQ ID NO: 260208 - DNA, 20 bp, Artificial Sequence
  chemically synthesized
ctgcaacacagccaagagtc

SEQ ID NO: 260209 - DNA, 20 bp, Artificial Sequence
  chemically synthesized
cctgcaacacagccaagagt

SEQ ID NO: 260210 - DNA, 20 bp, Artificial Sequence
  chemically synthesized
tttacctgcaacacagccaa

SEQ ID NO: 260211 - DNA, 20 bp, Artificial Sequence
  chemically synthesized
aatttacctgcaacacagcc

SEQ ID NO: 260212 - DNA, 20 bp, Artificial Sequence
  chemically synthesized
cctgactcttggctgtgttg

SEQ ID NO: 260213 - DNA, 20 bp, Artificial Sequence
  chemically synthesized
ctgactcttggctgtgttgc

SEQ ID NO: 260214 - DNA, 20 bp, Artificial Sequence
  chemically synthesized
attttaatttacctgcaaca

SEQ ID NO: 260215 - DNA, 20 bp, Artificial Sequence
  chemically synthesized
ttatttattcagaggtcaga

SEQ ID NO: 260216 - DNA, 20 bp, Artificial Sequence
  chemically synthesized
cactttatttattcagaggt

SEQ ID NO: 260217 - DNA, 20 bp, Artificial Sequence
  chemically synthesized
gtggcactttatttattcag

SEQ ID NO: 260218 - DNA, 20 bp, Artificial Sequence
  chemically synthesized
agtggcactttatttattca

SEQ ID NO: 260219 - DNA, 20 bp, Artificial Sequence
  chemically synthesized
acagtggcactttatttatt

SEQ ID NO: 260220 - DNA, 20 bp, Artificial Sequence
  chemically synthesized
atctgacctctgaataaata

SEQ ID NO: 260221 - DNA, 20 bp, Artificial Sequence
  chemically synthesized
aaccatttctatacacacag

SEQ ID NO: 260222 - DNA, 20 bp, Artificial Sequence
  chemically synthesized
ataaagtgccactgtgtgta

SEQ ID NO: 260223 - DNA, 20 bp, Artificial Sequence
  chemically synthesized
tataaccatttctatacaca

SEQ ID NO: 260224 - DNA, 20 bp, Artificial Sequence
  chemically synthesized
tgccactgtgtgtatagaaa

SEQ ID NO: 260225 - DNA, 20 bp, Artificial Sequence
  chemically synthesized
ctggcaaaatatattatttt

SEQ ID NO: 260226 - DNA, 20 bp, Artificial Sequence
  chemically synthesized
cctggcaaaatatattattt

SEQ ID NO: 260227 - DNA, 20 bp, Artificial Sequence
  chemically synthesized
cccaaaataatatattttgc

SEQ ID NO: 260228 - DNA, 20 bp, Artificial Sequence
  chemically synthesized
ccaaaataatatattttgcc

SEQ ID NO: 260229 - DNA, 20 bp, Artificial Sequence
  chemically synthesized
tattttgcaaagttataacc

SEQ ID NO: 260230 - DNA, 20 bp, Artificial Sequence
  chemically synthesized
gactattaccatattttgca

SEQ ID NO: 260231 - DNA, 20 bp, Artificial Sequence
  chemically synthesized
ggttataactttgcaaaata

SEQ ID NO: 260232 - DNA, 20 bp, Artificial Sequence
  chemically synthesized
aactttgcaaaatatggtaa

SEQ ID NO: 260233 - DNA, 20 bp, Artificial Sequence
  chemically synthesized
aaatatggtaatagtcactg

SEQ ID NO: 260234 - DNA, 20 bp, Artificial Sequence
  chemically synthesized
aagagaaaaatggttttctt

SEQ ID NO: 260235 - DNA, 20 bp, Artificial Sequence
  chemically synthesized
aatctttggtaagagaaaaa

SEQ ID NO: 260236 - DNA, 20 bp, Artificial Sequence
  chemically synthesized
aaaccatttttctcttacca

SEQ ID NO: 260237 - DNA, 20 bp, Artificial Sequence
  chemically synthesized
ttgagcgtaatctttggtaa

SEQ ID NO: 260238 - DNA, 20 bp, Artificial Sequence
  chemically synthesized
aattgagcgtaatctttggt

SEQ ID NO: 260239 - DNA, 20 bp, Artificial Sequence
  chemically synthesized
aaagaattgagcgtaatctt

SEQ ID NO: 260240 - DNA, 20 bp, Artificial Sequence
  chemically synthesized
aaaacttttaaaaaagaatt

SEQ ID NO: 260241 - DNA, 20 bp, Artificial Sequence
  chemically synthesized
tacgctcaattcttttttaa

SEQ ID NO: 260242 - DNA, 20 bp, Artificial Sequence
  chemically synthesized
aattcacaaaacttttaaaa

SEQ ID NO: 260243 - DNA, 20 bp, Artificial Sequence
  chemically synthesized
ttgtgaatttaatgacacct

SEQ ID NO: 260244 - DNA, 20 bp, Artificial Sequence
  chemically synthesized
tgtgaatttaatgacacctt

SEQ ID NO: 260245 - DNA, 20 bp, Artificial Sequence
  chemically synthesized
agtagagcacattaagccta

SEQ ID NO: 260246 - DNA, 20 bp, Artificial Sequence
  chemically synthesized
aagtagagcacattaagcct

SEQ ID NO: 260247 - DNA, 20 bp, Artificial Sequence
  chemically synthesized
attgtaaagtagagcacatt

SEQ ID NO: 260248 - DNA, 20 bp, Artificial Sequence
  chemically synthesized
actatctggattgtaaagta

SEQ ID NO: 260249 - DNA, 20 bp, Artificial Sequence
  chemically synthesized
aaactatctggattgtaaag

SEQ ID NO: 260250 - DNA, 20 bp, Artificial Sequence
  chemically synthesized
atgtgctctactttacaatc

SEQ ID NO: 260251 - DNA, 20 bp, Artificial Sequence
  chemically synthesized
gagaaactatctggattgta

SEQ ID NO: 260252 - DNA, 20 bp, Artificial Sequence
  chemically synthesized
gctctactttacaatccaga

SEQ ID NO: 260253 - DNA, 20 bp, Artificial Sequence
  chemically synthesized
ctattttaggagaaactatc

SEQ ID NO: 260254 - DNA, 20 bp, Artificial Sequence
  chemically synthesized
ccagatagtttctcctaaaa

SEQ ID NO: 260255 - DNA, 20 bp, Artificial Sequence
  chemically synthesized
cagagaacaagctattttag

SEQ ID NO: 260256 - DNA, 20 bp, Artificial Sequence
  chemically synthesized
gacagagaacaagctatttt

SEQ ID NO: 260257 - DNA, 20 bp, Artificial Sequence
  chemically synthesized
tgacagagaacaagctattt

SEQ ID NO: 260258 - DNA, 20 bp, Artificial Sequence
  chemically synthesized
ctggaacattgacagagaac

SEQ ID NO: 260259 - DNA, 20 bp, Artificial Sequence
  chemically synthesized
tatttcctggaacattgaca

SEQ ID NO: 260260 - DNA, 20 bp, Artificial Sequence
  chemically synthesized
attatttcctggaacattga

SEQ ID NO: 260261 - DNA, 20 bp, Artificial Sequence
  chemically synthesized
cttgttctctgtcaatgttc

SEQ ID NO: 260262 - DNA, 20 bp, Artificial Sequence
  chemically synthesized
ttgttctctgtcaatgttcc

SEQ ID NO: 260263 - DNA, 20 bp, Artificial Sequence
  chemically synthesized
atacaatgactattatttcc

SEQ ID NO: 260264 - DNA, 20 bp, Artificial Sequence
  chemically synthesized
gtcaatgttccaggaaataa

SEQ ID NO: 260265 - DNA, 20 bp, Artificial Sequence
  chemically synthesized
atagtcattgtattatccta

SEQ ID NO: 260266 - DNA, 20 bp, Artificial Sequence
  chemically synthesized
tcattgtattatcctatggc

SEQ ID NO: 260267 - DNA, 20 bp, Artificial Sequence
  chemically synthesized
cattgtattatcctatggca

SEQ ID NO: 260268 - DNA, 20 bp, Artificial Sequence
  chemically synthesized
tatattggaatccttgccat

SEQ ID NO: 260269 - DNA, 20 bp, Artificial Sequence
  chemically synthesized
ttatattggaatccttgcca

SEQ ID NO: 260270 - DNA, 20 bp, Artificial Sequence
  chemically synthesized
agaatagaacaattttatat

SEQ ID NO: 260271 - DNA, 20 bp, Artificial Sequence
  chemically synthesized
taaaattgttctattctgtc

SEQ ID NO: 260272 - DNA, 20 bp, Artificial Sequence
  chemically synthesized
tgtaaattttctggacagaa

SEQ ID NO: 260273 - DNA, 20 bp, Artificial Sequence
  chemically synthesized
aaacttgtaaattttctgga

SEQ ID NO: 260274 - DNA, 20 bp, Artificial Sequence
  chemically synthesized
gttaaaacttgtaaattttc

SEQ ID NO: 260275 - DNA, 20 bp, Artificial Sequence
  chemically synthesized
attctgtccagaaaatttac

SEQ ID NO: 260276 - DNA, 20 bp, Artificial Sequence
  chemically synthesized
tgtgtcaatatgagttttta

SEQ ID NO: 260277 - DNA, 20 bp, Artificial Sequence
  chemically synthesized
attgtgtcaatatgagtttt

SEQ ID NO: 260278 - DNA, 20 bp, Artificial Sequence
  chemically synthesized
aaaattgattgtgtcaatat

SEQ ID NO: 260279 - DNA, 20 bp, Artificial Sequence
  chemically synthesized
aatcaattttcactccattt

SEQ ID NO: 260280 - DNA, 20 bp, Artificial Sequence
  chemically synthesized
aaaatatatgatctaaaatg

SEQ ID NO: 260281 - DNA, 20 bp, Artificial Sequence
  chemically synthesized
tcaaaatatatgatctaaaa

SEQ ID NO: 260282 - DNA, 20 bp, Artificial Sequence
  chemically synthesized
tttagatcatatattttgaa

SEQ ID NO: 260283 - DNA, 20 bp, Artificial Sequence
  chemically synthesized
ttagatcatatattttgaaa

SEQ ID NO: 260284 - DNA, 20 bp, Artificial Sequence
  chemically synthesized
ttttgaaaaggtaattaact

SEQ ID NO: 260285 - DNA, 20 bp, Artificial Sequence
  chemically synthesized
aaggtaattaactgagaact

SEQ ID NO: 260286 - DNA, 20 bp, Artificial Sequence
  chemically synthesized
aacagtcatatccaagttct

SEQ ID NO: 260287 - DNA, 20 bp, Artificial Sequence
  chemically synthesized
ggggaggaacagtcatatcc

SEQ ID NO: 260288 - DNA, 20 bp, Artificial Sequence
  chemically synthesized
aaggagattgtggggaggaa

SEQ ID NO: 260289 - DNA, 20 bp, Artificial Sequence
  chemically synthesized
tttacaaggagattgtgggg

SEQ ID NO: 260290 - DNA, 20 bp, Artificial Sequence
  chemically synthesized
ttttacaaggagattgtggg

SEQ ID NO: 260291 - DNA, 20 bp, Artificial Sequence
  chemically synthesized
gcttttacaaggagattgtg

SEQ ID NO: 260292 - DNA, 20 bp, Artificial Sequence
  chemically synthesized
tgcttttacaaggagattgt

SEQ ID NO: 260293 - DNA, 20 bp, Artificial Sequence
  chemically synthesized
ctgcttttacaaggagattg

SEQ ID NO: 260294 - DNA, 20 bp, Artificial Sequence
  chemically synthesized
tccccacaatctccttgtaa

SEQ ID NO: 260295 - DNA, 20 bp, Artificial Sequence
  chemically synthesized
gttgtagctgcttttacaag

SEQ ID NO: 260296 - DNA, 20 bp, Artificial Sequence
  chemically synthesized
ctgttgtagctgcttttaca

SEQ ID NO: 260297 - DNA, 20 bp, Artificial Sequence
  chemically synthesized
ccacaatctccttgtaaaag

SEQ ID NO: 260298 - DNA, 20 bp, Artificial Sequence
  chemically synthesized
tctgttgtagctgcttttac

SEQ ID NO: 260299 - DNA, 20 bp, Artificial Sequence
  chemically synthesized
ccttgtaaaagcagctacaa

SEQ ID NO: 260300 - DNA, 20 bp, Artificial Sequence
  chemically synthesized
aaaatactttatttctgttg

SEQ ID NO: 260301 - DNA, 20 bp, Artificial Sequence
  chemically synthesized
aagcagctacaacagaaata

SEQ ID NO: 260302 - DNA, 20 bp, Artificial Sequence
  chemically synthesized
aaaaaaatttattttttatt

SEQ ID NO: 260303 - DNA, 20 bp, Artificial Sequence
  chemically synthesized
gtattctgaaaagttttgag

SEQ ID NO: 260304 - DNA, 20 bp, Artificial Sequence
  chemically synthesized
tttgtattctgaaaagtttt

SEQ ID NO: 260305 - DNA, 20 bp, Artificial Sequence
  chemically synthesized
tttcacttctcaaaactttt

SEQ ID NO: 260306 - DNA, 20 bp, Artificial Sequence
  chemically synthesized
aattaaatttgtattctgaa

SEQ ID NO: 260307 - DNA, 20 bp, Artificial Sequence
  chemically synthesized
tttcagaatacaaatttaat

SEQ ID NO: 260308 - DNA, 20 bp, Artificial Sequence
  chemically synthesized
aattggtctggatataatat

SEQ ID NO: 260309 - DNA, 20 bp, Artificial Sequence
  chemically synthesized
taattggcttatattatatc

SEQ ID NO: 260310 - DNA, 20 bp, Artificial Sequence
  chemically synthesized
tatttaagaaataattggtc

SEQ ID NO: 260311 - DNA, 20 bp, Artificial Sequence
  chemically synthesized
attattatttaagaaataat

SEQ ID NO: 260312 - DNA, 20 bp, Artificial Sequence
  chemically synthesized
attttagttaattattattt

SEQ ID NO: 260313 - DNA, 20 bp, Artificial Sequence
  chemically synthesized
gactctaacgttcatcattt

SEQ ID NO: 260314 - DNA, 20 bp, Artificial Sequence
  chemically synthesized
ttaactaaaatgatgaacgt

SEQ ID NO: 260315 - DNA, 20 bp, Artificial Sequence
  chemically synthesized
aactaaaatgatgaacgtta

SEQ ID NO: 260316 - DNA, 20 bp, Artificial Sequence
  chemically synthesized
taattatttgtgattgacaa

SEQ ID NO: 260317 - DNA, 20 bp, Artificial Sequence
  chemically synthesized
caaataattatgttaattat

SEQ ID NO: 260318 - DNA, 20 bp, Artificial Sequence
  chemically synthesized
ttattagtcattatgatcac

SEQ ID NO: 260319 - DNA, 20 bp, Artificial Sequence
  chemically synthesized
tattagtcattatgatcact

SEQ ID NO: 260320 - DNA, 20 bp, Artificial Sequence
  chemically synthesized
attatgatcactgggaaata

SEQ ID NO: 260321 - DNA, 20 bp, Artificial Sequence
  chemically synthesized
ttttcacattctttatttcc

SEQ ID NO: 260322 - DNA, 20 bp, Artificial Sequence
  chemically synthesized
ggaaataaagaatgtgaaaa

SEQ ID NO: 260323 - DNA, 20 bp, Artificial Sequence
  chemically synthesized
taacattaacgcattttgtt

SEQ ID NO: 260324 - DNA, 20 bp, Artificial Sequence
  chemically synthesized
ataattgtaaacaatgcatc

SEQ ID NO: 260325 - DNA, 20 bp, Artificial Sequence
  chemically synthesized
gcattgtttacaattatgaa

SEQ ID NO: 260326 - DNA, 20 bp, Artificial Sequence
  chemically synthesized
cattgtttacaattatgaaa

SEQ ID NO: 260327 - DNA, 20 bp, Artificial Sequence
  chemically synthesized
gtttacaattatgaaaagga

SEQ ID NO: 260328 - DNA, 20 bp, Artificial Sequence
  chemically synthesized
caaaaattaattcaaaacag

SEQ ID NO: 260329 - DNA, 20 bp, Artificial Sequence
  chemically synthesized
atccaaaaattaattcaaaa

SEQ ID NO: 260330 - DNA, 20 bp, Artificial Sequence
  chemically synthesized
ttctgttttgaattaatttt

SEQ ID NO: 260331 - DNA, 20 bp, Artificial Sequence
  chemically synthesized
tatcatttcctgatgatatt

SEQ ID NO: 260332 - DNA, 20 bp, Artificial Sequence
  chemically synthesized
ttttggattccaaatatcat

SEQ ID NO: 260333 - DNA, 20 bp, Artificial Sequence
  chemically synthesized
tttggattccaaatatcatc

SEQ ID NO: 260334 - DNA, 20 bp, Artificial Sequence
  chemically synthesized
tcaggaaatgatactattat

SEQ ID NO: 260335 - DNA, 20 bp, Artificial Sequence
  chemically synthesized
gtgatataaagaactcataa

SEQ ID NO: 260336 - DNA, 20 bp, Artificial Sequence
  chemically synthesized
ttgtttgttttggtgatata

SEQ ID NO: 260337 - DNA, 20 bp, Artificial Sequence
  chemically synthesized
gaatctgtttttgtttgttt

SEQ ID NO: 260338 - DNA, 20 bp, Artificial Sequence
  chemically synthesized
atcaccaaaacaaacaaaaa

SEQ ID NO: 260339 - DNA, 20 bp, Artificial Sequence
  chemically synthesized
aacaaaaacagattcaaatc

SEQ ID NO: 260340 - DNA, 20 bp, Artificial Sequence
  chemically synthesized
caaaaacagattcaaatcca

SEQ ID NO: 260341 - DNA, 20 bp, Artificial Sequence
  chemically synthesized
aaaaacagattcaaatccag

SEQ ID NO: 260342 - DNA, 20 bp, Artificial Sequence
  chemically synthesized
gtataaatattttcatcctc

SEQ ID NO: 260343 - DNA, 20 bp, Artificial Sequence
  chemically synthesized
ggatgaaaatatttatacac

SEQ ID NO: 260344 - DNA, 20 bp, Artificial Sequence
  chemically synthesized
tacacaagaaaataccattt

SEQ ID NO: 260345 - DNA, 20 bp, Artificial Sequence
  chemically synthesized
aaataataaaggtaccaaaa

SEQ ID NO: 260346 - DNA, 20 bp, Artificial Sequence
  chemically synthesized
ttaacacttacaaataataa

SEQ ID NO: 260347 - DNA, 20 bp, Artificial Sequence
  chemically synthesized
gttaacacttacaaataata

SEQ ID NO: 260348 - DNA, 20 bp, Artificial Sequence
  chemically synthesized
ttggtacctttattatttgt

SEQ ID NO: 260349 - DNA, 20 bp, Artificial Sequence
  chemically synthesized
gtgttaacgttgaacaatgt

SEQ ID NO: 260350 - DNA, 20 bp, Artificial Sequence
  chemically synthesized
cacaaaaaagagtagaatta

SEQ ID NO: 260351 - DNA, 20 bp, Artificial Sequence
  chemically synthesized
acacaaaaaagagtagaatt

SEQ ID NO: 260352 - DNA, 20 bp, Artificial Sequence
  chemically synthesized
tacacaaaaaagagtagaat

SEQ ID NO: 260353 - DNA, 20 bp, Artificial Sequence
  chemically synthesized
acaaaatacacaaaaaagag

SEQ ID NO: 260354 - DNA, 20 bp, Artificial Sequence
  chemically synthesized
aagacaaaatacacaaaaaa

SEQ ID NO: 260355 - DNA, 20 bp, Artificial Sequence
  chemically synthesized
acaagacaaaatacacaaaa

SEQ ID NO: 260356 - DNA, 20 bp, Artificial Sequence
  chemically synthesized
cacatgtgaggagcaaaaac

SEQ ID NO: 260357 - DNA, 20 bp, Artificial Sequence
  chemically synthesized
tttattttgtcacatgtgag

SEQ ID NO: 260358 - DNA, 20 bp, Artificial Sequence
  chemically synthesized
aatttattttgtcacatgtg

SEQ ID NO: 260359 - DNA, 20 bp, Artificial Sequence
  chemically synthesized
gaatttattttgtcacatgt

SEQ ID NO: 260360 - DNA, 20 bp, Artificial Sequence
  chemically synthesized
acatgtgacaaaataaattc

SEQ ID NO: 260361 - DNA, 20 bp, Artificial Sequence
  chemically synthesized
taaattcaagaatgttattc

SEQ ID NO: 260362 - DNA, 20 bp, Artificial Sequence
  chemically synthesized
attcaagaatgttattccag

SEQ ID NO: 260363 - DNA, 20 bp, Artificial Sequence
  chemically synthesized
gccccataacagttatccac

SEQ ID NO: 260364 - DNA, 20 bp, Artificial Sequence
  chemically synthesized
attccagtggataactgtta

SEQ ID NO: 260365 - DNA, 20 bp, Artificial Sequence
  chemically synthesized
ttccagtggataactgttat

SEQ ID NO: 260366 - DNA, 20 bp, Artificial Sequence
  chemically synthesized
tccagtggataactgttatg

SEQ ID NO: 260367 - DNA, 20 bp, Artificial Sequence
  chemically synthesized
aagcagtactggccccataa

SEQ ID NO: 260368 - DNA, 20 bp, Artificial Sequence
  chemically synthesized
gtggataactgttatggggc

SEQ ID NO: 260369 - DNA, 20 bp, Artificial Sequence
  chemically synthesized
gcctgttcggcaagcagtac

SEQ ID NO: 260370 - DNA, 20 bp, Artificial Sequence
  chemically synthesized
tgtatggcctgttcggcaag

SEQ ID NO: 260371 - DNA, 20 bp, Artificial Sequence
  chemically synthesized
ggccagtactgcttgccgaa

SEQ ID NO: 260372 - DNA, 20 bp, Artificial Sequence
  chemically synthesized
gccagtactgcttgccgaac

SEQ ID NO: 260373 - DNA, 20 bp, Artificial Sequence
  chemically synthesized
atatgtatggcctgttcggc

SEQ ID NO: 260374 - DNA, 20 bp, Artificial Sequence
  chemically synthesized
tcctatatgtatggcctgtt

SEQ ID NO: 260375 - DNA, 20 bp, Artificial Sequence
  chemically synthesized
tgccgaacaggccatacata

SEQ ID NO: 260376 - DNA, 20 bp, Artificial Sequence
  chemically synthesized
gccgaacaggccatacatat

SEQ ID NO: 260377 - DNA, 20 bp, Artificial Sequence
  chemically synthesized
accatcacctcctatatgta

SEQ ID NO: 260378 - DNA, 20 bp, Artificial Sequence
  chemically synthesized
cgaacaggccatacatatag

SEQ ID NO: 260379 - DNA, 20 bp, Artificial Sequence
  chemically synthesized
gaacaggccatacatatagg

SEQ ID NO: 260380 - DNA, 20 bp, Artificial Sequence
  chemically synthesized
gccatacatataggaggtga

SEQ ID NO: 260381 - DNA, 20 bp, Artificial Sequence
  chemically synthesized
gtttcagaatgaggaagaga

SEQ ID NO: 260382 - DNA, 20 bp, Artificial Sequence
  chemically synthesized
tgaagtttcagaatgaggaa

SEQ ID NO: 260383 - DNA, 20 bp, Artificial Sequence
  chemically synthesized
cttgaagtttcagaatgagg

SEQ ID NO: 260384 - DNA, 20 bp, Artificial Sequence
  chemically synthesized
ttgcttgaagtttcagaatg

SEQ ID NO: 260385 - DNA, 20 bp, Artificial Sequence
  chemically synthesized
gttgcttgaagtttcagaat

SEQ ID NO: 260386 - DNA, 20 bp, Artificial Sequence
  chemically synthesized
cttcctcattctgaaacttc

SEQ ID NO: 260387 - DNA, 20 bp, Artificial Sequence
  chemically synthesized
atattggttgcttgaagttt

SEQ ID NO: 260388 - DNA, 20 bp, Artificial Sequence
  chemically synthesized
gtttctatattggttgcttg

SEQ ID NO: 260389 - DNA, 20 bp, Artificial Sequence
  chemically synthesized
gaaacttcaagcaaccaata

SEQ ID NO: 260390 - DNA, 20 bp, Artificial Sequence
  chemically synthesized
ttcctgctaagtttctatat

SEQ ID NO: 260391 - DNA, 20 bp, Artificial Sequence
  chemically synthesized
aagcaaccaatatagaaact

SEQ ID NO: 260392 - DNA, 20 bp, Artificial Sequence
  chemically synthesized
caaccaatatagaaacttag

SEQ ID NO: 260393 - DNA, 20 bp, Artificial Sequence
  chemically synthesized
aaccaatatagaaacttagc

SEQ ID NO: 260394 - DNA, 20 bp, Artificial Sequence
  chemically synthesized
gaaggaataccattcctgct

SEQ ID NO: 260395 - DNA, 20 bp, Artificial Sequence
  chemically synthesized
atatagaaacttagcaggaa

SEQ ID NO: 260396 - DNA, 20 bp, Artificial Sequence
  chemically synthesized
agataaatttatttacatga

SEQ ID NO: 260397 - DNA, 20 bp, Artificial Sequence
  chemically synthesized
tagataaatttatttacatg

SEQ ID NO: 260398 - DNA, 20 bp, Artificial Sequence
  chemically synthesized
tcatgtaaataaatttatct

SEQ ID NO: 260399 - DNA, 20 bp, Artificial Sequence
  chemically synthesized
gtaaataaatttatctaagt

SEQ ID NO: 260400 - DNA, 20 bp, Artificial Sequence
  chemically synthesized
aataaatttatctaagttgg

SEQ ID NO: 260401 - DNA, 20 bp, Artificial Sequence
  chemically synthesized
atgtccgtaaaccaccaact

SEQ ID NO: 260402 - DNA, 20 bp, Artificial Sequence
  chemically synthesized
ttatctaagttggtggttta

SEQ ID NO: 260403 - DNA, 20 bp, Artificial Sequence
  chemically synthesized
tttacggacattgtatttca

SEQ ID NO: 260404 - DNA, 20 bp, Artificial Sequence
  chemically synthesized
ttacggacattgtatttcat

SEQ ID NO: 260405 - DNA, 20 bp, Artificial Sequence
  chemically synthesized
ttacaaaaaaaaaaaactat

SEQ ID NO: 260406 - DNA, 20 bp, Artificial Sequence
  chemically synthesized
tacaaaaaaaaaaaactatt

SEQ ID NO: 260407 - DNA, 20 bp, Artificial Sequence
  chemically synthesized
acaaaaaaaaaaaactatta

SEQ ID NO: 260408 - DNA, 20 bp, Artificial Sequence
  chemically synthesized
acttttgtgatgttccctaa

SEQ ID NO: 260409 - DNA, 20 bp, Artificial Sequence
  chemically synthesized
actattagggaacatcacaa

SEQ ID NO: 260410 - DNA, 20 bp, Artificial Sequence
  chemically synthesized
ttactagaaaaagtaaaggg

SEQ ID NO: 260411 - DNA, 20 bp, Artificial Sequence
  chemically synthesized
cctttactagaaaaagtaaa

SEQ ID NO: 260412 - DNA, 20 bp, Artificial Sequence
  chemically synthesized
tcctttactagaaaaagtaa

SEQ ID NO: 260413 - DNA, 20 bp, Artificial Sequence
  chemically synthesized
gtcctttactagaaaaagta

SEQ ID NO: 260414 - DNA, 20 bp, Artificial Sequence
  chemically synthesized
gttctgccctttactttttc

SEQ ID NO: 260415 - DNA, 20 bp, Artificial Sequence
  chemically synthesized
acaatgtcctttactagaaa

SEQ ID NO: 260416 - DNA, 20 bp, Artificial Sequence
  chemically synthesized
gccctttactttttctagta

SEQ ID NO: 260417 - DNA, 20 bp, Artificial Sequence
  chemically synthesized
ccctttactttttctagtaa

SEQ ID NO: 260418 - DNA, 20 bp, Artificial Sequence
  chemically synthesized
tttgttacaatgtcctttac

SEQ ID NO: 260419 - DNA, 20 bp, Artificial Sequence
  chemically synthesized
aaaggacattgtaacaaaat

SEQ ID NO: 260420 - DNA, 20 bp, Artificial Sequence
  chemically synthesized
ggacattgtaacaaaatgag

SEQ ID NO: 260421 - DNA, 20 bp, Artificial Sequence
  chemically synthesized
attgtaacaaaatgagaaga

SEQ ID NO: 260422 - DNA, 20 bp, Artificial Sequence
  chemically synthesized
acaaaatgagaagaaagaaa

SEQ ID NO: 260423 - DNA, 20 bp, Artificial Sequence
  chemically synthesized
aatgagaagaaagaaaaaga

SEQ ID NO: 260424 - DNA, 20 bp, Artificial Sequence
  chemically synthesized
atgagaagaaagaaaaagaa

SEQ ID NO: 260425 - DNA, 20 bp, Artificial Sequence
  chemically synthesized
cagttttggaggtattaaaa

SEQ ID NO: 260426 - DNA, 20 bp, Artificial Sequence
  chemically synthesized
atgggtttcaacagttttgg

SEQ ID NO: 260427 - DNA, 20 bp, Artificial Sequence
  chemically synthesized
tatgggtttcaacagttttg

SEQ ID NO: 260428 - DNA, 20 bp, Artificial Sequence
  chemically synthesized
attatgggtttcaacagttt

SEQ ID NO: 260429 - DNA, 20 bp, Artificial Sequence
  chemically synthesized
ttcaaaattatgggtttcaa

SEQ ID NO: 260430 - DNA, 20 bp, Artificial Sequence
  chemically synthesized
gtcctttctttcaaaattat

SEQ ID NO: 260431 - DNA, 20 bp, Artificial Sequence
  chemically synthesized
tgtcctttctttcaaaatta

SEQ ID NO: 260432 - DNA, 20 bp, Artificial Sequence
  chemically synthesized
gttgaaacccataattttga

SEQ ID NO: 260433 - DNA, 20 bp, Artificial Sequence
  chemically synthesized
aaacccataattttgaaaga

SEQ ID NO: 260434 - DNA, 20 bp, Artificial Sequence
  chemically synthesized
aacccataattttgaaagaa

SEQ ID NO: 260435 - DNA, 20 bp, Artificial Sequence
  chemically synthesized
aaagcaaagttttttaatgc

SEQ ID NO: 260436 - DNA, 20 bp, Artificial Sequence
  chemically synthesized
atttagcttttcataaagca

SEQ ID NO: 260437 - DNA, 20 bp, Artificial Sequence
  chemically synthesized
aaaaaactttgctttatgaa

SEQ ID NO: 260438 - DNA, 20 bp, Artificial Sequence
  chemically synthesized
tttttatttagcttttcata

SEQ ID NO: 260439 - DNA, 20 bp, Artificial Sequence
  chemically synthesized
aaaaagagcaattttttatt

SEQ ID NO: 260440 - DNA, 20 bp, Artificial Sequence
  chemically synthesized
cataaggaaaagaaaaaaaa

SEQ ID NO: 260441 - DNA, 20 bp, Artificial Sequence
  chemically synthesized
tccataaggaaaagaaaaaa

SEQ ID NO: 260442 - DNA, 20 bp, Artificial Sequence
  chemically synthesized
tcttttttttcttttcctta

SEQ ID NO: 260443 - DNA, 20 bp, Artificial Sequence
  chemically synthesized
tttcaatggtccataaggaa

SEQ ID NO: 260444 - DNA, 20 bp, Artificial Sequence
  chemically synthesized
gaagttttcaatggtccata

SEQ ID NO: 260445 - DNA, 20 bp, Artificial Sequence
  chemically synthesized
agaagttttcaatggtccat

SEQ ID NO: 260446 - DNA, 20 bp, Artificial Sequence
  chemically synthesized
catggtccagaagttttcaa

SEQ ID NO: 260447 - DNA, 20 bp, Artificial Sequence
  chemically synthesized
tatggaccattgaaaacttc

SEQ ID NO: 260448 - DNA, 20 bp, Artificial Sequence
  chemically synthesized
gccagtctgccatggtccag

SEQ ID NO: 260449 - DNA, 20 bp, Artificial Sequence
  chemically synthesized
cattgaaaacttctggacca

SEQ ID NO: 260450 - DNA, 20 bp, Artificial Sequence
  chemically synthesized
aatgccagtctgccatggtc

SEQ ID NO: 260451 - DNA, 20 bp, Artificial Sequence
  chemically synthesized
tgaaaacttctggaccatgg

SEQ ID NO: 260452 - DNA, 20 bp, Artificial Sequence
  chemically synthesized
atcctaatgccagtctgcca

SEQ ID NO: 260453 - DNA, 20 bp, Artificial Sequence
  chemically synthesized
acttctggaccatggcagac

SEQ ID NO: 260454 - DNA, 20 bp, Artificial Sequence
  chemically synthesized
ggaccatggcagactggcat

SEQ ID NO: 260455 - DNA, 20 bp, Artificial Sequence
  chemically synthesized
gaccatggcagactggcatt

SEQ ID NO: 260456 - DNA, 20 bp, Artificial Sequence
  chemically synthesized
tgtcagtggtatcctaatgc

SEQ ID NO: 260457 - DNA, 20 bp, Artificial Sequence
  chemically synthesized
gttctgtatttttatgtcag

SEQ ID NO: 260458 - DNA, 20 bp, Artificial Sequence
  chemically synthesized
gttgttctgtatttttatgt

SEQ ID NO: 260459 - DNA, 20 bp, Artificial Sequence
  chemically synthesized
ataccactgacataaaaata

SEQ ID NO: 260460 - DNA, 20 bp, Artificial Sequence
  chemically synthesized
aatccctgcagtttcagagt

SEQ ID NO: 260461 - DNA, 20 bp, Artificial Sequence
  chemically synthesized
tggaaatccctgcagtttca

SEQ ID NO: 260462 - DNA, 20 bp, Artificial Sequence
  chemically synthesized
aacaaccaactctgaaactg

SEQ ID NO: 260463 - DNA, 20 bp, Artificial Sequence
  chemically synthesized
acaaccaactctgaaactgc

SEQ ID NO: 260464 - DNA, 20 bp, Artificial Sequence
  chemically synthesized
tgtggaaatccctgcagttt

SEQ ID NO: 260465 - DNA, 20 bp, Artificial Sequence
  chemically synthesized
caaccaactctgaaactgca

SEQ ID NO: 260466 - DNA, 20 bp, Artificial Sequence
  chemically synthesized
tcttcctgtggaaatccctg

SEQ ID NO: 260467 - DNA, 20 bp, Artificial Sequence
  chemically synthesized
tgaaactgcagggatttcca

SEQ ID NO: 260468 - DNA, 20 bp, Artificial Sequence
  chemically synthesized
gaaactgcagggatttccac

SEQ ID NO: 260469 - DNA, 20 bp, Artificial Sequence
  chemically synthesized
actgcagggatttccacagg

SEQ ID NO: 260470 - DNA, 20 bp, Artificial Sequence
  chemically synthesized
gaatgtataacatcttcctg

SEQ ID NO: 260471 - DNA, 20 bp, Artificial Sequence
  chemically synthesized
aggtatttaatgaaagtatg

SEQ ID NO: 260472 - DNA, 20 bp, Artificial Sequence
  chemically synthesized
acagagcaggtatttaatga

SEQ ID NO: 260473 - DNA, 20 bp, Artificial Sequence
  chemically synthesized
catagagtctatcacagagc

SEQ ID NO: 260474 - DNA, 20 bp, Artificial Sequence
  chemically synthesized
acatagagtctatcacagag

SEQ ID NO: 260475 - DNA, 20 bp, Artificial Sequence
  chemically synthesized
attaaatacctgctctgtga

SEQ ID NO: 260476 - DNA, 20 bp, Artificial Sequence
  chemically synthesized
aagacatagagtctatcaca

SEQ ID NO: 260477 - DNA, 20 bp, Artificial Sequence
  chemically synthesized
ccaagacatagagtctatca

SEQ ID NO: 260478 - DNA, 20 bp, Artificial Sequence
  chemically synthesized
ctgtgatagactctatgtct

SEQ ID NO: 260479 - DNA, 20 bp, Artificial Sequence
  chemically synthesized
cactgtttccccaagacata

SEQ ID NO: 260480 - DNA, 20 bp, Artificial Sequence
  chemically synthesized
tgtgatagactctatgtctt

SEQ ID NO: 260481 - DNA, 20 bp, Artificial Sequence
  chemically synthesized
gtgatagactctatgtcttg

SEQ ID NO: 260482 - DNA, 20 bp, Artificial Sequence
  chemically synthesized
gtcactgtttccccaagaca

SEQ ID NO: 260483 - DNA, 20 bp, Artificial Sequence
  chemically synthesized
gactctatgtcttggggaaa

SEQ ID NO: 260484 - DNA, 20 bp, Artificial Sequence
  chemically synthesized
ttgttagtcactgtttcccc

SEQ ID NO: 260485 - DNA, 20 bp, Artificial Sequence
  chemically synthesized
ttggggaaacagtgactaac

SEQ ID NO: 260486 - DNA, 20 bp, Artificial Sequence
  chemically synthesized
ggaaacagtgactaacaaga

SEQ ID NO: 260487 - DNA, 20 bp, Artificial Sequence
  chemically synthesized
aggagcctattctatcttgt

SEQ ID NO: 260488 - DNA, 20 bp, Artificial Sequence
  chemically synthesized
cagtgactaacaagatagaa

SEQ ID NO: 260489 - DNA, 20 bp, Artificial Sequence
  chemically synthesized
agtgactaacaagatagaat

SEQ ID NO: 260490 - DNA, 20 bp, Artificial Sequence
  chemically synthesized
tgtaggcttgatgaagtcag

SEQ ID NO: 260491 - DNA, 20 bp, Artificial Sequence
  chemically synthesized
aatgtaggcttgatgaagtc

SEQ ID NO: 260492 - DNA, 20 bp, Artificial Sequence
  chemically synthesized
gaatgtaggcttgatgaagt

SEQ ID NO: 260493 - DNA, 20 bp, Artificial Sequence
  chemically synthesized
aataggctcctgacttcatc

SEQ ID NO: 260494 - DNA, 20 bp, Artificial Sequence
  chemically synthesized
attagaatgtaggcttgatg

SEQ ID NO: 260495 - DNA, 20 bp, Artificial Sequence
  chemically synthesized
gtctgctatcattagaatgt

SEQ ID NO: 260496 - DNA, 20 bp, Artificial Sequence
  chemically synthesized
tgtctgctatcattagaatg

SEQ ID NO: 260497 - DNA, 20 bp, Artificial Sequence
  chemically synthesized
tcaagcctacattctaatga

SEQ ID NO: 260498 - DNA, 20 bp, Artificial Sequence
  chemically synthesized
agcctacattctaatgatag

SEQ ID NO: 260499 - DNA, 20 bp, Artificial Sequence
  chemically synthesized
tataatttgtctgctatcat

SEQ ID NO: 260500 - DNA, 20 bp, Artificial Sequence
  chemically synthesized
atagcagacaaattataaac

SEQ ID NO: 260501 - DNA, 20 bp, Artificial Sequence
  chemically synthesized
tataaacaagtaaacatgca

SEQ ID NO: 260502 - DNA, 20 bp, Artificial Sequence
  chemically synthesized
ataaacaagtaaacatgcaa

SEQ ID NO: 260503 - DNA, 20 bp, Artificial Sequence
  chemically synthesized
acatgcaaaggtaacatttg

SEQ ID NO: 260504 - DNA, 20 bp, Artificial Sequence
  chemically synthesized
aaggtaacatttgcagattg

SEQ ID NO: 260505 - DNA, 20 bp, Artificial Sequence
  chemically synthesized
ttgcagattgcagtaaatat

SEQ ID NO: 260506 - DNA, 20 bp, Artificial Sequence
  chemically synthesized
cagattgcagtaaatattag

SEQ ID NO: 260507 - DNA, 20 bp, Artificial Sequence
  chemically synthesized
agattgcagtaaatattaga

SEQ ID NO: 260508 - DNA, 20 bp, Artificial Sequence
  chemically synthesized
gattgcagtaaatattagaa

SEQ ID NO: 260509 - DNA, 20 bp, Artificial Sequence
  chemically synthesized
aatattagaagggaaacgtc

SEQ ID NO: 260510 - DNA, 20 bp, Artificial Sequence
  chemically synthesized
tcatgctctagaacatcagc

SEQ ID NO: 260511 - DNA, 20 bp, Artificial Sequence
  chemically synthesized
gaaacgtctagctgatgttc

SEQ ID NO: 260512 - DNA, 20 bp, Artificial Sequence
  chemically synthesized
accatcatgctctagaacat

SEQ ID NO: 260513 - DNA, 20 bp, Artificial Sequence
  chemically synthesized
aacgtctagctgatgttcta

SEQ ID NO: 260514 - DNA, 20 bp, Artificial Sequence
  chemically synthesized
ctatccttaccatcatgctc

SEQ ID NO: 260515 - DNA, 20 bp, Artificial Sequence
  chemically synthesized
gctgatgttctagagcatga

SEQ ID NO: 260516 - DNA, 20 bp, Artificial Sequence
  chemically synthesized
atgttctagagcatgatggt

SEQ ID NO: 260517 - DNA, 20 bp, Artificial Sequence
  chemically synthesized
tgttctagagcatgatggta

SEQ ID NO: 260518 - DNA, 20 bp, Artificial Sequence
  chemically synthesized
ctagagcatgatggtaagga

SEQ ID NO: 260519 - DNA, 20 bp, Artificial Sequence
  chemically synthesized
gcatgatggtaaggatagaa

SEQ ID NO: 260520 - DNA, 20 bp, Artificial Sequence
  chemically synthesized
tggtaaggatagaatggatg

SEQ ID NO: 260521 - DNA, 20 bp, Artificial Sequence
  chemically synthesized
atgtggcgaacgacataaaa

SEQ ID NO: 260522 - DNA, 20 bp, Artificial Sequence
  chemically synthesized
tgtggcgaacgacataaaat

SEQ ID NO: 260523 - DNA, 20 bp, Artificial Sequence
  chemically synthesized
cgacataaaataggttgtcg

SEQ ID NO: 260524 - DNA, 20 bp, Artificial Sequence
  chemically synthesized
gacataaaataggttgtcga

SEQ ID NO: 260525 - DNA, 20 bp, Artificial Sequence
  chemically synthesized
ataaaataggttgtcgaagg

SEQ ID NO: 260526 - DNA, 20 bp, Artificial Sequence
  chemically synthesized
taaaataggttgtcgaaggc

SEQ ID NO: 260527 - DNA, 20 bp, Artificial Sequence
  chemically synthesized
tgtcgaaggcaggccacctg

SEQ ID NO: 260528 - DNA, 20 bp, Artificial Sequence
  chemically synthesized
tcgaaggcaggccacctgtg

SEQ ID NO: 260529 - DNA, 20 bp, Artificial Sequence
  chemically synthesized
gtgaacattatctccacagg

SEQ ID NO: 260530 - DNA, 20 bp, Artificial Sequence
  chemically synthesized
agagtgaacattatctccac

SEQ ID NO: 260531 - DNA, 20 bp, Artificial Sequence
  chemically synthesized
cagagtgaacattatctcca

SEQ ID NO: 260532 - DNA, 20 bp, Artificial Sequence
  chemically synthesized
ccgtcacattgcaggatgca

SEQ ID NO: 260533 - DNA, 20 bp, Artificial Sequence
  chemically synthesized
tcccgtcacattgcaggatg

SEQ ID NO: 260534 - DNA, 20 bp, Artificial Sequence
  chemically synthesized
ctggtctcccgtcacattgc

SEQ ID NO: 260535 - DNA, 20 bp, Artificial Sequence
  chemically synthesized
gctggtctcccgtcacattg

SEQ ID NO: 260536 - DNA, 20 bp, Artificial Sequence
  chemically synthesized
ctctgcatcctgcaatgtga

SEQ ID NO: 260537 - DNA, 20 bp, Artificial Sequence
  chemically synthesized
tctgcatcctgcaatgtgac

SEQ ID NO: 260538 - DNA, 20 bp, Artificial Sequence
  chemically synthesized
tgcatcctgcaatgtgacgg

SEQ ID NO: 260539 - DNA, 20 bp, Artificial Sequence
  chemically synthesized
cctgcaatgtgacgggagac

SEQ ID NO: 260540 - DNA, 20 bp, Artificial Sequence
  chemically synthesized
caatgtgacgggagaccagc

SEQ ID NO: 260541 - DNA, 20 bp, Artificial Sequence
  chemically synthesized
aatgtgacgggagaccagca

SEQ ID NO: 260542 - DNA, 20 bp, Artificial Sequence
  chemically synthesized
atttctggatatttccttgc

SEQ ID NO: 260543 - DNA, 20 bp, Artificial Sequence
  chemically synthesized
gagaccagcaaggaaatatc

SEQ ID NO: 260544 - DNA, 20 bp, Artificial Sequence
  chemically synthesized
agcaaggaaatatccagaaa

SEQ ID NO: 260545 - DNA, 20 bp, Artificial Sequence
  chemically synthesized
caaggaaatatccagaaata

SEQ ID NO: 260546 - DNA, 20 bp, Artificial Sequence
  chemically synthesized
aaggaaatatccagaaatag

SEQ ID NO: 260547 - DNA, 20 bp, Artificial Sequence
  chemically synthesized
ttgacttgggcctctatttc

SEQ ID NO: 260548 - DNA, 20 bp, Artificial Sequence
  chemically synthesized
atatccagaaatagaggccc

SEQ ID NO: 260549 - DNA, 20 bp, Artificial Sequence
  chemically synthesized
agaaatagaggcccaagtca

SEQ ID NO: 260550 - DNA, 20 bp, Artificial Sequence
  chemically synthesized
gaaatagaggcccaagtcaa

SEQ ID NO: 260551 - DNA, 20 bp, Artificial Sequence
  chemically synthesized
aattatgtttcctttgactt

SEQ ID NO: 260552 - DNA, 20 bp, Artificial Sequence
  chemically synthesized
caattatgtttcctttgact

SEQ ID NO: 260553 - DNA, 20 bp, Artificial Sequence
  chemically synthesized
aaacataattgcaatgacct

SEQ ID NO: 260554 - DNA, 20 bp, Artificial Sequence
  chemically synthesized
aacataattgcaatgacctg

SEQ ID NO: 260555 - DNA, 20 bp, Artificial Sequence
  chemically synthesized
ataattgcaatgacctgagg

SEQ ID NO: 260556 - DNA, 20 bp, Artificial Sequence
  chemically synthesized
attgcaatgacctgaggtag

SEQ ID NO: 260557 - DNA, 20 bp, Artificial Sequence
  chemically synthesized
gccaagatgtcttctacctc

SEQ ID NO: 260558 - DNA, 20 bp, Artificial Sequence
  chemically synthesized
tgccaagatgtcttctacct

SEQ ID NO: 260559 - DNA, 20 bp, Artificial Sequence
  chemically synthesized
acctgaggtagaagacatct

SEQ ID NO: 260560 - DNA, 20 bp, Artificial Sequence
  chemically synthesized
gaggtagaagacatcttggc

SEQ ID NO: 260561 - DNA, 20 bp, Artificial Sequence
  chemically synthesized
tcctcttctttaaacttgcc

SEQ ID NO: 260562 - DNA, 20 bp, Artificial Sequence
  chemically synthesized
aagacatcttggcaagttta

SEQ ID NO: 260563 - DNA, 20 bp, Artificial Sequence
  chemically synthesized
acatcttggcaagtttaaag

SEQ ID NO: 260564 - DNA, 20 bp, Artificial Sequence
  chemically synthesized
atcttggcaagtttaaagaa

SEQ ID NO: 260565 - DNA, 20 bp, Artificial Sequence
  chemically synthesized
tcttggcaagtttaaagaag

SEQ ID NO: 260566 - DNA, 20 bp, Artificial Sequence
  chemically synthesized
ttggcaagtttaaagaagag

SEQ ID NO: 260567 - DNA, 20 bp, Artificial Sequence
  chemically synthesized
tggcaagtttaaagaagagg

SEQ ID NO: 260568 - DNA, 20 bp, Artificial Sequence
  chemically synthesized
ggcaagtttaaagaagagga

SEQ ID NO: 260569 - DNA, 20 bp, Artificial Sequence
  chemically synthesized
taaagaagaggagggctttg

SEQ ID NO: 260570 - DNA, 20 bp, Artificial Sequence
  chemically synthesized
agaagaggagggctttgtag

SEQ ID NO: 260571 - DNA, 20 bp, Artificial Sequence
  chemically synthesized
ggtctctttaatctgctaca

SEQ ID NO: 260572 - DNA, 20 bp, Artificial Sequence
  chemically synthesized
gagggctttgtagcagatta

SEQ ID NO: 260573 - DNA, 20 bp, Artificial Sequence
  chemically synthesized
gggctttgtagcagattaaa

SEQ ID NO: 260574 - DNA, 20 bp, Artificial Sequence
  chemically synthesized
ttggcctccctaatgggaaa

SEQ ID NO: 260575 - DNA, 20 bp, Artificial Sequence
  chemically synthesized
ttaaagagaccctttcccat

SEQ ID NO: 260576 - DNA, 20 bp, Artificial Sequence
  chemically synthesized
attggcctccctaatgggaa

SEQ ID NO: 260577 - DNA, 20 bp, Artificial Sequence
  chemically synthesized
taaagagaccctttcccatt

SEQ ID NO: 260578 - DNA, 20 bp, Artificial Sequence
  chemically synthesized
tattggcctccctaatggga

SEQ ID NO: 260579 - DNA, 20 bp, Artificial Sequence
  chemically synthesized
aaagagaccctttcccatta

SEQ ID NO: 260580 - DNA, 20 bp, Artificial Sequence
  chemically synthesized
agagaccctttcccattagg

SEQ ID NO: 260581 - DNA, 20 bp, Artificial Sequence
  chemically synthesized
gagaccctttcccattaggg

SEQ ID NO: 260582 - DNA, 20 bp, Artificial Sequence
  chemically synthesized
catatattggcctccctaat

SEQ ID NO: 260583 - DNA, 20 bp, Artificial Sequence
  chemically synthesized
tcatatattggcctccctaa

SEQ ID NO: 260584 - DNA, 20 bp, Artificial Sequence
  chemically synthesized
attagggaggccaatatatg

SEQ ID NO: 260585 - DNA, 20 bp, Artificial Sequence
  chemically synthesized
atctagtcctcttcatatat

SEQ ID NO: 260586 - DNA, 20 bp, Artificial Sequence
  chemically synthesized
tagggaggccaatatatgaa

SEQ ID NO: 260587 - DNA, 20 bp, Artificial Sequence
  chemically synthesized
agggaggccaatatatgaag

SEQ ID NO: 260588 - DNA, 20 bp, Artificial Sequence
  chemically synthesized
ggccaatatatgaagaggac

SEQ ID NO: 260589 - DNA, 20 bp, Artificial Sequence
  chemically synthesized
atgtggaaaattaagagatc

SEQ ID NO: 260590 - DNA, 20 bp, Artificial Sequence
  chemically synthesized
tttcatatgtggaaaattaa

SEQ ID NO: 260591 - DNA, 20 bp, Artificial Sequence
  chemically synthesized
tatttcatatgtggaaaatt

SEQ ID NO: 260592 - DNA, 20 bp, Artificial Sequence
  chemically synthesized
acactcgagtatttcatatg

SEQ ID NO: 260593 - DNA, 20 bp, Artificial Sequence
  chemically synthesized
tttccacatatgaaatactc

SEQ ID NO: 260594 - DNA, 20 bp, Artificial Sequence
  chemically synthesized
cttgcttcgtagatacactc

SEQ ID NO: 260595 - DNA, 20 bp, Artificial Sequence
  chemically synthesized
aatactcgagtgtatctacg

SEQ ID NO: 260596 - DNA, 20 bp, Artificial Sequence
  chemically synthesized
ctcgagtgtatctacgaagc

SEQ ID NO: 260597 - DNA, 20 bp, Artificial Sequence
  chemically synthesized
tattttcatttcttgcttcg

SEQ ID NO: 260598 - DNA, 20 bp, Artificial Sequence
  chemically synthesized
cgaagcaagaaatgaaaata

SEQ ID NO: 260599 - DNA, 20 bp, Artificial Sequence
  chemically synthesized
acatgaaacatgaataatat

SEQ ID NO: 260600 - DNA, 20 bp, Artificial Sequence
  chemically synthesized
catgtgtgtttatgattgtc

SEQ ID NO: 260601 - DNA, 20 bp, Artificial Sequence
  chemically synthesized
tgtgttaactggttagtatc

SEQ ID NO: 260602 - DNA, 20 bp, Artificial Sequence
  chemically synthesized
atgattgtctagatactaac

SEQ ID NO: 260603 - DNA, 20 bp, Artificial Sequence
  chemically synthesized
ctcaaaatgtgttaactggt

SEQ ID NO: 260604 - DNA, 20 bp, Artificial Sequence
  chemically synthesized
aaagctcaaaatgtgttaac

SEQ ID NO: 260605 - DNA, 20 bp, Artificial Sequence
  chemically synthesized
ctaaccagttaacacatttt

SEQ ID NO: 260606 - DNA, 20 bp, Artificial Sequence
  chemically synthesized
aacacattttgagctttata

SEQ ID NO: 260607 - DNA, 20 bp, Artificial Sequence
  chemically synthesized
acacattttgagctttatac

SEQ ID NO: 260608 - DNA, 20 bp, Artificial Sequence
  chemically synthesized
ctccatctgtgacccgtata

SEQ ID NO: 260609 - DNA, 20 bp, Artificial Sequence
  chemically synthesized
tttgagctttatacgggtca

SEQ ID NO: 260610 - DNA, 20 bp, Artificial Sequence
  chemically synthesized
agctttatacgggtcacaga

SEQ ID NO: 260611 - DNA, 20 bp, Artificial Sequence
  chemically synthesized
ctttatacgggtcacagatg

SEQ ID NO: 260612 - DNA, 20 bp, Artificial Sequence
  chemically synthesized
acagatggagttatatgtta

SEQ ID NO: 260613 - DNA, 20 bp, Artificial Sequence
  chemically synthesized
ttatagataactgtatttgt

SEQ ID NO: 260614 - DNA, 20 bp, Artificial Sequence
  chemically synthesized
aatgaattacctaacaaata

SEQ ID NO: 260615 - DNA, 20 bp, Artificial Sequence
  chemically synthesized
tatagataactgtatttgtt

SEQ ID NO: 260616 - DNA, 20 bp, Artificial Sequence
  chemically synthesized
ttcatttatttttcatcacc

SEQ ID NO: 260617 - DNA, 20 bp, Artificial Sequence
  chemically synthesized
tttatttttcatcacccaga

SEQ ID NO: 260618 - DNA, 20 bp, Artificial Sequence
  chemically synthesized
tcttagttaatagactatct

SEQ ID NO: 260619 - DNA, 20 bp, Artificial Sequence
  chemically synthesized
ttcttagttaatagactatc

SEQ ID NO: 260620 - DNA, 20 bp, Artificial Sequence
  chemically synthesized
acccagatagtctattaact

SEQ ID NO: 260621 - DNA, 20 bp, Artificial Sequence
  chemically synthesized
attagtgctttcttagttaa

SEQ ID NO: 260622 - DNA, 20 bp, Artificial Sequence
  chemically synthesized
agatagtctattaactaaga

SEQ ID NO: 260623 - DNA, 20 bp, Artificial Sequence
  chemically synthesized
cataataattagtgctttct

SEQ ID NO: 260624 - DNA, 20 bp, Artificial Sequence
  chemically synthesized
taagaaagcactaattatta

SEQ ID NO: 260625 - DNA, 20 bp, Artificial Sequence
  chemically synthesized
ccataattttccataataat

SEQ ID NO: 260626 - DNA, 20 bp, Artificial Sequence
  chemically synthesized
ctaattattatggaaaatta

SEQ ID NO: 260627 - DNA, 20 bp, Artificial Sequence
  chemically synthesized
atggaaaattatggaccttc

SEQ ID NO: 260628 - DNA, 20 bp, Artificial Sequence
  chemically synthesized
taactggggaaagttccaga

SEQ ID NO: 260629 - DNA, 20 bp, Artificial Sequence
  chemically synthesized
ttaactggggaaagttccag

SEQ ID NO: 260630 - DNA, 20 bp, Artificial Sequence
  chemically synthesized
aaattaactggggaaagttc

SEQ ID NO: 260631 - DNA, 20 bp, Artificial Sequence
  chemically synthesized
ggaccttctggaactttccc

SEQ ID NO: 260632 - DNA, 20 bp, Artificial Sequence
  chemically synthesized
cagaataaattaactgggga

SEQ ID NO: 260633 - DNA, 20 bp, Artificial Sequence
  chemically synthesized
tcgccagaataaattaactg

SEQ ID NO: 260634 - DNA, 20 bp, Artificial Sequence
  chemically synthesized
ctcgccagaataaattaact

SEQ ID NO: 260635 - DNA, 20 bp, Artificial Sequence
  chemically synthesized
tctcgccagaataaattaac

SEQ ID NO: 260636 - DNA, 20 bp, Artificial Sequence
  chemically synthesized
tttccccagttaatttattc

SEQ ID NO: 260637 - DNA, 20 bp, Artificial Sequence
  chemically synthesized
cccagttaatttattctggc

SEQ ID NO: 260638 - DNA, 20 bp, Artificial Sequence
  chemically synthesized
agttaatttattctggcgag

SEQ ID NO: 260639 - DNA, 20 bp, Artificial Sequence
  chemically synthesized
agtgcatgggcacttctcgc

SEQ ID NO: 260640 - DNA, 20 bp, Artificial Sequence
  chemically synthesized
ttttctggatatcagtgcat

SEQ ID NO: 260641 - DNA, 20 bp, Artificial Sequence
  chemically synthesized
tttttctggatatcagtgca

SEQ ID NO: 260642 - DNA, 20 bp, Artificial Sequence
  chemically synthesized
agtgcccatgcactgatatc

SEQ ID NO: 260643 - DNA, 20 bp, Artificial Sequence
  chemically synthesized
ttaactgtttttctggatat

SEQ ID NO: 260644 - DNA, 20 bp, Artificial Sequence
  chemically synthesized
tgcactgatatccagaaaaa

SEQ ID NO: 260645 - DNA, 20 bp, Artificial Sequence
  chemically synthesized
ggcattgttaactgtttttc

SEQ ID NO: 260646 - DNA, 20 bp, Artificial Sequence
  chemically synthesized
aagatgttcagataatttgg

SEQ ID NO: 260647 - DNA, 20 bp, Artificial Sequence
  chemically synthesized
taagatgttcagataatttg

SEQ ID NO: 260648 - DNA, 20 bp, Artificial Sequence
  chemically synthesized
cttaagatgttcagataatt

SEQ ID NO: 260649 - DNA, 20 bp, Artificial Sequence
  chemically synthesized
ctgtacaaacttaagatgtt

SEQ ID NO: 260650 - DNA, 20 bp, Artificial Sequence
  chemically synthesized
ccaaattatctgaacatctt

SEQ ID NO: 260651 - DNA, 20 bp, Artificial Sequence
  chemically synthesized
gcccatatctgtacaaactt

SEQ ID NO: 260652 - DNA, 20 bp, Artificial Sequence
  chemically synthesized
ctgaacatcttaagtttgta

SEQ ID NO: 260653 - DNA, 20 bp, Artificial Sequence
  chemically synthesized
atcttaagtttgtacagata

SEQ ID NO: 260654 - DNA, 20 bp, Artificial Sequence
  chemically synthesized
tcttaagtttgtacagatat

SEQ ID NO: 260655 - DNA, 20 bp, Artificial Sequence
  chemically synthesized
tttgtacagatatgggcact

SEQ ID NO: 260656 - DNA, 20 bp, Artificial Sequence
  chemically synthesized
gcatggattaaatataatcc

SEQ ID NO: 260657 - DNA, 20 bp, Artificial Sequence
  chemically synthesized
atccatggatgaaagatgca

SEQ ID NO: 260658 - DNA, 20 bp, Artificial Sequence
  chemically synthesized
atccatgcatctttcatcca

SEQ ID NO: 260659 - DNA, 20 bp, Artificial Sequence
  chemically synthesized
ggtgactaatccatggatga

SEQ ID NO: 260660 - DNA, 20 bp, Artificial Sequence
  chemically synthesized
tgcatctttcatccatggat

SEQ ID NO: 260661 - DNA, 20 bp, Artificial Sequence
  chemically synthesized
atttagtggtgactaatcca

SEQ ID NO: 260662 - DNA, 20 bp, Artificial Sequence
  chemically synthesized
ggattagtcaccactaaata

SEQ ID NO: 260663 - DNA, 20 bp, Artificial Sequence
  chemically synthesized
cagaggaaagctatatttag

SEQ ID NO: 260664 - DNA, 20 bp, Artificial Sequence
  chemically synthesized
aaacagaggaaagctatatt

SEQ ID NO: 260665 - DNA, 20 bp, Artificial Sequence
  chemically synthesized
aacgcatgtaaaacagagga

SEQ ID NO: 260666 - DNA, 20 bp, Artificial Sequence
  chemically synthesized
ttttaacgcatgtaaaacag

SEQ ID NO: 260667 - DNA, 20 bp, Artificial Sequence
  chemically synthesized
attttaacgcatgtaaaaca

SEQ ID NO: 260668 - DNA, 20 bp, Artificial Sequence
  chemically synthesized
ctattttaacgcatgtaaaa

SEQ ID NO: 260669 - DNA, 20 bp, Artificial Sequence
  chemically synthesized
ctgttttacatgcgttaaaa

SEQ ID NO: 260670 - DNA, 20 bp, Artificial Sequence
  chemically synthesized
catgcgttaaaatagctatt

SEQ ID NO: 260671 - DNA, 20 bp, Artificial Sequence
  chemically synthesized
atgcgttaaaatagctattt

SEQ ID NO: 260672 - DNA, 20 bp, Artificial Sequence
  chemically synthesized
cagtttttaaaattcctaaa

SEQ ID NO: 260673 - DNA, 20 bp, Artificial Sequence
  chemically synthesized
ccatatgctataatcatgag

SEQ ID NO: 260674 - DNA, 20 bp, Artificial Sequence
  chemically synthesized
ttaaaaactgctcatgatta

SEQ ID NO: 260675 - DNA, 20 bp, Artificial Sequence
  chemically synthesized
gcaccatatgctataatcat

SEQ ID NO: 260676 - DNA, 20 bp, Artificial Sequence
  chemically synthesized
ctgctcatgattatagcata

SEQ ID NO: 260677 - DNA, 20 bp, Artificial Sequence
  chemically synthesized
tagcatatggtgctaaattt

SEQ ID NO: 260678 - DNA, 20 bp, Artificial Sequence
  chemically synthesized
attgattgcattctcaaatt

SEQ ID NO: 260679 - DNA, 20 bp, Artificial Sequence
  chemically synthesized
atttgagaatgcaatcaatt

SEQ ID NO: 260680 - DNA, 20 bp, Artificial Sequence
  chemically synthesized
aatcaattcggacttccatt

SEQ ID NO: 260681 - DNA, 20 bp, Artificial Sequence
  chemically synthesized
cagccaagagaactaaatgg

SEQ ID NO: 260682 - DNA, 20 bp, Artificial Sequence
  chemically synthesized
taacagccaagagaactaaa

SEQ ID NO: 260683 - DNA, 20 bp, Artificial Sequence
  chemically synthesized
ggacttccatttagttctct

SEQ ID NO: 260684 - DNA, 20 bp, Artificial Sequence
  chemically synthesized
acccatttagtaacagccaa

SEQ ID NO: 260685 - DNA, 20 bp, Artificial Sequence
  chemically synthesized
gcacccatttagtaacagcc

SEQ ID NO: 260686 - DNA, 20 bp, Artificial Sequence
  chemically synthesized
gtttagcacccatttagtaa

SEQ ID NO: 260687 - DNA, 20 bp, Artificial Sequence
  chemically synthesized
ttctcttggctgttactaaa

SEQ ID NO: 260688 - DNA, 20 bp, Artificial Sequence
  chemically synthesized
tctcttggctgttactaaat

SEQ ID NO: 260689 - DNA, 20 bp, Artificial Sequence
  chemically synthesized
agtatagtttagcacccatt

SEQ ID NO: 260690 - DNA, 20 bp, Artificial Sequence
  chemically synthesized
ttaatcttttgagtatagtt

SEQ ID NO: 260691 - DNA, 20 bp, Artificial Sequence
  chemically synthesized
gggtgctaaactatactcaa

SEQ ID NO: 260692 - DNA, 20 bp, Artificial Sequence
  chemically synthesized
tttatttaatcttttgagta

SEQ ID NO: 260693 - DNA, 20 bp, Artificial Sequence
  chemically synthesized
taccctttatttaatctttt

SEQ ID NO: 260694 - DNA, 20 bp, Artificial Sequence
  chemically synthesized
tatactcaaaagattaaata

SEQ ID NO: 260695 - DNA, 20 bp, Artificial Sequence
  chemically synthesized
atactcaaaagattaaataa

SEQ ID NO: 260696 - DNA, 20 bp, Artificial Sequence
  chemically synthesized
tactcaaaagattaaataaa

SEQ ID NO: 260697 - DNA, 20 bp, Artificial Sequence
  chemically synthesized
taaataaagggtaaaaatga

SEQ ID NO: 260698 - DNA, 20 bp, Artificial Sequence
  chemically synthesized
aaaaatgatagaatgttttt

SEQ ID NO: 260699 - DNA, 20 bp, Artificial Sequence
  chemically synthesized
caaaattatgttataacatc

SEQ ID NO: 260700 - DNA, 20 bp, Artificial Sequence
  chemically synthesized
aaaattatgttataacatca

SEQ ID NO: 260701 - DNA, 20 bp, Artificial Sequence
  chemically synthesized
atgaataatacaaattcaca

SEQ ID NO: 260702 - DNA, 20 bp, Artificial Sequence
  chemically synthesized
attaaggtttgtttaaaatt

SEQ ID NO: 260703 - DNA, 20 bp, Artificial Sequence
  chemically synthesized
agttgcttttgaaataatta

SEQ ID NO: 260704 - DNA, 20 bp, Artificial Sequence
  chemically synthesized
cagttgcttttgaaataatt

SEQ ID NO: 260705 - DNA, 20 bp, Artificial Sequence
  chemically synthesized
acaaaccttaattatttcaa

SEQ ID NO: 260706 - DNA, 20 bp, Artificial Sequence
  chemically synthesized
ttaattatttcaaaagcaac

SEQ ID NO: 260707 - DNA, 20 bp, Artificial Sequence
  chemically synthesized
tcaaaagcaactggatcata

SEQ ID NO: 260708 - DNA, 20 bp, Artificial Sequence
  chemically synthesized
tcctgccctcctttatgatc

SEQ ID NO: 260709 - DNA, 20 bp, Artificial Sequence
  chemically synthesized
caaaagcaactggatcataa

SEQ ID NO: 260710 - DNA, 20 bp, Artificial Sequence
  chemically synthesized
aaagcaactggatcataaag

SEQ ID NO: 260711 - DNA, 20 bp, Artificial Sequence
  chemically synthesized
aagcaactggatcataaagg

SEQ ID NO: 260712 - DNA, 20 bp, Artificial Sequence
  chemically synthesized
agcaactggatcataaagga

SEQ ID NO: 260713 - DNA, 20 bp, Artificial Sequence
  chemically synthesized
aactggatcataaaggaggg

SEQ ID NO: 260714 - DNA, 20 bp, Artificial Sequence
  chemically synthesized
actggatcataaaggagggc

SEQ ID NO: 260715 - DNA, 20 bp, Artificial Sequence
  chemically synthesized
tggatcataaaggagggcag

SEQ ID NO: 260716 - DNA, 20 bp, Artificial Sequence
  chemically synthesized
aaggagggcaggagaattat

SEQ ID NO: 260717 - DNA, 20 bp, Artificial Sequence
  chemically synthesized
tataatattttcaagttggt

SEQ ID NO: 260718 - DNA, 20 bp, Artificial Sequence
  chemically synthesized
ggattataatattttcaagt

SEQ ID NO: 260719 - DNA, 20 bp, Artificial Sequence
  chemically synthesized
aaaaggattataatattttc

SEQ ID NO: 260720 - DNA, 20 bp, Artificial Sequence
  chemically synthesized
tttgattttcacaaaataaa

SEQ ID NO: 260721 - DNA, 20 bp, Artificial Sequence
  chemically synthesized
ctttgattttcacaaaataa

SEQ ID NO: 260722 - DNA, 20 bp, Artificial Sequence
  chemically synthesized
cttttattttgtgaaaatca

SEQ ID NO: 260723 - DNA, 20 bp, Artificial Sequence
  chemically synthesized
ttattttgtgaaaatcaaag

SEQ ID NO: 260724 - DNA, 20 bp, Artificial Sequence
  chemically synthesized
gaaaacaatatacacttgaa

SEQ ID NO: 260725 - DNA, 20 bp, Artificial Sequence
  chemically synthesized
cagatgaataaaatctattc

SEQ ID NO: 260726 - DNA, 20 bp, Artificial Sequence
  chemically synthesized
agattttattcatctgttct

SEQ ID NO: 260727 - DNA, 20 bp, Artificial Sequence
  chemically synthesized
tatggaacatattctgagaa

SEQ ID NO: 260728 - DNA, 20 bp, Artificial Sequence
  chemically synthesized
cattgtatggaacatattct

SEQ ID NO: 260729 - DNA, 20 bp, Artificial Sequence
  chemically synthesized
cagaatatgttccatacaat

SEQ ID NO: 260730 - DNA, 20 bp, Artificial Sequence
  chemically synthesized
tacttaagactctcattgta

SEQ ID NO: 260731 - DNA, 20 bp, Artificial Sequence
  chemically synthesized
gaatatgttccatacaatga

SEQ ID NO: 260732 - DNA, 20 bp, Artificial Sequence
  chemically synthesized
ttccatacaatgagagtctt

SEQ ID NO: 260733 - DNA, 20 bp, Artificial Sequence
  chemically synthesized
tgattcttcaatgattactt

SEQ ID NO: 260734 - DNA, 20 bp, Artificial Sequence
  chemically synthesized
agagtcttaagtaatcattg

SEQ ID NO: 260735 - DNA, 20 bp, Artificial Sequence
  chemically synthesized
ttaagtaatcattgaagaat

SEQ ID NO: 260736 - DNA, 20 bp, Artificial Sequence
  chemically synthesized
tgaagaatcagaatgattca

SEQ ID NO: 260737 - DNA, 20 bp, Artificial Sequence
  chemically synthesized
gaatcagaatgattcacaga

SEQ ID NO: 260738 - DNA, 20 bp, Artificial Sequence
  chemically synthesized
gaatgattcacagatggtgc

SEQ ID NO: 260739 - DNA, 20 bp, Artificial Sequence
  chemically synthesized
gtgatttaattatttttaac

SEQ ID NO: 260740 - DNA, 20 bp, Artificial Sequence
  chemically synthesized
ttatttttaaccagttgttc

SEQ ID NO: 260741 - DNA, 20 bp, Artificial Sequence
  chemically synthesized
ctgagcatgtccagaacaac

SEQ ID NO: 260742 - DNA, 20 bp, Artificial Sequence
  chemically synthesized
aatatccttctgagcatgtc

SEQ ID NO: 260743 - DNA, 20 bp, Artificial Sequence
  chemically synthesized
ccagttgttctggacatgct

SEQ ID NO: 260744 - DNA, 20 bp, Artificial Sequence
  chemically synthesized
gttgttctggacatgctcag

SEQ ID NO: 260745 - DNA, 20 bp, Artificial Sequence
  chemically synthesized
ttgttctggacatgctcaga

SEQ ID NO: 260746 - DNA, 20 bp, Artificial Sequence
  chemically synthesized
ggggttggaaatatccttct

SEQ ID NO: 260747 - DNA, 20 bp, Artificial Sequence
  chemically synthesized
gatggcttctgcagtggggt

SEQ ID NO: 260748 - DNA, 20 bp, Artificial Sequence
  chemically synthesized
ggatatttccaaccccactg

SEQ ID NO: 260749 - DNA, 20 bp, Artificial Sequence
  chemically synthesized
ctcagatggcttctgcagtg

SEQ ID NO: 260750 - DNA, 20 bp, Artificial Sequence
  chemically synthesized
tatttccaaccccactgcag

SEQ ID NO: 260751 - DNA, 20 bp, Artificial Sequence
  chemically synthesized
gctcagatggcttctgcagt

SEQ ID NO: 260752 - DNA, 20 bp, Artificial Sequence
  chemically synthesized
agctcagatggcttctgcag

SEQ ID NO: 260753 - DNA, 20 bp, Artificial Sequence
  chemically synthesized
gggagctcagatggcttctg

SEQ ID NO: 260754 - DNA, 20 bp, Artificial Sequence
  chemically synthesized
ccccactgcagaagccatct

SEQ ID NO: 260755 - DNA, 20 bp, Artificial Sequence
  chemically synthesized
cagctggaagggagctcaga

SEQ ID NO: 260756 - DNA, 20 bp, Artificial Sequence
  chemically synthesized
acaccagctggaagggagct

SEQ ID NO: 260757 - DNA, 20 bp, Artificial Sequence
  chemically synthesized
aagccatctgagctcccttc

SEQ ID NO: 260758 - DNA, 20 bp, Artificial Sequence
  chemically synthesized
atggaacaccagctggaagg

SEQ ID NO: 260759 - DNA, 20 bp, Artificial Sequence
  chemically synthesized
catctgagctcccttccagc

SEQ ID NO: 260760 - DNA, 20 bp, Artificial Sequence
  chemically synthesized
atatggaacaccagctggaa

SEQ ID NO: 260761 - DNA, 20 bp, Artificial Sequence
  chemically synthesized
aatatggaacaccagctgga

SEQ ID NO: 260762 - DNA, 20 bp, Artificial Sequence
  chemically synthesized
aaatatggaacaccagctgg

SEQ ID NO: 260763 - DNA, 20 bp, Artificial Sequence
  chemically synthesized
tgaaaatatggaacaccagc

SEQ ID NO: 260764 - DNA, 20 bp, Artificial Sequence
  chemically synthesized
gctttgaaaatatggaacac

SEQ ID NO: 260765 - DNA, 20 bp, Artificial Sequence
  chemically synthesized
ctaaatttgctttgaaaata

SEQ ID NO: 260766 - DNA, 20 bp, Artificial Sequence
  chemically synthesized
gctggtgttccatattttca

SEQ ID NO: 260767 - DNA, 20 bp, Artificial Sequence
  chemically synthesized
ccatattttcaaagcaaatt

SEQ ID NO: 260768 - DNA, 20 bp, Artificial Sequence
  chemically synthesized
ttttcaaagcaaatttagat

SEQ ID NO: 260769 - DNA, 20 bp, Artificial Sequence
  chemically synthesized
ttcaaagcaaatttagattg

SEQ ID NO: 260770 - DNA, 20 bp, Artificial Sequence
  chemically synthesized
gtttgcaacacaacaatata

SEQ ID NO: 260771 - DNA, 20 bp, Artificial Sequence
  chemically synthesized
ttatattgttgtgttgcaaa

SEQ ID NO: 260772 - DNA, 20 bp, Artificial Sequence
  chemically synthesized
atattgttgtgttgcaaacg

SEQ ID NO: 260773 - DNA, 20 bp, Artificial Sequence
  chemically synthesized
tattgttgtgttgcaaacgg

SEQ ID NO: 260774 - DNA, 20 bp, Artificial Sequence
  chemically synthesized
aaagaacaagaatttataca

SEQ ID NO: 260775 - DNA, 20 bp, Artificial Sequence
  chemically synthesized
caatgaagaaaaaaaagaac

SEQ ID NO: 260776 - DNA, 20 bp, Artificial Sequence
  chemically synthesized
ctcatacaatgaagaaaaaa

SEQ ID NO: 260777 - DNA, 20 bp, Artificial Sequence
  chemically synthesized
taaatataactcatacaatg

SEQ ID NO: 260778 - DNA, 20 bp, Artificial Sequence
  chemically synthesized
cttttttttcttcattgtat

SEQ ID NO: 260779 - DNA, 20 bp, Artificial Sequence
  chemically synthesized
aatccatagcaatcatacaa

SEQ ID NO: 260780 - DNA, 20 bp, Artificial Sequence
  chemically synthesized
cgtcttttgtatgattgcta

SEQ ID NO: 260781 - DNA, 20 bp, Artificial Sequence
  chemically synthesized
aaataccattggcaaatcca

SEQ ID NO: 260782 - DNA, 20 bp, Artificial Sequence
  chemically synthesized
gattgctatggatttgccaa

SEQ ID NO: 260783 - DNA, 20 bp, Artificial Sequence
  chemically synthesized
cacaaaacgtaaaataccat

SEQ ID NO: 260784 - DNA, 20 bp, Artificial Sequence
  chemically synthesized
attttacgttttgtgttgtc

SEQ ID NO: 260785 - DNA, 20 bp, Artificial Sequence
  chemically synthesized
gttttgtgttgtctggcact

SEQ ID NO: 260786 - DNA, 20 bp, Artificial Sequence
  chemically synthesized
ttttgtgttgtctggcactt

SEQ ID NO: 260787 - DNA, 20 bp, Artificial Sequence
  chemically synthesized
atctagtgcctcctaagtgc

SEQ ID NO: 260788 - DNA, 20 bp, Artificial Sequence
  chemically synthesized
ttgtgttgtctggcacttag

SEQ ID NO: 260789 - DNA, 20 bp, Artificial Sequence
  chemically synthesized
tgtgttgtctggcacttagg

SEQ ID NO: 260790 - DNA, 20 bp, Artificial Sequence
  chemically synthesized
acatttatctagtgcctcct

SEQ ID NO: 260791 - DNA, 20 bp, Artificial Sequence
  chemically synthesized
gtctggcacttaggaggcac

SEQ ID NO: 260792 - DNA, 20 bp, Artificial Sequence
  chemically synthesized
tcattgaataaacatttatc

SEQ ID NO: 260793 - DNA, 20 bp, Artificial Sequence
  chemically synthesized
gataaatgtttattcaatga

SEQ ID NO: 260794 - DNA, 20 bp, Artificial Sequence
  chemically synthesized
caatgaaagaaataccaatt

SEQ ID NO: 260795 - DNA, 20 bp, Artificial Sequence
  chemically synthesized
ttattttgaatacactgaat

SEQ ID NO: 260796 - DNA, 20 bp, Artificial Sequence
  chemically synthesized
gtgagtctagaaataaattc

SEQ ID NO: 260797 - DNA, 20 bp, Artificial Sequence
  chemically synthesized
ataaaacttgaatttatttc

SEQ ID NO: 260798 - DNA, 20 bp, Artificial Sequence
  chemically synthesized
ccatacacttagtgtgagtc

SEQ ID NO: 260799 - DNA, 20 bp, Artificial Sequence
  chemically synthesized
tttatttctagactcacact

SEQ ID NO: 260800 - DNA, 20 bp, Artificial Sequence
  chemically synthesized
taactccatacacttagtgt

SEQ ID NO: 260801 - DNA, 20 bp, Artificial Sequence
  chemically synthesized
ctagactcacactaagtgta

SEQ ID NO: 260802 - DNA, 20 bp, Artificial Sequence
  chemically synthesized
aaatggtaactccatacact

SEQ ID NO: 260803 - DNA, 20 bp, Artificial Sequence
  chemically synthesized
agactcacactaagtgtatg

SEQ ID NO: 260804 - DNA, 20 bp, Artificial Sequence
  chemically synthesized
atggtgaggatgcagttaaa

SEQ ID NO: 260805 - DNA, 20 bp, Artificial Sequence
  chemically synthesized
tcccaataatggtgaggatg

SEQ ID NO: 260806 - DNA, 20 bp, Artificial Sequence
  chemically synthesized
ggaacctcccaataatggtg

SEQ ID NO: 260807 - DNA, 20 bp, Artificial Sequence
  chemically synthesized
gggaacctcccaataatggt

SEQ ID NO: 260808 - DNA, 20 bp, Artificial Sequence
  chemically synthesized
aactgcatcctcaccattat

SEQ ID NO: 260809 - DNA, 20 bp, Artificial Sequence
  chemically synthesized
actgcatcctcaccattatt

SEQ ID NO: 260810 - DNA, 20 bp, Artificial Sequence
  chemically synthesized
tgcatcctcaccattattgg

SEQ ID NO: 260811 - DNA, 20 bp, Artificial Sequence
  chemically synthesized
taatgggaacctcccaataa

SEQ ID NO: 260812 - DNA, 20 bp, Artificial Sequence
  chemically synthesized
gcatcctcaccattattggg

SEQ ID NO: 260813 - DNA, 20 bp, Artificial Sequence
  chemically synthesized
tttttttgttcatttttaat

SEQ ID NO: 260814 - DNA, 20 bp, Artificial Sequence
  chemically synthesized
ctttttttgttcatttttaa

SEQ ID NO: 260815 - DNA, 20 bp, Artificial Sequence
  chemically synthesized
ccattaaaaatgaacaaaaa

SEQ ID NO: 260816 - DNA, 20 bp, Artificial Sequence
  chemically synthesized
cattaaaaatgaacaaaaaa

SEQ ID NO: 260817 - DNA, 20 bp, Artificial Sequence
  chemically synthesized
taaaaatgaacaaaaaaagg

SEQ ID NO: 260818 - DNA, 20 bp, Artificial Sequence
  chemically synthesized
gtggtattgttttattacat

SEQ ID NO: 260819 - DNA, 20 bp, Artificial Sequence
  chemically synthesized
gatgatgggggtagtgatcg

SEQ ID NO: 260820 - DNA, 20 bp, Artificial Sequence
  chemically synthesized
attttctttgatgatggggg

SEQ ID NO: 260821 - DNA, 20 bp, Artificial Sequence
  chemically synthesized
atgattttctttgatgatgg

SEQ ID NO: 260822 - DNA, 20 bp, Artificial Sequence
  chemically synthesized
gatgattttctttgatgatg

SEQ ID NO: 260823 - DNA, 20 bp, Artificial Sequence
  chemically synthesized
gatcactacccccatcatca

SEQ ID NO: 260824 - DNA, 20 bp, Artificial Sequence
  chemically synthesized
tgatgattttctttgatgat

SEQ ID NO: 260825 - DNA, 20 bp, Artificial Sequence
  chemically synthesized
ttgatgattttctttgatga

SEQ ID NO: 260826 - DNA, 20 bp, Artificial Sequence
  chemically synthesized
ttacttattgaattaacaca

SEQ ID NO: 260827 - DNA, 20 bp, Artificial Sequence
  chemically synthesized
ttttacttattgaattaaca

SEQ ID NO: 260828 - DNA, 20 bp, Artificial Sequence
  chemically synthesized
aaactctgtgttaattcaat

SEQ ID NO: 260829 - DNA, 20 bp, Artificial Sequence
  chemically synthesized
agggttccagcatcaagatg

SEQ ID NO: 260830 - DNA, 20 bp, Artificial Sequence
  chemically synthesized
gtaaaactacatcttgatgc

SEQ ID NO: 260831 - DNA, 20 bp, Artificial Sequence
  chemically synthesized
ggggacagggttccagcatc

SEQ ID NO: 260832 - DNA, 20 bp, Artificial Sequence
  chemically synthesized
aaaattaggggacagggttc

SEQ ID NO: 260833 - DNA, 20 bp, Artificial Sequence
  chemically synthesized
tcctataaaattaggggaca

SEQ ID NO: 260834 - DNA, 20 bp, Artificial Sequence
  chemically synthesized
atcctataaaattaggggac

SEQ ID NO: 260835 - DNA, 20 bp, Artificial Sequence
  chemically synthesized
gatcctataaaattagggga

SEQ ID NO: 260836 - DNA, 20 bp, Artificial Sequence
  chemically synthesized
ctaagatcctataaaattag

SEQ ID NO: 260837 - DNA, 20 bp, Artificial Sequence
  chemically synthesized
cctaagatcctataaaatta

SEQ ID NO: 260838 - DNA, 20 bp, Artificial Sequence
  chemically synthesized
aaccctgtcccctaatttta

SEQ ID NO: 260839 - DNA, 20 bp, Artificial Sequence
  chemically synthesized
tcctaagatcctataaaatt

SEQ ID NO: 260840 - DNA, 20 bp, Artificial Sequence
  chemically synthesized
accctgtcccctaattttat

SEQ ID NO: 260841 - DNA, 20 bp, Artificial Sequence
  chemically synthesized
ttcctaagatcctataaaat

SEQ ID NO: 260842 - DNA, 20 bp, Artificial Sequence
  chemically synthesized
cccctaattttataggatct

SEQ ID NO: 260843 - DNA, 20 bp, Artificial Sequence
  chemically synthesized
ccctaattttataggatctt

SEQ ID NO: 260844 - DNA, 20 bp, Artificial Sequence
  chemically synthesized
atttgtcaagcaggtttcct

SEQ ID NO: 260845 - DNA, 20 bp, Artificial Sequence
  chemically synthesized
aaggtgaaaatttgtcaagc

SEQ ID NO: 260846 - DNA, 20 bp, Artificial Sequence
  chemically synthesized
aaaggtgaaaatttgtcaag

SEQ ID NO: 260847 - DNA, 20 bp, Artificial Sequence
  chemically synthesized
taaaaaggtgaaaatttgtc

SEQ ID NO: 260848 - DNA, 20 bp, Artificial Sequence
  chemically synthesized
ttgacaaattttcacctttt

SEQ ID NO: 260849 - DNA, 20 bp, Artificial Sequence
  chemically synthesized
tgacaaattttcaccttttt

SEQ ID NO: 260850 - DNA, 20 bp, Artificial Sequence
  chemically synthesized
atccttatgatagcctaaaa

SEQ ID NO: 260851 - DNA, 20 bp, Artificial Sequence
  chemically synthesized
tatccttatgatagcctaaa

SEQ ID NO: 260852 - DNA, 20 bp, Artificial Sequence
  chemically synthesized
tcacctttttaggctatcat

SEQ ID NO: 260853 - DNA, 20 bp, Artificial Sequence
  chemically synthesized
cacctttttaggctatcata

SEQ ID NO: 260854 - DNA, 20 bp, Artificial Sequence
  chemically synthesized
ggtatctcttatccttatga

SEQ ID NO: 260855 - DNA, 20 bp, Artificial Sequence
  chemically synthesized
ttttaggctatcataaggat

SEQ ID NO: 260856 - DNA, 20 bp, Artificial Sequence
  chemically synthesized
ttaggctatcataaggataa

SEQ ID NO: 260857 - DNA, 20 bp, Artificial Sequence
  chemically synthesized
caagactaaatttttacaaa

SEQ ID NO: 260858 - DNA, 20 bp, Artificial Sequence
  chemically synthesized
gcaagactaaatttttacaa

SEQ ID NO: 260859 - DNA, 20 bp, Artificial Sequence
  chemically synthesized
tgcaagactaaatttttaca

SEQ ID NO: 260860 - DNA, 20 bp, Artificial Sequence
  chemically synthesized
agataccctttgtaaaaatt

SEQ ID NO: 260861 - DNA, 20 bp, Artificial Sequence
  chemically synthesized
ttccgcattatgaagtatgc

SEQ ID NO: 260862 - DNA, 20 bp, Artificial Sequence
  chemically synthesized
gtcttgcatacttcataatg

SEQ ID NO: 260863 - DNA, 20 bp, Artificial Sequence
  chemically synthesized
tacagtcattccgcattatg

SEQ ID NO: 260864 - DNA, 20 bp, Artificial Sequence
  chemically synthesized
atgcggaatgactgtaacat

SEQ ID NO: 260865 - DNA, 20 bp, Artificial Sequence
  chemically synthesized
atgtttcttgactgatgtta

SEQ ID NO: 260866 - DNA, 20 bp, Artificial Sequence
  chemically synthesized
gaatgactgtaacatcagtc

SEQ ID NO: 260867 - DNA, 20 bp, Artificial Sequence
  chemically synthesized
gtggaaatgattacagatat

SEQ ID NO: 260868 - DNA, 20 bp, Artificial Sequence
  chemically synthesized
tagcatagtggaaatgatta

SEQ ID NO: 260869 - DNA, 20 bp, Artificial Sequence
  chemically synthesized
gtaatcatttccactatgct

SEQ ID NO: 260870 - DNA, 20 bp, Artificial Sequence
  chemically synthesized
attcccttttcttagcatag

SEQ ID NO: 260871 - DNA, 20 bp, Artificial Sequence
  chemically synthesized
tccattcccttttcttagca

SEQ ID NO: 260872 - DNA, 20 bp, Artificial Sequence
  chemically synthesized
catttccactatgctaagaa

SEQ ID NO: 260873 - DNA, 20 bp, Artificial Sequence
  chemically synthesized
atttccactatgctaagaaa

SEQ ID NO: 260874 - DNA, 20 bp, Artificial Sequence
  chemically synthesized
tttccactatgctaagaaaa

SEQ ID NO: 260875 - DNA, 20 bp, Artificial Sequence
  chemically synthesized
ttccttccattcccttttct

SEQ ID NO: 260876 - DNA, 20 bp, Artificial Sequence
  chemically synthesized
actatgctaagaaaagggaa

SEQ ID NO: 260877 - DNA, 20 bp, Artificial Sequence
  chemically synthesized
atgctaagaaaagggaatgg

SEQ ID NO: 260878 - DNA, 20 bp, Artificial Sequence
  chemically synthesized
tgctaagaaaagggaatgga

SEQ ID NO: 260879 - DNA, 20 bp, Artificial Sequence
  chemically synthesized
aaaagggaatggaaggaata

SEQ ID NO: 260880 - DNA, 20 bp, Artificial Sequence
  chemically synthesized
aaagggaatggaaggaatat

SEQ ID NO: 260881 - DNA, 20 bp, Artificial Sequence
  chemically synthesized
ttgtgactatggacattaat

SEQ ID NO: 260882 - DNA, 20 bp, Artificial Sequence
  chemically synthesized
attgtgactatggacattaa

SEQ ID NO: 260883 - DNA, 20 bp, Artificial Sequence
  chemically synthesized
gggcatcccattaatgtcca

SEQ ID NO: 260884 - DNA, 20 bp, Artificial Sequence
  chemically synthesized
gttacttctcattgtgacta

SEQ ID NO: 260885 - DNA, 20 bp, Artificial Sequence
  chemically synthesized
ttaatgtccatagtcacaat

SEQ ID NO: 260886 - DNA, 20 bp, Artificial Sequence
  chemically synthesized
atgtccatagtcacaatgag

SEQ ID NO: 260887 - DNA, 20 bp, Artificial Sequence
  chemically synthesized
ttgatagaactatttgggaa

SEQ ID NO: 260888 - DNA, 20 bp, Artificial Sequence
  chemically synthesized
agtaacaaactgttcccaaa

SEQ ID NO: 260889 - DNA, 20 bp, Artificial Sequence
  chemically synthesized
tacatttgatagaactattt

SEQ ID NO: 260890 - DNA, 20 bp, Artificial Sequence
  chemically synthesized
ttacatttgatagaactatt

SEQ ID NO: 260891 - DNA, 20 bp, Artificial Sequence
  chemically synthesized
tgaaaaattattacatttga

SEQ ID NO: 260892 - DNA, 20 bp, Artificial Sequence
  chemically synthesized
atcaaatgtaataatttttc

SEQ ID NO: 260893 - DNA, 20 bp, Artificial Sequence
  chemically synthesized
tcaaatgtaataatttttca

SEQ ID NO: 260894 - DNA, 20 bp, Artificial Sequence
  chemically synthesized
gtaataatttttcaaggttg

SEQ ID NO: 260895 - DNA, 20 bp, Artificial Sequence
  chemically synthesized
aaggttgtagcattcaaata

SEQ ID NO: 260896 - DNA, 20 bp, Artificial Sequence
  chemically synthesized
aataaagataatactaactt

SEQ ID NO: 260897 - DNA, 20 bp, Artificial Sequence
  chemically synthesized
gaaacttggttcactaaagt

SEQ ID NO: 260898 - DNA, 20 bp, Artificial Sequence
  chemically synthesized
tgaggaaacttggttcacta

SEQ ID NO: 260899 - DNA, 20 bp, Artificial Sequence
  chemically synthesized
aatactaactttagtgaacc

SEQ ID NO: 260900 - DNA, 20 bp, Artificial Sequence
  chemically synthesized
tagcatcagatgaggaaact

SEQ ID NO: 260901 - DNA, 20 bp, Artificial Sequence
  chemically synthesized
ctcatttttagcatcagatg

SEQ ID NO: 260902 - DNA, 20 bp, Artificial Sequence
  chemically synthesized
actcatttttagcatcagat

SEQ ID NO: 260903 - DNA, 20 bp, Artificial Sequence
  chemically synthesized
atataactcatttttagcat

SEQ ID NO: 260904 - DNA, 20 bp, Artificial Sequence
  chemically synthesized
cctcatctgatgctaaaaat

SEQ ID NO: 260905 - DNA, 20 bp, Artificial Sequence
  chemically synthesized
aaaaaaatataactcatttt

SEQ ID NO: 260906 - DNA, 20 bp, Artificial Sequence
  chemically synthesized
ttatatttttttaattttat

SEQ ID NO: 260907 - DNA, 20 bp, Artificial Sequence
  chemically synthesized
ttatcagtaacattatatga

SEQ ID NO: 260908 - DNA, 20 bp, Artificial Sequence
  chemically synthesized
tgatgaattattgatatgtg

SEQ ID NO: 260909 - DNA, 20 bp, Artificial Sequence
  chemically synthesized
ttggatataaatacaaaatg

SEQ ID NO: 260910 - DNA, 20 bp, Artificial Sequence
  chemically synthesized
aatatatttttcagaaatat

SEQ ID NO: 260911 - DNA, 20 bp, Artificial Sequence
  chemically synthesized
tctatgattaatatattttt

SEQ ID NO: 260912 - DNA, 20 bp, Artificial Sequence
  chemically synthesized
tctgaaaaatatattaatca

SEQ ID NO: 260913 - DNA, 20 bp, Artificial Sequence
  chemically synthesized
tatattaatcatagattttg

SEQ ID NO: 260914 - DNA, 20 bp, Artificial Sequence
  chemically synthesized
tttgcagtcaatatttcctg

SEQ ID NO: 260915 - DNA, 20 bp, Artificial Sequence
  chemically synthesized
ggaaatttagcacattcttc

SEQ ID NO: 260916 - DNA, 20 bp, Artificial Sequence
  chemically synthesized
tggaaatttagcacattctt

SEQ ID NO: 260917 - DNA, 20 bp, Artificial Sequence
  chemically synthesized
ttttctatcaagtggaaatt

SEQ ID NO: 260918 - DNA, 20 bp, Artificial Sequence
  chemically synthesized
tgtgctaaatttccacttga

SEQ ID NO: 260919 - DNA, 20 bp, Artificial Sequence
  chemically synthesized
tgtcaaatttttctatcaag

SEQ ID NO: 260920 - DNA, 20 bp, Artificial Sequence
  chemically synthesized
ctgtgtcaaatttttctatc

SEQ ID NO: 260921 - DNA, 20 bp, Artificial Sequence
  chemically synthesized
cttgatagaaaaatttgaca

SEQ ID NO: 260922 - DNA, 20 bp, Artificial Sequence
  chemically synthesized
aataaacataagaaaaaaca

SEQ ID NO: 260923 - DNA, 20 bp, Artificial Sequence
  chemically synthesized
tcaaatatattaataaacat

SEQ ID NO: 260924 - DNA, 20 bp, Artificial Sequence
  chemically synthesized
aacacattgcatgatgactg

SEQ ID NO: 260925 - DNA, 20 bp, Artificial Sequence
  chemically synthesized
aatgttacagtaatagacta

SEQ ID NO: 260926 - DNA, 20 bp, Artificial Sequence
  chemically synthesized
ctgaattaatgttacagtaa

SEQ ID NO: 260927 - DNA, 20 bp, Artificial Sequence
  chemically synthesized
tatcttctgaattaatgtta

SEQ ID NO: 260928 - DNA, 20 bp, Artificial Sequence
  chemically synthesized
ctattactgtaacattaatt

SEQ ID NO: 260929 - DNA, 20 bp, Artificial Sequence
  chemically synthesized
ttactgtaacattaattcag

SEQ ID NO: 260930 - DNA, 20 bp, Artificial Sequence
  chemically synthesized
gtaacattaattcagaagat

SEQ ID NO: 260931 - DNA, 20 bp, Artificial Sequence
  chemically synthesized
atataaaattgtatatctaa

SEQ ID NO: 260932 - DNA, 20 bp, Artificial Sequence
  chemically synthesized
ataaaattgtatatctaaca

SEQ ID NO: 260933 - DNA, 20 bp, Artificial Sequence
  chemically synthesized
tagttagattatggctctgt

SEQ ID NO: 260934 - DNA, 20 bp, Artificial Sequence
  chemically synthesized
attattttatagttagatta

SEQ ID NO: 260935 - DNA, 20 bp, Artificial Sequence
  chemically synthesized
attcacaattattttatagt

SEQ ID NO: 260936 - DNA, 20 bp, Artificial Sequence
  chemically synthesized
tactattcacaattatttta

SEQ ID NO: 260937 - DNA, 20 bp, Artificial Sequence
  chemically synthesized
aactataaaataattgtgaa

SEQ ID NO: 260938 - DNA, 20 bp, Artificial Sequence
  chemically synthesized
ataaaataattgtgaatagt

SEQ ID NO: 260939 - DNA, 20 bp, Artificial Sequence
  chemically synthesized
ataattgtgaatagtaagtg

SEQ ID NO: 260940 - DNA, 20 bp, Artificial Sequence
  chemically synthesized
aatagtagaataaatgtgtc

SEQ ID NO: 260941 - DNA, 20 bp, Artificial Sequence
  chemically synthesized
agcacgttaaataaaaatag

SEQ ID NO: 260942 - DNA, 20 bp, Artificial Sequence
  chemically synthesized
agtagcacgttaaataaaaa

SEQ ID NO: 260943 - DNA, 20 bp, Artificial Sequence
  chemically synthesized
tttatttaacgtgctacttg

SEQ ID NO: 260944 - DNA, 20 bp, Artificial Sequence
  chemically synthesized
ctcaaatgactggcttcaag

SEQ ID NO: 260945 - DNA, 20 bp, Artificial Sequence
  chemically synthesized
tttaacgtgctacttgaagc

SEQ ID NO: 260946 - DNA, 20 bp, Artificial Sequence
  chemically synthesized
tgtctcaaatgactggcttc

SEQ ID NO: 260947 - DNA, 20 bp, Artificial Sequence
  chemically synthesized
ctacttgaagccagtcattt

SEQ ID NO: 260948 - DNA, 20 bp, Artificial Sequence
  chemically synthesized
tgaatattgtctcaaatgac

SEQ ID NO: 260949 - DNA, 20 bp, Artificial Sequence
  chemically synthesized
agtcatttgagacaatattc

SEQ ID NO: 260950 - DNA, 20 bp, Artificial Sequence
  chemically synthesized
tcatttgagacaatattcaa

SEQ ID NO: 260951 - DNA, 20 bp, Artificial Sequence
  chemically synthesized
catttgagacaatattcaag

SEQ ID NO: 260952 - DNA, 20 bp, Artificial Sequence
  chemically synthesized
ttgtataaatcacgtataaa

SEQ ID NO: 260953 - DNA, 20 bp, Artificial Sequence
  chemically synthesized
tttaatattcttgtaagttt

SEQ ID NO: 260954 - DNA, 20 bp, Artificial Sequence
  chemically synthesized
gtaaatttgcttaaacttac

SEQ ID NO: 260955 - DNA, 20 bp, Artificial Sequence
  chemically synthesized
ttacagtttaatattcttgt

SEQ ID NO: 260956 - DNA, 20 bp, Artificial Sequence
  chemically synthesized
ataaaataagatgttaatta

SEQ ID NO: 260957 - DNA, 20 bp, Artificial Sequence
  chemically synthesized
gccatcactatgtataaaat

SEQ ID NO: 260958 - DNA, 20 bp, Artificial Sequence
  chemically synthesized
ttaacatcttattttataca

SEQ ID NO: 260959 - DNA, 20 bp, Artificial Sequence
  chemically synthesized
tcttattttatacatagtga

SEQ ID NO: 260960 - DNA, 20 bp, Artificial Sequence
  chemically synthesized
tttatacatagtgatggctt

SEQ ID NO: 260961 - DNA, 20 bp, Artificial Sequence
  chemically synthesized
acatagtgatggctttggac

SEQ ID NO: 260962 - DNA, 20 bp, Artificial Sequence
  chemically synthesized
atagtgatggctttggacta

SEQ ID NO: 260963 - DNA, 20 bp, Artificial Sequence
  chemically synthesized
ttccgaatatctctagtcca

SEQ ID NO: 260964 - DNA, 20 bp, Artificial Sequence
  chemically synthesized
ttgtgttttccgaatatctc

SEQ ID NO: 260965 - DNA, 20 bp, Artificial Sequence
  chemically synthesized
ggctttggactagagatatt

SEQ ID NO: 260966 - DNA, 20 bp, Artificial Sequence
  chemically synthesized
gtaagaaactatatgaacat

SEQ ID NO: 260967 - DNA, 20 bp, Artificial Sequence
  chemically synthesized
agtaagaaactatatgaaca

SEQ ID NO: 260968 - DNA, 20 bp, Artificial Sequence
  chemically synthesized
cacaaaatcctatgttcata

SEQ ID NO: 260969 - DNA, 20 bp, Artificial Sequence
  chemically synthesized
ttgaattcatcaagggtagt

SEQ ID NO: 260970 - DNA, 20 bp, Artificial Sequence
  chemically synthesized
ttaattgaattcatcaaggg

SEQ ID NO: 260971 - DNA, 20 bp, Artificial Sequence
  chemically synthesized
acattaattgaattcatcaa

SEQ ID NO: 260972 - DNA, 20 bp, Artificial Sequence
  chemically synthesized
aacattaattgaattcatca

SEQ ID NO: 260973 - DNA, 20 bp, Artificial Sequence
  chemically synthesized
gaacattaattgaattcatc

SEQ ID NO: 260974 - DNA, 20 bp, Artificial Sequence
  chemically synthesized
caattaatgttcttaaacct

SEQ ID NO: 260975 - DNA, 20 bp, Artificial Sequence
  chemically synthesized
caaatagaaaactgaggttt

SEQ ID NO: 260976 - DNA, 20 bp, Artificial Sequence
  chemically synthesized
ataatccaaatagaaaactg

SEQ ID NO: 260977 - DNA, 20 bp, Artificial Sequence
  chemically synthesized
aataatccaaatagaaaact

SEQ ID NO: 260978 - DNA, 20 bp, Artificial Sequence
  chemically synthesized
ttaaacctcagttttctatt

SEQ ID NO: 260979 - DNA, 20 bp, Artificial Sequence
  chemically synthesized
gttaaagcaaataatccaaa

SEQ ID NO: 260980 - DNA, 20 bp, Artificial Sequence
  chemically synthesized
aaagacaagctattaagtta

SEQ ID NO: 260981 - DNA, 20 bp, Artificial Sequence
  chemically synthesized
gattatttgctttaacttaa

SEQ ID NO: 260982 - DNA, 20 bp, Artificial Sequence
  chemically synthesized
aaaaataaagacaagctatt

SEQ ID NO: 260983 - DNA, 20 bp, Artificial Sequence
  chemically synthesized
gtagagggaaaaataaagac

SEQ ID NO: 260984 - DNA, 20 bp, Artificial Sequence
  chemically synthesized
gaatagtagagggaaaaata

SEQ ID NO: 260985 - DNA, 20 bp, Artificial Sequence
  chemically synthesized
tacaatttttgaatagtaga

SEQ ID NO: 260986 - DNA, 20 bp, Artificial Sequence
  chemically synthesized
atacaatttttgaatagtag

SEQ ID NO: 260987 - DNA, 20 bp, Artificial Sequence
  chemically synthesized
tatacaatttttgaatagta

SEQ ID NO: 260988 - DNA, 20 bp, Artificial Sequence
  chemically synthesized
agtatacaatttttgaatag

SEQ ID NO: 260989 - DNA, 20 bp, Artificial Sequence
  chemically synthesized
agaagtatacaatttttgaa

SEQ ID NO: 260990 - DNA, 20 bp, Artificial Sequence
  chemically synthesized
actaatcattaaatcgatag

SEQ ID NO: 260991 - DNA, 20 bp, Artificial Sequence
  chemically synthesized
tatactaatcattaaatcga

SEQ ID NO: 260992 - DNA, 20 bp, Artificial Sequence
  chemically synthesized
acttctatcgatttaatgat

SEQ ID NO: 260993 - DNA, 20 bp, Artificial Sequence
  chemically synthesized
caaaatttcttgtgcgtgtt

SEQ ID NO: 260994 - DNA, 20 bp, Artificial Sequence
  chemically synthesized
ataaaattcttaacacgcac

SEQ ID NO: 260995 - DNA, 20 bp, Artificial Sequence
  chemically synthesized
acacgcacaagaaattttgc

SEQ ID NO: 260996 - DNA, 20 bp, Artificial Sequence
  chemically synthesized
attttgcaagttttcattct

SEQ ID NO: 260997 - DNA, 20 bp, Artificial Sequence
  chemically synthesized
aagttttcattctaagcact

SEQ ID NO: 260998 - DNA, 20 bp, Artificial Sequence
  chemically synthesized
tttaagattctcttagtgct

SEQ ID NO: 260999 - DNA, 20 bp, Artificial Sequence
  chemically synthesized
gttttcattctaagcactaa

SEQ ID NO: 261000 - DNA, 20 bp, Artificial Sequence
  chemically synthesized
aagcaattttaagattctct

SEQ ID NO: 261001 - DNA, 20 bp, Artificial Sequence
  chemically synthesized
ataatgaataaagcaatttt

SEQ ID NO: 261002 - DNA, 20 bp, Artificial Sequence
  chemically synthesized
taattaatcaataatgaata

SEQ ID NO: 261003 - DNA, 20 bp, Artificial Sequence
  chemically synthesized
atttgtttaattcataaaat

SEQ ID NO: 261004 - DNA, 20 bp, Artificial Sequence
  chemically synthesized
acaaatatatactgtgtacc

SEQ ID NO: 261005 - DNA, 20 bp, Artificial Sequence
  chemically synthesized
caaaacagtgactaggtaca

SEQ ID NO: 261006 - DNA, 20 bp, Artificial Sequence
  chemically synthesized
caacacccaaaacagtgact

SEQ ID NO: 261007 - DNA, 20 bp, Artificial Sequence
  chemically synthesized
tcaacacccaaaacagtgac

SEQ ID NO: 261008 - DNA, 20 bp, Artificial Sequence
  chemically synthesized
tgtgtacctagtcactgttt

SEQ ID NO: 261009 - DNA, 20 bp, Artificial Sequence
  chemically synthesized
gtgtacctagtcactgtttt

SEQ ID NO: 261010 - DNA, 20 bp, Artificial Sequence
  chemically synthesized
tgtgtcctcaacacccaaaa

SEQ ID NO: 261011 - DNA, 20 bp, Artificial Sequence
  chemically synthesized
tagtcactgttttgggtgtt

SEQ ID NO: 261012 - DNA, 20 bp, Artificial Sequence
  chemically synthesized
agtcactgttttgggtgttg

SEQ ID NO: 261013 - DNA, 20 bp, Artificial Sequence
  chemically synthesized
tgttttgggtgttgaggaca

SEQ ID NO: 261014 - DNA, 20 bp, Artificial Sequence
  chemically synthesized
tttgggtgttgaggacacag

SEQ ID NO: 261015 - DNA, 20 bp, Artificial Sequence
  chemically synthesized
gggtgttgaggacacagcag

SEQ ID NO: 261016 - DNA, 20 bp, Artificial Sequence
  chemically synthesized
ggtgttgaggacacagcagt

SEQ ID NO: 261017 - DNA, 20 bp, Artificial Sequence
  chemically synthesized
ggacacagcagtgggaaaaa

SEQ ID NO: 261018 - DNA, 20 bp, Artificial Sequence
  chemically synthesized
acaatttttttttgcattgt

SEQ ID NO: 261019 - DNA, 20 bp, Artificial Sequence
  chemically synthesized
caatttttttttgcattgtt

SEQ ID NO: 261020 - DNA, 20 bp, Artificial Sequence
  chemically synthesized
ttttttttgcattgttgggt

SEQ ID NO: 261021 - DNA, 20 bp, Artificial Sequence
  chemically synthesized
ttttttgcattgttgggttg

SEQ ID NO: 261022 - DNA, 20 bp, Artificial Sequence
  chemically synthesized
ttgggttggagctctacttc

SEQ ID NO: 261023 - DNA, 20 bp, Artificial Sequence
  chemically synthesized
tgggttggagctctacttct

SEQ ID NO: 261024 - DNA, 20 bp, Artificial Sequence
  chemically synthesized
tatttccctacctagaagta

SEQ ID NO: 261025 - DNA, 20 bp, Artificial Sequence
  chemically synthesized
tttatttccctacctagaag

SEQ ID NO: 261026 - DNA, 20 bp, Artificial Sequence
  chemically synthesized
gttggagctctacttctagg

SEQ ID NO: 261027 - DNA, 20 bp, Artificial Sequence
  chemically synthesized
ttggagctctacttctaggt

SEQ ID NO: 261028 - DNA, 20 bp, Artificial Sequence
  chemically synthesized
tggagctctacttctaggta

SEQ ID NO: 261029 - DNA, 20 bp, Artificial Sequence
  chemically synthesized
gtatttatttccctacctag

SEQ ID NO: 261030 - DNA, 20 bp, Artificial Sequence
  chemically synthesized
tgagtatttatttccctacc

SEQ ID NO: 261031 - DNA, 20 bp, Artificial Sequence
  chemically synthesized
aggtagggaaataaatactc

SEQ ID NO: 261032 - DNA, 20 bp, Artificial Sequence
  chemically synthesized
tagggaaataaatactcaag

SEQ ID NO: 261033 - DNA, 20 bp, Artificial Sequence
  chemically synthesized
ttttccttctttatcttctt

SEQ ID NO: 261034 - DNA, 20 bp, Artificial Sequence
  chemically synthesized
aataaatactcaagaagata

SEQ ID NO: 261035 - DNA, 20 bp, Artificial Sequence
  chemically synthesized
aaatactcaagaagataaag

SEQ ID NO: 261036 - DNA, 20 bp, Artificial Sequence
  chemically synthesized
aatactcaagaagataaaga

SEQ ID NO: 261037 - DNA, 20 bp, Artificial Sequence
  chemically synthesized
agataaagaaggaaaatatt

SEQ ID NO: 261038 - DNA, 20 bp, Artificial Sequence
  chemically synthesized
gaaaatattgagaactttcc

SEQ ID NO: 261039 - DNA, 20 bp, Artificial Sequence
  chemically synthesized
aataaagtgcatgaccagga

SEQ ID NO: 261040 - DNA, 20 bp, Artificial Sequence
  chemically synthesized
tctcaataaagtgcatgacc

SEQ ID NO: 261041 - DNA, 20 bp, Artificial Sequence
  chemically synthesized
ttctcaataaagtgcatgac

SEQ ID NO: 261042 - DNA, 20 bp, Artificial Sequence
  chemically synthesized
tcctggtcatgcactttatt

SEQ ID NO: 261043 - DNA, 20 bp, Artificial Sequence
  chemically synthesized
ctcatttatttttctcaata

SEQ ID NO: 261044 - DNA, 20 bp, Artificial Sequence
  chemically synthesized
ctttattgagaaaaataaat

SEQ ID NO: 261045 - DNA, 20 bp, Artificial Sequence
  chemically synthesized
tttattgagaaaaataaatg

SEQ ID NO: 261046 - DNA, 20 bp, Artificial Sequence
  chemically synthesized
ttgagaaaaataaatgagga

SEQ ID NO: 261047 - DNA, 20 bp, Artificial Sequence
  chemically synthesized
aaaaataaatgaggaaagca

SEQ ID NO: 261048 - DNA, 20 bp, Artificial Sequence
  chemically synthesized
atgaggaaagcatggataaa

SEQ ID NO: 261049 - DNA, 20 bp, Artificial Sequence
  chemically synthesized
tgtgtgtgtgtgtgtgtgtg

SEQ ID NO: 261050 - DNA, 20 bp, Artificial Sequence
  chemically synthesized
tgtggtgtatgtgcacacat

SEQ ID NO: 261051 - DNA, 20 bp, Artificial Sequence
  chemically synthesized
gtgtatgtgcacacatgaga

SEQ ID NO: 261052 - DNA, 20 bp, Artificial Sequence
  chemically synthesized
tcattgaaaaaaacactttt

SEQ ID NO: 261053 - DNA, 20 bp, Artificial Sequence
  chemically synthesized
gaaaaaaacacttttgagta

SEQ ID NO: 261054 - DNA, 20 bp, Artificial Sequence
  chemically synthesized
gccttaacttctttactcaa

SEQ ID NO: 261055 - DNA, 20 bp, Artificial Sequence
  chemically synthesized
aaaaacacttttgagtaaag

SEQ ID NO: 261056 - DNA, 20 bp, Artificial Sequence
  chemically synthesized
cacttttgagtaaagaagtt

SEQ ID NO: 261057 - DNA, 20 bp, Artificial Sequence
  chemically synthesized
acttttgagtaaagaagtta

SEQ ID NO: 261058 - DNA, 20 bp, Artificial Sequence
  chemically synthesized
tttgagtaaagaagttaagg

SEQ ID NO: 261059 - DNA, 20 bp, Artificial Sequence
  chemically synthesized
gaagttaaggcagaaacgaa

SEQ ID NO: 261060 - DNA, 20 bp, Artificial Sequence
  chemically synthesized
agttaaggcagaaacgaaaa

SEQ ID NO: 261061 - DNA, 20 bp, Artificial Sequence
  chemically synthesized
cagaaacgaaaagagccaca

SEQ ID NO: 261062 - DNA, 20 bp, Artificial Sequence
  chemically synthesized
gaaacgaaaagagccacatg

SEQ ID NO: 261063 - DNA, 20 bp, Artificial Sequence
  chemically synthesized
tcctcccccgtttctccatg

SEQ ID NO: 261064 - DNA, 20 bp, Artificial Sequence
  chemically synthesized
aaaagagccacatggagaaa

SEQ ID NO: 261065 - DNA, 20 bp, Artificial Sequence
  chemically synthesized
aaagagccacatggagaaac

SEQ ID NO: 261066 - DNA, 20 bp, Artificial Sequence
  chemically synthesized
aagagccacatggagaaacg

SEQ ID NO: 261067 - DNA, 20 bp, Artificial Sequence
  chemically synthesized
agagccacatggagaaacgg

SEQ ID NO: 261068 - DNA, 20 bp, Artificial Sequence
  chemically synthesized
agccacatggagaaacgggg

SEQ ID NO: 261069 - DNA, 20 bp, Artificial Sequence
  chemically synthesized
gccacatggagaaacggggg

SEQ ID NO: 261070 - DNA, 20 bp, Artificial Sequence
  chemically synthesized
gaaacgggggaggattattt

SEQ ID NO: 261071 - DNA, 20 bp, Artificial Sequence
  chemically synthesized
aaacgggggaggattatttt

SEQ ID NO: 261072 - DNA, 20 bp, Artificial Sequence
  chemically synthesized
cgggggaggattattttagg

SEQ ID NO: 261073 - DNA, 20 bp, Artificial Sequence
  chemically synthesized
ggggaggattattttaggca

SEQ ID NO: 261074 - DNA, 20 bp, Artificial Sequence
  chemically synthesized
gggaggattattttaggcag

SEQ ID NO: 261075 - DNA, 20 bp, Artificial Sequence
  chemically synthesized
aggattattttaggcagagg

SEQ ID NO: 261076 - DNA, 20 bp, Artificial Sequence
  chemically synthesized
agaggtagcacacaatgcaa

SEQ ID NO: 261077 - DNA, 20 bp, Artificial Sequence
  chemically synthesized
gaggtagcacacaatgcaat

SEQ ID NO: 261078 - DNA, 20 bp, Artificial Sequence
  chemically synthesized
acaatgcaatgggtgcatgt

SEQ ID NO: 261079 - DNA, 20 bp, Artificial Sequence
  chemically synthesized
ggtgcatgtcagatctgtga

SEQ ID NO: 261080 - DNA, 20 bp, Artificial Sequence
  chemically synthesized
gcatgtcagatctgtgaaag

SEQ ID NO: 261081 - DNA, 20 bp, Artificial Sequence
  chemically synthesized
cccctttgctgctgctttca

SEQ ID NO: 261082 - DNA, 20 bp, Artificial Sequence
  chemically synthesized
tgtcagatctgtgaaagcag

SEQ ID NO: 261083 - DNA, 20 bp, Artificial Sequence
  chemically synthesized
gatctgtgaaagcagcagca

SEQ ID NO: 261084 - DNA, 20 bp, Artificial Sequence
  chemically synthesized
atctgtgaaagcagcagcaa

SEQ ID NO: 261085 - DNA, 20 bp, Artificial Sequence
  chemically synthesized
tctgtgaaagcagcagcaaa

SEQ ID NO: 261086 - DNA, 20 bp, Artificial Sequence
  chemically synthesized
ctgtgaaagcagcagcaaag

SEQ ID NO: 261087 - DNA, 20 bp, Artificial Sequence
  chemically synthesized
cagcagcaaaggggtcaaca

SEQ ID NO: 261088 - DNA, 20 bp, Artificial Sequence
  chemically synthesized
agcagcaaaggggtcaacat

SEQ ID NO: 261089 - DNA, 20 bp, Artificial Sequence
  chemically synthesized
agcaaaggggtcaacatagg

SEQ ID NO: 261090 - DNA, 20 bp, Artificial Sequence
  chemically synthesized
caaaggggtcaacataggtg

SEQ ID NO: 261091 - DNA, 20 bp, Artificial Sequence
  chemically synthesized
aggggtcaacataggtggag

SEQ ID NO: 261092 - DNA, 20 bp, Artificial Sequence
  chemically synthesized
gggtcaacataggtggagca

SEQ ID NO: 261093 - DNA, 20 bp, Artificial Sequence
  chemically synthesized
ggtcaacataggtggagcag

SEQ ID NO: 261094 - DNA, 20 bp, Artificial Sequence
  chemically synthesized
aacataggtggagcagagga

SEQ ID NO: 261095 - DNA, 20 bp, Artificial Sequence
  chemically synthesized
gtggagcagaggaaagtatt

SEQ ID NO: 261096 - DNA, 20 bp, Artificial Sequence
  chemically synthesized
ggagcagaggaaagtattaa

SEQ ID NO: 261097 - DNA, 20 bp, Artificial Sequence
  chemically synthesized
agaggaaagtattaagagat

SEQ ID NO: 261098 - DNA, 20 bp, Artificial Sequence
  chemically synthesized
gaggaaagtattaagagata

SEQ ID NO: 261099 - DNA, 20 bp, Artificial Sequence
  chemically synthesized
agtattaagagataaggcct

SEQ ID NO: 261100 - DNA, 20 bp, Artificial Sequence
  chemically synthesized
taagagataaggcctgagtt

SEQ ID NO: 261101 - DNA, 20 bp, Artificial Sequence
  chemically synthesized
gctggcccacttcttaactc

SEQ ID NO: 261102 - DNA, 20 bp, Artificial Sequence
  chemically synthesized
gagataaggcctgagttaag

SEQ ID NO: 261103 - DNA, 20 bp, Artificial Sequence
  chemically synthesized
ggctggcccacttcttaact

SEQ ID NO: 261104 - DNA, 20 bp, Artificial Sequence
  chemically synthesized
ataaggcctgagttaagaag

SEQ ID NO: 261105 - DNA, 20 bp, Artificial Sequence
  chemically synthesized
taaggcctgagttaagaagt

SEQ ID NO: 261106 - DNA, 20 bp, Artificial Sequence
  chemically synthesized
gcctgagttaagaagtgggc

SEQ ID NO: 261107 - DNA, 20 bp, Artificial Sequence
  chemically synthesized
gagttaagaagtgggccagc

SEQ ID NO: 261108 - DNA, 20 bp, Artificial Sequence
  chemically synthesized
agttaagaagtgggccagcc

SEQ ID NO: 261109 - DNA, 20 bp, Artificial Sequence
  chemically synthesized
aagaagtgggccagccaggt

SEQ ID NO: 261110 - DNA, 20 bp, Artificial Sequence
  chemically synthesized
caagggatatctgacctggc

SEQ ID NO: 261111 - DNA, 20 bp, Artificial Sequence
  chemically synthesized
atttcaagggatatctgacc

SEQ ID NO: 261112 - DNA, 20 bp, Artificial Sequence
  chemically synthesized
aaactcttcatgaatttcaa

SEQ ID NO: 261113 - DNA, 20 bp, Artificial Sequence
  chemically synthesized
aaaactcttcatgaatttca

SEQ ID NO: 261114 - DNA, 20 bp, Artificial Sequence
  chemically synthesized
caaaactcttcatgaatttc

SEQ ID NO: 261115 - DNA, 20 bp, Artificial Sequence
  chemically synthesized
gatatcccttgaaattcatg

SEQ ID NO: 261116 - DNA, 20 bp, Artificial Sequence
  chemically synthesized
tatcccttgaaattcatgaa

SEQ ID NO: 261117 - DNA, 20 bp, Artificial Sequence
  chemically synthesized
ttgaaattcatgaagagttt

SEQ ID NO: 261118 - DNA, 20 bp, Artificial Sequence
  chemically synthesized
ttttggatttcacttaaaaa

SEQ ID NO: 261119 - DNA, 20 bp, Artificial Sequence
  chemically synthesized
atgaattcccatctattttt

SEQ ID NO: 261120 - DNA, 20 bp, Artificial Sequence
  chemically synthesized
ggatttcacttaaaaataga

SEQ ID NO: 261121 - DNA, 20 bp, Artificial Sequence
  chemically synthesized
gatttcacttaaaaatagat

SEQ ID NO: 261122 - DNA, 20 bp, Artificial Sequence
  chemically synthesized
aaatagatgggaattcattg

SEQ ID NO: 261123 - DNA, 20 bp, Artificial Sequence
  chemically synthesized
aatagatgggaattcattga

SEQ ID NO: 261124 - DNA, 20 bp, Artificial Sequence
  chemically synthesized
attcattgaaggattatgat

SEQ ID NO: 261125 - DNA, 20 bp, Artificial Sequence
  chemically synthesized
attatgatcagatttaaata

SEQ ID NO: 261126 - DNA, 20 bp, Artificial Sequence
  chemically synthesized
ctatctctacacaatacaca

SEQ ID NO: 261127 - DNA, 20 bp, Artificial Sequence
  chemically synthesized
cctatctctacacaatacac

SEQ ID NO: 261128 - DNA, 20 bp, Artificial Sequence
  chemically synthesized
gcctatctctacacaataca

SEQ ID NO: 261129 - DNA, 20 bp, Artificial Sequence
  chemically synthesized
tgttgtccctgtgtattgtg

SEQ ID NO: 261130 - DNA, 20 bp, Artificial Sequence
  chemically synthesized
ttgtccctgtgtattgtgta

SEQ ID NO: 261131 - DNA, 20 bp, Artificial Sequence
  chemically synthesized
ccctgtgtattgtgtagaga

SEQ ID NO: 261132 - DNA, 20 bp, Artificial Sequence
  chemically synthesized
cctgtgtattgtgtagagat

SEQ ID NO: 261133 - DNA, 20 bp, Artificial Sequence
  chemically synthesized
tattgtgtagagataggcta

SEQ ID NO: 261134 - DNA, 20 bp, Artificial Sequence
  chemically synthesized
gtgtagagataggctaaaga

SEQ ID NO: 261135 - DNA, 20 bp, Artificial Sequence
  chemically synthesized
aaatctacgcatgctttctt

SEQ ID NO: 261136 - DNA, 20 bp, Artificial Sequence
  chemically synthesized
taggctaaagaaagcatgcg

SEQ ID NO: 261137 - DNA, 20 bp, Artificial Sequence
  chemically synthesized
accgttctttcaaattttca

SEQ ID NO: 261138 - DNA, 20 bp, Artificial Sequence
  chemically synthesized
gcaccgttctttcaaatttt

SEQ ID NO: 261139 - DNA, 20 bp, Artificial Sequence
  chemically synthesized
ttttttctctgaaaatttga

SEQ ID NO: 261140 - DNA, 20 bp, Artificial Sequence
  chemically synthesized
tctctgaaaatttgaaagaa

SEQ ID NO: 261141 - DNA, 20 bp, Artificial Sequence
  chemically synthesized
tttcccctcaaatgcagtgg

SEQ ID NO: 261142 - DNA, 20 bp, Artificial Sequence
  chemically synthesized
tcttttcccctcaaatgcag

SEQ ID NO: 261143 - DNA, 20 bp, Artificial Sequence
  chemically synthesized
acggtgcttccactgcattt

SEQ ID NO: 261144 - DNA, 20 bp, Artificial Sequence
  chemically synthesized
cggtgcttccactgcatttg

SEQ ID NO: 261145 - DNA, 20 bp, Artificial Sequence
  chemically synthesized
ggtgcttccactgcatttga

SEQ ID NO: 261146 - DNA, 20 bp, Artificial Sequence
  chemically synthesized
tattcttttcccctcaaatg

SEQ ID NO: 261147 - DNA, 20 bp, Artificial Sequence
  chemically synthesized
gtgcttccactgcatttgag

SEQ ID NO: 261148 - DNA, 20 bp, Artificial Sequence
  chemically synthesized
tccactgcatttgaggggaa

SEQ ID NO: 261149 - DNA, 20 bp, Artificial Sequence
  chemically synthesized
agaataattttgttttaatc

SEQ ID NO: 261150 - DNA, 20 bp, Artificial Sequence
  chemically synthesized
ttttgttttaatcaagtcac

SEQ ID NO: 261151 - DNA, 20 bp, Artificial Sequence
  chemically synthesized
tttgttttaatcaagtcacg

SEQ ID NO: 261152 - DNA, 20 bp, Artificial Sequence
  chemically synthesized
ttttaatcaagtcacgaggc

SEQ ID NO: 261153 - DNA, 20 bp, Artificial Sequence
  chemically synthesized
tatgtcttgctgttttcatc

SEQ ID NO: 261154 - DNA, 20 bp, Artificial Sequence
  chemically synthesized
gtcacgaggctggatgaaaa

SEQ ID NO: 261155 - DNA, 20 bp, Artificial Sequence
  chemically synthesized
cgaggctggatgaaaacagc

SEQ ID NO: 261156 - DNA, 20 bp, Artificial Sequence
  chemically synthesized
tgaaaacagcaagacatata

SEQ ID NO: 261157 - DNA, 20 bp, Artificial Sequence
  chemically synthesized
atatatagaataaataaaaa

SEQ ID NO: 261158 - DNA, 20 bp, Artificial Sequence
  chemically synthesized
atagaataaataaaaatggc

SEQ ID NO: 261159 - DNA, 20 bp, Artificial Sequence
  chemically synthesized
aataaaaatggcaagtgccc

SEQ ID NO: 261160 - DNA, 20 bp, Artificial Sequence
  chemically synthesized
ataaaaatggcaagtgccca

SEQ ID NO: 261161 - DNA, 20 bp, Artificial Sequence
  chemically synthesized
atggcaagtgcccaaggact

SEQ ID NO: 261162 - DNA, 20 bp, Artificial Sequence
  chemically synthesized
tgcctcagtgctcagtcctt

SEQ ID NO: 261163 - DNA, 20 bp, Artificial Sequence
  chemically synthesized
atgcctcagtgctcagtcct

SEQ ID NO: 261164 - DNA, 20 bp, Artificial Sequence
  chemically synthesized
gtgcccaaggactgagcact

SEQ ID NO: 261165 - DNA, 20 bp, Artificial Sequence
  chemically synthesized
tgcccaaggactgagcactg

SEQ ID NO: 261166 - DNA, 20 bp, Artificial Sequence
  chemically synthesized
tgctgaaatgcctcagtgct

SEQ ID NO: 261167 - DNA, 20 bp, Artificial Sequence
  chemically synthesized
tctctaatgctgaaatgcct

SEQ ID NO: 261168 - DNA, 20 bp, Artificial Sequence
  chemically synthesized
gactgagcactgaggcattt

SEQ ID NO: 261169 - DNA, 20 bp, Artificial Sequence
  chemically synthesized
gcactgaggcatttcagcat

SEQ ID NO: 261170 - DNA, 20 bp, Artificial Sequence
  chemically synthesized
actgaggcatttcagcatta

SEQ ID NO: 261171 - DNA, 20 bp, Artificial Sequence
  chemically synthesized
gaggcatttcagcattagag

SEQ ID NO: 261172 - DNA, 20 bp, Artificial Sequence
  chemically synthesized
gcatttcagcattagagaag

SEQ ID NO: 261173 - DNA, 20 bp, Artificial Sequence
  chemically synthesized
catttcagcattagagaagt

SEQ ID NO: 261174 - DNA, 20 bp, Artificial Sequence
  chemically synthesized
agagaagtaggtactaccta

SEQ ID NO: 261175 - DNA, 20 bp, Artificial Sequence
  chemically synthesized
tgtttctcagtttccatagg

SEQ ID NO: 261176 - DNA, 20 bp, Artificial Sequence
  chemically synthesized
tattgtttctcagtttccat

SEQ ID NO: 261177 - DNA, 20 bp, Artificial Sequence
  chemically synthesized
gtattgtttctcagtttcca

SEQ ID NO: 261178 - DNA, 20 bp, Artificial Sequence
  chemically synthesized
aggtactacctatggaaact

SEQ ID NO: 261179 - DNA, 20 bp, Artificial Sequence
  chemically synthesized
cctttctatgtattgtttct

SEQ ID NO: 261180 - DNA, 20 bp, Artificial Sequence
  chemically synthesized
ggaaactgagaaacaataca

SEQ ID NO: 261181 - DNA, 20 bp, Artificial Sequence
  chemically synthesized
actgagaaacaatacataga

SEQ ID NO: 261182 - DNA, 20 bp, Artificial Sequence
  chemically synthesized
ctgagaaacaatacatagaa

SEQ ID NO: 261183 - DNA, 20 bp, Artificial Sequence
  chemically synthesized
agaaacaatacatagaaagg

SEQ ID NO: 261184 - DNA, 20 bp, Artificial Sequence
  chemically synthesized
aacaatacatagaaaggtag

SEQ ID NO: 261185 - DNA, 20 bp, Artificial Sequence
  chemically synthesized
acaatacatagaaaggtagc

SEQ ID NO: 261186 - DNA, 20 bp, Artificial Sequence
  chemically synthesized
tagaaaggtagcaggtaaac

SEQ ID NO: 261187 - DNA, 20 bp, Artificial Sequence
  chemically synthesized
aggtggttaagtttttcatc

SEQ ID NO: 261188 - DNA, 20 bp, Artificial Sequence
  chemically synthesized
tgaaacatgagaaggtggtt

SEQ ID NO: 261189 - DNA, 20 bp, Artificial Sequence
  chemically synthesized
atcaatgaaacatgagaagg

SEQ ID NO: 261190 - DNA, 20 bp, Artificial Sequence
  chemically synthesized
gacatcaatgaaacatgaga

SEQ ID NO: 261191 - DNA, 20 bp, Artificial Sequence
  chemically synthesized
ggacatcaatgaaacatgag

SEQ ID NO: 261192 - DNA, 20 bp, Artificial Sequence
  chemically synthesized
gctggacatcaatgaaacat

SEQ ID NO: 261193 - DNA, 20 bp, Artificial Sequence
  chemically synthesized
tctcatgtttcattgatgtc

SEQ ID NO: 261194 - DNA, 20 bp, Artificial Sequence
  chemically synthesized
attaaaaaacagaaaaatgc

SEQ ID NO: 261195 - DNA, 20 bp, Artificial Sequence
  chemically synthesized
tgaaagtgtctattaaaaaa

SEQ ID NO: 261196 - DNA, 20 bp, Artificial Sequence
  chemically synthesized
agcatttttctgttttttaa

SEQ ID NO: 261197 - DNA, 20 bp, Artificial Sequence
  chemically synthesized
ttaatagacactttcataca

SEQ ID NO: 261198 - DNA, 20 bp, Artificial Sequence
  chemically synthesized
taaacatttaccgtgtatga

SEQ ID NO: 261199 - DNA, 20 bp, Artificial Sequence
  chemically synthesized
tacacggtaaatgtttattt

SEQ ID NO: 261200 - DNA, 20 bp, Artificial Sequence
  chemically synthesized
aaaatggtaaaaaaatggaa

SEQ ID NO: 261201 - DNA, 20 bp, Artificial Sequence
  chemically synthesized
caaagaaaatggtaaaaaaa

SEQ ID NO: 261202 - DNA, 20 bp, Artificial Sequence
  chemically synthesized
aaaatgatgtgcaaagaaaa

SEQ ID NO: 261203 - DNA, 20 bp, Artificial Sequence
  chemically synthesized
gcaaaagaaaatgatgtgca

SEQ ID NO: 261204 - DNA, 20 bp, Artificial Sequence
  chemically synthesized
ttgcacatcattttcttttg

SEQ ID NO: 261205 - DNA, 20 bp, Artificial Sequence
  chemically synthesized
atggaagatttaagctgcaa

SEQ ID NO: 261206 - DNA, 20 bp, Artificial Sequence
  chemically synthesized
agatacaagatggaagattt

SEQ ID NO: 261207 - DNA, 20 bp, Artificial Sequence
  chemically synthesized
aggagaaagatacaagatgg

SEQ ID NO: 261208 - DNA, 20 bp, Artificial Sequence
  chemically synthesized
agcaggagaaagatacaaga

SEQ ID NO: 261209 - DNA, 20 bp, Artificial Sequence
  chemically synthesized
tttaagcaggagaaagatac

SEQ ID NO: 261210 - DNA, 20 bp, Artificial Sequence
  chemically synthesized
attggtctttaagcaggaga

SEQ ID NO: 261211 - DNA, 20 bp, Artificial Sequence
  chemically synthesized
ttgtatctttctcctgctta

SEQ ID NO: 261212 - DNA, 20 bp, Artificial Sequence
  chemically synthesized
caagattggtctttaagcag

SEQ ID NO: 261213 - DNA, 20 bp, Artificial Sequence
  chemically synthesized
gtcaagattggtctttaagc

SEQ ID NO: 261214 - DNA, 20 bp, Artificial Sequence
  chemically synthesized
cgtcaagattggtctttaag

SEQ ID NO: 261215 - DNA, 20 bp, Artificial Sequence
  chemically synthesized
ggacgtcaagattggtcttt

SEQ ID NO: 261216 - DNA, 20 bp, Artificial Sequence
  chemically synthesized
cctttagaggacgtcaagat

SEQ ID NO: 261217 - DNA, 20 bp, Artificial Sequence
  chemically synthesized
aattccctttagaggacgtc

SEQ ID NO: 261218 - DNA, 20 bp, Artificial Sequence
  chemically synthesized
accaatcttgacgtcctcta

SEQ ID NO: 261219 - DNA, 20 bp, Artificial Sequence
  chemically synthesized
ccaatcttgacgtcctctaa

SEQ ID NO: 261220 - DNA, 20 bp, Artificial Sequence
  chemically synthesized
caatcttgacgtcctctaaa

SEQ ID NO: 261221 - DNA, 20 bp, Artificial Sequence
  chemically synthesized
tagcataaaattccctttag

SEQ ID NO: 261222 - DNA, 20 bp, Artificial Sequence
  chemically synthesized
ctagcataaaattcccttta

SEQ ID NO: 261223 - DNA, 20 bp, Artificial Sequence
  chemically synthesized
tactagcataaaattccctt

SEQ ID NO: 261224 - DNA, 20 bp, Artificial Sequence
  chemically synthesized
ctctaaagggaattttatgc

SEQ ID NO: 261225 - DNA, 20 bp, Artificial Sequence
  chemically synthesized
gggaattttatgctagtaaa

SEQ ID NO: 261226 - DNA, 20 bp, Artificial Sequence
  chemically synthesized
gacacacagaaaccgtttac

SEQ ID NO: 261227 - DNA, 20 bp, Artificial Sequence
  chemically synthesized
taaagatcttttcagacaca

SEQ ID NO: 261228 - DNA, 20 bp, Artificial Sequence
  chemically synthesized
acggtttctgtgtgtctgaa

SEQ ID NO: 261229 - DNA, 20 bp, Artificial Sequence
  chemically synthesized
cattgaaataaagatctttt

SEQ ID NO: 261230 - DNA, 20 bp, Artificial Sequence
  chemically synthesized
tcaggaataacattgaaata

SEQ ID NO: 261231 - DNA, 20 bp, Artificial Sequence
  chemically synthesized
tatttcaatgttattcctga

SEQ ID NO: 261232 - DNA, 20 bp, Artificial Sequence
  chemically synthesized
tttcaatgttattcctgaaa

SEQ ID NO: 261233 - DNA, 20 bp, Artificial Sequence
  chemically synthesized
tcaatgttattcctgaaaga

SEQ ID NO: 261234 - DNA, 20 bp, Artificial Sequence
  chemically synthesized
actgatagaaactctctttc

SEQ ID NO: 261235 - DNA, 20 bp, Artificial Sequence
  chemically synthesized
tactgatagaaactctcttt

SEQ ID NO: 261236 - DNA, 20 bp, Artificial Sequence
  chemically synthesized
tcctgaaagagagtttctat

SEQ ID NO: 261237 - DNA, 20 bp, Artificial Sequence
  chemically synthesized
aacctagaattgtgtactga

SEQ ID NO: 261238 - DNA, 20 bp, Artificial Sequence
  chemically synthesized
tttctatcagtacacaattc

SEQ ID NO: 261239 - DNA, 20 bp, Artificial Sequence
  chemically synthesized
ttctatcagtacacaattct

SEQ ID NO: 261240 - DNA, 20 bp, Artificial Sequence
  chemically synthesized
agaacatccacgtaggaacc

SEQ ID NO: 261241 - DNA, 20 bp, Artificial Sequence
  chemically synthesized
cacaattctaggttcctacg

SEQ ID NO: 261242 - DNA, 20 bp, Artificial Sequence
  chemically synthesized
caatgaaagaacatccacgt

SEQ ID NO: 261243 - DNA, 20 bp, Artificial Sequence
  chemically synthesized
acaatgaaagaacatccacg

SEQ ID NO: 261244 - DNA, 20 bp, Artificial Sequence
  chemically synthesized
aatattttcaaaaacaatga

SEQ ID NO: 261245 - DNA, 20 bp, Artificial Sequence
  chemically synthesized
tgatagaagccagaagacgg

SEQ ID NO: 261246 - DNA, 20 bp, Artificial Sequence
  chemically synthesized
aatattattctaccgtcttc

SEQ ID NO: 261247 - DNA, 20 bp, Artificial Sequence
  chemically synthesized
caatgatagaagccagaaga

SEQ ID NO: 261248 - DNA, 20 bp, Artificial Sequence
  chemically synthesized
agagcaatgatagaagccag

SEQ ID NO: 261249 - DNA, 20 bp, Artificial Sequence
  chemically synthesized
tttagagcaatgatagaagc

SEQ ID NO: 261250 - DNA, 20 bp, Artificial Sequence
  chemically synthesized
tggttttagagcaatgatag

SEQ ID NO: 261251 - DNA, 20 bp, Artificial Sequence
  chemically synthesized
acctggttttagagcaatga

SEQ ID NO: 261252 - DNA, 20 bp, Artificial Sequence
  chemically synthesized
ttctatcattgctctaaaac

SEQ ID NO: 261253 - DNA, 20 bp, Artificial Sequence
  chemically synthesized
tctatcattgctctaaaacc

SEQ ID NO: 261254 - DNA, 20 bp, Artificial Sequence
  chemically synthesized
taaaatggtacctggtttta

SEQ ID NO: 261255 - DNA, 20 bp, Artificial Sequence
  chemically synthesized
cttaaaatggtacctggttt

SEQ ID NO: 261256 - DNA, 20 bp, Artificial Sequence
  chemically synthesized
gtgacacttaaaatggtacc

SEQ ID NO: 261257 - DNA, 20 bp, Artificial Sequence
  chemically synthesized
ctaaaaccaggtaccatttt

SEQ ID NO: 261258 - DNA, 20 bp, Artificial Sequence
  chemically synthesized
gaaagtagtgacacttaaaa

SEQ ID NO: 261259 - DNA, 20 bp, Artificial Sequence
  chemically synthesized
tttaagtgtcactactttct

SEQ ID NO: 261260 - DNA, 20 bp, Artificial Sequence
  chemically synthesized
ttaagtgtcactactttcta

SEQ ID NO: 261261 - DNA, 20 bp, Artificial Sequence
  chemically synthesized
tgctgtatttccttagaaag

SEQ ID NO: 261262 - DNA, 20 bp, Artificial Sequence
  chemically synthesized
tactgctgtatttccttaga

SEQ ID NO: 261263 - DNA, 20 bp, Artificial Sequence
  chemically synthesized
taaatactgctgtatttcct

SEQ ID NO: 261264 - DNA, 20 bp, Artificial Sequence
  chemically synthesized
cactactttctaaggaaata

SEQ ID NO: 261265 - DNA, 20 bp, Artificial Sequence
  chemically synthesized
tactttctaaggaaatacag

SEQ ID NO: 261266 - DNA, 20 bp, Artificial Sequence
  chemically synthesized
tgatgaatccaaaaaaagca

SEQ ID NO: 261267 - DNA, 20 bp, Artificial Sequence
  chemically synthesized
aattatttctttgctttttt

SEQ ID NO: 261268 - DNA, 20 bp, Artificial Sequence
  chemically synthesized
gaatctgatgaatccaaaaa

SEQ ID NO: 261269 - DNA, 20 bp, Artificial Sequence
  chemically synthesized
tttgctttttttggattcat

SEQ ID NO: 261270 - DNA, 20 bp, Artificial Sequence
  chemically synthesized
tcatcagattcatcgtctca

SEQ ID NO: 261271 - DNA, 20 bp, Artificial Sequence
  chemically synthesized
taagtatagatcatcactat

SEQ ID NO: 261272 - DNA, 20 bp, Artificial Sequence
  chemically synthesized
aaaaaaaagaaatataagta

SEQ ID NO: 261273 - DNA, 20 bp, Artificial Sequence
  chemically synthesized
ttattaaaaaaaagaaatat

SEQ ID NO: 261274 - DNA, 20 bp, Artificial Sequence
  chemically synthesized
cagaaaagattattaaaaaa

SEQ ID NO: 261275 - DNA, 20 bp, Artificial Sequence
  chemically synthesized
tgagcaaatctgaagcagaa

SEQ ID NO: 261276 - DNA, 20 bp, Artificial Sequence
  chemically synthesized
tttaataatcttttctgctt

SEQ ID NO: 261277 - DNA, 20 bp, Artificial Sequence
  chemically synthesized
gaaactgagcaaatctgaag

SEQ ID NO: 261278 - DNA, 20 bp, Artificial Sequence
  chemically synthesized
tgggaaactgagcaaatctg

SEQ ID NO: 261279 - DNA, 20 bp, Artificial Sequence
  chemically synthesized
ttttctgcttcagatttgct

SEQ ID NO: 261280 - DNA, 20 bp, Artificial Sequence
  chemically synthesized
aatactccgattgggaaact

SEQ ID NO: 261281 - DNA, 20 bp, Artificial Sequence
  chemically synthesized
gatttgctcagtttcccaat

SEQ ID NO: 261282 - DNA, 20 bp, Artificial Sequence
  chemically synthesized
tttgctcagtttcccaatcg

SEQ ID NO: 261283 - DNA, 20 bp, Artificial Sequence
  chemically synthesized
gaaattccaatactccgatt

SEQ ID NO: 261284 - DNA, 20 bp, Artificial Sequence
  chemically synthesized
agaaattccaatactccgat

SEQ ID NO: 261285 - DNA, 20 bp, Artificial Sequence
  chemically synthesized
cagtttcccaatcggagtat

SEQ ID NO: 261286 - DNA, 20 bp, Artificial Sequence
  chemically synthesized
ggagtattggaatttctatt

SEQ ID NO: 261287 - DNA, 20 bp, Artificial Sequence
  chemically synthesized
ttaggattttcaaaacttaa

SEQ ID NO: 261288 - DNA, 20 bp, Artificial Sequence
  chemically synthesized
tattaagttttgaaaatcct

SEQ ID NO: 261289 - DNA, 20 bp, Artificial Sequence
  chemically synthesized
atctgtagtgataatagctt

SEQ ID NO: 261290 - DNA, 20 bp, Artificial Sequence
  chemically synthesized
tatctgtagtgataatagct

SEQ ID NO: 261291 - DNA, 20 bp, Artificial Sequence
  chemically synthesized
ggcattatctgtagtgataa

SEQ ID NO: 261292 - DNA, 20 bp, Artificial Sequence
  chemically synthesized
atcctaagctattatcacta

SEQ ID NO: 261293 - DNA, 20 bp, Artificial Sequence
  chemically synthesized
tggagaagaggcattatctg

SEQ ID NO: 261294 - DNA, 20 bp, Artificial Sequence
  chemically synthesized
tcctacccacaatggagaag

SEQ ID NO: 261295 - DNA, 20 bp, Artificial Sequence
  chemically synthesized
atcctacccacaatggagaa

SEQ ID NO: 261296 - DNA, 20 bp, Artificial Sequence
  chemically synthesized
aaatcctacccacaatggag

SEQ ID NO: 261297 - DNA, 20 bp, Artificial Sequence
  chemically synthesized
ataatgcctcttctccattg

SEQ ID NO: 261298 - DNA, 20 bp, Artificial Sequence
  chemically synthesized
taatgcctcttctccattgt

SEQ ID NO: 261299 - DNA, 20 bp, Artificial Sequence
  chemically synthesized
aataaatcctacccacaatg

SEQ ID NO: 261300 - DNA, 20 bp, Artificial Sequence
  chemically synthesized
tgcctcttctccattgtggg

SEQ ID NO: 261301 - DNA, 20 bp, Artificial Sequence
  chemically synthesized
taaataaatcctacccacaa

SEQ ID NO: 261302 - DNA, 20 bp, Artificial Sequence
  chemically synthesized
gcctcttctccattgtgggt

SEQ ID NO: 261303 - DNA, 20 bp, Artificial Sequence
  chemically synthesized
gatttatttattccccttta

SEQ ID NO: 261304 - DNA, 20 bp, Artificial Sequence
  chemically synthesized
ggcttccctcagctgtaaag

SEQ ID NO: 261305 - DNA, 20 bp, Artificial Sequence
  chemically synthesized
gggcttccctcagctgtaaa

SEQ ID NO: 261306 - DNA, 20 bp, Artificial Sequence
  chemically synthesized
agggcttccctcagctgtaa

SEQ ID NO: 261307 - DNA, 20 bp, Artificial Sequence
  chemically synthesized
atttattcccctttacagct

SEQ ID NO: 261308 - DNA, 20 bp, Artificial Sequence
  chemically synthesized
aagggcttccctcagctgta

SEQ ID NO: 261309 - DNA, 20 bp, Artificial Sequence
  chemically synthesized
tttattcccctttacagctg

SEQ ID NO: 261310 - DNA, 20 bp, Artificial Sequence
  chemically synthesized
ttattcccctttacagctga

SEQ ID NO: 261311 - DNA, 20 bp, Artificial Sequence
  chemically synthesized
ttcccctttacagctgaggg

SEQ ID NO: 261312 - DNA, 20 bp, Artificial Sequence
  chemically synthesized
gaattttcaagggcttccct

SEQ ID NO: 261313 - DNA, 20 bp, Artificial Sequence
  chemically synthesized
cttaaagtctgaattttcaa

SEQ ID NO: 261314 - DNA, 20 bp, Artificial Sequence
  chemically synthesized
ccttaaagtctgaattttca

SEQ ID NO: 261315 - DNA, 20 bp, Artificial Sequence
  chemically synthesized
gagggaagcccttgaaaatt

SEQ ID NO: 261316 - DNA, 20 bp, Artificial Sequence
  chemically synthesized
tccttaaagtctgaattttc

SEQ ID NO: 261317 - DNA, 20 bp, Artificial Sequence
  chemically synthesized
cccttgaaaattcagacttt

SEQ ID NO: 261318 - DNA, 20 bp, Artificial Sequence
  chemically synthesized
ccttgaaaattcagacttta

SEQ ID NO: 261319 - DNA, 20 bp, Artificial Sequence
  chemically synthesized
ttgaaaattcagactttaag

SEQ ID NO: 261320 - DNA, 20 bp, Artificial Sequence
  chemically synthesized
tgaaaattcagactttaagg

SEQ ID NO: 261321 - DNA, 20 bp, Artificial Sequence
  chemically synthesized
gaaaattcagactttaagga

SEQ ID NO: 261322 - DNA, 20 bp, Artificial Sequence
  chemically synthesized
aaaattcagactttaaggag

SEQ ID NO: 261323 - DNA, 20 bp, Artificial Sequence
  chemically synthesized
gaaaataaaacccctcctta

SEQ ID NO: 261324 - DNA, 20 bp, Artificial Sequence
  chemically synthesized
ttcaacaacacataatatag

SEQ ID NO: 261325 - DNA, 20 bp, Artificial Sequence
  chemically synthesized
cttcaacaacacataatata

SEQ ID NO: 261326 - DNA, 20 bp, Artificial Sequence
  chemically synthesized
accttcaacaacacataata

SEQ ID NO: 261327 - DNA, 20 bp, Artificial Sequence
  chemically synthesized
ctctatattatgtgttgttg

SEQ ID NO: 261328 - DNA, 20 bp, Artificial Sequence
  chemically synthesized
tctatattatgtgttgttga

SEQ ID NO: 261329 - DNA, 20 bp, Artificial Sequence
  chemically synthesized
ggtcacatattttgtcctaa

SEQ ID NO: 261330 - DNA, 20 bp, Artificial Sequence
  chemically synthesized
gtcacatattttgtcctaaa

SEQ ID NO: 261331 - DNA, 20 bp, Artificial Sequence
  chemically synthesized
agaagttttcaagacctttt

SEQ ID NO: 261332 - DNA, 20 bp, Artificial Sequence
  chemically synthesized
aagaagttttcaagaccttt

SEQ ID NO: 261333 - DNA, 20 bp, Artificial Sequence
  chemically synthesized
atggctaggaagaagttttc

SEQ ID NO: 261334 - DNA, 20 bp, Artificial Sequence
  chemically synthesized
aggtcttgaaaacttcttcc

SEQ ID NO: 261335 - DNA, 20 bp, Artificial Sequence
  chemically synthesized
agagcctaatggctaggaag

SEQ ID NO: 261336 - DNA, 20 bp, Artificial Sequence
  chemically synthesized
ttgagagcctaatggctagg

SEQ ID NO: 261337 - DNA, 20 bp, Artificial Sequence
  chemically synthesized
gaaaacttcttcctagccat

SEQ ID NO: 261338 - DNA, 20 bp, Artificial Sequence
  chemically synthesized
aaaacttcttcctagccatt

SEQ ID NO: 261339 - DNA, 20 bp, Artificial Sequence
  chemically synthesized
ggattgagagcctaatggct

SEQ ID NO: 261340 - DNA, 20 bp, Artificial Sequence
  chemically synthesized
tggattgagagcctaatggc

SEQ ID NO: 261341 - DNA, 20 bp, Artificial Sequence
  chemically synthesized
aacctggattgagagcctaa

SEQ ID NO: 261342 - DNA, 20 bp, Artificial Sequence
  chemically synthesized
tagccattaggctctcaatc

SEQ ID NO: 261343 - DNA, 20 bp, Artificial Sequence
  chemically synthesized
agccattaggctctcaatcc

SEQ ID NO: 261344 - DNA, 20 bp, Artificial Sequence
  chemically synthesized
tgaaactgaacctggattga

SEQ ID NO: 261345 - DNA, 20 bp, Artificial Sequence
  chemically synthesized
cgtgaaactgaacctggatt

SEQ ID NO: 261346 - DNA, 20 bp, Artificial Sequence
  chemically synthesized
ttaggctctcaatccaggtt

SEQ ID NO: 261347 - DNA, 20 bp, Artificial Sequence
  chemically synthesized
atcttacgtgaaactgaacc

SEQ ID NO: 261348 - DNA, 20 bp, Artificial Sequence
  chemically synthesized
atccaggttcagtttcacgt

SEQ ID NO: 261349 - DNA, 20 bp, Artificial Sequence
  chemically synthesized
taagatgatttgatcattca

SEQ ID NO: 261350 - DNA, 20 bp, Artificial Sequence
  chemically synthesized
atttgatcattcatggcaca

SEQ ID NO: 261351 - DNA, 20 bp, Artificial Sequence
  chemically synthesized
ttgatcattcatggcacaca

SEQ ID NO: 261352 - DNA, 20 bp, Artificial Sequence
  chemically synthesized
tgatcattcatggcacacag

SEQ ID NO: 261353 - DNA, 20 bp, Artificial Sequence
  chemically synthesized
gatcattcatggcacacaga

SEQ ID NO: 261354 - DNA, 20 bp, Artificial Sequence
  chemically synthesized
cattcatggcacacagaggg

SEQ ID NO: 261355 - DNA, 20 bp, Artificial Sequence
  chemically synthesized
ttcatggcacacagagggaa

SEQ ID NO: 261356 - DNA, 20 bp, Artificial Sequence
  chemically synthesized
catggcacacagagggaaga

SEQ ID NO: 261357 - DNA, 20 bp, Artificial Sequence
  chemically synthesized
atggcacacagagggaagag

SEQ ID NO: 261358 - DNA, 20 bp, Artificial Sequence
  chemically synthesized
agggaagagaggttccacca

SEQ ID NO: 261359 - DNA, 20 bp, Artificial Sequence
  chemically synthesized
aatacacagctgggctatgg

SEQ ID NO: 261360 - DNA, 20 bp, Artificial Sequence
  chemically synthesized
agagaggttccaccatagcc

SEQ ID NO: 261361 - DNA, 20 bp, Artificial Sequence
  chemically synthesized
ttaaatacacagctgggcta

SEQ ID NO: 261362 - DNA, 20 bp, Artificial Sequence
  chemically synthesized
aaagttttaaatacacagct

SEQ ID NO: 261363 - DNA, 20 bp, Artificial Sequence
  chemically synthesized
aaaagttttaaatacacagc

SEQ ID NO: 261364 - DNA, 20 bp, Artificial Sequence
  chemically synthesized
ttttaaaagttttaaataca

SEQ ID NO: 261365 - DNA, 20 bp, Artificial Sequence
  chemically synthesized
gaataaaatataatttttaa

SEQ ID NO: 261366 - DNA, 20 bp, Artificial Sequence
  chemically synthesized
tttaaaaattatattttatt

SEQ ID NO: 261367 - DNA, 20 bp, Artificial Sequence
  chemically synthesized
accccctcacttcaaatgcg

SEQ ID NO: 261368 - DNA, 20 bp, Artificial Sequence
  chemically synthesized
tcagaatttccacgcatttg

SEQ ID NO: 261369 - DNA, 20 bp, Artificial Sequence
  chemically synthesized
aatttccacgcatttgaagt

SEQ ID NO: 261370 - DNA, 20 bp, Artificial Sequence
  chemically synthesized
atttccacgcatttgaagtg

SEQ ID NO: 261371 - DNA, 20 bp, Artificial Sequence
  chemically synthesized
tttccacgcatttgaagtga

SEQ ID NO: 261372 - DNA, 20 bp, Artificial Sequence
  chemically synthesized
ttccacgcatttgaagtgag

SEQ ID NO: 261373 - DNA, 20 bp, Artificial Sequence
  chemically synthesized
tccacgcatttgaagtgagg

SEQ ID NO: 261374 - DNA, 20 bp, Artificial Sequence
  chemically synthesized
cgcatttgaagtgagggggt

SEQ ID NO: 261375 - DNA, 20 bp, Artificial Sequence
  chemically synthesized
gcatttgaagtgagggggtg

SEQ ID NO: 261376 - DNA, 20 bp, Artificial Sequence
  chemically synthesized
aagtgagggggtgaggaatt

SEQ ID NO: 261377 - DNA, 20 bp, Artificial Sequence
  chemically synthesized
gagggggtgaggaattaagt

SEQ ID NO: 261378 - DNA, 20 bp, Artificial Sequence
  chemically synthesized
atcagcttccagaaagatga

SEQ ID NO: 261379 - DNA, 20 bp, Artificial Sequence
  chemically synthesized
aagtcagtctgtcatctttc

SEQ ID NO: 261380 - DNA, 20 bp, Artificial Sequence
  chemically synthesized
tcagtctgtcatctttctgg

SEQ ID NO: 261381 - DNA, 20 bp, Artificial Sequence
  chemically synthesized
agcgagtatcagcttccaga

SEQ ID NO: 261382 - DNA, 20 bp, Artificial Sequence
  chemically synthesized
gttcagcgagtatcagcttc

SEQ ID NO: 261383 - DNA, 20 bp, Artificial Sequence
  chemically synthesized
gaggcatgttcagcgagtat

SEQ ID NO: 261384 - DNA, 20 bp, Artificial Sequence
  chemically synthesized
taagtagaggcatgttcagc

SEQ ID NO: 261385 - DNA, 20 bp, Artificial Sequence
  chemically synthesized
tggttaagtagaggcatgtt

SEQ ID NO: 261386 - DNA, 20 bp, Artificial Sequence
  chemically synthesized
tcagtttaatggttaagtag

SEQ ID NO: 261387 - DNA, 20 bp, Artificial Sequence
  chemically synthesized
atcagtttaatggttaagta

SEQ ID NO: 261388 - DNA, 20 bp, Artificial Sequence
  chemically synthesized
taatcagtttaatggttaag

SEQ ID NO: 261389 - DNA, 20 bp, Artificial Sequence
  chemically synthesized
gcataatcagtttaatggtt

SEQ ID NO: 261390 - DNA, 20 bp, Artificial Sequence
  chemically synthesized
gtgtagcataatcagtttaa

SEQ ID NO: 261391 - DNA, 20 bp, Artificial Sequence
  chemically synthesized
gtctagttgtgtagcataat

SEQ ID NO: 261392 - DNA, 20 bp, Artificial Sequence
  chemically synthesized
aactgattatgctacacaac

SEQ ID NO: 261393 - DNA, 20 bp, Artificial Sequence
  chemically synthesized
tgttctagtgtctagttgtg

SEQ ID NO: 261394 - DNA, 20 bp, Artificial Sequence
  chemically synthesized
tatgctacacaactagacac

SEQ ID NO: 261395 - DNA, 20 bp, Artificial Sequence
  chemically synthesized
agtttttttgttctagtgtc

SEQ ID NO: 261396 - DNA, 20 bp, Artificial Sequence
  chemically synthesized
tgtacggagtttttttgttc

SEQ ID NO: 261397 - DNA, 20 bp, Artificial Sequence
  chemically synthesized
tggttataaatatttgtacg

SEQ ID NO: 261398 - DNA, 20 bp, Artificial Sequence
  chemically synthesized
agtggttataaatatttgta

SEQ ID NO: 261399 - DNA, 20 bp, Artificial Sequence
  chemically synthesized
tagattgttgatgatcatag

SEQ ID NO: 261400 - DNA, 20 bp, Artificial Sequence
  chemically synthesized
ttctagattgttgatgatca

SEQ ID NO: 261401 - DNA, 20 bp, Artificial Sequence
  chemically synthesized
cactatgatcatcaacaatc

SEQ ID NO: 261402 - DNA, 20 bp, Artificial Sequence
  chemically synthesized
gctaacattttatgtttttc

SEQ ID NO: 261403 - DNA, 20 bp, Artificial Sequence
  chemically synthesized
tctagaaaaacataaaatgt

SEQ ID NO: 261404 - DNA, 20 bp, Artificial Sequence
  chemically synthesized
acaaggattaaaaaagaaat

SEQ ID NO: 261405 - DNA, 20 bp, Artificial Sequence
  chemically synthesized
acatattacaaggattaaaa

SEQ ID NO: 261406 - DNA, 20 bp, Artificial Sequence
  chemically synthesized
tttgtaattaacatattaca

SEQ ID NO: 261407 - DNA, 20 bp, Artificial Sequence
  chemically synthesized
ttttgtaattaacatattac

SEQ ID NO: 261408 - DNA, 20 bp, Artificial Sequence
  chemically synthesized
aatatgttaattacaaaatt

SEQ ID NO: 261409 - DNA, 20 bp, Artificial Sequence
  chemically synthesized
gttaattacaaaattgagct

SEQ ID NO: 261410 - DNA, 20 bp, Artificial Sequence
  chemically synthesized
taattacaaaattgagctga

SEQ ID NO: 261411 - DNA, 20 bp, Artificial Sequence
  chemically synthesized
aattacaaaattgagctgag

SEQ ID NO: 261412 - DNA, 20 bp, Artificial Sequence
  chemically synthesized
ttacaaaattgagctgagag

SEQ ID NO: 261413 - DNA, 20 bp, Artificial Sequence
  chemically synthesized
ttgtagaatttttctcctct

SEQ ID NO: 261414 - DNA, 20 bp, Artificial Sequence
  chemically synthesized
gaggagaaaaattctacaaa

SEQ ID NO: 261415 - DNA, 20 bp, Artificial Sequence
  chemically synthesized
caccaggatgtagctgtttg

SEQ ID NO: 261416 - DNA, 20 bp, Artificial Sequence
  chemically synthesized
ttctacaaacagctacatcc

SEQ ID NO: 261417 - DNA, 20 bp, Artificial Sequence
  chemically synthesized
ggaaatgttgcaccaggatg

SEQ ID NO: 261418 - DNA, 20 bp, Artificial Sequence
  chemically synthesized
gttaagggaaatgttgcacc

SEQ ID NO: 261419 - DNA, 20 bp, Artificial Sequence
  chemically synthesized
tgttaagggaaatgttgcac

SEQ ID NO: 261420 - DNA, 20 bp, Artificial Sequence
  chemically synthesized
agactaataatggttgttaa

SEQ ID NO: 261421 - DNA, 20 bp, Artificial Sequence
  chemically synthesized
aagactaataatggttgtta

SEQ ID NO: 261422 - DNA, 20 bp, Artificial Sequence
  chemically synthesized
aaagactaataatggttgtt

SEQ ID NO: 261423 - DNA, 20 bp, Artificial Sequence
  chemically synthesized
tttcccttaacaaccattat

SEQ ID NO: 261424 - DNA, 20 bp, Artificial Sequence
  chemically synthesized
taaatacaaaagactaataa

SEQ ID NO: 261425 - DNA, 20 bp, Artificial Sequence
  chemically synthesized
aaatggaattgtaaatacaa

SEQ ID NO: 261426 - DNA, 20 bp, Artificial Sequence
  chemically synthesized
atttacaattccatttgcta

SEQ ID NO: 261427 - DNA, 20 bp, Artificial Sequence
  chemically synthesized
acagaatgttctttagcaaa

SEQ ID NO: 261428 - DNA, 20 bp, Artificial Sequence
  chemically synthesized
tttagagacagaatgttctt

SEQ ID NO: 261429 - DNA, 20 bp, Artificial Sequence
  chemically synthesized
atgattttcttatttagaga

SEQ ID NO: 261430 - DNA, 20 bp, Artificial Sequence
  chemically synthesized
agaacattctgtctctaaat

SEQ ID NO: 261431 - DNA, 20 bp, Artificial Sequence
  chemically synthesized
ataaatgattttcttattta

SEQ ID NO: 261432 - DNA, 20 bp, Artificial Sequence
  chemically synthesized
agataaatgattttcttatt

SEQ ID NO: 261433 - DNA, 20 bp, Artificial Sequence
  chemically synthesized
acatccttggagaatttggg

SEQ ID NO: 261434 - DNA, 20 bp, Artificial Sequence
  chemically synthesized
gcaacatccttggagaattt

SEQ ID NO: 261435 - DNA, 20 bp, Artificial Sequence
  chemically synthesized
tgcaacatccttggagaatt

SEQ ID NO: 261436 - DNA, 20 bp, Artificial Sequence
  chemically synthesized
tttatcttcccaaattctcc

SEQ ID NO: 261437 - DNA, 20 bp, Artificial Sequence
  chemically synthesized
ttatcttcccaaattctcca

SEQ ID NO: 261438 - DNA, 20 bp, Artificial Sequence
  chemically synthesized
ctgccagtgcaacatccttg

SEQ ID NO: 261439 - DNA, 20 bp, Artificial Sequence
  chemically synthesized
agctgccagtgcaacatcct

SEQ ID NO: 261440 - DNA, 20 bp, Artificial Sequence
  chemically synthesized
attctccaaggatgttgcac

SEQ ID NO: 261441 - DNA, 20 bp, Artificial Sequence
  chemically synthesized
ctccaaggatgttgcactgg

SEQ ID NO: 261442 - DNA, 20 bp, Artificial Sequence
  chemically synthesized
caacaaagattgtcagctgc

SEQ ID NO: 261443 - DNA, 20 bp, Artificial Sequence
  chemically synthesized
gaaataacaacaaagattgt

SEQ ID NO: 261444 - DNA, 20 bp, Artificial Sequence
  chemically synthesized
tttgccttgaaataacaaca

SEQ ID NO: 261445 - DNA, 20 bp, Artificial Sequence
  chemically synthesized
acaatctttgttgttatttc

SEQ ID NO: 261446 - DNA, 20 bp, Artificial Sequence
  chemically synthesized
caatctttgttgttatttca

SEQ ID NO: 261447 - DNA, 20 bp, Artificial Sequence
  chemically synthesized
tttgttgttatttcaaggca

SEQ ID NO: 261448 - DNA, 20 bp, Artificial Sequence
  chemically synthesized
gttgttatttcaaggcaaag

SEQ ID NO: 261449 - DNA, 20 bp, Artificial Sequence
  chemically synthesized
ggcaaagaagaaaatctatg

SEQ ID NO: 261450 - DNA, 20 bp, Artificial Sequence
  chemically synthesized
gtctttgcataattgccaca

SEQ ID NO: 261451 - DNA, 20 bp, Artificial Sequence
  chemically synthesized
atctatgtggcaattatgca

SEQ ID NO: 261452 - DNA, 20 bp, Artificial Sequence
  chemically synthesized
cattttgagaataaaattag

SEQ ID NO: 261453 - DNA, 20 bp, Artificial Sequence
  chemically synthesized
tcattttgagaataaaatta

SEQ ID NO: 261454 - DNA, 20 bp, Artificial Sequence
  chemically synthesized
ctcattttgagaataaaatt

SEQ ID NO: 261455 - DNA, 20 bp, Artificial Sequence
  chemically synthesized
actcattttgagaataaaat

SEQ ID NO: 261456 - DNA, 20 bp, Artificial Sequence
  chemically synthesized
cctaattttattctcaaaat

SEQ ID NO: 261457 - DNA, 20 bp, Artificial Sequence
  chemically synthesized
taataaaagcaactcatttt

SEQ ID NO: 261458 - DNA, 20 bp, Artificial Sequence
  chemically synthesized
aaatgagttgcttttattac

SEQ ID NO: 261459 - DNA, 20 bp, Artificial Sequence
  chemically synthesized
tgtctcctatcttgtaataa

SEQ ID NO: 261460 - DNA, 20 bp, Artificial Sequence
  chemically synthesized
gagttgcttttattacaaga

SEQ ID NO: 261461 - DNA, 20 bp, Artificial Sequence
  chemically synthesized
agttgcttttattacaagat

SEQ ID NO: 261462 - DNA, 20 bp, Artificial Sequence
  chemically synthesized
ttgcttttattacaagatag

SEQ ID NO: 261463 - DNA, 20 bp, Artificial Sequence
  chemically synthesized
gagacaatataaaaaatgtg

SEQ ID NO: 261464 - DNA, 20 bp, Artificial Sequence
  chemically synthesized
acaatataaaaaatgtgtag

SEQ ID NO: 261465 - DNA, 20 bp, Artificial Sequence
  chemically synthesized
gtgtagcagaccattaaatc

SEQ ID NO: 261466 - DNA, 20 bp, Artificial Sequence
  chemically synthesized
atgtctgagcctagatttaa

SEQ ID NO: 261467 - DNA, 20 bp, Artificial Sequence
  chemically synthesized
tgtagcagaccattaaatct

SEQ ID NO: 261468 - DNA, 20 bp, Artificial Sequence
  chemically synthesized
cagaccattaaatctaggct

SEQ ID NO: 261469 - DNA, 20 bp, Artificial Sequence
  chemically synthesized
tgtaaaataatgtctgagcc

SEQ ID NO: 261470 - DNA, 20 bp, Artificial Sequence
  chemically synthesized
ccttatgtaaaataatgtct

SEQ ID NO: 261471 - DNA, 20 bp, Artificial Sequence
  chemically synthesized
gctcagacattattttacat

SEQ ID NO: 261472 - DNA, 20 bp, Artificial Sequence
  chemically synthesized
ctcagacattattttacata

SEQ ID NO: 261473 - DNA, 20 bp, Artificial Sequence
  chemically synthesized
agacattattttacataagg

SEQ ID NO: 261474 - DNA, 20 bp, Artificial Sequence
  chemically synthesized
cattattttacataaggtgg

SEQ ID NO: 261475 - DNA, 20 bp, Artificial Sequence
  chemically synthesized
ttacataaggtggtggcaaa

SEQ ID NO: 261476 - DNA, 20 bp, Artificial Sequence
  chemically synthesized
atgtacaagaaaagtaataa

SEQ ID NO: 261477 - DNA, 20 bp, Artificial Sequence
  chemically synthesized
taagcagagatgtacaagaa

SEQ ID NO: 261478 - DNA, 20 bp, Artificial Sequence
  chemically synthesized
aaatttaagcagagatgtac

SEQ ID NO: 261479 - DNA, 20 bp, Artificial Sequence
  chemically synthesized
gatttccttaaatttaagca

SEQ ID NO: 261480 - DNA, 20 bp, Artificial Sequence
  chemically synthesized
gggatttccttaaatttaag

SEQ ID NO: 261481 - DNA, 20 bp, Artificial Sequence
  chemically synthesized
gtacatctctgcttaaattt

SEQ ID NO: 261482 - DNA, 20 bp, Artificial Sequence
  chemically synthesized
tacatctctgcttaaattta

SEQ ID NO: 261483 - DNA, 20 bp, Artificial Sequence
  chemically synthesized
tttgggatttccttaaattt

SEQ ID NO: 261484 - DNA, 20 bp, Artificial Sequence
  chemically synthesized
tttaaggaaatcccaaacaa

SEQ ID NO: 261485 - DNA, 20 bp, Artificial Sequence
  chemically synthesized
tcattattcttctgttgttt

SEQ ID NO: 261486 - DNA, 20 bp, Artificial Sequence
  chemically synthesized
atcattattcttctgttgtt

SEQ ID NO: 261487 - DNA, 20 bp, Artificial Sequence
  chemically synthesized
aaggaaatcccaaacaacag

SEQ ID NO: 261488 - DNA, 20 bp, Artificial Sequence
  chemically synthesized
acaacagaagaataatgata

SEQ ID NO: 261489 - DNA, 20 bp, Artificial Sequence
  chemically synthesized
attctttagaaaaaaatggg

SEQ ID NO: 261490 - DNA, 20 bp, Artificial Sequence
  chemically synthesized
aatattctttagaaaaaaat

SEQ ID NO: 261491 - DNA, 20 bp, Artificial Sequence
  chemically synthesized
gaatattctttagaaaaaaa

SEQ ID NO: 261492 - DNA, 20 bp, Artificial Sequence
  chemically synthesized
gttcttcccatttttttcta

SEQ ID NO: 261493 - DNA, 20 bp, Artificial Sequence
  chemically synthesized
ggtgaaataagaatattctt

SEQ ID NO: 261494 - DNA, 20 bp, Artificial Sequence
  chemically synthesized
tatttgagtgatggtgaaat

SEQ ID NO: 261495 - DNA, 20 bp, Artificial Sequence
  chemically synthesized
aaggtttcttatttgagtga

SEQ ID NO: 261496 - DNA, 20 bp, Artificial Sequence
  chemically synthesized
tatttcaccatcactcaaat

SEQ ID NO: 261497 - DNA, 20 bp, Artificial Sequence
  chemically synthesized
tgatgaaaggtttcttattt

SEQ ID NO: 261498 - DNA, 20 bp, Artificial Sequence
  chemically synthesized
tttgatttcagattgatgaa

SEQ ID NO: 261499 - DNA, 20 bp, Artificial Sequence
  chemically synthesized
atttgatttcagattgatga

SEQ ID NO: 261500 - DNA, 20 bp, Artificial Sequence
  chemically synthesized
agaaaagggaaatttgattt

SEQ ID NO: 261501 - DNA, 20 bp, Artificial Sequence
  chemically synthesized
tagacagttgcagtagaaaa

SEQ ID NO: 261502 - DNA, 20 bp, Artificial Sequence
  chemically synthesized
ctagacagttgcagtagaaa

SEQ ID NO: 261503 - DNA, 20 bp, Artificial Sequence
  chemically synthesized
tctagacagttgcagtagaa

SEQ ID NO: 261504 - DNA, 20 bp, Artificial Sequence
  chemically synthesized
tcacatctagacagttgcag

SEQ ID NO: 261505 - DNA, 20 bp, Artificial Sequence
  chemically synthesized
ctttcacatctagacagttg

SEQ ID NO: 261506 - DNA, 20 bp, Artificial Sequence
  chemically synthesized
ccttttctactgcaactgtc

SEQ ID NO: 261507 - DNA, 20 bp, Artificial Sequence
  chemically synthesized
tatagactttcacatctaga

SEQ ID NO: 261508 - DNA, 20 bp, Artificial Sequence
  chemically synthesized
ctgcaactgtctagatgtga

SEQ ID NO: 261509 - DNA, 20 bp, Artificial Sequence
  chemically synthesized
attctatagactttcacatc

SEQ ID NO: 261510 - DNA, 20 bp, Artificial Sequence
  chemically synthesized
tgtctagatgtgaaagtcta

SEQ ID NO: 261511 - DNA, 20 bp, Artificial Sequence
  chemically synthesized
tatgaaggggttagattcta

SEQ ID NO: 261512 - DNA, 20 bp, Artificial Sequence
  chemically synthesized
atgactttctatgaaggggt

SEQ ID NO: 261513 - DNA, 20 bp, Artificial Sequence
  chemically synthesized
tatagaatctaaccccttca

SEQ ID NO: 261514 - DNA, 20 bp, Artificial Sequence
  chemically synthesized
gattatgactttctatgaag

SEQ ID NO: 261515 - DNA, 20 bp, Artificial Sequence
  chemically synthesized
ggattatgactttctatgaa

SEQ ID NO: 261516 - DNA, 20 bp, Artificial Sequence
  chemically synthesized
gaatctaaccccttcataga

SEQ ID NO: 261517 - DNA, 20 bp, Artificial Sequence
  chemically synthesized
gggattatgactttctatga

SEQ ID NO: 261518 - DNA, 20 bp, Artificial Sequence
  chemically synthesized
tgggattatgactttctatg

SEQ ID NO: 261519 - DNA, 20 bp, Artificial Sequence
  chemically synthesized
atagaaagtcataatcccat

SEQ ID NO: 261520 - DNA, 20 bp, Artificial Sequence
  chemically synthesized
agtgcgtttgatatgctaat

SEQ ID NO: 261521 - DNA, 20 bp, Artificial Sequence
  chemically synthesized
tagtgcgtttgatatgctaa

SEQ ID NO: 261522 - DNA, 20 bp, Artificial Sequence
  chemically synthesized
cattagcatatcaaacgcac

SEQ ID NO: 261523 - DNA, 20 bp, Artificial Sequence
  chemically synthesized
agcatatcaaacgcactaga

SEQ ID NO: 261524 - DNA, 20 bp, Artificial Sequence
  chemically synthesized
ttccttactctataactttc

SEQ ID NO: 261525 - DNA, 20 bp, Artificial Sequence
  chemically synthesized
tcaaacgcactagaaagtta

SEQ ID NO: 261526 - DNA, 20 bp, Artificial Sequence
  chemically synthesized
aaacgcactagaaagttata

SEQ ID NO: 261527 - DNA, 20 bp, Artificial Sequence
  chemically synthesized
gcactagaaagttatagagt

SEQ ID NO: 261528 - DNA, 20 bp, Artificial Sequence
  chemically synthesized
cactagaaagttatagagta

SEQ ID NO: 261529 - DNA, 20 bp, Artificial Sequence
  chemically synthesized
agaaagttatagagtaagga

SEQ ID NO: 261530 - DNA, 20 bp, Artificial Sequence
  chemically synthesized
attttggtaaacagtagatt

SEQ ID NO: 261531 - DNA, 20 bp, Artificial Sequence
  chemically synthesized
taaacaattttggtaaacag

SEQ ID NO: 261532 - DNA, 20 bp, Artificial Sequence
  chemically synthesized
gtttaaacaattttggtaaa

SEQ ID NO: 261533 - DNA, 20 bp, Artificial Sequence
  chemically synthesized
tttcagtgtttaaacaattt

SEQ ID NO: 261534 - DNA, 20 bp, Artificial Sequence
  chemically synthesized
ataaaaaaggaaaaaagttt

SEQ ID NO: 261535 - DNA, 20 bp, Artificial Sequence
  chemically synthesized
ttattaataaaaaaggaaaa

SEQ ID NO: 261536 - DNA, 20 bp, Artificial Sequence
  chemically synthesized
gtgggagttattaataaaaa

SEQ ID NO: 261537 - DNA, 20 bp, Artificial Sequence
  chemically synthesized
ggtgggagttattaataaaa

SEQ ID NO: 261538 - DNA, 20 bp, Artificial Sequence
  chemically synthesized
tgctttccaaaacatggtgg

SEQ ID NO: 261539 - DNA, 20 bp, Artificial Sequence
  chemically synthesized
actgctttccaaaacatggt

SEQ ID NO: 261540 - DNA, 20 bp, Artificial Sequence
  chemically synthesized
cactgctttccaaaacatgg

SEQ ID NO: 261541 - DNA, 20 bp, Artificial Sequence
  chemically synthesized
taataactcccaccatgttt

SEQ ID NO: 261542 - DNA, 20 bp, Artificial Sequence
  chemically synthesized
actcactgctttccaaaaca

SEQ ID NO: 261543 - DNA, 20 bp, Artificial Sequence
  chemically synthesized
aactcccaccatgttttgga

SEQ ID NO: 261544 - DNA, 20 bp, Artificial Sequence
  chemically synthesized
tcccaccatgttttggaaag

SEQ ID NO: 261545 - DNA, 20 bp, Artificial Sequence
  chemically synthesized
accatgttttggaaagcagt

SEQ ID NO: 261546 - DNA, 20 bp, Artificial Sequence
  chemically synthesized
ttttggaaagcagtgagttc

SEQ ID NO: 261547 - DNA, 20 bp, Artificial Sequence
  chemically synthesized
gaaagcagtgagttcaagtt

SEQ ID NO: 261548 - DNA, 20 bp, Artificial Sequence
  chemically synthesized
aggatacatctgagaaatgg

SEQ ID NO: 261549 - DNA, 20 bp, Artificial Sequence
  chemically synthesized
gtttggcgtcttccatttct

SEQ ID NO: 261550 - DNA, 20 bp, Artificial Sequence
  chemically synthesized
ccaaggatacatctgagaaa

SEQ ID NO: 261551 - DNA, 20 bp, Artificial Sequence
  chemically synthesized
atttgtccaaggatacatct

SEQ ID NO: 261552 - DNA, 20 bp, Artificial Sequence
  chemically synthesized
ccatttctcagatgtatcct

SEQ ID NO: 261553 - DNA, 20 bp, Artificial Sequence
  chemically synthesized
gaggttaagagatttgtcca

SEQ ID NO: 261554 - DNA, 20 bp, Artificial Sequence
  chemically synthesized
tgaggttaagagatttgtcc

SEQ ID NO: 261555 - DNA, 20 bp, Artificial Sequence
  chemically synthesized
attagcataaatgaggttaa

SEQ ID NO: 261556 - DNA, 20 bp, Artificial Sequence
  chemically synthesized
aaattagcataaatgaggtt

SEQ ID NO: 261557 - DNA, 20 bp, Artificial Sequence
  chemically synthesized
aagaaaaattagcataaatg

SEQ ID NO: 261558 - DNA, 20 bp, Artificial Sequence
  chemically synthesized
taagaaaaattagcataaat

SEQ ID NO: 261559 - DNA, 20 bp, Artificial Sequence
  chemically synthesized
cattttactgtaagaaaaat

SEQ ID NO: 261560 - DNA, 20 bp, Artificial Sequence
  chemically synthesized
atttatgctaatttttctta

SEQ ID NO: 261561 - DNA, 20 bp, Artificial Sequence
  chemically synthesized
tttctttgtcattttactgt

SEQ ID NO: 261562 - DNA, 20 bp, Artificial Sequence
  chemically synthesized
tttcttacagtaaaatgaca

SEQ ID NO: 261563 - DNA, 20 bp, Artificial Sequence
  chemically synthesized
tgacaaagaaaatgatactt

SEQ ID NO: 261564 - DNA, 20 bp, Artificial Sequence
  chemically synthesized
acaaagaaaatgatacttga

SEQ ID NO: 261565 - DNA, 20 bp, Artificial Sequence
  chemically synthesized
caaagaaaatgatacttgag

SEQ ID NO: 261566 - DNA, 20 bp, Artificial Sequence
  chemically synthesized
aaagaaaatgatacttgaga

SEQ ID NO: 261567 - DNA, 20 bp, Artificial Sequence
  chemically synthesized
atcacagtaatgaccctctc

SEQ ID NO: 261568 - DNA, 20 bp, Artificial Sequence
  chemically synthesized
acatgcatctagtttgatca

SEQ ID NO: 261569 - DNA, 20 bp, Artificial Sequence
  chemically synthesized
ggtcattactgtgatcaaac

SEQ ID NO: 261570 - DNA, 20 bp, Artificial Sequence
  chemically synthesized
aaagagttttcacatgcatc

SEQ ID NO: 261571 - DNA, 20 bp, Artificial Sequence
  chemically synthesized
tagtattatacattcacaaa

SEQ ID NO: 261572 - DNA, 20 bp, Artificial Sequence
  chemically synthesized
aatagtattatacattcaca

SEQ ID NO: 261573 - DNA, 20 bp, Artificial Sequence
  chemically synthesized
tgtgaatgtataatactatt

SEQ ID NO: 261574 - DNA, 20 bp, Artificial Sequence
  chemically synthesized
ttaagttgtttgaatctgaa

SEQ ID NO: 261575 - DNA, 20 bp, Artificial Sequence
  chemically synthesized
cagattcaaacaacttaaaa

SEQ ID NO: 261576 - DNA, 20 bp, Artificial Sequence
  chemically synthesized
atttttccactaactttttt

SEQ ID NO: 261577 - DNA, 20 bp, Artificial Sequence
  chemically synthesized
ttcaaacaacttaaaaaagt

SEQ ID NO: 261578 - DNA, 20 bp, Artificial Sequence
  chemically synthesized
aaacaacttaaaaaagttag

SEQ ID NO: 261579 - DNA, 20 bp, Artificial Sequence
  chemically synthesized
ggaaaaatattcacaatata

SEQ ID NO: 261580 - DNA, 20 bp, Artificial Sequence
  chemically synthesized
gaaaaatattcacaatatat

SEQ ID NO: 261581 - DNA, 20 bp, Artificial Sequence
  chemically synthesized
ttttacaaatttattcaatt

SEQ ID NO: 261582 - DNA, 20 bp, Artificial Sequence
  chemically synthesized
tttacaaatttattcaatta

SEQ ID NO: 261583 - DNA, 20 bp, Artificial Sequence
  chemically synthesized
cccgcctcaagaaaaaaaag

SEQ ID NO: 261584 - DNA, 20 bp, Artificial Sequence
  chemically synthesized
gaccccgcctcaagaaaaaa

SEQ ID NO: 261585 - DNA, 20 bp, Artificial Sequence
  chemically synthesized
aaggactacttttttttctt

SEQ ID NO: 261586 - DNA, 20 bp, Artificial Sequence
  chemically synthesized
aggactacttttttttcttg

SEQ ID NO: 261587 - DNA, 20 bp, Artificial Sequence
  chemically synthesized
actacttttttttcttgagg

SEQ ID NO: 261588 - DNA, 20 bp, Artificial Sequence
  chemically synthesized
ctacttttttttcttgaggc

SEQ ID NO: 261589 - DNA, 20 bp, Artificial Sequence
  chemically synthesized
tacttttttttcttgaggcg

SEQ ID NO: 261590 - DNA, 20 bp, Artificial Sequence
  chemically synthesized
acagattgagaccccgcctc

SEQ ID NO: 261591 - DNA, 20 bp, Artificial Sequence
  chemically synthesized
tacagcctgggcaacagatt

SEQ ID NO: 261592 - DNA, 20 bp, Artificial Sequence
  chemically synthesized
cggggtctcaatctgttgcc

SEQ ID NO: 261593 - DNA, 20 bp, Artificial Sequence
  chemically synthesized
ggggtctcaatctgttgccc

SEQ ID NO: 261594 - DNA, 20 bp, Artificial Sequence
  chemically synthesized
ctgcactacagcctgggcaa

SEQ ID NO: 261595 - DNA, 20 bp, Artificial Sequence
  chemically synthesized
tcaatctgttgcccaggctg

SEQ ID NO: 261596 - DNA, 20 bp, Artificial Sequence
  chemically synthesized
acaccactgcactacagcct

SEQ ID NO: 261597 - DNA, 20 bp, Artificial Sequence
  chemically synthesized
cacaccactgcactacagcc

SEQ ID NO: 261598 - DNA, 20 bp, Artificial Sequence
  chemically synthesized
ctgttgcccaggctgtagtg

SEQ ID NO: 261599 - DNA, 20 bp, Artificial Sequence
  chemically synthesized
gggatcacaccactgcacta

SEQ ID NO: 261600 - DNA, 20 bp, Artificial Sequence
  chemically synthesized
ttgcccaggctgtagtgcag

SEQ ID NO: 261601 - DNA, 20 bp, Artificial Sequence
  chemically synthesized
gacagaggttacagtcagca

SEQ ID NO: 261602 - DNA, 20 bp, Artificial Sequence
  chemically synthesized
agacagaggttacagtcagc

SEQ ID NO: 261603 - DNA, 20 bp, Artificial Sequence
  chemically synthesized
gagacagaggttacagtcag

SEQ ID NO: 261604 - DNA, 20 bp, Artificial Sequence
  chemically synthesized
tgggagacagaggttacagt

SEQ ID NO: 261605 - DNA, 20 bp, Artificial Sequence
  chemically synthesized
aaactgggagacagaggtta

SEQ ID NO: 261606 - DNA, 20 bp, Artificial Sequence
  chemically synthesized
tgcttgaaactgggagacag

SEQ ID NO: 261607 - DNA, 20 bp, Artificial Sequence
  chemically synthesized
tgactgtaacctctgtctcc

SEQ ID NO: 261608 - DNA, 20 bp, Artificial Sequence
  chemically synthesized
ttgcttgaaactgggagaca

SEQ ID NO: 261609 - DNA, 20 bp, Artificial Sequence
  chemically synthesized
aattgcttgaaactgggaga

SEQ ID NO: 261610 - DNA, 20 bp, Artificial Sequence
  chemically synthesized
tgagaattgcttgaaactgg

SEQ ID NO: 261611 - DNA, 20 bp, Artificial Sequence
  chemically synthesized
aacctctgtctcccagtttc

SEQ ID NO: 261612 - DNA, 20 bp, Artificial Sequence
  chemically synthesized
catgagaattgcttgaaact

SEQ ID NO: 261613 - DNA, 20 bp, Artificial Sequence
  chemically synthesized
gcatgagaattgcttgaaac

SEQ ID NO: 261614 - DNA, 20 bp, Artificial Sequence
  chemically synthesized
ttcaagcaattctcatgcct

SEQ ID NO: 261615 - DNA, 20 bp, Artificial Sequence
  chemically synthesized
cttctcagaggctgaggcat

SEQ ID NO: 261616 - DNA, 20 bp, Artificial Sequence
  chemically synthesized
tccaagcttctcagaggctg

SEQ ID NO: 261617 - DNA, 20 bp, Artificial Sequence
  chemically synthesized
attctcatgcctcagcctct

SEQ ID NO: 261618 - DNA, 20 bp, Artificial Sequence
  chemically synthesized
atccaagcttctcagaggct

SEQ ID NO: 261619 - DNA, 20 bp, Artificial Sequence
  chemically synthesized
ctcatgcctcagcctctgag

SEQ ID NO: 261620 - DNA, 20 bp, Artificial Sequence
  chemically synthesized
ttgtaatccaagcttctcag

SEQ ID NO: 261621 - DNA, 20 bp, Artificial Sequence
  chemically synthesized
cttgtaatccaagcttctca

SEQ ID NO: 261622 - DNA, 20 bp, Artificial Sequence
  chemically synthesized
gcctcagcctctgagaagct

SEQ ID NO: 261623 - DNA, 20 bp, Artificial Sequence
  chemically synthesized
tgcttgtaatccaagcttct

SEQ ID NO: 261624 - DNA, 20 bp, Artificial Sequence
  chemically synthesized
ctctgagaagcttggattac

SEQ ID NO: 261625 - DNA, 20 bp, Artificial Sequence
  chemically synthesized
ctggcagttgcttgtaatcc

SEQ ID NO: 261626 - DNA, 20 bp, Artificial Sequence
  chemically synthesized
cttggattacaagcaactgc

SEQ ID NO: 261627 - DNA, 20 bp, Artificial Sequence
  chemically synthesized
gattacaagcaactgccagc

SEQ ID NO: 261628 - DNA, 20 bp, Artificial Sequence
  chemically synthesized
aaattagccaggcttgctgg

SEQ ID NO: 261629 - DNA, 20 bp, Artificial Sequence
  chemically synthesized
caagcaactgccagcaagcc

SEQ ID NO: 261630 - DNA, 20 bp, Artificial Sequence
  chemically synthesized
ataaaattagccaggcttgc

SEQ ID NO: 261631 - DNA, 20 bp, Artificial Sequence
  chemically synthesized
ttttatatataaaattagcc

SEQ ID NO: 261632 - DNA, 20 bp, Artificial Sequence
  chemically synthesized
gttttatatataaaattagc

SEQ ID NO: 261633 - DNA, 20 bp, Artificial Sequence
  chemically synthesized
atatgttttatatataaaat

SEQ ID NO: 261634 - DNA, 20 bp, Artificial Sequence
  chemically synthesized
catatataacatatatatac

SEQ ID NO: 261635 - DNA, 20 bp, Artificial Sequence
  chemically synthesized
ttgtatatatatgttatata

SEQ ID NO: 261636 - DNA, 20 bp, Artificial Sequence
  chemically synthesized
atatataacatgtatatacg

SEQ ID NO: 261637 - DNA, 20 bp, Artificial Sequence
  chemically synthesized
atacgtagaacatgtgtata

SEQ ID NO: 261638 - DNA, 20 bp, Artificial Sequence
  chemically synthesized
tacgtagaacatgtgtatat

SEQ ID NO: 261639 - DNA, 20 bp, Artificial Sequence
  chemically synthesized
atacacatgttatacacaca

SEQ ID NO: 261640 - DNA, 20 bp, Artificial Sequence
  chemically synthesized
ataacatgtgtatatatgta

SEQ ID NO: 261641 - DNA, 20 bp, Artificial Sequence
  chemically synthesized
acatgacatgttatatatgt

SEQ ID NO: 261642 - DNA, 20 bp, Artificial Sequence
  chemically synthesized
gacatgttatatatgttagc

SEQ ID NO: 261643 - DNA, 20 bp, Artificial Sequence
  chemically synthesized
acatgttatatatgttagcc

SEQ ID NO: 261644 - DNA, 20 bp, Artificial Sequence
  chemically synthesized
ggaggagttccagatcagcc

SEQ ID NO: 261645 - DNA, 20 bp, Artificial Sequence
  chemically synthesized
atatgttagccaggctgatc

SEQ ID NO: 261646 - DNA, 20 bp, Artificial Sequence
  chemically synthesized
cttgaggaggagttccagat

SEQ ID NO: 261647 - DNA, 20 bp, Artificial Sequence
  chemically synthesized
gatcacttgaggaggagttc

SEQ ID NO: 261648 - DNA, 20 bp, Artificial Sequence
  chemically synthesized
ctgatctggaactcctcctc

SEQ ID NO: 261649 - DNA, 20 bp, Artificial Sequence
  chemically synthesized
tgggcggatcacttgaggag

SEQ ID NO: 261650 - DNA, 20 bp, Artificial Sequence
  chemically synthesized
ggtgggcggatcacttgagg

SEQ ID NO: 261651 - DNA, 20 bp, Artificial Sequence
  chemically synthesized
aggtgggcggatcacttgag

SEQ ID NO: 261652 - DNA, 20 bp, Artificial Sequence
  chemically synthesized
cgaggtgggcggatcacttg

SEQ ID NO: 261653 - DNA, 20 bp, Artificial Sequence
  chemically synthesized
ccgaggtgggcggatcactt

SEQ ID NO: 261654 - DNA, 20 bp, Artificial Sequence
  chemically synthesized
ctcaagtgatccgcccacct

SEQ ID NO: 261655 - DNA, 20 bp, Artificial Sequence
  chemically synthesized
ctttgtgaggccgaggtggg

SEQ ID NO: 261656 - DNA, 20 bp, Artificial Sequence
  chemically synthesized
gctctttgtgaggccgaggt

SEQ ID NO: 261657 - DNA, 20 bp, Artificial Sequence
  chemically synthesized
agctctttgtgaggccgagg

SEQ ID NO: 261658 - DNA, 20 bp, Artificial Sequence
  chemically synthesized
cccagctctttgtgaggccg

SEQ ID NO: 261659 - DNA, 20 bp, Artificial Sequence
  chemically synthesized
tcccagctctttgtgaggcc

SEQ ID NO: 261660 - DNA, 20 bp, Artificial Sequence
  chemically synthesized
ccgcccacctcggcctcaca

SEQ ID NO: 261661 - DNA, 20 bp, Artificial Sequence
  chemically synthesized
gcccacctcggcctcacaaa

SEQ ID NO: 261662 - DNA, 20 bp, Artificial Sequence
  chemically synthesized
tgtaatcccagctctttgtg

SEQ ID NO: 261663 - DNA, 20 bp, Artificial Sequence
  chemically synthesized
ctgtaatcccagctctttgt

SEQ ID NO: 261664 - DNA, 20 bp, Artificial Sequence
  chemically synthesized
acctcggcctcacaaagagc

SEQ ID NO: 261665 - DNA, 20 bp, Artificial Sequence
  chemically synthesized
cctcggcctcacaaagagct

SEQ ID NO: 261666 - DNA, 20 bp, Artificial Sequence
  chemically synthesized
ctcacaaagagctgggatta

SEQ ID NO: 261667 - DNA, 20 bp, Artificial Sequence
  chemically synthesized
gtggctcacaactgtaatcc

SEQ ID NO: 261668 - DNA, 20 bp, Artificial Sequence
  chemically synthesized
agagctgggattacagttgt

SEQ ID NO: 261669 - DNA, 20 bp, Artificial Sequence
  chemically synthesized
cagttgtgagccaccacgcc

SEQ ID NO: 261670 - DNA, 20 bp, Artificial Sequence
  chemically synthesized
tagtccttggctgggcgtgg

SEQ ID NO: 261671 - DNA, 20 bp, Artificial Sequence
  chemically synthesized
aaatagtccttggctgggcg

SEQ ID NO: 261672 - DNA, 20 bp, Artificial Sequence
  chemically synthesized
gtgagccaccacgcccagcc

SEQ ID NO: 261673 - DNA, 20 bp, Artificial Sequence
  chemically synthesized
tgagccaccacgcccagcca

SEQ ID NO: 261674 - DNA, 20 bp, Artificial Sequence
  chemically synthesized
atttaaaatagtccttggct

SEQ ID NO: 261675 - DNA, 20 bp, Artificial Sequence
  chemically synthesized
tatttaaaatagtccttggc

SEQ ID NO: 261676 - DNA, 20 bp, Artificial Sequence
  chemically synthesized
gtgttatttaaaatagtcct

SEQ ID NO: 261677 - DNA, 20 bp, Artificial Sequence
  chemically synthesized
aataaatgtgttatttaaaa

SEQ ID NO: 261678 - DNA, 20 bp, Artificial Sequence
  chemically synthesized
tttaaataacacatttattg

SEQ ID NO: 261679 - DNA, 20 bp, Artificial Sequence
  chemically synthesized
gcagcatttaatctacaaac

SEQ ID NO: 261680 - DNA, 20 bp, Artificial Sequence
  chemically synthesized
cagcatttaatctacaaaca

SEQ ID NO: 261681 - DNA, 20 bp, Artificial Sequence
  chemically synthesized
tagaaaattaaccttgtttg

SEQ ID NO: 261682 - DNA, 20 bp, Artificial Sequence
  chemically synthesized
aaacaaggttaattttctat

SEQ ID NO: 261683 - DNA, 20 bp, Artificial Sequence
  chemically synthesized
acatgctcttggaaggctga

SEQ ID NO: 261684 - DNA, 20 bp, Artificial Sequence
  chemically synthesized
taattttctatcagccttcc

SEQ ID NO: 261685 - DNA, 20 bp, Artificial Sequence
  chemically synthesized
attttctatcagccttccaa

SEQ ID NO: 261686 - DNA, 20 bp, Artificial Sequence
  chemically synthesized
aaaatatacatgctcttgga

SEQ ID NO: 261687 - DNA, 20 bp, Artificial Sequence
  chemically synthesized
caaaatatacatgctcttgg

SEQ ID NO: 261688 - DNA, 20 bp, Artificial Sequence
  chemically synthesized
ttccaaaatatacatgctct

SEQ ID NO: 261689 - DNA, 20 bp, Artificial Sequence
  chemically synthesized
ttccaagagcatgtatattt

SEQ ID NO: 261690 - DNA, 20 bp, Artificial Sequence
  chemically synthesized
gggatattttgacaaaatta

SEQ ID NO: 261691 - DNA, 20 bp, Artificial Sequence
  chemically synthesized
tacagcagagtaattgtaat

SEQ ID NO: 261692 - DNA, 20 bp, Artificial Sequence
  chemically synthesized
ctacagcagagtaattgtaa

SEQ ID NO: 261693 - DNA, 20 bp, Artificial Sequence
  chemically synthesized
ccattacaattactctgctg

SEQ ID NO: 261694 - DNA, 20 bp, Artificial Sequence
  chemically synthesized
cattacaattactctgctgt

SEQ ID NO: 261695 - DNA, 20 bp, Artificial Sequence
  chemically synthesized
ggatagcttgtcctacagca

SEQ ID NO: 261696 - DNA, 20 bp, Artificial Sequence
  chemically synthesized
atggatagcttgtcctacag

SEQ ID NO: 261697 - DNA, 20 bp, Artificial Sequence
  chemically synthesized
caattactctgctgtaggac

SEQ ID NO: 261698 - DNA, 20 bp, Artificial Sequence
  chemically synthesized
gcaatggatagcttgtccta

SEQ ID NO: 261699 - DNA, 20 bp, Artificial Sequence
  chemically synthesized
caatattgtattgcaatgga

SEQ ID NO: 261700 - DNA, 20 bp, Artificial Sequence
  chemically synthesized
gttacaatattgtattgcaa

SEQ ID NO: 261701 - DNA, 20 bp, Artificial Sequence
  chemically synthesized
gtaaaagatgaatatgaaga

SEQ ID NO: 261702 - DNA, 20 bp, Artificial Sequence
  chemically synthesized
ggtaaaagatgaatatgaag

SEQ ID NO: 261703 - DNA, 20 bp, Artificial Sequence
  chemically synthesized
tggtaaaagatgaatatgaa

SEQ ID NO: 261704 - DNA, 20 bp, Artificial Sequence
  chemically synthesized
ggtggtaaaagatgaatatg

SEQ ID NO: 261705 - DNA, 20 bp, Artificial Sequence
  chemically synthesized
acataaaagtgaggtggtaa

SEQ ID NO: 261706 - DNA, 20 bp, Artificial Sequence
  chemically synthesized
tctggaacataaaagtgagg

SEQ ID NO: 261707 - DNA, 20 bp, Artificial Sequence
  chemically synthesized
gcttctggaacataaaagtg

SEQ ID NO: 261708 - DNA, 20 bp, Artificial Sequence
  chemically synthesized
agcttctggaacataaaagt

SEQ ID NO: 261709 - DNA, 20 bp, Artificial Sequence
  chemically synthesized
acacagcttctggaacataa

SEQ ID NO: 261710 - DNA, 20 bp, Artificial Sequence
  chemically synthesized
accacctcacttttatgttc

SEQ ID NO: 261711 - DNA, 20 bp, Artificial Sequence
  chemically synthesized
acctcacttttatgttccag

SEQ ID NO: 261712 - DNA, 20 bp, Artificial Sequence
  chemically synthesized
ctaaggaaagacacagcttc

SEQ ID NO: 261713 - DNA, 20 bp, Artificial Sequence
  chemically synthesized
aggcatactaaggaaagaca

SEQ ID NO: 261714 - DNA, 20 bp, Artificial Sequence
  chemically synthesized
ccagaagctgtgtctttcct

SEQ ID NO: 261715 - DNA, 20 bp, Artificial Sequence
  chemically synthesized
agaagtaggcatactaagga

SEQ ID NO: 261716 - DNA, 20 bp, Artificial Sequence
  chemically synthesized
ttctagaagtaggcatacta

SEQ ID NO: 261717 - DNA, 20 bp, Artificial Sequence
  chemically synthesized
cttctagaagtaggcatact

SEQ ID NO: 261718 - DNA, 20 bp, Artificial Sequence
  chemically synthesized
ttccttagtatgcctacttc

SEQ ID NO: 261719 - DNA, 20 bp, Artificial Sequence
  chemically synthesized
ttacggttacttctagaagt

SEQ ID NO: 261720 - DNA, 20 bp, Artificial Sequence
  chemically synthesized
cttagtatgcctacttctag

SEQ ID NO: 261721 - DNA, 20 bp, Artificial Sequence
  chemically synthesized
cttacggttacttctagaag

SEQ ID NO: 261722 - DNA, 20 bp, Artificial Sequence
  chemically synthesized
tctcttacggttacttctag

SEQ ID NO: 261723 - DNA, 20 bp, Artificial Sequence
  chemically synthesized
gtttctcttacggttacttc

SEQ ID NO: 261724 - DNA, 20 bp, Artificial Sequence
  chemically synthesized
ctacttctagaagtaaccgt

SEQ ID NO: 261725 - DNA, 20 bp, Artificial Sequence
  chemically synthesized
acttctagaagtaaccgtaa

SEQ ID NO: 261726 - DNA, 20 bp, Artificial Sequence
  chemically synthesized
cagaacatcagtttctctta

SEQ ID NO: 261727 - DNA, 20 bp, Artificial Sequence
  chemically synthesized
agactgctcgttcagaacat

SEQ ID NO: 261728 - DNA, 20 bp, Artificial Sequence
  chemically synthesized
gagaaactgatgttctgaac

SEQ ID NO: 261729 - DNA, 20 bp, Artificial Sequence
  chemically synthesized
aaactgatgttctgaacgag

SEQ ID NO: 261730 - DNA, 20 bp, Artificial Sequence
  chemically synthesized
ggagtttaagactgctcgtt

SEQ ID NO: 261731 - DNA, 20 bp, Artificial Sequence
  chemically synthesized
tgtatgcaaattcggagttt

SEQ ID NO: 261732 - DNA, 20 bp, Artificial Sequence
  chemically synthesized
tacttatgtatgcaaattcg

SEQ ID NO: 261733 - DNA, 20 bp, Artificial Sequence
  chemically synthesized
tatacttatgtatgcaaatt

SEQ ID NO: 261734 - DNA, 20 bp, Artificial Sequence
  chemically synthesized
aactccgaatttgcatacat

SEQ ID NO: 261735 - DNA, 20 bp, Artificial Sequence
  chemically synthesized
cgaatttgcatacataagta

SEQ ID NO: 261736 - DNA, 20 bp, Artificial Sequence
  chemically synthesized
gaatttgcatacataagtat

SEQ ID NO: 261737 - DNA, 20 bp, Artificial Sequence
  chemically synthesized
aatttgcatacataagtata

SEQ ID NO: 261738 - DNA, 20 bp, Artificial Sequence
  chemically synthesized
ggaatataaaacatttataa

SEQ ID NO: 261739 - DNA, 20 bp, Artificial Sequence
  chemically synthesized
aatctggttatgtaatgtag

SEQ ID NO: 261740 - DNA, 20 bp, Artificial Sequence
  chemically synthesized
tataatctggttatgtaatg

SEQ ID NO: 261741 - DNA, 20 bp, Artificial Sequence
  chemically synthesized
aaactactacattacataac

SEQ ID NO: 261742 - DNA, 20 bp, Artificial Sequence
  chemically synthesized
tagaactttgatgtataatc

SEQ ID NO: 261743 - DNA, 20 bp, Artificial Sequence
  chemically synthesized
cataaccagattatacatca

SEQ ID NO: 261744 - DNA, 20 bp, Artificial Sequence
  chemically synthesized
taggaacaatgaatatttag

SEQ ID NO: 261745 - DNA, 20 bp, Artificial Sequence
  chemically synthesized
atttaggaacaatgaatatt

SEQ ID NO: 261746 - DNA, 20 bp, Artificial Sequence
  chemically synthesized
tattcattgttcctaaatga

SEQ ID NO: 261747 - DNA, 20 bp, Artificial Sequence
  chemically synthesized
attcattgttcctaaatgaa

SEQ ID NO: 261748 - DNA, 20 bp, Artificial Sequence
  chemically synthesized
atttagatatcctttcattt

SEQ ID NO: 261749 - DNA, 20 bp, Artificial Sequence
  chemically synthesized
tatttagatatcctttcatt

SEQ ID NO: 261750 - DNA, 20 bp, Artificial Sequence
  chemically synthesized
aaatgaaaggatatctaaat

SEQ ID NO: 261751 - DNA, 20 bp, Artificial Sequence
  chemically synthesized
cataggtgctataacttatt

SEQ ID NO: 261752 - DNA, 20 bp, Artificial Sequence
  chemically synthesized
aaggatatctaaataagtta

SEQ ID NO: 261753 - DNA, 20 bp, Artificial Sequence
  chemically synthesized
tttcacctagaattttgcat

SEQ ID NO: 261754 - DNA, 20 bp, Artificial Sequence
  chemically synthesized
ttttcacctagaattttgca

SEQ ID NO: 261755 - DNA, 20 bp, Artificial Sequence
  chemically synthesized
atagcacctatgcaaaattc

SEQ ID NO: 261756 - DNA, 20 bp, Artificial Sequence
  chemically synthesized
tagcacctatgcaaaattct

SEQ ID NO: 261757 - DNA, 20 bp, Artificial Sequence
  chemically synthesized
ctaatggaatatttttcacc

SEQ ID NO: 261758 - DNA, 20 bp, Artificial Sequence
  chemically synthesized
ctaggtgaaaaatattccat

SEQ ID NO: 261759 - DNA, 20 bp, Artificial Sequence
  chemically synthesized
ctttgaacatatttttctaa

SEQ ID NO: 261760 - DNA, 20 bp, Artificial Sequence
  chemically synthesized
ccattagaaaaatatgttca

SEQ ID NO: 261761 - DNA, 20 bp, Artificial Sequence
  chemically synthesized
tatgttcaaagatactgata

SEQ ID NO: 261762 - DNA, 20 bp, Artificial Sequence
  chemically synthesized
aaccaatttcatttccatat

SEQ ID NO: 261763 - DNA, 20 bp, Artificial Sequence
  chemically synthesized
tactgatatggaaatgaaat

SEQ ID NO: 261764 - DNA, 20 bp, Artificial Sequence
  chemically synthesized
aaatgaaattggttgtgttt

SEQ ID NO: 261765 - DNA, 20 bp, Artificial Sequence
  chemically synthesized
aaattggttgtgtttaagta

SEQ ID NO: 261766 - DNA, 20 bp, Artificial Sequence
  chemically synthesized
ggttgtgtttaagtatagaa

SEQ ID NO: 261767 - DNA, 20 bp, Artificial Sequence
  chemically synthesized
aagtatagaaaagaaacctt

SEQ ID NO: 261768 - DNA, 20 bp, Artificial Sequence
  chemically synthesized
agtatagaaaagaaaccttt

SEQ ID NO: 261769 - DNA, 20 bp, Artificial Sequence
  chemically synthesized
ctgctaacatagaggcctaa

SEQ ID NO: 261770 - DNA, 20 bp, Artificial Sequence
  chemically synthesized
tctgctaacatagaggccta

SEQ ID NO: 261771 - DNA, 20 bp, Artificial Sequence
  chemically synthesized
aaacctttaggcctctatgt

SEQ ID NO: 261772 - DNA, 20 bp, Artificial Sequence
  chemically synthesized
ttgctcttctgctaacatag

SEQ ID NO: 261773 - DNA, 20 bp, Artificial Sequence
  chemically synthesized
tttgctcttctgctaacata

SEQ ID NO: 261774 - DNA, 20 bp, Artificial Sequence
  chemically synthesized
cctttaggcctctatgttag

SEQ ID NO: 261775 - DNA, 20 bp, Artificial Sequence
  chemically synthesized
tttttgctcttctgctaaca

SEQ ID NO: 261776 - DNA, 20 bp, Artificial Sequence
  chemically synthesized
ttaggcctctatgttagcag

SEQ ID NO: 261777 - DNA, 20 bp, Artificial Sequence
  chemically synthesized
aggcctctatgttagcagaa

SEQ ID NO: 261778 - DNA, 20 bp, Artificial Sequence
  chemically synthesized
tatgttagcagaagagcaaa

SEQ ID NO: 261779 - DNA, 20 bp, Artificial Sequence
  chemically synthesized
atgttagcagaagagcaaaa

SEQ ID NO: 261780 - DNA, 20 bp, Artificial Sequence
  chemically synthesized
tgttagcagaagagcaaaaa

SEQ ID NO: 261781 - DNA, 20 bp, Artificial Sequence
  chemically synthesized
ttagcagaagagcaaaaagg

SEQ ID NO: 261782 - DNA, 20 bp, Artificial Sequence
  chemically synthesized
gaagagcaaaaagggagaca

SEQ ID NO: 261783 - DNA, 20 bp, Artificial Sequence
  chemically synthesized
caaaaagggagacaaagtgt

SEQ ID NO: 261784 - DNA, 20 bp, Artificial Sequence
  chemically synthesized
gggagacaaagtgtgagtaa

SEQ ID NO: 261785 - DNA, 20 bp, Artificial Sequence
  chemically synthesized
agacaaagtgtgagtaacag

SEQ ID NO: 261786 - DNA, 20 bp, Artificial Sequence
  chemically synthesized
agtgtgagtaacagaagtga

SEQ ID NO: 261787 - DNA, 20 bp, Artificial Sequence
  chemically synthesized
gtgtgagtaacagaagtgat

SEQ ID NO: 261788 - DNA, 20 bp, Artificial Sequence
  chemically synthesized
tgagtaacagaagtgatagg

SEQ ID NO: 261789 - DNA, 20 bp, Artificial Sequence
  chemically synthesized
gagtaacagaagtgatagga

SEQ ID NO: 261790 - DNA, 20 bp, Artificial Sequence
  chemically synthesized
agtaacagaagtgataggaa

SEQ ID NO: 261791 - DNA, 20 bp, Artificial Sequence
  chemically synthesized
gtaacagaagtgataggaag

SEQ ID NO: 261792 - DNA, 20 bp, Artificial Sequence
  chemically synthesized
taggaaggggctacatcata

SEQ ID NO: 261793 - DNA, 20 bp, Artificial Sequence
  chemically synthesized
ctgtgatccgctatatgatg

SEQ ID NO: 261794 - DNA, 20 bp, Artificial Sequence
  chemically synthesized
gaaggggctacatcatatag

SEQ ID NO: 261795 - DNA, 20 bp, Artificial Sequence
  chemically synthesized
ctacatcatatagcggatca

SEQ ID NO: 261796 - DNA, 20 bp, Artificial Sequence
  chemically synthesized
tacatcatatagcggatcac

SEQ ID NO: 261797 - DNA, 20 bp, Artificial Sequence
  chemically synthesized
ggatcacaggatttcattta

SEQ ID NO: 261798 - DNA, 20 bp, Artificial Sequence
  chemically synthesized
atcacaggatttcatttaaa

SEQ ID NO: 261799 - DNA, 20 bp, Artificial Sequence
  chemically synthesized
ggatttcatttaaagagtaa

SEQ ID NO: 261800 - DNA, 20 bp, Artificial Sequence
  chemically synthesized
gatttcatttaaagagtaat

SEQ ID NO: 261801 - DNA, 20 bp, Artificial Sequence
  chemically synthesized
ttcatttaaagagtaatggg

SEQ ID NO: 261802 - DNA, 20 bp, Artificial Sequence
  chemically synthesized
tcatttaaagagtaatgggc

SEQ ID NO: 261803 - DNA, 20 bp, Artificial Sequence
  chemically synthesized
atttaaagagtaatgggcag

SEQ ID NO: 261804 - DNA, 20 bp, Artificial Sequence
  chemically synthesized
tttaaagagtaatgggcagg

SEQ ID NO: 261805 - DNA, 20 bp, Artificial Sequence
  chemically synthesized
ttaaagagtaatgggcagga

SEQ ID NO: 261806 - DNA, 20 bp, Artificial Sequence
  chemically synthesized
taaagagtaatgggcaggag

SEQ ID NO: 261807 - DNA, 20 bp, Artificial Sequence
  chemically synthesized
ggagttaatgagatcatatc

SEQ ID NO: 261808 - DNA, 20 bp, Artificial Sequence
  chemically synthesized
aggagttaatgagatcatat

SEQ ID NO: 261809 - DNA, 20 bp, Artificial Sequence
  chemically synthesized
gctccttctaaggagttaat

SEQ ID NO: 261810 - DNA, 20 bp, Artificial Sequence
  chemically synthesized
atatgatctcattaactcct

SEQ ID NO: 261811 - DNA, 20 bp, Artificial Sequence
  chemically synthesized
tgatctcattaactccttag

SEQ ID NO: 261812 - DNA, 20 bp, Artificial Sequence
  chemically synthesized
gatctcattaactccttaga

SEQ ID NO: 261813 - DNA, 20 bp, Artificial Sequence
  chemically synthesized
ggcagagagctccttctaag

SEQ ID NO: 261814 - DNA, 20 bp, Artificial Sequence
  chemically synthesized
tctcattaactccttagaag

SEQ ID NO: 261815 - DNA, 20 bp, Artificial Sequence
  chemically synthesized
aaggcagagagctccttcta

SEQ ID NO: 261816 - DNA, 20 bp, Artificial Sequence
  chemically synthesized
gaaggcagagagctccttct

SEQ ID NO: 261817 - DNA, 20 bp, Artificial Sequence
  chemically synthesized
tttctcctggtgaaggcaga

SEQ ID NO: 261818 - DNA, 20 bp, Artificial Sequence
  chemically synthesized
tatttctcctggtgaaggca

SEQ ID NO: 261819 - DNA, 20 bp, Artificial Sequence
  chemically synthesized
aaggagctctctgccttcac

SEQ ID NO: 261820 - DNA, 20 bp, Artificial Sequence
  chemically synthesized
catatttctcctggtgaagg

SEQ ID NO: 261821 - DNA, 20 bp, Artificial Sequence
  chemically synthesized
aggagctctctgccttcacc

SEQ ID NO: 261822 - DNA, 20 bp, Artificial Sequence
  chemically synthesized
gagctctctgccttcaccag

SEQ ID NO: 261823 - DNA, 20 bp, Artificial Sequence
  chemically synthesized
caccatatttctcctggtga

SEQ ID NO: 261824 - DNA, 20 bp, Artificial Sequence
  chemically synthesized
acaccatatttctcctggtg

SEQ ID NO: 261825 - DNA, 20 bp, Artificial Sequence
  chemically synthesized
cacttacaccatatttctcc

SEQ ID NO: 261826 - DNA, 20 bp, Artificial Sequence
  chemically synthesized
tgccttcaccaggagaaata

SEQ ID NO: 261827 - DNA, 20 bp, Artificial Sequence
  chemically synthesized
caccaggagaaatatggtgt

SEQ ID NO: 261828 - DNA, 20 bp, Artificial Sequence
  chemically synthesized
caggagaaatatggtgtaag

SEQ ID NO: 261829 - DNA, 20 bp, Artificial Sequence
  chemically synthesized
aggagaaatatggtgtaagt

SEQ ID NO: 261830 - DNA, 20 bp, Artificial Sequence
  chemically synthesized
ggagaaatatggtgtaagtg

SEQ ID NO: 261831 - DNA, 20 bp, Artificial Sequence
  chemically synthesized
aaatatggtgtaagtgggga

SEQ ID NO: 261832 - DNA, 20 bp, Artificial Sequence
  chemically synthesized
tggtgtaagtggggaaagac

SEQ ID NO: 261833 - DNA, 20 bp, Artificial Sequence
  chemically synthesized
tgtaagtggggaaagactgg

SEQ ID NO: 261834 - DNA, 20 bp, Artificial Sequence
  chemically synthesized
aagtggggaaagactggaag

SEQ ID NO: 261835 - DNA, 20 bp, Artificial Sequence
  chemically synthesized
gtggggaaagactggaagaa

SEQ ID NO: 261836 - DNA, 20 bp, Artificial Sequence
  chemically synthesized
tggggaaagactggaagaag

SEQ ID NO: 261837 - DNA, 20 bp, Artificial Sequence
  chemically synthesized
caacctctaacctcttcttc

SEQ ID NO: 261838 - DNA, 20 bp, Artificial Sequence
  chemically synthesized
gaaagactggaagaagaggt

SEQ ID NO: 261839 - DNA, 20 bp, Artificial Sequence
  chemically synthesized
aagactggaagaagaggtta

SEQ ID NO: 261840 - DNA, 20 bp, Artificial Sequence
  chemically synthesized
agactggaagaagaggttag

SEQ ID NO: 261841 - DNA, 20 bp, Artificial Sequence
  chemically synthesized
gaagaggttagaggttgttg

SEQ ID NO: 261842 - DNA, 20 bp, Artificial Sequence
  chemically synthesized
tagaggttgttgaagtaatc

SEQ ID NO: 261843 - DNA, 20 bp, Artificial Sequence
  chemically synthesized
gttgttgaagtaatccagat

SEQ ID NO: 261844 - DNA, 20 bp, Artificial Sequence
  chemically synthesized
tgttgaagtaatccagatga

SEQ ID NO: 261845 - DNA, 20 bp, Artificial Sequence
  chemically synthesized
caagattattatctctcatc

SEQ ID NO: 261846 - DNA, 20 bp, Artificial Sequence
  chemically synthesized
gatgagagataataatcttg

SEQ ID NO: 261847 - DNA, 20 bp, Artificial Sequence
  chemically synthesized
gagataataatcttgtagat

SEQ ID NO: 261848 - DNA, 20 bp, Artificial Sequence
  chemically synthesized
ttatggaagtgctaatctac

SEQ ID NO: 261849 - DNA, 20 bp, Artificial Sequence
  chemically synthesized
gtagattagcacttccataa

SEQ ID NO: 261850 - DNA, 20 bp, Artificial Sequence
  chemically synthesized
ctcctccgtatctgttatgg

SEQ ID NO: 261851 - DNA, 20 bp, Artificial Sequence
  chemically synthesized
tcactcctccgtatctgtta

SEQ ID NO: 261852 - DNA, 20 bp, Artificial Sequence
  chemically synthesized
tagcacttccataacagata

SEQ ID NO: 261853 - DNA, 20 bp, Artificial Sequence
  chemically synthesized
gcacttccataacagatacg

SEQ ID NO: 261854 - DNA, 20 bp, Artificial Sequence
  chemically synthesized
cacttccataacagatacgg

SEQ ID NO: 261855 - DNA, 20 bp, Artificial Sequence
  chemically synthesized
cttccataacagatacggag

SEQ ID NO: 261856 - DNA, 20 bp, Artificial Sequence
  chemically synthesized
gagtgatttgatgcattttg

SEQ ID NO: 261857 - DNA, 20 bp, Artificial Sequence
  chemically synthesized
agtgatttgatgcattttgc

SEQ ID NO: 261858 - DNA, 20 bp, Artificial Sequence
  chemically synthesized
attttgcaggtatatccaac

SEQ ID NO: 261859 - DNA, 20 bp, Artificial Sequence
  chemically synthesized
tttgcaggtatatccaacaa

SEQ ID NO: 261860 - DNA, 20 bp, Artificial Sequence
  chemically synthesized
gcaggtatatccaacaagag

SEQ ID NO: 261861 - DNA, 20 bp, Artificial Sequence
  chemically synthesized
taaattatttccactcttgt

SEQ ID NO: 261862 - DNA, 20 bp, Artificial Sequence
  chemically synthesized
aagagtggaaataatttaca

SEQ ID NO: 261863 - DNA, 20 bp, Artificial Sequence
  chemically synthesized
aataatttacatggtaatgt

SEQ ID NO: 261864 - DNA, 20 bp, Artificial Sequence
  chemically synthesized
taatttacatggtaatgtaa

SEQ ID NO: 261865 - DNA, 20 bp, Artificial Sequence
  chemically synthesized
tacatggtaatgtaagagaa

SEQ ID NO: 261866 - DNA, 20 bp, Artificial Sequence
  chemically synthesized
tgtaagagaaaagaatcatg

SEQ ID NO: 261867 - DNA, 20 bp, Artificial Sequence
  chemically synthesized
gtaagagaaaagaatcatga

SEQ ID NO: 261868 - DNA, 20 bp, Artificial Sequence
  chemically synthesized
aaagaatcatgaaggatgtc

SEQ ID NO: 261869 - DNA, 20 bp, Artificial Sequence
  chemically synthesized
aagaatcatgaaggatgtct

SEQ ID NO: 261870 - DNA, 20 bp, Artificial Sequence
  chemically synthesized
atttacttaagtcagaaacc

SEQ ID NO: 261871 - DNA, 20 bp, Artificial Sequence
  chemically synthesized
gatgtctaggtttctgactt

SEQ ID NO: 261872 - DNA, 20 bp, Artificial Sequence
  chemically synthesized
gcactattatttacttaagt

SEQ ID NO: 261873 - DNA, 20 bp, Artificial Sequence
  chemically synthesized
aattgcactattatttactt

SEQ ID NO: 261874 - DNA, 20 bp, Artificial Sequence
  chemically synthesized
tttctgacttaagtaaataa

SEQ ID NO: 261875 - DNA, 20 bp, Artificial Sequence
  chemically synthesized
tagtgcaatttaataacatc

SEQ ID NO: 261876 - DNA, 20 bp, Artificial Sequence
  chemically synthesized
gtgcaatttaataacatctg

SEQ ID NO: 261877 - DNA, 20 bp, Artificial Sequence
  chemically synthesized
ttaataacatctggagatgt

SEQ ID NO: 261878 - DNA, 20 bp, Artificial Sequence
  chemically synthesized
ttggcatctaccaacatctc

SEQ ID NO: 261879 - DNA, 20 bp, Artificial Sequence
  chemically synthesized
ataacatctggagatgttgg

SEQ ID NO: 261880 - DNA, 20 bp, Artificial Sequence
  chemically synthesized
ttggtagatgccaattaacg

SEQ ID NO: 261881 - DNA, 20 bp, Artificial Sequence
  chemically synthesized
caccccccatctacgttaat

SEQ ID NO: 261882 - DNA, 20 bp, Artificial Sequence
  chemically synthesized
tagatgccaattaacgtaga

SEQ ID NO: 261883 - DNA, 20 bp, Artificial Sequence
  chemically synthesized
agatgccaattaacgtagat

SEQ ID NO: 261884 - DNA, 20 bp, Artificial Sequence
  chemically synthesized
gatgccaattaacgtagatg

SEQ ID NO: 261885 - DNA, 20 bp, Artificial Sequence
  chemically synthesized
atgccaattaacgtagatgg

SEQ ID NO: 261886 - DNA, 20 bp, Artificial Sequence
  chemically synthesized
tgccaattaacgtagatggg

SEQ ID NO: 261887 - DNA, 20 bp, Artificial Sequence
  chemically synthesized
caattaacgtagatgggggg

SEQ ID NO: 261888 - DNA, 20 bp, Artificial Sequence
  chemically synthesized
tggatcatttatttttcact

SEQ ID NO: 261889 - DNA, 20 bp, Artificial Sequence
  chemically synthesized
atctcaaacatacaatagcc

SEQ ID NO: 261890 - DNA, 20 bp, Artificial Sequence
  chemically synthesized
tgagcatctcaaacatacaa

SEQ ID NO: 261891 - DNA, 20 bp, Artificial Sequence
  chemically synthesized
cacttggctattgtatgttt

SEQ ID NO: 261892 - DNA, 20 bp, Artificial Sequence
  chemically synthesized
tgtatgtttgagatgctcat

SEQ ID NO: 261893 - DNA, 20 bp, Artificial Sequence
  chemically synthesized
gtatgtttgagatgctcatt

SEQ ID NO: 261894 - DNA, 20 bp, Artificial Sequence
  chemically synthesized
tcttatcttggatgcctaat

SEQ ID NO: 261895 - DNA, 20 bp, Artificial Sequence
  chemically synthesized
gagatgctcattaggcatcc

SEQ ID NO: 261896 - DNA, 20 bp, Artificial Sequence
  chemically synthesized
gctcattaggcatccaagat

SEQ ID NO: 261897 - DNA, 20 bp, Artificial Sequence
  chemically synthesized
tcattaggcatccaagataa

SEQ ID NO: 261898 - DNA, 20 bp, Artificial Sequence
  chemically synthesized
tatccaacagtctcttatct

SEQ ID NO: 261899 - DNA, 20 bp, Artificial Sequence
  chemically synthesized
catccaagataagagactgt

SEQ ID NO: 261900 - DNA, 20 bp, Artificial Sequence
  chemically synthesized
gtttaacattttatatccaa

SEQ ID NO: 261901 - DNA, 20 bp, Artificial Sequence
  chemically synthesized
gatataaaatgttaaacatc

SEQ ID NO: 261902 - DNA, 20 bp, Artificial Sequence
  chemically synthesized
aaacatcaagatcatatact

SEQ ID NO: 261903 - DNA, 20 bp, Artificial Sequence
  chemically synthesized
atgttatgacatcaaatacc

SEQ ID NO: 261904 - DNA, 20 bp, Artificial Sequence
  chemically synthesized
atttgatgtcataacatgct

SEQ ID NO: 261905 - DNA, 20 bp, Artificial Sequence
  chemically synthesized
tgtcataacatgctcagctc

SEQ ID NO: 261906 - DNA, 20 bp, Artificial Sequence
  chemically synthesized
aatacatttccacttgagct

SEQ ID NO: 261907 - DNA, 20 bp, Artificial Sequence
  chemically synthesized
cataacatgctcagctcaag

SEQ ID NO: 261908 - DNA, 20 bp, Artificial Sequence
  chemically synthesized
ttctaaatacatttccactt

SEQ ID NO: 261909 - DNA, 20 bp, Artificial Sequence
  chemically synthesized
agctcaagtggaaatgtatt

SEQ ID NO: 261910 - DNA, 20 bp, Artificial Sequence
  chemically synthesized
gtggaaatgtatttagaaaa

SEQ ID NO: 261911 - DNA, 20 bp, Artificial Sequence
  chemically synthesized
agcccacttcagtgaagaaa

SEQ ID NO: 261912 - DNA, 20 bp, Artificial Sequence
  chemically synthesized
acatttctttttcttcactg

SEQ ID NO: 261913 - DNA, 20 bp, Artificial Sequence
  chemically synthesized
aaaaaaagcccacttcagtg

SEQ ID NO: 261914 - DNA, 20 bp, Artificial Sequence
  chemically synthesized
tttctttttcttcactgaag

SEQ ID NO: 261915 - DNA, 20 bp, Artificial Sequence
  chemically synthesized
ttctttttcttcactgaagt

SEQ ID NO: 261916 - DNA, 20 bp, Artificial Sequence
  chemically synthesized
atacaaaaaaaagcccactt

SEQ ID NO: 261917 - DNA, 20 bp, Artificial Sequence
  chemically synthesized
cagcaaaaaaatacaaaaaa

SEQ ID NO: 261918 - DNA, 20 bp, Artificial Sequence
  chemically synthesized
tatttttttgctgctgttct

SEQ ID NO: 261919 - DNA, 20 bp, Artificial Sequence
  chemically synthesized
catgacctttccaagaacag

SEQ ID NO: 261920 - DNA, 20 bp, Artificial Sequence
  chemically synthesized
atacatgacctttccaagaa

SEQ ID NO: 261921 - DNA, 20 bp, Artificial Sequence
  chemically synthesized
tttttgctgctgttcttgga

SEQ ID NO: 261922 - DNA, 20 bp, Artificial Sequence
  chemically synthesized
ttttgctgctgttcttggaa

SEQ ID NO: 261923 - DNA, 20 bp, Artificial Sequence
  chemically synthesized
tatacatacatgacctttcc

SEQ ID NO: 261924 - DNA, 20 bp, Artificial Sequence
  chemically synthesized
tcatgtatgtatacatattt

SEQ ID NO: 261925 - DNA, 20 bp, Artificial Sequence
  chemically synthesized
atgtatgtatacatatttca

SEQ ID NO: 261926 - DNA, 20 bp, Artificial Sequence
  chemically synthesized
tgtatgtatacatatttcag

SEQ ID NO: 261927 - DNA, 20 bp, Artificial Sequence
  chemically synthesized
gtatacatatttcagaggtt

SEQ ID NO: 261928 - DNA, 20 bp, Artificial Sequence
  chemically synthesized
aatgtttctagatagcaaaa

SEQ ID NO: 261929 - DNA, 20 bp, Artificial Sequence
  chemically synthesized
tttagcacttttttgctatc

SEQ ID NO: 261930 - DNA, 20 bp, Artificial Sequence
  chemically synthesized
ccaattataatgtttctaga

SEQ ID NO: 261931 - DNA, 20 bp, Artificial Sequence
  chemically synthesized
attaccaattataatgtttc

SEQ ID NO: 261932 - DNA, 20 bp, Artificial Sequence
  chemically synthesized
ctatctagaaacattataat

SEQ ID NO: 261933 - DNA, 20 bp, Artificial Sequence
  chemically synthesized
ataattggtaataatttaca

SEQ ID NO: 261934 - DNA, 20 bp, Artificial Sequence
  chemically synthesized
acatagaacacattatgcac

SEQ ID NO: 261935 - DNA, 20 bp, Artificial Sequence
  chemically synthesized
agataatggcaacaaatata

SEQ ID NO: 261936 - DNA, 20 bp, Artificial Sequence
  chemically synthesized
gagataatggcaacaaatat

SEQ ID NO: 261937 - DNA, 20 bp, Artificial Sequence
  chemically synthesized
acaagacttattcgagataa

SEQ ID NO: 261938 - DNA, 20 bp, Artificial Sequence
  chemically synthesized
ttgttgccattatctcgaat

SEQ ID NO: 261939 - DNA, 20 bp, Artificial Sequence
  chemically synthesized
gataaaaacaagacttattc

SEQ ID NO: 261940 - DNA, 20 bp, Artificial Sequence
  chemically synthesized
atgtaaagggagataaaaac

SEQ ID NO: 261941 - DNA, 20 bp, Artificial Sequence
  chemically synthesized
ttacatatgctatgtaaagg

SEQ ID NO: 261942 - DNA, 20 bp, Artificial Sequence
  chemically synthesized
tgtttttatctccctttaca

SEQ ID NO: 261943 - DNA, 20 bp, Artificial Sequence
  chemically synthesized
tattacatatgctatgtaaa

SEQ ID NO: 261944 - DNA, 20 bp, Artificial Sequence
  chemically synthesized
atattacatatgctatgtaa

SEQ ID NO: 261945 - DNA, 20 bp, Artificial Sequence
  chemically synthesized
catattacatatgctatgta

SEQ ID NO: 261946 - DNA, 20 bp, Artificial Sequence
  chemically synthesized
tacatagcatatgtaatatg

SEQ ID NO: 261947 - DNA, 20 bp, Artificial Sequence
  chemically synthesized
acatagcatatgtaatatgc

SEQ ID NO: 261948 - DNA, 20 bp, Artificial Sequence
  chemically synthesized
taatatgcaggatatgaatt

SEQ ID NO: 261949 - DNA, 20 bp, Artificial Sequence
  chemically synthesized
aatatgcaggatatgaatta

SEQ ID NO: 261950 - DNA, 20 bp, Artificial Sequence
  chemically synthesized
aattaaggatatgtaattca

SEQ ID NO: 261951 - DNA, 20 bp, Artificial Sequence
  chemically synthesized
attaaggatatgtaattcat

SEQ ID NO: 261952 - DNA, 20 bp, Artificial Sequence
  chemically synthesized
taattcataggatatgcaat

SEQ ID NO: 261953 - DNA, 20 bp, Artificial Sequence
  chemically synthesized
aagagagagaaatcaaatag

SEQ ID NO: 261954 - DNA, 20 bp, Artificial Sequence
  chemically synthesized
gtaaagagagagaaatcaaa

SEQ ID NO: 261955 - DNA, 20 bp, Artificial Sequence
  chemically synthesized
actgatcctgtgtaaagaga

SEQ ID NO: 261956 - DNA, 20 bp, Artificial Sequence
  chemically synthesized
tgactgatcctgtgtaaaga

SEQ ID NO: 261957 - DNA, 20 bp, Artificial Sequence
  chemically synthesized
ttgatttctctctctttaca

SEQ ID NO: 261958 - DNA, 20 bp, Artificial Sequence
  chemically synthesized
tgatttctctctctttacac

SEQ ID NO: 261959 - DNA, 20 bp, Artificial Sequence
  chemically synthesized
tttgactgatcctgtgtaaa

SEQ ID NO: 261960 - DNA, 20 bp, Artificial Sequence
  chemically synthesized
tgtttgactgatcctgtgta

SEQ ID NO: 261961 - DNA, 20 bp, Artificial Sequence
  chemically synthesized
tctctctctttacacaggat

SEQ ID NO: 261962 - DNA, 20 bp, Artificial Sequence
  chemically synthesized
cacagaatactaggagaatg

SEQ ID NO: 261963 - DNA, 20 bp, Artificial Sequence
  chemically synthesized
agtcaaacactgcattctcc

SEQ ID NO: 261964 - DNA, 20 bp, Artificial Sequence
  chemically synthesized
aggaaaacacagaatactag

SEQ ID NO: 261965 - DNA, 20 bp, Artificial Sequence
  chemically synthesized
caaggaaaacacagaatact

SEQ ID NO: 261966 - DNA, 20 bp, Artificial Sequence
  chemically synthesized
ccaaggaaaacacagaatac

SEQ ID NO: 261967 - DNA, 20 bp, Artificial Sequence
  chemically synthesized
cagtgccaccaaggaaaaca

SEQ ID NO: 261968 - DNA, 20 bp, Artificial Sequence
  chemically synthesized
ctagtattctgtgttttcct

SEQ ID NO: 261969 - DNA, 20 bp, Artificial Sequence
  chemically synthesized
gtattctgtgttttccttgg

SEQ ID NO: 261970 - DNA, 20 bp, Artificial Sequence
  chemically synthesized
aaatttggtcagtgccacca

SEQ ID NO: 261971 - DNA, 20 bp, Artificial Sequence
  chemically synthesized
aaaatttggtcagtgccacc

SEQ ID NO: 261972 - DNA, 20 bp, Artificial Sequence
  chemically synthesized
ttataatcctaaaatttggt

SEQ ID NO: 261973 - DNA, 20 bp, Artificial Sequence
  chemically synthesized
tggtggcactgaccaaattt

SEQ ID NO: 261974 - DNA, 20 bp, Artificial Sequence
  chemically synthesized
ggtggcactgaccaaatttt

SEQ ID NO: 261975 - DNA, 20 bp, Artificial Sequence
  chemically synthesized
aagcttataatcctaaaatt

SEQ ID NO: 261976 - DNA, 20 bp, Artificial Sequence
  chemically synthesized
tgaccaaattttaggattat

SEQ ID NO: 261977 - DNA, 20 bp, Artificial Sequence
  chemically synthesized
aataagaacatttattaaaa

SEQ ID NO: 261978 - DNA, 20 bp, Artificial Sequence
  chemically synthesized
ttaataaatgttcttattta

SEQ ID NO: 261979 - DNA, 20 bp, Artificial Sequence
  chemically synthesized
aataaatgttcttatttaca

SEQ ID NO: 261980 - DNA, 20 bp, Artificial Sequence
  chemically synthesized
aaattgttttctctgtaaat

SEQ ID NO: 261981 - DNA, 20 bp, Artificial Sequence
  chemically synthesized
acagagaaaacaattttata

SEQ ID NO: 261982 - DNA, 20 bp, Artificial Sequence
  chemically synthesized
aggaaggagacagcgatgta

SEQ ID NO: 261983 - DNA, 20 bp, Artificial Sequence
  chemically synthesized
tgaaactagaaggaaggaga

SEQ ID NO: 261984 - DNA, 20 bp, Artificial Sequence
  chemically synthesized
aaaatgaaactagaaggaag

SEQ ID NO: 261985 - DNA, 20 bp, Artificial Sequence
  chemically synthesized
catcgctgtctccttccttc

SEQ ID NO: 261986 - DNA, 20 bp, Artificial Sequence
  chemically synthesized
ataaaatgaaactagaagga

SEQ ID NO: 261987 - DNA, 20 bp, Artificial Sequence
  chemically synthesized
aataaaatgaaactagaagg

SEQ ID NO: 261988 - DNA, 20 bp, Artificial Sequence
  chemically synthesized
taaaataaaatgaaactaga

SEQ ID NO: 261989 - DNA, 20 bp, Artificial Sequence
  chemically synthesized
gtaaaataaaatgaaactag

SEQ ID NO: 261990 - DNA, 20 bp, Artificial Sequence
  chemically synthesized
tgtgtaaaataaaatgaaac

SEQ ID NO: 261991 - DNA, 20 bp, Artificial Sequence
  chemically synthesized
ttttacacaaatatattgct

SEQ ID NO: 261992 - DNA, 20 bp, Artificial Sequence
  chemically synthesized
tttttgctaaaataattact

SEQ ID NO: 261993 - DNA, 20 bp, Artificial Sequence
  chemically synthesized
atattgcttagtaattattt

SEQ ID NO: 261994 - DNA, 20 bp, Artificial Sequence
  chemically synthesized
attattttagcaaaaatcta

SEQ ID NO: 261995 - DNA, 20 bp, Artificial Sequence
  chemically synthesized
tttagcaaaaatctatagac

SEQ ID NO: 261996 - DNA, 20 bp, Artificial Sequence
  chemically synthesized
aactaagaatttcttgtcta

SEQ ID NO: 261997 - DNA, 20 bp, Artificial Sequence
  chemically synthesized
atctatagacaagaaattct

SEQ ID NO: 261998 - DNA, 20 bp, Artificial Sequence
  chemically synthesized
gtttcacctgaacaaaaact

SEQ ID NO: 261999 - DNA, 20 bp, Artificial Sequence
  chemically synthesized
agaaattcttagtttttgtt

SEQ ID NO: 262000 - DNA, 20 bp, Artificial Sequence
  chemically synthesized
gaaattcttagtttttgttc

SEQ ID NO: 262001 - DNA, 20 bp, Artificial Sequence
  chemically synthesized
agtttttgttcaggtgaaac

SEQ ID NO: 262002 - DNA, 20 bp, Artificial Sequence
  chemically synthesized
aatattctcagacatacagc

SEQ ID NO: 262003 - DNA, 20 bp, Artificial Sequence
  chemically synthesized
gtgaaactagctgtatgtct

SEQ ID NO: 262004 - DNA, 20 bp, Artificial Sequence
  chemically synthesized
gcaaaatattctcagacata

SEQ ID NO: 262005 - DNA, 20 bp, Artificial Sequence
  chemically synthesized
gaattaaggcaaaatattct

SEQ ID NO: 262006 - DNA, 20 bp, Artificial Sequence
  chemically synthesized
aaaacatgattcaagaatta

SEQ ID NO: 262007 - DNA, 20 bp, Artificial Sequence
  chemically synthesized
taaaacatgattcaagaatt

SEQ ID NO: 262008 - DNA, 20 bp, Artificial Sequence
  chemically synthesized
taccaggtaaaacatgattc

SEQ ID NO: 262009 - DNA, 20 bp, Artificial Sequence
  chemically synthesized
ttcttgaatcatgttttacc

SEQ ID NO: 262010 - DNA, 20 bp, Artificial Sequence
  chemically synthesized
taggcacattttcaaatacc

SEQ ID NO: 262011 - DNA, 20 bp, Artificial Sequence
  chemically synthesized
ctaggcacattttcaaatac

SEQ ID NO: 262012 - DNA, 20 bp, Artificial Sequence
  chemically synthesized
ctggtatttgaaaatgtgcc

SEQ ID NO: 262013 - DNA, 20 bp, Artificial Sequence
  chemically synthesized
aataatatcttcaaaatgct

SEQ ID NO: 262014 - DNA, 20 bp, Artificial Sequence
  chemically synthesized
gaataatatcttcaaaatgc

SEQ ID NO: 262015 - DNA, 20 bp, Artificial Sequence
  chemically synthesized
aaaatgtgcctagcattttg

SEQ ID NO: 262016 - DNA, 20 bp, Artificial Sequence
  chemically synthesized
caacaatagatattagaaga

SEQ ID NO: 262017 - DNA, 20 bp, Artificial Sequence
  chemically synthesized
tcatcaacaatagatattag

SEQ ID NO: 262018 - DNA, 20 bp, Artificial Sequence
  chemically synthesized
ttttcatcaacaatagatat

SEQ ID NO: 262019 - DNA, 20 bp, Artificial Sequence
  chemically synthesized
tgaagacttttcatcaacaa

SEQ ID NO: 262020 - DNA, 20 bp, Artificial Sequence
  chemically synthesized
taatatctattgttgatgaa

SEQ ID NO: 262021 - DNA, 20 bp, Artificial Sequence
  chemically synthesized
tattgttgatgaaaagtctt

SEQ ID NO: 262022 - DNA, 20 bp, Artificial Sequence
  chemically synthesized
caggatgacaatattgactg

SEQ ID NO: 262023 - DNA, 20 bp, Artificial Sequence
  chemically synthesized
taagacaaaagaacatttac

SEQ ID NO: 262024 - DNA, 20 bp, Artificial Sequence
  chemically synthesized
ttaagacaaaagaacattta

SEQ ID NO: 262025 - DNA, 20 bp, Artificial Sequence
  chemically synthesized
tgtaaatgttcttttgtctt

SEQ ID NO: 262026 - DNA, 20 bp, Artificial Sequence
  chemically synthesized
ttaagggttacttaagacaa

SEQ ID NO: 262027 - DNA, 20 bp, Artificial Sequence
  chemically synthesized
ggtatcattaagggttactt

SEQ ID NO: 262028 - DNA, 20 bp, Artificial Sequence
  chemically synthesized
aatcaaaaaggtatcattaa

SEQ ID NO: 262029 - DNA, 20 bp, Artificial Sequence
  chemically synthesized
taatcaaaaaggtatcatta

SEQ ID NO: 262030 - DNA, 20 bp, Artificial Sequence
  chemically synthesized
gtaatcaaaaaggtatcatt

SEQ ID NO: 262031 - DNA, 20 bp, Artificial Sequence
  chemically synthesized
cagagcatcagtaatcaaaa

SEQ ID NO: 262032 - DNA, 20 bp, Artificial Sequence
  chemically synthesized
tcagagcatcagtaatcaaa

SEQ ID NO: 262033 - DNA, 20 bp, Artificial Sequence
  chemically synthesized
tttttgattactgatgctct

SEQ ID NO: 262034 - DNA, 20 bp, Artificial Sequence
  chemically synthesized
ctgaatgaaactcagagcat

SEQ ID NO: 262035 - DNA, 20 bp, Artificial Sequence
  chemically synthesized
ctagctctgaatgaaactca

SEQ ID NO: 262036 - DNA, 20 bp, Artificial Sequence
  chemically synthesized
agctagctctgaatgaaact

SEQ ID NO: 262037 - DNA, 20 bp, Artificial Sequence
  chemically synthesized
ctgatgctctgagtttcatt

SEQ ID NO: 262038 - DNA, 20 bp, Artificial Sequence
  chemically synthesized
gatgctctgagtttcattca

SEQ ID NO: 262039 - DNA, 20 bp, Artificial Sequence
  chemically synthesized
ctctgagtttcattcagagc

SEQ ID NO: 262040 - DNA, 20 bp, Artificial Sequence
  chemically synthesized
gagtttcattcagagctagc

SEQ ID NO: 262041 - DNA, 20 bp, Artificial Sequence
  chemically synthesized
tttcattcagagctagctgg

SEQ ID NO: 262042 - DNA, 20 bp, Artificial Sequence
  chemically synthesized
ataaaaacaagtctaccagc

SEQ ID NO: 262043 - DNA, 20 bp, Artificial Sequence
  chemically synthesized
aaaaataaaaacaagtctac

SEQ ID NO: 262044 - DNA, 20 bp, Artificial Sequence
  chemically synthesized
aacgtggaaaaaataaaaac

SEQ ID NO: 262045 - DNA, 20 bp, Artificial Sequence
  chemically synthesized
tgtttttattttttccacgt

SEQ ID NO: 262046 - DNA, 20 bp, Artificial Sequence
  chemically synthesized
tcaataaaggtcaaccaacg

SEQ ID NO: 262047 - DNA, 20 bp, Artificial Sequence
  chemically synthesized
tgaatcctcaaattcaataa

SEQ ID NO: 262048 - DNA, 20 bp, Artificial Sequence
  chemically synthesized
atgaatcctcaaattcaata

SEQ ID NO: 262049 - DNA, 20 bp, Artificial Sequence
  chemically synthesized
ggttgacctttattgaattt

SEQ ID NO: 262050 - DNA, 20 bp, Artificial Sequence
  chemically synthesized
gttgacctttattgaatttg

SEQ ID NO: 262051 - DNA, 20 bp, Artificial Sequence
  chemically synthesized
attaatgaaatttaataaaa

SEQ ID NO: 262052 - DNA, 20 bp, Artificial Sequence
  chemically synthesized
aaaatagggattatggggaa

SEQ ID NO: 262053 - DNA, 20 bp, Artificial Sequence
  chemically synthesized
aaaaaatagggattatgggg

SEQ ID NO: 262054 - DNA, 20 bp, Artificial Sequence
  chemically synthesized
tgaaaaaaatagggattatg

SEQ ID NO: 262055 - DNA, 20 bp, Artificial Sequence
  chemically synthesized
ttgaaaaaaatagggattat

SEQ ID NO: 262056 - DNA, 20 bp, Artificial Sequence
  chemically synthesized
gttgaaaaaaatagggatta

SEQ ID NO: 262057 - DNA, 20 bp, Artificial Sequence
  chemically synthesized
gtttcaagttgaaaaaaata

SEQ ID NO: 262058 - DNA, 20 bp, Artificial Sequence
  chemically synthesized
agtttcaagttgaaaaaaat

SEQ ID NO: 262059 - DNA, 20 bp, Artificial Sequence
  chemically synthesized
aagtttcaagttgaaaaaaa

SEQ ID NO: 262060 - DNA, 20 bp, Artificial Sequence
  chemically synthesized
atctgcgtgaaataagtttc

SEQ ID NO: 262061 - DNA, 20 bp, Artificial Sequence
  chemically synthesized
ctcaaacatctgcgtgaaat

SEQ ID NO: 262062 - DNA, 20 bp, Artificial Sequence
  chemically synthesized
aacttgaaacttatttcacg

SEQ ID NO: 262063 - DNA, 20 bp, Artificial Sequence
  chemically synthesized
cttatttcacgcagatgttt

SEQ ID NO: 262064 - DNA, 20 bp, Artificial Sequence
  chemically synthesized
ttatttcacgcagatgtttg

SEQ ID NO: 262065 - DNA, 20 bp, Artificial Sequence
  chemically synthesized
tatttcacgcagatgtttga

SEQ ID NO: 262066 - DNA, 20 bp, Artificial Sequence
  chemically synthesized
attaattatattttcatttc

SEQ ID NO: 262067 - DNA, 20 bp, Artificial Sequence
  chemically synthesized
agatttgaaaaaacaaagtc

SEQ ID NO: 262068 - DNA, 20 bp, Artificial Sequence
  chemically synthesized
aacgaagatttgaaaaaaca

SEQ ID NO: 262069 - DNA, 20 bp, Artificial Sequence
  chemically synthesized
cattatataaagtgaaaacg

SEQ ID NO: 262070 - DNA, 20 bp, Artificial Sequence
  chemically synthesized
ttcgttttcactttatataa

SEQ ID NO: 262071 - DNA, 20 bp, Artificial Sequence
  chemically synthesized
taagaataggccattatata

SEQ ID NO: 262072 - DNA, 20 bp, Artificial Sequence
  chemically synthesized
gatttttttccagtaagaat

SEQ ID NO: 262073 - DNA, 20 bp, Artificial Sequence
  chemically synthesized
atataatggcctattcttac

SEQ ID NO: 262074 - DNA, 20 bp, Artificial Sequence
  chemically synthesized
ggatttttttccagtaagaa

SEQ ID NO: 262075 - DNA, 20 bp, Artificial Sequence
  chemically synthesized
taaatggatttttttccagt

SEQ ID NO: 262076 - DNA, 20 bp, Artificial Sequence
  chemically synthesized
aaattaaatggatttttttc

SEQ ID NO: 262077 - DNA, 20 bp, Artificial Sequence
  chemically synthesized
gttcaaaaataaaaattaaa

SEQ ID NO: 262078 - DNA, 20 bp, Artificial Sequence
  chemically synthesized
gataatcaccaaaggatatt

SEQ ID NO: 262079 - DNA, 20 bp, Artificial Sequence
  chemically synthesized
aaaaattacttaatatcctt

SEQ ID NO: 262080 - DNA, 20 bp, Artificial Sequence
  chemically synthesized
gataagaggataatcaccaa

SEQ ID NO: 262081 - DNA, 20 bp, Artificial Sequence
  chemically synthesized
agataagaggataatcacca

SEQ ID NO: 262082 - DNA, 20 bp, Artificial Sequence
  chemically synthesized
ctgaagaaaatagagataag

SEQ ID NO: 262083 - DNA, 20 bp, Artificial Sequence
  chemically synthesized
cctgaagaaaatagagataa

SEQ ID NO: 262084 - DNA, 20 bp, Artificial Sequence
  chemically synthesized
tacctgaagaaaatagagat

SEQ ID NO: 262085 - DNA, 20 bp, Artificial Sequence
  chemically synthesized
atgtatacctgaagaaaata

SEQ ID NO: 262086 - DNA, 20 bp, Artificial Sequence
  chemically synthesized
cctcttatctctattttctt

SEQ ID NO: 262087 - DNA, 20 bp, Artificial Sequence
  chemically synthesized
gaatgtatacctgaagaaaa

SEQ ID NO: 262088 - DNA, 20 bp, Artificial Sequence
  chemically synthesized
ctcttatctctattttcttc

SEQ ID NO: 262089 - DNA, 20 bp, Artificial Sequence
  chemically synthesized
aaaaggagaatgtatacctg

SEQ ID NO: 262090 - DNA, 20 bp, Artificial Sequence
  chemically synthesized
cagatgccaaacgttaaaag

SEQ ID NO: 262091 - DNA, 20 bp, Artificial Sequence
  chemically synthesized
atcagatgccaaacgttaaa

SEQ ID NO: 262092 - DNA, 20 bp, Artificial Sequence
  chemically synthesized
tatcagatgccaaacgttaa

SEQ ID NO: 262093 - DNA, 20 bp, Artificial Sequence
  chemically synthesized
tacattctccttttaacgtt

SEQ ID NO: 262094 - DNA, 20 bp, Artificial Sequence
  chemically synthesized
aaaattataagcaatgttat

SEQ ID NO: 262095 - DNA, 20 bp, Artificial Sequence
  chemically synthesized
ttattgtggaaaaaaattat

SEQ ID NO: 262096 - DNA, 20 bp, Artificial Sequence
  chemically synthesized
aactaaaattatgattattg

SEQ ID NO: 262097 - DNA, 20 bp, Artificial Sequence
  chemically synthesized
ttccacaataatcataattt

SEQ ID NO: 262098 - DNA, 20 bp, Artificial Sequence
  chemically synthesized
taatcataattttagtttgt

SEQ ID NO: 262099 - DNA, 20 bp, Artificial Sequence
  chemically synthesized
gtgaaactgctaaggaacat

SEQ ID NO: 262100 - DNA, 20 bp, Artificial Sequence
  chemically synthesized
gtttgtaagcttatgttcct

SEQ ID NO: 262101 - DNA, 20 bp, Artificial Sequence
  chemically synthesized
tgtaagcttatgttccttag

SEQ ID NO: 262102 - DNA, 20 bp, Artificial Sequence
  chemically synthesized
agggtcatgtgaaactgcta

SEQ ID NO: 262103 - DNA, 20 bp, Artificial Sequence
  chemically synthesized
aagggtcatgtgaaactgct

SEQ ID NO: 262104 - DNA, 20 bp, Artificial Sequence
  chemically synthesized
tagcagtttcacatgaccct

SEQ ID NO: 262105 - DNA, 20 bp, Artificial Sequence
  chemically synthesized
agcagtttcacatgaccctt

SEQ ID NO: 262106 - DNA, 20 bp, Artificial Sequence
  chemically synthesized
gcagtttcacatgacccttg

SEQ ID NO: 262107 - DNA, 20 bp, Artificial Sequence
  chemically synthesized
cagtttcacatgacccttgg

SEQ ID NO: 262108 - DNA, 20 bp, Artificial Sequence
  chemically synthesized
gataccactacaacccccaa

SEQ ID NO: 262109 - DNA, 20 bp, Artificial Sequence
  chemically synthesized
agataccactacaaccccca

SEQ ID NO: 262110 - DNA, 20 bp, Artificial Sequence
  chemically synthesized
aagataccactacaaccccc

SEQ ID NO: 262111 - DNA, 20 bp, Artificial Sequence
  chemically synthesized
cacatgacccttgggggttg

SEQ ID NO: 262112 - DNA, 20 bp, Artificial Sequence
  chemically synthesized
atgacccttgggggttgtag

SEQ ID NO: 262113 - DNA, 20 bp, Artificial Sequence
  chemically synthesized
aaacacaaaattatacaatg

SEQ ID NO: 262114 - DNA, 20 bp, Artificial Sequence
  chemically synthesized
attttgtgtttgcaaatgcc

SEQ ID NO: 262115 - DNA, 20 bp, Artificial Sequence
  chemically synthesized
ttttgtgtttgcaaatgcct

SEQ ID NO: 262116 - DNA, 20 bp, Artificial Sequence
  chemically synthesized
aaaataacctcagagagccc

SEQ ID NO: 262117 - DNA, 20 bp, Artificial Sequence
  chemically synthesized
gaaaataacctcagagagcc

SEQ ID NO: 262118 - DNA, 20 bp, Artificial Sequence
  chemically synthesized
tgcaaatgcctgggctctct

SEQ ID NO: 262119 - DNA, 20 bp, Artificial Sequence
  chemically synthesized
gcaaatgcctgggctctctg

SEQ ID NO: 262120 - DNA, 20 bp, Artificial Sequence
  chemically synthesized
atttggaaaataacctcaga

SEQ ID NO: 262121 - DNA, 20 bp, Artificial Sequence
  chemically synthesized
gcatttggaaaataacctca

SEQ ID NO: 262122 - DNA, 20 bp, Artificial Sequence
  chemically synthesized
tagcatttggaaaataacct

SEQ ID NO: 262123 - DNA, 20 bp, Artificial Sequence
  chemically synthesized
cctcacatcattgtagcatt

SEQ ID NO: 262124 - DNA, 20 bp, Artificial Sequence
  chemically synthesized
aactgcccctcacatcattg

SEQ ID NO: 262125 - DNA, 20 bp, Artificial Sequence
  chemically synthesized
tccaaatgctacaatgatgt

SEQ ID NO: 262126 - DNA, 20 bp, Artificial Sequence
  chemically synthesized
ccaaatgctacaatgatgtg

SEQ ID NO: 262127 - DNA, 20 bp, Artificial Sequence
  chemically synthesized
caaatgctacaatgatgtga

SEQ ID NO: 262128 - DNA, 20 bp, Artificial Sequence
  chemically synthesized
aaatgctacaatgatgtgag

SEQ ID NO: 262129 - DNA, 20 bp, Artificial Sequence
  chemically synthesized
tgctacaatgatgtgagggg

SEQ ID NO: 262130 - DNA, 20 bp, Artificial Sequence
  chemically synthesized
caatgatgtgaggggcagtt

SEQ ID NO: 262131 - DNA, 20 bp, Artificial Sequence
  chemically synthesized
aatgatgtgaggggcagttt

SEQ ID NO: 262132 - DNA, 20 bp, Artificial Sequence
  chemically synthesized
atgatgtgaggggcagttta

SEQ ID NO: 262133 - DNA, 20 bp, Artificial Sequence
  chemically synthesized
gggaaaatcatgccctttct

SEQ ID NO: 262134 - DNA, 20 bp, Artificial Sequence
  chemically synthesized
atctgatgactgccaagaaa

SEQ ID NO: 262135 - DNA, 20 bp, Artificial Sequence
  chemically synthesized
aaaatcatgccctttcttgg

SEQ ID NO: 262136 - DNA, 20 bp, Artificial Sequence
  chemically synthesized
aatctgatgactgccaagaa

SEQ ID NO: 262137 - DNA, 20 bp, Artificial Sequence
  chemically synthesized
aaatctgatgactgccaaga

SEQ ID NO: 262138 - DNA, 20 bp, Artificial Sequence
  chemically synthesized
acacaaatctgatgactgcc

SEQ ID NO: 262139 - DNA, 20 bp, Artificial Sequence
  chemically synthesized
tgccctttcttggcagtcat

SEQ ID NO: 262140 - DNA, 20 bp, Artificial Sequence
  chemically synthesized
tagattcacagaataaacac

SEQ ID NO: 262141 - DNA, 20 bp, Artificial Sequence
  chemically synthesized
ctagattcacagaataaaca

SEQ ID NO: 262142 - DNA, 20 bp, Artificial Sequence
  chemically synthesized
ctgtgtttattctgtgaatc

SEQ ID NO: 262143 - DNA, 20 bp, Artificial Sequence
  chemically synthesized
gatacttttctctagattca

SEQ ID NO: 262144 - DNA, 20 bp, Artificial Sequence
  chemically synthesized
gtgtttattctgtgaatcta

SEQ ID NO: 262145 - DNA, 20 bp, Artificial Sequence
  chemically synthesized
tattctgtgaatctagagaa

SEQ ID NO: 262146 - DNA, 20 bp, Artificial Sequence
  chemically synthesized
tataagcagatacttttctc

SEQ ID NO: 262147 - DNA, 20 bp, Artificial Sequence
  chemically synthesized
ttaattctataatatataag

SEQ ID NO: 262148 - DNA, 20 bp, Artificial Sequence
  chemically synthesized
aatttaattctataatatat

SEQ ID NO: 262149 - DNA, 20 bp, Artificial Sequence
  chemically synthesized
aagtatctgcttatatatta

SEQ ID NO: 262150 - DNA, 20 bp, Artificial Sequence
  chemically synthesized
atttgaaattttcactgaac

SEQ ID NO: 262151 - DNA, 20 bp, Artificial Sequence
  chemically synthesized
ttaacaacagatatctcgtt

SEQ ID NO: 262152 - DNA, 20 bp, Artificial Sequence
  chemically synthesized
tttgtttaaaatgttaacaa

SEQ ID NO: 262153 - DNA, 20 bp, Artificial Sequence
  chemically synthesized
cattaagagaattaagtacg

SEQ ID NO: 262154 - DNA, 20 bp, Artificial Sequence
  chemically synthesized
cataagtcattaagagaatt

SEQ ID NO: 262155 - DNA, 20 bp, Artificial Sequence
  chemically synthesized
atattttcataagtcattaa

SEQ ID NO: 262156 - DNA, 20 bp, Artificial Sequence
  chemically synthesized
aaatattttcataagtcatt

SEQ ID NO: 262157 - DNA, 20 bp, Artificial Sequence
  chemically synthesized
aatttttaaaatattttcat

SEQ ID NO: 262158 - DNA, 20 bp, Artificial Sequence
  chemically synthesized
tgaaaatattttaaaaatta

SEQ ID NO: 262159 - DNA, 20 bp, Artificial Sequence
  chemically synthesized
tatatattaacattggaaaa

SEQ ID NO: 262160 - DNA, 20 bp, Artificial Sequence
  chemically synthesized
ttctgtatatatattaacat

SEQ ID NO: 262161 - DNA, 20 bp, Artificial Sequence
  chemically synthesized
ttccaatgttaatatatata

SEQ ID NO: 262162 - DNA, 20 bp, Artificial Sequence
  chemically synthesized
aatgttaatatatatacaga

SEQ ID NO: 262163 - DNA, 20 bp, Artificial Sequence
  chemically synthesized
atgttaatatatatacagaa

SEQ ID NO: 262164 - DNA, 20 bp, Artificial Sequence
  chemically synthesized
gttaatatatatacagaaag

SEQ ID NO: 262165 - DNA, 20 bp, Artificial Sequence
  chemically synthesized
atatatacagaaaggagacg

SEQ ID NO: 262166 - DNA, 20 bp, Artificial Sequence
  chemically synthesized
tatgcaggctcaatgcatga

SEQ ID NO: 262167 - DNA, 20 bp, Artificial Sequence
  chemically synthesized
gaagaaaactttcatgcatt

SEQ ID NO: 262168 - DNA, 20 bp, Artificial Sequence
  chemically synthesized
aaacacctgctgcgttatgc

SEQ ID NO: 262169 - DNA, 20 bp, Artificial Sequence
  chemically synthesized
tgcattgagcctgcataacg

SEQ ID NO: 262170 - DNA, 20 bp, Artificial Sequence
  chemically synthesized
caaacacctgctgcgttatg

SEQ ID NO: 262171 - DNA, 20 bp, Artificial Sequence
  chemically synthesized
attgagcctgcataacgcag

SEQ ID NO: 262172 - DNA, 20 bp, Artificial Sequence
  chemically synthesized
ttgagcctgcataacgcagc

SEQ ID NO: 262173 - DNA, 20 bp, Artificial Sequence
  chemically synthesized
atgtttctgaggattaaata

SEQ ID NO: 262174 - DNA, 20 bp, Artificial Sequence
  chemically synthesized
gatgtttctgaggattaaat

SEQ ID NO: 262175 - DNA, 20 bp, Artificial Sequence
  chemically synthesized
atattaccttatttaatcct

SEQ ID NO: 262176 - DNA, 20 bp, Artificial Sequence
  chemically synthesized
tagagataaggatgtttctg

SEQ ID NO: 262177 - DNA, 20 bp, Artificial Sequence
  chemically synthesized
atagagataaggatgtttct

SEQ ID NO: 262178 - DNA, 20 bp, Artificial Sequence
  chemically synthesized
tcatctgtacaatagagata

SEQ ID NO: 262179 - DNA, 20 bp, Artificial Sequence
  chemically synthesized
ttcatctgtacaatagagat

SEQ ID NO: 262180 - DNA, 20 bp, Artificial Sequence
  chemically synthesized
acatccttatctctattgta

SEQ ID NO: 262181 - DNA, 20 bp, Artificial Sequence
  chemically synthesized
tttacttcatctgtacaata

SEQ ID NO: 262182 - DNA, 20 bp, Artificial Sequence
  chemically synthesized
catttacttcatctgtacaa

SEQ ID NO: 262183 - DNA, 20 bp, Artificial Sequence
  chemically synthesized
ttatctctattgtacagatg

SEQ ID NO: 262184 - DNA, 20 bp, Artificial Sequence
  chemically synthesized
attgtacagatgaagtaaat

SEQ ID NO: 262185 - DNA, 20 bp, Artificial Sequence
  chemically synthesized
cagatgaagtaaatgagact

SEQ ID NO: 262186 - DNA, 20 bp, Artificial Sequence
  chemically synthesized
tgtatgatcagggataaact

SEQ ID NO: 262187 - DNA, 20 bp, Artificial Sequence
  chemically synthesized
ctttgagtgctgtatgatca

SEQ ID NO: 262188 - DNA, 20 bp, Artificial Sequence
  chemically synthesized
tcagtttatccctgatcata

SEQ ID NO: 262189 - DNA, 20 bp, Artificial Sequence
  chemically synthesized
actttgagtgctgtatgatc

SEQ ID NO: 262190 - DNA, 20 bp, Artificial Sequence
  chemically synthesized
gactttgagtgctgtatgat

SEQ ID NO: 262191 - DNA, 20 bp, Artificial Sequence
  chemically synthesized
ccctgatcatacagcactca

SEQ ID NO: 262192 - DNA, 20 bp, Artificial Sequence
  chemically synthesized
atatgaatcccagtgacttt

SEQ ID NO: 262193 - DNA, 20 bp, Artificial Sequence
  chemically synthesized
catacagcactcaaagtcac

SEQ ID NO: 262194 - DNA, 20 bp, Artificial Sequence
  chemically synthesized
atacagcactcaaagtcact

SEQ ID NO: 262195 - DNA, 20 bp, Artificial Sequence
  chemically synthesized
acagccttgaatatgaatcc

SEQ ID NO: 262196 - DNA, 20 bp, Artificial Sequence
  chemically synthesized
agtcactgggattcatattc

SEQ ID NO: 262197 - DNA, 20 bp, Artificial Sequence
  chemically synthesized
gtcactgggattcatattca

SEQ ID NO: 262198 - DNA, 20 bp, Artificial Sequence
  chemically synthesized
atattcaaggctgtttatcc

SEQ ID NO: 262199 - DNA, 20 bp, Artificial Sequence
  chemically synthesized
aaaattaactcttggataaa

SEQ ID NO: 262200 - DNA, 20 bp, Artificial Sequence
  chemically synthesized
attcaaggctgtttatccaa

SEQ ID NO: 262201 - DNA, 20 bp, Artificial Sequence
  chemically synthesized
ggtctagtaaaattaactct

SEQ ID NO: 262202 - DNA, 20 bp, Artificial Sequence
  chemically synthesized
tatccaagagttaattttac

SEQ ID NO: 262203 - DNA, 20 bp, Artificial Sequence
  chemically synthesized
actatcacagcagtgtggtc

SEQ ID NO: 262204 - DNA, 20 bp, Artificial Sequence
  chemically synthesized
gatgtactatcacagcagtg

SEQ ID NO: 262205 - DNA, 20 bp, Artificial Sequence
  chemically synthesized
actagaccacactgctgtga

SEQ ID NO: 262206 - DNA, 20 bp, Artificial Sequence
  chemically synthesized
tataggatgtactatcacag

SEQ ID NO: 262207 - DNA, 20 bp, Artificial Sequence
  chemically synthesized
ttctataggatgtactatca

SEQ ID NO: 262208 - DNA, 20 bp, Artificial Sequence
  chemically synthesized
tgctgtgatagtacatccta

SEQ ID NO: 262209 - DNA, 20 bp, Artificial Sequence
  chemically synthesized
aggaaaagggatagttctat

SEQ ID NO: 262210 - DNA, 20 bp, Artificial Sequence
  chemically synthesized
gaggaaaagggatagttcta

SEQ ID NO: 262211 - DNA, 20 bp, Artificial Sequence
  chemically synthesized
tgtaaactgaggaaaaggga

SEQ ID NO: 262212 - DNA, 20 bp, Artificial Sequence
  chemically synthesized
atagaactatcccttttcct

SEQ ID NO: 262213 - DNA, 20 bp, Artificial Sequence
  chemically synthesized
ggactgtaaactgaggaaaa

SEQ ID NO: 262214 - DNA, 20 bp, Artificial Sequence
  chemically synthesized
cggactgtaaactgaggaaa

SEQ ID NO: 262215 - DNA, 20 bp, Artificial Sequence
  chemically synthesized
acggactgtaaactgaggaa

SEQ ID NO: 262216 - DNA, 20 bp, Artificial Sequence
  chemically synthesized
tatcccttttcctcagttta

SEQ ID NO: 262217 - DNA, 20 bp, Artificial Sequence
  chemically synthesized
caagcacggactgtaaactg

SEQ ID NO: 262218 - DNA, 20 bp, Artificial Sequence
  chemically synthesized
ccaagcacggactgtaaact

SEQ ID NO: 262219 - DNA, 20 bp, Artificial Sequence
  chemically synthesized
ctcagtttacagtccgtgct

SEQ ID NO: 262220 - DNA, 20 bp, Artificial Sequence
  chemically synthesized
tcctcagttaagaccaagca

SEQ ID NO: 262221 - DNA, 20 bp, Artificial Sequence
  chemically synthesized
taggttcctcagttaagacc

SEQ ID NO: 262222 - DNA, 20 bp, Artificial Sequence
  chemically synthesized
gtccgtgcttggtcttaact

SEQ ID NO: 262223 - DNA, 20 bp, Artificial Sequence
  chemically synthesized
tccgtgcttggtcttaactg

SEQ ID NO: 262224 - DNA, 20 bp, Artificial Sequence
  chemically synthesized
agaaactaggttcctcagtt

SEQ ID NO: 262225 - DNA, 20 bp, Artificial Sequence
  chemically synthesized
ttggtcttaactgaggaacc

SEQ ID NO: 262226 - DNA, 20 bp, Artificial Sequence
  chemically synthesized
ggtttagaaactaggttcct

SEQ ID NO: 262227 - DNA, 20 bp, Artificial Sequence
  chemically synthesized
ttcctgttggtttagaaact

SEQ ID NO: 262228 - DNA, 20 bp, Artificial Sequence
  chemically synthesized
tttcctgttggtttagaaac

SEQ ID NO: 262229 - DNA, 20 bp, Artificial Sequence
  chemically synthesized
gaacctagtttctaaaccaa

SEQ ID NO: 262230 - DNA, 20 bp, Artificial Sequence
  chemically synthesized
aacctagtttctaaaccaac

SEQ ID NO: 262231 - DNA, 20 bp, Artificial Sequence
  chemically synthesized
taatatatttcctgttggtt

SEQ ID NO: 262232 - DNA, 20 bp, Artificial Sequence
  chemically synthesized
atttctaatatatttcctgt

SEQ ID NO: 262233 - DNA, 20 bp, Artificial Sequence
  chemically synthesized
taaaccaacaggaaatatat

SEQ ID NO: 262234 - DNA, 20 bp, Artificial Sequence
  chemically synthesized
ggaaatatattagaaatgat

SEQ ID NO: 262235 - DNA, 20 bp, Artificial Sequence
  chemically synthesized
aatgattggaattcctaatt

SEQ ID NO: 262236 - DNA, 20 bp, Artificial Sequence
  chemically synthesized
atgattggaattcctaatta

SEQ ID NO: 262237 - DNA, 20 bp, Artificial Sequence
  chemically synthesized
agagaactcctgccttaatt

SEQ ID NO: 262238 - DNA, 20 bp, Artificial Sequence
  chemically synthesized
attggaattcctaattaagg

SEQ ID NO: 262239 - DNA, 20 bp, Artificial Sequence
  chemically synthesized
gagagaactcctgccttaat

SEQ ID NO: 262240 - DNA, 20 bp, Artificial Sequence
  chemically synthesized
ttggaattcctaattaaggc

SEQ ID NO: 262241 - DNA, 20 bp, Artificial Sequence
  chemically synthesized
ggaattcctaattaaggcag

SEQ ID NO: 262242 - DNA, 20 bp, Artificial Sequence
  chemically synthesized
ttaccagatattcaaaatga

SEQ ID NO: 262243 - DNA, 20 bp, Artificial Sequence
  chemically synthesized
ttttaccagatattcaaaat

SEQ ID NO: 262244 - DNA, 20 bp, Artificial Sequence
  chemically synthesized
gttctctcattttgaatatc

SEQ ID NO: 262245 - DNA, 20 bp, Artificial Sequence
  chemically synthesized
gacgcaggtaaaaattttac

SEQ ID NO: 262246 - DNA, 20 bp, Artificial Sequence
  chemically synthesized
gcatgagactgggaggacgc

SEQ ID NO: 262247 - DNA, 20 bp, Artificial Sequence
  chemically synthesized
ggcatgagactgggaggacg

SEQ ID NO: 262248 - DNA, 20 bp, Artificial Sequence
  chemically synthesized
aatttttacctgcgtcctcc

SEQ ID NO: 262249 - DNA, 20 bp, Artificial Sequence
  chemically synthesized
gaaagaggcatgagactggg

SEQ ID NO: 262250 - DNA, 20 bp, Artificial Sequence
  chemically synthesized
agaaagaggcatgagactgg

SEQ ID NO: 262251 - DNA, 20 bp, Artificial Sequence
  chemically synthesized
aaagaaagaggcatgagact

SEQ ID NO: 262252 - DNA, 20 bp, Artificial Sequence
  chemically synthesized
taaagaaagaggcatgagac

SEQ ID NO: 262253 - DNA, 20 bp, Artificial Sequence
  chemically synthesized
gatgataaagaaagaggcat

SEQ ID NO: 262254 - DNA, 20 bp, Artificial Sequence
  chemically synthesized
cctggagatgataaagaaag

SEQ ID NO: 262255 - DNA, 20 bp, Artificial Sequence
  chemically synthesized
acctggagatgataaagaaa

SEQ ID NO: 262256 - DNA, 20 bp, Artificial Sequence
  chemically synthesized
aaacctggagatgataaaga

SEQ ID NO: 262257 - DNA, 20 bp, Artificial Sequence
  chemically synthesized
gggcaaacctggagatgata

SEQ ID NO: 262258 - DNA, 20 bp, Artificial Sequence
  chemically synthesized
gcctctttctttatcatctc

SEQ ID NO: 262259 - DNA, 20 bp, Artificial Sequence
  chemically synthesized
cctctttctttatcatctcc

SEQ ID NO: 262260 - DNA, 20 bp, Artificial Sequence
  chemically synthesized
tggtcctcagggcaaacctg

SEQ ID NO: 262261 - DNA, 20 bp, Artificial Sequence
  chemically synthesized
tgtggtcctcagggcaaacc

SEQ ID NO: 262262 - DNA, 20 bp, Artificial Sequence
  chemically synthesized
atcatctccaggtttgccct

SEQ ID NO: 262263 - DNA, 20 bp, Artificial Sequence
  chemically synthesized
tcatctccaggtttgccctg

SEQ ID NO: 262264 - DNA, 20 bp, Artificial Sequence
  chemically synthesized
tctgcaaattgtggtcctca

SEQ ID NO: 262265 - DNA, 20 bp, Artificial Sequence
  chemically synthesized
atctgcaaattgtggtcctc

SEQ ID NO: 262266 - DNA, 20 bp, Artificial Sequence
  chemically synthesized
tatctgcaaattgtggtcct

SEQ ID NO: 262267 - DNA, 20 bp, Artificial Sequence
  chemically synthesized
gccctgaggaccacaatttg

SEQ ID NO: 262268 - DNA, 20 bp, Artificial Sequence
  chemically synthesized
tagagggtatctgcaaattg

SEQ ID NO: 262269 - DNA, 20 bp, Artificial Sequence
  chemically synthesized
gcagaccaaagcatagtaga

SEQ ID NO: 262270 - DNA, 20 bp, Artificial Sequence
  chemically synthesized
tgcagaccaaagcatagtag

SEQ ID NO: 262271 - DNA, 20 bp, Artificial Sequence
  chemically synthesized
atgcagaccaaagcatagta

SEQ ID NO: 262272 - DNA, 20 bp, Artificial Sequence
  chemically synthesized
gaatgcagaccaaagcatag

SEQ ID NO: 262273 - DNA, 20 bp, Artificial Sequence
  chemically synthesized
agataccctctactatgctt

SEQ ID NO: 262274 - DNA, 20 bp, Artificial Sequence
  chemically synthesized
caggaatgcagaccaaagca

SEQ ID NO: 262275 - DNA, 20 bp, Artificial Sequence
  chemically synthesized
ccacacaggaatgcagacca

SEQ ID NO: 262276 - DNA, 20 bp, Artificial Sequence
  chemically synthesized
cgcccagccacacaggaatg

SEQ ID NO: 262277 - DNA, 20 bp, Artificial Sequence
  chemically synthesized
ctttggtctgcattcctgtg

SEQ ID NO: 262278 - DNA, 20 bp, Artificial Sequence
  chemically synthesized
ggtctgcattcctgtgtggc

SEQ ID NO: 262279 - DNA, 20 bp, Artificial Sequence
  chemically synthesized
gaggcagcgcccagccacac

SEQ ID NO: 262280 - DNA, 20 bp, Artificial Sequence
  chemically synthesized
gtctgcattcctgtgtggct

SEQ ID NO: 262281 - DNA, 20 bp, Artificial Sequence
  chemically synthesized
tgaggcagcgcccagccaca

SEQ ID NO: 262282 - DNA, 20 bp, Artificial Sequence
  chemically synthesized
aacaatcatgaggcagcgcc

SEQ ID NO: 262283 - DNA, 20 bp, Artificial Sequence
  chemically synthesized
ttgagggaacaatcatgagg

SEQ ID NO: 262284 - DNA, 20 bp, Artificial Sequence
  chemically synthesized
actttgagggaacaatcatg

SEQ ID NO: 262285 - DNA, 20 bp, Artificial Sequence
  chemically synthesized
gactttgagggaacaatcat

SEQ ID NO: 262286 - DNA, 20 bp, Artificial Sequence
  chemically synthesized
gcctcatgattgttccctca

SEQ ID NO: 262287 - DNA, 20 bp, Artificial Sequence
  chemically synthesized
gaaaaggactgagactttga

SEQ ID NO: 262288 - DNA, 20 bp, Artificial Sequence
  chemically synthesized
agaaaaggactgagactttg

SEQ ID NO: 262289 - DNA, 20 bp, Artificial Sequence
  chemically synthesized
tgattgttccctcaaagtct

SEQ ID NO: 262290 - DNA, 20 bp, Artificial Sequence
  chemically synthesized
cagaaaaggactgagacttt

SEQ ID NO: 262291 - DNA, 20 bp, Artificial Sequence
  chemically synthesized
ataaagctcagaaaaggact

SEQ ID NO: 262292 - DNA, 20 bp, Artificial Sequence
  chemically synthesized
caaagtctcagtccttttct

SEQ ID NO: 262293 - DNA, 20 bp, Artificial Sequence
  chemically synthesized
gtagtaataaagctcagaaa

SEQ ID NO: 262294 - DNA, 20 bp, Artificial Sequence
  chemically synthesized
ggtagtaataaagctcagaa

SEQ ID NO: 262295 - DNA, 20 bp, Artificial Sequence
  chemically synthesized
tatatggtagtaataaagct

SEQ ID NO: 262296 - DNA, 20 bp, Artificial Sequence
  chemically synthesized
agctatatatggtagtaata

SEQ ID NO: 262297 - DNA, 20 bp, Artificial Sequence
  chemically synthesized
agctttattactaccatata

SEQ ID NO: 262298 - DNA, 20 bp, Artificial Sequence
  chemically synthesized
catgtcagagctatatatgg

SEQ ID NO: 262299 - DNA, 20 bp, Artificial Sequence
  chemically synthesized
gtccatgtcagagctatata

SEQ ID NO: 262300 - DNA, 20 bp, Artificial Sequence
  chemically synthesized
taccatatatagctctgaca

SEQ ID NO: 262301 - DNA, 20 bp, Artificial Sequence
  chemically synthesized
aggggactctgtccatgtca

SEQ ID NO: 262302 - DNA, 20 bp, Artificial Sequence
  chemically synthesized
atatatagctctgacatgga

SEQ ID NO: 262303 - DNA, 20 bp, Artificial Sequence
  chemically synthesized
ttaggggactctgtccatgt

SEQ ID NO: 262304 - DNA, 20 bp, Artificial Sequence
  chemically synthesized
atatagctctgacatggaca

SEQ ID NO: 262305 - DNA, 20 bp, Artificial Sequence
  chemically synthesized
tgtaaaattaaggcatttag

SEQ ID NO: 262306 - DNA, 20 bp, Artificial Sequence
  chemically synthesized
ctgtaaaattaaggcattta

SEQ ID NO: 262307 - DNA, 20 bp, Artificial Sequence
  chemically synthesized
actgtaaaattaaggcattt

SEQ ID NO: 262308 - DNA, 20 bp, Artificial Sequence
  chemically synthesized
cactgtaaaattaaggcatt

SEQ ID NO: 262309 - DNA, 20 bp, Artificial Sequence
  chemically synthesized
tgctaaccactgtaaaatta

SEQ ID NO: 262310 - DNA, 20 bp, Artificial Sequence
  chemically synthesized
ccctaaatgccttaatttta

SEQ ID NO: 262311 - DNA, 20 bp, Artificial Sequence
  chemically synthesized
gtgctaaccactgtaaaatt

SEQ ID NO: 262312 - DNA, 20 bp, Artificial Sequence
  chemically synthesized
taaatgccttaattttacag

SEQ ID NO: 262313 - DNA, 20 bp, Artificial Sequence
  chemically synthesized
tgccttaattttacagtggt

SEQ ID NO: 262314 - DNA, 20 bp, Artificial Sequence
  chemically synthesized
acagtggttagcacttctct

SEQ ID NO: 262315 - DNA, 20 bp, Artificial Sequence
  chemically synthesized
tcacagataaagactcagag

SEQ ID NO: 262316 - DNA, 20 bp, Artificial Sequence
  chemically synthesized
atctcacagataaagactca

SEQ ID NO: 262317 - DNA, 20 bp, Artificial Sequence
  chemically synthesized
ttatctcacagataaagact

SEQ ID NO: 262318 - DNA, 20 bp, Artificial Sequence
  chemically synthesized
ttctctgagtctttatctgt

SEQ ID NO: 262319 - DNA, 20 bp, Artificial Sequence
  chemically synthesized
ttttccttatctcacagata

SEQ ID NO: 262320 - DNA, 20 bp, Artificial Sequence
  chemically synthesized
tgagtctttatctgtgagat

SEQ ID NO: 262321 - DNA, 20 bp, Artificial Sequence
  chemically synthesized
gagtctttatctgtgagata

SEQ ID NO: 262322 - DNA, 20 bp, Artificial Sequence
  chemically synthesized
aattaattttccttatctca

SEQ ID NO: 262323 - DNA, 20 bp, Artificial Sequence
  chemically synthesized
tttttcattttaaactcact

SEQ ID NO: 262324 - DNA, 20 bp, Artificial Sequence
  chemically synthesized
ttagtatgtgagagctgagt

SEQ ID NO: 262325 - DNA, 20 bp, Artificial Sequence
  chemically synthesized
atgcttagtatgtgagagct

SEQ ID NO: 262326 - DNA, 20 bp, Artificial Sequence
  chemically synthesized
ttaaaatgcttagtatgtga

SEQ ID NO: 262327 - DNA, 20 bp, Artificial Sequence
  chemically synthesized
tcactcagctctcacatact

SEQ ID NO: 262328 - DNA, 20 bp, Artificial Sequence
  chemically synthesized
tcttaaaatgcttagtatgt

SEQ ID NO: 262329 - DNA, 20 bp, Artificial Sequence
  chemically synthesized
agcggtactcttaaaatgct

SEQ ID NO: 262330 - DNA, 20 bp, Artificial Sequence
  chemically synthesized
tctcacatactaagcatttt

SEQ ID NO: 262331 - DNA, 20 bp, Artificial Sequence
  chemically synthesized
tcacatactaagcattttaa

SEQ ID NO: 262332 - DNA, 20 bp, Artificial Sequence
  chemically synthesized
caacatgttgaaatagtaag

SEQ ID NO: 262333 - DNA, 20 bp, Artificial Sequence
  chemically synthesized
cagcaacatgttgaaatagt

SEQ ID NO: 262334 - DNA, 20 bp, Artificial Sequence
  chemically synthesized
tttacagcaacatgttgaaa

SEQ ID NO: 262335 - DNA, 20 bp, Artificial Sequence
  chemically synthesized
tatttcaacatgttgctgta

SEQ ID NO: 262336 - DNA, 20 bp, Artificial Sequence
  chemically synthesized
gttcatctttcatgtcttta

SEQ ID NO: 262337 - DNA, 20 bp, Artificial Sequence
  chemically synthesized
atgttgctgtaaagacatga

SEQ ID NO: 262338 - DNA, 20 bp, Artificial Sequence
  chemically synthesized
agacatgaaagatgaacttt

SEQ ID NO: 262339 - DNA, 20 bp, Artificial Sequence
  chemically synthesized
agatataaactgtaggctta

SEQ ID NO: 262340 - DNA, 20 bp, Artificial Sequence
  chemically synthesized
aaagatgaactttaagccta

SEQ ID NO: 262341 - DNA, 20 bp, Artificial Sequence
  chemically synthesized
tttttctagatataaactgt

SEQ ID NO: 262342 - DNA, 20 bp, Artificial Sequence
  chemically synthesized
gtttttctagatataaactg

SEQ ID NO: 262343 - DNA, 20 bp, Artificial Sequence
  chemically synthesized
ttaagcctacagtttatatc

SEQ ID NO: 262344 - DNA, 20 bp, Artificial Sequence
  chemically synthesized
actgtccctttttgtttttc

SEQ ID NO: 262345 - DNA, 20 bp, Artificial Sequence
  chemically synthesized
tttatatctagaaaaacaaa

SEQ ID NO: 262346 - DNA, 20 bp, Artificial Sequence
  chemically synthesized
ttatatctagaaaaacaaaa

SEQ ID NO: 262347 - DNA, 20 bp, Artificial Sequence
  chemically synthesized
tatatctagaaaaacaaaaa

SEQ ID NO: 262348 - DNA, 20 bp, Artificial Sequence
  chemically synthesized
tctagaaaaacaaaaaggga

SEQ ID NO: 262349 - DNA, 20 bp, Artificial Sequence
  chemically synthesized
gaaaaacaaaaagggacagt

SEQ ID NO: 262350 - DNA, 20 bp, Artificial Sequence
  chemically synthesized
aaaaacaaaaagggacagtt

SEQ ID NO: 262351 - DNA, 20 bp, Artificial Sequence
  chemically synthesized
caaaaagggacagttaggaa

SEQ ID NO: 262352 - DNA, 20 bp, Artificial Sequence
  chemically synthesized
aaaagtaaaaatcaaacaat

SEQ ID NO: 262353 - DNA, 20 bp, Artificial Sequence
  chemically synthesized
aagtaaaaatcaaacaatta

SEQ ID NO: 262354 - DNA, 20 bp, Artificial Sequence
  chemically synthesized
taaaaatcaaacaattagag

SEQ ID NO: 262355 - DNA, 20 bp, Artificial Sequence
  chemically synthesized
aaaaatcaaacaattagaga

SEQ ID NO: 262356 - DNA, 20 bp, Artificial Sequence
  chemically synthesized
aaatcaaacaattagagaag

SEQ ID NO: 262357 - DNA, 20 bp, Artificial Sequence
  chemically synthesized
acaattagagaaggagaata

SEQ ID NO: 262358 - DNA, 20 bp, Artificial Sequence
  chemically synthesized
caattagagaaggagaatat

SEQ ID NO: 262359 - DNA, 20 bp, Artificial Sequence
  chemically synthesized
aattagagaaggagaatata

SEQ ID NO: 262360 - DNA, 20 bp, Artificial Sequence
  chemically synthesized
attagagaaggagaatatag

SEQ ID NO: 262361 - DNA, 20 bp, Artificial Sequence
  chemically synthesized
ttagagaaggagaatatagg

SEQ ID NO: 262362 - DNA, 20 bp, Artificial Sequence
  chemically synthesized
agagaaggagaatatagggg

SEQ ID NO: 262363 - DNA, 20 bp, Artificial Sequence
  chemically synthesized
gagaaggagaatataggggg

SEQ ID NO: 262364 - DNA, 20 bp, Artificial Sequence
  chemically synthesized
aggagaatatagggggaggt

SEQ ID NO: 262365 - DNA, 20 bp, Artificial Sequence
  chemically synthesized
gggggaggtaagaaattctg

SEQ ID NO: 262366 - DNA, 20 bp, Artificial Sequence
  chemically synthesized
ggtaagaaattctgaagcta

SEQ ID NO: 262367 - DNA, 20 bp, Artificial Sequence
  chemically synthesized
tgcagcatatgccatagctt

SEQ ID NO: 262368 - DNA, 20 bp, Artificial Sequence
  chemically synthesized
ctctgatgcagcatatgcca

SEQ ID NO: 262369 - DNA, 20 bp, Artificial Sequence
  chemically synthesized
agctatggcatatgctgcat

SEQ ID NO: 262370 - DNA, 20 bp, Artificial Sequence
  chemically synthesized
ctatggcatatgctgcatca

SEQ ID NO: 262371 - DNA, 20 bp, Artificial Sequence
  chemically synthesized
accttacaatggctctgatg

SEQ ID NO: 262372 - DNA, 20 bp, Artificial Sequence
  chemically synthesized
tgctgcatcagagccattgt

SEQ ID NO: 262373 - DNA, 20 bp, Artificial Sequence
  chemically synthesized
gctgcatcagagccattgta

SEQ ID NO: 262374 - DNA, 20 bp, Artificial Sequence
  chemically synthesized
tatttgatataaccttacaa

SEQ ID NO: 262375 - DNA, 20 bp, Artificial Sequence
  chemically synthesized
agtaacagcttaatgaaaag

SEQ ID NO: 262376 - DNA, 20 bp, Artificial Sequence
  chemically synthesized
atcaaatactacttttcatt

SEQ ID NO: 262377 - DNA, 20 bp, Artificial Sequence
  chemically synthesized
cacagtaacagcttaatgaa

SEQ ID NO: 262378 - DNA, 20 bp, Artificial Sequence
  chemically synthesized
atttgtgatagtcacagtaa

SEQ ID NO: 262379 - DNA, 20 bp, Artificial Sequence
  chemically synthesized
agagtcatttgtgatagtca

SEQ ID NO: 262380 - DNA, 20 bp, Artificial Sequence
  chemically synthesized
cgccctagagtcatttgtga

SEQ ID NO: 262381 - DNA, 20 bp, Artificial Sequence
  chemically synthesized
gtgactatcacaaatgactc

SEQ ID NO: 262382 - DNA, 20 bp, Artificial Sequence
  chemically synthesized
tgactatcacaaatgactct

SEQ ID NO: 262383 - DNA, 20 bp, Artificial Sequence
  chemically synthesized
gactatcacaaatgactcta

SEQ ID NO: 262384 - DNA, 20 bp, Artificial Sequence
  chemically synthesized
ttcccaattcttacgcccta

SEQ ID NO: 262385 - DNA, 20 bp, Artificial Sequence
  chemically synthesized
cacaaatgactctagggcgt

SEQ ID NO: 262386 - DNA, 20 bp, Artificial Sequence
  chemically synthesized
ctttcccaattcttacgccc

SEQ ID NO: 262387 - DNA, 20 bp, Artificial Sequence
  chemically synthesized
tgactctagggcgtaagaat

SEQ ID NO: 262388 - DNA, 20 bp, Artificial Sequence
  chemically synthesized
gactctagggcgtaagaatt

SEQ ID NO: 262389 - DNA, 20 bp, Artificial Sequence
  chemically synthesized
ctagggcgtaagaattggga

SEQ ID NO: 262390 - DNA, 20 bp, Artificial Sequence
  chemically synthesized
ttgggaaagataactctaat

SEQ ID NO: 262391 - DNA, 20 bp, Artificial Sequence
  chemically synthesized
ggaaagataactctaatcag

SEQ ID NO: 262392 - DNA, 20 bp, Artificial Sequence
  chemically synthesized
ttcactgtggccactgatta

SEQ ID NO: 262393 - DNA, 20 bp, Artificial Sequence
  chemically synthesized
atttcactgtggccactgat

SEQ ID NO: 262394 - DNA, 20 bp, Artificial Sequence
  chemically synthesized
ataactctaatcagtggcca

SEQ ID NO: 262395 - DNA, 20 bp, Artificial Sequence
  chemically synthesized
ttttaaaactaatttcactg

SEQ ID NO: 262396 - DNA, 20 bp, Artificial Sequence
  chemically synthesized
atcagtggccacagtgaaat

SEQ ID NO: 262397 - DNA, 20 bp, Artificial Sequence
  chemically synthesized
ttttaaaatgcattgacaat

SEQ ID NO: 262398 - DNA, 20 bp, Artificial Sequence
  chemically synthesized
aaatgcattgacaattggtc

SEQ ID NO: 262399 - DNA, 20 bp, Artificial Sequence
  chemically synthesized
ttgacaattggtcaagtata

SEQ ID NO: 262400 - DNA, 20 bp, Artificial Sequence
  chemically synthesized
aggtgggtgtagaaatattc

SEQ ID NO: 262401 - DNA, 20 bp, Artificial Sequence
  chemically synthesized
gatagatagacaggtgggtg

SEQ ID NO: 262402 - DNA, 20 bp, Artificial Sequence
  chemically synthesized
aggtagatagatagacaggt

SEQ ID NO: 262403 - DNA, 20 bp, Artificial Sequence
  chemically synthesized
taggtagatagatagacagg

SEQ ID NO: 262404 - DNA, 20 bp, Artificial Sequence
  chemically synthesized
tggtaggtagatagatagac

SEQ ID NO: 262405 - DNA, 20 bp, Artificial Sequence
  chemically synthesized
ttggtaggtagatagataga

SEQ ID NO: 262406 - DNA, 20 bp, Artificial Sequence
  chemically synthesized
taggttggtaggtagataga

SEQ ID NO: 262407 - DNA, 20 bp, Artificial Sequence
  chemically synthesized
tatataggttggtaggtaga

SEQ ID NO: 262408 - DNA, 20 bp, Artificial Sequence
  chemically synthesized
taggtatataggttggtagg

SEQ ID NO: 262409 - DNA, 20 bp, Artificial Sequence
  chemically synthesized
aagtaggtatataggttggt

SEQ ID NO: 262410 - DNA, 20 bp, Artificial Sequence
  chemically synthesized
taagtaggtatataggttgg

SEQ ID NO: 262411 - DNA, 20 bp, Artificial Sequence
  chemically synthesized
tgataagtaggtatataggt

SEQ ID NO: 262412 - DNA, 20 bp, Artificial Sequence
  chemically synthesized
tagatgataagtaggtatat

SEQ ID NO: 262413 - DNA, 20 bp, Artificial Sequence
  chemically synthesized
atagatgataagtaggtata

SEQ ID NO: 262414 - DNA, 20 bp, Artificial Sequence
  chemically synthesized
ataattgatagatgataagt

SEQ ID NO: 262415 - DNA, 20 bp, Artificial Sequence
  chemically synthesized
gataattgatagatgataag

SEQ ID NO: 262416 - DNA, 20 bp, Artificial Sequence
  chemically synthesized
agggataattgatagatgat

SEQ ID NO: 262417 - DNA, 20 bp, Artificial Sequence
  chemically synthesized
tagaactgagggataattga

SEQ ID NO: 262418 - DNA, 20 bp, Artificial Sequence
  chemically synthesized
atcatctatcaattatccct

SEQ ID NO: 262419 - DNA, 20 bp, Artificial Sequence
  chemically synthesized
cgtattttaattagaactga

SEQ ID NO: 262420 - DNA, 20 bp, Artificial Sequence
  chemically synthesized
tcgtattttaattagaactg

SEQ ID NO: 262421 - DNA, 20 bp, Artificial Sequence
  chemically synthesized
atcgtattttaattagaact

SEQ ID NO: 262422 - DNA, 20 bp, Artificial Sequence
  chemically synthesized
atttggcatcgtattttaat

SEQ ID NO: 262423 - DNA, 20 bp, Artificial Sequence
  chemically synthesized
tttaatattgcagttatatt

SEQ ID NO: 262424 - DNA, 20 bp, Artificial Sequence
  chemically synthesized
gaataatcaatttaatattg

SEQ ID NO: 262425 - DNA, 20 bp, Artificial Sequence
  chemically synthesized
taaattgattattcttcata

SEQ ID NO: 262426 - DNA, 20 bp, Artificial Sequence
  chemically synthesized
aagtaatcacaatctgtatg

SEQ ID NO: 262427 - DNA, 20 bp, Artificial Sequence
  chemically synthesized
cttaattatccatgataata

SEQ ID NO: 262428 - DNA, 20 bp, Artificial Sequence
  chemically synthesized
ttgtgattactttattatca

SEQ ID NO: 262429 - DNA, 20 bp, Artificial Sequence
  chemically synthesized
ctttattatcatggataatt

SEQ ID NO: 262430 - DNA, 20 bp, Artificial Sequence
  chemically synthesized
ttattatcatggataattaa

SEQ ID NO: 262431 - DNA, 20 bp, Artificial Sequence
  chemically synthesized
attaagagttaacacaaaaa

SEQ ID NO: 262432 - DNA, 20 bp, Artificial Sequence
  chemically synthesized
caaaattcagaatgtgaagg

SEQ ID NO: 262433 - DNA, 20 bp, Artificial Sequence
  chemically synthesized
ccaaaattcagaatgtgaag

SEQ ID NO: 262434 - DNA, 20 bp, Artificial Sequence
  chemically synthesized
tccaaaattcagaatgtgaa

SEQ ID NO: 262435 - DNA, 20 bp, Artificial Sequence
  chemically synthesized
atccaaaattcagaatgtga

SEQ ID NO: 262436 - DNA, 20 bp, Artificial Sequence
  chemically synthesized
gatccaaaattcagaatgtg

SEQ ID NO: 262437 - DNA, 20 bp, Artificial Sequence
  chemically synthesized
ccccttcacattctgaattt

SEQ ID NO: 262438 - DNA, 20 bp, Artificial Sequence
  chemically synthesized
tatattaaagatccaaaatt

SEQ ID NO: 262439 - DNA, 20 bp, Artificial Sequence
  chemically synthesized
ttcttaagttttatatatta

SEQ ID NO: 262440 - DNA, 20 bp, Artificial Sequence
  chemically synthesized
atctttaatatataaaactt

SEQ ID NO: 262441 - DNA, 20 bp, Artificial Sequence
  chemically synthesized
ctcataaacgatttattctt

SEQ ID NO: 262442 - DNA, 20 bp, Artificial Sequence
  chemically synthesized
cttaagaataaatcgtttat

SEQ ID NO: 262443 - DNA, 20 bp, Artificial Sequence
  chemically synthesized
ttaagaataaatcgtttatg

SEQ ID NO: 262444 - DNA, 20 bp, Artificial Sequence
  chemically synthesized
tttatgaggaaaatatatcc

SEQ ID NO: 262445 - DNA, 20 bp, Artificial Sequence
  chemically synthesized
aaaaattgtagtaaaattct

SEQ ID NO: 262446 - DNA, 20 bp, Artificial Sequence
  chemically synthesized
aaaaaattgtagtaaaattc

SEQ ID NO: 262447 - DNA, 20 bp, Artificial Sequence
  chemically synthesized
tatatatttttaaaaaattg

SEQ ID NO: 262448 - DNA, 20 bp, Artificial Sequence
  chemically synthesized
aattttttaaaaatatatac

SEQ ID NO: 262449 - DNA, 20 bp, Artificial Sequence
  chemically synthesized
taaaggaagcatgtgtgaac

SEQ ID NO: 262450 - DNA, 20 bp, Artificial Sequence
  chemically synthesized
aatgactggtgaaataaagg

SEQ ID NO: 262451 - DNA, 20 bp, Artificial Sequence
  chemically synthesized
aataatgactggtgaaataa

SEQ ID NO: 262452 - DNA, 20 bp, Artificial Sequence
  chemically synthesized
taataatgactggtgaaata

SEQ ID NO: 262453 - DNA, 20 bp, Artificial Sequence
  chemically synthesized
acatgcttcctttatttcac

SEQ ID NO: 262454 - DNA, 20 bp, Artificial Sequence
  chemically synthesized
ttgtacaacgtaataatgac

SEQ ID NO: 262455 - DNA, 20 bp, Artificial Sequence
  chemically synthesized
acgttgtacaaatatttgtt

SEQ ID NO: 262456 - DNA, 20 bp, Artificial Sequence
  chemically synthesized
gttgtacaaatatttgttga

SEQ ID NO: 262457 - DNA, 20 bp, Artificial Sequence
  chemically synthesized
attatgtccctattcatagt

SEQ ID NO: 262458 - DNA, 20 bp, Artificial Sequence
  chemically synthesized
tgttgagagcctactatgaa

SEQ ID NO: 262459 - DNA, 20 bp, Artificial Sequence
  chemically synthesized
cattatgtccctattcatag

SEQ ID NO: 262460 - DNA, 20 bp, Artificial Sequence
  chemically synthesized
gttgagagcctactatgaat

SEQ ID NO: 262461 - DNA, 20 bp, Artificial Sequence
  chemically synthesized
ttgagagcctactatgaata

SEQ ID NO: 262462 - DNA, 20 bp, Artificial Sequence
  chemically synthesized
tgccattatgtccctattca

SEQ ID NO: 262463 - DNA, 20 bp, Artificial Sequence
  chemically synthesized
tactatgaatagggacataa

SEQ ID NO: 262464 - DNA, 20 bp, Artificial Sequence
  chemically synthesized
tagggacataatggcatttt

SEQ ID NO: 262465 - DNA, 20 bp, Artificial Sequence
  chemically synthesized
gacataatggcattttaagt

SEQ ID NO: 262466 - DNA, 20 bp, Artificial Sequence
  chemically synthesized
ataatggcattttaagtaag

SEQ ID NO: 262467 - DNA, 20 bp, Artificial Sequence
  chemically synthesized
cattttaagtaagtggttta

SEQ ID NO: 262468 - DNA, 20 bp, Artificial Sequence
  chemically synthesized
ttttaagtaagtggtttatg

SEQ ID NO: 262469 - DNA, 20 bp, Artificial Sequence
  chemically synthesized
ctttatggctaaataggcac

SEQ ID NO: 262470 - DNA, 20 bp, Artificial Sequence
  chemically synthesized
gctttatggctaaataggca

SEQ ID NO: 262471 - DNA, 20 bp, Artificial Sequence
  chemically synthesized
tttttgatcctgtgcctatt

SEQ ID NO: 262472 - DNA, 20 bp, Artificial Sequence
  chemically synthesized
ctaatgctttatggctaaat

SEQ ID NO: 262473 - DNA, 20 bp, Artificial Sequence
  chemically synthesized
gctaatgctttatggctaaa

SEQ ID NO: 262474 - DNA, 20 bp, Artificial Sequence
  chemically synthesized
cctgtgcctatttagccata

SEQ ID NO: 262475 - DNA, 20 bp, Artificial Sequence
  chemically synthesized
atcaagttgctaatgcttta

SEQ ID NO: 262476 - DNA, 20 bp, Artificial Sequence
  chemically synthesized
cctatttagccataaagcat

SEQ ID NO: 262477 - DNA, 20 bp, Artificial Sequence
  chemically synthesized
taaagcattagcaacttgat

SEQ ID NO: 262478 - DNA, 20 bp, Artificial Sequence
  chemically synthesized
aaattcgttacaaactaatc

SEQ ID NO: 262479 - DNA, 20 bp, Artificial Sequence
  chemically synthesized
cgaattttaaacctgcatat

SEQ ID NO: 262480 - DNA, 20 bp, Artificial Sequence
  chemically synthesized
gaattttaaacctgcatatt

SEQ ID NO: 262481 - DNA, 20 bp, Artificial Sequence
  chemically synthesized
tcttgacacacccaatatgc

SEQ ID NO: 262482 - DNA, 20 bp, Artificial Sequence
  chemically synthesized
gtcttgacacacccaatatg

SEQ ID NO: 262483 - DNA, 20 bp, Artificial Sequence
  chemically synthesized
acctgcatattgggtgtgtc

SEQ ID NO: 262484 - DNA, 20 bp, Artificial Sequence
  chemically synthesized
atattgggtgtgtcaagacc

SEQ ID NO: 262485 - DNA, 20 bp, Artificial Sequence
  chemically synthesized
tattgggtgtgtcaagacct

SEQ ID NO: 262486 - DNA, 20 bp, Artificial Sequence
  chemically synthesized
attgggtgtgtcaagacctg

SEQ ID NO: 262487 - DNA, 20 bp, Artificial Sequence
  chemically synthesized
tctccattccaattttcccc

SEQ ID NO: 262488 - DNA, 20 bp, Artificial Sequence
  chemically synthesized
ttctccattccaattttccc

SEQ ID NO: 262489 - DNA, 20 bp, Artificial Sequence
  chemically synthesized
tgtcaagacctggggaaaat

SEQ ID NO: 262490 - DNA, 20 bp, Artificial Sequence
  chemically synthesized
agacctggggaaaattggaa

SEQ ID NO: 262491 - DNA, 20 bp, Artificial Sequence
  chemically synthesized
acctggggaaaattggaatg

SEQ ID NO: 262492 - DNA, 20 bp, Artificial Sequence
  chemically synthesized
gaaaattggaatggagaaat

SEQ ID NO: 262493 - DNA, 20 bp, Artificial Sequence
  chemically synthesized
attggaatggagaaatgagt

SEQ ID NO: 262494 - DNA, 20 bp, Artificial Sequence
  chemically synthesized
ggaatggagaaatgagttag

SEQ ID NO: 262495 - DNA, 20 bp, Artificial Sequence
  chemically synthesized
tggagaaatgagttagtagt

SEQ ID NO: 262496 - DNA, 20 bp, Artificial Sequence
  chemically synthesized
gttagtagtcagataattca

SEQ ID NO: 262497 - DNA, 20 bp, Artificial Sequence
  chemically synthesized
tagtcagataattcaaagca

SEQ ID NO: 262498 - DNA, 20 bp, Artificial Sequence
  chemically synthesized
agtcagataattcaaagcaa

SEQ ID NO: 262499 - DNA, 20 bp, Artificial Sequence
  chemically synthesized
ttaatagatcattcaagggg

SEQ ID NO: 262500 - DNA, 20 bp, Artificial Sequence
  chemically synthesized
atttaatagatcattcaagg

SEQ ID NO: 262501 - DNA, 20 bp, Artificial Sequence
  chemically synthesized
aatttaatagatcattcaag

SEQ ID NO: 262502 - DNA, 20 bp, Artificial Sequence
  chemically synthesized
caatttaatagatcattcaa

SEQ ID NO: 262503 - DNA, 20 bp, Artificial Sequence
  chemically synthesized
tcaatttaatagatcattca

SEQ ID NO: 262504 - DNA, 20 bp, Artificial Sequence
  chemically synthesized
ctcaatttaatagatcattc

SEQ ID NO: 262505 - DNA, 20 bp, Artificial Sequence
  chemically synthesized
cttgaatgatctattaaatt

SEQ ID NO: 262506 - DNA, 20 bp, Artificial Sequence
  chemically synthesized
atagtttcacctcaatttaa

SEQ ID NO: 262507 - DNA, 20 bp, Artificial Sequence
  chemically synthesized
ttgaatgatctattaaattg

SEQ ID NO: 262508 - DNA, 20 bp, Artificial Sequence
  chemically synthesized
ttgaggtgaaactattttat

SEQ ID NO: 262509 - DNA, 20 bp, Artificial Sequence
  chemically synthesized
aaaagaaaattctaataaaa

SEQ ID NO: 262510 - DNA, 20 bp, Artificial Sequence
  chemically synthesized
gaaagattaaggcaatcaaa

SEQ ID NO: 262511 - DNA, 20 bp, Artificial Sequence
  chemically synthesized
caaaatgaagcgaaagatta

SEQ ID NO: 262512 - DNA, 20 bp, Artificial Sequence
  chemically synthesized
gcaaaatgaagcgaaagatt

SEQ ID NO: 262513 - DNA, 20 bp, Artificial Sequence
  chemically synthesized
gcagatgcaaaatgaagcga

SEQ ID NO: 262514 - DNA, 20 bp, Artificial Sequence
  chemically synthesized
gtgtctgcagatgcaaaatg

SEQ ID NO: 262515 - DNA, 20 bp, Artificial Sequence
  chemically synthesized
ttcgcttcattttgcatctg

SEQ ID NO: 262516 - DNA, 20 bp, Artificial Sequence
  chemically synthesized
tcattttgcatctgcagaca

SEQ ID NO: 262517 - DNA, 20 bp, Artificial Sequence
  chemically synthesized
cattttgcatctgcagacac

SEQ ID NO: 262518 - DNA, 20 bp, Artificial Sequence
  chemically synthesized
aaccagcaagcctgtgtctg

SEQ ID NO: 262519 - DNA, 20 bp, Artificial Sequence
  chemically synthesized
atctgcagacacaggcttgc

SEQ ID NO: 262520 - DNA, 20 bp, Artificial Sequence
  chemically synthesized
gcagacacaggcttgctggt

SEQ ID NO: 262521 - DNA, 20 bp, Artificial Sequence
  chemically synthesized
ataaccttacactaaccagc

SEQ ID NO: 262522 - DNA, 20 bp, Artificial Sequence
  chemically synthesized
ataaataaccttacactaac

SEQ ID NO: 262523 - DNA, 20 bp, Artificial Sequence
  chemically synthesized
acaggcttgctggttagtgt

SEQ ID NO: 262524 - DNA, 20 bp, Artificial Sequence
  chemically synthesized
caggcttgctggttagtgta

SEQ ID NO: 262525 - DNA, 20 bp, Artificial Sequence
  chemically synthesized
cattcataacatctaatatg

SEQ ID NO: 262526 - DNA, 20 bp, Artificial Sequence
  chemically synthesized
attcataacatctaatatga

SEQ ID NO: 262527 - DNA, 20 bp, Artificial Sequence
  chemically synthesized
cagcctattatccttcatat

SEQ ID NO: 262528 - DNA, 20 bp, Artificial Sequence
  chemically synthesized
acatctaatatgaaggataa

SEQ ID NO: 262529 - DNA, 20 bp, Artificial Sequence
  chemically synthesized
catctaatatgaaggataat

SEQ ID NO: 262530 - DNA, 20 bp, Artificial Sequence
  chemically synthesized
ggataataggctgaaacatt

SEQ ID NO: 262531 - DNA, 20 bp, Artificial Sequence
  chemically synthesized
ttccacctggctgaatgttt

SEQ ID NO: 262532 - DNA, 20 bp, Artificial Sequence
  chemically synthesized
aataggctgaaacattcagc

SEQ ID NO: 262533 - DNA, 20 bp, Artificial Sequence
  chemically synthesized
ataggctgaaacattcagcc

SEQ ID NO: 262534 - DNA, 20 bp, Artificial Sequence
  chemically synthesized
ggctgaaacattcagccagg

SEQ ID NO: 262535 - DNA, 20 bp, Artificial Sequence
  chemically synthesized
atgtgaagtctaattccacc

SEQ ID NO: 262536 - DNA, 20 bp, Artificial Sequence
  chemically synthesized
aacattcagccaggtggaat

SEQ ID NO: 262537 - DNA, 20 bp, Artificial Sequence
  chemically synthesized
gcgaaactgtattgcatgtg

SEQ ID NO: 262538 - DNA, 20 bp, Artificial Sequence
  chemically synthesized
attagacttcacatgcaata

SEQ ID NO: 262539 - DNA, 20 bp, Artificial Sequence
  chemically synthesized
aattggaagaatacgagaaa

SEQ ID NO: 262540 - DNA, 20 bp, Artificial Sequence
  chemically synthesized
ctgagcaattggaagaatac

SEQ ID NO: 262541 - DNA, 20 bp, Artificial Sequence
  chemically synthesized
gaattattctgagcaattgg

SEQ ID NO: 262542 - DNA, 20 bp, Artificial Sequence
  chemically synthesized
ctcgtattcttccaattgct

SEQ ID NO: 262543 - DNA, 20 bp, Artificial Sequence
  chemically synthesized
ggtgaattattctgagcaat

SEQ ID NO: 262544 - DNA, 20 bp, Artificial Sequence
  chemically synthesized
aatagcaggtgaattattct

SEQ ID NO: 262545 - DNA, 20 bp, Artificial Sequence
  chemically synthesized
ataccctaaagtttaatagc

SEQ ID NO: 262546 - DNA, 20 bp, Artificial Sequence
  chemically synthesized
aataccctaaagtttaatag

SEQ ID NO: 262547 - DNA, 20 bp, Artificial Sequence
  chemically synthesized
tctaataccctaaagtttaa

SEQ ID NO: 262548 - DNA, 20 bp, Artificial Sequence
  chemically synthesized
attcacctgctattaaactt

SEQ ID NO: 262549 - DNA, 20 bp, Artificial Sequence
  chemically synthesized
ttcacctgctattaaacttt

SEQ ID NO: 262550 - DNA, 20 bp, Artificial Sequence
  chemically synthesized
tcacctgctattaaacttta

SEQ ID NO: 262551 - DNA, 20 bp, Artificial Sequence
  chemically synthesized
ctgttaaatctaatacccta

SEQ ID NO: 262552 - DNA, 20 bp, Artificial Sequence
  chemically synthesized
gctattaaactttagggtat

SEQ ID NO: 262553 - DNA, 20 bp, Artificial Sequence
  chemically synthesized
ctttagggtattagatttaa

SEQ ID NO: 262554 - DNA, 20 bp, Artificial Sequence
  chemically synthesized
gtattagatttaacagaaaa

SEQ ID NO: 262555 - DNA, 20 bp, Artificial Sequence
  chemically synthesized
tgtatttattaattttcttg

SEQ ID NO: 262556 - DNA, 20 bp, Artificial Sequence
  chemically synthesized
gtgacttcttttaatacttc

SEQ ID NO: 262557 - DNA, 20 bp, Artificial Sequence
  chemically synthesized
taattttcttgaagtattaa

SEQ ID NO: 262558 - DNA, 20 bp, Artificial Sequence
  chemically synthesized
ttttcttgaagtattaaaag

SEQ ID NO: 262559 - DNA, 20 bp, Artificial Sequence
  chemically synthesized
attttataagcatataaggg

SEQ ID NO: 262560 - DNA, 20 bp, Artificial Sequence
  chemically synthesized
ttaattttataagcatataa

SEQ ID NO: 262561 - DNA, 20 bp, Artificial Sequence
  chemically synthesized
cttaattttataagcatata

SEQ ID NO: 262562 - DNA, 20 bp, Artificial Sequence
  chemically synthesized
acttaattttataagcatat

SEQ ID NO: 262563 - DNA, 20 bp, Artificial Sequence
  chemically synthesized
ttaccataacttaattttat

SEQ ID NO: 262564 - DNA, 20 bp, Artificial Sequence
  chemically synthesized
ccttatatgcttataaaatt

SEQ ID NO: 262565 - DNA, 20 bp, Artificial Sequence
  chemically synthesized
atgcttataaaattaagtta

SEQ ID NO: 262566 - DNA, 20 bp, Artificial Sequence
  chemically synthesized
tatttttaaaatgtcaaaag

SEQ ID NO: 262567 - DNA, 20 bp, Artificial Sequence
  chemically synthesized
gtatatttttaaaatgtcaa

SEQ ID NO: 262568 - DNA, 20 bp, Artificial Sequence
  chemically synthesized
aaaatatacaccaaattaaa

SEQ ID NO: 262569 - DNA, 20 bp, Artificial Sequence
  chemically synthesized
agtgtcagttccatttaatt

SEQ ID NO: 262570 - DNA, 20 bp, Artificial Sequence
  chemically synthesized
aacttcttctgtgatagtgt

SEQ ID NO: 262571 - DNA, 20 bp, Artificial Sequence
  chemically synthesized
aaatggaactgacactatca

SEQ ID NO: 262572 - DNA, 20 bp, Artificial Sequence
  chemically synthesized
tggaactgacactatcacag

SEQ ID NO: 262573 - DNA, 20 bp, Artificial Sequence
  chemically synthesized
cttgggaacttcttctgtga

SEQ ID NO: 262574 - DNA, 20 bp, Artificial Sequence
  chemically synthesized
aactgacactatcacagaag

SEQ ID NO: 262575 - DNA, 20 bp, Artificial Sequence
  chemically synthesized
ctatcacagaagaagttccc

SEQ ID NO: 262576 - DNA, 20 bp, Artificial Sequence
  chemically synthesized
tcacagaagaagttcccaag

SEQ ID NO: 262577 - DNA, 20 bp, Artificial Sequence
  chemically synthesized
gcccatgtatgagacttctt

SEQ ID NO: 262578 - DNA, 20 bp, Artificial Sequence
  chemically synthesized
agcccatgtatgagacttct

SEQ ID NO: 262579 - DNA, 20 bp, Artificial Sequence
  chemically synthesized
ttcccaagaagtctcataca

SEQ ID NO: 262580 - DNA, 20 bp, Artificial Sequence
  chemically synthesized
tcccaagaagtctcatacat

SEQ ID NO: 262581 - DNA, 20 bp, Artificial Sequence
  chemically synthesized
atagggttcagcccatgtat

SEQ ID NO: 262582 - DNA, 20 bp, Artificial Sequence
  chemically synthesized
aataataactgcatagggtt

SEQ ID NO: 262583 - DNA, 20 bp, Artificial Sequence
  chemically synthesized
tacatgggctgaaccctatg

SEQ ID NO: 262584 - DNA, 20 bp, Artificial Sequence
  chemically synthesized
atgtaaataataactgcata

SEQ ID NO: 262585 - DNA, 20 bp, Artificial Sequence
  chemically synthesized
tatgtaaataataactgcat

SEQ ID NO: 262586 - DNA, 20 bp, Artificial Sequence
  chemically synthesized
ctatgtaaataataactgca

SEQ ID NO: 262587 - DNA, 20 bp, Artificial Sequence
  chemically synthesized
ctatgcagttattatttaca

SEQ ID NO: 262588 - DNA, 20 bp, Artificial Sequence
  chemically synthesized
tatgcagttattatttacat

SEQ ID NO: 262589 - DNA, 20 bp, Artificial Sequence
  chemically synthesized
atgcagttattatttacata

SEQ ID NO: 262590 - DNA, 20 bp, Artificial Sequence
  chemically synthesized
attatttacatagggcaaaa

SEQ ID NO: 262591 - DNA, 20 bp, Artificial Sequence
  chemically synthesized
ttacatagggcaaaatggtt

SEQ ID NO: 262592 - DNA, 20 bp, Artificial Sequence
  chemically synthesized
gttgaattatatgaatcaaa

SEQ ID NO: 262593 - DNA, 20 bp, Artificial Sequence
  chemically synthesized
taagtctttatagttaagtt

SEQ ID NO: 262594 - DNA, 20 bp, Artificial Sequence
  chemically synthesized
ctaagtctttatagttaagt

SEQ ID NO: 262595 - DNA, 20 bp, Artificial Sequence
  chemically synthesized
ttcaacctaacttaactata

SEQ ID NO: 262596 - DNA, 20 bp, Artificial Sequence
  chemically synthesized
gaaactaagtctttatagtt

SEQ ID NO: 262597 - DNA, 20 bp, Artificial Sequence
  chemically synthesized
atctggaaactaagtcttta

SEQ ID NO: 262598 - DNA, 20 bp, Artificial Sequence
  chemically synthesized
ctaacttaactataaagact

SEQ ID NO: 262599 - DNA, 20 bp, Artificial Sequence
  chemically synthesized
aactataaagacttagtttc

SEQ ID NO: 262600 - DNA, 20 bp, Artificial Sequence
  chemically synthesized
gatgtcaaaatctggaaact

SEQ ID NO: 262601 - DNA, 20 bp, Artificial Sequence
  chemically synthesized
aaaaccaggatgtcaaaatc

SEQ ID NO: 262602 - DNA, 20 bp, Artificial Sequence
  chemically synthesized
gtttccagattttgacatcc

SEQ ID NO: 262603 - DNA, 20 bp, Artificial Sequence
  chemically synthesized
aaagtactcctcacaaaacc

SEQ ID NO: 262604 - DNA, 20 bp, Artificial Sequence
  chemically synthesized
ttttgacatcctggttttgt

SEQ ID NO: 262605 - DNA, 20 bp, Artificial Sequence
  chemically synthesized
gaaagtactcctcacaaaac

SEQ ID NO: 262606 - DNA, 20 bp, Artificial Sequence
  chemically synthesized
tttgacatcctggttttgtg

SEQ ID NO: 262607 - DNA, 20 bp, Artificial Sequence
  chemically synthesized
tgacatcctggttttgtgag

SEQ ID NO: 262608 - DNA, 20 bp, Artificial Sequence
  chemically synthesized
tcatctgtaattatagaaga

SEQ ID NO: 262609 - DNA, 20 bp, Artificial Sequence
  chemically synthesized
atcatcatctgtaattatag

SEQ ID NO: 262610 - DNA, 20 bp, Artificial Sequence
  chemically synthesized
agtactttcttctataatta

SEQ ID NO: 262611 - DNA, 20 bp, Artificial Sequence
  chemically synthesized
atgatcatcatctgtaatta

SEQ ID NO: 262612 - DNA, 20 bp, Artificial Sequence
  chemically synthesized
ttaacacttgtaagatgaag

SEQ ID NO: 262613 - DNA, 20 bp, Artificial Sequence
  chemically synthesized
attaacacttgtaagatgaa

SEQ ID NO: 262614 - DNA, 20 bp, Artificial Sequence
  chemically synthesized
ttattaacacttgtaagatg

SEQ ID NO: 262615 - DNA, 20 bp, Artificial Sequence
  chemically synthesized
atcattcctcttcatcttac

SEQ ID NO: 262616 - DNA, 20 bp, Artificial Sequence
  chemically synthesized
ttcctattattaacacttgt

SEQ ID NO: 262617 - DNA, 20 bp, Artificial Sequence
  chemically synthesized
catcttacaagtgttaataa

SEQ ID NO: 262618 - DNA, 20 bp, Artificial Sequence
  chemically synthesized
atcttacaagtgttaataat

SEQ ID NO: 262619 - DNA, 20 bp, Artificial Sequence
  chemically synthesized
aggaacaaaaatgtacctgt

SEQ ID NO: 262620 - DNA, 20 bp, Artificial Sequence
  chemically synthesized
aaccatagaggttttctgac

SEQ ID NO: 262621 - DNA, 20 bp, Artificial Sequence
  chemically synthesized
aaaccatagaggttttctga

SEQ ID NO: 262622 - DNA, 20 bp, Artificial Sequence
  chemically synthesized
tacctgtcagaaaacctcta

SEQ ID NO: 262623 - DNA, 20 bp, Artificial Sequence
  chemically synthesized
gtagtaggtataaaccatag

SEQ ID NO: 262624 - DNA, 20 bp, Artificial Sequence
  chemically synthesized
tgtagtaggtataaaccata

SEQ ID NO: 262625 - DNA, 20 bp, Artificial Sequence
  chemically synthesized
tttgtagtaggtataaacca

SEQ ID NO: 262626 - DNA, 20 bp, Artificial Sequence
  chemically synthesized
ctcacttctttatttgtagt

SEQ ID NO: 262627 - DNA, 20 bp, Artificial Sequence
  chemically synthesized
tctcacttctttatttgtag

SEQ ID NO: 262628 - DNA, 20 bp, Artificial Sequence
  chemically synthesized
gtttatacctactacaaata

SEQ ID NO: 262629 - DNA, 20 bp, Artificial Sequence
  chemically synthesized
tggtctcacttctttatttg

SEQ ID NO: 262630 - DNA, 20 bp, Artificial Sequence
  chemically synthesized
tatacctactacaaataaag

SEQ ID NO: 262631 - DNA, 20 bp, Artificial Sequence
  chemically synthesized
cctactacaaataaagaagt

SEQ ID NO: 262632 - DNA, 20 bp, Artificial Sequence
  chemically synthesized
acaaataaagaagtgagacc

SEQ ID NO: 262633 - DNA, 20 bp, Artificial Sequence
  chemically synthesized
gcgattcagaattgttagct

SEQ ID NO: 262634 - DNA, 20 bp, Artificial Sequence
  chemically synthesized
aaaaggcgattcagaattgt

SEQ ID NO: 262635 - DNA, 20 bp, Artificial Sequence
  chemically synthesized
ctctctttaaaaaggcgatt

SEQ ID NO: 262636 - DNA, 20 bp, Artificial Sequence
  chemically synthesized
aattctgaatcgccttttta

SEQ ID NO: 262637 - DNA, 20 bp, Artificial Sequence
  chemically synthesized
ttctgaatcgcctttttaaa

SEQ ID NO: 262638 - DNA, 20 bp, Artificial Sequence
  chemically synthesized
gtatggttctctctttaaaa

SEQ ID NO: 262639 - DNA, 20 bp, Artificial Sequence
  chemically synthesized
tgtatggttctctctttaaa

SEQ ID NO: 262640 - DNA, 20 bp, Artificial Sequence
  chemically synthesized
ctgaatcgcctttttaaaga

SEQ ID NO: 262641 - DNA, 20 bp, Artificial Sequence
  chemically synthesized
acaactgaatggaaagtgta

SEQ ID NO: 262642 - DNA, 20 bp, Artificial Sequence
  chemically synthesized
agaaccatacactttccatt

SEQ ID NO: 262643 - DNA, 20 bp, Artificial Sequence
  chemically synthesized
ctttcaaacaactgaatgga

SEQ ID NO: 262644 - DNA, 20 bp, Artificial Sequence
  chemically synthesized
tcttctttcaaacaactgaa

SEQ ID NO: 262645 - DNA, 20 bp, Artificial Sequence
  chemically synthesized
ctttccattcagttgtttga

SEQ ID NO: 262646 - DNA, 20 bp, Artificial Sequence
  chemically synthesized
tccattcagttgtttgaaag

SEQ ID NO: 262647 - DNA, 20 bp, Artificial Sequence
  chemically synthesized
cattcagttgtttgaaagaa

SEQ ID NO: 262648 - DNA, 20 bp, Artificial Sequence
  chemically synthesized
tcagttgtttgaaagaagag

SEQ ID NO: 262649 - DNA, 20 bp, Artificial Sequence
  chemically synthesized
ttaccagccaaaacaaaaag

SEQ ID NO: 262650 - DNA, 20 bp, Artificial Sequence
  chemically synthesized
tgttaccagccaaaacaaaa

SEQ ID NO: 262651 - DNA, 20 bp, Artificial Sequence
  chemically synthesized
gcagtcactcctttttgttt

SEQ ID NO: 262652 - DNA, 20 bp, Artificial Sequence
  chemically synthesized
atgttaccagccaaaacaaa

SEQ ID NO: 262653 - DNA, 20 bp, Artificial Sequence
  chemically synthesized
tcactcctttttgttttggc

SEQ ID NO: 262654 - DNA, 20 bp, Artificial Sequence
  chemically synthesized
tgttattactgaaatgttac

SEQ ID NO: 262655 - DNA, 20 bp, Artificial Sequence
  chemically synthesized
tgttttggctggtaacattt

SEQ ID NO: 262656 - DNA, 20 bp, Artificial Sequence
  chemically synthesized
gattgcagattgaacaatat

SEQ ID NO: 262657 - DNA, 20 bp, Artificial Sequence
  chemically synthesized
agatggttgctaattgattg

SEQ ID NO: 262658 - DNA, 20 bp, Artificial Sequence
  chemically synthesized
ttgttcaatctgcaatcaat

SEQ ID NO: 262659 - DNA, 20 bp, Artificial Sequence
  chemically synthesized
tcaattagcaaccatcttac

SEQ ID NO: 262660 - DNA, 20 bp, Artificial Sequence
  chemically synthesized
caattagcaaccatcttact

SEQ ID NO: 262661 - DNA, 20 bp, Artificial Sequence
  chemically synthesized
gaactggatgcctagtaaga

SEQ ID NO: 262662 - DNA, 20 bp, Artificial Sequence
  chemically synthesized
aaaagaactggatgcctagt

SEQ ID NO: 262663 - DNA, 20 bp, Artificial Sequence
  chemically synthesized
caaccatcttactaggcatc

SEQ ID NO: 262664 - DNA, 20 bp, Artificial Sequence
  chemically synthesized
ccataaaagaactggatgcc

SEQ ID NO: 262665 - DNA, 20 bp, Artificial Sequence
  chemically synthesized
tacagtgcccataaaagaac

SEQ ID NO: 262666 - DNA, 20 bp, Artificial Sequence
  chemically synthesized
ctaggcatccagttctttta

SEQ ID NO: 262667 - DNA, 20 bp, Artificial Sequence
  chemically synthesized
taggcatccagttcttttat

SEQ ID NO: 262668 - DNA, 20 bp, Artificial Sequence
  chemically synthesized
atgggttacagtgcccataa

SEQ ID NO: 262669 - DNA, 20 bp, Artificial Sequence
  chemically synthesized
tttaactacttaatgggtta

SEQ ID NO: 262670 - DNA, 20 bp, Artificial Sequence
  chemically synthesized
tatgggcactgtaacccatt

SEQ ID NO: 262671 - DNA, 20 bp, Artificial Sequence
  chemically synthesized
gggcactgtaacccattaag

SEQ ID NO: 262672 - DNA, 20 bp, Artificial Sequence
  chemically synthesized
acctggtttaactacttaat

SEQ ID NO: 262673 - DNA, 20 bp, Artificial Sequence
  chemically synthesized
cacctggtttaactacttaa

SEQ ID NO: 262674 - DNA, 20 bp, Artificial Sequence
  chemically synthesized
aacccattaagtagttaaac

SEQ ID NO: 262675 - DNA, 20 bp, Artificial Sequence
  chemically synthesized
acccattaagtagttaaacc

SEQ ID NO: 262676 - DNA, 20 bp, Artificial Sequence
  chemically synthesized
taagtagttaaaccaggtgt

SEQ ID NO: 262677 - DNA, 20 bp, Artificial Sequence
  chemically synthesized
aagtagttaaaccaggtgtg

SEQ ID NO: 262678 - DNA, 20 bp, Artificial Sequence
  chemically synthesized
aatagcttaatcctcacacc

SEQ ID NO: 262679 - DNA, 20 bp, Artificial Sequence
  chemically synthesized
ttaaaccaggtgtgaggatt

SEQ ID NO: 262680 - DNA, 20 bp, Artificial Sequence
  chemically synthesized
ctcattgacttgaagaataa

SEQ ID NO: 262681 - DNA, 20 bp, Artificial Sequence
  chemically synthesized
ggattaagctattattcttc

SEQ ID NO: 262682 - DNA, 20 bp, Artificial Sequence
  chemically synthesized
gccattatctcattgacttg

SEQ ID NO: 262683 - DNA, 20 bp, Artificial Sequence
  chemically synthesized
ctattattcttcaagtcaat

SEQ ID NO: 262684 - DNA, 20 bp, Artificial Sequence
  chemically synthesized
tcttcaagtcaatgagataa

SEQ ID NO: 262685 - DNA, 20 bp, Artificial Sequence
  chemically synthesized
caatgagataatggcttatg

SEQ ID NO: 262686 - DNA, 20 bp, Artificial Sequence
  chemically synthesized
aatgagataatggcttatgc

SEQ ID NO: 262687 - DNA, 20 bp, Artificial Sequence
  chemically synthesized
catcttatgtcaacctgcat

SEQ ID NO: 262688 - DNA, 20 bp, Artificial Sequence
  chemically synthesized
tggcttatgcaggttgacat

SEQ ID NO: 262689 - DNA, 20 bp, Artificial Sequence
  chemically synthesized
gataaataataaatatttca

SEQ ID NO: 262690 - DNA, 20 bp, Artificial Sequence
  chemically synthesized
ttatttatcatgtatacatt

SEQ ID NO: 262691 - DNA, 20 bp, Artificial Sequence
  chemically synthesized
ttatcatgtatacattaaga

SEQ ID NO: 262692 - DNA, 20 bp, Artificial Sequence
  chemically synthesized
atacattaagaaagtaaaat

SEQ ID NO: 262693 - DNA, 20 bp, Artificial Sequence
  chemically synthesized
ttaagaaagtaaaatcagca

SEQ ID NO: 262694 - DNA, 20 bp, Artificial Sequence
  chemically synthesized
taagaaagtaaaatcagcat

SEQ ID NO: 262695 - DNA, 20 bp, Artificial Sequence
  chemically synthesized
aaatcagcatgggatgatct

SEQ ID NO: 262696 - DNA, 20 bp, Artificial Sequence
  chemically synthesized
aatcagcatgggatgatctc

SEQ ID NO: 262697 - DNA, 20 bp, Artificial Sequence
  chemically synthesized
agcatgggatgatctcagga

SEQ ID NO: 262698 - DNA, 20 bp, Artificial Sequence
  chemically synthesized
aaaatatgtattgctttcct

SEQ ID NO: 262699 - DNA, 20 bp, Artificial Sequence
  chemically synthesized
ggaaagcaatacatattttt

SEQ ID NO: 262700 - DNA, 20 bp, Artificial Sequence
  chemically synthesized
gcaatacatattttttggat

SEQ ID NO: 262701 - DNA, 20 bp, Artificial Sequence
  chemically synthesized
attttttggattagacattg

SEQ ID NO: 262702 - DNA, 20 bp, Artificial Sequence
  chemically synthesized
ttggattagacattgaagta

SEQ ID NO: 262703 - DNA, 20 bp, Artificial Sequence
  chemically synthesized
tacatcatttttcataacat

SEQ ID NO: 262704 - DNA, 20 bp, Artificial Sequence
  chemically synthesized
caatgttatgaaaaatgatg

SEQ ID NO: 262705 - DNA, 20 bp, Artificial Sequence
  chemically synthesized
atgatgtagcaaaaaaaatt

SEQ ID NO: 262706 - DNA, 20 bp, Artificial Sequence
  chemically synthesized
gatgtattttcatttttgat

SEQ ID NO: 262707 - DNA, 20 bp, Artificial Sequence
  chemically synthesized
atgtattttcatttttgata

SEQ ID NO: 262708 - DNA, 20 bp, Artificial Sequence
  chemically synthesized
tgtattttcatttttgataa

SEQ ID NO: 262709 - DNA, 20 bp, Artificial Sequence
  chemically synthesized
gtattttcatttttgataag

SEQ ID NO: 262710 - DNA, 20 bp, Artificial Sequence
  chemically synthesized
caagaaattaacagataaca

SEQ ID NO: 262711 - DNA, 20 bp, Artificial Sequence
  chemically synthesized
acaagaaattaacagataac

SEQ ID NO: 262712 - DNA, 20 bp, Artificial Sequence
  chemically synthesized
cacaagaaattaacagataa

SEQ ID NO: 262713 - DNA, 20 bp, Artificial Sequence
  chemically synthesized
ttaaagacacaagaaattaa

SEQ ID NO: 262714 - DNA, 20 bp, Artificial Sequence
  chemically synthesized
attttgccaattaaagacac

SEQ ID NO: 262715 - DNA, 20 bp, Artificial Sequence
  chemically synthesized
taatttcttgtgtctttaat

SEQ ID NO: 262716 - DNA, 20 bp, Artificial Sequence
  chemically synthesized
gtgcttaattttgccaatta

SEQ ID NO: 262717 - DNA, 20 bp, Artificial Sequence
  chemically synthesized
tgtctttaattggcaaaatt

SEQ ID NO: 262718 - DNA, 20 bp, Artificial Sequence
  chemically synthesized
taattggcaaaattaagcac

SEQ ID NO: 262719 - DNA, 20 bp, Artificial Sequence
  chemically synthesized
aaaattaagcactagtgtta

SEQ ID NO: 262720 - DNA, 20 bp, Artificial Sequence
  chemically synthesized
actttgggcttctgtaacac

SEQ ID NO: 262721 - DNA, 20 bp, Artificial Sequence
  chemically synthesized
attaagcactagtgttacag

SEQ ID NO: 262722 - DNA, 20 bp, Artificial Sequence
  chemically synthesized
actagtgttacagaagccca

SEQ ID NO: 262723 - DNA, 20 bp, Artificial Sequence
  chemically synthesized
gtgttacagaagcccaaagt

SEQ ID NO: 262724 - DNA, 20 bp, Artificial Sequence
  chemically synthesized
tgttacagaagcccaaagtg

SEQ ID NO: 262725 - DNA, 20 bp, Artificial Sequence
  chemically synthesized
gttacagaagcccaaagtga

SEQ ID NO: 262726 - DNA, 20 bp, Artificial Sequence
  chemically synthesized
tgagtggtttccctcacttt

SEQ ID NO: 262727 - DNA, 20 bp, Artificial Sequence
  chemically synthesized
gtgagtggtttccctcactt

SEQ ID NO: 262728 - DNA, 20 bp, Artificial Sequence
  chemically synthesized
atgtacattctgaaagtgag

SEQ ID NO: 262729 - DNA, 20 bp, Artificial Sequence
  chemically synthesized
tgagggaaaccactcacttt

SEQ ID NO: 262730 - DNA, 20 bp, Artificial Sequence
  chemically synthesized
ctaatgtacattctgaaagt

SEQ ID NO: 262731 - DNA, 20 bp, Artificial Sequence
  chemically synthesized
acttctaatgtacattctga

SEQ ID NO: 262732 - DNA, 20 bp, Artificial Sequence
  chemically synthesized
ctcactttcagaatgtacat

SEQ ID NO: 262733 - DNA, 20 bp, Artificial Sequence
  chemically synthesized
actttcagaatgtacattag

SEQ ID NO: 262734 - DNA, 20 bp, Artificial Sequence
  chemically synthesized
tagaagtttaaaactgtacc

SEQ ID NO: 262735 - DNA, 20 bp, Artificial Sequence
  chemically synthesized
agagacaaaaaatctgggta

SEQ ID NO: 262736 - DNA, 20 bp, Artificial Sequence
  chemically synthesized
aaaaaagagacaaaaaatct

SEQ ID NO: 262737 - DNA, 20 bp, Artificial Sequence
  chemically synthesized
aaaaaaagagacaaaaaatc

SEQ ID NO: 262738 - DNA, 20 bp, Artificial Sequence
  chemically synthesized
gcctactaataaaaaaaaaa

SEQ ID NO: 262739 - DNA, 20 bp, Artificial Sequence
  chemically synthesized
aggcctactaataaaaaaaa

SEQ ID NO: 262740 - DNA, 20 bp, Artificial Sequence
  chemically synthesized
tttgtctcttttttttttat

SEQ ID NO: 262741 - DNA, 20 bp, Artificial Sequence
  chemically synthesized
gtctcttttttttttattag

SEQ ID NO: 262742 - DNA, 20 bp, Artificial Sequence
  chemically synthesized
tctcttttttttttattagt

SEQ ID NO: 262743 - DNA, 20 bp, Artificial Sequence
  chemically synthesized
tattagtaggcctctgttaa

SEQ ID NO: 262744 - DNA, 20 bp, Artificial Sequence
  chemically synthesized
aactactactctattaacag

SEQ ID NO: 262745 - DNA, 20 bp, Artificial Sequence
  chemically synthesized
caactactactctattaaca

SEQ ID NO: 262746 - DNA, 20 bp, Artificial Sequence
  chemically synthesized
ttagtaggcctctgttaata

SEQ ID NO: 262747 - DNA, 20 bp, Artificial Sequence
  chemically synthesized
tgcaactactactctattaa

SEQ ID NO: 262748 - DNA, 20 bp, Artificial Sequence
  chemically synthesized
gtaggcctctgttaatagag

SEQ ID NO: 262749 - DNA, 20 bp, Artificial Sequence
  chemically synthesized
ggcctctgttaatagagtag

SEQ ID NO: 262750 - DNA, 20 bp, Artificial Sequence
  chemically synthesized
agtagttgcaaacacatacg

SEQ ID NO: 262751 - DNA, 20 bp, Artificial Sequence
  chemically synthesized
gtagttgcaaacacatacgt

SEQ ID NO: 262752 - DNA, 20 bp, Artificial Sequence
  chemically synthesized
aaacacatacgtgggtttgc

SEQ ID NO: 262753 - DNA, 20 bp, Artificial Sequence
  chemically synthesized
cacaaattgtgagttgttac

SEQ ID NO: 262754 - DNA, 20 bp, Artificial Sequence
  chemically synthesized
ctcaactttgcacaaattgt

SEQ ID NO: 262755 - DNA, 20 bp, Artificial Sequence
  chemically synthesized
aacaactcacaatttgtgca

SEQ ID NO: 262756 - DNA, 20 bp, Artificial Sequence
  chemically synthesized
ctcacaatttgtgcaaagtt

SEQ ID NO: 262757 - DNA, 20 bp, Artificial Sequence
  chemically synthesized
aaagttgagtcttcgaaact

SEQ ID NO: 262758 - DNA, 20 bp, Artificial Sequence
  chemically synthesized
agcaaatttgctcagtttcg

SEQ ID NO: 262759 - DNA, 20 bp, Artificial Sequence
  chemically synthesized
aaattgagagcaaatttgct

SEQ ID NO: 262760 - DNA, 20 bp, Artificial Sequence
  chemically synthesized
aagcgctggcgggaaattga

SEQ ID NO: 262761 - DNA, 20 bp, Artificial Sequence
  chemically synthesized
gcaagcgctggcgggaaatt

SEQ ID NO: 262762 - DNA, 20 bp, Artificial Sequence
  chemically synthesized
atttgctctcaatttcccgc

SEQ ID NO: 262763 - DNA, 20 bp, Artificial Sequence
  chemically synthesized
ccagctcagcaagcgctggc

SEQ ID NO: 262764 - DNA, 20 bp, Artificial Sequence
  chemically synthesized
tccagctcagcaagcgctgg

SEQ ID NO: 262765 - DNA, 20 bp, Artificial Sequence
  chemically synthesized
agatccagctcagcaagcgc

SEQ ID NO: 262766 - DNA, 20 bp, Artificial Sequence
  chemically synthesized
atttcccgccagcgcttgct

SEQ ID NO: 262767 - DNA, 20 bp, Artificial Sequence
  chemically synthesized
cccgccagcgcttgctgagc

SEQ ID NO: 262768 - DNA, 20 bp, Artificial Sequence
  chemically synthesized
caactcagatccagctcagc

SEQ ID NO: 262769 - DNA, 20 bp, Artificial Sequence
  chemically synthesized
gagccaactcagatccagct

SEQ ID NO: 262770 - DNA, 20 bp, Artificial Sequence
  chemically synthesized
gcgcttgctgagctggatct

SEQ ID NO: 262771 - DNA, 20 bp, Artificial Sequence
  chemically synthesized
cagtggagccaactcagatc

SEQ ID NO: 262772 - DNA, 20 bp, Artificial Sequence
  chemically synthesized
ttgctgagctggatctgagt

SEQ ID NO: 262773 - DNA, 20 bp, Artificial Sequence
  chemically synthesized
caatggcagtggagccaact

SEQ ID NO: 262774 - DNA, 20 bp, Artificial Sequence
  chemically synthesized
atggggccgcaatggcagtg

SEQ ID NO: 262775 - DNA, 20 bp, Artificial Sequence
  chemically synthesized
ggatggggccgcaatggcag

SEQ ID NO: 262776 - DNA, 20 bp, Artificial Sequence
  chemically synthesized
agttggctccactgccattg

SEQ ID NO: 262777 - DNA, 20 bp, Artificial Sequence
  chemically synthesized
tgaggatggggccgcaatgg

SEQ ID NO: 262778 - DNA, 20 bp, Artificial Sequence
  chemically synthesized
gtctgaggatggggccgcaa

SEQ ID NO: 262779 - DNA, 20 bp, Artificial Sequence
  chemically synthesized
tgccattgcggccccatcct

SEQ ID NO: 262780 - DNA, 20 bp, Artificial Sequence
  chemically synthesized
tgagggcttgtctgaggatg

SEQ ID NO: 262781 - DNA, 20 bp, Artificial Sequence
  chemically synthesized
ctgagggcttgtctgaggat

SEQ ID NO: 262782 - DNA, 20 bp, Artificial Sequence
  chemically synthesized
gctgagggcttgtctgagga

SEQ ID NO: 262783 - DNA, 20 bp, Artificial Sequence
  chemically synthesized
ttgcggccccatcctcagac

SEQ ID NO: 262784 - DNA, 20 bp, Artificial Sequence
  chemically synthesized
gcaagctgagggcttgtctg

SEQ ID NO: 262785 - DNA, 20 bp, Artificial Sequence
  chemically synthesized
ggcaagctgagggcttgtct

SEQ ID NO: 262786 - DNA, 20 bp, Artificial Sequence
  chemically synthesized
cccatcctcagacaagccct

SEQ ID NO: 262787 - DNA, 20 bp, Artificial Sequence
  chemically synthesized
gcagtgcgtaggcaagctga

SEQ ID NO: 262788 - DNA, 20 bp, Artificial Sequence
  chemically synthesized
tgcagtgcgtaggcaagctg

SEQ ID NO: 262789 - DNA, 20 bp, Artificial Sequence
  chemically synthesized
atgcagtgcgtaggcaagct

SEQ ID NO: 262790 - DNA, 20 bp, Artificial Sequence
  chemically synthesized
gctgaatgcagtgcgtaggc

SEQ ID NO: 262791 - DNA, 20 bp, Artificial Sequence
  chemically synthesized
aggagctgaatgcagtgcgt

SEQ ID NO: 262792 - DNA, 20 bp, Artificial Sequence
  chemically synthesized
gaggagctgaatgcagtgcg

SEQ ID NO: 262793 - DNA, 20 bp, Artificial Sequence
  chemically synthesized
gcttgcctacgcactgcatt

SEQ ID NO: 262794 - DNA, 20 bp, Artificial Sequence
  chemically synthesized
gaagaaagaggagctgaatg

SEQ ID NO: 262795 - DNA, 20 bp, Artificial Sequence
  chemically synthesized
aattgcagaagaagaaagag

SEQ ID NO: 262796 - DNA, 20 bp, Artificial Sequence
  chemically synthesized
ggaattgcagaagaagaaag

SEQ ID NO: 262797 - DNA, 20 bp, Artificial Sequence
  chemically synthesized
gggaattgcagaagaagaaa

SEQ ID NO: 262798 - DNA, 20 bp, Artificial Sequence
  chemically synthesized
tcgggaattgcagaagaaga

SEQ ID NO: 262799 - DNA, 20 bp, Artificial Sequence
  chemically synthesized
ttgatcgggaattgcagaag

SEQ ID NO: 262800 - DNA, 20 bp, Artificial Sequence
  chemically synthesized
aaattgatcgggaattgcag

SEQ ID NO: 262801 - DNA, 20 bp, Artificial Sequence
  chemically synthesized
aggaaattgatcgggaattg

SEQ ID NO: 262802 - DNA, 20 bp, Artificial Sequence
  chemically synthesized
tgctcaataggaaattgatc

SEQ ID NO: 262803 - DNA, 20 bp, Artificial Sequence
  chemically synthesized
ttgctcaataggaaattgat

SEQ ID NO: 262804 - DNA, 20 bp, Artificial Sequence
  chemically synthesized
ttcccgatcaatttcctatt

SEQ ID NO: 262805 - DNA, 20 bp, Artificial Sequence
  chemically synthesized
ctgtattggttttgctcaat

SEQ ID NO: 262806 - DNA, 20 bp, Artificial Sequence
  chemically synthesized
cctgtattggttttgctcaa

SEQ ID NO: 262807 - DNA, 20 bp, Artificial Sequence
  chemically synthesized
cctattgagcaaaaccaata

SEQ ID NO: 262808 - DNA, 20 bp, Artificial Sequence
  chemically synthesized
ctattgagcaaaaccaatac

SEQ ID NO: 262809 - DNA, 20 bp, Artificial Sequence
  chemically synthesized
tattgagcaaaaccaataca

SEQ ID NO: 262810 - DNA, 20 bp, Artificial Sequence
  chemically synthesized
aactgccctgggccctgtat

SEQ ID NO: 262811 - DNA, 20 bp, Artificial Sequence
  chemically synthesized
agcaaaaccaatacagggcc

SEQ ID NO: 262812 - DNA, 20 bp, Artificial Sequence
  chemically synthesized
gcaaaaccaatacagggccc

SEQ ID NO: 262813 - DNA, 20 bp, Artificial Sequence
  chemically synthesized
caaaaccaatacagggccca

SEQ ID NO: 262814 - DNA, 20 bp, Artificial Sequence
  chemically synthesized
aaccaatacagggcccaggg

SEQ ID NO: 262815 - DNA, 20 bp, Artificial Sequence
  chemically synthesized
tgtggttagctaactgccct

SEQ ID NO: 262816 - DNA, 20 bp, Artificial Sequence
  chemically synthesized
aatacagggcccagggcagt

SEQ ID NO: 262817 - DNA, 20 bp, Artificial Sequence
  chemically synthesized
atgtggttagctaactgccc

SEQ ID NO: 262818 - DNA, 20 bp, Artificial Sequence
  chemically synthesized
tgcaagtcggttgatgtggt

SEQ ID NO: 262819 - DNA, 20 bp, Artificial Sequence
  chemically synthesized
tgcttgcaagtcggttgatg

SEQ ID NO: 262820 - DNA, 20 bp, Artificial Sequence
  chemically synthesized
aaccacatcaaccgacttgc

SEQ ID NO: 262821 - DNA, 20 bp, Artificial Sequence
  chemically synthesized
agtatttgctgcttgcaagt

SEQ ID NO: 262822 - DNA, 20 bp, Artificial Sequence
  chemically synthesized
cacatcaaccgacttgcaag

SEQ ID NO: 262823 - DNA, 20 bp, Artificial Sequence
  chemically synthesized
gagaagtatttgctgcttgc

SEQ ID NO: 262824 - DNA, 20 bp, Artificial Sequence
  chemically synthesized
agcctttgaaattttgagag

SEQ ID NO: 262825 - DNA, 20 bp, Artificial Sequence
  chemically synthesized
aacagcctttgaaattttga

SEQ ID NO: 262826 - DNA, 20 bp, Artificial Sequence
  chemically synthesized
acaacagcctttgaaatttt

SEQ ID NO: 262827 - DNA, 20 bp, Artificial Sequence
  chemically synthesized
atacttctctcaaaatttca

SEQ ID NO: 262828 - DNA, 20 bp, Artificial Sequence
  chemically synthesized
tacttctctcaaaatttcaa

SEQ ID NO: 262829 - DNA, 20 bp, Artificial Sequence
  chemically synthesized
ggatgacaataaagggacaa

SEQ ID NO: 262830 - DNA, 20 bp, Artificial Sequence
  chemically synthesized
cttcaaaggatgacaataaa

SEQ ID NO: 262831 - DNA, 20 bp, Artificial Sequence
  chemically synthesized
acttcaaaggatgacaataa

SEQ ID NO: 262832 - DNA, 20 bp, Artificial Sequence
  chemically synthesized
aacttcaaaggatgacaata

SEQ ID NO: 262833 - DNA, 20 bp, Artificial Sequence
  chemically synthesized
ccctttattgtcatcctttg

SEQ ID NO: 262834 - DNA, 20 bp, Artificial Sequence
  chemically synthesized
ttcatatttgtaaacttcaa

SEQ ID NO: 262835 - DNA, 20 bp, Artificial Sequence
  chemically synthesized
tttcatatttgtaaacttca

SEQ ID NO: 262836 - DNA, 20 bp, Artificial Sequence
  chemically synthesized
tttgaagtttacaaatatga

SEQ ID NO: 262837 - DNA, 20 bp, Artificial Sequence
  chemically synthesized
ttgaagtttacaaatatgaa

SEQ ID NO: 262838 - DNA, 20 bp, Artificial Sequence
  chemically synthesized
gggttattgagcgaggatga

SEQ ID NO: 262839 - DNA, 20 bp, Artificial Sequence
  chemically synthesized
aatatttgggttattgagcg

SEQ ID NO: 262840 - DNA, 20 bp, Artificial Sequence
  chemically synthesized
taatatttgggttattgagc

SEQ ID NO: 262841 - DNA, 20 bp, Artificial Sequence
  chemically synthesized
gaaataatatttgggttatt

SEQ ID NO: 262842 - DNA, 20 bp, Artificial Sequence
  chemically synthesized
ggataactgaaataatattt

SEQ ID NO: 262843 - DNA, 20 bp, Artificial Sequence
  chemically synthesized
aggataactgaaataatatt

SEQ ID NO: 262844 - DNA, 20 bp, Artificial Sequence
  chemically synthesized
caataacccaaatattattt

SEQ ID NO: 262845 - DNA, 20 bp, Artificial Sequence
  chemically synthesized
atctaaaaccaagcattcaa

SEQ ID NO: 262846 - DNA, 20 bp, Artificial Sequence
  chemically synthesized
tatctaaaaccaagcattca

SEQ ID NO: 262847 - DNA, 20 bp, Artificial Sequence
  chemically synthesized
tcagttatcctttgaatgct

SEQ ID NO: 262848 - DNA, 20 bp, Artificial Sequence
  chemically synthesized
atcctttgaatgcttggttt

SEQ ID NO: 262849 - DNA, 20 bp, Artificial Sequence
  chemically synthesized
taattagaatatctaaaacc

SEQ ID NO: 262850 - DNA, 20 bp, Artificial Sequence
  chemically synthesized
tggttttagatattctaatt

SEQ ID NO: 262851 - DNA, 20 bp, Artificial Sequence
  chemically synthesized
aatttcaatatttacttaat

SEQ ID NO: 262852 - DNA, 20 bp, Artificial Sequence
  chemically synthesized
aattaagtaaatattgaaat

SEQ ID NO: 262853 - DNA, 20 bp, Artificial Sequence
  chemically synthesized
atttagaagaaagaaaatgt

SEQ ID NO: 262854 - DNA, 20 bp, Artificial Sequence
  chemically synthesized
caccagaggaatttagaaga

SEQ ID NO: 262855 - DNA, 20 bp, Artificial Sequence
  chemically synthesized
aagacaccagaggaatttag

SEQ ID NO: 262856 - DNA, 20 bp, Artificial Sequence
  chemically synthesized
cccaagacaccagaggaatt

SEQ ID NO: 262857 - DNA, 20 bp, Artificial Sequence
  chemically synthesized
ttctttcttctaaattcctc

SEQ ID NO: 262858 - DNA, 20 bp, Artificial Sequence
  chemically synthesized
ttcaaatcccaagacaccag

SEQ ID NO: 262859 - DNA, 20 bp, Artificial Sequence
  chemically synthesized
tttcaaatcccaagacacca

SEQ ID NO: 262860 - DNA, 20 bp, Artificial Sequence
  chemically synthesized
tctaaattcctctggtgtct

SEQ ID NO: 262861 - DNA, 20 bp, Artificial Sequence
  chemically synthesized
ctaaattcctctggtgtctt

SEQ ID NO: 262862 - DNA, 20 bp, Artificial Sequence
  chemically synthesized
tgtttcaaatcccaagacac

SEQ ID NO: 262863 - DNA, 20 bp, Artificial Sequence
  chemically synthesized
tccaaattgtttcaaatccc

SEQ ID NO: 262864 - DNA, 20 bp, Artificial Sequence
  chemically synthesized
tcttgggatttgaaacaatt

SEQ ID NO: 262865 - DNA, 20 bp, Artificial Sequence
  chemically synthesized
ttgggatttgaaacaatttg

SEQ ID NO: 262866 - DNA, 20 bp, Artificial Sequence
  chemically synthesized
gacggtccctaataaataat

SEQ ID NO: 262867 - DNA, 20 bp, Artificial Sequence
  chemically synthesized
agtgataactcattatttat

SEQ ID NO: 262868 - DNA, 20 bp, Artificial Sequence
  chemically synthesized
gtgataactcattatttatt

SEQ ID NO: 262869 - DNA, 20 bp, Artificial Sequence
  chemically synthesized
tgataactcattatttatta

SEQ ID NO: 262870 - DNA, 20 bp, Artificial Sequence
  chemically synthesized
tttattagggaccgtccaca

SEQ ID NO: 262871 - DNA, 20 bp, Artificial Sequence
  chemically synthesized
taaattatattctatgtgga

SEQ ID NO: 262872 - DNA, 20 bp, Artificial Sequence
  chemically synthesized
cctctaaattatattctatg

SEQ ID NO: 262873 - DNA, 20 bp, Artificial Sequence
  chemically synthesized
cgtccacatagaatataatt

SEQ ID NO: 262874 - DNA, 20 bp, Artificial Sequence
  chemically synthesized
tccacatagaatataattta

SEQ ID NO: 262875 - DNA, 20 bp, Artificial Sequence
  chemically synthesized
ccacatagaatataatttag

SEQ ID NO: 262876 - DNA, 20 bp, Artificial Sequence
  chemically synthesized
cacatagaatataatttaga

SEQ ID NO: 262877 - DNA, 20 bp, Artificial Sequence
  chemically synthesized
tagaatataatttagagggt

SEQ ID NO: 262878 - DNA, 20 bp, Artificial Sequence
  chemically synthesized
aatttagagggtaagtgaat

SEQ ID NO: 262879 - DNA, 20 bp, Artificial Sequence
  chemically synthesized
agttatttatttccttttta

SEQ ID NO: 262880 - DNA, 20 bp, Artificial Sequence
  chemically synthesized
gttatttatttcctttttaa

SEQ ID NO: 262881 - DNA, 20 bp, Artificial Sequence
  chemically synthesized
agttcctcaaacctttaaaa

SEQ ID NO: 262882 - DNA, 20 bp, Artificial Sequence
  chemically synthesized
gagttcctcaaacctttaaa

SEQ ID NO: 262883 - DNA, 20 bp, Artificial Sequence
  chemically synthesized
tatttcctttttaaaggttt

SEQ ID NO: 262884 - DNA, 20 bp, Artificial Sequence
  chemically synthesized
atttcctttttaaaggtttg

SEQ ID NO: 262885 - DNA, 20 bp, Artificial Sequence
  chemically synthesized
taaaggtttgaggaactcaa

SEQ ID NO: 262886 - DNA, 20 bp, Artificial Sequence
  chemically synthesized
aaggtttgaggaactcaaca

SEQ ID NO: 262887 - DNA, 20 bp, Artificial Sequence
  chemically synthesized
attttgcttcattctctgtt

SEQ ID NO: 262888 - DNA, 20 bp, Artificial Sequence
  chemically synthesized
gaggaactcaacagagaatg

SEQ ID NO: 262889 - DNA, 20 bp, Artificial Sequence
  chemically synthesized
agagaatgaagcaaaataaa

SEQ ID NO: 262890 - DNA, 20 bp, Artificial Sequence
  chemically synthesized
taaaaagtgtaaaataataa

SEQ ID NO: 262891 - DNA, 20 bp, Artificial Sequence
  chemically synthesized
ataacagaaaaaaacatatt

SEQ ID NO: 262892 - DNA, 20 bp, Artificial Sequence
  chemically synthesized
acaatatgcaaataaatcta

SEQ ID NO: 262893 - DNA, 20 bp, Artificial Sequence
  chemically synthesized
aatatgcaaataaatctata

SEQ ID NO: 262894 - DNA, 20 bp, Artificial Sequence
  chemically synthesized
tatgcaaataaatctataga

SEQ ID NO: 262895 - DNA, 20 bp, Artificial Sequence
  chemically synthesized
acatcagtgttcactctcta

SEQ ID NO: 262896 - DNA, 20 bp, Artificial Sequence
  chemically synthesized
agagtgaacactgatgtgtg

SEQ ID NO: 262897 - DNA, 20 bp, Artificial Sequence
  chemically synthesized
atcagagcatcttcacacat

SEQ ID NO: 262898 - DNA, 20 bp, Artificial Sequence
  chemically synthesized
ttagcccattcatttcatca

SEQ ID NO: 262899 - DNA, 20 bp, Artificial Sequence
  chemically synthesized
tgttagcccattcatttcat

SEQ ID NO: 262900 - DNA, 20 bp, Artificial Sequence
  chemically synthesized
agatgctctgatgaaatgaa

SEQ ID NO: 262901 - DNA, 20 bp, Artificial Sequence
  chemically synthesized
gatgctctgatgaaatgaat

SEQ ID NO: 262902 - DNA, 20 bp, Artificial Sequence
  chemically synthesized
tgaaatgaatgggctaacat

SEQ ID NO: 262903 - DNA, 20 bp, Artificial Sequence
  chemically synthesized
ggacgacttcttactcatgt

SEQ ID NO: 262904 - DNA, 20 bp, Artificial Sequence
  chemically synthesized
atgaatgggctaacatgagt

SEQ ID NO: 262905 - DNA, 20 bp, Artificial Sequence
  chemically synthesized
aatgggctaacatgagtaag

SEQ ID NO: 262906 - DNA, 20 bp, Artificial Sequence
  chemically synthesized
actaatgacttatcggtata

SEQ ID NO: 262907 - DNA, 20 bp, Artificial Sequence
  chemically synthesized
gaagtcgtccatataccgat

SEQ ID NO: 262908 - DNA, 20 bp, Artificial Sequence
  chemically synthesized
cagatgaactaatgacttat

SEQ ID NO: 262909 - DNA, 20 bp, Artificial Sequence
  chemically synthesized
tccatataccgataagtcat

SEQ ID NO: 262910 - DNA, 20 bp, Artificial Sequence
  chemically synthesized
cgataagtcattagttcatc

SEQ ID NO: 262911 - DNA, 20 bp, Artificial Sequence
  chemically synthesized
tcattagttcatctggaaca

SEQ ID NO: 262912 - DNA, 20 bp, Artificial Sequence
  chemically synthesized
gactttgtgtatctttgttc

SEQ ID NO: 262913 - DNA, 20 bp, Artificial Sequence
  chemically synthesized
atctggaacaaagatacaca

SEQ ID NO: 262914 - DNA, 20 bp, Artificial Sequence
  chemically synthesized
aaagtcaattacaattttac

SEQ ID NO: 262915 - DNA, 20 bp, Artificial Sequence
  chemically synthesized
aagaaatgtgatgtgttttc

SEQ ID NO: 262916 - DNA, 20 bp, Artificial Sequence
  chemically synthesized
tagactatgtaaagtgattt

SEQ ID NO: 262917 - DNA, 20 bp, Artificial Sequence
  chemically synthesized
atttcttaaatcactttaca

SEQ ID NO: 262918 - DNA, 20 bp, Artificial Sequence
  chemically synthesized
aaaatgttttagactatgta

SEQ ID NO: 262919 - DNA, 20 bp, Artificial Sequence
  chemically synthesized
gttgaatgaataaaatgttt

SEQ ID NO: 262920 - DNA, 20 bp, Artificial Sequence
  chemically synthesized
ttcagtaaatgtattgtatt

SEQ ID NO: 262921 - DNA, 20 bp, Artificial Sequence
  chemically synthesized
cttgtattgtgtgttgtttt

SEQ ID NO: 262922 - DNA, 20 bp, Artificial Sequence
  chemically synthesized
ctgaaaacaacacacaatac

SEQ ID NO: 262923 - DNA, 20 bp, Artificial Sequence
  chemically synthesized
tgaaaacaacacacaataca

SEQ ID NO: 262924 - DNA, 20 bp, Artificial Sequence
  chemically synthesized
caaggaaatgcatcaaatca

SEQ ID NO: 262925 - DNA, 20 bp, Artificial Sequence
  chemically synthesized
aggaaatgcatcaaatcaaa

SEQ ID NO: 262926 - DNA, 20 bp, Artificial Sequence
  chemically synthesized
caaatcaaagagaacgttaa

SEQ ID NO: 262927 - DNA, 20 bp, Artificial Sequence
  chemically synthesized
aagagaacgttaatagaaac

SEQ ID NO: 262928 - DNA, 20 bp, Artificial Sequence
  chemically synthesized
cattttaaatatgatcttca

SEQ ID NO: 262929 - DNA, 20 bp, Artificial Sequence
  chemically synthesized
attttaaatatgatcttcac

SEQ ID NO: 262930 - DNA, 20 bp, Artificial Sequence
  chemically synthesized
tacagtttaattaacctgtg

SEQ ID NO: 262931 - DNA, 20 bp, Artificial Sequence
  chemically synthesized
caataccagattttattata

SEQ ID NO: 262932 - DNA, 20 bp, Artificial Sequence
  chemically synthesized
ttaaactgtataataaaatc

SEQ ID NO: 262933 - DNA, 20 bp, Artificial Sequence
  chemically synthesized
ttgttttagaatgtcaatac

SEQ ID NO: 262934 - DNA, 20 bp, Artificial Sequence
  chemically synthesized
aaataaaggtaatgttgttt

SEQ ID NO: 262935 - DNA, 20 bp, Artificial Sequence
  chemically synthesized
cagagatgaaaggaaaataa

SEQ ID NO: 262936 - DNA, 20 bp, Artificial Sequence
  chemically synthesized
ccagagatgaaaggaaaata

SEQ ID NO: 262937 - DNA, 20 bp, Artificial Sequence
  chemically synthesized
tacctgagcccagagatgaa

SEQ ID NO: 262938 - DNA, 20 bp, Artificial Sequence
  chemically synthesized
ctttattttcctttcatctc

SEQ ID NO: 262939 - DNA, 20 bp, Artificial Sequence
  chemically synthesized
ctacctgagcccagagatga

SEQ ID NO: 262940 - DNA, 20 bp, Artificial Sequence
  chemically synthesized
tttattttcctttcatctct

SEQ ID NO: 262941 - DNA, 20 bp, Artificial Sequence
  chemically synthesized
tttcctttcatctctgggct

SEQ ID NO: 262942 - DNA, 20 bp, Artificial Sequence
  chemically synthesized
ttcctttcatctctgggctc

SEQ ID NO: 262943 - DNA, 20 bp, Artificial Sequence
  chemically synthesized
agccagcctacctgagccca

SEQ ID NO: 262944 - DNA, 20 bp, Artificial Sequence
  chemically synthesized
ttagccagcctacctgagcc

SEQ ID NO: 262945 - DNA, 20 bp, Artificial Sequence
  chemically synthesized
ctttcatctctgggctcagg

SEQ ID NO: 262946 - DNA, 20 bp, Artificial Sequence
  chemically synthesized
tttcatctctgggctcaggt

SEQ ID NO: 262947 - DNA, 20 bp, Artificial Sequence
  chemically synthesized
aaaaattagccagcctacct

SEQ ID NO: 262948 - DNA, 20 bp, Artificial Sequence
  chemically synthesized
atctctgggctcaggtaggc

SEQ ID NO: 262949 - DNA, 20 bp, Artificial Sequence
  chemically synthesized
gacattgaaaaaaaattagc

SEQ ID NO: 262950 - DNA, 20 bp, Artificial Sequence
  chemically synthesized
ggatgacattgaaaaaaaat

SEQ ID NO: 262951 - DNA, 20 bp, Artificial Sequence
  chemically synthesized
attttttttcaatgtcatcc

SEQ ID NO: 262952 - DNA, 20 bp, Artificial Sequence
  chemically synthesized
tcaatgtcatccaagcattt

SEQ ID NO: 262953 - DNA, 20 bp, Artificial Sequence
  chemically synthesized
tgatgatctcctgaaatgct

SEQ ID NO: 262954 - DNA, 20 bp, Artificial Sequence
  chemically synthesized
caatgtcatccaagcatttc

SEQ ID NO: 262955 - DNA, 20 bp, Artificial Sequence
  chemically synthesized
atgtcatccaagcatttcag

SEQ ID NO: 262956 - DNA, 20 bp, Artificial Sequence
  chemically synthesized
caagcatttcaggagatcat

SEQ ID NO: 262957 - DNA, 20 bp, Artificial Sequence
  chemically synthesized
gtggtatcagtacaagaggc

SEQ ID NO: 262958 - DNA, 20 bp, Artificial Sequence
  chemically synthesized
agtggtatcagtacaagagg

SEQ ID NO: 262959 - DNA, 20 bp, Artificial Sequence
  chemically synthesized
atcagtggtatcagtacaag

SEQ ID NO: 262960 - DNA, 20 bp, Artificial Sequence
  chemically synthesized
catcagtggtatcagtacaa

SEQ ID NO: 262961 - DNA, 20 bp, Artificial Sequence
  chemically synthesized
ctcatcagtggtatcagtac

SEQ ID NO: 262962 - DNA, 20 bp, Artificial Sequence
  chemically synthesized
aaatttctcatcagtggtat

SEQ ID NO: 262963 - DNA, 20 bp, Artificial Sequence
  chemically synthesized
cttgtactgataccactgat

SEQ ID NO: 262964 - DNA, 20 bp, Artificial Sequence
  chemically synthesized
ctctagaaatttctcatcag

SEQ ID NO: 262965 - DNA, 20 bp, Artificial Sequence
  chemically synthesized
aggctctagaaatttctcat

SEQ ID NO: 262966 - DNA, 20 bp, Artificial Sequence
  chemically synthesized
taccactgatgagaaatttc

SEQ ID NO: 262967 - DNA, 20 bp, Artificial Sequence
  chemically synthesized
ccactgatgagaaatttcta

SEQ ID NO: 262968 - DNA, 20 bp, Artificial Sequence
  chemically synthesized
tcaaagaagaaaaaaggctc

SEQ ID NO: 262969 - DNA, 20 bp, Artificial Sequence
  chemically synthesized
gaggtctcaaagaagaaaaa

SEQ ID NO: 262970 - DNA, 20 bp, Artificial Sequence
  chemically synthesized
tgaggtctcaaagaagaaaa

SEQ ID NO: 262971 - DNA, 20 bp, Artificial Sequence
  chemically synthesized
tagagccttttttcttcttt

SEQ ID NO: 262972 - DNA, 20 bp, Artificial Sequence
  chemically synthesized
caggatttgaggtctcaaag

SEQ ID NO: 262973 - DNA, 20 bp, Artificial Sequence
  chemically synthesized
gaacaggatttgaggtctca

SEQ ID NO: 262974 - DNA, 20 bp, Artificial Sequence
  chemically synthesized
tgcaccatgaacaggatttg

SEQ ID NO: 262975 - DNA, 20 bp, Artificial Sequence
  chemically synthesized
ctgcaccatgaacaggattt

SEQ ID NO: 262976 - DNA, 20 bp, Artificial Sequence
  chemically synthesized
gagacctcaaatcctgttca

SEQ ID NO: 262977 - DNA, 20 bp, Artificial Sequence
  chemically synthesized
ataatgtctgcaccatgaac

SEQ ID NO: 262978 - DNA, 20 bp, Artificial Sequence
  chemically synthesized
aataatgtctgcaccatgaa

SEQ ID NO: 262979 - DNA, 20 bp, Artificial Sequence
  chemically synthesized
ctcaaatcctgttcatggtg

SEQ ID NO: 262980 - DNA, 20 bp, Artificial Sequence
  chemically synthesized
aaaatatcaatatatatgta

SEQ ID NO: 262981 - DNA, 20 bp, Artificial Sequence
  chemically synthesized
atatatgtatagtgcacttc

SEQ ID NO: 262982 - DNA, 20 bp, Artificial Sequence
  chemically synthesized
gtatagtgcacttctggctg

SEQ ID NO: 262983 - DNA, 20 bp, Artificial Sequence
  chemically synthesized
tgataaataactgcagccag

SEQ ID NO: 262984 - DNA, 20 bp, Artificial Sequence
  chemically synthesized
ttttgataaataactgcagc

SEQ ID NO: 262985 - DNA, 20 bp, Artificial Sequence
  chemically synthesized
attattttgataaataactg

SEQ ID NO: 262986 - DNA, 20 bp, Artificial Sequence
  chemically synthesized
taagttgtacaaaaagatga

SEQ ID NO: 262987 - DNA, 20 bp, Artificial Sequence
  chemically synthesized
ctaagttgtacaaaaagatg

SEQ ID NO: 262988 - DNA, 20 bp, Artificial Sequence
  chemically synthesized
cctaagttgtacaaaaagat

SEQ ID NO: 262989 - DNA, 20 bp, Artificial Sequence
  chemically synthesized
tttaacctaagttgtacaaa

SEQ ID NO: 262990 - DNA, 20 bp, Artificial Sequence
  chemically synthesized
cctcatctttttgtacaact

SEQ ID NO: 262991 - DNA, 20 bp, Artificial Sequence
  chemically synthesized
ctcatctttttgtacaactt

SEQ ID NO: 262992 - DNA, 20 bp, Artificial Sequence
  chemically synthesized
tttaaatatgattttaacct

SEQ ID NO: 262993 - DNA, 20 bp, Artificial Sequence
  chemically synthesized
atttaaatgcaaaatataca

SEQ ID NO: 262994 - DNA, 20 bp, Artificial Sequence
  chemically synthesized
taattaaattgcctatgcat

SEQ ID NO: 262995 - DNA, 20 bp, Artificial Sequence
  chemically synthesized
aattaaattgcctatgcatg

SEQ ID NO: 262996 - DNA, 20 bp, Artificial Sequence
  chemically synthesized
atgggtcccgcctcatgcat

SEQ ID NO: 262997 - DNA, 20 bp, Artificial Sequence
  chemically synthesized
catgggtcccgcctcatgca

SEQ ID NO: 262998 - DNA, 20 bp, Artificial Sequence
  chemically synthesized
taaattgcctatgcatgagg

SEQ ID NO: 262999 - DNA, 20 bp, Artificial Sequence
  chemically synthesized
aaattgcctatgcatgaggc

SEQ ID NO: 263000 - DNA, 20 bp, Artificial Sequence
  chemically synthesized
catgaggcgggacccatgta

SEQ ID NO: 263001 - DNA, 20 bp, Artificial Sequence
  chemically synthesized
atgaggcgggacccatgtat

SEQ ID NO: 263002 - DNA, 20 bp, Artificial Sequence
  chemically synthesized
tttcttagcttcctatacat

SEQ ID NO: 263003 - DNA, 20 bp, Artificial Sequence
  chemically synthesized
gtttcttagcttcctataca

SEQ ID NO: 263004 - DNA, 20 bp, Artificial Sequence
  chemically synthesized
aggcgggacccatgtatagg

SEQ ID NO: 263005 - DNA, 20 bp, Artificial Sequence
  chemically synthesized
ggacccatgtataggaagct

SEQ ID NO: 263006 - DNA, 20 bp, Artificial Sequence
  chemically synthesized
agtgtgttattcaggtttct

SEQ ID NO: 263007 - DNA, 20 bp, Artificial Sequence
  chemically synthesized
atactttaagtgtgttattc

SEQ ID NO: 263008 - DNA, 20 bp, Artificial Sequence
  chemically synthesized
aatactttaagtgtgttatt

SEQ ID NO: 263009 - DNA, 20 bp, Artificial Sequence
  chemically synthesized
aaacctgaataacacactta

SEQ ID NO: 263010 - DNA, 20 bp, Artificial Sequence
  chemically synthesized
atgctaagagaaaatacttt

SEQ ID NO: 263011 - DNA, 20 bp, Artificial Sequence
  chemically synthesized
acacttaaagtattttctct

SEQ ID NO: 263012 - DNA, 20 bp, Artificial Sequence
  chemically synthesized
agcaagtttgaacatgctaa

SEQ ID NO: 263013 - DNA, 20 bp, Artificial Sequence
  chemically synthesized
taagcaagtttgaacatgct

SEQ ID NO: 263014 - DNA, 20 bp, Artificial Sequence
  chemically synthesized
atgtgacaaaatttttaagc

SEQ ID NO: 263015 - DNA, 20 bp, Artificial Sequence
  chemically synthesized
ttgaatgtgacaaaattttt

SEQ ID NO: 263016 - DNA, 20 bp, Artificial Sequence
  chemically synthesized
acattcaattgactcttaat

SEQ ID NO: 263017 - DNA, 20 bp, Artificial Sequence
  chemically synthesized
cacaacagttagctcattaa

SEQ ID NO: 263018 - DNA, 20 bp, Artificial Sequence
  chemically synthesized
tacacaacagttagctcatt

SEQ ID NO: 263019 - DNA, 20 bp, Artificial Sequence
  chemically synthesized
cacataaactacacaacagt

SEQ ID NO: 263020 - DNA, 20 bp, Artificial Sequence
  chemically synthesized
ttaatgagctaactgttgtg

SEQ ID NO: 263021 - DNA, 20 bp, Artificial Sequence
  chemically synthesized
cttgcacataaactacacaa

SEQ ID NO: 263022 - DNA, 20 bp, Artificial Sequence
  chemically synthesized
ctgttgtgtagtttatgtgc

SEQ ID NO: 263023 - DNA, 20 bp, Artificial Sequence
  chemically synthesized
gttgtgtagtttatgtgcaa

SEQ ID NO: 263024 - DNA, 20 bp, Artificial Sequence
  chemically synthesized
acgaatacaattgacttaac

SEQ ID NO: 263025 - DNA, 20 bp, Artificial Sequence
  chemically synthesized
ttgtgagtttgtatctagtt

SEQ ID NO: 263026 - DNA, 20 bp, Artificial Sequence
  chemically synthesized
taggtttgtgagtttgtatc

SEQ ID NO: 263027 - DNA, 20 bp, Artificial Sequence
  chemically synthesized
tagatacaaactcacaaacc

SEQ ID NO: 263028 - DNA, 20 bp, Artificial Sequence
  chemically synthesized
tacaaactcactaggtttgt

SEQ ID NO: 263029 - DNA, 20 bp, Artificial Sequence
  chemically synthesized
tacaaactcacaaacctagt

SEQ ID NO: 263030 - DNA, 20 bp, Artificial Sequence
  chemically synthesized
aagtcagatacaaactcact

SEQ ID NO: 263031 - DNA, 20 bp, Artificial Sequence
  chemically synthesized
taagtcagatacaaactcac

SEQ ID NO: 263032 - DNA, 20 bp, Artificial Sequence
  chemically synthesized
gaattttacctattttaagt

SEQ ID NO: 263033 - DNA, 20 bp, Artificial Sequence
  chemically synthesized
agtttgtatctgacttaaaa

SEQ ID NO: 263034 - DNA, 20 bp, Artificial Sequence
  chemically synthesized
gtttgtatctgacttaaaat

SEQ ID NO: 263035 - DNA, 20 bp, Artificial Sequence
  chemically synthesized
tttagaattttacctatttt

SEQ ID NO: 263036 - DNA, 20 bp, Artificial Sequence
  chemically synthesized
aaggctaaagatatacattt

SEQ ID NO: 263037 - DNA, 20 bp, Artificial Sequence
  chemically synthesized
aattctaaaatgtatatctt

SEQ ID NO: 263038 - DNA, 20 bp, Artificial Sequence
  chemically synthesized
aaaatgtatatctttagcct

SEQ ID NO: 263039 - DNA, 20 bp, Artificial Sequence
  chemically synthesized
aaatgtatatctttagcctt

SEQ ID NO: 263040 - DNA, 20 bp, Artificial Sequence
  chemically synthesized
gttgatgagccccaaggcta

SEQ ID NO: 263041 - DNA, 20 bp, Artificial Sequence
  chemically synthesized
aatgtatatctttagccttg

SEQ ID NO: 263042 - DNA, 20 bp, Artificial Sequence
  chemically synthesized
agttttgttgatgagcccca

SEQ ID NO: 263043 - DNA, 20 bp, Artificial Sequence
  chemically synthesized
aagttttgttgatgagcccc

SEQ ID NO: 263044 - DNA, 20 bp, Artificial Sequence
  chemically synthesized
gtacataaagttttgttgat

SEQ ID NO: 263045 - DNA, 20 bp, Artificial Sequence
  chemically synthesized
gtatattggttgagtacata

SEQ ID NO: 263046 - DNA, 20 bp, Artificial Sequence
  chemically synthesized
aacatgaatgtatattggtt

SEQ ID NO: 263047 - DNA, 20 bp, Artificial Sequence
  chemically synthesized
ctaaaaacatgaatgtatat

SEQ ID NO: 263048 - DNA, 20 bp, Artificial Sequence
  chemically synthesized
ccaatatacattcatgtttt

SEQ ID NO: 263049 - DNA, 20 bp, Artificial Sequence
  chemically synthesized
gtttttagaaatgcctacat

SEQ ID NO: 263050 - DNA, 20 bp, Artificial Sequence
  chemically synthesized
ttttagaaatgcctacataa

SEQ ID NO: 263051 - DNA, 20 bp, Artificial Sequence
  chemically synthesized
ggcctatgaaactcttatgt

SEQ ID NO: 263052 - DNA, 20 bp, Artificial Sequence
  chemically synthesized
tggcctatgaaactcttatg

SEQ ID NO: 263053 - DNA, 20 bp, Artificial Sequence
  chemically synthesized
atgcctacataagagtttca

SEQ ID NO: 263054 - DNA, 20 bp, Artificial Sequence
  chemically synthesized
tgcctacataagagtttcat

SEQ ID NO: 263055 - DNA, 20 bp, Artificial Sequence
  chemically synthesized
ttctaatcataaaatattaa

SEQ ID NO: 263056 - DNA, 20 bp, Artificial Sequence
  chemically synthesized
ggccattaatattttatgat

SEQ ID NO: 263057 - DNA, 20 bp, Artificial Sequence
  chemically synthesized
attttatgattagaaatata

SEQ ID NO: 263058 - DNA, 20 bp, Artificial Sequence
  chemically synthesized
ttagaaatataaagccattt

SEQ ID NO: 263059 - DNA, 20 bp, Artificial Sequence
  chemically synthesized
agtttataagacaactaaaa

SEQ ID NO: 263060 - DNA, 20 bp, Artificial Sequence
  chemically synthesized
tacagcttggaacagtttat

SEQ ID NO: 263061 - DNA, 20 bp, Artificial Sequence
  chemically synthesized
gttgtcttataaactgttcc

SEQ ID NO: 263062 - DNA, 20 bp, Artificial Sequence
  chemically synthesized
tctacacatacagcttggaa

SEQ ID NO: 263063 - DNA, 20 bp, Artificial Sequence
  chemically synthesized
acacttctacacatacagct

SEQ ID NO: 263064 - DNA, 20 bp, Artificial Sequence
  chemically synthesized
actgttccaagctgtatgtg

SEQ ID NO: 263065 - DNA, 20 bp, Artificial Sequence
  chemically synthesized
tggtgacacttctacacata

SEQ ID NO: 263066 - DNA, 20 bp, Artificial Sequence
  chemically synthesized
gttccaagctgtatgtgtag

SEQ ID NO: 263067 - DNA, 20 bp, Artificial Sequence
  chemically synthesized
gttcaccaatatacgaacag

SEQ ID NO: 263068 - DNA, 20 bp, Artificial Sequence
  chemically synthesized
tatgttcaccaatatacgaa

SEQ ID NO: 263069 - DNA, 20 bp, Artificial Sequence
  chemically synthesized
tgtcaccactgttcgtatat

SEQ ID NO: 263070 - DNA, 20 bp, Artificial Sequence
  chemically synthesized
tatctcacataattttttat

SEQ ID NO: 263071 - DNA, 20 bp, Artificial Sequence
  chemically synthesized
taactaataaaaaattatgt

SEQ ID NO: 263072 - DNA, 20 bp, Artificial Sequence
  chemically synthesized
tatgcaagccttggaaggag

SEQ ID NO: 263073 - DNA, 20 bp, Artificial Sequence
  chemically synthesized
agataaatgcttctccttcc

SEQ ID NO: 263074 - DNA, 20 bp, Artificial Sequence
  chemically synthesized
gataaatgcttctccttcca

SEQ ID NO: 263075 - DNA, 20 bp, Artificial Sequence
  chemically synthesized
ggctatgcaagccttggaag

SEQ ID NO: 263076 - DNA, 20 bp, Artificial Sequence
  chemically synthesized
gtggctatgcaagccttgga

SEQ ID NO: 263077 - DNA, 20 bp, Artificial Sequence
  chemically synthesized
tgtggctatgcaagccttgg

SEQ ID NO: 263078 - DNA, 20 bp, Artificial Sequence
  chemically synthesized
aaatgtggctatgcaagcct

SEQ ID NO: 263079 - DNA, 20 bp, Artificial Sequence
  chemically synthesized
ttctccttccaaggcttgca

SEQ ID NO: 263080 - DNA, 20 bp, Artificial Sequence
  chemically synthesized
taagataaatgtggctatgc

SEQ ID NO: 263081 - DNA, 20 bp, Artificial Sequence
  chemically synthesized
ttggtatagtaagataaatg

SEQ ID NO: 263082 - DNA, 20 bp, Artificial Sequence
  chemically synthesized
agagcatgatttggtatagt

SEQ ID NO: 263083 - DNA, 20 bp, Artificial Sequence
  chemically synthesized
atttagagcatgatttggta

SEQ ID NO: 263084 - DNA, 20 bp, Artificial Sequence
  chemically synthesized
tttgcatttagagcatgatt

SEQ ID NO: 263085 - DNA, 20 bp, Artificial Sequence
  chemically synthesized
agttaattgttttgcattta

SEQ ID NO: 263086 - DNA, 20 bp, Artificial Sequence
  chemically synthesized
atagttaattgttttgcatt

SEQ ID NO: 263087 - DNA, 20 bp, Artificial Sequence
  chemically synthesized
tgctgttttcttttttcaaa

SEQ ID NO: 263088 - DNA, 20 bp, Artificial Sequence
  chemically synthesized
aacaattaactatttgaaaa

SEQ ID NO: 263089 - DNA, 20 bp, Artificial Sequence
  chemically synthesized
aactatttgaaaaaagaaaa

SEQ ID NO: 263090 - DNA, 20 bp, Artificial Sequence
  chemically synthesized
atttgaaaaaagaaaacagc

SEQ ID NO: 263091 - DNA, 20 bp, Artificial Sequence
  chemically synthesized
gtcttatcacattgatttga

SEQ ID NO: 263092 - DNA, 20 bp, Artificial Sequence
  chemically synthesized
tgctttcaaatcaatgtgat

SEQ ID NO: 263093 - DNA, 20 bp, Artificial Sequence
  chemically synthesized
ccattgttgatttattaaat

SEQ ID NO: 263094 - DNA, 20 bp, Artificial Sequence
  chemically synthesized
ctaatttaataaatcaacaa

SEQ ID NO: 263095 - DNA, 20 bp, Artificial Sequence
  chemically synthesized
taatttaataaatcaacaat

SEQ ID NO: 263096 - DNA, 20 bp, Artificial Sequence
  chemically synthesized
atttaataaatcaacaatgg

SEQ ID NO: 263097 - DNA, 20 bp, Artificial Sequence
  chemically synthesized
tttaataaatcaacaatggg

SEQ ID NO: 263098 - DNA, 20 bp, Artificial Sequence
  chemically synthesized
aatcaacaatgggaggaaat

SEQ ID NO: 263099 - DNA, 20 bp, Artificial Sequence
  chemically synthesized
tcagtcatcatgctctttac

SEQ ID NO: 263100 - DNA, 20 bp, Artificial Sequence
  chemically synthesized
atattgagtgtgcttgtaaa

SEQ ID NO: 263101 - DNA, 20 bp, Artificial Sequence
  chemically synthesized
agatattgagtgtgcttgta

SEQ ID NO: 263102 - DNA, 20 bp, Artificial Sequence
  chemically synthesized
tattaatcacagaagatatt

SEQ ID NO: 263103 - DNA, 20 bp, Artificial Sequence
  chemically synthesized
agtaattctattaatcacag

SEQ ID NO: 263104 - DNA, 20 bp, Artificial Sequence
  chemically synthesized
tcaatatcttctgtgattaa

SEQ ID NO: 263105 - DNA, 20 bp, Artificial Sequence
  chemically synthesized
ttgagtaattctattaatca

SEQ ID NO: 263106 - DNA, 20 bp, Artificial Sequence
  chemically synthesized
gaattataaaatggcatttt

SEQ ID NO: 263107 - DNA, 20 bp, Artificial Sequence
  chemically synthesized
tgttcccatgaattataaaa

SEQ ID NO: 263108 - DNA, 20 bp, Artificial Sequence
  chemically synthesized
aaatgccattttataattca

SEQ ID NO: 263109 - DNA, 20 bp, Artificial Sequence
  chemically synthesized
aatgccattttataattcat

SEQ ID NO: 263110 - DNA, 20 bp, Artificial Sequence
  chemically synthesized
tttataattcatgggaacat

SEQ ID NO: 263111 - DNA, 20 bp, Artificial Sequence
  chemically synthesized
gggaacataagctctgcatg

SEQ ID NO: 263112 - DNA, 20 bp, Artificial Sequence
  chemically synthesized
agaaatgaaagctgcatgca

SEQ ID NO: 263113 - DNA, 20 bp, Artificial Sequence
  chemically synthesized
gtagaaatgaaagctgcatg

SEQ ID NO: 263114 - DNA, 20 bp, Artificial Sequence
  chemically synthesized
gctactttctgtagaaatga

SEQ ID NO: 263115 - DNA, 20 bp, Artificial Sequence
  chemically synthesized
gcatgcagctttcatttcta

SEQ ID NO: 263116 - DNA, 20 bp, Artificial Sequence
  chemically synthesized
gcagctttcatttctacaga

SEQ ID NO: 263117 - DNA, 20 bp, Artificial Sequence
  chemically synthesized
gctttcatttctacagaaag

SEQ ID NO: 263118 - DNA, 20 bp, Artificial Sequence
  chemically synthesized
accctaattgctactttctg

SEQ ID NO: 263119 - DNA, 20 bp, Artificial Sequence
  chemically synthesized
tttctacagaaagtagcaat

SEQ ID NO: 263120 - DNA, 20 bp, Artificial Sequence
  chemically synthesized
ttctacagaaagtagcaatt

SEQ ID NO: 263121 - DNA, 20 bp, Artificial Sequence
  chemically synthesized
tctacagaaagtagcaatta

SEQ ID NO: 263122 - DNA, 20 bp, Artificial Sequence
  chemically synthesized
agcaattagggttttattca

SEQ ID NO: 263123 - DNA, 20 bp, Artificial Sequence
  chemically synthesized
gcaattagggttttattcac

SEQ ID NO: 263124 - DNA, 20 bp, Artificial Sequence
  chemically synthesized
tttattcacaggtttaattc

SEQ ID NO: 263125 - DNA, 20 bp, Artificial Sequence
  chemically synthesized
agcgaaaaaataataaatat

SEQ ID NO: 263126 - DNA, 20 bp, Artificial Sequence
  chemically synthesized
gcgaaaaaataataaatatc

SEQ ID NO: 263127 - DNA, 20 bp, Artificial Sequence
  chemically synthesized
cgaaaaaataataaatatca

SEQ ID NO: 263128 - DNA, 20 bp, Artificial Sequence
  chemically synthesized
ttccaatggaatgaaatttt

SEQ ID NO: 263129 - DNA, 20 bp, Artificial Sequence
  chemically synthesized
ttctaaaaatttcattccat

SEQ ID NO: 263130 - DNA, 20 bp, Artificial Sequence
  chemically synthesized
agaaggtcaaaattttccaa

SEQ ID NO: 263131 - DNA, 20 bp, Artificial Sequence
  chemically synthesized
cttatgaaatattttagaga

SEQ ID NO: 263132 - DNA, 20 bp, Artificial Sequence
  chemically synthesized
ccttatgaaatattttagag

SEQ ID NO: 263133 - DNA, 20 bp, Artificial Sequence
  chemically synthesized
ggtccttatgaaatatttta

SEQ ID NO: 263134 - DNA, 20 bp, Artificial Sequence
  chemically synthesized
ctggtccttatgaaatattt

SEQ ID NO: 263135 - DNA, 20 bp, Artificial Sequence
  chemically synthesized
ccttctctaaaatatttcat

SEQ ID NO: 263136 - DNA, 20 bp, Artificial Sequence
  chemically synthesized
cttctctaaaatatttcata

SEQ ID NO: 263137 - DNA, 20 bp, Artificial Sequence
  chemically synthesized
ctaaaatatttcataaggac

SEQ ID NO: 263138 - DNA, 20 bp, Artificial Sequence
  chemically synthesized
tatttcataaggaccagaat

SEQ ID NO: 263139 - DNA, 20 bp, Artificial Sequence
  chemically synthesized
ctgtcaaatagttccaattc

SEQ ID NO: 263140 - DNA, 20 bp, Artificial Sequence
  chemically synthesized
ccagaattggaactatttga

SEQ ID NO: 263141 - DNA, 20 bp, Artificial Sequence
  chemically synthesized
cagaattggaactatttgac

SEQ ID NO: 263142 - DNA, 20 bp, Artificial Sequence
  chemically synthesized
aactttttaaacctgtcaaa

SEQ ID NO: 263143 - DNA, 20 bp, Artificial Sequence
  chemically synthesized
aactatttgacaggtttaaa

SEQ ID NO: 263144 - DNA, 20 bp, Artificial Sequence
  chemically synthesized
taaaaagttattgaatatgt

SEQ ID NO: 263145 - DNA, 20 bp, Artificial Sequence
  chemically synthesized
agttattgaatatgttggta

SEQ ID NO: 263146 - DNA, 20 bp, Artificial Sequence
  chemically synthesized
ttgaatatgttggtatagat

SEQ ID NO: 263147 - DNA, 20 bp, Artificial Sequence
  chemically synthesized
tatgttggtatagattggtt

SEQ ID NO: 263148 - DNA, 20 bp, Artificial Sequence
  chemically synthesized
ttggtatagattggtttggc

SEQ ID NO: 263149 - DNA, 20 bp, Artificial Sequence
  chemically synthesized
gtatagattggtttggcgag

SEQ ID NO: 263150 - DNA, 20 bp, Artificial Sequence
  chemically synthesized
cgattttgattaatcactta

SEQ ID NO: 263151 - DNA, 20 bp, Artificial Sequence
  chemically synthesized
ttcttgcaaatacaggctat

SEQ ID NO: 263152 - DNA, 20 bp, Artificial Sequence
  chemically synthesized
tagttcattcttgcaaatac

SEQ ID NO: 263153 - DNA, 20 bp, Artificial Sequence
  chemically synthesized
cacttatagcctgtatttgc

SEQ ID NO: 263154 - DNA, 20 bp, Artificial Sequence
  chemically synthesized
gtagttcattcttgcaaata

SEQ ID NO: 263155 - DNA, 20 bp, Artificial Sequence
  chemically synthesized
acaaactagataatgaaatg

SEQ ID NO: 263156 - DNA, 20 bp, Artificial Sequence
  chemically synthesized
atgaactacatttcattatc

SEQ ID NO: 263157 - DNA, 20 bp, Artificial Sequence
  chemically synthesized
attcccaattttaaacaaac

SEQ ID NO: 263158 - DNA, 20 bp, Artificial Sequence
  chemically synthesized
ttatctagtttgtttaaaat

SEQ ID NO: 263159 - DNA, 20 bp, Artificial Sequence
  chemically synthesized
tatctagtttgtttaaaatt

SEQ ID NO: 263160 - DNA, 20 bp, Artificial Sequence
  chemically synthesized
ataaaacataaagtacagca

SEQ ID NO: 263161 - DNA, 20 bp, Artificial Sequence
  chemically synthesized
cataaaacataaagtacagc

SEQ ID NO: 263162 - DNA, 20 bp, Artificial Sequence
  chemically synthesized
tcaacataaaacataaagta

SEQ ID NO: 263163 - DNA, 20 bp, Artificial Sequence
  chemically synthesized
aaaattcaacataaaacata

SEQ ID NO: 263164 - DNA, 20 bp, Artificial Sequence
  chemically synthesized
gttgaattttcaaaccttct

SEQ ID NO: 263165 - DNA, 20 bp, Artificial Sequence
  chemically synthesized
ttgaattttcaaaccttctg

SEQ ID NO: 263166 - DNA, 20 bp, Artificial Sequence
  chemically synthesized
gaattttcaaaccttctgag

SEQ ID NO: 263167 - DNA, 20 bp, Artificial Sequence
  chemically synthesized
gttcgatctgactcctcaga

SEQ ID NO: 263168 - DNA, 20 bp, Artificial Sequence
  chemically synthesized
cgttcgatctgactcctcag

SEQ ID NO: 263169 - DNA, 20 bp, Artificial Sequence
  chemically synthesized
tttcaaaccttctgaggagt

SEQ ID NO: 263170 - DNA, 20 bp, Artificial Sequence
  chemically synthesized
cagcgttcgatctgactcct

SEQ ID NO: 263171 - DNA, 20 bp, Artificial Sequence
  chemically synthesized
cttgctacctttgaaaaaag

SEQ ID NO: 263172 - DNA, 20 bp, Artificial Sequence
  chemically synthesized
atcgaacgctgcttttttca

SEQ ID NO: 263173 - DNA, 20 bp, Artificial Sequence
  chemically synthesized
tcgaacgctgcttttttcaa

SEQ ID NO: 263174 - DNA, 20 bp, Artificial Sequence
  chemically synthesized
tatcttgctacctttgaaaa

SEQ ID NO: 263175 - DNA, 20 bp, Artificial Sequence
  chemically synthesized
aacgctgcttttttcaaagg

SEQ ID NO: 263176 - DNA, 20 bp, Artificial Sequence
  chemically synthesized
ctgcttttttcaaaggtagc

SEQ ID NO: 263177 - DNA, 20 bp, Artificial Sequence
  chemically synthesized
ttttcaaaggtagcaagata

SEQ ID NO: 263178 - DNA, 20 bp, Artificial Sequence
  chemically synthesized
caagatacagccacgtgaat

SEQ ID NO: 263179 - DNA, 20 bp, Artificial Sequence
  chemically synthesized
tggctcaactctaattcacg

SEQ ID NO: 263180 - DNA, 20 bp, Artificial Sequence
  chemically synthesized
agatacagccacgtgaatta

SEQ ID NO: 263181 - DNA, 20 bp, Artificial Sequence
  chemically synthesized
cagccacgtgaattagagtt

SEQ ID NO: 263182 - DNA, 20 bp, Artificial Sequence
  chemically synthesized
gttatgtcacaaataaggca

SEQ ID NO: 263183 - DNA, 20 bp, Artificial Sequence
  chemically synthesized
tgtgagttatgtcacaaata

SEQ ID NO: 263184 - DNA, 20 bp, Artificial Sequence
  chemically synthesized
atgtgagttatgtcacaaat

SEQ ID NO: 263185 - DNA, 20 bp, Artificial Sequence
  chemically synthesized
ctttctcctggcaaagatgt

SEQ ID NO: 263186 - DNA, 20 bp, Artificial Sequence
  chemically synthesized
gacataactcacatctttgc

SEQ ID NO: 263187 - DNA, 20 bp, Artificial Sequence
  chemically synthesized
acataactcacatctttgcc

SEQ ID NO: 263188 - DNA, 20 bp, Artificial Sequence
  chemically synthesized
ataactcacatctttgccag

SEQ ID NO: 263189 - DNA, 20 bp, Artificial Sequence
  chemically synthesized
ccaagccctttctcctggca

SEQ ID NO: 263190 - DNA, 20 bp, Artificial Sequence
  chemically synthesized
ctcacatctttgccaggaga

SEQ ID NO: 263191 - DNA, 20 bp, Artificial Sequence
  chemically synthesized
tcacatctttgccaggagaa

SEQ ID NO: 263192 - DNA, 20 bp, Artificial Sequence
  chemically synthesized
cacatctttgccaggagaaa

SEQ ID NO: 263193 - DNA, 20 bp, Artificial Sequence
  chemically synthesized
gaccaccaagccctttctcc

SEQ ID NO: 263194 - DNA, 20 bp, Artificial Sequence
  chemically synthesized
ctttgccaggagaaagggct

SEQ ID NO: 263195 - DNA, 20 bp, Artificial Sequence
  chemically synthesized
tgccaggagaaagggcttgg

SEQ ID NO: 263196 - DNA, 20 bp, Artificial Sequence
  chemically synthesized
gtttcagattgatgaccacc

SEQ ID NO: 263197 - DNA, 20 bp, Artificial Sequence
  chemically synthesized
ttaggaaatgaaagatgttt

SEQ ID NO: 263198 - DNA, 20 bp, Artificial Sequence
  chemically synthesized
actttgtgcttaggaaatga

SEQ ID NO: 263199 - DNA, 20 bp, Artificial Sequence
  chemically synthesized
tgaaacatctttcatttcct

SEQ ID NO: 263200 - DNA, 20 bp, Artificial Sequence
  chemically synthesized
tctttcatttcctaagcaca

SEQ ID NO: 263201 - DNA, 20 bp, Artificial Sequence
  chemically synthesized
ttatacatcactttgtgctt

SEQ ID NO: 263202 - DNA, 20 bp, Artificial Sequence
  chemically synthesized
attatacatcactttgtgct

SEQ ID NO: 263203 - DNA, 20 bp, Artificial Sequence
  chemically synthesized
tgtataatatgtaaaatatt

SEQ ID NO: 263204 - DNA, 20 bp, Artificial Sequence
  chemically synthesized
tataatatgtaaaatattta

SEQ ID NO: 263205 - DNA, 20 bp, Artificial Sequence
  chemically synthesized
aaatatttagagatgtcatg

SEQ ID NO: 263206 - DNA, 20 bp, Artificial Sequence
  chemically synthesized
agatgtcatgtagatttctt

SEQ ID NO: 263207 - DNA, 20 bp, Artificial Sequence
  chemically synthesized
atgtcatgtagatttcttta

SEQ ID NO: 263208 - DNA, 20 bp, Artificial Sequence
  chemically synthesized
tgtcatgtagatttctttag

SEQ ID NO: 263209 - DNA, 20 bp, Artificial Sequence
  chemically synthesized
ggtcatctggcattcctcta

SEQ ID NO: 263210 - DNA, 20 bp, Artificial Sequence
  chemically synthesized
agatttctttagaggaatgc

SEQ ID NO: 263211 - DNA, 20 bp, Artificial Sequence
  chemically synthesized
agcagtgtttaatggtcatc

SEQ ID NO: 263212 - DNA, 20 bp, Artificial Sequence
  chemically synthesized
tactgaatagcagtgtttaa

SEQ ID NO: 263213 - DNA, 20 bp, Artificial Sequence
  chemically synthesized
gaccattaaacactgctatt

SEQ ID NO: 263214 - DNA, 20 bp, Artificial Sequence
  chemically synthesized
gtgtgtgtcctactgaatag

SEQ ID NO: 263215 - DNA, 20 bp, Artificial Sequence
  chemically synthesized
cattaaacactgctattcag

SEQ ID NO: 263216 - DNA, 20 bp, Artificial Sequence
  chemically synthesized
attaaacactgctattcagt

SEQ ID NO: 263217 - DNA, 20 bp, Artificial Sequence
  chemically synthesized
atggtgtgtgtcctactgaa

SEQ ID NO: 263218 - DNA, 20 bp, Artificial Sequence
  chemically synthesized
tatctacactggtcgtatga

SEQ ID NO: 263219 - DNA, 20 bp, Artificial Sequence
  chemically synthesized
gacacacaccatcatacgac

SEQ ID NO: 263220 - DNA, 20 bp, Artificial Sequence
  chemically synthesized
acaccatcatacgaccagtg

SEQ ID NO: 263221 - DNA, 20 bp, Artificial Sequence
  chemically synthesized
gctttcagaagtatctacac

SEQ ID NO: 263222 - DNA, 20 bp, Artificial Sequence
  chemically synthesized
accagtgtagatacttctga

SEQ ID NO: 263223 - DNA, 20 bp, Artificial Sequence
  chemically synthesized
aactgtgagcaagctttcag

SEQ ID NO: 263224 - DNA, 20 bp, Artificial Sequence
  chemically synthesized
tccaactgtgagcaagcttt

SEQ ID NO: 263225 - DNA, 20 bp, Artificial Sequence
  chemically synthesized
tacttctgaaagcttgctca

SEQ ID NO: 263226 - DNA, 20 bp, Artificial Sequence
  chemically synthesized
acacccttccaactgtgagc

SEQ ID NO: 263227 - DNA, 20 bp, Artificial Sequence
  chemically synthesized
tctgaaagcttgctcacagt

SEQ ID NO: 263228 - DNA, 20 bp, Artificial Sequence
  chemically synthesized
actcacacccttccaactgt

SEQ ID NO: 263229 - DNA, 20 bp, Artificial Sequence
  chemically synthesized
gaaagcttgctcacagttgg

SEQ ID NO: 263230 - DNA, 20 bp, Artificial Sequence
  chemically synthesized
aaagcttgctcacagttgga

SEQ ID NO: 263231 - DNA, 20 bp, Artificial Sequence
  chemically synthesized
aagcttgctcacagttggaa

SEQ ID NO: 263232 - DNA, 20 bp, Artificial Sequence
  chemically synthesized
gctcacagttggaagggtgt

SEQ ID NO: 263233 - DNA, 20 bp, Artificial Sequence
  chemically synthesized
ttggaagggtgtgagttaca

SEQ ID NO: 263234 - DNA, 20 bp, Artificial Sequence
  chemically synthesized
tacatagcgttccgattttc

SEQ ID NO: 263235 - DNA, 20 bp, Artificial Sequence
  chemically synthesized
ccataatgtgtctagaaaat

SEQ ID NO: 263236 - DNA, 20 bp, Artificial Sequence
  chemically synthesized
aaagcacaccataatgtgtc

SEQ ID NO: 263237 - DNA, 20 bp, Artificial Sequence
  chemically synthesized
ccgattttctagacacatta

SEQ ID NO: 263238 - DNA, 20 bp, Artificial Sequence
  chemically synthesized
tcttcctcgagggagtgcaa

SEQ ID NO: 263239 - DNA, 20 bp, Artificial Sequence
  chemically synthesized
gtgtgcttttgcactccctc

SEQ ID NO: 263240 - DNA, 20 bp, Artificial Sequence
  chemically synthesized
tgtgcttttgcactccctcg

SEQ ID NO: 263241 - DNA, 20 bp, Artificial Sequence
  chemically synthesized
aaaaggcctcttcctcgagg

SEQ ID NO: 263242 - DNA, 20 bp, Artificial Sequence
  chemically synthesized
gcttttgcactccctcgagg

SEQ ID NO: 263243 - DNA, 20 bp, Artificial Sequence
  chemically synthesized
agaaaaggcctcttcctcga

SEQ ID NO: 263244 - DNA, 20 bp, Artificial Sequence
  chemically synthesized
ttttgcactccctcgaggaa

SEQ ID NO: 263245 - DNA, 20 bp, Artificial Sequence
  chemically synthesized
cagaaaaggcctcttcctcg

SEQ ID NO: 263246 - DNA, 20 bp, Artificial Sequence
  chemically synthesized
tttgcactccctcgaggaag

SEQ ID NO: 263247 - DNA, 20 bp, Artificial Sequence
  chemically synthesized
acagaaaaggcctcttcctc

SEQ ID NO: 263248 - DNA, 20 bp, Artificial Sequence
  chemically synthesized
ataaatatagtaaacagaaa

SEQ ID NO: 263249 - DNA, 20 bp, Artificial Sequence
  chemically synthesized
gataaatatagtaaacagaa

SEQ ID NO: 263250 - DNA, 20 bp, Artificial Sequence
  chemically synthesized
ctgctgataaatatagtaaa

SEQ ID NO: 263251 - DNA, 20 bp, Artificial Sequence
  chemically synthesized
tttctgtttactatatttat

SEQ ID NO: 263252 - DNA, 20 bp, Artificial Sequence
  chemically synthesized
aaggtaactgctgataaata

SEQ ID NO: 263253 - DNA, 20 bp, Artificial Sequence
  chemically synthesized
ctgtttactatatttatcag

SEQ ID NO: 263254 - DNA, 20 bp, Artificial Sequence
  chemically synthesized
tatttatcagcagttacctt

SEQ ID NO: 263255 - DNA, 20 bp, Artificial Sequence
  chemically synthesized
ttggccagcaggtgttctga

SEQ ID NO: 263256 - DNA, 20 bp, Artificial Sequence
  chemically synthesized
attggccagcaggtgttctg

SEQ ID NO: 263257 - DNA, 20 bp, Artificial Sequence
  chemically synthesized
gttaccttcagaacacctgc

SEQ ID NO: 263258 - DNA, 20 bp, Artificial Sequence
  chemically synthesized
ggaaagtctaattggccagc

SEQ ID NO: 263259 - DNA, 20 bp, Artificial Sequence
  chemically synthesized
aggaaagtctaattggccag

SEQ ID NO: 263260 - DNA, 20 bp, Artificial Sequence
  chemically synthesized
cagaacacctgctggccaat

SEQ ID NO: 263261 - DNA, 20 bp, Artificial Sequence
  chemically synthesized
acaaggaaagtctaattggc

SEQ ID NO: 263262 - DNA, 20 bp, Artificial Sequence
  chemically synthesized
atccacaaggaaagtctaat

SEQ ID NO: 263263 - DNA, 20 bp, Artificial Sequence
  chemically synthesized
ggccaattagactttccttg

SEQ ID NO: 263264 - DNA, 20 bp, Artificial Sequence
  chemically synthesized
ctgcaaggaatccacaagga

SEQ ID NO: 263265 - DNA, 20 bp, Artificial Sequence
  chemically synthesized
gtgcctgcaaggaatccaca

SEQ ID NO: 263266 - DNA, 20 bp, Artificial Sequence
  chemically synthesized
tgtgcctgcaaggaatccac

SEQ ID NO: 263267 - DNA, 20 bp, Artificial Sequence
  chemically synthesized
ctttccttgtggattccttg

SEQ ID NO: 263268 - DNA, 20 bp, Artificial Sequence
  chemically synthesized
tttccttgtggattccttgc

SEQ ID NO: 263269 - DNA, 20 bp, Artificial Sequence
  chemically synthesized
tacacaatattgtgcctgca

SEQ ID NO: 263270 - DNA, 20 bp, Artificial Sequence
  chemically synthesized
ttacacaatattgtgcctgc

SEQ ID NO: 263271 - DNA, 20 bp, Artificial Sequence
  chemically synthesized
atattgtgtaattacattct

SEQ ID NO: 263272 - DNA, 20 bp, Artificial Sequence
  chemically synthesized
ttgtgtaattacattctcag

SEQ ID NO: 263273 - DNA, 20 bp, Artificial Sequence
  chemically synthesized
tcaaccaaataaacactgct

SEQ ID NO: 263274 - DNA, 20 bp, Artificial Sequence
  chemically synthesized
cattctcagcagtgtttatt

SEQ ID NO: 263275 - DNA, 20 bp, Artificial Sequence
  chemically synthesized
agtgtttatttggttgacta

SEQ ID NO: 263276 - DNA, 20 bp, Artificial Sequence
  chemically synthesized
gtgtttatttggttgactat

SEQ ID NO: 263277 - DNA, 20 bp, Artificial Sequence
  chemically synthesized
tgtttatttggttgactata

SEQ ID NO: 263278 - DNA, 20 bp, Artificial Sequence
  chemically synthesized
gtttatttggttgactatag

SEQ ID NO: 263279 - DNA, 20 bp, Artificial Sequence
  chemically synthesized
tttatttggttgactatagg

SEQ ID NO: 263280 - DNA, 20 bp, Artificial Sequence
  chemically synthesized
gaataaaacctttcccccta

SEQ ID NO: 263281 - DNA, 20 bp, Artificial Sequence
  chemically synthesized
tttggttgactataggggga

SEQ ID NO: 263282 - DNA, 20 bp, Artificial Sequence
  chemically synthesized
ttggttgactatagggggaa

SEQ ID NO: 263283 - DNA, 20 bp, Artificial Sequence
  chemically synthesized
tgctttctacatgcaaataa

SEQ ID NO: 263284 - DNA, 20 bp, Artificial Sequence
  chemically synthesized
tctgctttctacatgcaaat

SEQ ID NO: 263285 - DNA, 20 bp, Artificial Sequence
  chemically synthesized
tttattctcttatttgcatg

SEQ ID NO: 263286 - DNA, 20 bp, Artificial Sequence
  chemically synthesized
ttctcttatttgcatgtaga

SEQ ID NO: 263287 - DNA, 20 bp, Artificial Sequence
  chemically synthesized
tcttatttgcatgtagaaag

SEQ ID NO: 263288 - DNA, 20 bp, Artificial Sequence
  chemically synthesized
atccacctagcaggtagatg

SEQ ID NO: 263289 - DNA, 20 bp, Artificial Sequence
  chemically synthesized
ggatccacctagcaggtaga

SEQ ID NO: 263290 - DNA, 20 bp, Artificial Sequence
  chemically synthesized
agcagactccatctacctgc

SEQ ID NO: 263291 - DNA, 20 bp, Artificial Sequence
  chemically synthesized
gcagactccatctacctgct

SEQ ID NO: 263292 - DNA, 20 bp, Artificial Sequence
  chemically synthesized
aggtggatccacctagcagg

SEQ ID NO: 263293 - DNA, 20 bp, Artificial Sequence
  chemically synthesized
gactccatctacctgctagg

SEQ ID NO: 263294 - DNA, 20 bp, Artificial Sequence
  chemically synthesized
tgaaggtggatccacctagc

SEQ ID NO: 263295 - DNA, 20 bp, Artificial Sequence
  chemically synthesized
atgaaggtggatccacctag

SEQ ID NO: 263296 - DNA, 20 bp, Artificial Sequence
  chemically synthesized
gttatgaaggtggatccacc

SEQ ID NO: 263297 - DNA, 20 bp, Artificial Sequence
  chemically synthesized
gagctatgtagttatgaagg

SEQ ID NO: 263298 - DNA, 20 bp, Artificial Sequence
  chemically synthesized
tttgagctatgtagttatga

SEQ ID NO: 263299 - DNA, 20 bp, Artificial Sequence
  chemically synthesized
ttttgagctatgtagttatg

SEQ ID NO: 263300 - DNA, 20 bp, Artificial Sequence
  chemically synthesized
gatccaccttcataactaca

SEQ ID NO: 263301 - DNA, 20 bp, Artificial Sequence
  chemically synthesized
aatcactcttttgagctatg

SEQ ID NO: 263302 - DNA, 20 bp, Artificial Sequence
  chemically synthesized
ttcataactacatagctcaa

SEQ ID NO: 263303 - DNA, 20 bp, Artificial Sequence
  chemically synthesized
cataactacatagctcaaaa

SEQ ID NO: 263304 - DNA, 20 bp, Artificial Sequence
  chemically synthesized
tccttgtaaatcactctttt

SEQ ID NO: 263305 - DNA, 20 bp, Artificial Sequence
  chemically synthesized
agctcaaaagagtgatttac

SEQ ID NO: 263306 - DNA, 20 bp, Artificial Sequence
  chemically synthesized
gctcaaaagagtgatttaca

SEQ ID NO: 263307 - DNA, 20 bp, Artificial Sequence
  chemically synthesized
aaagagtgatttacaaggaa

SEQ ID NO: 263308 - DNA, 20 bp, Artificial Sequence
  chemically synthesized
gtgatttacaaggaaaagct

SEQ ID NO: 263309 - DNA, 20 bp, Artificial Sequence
  chemically synthesized
ttctaatacttttaattgct

SEQ ID NO: 263310 - DNA, 20 bp, Artificial Sequence
  chemically synthesized
aggaaaagctcagcaattaa

SEQ ID NO: 263311 - DNA, 20 bp, Artificial Sequence
  chemically synthesized
agctcagcaattaaaagtat

SEQ ID NO: 263312 - DNA, 20 bp, Artificial Sequence
  chemically synthesized
aattaaaagtattagaaaat

SEQ ID NO: 263313 - DNA, 20 bp, Artificial Sequence
  chemically synthesized
ataatcactatttgcatgca

SEQ ID NO: 263314 - DNA, 20 bp, Artificial Sequence
  chemically synthesized
aaatcagccatgcatgcaaa

SEQ ID NO: 263315 - DNA, 20 bp, Artificial Sequence
  chemically synthesized
tgcaaatagtgattattgca

SEQ ID NO: 263316 - DNA, 20 bp, Artificial Sequence
  chemically synthesized
gcaaagcatatacaaaaaaa

SEQ ID NO: 263317 - DNA, 20 bp, Artificial Sequence
  chemically synthesized
cttgagactagacatgtgga

SEQ ID NO: 263318 - DNA, 20 bp, Artificial Sequence
  chemically synthesized
cacaaaactttccacatgtc

SEQ ID NO: 263319 - DNA, 20 bp, Artificial Sequence
  chemically synthesized
agttcttgagactagacatg

SEQ ID NO: 263320 - DNA, 20 bp, Artificial Sequence
  chemically synthesized
ctttccacatgtctagtctc

SEQ ID NO: 263321 - DNA, 20 bp, Artificial Sequence
  chemically synthesized
atctaggaagttcttgagac

SEQ ID NO: 263322 - DNA, 20 bp, Artificial Sequence
  chemically synthesized
ataatatctaggaagttctt

SEQ ID NO: 263323 - DNA, 20 bp, Artificial Sequence
  chemically synthesized
gtctagtctcaagaacttcc

SEQ ID NO: 263324 - DNA, 20 bp, Artificial Sequence
  chemically synthesized
tttctataataatatctagg

SEQ ID NO: 263325 - DNA, 20 bp, Artificial Sequence
  chemically synthesized
atttttctataataatatct

SEQ ID NO: 263326 - DNA, 20 bp, Artificial Sequence
  chemically synthesized
aatttttctataataatatc

SEQ ID NO: 263327 - DNA, 20 bp, Artificial Sequence
  chemically synthesized
gaacttcctagatattatta

SEQ ID NO: 263328 - DNA, 20 bp, Artificial Sequence
  chemically synthesized
gatattattatagaaaaatt

SEQ ID NO: 263329 - DNA, 20 bp, Artificial Sequence
  chemically synthesized
ctggtttgtgcaggaagagc

SEQ ID NO: 263330 - DNA, 20 bp, Artificial Sequence
  chemically synthesized
tctggtttgtgcaggaagag

SEQ ID NO: 263331 - DNA, 20 bp, Artificial Sequence
  chemically synthesized
tcatctggtttgtgcaggaa

SEQ ID NO: 263332 - DNA, 20 bp, Artificial Sequence
  chemically synthesized
actcatctggtttgtgcagg

SEQ ID NO: 263333 - DNA, 20 bp, Artificial Sequence
  chemically synthesized
gtgactcatctggtttgtgc

SEQ ID NO: 263334 - DNA, 20 bp, Artificial Sequence
  chemically synthesized
cctgctcttcctgcacaaac

SEQ ID NO: 263335 - DNA, 20 bp, Artificial Sequence
  chemically synthesized
ggtgactcatctggtttgtg

SEQ ID NO: 263336 - DNA, 20 bp, Artificial Sequence
  chemically synthesized
tcttcctgcacaaaccagat

SEQ ID NO: 263337 - DNA, 20 bp, Artificial Sequence
  chemically synthesized
aagtccccaggtgactcatc

SEQ ID NO: 263338 - DNA, 20 bp, Artificial Sequence
  chemically synthesized
cacaaaccagatgagtcacc

SEQ ID NO: 263339 - DNA, 20 bp, Artificial Sequence
  chemically synthesized
acaaaccagatgagtcacct

SEQ ID NO: 263340 - DNA, 20 bp, Artificial Sequence
  chemically synthesized
caaaccagatgagtcacctg

SEQ ID NO: 263341 - DNA, 20 bp, Artificial Sequence
  chemically synthesized
gtgtatggcttcaagtcccc

SEQ ID NO: 263342 - DNA, 20 bp, Artificial Sequence
  chemically synthesized
agtgtatggcttcaagtccc

SEQ ID NO: 263343 - DNA, 20 bp, Artificial Sequence
  chemically synthesized
atgagtcacctggggacttg

SEQ ID NO: 263344 - DNA, 20 bp, Artificial Sequence
  chemically synthesized
gcagtgtagtgtatggcttc

SEQ ID NO: 263345 - DNA, 20 bp, Artificial Sequence
  chemically synthesized
atattaagcagtgtagtgta

SEQ ID NO: 263346 - DNA, 20 bp, Artificial Sequence
  chemically synthesized
tactttcatattaagcagtg

SEQ ID NO: 263347 - DNA, 20 bp, Artificial Sequence
  chemically synthesized
actgctactttcatattaag

SEQ ID NO: 263348 - DNA, 20 bp, Artificial Sequence
  chemically synthesized
cactacactgcttaatatga

SEQ ID NO: 263349 - DNA, 20 bp, Artificial Sequence
  chemically synthesized
agaactgctactttcatatt

SEQ ID NO: 263350 - DNA, 20 bp, Artificial Sequence
  chemically synthesized
tacactgcttaatatgaaag

SEQ ID NO: 263351 - DNA, 20 bp, Artificial Sequence
  chemically synthesized
actgcttaatatgaaagtag

SEQ ID NO: 263352 - DNA, 20 bp, Artificial Sequence
  chemically synthesized
gaaagtagcagttcttattc

SEQ ID NO: 263353 - DNA, 20 bp, Artificial Sequence
  chemically synthesized
aaagtagcagttcttattca

SEQ ID NO: 263354 - DNA, 20 bp, Artificial Sequence
  chemically synthesized
aagtagcagttcttattcaa

SEQ ID NO: 263355 - DNA, 20 bp, Artificial Sequence
  chemically synthesized
taatcttagtgcccttgaat

SEQ ID NO: 263356 - DNA, 20 bp, Artificial Sequence
  chemically synthesized
agttcttattcaagggcact

SEQ ID NO: 263357 - DNA, 20 bp, Artificial Sequence
  chemically synthesized
ggaatcctaaaaaataatct

SEQ ID NO: 263358 - DNA, 20 bp, Artificial Sequence
  chemically synthesized
agggcactaagattattttt

SEQ ID NO: 263359 - DNA, 20 bp, Artificial Sequence
  chemically synthesized
gggcactaagattatttttt

SEQ ID NO: 263360 - DNA, 20 bp, Artificial Sequence
  chemically synthesized
aagtcaaatttcatttatgt

SEQ ID NO: 263361 - DNA, 20 bp, Artificial Sequence
  chemically synthesized
aaagtcaaatttcatttatg

SEQ ID NO: 263362 - DNA, 20 bp, Artificial Sequence
  chemically synthesized
ataaatgaaatttgactttg

SEQ ID NO: 263363 - DNA, 20 bp, Artificial Sequence
  chemically synthesized
atgaaatttgactttgtaga

SEQ ID NO: 263364 - DNA, 20 bp, Artificial Sequence
  chemically synthesized
actctttgcaactatctaca

SEQ ID NO: 263365 - DNA, 20 bp, Artificial Sequence
  chemically synthesized
tgactttgtagatagttgca

SEQ ID NO: 263366 - DNA, 20 bp, Artificial Sequence
  chemically synthesized
actttgtagatagttgcaaa

SEQ ID NO: 263367 - DNA, 20 bp, Artificial Sequence
  chemically synthesized
tgcaaagagtgactttctta

SEQ ID NO: 263368 - DNA, 20 bp, Artificial Sequence
  chemically synthesized
gcaaagagtgactttcttaa

SEQ ID NO: 263369 - DNA, 20 bp, Artificial Sequence
  chemically synthesized
actttattatgcctttaaga

SEQ ID NO: 263370 - DNA, 20 bp, Artificial Sequence
  chemically synthesized
taaaactttattatgccttt

SEQ ID NO: 263371 - DNA, 20 bp, Artificial Sequence
  chemically synthesized
actttcttaaaggcataata

SEQ ID NO: 263372 - DNA, 20 bp, Artificial Sequence
  chemically synthesized
aaagttttaaaaataaataa

SEQ ID NO: 263373 - DNA, 20 bp, Artificial Sequence
  chemically synthesized
taaaaataaataaaagaatc

SEQ ID NO: 263374 - DNA, 20 bp, Artificial Sequence
  chemically synthesized
aaaaataaataaaagaatct

SEQ ID NO: 263375 - DNA, 20 bp, Artificial Sequence
  chemically synthesized
aaaataaataaaagaatcta

SEQ ID NO: 263376 - DNA, 20 bp, Artificial Sequence
  chemically synthesized
gatacttgtttaataagccc

SEQ ID NO: 263377 - DNA, 20 bp, Artificial Sequence
  chemically synthesized
gaatctagggcttattaaac

SEQ ID NO: 263378 - DNA, 20 bp, Artificial Sequence
  chemically synthesized
taacctgatacttgtttaat

SEQ ID NO: 263379 - DNA, 20 bp, Artificial Sequence
  chemically synthesized
agggcttattaaacaagtat

SEQ ID NO: 263380 - DNA, 20 bp, Artificial Sequence
  chemically synthesized
gggcttattaaacaagtatc

SEQ ID NO: 263381 - DNA, 20 bp, Artificial Sequence
  chemically synthesized
gtatcaggttaccaaaaaat

SEQ ID NO: 263382 - DNA, 20 bp, Artificial Sequence
  chemically synthesized
ttgcattaggtccaattttt

SEQ ID NO: 263383 - DNA, 20 bp, Artificial Sequence
  chemically synthesized
caaaaaattggacctaatgc

SEQ ID NO: 263384 - DNA, 20 bp, Artificial Sequence
  chemically synthesized
taattgattttgcttgcatt

SEQ ID NO: 263385 - DNA, 20 bp, Artificial Sequence
  chemically synthesized
ttaattgattttgcttgcat

SEQ ID NO: 263386 - DNA, 20 bp, Artificial Sequence
  chemically synthesized
taatgcaagcaaaatcaatt

SEQ ID NO: 263387 - DNA, 20 bp, Artificial Sequence
  chemically synthesized
caagcaaaatcaattaagta

SEQ ID NO: 263388 - DNA, 20 bp, Artificial Sequence
  chemically synthesized
caaaatcaattaagtaaaga

SEQ ID NO: 263389 - DNA, 20 bp, Artificial Sequence
  chemically synthesized
aatcaattaagtaaagaaag

SEQ ID NO: 263390 - DNA, 20 bp, Artificial Sequence
  chemically synthesized
atcaattaagtaaagaaagc

SEQ ID NO: 263391 - DNA, 20 bp, Artificial Sequence
  chemically synthesized
agtaaagaaagcaggaataa

SEQ ID NO: 263392 - DNA, 20 bp, Artificial Sequence
  chemically synthesized
gcaggaataatggatacatg

SEQ ID NO: 263393 - DNA, 20 bp, Artificial Sequence
  chemically synthesized
aataatggatacatgtagat

SEQ ID NO: 263394 - DNA, 20 bp, Artificial Sequence
  chemically synthesized
tacatgtagatcggttattc

SEQ ID NO: 263395 - DNA, 20 bp, Artificial Sequence
  chemically synthesized
atgtagatcggttattctgg

SEQ ID NO: 263396 - DNA, 20 bp, Artificial Sequence
  chemically synthesized
agatcggttattctggcagt

SEQ ID NO: 263397 - DNA, 20 bp, Artificial Sequence
  chemically synthesized
gatcggttattctggcagtt

SEQ ID NO: 263398 - DNA, 20 bp, Artificial Sequence
  chemically synthesized
aaaaaaacctgcctaactgc

SEQ ID NO: 263399 - DNA, 20 bp, Artificial Sequence
  chemically synthesized
cggttattctggcagttagg

SEQ ID NO: 263400 - DNA, 20 bp, Artificial Sequence
  chemically synthesized
ggttattctggcagttaggc

SEQ ID NO: 263401 - DNA, 20 bp, Artificial Sequence
  chemically synthesized
ggcaggtttttttcaatata

SEQ ID NO: 263402 - DNA, 20 bp, Artificial Sequence
  chemically synthesized
aggtttttttcaatataaag

SEQ ID NO: 263403 - DNA, 20 bp, Artificial Sequence
  chemically synthesized
ctaatgtgctttatttttat

SEQ ID NO: 263404 - DNA, 20 bp, Artificial Sequence
  chemically synthesized
taaagtagctgataaaaata

SEQ ID NO: 263405 - DNA, 20 bp, Artificial Sequence
  chemically synthesized
ctgataaaaataaagcacat

SEQ ID NO: 263406 - DNA, 20 bp, Artificial Sequence
  chemically synthesized
cattagaaaattaaatgtat

SEQ ID NO: 263407 - DNA, 20 bp, Artificial Sequence
  chemically synthesized
gaaagatgggaatgcattca

SEQ ID NO: 263408 - DNA, 20 bp, Artificial Sequence
  chemically synthesized
ctaagtagtaattgaaagat

SEQ ID NO: 263409 - DNA, 20 bp, Artificial Sequence
  chemically synthesized
tctaagtagtaattgaaaga

SEQ ID NO: 263410 - DNA, 20 bp, Artificial Sequence
  chemically synthesized
tttttctaagtagtaattga

SEQ ID NO: 263411 - DNA, 20 bp, Artificial Sequence
  chemically synthesized
cccatctttcaattactact

SEQ ID NO: 263412 - DNA, 20 bp, Artificial Sequence
  chemically synthesized
taaagacatatttttctaag

SEQ ID NO: 263413 - DNA, 20 bp, Artificial Sequence
  chemically synthesized
ttttaaagacatatttttct

SEQ ID NO: 263414 - DNA, 20 bp, Artificial Sequence
  chemically synthesized
tagaaaaatatgtctttaaa

SEQ ID NO: 263415 - DNA, 20 bp, Artificial Sequence
  chemically synthesized
ttaaaagttatggcttttta

SEQ ID NO: 263416 - DNA, 20 bp, Artificial Sequence
  chemically synthesized
gatgtgttgcttaaaagtta

SEQ ID NO: 263417 - DNA, 20 bp, Artificial Sequence
  chemically synthesized
tttaaaaagccataactttt

SEQ ID NO: 263418 - DNA, 20 bp, Artificial Sequence
  chemically synthesized
ttgaacgatgtgttgcttaa

SEQ ID NO: 263419 - DNA, 20 bp, Artificial Sequence
  chemically synthesized
ctttatttaacatttttgag

SEQ ID NO: 263420 - DNA, 20 bp, Artificial Sequence
  chemically synthesized
atgctttatttaacattttt

SEQ ID NO: 263421 - DNA, 20 bp, Artificial Sequence
  chemically synthesized
ccactcaaaaatgttaaata

SEQ ID NO: 263422 - DNA, 20 bp, Artificial Sequence
  chemically synthesized
aataaagcatacacattgaa

SEQ ID NO: 263423 - DNA, 20 bp, Artificial Sequence
  chemically synthesized
gcatacacattgaacagaaa

SEQ ID NO: 263424 - DNA, 20 bp, Artificial Sequence
  chemically synthesized
acacattgaacagaaaaagt

SEQ ID NO: 263425 - DNA, 20 bp, Artificial Sequence
  chemically synthesized
aaagtgagtttctgatgact

SEQ ID NO: 263426 - DNA, 20 bp, Artificial Sequence
  chemically synthesized
tctgcttcagacttagtcat

SEQ ID NO: 263427 - DNA, 20 bp, Artificial Sequence
  chemically synthesized
gtttctgatgactaagtctg

SEQ ID NO: 263428 - DNA, 20 bp, Artificial Sequence
  chemically synthesized
aataaaatctgcttcagact

SEQ ID NO: 263429 - DNA, 20 bp, Artificial Sequence
  chemically synthesized
tctgatgactaagtctgaag

SEQ ID NO: 263430 - DNA, 20 bp, Artificial Sequence
  chemically synthesized
tgcattaataaaatctgctt

SEQ ID NO: 263431 - DNA, 20 bp, Artificial Sequence
  chemically synthesized
tggtttttttttaatatata

SEQ ID NO: 263432 - DNA, 20 bp, Artificial Sequence
  chemically synthesized
gtggtttttttttaatatat

SEQ ID NO: 263433 - DNA, 20 bp, Artificial Sequence
  chemically synthesized
tgtggtttttttttaatata

SEQ ID NO: 263434 - DNA, 20 bp, Artificial Sequence
  chemically synthesized
tatatattaaaaaaaaacca

SEQ ID NO: 263435 - DNA, 20 bp, Artificial Sequence
  chemically synthesized
atatattaaaaaaaaaccac

SEQ ID NO: 263436 - DNA, 20 bp, Artificial Sequence
  chemically synthesized
attaaaaaaaaaccacaggc

SEQ ID NO: 263437 - DNA, 20 bp, Artificial Sequence
  chemically synthesized
ttaaaaaaaaaccacaggca

SEQ ID NO: 263438 - DNA, 20 bp, Artificial Sequence
  chemically synthesized
attataatataccttgcctg

SEQ ID NO: 263439 - DNA, 20 bp, Artificial Sequence
  chemically synthesized
ggcaaggtatattataattt

SEQ ID NO: 263440 - DNA, 20 bp, Artificial Sequence
  chemically synthesized
ataatgctctcaaggtatta

SEQ ID NO: 263441 - DNA, 20 bp, Artificial Sequence
  chemically synthesized
aattttagctctaatacctt

SEQ ID NO: 263442 - DNA, 20 bp, Artificial Sequence
  chemically synthesized
acataatgctctcaaggtat

SEQ ID NO: 263443 - DNA, 20 bp, Artificial Sequence
  chemically synthesized
ttttagctctaataccttga

SEQ ID NO: 263444 - DNA, 20 bp, Artificial Sequence
  chemically synthesized
gacaaaacataatgctctca

SEQ ID NO: 263445 - DNA, 20 bp, Artificial Sequence
  chemically synthesized
agacaaaacataatgctctc

SEQ ID NO: 263446 - DNA, 20 bp, Artificial Sequence
  chemically synthesized
gcattatgttttgtctgtaa

SEQ ID NO: 263447 - DNA, 20 bp, Artificial Sequence
  chemically synthesized
agataaaacagcagctgtta

SEQ ID NO: 263448 - DNA, 20 bp, Artificial Sequence
  chemically synthesized
aggaaataaagataaaacag

SEQ ID NO: 263449 - DNA, 20 bp, Artificial Sequence
  chemically synthesized
gagaggaaataaagataaaa

SEQ ID NO: 263450 - DNA, 20 bp, Artificial Sequence
  chemically synthesized
agagaaagcgagaggaaata

SEQ ID NO: 263451 - DNA, 20 bp, Artificial Sequence
  chemically synthesized
cacagatgagagaaagcgag

SEQ ID NO: 263452 - DNA, 20 bp, Artificial Sequence
  chemically synthesized
tcacagatgagagaaagcga

SEQ ID NO: 263453 - DNA, 20 bp, Artificial Sequence
  chemically synthesized
aatcacagatgagagaaagc

SEQ ID NO: 263454 - DNA, 20 bp, Artificial Sequence
  chemically synthesized
aaagaatcacagatgagaga

SEQ ID NO: 263455 - DNA, 20 bp, Artificial Sequence
  chemically synthesized
caacaaagaatcacagatga

SEQ ID NO: 263456 - DNA, 20 bp, Artificial Sequence
  chemically synthesized
tacaacaaagaatcacagat

SEQ ID NO: 263457 - DNA, 20 bp, Artificial Sequence
  chemically synthesized
caacttacaacaaagaatca

SEQ ID NO: 263458 - DNA, 20 bp, Artificial Sequence
  chemically synthesized
catctgtgattctttgttgt

SEQ ID NO: 263459 - DNA, 20 bp, Artificial Sequence
  chemically synthesized
agaggagacaacttacaaca

SEQ ID NO: 263460 - DNA, 20 bp, Artificial Sequence
  chemically synthesized
aaaagaattgttgcaaagag

SEQ ID NO: 263461 - DNA, 20 bp, Artificial Sequence
  chemically synthesized
gtaaaagaattgttgcaaag

SEQ ID NO: 263462 - DNA, 20 bp, Artificial Sequence
  chemically synthesized
tgtaaaagaattgttgcaaa

SEQ ID NO: 263463 - DNA, 20 bp, Artificial Sequence
  chemically synthesized
actgtaaaagaattgttgca

SEQ ID NO: 263464 - DNA, 20 bp, Artificial Sequence
  chemically synthesized
tctttgcaacaattctttta

SEQ ID NO: 263465 - DNA, 20 bp, Artificial Sequence
  chemically synthesized
agacaatgagggtactgtaa

SEQ ID NO: 263466 - DNA, 20 bp, Artificial Sequence
  chemically synthesized
gatcagaatgaagacaatga

SEQ ID NO: 263467 - DNA, 20 bp, Artificial Sequence
  chemically synthesized
tgatcagaatgaagacaatg

SEQ ID NO: 263468 - DNA, 20 bp, Artificial Sequence
  chemically synthesized
ttgatcagaatgaagacaat

SEQ ID NO: 263469 - DNA, 20 bp, Artificial Sequence
  chemically synthesized
tgttgtttttgatcagaatg

SEQ ID NO: 263470 - DNA, 20 bp, Artificial Sequence
  chemically synthesized
ctgtacttgttgtttttgat

SEQ ID NO: 263471 - DNA, 20 bp, Artificial Sequence
  chemically synthesized
tcattctgatcaaaaacaac

SEQ ID NO: 263472 - DNA, 20 bp, Artificial Sequence
  chemically synthesized
ctgatcaaaaacaacaagta

SEQ ID NO: 263473 - DNA, 20 bp, Artificial Sequence
  chemically synthesized
aacaagtacagtcttcattt

SEQ ID NO: 263474 - DNA, 20 bp, Artificial Sequence
  chemically synthesized
gctttttaaaaaccaaaatg

SEQ ID NO: 263475 - DNA, 20 bp, Artificial Sequence
  chemically synthesized
tcttcattttggtttttaaa

SEQ ID NO: 263476 - DNA, 20 bp, Artificial Sequence
  chemically synthesized
ttatctctgttaacaatgta

SEQ ID NO: 263477 - DNA, 20 bp, Artificial Sequence
  chemically synthesized
aaaaagctgtacattgttaa

SEQ ID NO: 263478 - DNA, 20 bp, Artificial Sequence
  chemically synthesized
aaagctgtacattgttaaca

SEQ ID NO: 263479 - DNA, 20 bp, Artificial Sequence
  chemically synthesized
acattgttaacagagataat

SEQ ID NO: 263480 - DNA, 20 bp, Artificial Sequence
  chemically synthesized
attccatgaaagttttaaat

SEQ ID NO: 263481 - DNA, 20 bp, Artificial Sequence
  chemically synthesized
aatccaatttaaaactttca

SEQ ID NO: 263482 - DNA, 20 bp, Artificial Sequence
  chemically synthesized
cttataatagcattccatga

SEQ ID NO: 263483 - DNA, 20 bp, Artificial Sequence
  chemically synthesized
ctttcatggaatgctattat

SEQ ID NO: 263484 - DNA, 20 bp, Artificial Sequence
  chemically synthesized
atgagcacagtatcttataa

SEQ ID NO: 263485 - DNA, 20 bp, Artificial Sequence
  chemically synthesized
attataagatactgtgctca

SEQ ID NO: 263486 - DNA, 20 bp, Artificial Sequence
  chemically synthesized
taaaagaaaggctatgagca

SEQ ID NO: 263487 - DNA, 20 bp, Artificial Sequence
  chemically synthesized
aaatgtaaaagaaaggctat

SEQ ID NO: 263488 - DNA, 20 bp, Artificial Sequence
  chemically synthesized
aagtaccaaatgtaaaagaa

SEQ ID NO: 263489 - DNA, 20 bp, Artificial Sequence
  chemically synthesized
caagtaccaaatgtaaaaga

SEQ ID NO: 263490 - DNA, 20 bp, Artificial Sequence
  chemically synthesized
catagcctttcttttacatt

SEQ ID NO: 263491 - DNA, 20 bp, Artificial Sequence
  chemically synthesized
acctcaagtaccaaatgtaa

SEQ ID NO: 263492 - DNA, 20 bp, Artificial Sequence
  chemically synthesized
ttcttttacatttggtactt

SEQ ID NO: 263493 - DNA, 20 bp, Artificial Sequence
  chemically synthesized
tcttttacatttggtacttg

SEQ ID NO: 263494 - DNA, 20 bp, Artificial Sequence
  chemically synthesized
gaaacttattttgaaacctc

SEQ ID NO: 263495 - DNA, 20 bp, Artificial Sequence
  chemically synthesized
ggtacttgaggtttcaaaat

SEQ ID NO: 263496 - DNA, 20 bp, Artificial Sequence
  chemically synthesized
aaaataagtttcctcccatc

SEQ ID NO: 263497 - DNA, 20 bp, Artificial Sequence
  chemically synthesized
gttctttacaactagatggg

SEQ ID NO: 263498 - DNA, 20 bp, Artificial Sequence
  chemically synthesized
tgttctttacaactagatgg

SEQ ID NO: 263499 - DNA, 20 bp, Artificial Sequence
  chemically synthesized
tgtgttctttacaactagat

SEQ ID NO: 263500 - DNA, 20 bp, Artificial Sequence
  chemically synthesized
atgtgttctttacaactaga

SEQ ID NO: 263501 - DNA, 20 bp, Artificial Sequence
  chemically synthesized
tttcctcccatctagttgta

SEQ ID NO: 263502 - DNA, 20 bp, Artificial Sequence
  chemically synthesized
aaaaatgtgttctttacaac

SEQ ID NO: 263503 - DNA, 20 bp, Artificial Sequence
  chemically synthesized
agttgtaaagaacacatttt

SEQ ID NO: 263504 - DNA, 20 bp, Artificial Sequence
  chemically synthesized
gttgtaaagaacacattttt

SEQ ID NO: 263505 - DNA, 20 bp, Artificial Sequence
  chemically synthesized
ttgtaaagaacacattttta

SEQ ID NO: 263506 - DNA, 20 bp, Artificial Sequence
  chemically synthesized
tgtaaagaacacatttttag

SEQ ID NO: 263507 - DNA, 20 bp, Artificial Sequence
  chemically synthesized
cacatttttaggggcacctg

SEQ ID NO: 263508 - DNA, 20 bp, Artificial Sequence
  chemically synthesized
tttttaggggcacctgtaga

SEQ ID NO: 263509 - DNA, 20 bp, Artificial Sequence
  chemically synthesized
acactcccccatctttctac

SEQ ID NO: 263510 - DNA, 20 bp, Artificial Sequence
  chemically synthesized
cacactcccccatctttcta

SEQ ID NO: 263511 - DNA, 20 bp, Artificial Sequence
  chemically synthesized
taggggcacctgtagaaaga

SEQ ID NO: 263512 - DNA, 20 bp, Artificial Sequence
  chemically synthesized
aggggcacctgtagaaagat

SEQ ID NO: 263513 - DNA, 20 bp, Artificial Sequence
  chemically synthesized
ggggcacctgtagaaagatg

SEQ ID NO: 263514 - DNA, 20 bp, Artificial Sequence
  chemically synthesized
gggcacctgtagaaagatgg

SEQ ID NO: 263515 - DNA, 20 bp, Artificial Sequence
  chemically synthesized
gcacctgtagaaagatgggg

SEQ ID NO: 263516 - DNA, 20 bp, Artificial Sequence
  chemically synthesized
tgtagaaagatgggggagtg

SEQ ID NO: 263517 - DNA, 20 bp, Artificial Sequence
  chemically synthesized
atgacttgtctgacatgatg

SEQ ID NO: 263518 - DNA, 20 bp, Artificial Sequence
  chemically synthesized
agtgtggtacttcatcatgt

SEQ ID NO: 263519 - DNA, 20 bp, Artificial Sequence
  chemically synthesized
ggtacttcatcatgtcagac

SEQ ID NO: 263520 - DNA, 20 bp, Artificial Sequence
  chemically synthesized
caagtcatgaattactgtga

SEQ ID NO: 263521 - DNA, 20 bp, Artificial Sequence
  chemically synthesized
aagccaaaagaatactttca

SEQ ID NO: 263522 - DNA, 20 bp, Artificial Sequence
  chemically synthesized
ttactgtgaaagtattcttt

SEQ ID NO: 263523 - DNA, 20 bp, Artificial Sequence
  chemically synthesized
aactacactaaaaaagccaa

SEQ ID NO: 263524 - DNA, 20 bp, Artificial Sequence
  chemically synthesized
aagtattcttttggcttttt

SEQ ID NO: 263525 - DNA, 20 bp, Artificial Sequence
  chemically synthesized
tttctagaactacactaaaa

SEQ ID NO: 263526 - DNA, 20 bp, Artificial Sequence
  chemically synthesized
ttcttttggcttttttagtg

SEQ ID NO: 263527 - DNA, 20 bp, Artificial Sequence
  chemically synthesized
tggcttttttagtgtagttc

SEQ ID NO: 263528 - DNA, 20 bp, Artificial Sequence
  chemically synthesized
ttctctaatgttttaatttc

SEQ ID NO: 263529 - DNA, 20 bp, Artificial Sequence
  chemically synthesized
agttctagaaattaaaacat

SEQ ID NO: 263530 - DNA, 20 bp, Artificial Sequence
  chemically synthesized
ttctagaaattaaaacatta

SEQ ID NO: 263531 - DNA, 20 bp, Artificial Sequence
  chemically synthesized
aattaaaacattagagaaat

SEQ ID NO: 263532 - DNA, 20 bp, Artificial Sequence
  chemically synthesized
aacattagagaaatgagcta

SEQ ID NO: 263533 - DNA, 20 bp, Artificial Sequence
  chemically synthesized
aacattataaatgataactt

SEQ ID NO: 263534 - DNA, 20 bp, Artificial Sequence
  chemically synthesized
ataatgttaactgatccata

SEQ ID NO: 263535 - DNA, 20 bp, Artificial Sequence
  chemically synthesized
atctgtattcctttatggat

SEQ ID NO: 263536 - DNA, 20 bp, Artificial Sequence
  chemically synthesized
taatgttaactgatccataa

SEQ ID NO: 263537 - DNA, 20 bp, Artificial Sequence
  chemically synthesized
tacacatctgtattccttta

SEQ ID NO: 263538 - DNA, 20 bp, Artificial Sequence
  chemically synthesized
aactgatccataaaggaata

SEQ ID NO: 263539 - DNA, 20 bp, Artificial Sequence
  chemically synthesized
acagatgtgtatttgtgact

SEQ ID NO: 263540 - DNA, 20 bp, Artificial Sequence
  chemically synthesized
tgtatttgtgactgagataa

SEQ ID NO: 263541 - DNA, 20 bp, Artificial Sequence
  chemically synthesized
tttcagatttgctgttatct

SEQ ID NO: 263542 - DNA, 20 bp, Artificial Sequence
  chemically synthesized
tagttgtgtgttaatatttt

SEQ ID NO: 263543 - DNA, 20 bp, Artificial Sequence
  chemically synthesized
taaatcaaaatattttcatg

SEQ ID NO: 263544 - DNA, 20 bp, Artificial Sequence
  chemically synthesized
aggagttattagataggaat

SEQ ID NO: 263545 - DNA, 20 bp, Artificial Sequence
  chemically synthesized
tgaagcaggagttattagat

SEQ ID NO: 263546 - DNA, 20 bp, Artificial Sequence
  chemically synthesized
atgaagcaggagttattaga

SEQ ID NO: 263547 - DNA, 20 bp, Artificial Sequence
  chemically synthesized
agaaatgaagcaggagttat

SEQ ID NO: 263548 - DNA, 20 bp, Artificial Sequence
  chemically synthesized
aggtttcagaaatgaagcag

SEQ ID NO: 263549 - DNA, 20 bp, Artificial Sequence
  chemically synthesized
ttaggtttcagaaatgaagc

SEQ ID NO: 263550 - DNA, 20 bp, Artificial Sequence
  chemically synthesized
tttaggtttcagaaatgaag

SEQ ID NO: 263551 - DNA, 20 bp, Artificial Sequence
  chemically synthesized
gcatttaggtttcagaaatg

SEQ ID NO: 263552 - DNA, 20 bp, Artificial Sequence
  chemically synthesized
aatattgagcatttaggttt

SEQ ID NO: 263553 - DNA, 20 bp, Artificial Sequence
  chemically synthesized
cctattaatattgagcattt

SEQ ID NO: 263554 - DNA, 20 bp, Artificial Sequence
  chemically synthesized
tcctattaatattgagcatt

SEQ ID NO: 263555 - DNA, 20 bp, Artificial Sequence
  chemically synthesized
atatttctcctattaatatt

SEQ ID NO: 263556 - DNA, 20 bp, Artificial Sequence
  chemically synthesized
acctaaatgctcaatattaa

SEQ ID NO: 263557 - DNA, 20 bp, Artificial Sequence
  chemically synthesized
cctaaatgctcaatattaat

SEQ ID NO: 263558 - DNA, 20 bp, Artificial Sequence
  chemically synthesized
taaatgctcaatattaatag

SEQ ID NO: 263559 - DNA, 20 bp, Artificial Sequence
  chemically synthesized
aatattaataggagaaatat

SEQ ID NO: 263560 - DNA, 20 bp, Artificial Sequence
  chemically synthesized
atattaataggagaaatatc

SEQ ID NO: 263561 - DNA, 20 bp, Artificial Sequence
  chemically synthesized
attaataaaaatcatgtgct

SEQ ID NO: 263562 - DNA, 20 bp, Artificial Sequence
  chemically synthesized
gaaattatttgatggtaact

SEQ ID NO: 263563 - DNA, 20 bp, Artificial Sequence
  chemically synthesized
atattttagaaattatttga

SEQ ID NO: 263564 - DNA, 20 bp, Artificial Sequence
  chemically synthesized
catgcatatatgacatattt

SEQ ID NO: 263565 - DNA, 20 bp, Artificial Sequence
  chemically synthesized
gatcaaataatactaaaata

SEQ ID NO: 263566 - DNA, 20 bp, Artificial Sequence
  chemically synthesized
ccattttccagtccatattt

SEQ ID NO: 263567 - DNA, 20 bp, Artificial Sequence
  chemically synthesized
aataatactaaaatatggac

SEQ ID NO: 263568 - DNA, 20 bp, Artificial Sequence
  chemically synthesized
ctaaaatatggactggaaaa

SEQ ID NO: 263569 - DNA, 20 bp, Artificial Sequence
  chemically synthesized
aaatgtttaaagccattttc

SEQ ID NO: 263570 - DNA, 20 bp, Artificial Sequence
  chemically synthesized
atacccattgaaaatgttta

SEQ ID NO: 263571 - DNA, 20 bp, Artificial Sequence
  chemically synthesized
atggctttaaacattttcaa

SEQ ID NO: 263572 - DNA, 20 bp, Artificial Sequence
  chemically synthesized
tggctttaaacattttcaat

SEQ ID NO: 263573 - DNA, 20 bp, Artificial Sequence
  chemically synthesized
caatgggtattttgttcctt

SEQ ID NO: 263574 - DNA, 20 bp, Artificial Sequence
  chemically synthesized
aatgggtattttgttccttt

SEQ ID NO: 263575 - DNA, 20 bp, Artificial Sequence
  chemically synthesized
atattgttcttgcagcctaa

SEQ ID NO: 263576 - DNA, 20 bp, Artificial Sequence
  chemically synthesized
gatattgttcttgcagccta

SEQ ID NO: 263577 - DNA, 20 bp, Artificial Sequence
  chemically synthesized
attttgttcctttaggctgc

SEQ ID NO: 263578 - DNA, 20 bp, Artificial Sequence
  chemically synthesized
aaattaagatattgttcttg

SEQ ID NO: 263579 - DNA, 20 bp, Artificial Sequence
  chemically synthesized
atttctaagtaaagaaaatt

SEQ ID NO: 263580 - DNA, 20 bp, Artificial Sequence
  chemically synthesized
atatcttaattttctttact

SEQ ID NO: 263581 - DNA, 20 bp, Artificial Sequence
  chemically synthesized
aaacattttatttctaagta

SEQ ID NO: 263582 - DNA, 20 bp, Artificial Sequence
  chemically synthesized
attcaaaacattttatttct

SEQ ID NO: 263583 - DNA, 20 bp, Artificial Sequence
  chemically synthesized
aaaatgttttgaataaatgc

SEQ ID NO: 263584 - DNA, 20 bp, Artificial Sequence
  chemically synthesized
tatatgcgactatattagac

SEQ ID NO: 263585 - DNA, 20 bp, Artificial Sequence
  chemically synthesized
gaataaatgctggtctaata

SEQ ID NO: 263586 - DNA, 20 bp, Artificial Sequence
  chemically synthesized
ggtcatatatgcgactatat

SEQ ID NO: 263587 - DNA, 20 bp, Artificial Sequence
  chemically synthesized
actaaaggtgaaaaatcaca

SEQ ID NO: 263588 - DNA, 20 bp, Artificial Sequence
  chemically synthesized
accatgtgatttttcacctt

SEQ ID NO: 263589 - DNA, 20 bp, Artificial Sequence
  chemically synthesized
gttgaaagaaagaaaactaa

SEQ ID NO: 263590 - DNA, 20 bp, Artificial Sequence
  chemically synthesized
agttgaaagaaagaaaacta

SEQ ID NO: 263591 - DNA, 20 bp, Artificial Sequence
  chemically synthesized
tcacattctgagttgaaaga

SEQ ID NO: 263592 - DNA, 20 bp, Artificial Sequence
  chemically synthesized
tagttttctttctttcaact

SEQ ID NO: 263593 - DNA, 20 bp, Artificial Sequence
  chemically synthesized
gttttcacattctgagttga

SEQ ID NO: 263594 - DNA, 20 bp, Artificial Sequence
  chemically synthesized
atacaaagttttcacattct

SEQ ID NO: 263595 - DNA, 20 bp, Artificial Sequence
  chemically synthesized
gaatgtgaaaactttgtatc

SEQ ID NO: 263596 - DNA, 20 bp, Artificial Sequence
  chemically synthesized
atgtgagactacttgataca

SEQ ID NO: 263597 - DNA, 20 bp, Artificial Sequence
  chemically synthesized
tgtgaaaactttgtatcaag

SEQ ID NO: 263598 - DNA, 20 bp, Artificial Sequence
  chemically synthesized
cttgagtaccattacaatgt

SEQ ID NO: 263599 - DNA, 20 bp, Artificial Sequence
  chemically synthesized
caagtagtctcacattgtaa

SEQ ID NO: 263600 - DNA, 20 bp, Artificial Sequence
  chemically synthesized
ctcacattgtaatggtactc

SEQ ID NO: 263601 - DNA, 20 bp, Artificial Sequence
  chemically synthesized
tcacattgtaatggtactca

SEQ ID NO: 263602 - DNA, 20 bp, Artificial Sequence
  chemically synthesized
ttatgtcatcagtgtacctt

SEQ ID NO: 263603 - DNA, 20 bp, Artificial Sequence
  chemically synthesized
tcaaggtacactgatgacat

SEQ ID NO: 263604 - DNA, 20 bp, Artificial Sequence
  chemically synthesized
atttgttttccttatgtcat

SEQ ID NO: 263605 - DNA, 20 bp, Artificial Sequence
  chemically synthesized
caaggtacactgatgacata

SEQ ID NO: 263606 - DNA, 20 bp, Artificial Sequence
  chemically synthesized
aaacaaataataaatttcaa

SEQ ID NO: 263607 - DNA, 20 bp, Artificial Sequence
  chemically synthesized
taataaatttcaaaagtcac

SEQ ID NO: 263608 - DNA, 20 bp, Artificial Sequence
  chemically synthesized
gtatgtgtgtattacaattc

SEQ ID NO: 263609 - DNA, 20 bp, Artificial Sequence
  chemically synthesized
tatgtgtgtattacaattca

SEQ ID NO: 263610 - DNA, 20 bp, Artificial Sequence
  chemically synthesized
tgtattacaattcaaggaat

SEQ ID NO: 263611 - DNA, 20 bp, Artificial Sequence
  chemically synthesized
gtgttgaagtttatgcatta

SEQ ID NO: 263612 - DNA, 20 bp, Artificial Sequence
  chemically synthesized
cagtcctcagttgcgtgttg

SEQ ID NO: 263613 - DNA, 20 bp, Artificial Sequence
  chemically synthesized
ataaacttcaacacgcaact

SEQ ID NO: 263614 - DNA, 20 bp, Artificial Sequence
  chemically synthesized
taaacttcaacacgcaactg

SEQ ID NO: 263615 - DNA, 20 bp, Artificial Sequence
  chemically synthesized
atacaaaatgaatcagtcct

SEQ ID NO: 263616 - DNA, 20 bp, Artificial Sequence
  chemically synthesized
ttcccccatacaaaatgaat

SEQ ID NO: 263617 - DNA, 20 bp, Artificial Sequence
  chemically synthesized
gaggactgattcattttgta

SEQ ID NO: 263618 - DNA, 20 bp, Artificial Sequence
  chemically synthesized
aggactgattcattttgtat

SEQ ID NO: 263619 - DNA, 20 bp, Artificial Sequence
  chemically synthesized
ggactgattcattttgtatg

SEQ ID NO: 263620 - DNA, 20 bp, Artificial Sequence
  chemically synthesized
gactgattcattttgtatgg

SEQ ID NO: 263621 - DNA, 20 bp, Artificial Sequence
  chemically synthesized
gattcattttgtatggggga

SEQ ID NO: 263622 - DNA, 20 bp, Artificial Sequence
  chemically synthesized
attcattttgtatgggggaa

SEQ ID NO: 263623 - DNA, 20 bp, Artificial Sequence
  chemically synthesized
ttcattttgtatgggggaaa

SEQ ID NO: 263624 - DNA, 20 bp, Artificial Sequence
  chemically synthesized
gggaaagggattatttttgt

SEQ ID NO: 263625 - DNA, 20 bp, Artificial Sequence
  chemically synthesized
gaaagggattatttttgtca

SEQ ID NO: 263626 - DNA, 20 bp, Artificial Sequence
  chemically synthesized
ggattatttttgtcagagac

SEQ ID NO: 263627 - DNA, 20 bp, Artificial Sequence
  chemically synthesized
tgtttctttagattattgac

SEQ ID NO: 263628 - DNA, 20 bp, Artificial Sequence
  chemically synthesized
agagactggtcaataatcta

SEQ ID NO: 263629 - DNA, 20 bp, Artificial Sequence
  chemically synthesized
tattatgccgtatgtttctt

SEQ ID NO: 263630 - DNA, 20 bp, Artificial Sequence
  chemically synthesized
caataatctaaagaaacata

SEQ ID NO: 263631 - DNA, 20 bp, Artificial Sequence
  chemically synthesized
aagaaacatacggcataata

SEQ ID NO: 263632 - DNA, 20 bp, Artificial Sequence
  chemically synthesized
tgatgtgtctatattatgat

SEQ ID NO: 263633 - DNA, 20 bp, Artificial Sequence
  chemically synthesized
attatatacttatcataata

SEQ ID NO: 263634 - DNA, 20 bp, Artificial Sequence
  chemically synthesized
atagacacatcatatactta

SEQ ID NO: 263635 - DNA, 20 bp, Artificial Sequence
  chemically synthesized
taaagtcttttacagactat

SEQ ID NO: 263636 - DNA, 20 bp, Artificial Sequence
  chemically synthesized
catatacttatagtctgtaa

SEQ ID NO: 263637 - DNA, 20 bp, Artificial Sequence
  chemically synthesized
aaaataagtaaagtctttta

SEQ ID NO: 263638 - DNA, 20 bp, Artificial Sequence
  chemically synthesized
aacaccttttaaaataagta

SEQ ID NO: 263639 - DNA, 20 bp, Artificial Sequence
  chemically synthesized
aaagactttacttattttaa

SEQ ID NO: 263640 - DNA, 20 bp, Artificial Sequence
  chemically synthesized
tttacaacaccttttaaaat

SEQ ID NO: 263641 - DNA, 20 bp, Artificial Sequence
  chemically synthesized
aagactttacttattttaaa

SEQ ID NO: 263642 - DNA, 20 bp, Artificial Sequence
  chemically synthesized
tattttaaaaggtgttgtaa

SEQ ID NO: 263643 - DNA, 20 bp, Artificial Sequence
  chemically synthesized
aaaggtgttgtaaaagtctg

SEQ ID NO: 263644 - DNA, 20 bp, Artificial Sequence
  chemically synthesized
ctcagccctagaaaatgcta

SEQ ID NO: 263645 - DNA, 20 bp, Artificial Sequence
  chemically synthesized
taaaagtctgtagcattttc

SEQ ID NO: 263646 - DNA, 20 bp, Artificial Sequence
  chemically synthesized
aaaagtctgtagcattttct

SEQ ID NO: 263647 - DNA, 20 bp, Artificial Sequence
  chemically synthesized
aaagtctgtagcattttcta

SEQ ID NO: 263648 - DNA, 20 bp, Artificial Sequence
  chemically synthesized
ctgtagcattttctagggct

SEQ ID NO: 263649 - DNA, 20 bp, Artificial Sequence
  chemically synthesized
tgtagcattttctagggctg

SEQ ID NO: 263650 - DNA, 20 bp, Artificial Sequence
  chemically synthesized
gttgtttttgtcctcagccc

SEQ ID NO: 263651 - DNA, 20 bp, Artificial Sequence
  chemically synthesized
ttttttgttgtttttgtcct

SEQ ID NO: 263652 - DNA, 20 bp, Artificial Sequence
  chemically synthesized
tatagggaaagaagtgaagt

SEQ ID NO: 263653 - DNA, 20 bp, Artificial Sequence
  chemically synthesized
gtatagggaaagaagtgaag

SEQ ID NO: 263654 - DNA, 20 bp, Artificial Sequence
  chemically synthesized
ctggtatagggaaagaagtg

SEQ ID NO: 263655 - DNA, 20 bp, Artificial Sequence
  chemically synthesized
ctcaactggtatagggaaag

SEQ ID NO: 263656 - DNA, 20 bp, Artificial Sequence
  chemically synthesized
gccctcaactggtataggga

SEQ ID NO: 263657 - DNA, 20 bp, Artificial Sequence
  chemically synthesized
cttcacttctttccctatac

SEQ ID NO: 263658 - DNA, 20 bp, Artificial Sequence
  chemically synthesized
tagagccctcaactggtata

SEQ ID NO: 263659 - DNA, 20 bp, Artificial Sequence
  chemically synthesized
ctagagccctcaactggtat

SEQ ID NO: 263660 - DNA, 20 bp, Artificial Sequence
  chemically synthesized
cctagagccctcaactggta

SEQ ID NO: 263661 - DNA, 20 bp, Artificial Sequence
  chemically synthesized
cttctttccctataccagtt

SEQ ID NO: 263662 - DNA, 20 bp, Artificial Sequence
  chemically synthesized
ttctttccctataccagttg

SEQ ID NO: 263663 - DNA, 20 bp, Artificial Sequence
  chemically synthesized
tctttccctataccagttga

SEQ ID NO: 263664 - DNA, 20 bp, Artificial Sequence
  chemically synthesized
tctgccctagagccctcaac

SEQ ID NO: 263665 - DNA, 20 bp, Artificial Sequence
  chemically synthesized
cctataccagttgagggctc

SEQ ID NO: 263666 - DNA, 20 bp, Artificial Sequence
  chemically synthesized
ctataccagttgagggctct

SEQ ID NO: 263667 - DNA, 20 bp, Artificial Sequence
  chemically synthesized
tataccagttgagggctcta

SEQ ID NO: 263668 - DNA, 20 bp, Artificial Sequence
  chemically synthesized
accagttgagggctctaggg

SEQ ID NO: 263669 - DNA, 20 bp, Artificial Sequence
  chemically synthesized
cagttgagggctctagggca

SEQ ID NO: 263670 - DNA, 20 bp, Artificial Sequence
  chemically synthesized
ctgaccccaactctgcccta

SEQ ID NO: 263671 - DNA, 20 bp, Artificial Sequence
  chemically synthesized
ggctgaccccaactctgccc

SEQ ID NO: 263672 - DNA, 20 bp, Artificial Sequence
  chemically synthesized
tgagggctctagggcagagt

SEQ ID NO: 263673 - DNA, 20 bp, Artificial Sequence
  chemically synthesized
gagggctctagggcagagtt

SEQ ID NO: 263674 - DNA, 20 bp, Artificial Sequence
  chemically synthesized
agggctctagggcagagttg

SEQ ID NO: 263675 - DNA, 20 bp, Artificial Sequence
  chemically synthesized
ctctagggcagagttggggt

SEQ ID NO: 263676 - DNA, 20 bp, Artificial Sequence
  chemically synthesized
ggcagagttggggtcagccc

SEQ ID NO: 263677 - DNA, 20 bp, Artificial Sequence
  chemically synthesized
cagagttggggtcagcccaa

SEQ ID NO: 263678 - DNA, 20 bp, Artificial Sequence
  chemically synthesized
agagttggggtcagcccaag

SEQ ID NO: 263679 - DNA, 20 bp, Artificial Sequence
  chemically synthesized
aaaagtactgattacctctt

SEQ ID NO: 263680 - DNA, 20 bp, Artificial Sequence
  chemically synthesized
aaaaagtactgattacctct

SEQ ID NO: 263681 - DNA, 20 bp, Artificial Sequence
  chemically synthesized
gggtcagcccaagaggtaat

SEQ ID NO: 263682 - DNA, 20 bp, Artificial Sequence
  chemically synthesized
gagggcaccaagatgaaaaa

SEQ ID NO: 263683 - DNA, 20 bp, Artificial Sequence
  chemically synthesized
atcagtactttttttcatct

SEQ ID NO: 263684 - DNA, 20 bp, Artificial Sequence
  chemically synthesized
agaagaaactagagggcacc

SEQ ID NO: 263685 - DNA, 20 bp, Artificial Sequence
  chemically synthesized
tttttcatcttggtgccctc

SEQ ID NO: 263686 - DNA, 20 bp, Artificial Sequence
  chemically synthesized
aggtcaaagaagaaactaga

SEQ ID NO: 263687 - DNA, 20 bp, Artificial Sequence
  chemically synthesized
caggtcaaagaagaaactag

SEQ ID NO: 263688 - DNA, 20 bp, Artificial Sequence
  chemically synthesized
tcaggtcaaagaagaaacta

SEQ ID NO: 263689 - DNA, 20 bp, Artificial Sequence
  chemically synthesized
cttcaggtcaaagaagaaac

SEQ ID NO: 263690 - DNA, 20 bp, Artificial Sequence
  chemically synthesized
atctctacttcaggtcaaag

SEQ ID NO: 263691 - DNA, 20 bp, Artificial Sequence
  chemically synthesized
ctagtttcttctttgacctg

SEQ ID NO: 263692 - DNA, 20 bp, Artificial Sequence
  chemically synthesized
gcaatctctacttcaggtca

SEQ ID NO: 263693 - DNA, 20 bp, Artificial Sequence
  chemically synthesized
gtttcttctttgacctgaag

SEQ ID NO: 263694 - DNA, 20 bp, Artificial Sequence
  chemically synthesized
ttcttctttgacctgaagta

SEQ ID NO: 263695 - DNA, 20 bp, Artificial Sequence
  chemically synthesized
gttacagcaatctctacttc

SEQ ID NO: 263696 - DNA, 20 bp, Artificial Sequence
  chemically synthesized
agttacagcaatctctactt

SEQ ID NO: 263697 - DNA, 20 bp, Artificial Sequence
  chemically synthesized
aagtagagattgctgtaact

SEQ ID NO: 263698 - DNA, 20 bp, Artificial Sequence
  chemically synthesized
ctttccaagttgctgagtta

SEQ ID NO: 263699 - DNA, 20 bp, Artificial Sequence
  chemically synthesized
attgctgtaactcagcaact

SEQ ID NO: 263700 - DNA, 20 bp, Artificial Sequence
  chemically synthesized
aagaggctttccaagttgct

SEQ ID NO: 263701 - DNA, 20 bp, Artificial Sequence
  chemically synthesized
ctgtaactcagcaacttgga

SEQ ID NO: 263702 - DNA, 20 bp, Artificial Sequence
  chemically synthesized
aaagacggaagaggctttcc

SEQ ID NO: 263703 - DNA, 20 bp, Artificial Sequence
  chemically synthesized
agcttgtggaaagacggaag

SEQ ID NO: 263704 - DNA, 20 bp, Artificial Sequence
  chemically synthesized
cagcttgtggaaagacggaa

SEQ ID NO: 263705 - DNA, 20 bp, Artificial Sequence
  chemically synthesized
ctcagcttgtggaaagacgg

SEQ ID NO: 263706 - DNA, 20 bp, Artificial Sequence
  chemically synthesized
caactcagcttgtggaaaga

SEQ ID NO: 263707 - DNA, 20 bp, Artificial Sequence
  chemically synthesized
agcctcttccgtctttccac

SEQ ID NO: 263708 - DNA, 20 bp, Artificial Sequence
  chemically synthesized
ttgccaactcagcttgtgga

SEQ ID NO: 263709 - DNA, 20 bp, Artificial Sequence
  chemically synthesized
cttccgtctttccacaagct

SEQ ID NO: 263710 - DNA, 20 bp, Artificial Sequence
  chemically synthesized
ggccttgccaactcagcttg

SEQ ID NO: 263711 - DNA, 20 bp, Artificial Sequence
  chemically synthesized
cgtctttccacaagctgagt

SEQ ID NO: 263712 - DNA, 20 bp, Artificial Sequence
  chemically synthesized
tttccacaagctgagttggc

SEQ ID NO: 263713 - DNA, 20 bp, Artificial Sequence
  chemically synthesized
gtttggtggccttgccaact

SEQ ID NO: 263714 - DNA, 20 bp, Artificial Sequence
  chemically synthesized
ttccacaagctgagttggca

SEQ ID NO: 263715 - DNA, 20 bp, Artificial Sequence
  chemically synthesized
tccccatgtatggggtttgg

SEQ ID NO: 263716 - DNA, 20 bp, Artificial Sequence
  chemically synthesized
tactccccatgtatggggtt

SEQ ID NO: 263717 - DNA, 20 bp, Artificial Sequence
  chemically synthesized
aggccaccaaaccccataca

SEQ ID NO: 263718 - DNA, 20 bp, Artificial Sequence
  chemically synthesized
ggccaccaaaccccatacat

SEQ ID NO: 263719 - DNA, 20 bp, Artificial Sequence
  chemically synthesized
atcaatactccccatgtatg

SEQ ID NO: 263720 - DNA, 20 bp, Artificial Sequence
  chemically synthesized
gccaccaaaccccatacatg

SEQ ID NO: 263721 - DNA, 20 bp, Artificial Sequence
  chemically synthesized
aatcaatactccccatgtat

SEQ ID NO: 263722 - DNA, 20 bp, Artificial Sequence
  chemically synthesized
caatcaatactccccatgta

SEQ ID NO: 263723 - DNA, 20 bp, Artificial Sequence
  chemically synthesized
caccaaaccccatacatggg

SEQ ID NO: 263724 - DNA, 20 bp, Artificial Sequence
  chemically synthesized
atacatggggagtattgatt

SEQ ID NO: 263725 - DNA, 20 bp, Artificial Sequence
  chemically synthesized
tacatggggagtattgattg

SEQ ID NO: 263726 - DNA, 20 bp, Artificial Sequence
  chemically synthesized
atggggagtattgattgagg

SEQ ID NO: 263727 - DNA, 20 bp, Artificial Sequence
  chemically synthesized
agtattgattgaggcagctc

SEQ ID NO: 263728 - DNA, 20 bp, Artificial Sequence
  chemically synthesized
gtattgattgaggcagctcc

SEQ ID NO: 263729 - DNA, 20 bp, Artificial Sequence
  chemically synthesized
ttgattgaggcagctccagg

SEQ ID NO: 263730 - DNA, 20 bp, Artificial Sequence
  chemically synthesized
attgaggcagctccaggaag

SEQ ID NO: 263731 - DNA, 20 bp, Artificial Sequence
  chemically synthesized
atcttagttcccacttcctg

SEQ ID NO: 263732 - DNA, 20 bp, Artificial Sequence
  chemically synthesized
ttgaggcagctccaggaagt

SEQ ID NO: 263733 - DNA, 20 bp, Artificial Sequence
  chemically synthesized
caatcttagttcccacttcc

SEQ ID NO: 263734 - DNA, 20 bp, Artificial Sequence
  chemically synthesized
agctccaggaagtgggaact

SEQ ID NO: 263735 - DNA, 20 bp, Artificial Sequence
  chemically synthesized
caggaagtgggaactaagat

SEQ ID NO: 263736 - DNA, 20 bp, Artificial Sequence
  chemically synthesized
gaagtgggaactaagattgg

SEQ ID NO: 263737 - DNA, 20 bp, Artificial Sequence
  chemically synthesized
agaactattcccaccaatct

SEQ ID NO: 263738 - DNA, 20 bp, Artificial Sequence
  chemically synthesized
aagtgggaactaagattggt

SEQ ID NO: 263739 - DNA, 20 bp, Artificial Sequence
  chemically synthesized
ggaactaagattggtgggaa

SEQ ID NO: 263740 - DNA, 20 bp, Artificial Sequence
  chemically synthesized
ataagtgtgtgaagcaatag

SEQ ID NO: 263741 - DNA, 20 bp, Artificial Sequence
  chemically synthesized
taataagtgtgtgaagcaat

SEQ ID NO: 263742 - DNA, 20 bp, Artificial Sequence
  chemically synthesized
gtaataagtgtgtgaagcaa

SEQ ID NO: 263743 - DNA, 20 bp, Artificial Sequence
  chemically synthesized
ttttaggtaataagtgtgtg

SEQ ID NO: 263744 - DNA, 20 bp, Artificial Sequence
  chemically synthesized
atatataaattttaggtaat

SEQ ID NO: 263745 - DNA, 20 bp, Artificial Sequence
  chemically synthesized
gaagacaatatataaatttt

SEQ ID NO: 263746 - DNA, 20 bp, Artificial Sequence
  chemically synthesized
agaagacaatatataaattt

SEQ ID NO: 263747 - DNA, 20 bp, Artificial Sequence
  chemically synthesized
atgcttgaaagtgacatcag

SEQ ID NO: 263748 - DNA, 20 bp, Artificial Sequence
  chemically synthesized
acaatgcttgaaagtgacat

SEQ ID NO: 263749 - DNA, 20 bp, Artificial Sequence
  chemically synthesized
tgtcttctgatgtcactttc

SEQ ID NO: 263750 - DNA, 20 bp, Artificial Sequence
  chemically synthesized
ccttctcagacaatgcttga

SEQ ID NO: 263751 - DNA, 20 bp, Artificial Sequence
  chemically synthesized
gtcactttcaagcattgtct

SEQ ID NO: 263752 - DNA, 20 bp, Artificial Sequence
  chemically synthesized
actttcaagcattgtctgag

SEQ ID NO: 263753 - DNA, 20 bp, Artificial Sequence
  chemically synthesized
ctttcaagcattgtctgaga

SEQ ID NO: 263754 - DNA, 20 bp, Artificial Sequence
  chemically synthesized
taccagtgctagagccttct

SEQ ID NO: 263755 - DNA, 20 bp, Artificial Sequence
  chemically synthesized
agcattgtctgagaaggctc

SEQ ID NO: 263756 - DNA, 20 bp, Artificial Sequence
  chemically synthesized
gtctgagaaggctctagcac

SEQ ID NO: 263757 - DNA, 20 bp, Artificial Sequence
  chemically synthesized
ctttacaattaccagtgcta

SEQ ID NO: 263758 - DNA, 20 bp, Artificial Sequence
  chemically synthesized
acctttacaattaccagtgc

SEQ ID NO: 263759 - DNA, 20 bp, Artificial Sequence
  chemically synthesized
ttcttaacctttacaattac

SEQ ID NO: 263760 - DNA, 20 bp, Artificial Sequence
  chemically synthesized
ctctagcactggtaattgta

SEQ ID NO: 263761 - DNA, 20 bp, Artificial Sequence
  chemically synthesized
tctagcactggtaattgtaa

SEQ ID NO: 263762 - DNA, 20 bp, Artificial Sequence
  chemically synthesized
cactggtaattgtaaaggtt

SEQ ID NO: 263763 - DNA, 20 bp, Artificial Sequence
  chemically synthesized
tgtaaaggttaagaatgcca

SEQ ID NO: 263764 - DNA, 20 bp, Artificial Sequence
  chemically synthesized
taaaggttaagaatgccaca

SEQ ID NO: 263765 - DNA, 20 bp, Artificial Sequence
  chemically synthesized
aaaggttaagaatgccacag

SEQ ID NO: 263766 - DNA, 20 bp, Artificial Sequence
  chemically synthesized
tttcactgccatcacctctg

SEQ ID NO: 263767 - DNA, 20 bp, Artificial Sequence
  chemically synthesized
taagaatgccacagaggtga

SEQ ID NO: 263768 - DNA, 20 bp, Artificial Sequence
  chemically synthesized
gaatgccacagaggtgatgg

SEQ ID NO: 263769 - DNA, 20 bp, Artificial Sequence
  chemically synthesized
cacagaggtgatggcagtga

SEQ ID NO: 263770 - DNA, 20 bp, Artificial Sequence
  chemically synthesized
cagaggtgatggcagtgaaa

SEQ ID NO: 263771 - DNA, 20 bp, Artificial Sequence
  chemically synthesized
agaggtgatggcagtgaaag

SEQ ID NO: 263772 - DNA, 20 bp, Artificial Sequence
  chemically synthesized
gaggtgatggcagtgaaaga

SEQ ID NO: 263773 - DNA, 20 bp, Artificial Sequence
  chemically synthesized
aggtgatggcagtgaaagag

SEQ ID NO: 263774 - DNA, 20 bp, Artificial Sequence
  chemically synthesized
agaggggaaaaaattgtgaa

SEQ ID NO: 263775 - DNA, 20 bp, Artificial Sequence
  chemically synthesized
gaggggaaaaaattgtgaaa

SEQ ID NO: 263776 - DNA, 20 bp, Artificial Sequence
  chemically synthesized
ggggaaaaaattgtgaaaag

SEQ ID NO: 263777 - DNA, 20 bp, Artificial Sequence
  chemically synthesized
gggaaaaaattgtgaaaagg

SEQ ID NO: 263778 - DNA, 20 bp, Artificial Sequence
  chemically synthesized
aaattgtgaaaaggaggatg

SEQ ID NO: 263779 - DNA, 20 bp, Artificial Sequence
  chemically synthesized
attgtgaaaaggaggatgaa

SEQ ID NO: 263780 - DNA, 20 bp, Artificial Sequence
  chemically synthesized
tgtgaaaaggaggatgaaga

SEQ ID NO: 263781 - DNA, 20 bp, Artificial Sequence
  chemically synthesized
aggatgaagagagaaaaaaa

SEQ ID NO: 263782 - DNA, 20 bp, Artificial Sequence
  chemically synthesized
tgaagagagaaaaaaaaagt

SEQ ID NO: 263783 - DNA, 20 bp, Artificial Sequence
  chemically synthesized
gaaaaaaaaagtcagttaat

SEQ ID NO: 263784 - DNA, 20 bp, Artificial Sequence
  chemically synthesized
aaaaaaaaagtcagttaata

SEQ ID NO: 263785 - DNA, 20 bp, Artificial Sequence
  chemically synthesized
gatgtgatgtacaaatattc

SEQ ID NO: 263786 - DNA, 20 bp, Artificial Sequence
  chemically synthesized
tgatgtacaaatattcaagc

SEQ ID NO: 263787 - DNA, 20 bp, Artificial Sequence
  chemically synthesized
atgtacaaatattcaagcca

SEQ ID NO: 263788 - DNA, 20 bp, Artificial Sequence
  chemically synthesized
gtacaaatattcaagccaga

SEQ ID NO: 263789 - DNA, 20 bp, Artificial Sequence
  chemically synthesized
gtatctactacatttctctc

SEQ ID NO: 263790 - DNA, 20 bp, Artificial Sequence
  chemically synthesized
attcaagccagagagaaatg

SEQ ID NO: 263791 - DNA, 20 bp, Artificial Sequence
  chemically synthesized
caagccagagagaaatgtag

SEQ ID NO: 263792 - DNA, 20 bp, Artificial Sequence
  chemically synthesized
tgtagtagatactttgaaat

SEQ ID NO: 263793 - DNA, 20 bp, Artificial Sequence
  chemically synthesized
ttcaatcccaactaatttca

SEQ ID NO: 263794 - DNA, 20 bp, Artificial Sequence
  chemically synthesized
gtagatactttgaaattagt

SEQ ID NO: 263795 - DNA, 20 bp, Artificial Sequence
  chemically synthesized
tagatactttgaaattagtt

SEQ ID NO: 263796 - DNA, 20 bp, Artificial Sequence
  chemically synthesized
tttgaaattagttgggattg

SEQ ID NO: 263797 - DNA, 20 bp, Artificial Sequence
  chemically synthesized
ttgaaattagttgggattga

SEQ ID NO: 263798 - DNA, 20 bp, Artificial Sequence
  chemically synthesized
gaaattagttgggattgaag

SEQ ID NO: 263799 - DNA, 20 bp, Artificial Sequence
  chemically synthesized
ggattgaaggagaatattct

SEQ ID NO: 263800 - DNA, 20 bp, Artificial Sequence
  chemically synthesized
gattgaaggagaatattctg

SEQ ID NO: 263801 - DNA, 20 bp, Artificial Sequence
  chemically synthesized
gaaggagaatattctgaggt

SEQ ID NO: 263802 - DNA, 20 bp, Artificial Sequence
  chemically synthesized
aaggagaatattctgaggtt

SEQ ID NO: 263803 - DNA, 20 bp, Artificial Sequence
  chemically synthesized
atgtgtgctcttcccaacct

SEQ ID NO: 263804 - DNA, 20 bp, Artificial Sequence
  chemically synthesized
gagaatattctgaggttggg

SEQ ID NO: 263805 - DNA, 20 bp, Artificial Sequence
  chemically synthesized
gaatattctgaggttgggaa

SEQ ID NO: 263806 - DNA, 20 bp, Artificial Sequence
  chemically synthesized
gaggttgggaagagcacaca

SEQ ID NO: 263807 - DNA, 20 bp, Artificial Sequence
  chemically synthesized
ctgcttatttcatgggagta

SEQ ID NO: 263808 - DNA, 20 bp, Artificial Sequence
  chemically synthesized
tcatgctgcttatttcatgg

SEQ ID NO: 263809 - DNA, 20 bp, Artificial Sequence
  chemically synthesized
tttctttactcccatgaaat

SEQ ID NO: 263810 - DNA, 20 bp, Artificial Sequence
  chemically synthesized
attcatgctgcttatttcat

SEQ ID NO: 263811 - DNA, 20 bp, Artificial Sequence
  chemically synthesized
aattcatgctgcttatttca

SEQ ID NO: 263812 - DNA, 20 bp, Artificial Sequence
  chemically synthesized
ctttactcccatgaaataag

SEQ ID NO: 263813 - DNA, 20 bp, Artificial Sequence
  chemically synthesized
gcatgaatttatacacattt

SEQ ID NO: 263814 - DNA, 20 bp, Artificial Sequence
  chemically synthesized
ttaccaaatagttgtttagt

SEQ ID NO: 263815 - DNA, 20 bp, Artificial Sequence
  chemically synthesized
tgttttaccaaatagttgtt

SEQ ID NO: 263816 - DNA, 20 bp, Artificial Sequence
  chemically synthesized
gtactaactaaacaactatt

SEQ ID NO: 263817 - DNA, 20 bp, Artificial Sequence
  chemically synthesized
cacaaagttgttttaccaaa

SEQ ID NO: 263818 - DNA, 20 bp, Artificial Sequence
  chemically synthesized
tatttggtaaaacaactttg

SEQ ID NO: 263819 - DNA, 20 bp, Artificial Sequence
  chemically synthesized
atttggtaaaacaactttgt

SEQ ID NO: 263820 - DNA, 20 bp, Artificial Sequence
  chemically synthesized
atttattacaatttcccaca

SEQ ID NO: 263821 - DNA, 20 bp, Artificial Sequence
  chemically synthesized
aacatttatttcaatgaaga

SEQ ID NO: 263822 - DNA, 20 bp, Artificial Sequence
  chemically synthesized
ataacatttatttcaatgaa

SEQ ID NO: 263823 - DNA, 20 bp, Artificial Sequence
  chemically synthesized
gtataacatttatttcaatg

SEQ ID NO: 263824 - DNA, 20 bp, Artificial Sequence
  chemically synthesized
tgtatcagcaatgtttttgg

SEQ ID NO: 263825 - DNA, 20 bp, Artificial Sequence
  chemically synthesized
ttttgtatcagcaatgtttt

SEQ ID NO: 263826 - DNA, 20 bp, Artificial Sequence
  chemically synthesized
agatgactgacattttgtat

SEQ ID NO: 263827 - DNA, 20 bp, Artificial Sequence
  chemically synthesized
acattgctgatacaaaatgt

SEQ ID NO: 263828 - DNA, 20 bp, Artificial Sequence
  chemically synthesized
aaaatgtcagtcatctatga

SEQ ID NO: 263829 - DNA, 20 bp, Artificial Sequence
  chemically synthesized
aataaaatactcaactatca

SEQ ID NO: 263830 - DNA, 20 bp, Artificial Sequence
  chemically synthesized
gtcagtcatctatgatagtt

SEQ ID NO: 263831 - DNA, 20 bp, Artificial Sequence
  chemically synthesized
tgagtattttattaaatttt

SEQ ID NO: 263832 - DNA, 20 bp, Artificial Sequence
  chemically synthesized
caaaatgtaattggaaaaaa

SEQ ID NO: 263833 - DNA, 20 bp, Artificial Sequence
  chemically synthesized
ggcaaaatgtaattggaaaa

SEQ ID NO: 263834 - DNA, 20 bp, Artificial Sequence
  chemically synthesized
tatcaagggcaaaatgtaat

SEQ ID NO: 263835 - DNA, 20 bp, Artificial Sequence
  chemically synthesized
aattacattttgcccttgat

SEQ ID NO: 263836 - DNA, 20 bp, Artificial Sequence
  chemically synthesized
cctacttttgaacttatcaa

SEQ ID NO: 263837 - DNA, 20 bp, Artificial Sequence
  chemically synthesized
acctacttttgaacttatca

SEQ ID NO: 263838 - DNA, 20 bp, Artificial Sequence
  chemically synthesized
gacctacttttgaacttatc

SEQ ID NO: 263839 - DNA, 20 bp, Artificial Sequence
  chemically synthesized
tttgcccttgataagttcaa

SEQ ID NO: 263840 - DNA, 20 bp, Artificial Sequence
  chemically synthesized
gcccttgataagttcaaaag

SEQ ID NO: 263841 - DNA, 20 bp, Artificial Sequence
  chemically synthesized
cccttgataagttcaaaagt

SEQ ID NO: 263842 - DNA, 20 bp, Artificial Sequence
  chemically synthesized
tgataagttcaaaagtaggt

SEQ ID NO: 263843 - DNA, 20 bp, Artificial Sequence
  chemically synthesized
gataagttcaaaagtaggtc

SEQ ID NO: 263844 - DNA, 20 bp, Artificial Sequence
  chemically synthesized
tcaaaagtaggtcaggtcaa

SEQ ID NO: 263845 - DNA, 20 bp, Artificial Sequence
  chemically synthesized
tcaggtcaaaagaaaattgc

SEQ ID NO: 263846 - DNA, 20 bp, Artificial Sequence
  chemically synthesized
caggtcaaaagaaaattgct

SEQ ID NO: 263847 - DNA, 20 bp, Artificial Sequence
  chemically synthesized
acggtttctaataaatagcc

SEQ ID NO: 263848 - DNA, 20 bp, Artificial Sequence
  chemically synthesized
aaaattgctgggctatttat

SEQ ID NO: 263849 - DNA, 20 bp, Artificial Sequence
  chemically synthesized
cacttacggtttctaataaa

SEQ ID NO: 263850 - DNA, 20 bp, Artificial Sequence
  chemically synthesized
ggctatttattagaaaccgt

SEQ ID NO: 263851 - DNA, 20 bp, Artificial Sequence
  chemically synthesized
tggtaatataggagcactta

SEQ ID NO: 263852 - DNA, 20 bp, Artificial Sequence
  chemically synthesized
actatggtatggtaatatag

SEQ ID NO: 263853 - DNA, 20 bp, Artificial Sequence
  chemically synthesized
ttactatggtatggtaatat

SEQ ID NO: 263854 - DNA, 20 bp, Artificial Sequence
  chemically synthesized
attactatggtatggtaata

SEQ ID NO: 263855 - DNA, 20 bp, Artificial Sequence
  chemically synthesized
gctcctatattaccatacca

SEQ ID NO: 263856 - DNA, 20 bp, Artificial Sequence
  chemically synthesized
aatgctgaattactatggta

SEQ ID NO: 263857 - DNA, 20 bp, Artificial Sequence
  chemically synthesized
ttacaaatgctgaattacta

SEQ ID NO: 263858 - DNA, 20 bp, Artificial Sequence
  chemically synthesized
attaccataccatagtaatt

SEQ ID NO: 263859 - DNA, 20 bp, Artificial Sequence
  chemically synthesized
taattcagcatttgtaataa

SEQ ID NO: 263860 - DNA, 20 bp, Artificial Sequence
  chemically synthesized
aattcagcatttgtaataaa

SEQ ID NO: 263861 - DNA, 20 bp, Artificial Sequence
  chemically synthesized
agcatttgtaataaaaggcc

SEQ ID NO: 263862 - DNA, 20 bp, Artificial Sequence
  chemically synthesized
ttataaatgcagaatattct

SEQ ID NO: 263863 - DNA, 20 bp, Artificial Sequence
  chemically synthesized
tctaatgaattttataaatg

SEQ ID NO: 263864 - DNA, 20 bp, Artificial Sequence
  chemically synthesized
tctgcatttataaaattcat

SEQ ID NO: 263865 - DNA, 20 bp, Artificial Sequence
  chemically synthesized
agtctccaactgaattttca

SEQ ID NO: 263866 - DNA, 20 bp, Artificial Sequence
  chemically synthesized
taatatgtgctctgaaaatt

SEQ ID NO: 263867 - DNA, 20 bp, Artificial Sequence
  chemically synthesized
taagtctccaactgaatttt

SEQ ID NO: 263868 - DNA, 20 bp, Artificial Sequence
  chemically synthesized
atgtgctctgaaaattcagt

SEQ ID NO: 263869 - DNA, 20 bp, Artificial Sequence
  chemically synthesized
gtgctctgaaaattcagttg

SEQ ID NO: 263870 - DNA, 20 bp, Artificial Sequence
  chemically synthesized
attcagttggagacttatct

SEQ ID NO: 263871 - DNA, 20 bp, Artificial Sequence
  chemically synthesized
tatttggaaagaacttagat

SEQ ID NO: 263872 - DNA, 20 bp, Artificial Sequence
  chemically synthesized
ataaatatttggaaagaact

SEQ ID NO: 263873 - DNA, 20 bp, Artificial Sequence
  chemically synthesized
agtggaaataaatatttgga

SEQ ID NO: 263874 - DNA, 20 bp, Artificial Sequence
  chemically synthesized
taggagtggaaataaatatt

SEQ ID NO: 263875 - DNA, 20 bp, Artificial Sequence
  chemically synthesized
caaatatttatttccactcc

SEQ ID NO: 263876 - DNA, 20 bp, Artificial Sequence
  chemically synthesized
aagtgtgaatgaactaggag

SEQ ID NO: 263877 - DNA, 20 bp, Artificial Sequence
  chemically synthesized
taaaagtgtgaatgaactag

SEQ ID NO: 263878 - DNA, 20 bp, Artificial Sequence
  chemically synthesized
gataaaagtgtgaatgaact

SEQ ID NO: 263879 - DNA, 20 bp, Artificial Sequence
  chemically synthesized
tgataaaagtgtgaatgaac

SEQ ID NO: 263880 - DNA, 20 bp, Artificial Sequence
  chemically synthesized
tggtaaattggttgtgataa

SEQ ID NO: 263881 - DNA, 20 bp, Artificial Sequence
  chemically synthesized
tcaataaagatatggtaaat

SEQ ID NO: 263882 - DNA, 20 bp, Artificial Sequence
  chemically synthesized
ggaagacttcaataaagata

SEQ ID NO: 263883 - DNA, 20 bp, Artificial Sequence
  chemically synthesized
aatttaccatatctttattg

SEQ ID NO: 263884 - DNA, 20 bp, Artificial Sequence
  chemically synthesized
gaaagaggaagacttcaata

SEQ ID NO: 263885 - DNA, 20 bp, Artificial Sequence
  chemically synthesized
ttattgaagtcttcctcttt

SEQ ID NO: 263886 - DNA, 20 bp, Artificial Sequence
  chemically synthesized
gggggtgaatctgaaagagg

SEQ ID NO: 263887 - DNA, 20 bp, Artificial Sequence
  chemically synthesized
gcagggggtgaatctgaaag

SEQ ID NO: 263888 - DNA, 20 bp, Artificial Sequence
  chemically synthesized
agcagggggtgaatctgaaa

SEQ ID NO: 263889 - DNA, 20 bp, Artificial Sequence
  chemically synthesized
tcagcagggggtgaatctga

SEQ ID NO: 263890 - DNA, 20 bp, Artificial Sequence
  chemically synthesized
ggaggctgaaattcagcagg

SEQ ID NO: 263891 - DNA, 20 bp, Artificial Sequence
  chemically synthesized
tggaggctgaaattcagcag

SEQ ID NO: 263892 - DNA, 20 bp, Artificial Sequence
  chemically synthesized
ctggaggctgaaattcagca

SEQ ID NO: 263893 - DNA, 20 bp, Artificial Sequence
  chemically synthesized
actggaggctgaaattcagc

SEQ ID NO: 263894 - DNA, 20 bp, Artificial Sequence
  chemically synthesized
cactggaggctgaaattcag

SEQ ID NO: 263895 - DNA, 20 bp, Artificial Sequence
  chemically synthesized
attcaccccctgctgaattt

SEQ ID NO: 263896 - DNA, 20 bp, Artificial Sequence
  chemically synthesized
aaccactggaggctgaaatt

SEQ ID NO: 263897 - DNA, 20 bp, Artificial Sequence
  chemically synthesized
ccctgctgaatttcagcctc

SEQ ID NO: 263898 - DNA, 20 bp, Artificial Sequence
  chemically synthesized
tgctgaatttcagcctccag

SEQ ID NO: 263899 - DNA, 20 bp, Artificial Sequence
  chemically synthesized
aaaattgcttgaaccactgg

SEQ ID NO: 263900 - DNA, 20 bp, Artificial Sequence
  chemically synthesized
aaaaattgcttgaaccactg

SEQ ID NO: 263901 - DNA, 20 bp, Artificial Sequence
  chemically synthesized
atttcagcctccagtggttc

SEQ ID NO: 263902 - DNA, 20 bp, Artificial Sequence
  chemically synthesized
acaaaaattgcttgaaccac

SEQ ID NO: 263903 - DNA, 20 bp, Artificial Sequence
  chemically synthesized
caagcaatttttgtatatct

SEQ ID NO: 263904 - DNA, 20 bp, Artificial Sequence
  chemically synthesized
ggaattggagcagtttaact

SEQ ID NO: 263905 - DNA, 20 bp, Artificial Sequence
  chemically synthesized
ttcctttgaaggaattggag

SEQ ID NO: 263906 - DNA, 20 bp, Artificial Sequence
  chemically synthesized
ccattcctttgaaggaattg

SEQ ID NO: 263907 - DNA, 20 bp, Artificial Sequence
  chemically synthesized
ctccattcctttgaaggaat

SEQ ID NO: 263908 - DNA, 20 bp, Artificial Sequence
  chemically synthesized
aaactgctccaattccttca

SEQ ID NO: 263909 - DNA, 20 bp, Artificial Sequence
  chemically synthesized
aactgctccaattccttcaa

SEQ ID NO: 263910 - DNA, 20 bp, Artificial Sequence
  chemically synthesized
ttaggcctccattcctttga

SEQ ID NO: 263911 - DNA, 20 bp, Artificial Sequence
  chemically synthesized
tttaggcctccattcctttg

SEQ ID NO: 263912 - DNA, 20 bp, Artificial Sequence
  chemically synthesized
ctccaattccttcaaaggaa

SEQ ID NO: 263913 - DNA, 20 bp, Artificial Sequence
  chemically synthesized
ccaattccttcaaaggaatg

SEQ ID NO: 263914 - DNA, 20 bp, Artificial Sequence
  chemically synthesized
caattccttcaaaggaatgg

SEQ ID NO: 263915 - DNA, 20 bp, Artificial Sequence
  chemically synthesized
ggaatggaggcctaaaaaaa

SEQ ID NO: 263916 - DNA, 20 bp, Artificial Sequence
  chemically synthesized
gtagcactatcttttttttt

SEQ ID NO: 263917 - DNA, 20 bp, Artificial Sequence
  chemically synthesized
agtagcactatctttttttt

SEQ ID NO: 263918 - DNA, 20 bp, Artificial Sequence
  chemically synthesized
tggaggcctaaaaaaaaaga

SEQ ID NO: 263919 - DNA, 20 bp, Artificial Sequence
  chemically synthesized
aaagtaattttgatttaaag

SEQ ID NO: 263920 - DNA, 20 bp, Artificial Sequence
  chemically synthesized
taaaaagtaattttgattta

SEQ ID NO: 263921 - DNA, 20 bp, Artificial Sequence
  chemically synthesized
aaatcaaaattactttttat

SEQ ID NO: 263922 - DNA, 20 bp, Artificial Sequence
  chemically synthesized
tggtttatgtttctaataaa

SEQ ID NO: 263923 - DNA, 20 bp, Artificial Sequence
  chemically synthesized
ttattagaaacataaaccaa

SEQ ID NO: 263924 - DNA, 20 bp, Artificial Sequence
  chemically synthesized
ttgaataaatgtatttcttt

SEQ ID NO: 263925 - DNA, 20 bp, Artificial Sequence
  chemically synthesized
gtgattagtttagcaacagg

SEQ ID NO: 263926 - DNA, 20 bp, Artificial Sequence
  chemically synthesized
tgtgattagtttagcaacag

SEQ ID NO: 263927 - DNA, 20 bp, Artificial Sequence
  chemically synthesized
catgtgattagtttagcaac

SEQ ID NO: 263928 - DNA, 20 bp, Artificial Sequence
  chemically synthesized
gcatgtgattagtttagcaa

SEQ ID NO: 263929 - DNA, 20 bp, Artificial Sequence
  chemically synthesized
cataatgcatgtgattagtt

SEQ ID NO: 263930 - DNA, 20 bp, Artificial Sequence
  chemically synthesized
ggaaacataatgcatgtgat

SEQ ID NO: 263931 - DNA, 20 bp, Artificial Sequence
  chemically synthesized
acccttcataaaacataata

SEQ ID NO: 263932 - DNA, 20 bp, Artificial Sequence
  chemically synthesized
tttccatattatgttttatg

SEQ ID NO: 263933 - DNA, 20 bp, Artificial Sequence
  chemically synthesized
ttccatattatgttttatga

SEQ ID NO: 263934 - DNA, 20 bp, Artificial Sequence
  chemically synthesized
tccatattatgttttatgaa

SEQ ID NO: 263935 - DNA, 20 bp, Artificial Sequence
  chemically synthesized
gaagggttttgaaatacaac

SEQ ID NO: 263936 - DNA, 20 bp, Artificial Sequence
  chemically synthesized
gttttgaaatacaactggaa

SEQ ID NO: 263937 - DNA, 20 bp, Artificial Sequence
  chemically synthesized
tgcatcctcaggtacttttc

SEQ ID NO: 263938 - DNA, 20 bp, Artificial Sequence
  chemically synthesized
atacaactggaaaagtacct

SEQ ID NO: 263939 - DNA, 20 bp, Artificial Sequence
  chemically synthesized
tacaactggaaaagtacctg

SEQ ID NO: 263940 - DNA, 20 bp, Artificial Sequence
  chemically synthesized
ttctccttatttgcatcctc

SEQ ID NO: 263941 - DNA, 20 bp, Artificial Sequence
  chemically synthesized
tttctccttatttgcatcct

SEQ ID NO: 263942 - DNA, 20 bp, Artificial Sequence
  chemically synthesized
aagtacctgaggatgcaaat

SEQ ID NO: 263943 - DNA, 20 bp, Artificial Sequence
  chemically synthesized
agtacctgaggatgcaaata

SEQ ID NO: 263944 - DNA, 20 bp, Artificial Sequence
  chemically synthesized
tacctgaggatgcaaataag

SEQ ID NO: 263945 - DNA, 20 bp, Artificial Sequence
  chemically synthesized
ggagaaacatttcacatcac

SEQ ID NO: 263946 - DNA, 20 bp, Artificial Sequence
  chemically synthesized
agaaacatttcacatcacca

SEQ ID NO: 263947 - DNA, 20 bp, Artificial Sequence
  chemically synthesized
cttgcatgtatgttcagctc

SEQ ID NO: 263948 - DNA, 20 bp, Artificial Sequence
  chemically synthesized
tactatcttgcatgtatgtt

SEQ ID NO: 263949 - DNA, 20 bp, Artificial Sequence
  chemically synthesized
ccagagctgaacatacatgc

SEQ ID NO: 263950 - DNA, 20 bp, Artificial Sequence
  chemically synthesized
agctgaacatacatgcaaga

SEQ ID NO: 263951 - DNA, 20 bp, Artificial Sequence
  chemically synthesized
agatagtacaattcatcatt

SEQ ID NO: 263952 - DNA, 20 bp, Artificial Sequence
  chemically synthesized
tcatttggtgatatcaacaa

SEQ ID NO: 263953 - DNA, 20 bp, Artificial Sequence
  chemically synthesized
tatcaacaacagtcaattta

SEQ ID NO: 263954 - DNA, 20 bp, Artificial Sequence
  chemically synthesized
aatttacagatacatttgaa

SEQ ID NO: 263955 - DNA, 20 bp, Artificial Sequence
  chemically synthesized
atttacagatacatttgaat

SEQ ID NO: 263956 - DNA, 20 bp, Artificial Sequence
  chemically synthesized
gactttagaatattaaaaat

SEQ ID NO: 263957 - DNA, 20 bp, Artificial Sequence
  chemically synthesized
ggctaatttttaatattcta

SEQ ID NO: 263958 - DNA, 20 bp, Artificial Sequence
  chemically synthesized
aataaggtcaaatttgactt

SEQ ID NO: 263959 - DNA, 20 bp, Artificial Sequence
  chemically synthesized
atatcagaatatttaaaata

SEQ ID NO: 263960 - DNA, 20 bp, Artificial Sequence
  chemically synthesized
tatatcagaatatttaaaat

SEQ ID NO: 263961 - DNA, 20 bp, Artificial Sequence
  chemically synthesized
ttacccaaatgtatttatat

SEQ ID NO: 263962 - DNA, 20 bp, Artificial Sequence
  chemically synthesized
tattctgatataaatacatt

SEQ ID NO: 263963 - DNA, 20 bp, Artificial Sequence
  chemically synthesized
attctgatataaatacattt

SEQ ID NO: 263964 - DNA, 20 bp, Artificial Sequence
  chemically synthesized
tttgggtaaatatgtctcat

SEQ ID NO: 263965 - DNA, 20 bp, Artificial Sequence
  chemically synthesized
taaatgaggcaatttctgat

SEQ ID NO: 263966 - DNA, 20 bp, Artificial Sequence
  chemically synthesized
ttactgttacttgataaatg

SEQ ID NO: 263967 - DNA, 20 bp, Artificial Sequence
  chemically synthesized
cagaaattgcctcatttatc

SEQ ID NO: 263968 - DNA, 20 bp, Artificial Sequence
  chemically synthesized
gttactgttacttgataaat

SEQ ID NO: 263969 - DNA, 20 bp, Artificial Sequence
  chemically synthesized
ttgcctcatttatcaagtaa

SEQ ID NO: 263970 - DNA, 20 bp, Artificial Sequence
  chemically synthesized
ttatcaagtaacagtaacct

SEQ ID NO: 263971 - DNA, 20 bp, Artificial Sequence
  chemically synthesized
tatcaagtaacagtaacctc

SEQ ID NO: 263972 - DNA, 20 bp, Artificial Sequence
  chemically synthesized
caagtaacagtaacctcagg

SEQ ID NO: 263973 - DNA, 20 bp, Artificial Sequence
  chemically synthesized
caattctgcatttctacctg

SEQ ID NO: 263974 - DNA, 20 bp, Artificial Sequence
  chemically synthesized
acaattctgcatttctacct

SEQ ID NO: 263975 - DNA, 20 bp, Artificial Sequence
  chemically synthesized
agtaacctcaggtagaaatg

SEQ ID NO: 263976 - DNA, 20 bp, Artificial Sequence
  chemically synthesized
cagaattgtcatcttatcct

SEQ ID NO: 263977 - DNA, 20 bp, Artificial Sequence
  chemically synthesized
catgtagtttttctaaggat

SEQ ID NO: 263978 - DNA, 20 bp, Artificial Sequence
  chemically synthesized
attgccatgtagtttttcta

SEQ ID NO: 263979 - DNA, 20 bp, Artificial Sequence
  chemically synthesized
gattgccatgtagtttttct

SEQ ID NO: 263980 - DNA, 20 bp, Artificial Sequence
  chemically synthesized
ttatccttagaaaaactaca

SEQ ID NO: 263981 - DNA, 20 bp, Artificial Sequence
  chemically synthesized
catctgagcagattgccatg

SEQ ID NO: 263982 - DNA, 20 bp, Artificial Sequence
  chemically synthesized
aaactacatggcaatctgct

SEQ ID NO: 263983 - DNA, 20 bp, Artificial Sequence
  chemically synthesized
tgtcatttaaaacatctgag

SEQ ID NO: 263984 - DNA, 20 bp, Artificial Sequence
  chemically synthesized
aaatgtcatttaaaacatct

SEQ ID NO: 263985 - DNA, 20 bp, Artificial Sequence
  chemically synthesized
gatgttttaaatgacatttt

SEQ ID NO: 263986 - DNA, 20 bp, Artificial Sequence
  chemically synthesized
tttaaatgacatttttagca

SEQ ID NO: 263987 - DNA, 20 bp, Artificial Sequence
  chemically synthesized
ttttagcacagcacaattga

SEQ ID NO: 263988 - DNA, 20 bp, Artificial Sequence
  chemically synthesized
tttagcacagcacaattgac

SEQ ID NO: 263989 - DNA, 20 bp, Artificial Sequence
  chemically synthesized
attgacaggcatgctcttct

SEQ ID NO: 263990 - DNA, 20 bp, Artificial Sequence
  chemically synthesized
ctaatggcattgtcttagaa

SEQ ID NO: 263991 - DNA, 20 bp, Artificial Sequence
  chemically synthesized
agctaatggcattgtcttag

SEQ ID NO: 263992 - DNA, 20 bp, Artificial Sequence
  chemically synthesized
gcaagctaatggcattgtct

SEQ ID NO: 263993 - DNA, 20 bp, Artificial Sequence
  chemically synthesized
ctcttctaagacaatgccat

SEQ ID NO: 263994 - DNA, 20 bp, Artificial Sequence
  chemically synthesized
ctgttcctaaggcaagctaa

SEQ ID NO: 263995 - DNA, 20 bp, Artificial Sequence
  chemically synthesized
acaatgccattagcttgcct

SEQ ID NO: 263996 - DNA, 20 bp, Artificial Sequence
  chemically synthesized
caatgccattagcttgcctt

SEQ ID NO: 263997 - DNA, 20 bp, Artificial Sequence
  chemically synthesized
aaccaaactgttcctaaggc

SEQ ID NO: 263998 - DNA, 20 bp, Artificial Sequence
  chemically synthesized
ccattagcttgccttaggaa

SEQ ID NO: 263999 - DNA, 20 bp, Artificial Sequence
  chemically synthesized
caccaaccaaactgttccta

SEQ ID NO: 264000 - DNA, 20 bp, Artificial Sequence
  chemically synthesized
tcaccaaccaaactgttcct

SEQ ID NO: 264001 - DNA, 20 bp, Artificial Sequence
  chemically synthesized
agcttgccttaggaacagtt

SEQ ID NO: 264002 - DNA, 20 bp, Artificial Sequence
  chemically synthesized
tgccttaggaacagtttggt

SEQ ID NO: 264003 - DNA, 20 bp, Artificial Sequence
  chemically synthesized
ttctttatgtgaaatatatt

SEQ ID NO: 264004 - DNA, 20 bp, Artificial Sequence
  chemically synthesized
attctttatgtgaaatatat

SEQ ID NO: 264005 - DNA, 20 bp, Artificial Sequence
  chemically synthesized
aacctaatatatttcacata

SEQ ID NO: 264006 - DNA, 20 bp, Artificial Sequence
  chemically synthesized
gtttacaaggttgaaaagca

SEQ ID NO: 264007 - DNA, 20 bp, Artificial Sequence
  chemically synthesized
ctgatgtttacaaggttgaa

SEQ ID NO: 264008 - DNA, 20 bp, Artificial Sequence
  chemically synthesized
taaagaaactgatgtttaca

SEQ ID NO: 264009 - DNA, 20 bp, Artificial Sequence
  chemically synthesized
gtaaagaaactgatgtttac

SEQ ID NO: 264010 - DNA, 20 bp, Artificial Sequence
  chemically synthesized
cttttcaaccttgtaaacat

SEQ ID NO: 264011 - DNA, 20 bp, Artificial Sequence
  chemically synthesized
tcattatcagttcaaaagta

SEQ ID NO: 264012 - DNA, 20 bp, Artificial Sequence
  chemically synthesized
actggtcattatcagttcaa

SEQ ID NO: 264013 - DNA, 20 bp, Artificial Sequence
  chemically synthesized
tttcttagactggtcattat

SEQ ID NO: 264014 - DNA, 20 bp, Artificial Sequence
  chemically synthesized
acttttgaactgataatgac

SEQ ID NO: 264015 - DNA, 20 bp, Artificial Sequence
  chemically synthesized
gaactgataatgaccagtct

SEQ ID NO: 264016 - DNA, 20 bp, Artificial Sequence
  chemically synthesized
attttaaagttttcttagac

SEQ ID NO: 264017 - DNA, 20 bp, Artificial Sequence
  chemically synthesized
aagagattttaaagttttct

SEQ ID NO: 264018 - DNA, 20 bp, Artificial Sequence
  chemically synthesized
tagaaagtcaagagatttta

SEQ ID NO: 264019 - DNA, 20 bp, Artificial Sequence
  chemically synthesized
ggttttgtttagaaagtcaa

SEQ ID NO: 264020 - DNA, 20 bp, Artificial Sequence
  chemically synthesized
agggttttgtttagaaagtc

SEQ ID NO: 264021 - DNA, 20 bp, Artificial Sequence
  chemically synthesized
tttcaagggttttgtttaga

SEQ ID NO: 264022 - DNA, 20 bp, Artificial Sequence
  chemically synthesized
tccttttcaagggttttgtt

SEQ ID NO: 264023 - DNA, 20 bp, Artificial Sequence
  chemically synthesized
ttctaaacaaaacccttgaa

SEQ ID NO: 264024 - DNA, 20 bp, Artificial Sequence
  chemically synthesized
tctaaacaaaacccttgaaa

SEQ ID NO: 264025 - DNA, 20 bp, Artificial Sequence
  chemically synthesized
cacttatcactccttttcaa

SEQ ID NO: 264026 - DNA, 20 bp, Artificial Sequence
  chemically synthesized
taaacaaaacccttgaaaag

SEQ ID NO: 264027 - DNA, 20 bp, Artificial Sequence
  chemically synthesized
tcacttatcactccttttca

SEQ ID NO: 264028 - DNA, 20 bp, Artificial Sequence
  chemically synthesized
ttcacttatcactccttttc

SEQ ID NO: 264029 - DNA, 20 bp, Artificial Sequence
  chemically synthesized
aacccttgaaaaggagtgat

SEQ ID NO: 264030 - DNA, 20 bp, Artificial Sequence
  chemically synthesized
gaaaaggagtgataagtgaa

SEQ ID NO: 264031 - DNA, 20 bp, Artificial Sequence
  chemically synthesized
gagtgataagtgaaaagaca

SEQ ID NO: 264032 - DNA, 20 bp, Artificial Sequence
  chemically synthesized
aatcaaatatatattcaaaa

SEQ ID NO: 264033 - DNA, 20 bp, Artificial Sequence
  chemically synthesized
caaatatatattcaaaaaag

SEQ ID NO: 264034 - DNA, 20 bp, Artificial Sequence
  chemically synthesized
aaatatatattcaaaaaagt

SEQ ID NO: 264035 - DNA, 20 bp, Artificial Sequence
  chemically synthesized
atatattcaaaaaagtgggc

SEQ ID NO: 264036 - DNA, 20 bp, Artificial Sequence
  chemically synthesized
tatattcaaaaaagtgggca

SEQ ID NO: 264037 - DNA, 20 bp, Artificial Sequence
  chemically synthesized
tcaaaaaagtgggcaaggtt

SEQ ID NO: 264038 - DNA, 20 bp, Artificial Sequence
  chemically synthesized
agtgggcaaggtttagttat

SEQ ID NO: 264039 - DNA, 20 bp, Artificial Sequence
  chemically synthesized
gtatcaatgtattttattaa

SEQ ID NO: 264040 - DNA, 20 bp, Artificial Sequence
  chemically synthesized
atacagcataaagattgaga

SEQ ID NO: 264041 - DNA, 20 bp, Artificial Sequence
  chemically synthesized
aaatacagcataaagattga

SEQ ID NO: 264042 - DNA, 20 bp, Artificial Sequence
  chemically synthesized
agaaatacagcataaagatt

SEQ ID NO: 264043 - DNA, 20 bp, Artificial Sequence
  chemically synthesized
atggaaagaaatacagcata

SEQ ID NO: 264044 - DNA, 20 bp, Artificial Sequence
  chemically synthesized
tgttttaatggaaagaaata

SEQ ID NO: 264045 - DNA, 20 bp, Artificial Sequence
  chemically synthesized
tgttctagtgttttaatgga

SEQ ID NO: 264046 - DNA, 20 bp, Artificial Sequence
  chemically synthesized
aatatgttctagtgttttaa

SEQ ID NO: 264047 - DNA, 20 bp, Artificial Sequence
  chemically synthesized
atttctttccattaaaacac

SEQ ID NO: 264048 - DNA, 20 bp, Artificial Sequence
  chemically synthesized
atcccatataaaatatgttc

SEQ ID NO: 264049 - DNA, 20 bp, Artificial Sequence
  chemically synthesized
acactagaacatattttata

SEQ ID NO: 264050 - DNA, 20 bp, Artificial Sequence
  chemically synthesized
cactagaacatattttatat

SEQ ID NO: 264051 - DNA, 20 bp, Artificial Sequence
  chemically synthesized
agaacatattttatatggga

SEQ ID NO: 264052 - DNA, 20 bp, Artificial Sequence
  chemically synthesized
tgtcatctatgggttttcaa

SEQ ID NO: 264053 - DNA, 20 bp, Artificial Sequence
  chemically synthesized
tatgtcatctatgggttttc

SEQ ID NO: 264054 - DNA, 20 bp, Artificial Sequence
  chemically synthesized
ggatagctcttgaaaaccca

SEQ ID NO: 264055 - DNA, 20 bp, Artificial Sequence
  chemically synthesized
gatttctgtatgtcatctat

SEQ ID NO: 264056 - DNA, 20 bp, Artificial Sequence
  chemically synthesized
agatttctgtatgtcatcta

SEQ ID NO: 264057 - DNA, 20 bp, Artificial Sequence
  chemically synthesized
gaaaacccatagatgacata

SEQ ID NO: 264058 - DNA, 20 bp, Artificial Sequence
  chemically synthesized
ttttagctctgaaagaaaat

SEQ ID NO: 264059 - DNA, 20 bp, Artificial Sequence
  chemically synthesized
acagaaatctgattttcttt

SEQ ID NO: 264060 - DNA, 20 bp, Artificial Sequence
  chemically synthesized
agaaatctgattttctttca

SEQ ID NO: 264061 - DNA, 20 bp, Artificial Sequence
  chemically synthesized
gtaaaatgttttagctctga

SEQ ID NO: 264062 - DNA, 20 bp, Artificial Sequence
  chemically synthesized
tttacaaaagtaaaatgttt

SEQ ID NO: 264063 - DNA, 20 bp, Artificial Sequence
  chemically synthesized
ttcctgaattggttttacaa

SEQ ID NO: 264064 - DNA, 20 bp, Artificial Sequence
  chemically synthesized
ttacttttgtaaaaccaatt

SEQ ID NO: 264065 - DNA, 20 bp, Artificial Sequence
  chemically synthesized
tacttttgtaaaaccaattc

SEQ ID NO: 264066 - DNA, 20 bp, Artificial Sequence
  chemically synthesized
cacgggggtcattcctgaat

SEQ ID NO: 264067 - DNA, 20 bp, Artificial Sequence
  chemically synthesized
cgtcttggcaaaagacacgg

SEQ ID NO: 264068 - DNA, 20 bp, Artificial Sequence
  chemically synthesized
tcgtcttggcaaaagacacg

SEQ ID NO: 264069 - DNA, 20 bp, Artificial Sequence
  chemically synthesized
atcgtcttggcaaaagacac

SEQ ID NO: 264070 - DNA, 20 bp, Artificial Sequence
  chemically synthesized
aatcgtcttggcaaaagaca

SEQ ID NO: 264071 - DNA, 20 bp, Artificial Sequence
  chemically synthesized
tgacccccgtgtcttttgcc

SEQ ID NO: 264072 - DNA, 20 bp, Artificial Sequence
  chemically synthesized
gaatgtaatcgtcttggcaa

SEQ ID NO: 264073 - DNA, 20 bp, Artificial Sequence
  chemically synthesized
cttgatgaatgtaatcgtct

SEQ ID NO: 264074 - DNA, 20 bp, Artificial Sequence
  chemically synthesized
ccaagacgattacattcatc

SEQ ID NO: 264075 - DNA, 20 bp, Artificial Sequence
  chemically synthesized
acgattacattcatcaagtt

SEQ ID NO: 264076 - DNA, 20 bp, Artificial Sequence
  chemically synthesized
tgactggagaagggtaggtg

SEQ ID NO: 264077 - DNA, 20 bp, Artificial Sequence
  chemically synthesized
gtgactggagaagggtaggt

SEQ ID NO: 264078 - DNA, 20 bp, Artificial Sequence
  chemically synthesized
tgtgactggagaagggtagg

SEQ ID NO: 264079 - DNA, 20 bp, Artificial Sequence
  chemically synthesized
gaatgtgactggagaagggt

SEQ ID NO: 264080 - DNA, 20 bp, Artificial Sequence
  chemically synthesized
ggaatgtgactggagaaggg

SEQ ID NO: 264081 - DNA, 20 bp, Artificial Sequence
  chemically synthesized
ggtccccacctacccttctc

SEQ ID NO: 264082 - DNA, 20 bp, Artificial Sequence
  chemically synthesized
ctgggaatgtgactggagaa

SEQ ID NO: 264083 - DNA, 20 bp, Artificial Sequence
  chemically synthesized
cctgggaatgtgactggaga

SEQ ID NO: 264084 - DNA, 20 bp, Artificial Sequence
  chemically synthesized
tcctgggaatgtgactggag

SEQ ID NO: 264085 - DNA, 20 bp, Artificial Sequence
  chemically synthesized
tcttcctgggaatgtgactg

SEQ ID NO: 264086 - DNA, 20 bp, Artificial Sequence
  chemically synthesized
cctcttcctgggaatgtgac

SEQ ID NO: 264087 - DNA, 20 bp, Artificial Sequence
  chemically synthesized
cccttctccagtcacattcc

SEQ ID NO: 264088 - DNA, 20 bp, Artificial Sequence
  chemically synthesized
ccttctccagtcacattccc

SEQ ID NO: 264089 - DNA, 20 bp, Artificial Sequence
  chemically synthesized
tctccagtcacattcccagg

SEQ ID NO: 264090 - DNA, 20 bp, Artificial Sequence
  chemically synthesized
tccagtcacattcccaggaa

SEQ ID NO: 264091 - DNA, 20 bp, Artificial Sequence
  chemically synthesized
ccagtcacattcccaggaag

SEQ ID NO: 264092 - DNA, 20 bp, Artificial Sequence
  chemically synthesized
taaaaattcaacctcttcct

SEQ ID NO: 264093 - DNA, 20 bp, Artificial Sequence
  chemically synthesized
ataaaaattcaacctcttcc

SEQ ID NO: 264094 - DNA, 20 bp, Artificial Sequence
  chemically synthesized
ggaagaggttgaatttttat

SEQ ID NO: 264095 - DNA, 20 bp, Artificial Sequence
  chemically synthesized
gaggttgaatttttattaga

SEQ ID NO: 264096 - DNA, 20 bp, Artificial Sequence
  chemically synthesized
ttttattagatggcaacttc

SEQ ID NO: 264097 - DNA, 20 bp, Artificial Sequence
  chemically synthesized
ttatccgtattgttcaccag

SEQ ID NO: 264098 - DNA, 20 bp, Artificial Sequence
  chemically synthesized
cacttatccgtattgttcac

SEQ ID NO: 264099 - DNA, 20 bp, Artificial Sequence
  chemically synthesized
gcaacttctggtgaacaata

SEQ ID NO: 264100 - DNA, 20 bp, Artificial Sequence
  chemically synthesized
ttctggtgaacaatacggat

SEQ ID NO: 264101 - DNA, 20 bp, Artificial Sequence
  chemically synthesized
gtgaacaatacggataagtg

SEQ ID NO: 264102 - DNA, 20 bp, Artificial Sequence
  chemically synthesized
aacaatacggataagtgtag

SEQ ID NO: 264103 - DNA, 20 bp, Artificial Sequence
  chemically synthesized
gattattacctttagatatt

SEQ ID NO: 264104 - DNA, 20 bp, Artificial Sequence
  chemically synthesized
gaagaaaaactaaatatcta

SEQ ID NO: 264105 - DNA, 20 bp, Artificial Sequence
  chemically synthesized
aagaaaaactaaatatctaa

SEQ ID NO: 264106 - DNA, 20 bp, Artificial Sequence
  chemically synthesized
tagtgacagattattacctt

SEQ ID NO: 264107 - DNA, 20 bp, Artificial Sequence
  chemically synthesized
attcacttcttcaatagtga

SEQ ID NO: 264108 - DNA, 20 bp, Artificial Sequence
  chemically synthesized
gtaataatctgtcactattg

SEQ ID NO: 264109 - DNA, 20 bp, Artificial Sequence
  chemically synthesized
ataatctgtcactattgaag

SEQ ID NO: 264110 - DNA, 20 bp, Artificial Sequence
  chemically synthesized
ttgattattcacttcttcaa

SEQ ID NO: 264111 - DNA, 20 bp, Artificial Sequence
  chemically synthesized
gagaatcatgtcatcatgaa

SEQ ID NO: 264112 - DNA, 20 bp, Artificial Sequence
  chemically synthesized
tggttattcatgttgcatat

SEQ ID NO: 264113 - DNA, 20 bp, Artificial Sequence
  chemically synthesized
agaagtacctagaagatatg

SEQ ID NO: 264114 - DNA, 20 bp, Artificial Sequence
  chemically synthesized
atgaataaccacatatcttc

SEQ ID NO: 264115 - DNA, 20 bp, Artificial Sequence
  chemically synthesized
tgaataaccacatatcttct

SEQ ID NO: 264116 - DNA, 20 bp, Artificial Sequence
  chemically synthesized
gggtgtgtagaagtacctag

SEQ ID NO: 264117 - DNA, 20 bp, Artificial Sequence
  chemically synthesized
caggggtgtgtagaagtacc

SEQ ID NO: 264118 - DNA, 20 bp, Artificial Sequence
  chemically synthesized
aatctttcaggggtgtgtag

SEQ ID NO: 264119 - DNA, 20 bp, Artificial Sequence
  chemically synthesized
ataaatctttcaggggtgtg

SEQ ID NO: 264120 - DNA, 20 bp, Artificial Sequence
  chemically synthesized
gtacttctacacacccctga

SEQ ID NO: 264121 - DNA, 20 bp, Artificial Sequence
  chemically synthesized
ttatctcataaatctttcag

SEQ ID NO: 264122 - DNA, 20 bp, Artificial Sequence
  chemically synthesized
attatctcataaatctttca

SEQ ID NO: 264123 - DNA, 20 bp, Artificial Sequence
  chemically synthesized
aattatctcataaatctttc

SEQ ID NO: 264124 - DNA, 20 bp, Artificial Sequence
  chemically synthesized
aaattatctcataaatcttt

SEQ ID NO: 264125 - DNA, 20 bp, Artificial Sequence
  chemically synthesized
cacacccctgaaagatttat

SEQ ID NO: 264126 - DNA, 20 bp, Artificial Sequence
  chemically synthesized
aagatttatgagataatttt

SEQ ID NO: 264127 - DNA, 20 bp, Artificial Sequence
  chemically synthesized
taattttaagtgacctatta

SEQ ID NO: 264128 - DNA, 20 bp, Artificial Sequence
  chemically synthesized
ttaaaaactggtactgtaat

SEQ ID NO: 264129 - DNA, 20 bp, Artificial Sequence
  chemically synthesized
tttaaaaactggtactgtaa

SEQ ID NO: 264130 - DNA, 20 bp, Artificial Sequence
  chemically synthesized
taagtgacctattacagtac

SEQ ID NO: 264131 - DNA, 20 bp, Artificial Sequence
  chemically synthesized
gatcattaggatttaaaaac

SEQ ID NO: 264132 - DNA, 20 bp, Artificial Sequence
  chemically synthesized
tcaaatggcaaatgatcatt

SEQ ID NO: 264133 - DNA, 20 bp, Artificial Sequence
  chemically synthesized
ttcaaatggcaaatgatcat

SEQ ID NO: 264134 - DNA, 20 bp, Artificial Sequence
  chemically synthesized
ataacttatgatatttcaaa

SEQ ID NO: 264135 - DNA, 20 bp, Artificial Sequence
  chemically synthesized
tttgccatttgaaatatcat

SEQ ID NO: 264136 - DNA, 20 bp, Artificial Sequence
  chemically synthesized
atatcataagttatttgaac

SEQ ID NO: 264137 - DNA, 20 bp, Artificial Sequence
  chemically synthesized
ataagttatttgaaccagta

SEQ ID NO: 264138 - DNA, 20 bp, Artificial Sequence
  chemically synthesized
gtaccactaccaatctatac

SEQ ID NO: 264139 - DNA, 20 bp, Artificial Sequence
  chemically synthesized
ttatttgaaccagtatagat

SEQ ID NO: 264140 - DNA, 20 bp, Artificial Sequence
  chemically synthesized
tttgaaccagtatagattgg

SEQ ID NO: 264141 - DNA, 20 bp, Artificial Sequence
  chemically synthesized
gaaccagtatagattggtag

SEQ ID NO: 264142 - DNA, 20 bp, Artificial Sequence
  chemically synthesized
tagtggtacaaacatgctta

SEQ ID NO: 264143 - DNA, 20 bp, Artificial Sequence
  chemically synthesized
aatacagacattgaaacttt

SEQ ID NO: 264144 - DNA, 20 bp, Artificial Sequence
  chemically synthesized
agtttcaatgtctgtattat

SEQ ID NO: 264145 - DNA, 20 bp, Artificial Sequence
  chemically synthesized
taccgtaattgctaataata

SEQ ID NO: 264146 - DNA, 20 bp, Artificial Sequence
  chemically synthesized
gtctgtattattagcaatta

SEQ ID NO: 264147 - DNA, 20 bp, Artificial Sequence
  chemically synthesized
caataaaatcatacactgtt

SEQ ID NO: 264148 - DNA, 20 bp, Artificial Sequence
  chemically synthesized
tacttttaccgtcatctaaa

SEQ ID NO: 264149 - DNA, 20 bp, Artificial Sequence
  chemically synthesized
atcatacactgtttagatga

SEQ ID NO: 264150 - DNA, 20 bp, Artificial Sequence
  chemically synthesized
cactgtttagatgacggtaa

SEQ ID NO: 264151 - DNA, 20 bp, Artificial Sequence
  chemically synthesized
tagatgacggtaaaagtaaa

SEQ ID NO: 264152 - DNA, 20 bp, Artificial Sequence
  chemically synthesized
gtaaaaagattaacaaccct

SEQ ID NO: 264153 - DNA, 20 bp, Artificial Sequence
  chemically synthesized
ttgtatagttatgattctaa

SEQ ID NO: 264154 - DNA, 20 bp, Artificial Sequence
  chemically synthesized
attgtatagttatgattcta

SEQ ID NO: 264155 - DNA, 20 bp, Artificial Sequence
  chemically synthesized
aattgtatagttatgattct

SEQ ID NO: 264156 - DNA, 20 bp, Artificial Sequence
  chemically synthesized
tcaccaaattgataattgta

SEQ ID NO: 264157 - DNA, 20 bp, Artificial Sequence
  chemically synthesized
taactatacaattatcaatt

SEQ ID NO: 264158 - DNA, 20 bp, Artificial Sequence
  chemically synthesized
tgatattttatgttattaaa

SEQ ID NO: 264159 - DNA, 20 bp, Artificial Sequence
  chemically synthesized
tagttgctttcattaaatat

SEQ ID NO: 264160 - DNA, 20 bp, Artificial Sequence
  chemically synthesized
catttgctaatatttaatga

SEQ ID NO: 264161 - DNA, 20 bp, Artificial Sequence
  chemically synthesized
tcacaaaatcacatagaaca

SEQ ID NO: 264162 - DNA, 20 bp, Artificial Sequence
  chemically synthesized
tatgtattcacaaaatcaca

SEQ ID NO: 264163 - DNA, 20 bp, Artificial Sequence
  chemically synthesized
gacatccaagtacacaataa

SEQ ID NO: 264164 - DNA, 20 bp, Artificial Sequence
  chemically synthesized
aataacttttattgtgtact

SEQ ID NO: 264165 - DNA, 20 bp, Artificial Sequence
  chemically synthesized
tttattgtgtacttggatgt

SEQ ID NO: 264166 - DNA, 20 bp, Artificial Sequence
  chemically synthesized
cctatgttcttctgacatcc

SEQ ID NO: 264167 - DNA, 20 bp, Artificial Sequence
  chemically synthesized
attgtgtacttggatgtcag

SEQ ID NO: 264168 - DNA, 20 bp, Artificial Sequence
  chemically synthesized
acttggatgtcagaagaaca

SEQ ID NO: 264169 - DNA, 20 bp, Artificial Sequence
  chemically synthesized
cttggatgtcagaagaacat

SEQ ID NO: 264170 - DNA, 20 bp, Artificial Sequence
  chemically synthesized
gaagaacataggtctattta

SEQ ID NO: 264171 - DNA, 20 bp, Artificial Sequence
  chemically synthesized
caggtaaatctgactgtaaa

SEQ ID NO: 264172 - DNA, 20 bp, Artificial Sequence
  chemically synthesized
aacataggtctatttacagt

SEQ ID NO: 264173 - DNA, 20 bp, Artificial Sequence
  chemically synthesized
agaagcagttggaataaaac

SEQ ID NO: 264174 - DNA, 20 bp, Artificial Sequence
  chemically synthesized
aagaagcagttggaataaaa

SEQ ID NO: 264175 - DNA, 20 bp, Artificial Sequence
  chemically synthesized
tgagctagagaagaagcagt

SEQ ID NO: 264176 - DNA, 20 bp, Artificial Sequence
  chemically synthesized
gagatgagctagagaagaag

SEQ ID NO: 264177 - DNA, 20 bp, Artificial Sequence
  chemically synthesized
tattccaactgcttcttctc

SEQ ID NO: 264178 - DNA, 20 bp, Artificial Sequence
  chemically synthesized
ggagagatgagctagagaag

SEQ ID NO: 264179 - DNA, 20 bp, Artificial Sequence
  chemically synthesized
catggagagatgagctagag

SEQ ID NO: 264180 - DNA, 20 bp, Artificial Sequence
  chemically synthesized
attcatggagagatgagcta

SEQ ID NO: 264181 - DNA, 20 bp, Artificial Sequence
  chemically synthesized
aaattcatggagagatgagc

SEQ ID NO: 264182 - DNA, 20 bp, Artificial Sequence
  chemically synthesized
agttaaattcatggagagat

SEQ ID NO: 264183 - DNA, 20 bp, Artificial Sequence
  chemically synthesized
atagaagttaaattcatgga

SEQ ID NO: 264184 - DNA, 20 bp, Artificial Sequence
  chemically synthesized
taatagaagttaaattcatg

SEQ ID NO: 264185 - DNA, 20 bp, Artificial Sequence
  chemically synthesized
attaatagaagttaaattca

SEQ ID NO: 264186 - DNA, 20 bp, Artificial Sequence
  chemically synthesized
attgtatcttaaattaatag

SEQ ID NO: 264187 - DNA, 20 bp, Artificial Sequence
  chemically synthesized
aatttaacttctattaattt

SEQ ID NO: 264188 - DNA, 20 bp, Artificial Sequence
  chemically synthesized
aaaattgtatcttaaattaa

SEQ ID NO: 264189 - DNA, 20 bp, Artificial Sequence
  chemically synthesized
ataaaaaattgttaaattcg

SEQ ID NO: 264190 - DNA, 20 bp, Artificial Sequence
  chemically synthesized
aacaattttttatgccttcc

SEQ ID NO: 264191 - DNA, 20 bp, Artificial Sequence
  chemically synthesized
gcttagggtgaagacttgga

SEQ ID NO: 264192 - DNA, 20 bp, Artificial Sequence
  chemically synthesized
agcttagggtgaagacttgg

SEQ ID NO: 264193 - DNA, 20 bp, Artificial Sequence
  chemically synthesized
aacagcttagggtgaagact

SEQ ID NO: 264194 - DNA, 20 bp, Artificial Sequence
  chemically synthesized
gccttccaagtcttcaccct

SEQ ID NO: 264195 - DNA, 20 bp, Artificial Sequence
  chemically synthesized
tcagataacagcttagggtg

SEQ ID NO: 264196 - DNA, 20 bp, Artificial Sequence
  chemically synthesized
aaaagtcagataacagctta

SEQ ID NO: 264197 - DNA, 20 bp, Artificial Sequence
  chemically synthesized
caaaagtcagataacagctt

SEQ ID NO: 264198 - DNA, 20 bp, Artificial Sequence
  chemically synthesized
tcaaaagtcagataacagct

SEQ ID NO: 264199 - DNA, 20 bp, Artificial Sequence
  chemically synthesized
ggaattcaaaagtcagataa

SEQ ID NO: 264200 - DNA, 20 bp, Artificial Sequence
  chemically synthesized
ctagatgggaattcaaaagt

SEQ ID NO: 264201 - DNA, 20 bp, Artificial Sequence
  chemically synthesized
gagtctagatgggaattcaa

SEQ ID NO: 264202 - DNA, 20 bp, Artificial Sequence
  chemically synthesized
ctgacttttgaattcccatc

SEQ ID NO: 264203 - DNA, 20 bp, Artificial Sequence
  chemically synthesized
ggctattggagagtctagat

SEQ ID NO: 264204 - DNA, 20 bp, Artificial Sequence
  chemically synthesized
tggctattggagagtctaga

SEQ ID NO: 264205 - DNA, 20 bp, Artificial Sequence
  chemically synthesized
cagctggctattggagagtc

SEQ ID NO: 264206 - DNA, 20 bp, Artificial Sequence
  chemically synthesized
ttcccatctagactctccaa

SEQ ID NO: 264207 - DNA, 20 bp, Artificial Sequence
  chemically synthesized
aaattcagctggctattgga

SEQ ID NO: 264208 - DNA, 20 bp, Artificial Sequence
  chemically synthesized
catctagactctccaatagc

SEQ ID NO: 264209 - DNA, 20 bp, Artificial Sequence
  chemically synthesized
gaaaattcagctggctattg

SEQ ID NO: 264210 - DNA, 20 bp, Artificial Sequence
  chemically synthesized
gtgaaaattcagctggctat

SEQ ID NO: 264211 - DNA, 20 bp, Artificial Sequence
  chemically synthesized
acttcaggtgaaaattcagc

SEQ ID NO: 264212 - DNA, 20 bp, Artificial Sequence
  chemically synthesized
tgaaacttcaggtgaaaatt

SEQ ID NO: 264213 - DNA, 20 bp, Artificial Sequence
  chemically synthesized
gccagctgaattttcacctg

SEQ ID NO: 264214 - DNA, 20 bp, Artificial Sequence
  chemically synthesized
tactaggaatgtgaaacttc

SEQ ID NO: 264215 - DNA, 20 bp, Artificial Sequence
  chemically synthesized
atactaggaatgtgaaactt

SEQ ID NO: 264216 - DNA, 20 bp, Artificial Sequence
  chemically synthesized
cacctgaagtttcacattcc

SEQ ID NO: 264217 - DNA, 20 bp, Artificial Sequence
  chemically synthesized
gaagtttcacattcctagta

SEQ ID NO: 264218 - DNA, 20 bp, Artificial Sequence
  chemically synthesized
agtttcacattcctagtatg

SEQ ID NO: 264219 - DNA, 20 bp, Artificial Sequence
  chemically synthesized
aagataatgtgctccatact

SEQ ID NO: 264220 - DNA, 20 bp, Artificial Sequence
  chemically synthesized
aaagataatgtgctccatac

SEQ ID NO: 264221 - DNA, 20 bp, Artificial Sequence
  chemically synthesized
attgtaagcagtttgcggga

SEQ ID NO: 264222 - DNA, 20 bp, Artificial Sequence
  chemically synthesized
tagtattgtaagcagtttgc

SEQ ID NO: 264223 - DNA, 20 bp, Artificial Sequence
  chemically synthesized
ttagtattgtaagcagtttg

SEQ ID NO: 264224 - DNA, 20 bp, Artificial Sequence
  chemically synthesized
agggaagttagtattgtaag

SEQ ID NO: 264225 - DNA, 20 bp, Artificial Sequence
  chemically synthesized
actagggaagttagtattgt

SEQ ID NO: 264226 - DNA, 20 bp, Artificial Sequence
  chemically synthesized
gcttacaatactaacttccc

SEQ ID NO: 264227 - DNA, 20 bp, Artificial Sequence
  chemically synthesized
attaagagaactagggaagt

SEQ ID NO: 264228 - DNA, 20 bp, Artificial Sequence
  chemically synthesized
ttccattaagagaactaggg

SEQ ID NO: 264229 - DNA, 20 bp, Artificial Sequence
  chemically synthesized
gtcttccattaagagaacta

SEQ ID NO: 264230 - DNA, 20 bp, Artificial Sequence
  chemically synthesized
ggtcttccattaagagaact

SEQ ID NO: 264231 - DNA, 20 bp, Artificial Sequence
  chemically synthesized
tggtcttccattaagagaac

SEQ ID NO: 264232 - DNA, 20 bp, Artificial Sequence
  chemically synthesized
aacttccctagttctcttaa

SEQ ID NO: 264233 - DNA, 20 bp, Artificial Sequence
  chemically synthesized
ttccctagttctcttaatgg

SEQ ID NO: 264234 - DNA, 20 bp, Artificial Sequence
  chemically synthesized
gagaaatggtcttccattaa

SEQ ID NO: 264235 - DNA, 20 bp, Artificial Sequence
  chemically synthesized
gagagaaatggtcttccatt

SEQ ID NO: 264236 - DNA, 20 bp, Artificial Sequence
  chemically synthesized
taatggaagaccatttctct

SEQ ID NO: 264237 - DNA, 20 bp, Artificial Sequence
  chemically synthesized
gcctgaatgactgagagaaa

SEQ ID NO: 264238 - DNA, 20 bp, Artificial Sequence
  chemically synthesized
ttttacgcctgaatgactga

SEQ ID NO: 264239 - DNA, 20 bp, Artificial Sequence
  chemically synthesized
gaccatttctctcagtcatt

SEQ ID NO: 264240 - DNA, 20 bp, Artificial Sequence
  chemically synthesized
cgttttacgcctgaatgact

SEQ ID NO: 264241 - DNA, 20 bp, Artificial Sequence
  chemically synthesized
accatttctctcagtcattc

SEQ ID NO: 264242 - DNA, 20 bp, Artificial Sequence
  chemically synthesized
gtcattcaggcgtaaaacgt

SEQ ID NO: 264243 - DNA, 20 bp, Artificial Sequence
  chemically synthesized
tagagtgagatgttcaaaaa

SEQ ID NO: 264244 - DNA, 20 bp, Artificial Sequence
  chemically synthesized
tatttattagacattagagt

SEQ ID NO: 264245 - DNA, 20 bp, Artificial Sequence
  chemically synthesized
ttgatatttattagacatta

SEQ ID NO: 264246 - DNA, 20 bp, Artificial Sequence
  chemically synthesized
acttgatatttattagacat

SEQ ID NO: 264247 - DNA, 20 bp, Artificial Sequence
  chemically synthesized
gacacttacttgatatttat

SEQ ID NO: 264248 - DNA, 20 bp, Artificial Sequence
  chemically synthesized
tctaatgtctaataaatatc

SEQ ID NO: 264249 - DNA, 20 bp, Artificial Sequence
  chemically synthesized
atgtctaataaatatcaagt

SEQ ID NO: 264250 - DNA, 20 bp, Artificial Sequence
  chemically synthesized
caaagcaagtggatcatagc

SEQ ID NO: 264251 - DNA, 20 bp, Artificial Sequence
  chemically synthesized
aatacaaagcaagtggatca

SEQ ID NO: 264252 - DNA, 20 bp, Artificial Sequence
  chemically synthesized
ctctgggaatacaaagcaag

SEQ ID NO: 264253 - DNA, 20 bp, Artificial Sequence
  chemically synthesized
agtctctgggaatacaaagc

SEQ ID NO: 264254 - DNA, 20 bp, Artificial Sequence
  chemically synthesized
atggagtctctgggaataca

SEQ ID NO: 264255 - DNA, 20 bp, Artificial Sequence
  chemically synthesized
atccacttgctttgtattcc

SEQ ID NO: 264256 - DNA, 20 bp, Artificial Sequence
  chemically synthesized
ccacttgctttgtattccca

SEQ ID NO: 264257 - DNA, 20 bp, Artificial Sequence
  chemically synthesized
ccaggaacgatggagtctct

SEQ ID NO: 264258 - DNA, 20 bp, Artificial Sequence
  chemically synthesized
accaggaacgatggagtctc

SEQ ID NO: 264259 - DNA, 20 bp, Artificial Sequence
  chemically synthesized
tgtaaggaccaggaacgatg

SEQ ID NO: 264260 - DNA, 20 bp, Artificial Sequence
  chemically synthesized
cccagagactccatcgttcc

SEQ ID NO: 264261 - DNA, 20 bp, Artificial Sequence
  chemically synthesized
tgtgtaaggaccaggaacga

SEQ ID NO: 264262 - DNA, 20 bp, Artificial Sequence
  chemically synthesized
cttagttttgtgtaaggacc

SEQ ID NO: 264263 - DNA, 20 bp, Artificial Sequence
  chemically synthesized
ccttagttttgtgtaaggac

SEQ ID NO: 264264 - DNA, 20 bp, Artificial Sequence
  chemically synthesized
tattgccttagttttgtgta

SEQ ID NO: 264265 - DNA, 20 bp, Artificial Sequence
  chemically synthesized
ttattgccttagttttgtgt

SEQ ID NO: 264266 - DNA, 20 bp, Artificial Sequence
  chemically synthesized
cctggtccttacacaaaact

SEQ ID NO: 264267 - DNA, 20 bp, Artificial Sequence
  chemically synthesized
ctggtccttacacaaaacta

SEQ ID NO: 264268 - DNA, 20 bp, Artificial Sequence
  chemically synthesized
ttacacaaaactaaggcaat

SEQ ID NO: 264269 - DNA, 20 bp, Artificial Sequence
  chemically synthesized
cttttcaaagcttattgcct

SEQ ID NO: 264270 - DNA, 20 bp, Artificial Sequence
  chemically synthesized
ctaaggcaataagctttgaa

SEQ ID NO: 264271 - DNA, 20 bp, Artificial Sequence
  chemically synthesized
ggagattttacatcttttca

SEQ ID NO: 264272 - DNA, 20 bp, Artificial Sequence
  chemically synthesized
aaagatgtaaaatctccttt

SEQ ID NO: 264273 - DNA, 20 bp, Artificial Sequence
  chemically synthesized
ggaactggtttgactgaaag

SEQ ID NO: 264274 - DNA, 20 bp, Artificial Sequence
  chemically synthesized
ctggaactggtttgactgaa

SEQ ID NO: 264275 - DNA, 20 bp, Artificial Sequence
  chemically synthesized
gctggaactggtttgactga

SEQ ID NO: 264276 - DNA, 20 bp, Artificial Sequence
  chemically synthesized
aaatctcctttcagtcaaac

SEQ ID NO: 264277 - DNA, 20 bp, Artificial Sequence
  chemically synthesized
cctttcagtcaaaccagttc

SEQ ID NO: 264278 - DNA, 20 bp, Artificial Sequence
  chemically synthesized
cattgggcacaggctggaac

SEQ ID NO: 264279 - DNA, 20 bp, Artificial Sequence
  chemically synthesized
gctgatcattgggcacaggc

SEQ ID NO: 264280 - DNA, 20 bp, Artificial Sequence
  chemically synthesized
gtaagctgatcattgggcac

SEQ ID NO: 264281 - DNA, 20 bp, Artificial Sequence
  chemically synthesized
agtaagctgatcattgggca

SEQ ID NO: 264282 - DNA, 20 bp, Artificial Sequence
  chemically synthesized
tccagcctgtgcccaatgat

SEQ ID NO: 264283 - DNA, 20 bp, Artificial Sequence
  chemically synthesized
aacatagtaagctgatcatt

SEQ ID NO: 264284 - DNA, 20 bp, Artificial Sequence
  chemically synthesized
aaacatagtaagctgatcat

SEQ ID NO: 264285 - DNA, 20 bp, Artificial Sequence
  chemically synthesized
aaaggtttttgaaacatagt

SEQ ID NO: 264286 - DNA, 20 bp, Artificial Sequence
  chemically synthesized
aaagaaaggtttttgaaaca

SEQ ID NO: 264287 - DNA, 20 bp, Artificial Sequence
  chemically synthesized
taaatagcataatgaaagaa

SEQ ID NO: 264288 - DNA, 20 bp, Artificial Sequence
  chemically synthesized
ataaatagcataatgaaaga

SEQ ID NO: 264289 - DNA, 20 bp, Artificial Sequence
  chemically synthesized
gcaaataaatagcataatga

SEQ ID NO: 264290 - DNA, 20 bp, Artificial Sequence
  chemically synthesized
gaggttcttcagcaaataaa

SEQ ID NO: 264291 - DNA, 20 bp, Artificial Sequence
  chemically synthesized
attatgctatttatttgctg

SEQ ID NO: 264292 - DNA, 20 bp, Artificial Sequence
  chemically synthesized
aatagatgcaggaggttctt

SEQ ID NO: 264293 - DNA, 20 bp, Artificial Sequence
  chemically synthesized
ttatactcaatagatgcagg

SEQ ID NO: 264294 - DNA, 20 bp, Artificial Sequence
  chemically synthesized
tttatactcaatagatgcag

SEQ ID NO: 264295 - DNA, 20 bp, Artificial Sequence
  chemically synthesized
tatttatactcaatagatgc

SEQ ID NO: 264296 - DNA, 20 bp, Artificial Sequence
  chemically synthesized
ctatttatactcaatagatg

SEQ ID NO: 264297 - DNA, 20 bp, Artificial Sequence
  chemically synthesized
aagaacctcctgcatctatt

SEQ ID NO: 264298 - DNA, 20 bp, Artificial Sequence
  chemically synthesized
tttattctatttatactcaa

SEQ ID NO: 264299 - DNA, 20 bp, Artificial Sequence
  chemically synthesized
ctgcatctattgagtataaa

SEQ ID NO: 264300 - DNA, 20 bp, Artificial Sequence
  chemically synthesized
tattgagtataaatagaata

SEQ ID NO: 264301 - DNA, 20 bp, Artificial Sequence
  chemically synthesized
atagaataaagtccaacctc

SEQ ID NO: 264302 - DNA, 20 bp, Artificial Sequence
  chemically synthesized
ttgactactgtgctggaggt

SEQ ID NO: 264303 - DNA, 20 bp, Artificial Sequence
  chemically synthesized
ataaagtccaacctccagca

SEQ ID NO: 264304 - DNA, 20 bp, Artificial Sequence
  chemically synthesized
agccttgactactgtgctgg

SEQ ID NO: 264305 - DNA, 20 bp, Artificial Sequence
  chemically synthesized
aagccttgactactgtgctg

SEQ ID NO: 264306 - DNA, 20 bp, Artificial Sequence
  chemically synthesized
aagtccaacctccagcacag

SEQ ID NO: 264307 - DNA, 20 bp, Artificial Sequence
  chemically synthesized
agaagccttgactactgtgc

SEQ ID NO: 264308 - DNA, 20 bp, Artificial Sequence
  chemically synthesized
caacctccagcacagtagtc

SEQ ID NO: 264309 - DNA, 20 bp, Artificial Sequence
  chemically synthesized
aacctccagcacagtagtca

SEQ ID NO: 264310 - DNA, 20 bp, Artificial Sequence
  chemically synthesized
ctttggggcaagattaggag

SEQ ID NO: 264311 - DNA, 20 bp, Artificial Sequence
  chemically synthesized
agtctttggggcaagattag

SEQ ID NO: 264312 - DNA, 20 bp, Artificial Sequence
  chemically synthesized
caagtctttggggcaagatt

SEQ ID NO: 264313 - DNA, 20 bp, Artificial Sequence
  chemically synthesized
gcaagtctttggggcaagat

SEQ ID NO: 264314 - DNA, 20 bp, Artificial Sequence
  chemically synthesized
cttctcctaatcttgcccca

SEQ ID NO: 264315 - DNA, 20 bp, Artificial Sequence
  chemically synthesized
ggctggcaagtctttggggc

SEQ ID NO: 264316 - DNA, 20 bp, Artificial Sequence
  chemically synthesized
ataaggctggcaagtctttg

SEQ ID NO: 264317 - DNA, 20 bp, Artificial Sequence
  chemically synthesized
cataaggctggcaagtcttt

SEQ ID NO: 264318 - DNA, 20 bp, Artificial Sequence
  chemically synthesized
acataaggctggcaagtctt

SEQ ID NO: 264319 - DNA, 20 bp, Artificial Sequence
  chemically synthesized
atcttgccccaaagacttgc

SEQ ID NO: 264320 - DNA, 20 bp, Artificial Sequence
  chemically synthesized
aacacttacataaggctggc

SEQ ID NO: 264321 - DNA, 20 bp, Artificial Sequence
  chemically synthesized
taggaacacttacataaggc

SEQ ID NO: 264322 - DNA, 20 bp, Artificial Sequence
  chemically synthesized
aagacttgccagccttatgt

SEQ ID NO: 264323 - DNA, 20 bp, Artificial Sequence
  chemically synthesized
atattaggaacacttacata

SEQ ID NO: 264324 - DNA, 20 bp, Artificial Sequence
  chemically synthesized
tatattaggaacacttacat

SEQ ID NO: 264325 - DNA, 20 bp, Artificial Sequence
  chemically synthesized
ttatgtaagtgttcctaata

SEQ ID NO: 264326 - DNA, 20 bp, Artificial Sequence
  chemically synthesized
tgcaaaaaaaggtctatatt

SEQ ID NO: 264327 - DNA, 20 bp, Artificial Sequence
  chemically synthesized
ctgcaaaaaaaggtctatat

SEQ ID NO: 264328 - DNA, 20 bp, Artificial Sequence
  chemically synthesized
ctaatatagacctttttttg

SEQ ID NO: 264329 - DNA, 20 bp, Artificial Sequence
  chemically synthesized
accaaatggcctgcaaaaaa

SEQ ID NO: 264330 - DNA, 20 bp, Artificial Sequence
  chemically synthesized
taatatagacctttttttgc

SEQ ID NO: 264331 - DNA, 20 bp, Artificial Sequence
  chemically synthesized
caccaaatggcctgcaaaaa

SEQ ID NO: 264332 - DNA, 20 bp, Artificial Sequence
  chemically synthesized
acctttttttgcaggccatt

SEQ ID NO: 264333 - DNA, 20 bp, Artificial Sequence
  chemically synthesized
cataacagaagatcaccaaa

SEQ ID NO: 264334 - DNA, 20 bp, Artificial Sequence
  chemically synthesized
cattgaaggaggcataacag

SEQ ID NO: 264335 - DNA, 20 bp, Artificial Sequence
  chemically synthesized
ggtcattgaaggaggcataa

SEQ ID NO: 264336 - DNA, 20 bp, Artificial Sequence
  chemically synthesized
tattctaaggtcattgaagg

SEQ ID NO: 264337 - DNA, 20 bp, Artificial Sequence
  chemically synthesized
gtattctaaggtcattgaag

SEQ ID NO: 264338 - DNA, 20 bp, Artificial Sequence
  chemically synthesized
aagtattctaaggtcattga

SEQ ID NO: 264339 - DNA, 20 bp, Artificial Sequence
  chemically synthesized
aaagtattctaaggtcattg

SEQ ID NO: 264340 - DNA, 20 bp, Artificial Sequence
  chemically synthesized
tatgcctccttcaatgacct

SEQ ID NO: 264341 - DNA, 20 bp, Artificial Sequence
  chemically synthesized
agaagatgaaaagtattcta

SEQ ID NO: 264342 - DNA, 20 bp, Artificial Sequence
  chemically synthesized
tagaagatgaaaagtattct

SEQ ID NO: 264343 - DNA, 20 bp, Artificial Sequence
  chemically synthesized
gttcttcactagaagatgaa

SEQ ID NO: 264344 - DNA, 20 bp, Artificial Sequence
  chemically synthesized
ttagaatacttttcatcttc

SEQ ID NO: 264345 - DNA, 20 bp, Artificial Sequence
  chemically synthesized
atacttttcatcttctagtg

SEQ ID NO: 264346 - DNA, 20 bp, Artificial Sequence
  chemically synthesized
aagtttatgttcttcactag

SEQ ID NO: 264347 - DNA, 20 bp, Artificial Sequence
  chemically synthesized
cagaagtttatgttcttcac

SEQ ID NO: 264348 - DNA, 20 bp, Artificial Sequence
  chemically synthesized
atctatgcattttcatacag

SEQ ID NO: 264349 - DNA, 20 bp, Artificial Sequence
  chemically synthesized
tcaatctatgcattttcata

SEQ ID NO: 264350 - DNA, 20 bp, Artificial Sequence
  chemically synthesized
aacttctgtatgaaaatgca

SEQ ID NO: 264351 - DNA, 20 bp, Artificial Sequence
  chemically synthesized
gaaaatgcatagattgaatc

SEQ ID NO: 264352 - DNA, 20 bp, Artificial Sequence
  chemically synthesized
aaaatgcatagattgaatct

SEQ ID NO: 264353 - DNA, 20 bp, Artificial Sequence
  chemically synthesized
agctagtaaatggtagagcc

SEQ ID NO: 264354 - DNA, 20 bp, Artificial Sequence
  chemically synthesized
ccctcagctagtaaatggta

SEQ ID NO: 264355 - DNA, 20 bp, Artificial Sequence
  chemically synthesized
ttccctcagctagtaaatgg

SEQ ID NO: 264356 - DNA, 20 bp, Artificial Sequence
  chemically synthesized
atctgggctctaccatttac

SEQ ID NO: 264357 - DNA, 20 bp, Artificial Sequence
  chemically synthesized
aagttccctcagctagtaaa

SEQ ID NO: 264358 - DNA, 20 bp, Artificial Sequence
  chemically synthesized
ggctctaccatttactagct

SEQ ID NO: 264359 - DNA, 20 bp, Artificial Sequence
  chemically synthesized
gctctaccatttactagctg

SEQ ID NO: 264360 - DNA, 20 bp, Artificial Sequence
  chemically synthesized
ctctaccatttactagctga

SEQ ID NO: 264361 - DNA, 20 bp, Artificial Sequence
  chemically synthesized
cttgtctaagttccctcagc

SEQ ID NO: 264362 - DNA, 20 bp, Artificial Sequence
  chemically synthesized
ataacttgtctaagttccct

SEQ ID NO: 264363 - DNA, 20 bp, Artificial Sequence
  chemically synthesized
atttactagctgagggaact

SEQ ID NO: 264364 - DNA, 20 bp, Artificial Sequence
  chemically synthesized
ctagctgagggaacttagac

SEQ ID NO: 264365 - DNA, 20 bp, Artificial Sequence
  chemically synthesized
tgaggataaataacttgtct

SEQ ID NO: 264366 - DNA, 20 bp, Artificial Sequence
  chemically synthesized
aaagaaactgaggttcaatg

SEQ ID NO: 264367 - DNA, 20 bp, Artificial Sequence
  chemically synthesized
taaagaaactgaggttcaat

SEQ ID NO: 264368 - DNA, 20 bp, Artificial Sequence
  chemically synthesized
tatttatcctcattgaacct

SEQ ID NO: 264369 - DNA, 20 bp, Artificial Sequence
  chemically synthesized
tccatgttataaagaaactg

SEQ ID NO: 264370 - DNA, 20 bp, Artificial Sequence
  chemically synthesized
ctccatgttataaagaaact

SEQ ID NO: 264371 - DNA, 20 bp, Artificial Sequence
  chemically synthesized
acctcagtttctttataaca

SEQ ID NO: 264372 - DNA, 20 bp, Artificial Sequence
  chemically synthesized
catcttatctccatgttata

SEQ ID NO: 264373 - DNA, 20 bp, Artificial Sequence
  chemically synthesized
ctcagtttctttataacatg

SEQ ID NO: 264374 - DNA, 20 bp, Artificial Sequence
  chemically synthesized
tttctttataacatggagat

SEQ ID NO: 264375 - DNA, 20 bp, Artificial Sequence
  chemically synthesized
taagatgaatatctacctca

SEQ ID NO: 264376 - DNA, 20 bp, Artificial Sequence
  chemically synthesized
aagatgaatatctacctcac

SEQ ID NO: 264377 - DNA, 20 bp, Artificial Sequence
  chemically synthesized
agatgaatatctacctcaca

SEQ ID NO: 264378 - DNA, 20 bp, Artificial Sequence
  chemically synthesized
ttagtaatagccctgtgagg

SEQ ID NO: 264379 - DNA, 20 bp, Artificial Sequence
  chemically synthesized
atcttagtaatagccctgtg

SEQ ID NO: 264380 - DNA, 20 bp, Artificial Sequence
  chemically synthesized
gatcttagtaatagccctgt

SEQ ID NO: 264381 - DNA, 20 bp, Artificial Sequence
  chemically synthesized
tacctcacagggctattact

SEQ ID NO: 264382 - DNA, 20 bp, Artificial Sequence
  chemically synthesized
aacatatttgatcttagtaa

SEQ ID NO: 264383 - DNA, 20 bp, Artificial Sequence
  chemically synthesized
cattctaacatatttgatct

SEQ ID NO: 264384 - DNA, 20 bp, Artificial Sequence
  chemically synthesized
attactaagatcaaatatgt

SEQ ID NO: 264385 - DNA, 20 bp, Artificial Sequence
  chemically synthesized
taagatcaaatatgttagaa

SEQ ID NO: 264386 - DNA, 20 bp, Artificial Sequence
  chemically synthesized
aaatatgttagaatggtgtc

SEQ ID NO: 264387 - DNA, 20 bp, Artificial Sequence
  chemically synthesized
attaagcttttattatatac

SEQ ID NO: 264388 - DNA, 20 bp, Artificial Sequence
  chemically synthesized
tggtgtctggtatataataa

SEQ ID NO: 264389 - DNA, 20 bp, Artificial Sequence
  chemically synthesized
aataatagtcaacatttatt

SEQ ID NO: 264390 - DNA, 20 bp, Artificial Sequence
  chemically synthesized
agaagtttgagagaaaataa

SEQ ID NO: 264391 - DNA, 20 bp, Artificial Sequence
  chemically synthesized
atggacacatagaagtttga

SEQ ID NO: 264392 - DNA, 20 bp, Artificial Sequence
  chemically synthesized
ggatggacacatagaagttt

SEQ ID NO: 264393 - DNA, 20 bp, Artificial Sequence
  chemically synthesized
tatattggatggacacatag

SEQ ID NO: 264394 - DNA, 20 bp, Artificial Sequence
  chemically synthesized
atttatattggatggacaca

SEQ ID NO: 264395 - DNA, 20 bp, Artificial Sequence
  chemically synthesized
gagcatgtatttatattgga

SEQ ID NO: 264396 - DNA, 20 bp, Artificial Sequence
  chemically synthesized
tatagagcatgtatttatat

SEQ ID NO: 264397 - DNA, 20 bp, Artificial Sequence
  chemically synthesized
aataagacccaagatttata

SEQ ID NO: 264398 - DNA, 20 bp, Artificial Sequence
  chemically synthesized
aatacatgctctataaatct

SEQ ID NO: 264399 - DNA, 20 bp, Artificial Sequence
  chemically synthesized
aaaataagacccaagattta

SEQ ID NO: 264400 - DNA, 20 bp, Artificial Sequence
  chemically synthesized
atacatgctctataaatctt

SEQ ID NO: 264401 - DNA, 20 bp, Artificial Sequence
  chemically synthesized
agaggatcaaaataagaccc

SEQ ID NO: 264402 - DNA, 20 bp, Artificial Sequence
  chemically synthesized
gattttgagaggatcaaaat

SEQ ID NO: 264403 - DNA, 20 bp, Artificial Sequence
  chemically synthesized
tggatgattaggattttgag

SEQ ID NO: 264404 - DNA, 20 bp, Artificial Sequence
  chemically synthesized
atggatgattaggattttga

SEQ ID NO: 264405 - DNA, 20 bp, Artificial Sequence
  chemically synthesized
caatggatgattaggatttt

SEQ ID NO: 264406 - DNA, 20 bp, Artificial Sequence
  chemically synthesized
acctgagccaatggatgatt

SEQ ID NO: 264407 - DNA, 20 bp, Artificial Sequence
  chemically synthesized
gacctgagccaatggatgat

SEQ ID NO: 264408 - DNA, 20 bp, Artificial Sequence
  chemically synthesized
tcaaaatcctaatcatccat

SEQ ID NO: 264409 - DNA, 20 bp, Artificial Sequence
  chemically synthesized
atcctaatcatccattggct

SEQ ID NO: 264410 - DNA, 20 bp, Artificial Sequence
  chemically synthesized
tcctaatcatccattggctc

SEQ ID NO: 264411 - DNA, 20 bp, Artificial Sequence
  chemically synthesized
aagggcttgacctgagccaa

SEQ ID NO: 264412 - DNA, 20 bp, Artificial Sequence
  chemically synthesized
atcatccattggctcaggtc

SEQ ID NO: 264413 - DNA, 20 bp, Artificial Sequence
  chemically synthesized
aaggaggaagggcttgacct

SEQ ID NO: 264414 - DNA, 20 bp, Artificial Sequence
  chemically synthesized
catagatttcaaaggaggaa

SEQ ID NO: 264415 - DNA, 20 bp, Artificial Sequence
  chemically synthesized
ccatagatttcaaaggagga

SEQ ID NO: 264416 - DNA, 20 bp, Artificial Sequence
  chemically synthesized
accatagatttcaaaggagg

SEQ ID NO: 264417 - DNA, 20 bp, Artificial Sequence
  chemically synthesized
aaaaccatagatttcaaagg

SEQ ID NO: 264418 - DNA, 20 bp, Artificial Sequence
  chemically synthesized
taaaaccatagatttcaaag

SEQ ID NO: 264419 - DNA, 20 bp, Artificial Sequence
  chemically synthesized
tttaaaaccatagatttcaa

SEQ ID NO: 264420 - DNA, 20 bp, Artificial Sequence
  chemically synthesized
ctttaaaaccatagatttca

SEQ ID NO: 264421 - DNA, 20 bp, Artificial Sequence
  chemically synthesized
ccttcctcctttgaaatcta

SEQ ID NO: 264422 - DNA, 20 bp, Artificial Sequence
  chemically synthesized
tattttatcctttaaaacca

SEQ ID NO: 264423 - DNA, 20 bp, Artificial Sequence
  chemically synthesized
ctttgaaatctatggtttta

SEQ ID NO: 264424 - DNA, 20 bp, Artificial Sequence
  chemically synthesized
tttgaaatctatggttttaa

SEQ ID NO: 264425 - DNA, 20 bp, Artificial Sequence
  chemically synthesized
taaagactcattatatcaat

SEQ ID NO: 264426 - DNA, 20 bp, Artificial Sequence
  chemically synthesized
tacatgcttattgatataat

SEQ ID NO: 264427 - DNA, 20 bp, Artificial Sequence
  chemically synthesized
tcaaatcccttggtaaaata

SEQ ID NO: 264428 - DNA, 20 bp, Artificial Sequence
  chemically synthesized
taatgagtctttattttacc

SEQ ID NO: 264429 - DNA, 20 bp, Artificial Sequence
  chemically synthesized
aatgagtctttattttacca

SEQ ID NO: 264430 - DNA, 20 bp, Artificial Sequence
  chemically synthesized
atgagtctttattttaccaa

SEQ ID NO: 264431 - DNA, 20 bp, Artificial Sequence
  chemically synthesized
tatgatttcatcaaatccct

SEQ ID NO: 264432 - DNA, 20 bp, Artificial Sequence
  chemically synthesized
atgaaatcataacattgtaa

SEQ ID NO: 264433 - DNA, 20 bp, Artificial Sequence
  chemically synthesized
taacattgtaatggtgaaca

SEQ ID NO: 264434 - DNA, 20 bp, Artificial Sequence
  chemically synthesized
acattgtaatggtgaacatg

SEQ ID NO: 264435 - DNA, 20 bp, Artificial Sequence
  chemically synthesized
cattgtaatggtgaacatgg

SEQ ID NO: 264436 - DNA, 20 bp, Artificial Sequence
  chemically synthesized
atggtgaacatggaggattt

SEQ ID NO: 264437 - DNA, 20 bp, Artificial Sequence
  chemically synthesized
acatggaggattttagattc

SEQ ID NO: 264438 - DNA, 20 bp, Artificial Sequence
  chemically synthesized
gaggattttagattccagtt

SEQ ID NO: 264439 - DNA, 20 bp, Artificial Sequence
  chemically synthesized
gattttagattccagtttgg

SEQ ID NO: 264440 - DNA, 20 bp, Artificial Sequence
  chemically synthesized
attatgtaactctaccaaac

SEQ ID NO: 264441 - DNA, 20 bp, Artificial Sequence
  chemically synthesized
ttttagattccagtttggta

SEQ ID NO: 264442 - DNA, 20 bp, Artificial Sequence
  chemically synthesized
ggtagagttacataatcctg

SEQ ID NO: 264443 - DNA, 20 bp, Artificial Sequence
  chemically synthesized
aatctgtagttttgttcttc

SEQ ID NO: 264444 - DNA, 20 bp, Artificial Sequence
  chemically synthesized
taatctgtagttttgttctt

SEQ ID NO: 264445 - DNA, 20 bp, Artificial Sequence
  chemically synthesized
aatcctgaagaacaaaacta

SEQ ID NO: 264446 - DNA, 20 bp, Artificial Sequence
  chemically synthesized
gccgcagataaattaatctg

SEQ ID NO: 264447 - DNA, 20 bp, Artificial Sequence
  chemically synthesized
actacagattaatttatctg

SEQ ID NO: 264448 - DNA, 20 bp, Artificial Sequence
  chemically synthesized
tatcactttttatattgccg

SEQ ID NO: 264449 - DNA, 20 bp, Artificial Sequence
  chemically synthesized
tttatctgcggcaatataaa

SEQ ID NO: 264450 - DNA, 20 bp, Artificial Sequence
  chemically synthesized
caatataaaaagtgatatca

SEQ ID NO: 264451 - DNA, 20 bp, Artificial Sequence
  chemically synthesized
tgatatcacagccttgcatt

SEQ ID NO: 264452 - DNA, 20 bp, Artificial Sequence
  chemically synthesized
caccctgtaaactaaatgca

SEQ ID NO: 264453 - DNA, 20 bp, Artificial Sequence
  chemically synthesized
gcaccctgtaaactaaatgc

SEQ ID NO: 264454 - DNA, 20 bp, Artificial Sequence
  chemically synthesized
acagccttgcatttagttta

SEQ ID NO: 264455 - DNA, 20 bp, Artificial Sequence
  chemically synthesized
cagccttgcatttagtttac

SEQ ID NO: 264456 - DNA, 20 bp, Artificial Sequence
  chemically synthesized
agccttgcatttagtttaca

SEQ ID NO: 264457 - DNA, 20 bp, Artificial Sequence
  chemically synthesized
tgcatttagtttacagggtg

SEQ ID NO: 264458 - DNA, 20 bp, Artificial Sequence
  chemically synthesized
tgcagttttttttttttaat

SEQ ID NO: 264459 - DNA, 20 bp, Artificial Sequence
  chemically synthesized
gcagttttttttttttaatc

SEQ ID NO: 264460 - DNA, 20 bp, Artificial Sequence
  chemically synthesized
ttttttaatcaggaattatt

SEQ ID NO: 264461 - DNA, 20 bp, Artificial Sequence
  chemically synthesized
ttttaatcaggaattatttg

SEQ ID NO: 264462 - DNA, 20 bp, Artificial Sequence
  chemically synthesized
aatcaggaattatttggaga

SEQ ID NO: 264463 - DNA, 20 bp, Artificial Sequence
  chemically synthesized
ggaattatttggagacagaa

SEQ ID NO: 264464 - DNA, 20 bp, Artificial Sequence
  chemically synthesized
gaattatttggagacagaaa

SEQ ID NO: 264465 - DNA, 20 bp, Artificial Sequence
  chemically synthesized
gagacagaaaaggcatacca

SEQ ID NO: 264466 - DNA, 20 bp, Artificial Sequence
  chemically synthesized
gaaaaggcataccacagata

SEQ ID NO: 264467 - DNA, 20 bp, Artificial Sequence
  chemically synthesized
caccccactgactgtatctg

SEQ ID NO: 264468 - DNA, 20 bp, Artificial Sequence
  chemically synthesized
aggcataccacagatacagt

SEQ ID NO: 264469 - DNA, 20 bp, Artificial Sequence
  chemically synthesized
cataccacagatacagtcag

SEQ ID NO: 264470 - DNA, 20 bp, Artificial Sequence
  chemically synthesized
ataccacagatacagtcagt

SEQ ID NO: 264471 - DNA, 20 bp, Artificial Sequence
  chemically synthesized
taccacagatacagtcagtg

SEQ ID NO: 264472 - DNA, 20 bp, Artificial Sequence
  chemically synthesized
agtcagtggggtgtgttccc

SEQ ID NO: 264473 - DNA, 20 bp, Artificial Sequence
  chemically synthesized
tcagctccataggatgtcta

SEQ ID NO: 264474 - DNA, 20 bp, Artificial Sequence
  chemically synthesized
ctcagctccataggatgtct

SEQ ID NO: 264475 - DNA, 20 bp, Artificial Sequence
  chemically synthesized
actcagctccataggatgtc

SEQ ID NO: 264476 - DNA, 20 bp, Artificial Sequence
  chemically synthesized
tgtgttccctagacatccta

SEQ ID NO: 264477 - DNA, 20 bp, Artificial Sequence
  chemically synthesized
tgttccctagacatcctatg

SEQ ID NO: 264478 - DNA, 20 bp, Artificial Sequence
  chemically synthesized
catgagaaactcagctccat

SEQ ID NO: 264479 - DNA, 20 bp, Artificial Sequence
  chemically synthesized
cctagacatcctatggagct

SEQ ID NO: 264480 - DNA, 20 bp, Artificial Sequence
  chemically synthesized
acatgagaaactcagctcca

SEQ ID NO: 264481 - DNA, 20 bp, Artificial Sequence
  chemically synthesized
taggttgaacatgagaaact

SEQ ID NO: 264482 - DNA, 20 bp, Artificial Sequence
  chemically synthesized
aatgactgtaggttgaacat

SEQ ID NO: 264483 - DNA, 20 bp, Artificial Sequence
  chemically synthesized
agtttctcatgttcaaccta

SEQ ID NO: 264484 - DNA, 20 bp, Artificial Sequence
  chemically synthesized
tatgtaccagaaatgactgt

SEQ ID NO: 264485 - DNA, 20 bp, Artificial Sequence
  chemically synthesized
ctatgtaccagaaatgactg

SEQ ID NO: 264486 - DNA, 20 bp, Artificial Sequence
  chemically synthesized
gttcaacctacagtcatttc

SEQ ID NO: 264487 - DNA, 20 bp, Artificial Sequence
  chemically synthesized
ctacagtcatttctggtaca

SEQ ID NO: 264488 - DNA, 20 bp, Artificial Sequence
  chemically synthesized
tatgaatatttactatgtac

SEQ ID NO: 264489 - DNA, 20 bp, Artificial Sequence
  chemically synthesized
ggtacatagtaaatattcat

SEQ ID NO: 264490 - DNA, 20 bp, Artificial Sequence
  chemically synthesized
ttttgttcatttattttttc

SEQ ID NO: 264491 - DNA, 20 bp, Artificial Sequence
  chemically synthesized
cttttgttcatttatttttt

SEQ ID NO: 264492 - DNA, 20 bp, Artificial Sequence
  chemically synthesized
ctgaaaaaataaatgaacaa

SEQ ID NO: 264493 - DNA, 20 bp, Artificial Sequence
  chemically synthesized
tgaacaaaagactaaaaatt

SEQ ID NO: 264494 - DNA, 20 bp, Artificial Sequence
  chemically synthesized
gaacaaaagactaaaaattg

SEQ ID NO: 264495 - DNA, 20 bp, Artificial Sequence
  chemically synthesized
ctattttggccctcaatttt

SEQ ID NO: 264496 - DNA, 20 bp, Artificial Sequence
  chemically synthesized
aacaaaagactaaaaattga

SEQ ID NO: 264497 - DNA, 20 bp, Artificial Sequence
  chemically synthesized
ctaaaaattgagggccaaaa

SEQ ID NO: 264498 - DNA, 20 bp, Artificial Sequence
  chemically synthesized
gctccttgaaatgtctattt

SEQ ID NO: 264499 - DNA, 20 bp, Artificial Sequence
  chemically synthesized
agggccaaaatagacatttc

SEQ ID NO: 264500 - DNA, 20 bp, Artificial Sequence
  chemically synthesized
gggccaaaatagacatttca

SEQ ID NO: 264501 - DNA, 20 bp, Artificial Sequence
  chemically synthesized
gccaaaatagacatttcaag

SEQ ID NO: 264502 - DNA, 20 bp, Artificial Sequence
  chemically synthesized
gacatttcaaggagcttttt

SEQ ID NO: 264503 - DNA, 20 bp, Artificial Sequence
  chemically synthesized
aaaattccatgtcactaaaa

SEQ ID NO: 264504 - DNA, 20 bp, Artificial Sequence
  chemically synthesized
aaggagcttttttagtgaca

SEQ ID NO: 264505 - DNA, 20 bp, Artificial Sequence
  chemically synthesized
taaataacacaatttctatg

SEQ ID NO: 264506 - DNA, 20 bp, Artificial Sequence
  chemically synthesized
ggtcttttgacatttctaca

SEQ ID NO: 264507 - DNA, 20 bp, Artificial Sequence
  chemically synthesized
tttctatgtagaaatgtcaa

SEQ ID NO: 264508 - DNA, 20 bp, Artificial Sequence
  chemically synthesized
gaaatgtcaaaagacctgac

SEQ ID NO: 264509 - DNA, 20 bp, Artificial Sequence
  chemically synthesized
tgtcaaaagacctgactggt

SEQ ID NO: 264510 - DNA, 20 bp, Artificial Sequence
  chemically synthesized
tcatataatgctaaccagtc

SEQ ID NO: 264511 - DNA, 20 bp, Artificial Sequence
  chemically synthesized
ctcatataatgctaaccagt

SEQ ID NO: 264512 - DNA, 20 bp, Artificial Sequence
  chemically synthesized
catactcatataatgctaac

SEQ ID NO: 264513 - DNA, 20 bp, Artificial Sequence
  chemically synthesized
ctgactggttagcattatat

SEQ ID NO: 264514 - DNA, 20 bp, Artificial Sequence
  chemically synthesized
gttgcttagcatttgggcag

SEQ ID NO: 264515 - DNA, 20 bp, Artificial Sequence
  chemically synthesized
catgttgcttagcatttggg

SEQ ID NO: 264516 - DNA, 20 bp, Artificial Sequence
  chemically synthesized
ttaactgctgcccaaatgct

SEQ ID NO: 264517 - DNA, 20 bp, Artificial Sequence
  chemically synthesized
tatcatgttgcttagcattt

SEQ ID NO: 264518 - DNA, 20 bp, Artificial Sequence
  chemically synthesized
gtatcatgttgcttagcatt

SEQ ID NO: 264519 - DNA, 20 bp, Artificial Sequence
  chemically synthesized
cctggtggtatcatgttgct

SEQ ID NO: 264520 - DNA, 20 bp, Artificial Sequence
  chemically synthesized
gctaagcaacatgataccac

SEQ ID NO: 264521 - DNA, 20 bp, Artificial Sequence
  chemically synthesized
ctaagcaacatgataccacc

SEQ ID NO: 264522 - DNA, 20 bp, Artificial Sequence
  chemically synthesized
ccttttttgtgtttacctgg

SEQ ID NO: 264523 - DNA, 20 bp, Artificial Sequence
  chemically synthesized
cccccttttttgtgtttacc

SEQ ID NO: 264524 - DNA, 20 bp, Artificial Sequence
  chemically synthesized
accaccaggtaaacacaaaa

SEQ ID NO: 264525 - DNA, 20 bp, Artificial Sequence
  chemically synthesized
ccaccaggtaaacacaaaaa

SEQ ID NO: 264526 - DNA, 20 bp, Artificial Sequence
  chemically synthesized
caccaggtaaacacaaaaaa

SEQ ID NO: 264527 - DNA, 20 bp, Artificial Sequence
  chemically synthesized
accaggtaaacacaaaaaag

SEQ ID NO: 264528 - DNA, 20 bp, Artificial Sequence
  chemically synthesized
ccaggtaaacacaaaaaagg

SEQ ID NO: 264529 - DNA, 20 bp, Artificial Sequence
  chemically synthesized
ggtaaacacaaaaaaggggg

SEQ ID NO: 264530 - DNA, 20 bp, Artificial Sequence
  chemically synthesized
aaaaagggggaagatgtaaa

SEQ ID NO: 264531 - DNA, 20 bp, Artificial Sequence
  chemically synthesized
aaagggggaagatgtaaaaa

SEQ ID NO: 264532 - DNA, 20 bp, Artificial Sequence
  chemically synthesized
ggaagatgtaaaaagagctt

SEQ ID NO: 264533 - DNA, 20 bp, Artificial Sequence
  chemically synthesized
gaagatgtaaaaagagcttt

SEQ ID NO: 264534 - DNA, 20 bp, Artificial Sequence
  chemically synthesized
agatgtaaaaagagctttgg

SEQ ID NO: 264535 - DNA, 20 bp, Artificial Sequence
  chemically synthesized
atgtaaaaagagctttggga

SEQ ID NO: 264536 - DNA, 20 bp, Artificial Sequence
  chemically synthesized
gtttttggtagtctctccca

SEQ ID NO: 264537 - DNA, 20 bp, Artificial Sequence
  chemically synthesized
attagcacttcagtttttgg

SEQ ID NO: 264538 - DNA, 20 bp, Artificial Sequence
  chemically synthesized
ggagagactaccaaaaactg

SEQ ID NO: 264539 - DNA, 20 bp, Artificial Sequence
  chemically synthesized
ataattagcacttcagtttt

SEQ ID NO: 264540 - DNA, 20 bp, Artificial Sequence
  chemically synthesized
tgcctgaataattagcactt

SEQ ID NO: 264541 - DNA, 20 bp, Artificial Sequence
  chemically synthesized
aaactgaagtgctaattatt

SEQ ID NO: 264542 - DNA, 20 bp, Artificial Sequence
  chemically synthesized
aactgaagtgctaattattc

SEQ ID NO: 264543 - DNA, 20 bp, Artificial Sequence
  chemically synthesized
cattatcttgcctgaataat

SEQ ID NO: 264544 - DNA, 20 bp, Artificial Sequence
  chemically synthesized
gaagtgctaattattcaggc

SEQ ID NO: 264545 - DNA, 20 bp, Artificial Sequence
  chemically synthesized
taattattcaggcaagataa

SEQ ID NO: 264546 - DNA, 20 bp, Artificial Sequence
  chemically synthesized
caggcaagataatggaaact

SEQ ID NO: 264547 - DNA, 20 bp, Artificial Sequence
  chemically synthesized
acattgaactaaagaagtct

SEQ ID NO: 264548 - DNA, 20 bp, Artificial Sequence
  chemically synthesized
aatggaaacttagacttctt

SEQ ID NO: 264549 - DNA, 20 bp, Artificial Sequence
  chemically synthesized
ccctacacattgaactaaag

SEQ ID NO: 264550 - DNA, 20 bp, Artificial Sequence
  chemically synthesized
agaccctacacattgaacta

SEQ ID NO: 264551 - DNA, 20 bp, Artificial Sequence
  chemically synthesized
gacttctttagttcaatgtg

SEQ ID NO: 264552 - DNA, 20 bp, Artificial Sequence
  chemically synthesized
acttctttagttcaatgtgt

SEQ ID NO: 264553 - DNA, 20 bp, Artificial Sequence
  chemically synthesized
cttctttagttcaatgtgta

SEQ ID NO: 264554 - DNA, 20 bp, Artificial Sequence
  chemically synthesized
tagtctttcattggaaaatt

SEQ ID NO: 264555 - DNA, 20 bp, Artificial Sequence
  chemically synthesized
gggtctaaattttccaatga

SEQ ID NO: 264556 - DNA, 20 bp, Artificial Sequence
  chemically synthesized
aatgcacggtagtctttcat

SEQ ID NO: 264557 - DNA, 20 bp, Artificial Sequence
  chemically synthesized
tttttaaacaaaatgcacgg

SEQ ID NO: 264558 - DNA, 20 bp, Artificial Sequence
  chemically synthesized
atttttttaaacaaaatgca

SEQ ID NO: 264559 - DNA, 20 bp, Artificial Sequence
  chemically synthesized
tgcattttgtttaaaaaaat

SEQ ID NO: 264560 - DNA, 20 bp, Artificial Sequence
  chemically synthesized
gcattttgtttaaaaaaatt

SEQ ID NO: 264561 - DNA, 20 bp, Artificial Sequence
  chemically synthesized
ttttgtttaaaaaaattagg

SEQ ID NO: 264562 - DNA, 20 bp, Artificial Sequence
  chemically synthesized
ttaaaaaaattaggaagatt

SEQ ID NO: 264563 - DNA, 20 bp, Artificial Sequence
  chemically synthesized
attaggaagattaagaattt

SEQ ID NO: 264564 - DNA, 20 bp, Artificial Sequence
  chemically synthesized
aggaagattaagaatttgag

SEQ ID NO: 264565 - DNA, 20 bp, Artificial Sequence
  chemically synthesized
ttgagtagttttattttgtg

SEQ ID NO: 264566 - DNA, 20 bp, Artificial Sequence
  chemically synthesized
ttttattttgtgtagtttca

SEQ ID NO: 264567 - DNA, 20 bp, Artificial Sequence
  chemically synthesized
tcaaagtgattaactaaaat

SEQ ID NO: 264568 - DNA, 20 bp, Artificial Sequence
  chemically synthesized
aagtgattaactaaaatcag

SEQ ID NO: 264569 - DNA, 20 bp, Artificial Sequence
  chemically synthesized
taatttttgcccactgattt

SEQ ID NO: 264570 - DNA, 20 bp, Artificial Sequence
  chemically synthesized
agtgattaactaaaatcagt

SEQ ID NO: 264571 - DNA, 20 bp, Artificial Sequence
  chemically synthesized
atcagtgggcaaaaattatt

SEQ ID NO: 264572 - DNA, 20 bp, Artificial Sequence
  chemically synthesized
cagtgggcaaaaattatttg

SEQ ID NO: 264573 - DNA, 20 bp, Artificial Sequence
  chemically synthesized
attatttggagcctaaattt

SEQ ID NO: 264574 - DNA, 20 bp, Artificial Sequence
  chemically synthesized
ttatttggagcctaaatttt

SEQ ID NO: 264575 - DNA, 20 bp, Artificial Sequence
  chemically synthesized
cttatataaacctaaaattt

SEQ ID NO: 264576 - DNA, 20 bp, Artificial Sequence
  chemically synthesized
tcttatataaacctaaaatt

SEQ ID NO: 264577 - DNA, 20 bp, Artificial Sequence
  chemically synthesized
cctaaattttaggtttatat

SEQ ID NO: 264578 - DNA, 20 bp, Artificial Sequence
  chemically synthesized
tttatataagaacaactgat

SEQ ID NO: 264579 - DNA, 20 bp, Artificial Sequence
  chemically synthesized
ttatataagaacaactgatg

SEQ ID NO: 264580 - DNA, 20 bp, Artificial Sequence
  chemically synthesized
aaaaaaattgcagtcctcat

SEQ ID NO: 264581 - DNA, 20 bp, Artificial Sequence
  chemically synthesized
cagtgtttttaaaaaaattg

SEQ ID NO: 264582 - DNA, 20 bp, Artificial Sequence
  chemically synthesized
ttttaaaaacactgattttc

SEQ ID NO: 264583 - DNA, 20 bp, Artificial Sequence
  chemically synthesized
atttagcattacttgaaaat

SEQ ID NO: 264584 - DNA, 20 bp, Artificial Sequence
  chemically synthesized
agtctctgcttataaacatt

SEQ ID NO: 264585 - DNA, 20 bp, Artificial Sequence
  chemically synthesized
aagtaatgctaaatgtttat

SEQ ID NO: 264586 - DNA, 20 bp, Artificial Sequence
  chemically synthesized
taatgctaaatgtttataag

SEQ ID NO: 264587 - DNA, 20 bp, Artificial Sequence
  chemically synthesized
atgctaaatgtttataagca

SEQ ID NO: 264588 - DNA, 20 bp, Artificial Sequence
  chemically synthesized
aaatgtttataagcagagac

SEQ ID NO: 264589 - DNA, 20 bp, Artificial Sequence
  chemically synthesized
tttataagcagagactagat

SEQ ID NO: 264590 - DNA, 20 bp, Artificial Sequence
  chemically synthesized
ttataagcagagactagatg

SEQ ID NO: 264591 - DNA, 20 bp, Artificial Sequence
  chemically synthesized
tgactgaatacatcctcatc

SEQ ID NO: 264592 - DNA, 20 bp, Artificial Sequence
  chemically synthesized
agactagatgaggatgtatt

SEQ ID NO: 264593 - DNA, 20 bp, Artificial Sequence
  chemically synthesized
ggatgtattcagtcacattt

SEQ ID NO: 264594 - DNA, 20 bp, Artificial Sequence
  chemically synthesized
gatgtattcagtcacatttt

SEQ ID NO: 264595 - DNA, 20 bp, Artificial Sequence
  chemically synthesized
ggaacaaaatccttttcaca

SEQ ID NO: 264596 - DNA, 20 bp, Artificial Sequence
  chemically synthesized
aagaaaatgtctgtgtgaaa

SEQ ID NO: 264597 - DNA, 20 bp, Artificial Sequence
  chemically synthesized
taagaaaatgtctgtgtgaa

SEQ ID NO: 264598 - DNA, 20 bp, Artificial Sequence
  chemically synthesized
ctgtaaggttataaaatttt

SEQ ID NO: 264599 - DNA, 20 bp, Artificial Sequence
  chemically synthesized
cttaaaattttataacctta

SEQ ID NO: 264600 - DNA, 20 bp, Artificial Sequence
  chemically synthesized
aaattttataaccttacagt

SEQ ID NO: 264601 - DNA, 20 bp, Artificial Sequence
  chemically synthesized
agagacaagaacttactgta

SEQ ID NO: 264602 - DNA, 20 bp, Artificial Sequence
  chemically synthesized
tagagacaagaacttactgt

SEQ ID NO: 264603 - DNA, 20 bp, Artificial Sequence
  chemically synthesized
ttctacttgaatttagagac

SEQ ID NO: 264604 - DNA, 20 bp, Artificial Sequence
  chemically synthesized
aagttcttgtctctaaattc

SEQ ID NO: 264605 - DNA, 20 bp, Artificial Sequence
  chemically synthesized
aaaagttctacttgaattta

SEQ ID NO: 264606 - DNA, 20 bp, Artificial Sequence
  chemically synthesized
ataaaagttctacttgaatt

SEQ ID NO: 264607 - DNA, 20 bp, Artificial Sequence
  chemically synthesized
ttcttgtctctaaattcaag

SEQ ID NO: 264608 - DNA, 20 bp, Artificial Sequence
  chemically synthesized
aaattcaagtagaactttta

SEQ ID NO: 264609 - DNA, 20 bp, Artificial Sequence
  chemically synthesized
ttcaagtagaacttttatag

SEQ ID NO: 264610 - DNA, 20 bp, Artificial Sequence
  chemically synthesized
attgagctgcactactataa

SEQ ID NO: 264611 - DNA, 20 bp, Artificial Sequence
  chemically synthesized
gtagaacttttatagtagtg

SEQ ID NO: 264612 - DNA, 20 bp, Artificial Sequence
  chemically synthesized
tttatagtagtgcagctcaa

SEQ ID NO: 264613 - DNA, 20 bp, Artificial Sequence
  chemically synthesized
gcatgtattatatttctatt

SEQ ID NO: 264614 - DNA, 20 bp, Artificial Sequence
  chemically synthesized
aatatttaaaattacatata

SEQ ID NO: 264615 - DNA, 20 bp, Artificial Sequence
  chemically synthesized
atatgtaattttaaatattc

SEQ ID NO: 264616 - DNA, 20 bp, Artificial Sequence
  chemically synthesized
tttaaatattctagttgcca

SEQ ID NO: 264617 - DNA, 20 bp, Artificial Sequence
  chemically synthesized
ttgttttttactatggcaac

SEQ ID NO: 264618 - DNA, 20 bp, Artificial Sequence
  chemically synthesized
ctgttttttgttttttacta

SEQ ID NO: 264619 - DNA, 20 bp, Artificial Sequence
  chemically synthesized
ccatagtaaaaaacaaaaaa

SEQ ID NO: 264620 - DNA, 20 bp, Artificial Sequence
  chemically synthesized
tttggacatctcagtgaaat

SEQ ID NO: 264621 - DNA, 20 bp, Artificial Sequence
  chemically synthesized
ttaattttactgatttcact

SEQ ID NO: 264622 - DNA, 20 bp, Artificial Sequence
  chemically synthesized
atacaataatttggacatct

SEQ ID NO: 264623 - DNA, 20 bp, Artificial Sequence
  chemically synthesized
tatgagtttatacaataatt

SEQ ID NO: 264624 - DNA, 20 bp, Artificial Sequence
  chemically synthesized
catatttttgtattgattat

SEQ ID NO: 264625 - DNA, 20 bp, Artificial Sequence
  chemically synthesized
aaatatgtgtgggttttgaa

SEQ ID NO: 264626 - DNA, 20 bp, Artificial Sequence
  chemically synthesized
taaaatatgtgtgggttttg

SEQ ID NO: 264627 - DNA, 20 bp, Artificial Sequence
  chemically synthesized
aataagtgtaaaatatgtgt

SEQ ID NO: 264628 - DNA, 20 bp, Artificial Sequence
  chemically synthesized
aaataagtgtaaaatatgtg

SEQ ID NO: 264629 - DNA, 20 bp, Artificial Sequence
  chemically synthesized
ccatgttaagatttataaat

SEQ ID NO: 264630 - DNA, 20 bp, Artificial Sequence
  chemically synthesized
cttatttataaatcttaaca

SEQ ID NO: 264631 - DNA, 20 bp, Artificial Sequence
  chemically synthesized
tatttataaatcttaacatg

SEQ ID NO: 264632 - DNA, 20 bp, Artificial Sequence
  chemically synthesized
aaatttggctactccatgtt

SEQ ID NO: 264633 - DNA, 20 bp, Artificial Sequence
  chemically synthesized
ttataaatcttaacatggag

SEQ ID NO: 264634 - DNA, 20 bp, Artificial Sequence
  chemically synthesized
gccactgagctttagaaatt

SEQ ID NO: 264635 - DNA, 20 bp, Artificial Sequence
  chemically synthesized
atggagtagccaaatttcta

SEQ ID NO: 264636 - DNA, 20 bp, Artificial Sequence
  chemically synthesized
gtagccaaatttctaaagct

SEQ ID NO: 264637 - DNA, 20 bp, Artificial Sequence
  chemically synthesized
cacatgtggccactgagctt

SEQ ID NO: 264638 - DNA, 20 bp, Artificial Sequence
  chemically synthesized
gccaaatttctaaagctcag

SEQ ID NO: 264639 - DNA, 20 bp, Artificial Sequence
  chemically synthesized
atgaaccacatgtggccact

SEQ ID NO: 264640 - DNA, 20 bp, Artificial Sequence
  chemically synthesized
taaagctcagtggccacatg

SEQ ID NO: 264641 - DNA, 20 bp, Artificial Sequence
  chemically synthesized
aggtggtcatgaaccacatg

SEQ ID NO: 264642 - DNA, 20 bp, Artificial Sequence
  chemically synthesized
gtggttcatgaccaccttat

SEQ ID NO: 264643 - DNA, 20 bp, Artificial Sequence
  chemically synthesized
tggttcatgaccaccttatt

SEQ ID NO: 264644 - DNA, 20 bp, Artificial Sequence
  chemically synthesized
ctctatactgcctaataagg

SEQ ID NO: 264645 - DNA, 20 bp, Artificial Sequence
  chemically synthesized
ttcatgaccaccttattagg

SEQ ID NO: 264646 - DNA, 20 bp, Artificial Sequence
  chemically synthesized
gagctctatactgcctaata

SEQ ID NO: 264647 - DNA, 20 bp, Artificial Sequence
  chemically synthesized
agagctctatactgcctaat

SEQ ID NO: 264648 - DNA, 20 bp, Artificial Sequence
  chemically synthesized
gaccaccttattaggcagta

SEQ ID NO: 264649 - DNA, 20 bp, Artificial Sequence
  chemically synthesized
ccaccttattaggcagtata

SEQ ID NO: 264650 - DNA, 20 bp, Artificial Sequence
  chemically synthesized
tatgagtataatggttaata

SEQ ID NO: 264651 - DNA, 20 bp, Artificial Sequence
  chemically synthesized
gttatgagtataatggttaa

SEQ ID NO: 264652 - DNA, 20 bp, Artificial Sequence
  chemically synthesized
ttacaatgttatgagtataa

SEQ ID NO: 264653 - DNA, 20 bp, Artificial Sequence
  chemically synthesized
ttagttctttacaatgttat

SEQ ID NO: 264654 - DNA, 20 bp, Artificial Sequence
  chemically synthesized
attatactcataacattgta

SEQ ID NO: 264655 - DNA, 20 bp, Artificial Sequence
  chemically synthesized
tcaaagtaattatgagatat

SEQ ID NO: 264656 - DNA, 20 bp, Artificial Sequence
  chemically synthesized
attttattcaaagtaattat

SEQ ID NO: 264657 - DNA, 20 bp, Artificial Sequence
  chemically synthesized
aaacattactattttattca

SEQ ID NO: 264658 - DNA, 20 bp, Artificial Sequence
  chemically synthesized
cataattactttgaataaaa

SEQ ID NO: 264659 - DNA, 20 bp, Artificial Sequence
  chemically synthesized
aatgttttgtttataacttg

SEQ ID NO: 264660 - DNA, 20 bp, Artificial Sequence
  chemically synthesized
gaataatctaaattcaccac

SEQ ID NO: 264661 - DNA, 20 bp, Artificial Sequence
  chemically synthesized
tttataacttgtggtgaatt

SEQ ID NO: 264662 - DNA, 20 bp, Artificial Sequence
  chemically synthesized
aatttagattattcttacgt

SEQ ID NO: 264663 - DNA, 20 bp, Artificial Sequence
  chemically synthesized
caagataataagaccgacgt

SEQ ID NO: 264664 - DNA, 20 bp, Artificial Sequence
  chemically synthesized
aacacataatgcaagataat

SEQ ID NO: 264665 - DNA, 20 bp, Artificial Sequence
  chemically synthesized
tcactcagaacacataatgc

SEQ ID NO: 264666 - DNA, 20 bp, Artificial Sequence
  chemically synthesized
tatcttgcattatgtgttct

SEQ ID NO: 264667 - DNA, 20 bp, Artificial Sequence
  chemically synthesized
gactgcctgaaaatttcact

SEQ ID NO: 264668 - DNA, 20 bp, Artificial Sequence
  chemically synthesized
tgtgttctgagtgaaatttt

SEQ ID NO: 264669 - DNA, 20 bp, Artificial Sequence
  chemically synthesized
gtgttctgagtgaaattttc

SEQ ID NO: 264670 - DNA, 20 bp, Artificial Sequence
  chemically synthesized
ttctgagtgaaattttcagg

SEQ ID NO: 264671 - DNA, 20 bp, Artificial Sequence
  chemically synthesized
tgaaattttcaggcagtcct

SEQ ID NO: 264672 - DNA, 20 bp, Artificial Sequence
  chemically synthesized
gaaattttcaggcagtcctc

SEQ ID NO: 264673 - DNA, 20 bp, Artificial Sequence
  chemically synthesized
aaattttcaggcagtcctcg

SEQ ID NO: 264674 - DNA, 20 bp, Artificial Sequence
  chemically synthesized
ttcaggcagtcctcggggta

SEQ ID NO: 264675 - DNA, 20 bp, Artificial Sequence
  chemically synthesized
gtaatttttcctataccccg

SEQ ID NO: 264676 - DNA, 20 bp, Artificial Sequence
  chemically synthesized
tcaggcagtcctcggggtat

SEQ ID NO: 264677 - DNA, 20 bp, Artificial Sequence
  chemically synthesized
cgtaatttttcctatacccc

SEQ ID NO: 264678 - DNA, 20 bp, Artificial Sequence
  chemically synthesized
tcggggtataggaaaaatta

SEQ ID NO: 264679 - DNA, 20 bp, Artificial Sequence
  chemically synthesized
cggggtataggaaaaattac

SEQ ID NO: 264680 - DNA, 20 bp, Artificial Sequence
  chemically synthesized
gggtataggaaaaattacgg

SEQ ID NO: 264681 - DNA, 20 bp, Artificial Sequence
  chemically synthesized
tataggaaaaattacgggag

SEQ ID NO: 264682 - DNA, 20 bp, Artificial Sequence
  chemically synthesized
ataggaaaaattacgggagt

SEQ ID NO: 264683 - DNA, 20 bp, Artificial Sequence
  chemically synthesized
gtgggattgacctgttattt

SEQ ID NO: 264684 - DNA, 20 bp, Artificial Sequence
  chemically synthesized
atagaaactcctgaaataac

SEQ ID NO: 264685 - DNA, 20 bp, Artificial Sequence
  chemically synthesized
tgggattgacctgttatttc

SEQ ID NO: 264686 - DNA, 20 bp, Artificial Sequence
  chemically synthesized
aatagaaactcctgaaataa

SEQ ID NO: 264687 - DNA, 20 bp, Artificial Sequence
  chemically synthesized
ggattgacctgttatttcag

SEQ ID NO: 264688 - DNA, 20 bp, Artificial Sequence
  chemically synthesized
gagatacacataaatgagaa

SEQ ID NO: 264689 - DNA, 20 bp, Artificial Sequence
  chemically synthesized
aagctgagatacacataaat

SEQ ID NO: 264690 - DNA, 20 bp, Artificial Sequence
  chemically synthesized
attctcatttatgtgtatct

SEQ ID NO: 264691 - DNA, 20 bp, Artificial Sequence
  chemically synthesized
aaagcagtgcaacacaagct

SEQ ID NO: 264692 - DNA, 20 bp, Artificial Sequence
  chemically synthesized
ataagaaagcagtgcaacac

SEQ ID NO: 264693 - DNA, 20 bp, Artificial Sequence
  chemically synthesized
tattcctgtctataagaaag

SEQ ID NO: 264694 - DNA, 20 bp, Artificial Sequence
  chemically synthesized
tgtgttgcactgctttctta

SEQ ID NO: 264695 - DNA, 20 bp, Artificial Sequence
  chemically synthesized
ttatattcctgtctataaga

SEQ ID NO: 264696 - DNA, 20 bp, Artificial Sequence
  chemically synthesized
ttgcactgctttcttataga

SEQ ID NO: 264697 - DNA, 20 bp, Artificial Sequence
  chemically synthesized
tgcactgctttcttatagac

SEQ ID NO: 264698 - DNA, 20 bp, Artificial Sequence
  chemically synthesized
aatattatattcctgtctat

SEQ ID NO: 264699 - DNA, 20 bp, Artificial Sequence
  chemically synthesized
gacaggaatataatattatt

SEQ ID NO: 264700 - DNA, 20 bp, Artificial Sequence
  chemically synthesized
ataatattatttggctttca

SEQ ID NO: 264701 - DNA, 20 bp, Artificial Sequence
  chemically synthesized
agacaagcatatatctttga

SEQ ID NO: 264702 - DNA, 20 bp, Artificial Sequence
  chemically synthesized
gaaaatttatttagagagac

SEQ ID NO: 264703 - DNA, 20 bp, Artificial Sequence
  chemically synthesized
ggatggaaaatttatttaga

SEQ ID NO: 264704 - DNA, 20 bp, Artificial Sequence
  chemically synthesized
aaggatggaaaatttattta

SEQ ID NO: 264705 - DNA, 20 bp, Artificial Sequence
  chemically synthesized
ttaaggatggaaaatttatt

SEQ ID NO: 264706 - DNA, 20 bp, Artificial Sequence
  chemically synthesized
aaataaattttccatcctta

SEQ ID NO: 264707 - DNA, 20 bp, Artificial Sequence
  chemically synthesized
catattgccaactttaagga

SEQ ID NO: 264708 - DNA, 20 bp, Artificial Sequence
  chemically synthesized
aaattttccatccttaaagt

SEQ ID NO: 264709 - DNA, 20 bp, Artificial Sequence
  chemically synthesized
aagacatattgccaacttta

SEQ ID NO: 264710 - DNA, 20 bp, Artificial Sequence
  chemically synthesized
taagacatattgccaacttt

SEQ ID NO: 264711 - DNA, 20 bp, Artificial Sequence
  chemically synthesized
actggaaaatagagtagtat

SEQ ID NO: 264712 - DNA, 20 bp, Artificial Sequence
  chemically synthesized
gttttcactggaaaatagag

SEQ ID NO: 264713 - DNA, 20 bp, Artificial Sequence
  chemically synthesized
tcttatactactctattttc

SEQ ID NO: 264714 - DNA, 20 bp, Artificial Sequence
  chemically synthesized
agtgttttcactggaaaata

SEQ ID NO: 264715 - DNA, 20 bp, Artificial Sequence
  chemically synthesized
gcagtgttttcactggaaaa

SEQ ID NO: 264716 - DNA, 20 bp, Artificial Sequence
  chemically synthesized
ataaaaggcagtgttttcac

SEQ ID NO: 264717 - DNA, 20 bp, Artificial Sequence
  chemically synthesized
ttcctgtataaaataaaagg

SEQ ID NO: 264718 - DNA, 20 bp, Artificial Sequence
  chemically synthesized
cttttcctgtataaaataaa

SEQ ID NO: 264719 - DNA, 20 bp, Artificial Sequence
  chemically synthesized
ccttttcctgtataaaataa

SEQ ID NO: 264720 - DNA, 20 bp, Artificial Sequence
  chemically synthesized
acactgccttttattttata

SEQ ID NO: 264721 - DNA, 20 bp, Artificial Sequence
  chemically synthesized
cactgccttttattttatac

SEQ ID NO: 264722 - DNA, 20 bp, Artificial Sequence
  chemically synthesized
ccttttattttatacaggaa

SEQ ID NO: 264723 - DNA, 20 bp, Artificial Sequence
  chemically synthesized
cttttattttatacaggaaa

SEQ ID NO: 264724 - DNA, 20 bp, Artificial Sequence
  chemically synthesized
aaactaccgattgatataat

SEQ ID NO: 264725 - DNA, 20 bp, Artificial Sequence
  chemically synthesized
aaggtgcttattatatcaat

SEQ ID NO: 264726 - DNA, 20 bp, Artificial Sequence
  chemically synthesized
gtgcttattatatcaatcgg

SEQ ID NO: 264727 - DNA, 20 bp, Artificial Sequence
  chemically synthesized
attatatcaatcggtagttt

SEQ ID NO: 264728 - DNA, 20 bp, Artificial Sequence
  chemically synthesized
tgattaaattaatatatagg

SEQ ID NO: 264729 - DNA, 20 bp, Artificial Sequence
  chemically synthesized
ggttgattaaattaatatat

SEQ ID NO: 264730 - DNA, 20 bp, Artificial Sequence
  chemically synthesized
tggttgattaaattaatata

SEQ ID NO: 264731 - DNA, 20 bp, Artificial Sequence
  chemically synthesized
tatatattaatttaatcaac

SEQ ID NO: 264732 - DNA, 20 bp, Artificial Sequence
  chemically synthesized
ttggttataaaattggtcac

SEQ ID NO: 264733 - DNA, 20 bp, Artificial Sequence
  chemically synthesized
acttattttggttataaaat

SEQ ID NO: 264734 - DNA, 20 bp, Artificial Sequence
  chemically synthesized
accaattttataaccaaaat

SEQ ID NO: 264735 - DNA, 20 bp, Artificial Sequence
  chemically synthesized
ttggtttgataaacttattt

SEQ ID NO: 264736 - DNA, 20 bp, Artificial Sequence
  chemically synthesized
gtttatcaaaccaattgttt

SEQ ID NO: 264737 - DNA, 20 bp, Artificial Sequence
  chemically synthesized
aataacatagctaaaacaat

SEQ ID NO: 264738 - DNA, 20 bp, Artificial Sequence
  chemically synthesized
aattgttttagctatgttat

SEQ ID NO: 264739 - DNA, 20 bp, Artificial Sequence
  chemically synthesized
gtgctatcttgccaataaca

SEQ ID NO: 264740 - DNA, 20 bp, Artificial Sequence
  chemically synthesized
gttttagctatgttattggc

SEQ ID NO: 264741 - DNA, 20 bp, Artificial Sequence
  chemically synthesized
tagctatgttattggcaaga

SEQ ID NO: 264742 - DNA, 20 bp, Artificial Sequence
  chemically synthesized
tgttattggcaagatagcac

SEQ ID NO: 264743 - DNA, 20 bp, Artificial Sequence
  chemically synthesized
tcatatggctgtcaaatggc

SEQ ID NO: 264744 - DNA, 20 bp, Artificial Sequence
  chemically synthesized
agatagcaccagccatttga

SEQ ID NO: 264745 - DNA, 20 bp, Artificial Sequence
  chemically synthesized
ttaatcatatggctgtcaaa

SEQ ID NO: 264746 - DNA, 20 bp, Artificial Sequence
  chemically synthesized
tccaaagactattaatcata

SEQ ID NO: 264747 - DNA, 20 bp, Artificial Sequence
  chemically synthesized
tttgacagccatatgattaa

SEQ ID NO: 264748 - DNA, 20 bp, Artificial Sequence
  chemically synthesized
gccatatgattaatagtctt

SEQ ID NO: 264749 - DNA, 20 bp, Artificial Sequence
  chemically synthesized
ttttcatctctttgtgtcca

SEQ ID NO: 264750 - DNA, 20 bp, Artificial Sequence
  chemically synthesized
attaatagtctttggacaca

SEQ ID NO: 264751 - DNA, 20 bp, Artificial Sequence
  chemically synthesized
taatagtctttggacacaaa

SEQ ID NO: 264752 - DNA, 20 bp, Artificial Sequence
  chemically synthesized
aaaaattcattgcttttctt

SEQ ID NO: 264753 - DNA, 20 bp, Artificial Sequence
  chemically synthesized
aaattcattgcttttcttaa

SEQ ID NO: 264754 - DNA, 20 bp, Artificial Sequence
  chemically synthesized
aactagtgaactcttaagaa

SEQ ID NO: 264755 - DNA, 20 bp, Artificial Sequence
  chemically synthesized
tgctgaactagtgaactctt

SEQ ID NO: 264756 - DNA, 20 bp, Artificial Sequence
  chemically synthesized
tgcttttcttaagagttcac

SEQ ID NO: 264757 - DNA, 20 bp, Artificial Sequence
  chemically synthesized
ttcttaagagttcactagtt

SEQ ID NO: 264758 - DNA, 20 bp, Artificial Sequence
  chemically synthesized
ggcatagcctaatgctgaac

SEQ ID NO: 264759 - DNA, 20 bp, Artificial Sequence
  chemically synthesized
agagttcactagttcagcat

SEQ ID NO: 264760 - DNA, 20 bp, Artificial Sequence
  chemically synthesized
gagttcactagttcagcatt

SEQ ID NO: 264761 - DNA, 20 bp, Artificial Sequence
  chemically synthesized
tttctgttttagaatgggca

SEQ ID NO: 264762 - DNA, 20 bp, Artificial Sequence
  chemically synthesized
agtgttttctgttttagaat

SEQ ID NO: 264763 - DNA, 20 bp, Artificial Sequence
  chemically synthesized
aagtgttttctgttttagaa

SEQ ID NO: 264764 - DNA, 20 bp, Artificial Sequence
  chemically synthesized
aggctatgcccattctaaaa

SEQ ID NO: 264765 - DNA, 20 bp, Artificial Sequence
  chemically synthesized
tgggaaagtgttttctgttt

SEQ ID NO: 264766 - DNA, 20 bp, Artificial Sequence
  chemically synthesized
agaattttaattgggtggga

SEQ ID NO: 264767 - DNA, 20 bp, Artificial Sequence
  chemically synthesized
atgtagaattttaattgggt

SEQ ID NO: 264768 - DNA, 20 bp, Artificial Sequence
  chemically synthesized
catgtagaattttaattggg

SEQ ID NO: 264769 - DNA, 20 bp, Artificial Sequence
  chemically synthesized
tgacatgtagaattttaatt

SEQ ID NO: 264770 - DNA, 20 bp, Artificial Sequence
  chemically synthesized
atgacatgtagaattttaat

SEQ ID NO: 264771 - DNA, 20 bp, Artificial Sequence
  chemically synthesized
gaagaccaaggaatgacatg

SEQ ID NO: 264772 - DNA, 20 bp, Artificial Sequence
  chemically synthesized
aaattctacatgtcattcct

SEQ ID NO: 264773 - DNA, 20 bp, Artificial Sequence
  chemically synthesized
tacaaagacagggaagacca

SEQ ID NO: 264774 - DNA, 20 bp, Artificial Sequence
  chemically synthesized
ttacaaagacagggaagacc

SEQ ID NO: 264775 - DNA, 20 bp, Artificial Sequence
  chemically synthesized
tccaagttacaaagacaggg

SEQ ID NO: 264776 - DNA, 20 bp, Artificial Sequence
  chemically synthesized
aattccaagttacaaagaca

SEQ ID NO: 264777 - DNA, 20 bp, Artificial Sequence
  chemically synthesized
gaattccaagttacaaagac

SEQ ID NO: 264778 - DNA, 20 bp, Artificial Sequence
  chemically synthesized
agaattccaagttacaaaga

SEQ ID NO: 264779 - DNA, 20 bp, Artificial Sequence
  chemically synthesized
tcttccctgtctttgtaact

SEQ ID NO: 264780 - DNA, 20 bp, Artificial Sequence
  chemically synthesized
cataagaattccaagttaca

SEQ ID NO: 264781 - DNA, 20 bp, Artificial Sequence
  chemically synthesized
taaagttgcataagaattcc

SEQ ID NO: 264782 - DNA, 20 bp, Artificial Sequence
  chemically synthesized
tttcctttataaagttgcat

SEQ ID NO: 264783 - DNA, 20 bp, Artificial Sequence
  chemically synthesized
aattcttatgcaactttata

SEQ ID NO: 264784 - DNA, 20 bp, Artificial Sequence
  chemically synthesized
attcttatgcaactttataa

SEQ ID NO: 264785 - DNA, 20 bp, Artificial Sequence
  chemically synthesized
tattacatgtttcctttata

SEQ ID NO: 264786 - DNA, 20 bp, Artificial Sequence
  chemically synthesized
ttataaaggaaacatgtaat

SEQ ID NO: 264787 - DNA, 20 bp, Artificial Sequence
  chemically synthesized
aaaggaaacatgtaataaga

SEQ ID NO: 264788 - DNA, 20 bp, Artificial Sequence
  chemically synthesized
agaaagcgtttataatttaa

SEQ ID NO: 264789 - DNA, 20 bp, Artificial Sequence
  chemically synthesized
taatttaacagctcattctt

SEQ ID NO: 264790 - DNA, 20 bp, Artificial Sequence
  chemically synthesized
aaatttggtgactcaagaat

SEQ ID NO: 264791 - DNA, 20 bp, Artificial Sequence
  chemically synthesized
gttttaaaatttggtgactc

SEQ ID NO: 264792 - DNA, 20 bp, Artificial Sequence
  chemically synthesized
atactttgtgttttaaaatt

SEQ ID NO: 264793 - DNA, 20 bp, Artificial Sequence
  chemically synthesized
tcaccaaattttaaaacaca

SEQ ID NO: 264794 - DNA, 20 bp, Artificial Sequence
  chemically synthesized
ataattctgaattgaaaagc

SEQ ID NO: 264795 - DNA, 20 bp, Artificial Sequence
  chemically synthesized
cataattctgaattgaaaag

SEQ ID NO: 264796 - DNA, 20 bp, Artificial Sequence
  chemically synthesized
atcatgcctgcttttcaatt

SEQ ID NO: 264797 - DNA, 20 bp, Artificial Sequence
  chemically synthesized
tatcataattctgaattgaa

SEQ ID NO: 264798 - DNA, 20 bp, Artificial Sequence
  chemically synthesized
ttatgataaattgtctaaaa

SEQ ID NO: 264799 - DNA, 20 bp, Artificial Sequence
  chemically synthesized
gccattgctttcaactgttt

SEQ ID NO: 264800 - DNA, 20 bp, Artificial Sequence
  chemically synthesized
aaattgtctaaaacagttga

SEQ ID NO: 264801 - DNA, 20 bp, Artificial Sequence
  chemically synthesized
tctaaaacagttgaaagcaa

SEQ ID NO: 264802 - DNA, 20 bp, Artificial Sequence
  chemically synthesized
caataattaagatgatttat

SEQ ID NO: 264803 - DNA, 20 bp, Artificial Sequence
  chemically synthesized
tgataaatcatcttaattat

SEQ ID NO: 264804 - DNA, 20 bp, Artificial Sequence
  chemically synthesized
gataaatcatcttaattatt

SEQ ID NO: 264805 - DNA, 20 bp, Artificial Sequence
  chemically synthesized
aagtaacttacccaataatt

SEQ ID NO: 264806 - DNA, 20 bp, Artificial Sequence
  chemically synthesized
aatcatcttaattattgggt

SEQ ID NO: 264807 - DNA, 20 bp, Artificial Sequence
  chemically synthesized
atttcctttaaagtcaatag

SEQ ID NO: 264808 - DNA, 20 bp, Artificial Sequence
  chemically synthesized
tctatttcctttaaagtcaa

SEQ ID NO: 264809 - DNA, 20 bp, Artificial Sequence
  chemically synthesized
agttacttctattgacttta

SEQ ID NO: 264810 - DNA, 20 bp, Artificial Sequence
  chemically synthesized
gttacttctattgactttaa

SEQ ID NO: 264811 - DNA, 20 bp, Artificial Sequence
  chemically synthesized
gtggtcatctatttccttta

SEQ ID NO: 264812 - DNA, 20 bp, Artificial Sequence
  chemically synthesized
tctattgactttaaaggaaa

SEQ ID NO: 264813 - DNA, 20 bp, Artificial Sequence
  chemically synthesized
aaggaaatagatgaccacaa

SEQ ID NO: 264814 - DNA, 20 bp, Artificial Sequence
  chemically synthesized
ttgtgattccagttcttttg

SEQ ID NO: 264815 - DNA, 20 bp, Artificial Sequence
  chemically synthesized
atagatgaccacaaaagaac

SEQ ID NO: 264816 - DNA, 20 bp, Artificial Sequence
  chemically synthesized
gtgtgatttaattgtgattc

SEQ ID NO: 264817 - DNA, 20 bp, Artificial Sequence
  chemically synthesized
acaattaaatcacacaatgt

SEQ ID NO: 264818 - DNA, 20 bp, Artificial Sequence
  chemically synthesized
ttaaatcacacaatgttaga

SEQ ID NO: 264819 - DNA, 20 bp, Artificial Sequence
  chemically synthesized
gttagacagtgcacacaaaa

SEQ ID NO: 264820 - DNA, 20 bp, Artificial Sequence
  chemically synthesized
ttagacagtgcacacaaaat

SEQ ID NO: 264821 - DNA, 20 bp, Artificial Sequence
  chemically synthesized
agtgcacacaaaataggttt

SEQ ID NO: 264822 - DNA, 20 bp, Artificial Sequence
  chemically synthesized
caaaataggttttagttata

SEQ ID NO: 264823 - DNA, 20 bp, Artificial Sequence
  chemically synthesized
tatagaaaataatcaaacaa

SEQ ID NO: 264824 - DNA, 20 bp, Artificial Sequence
  chemically synthesized
caaaagttataatattgcat

SEQ ID NO: 264825 - DNA, 20 bp, Artificial Sequence
  chemically synthesized
agttataatattgcatgaga

SEQ ID NO: 264826 - DNA, 20 bp, Artificial Sequence
  chemically synthesized
tgcatgagaaagtgtatacc

SEQ ID NO: 264827 - DNA, 20 bp, Artificial Sequence
  chemically synthesized
gagaaagtgtataccaagca

SEQ ID NO: 264828 - DNA, 20 bp, Artificial Sequence
  chemically synthesized
agaaagtgtataccaagcat

SEQ ID NO: 264829 - DNA, 20 bp, Artificial Sequence
  chemically synthesized
aagtgtccaaaacctatgct

SEQ ID NO: 264830 - DNA, 20 bp, Artificial Sequence
  chemically synthesized
tgtataccaagcataggttt

SEQ ID NO: 264831 - DNA, 20 bp, Artificial Sequence
  chemically synthesized
aaaggtaagtaaaaaattaa

SEQ ID NO: 264832 - DNA, 20 bp, Artificial Sequence
  chemically synthesized
agctcttaaaatgaaaaggt

SEQ ID NO: 264833 - DNA, 20 bp, Artificial Sequence
  chemically synthesized
ctaaagctcttaaaatgaaa

SEQ ID NO: 264834 - DNA, 20 bp, Artificial Sequence
  chemically synthesized
gctaaagctcttaaaatgaa

SEQ ID NO: 264835 - DNA, 20 bp, Artificial Sequence
  chemically synthesized
tttacttaccttttcatttt

SEQ ID NO: 264836 - DNA, 20 bp, Artificial Sequence
  chemically synthesized
tacttaccttttcattttaa

SEQ ID NO: 264837 - DNA, 20 bp, Artificial Sequence
  chemically synthesized
ccttttcattttaagagctt

SEQ ID NO: 264838 - DNA, 20 bp, Artificial Sequence
  chemically synthesized
atgactgcacagtcatgcta

SEQ ID NO: 264839 - DNA, 20 bp, Artificial Sequence
  chemically synthesized
agagctttagcatgactgtg

SEQ ID NO: 264840 - DNA, 20 bp, Artificial Sequence
  chemically synthesized
atgtattttgtatgactgca

SEQ ID NO: 264841 - DNA, 20 bp, Artificial Sequence
  chemically synthesized
catacaaaatacatataaat

SEQ ID NO: 264842 - DNA, 20 bp, Artificial Sequence
  chemically synthesized
acaaaatacatataaattag

SEQ ID NO: 264843 - DNA, 20 bp, Artificial Sequence
  chemically synthesized
aatacatataaattagaaga

SEQ ID NO: 264844 - DNA, 20 bp, Artificial Sequence
  chemically synthesized
atacatataaattagaagac

SEQ ID NO: 264845 - DNA, 20 bp, Artificial Sequence
  chemically synthesized
tacatataaattagaagaca

SEQ ID NO: 264846 - DNA, 20 bp, Artificial Sequence
  chemically synthesized
atataaattagaagacaggg

SEQ ID NO: 264847 - DNA, 20 bp, Artificial Sequence
  chemically synthesized
agacagggaagtataataaa

SEQ ID NO: 264848 - DNA, 20 bp, Artificial Sequence
  chemically synthesized
aagtataataaatggataaa

SEQ ID NO: 264849 - DNA, 20 bp, Artificial Sequence
  chemically synthesized
aatggataaatggacacata

SEQ ID NO: 264850 - DNA, 20 bp, Artificial Sequence
  chemically synthesized
ggataaatggacacataaag

SEQ ID NO: 264851 - DNA, 20 bp, Artificial Sequence
  chemically synthesized
ataaatggacacataaagaa

SEQ ID NO: 264852 - DNA, 20 bp, Artificial Sequence
  chemically synthesized
atggacacataaagaagaga

SEQ ID NO: 264853 - DNA, 20 bp, Artificial Sequence
  chemically synthesized
ggacacataaagaagagaca

SEQ ID NO: 264854 - DNA, 20 bp, Artificial Sequence
  chemically synthesized
aaagaagagacagagaaacc

SEQ ID NO: 264855 - DNA, 20 bp, Artificial Sequence
  chemically synthesized
aagagacagagaaaccgaga

SEQ ID NO: 264856 - DNA, 20 bp, Artificial Sequence
  chemically synthesized
aaacaaagtgttgtctttct

SEQ ID NO: 264857 - DNA, 20 bp, Artificial Sequence
  chemically synthesized
ttaaaaaatcaaggaaaaca

SEQ ID NO: 264858 - DNA, 20 bp, Artificial Sequence
  chemically synthesized
tttgaaacattaaaaaatca

SEQ ID NO: 264859 - DNA, 20 bp, Artificial Sequence
  chemically synthesized
atttgaaacattaaaaaatc

SEQ ID NO: 264860 - DNA, 20 bp, Artificial Sequence
  chemically synthesized
aagcacaattaatagttgtt

SEQ ID NO: 264861 - DNA, 20 bp, Artificial Sequence
  chemically synthesized
atccaacaaagcacaattaa

SEQ ID NO: 264862 - DNA, 20 bp, Artificial Sequence
  chemically synthesized
aactattaattgtgctttgt

SEQ ID NO: 264863 - DNA, 20 bp, Artificial Sequence
  chemically synthesized
aatccttaaataatccaaca

SEQ ID NO: 264864 - DNA, 20 bp, Artificial Sequence
  chemically synthesized
tgtgctttgttggattattt

SEQ ID NO: 264865 - DNA, 20 bp, Artificial Sequence
  chemically synthesized
gtgctttgttggattattta

SEQ ID NO: 264866 - DNA, 20 bp, Artificial Sequence
  chemically synthesized
tttaaggattaatgaaattt

SEQ ID NO: 264867 - DNA, 20 bp, Artificial Sequence
  chemically synthesized
ttaaggattaatgaaattta

SEQ ID NO: 264868 - DNA, 20 bp, Artificial Sequence
  chemically synthesized
tgaaatttaaggctttgttg

SEQ ID NO: 264869 - DNA, 20 bp, Artificial Sequence
  chemically synthesized
ttaatgccaaaacttcaaca

SEQ ID NO: 264870 - DNA, 20 bp, Artificial Sequence
  chemically synthesized
ttaaggctttgttgaagttt

SEQ ID NO: 264871 - DNA, 20 bp, Artificial Sequence
  chemically synthesized
ttgttgaagttttggcatta

SEQ ID NO: 264872 - DNA, 20 bp, Artificial Sequence
  chemically synthesized
tgttaacttgttataaaatt

SEQ ID NO: 264873 - DNA, 20 bp, Artificial Sequence
  chemically synthesized
ttaaagctgaattttataac

SEQ ID NO: 264874 - DNA, 20 bp, Artificial Sequence
  chemically synthesized
aattttataacaagttaaca

SEQ ID NO: 264875 - DNA, 20 bp, Artificial Sequence
  chemically synthesized
attttataacaagttaacaa

SEQ ID NO: 264876 - DNA, 20 bp, Artificial Sequence
  chemically synthesized
aacaagttaacaaaggataa

SEQ ID NO: 264877 - DNA, 20 bp, Artificial Sequence
  chemically synthesized
taacaaaggataacagactg

SEQ ID NO: 264878 - DNA, 20 bp, Artificial Sequence
  chemically synthesized
aaggataacagactgaagaa

SEQ ID NO: 264879 - DNA, 20 bp, Artificial Sequence
  chemically synthesized
taattgatcttgcttttctt

SEQ ID NO: 264880 - DNA, 20 bp, Artificial Sequence
  chemically synthesized
ataacagactgaagaaaagc

SEQ ID NO: 264881 - DNA, 20 bp, Artificial Sequence
  chemically synthesized
gctttcaatttacaatgaat

SEQ ID NO: 264882 - DNA, 20 bp, Artificial Sequence
  chemically synthesized
actgattcattgtaaattga

SEQ ID NO: 264883 - DNA, 20 bp, Artificial Sequence
  chemically synthesized
tgaaagcattcaaaattact

SEQ ID NO: 264884 - DNA, 20 bp, Artificial Sequence
  chemically synthesized
aaaactaataaagtgtatct

SEQ ID NO: 264885 - DNA, 20 bp, Artificial Sequence
  chemically synthesized
attactcagatacactttat

SEQ ID NO: 264886 - DNA, 20 bp, Artificial Sequence
  chemically synthesized
cttacattttaaaactaata

SEQ ID NO: 264887 - DNA, 20 bp, Artificial Sequence
  chemically synthesized
ctttattagttttaaaatgt

SEQ ID NO: 264888 - DNA, 20 bp, Artificial Sequence
  chemically synthesized
tttaaaatgtaagctttcct

SEQ ID NO: 264889 - DNA, 20 bp, Artificial Sequence
  chemically synthesized
aagtaatatttaaccaagga

SEQ ID NO: 264890 - DNA, 20 bp, Artificial Sequence
  chemically synthesized
gccaaagtaatatttaacca

SEQ ID NO: 264891 - DNA, 20 bp, Artificial Sequence
  chemically synthesized
tgccaaagtaatatttaacc

SEQ ID NO: 264892 - DNA, 20 bp, Artificial Sequence
  chemically synthesized
tccttggttaaatattactt

SEQ ID NO: 264893 - DNA, 20 bp, Artificial Sequence
  chemically synthesized
tagtgtatctgtgcatgcca

SEQ ID NO: 264894 - DNA, 20 bp, Artificial Sequence
  chemically synthesized
aaatattactttggcatgca

SEQ ID NO: 264895 - DNA, 20 bp, Artificial Sequence
  chemically synthesized
tttggcatgcacagatacac

SEQ ID NO: 264896 - DNA, 20 bp, Artificial Sequence
  chemically synthesized
aaacacagtcgttattatgc

SEQ ID NO: 264897 - DNA, 20 bp, Artificial Sequence
  chemically synthesized
acttgctgtctgtgtaaaca

SEQ ID NO: 264898 - DNA, 20 bp, Artificial Sequence
  chemically synthesized
taataacgactgtgtttaca

SEQ ID NO: 264899 - DNA, 20 bp, Artificial Sequence
  chemically synthesized
aacgactgtgtttacacaga

SEQ ID NO: 264900 - DNA, 20 bp, Artificial Sequence
  chemically synthesized
actgtgtttacacagacagc

SEQ ID NO: 264901 - DNA, 20 bp, Artificial Sequence
  chemically synthesized
caagtaaacatttgttaatc

SEQ ID NO: 264902 - DNA, 20 bp, Artificial Sequence
  chemically synthesized
acatttgttaatctggacta

SEQ ID NO: 264903 - DNA, 20 bp, Artificial Sequence
  chemically synthesized
attattaagattccatagtc

SEQ ID NO: 264904 - DNA, 20 bp, Artificial Sequence
  chemically synthesized
tcatgattattaagattcca

SEQ ID NO: 264905 - DNA, 20 bp, Artificial Sequence
  chemically synthesized
ggtaatttatcatgattatt

SEQ ID NO: 264906 - DNA, 20 bp, Artificial Sequence
  chemically synthesized
ttagtgtgatttgaatatag

SEQ ID NO: 264907 - DNA, 20 bp, Artificial Sequence
  chemically synthesized
gttttagtgtgatttgaata

SEQ ID NO: 264908 - DNA, 20 bp, Artificial Sequence
  chemically synthesized
tttattttcaatttaggttt

SEQ ID NO: 264909 - DNA, 20 bp, Artificial Sequence
  chemically synthesized
ggattatttattttcaattt

SEQ ID NO: 264910 - DNA, 20 bp, Artificial Sequence
  chemically synthesized
tggattatttattttcaatt

SEQ ID NO: 264911 - DNA, 20 bp, Artificial Sequence
  chemically synthesized
aaattgaaaataaataatcc

SEQ ID NO: 264912 - DNA, 20 bp, Artificial Sequence
  chemically synthesized
aataaataatccaagtgcta

SEQ ID NO: 264913 - DNA, 20 bp, Artificial Sequence
  chemically synthesized
ttaaaccaatctgtagcact

SEQ ID NO: 264914 - DNA, 20 bp, Artificial Sequence
  chemically synthesized
ataatccaagtgctacagat

SEQ ID NO: 264915 - DNA, 20 bp, Artificial Sequence
  chemically synthesized
agcaattttaaaccaatctg

SEQ ID NO: 264916 - DNA, 20 bp, Artificial Sequence
  chemically synthesized
aaaggagactgatggatttg

SEQ ID NO: 264917 - DNA, 20 bp, Artificial Sequence
  chemically synthesized
taaaattgcttcaaatccat

SEQ ID NO: 264918 - DNA, 20 bp, Artificial Sequence
  chemically synthesized
gaatggaaaaaggagactga

SEQ ID NO: 264919 - DNA, 20 bp, Artificial Sequence
  chemically synthesized
aagctgcagaatggaaaaag

SEQ ID NO: 264920 - DNA, 20 bp, Artificial Sequence
  chemically synthesized
caaagctgcagaatggaaaa

SEQ ID NO: 264921 - DNA, 20 bp, Artificial Sequence
  chemically synthesized
tcaaagctgcagaatggaaa

SEQ ID NO: 264922 - DNA, 20 bp, Artificial Sequence
  chemically synthesized
agtctcctttttccattctg

SEQ ID NO: 264923 - DNA, 20 bp, Artificial Sequence
  chemically synthesized
aaattttcaaagctgcagaa

SEQ ID NO: 264924 - DNA, 20 bp, Artificial Sequence
  chemically synthesized
taaataaattttcaaagctg

SEQ ID NO: 264925 - DNA, 20 bp, Artificial Sequence
  chemically synthesized
taatgataaataaattttca

SEQ ID NO: 264926 - DNA, 20 bp, Artificial Sequence
  chemically synthesized
ttatcattacaatattgata

SEQ ID NO: 264927 - DNA, 20 bp, Artificial Sequence
  chemically synthesized
aatattgatatagaaaaata

SEQ ID NO: 264928 - DNA, 20 bp, Artificial Sequence
  chemically synthesized
atagaaaaataaagaattca

SEQ ID NO: 264929 - DNA, 20 bp, Artificial Sequence
  chemically synthesized
ataaagaattcatggaaacc

SEQ ID NO: 264930 - DNA, 20 bp, Artificial Sequence
  chemically synthesized
gtccttgaaatttttcatct

SEQ ID NO: 264931 - DNA, 20 bp, Artificial Sequence
  chemically synthesized
aaaccaagatgaaaaatttc

SEQ ID NO: 264932 - DNA, 20 bp, Artificial Sequence
  chemically synthesized
aaccaagatgaaaaatttca

SEQ ID NO: 264933 - DNA, 20 bp, Artificial Sequence
  chemically synthesized
agatgaaaaatttcaaggac

SEQ ID NO: 264934 - DNA, 20 bp, Artificial Sequence
  chemically synthesized
caaggacaagtaacacacta

SEQ ID NO: 264935 - DNA, 20 bp, Artificial Sequence
  chemically synthesized
acaagtaacacactatagta

SEQ ID NO: 264936 - DNA, 20 bp, Artificial Sequence
  chemically synthesized
agtctgtcttttctgtacta

SEQ ID NO: 264937 - DNA, 20 bp, Artificial Sequence
  chemically synthesized
taacacactatagtacagaa

SEQ ID NO: 264938 - DNA, 20 bp, Artificial Sequence
  chemically synthesized
acactatagtacagaaaaga

SEQ ID NO: 264939 - DNA, 20 bp, Artificial Sequence
  chemically synthesized
aactcttcatatcatatcag

SEQ ID NO: 264940 - DNA, 20 bp, Artificial Sequence
  chemically synthesized
aataactcttcatatcatat

SEQ ID NO: 264941 - DNA, 20 bp, Artificial Sequence
  chemically synthesized
cagactactgatatgatatg

SEQ ID NO: 264942 - DNA, 20 bp, Artificial Sequence
  chemically synthesized
gactactgatatgatatgaa

SEQ ID NO: 264943 - DNA, 20 bp, Artificial Sequence
  chemically synthesized
atttcacatcattctatctg

SEQ ID NO: 264944 - DNA, 20 bp, Artificial Sequence
  chemically synthesized
ttcacatcattctatctgta

SEQ ID NO: 264945 - DNA, 20 bp, Artificial Sequence
  chemically synthesized
tcacatcattctatctgtag

SEQ ID NO: 264946 - DNA, 20 bp, Artificial Sequence
  chemically synthesized
aagttcttttcctctacaga

SEQ ID NO: 264947 - DNA, 20 bp, Artificial Sequence
  chemically synthesized
ttgtaagttcttttcctcta

SEQ ID NO: 264948 - DNA, 20 bp, Artificial Sequence
  chemically synthesized
tcattctatctgtagaggaa

SEQ ID NO: 264949 - DNA, 20 bp, Artificial Sequence
  chemically synthesized
atacacttatttgtttttgt

SEQ ID NO: 264950 - DNA, 20 bp, Artificial Sequence
  chemically synthesized
aagaacttacaaaaacaaat

SEQ ID NO: 264951 - DNA, 20 bp, Artificial Sequence
  chemically synthesized
acaaaaacaaataagtgtat

SEQ ID NO: 264952 - DNA, 20 bp, Artificial Sequence
  chemically synthesized
aaacaaataagtgtattgga

SEQ ID NO: 264953 - DNA, 20 bp, Artificial Sequence
  chemically synthesized
tctttcttctagcatagatg

SEQ ID NO: 264954 - DNA, 20 bp, Artificial Sequence
  chemically synthesized
gaaagatactacatctatgc

SEQ ID NO: 264955 - DNA, 20 bp, Artificial Sequence
  chemically synthesized
agatactacatctatgctag

SEQ ID NO: 264956 - DNA, 20 bp, Artificial Sequence
  chemically synthesized
aaataatctttcttctagca

SEQ ID NO: 264957 - DNA, 20 bp, Artificial Sequence
  chemically synthesized
actacatctatgctagaaga

SEQ ID NO: 264958 - DNA, 20 bp, Artificial Sequence
  chemically synthesized
attttaaataatctttcttc

SEQ ID NO: 264959 - DNA, 20 bp, Artificial Sequence
  chemically synthesized
aagaaagattatttaaaata

SEQ ID NO: 264960 - DNA, 20 bp, Artificial Sequence
  chemically synthesized
tttaaaataatagaataaat

SEQ ID NO: 264961 - DNA, 20 bp, Artificial Sequence
  chemically synthesized
ctctaataattttaaaataa

SEQ ID NO: 264962 - DNA, 20 bp, Artificial Sequence
  chemically synthesized
ttctattattttaaaattat

SEQ ID NO: 264963 - DNA, 20 bp, Artificial Sequence
  chemically synthesized
ctattattttaaaattatta

SEQ ID NO: 264964 - DNA, 20 bp, Artificial Sequence
  chemically synthesized
ttaaaattattagagcaaac

SEQ ID NO: 264965 - DNA, 20 bp, Artificial Sequence
  chemically synthesized
tagagcaaacaagaaaatgt

SEQ ID NO: 264966 - DNA, 20 bp, Artificial Sequence
  chemically synthesized
ttaaataaattgactccaaa

SEQ ID NO: 264967 - DNA, 20 bp, Artificial Sequence
  chemically synthesized
caatgaaatgtcactatttg

SEQ ID NO: 264968 - DNA, 20 bp, Artificial Sequence
  chemically synthesized
accaatgaaatgtcactatt

SEQ ID NO: 264969 - DNA, 20 bp, Artificial Sequence
  chemically synthesized
tccaaatagtgacatttcat

SEQ ID NO: 264970 - DNA, 20 bp, Artificial Sequence
  chemically synthesized
ttcattggttgcattctttt

SEQ ID NO: 264971 - DNA, 20 bp, Artificial Sequence
  chemically synthesized
tggttgcattcttttgagaa

SEQ ID NO: 264972 - DNA, 20 bp, Artificial Sequence
  chemically synthesized
agtactttatctattctcaa

SEQ ID NO: 264973 - DNA, 20 bp, Artificial Sequence
  chemically synthesized
cattcttttgagaatagata

SEQ ID NO: 264974 - DNA, 20 bp, Artificial Sequence
  chemically synthesized
tttgagaatagataaagtac

SEQ ID NO: 264975 - DNA, 20 bp, Artificial Sequence
  chemically synthesized
tcaaagcattaaaggtaaac

SEQ ID NO: 264976 - DNA, 20 bp, Artificial Sequence
  chemically synthesized
ttttattatcaaagcattaa

SEQ ID NO: 264977 - DNA, 20 bp, Artificial Sequence
  chemically synthesized
tttttattatcaaagcatta

SEQ ID NO: 264978 - DNA, 20 bp, Artificial Sequence
  chemically synthesized
ttttcacatttttattatca

SEQ ID NO: 264979 - DNA, 20 bp, Artificial Sequence
  chemically synthesized
tgaaaatgtgactaatttgt

SEQ ID NO: 264980 - DNA, 20 bp, Artificial Sequence
  chemically synthesized
gaaaatgtgactaatttgtg

SEQ ID NO: 264981 - DNA, 20 bp, Artificial Sequence
  chemically synthesized
ctctaattagcctcacaaat

SEQ ID NO: 264982 - DNA, 20 bp, Artificial Sequence
  chemically synthesized
gactaatttgtgaggctaat

SEQ ID NO: 264983 - DNA, 20 bp, Artificial Sequence
  chemically synthesized
ctaatttgtgaggctaatta

SEQ ID NO: 264984 - DNA, 20 bp, Artificial Sequence
  chemically synthesized
taatttgtgaggctaattag

SEQ ID NO: 264985 - DNA, 20 bp, Artificial Sequence
  chemically synthesized
actgggtaatatcctctaat

SEQ ID NO: 264986 - DNA, 20 bp, Artificial Sequence
  chemically synthesized
gctaattagaggatattacc

SEQ ID NO: 264987 - DNA, 20 bp, Artificial Sequence
  chemically synthesized
aattagaggatattacccag

SEQ ID NO: 264988 - DNA, 20 bp, Artificial Sequence
  chemically synthesized
aaaatcaattgaaatctact

SEQ ID NO: 264989 - DNA, 20 bp, Artificial Sequence
  chemically synthesized
caaaatcaattgaaatctac

SEQ ID NO: 264990 - DNA, 20 bp, Artificial Sequence
  chemically synthesized
agatttcaattgattttgta

SEQ ID NO: 264991 - DNA, 20 bp, Artificial Sequence
  chemically synthesized
tcaattgattttgtatggat

SEQ ID NO: 264992 - DNA, 20 bp, Artificial Sequence
  chemically synthesized
caattgattttgtatggatg

SEQ ID NO: 264993 - DNA, 20 bp, Artificial Sequence
  chemically synthesized
catccagttttaaaatgtgt

SEQ ID NO: 264994 - DNA, 20 bp, Artificial Sequence
  chemically synthesized
atgcttacacattttaaaac

SEQ ID NO: 264995 - DNA, 20 bp, Artificial Sequence
  chemically synthesized
ccacgaatatattttgcatc

SEQ ID NO: 264996 - DNA, 20 bp, Artificial Sequence
  chemically synthesized
ctggatgcaaaatatattcg

SEQ ID NO: 264997 - DNA, 20 bp, Artificial Sequence
  chemically synthesized
tggatgcaaaatatattcgt

SEQ ID NO: 264998 - DNA, 20 bp, Artificial Sequence
  chemically synthesized
gcaaaatatattcgtgggtc

SEQ ID NO: 264999 - DNA, 20 bp, Artificial Sequence
  chemically synthesized
aaaaggtcgacagtaggaag

SEQ ID NO: 265000 - DNA, 20 bp, Artificial Sequence
  chemically synthesized
tataaaaggtcgacagtagg

SEQ ID NO: 265001 - DNA, 20 bp, Artificial Sequence
  chemically synthesized
ctttataaaaggtcgacagt

SEQ ID NO: 265002 - DNA, 20 bp, Artificial Sequence
  chemically synthesized
actttataaaaggtcgacag

SEQ ID NO: 265003 - DNA, 20 bp, Artificial Sequence
  chemically synthesized
taaactttataaaaggtcga

SEQ ID NO: 265004 - DNA, 20 bp, Artificial Sequence
  chemically synthesized
cctactgtcgaccttttata

SEQ ID NO: 265005 - DNA, 20 bp, Artificial Sequence
  chemically synthesized
tctaagttaaactttataaa

SEQ ID NO: 265006 - DNA, 20 bp, Artificial Sequence
  chemically synthesized
ttctaagttaaactttataa

SEQ ID NO: 265007 - DNA, 20 bp, Artificial Sequence
  chemically synthesized
accttttataaagtttaact

SEQ ID NO: 265008 - DNA, 20 bp, Artificial Sequence
  chemically synthesized
atgaaatagggcaatattct

SEQ ID NO: 265009 - DNA, 20 bp, Artificial Sequence
  chemically synthesized
agtcatgtaatcatgaaata

SEQ ID NO: 265010 - DNA, 20 bp, Artificial Sequence
  chemically synthesized
aagtcatgtaatcatgaaat

SEQ ID NO: 265011 - DNA, 20 bp, Artificial Sequence
  chemically synthesized
aaagtcatgtaatcatgaaa

SEQ ID NO: 265012 - DNA, 20 bp, Artificial Sequence
  chemically synthesized
ttcatgattacatgactttt

SEQ ID NO: 265013 - DNA, 20 bp, Artificial Sequence
  chemically synthesized
catgattacatgactttttg

SEQ ID NO: 265014 - DNA, 20 bp, Artificial Sequence
  chemically synthesized
gattacatgactttttggag

SEQ ID NO: 265015 - DNA, 20 bp, Artificial Sequence
  chemically synthesized
aattcatttcctactccaaa

SEQ ID NO: 265016 - DNA, 20 bp, Artificial Sequence
  chemically synthesized
attacatgactttttggagt

SEQ ID NO: 265017 - DNA, 20 bp, Artificial Sequence
  chemically synthesized
tggagtaggaaatgaattaa

SEQ ID NO: 265018 - DNA, 20 bp, Artificial Sequence
  chemically synthesized
gagtaggaaatgaattaaaa

SEQ ID NO: 265019 - DNA, 20 bp, Artificial Sequence
  chemically synthesized
agtaggaaatgaattaaaag

SEQ ID NO: 265020 - DNA, 20 bp, Artificial Sequence
  chemically synthesized
tgtctcccccatacatttta

SEQ ID NO: 265021 - DNA, 20 bp, Artificial Sequence
  chemically synthesized
acatttaactctaaaatgta

SEQ ID NO: 265022 - DNA, 20 bp, Artificial Sequence
  chemically synthesized
tctgtctcccccatacattt

SEQ ID NO: 265023 - DNA, 20 bp, Artificial Sequence
  chemically synthesized
catttaactctaaaatgtat

SEQ ID NO: 265024 - DNA, 20 bp, Artificial Sequence
  chemically synthesized
atttaactctaaaatgtatg

SEQ ID NO: 265025 - DNA, 20 bp, Artificial Sequence
  chemically synthesized
tttaactctaaaatgtatgg

SEQ ID NO: 265026 - DNA, 20 bp, Artificial Sequence
  chemically synthesized
taactctaaaatgtatgggg

SEQ ID NO: 265027 - DNA, 20 bp, Artificial Sequence
  chemically synthesized
tctaaaatgtatgggggaga

SEQ ID NO: 265028 - DNA, 20 bp, Artificial Sequence
  chemically synthesized
tgtatgggggagacagacaa

SEQ ID NO: 265029 - DNA, 20 bp, Artificial Sequence
  chemically synthesized
aagtaaaaacataacacttt

SEQ ID NO: 265030 - DNA, 20 bp, Artificial Sequence
  chemically synthesized
ttaaaatacaaaattgctta

SEQ ID NO: 265031 - DNA, 20 bp, Artificial Sequence
  chemically synthesized
aacctaagtaaatgaaaaga

SEQ ID NO: 265032 - DNA, 20 bp, Artificial Sequence
  chemically synthesized
aaacaacctaagtaaatgaa

SEQ ID NO: 265033 - DNA, 20 bp, Artificial Sequence
  chemically synthesized
aaactttcttttcatttact

SEQ ID NO: 265034 - DNA, 20 bp, Artificial Sequence
  chemically synthesized
aactttcttttcatttactt

SEQ ID NO: 265035 - DNA, 20 bp, Artificial Sequence
  chemically synthesized
ataaaactggaaaacaacct

SEQ ID NO: 265036 - DNA, 20 bp, Artificial Sequence
  chemically synthesized
catttacttaggttgttttc

SEQ ID NO: 265037 - DNA, 20 bp, Artificial Sequence
  chemically synthesized
gggaatggaagaaataaaac

SEQ ID NO: 265038 - DNA, 20 bp, Artificial Sequence
  chemically synthesized
gaagaaggaagggggaatgg

SEQ ID NO: 265039 - DNA, 20 bp, Artificial Sequence
  chemically synthesized
atggaagaaggaagggggaa

SEQ ID NO: 265040 - DNA, 20 bp, Artificial Sequence
  chemically synthesized
aagaaatggaagaaggaagg

SEQ ID NO: 265041 - DNA, 20 bp, Artificial Sequence
  chemically synthesized
gaagaaatggaagaaggaag

SEQ ID NO: 265042 - DNA, 20 bp, Artificial Sequence
  chemically synthesized
ggaagaaatggaagaaggaa

SEQ ID NO: 265043 - DNA, 20 bp, Artificial Sequence
  chemically synthesized
aggaagaaatggaagaagga

SEQ ID NO: 265044 - DNA, 20 bp, Artificial Sequence
  chemically synthesized
gaggaagaaatggaagaagg

SEQ ID NO: 265045 - DNA, 20 bp, Artificial Sequence
  chemically synthesized
agggaggaagaaatggaaga

SEQ ID NO: 265046 - DNA, 20 bp, Artificial Sequence
  chemically synthesized
tagggaggaagaaatggaag

SEQ ID NO: 265047 - DNA, 20 bp, Artificial Sequence
  chemically synthesized
tggtagggaggaagaaatgg

SEQ ID NO: 265048 - DNA, 20 bp, Artificial Sequence
  chemically synthesized
aggtggtagggaggaagaaa

SEQ ID NO: 265049 - DNA, 20 bp, Artificial Sequence
  chemically synthesized
aacaaaaggtggtagggagg

SEQ ID NO: 265050 - DNA, 20 bp, Artificial Sequence
  chemically synthesized
aagaacaaaaggtggtaggg

SEQ ID NO: 265051 - DNA, 20 bp, Artificial Sequence
  chemically synthesized
caagaacaaaaggtggtagg

SEQ ID NO: 265052 - DNA, 20 bp, Artificial Sequence
  chemically synthesized
gacaagaacaaaaggtggta

SEQ ID NO: 265053 - DNA, 20 bp, Artificial Sequence
  chemically synthesized
tgacaagaacaaaaggtggt

SEQ ID NO: 265054 - DNA, 20 bp, Artificial Sequence
  chemically synthesized
atgacaagaacaaaaggtgg

SEQ ID NO: 265055 - DNA, 20 bp, Artificial Sequence
  chemically synthesized
aaaatgacaagaacaaaagg

SEQ ID NO: 265056 - DNA, 20 bp, Artificial Sequence
  chemically synthesized
ttaaaaatgacaagaacaaa

SEQ ID NO: 265057 - DNA, 20 bp, Artificial Sequence
  chemically synthesized
attaaaaatgacaagaacaa

SEQ ID NO: 265058 - DNA, 20 bp, Artificial Sequence
  chemically synthesized
ctttttgtattaaaaatgac

SEQ ID NO: 265059 - DNA, 20 bp, Artificial Sequence
  chemically synthesized
cttgtcatttttaatacaaa

SEQ ID NO: 265060 - DNA, 20 bp, Artificial Sequence
  chemically synthesized
taacgaaatcactgtatttg

SEQ ID NO: 265061 - DNA, 20 bp, Artificial Sequence
  chemically synthesized
acccaatttcacttcaaata

SEQ ID NO: 265062 - DNA, 20 bp, Artificial Sequence
  chemically synthesized
cactgtatttgaagtgaaat

SEQ ID NO: 265063 - DNA, 20 bp, Artificial Sequence
  chemically synthesized
actgtatttgaagtgaaatt

SEQ ID NO: 265064 - DNA, 20 bp, Artificial Sequence
  chemically synthesized
ggtatgtttatactaacaca

SEQ ID NO: 265065 - DNA, 20 bp, Artificial Sequence
  chemically synthesized
tttgttggtctactatgtgt

SEQ ID NO: 265066 - DNA, 20 bp, Artificial Sequence
  chemically synthesized
atgtttatactaacacatag

SEQ ID NO: 265067 - DNA, 20 bp, Artificial Sequence
  chemically synthesized
tgtcataaagtagtttttgt

SEQ ID NO: 265068 - DNA, 20 bp, Artificial Sequence
  chemically synthesized
cctctatttatgtcataaag

SEQ ID NO: 265069 - DNA, 20 bp, Artificial Sequence
  chemically synthesized
ctgcctctatttatgtcata

SEQ ID NO: 265070 - DNA, 20 bp, Artificial Sequence
  chemically synthesized
aaactactttatgacataaa

SEQ ID NO: 265071 - DNA, 20 bp, Artificial Sequence
  chemically synthesized
actactttatgacataaata

SEQ ID NO: 265072 - DNA, 20 bp, Artificial Sequence
  chemically synthesized
ctactttatgacataaatag

SEQ ID NO: 265073 - DNA, 20 bp, Artificial Sequence
  chemically synthesized
ctttatgacataaatagagg

SEQ ID NO: 265074 - DNA, 20 bp, Artificial Sequence
  chemically synthesized
tagaggcagtaaactatgct

SEQ ID NO: 265075 - DNA, 20 bp, Artificial Sequence
  chemically synthesized
ttcaatacactgactcagca

SEQ ID NO: 265076 - DNA, 20 bp, Artificial Sequence
  chemically synthesized
ggcagtaaactatgctgagt

SEQ ID NO: 265077 - DNA, 20 bp, Artificial Sequence
  chemically synthesized
tccacttcaatacactgact

SEQ ID NO: 265078 - DNA, 20 bp, Artificial Sequence
  chemically synthesized
tatgctgagtcagtgtattg

SEQ ID NO: 265079 - DNA, 20 bp, Artificial Sequence
  chemically synthesized
gctgagtcagtgtattgaag

SEQ ID NO: 265080 - DNA, 20 bp, Artificial Sequence
  chemically synthesized
tcagtgtattgaagtggaca

SEQ ID NO: 265081 - DNA, 20 bp, Artificial Sequence
  chemically synthesized
tattgaagtggacaaagcaa

SEQ ID NO: 265082 - DNA, 20 bp, Artificial Sequence
  chemically synthesized
agtggacaaagcaatggact

SEQ ID NO: 265083 - DNA, 20 bp, Artificial Sequence
  chemically synthesized
caaagcaatggactgagatc

SEQ ID NO: 265084 - DNA, 20 bp, Artificial Sequence
  chemically synthesized
ggttagcaaatactagatct

SEQ ID NO: 265085 - DNA, 20 bp, Artificial Sequence
  chemically synthesized
acagtgtggttagcaaatac

SEQ ID NO: 265086 - DNA, 20 bp, Artificial Sequence
  chemically synthesized
tcacagttagacagtgtggt

SEQ ID NO: 265087 - DNA, 20 bp, Artificial Sequence
  chemically synthesized
gttctcacagttagacagtg

SEQ ID NO: 265088 - DNA, 20 bp, Artificial Sequence
  chemically synthesized
accaagttctcacagttaga

SEQ ID NO: 265089 - DNA, 20 bp, Artificial Sequence
  chemically synthesized
taaccacactgtctaactgt

SEQ ID NO: 265090 - DNA, 20 bp, Artificial Sequence
  chemically synthesized
gttgaccaagttctcacagt

SEQ ID NO: 265091 - DNA, 20 bp, Artificial Sequence
  chemically synthesized
gtgagttgaccaagttctca

SEQ ID NO: 265092 - DNA, 20 bp, Artificial Sequence
  chemically synthesized
actgtctaactgtgagaact

SEQ ID NO: 265093 - DNA, 20 bp, Artificial Sequence
  chemically synthesized
agagtgtcagtgagttgacc

SEQ ID NO: 265094 - DNA, 20 bp, Artificial Sequence
  chemically synthesized
gaggttgtgagagtgtcagt

SEQ ID NO: 265095 - DNA, 20 bp, Artificial Sequence
  chemically synthesized
ataggaggttgtgagagtgt

SEQ ID NO: 265096 - DNA, 20 bp, Artificial Sequence
  chemically synthesized
atatttataggaggttgtga

SEQ ID NO: 265097 - DNA, 20 bp, Artificial Sequence
  chemically synthesized
agatatttataggaggttgt

SEQ ID NO: 265098 - DNA, 20 bp, Artificial Sequence
  chemically synthesized
gactttcagatatttatagg

SEQ ID NO: 265099 - DNA, 20 bp, Artificial Sequence
  chemically synthesized
agactttcagatatttatag

SEQ ID NO: 265100 - DNA, 20 bp, Artificial Sequence
  chemically synthesized
agagactttcagatatttat

SEQ ID NO: 265101 - DNA, 20 bp, Artificial Sequence
  chemically synthesized
cagagactttcagatattta

SEQ ID NO: 265102 - DNA, 20 bp, Artificial Sequence
  chemically synthesized
aacctcctataaatatctga

SEQ ID NO: 265103 - DNA, 20 bp, Artificial Sequence
  chemically synthesized
tgctttggaccagagacttt

SEQ ID NO: 265104 - DNA, 20 bp, Artificial Sequence
  chemically synthesized
tataaatatctgaaagtctc

SEQ ID NO: 265105 - DNA, 20 bp, Artificial Sequence
  chemically synthesized
atctgaaagtctctggtcca

SEQ ID NO: 265106 - DNA, 20 bp, Artificial Sequence
  chemically synthesized
agcaattttgctttggacca

SEQ ID NO: 265107 - DNA, 20 bp, Artificial Sequence
  chemically synthesized
aaagcaattttgctttggac

SEQ ID NO: 265108 - DNA, 20 bp, Artificial Sequence
  chemically synthesized
gatgtaaagcaattttgctt

SEQ ID NO: 265109 - DNA, 20 bp, Artificial Sequence
  chemically synthesized
gatcagtgtcagtagatgta

SEQ ID NO: 265110 - DNA, 20 bp, Artificial Sequence
  chemically synthesized
agtcccctgatcagtgtcag

SEQ ID NO: 265111 - DNA, 20 bp, Artificial Sequence
  chemically synthesized
attagtcccctgatcagtgt

SEQ ID NO: 265112 - DNA, 20 bp, Artificial Sequence
  chemically synthesized
ttacatctactgacactgat

SEQ ID NO: 265113 - DNA, 20 bp, Artificial Sequence
  chemically synthesized
tacatctactgacactgatc

SEQ ID NO: 265114 - DNA, 20 bp, Artificial Sequence
  chemically synthesized
acatctactgacactgatca

SEQ ID NO: 265115 - DNA, 20 bp, Artificial Sequence
  chemically synthesized
catctactgacactgatcag

SEQ ID NO: 265116 - DNA, 20 bp, Artificial Sequence
  chemically synthesized
aggaaaattagtcccctgat

SEQ ID NO: 265117 - DNA, 20 bp, Artificial Sequence
  chemically synthesized
ctcctttgataaaggaaaat

SEQ ID NO: 265118 - DNA, 20 bp, Artificial Sequence
  chemically synthesized
ggactaattttcctttatca

SEQ ID NO: 265119 - DNA, 20 bp, Artificial Sequence
  chemically synthesized
gactaattttcctttatcaa

SEQ ID NO: 265120 - DNA, 20 bp, Artificial Sequence
  chemically synthesized
tgattgttctcctttgataa

SEQ ID NO: 265121 - DNA, 20 bp, Artificial Sequence
  chemically synthesized
ttgattgttctcctttgata

SEQ ID NO: 265122 - DNA, 20 bp, Artificial Sequence
  chemically synthesized
ctaattttcctttatcaaag

SEQ ID NO: 265123 - DNA, 20 bp, Artificial Sequence
  chemically synthesized
tttatcaaaggagaacaatc

SEQ ID NO: 265124 - DNA, 20 bp, Artificial Sequence
  chemically synthesized
aacaatcaagattcaccaaa

SEQ ID NO: 265125 - DNA, 20 bp, Artificial Sequence
  chemically synthesized
ttgaaataattaaagctatt

SEQ ID NO: 265126 - DNA, 20 bp, Artificial Sequence
  chemically synthesized
cataacatttgaaataatta

SEQ ID NO: 265127 - DNA, 20 bp, Artificial Sequence
  chemically synthesized
atttcaaatgttatgctaac

SEQ ID NO: 265128 - DNA, 20 bp, Artificial Sequence
  chemically synthesized
taaaactatctgggtcttgt

SEQ ID NO: 265129 - DNA, 20 bp, Artificial Sequence
  chemically synthesized
aatgttatgctaacaagacc

SEQ ID NO: 265130 - DNA, 20 bp, Artificial Sequence
  chemically synthesized
ttatgctaacaagacccaga

SEQ ID NO: 265131 - DNA, 20 bp, Artificial Sequence
  chemically synthesized
gtcatttgataaaactatct

SEQ ID NO: 265132 - DNA, 20 bp, Artificial Sequence
  chemically synthesized
tgtcatttgataaaactatc

SEQ ID NO: 265133 - DNA, 20 bp, Artificial Sequence
  chemically synthesized
gtgtaattgagtttggtgag

SEQ ID NO: 265134 - DNA, 20 bp, Artificial Sequence
  chemically synthesized
gatgtgtaattgagtttggt

SEQ ID NO: 265135 - DNA, 20 bp, Artificial Sequence
  chemically synthesized
agtagatgtgtaattgagtt

SEQ ID NO: 265136 - DNA, 20 bp, Artificial Sequence
  chemically synthesized
tttaaagtagatgtgtaatt

SEQ ID NO: 265137 - DNA, 20 bp, Artificial Sequence
  chemically synthesized
catgtaaaatatttttaaag

SEQ ID NO: 265138 - DNA, 20 bp, Artificial Sequence
  chemically synthesized
aaccatgtaaaatattttta

SEQ ID NO: 265139 - DNA, 20 bp, Artificial Sequence
  chemically synthesized
tactttaaaaatattttaca

SEQ ID NO: 265140 - DNA, 20 bp, Artificial Sequence
  chemically synthesized
aatattttacatggttacca

SEQ ID NO: 265141 - DNA, 20 bp, Artificial Sequence
  chemically synthesized
atattttacatggttaccaa

SEQ ID NO: 265142 - DNA, 20 bp, Artificial Sequence
  chemically synthesized
tattttacatggttaccaaa

SEQ ID NO: 265143 - DNA, 20 bp, Artificial Sequence
  chemically synthesized
acttcgctaataaatccctt

SEQ ID NO: 265144 - DNA, 20 bp, Artificial Sequence
  chemically synthesized
tggttaccaaagggatttat

SEQ ID NO: 265145 - DNA, 20 bp, Artificial Sequence
  chemically synthesized
accaaagggatttattagcg

SEQ ID NO: 265146 - DNA, 20 bp, Artificial Sequence
  chemically synthesized
atttattagcgaagtttcaa

SEQ ID NO: 265147 - DNA, 20 bp, Artificial Sequence
  chemically synthesized
gttatccctataacaaggtt

SEQ ID NO: 265148 - DNA, 20 bp, Artificial Sequence
  chemically synthesized
caatggacttaaccttgtta

SEQ ID NO: 265149 - DNA, 20 bp, Artificial Sequence
  chemically synthesized
aatggacttaaccttgttat

SEQ ID NO: 265150 - DNA, 20 bp, Artificial Sequence
  chemically synthesized
atggacttaaccttgttata

SEQ ID NO: 265151 - DNA, 20 bp, Artificial Sequence
  chemically synthesized
aattggttatccctataaca

SEQ ID NO: 265152 - DNA, 20 bp, Artificial Sequence
  chemically synthesized
taattggttatccctataac

SEQ ID NO: 265153 - DNA, 20 bp, Artificial Sequence
  chemically synthesized
attttttccacatgtgtaat

SEQ ID NO: 265154 - DNA, 20 bp, Artificial Sequence
  chemically synthesized
gggataaccaattacacatg

SEQ ID NO: 265155 - DNA, 20 bp, Artificial Sequence
  chemically synthesized
attacacatgtggaaaaaat

SEQ ID NO: 265156 - DNA, 20 bp, Artificial Sequence
  chemically synthesized
tggaaaaaataagctaacat

SEQ ID NO: 265157 - DNA, 20 bp, Artificial Sequence
  chemically synthesized
taacaacataattcttatgt

SEQ ID NO: 265158 - DNA, 20 bp, Artificial Sequence
  chemically synthesized
taacataagaattatgttgt

SEQ ID NO: 265159 - DNA, 20 bp, Artificial Sequence
  chemically synthesized
aacataagaattatgttgtt

SEQ ID NO: 265160 - DNA, 20 bp, Artificial Sequence
  chemically synthesized
tttattttactaaaatgaat

SEQ ID NO: 265161 - DNA, 20 bp, Artificial Sequence
  chemically synthesized
catatttttctgattcattt

SEQ ID NO: 265162 - DNA, 20 bp, Artificial Sequence
  chemically synthesized
ttttagtaaaataaaatttg

SEQ ID NO: 265163 - DNA, 20 bp, Artificial Sequence
  chemically synthesized
taaaatttgcagatattata

SEQ ID NO: 265164 - DNA, 20 bp, Artificial Sequence
  chemically synthesized
cagatattatacagtttgac

SEQ ID NO: 265165 - DNA, 20 bp, Artificial Sequence
  chemically synthesized
aggtaatagtaacagatcac

SEQ ID NO: 265166 - DNA, 20 bp, Artificial Sequence
  chemically synthesized
atatcttcaggtaatagtaa

SEQ ID NO: 265167 - DNA, 20 bp, Artificial Sequence
  chemically synthesized
tgatctgttactattacctg

SEQ ID NO: 265168 - DNA, 20 bp, Artificial Sequence
  chemically synthesized
caactaatatcttcaggtaa

SEQ ID NO: 265169 - DNA, 20 bp, Artificial Sequence
  chemically synthesized
tatttacaactaatatcttc

SEQ ID NO: 265170 - DNA, 20 bp, Artificial Sequence
  chemically synthesized
ttactattacctgaagatat

SEQ ID NO: 265171 - DNA, 20 bp, Artificial Sequence
  chemically synthesized
atatttacaactaatatctt

SEQ ID NO: 265172 - DNA, 20 bp, Artificial Sequence
  chemically synthesized
taaatattgcataatttgta

SEQ ID NO: 265173 - DNA, 20 bp, Artificial Sequence
  chemically synthesized
tgtaaatattgcataatttg

SEQ ID NO: 265174 - DNA, 20 bp, Artificial Sequence
  chemically synthesized
acaaattatgcaatatttac

SEQ ID NO: 265175 - DNA, 20 bp, Artificial Sequence
  chemically synthesized
atatttacaagtcttcatct

SEQ ID NO: 265176 - DNA, 20 bp, Artificial Sequence
  chemically synthesized
aaaacatgaaaactgagatg

SEQ ID NO: 265177 - DNA, 20 bp, Artificial Sequence
  chemically synthesized
tctataaaaacatgaaaact

SEQ ID NO: 265178 - DNA, 20 bp, Artificial Sequence
  chemically synthesized
tctcagttttcatgttttta

SEQ ID NO: 265179 - DNA, 20 bp, Artificial Sequence
  chemically synthesized
ggtatatagatattcatttt

SEQ ID NO: 265180 - DNA, 20 bp, Artificial Sequence
  chemically synthesized
gtaggtacattgtaggtata

SEQ ID NO: 265181 - DNA, 20 bp, Artificial Sequence
  chemically synthesized
aatttttgtaggtacattgt

SEQ ID NO: 265182 - DNA, 20 bp, Artificial Sequence
  chemically synthesized
taatttttgtaggtacattg

SEQ ID NO: 265183 - DNA, 20 bp, Artificial Sequence
  chemically synthesized
ttaatttttttaatttttgt

SEQ ID NO: 265184 - DNA, 20 bp, Artificial Sequence
  chemically synthesized
tttaatttttttaatttttg

SEQ ID NO: 265185 - DNA, 20 bp, Artificial Sequence
  chemically synthesized
attaaaaaaattaaaattta

SEQ ID NO: 265186 - DNA, 20 bp, Artificial Sequence
  chemically synthesized
taaaatttaaagaatatata

SEQ ID NO: 265187 - DNA, 20 bp, Artificial Sequence
  chemically synthesized
atttaaagaatatatatagc

SEQ ID NO: 265188 - DNA, 20 bp, Artificial Sequence
  chemically synthesized
atattgtatcttaattggaa

SEQ ID NO: 265189 - DNA, 20 bp, Artificial Sequence
  chemically synthesized
gcaagaatactgttccaatt

SEQ ID NO: 265190 - DNA, 20 bp, Artificial Sequence
  chemically synthesized
aaataatattgtatcttaat

SEQ ID NO: 265191 - DNA, 20 bp, Artificial Sequence
  chemically synthesized
tacaatattattttccatca

SEQ ID NO: 265192 - DNA, 20 bp, Artificial Sequence
  chemically synthesized
acaatattattttccatcat

SEQ ID NO: 265193 - DNA, 20 bp, Artificial Sequence
  chemically synthesized
ttataacttaacacctatga

SEQ ID NO: 265194 - DNA, 20 bp, Artificial Sequence
  chemically synthesized
tattttccatcataggtgtt

SEQ ID NO: 265195 - DNA, 20 bp, Artificial Sequence
  chemically synthesized
gtgttaagttataatacgat

SEQ ID NO: 265196 - DNA, 20 bp, Artificial Sequence
  chemically synthesized
taagttataatacgatcaga

SEQ ID NO: 265197 - DNA, 20 bp, Artificial Sequence
  chemically synthesized
agttataatacgatcagaaa

SEQ ID NO: 265198 - DNA, 20 bp, Artificial Sequence
  chemically synthesized
gcaaatacattgatattttg

SEQ ID NO: 265199 - DNA, 20 bp, Artificial Sequence
  chemically synthesized
tgcattgataaatctgacta

SEQ ID NO: 265200 - DNA, 20 bp, Artificial Sequence
  chemically synthesized
aaagcttaattttctgtagt

SEQ ID NO: 265201 - DNA, 20 bp, Artificial Sequence
  chemically synthesized
aattaaagcttaattttctg

SEQ ID NO: 265202 - DNA, 20 bp, Artificial Sequence
  chemically synthesized
aaatctgactacagaaaatt

SEQ ID NO: 265203 - DNA, 20 bp, Artificial Sequence
  chemically synthesized
ggattgaaaatttttaatta

SEQ ID NO: 265204 - DNA, 20 bp, Artificial Sequence
  chemically synthesized
aaggtccaatgaagatgtat

SEQ ID NO: 265205 - DNA, 20 bp, Artificial Sequence
  chemically synthesized
tcaatccaatacatcttcat

SEQ ID NO: 265206 - DNA, 20 bp, Artificial Sequence
  chemically synthesized
gtgatctagaaggtccaatg

SEQ ID NO: 265207 - DNA, 20 bp, Artificial Sequence
  chemically synthesized
tacatcttcattggaccttc

SEQ ID NO: 265208 - DNA, 20 bp, Artificial Sequence
  chemically synthesized
ttttataaatgtgatctaga

SEQ ID NO: 265209 - DNA, 20 bp, Artificial Sequence
  chemically synthesized
attttataaatgtgatctag

SEQ ID NO: 265210 - DNA, 20 bp, Artificial Sequence
  chemically synthesized
tgcattttataaatgtgatc

SEQ ID NO: 265211 - DNA, 20 bp, Artificial Sequence
  chemically synthesized
gcatcatttatttcccaccg

SEQ ID NO: 265212 - DNA, 20 bp, Artificial Sequence
  chemically synthesized
tggctctcctaaacttcggt

SEQ ID NO: 265213 - DNA, 20 bp, Artificial Sequence
  chemically synthesized
ttggctctcctaaacttcgg

SEQ ID NO: 265214 - DNA, 20 bp, Artificial Sequence
  chemically synthesized
atttatttcccaccgaagtt

SEQ ID NO: 265215 - DNA, 20 bp, Artificial Sequence
  chemically synthesized
tttatttcccaccgaagttt

SEQ ID NO: 265216 - DNA, 20 bp, Artificial Sequence
  chemically synthesized
attttggctctcctaaactt

SEQ ID NO: 265217 - DNA, 20 bp, Artificial Sequence
  chemically synthesized
tatttcccaccgaagtttag

SEQ ID NO: 265218 - DNA, 20 bp, Artificial Sequence
  chemically synthesized
tttcccaccgaagtttagga

SEQ ID NO: 265219 - DNA, 20 bp, Artificial Sequence
  chemically synthesized
aagcagtgatttaattattt

SEQ ID NO: 265220 - DNA, 20 bp, Artificial Sequence
  chemically synthesized
atgtgtggaaaataattaag

SEQ ID NO: 265221 - DNA, 20 bp, Artificial Sequence
  chemically synthesized
tctatgtgtggaaaataatt

SEQ ID NO: 265222 - DNA, 20 bp, Artificial Sequence
  chemically synthesized
gcttaattattttccacaca

SEQ ID NO: 265223 - DNA, 20 bp, Artificial Sequence
  chemically synthesized
ttaaaatatggttctatgtg

SEQ ID NO: 265224 - DNA, 20 bp, Artificial Sequence
  chemically synthesized
cacacatagaaccatatttt

SEQ ID NO: 265225 - DNA, 20 bp, Artificial Sequence
  chemically synthesized
gcctaatctatcttaaaata

SEQ ID NO: 265226 - DNA, 20 bp, Artificial Sequence
  chemically synthesized
catagaaccatattttaaga

SEQ ID NO: 265227 - DNA, 20 bp, Artificial Sequence
  chemically synthesized
aaccatattttaagatagat

SEQ ID NO: 265228 - DNA, 20 bp, Artificial Sequence
  chemically synthesized
accatattttaagatagatt

SEQ ID NO: 265229 - DNA, 20 bp, Artificial Sequence
  chemically synthesized
agaaaaagaaacacatgatt

SEQ ID NO: 265230 - DNA, 20 bp, Artificial Sequence
  chemically synthesized
aagaaaaagaaacacatgat

SEQ ID NO: 265231 - DNA, 20 bp, Artificial Sequence
  chemically synthesized
aatgtagaatatataagaaa

SEQ ID NO: 265232 - DNA, 20 bp, Artificial Sequence
  chemically synthesized
ccatgtaatgtagaatatat

SEQ ID NO: 265233 - DNA, 20 bp, Artificial Sequence
  chemically synthesized
cttatatattctacattaca

SEQ ID NO: 265234 - DNA, 20 bp, Artificial Sequence
  chemically synthesized
agtgaccttcccatgtaatg

SEQ ID NO: 265235 - DNA, 20 bp, Artificial Sequence
  chemically synthesized
ttatatattctacattacat

SEQ ID NO: 265236 - DNA, 20 bp, Artificial Sequence
  chemically synthesized
tatattctacattacatggg

SEQ ID NO: 265237 - DNA, 20 bp, Artificial Sequence
  chemically synthesized
atattctacattacatggga

SEQ ID NO: 265238 - DNA, 20 bp, Artificial Sequence
  chemically synthesized
ataggaggctgtgagagagt

SEQ ID NO: 265239 - DNA, 20 bp, Artificial Sequence
  chemically synthesized
gaaggtcactgactctctca

SEQ ID NO: 265240 - DNA, 20 bp, Artificial Sequence
  chemically synthesized
gtttataggaggctgtgaga

SEQ ID NO: 265241 - DNA, 20 bp, Artificial Sequence
  chemically synthesized
aagtttataggaggctgtga

SEQ ID NO: 265242 - DNA, 20 bp, Artificial Sequence
  chemically synthesized
acaagtttataggaggctgt

SEQ ID NO: 265243 - DNA, 20 bp, Artificial Sequence
  chemically synthesized
gactttcacaagtttatagg

SEQ ID NO: 265244 - DNA, 20 bp, Artificial Sequence
  chemically synthesized
agactttcacaagtttatag

SEQ ID NO: 265245 - DNA, 20 bp, Artificial Sequence
  chemically synthesized
agagactttcacaagtttat

SEQ ID NO: 265246 - DNA, 20 bp, Artificial Sequence
  chemically synthesized
aagagactttcacaagttta

SEQ ID NO: 265247 - DNA, 20 bp, Artificial Sequence
  chemically synthesized
agcctcctataaacttgtga

SEQ ID NO: 265248 - DNA, 20 bp, Artificial Sequence
  chemically synthesized
tttggataagagactttcac

SEQ ID NO: 265249 - DNA, 20 bp, Artificial Sequence
  chemically synthesized
ttgtgaaagtctcttatcca

SEQ ID NO: 265250 - DNA, 20 bp, Artificial Sequence
  chemically synthesized
agtaatcattctttggataa

SEQ ID NO: 265251 - DNA, 20 bp, Artificial Sequence
  chemically synthesized
aaagtaatcattctttggat

SEQ ID NO: 265252 - DNA, 20 bp, Artificial Sequence
  chemically synthesized
atataaaagtaatcattctt

SEQ ID NO: 265253 - DNA, 20 bp, Artificial Sequence
  chemically synthesized
ttcagtgtcagaagatataa

SEQ ID NO: 265254 - DNA, 20 bp, Artificial Sequence
  chemically synthesized
ttacttccattcagtgtcag

SEQ ID NO: 265255 - DNA, 20 bp, Artificial Sequence
  chemically synthesized
tttttacttccattcagtgt

SEQ ID NO: 265256 - DNA, 20 bp, Artificial Sequence
  chemically synthesized
ttatatcttctgacactgaa

SEQ ID NO: 265257 - DNA, 20 bp, Artificial Sequence
  chemically synthesized
tatcttctgacactgaatgg

SEQ ID NO: 265258 - DNA, 20 bp, Artificial Sequence
  chemically synthesized
tttttttttttacttccatt

SEQ ID NO: 265259 - DNA, 20 bp, Artificial Sequence
  chemically synthesized
aaaaaaaaaaaaaaaaaact

SEQ ID NO: 265260 - DNA, 20 bp, Artificial Sequence
  chemically synthesized
tgcaataattgtaaattacc

SEQ ID NO: 265261 - DNA, 20 bp, Artificial Sequence
  chemically synthesized
ttggtaatttacaattattg

SEQ ID NO: 265262 - DNA, 20 bp, Artificial Sequence
  chemically synthesized
caatcaaacaatgaatattt

SEQ ID NO: 265263 - DNA, 20 bp, Artificial Sequence
  chemically synthesized
aatatgagatttggacaatc

SEQ ID NO: 265264 - DNA, 20 bp, Artificial Sequence
  chemically synthesized
taatatgagatttggacaat

SEQ ID NO: 265265 - DNA, 20 bp, Artificial Sequence
  chemically synthesized
tacaactgtaatatgagatt

SEQ ID NO: 265266 - DNA, 20 bp, Artificial Sequence
  chemically synthesized
attgtccaaatctcatatta

SEQ ID NO: 265267 - DNA, 20 bp, Artificial Sequence
  chemically synthesized
atgtattacaactgtaatat

SEQ ID NO: 265268 - DNA, 20 bp, Artificial Sequence
  chemically synthesized
acagttgtaatacatatata

SEQ ID NO: 265269 - DNA, 20 bp, Artificial Sequence
  chemically synthesized
tgctgctaaaattcatgtag

SEQ ID NO: 265270 - DNA, 20 bp, Artificial Sequence
  chemically synthesized
aattgctgctaaaattcatg

SEQ ID NO: 265271 - DNA, 20 bp, Artificial Sequence
  chemically synthesized
agaaactgctacatgaattt

SEQ ID NO: 265272 - DNA, 20 bp, Artificial Sequence
  chemically synthesized
aactgctacatgaattttag

SEQ ID NO: 265273 - DNA, 20 bp, Artificial Sequence
  chemically synthesized
gaattttagcagcaattttc

SEQ ID NO: 265274 - DNA, 20 bp, Artificial Sequence
  chemically synthesized
aattttagcagcaattttca

SEQ ID NO: 265275 - DNA, 20 bp, Artificial Sequence
  chemically synthesized
agcaattttcaaggcctata

SEQ ID NO: 265276 - DNA, 20 bp, Artificial Sequence
  chemically synthesized
atgttctttaatttccatat

SEQ ID NO: 265277 - DNA, 20 bp, Artificial Sequence
  chemically synthesized
tatgttctttaatttccata

SEQ ID NO: 265278 - DNA, 20 bp, Artificial Sequence
  chemically synthesized
caaggcctatatggaaatta

SEQ ID NO: 265279 - DNA, 20 bp, Artificial Sequence
  chemically synthesized
ggaaattaaagaacatatgc

SEQ ID NO: 265280 - DNA, 20 bp, Artificial Sequence
  chemically synthesized
tatttgctataggatatatc

SEQ ID NO: 265281 - DNA, 20 bp, Artificial Sequence
  chemically synthesized
catatgccagatatatccta

SEQ ID NO: 265282 - DNA, 20 bp, Artificial Sequence
  chemically synthesized
tactaagacttatttgctat

SEQ ID NO: 265283 - DNA, 20 bp, Artificial Sequence
  chemically synthesized
ttactaagacttatttgcta

SEQ ID NO: 265284 - DNA, 20 bp, Artificial Sequence
  chemically synthesized
agatatatcctatagcaaat

SEQ ID NO: 265285 - DNA, 20 bp, Artificial Sequence
  chemically synthesized
atcctatagcaaataagtct

SEQ ID NO: 265286 - DNA, 20 bp, Artificial Sequence
  chemically synthesized
atagcaaataagtcttagta

SEQ ID NO: 265287 - DNA, 20 bp, Artificial Sequence
  chemically synthesized
tagcaaataagtcttagtaa

SEQ ID NO: 265288 - DNA, 20 bp, Artificial Sequence
  chemically synthesized
tctgactttgatcctttact

SEQ ID NO: 265289 - DNA, 20 bp, Artificial Sequence
  chemically synthesized
taagtcttagtaaaggatca

SEQ ID NO: 265290 - DNA, 20 bp, Artificial Sequence
  chemically synthesized
tcttagtaaaggatcaaagt

SEQ ID NO: 265291 - DNA, 20 bp, Artificial Sequence
  chemically synthesized
ttagtaaaggatcaaagtca

SEQ ID NO: 265292 - DNA, 20 bp, Artificial Sequence
  chemically synthesized
aaaataatttcacttttttc

SEQ ID NO: 265293 - DNA, 20 bp, Artificial Sequence
  chemically synthesized
aattgatactaaccagaaaa

SEQ ID NO: 265294 - DNA, 20 bp, Artificial Sequence
  chemically synthesized
taatttcacttttttctggt

SEQ ID NO: 265295 - DNA, 20 bp, Artificial Sequence
  chemically synthesized
attctgaaattgatactaac

SEQ ID NO: 265296 - DNA, 20 bp, Artificial Sequence
  chemically synthesized
tttctggttagtatcaattt

SEQ ID NO: 265297 - DNA, 20 bp, Artificial Sequence
  chemically synthesized
gaataaataatttaacattt

SEQ ID NO: 265298 - DNA, 20 bp, Artificial Sequence
  chemically synthesized
aatttaacatttcagctcct

SEQ ID NO: 265299 - DNA, 20 bp, Artificial Sequence
  chemically synthesized
aacatttcagctccttagaa

SEQ ID NO: 265300 - DNA, 20 bp, Artificial Sequence
  chemically synthesized
atatacttcactgttctaag

SEQ ID NO: 265301 - DNA, 20 bp, Artificial Sequence
  chemically synthesized
agatatacttcactgttcta

SEQ ID NO: 265302 - DNA, 20 bp, Artificial Sequence
  chemically synthesized
tagatatacttcactgttct

SEQ ID NO: 265303 - DNA, 20 bp, Artificial Sequence
  chemically synthesized
ttcagctccttagaacagtg

SEQ ID NO: 265304 - DNA, 20 bp, Artificial Sequence
  chemically synthesized
gtgaagtatatctaaatctc

SEQ ID NO: 265305 - DNA, 20 bp, Artificial Sequence
  chemically synthesized
attgtatttttctagagatt

SEQ ID NO: 265306 - DNA, 20 bp, Artificial Sequence
  chemically synthesized
gcttagattgtatttttcta

SEQ ID NO: 265307 - DNA, 20 bp, Artificial Sequence
  chemically synthesized
ttgcttagattgtatttttc

SEQ ID NO: 265308 - DNA, 20 bp, Artificial Sequence
  chemically synthesized
tctctagaaaaatacaatct

SEQ ID NO: 265309 - DNA, 20 bp, Artificial Sequence
  chemically synthesized
atttctacataaaatttgct

SEQ ID NO: 265310 - DNA, 20 bp, Artificial Sequence
  chemically synthesized
caatctaagcaaattttatg

SEQ ID NO: 265311 - DNA, 20 bp, Artificial Sequence
  chemically synthesized
attacataatattttgtaaa

SEQ ID NO: 265312 - DNA, 20 bp, Artificial Sequence
  chemically synthesized
taggtgtgtcatattaataa

SEQ ID NO: 265313 - DNA, 20 bp, Artificial Sequence
  chemically synthesized
ttaggtgtgtcatattaata

SEQ ID NO: 265314 - DNA, 20 bp, Artificial Sequence
  chemically synthesized
ttattaatatgacacaccta

SEQ ID NO: 265315 - DNA, 20 bp, Artificial Sequence
  chemically synthesized
attttgactaaacaaacttt

SEQ ID NO: 265316 - DNA, 20 bp, Artificial Sequence
  chemically synthesized
aattttgactaaacaaactt

SEQ ID NO: 265317 - DNA, 20 bp, Artificial Sequence
  chemically synthesized
tgacacacctaaagtttgtt

SEQ ID NO: 265318 - DNA, 20 bp, Artificial Sequence
  chemically synthesized
gtttagtcaaaattattttg

SEQ ID NO: 265319 - DNA, 20 bp, Artificial Sequence
  chemically synthesized
gtcaaaattattttgcagct

SEQ ID NO: 265320 - DNA, 20 bp, Artificial Sequence
  chemically synthesized
atttttattgttgtaatact

SEQ ID NO: 265321 - DNA, 20 bp, Artificial Sequence
  chemically synthesized
tcaataataaaatatgcatc

SEQ ID NO: 265322 - DNA, 20 bp, Artificial Sequence
  chemically synthesized
tttttttaatttttattttt

SEQ ID NO: 265323 - DNA, 20 bp, Artificial Sequence
  chemically synthesized
tttaatttttatttttgaga

SEQ ID NO: 265324 - DNA, 20 bp, Artificial Sequence
  chemically synthesized
cccagcctgggcgacagagt

SEQ ID NO: 265325 - DNA, 20 bp, Artificial Sequence
  chemically synthesized
tggaatctcactctgtcgcc

SEQ ID NO: 265326 - DNA, 20 bp, Artificial Sequence
  chemically synthesized
gcaccccagcctgggcgaca

SEQ ID NO: 265327 - DNA, 20 bp, Artificial Sequence
  chemically synthesized
ggaatctcactctgtcgccc

SEQ ID NO: 265328 - DNA, 20 bp, Artificial Sequence
  chemically synthesized
ctgcaccccagcctgggcga

SEQ ID NO: 265329 - DNA, 20 bp, Artificial Sequence
  chemically synthesized
tctcactctgtcgcccaggc

SEQ ID NO: 265330 - DNA, 20 bp, Artificial Sequence
  chemically synthesized
ctcactctgtcgcccaggct

SEQ ID NO: 265331 - DNA, 20 bp, Artificial Sequence
  chemically synthesized
tcactctgtcgcccaggctg

SEQ ID NO: 265332 - DNA, 20 bp, Artificial Sequence
  chemically synthesized
gcaccactgcaccccagcct

SEQ ID NO: 265333 - DNA, 20 bp, Artificial Sequence
  chemically synthesized
cgcaccactgcaccccagcc

SEQ ID NO: 265334 - DNA, 20 bp, Artificial Sequence
  chemically synthesized
ctgtcgcccaggctggggtg

SEQ ID NO: 265335 - DNA, 20 bp, Artificial Sequence
  chemically synthesized
gagatcgcaccactgcaccc

SEQ ID NO: 265336 - DNA, 20 bp, Artificial Sequence
  chemically synthesized
tcgcccaggctggggtgcag

SEQ ID NO: 265337 - DNA, 20 bp, Artificial Sequence
  chemically synthesized
ggggtgcagtggtgcgatct

SEQ ID NO: 265338 - DNA, 20 bp, Artificial Sequence
  chemically synthesized
ggcggaggttgcagtgagcc

SEQ ID NO: 265339 - DNA, 20 bp, Artificial Sequence
  chemically synthesized
cgggaggcggaggttgcagt

SEQ ID NO: 265340 - DNA, 20 bp, Artificial Sequence
  chemically synthesized
aacccgggaggcggaggttg

SEQ ID NO: 265341 - DNA, 20 bp, Artificial Sequence
  chemically synthesized
tgtttgaacccgggaggcgg

SEQ ID NO: 265342 - DNA, 20 bp, Artificial Sequence
  chemically synthesized
tcactgcaacctccgcctcc

SEQ ID NO: 265343 - DNA, 20 bp, Artificial Sequence
  chemically synthesized
ttgtttgaacccgggaggcg

SEQ ID NO: 265344 - DNA, 20 bp, Artificial Sequence
  chemically synthesized
cactgcaacctccgcctccc

SEQ ID NO: 265345 - DNA, 20 bp, Artificial Sequence
  chemically synthesized
aattgtttgaacccgggagg

SEQ ID NO: 265346 - DNA, 20 bp, Artificial Sequence
  chemically synthesized
ggaaattgtttgaacccggg

SEQ ID NO: 265347 - DNA, 20 bp, Artificial Sequence
  chemically synthesized
gggaaattgtttgaacccgg

SEQ ID NO: 265348 - DNA, 20 bp, Artificial Sequence
  chemically synthesized
gagggaaattgtttgaaccc

SEQ ID NO: 265349 - DNA, 20 bp, Artificial Sequence
  chemically synthesized
ggagggaaattgtttgaacc

SEQ ID NO: 265350 - DNA, 20 bp, Artificial Sequence
  chemically synthesized
gttcaaacaatttccctcct

SEQ ID NO: 265351 - DNA, 20 bp, Artificial Sequence
  chemically synthesized
gctacttgggaggctgagga

SEQ ID NO: 265352 - DNA, 20 bp, Artificial Sequence
  chemically synthesized
agctacttgggaggctgagg

SEQ ID NO: 265353 - DNA, 20 bp, Artificial Sequence
  chemically synthesized
cagctacttgggaggctgag

SEQ ID NO: 265354 - DNA, 20 bp, Artificial Sequence
  chemically synthesized
cccagctacttgggaggctg

SEQ ID NO: 265355 - DNA, 20 bp, Artificial Sequence
  chemically synthesized
tcccagctacttgggaggct

SEQ ID NO: 265356 - DNA, 20 bp, Artificial Sequence
  chemically synthesized
atttccctcctcagcctccc

SEQ ID NO: 265357 - DNA, 20 bp, Artificial Sequence
  chemically synthesized
tccctcctcagcctcccaag

SEQ ID NO: 265358 - DNA, 20 bp, Artificial Sequence
  chemically synthesized
tgtaatcccagctacttggg

SEQ ID NO: 265359 - DNA, 20 bp, Artificial Sequence
  chemically synthesized
ctgtaatcccagctacttgg

SEQ ID NO: 265360 - DNA, 20 bp, Artificial Sequence
  chemically synthesized
tcctcagcctcccaagtagc

SEQ ID NO: 265361 - DNA, 20 bp, Artificial Sequence
  chemically synthesized
gcctgtaatcccagctactt

SEQ ID NO: 265362 - DNA, 20 bp, Artificial Sequence
  chemically synthesized
cctcagcctcccaagtagct

SEQ ID NO: 265363 - DNA, 20 bp, Artificial Sequence
  chemically synthesized
cgcctgtaatcccagctact

SEQ ID NO: 265364 - DNA, 20 bp, Artificial Sequence
  chemically synthesized
ctcccaagtagctgggatta

SEQ ID NO: 265365 - DNA, 20 bp, Artificial Sequence
  chemically synthesized
tcccaagtagctgggattac

SEQ ID NO: 265366 - DNA, 20 bp, Artificial Sequence
  chemically synthesized
gtggtgggcgcctgtaatcc

SEQ ID NO: 265367 - DNA, 20 bp, Artificial Sequence
  chemically synthesized
aattagctgggcatggtggt

SEQ ID NO: 265368 - DNA, 20 bp, Artificial Sequence
  chemically synthesized
aaattagctgggcatggtgg

SEQ ID NO: 265369 - DNA, 20 bp, Artificial Sequence
  chemically synthesized
caggcgcccaccaccatgcc

SEQ ID NO: 265370 - DNA, 20 bp, Artificial Sequence
  chemically synthesized
caaaaattagctgggcatgg

SEQ ID NO: 265371 - DNA, 20 bp, Artificial Sequence
  chemically synthesized
atacaaaaattagctgggca

SEQ ID NO: 265372 - DNA, 20 bp, Artificial Sequence
  chemically synthesized
taaaaatacaaaaattagct

SEQ ID NO: 265373 - DNA, 20 bp, Artificial Sequence
  chemically synthesized
ctaaaaatacaaaaattagc

SEQ ID NO: 265374 - DNA, 20 bp, Artificial Sequence
  chemically synthesized
tctactaaaaatacaaaaat

SEQ ID NO: 265375 - DNA, 20 bp, Artificial Sequence
  chemically synthesized
ccagctaatttttgtatttt

SEQ ID NO: 265376 - DNA, 20 bp, Artificial Sequence
  chemically synthesized
gctaatttttgtatttttag

SEQ ID NO: 265377 - DNA, 20 bp, Artificial Sequence
  chemically synthesized
taatttttgtatttttagta

SEQ ID NO: 265378 - DNA, 20 bp, Artificial Sequence
  chemically synthesized
tttttgtatttttagtagag

SEQ ID NO: 265379 - DNA, 20 bp, Artificial Sequence
  chemically synthesized
ttttgtatttttagtagaga

SEQ ID NO: 265380 - DNA, 20 bp, Artificial Sequence
  chemically synthesized
tttgtatttttagtagagaa

SEQ ID NO: 265381 - DNA, 20 bp, Artificial Sequence
  chemically synthesized
ttgtatttttagtagagaag

SEQ ID NO: 265382 - DNA, 20 bp, Artificial Sequence
  chemically synthesized
gagaaggggatttgccatgt

SEQ ID NO: 265383 - DNA, 20 bp, Artificial Sequence
  chemically synthesized
aggggatttgccatgttggc

SEQ ID NO: 265384 - DNA, 20 bp, Artificial Sequence
  chemically synthesized
gaagatcaacctggccaaca

SEQ ID NO: 265385 - DNA, 20 bp, Artificial Sequence
  chemically synthesized
ggggatttgccatgttggcc

SEQ ID NO: 265386 - DNA, 20 bp, Artificial Sequence
  chemically synthesized
tcaggagttgaagatcaacc

SEQ ID NO: 265387 - DNA, 20 bp, Artificial Sequence
  chemically synthesized
tcacctgacgtcaggagttg

SEQ ID NO: 265388 - DNA, 20 bp, Artificial Sequence
  chemically synthesized
tgatcttcaactcctgacgt

SEQ ID NO: 265389 - DNA, 20 bp, Artificial Sequence
  chemically synthesized
ggcagatcacctgacgtcag

SEQ ID NO: 265390 - DNA, 20 bp, Artificial Sequence
  chemically synthesized
gatcttcaactcctgacgtc

SEQ ID NO: 265391 - DNA, 20 bp, Artificial Sequence
  chemically synthesized
caggcagatcacctgacgtc

SEQ ID NO: 265392 - DNA, 20 bp, Artificial Sequence
  chemically synthesized
gcaggcagatcacctgacgt

SEQ ID NO: 265393 - DNA, 20 bp, Artificial Sequence
  chemically synthesized
gacgtcaggtgatctgcctg

SEQ ID NO: 265394 - DNA, 20 bp, Artificial Sequence
  chemically synthesized
gtcaggtgatctgcctgcag

SEQ ID NO: 265395 - DNA, 20 bp, Artificial Sequence
  chemically synthesized
ctttgggaggccgctgcagg

SEQ ID NO: 265396 - DNA, 20 bp, Artificial Sequence
  chemically synthesized
acactttgggaggccgctgc

SEQ ID NO: 265397 - DNA, 20 bp, Artificial Sequence
  chemically synthesized
aacactttgggaggccgctg

SEQ ID NO: 265398 - DNA, 20 bp, Artificial Sequence
  chemically synthesized
ctgcctgcagcggcctccca

SEQ ID NO: 265399 - DNA, 20 bp, Artificial Sequence
  chemically synthesized
tgtaatcccaacactttggg

SEQ ID NO: 265400 - DNA, 20 bp, Artificial Sequence
  chemically synthesized
ctgtaatcccaacactttgg

SEQ ID NO: 265401 - DNA, 20 bp, Artificial Sequence
  chemically synthesized
gcagcggcctcccaaagtgt

SEQ ID NO: 265402 - DNA, 20 bp, Artificial Sequence
  chemically synthesized
gcctgtaatcccaacacttt

SEQ ID NO: 265403 - DNA, 20 bp, Artificial Sequence
  chemically synthesized
cagcggcctcccaaagtgtt

SEQ ID NO: 265404 - DNA, 20 bp, Artificial Sequence
  chemically synthesized
cgcctgtaatcccaacactt

SEQ ID NO: 265405 - DNA, 20 bp, Artificial Sequence
  chemically synthesized
ctcccaaagtgttgggatta

SEQ ID NO: 265406 - DNA, 20 bp, Artificial Sequence
  chemically synthesized
tcccaaagtgttgggattac

SEQ ID NO: 265407 - DNA, 20 bp, Artificial Sequence
  chemically synthesized
agtgttgggattacaggcgt

SEQ ID NO: 265408 - DNA, 20 bp, Artificial Sequence
  chemically synthesized
acaggcgtgagccaccgcac

SEQ ID NO: 265409 - DNA, 20 bp, Artificial Sequence
  chemically synthesized
caggcgtgagccaccgcacc

SEQ ID NO: 265410 - DNA, 20 bp, Artificial Sequence
  chemically synthesized
caataataggcctggtgcgg

SEQ ID NO: 265411 - DNA, 20 bp, Artificial Sequence
  chemically synthesized
ttccaataataggcctggtg

SEQ ID NO: 265412 - DNA, 20 bp, Artificial Sequence
  chemically synthesized
ataaattccaataataggcc

SEQ ID NO: 265413 - DNA, 20 bp, Artificial Sequence
  chemically synthesized
caccgcaccaggcctattat

SEQ ID NO: 265414 - DNA, 20 bp, Artificial Sequence
  chemically synthesized
tgcatataaattccaataat

SEQ ID NO: 265415 - DNA, 20 bp, Artificial Sequence
  chemically synthesized
ctgcatataaattccaataa

SEQ ID NO: 265416 - DNA, 20 bp, Artificial Sequence
  chemically synthesized
ctattattggaatttatatg

SEQ ID NO: 265417 - DNA, 20 bp, Artificial Sequence
  chemically synthesized
aatttatatgcagactttcc

SEQ ID NO: 265418 - DNA, 20 bp, Artificial Sequence
  chemically synthesized
ttaactctgattgactagga

SEQ ID NO: 265419 - DNA, 20 bp, Artificial Sequence
  chemically synthesized
tgcagactttcctagtcaat

SEQ ID NO: 265420 - DNA, 20 bp, Artificial Sequence
  chemically synthesized
aaatttaactctgattgact

SEQ ID NO: 265421 - DNA, 20 bp, Artificial Sequence
  chemically synthesized
caaatttaactctgattgac

SEQ ID NO: 265422 - DNA, 20 bp, Artificial Sequence
  chemically synthesized
cagactttcctagtcaatca

SEQ ID NO: 265423 - DNA, 20 bp, Artificial Sequence
  chemically synthesized
tagtcaatcagagttaaatt

SEQ ID NO: 265424 - DNA, 20 bp, Artificial Sequence
  chemically synthesized
gtcaatcagagttaaatttg

SEQ ID NO: 265425 - DNA, 20 bp, Artificial Sequence
  chemically synthesized
ttttgaattcatcatcttct

SEQ ID NO: 265426 - DNA, 20 bp, Artificial Sequence
  chemically synthesized
tttgaattcatcatcttctt

SEQ ID NO: 265427 - DNA, 20 bp, Artificial Sequence
  chemically synthesized
attacatacaaggacccaag

SEQ ID NO: 265428 - DNA, 20 bp, Artificial Sequence
  chemically synthesized
gtcattacatacaaggaccc

SEQ ID NO: 265429 - DNA, 20 bp, Artificial Sequence
  chemically synthesized
gagttaagtcattacataca

SEQ ID NO: 265430 - DNA, 20 bp, Artificial Sequence
  chemically synthesized
agagttaagtcattacatac

SEQ ID NO: 265431 - DNA, 20 bp, Artificial Sequence
  chemically synthesized
tgtatgtaatgacttaactc

SEQ ID NO: 265432 - DNA, 20 bp, Artificial Sequence
  chemically synthesized
gtatgtaatgacttaactct

SEQ ID NO: 265433 - DNA, 20 bp, Artificial Sequence
  chemically synthesized
tttagaggtagcctagagtt

SEQ ID NO: 265434 - DNA, 20 bp, Artificial Sequence
  chemically synthesized
agatatttagaggtagccta

SEQ ID NO: 265435 - DNA, 20 bp, Artificial Sequence
  chemically synthesized
ggagatatttagaggtagcc

SEQ ID NO: 265436 - DNA, 20 bp, Artificial Sequence
  chemically synthesized
gctgcggagatatttagagg

SEQ ID NO: 265437 - DNA, 20 bp, Artificial Sequence
  chemically synthesized
gctgctgcggagatatttag

SEQ ID NO: 265438 - DNA, 20 bp, Artificial Sequence
  chemically synthesized
tgctgctgcggagatattta

SEQ ID NO: 265439 - DNA, 20 bp, Artificial Sequence
  chemically synthesized
actgctgctgcggagatatt

SEQ ID NO: 265440 - DNA, 20 bp, Artificial Sequence
  chemically synthesized
gctacctctaaatatctccg

SEQ ID NO: 265441 - DNA, 20 bp, Artificial Sequence
  chemically synthesized
acctctaaatatctccgcag

SEQ ID NO: 265442 - DNA, 20 bp, Artificial Sequence
  chemically synthesized
cttagagaactgctgctgcg

SEQ ID NO: 265443 - DNA, 20 bp, Artificial Sequence
  chemically synthesized
tctaaatatctccgcagcag

SEQ ID NO: 265444 - DNA, 20 bp, Artificial Sequence
  chemically synthesized
cgcttagagaactgctgctg

SEQ ID NO: 265445 - DNA, 20 bp, Artificial Sequence
  chemically synthesized
ctccgcagcagcagttctct

SEQ ID NO: 265446 - DNA, 20 bp, Artificial Sequence
  chemically synthesized
cagcagcagttctctaagcg

SEQ ID NO: 265447 - DNA, 20 bp, Artificial Sequence
  chemically synthesized
aggtctagggaccacgctta

SEQ ID NO: 265448 - DNA, 20 bp, Artificial Sequence
  chemically synthesized
gaaggtctagggaccacgct

SEQ ID NO: 265449 - DNA, 20 bp, Artificial Sequence
  chemically synthesized
agttctctaagcgtggtccc

SEQ ID NO: 265450 - DNA, 20 bp, Artificial Sequence
  chemically synthesized
agattgatgctgaaggtcta

SEQ ID NO: 265451 - DNA, 20 bp, Artificial Sequence
  chemically synthesized
aagcgtggtccctagacctt

SEQ ID NO: 265452 - DNA, 20 bp, Artificial Sequence
  chemically synthesized
cagattgatgctgaaggtct

SEQ ID NO: 265453 - DNA, 20 bp, Artificial Sequence
  chemically synthesized
tcagattgatgctgaaggtc

SEQ ID NO: 265454 - DNA, 20 bp, Artificial Sequence
  chemically synthesized
ctaggtcagattgatgctga

SEQ ID NO: 265455 - DNA, 20 bp, Artificial Sequence
  chemically synthesized
tctaggtcagattgatgctg

SEQ ID NO: 265456 - DNA, 20 bp, Artificial Sequence
  chemically synthesized
ccttcagcatcaatctgacc

SEQ ID NO: 265457 - DNA, 20 bp, Artificial Sequence
  chemically synthesized
tttctaacatttttctaggt

SEQ ID NO: 265458 - DNA, 20 bp, Artificial Sequence
  chemically synthesized
tgcatttctaacatttttct

SEQ ID NO: 265459 - DNA, 20 bp, Artificial Sequence
  chemically synthesized
ttgcatttctaacatttttc

SEQ ID NO: 265460 - DNA, 20 bp, Artificial Sequence
  chemically synthesized
aatctgacctagaaaaatgt

SEQ ID NO: 265461 - DNA, 20 bp, Artificial Sequence
  chemically synthesized
aggtctggagtggagcacaa

SEQ ID NO: 265462 - DNA, 20 bp, Artificial Sequence
  chemically synthesized
ctaggtctggagtggagcac

SEQ ID NO: 265463 - DNA, 20 bp, Artificial Sequence
  chemically synthesized
caaactcttgtgctccactc

SEQ ID NO: 265464 - DNA, 20 bp, Artificial Sequence
  chemically synthesized
gactcactaggtctggagtg

SEQ ID NO: 265465 - DNA, 20 bp, Artificial Sequence
  chemically synthesized
ctgactcactaggtctggag

SEQ ID NO: 265466 - DNA, 20 bp, Artificial Sequence
  chemically synthesized
cttgtgctccactccagacc

SEQ ID NO: 265467 - DNA, 20 bp, Artificial Sequence
  chemically synthesized
cttctgactcactaggtctg

SEQ ID NO: 265468 - DNA, 20 bp, Artificial Sequence
  chemically synthesized
agcttctgactcactaggtc

SEQ ID NO: 265469 - DNA, 20 bp, Artificial Sequence
  chemically synthesized
tgctccactccagacctagt

SEQ ID NO: 265470 - DNA, 20 bp, Artificial Sequence
  chemically synthesized
ccactccagacctagtgagt

SEQ ID NO: 265471 - DNA, 20 bp, Artificial Sequence
  chemically synthesized
ctcagagcttctgactcact

SEQ ID NO: 265472 - DNA, 20 bp, Artificial Sequence
  chemically synthesized
actcagagcttctgactcac

SEQ ID NO: 265473 - DNA, 20 bp, Artificial Sequence
  chemically synthesized
ctccagacctagtgagtcag

SEQ ID NO: 265474 - DNA, 20 bp, Artificial Sequence
  chemically synthesized
cctagtgagtcagaagctct

SEQ ID NO: 265475 - DNA, 20 bp, Artificial Sequence
  chemically synthesized
tgagtcagaagctctgagtg

SEQ ID NO: 265476 - DNA, 20 bp, Artificial Sequence
  chemically synthesized
gagtcagaagctctgagtgt

SEQ ID NO: 265477 - DNA, 20 bp, Artificial Sequence
  chemically synthesized
tgtgctgggccccacactca

SEQ ID NO: 265478 - DNA, 20 bp, Artificial Sequence
  chemically synthesized
agtcagaagctctgagtgtg

SEQ ID NO: 265479 - DNA, 20 bp, Artificial Sequence
  chemically synthesized
agtgtgctgggccccacact

SEQ ID NO: 265480 - DNA, 20 bp, Artificial Sequence
  chemically synthesized
gaagctctgagtgtggggcc

SEQ ID NO: 265481 - DNA, 20 bp, Artificial Sequence
  chemically synthesized
gagtgtggggcccagcacac

SEQ ID NO: 265482 - DNA, 20 bp, Artificial Sequence
  chemically synthesized
attgttaaaaccagtgtgct

SEQ ID NO: 265483 - DNA, 20 bp, Artificial Sequence
  chemically synthesized
aattgttaaaaccagtgtgc

SEQ ID NO: 265484 - DNA, 20 bp, Artificial Sequence
  chemically synthesized
cttgggtgaattgttaaaac

SEQ ID NO: 265485 - DNA, 20 bp, Artificial Sequence
  chemically synthesized
ctggttttaacaattcaccc

SEQ ID NO: 265486 - DNA, 20 bp, Artificial Sequence
  chemically synthesized
taaatcttttgtatgcactt

SEQ ID NO: 265487 - DNA, 20 bp, Artificial Sequence
  chemically synthesized
gtaaatcttttgtatgcact

SEQ ID NO: 265488 - DNA, 20 bp, Artificial Sequence
  chemically synthesized
attcacccaagtgcatacaa

SEQ ID NO: 265489 - DNA, 20 bp, Artificial Sequence
  chemically synthesized
atacaaaagatttactgatc

SEQ ID NO: 265490 - DNA, 20 bp, Artificial Sequence
  chemically synthesized
aaggaaatttcagtctagat

SEQ ID NO: 265491 - DNA, 20 bp, Artificial Sequence
  chemically synthesized
gtggaaaggaaatttcagtc

SEQ ID NO: 265492 - DNA, 20 bp, Artificial Sequence
  chemically synthesized
tgggagtggaaaggaaattt

SEQ ID NO: 265493 - DNA, 20 bp, Artificial Sequence
  chemically synthesized
ggatagctatgggagtggaa

SEQ ID NO: 265494 - DNA, 20 bp, Artificial Sequence
  chemically synthesized
gggatagctatgggagtgga

SEQ ID NO: 265495 - DNA, 20 bp, Artificial Sequence
  chemically synthesized
aaatttcctttccactccca

SEQ ID NO: 265496 - DNA, 20 bp, Artificial Sequence
  chemically synthesized
aaaagggatagctatgggag

SEQ ID NO: 265497 - DNA, 20 bp, Artificial Sequence
  chemically synthesized
aaaaaaagggatagctatgg

SEQ ID NO: 265498 - DNA, 20 bp, Artificial Sequence
  chemically synthesized
tcaaaaaaagggatagctat

SEQ ID NO: 265499 - DNA, 20 bp, Artificial Sequence
  chemically synthesized
ctcaaaaaaagggatagcta

SEQ ID NO: 265500 - DNA, 20 bp, Artificial Sequence
  chemically synthesized
gatgacctcaaaaaaaggga

SEQ ID NO: 265501 - DNA, 20 bp, Artificial Sequence
  chemically synthesized
ccatagctatcccttttttt

SEQ ID NO: 265502 - DNA, 20 bp, Artificial Sequence
  chemically synthesized
cactgatgacctcaaaaaaa

SEQ ID NO: 265503 - DNA, 20 bp, Artificial Sequence
  chemically synthesized
catagctatccctttttttg

SEQ ID NO: 265504 - DNA, 20 bp, Artificial Sequence
  chemically synthesized
acactgatgacctcaaaaaa

SEQ ID NO: 265505 - DNA, 20 bp, Artificial Sequence
  chemically synthesized
tacactgatgacctcaaaaa

SEQ ID NO: 265506 - DNA, 20 bp, Artificial Sequence
  chemically synthesized
atccctttttttgaggtcat

SEQ ID NO: 265507 - DNA, 20 bp, Artificial Sequence
  chemically synthesized
ggtcatcagtgtatctcatc

SEQ ID NO: 265508 - DNA, 20 bp, Artificial Sequence
  chemically synthesized
gctattgcagtagtctagat

SEQ ID NO: 265509 - DNA, 20 bp, Artificial Sequence
  chemically synthesized
cgggagctattgcagtagtc

SEQ ID NO: 265510 - DNA, 20 bp, Artificial Sequence
  chemically synthesized
tctcatctagactactgcaa

SEQ ID NO: 265511 - DNA, 20 bp, Artificial Sequence
  chemically synthesized
aagttcgggagctattgcag

SEQ ID NO: 265512 - DNA, 20 bp, Artificial Sequence
  chemically synthesized
atgaagttcgggagctattg

SEQ ID NO: 265513 - DNA, 20 bp, Artificial Sequence
  chemically synthesized
aataatgacatgaagttcgg

SEQ ID NO: 265514 - DNA, 20 bp, Artificial Sequence
  chemically synthesized
tgaataatgacatgaagttc

SEQ ID NO: 265515 - DNA, 20 bp, Artificial Sequence
  chemically synthesized
ctgaataatgacatgaagtt

SEQ ID NO: 265516 - DNA, 20 bp, Artificial Sequence
  chemically synthesized
ttccactgaataatgacatg

SEQ ID NO: 265517 - DNA, 20 bp, Artificial Sequence
  chemically synthesized
ccgaacttcatgtcattatt

SEQ ID NO: 265518 - DNA, 20 bp, Artificial Sequence
  chemically synthesized
aacttcatgtcattattcag

SEQ ID NO: 265519 - DNA, 20 bp, Artificial Sequence
  chemically synthesized
agtccagtgatagttgtgag

SEQ ID NO: 265520 - DNA, 20 bp, Artificial Sequence
  chemically synthesized
ttagtccagtgatagttgtg

SEQ ID NO: 265521 - DNA, 20 bp, Artificial Sequence
  chemically synthesized
attagtccagtgatagttgt

SEQ ID NO: 265522 - DNA, 20 bp, Artificial Sequence
  chemically synthesized
attctcctcacaactatcac

SEQ ID NO: 265523 - DNA, 20 bp, Artificial Sequence
  chemically synthesized
ttgagaaattagtccagtga

SEQ ID NO: 265524 - DNA, 20 bp, Artificial Sequence
  chemically synthesized
gcactgttgagaaattagtc

SEQ ID NO: 265525 - DNA, 20 bp, Artificial Sequence
  chemically synthesized
tgtatgcactgttgagaaat

SEQ ID NO: 265526 - DNA, 20 bp, Artificial Sequence
  chemically synthesized
tcactggactaatttctcaa

SEQ ID NO: 265527 - DNA, 20 bp, Artificial Sequence
  chemically synthesized
gtatctgtgtatgcactgtt

SEQ ID NO: 265528 - DNA, 20 bp, Artificial Sequence
  chemically synthesized
atttctcaacagtgcataca

SEQ ID NO: 265529 - DNA, 20 bp, Artificial Sequence
  chemically synthesized
cacacacacacacacacaca

SEQ ID NO: 265530 - DNA, 20 bp, Artificial Sequence
  chemically synthesized
cacacacacacacacacaca

SEQ ID NO: 265531 - DNA, 20 bp, Artificial Sequence
  chemically synthesized
acacacacacagagcacatc

SEQ ID NO: 265532 - DNA, 20 bp, Artificial Sequence
  chemically synthesized
ttaattcagtatgcaatgaa

SEQ ID NO: 265533 - DNA, 20 bp, Artificial Sequence
  chemically synthesized
gcttaattcagtatgcaatg

SEQ ID NO: 265534 - DNA, 20 bp, Artificial Sequence
  chemically synthesized
tcttcattgcatactgaatt

SEQ ID NO: 265535 - DNA, 20 bp, Artificial Sequence
  chemically synthesized
ctaatcattcatgcttaatt

SEQ ID NO: 265536 - DNA, 20 bp, Artificial Sequence
  chemically synthesized
ctgaattaagcatgaatgat

SEQ ID NO: 265537 - DNA, 20 bp, Artificial Sequence
  chemically synthesized
ttaagcatgaatgattagtc

SEQ ID NO: 265538 - DNA, 20 bp, Artificial Sequence
  chemically synthesized
gtgaagaggtcatggacagc

SEQ ID NO: 265539 - DNA, 20 bp, Artificial Sequence
  chemically synthesized
cagtgtgaagaggtcatgga

SEQ ID NO: 265540 - DNA, 20 bp, Artificial Sequence
  chemically synthesized
gacacagtgtgaagaggtca

SEQ ID NO: 265541 - DNA, 20 bp, Artificial Sequence
  chemically synthesized
tggctagacacagtgtgaag

SEQ ID NO: 265542 - DNA, 20 bp, Artificial Sequence
  chemically synthesized
atggctagacacagtgtgaa

SEQ ID NO: 265543 - DNA, 20 bp, Artificial Sequence
  chemically synthesized
ttatggctagacacagtgtg

SEQ ID NO: 265544 - DNA, 20 bp, Artificial Sequence
  chemically synthesized
tgacctcttcacactgtgtc

SEQ ID NO: 265545 - DNA, 20 bp, Artificial Sequence
  chemically synthesized
ctgaagattatggctagaca

SEQ ID NO: 265546 - DNA, 20 bp, Artificial Sequence
  chemically synthesized
ataaggctgaagattatggc

SEQ ID NO: 265547 - DNA, 20 bp, Artificial Sequence
  chemically synthesized
ctgtgtctagccataatctt

SEQ ID NO: 265548 - DNA, 20 bp, Artificial Sequence
  chemically synthesized
gatgataaggctgaagatta

SEQ ID NO: 265549 - DNA, 20 bp, Artificial Sequence
  chemically synthesized
agttgtggatgataaggctg

SEQ ID NO: 265550 - DNA, 20 bp, Artificial Sequence
  chemically synthesized
aaacttagttgtggatgata

SEQ ID NO: 265551 - DNA, 20 bp, Artificial Sequence
  chemically synthesized
aaaacttagttgtggatgat

SEQ ID NO: 265552 - DNA, 20 bp, Artificial Sequence
  chemically synthesized
cagccttatcatccacaact

SEQ ID NO: 265553 - DNA, 20 bp, Artificial Sequence
  chemically synthesized
tggaagataaaacttagttg

SEQ ID NO: 265554 - DNA, 20 bp, Artificial Sequence
  chemically synthesized
agggcatggaagataaaact

SEQ ID NO: 265555 - DNA, 20 bp, Artificial Sequence
  chemically synthesized
tttcagagtagagggcatgg

SEQ ID NO: 265556 - DNA, 20 bp, Artificial Sequence
  chemically synthesized
agttttcagagtagagggca

SEQ ID NO: 265557 - DNA, 20 bp, Artificial Sequence
  chemically synthesized
cctttagttttcagagtaga

SEQ ID NO: 265558 - DNA, 20 bp, Artificial Sequence
  chemically synthesized
tcctttagttttcagagtag

SEQ ID NO: 265559 - DNA, 20 bp, Artificial Sequence
  chemically synthesized
ttcctttagttttcagagta

SEQ ID NO: 265560 - DNA, 20 bp, Artificial Sequence
  chemically synthesized
agttcctttagttttcagag

SEQ ID NO: 265561 - DNA, 20 bp, Artificial Sequence
  chemically synthesized
gtgagttcctttagttttca

SEQ ID NO: 265562 - DNA, 20 bp, Artificial Sequence
  chemically synthesized
gccctctactctgaaaacta

SEQ ID NO: 265563 - DNA, 20 bp, Artificial Sequence
  chemically synthesized
gagtgagttcctttagtttt

SEQ ID NO: 265564 - DNA, 20 bp, Artificial Sequence
  chemically synthesized
ccctctactctgaaaactaa

SEQ ID NO: 265565 - DNA, 20 bp, Artificial Sequence
  chemically synthesized
caatgaagagtgagttcctt

SEQ ID NO: 265566 - DNA, 20 bp, Artificial Sequence
  chemically synthesized
cagtgtgttcaatgaagagt

SEQ ID NO: 265567 - DNA, 20 bp, Artificial Sequence
  chemically synthesized
catacagtgtgttcaatgaa

SEQ ID NO: 265568 - DNA, 20 bp, Artificial Sequence
  chemically synthesized
agcatacagtgtgttcaatg

SEQ ID NO: 265569 - DNA, 20 bp, Artificial Sequence
  chemically synthesized
tgagaaagcttaggagcata

SEQ ID NO: 265570 - DNA, 20 bp, Artificial Sequence
  chemically synthesized
tgaacacactgtatgctcct

SEQ ID NO: 265571 - DNA, 20 bp, Artificial Sequence
  chemically synthesized
aaacatatgagaaagcttag

SEQ ID NO: 265572 - DNA, 20 bp, Artificial Sequence
  chemically synthesized
ataaacatatgagaaagctt

SEQ ID NO: 265573 - DNA, 20 bp, Artificial Sequence
  chemically synthesized
cataaacatatgagaaagct

SEQ ID NO: 265574 - DNA, 20 bp, Artificial Sequence
  chemically synthesized
ttcggcataaacatatgaga

SEQ ID NO: 265575 - DNA, 20 bp, Artificial Sequence
  chemically synthesized
acaattcggcataaacatat

SEQ ID NO: 265576 - DNA, 20 bp, Artificial Sequence
  chemically synthesized
acacagaggaggtaacaatt

SEQ ID NO: 265577 - DNA, 20 bp, Artificial Sequence
  chemically synthesized
tcactccagcaacacagagg

SEQ ID NO: 265578 - DNA, 20 bp, Artificial Sequence
  chemically synthesized
gtcactccagcaacacagag

SEQ ID NO: 265579 - DNA, 20 bp, Artificial Sequence
  chemically synthesized
cagtcactccagcaacacag

SEQ ID NO: 265580 - DNA, 20 bp, Artificial Sequence
  chemically synthesized
gcagtcactccagcaacaca

SEQ ID NO: 265581 - DNA, 20 bp, Artificial Sequence
  chemically synthesized
tgttacctcctctgtgttgc

SEQ ID NO: 265582 - DNA, 20 bp, Artificial Sequence
  chemically synthesized
tagcagtcactccagcaaca

SEQ ID NO: 265583 - DNA, 20 bp, Artificial Sequence
  chemically synthesized
ttacctcctctgtgttgctg

SEQ ID NO: 265584 - DNA, 20 bp, Artificial Sequence
  chemically synthesized
agtgagtttagcagtcactc

SEQ ID NO: 265585 - DNA, 20 bp, Artificial Sequence
  chemically synthesized
tgcatggtaagtgagtttag

SEQ ID NO: 265586 - DNA, 20 bp, Artificial Sequence
  chemically synthesized
gagtgcatggtaagtgagtt

SEQ ID NO: 265587 - DNA, 20 bp, Artificial Sequence
  chemically synthesized
agagtgagtgcatggtaagt

SEQ ID NO: 265588 - DNA, 20 bp, Artificial Sequence
  chemically synthesized
attgagagtgagtgcatggt

SEQ ID NO: 265589 - DNA, 20 bp, Artificial Sequence
  chemically synthesized
ctagattgagagtgagtgca

SEQ ID NO: 265590 - DNA, 20 bp, Artificial Sequence
  chemically synthesized
atggatactagattgagagt

SEQ ID NO: 265591 - DNA, 20 bp, Artificial Sequence
  chemically synthesized
ccatgcactcactctcaatc

SEQ ID NO: 265592 - DNA, 20 bp, Artificial Sequence
  chemically synthesized
gttcatggatactagattga

SEQ ID NO: 265593 - DNA, 20 bp, Artificial Sequence
  chemically synthesized
gtgttcatggatactagatt

SEQ ID NO: 265594 - DNA, 20 bp, Artificial Sequence
  chemically synthesized
caagatgtgttcatggatac

SEQ ID NO: 265595 - DNA, 20 bp, Artificial Sequence
  chemically synthesized
gatagggcaagatgtgttca

SEQ ID NO: 265596 - DNA, 20 bp, Artificial Sequence
  chemically synthesized
ttactgtttgatgatagggc

SEQ ID NO: 265597 - DNA, 20 bp, Artificial Sequence
  chemically synthesized
gagcttactgtttgatgata

SEQ ID NO: 265598 - DNA, 20 bp, Artificial Sequence
  chemically synthesized
ggagcttactgtttgatgat

SEQ ID NO: 265599 - DNA, 20 bp, Artificial Sequence
  chemically synthesized
aggagcttactgtttgatga

SEQ ID NO: 265600 - DNA, 20 bp, Artificial Sequence
  chemically synthesized
catcttgccctatcatcaaa

SEQ ID NO: 265601 - DNA, 20 bp, Artificial Sequence
  chemically synthesized
ttgccctatcatcaaacagt

SEQ ID NO: 265602 - DNA, 20 bp, Artificial Sequence
  chemically synthesized
taaaatacgatggattcaag

SEQ ID NO: 265603 - DNA, 20 bp, Artificial Sequence
  chemically synthesized
ggtaaaatacgatggattca

SEQ ID NO: 265604 - DNA, 20 bp, Artificial Sequence
  chemically synthesized
aggtaaaatacgatggattc

SEQ ID NO: 265605 - DNA, 20 bp, Artificial Sequence
  chemically synthesized
tattgctaggtaaaatacga

SEQ ID NO: 265606 - DNA, 20 bp, Artificial Sequence
  chemically synthesized
tgaatccatcgtattttacc

SEQ ID NO: 265607 - DNA, 20 bp, Artificial Sequence
  chemically synthesized
catcgtattttacctagcaa

SEQ ID NO: 265608 - DNA, 20 bp, Artificial Sequence
  chemically synthesized
agtgagggggatctattgct

SEQ ID NO: 265609 - DNA, 20 bp, Artificial Sequence
  chemically synthesized
tagtgagggggatctattgc

SEQ ID NO: 265610 - DNA, 20 bp, Artificial Sequence
  chemically synthesized
aacagtgtttggtagtgagg

SEQ ID NO: 265611 - DNA, 20 bp, Artificial Sequence
  chemically synthesized
taacagtgtttggtagtgag

SEQ ID NO: 265612 - DNA, 20 bp, Artificial Sequence
  chemically synthesized
ataacagtgtttggtagtga

SEQ ID NO: 265613 - DNA, 20 bp, Artificial Sequence
  chemically synthesized
gataacagtgtttggtagtg

SEQ ID NO: 265614 - DNA, 20 bp, Artificial Sequence
  chemically synthesized
cgataacagtgtttggtagt

SEQ ID NO: 265615 - DNA, 20 bp, Artificial Sequence
  chemically synthesized
tttccgataacagtgtttgg

SEQ ID NO: 265616 - DNA, 20 bp, Artificial Sequence
  chemically synthesized
tattttccgataacagtgtt

SEQ ID NO: 265617 - DNA, 20 bp, Artificial Sequence
  chemically synthesized
tcactaccaaacactgttat

SEQ ID NO: 265618 - DNA, 20 bp, Artificial Sequence
  chemically synthesized
catatattattttccgataa

SEQ ID NO: 265619 - DNA, 20 bp, Artificial Sequence
  chemically synthesized
tgttatcggaaaataatata

SEQ ID NO: 265620 - DNA, 20 bp, Artificial Sequence
  chemically synthesized
atcggaaaataatatatggt

SEQ ID NO: 265621 - DNA, 20 bp, Artificial Sequence
  chemically synthesized
gaaaataatatatggttggt

SEQ ID NO: 265622 - DNA, 20 bp, Artificial Sequence
  chemically synthesized
cttgagaaaagggattaatc

SEQ ID NO: 265623 - DNA, 20 bp, Artificial Sequence
  chemically synthesized
acttgagaaaagggattaat

SEQ ID NO: 265624 - DNA, 20 bp, Artificial Sequence
  chemically synthesized
cctgattaatcccttttctc

SEQ ID NO: 265625 - DNA, 20 bp, Artificial Sequence
  chemically synthesized
tgagtgaagacttgagaaaa

SEQ ID NO: 265626 - DNA, 20 bp, Artificial Sequence
  chemically synthesized
atgagtgaagacttgagaaa

SEQ ID NO: 265627 - DNA, 20 bp, Artificial Sequence
  chemically synthesized
aatgagtgaagacttgagaa

SEQ ID NO: 265628 - DNA, 20 bp, Artificial Sequence
  chemically synthesized
gcactaatgagtgaagactt

SEQ ID NO: 265629 - DNA, 20 bp, Artificial Sequence
  chemically synthesized
tttctcaagtcttcactcat

SEQ ID NO: 265630 - DNA, 20 bp, Artificial Sequence
  chemically synthesized
tctaaaagcactaatgagtg

SEQ ID NO: 265631 - DNA, 20 bp, Artificial Sequence
  chemically synthesized
gtatatctaaaagcactaat

SEQ ID NO: 265632 - DNA, 20 bp, Artificial Sequence
  chemically synthesized
tcttcactcattagtgcttt

SEQ ID NO: 265633 - DNA, 20 bp, Artificial Sequence
  chemically synthesized
gctagttgaggtatatctaa

SEQ ID NO: 265634 - DNA, 20 bp, Artificial Sequence
  chemically synthesized
gcttttagatatacctcaac

SEQ ID NO: 265635 - DNA, 20 bp, Artificial Sequence
  chemically synthesized
tttgggagagatgctagttg

SEQ ID NO: 265636 - DNA, 20 bp, Artificial Sequence
  chemically synthesized
atttgggagagatgctagtt

SEQ ID NO: 265637 - DNA, 20 bp, Artificial Sequence
  chemically synthesized
cagcaatttgggagagatgc

SEQ ID NO: 265638 - DNA, 20 bp, Artificial Sequence
  chemically synthesized
ggggagtcagcaatttggga

SEQ ID NO: 265639 - DNA, 20 bp, Artificial Sequence
  chemically synthesized
aaggggagtcagcaatttgg

SEQ ID NO: 265640 - DNA, 20 bp, Artificial Sequence
  chemically synthesized
agaaggggagtcagcaattt

SEQ ID NO: 265641 - DNA, 20 bp, Artificial Sequence
  chemically synthesized
gagaaggggagtcagcaatt

SEQ ID NO: 265642 - DNA, 20 bp, Artificial Sequence
  chemically synthesized
ccaagttggagaaggggagt

SEQ ID NO: 265643 - DNA, 20 bp, Artificial Sequence
  chemically synthesized
gaagccaagttggagaaggg

SEQ ID NO: 265644 - DNA, 20 bp, Artificial Sequence
  chemically synthesized
tagaagccaagttggagaag

SEQ ID NO: 265645 - DNA, 20 bp, Artificial Sequence
  chemically synthesized
ctagaagccaagttggagaa

SEQ ID NO: 265646 - DNA, 20 bp, Artificial Sequence
  chemically synthesized
tctagaagccaagttggaga

SEQ ID NO: 265647 - DNA, 20 bp, Artificial Sequence
  chemically synthesized
ctctagaagccaagttggag

SEQ ID NO: 265648 - DNA, 20 bp, Artificial Sequence
  chemically synthesized
ctgactccccttctccaact

SEQ ID NO: 265649 - DNA, 20 bp, Artificial Sequence
  chemically synthesized
tccctctagaagccaagttg

SEQ ID NO: 265650 - DNA, 20 bp, Artificial Sequence
  chemically synthesized
catccctctagaagccaagt

SEQ ID NO: 265651 - DNA, 20 bp, Artificial Sequence
  chemically synthesized
cccttctccaacttggcttc

SEQ ID NO: 265652 - DNA, 20 bp, Artificial Sequence
  chemically synthesized
tctccatccctctagaagcc

SEQ ID NO: 265653 - DNA, 20 bp, Artificial Sequence
  chemically synthesized
cttctccaacttggcttcta

SEQ ID NO: 265654 - DNA, 20 bp, Artificial Sequence
  chemically synthesized
ttctccaacttggcttctag

SEQ ID NO: 265655 - DNA, 20 bp, Artificial Sequence
  chemically synthesized
tctccaacttggcttctaga

SEQ ID NO: 265656 - DNA, 20 bp, Artificial Sequence
  chemically synthesized
acccctctccatccctctag

SEQ ID NO: 265657 - DNA, 20 bp, Artificial Sequence
  chemically synthesized
caacttggcttctagaggga

SEQ ID NO: 265658 - DNA, 20 bp, Artificial Sequence
  chemically synthesized
tctacccctctccatccctc

SEQ ID NO: 265659 - DNA, 20 bp, Artificial Sequence
  chemically synthesized
acttggcttctagagggatg

SEQ ID NO: 265660 - DNA, 20 bp, Artificial Sequence
  chemically synthesized
ttggcttctagagggatgga

SEQ ID NO: 265661 - DNA, 20 bp, Artificial Sequence
  chemically synthesized
tggcttctagagggatggag

SEQ ID NO: 265662 - DNA, 20 bp, Artificial Sequence
  chemically synthesized
ggcttctagagggatggaga

SEQ ID NO: 265663 - DNA, 20 bp, Artificial Sequence
  chemically synthesized
gcttctagagggatggagag

SEQ ID NO: 265664 - DNA, 20 bp, Artificial Sequence
  chemically synthesized
tctagagggatggagagggg

SEQ ID NO: 265665 - DNA, 20 bp, Artificial Sequence
  chemically synthesized
tttattcatattaattatga

SEQ ID NO: 265666 - DNA, 20 bp, Artificial Sequence
  chemically synthesized
aattaatatgaataaataat

SEQ ID NO: 265667 - DNA, 20 bp, Artificial Sequence
  chemically synthesized
agtataggaaggggcatggg

SEQ ID NO: 265668 - DNA, 20 bp, Artificial Sequence
  chemically synthesized
aaaagtataggaaggggcat

SEQ ID NO: 265669 - DNA, 20 bp, Artificial Sequence
  chemically synthesized
caaaagtataggaaggggca

SEQ ID NO: 265670 - DNA, 20 bp, Artificial Sequence
  chemically synthesized
ggagacaaaagtataggaag

SEQ ID NO: 265671 - DNA, 20 bp, Artificial Sequence
  chemically synthesized
aggagacaaaagtataggaa

SEQ ID NO: 265672 - DNA, 20 bp, Artificial Sequence
  chemically synthesized
taggagacaaaagtatagga

SEQ ID NO: 265673 - DNA, 20 bp, Artificial Sequence
  chemically synthesized
ataggagacaaaagtatagg

SEQ ID NO: 265674 - DNA, 20 bp, Artificial Sequence
  chemically synthesized
gtgataggagacaaaagtat

SEQ ID NO: 265675 - DNA, 20 bp, Artificial Sequence
  chemically synthesized
ggtgataggagacaaaagta

SEQ ID NO: 265676 - DNA, 20 bp, Artificial Sequence
  chemically synthesized
aataaggtgataggagacaa

SEQ ID NO: 265677 - DNA, 20 bp, Artificial Sequence
  chemically synthesized
tcgggaaaataaggtgatag

SEQ ID NO: 265678 - DNA, 20 bp, Artificial Sequence
  chemically synthesized
catcgggaaaataaggtgat

SEQ ID NO: 265679 - DNA, 20 bp, Artificial Sequence
  chemically synthesized
ccatcgggaaaataaggtga

SEQ ID NO: 265680 - DNA, 20 bp, Artificial Sequence
  chemically synthesized
tggataccatcgggaaaata

SEQ ID NO: 265681 - DNA, 20 bp, Artificial Sequence
  chemically synthesized
gtggataccatcgggaaaat

SEQ ID NO: 265682 - DNA, 20 bp, Artificial Sequence
  chemically synthesized
ctatcaccttattttcccga

SEQ ID NO: 265683 - DNA, 20 bp, Artificial Sequence
  chemically synthesized
gagggcaagtggataccatc

SEQ ID NO: 265684 - DNA, 20 bp, Artificial Sequence
  chemically synthesized
tgagggcaagtggataccat

SEQ ID NO: 265685 - DNA, 20 bp, Artificial Sequence
  chemically synthesized
gtggcatggctgagggcaag

SEQ ID NO: 265686 - DNA, 20 bp, Artificial Sequence
  chemically synthesized
cgatggtatccacttgccct

SEQ ID NO: 265687 - DNA, 20 bp, Artificial Sequence
  chemically synthesized
atagtggcatggctgagggc

SEQ ID NO: 265688 - DNA, 20 bp, Artificial Sequence
  chemically synthesized
gagtatagtggcatggctga

SEQ ID NO: 265689 - DNA, 20 bp, Artificial Sequence
  chemically synthesized
ggagtatagtggcatggctg

SEQ ID NO: 265690 - DNA, 20 bp, Artificial Sequence
  chemically synthesized
cggagtatagtggcatggct

SEQ ID NO: 265691 - DNA, 20 bp, Artificial Sequence
  chemically synthesized
ggcatcggagtatagtggca

SEQ ID NO: 265692 - DNA, 20 bp, Artificial Sequence
  chemically synthesized
tttagggcatcggagtatag

SEQ ID NO: 265693 - DNA, 20 bp, Artificial Sequence
  chemically synthesized
tgttttagggcatcggagta

SEQ ID NO: 265694 - DNA, 20 bp, Artificial Sequence
  chemically synthesized
gtctctgttttagggcatcg

SEQ ID NO: 265695 - DNA, 20 bp, Artificial Sequence
  chemically synthesized
ctgtctctgttttagggcat

SEQ ID NO: 265696 - DNA, 20 bp, Artificial Sequence
  chemically synthesized
tatactccgatgccctaaaa

SEQ ID NO: 265697 - DNA, 20 bp, Artificial Sequence
  chemically synthesized
tactccgatgccctaaaaca

SEQ ID NO: 265698 - DNA, 20 bp, Artificial Sequence
  chemically synthesized
tctcaactgtctctgtttta

SEQ ID NO: 265699 - DNA, 20 bp, Artificial Sequence
  chemically synthesized
gtctcaactgtctctgtttt

SEQ ID NO: 265700 - DNA, 20 bp, Artificial Sequence
  chemically synthesized
tgtctcaactgtctctgttt

SEQ ID NO: 265701 - DNA, 20 bp, Artificial Sequence
  chemically synthesized
ccgatgccctaaaacagaga

SEQ ID NO: 265702 - DNA, 20 bp, Artificial Sequence
  chemically synthesized
gccctaaaacagagacagtt

SEQ ID NO: 265703 - DNA, 20 bp, Artificial Sequence
  chemically synthesized
aaaacagagacagttgagac

SEQ ID NO: 265704 - DNA, 20 bp, Artificial Sequence
  chemically synthesized
aaacagagacagttgagaca

SEQ ID NO: 265705 - DNA, 20 bp, Artificial Sequence
  chemically synthesized
acagagacagttgagacaag

SEQ ID NO: 265706 - DNA, 20 bp, Artificial Sequence
  chemically synthesized
attgacagaatcaatgagga

SEQ ID NO: 265707 - DNA, 20 bp, Artificial Sequence
  chemically synthesized
aaattgacagaatcaatgag

SEQ ID NO: 265708 - DNA, 20 bp, Artificial Sequence
  chemically synthesized
gtaaattgacagaatcaatg

SEQ ID NO: 265709 - DNA, 20 bp, Artificial Sequence
  chemically synthesized
agtaaattgacagaatcaat

SEQ ID NO: 265710 - DNA, 20 bp, Artificial Sequence
  chemically synthesized
tagaaccctgagtaaattga

SEQ ID NO: 265711 - DNA, 20 bp, Artificial Sequence
  chemically synthesized
attgattctgtcaatttact

SEQ ID NO: 265712 - DNA, 20 bp, Artificial Sequence
  chemically synthesized
ttgattctgtcaatttactc

SEQ ID NO: 265713 - DNA, 20 bp, Artificial Sequence
  chemically synthesized
tgattctgtcaatttactca

SEQ ID NO: 265714 - DNA, 20 bp, Artificial Sequence
  chemically synthesized
agagataatattagaaccct

SEQ ID NO: 265715 - DNA, 20 bp, Artificial Sequence
  chemically synthesized
cagtcaatcagagataatat

SEQ ID NO: 265716 - DNA, 20 bp, Artificial Sequence
  chemically synthesized
agaattgcaacagtcaatca

SEQ ID NO: 265717 - DNA, 20 bp, Artificial Sequence
  chemically synthesized
tcagaattgcaacagtcaat

SEQ ID NO: 265718 - DNA, 20 bp, Artificial Sequence
  chemically synthesized
ggagaggatcagaattgcaa

SEQ ID NO: 265719 - DNA, 20 bp, Artificial Sequence
  chemically synthesized
gcagttttaatggagaggat

SEQ ID NO: 265720 - DNA, 20 bp, Artificial Sequence
  chemically synthesized
aaatggcagttttaatggag

SEQ ID NO: 265721 - DNA, 20 bp, Artificial Sequence
  chemically synthesized
gaaatggcagttttaatgga

SEQ ID NO: 265722 - DNA, 20 bp, Artificial Sequence
  chemically synthesized
aggaaatggcagttttaatg

SEQ ID NO: 265723 - DNA, 20 bp, Artificial Sequence
  chemically synthesized
tgaggaaatggcagttttaa

SEQ ID NO: 265724 - DNA, 20 bp, Artificial Sequence
  chemically synthesized
aaatcaatgtgaggaaatgg

SEQ ID NO: 265725 - DNA, 20 bp, Artificial Sequence
  chemically synthesized
gtgaaatcaatgtgaggaaa

SEQ ID NO: 265726 - DNA, 20 bp, Artificial Sequence
  chemically synthesized
atctatgtgaaatcaatgtg

SEQ ID NO: 265727 - DNA, 20 bp, Artificial Sequence
  chemically synthesized
aatctatgtgaaatcaatgt

SEQ ID NO: 265728 - DNA, 20 bp, Artificial Sequence
  chemically synthesized
ttcctcacattgatttcaca

SEQ ID NO: 265729 - DNA, 20 bp, Artificial Sequence
  chemically synthesized
gaaaaaacacgcttttttca

SEQ ID NO: 265730 - DNA, 20 bp, Artificial Sequence
  chemically synthesized
gtatccaatgactttgaaaa

SEQ ID NO: 265731 - DNA, 20 bp, Artificial Sequence
  chemically synthesized
cacgcttttttcaaagtcat

SEQ ID NO: 265732 - DNA, 20 bp, Artificial Sequence
  chemically synthesized
tcaaagtcattggatactct

SEQ ID NO: 265733 - DNA, 20 bp, Artificial Sequence
  chemically synthesized
caaagtcattggatactctt

SEQ ID NO: 265734 - DNA, 20 bp, Artificial Sequence
  chemically synthesized
attttattaaggttacctaa

SEQ ID NO: 265735 - DNA, 20 bp, Artificial Sequence
  chemically synthesized
ccattttattaaggttacct

SEQ ID NO: 265736 - DNA, 20 bp, Artificial Sequence
  chemically synthesized
tgccttttcccattttatta

SEQ ID NO: 265737 - DNA, 20 bp, Artificial Sequence
  chemically synthesized
cttaggtaaccttaataaaa

SEQ ID NO: 265738 - DNA, 20 bp, Artificial Sequence
  chemically synthesized
ctgccttttcccattttatt

SEQ ID NO: 265739 - DNA, 20 bp, Artificial Sequence
  chemically synthesized
ttaggtaaccttaataaaat

SEQ ID NO: 265740 - DNA, 20 bp, Artificial Sequence
  chemically synthesized
taaccttaataaaatgggaa

SEQ ID NO: 265741 - DNA, 20 bp, Artificial Sequence
  chemically synthesized
aaccttaataaaatgggaaa

SEQ ID NO: 265742 - DNA, 20 bp, Artificial Sequence
  chemically synthesized
cttaataaaatgggaaaagg

SEQ ID NO: 265743 - DNA, 20 bp, Artificial Sequence
  chemically synthesized
gcagcatttttatgtatttt

SEQ ID NO: 265744 - DNA, 20 bp, Artificial Sequence
  chemically synthesized
cagcatttttatgtatttta

SEQ ID NO: 265745 - DNA, 20 bp, Artificial Sequence
  chemically synthesized
agcatttttatgtattttaa

SEQ ID NO: 265746 - DNA, 20 bp, Artificial Sequence
  chemically synthesized
gcatttttatgtattttaag

SEQ ID NO: 265747 - DNA, 20 bp, Artificial Sequence
  chemically synthesized
tgtattttaaggggcgtatg

SEQ ID NO: 265748 - DNA, 20 bp, Artificial Sequence
  chemically synthesized
gtattttaaggggcgtatgt

SEQ ID NO: 265749 - DNA, 20 bp, Artificial Sequence
  chemically synthesized
gtgggacaaacataactcct

SEQ ID NO: 265750 - DNA, 20 bp, Artificial Sequence
  chemically synthesized
ggacaaacataactccttag

SEQ ID NO: 265751 - DNA, 20 bp, Artificial Sequence
  chemically synthesized
tgaatttaagaactactaag

SEQ ID NO: 265752 - DNA, 20 bp, Artificial Sequence
  chemically synthesized
gatgaatttaagaactacta

SEQ ID NO: 265753 - DNA, 20 bp, Artificial Sequence
  chemically synthesized
ggatgaatttaagaactact

SEQ ID NO: 265754 - DNA, 20 bp, Artificial Sequence
  chemically synthesized
ataatgaagtggatgaattt

SEQ ID NO: 265755 - DNA, 20 bp, Artificial Sequence
  chemically synthesized
cagccttaaagataatgaag

SEQ ID NO: 265756 - DNA, 20 bp, Artificial Sequence
  chemically synthesized
gaccagccttaaagataatg

SEQ ID NO: 265757 - DNA, 20 bp, Artificial Sequence
  chemically synthesized
tcatccacttcattatcttt

SEQ ID NO: 265758 - DNA, 20 bp, Artificial Sequence
  chemically synthesized
catccacttcattatcttta

SEQ ID NO: 265759 - DNA, 20 bp, Artificial Sequence
  chemically synthesized
cacttcattatctttaaggc

SEQ ID NO: 265760 - DNA, 20 bp, Artificial Sequence
  chemically synthesized
catgacaaagaccagcctta

SEQ ID NO: 265761 - DNA, 20 bp, Artificial Sequence
  chemically synthesized
gctattttcatgacaaagac

SEQ ID NO: 265762 - DNA, 20 bp, Artificial Sequence
  chemically synthesized
tctttgctattttcatgaca

SEQ ID NO: 265763 - DNA, 20 bp, Artificial Sequence
  chemically synthesized
gctggtctttgtcatgaaaa

SEQ ID NO: 265764 - DNA, 20 bp, Artificial Sequence
  chemically synthesized
tctttgtcatgaaaatagca

SEQ ID NO: 265765 - DNA, 20 bp, Artificial Sequence
  chemically synthesized
aagacacgattttctgactc

SEQ ID NO: 265766 - DNA, 20 bp, Artificial Sequence
  chemically synthesized
ctgctgtaatcgactggagt

SEQ ID NO: 265767 - DNA, 20 bp, Artificial Sequence
  chemically synthesized
gtctctgctgtaatcgactg

SEQ ID NO: 265768 - DNA, 20 bp, Artificial Sequence
  chemically synthesized
tggtctctgctgtaatcgac

SEQ ID NO: 265769 - DNA, 20 bp, Artificial Sequence
  chemically synthesized
tttctgactccagtcgatta

SEQ ID NO: 265770 - DNA, 20 bp, Artificial Sequence
  chemically synthesized
ctgactccagtcgattacag

SEQ ID NO: 265771 - DNA, 20 bp, Artificial Sequence
  chemically synthesized
gactccagtcgattacagca

SEQ ID NO: 265772 - DNA, 20 bp, Artificial Sequence
  chemically synthesized
gtcgattacagcagagacca

SEQ ID NO: 265773 - DNA, 20 bp, Artificial Sequence
  chemically synthesized
aaagaattgctgattttctg

SEQ ID NO: 265774 - DNA, 20 bp, Artificial Sequence
  chemically synthesized
cagcagagaccacagaaaat

SEQ ID NO: 265775 - DNA, 20 bp, Artificial Sequence
  chemically synthesized
aaactgatggaaaaaaatga

SEQ ID NO: 265776 - DNA, 20 bp, Artificial Sequence
  chemically synthesized
attctttcatttttttccat

SEQ ID NO: 265777 - DNA, 20 bp, Artificial Sequence
  chemically synthesized
ggggttgagacaaaaactga

SEQ ID NO: 265778 - DNA, 20 bp, Artificial Sequence
  chemically synthesized
cagtttttgtctcaaccccc

SEQ ID NO: 265779 - DNA, 20 bp, Artificial Sequence
  chemically synthesized
atggccgaatctggggggtt

SEQ ID NO: 265780 - DNA, 20 bp, Artificial Sequence
  chemically synthesized
cttgaatggccgaatctggg

SEQ ID NO: 265781 - DNA, 20 bp, Artificial Sequence
  chemically synthesized
ttgtctcaaccccccagatt

SEQ ID NO: 265782 - DNA, 20 bp, Artificial Sequence
  chemically synthesized
acttgaatggccgaatctgg

SEQ ID NO: 265783 - DNA, 20 bp, Artificial Sequence
  chemically synthesized
cacttgaatggccgaatctg

SEQ ID NO: 265784 - DNA, 20 bp, Artificial Sequence
  chemically synthesized
acacttgaatggccgaatct

SEQ ID NO: 265785 - DNA, 20 bp, Artificial Sequence
  chemically synthesized
tacacttgaatggccgaatc

SEQ ID NO: 265786 - DNA, 20 bp, Artificial Sequence
  chemically synthesized
ccccccagattcggccattc

SEQ ID NO: 265787 - DNA, 20 bp, Artificial Sequence
  chemically synthesized
ttacgtatattacacttgaa

SEQ ID NO: 265788 - DNA, 20 bp, Artificial Sequence
  chemically synthesized
aagtgtaatatacgtaacga

SEQ ID NO: 265789 - DNA, 20 bp, Artificial Sequence
  chemically synthesized
taaaaataattaatatcaat

SEQ ID NO: 265790 - DNA, 20 bp, Artificial Sequence
  chemically synthesized
ttaaaaataattaatatcaa

SEQ ID NO: 265791 - DNA, 20 bp, Artificial Sequence
  chemically synthesized
atcagtgtatagatatgaaa

SEQ ID NO: 265792 - DNA, 20 bp, Artificial Sequence
  chemically synthesized
aaaatgtattaatcagtgta

SEQ ID NO: 265793 - DNA, 20 bp, Artificial Sequence
  chemically synthesized
tgcatttaaaatgtattaat

SEQ ID NO: 265794 - DNA, 20 bp, Artificial Sequence
  chemically synthesized
ttaatctaaagattgtaatg

SEQ ID NO: 265795 - DNA, 20 bp, Artificial Sequence
  chemically synthesized
tttaatctaaagattgtaat

SEQ ID NO: 265796 - DNA, 20 bp, Artificial Sequence
  chemically synthesized
ttgatcctcattacaatctt

SEQ ID NO: 265797 - DNA, 20 bp, Artificial Sequence
  chemically synthesized
gcctgttttattttaatcta

SEQ ID NO: 265798 - DNA, 20 bp, Artificial Sequence
  chemically synthesized
atctttagattaaaataaaa

SEQ ID NO: 265799 - DNA, 20 bp, Artificial Sequence
  chemically synthesized
tctttagattaaaataaaac

SEQ ID NO: 265800 - DNA, 20 bp, Artificial Sequence
  chemically synthesized
tttctagctacaaaataagg

SEQ ID NO: 265801 - DNA, 20 bp, Artificial Sequence
  chemically synthesized
catttctagctacaaaataa

SEQ ID NO: 265802 - DNA, 20 bp, Artificial Sequence
  chemically synthesized
gcatcatctcccttattttg

SEQ ID NO: 265803 - DNA, 20 bp, Artificial Sequence
  chemically synthesized
tcatttctagctacaaaata

SEQ ID NO: 265804 - DNA, 20 bp, Artificial Sequence
  chemically synthesized
ctcatttctagctacaaaat

SEQ ID NO: 265805 - DNA, 20 bp, Artificial Sequence
  chemically synthesized
catctcccttattttgtagc

SEQ ID NO: 265806 - DNA, 20 bp, Artificial Sequence
  chemically synthesized
cttattttgtagctagaaat

SEQ ID NO: 265807 - DNA, 20 bp, Artificial Sequence
  chemically synthesized
ttattttgtagctagaaatg

SEQ ID NO: 265808 - DNA, 20 bp, Artificial Sequence
  chemically synthesized
acctctcagagcctcatttc

SEQ ID NO: 265809 - DNA, 20 bp, Artificial Sequence
  chemically synthesized
gtagctagaaatgaggctct

SEQ ID NO: 265810 - DNA, 20 bp, Artificial Sequence
  chemically synthesized
agctagaaatgaggctctga

SEQ ID NO: 265811 - DNA, 20 bp, Artificial Sequence
  chemically synthesized
gctagaaatgaggctctgag

SEQ ID NO: 265812 - DNA, 20 bp, Artificial Sequence
  chemically synthesized
atatgcctctttacctctca

SEQ ID NO: 265813 - DNA, 20 bp, Artificial Sequence
  chemically synthesized
aaatgaggctctgagaggta

SEQ ID NO: 265814 - DNA, 20 bp, Artificial Sequence
  chemically synthesized
ggatatgcctctttacctct

SEQ ID NO: 265815 - DNA, 20 bp, Artificial Sequence
  chemically synthesized
atgaggctctgagaggtaaa

SEQ ID NO: 265816 - DNA, 20 bp, Artificial Sequence
  chemically synthesized
tgaggctctgagaggtaaag

SEQ ID NO: 265817 - DNA, 20 bp, Artificial Sequence
  chemically synthesized
acattactacttagtgattt

SEQ ID NO: 265818 - DNA, 20 bp, Artificial Sequence
  chemically synthesized
gaggcatatccaaaatcact

SEQ ID NO: 265819 - DNA, 20 bp, Artificial Sequence
  chemically synthesized
gcatatccaaaatcactaag

SEQ ID NO: 265820 - DNA, 20 bp, Artificial Sequence
  chemically synthesized
tagctgagcacattactact

SEQ ID NO: 265821 - DNA, 20 bp, Artificial Sequence
  chemically synthesized
tcactaagtagtaatgtgct

SEQ ID NO: 265822 - DNA, 20 bp, Artificial Sequence
  chemically synthesized
taagtagtaatgtgctcagc

SEQ ID NO: 265823 - DNA, 20 bp, Artificial Sequence
  chemically synthesized
acctgctttgagcactagct

SEQ ID NO: 265824 - DNA, 20 bp, Artificial Sequence
  chemically synthesized
atgtgctcagctagtgctca

SEQ ID NO: 265825 - DNA, 20 bp, Artificial Sequence
  chemically synthesized
acaagacctgctttgagcac

SEQ ID NO: 265826 - DNA, 20 bp, Artificial Sequence
  chemically synthesized
tgctcagctagtgctcaaag

SEQ ID NO: 265827 - DNA, 20 bp, Artificial Sequence
  chemically synthesized
gctcagctagtgctcaaagc

SEQ ID NO: 265828 - DNA, 20 bp, Artificial Sequence
  chemically synthesized
caagacacaagacctgcttt

SEQ ID NO: 265829 - DNA, 20 bp, Artificial Sequence
  chemically synthesized
agtccttaacttcaagacac

SEQ ID NO: 265830 - DNA, 20 bp, Artificial Sequence
  chemically synthesized
aaagcaggtcttgtgtcttg

SEQ ID NO: 265831 - DNA, 20 bp, Artificial Sequence
  chemically synthesized
aggtcttgtgtcttgaagtt

SEQ ID NO: 265832 - DNA, 20 bp, Artificial Sequence
  chemically synthesized
ggtcttgtgtcttgaagtta

SEQ ID NO: 265833 - DNA, 20 bp, Artificial Sequence
  chemically synthesized
agcaaaaagtccttaacttc

SEQ ID NO: 265834 - DNA, 20 bp, Artificial Sequence
  chemically synthesized
agcagtatggtgagagcaaa

SEQ ID NO: 265835 - DNA, 20 bp, Artificial Sequence
  chemically synthesized
agcaaggagcagtatggtga

SEQ ID NO: 265836 - DNA, 20 bp, Artificial Sequence
  chemically synthesized
tcagcaaggagcagtatggt

SEQ ID NO: 265837 - DNA, 20 bp, Artificial Sequence
  chemically synthesized
ggcctcagcaaggagcagta

SEQ ID NO: 265838 - DNA, 20 bp, Artificial Sequence
  chemically synthesized
attttggcctcagcaaggag

SEQ ID NO: 265839 - DNA, 20 bp, Artificial Sequence
  chemically synthesized
tcaccatactgctccttgct

SEQ ID NO: 265840 - DNA, 20 bp, Artificial Sequence
  chemically synthesized
caccatactgctccttgctg

SEQ ID NO: 265841 - DNA, 20 bp, Artificial Sequence
  chemically synthesized
ttaattttggcctcagcaag

SEQ ID NO: 265842 - DNA, 20 bp, Artificial Sequence
  chemically synthesized
tgttaattttggcctcagca

SEQ ID NO: 265843 - DNA, 20 bp, Artificial Sequence
  chemically synthesized
atgttaattttggcctcagc

SEQ ID NO: 265844 - DNA, 20 bp, Artificial Sequence
  chemically synthesized
tgtaatgttaattttggcct

SEQ ID NO: 265845 - DNA, 20 bp, Artificial Sequence
  chemically synthesized
gctctctgtaatgttaattt

SEQ ID NO: 265846 - DNA, 20 bp, Artificial Sequence
  chemically synthesized
tgaggccaaaattaacatta

SEQ ID NO: 265847 - DNA, 20 bp, Artificial Sequence
  chemically synthesized
aggccaaaattaacattaca

SEQ ID NO: 265848 - DNA, 20 bp, Artificial Sequence
  chemically synthesized
gccaaaattaacattacaga

SEQ ID NO: 265849 - DNA, 20 bp, Artificial Sequence
  chemically synthesized
acattacagagagctgcact

SEQ ID NO: 265850 - DNA, 20 bp, Artificial Sequence
  chemically synthesized
aggacttgactgtccaagtg

SEQ ID NO: 265851 - DNA, 20 bp, Artificial Sequence
  chemically synthesized
tacagagagctgcacttgga

SEQ ID NO: 265852 - DNA, 20 bp, Artificial Sequence
  chemically synthesized
ggctgaggacttgactgtcc

SEQ ID NO: 265853 - DNA, 20 bp, Artificial Sequence
  chemically synthesized
agagctgcacttggacagtc

SEQ ID NO: 265854 - DNA, 20 bp, Artificial Sequence
  chemically synthesized
cacttggacagtcaagtcct

SEQ ID NO: 265855 - DNA, 20 bp, Artificial Sequence
  chemically synthesized
tcctcagttcagattggctg

SEQ ID NO: 265856 - DNA, 20 bp, Artificial Sequence
  chemically synthesized
atcctcagttcagattggct

SEQ ID NO: 265857 - DNA, 20 bp, Artificial Sequence
  chemically synthesized
aagggatcctcagttcagat

SEQ ID NO: 265858 - DNA, 20 bp, Artificial Sequence
  chemically synthesized
gtcctcagccaatctgaact

SEQ ID NO: 265859 - DNA, 20 bp, Artificial Sequence
  chemically synthesized
tcctcagccaatctgaactg

SEQ ID NO: 265860 - DNA, 20 bp, Artificial Sequence
  chemically synthesized
gagtaaagggatcctcagtt

SEQ ID NO: 265861 - DNA, 20 bp, Artificial Sequence
  chemically synthesized
gcagtgagtaaagggatcct

SEQ ID NO: 265862 - DNA, 20 bp, Artificial Sequence
  chemically synthesized
cccagaaagcagtgagtaaa

SEQ ID NO: 265863 - DNA, 20 bp, Artificial Sequence
  chemically synthesized
gcccagaaagcagtgagtaa

SEQ ID NO: 265864 - DNA, 20 bp, Artificial Sequence
  chemically synthesized
agcccagaaagcagtgagta

SEQ ID NO: 265865 - DNA, 20 bp, Artificial Sequence
  chemically synthesized
tccgaagcccagaaagcagt

SEQ ID NO: 265866 - DNA, 20 bp, Artificial Sequence
  chemically synthesized
tccctttactcactgctttc

SEQ ID NO: 265867 - DNA, 20 bp, Artificial Sequence
  chemically synthesized
ccctttactcactgctttct

SEQ ID NO: 265868 - DNA, 20 bp, Artificial Sequence
  chemically synthesized
aaattccgaagcccagaaag

SEQ ID NO: 265869 - DNA, 20 bp, Artificial Sequence
  chemically synthesized
aagaaattccgaagcccaga

SEQ ID NO: 265870 - DNA, 20 bp, Artificial Sequence
  chemically synthesized
actcactgctttctgggctt

SEQ ID NO: 265871 - DNA, 20 bp, Artificial Sequence
  chemically synthesized
tgacaagaaattccgaagcc

SEQ ID NO: 265872 - DNA, 20 bp, Artificial Sequence
  chemically synthesized
gttcatgacaagaaattccg

SEQ ID NO: 265873 - DNA, 20 bp, Artificial Sequence
  chemically synthesized
ctgccaggactgttcatgac

SEQ ID NO: 265874 - DNA, 20 bp, Artificial Sequence
  chemically synthesized
tcggaatttcttgtcatgaa

SEQ ID NO: 265875 - DNA, 20 bp, Artificial Sequence
  chemically synthesized
tttcttgtcatgaacagtcc

SEQ ID NO: 265876 - DNA, 20 bp, Artificial Sequence
  chemically synthesized
cttgtcatgaacagtcctgg

SEQ ID NO: 265877 - DNA, 20 bp, Artificial Sequence
  chemically synthesized
ttgtcatgaacagtcctggc

SEQ ID NO: 265878 - DNA, 20 bp, Artificial Sequence
  chemically synthesized
gtcatgaacagtcctggcag

SEQ ID NO: 265879 - DNA, 20 bp, Artificial Sequence
  chemically synthesized
gtactcccatgtctcctgcc

SEQ ID NO: 265880 - DNA, 20 bp, Artificial Sequence
  chemically synthesized
ggtactcccatgtctcctgc

SEQ ID NO: 265881 - DNA, 20 bp, Artificial Sequence
  chemically synthesized
aacagtcctggcaggagaca

SEQ ID NO: 265882 - DNA, 20 bp, Artificial Sequence
  chemically synthesized
acagtcctggcaggagacat

SEQ ID NO: 265883 - DNA, 20 bp, Artificial Sequence
  chemically synthesized
agtcctggcaggagacatgg

SEQ ID NO: 265884 - DNA, 20 bp, Artificial Sequence
  chemically synthesized
ttggtgaagaatacaaagtg

SEQ ID NO: 265885 - DNA, 20 bp, Artificial Sequence
  chemically synthesized
tttggtgaagaatacaaagt

SEQ ID NO: 265886 - DNA, 20 bp, Artificial Sequence
  chemically synthesized
atttggtgaagaatacaaag

SEQ ID NO: 265887 - DNA, 20 bp, Artificial Sequence
  chemically synthesized
actatttggtgaagaataca

SEQ ID NO: 265888 - DNA, 20 bp, Artificial Sequence
  chemically synthesized
actttgtattcttcaccaaa

SEQ ID NO: 265889 - DNA, 20 bp, Artificial Sequence
  chemically synthesized
tctagatttactatttggtg

SEQ ID NO: 265890 - DNA, 20 bp, Artificial Sequence
  chemically synthesized
tggtgtctagatttactatt

SEQ ID NO: 265891 - DNA, 20 bp, Artificial Sequence
  chemically synthesized
tcttcaccaaatagtaaatc

SEQ ID NO: 265892 - DNA, 20 bp, Artificial Sequence
  chemically synthesized
caaatagtaaatctagacac

SEQ ID NO: 265893 - DNA, 20 bp, Artificial Sequence
  chemically synthesized
gctgaaaattcactggtgtc

SEQ ID NO: 265894 - DNA, 20 bp, Artificial Sequence
  chemically synthesized
aacttatgctgaaaattcac

SEQ ID NO: 265895 - DNA, 20 bp, Artificial Sequence
  chemically synthesized
tctagacaccagtgaatttt

SEQ ID NO: 265896 - DNA, 20 bp, Artificial Sequence
  chemically synthesized
caccagtgaattttcagcat

SEQ ID NO: 265897 - DNA, 20 bp, Artificial Sequence
  chemically synthesized
cataagttatttctctattc

SEQ ID NO: 265898 - DNA, 20 bp, Artificial Sequence
  chemically synthesized
ataagttatttctctattca

SEQ ID NO: 265899 - DNA, 20 bp, Artificial Sequence
  chemically synthesized
taagttatttctctattcaa

SEQ ID NO: 265900 - DNA, 20 bp, Artificial Sequence
  chemically synthesized
ctctaaagagcccttgaata

SEQ ID NO: 265901 - DNA, 20 bp, Artificial Sequence
  chemically synthesized
aactctaaagagcccttgaa

SEQ ID NO: 265902 - DNA, 20 bp, Artificial Sequence
  chemically synthesized
ttctctattcaagggctctt

SEQ ID NO: 265903 - DNA, 20 bp, Artificial Sequence
  chemically synthesized
ctctattcaagggctcttta

SEQ ID NO: 265904 - DNA, 20 bp, Artificial Sequence
  chemically synthesized
ctttagaacataactctaaa

SEQ ID NO: 265905 - DNA, 20 bp, Artificial Sequence
  chemically synthesized
gcctttagaacataactcta

SEQ ID NO: 265906 - DNA, 20 bp, Artificial Sequence
  chemically synthesized
ctctttagagttatgttcta

SEQ ID NO: 265907 - DNA, 20 bp, Artificial Sequence
  chemically synthesized
tctttagagttatgttctaa

SEQ ID NO: 265908 - DNA, 20 bp, Artificial Sequence
  chemically synthesized
agtaatttcagtatagcctt

SEQ ID NO: 265909 - DNA, 20 bp, Artificial Sequence
  chemically synthesized
tgtaatcagtaatttcagta

SEQ ID NO: 265910 - DNA, 20 bp, Artificial Sequence
  chemically synthesized
ctctttgtaatcagtaattt

SEQ ID NO: 265911 - DNA, 20 bp, Artificial Sequence
  chemically synthesized
tactgaaattactgattaca

SEQ ID NO: 265912 - DNA, 20 bp, Artificial Sequence
  chemically synthesized
ggtcatagactctttgtaat

SEQ ID NO: 265913 - DNA, 20 bp, Artificial Sequence
  chemically synthesized
ctgaaattactgattacaaa

SEQ ID NO: 265914 - DNA, 20 bp, Artificial Sequence
  chemically synthesized
gattgaacacgggtaggtca

SEQ ID NO: 265915 - DNA, 20 bp, Artificial Sequence
  chemically synthesized
gatttggattgaacacgggt

SEQ ID NO: 265916 - DNA, 20 bp, Artificial Sequence
  chemically synthesized
agatttggattgaacacggg

SEQ ID NO: 265917 - DNA, 20 bp, Artificial Sequence
  chemically synthesized
agtagatttggattgaacac

SEQ ID NO: 265918 - DNA, 20 bp, Artificial Sequence
  chemically synthesized
aagtagatttggattgaaca

SEQ ID NO: 265919 - DNA, 20 bp, Artificial Sequence
  chemically synthesized
ggtgataaaaaaagtagatt

SEQ ID NO: 265920 - DNA, 20 bp, Artificial Sequence
  chemically synthesized
tactatggtgataaaaaaag

SEQ ID NO: 265921 - DNA, 20 bp, Artificial Sequence
  chemically synthesized
aaatactatggtgataaaaa

SEQ ID NO: 265922 - DNA, 20 bp, Artificial Sequence
  chemically synthesized
atctactttttttatcacca

SEQ ID NO: 265923 - DNA, 20 bp, Artificial Sequence
  chemically synthesized
cctggggaaaaaaaatacta

SEQ ID NO: 265924 - DNA, 20 bp, Artificial Sequence
  chemically synthesized
accatagtattttttttccc

SEQ ID NO: 265925 - DNA, 20 bp, Artificial Sequence
  chemically synthesized
ccatagtattttttttcccc

SEQ ID NO: 265926 - DNA, 20 bp, Artificial Sequence
  chemically synthesized
tttcatggaagagtaacctg

SEQ ID NO: 265927 - DNA, 20 bp, Artificial Sequence
  chemically synthesized
gtttcatggaagagtaacct

SEQ ID NO: 265928 - DNA, 20 bp, Artificial Sequence
  chemically synthesized
agtttcatggaagagtaacc

SEQ ID NO: 265929 - DNA, 20 bp, Artificial Sequence
  chemically synthesized
tatgtctaagtttcatggaa

SEQ ID NO: 265930 - DNA, 20 bp, Artificial Sequence
  chemically synthesized
tctatgtctaagtttcatgg

SEQ ID NO: 265931 - DNA, 20 bp, Artificial Sequence
  chemically synthesized
ggttactcttccatgaaact

SEQ ID NO: 265932 - DNA, 20 bp, Artificial Sequence
  chemically synthesized
gagtctatgtctaagtttca

SEQ ID NO: 265933 - DNA, 20 bp, Artificial Sequence
  chemically synthesized
tcttccatgaaacttagaca

SEQ ID NO: 265934 - DNA, 20 bp, Artificial Sequence
  chemically synthesized
ctatggttgagtctatgtct

SEQ ID NO: 265935 - DNA, 20 bp, Artificial Sequence
  chemically synthesized
cttagacatagactcaacca

SEQ ID NO: 265936 - DNA, 20 bp, Artificial Sequence
  chemically synthesized
aatatggcttttctatggtt

SEQ ID NO: 265937 - DNA, 20 bp, Artificial Sequence
  chemically synthesized
acatagactcaaccatagaa

SEQ ID NO: 265938 - DNA, 20 bp, Artificial Sequence
  chemically synthesized
gttagaatatggcttttcta

SEQ ID NO: 265939 - DNA, 20 bp, Artificial Sequence
  chemically synthesized
gataatattaggttagaata

SEQ ID NO: 265940 - DNA, 20 bp, Artificial Sequence
  chemically synthesized
tatacaggataatattaggt

SEQ ID NO: 265941 - DNA, 20 bp, Artificial Sequence
  chemically synthesized
gggttatacaggataatatt

SEQ ID NO: 265942 - DNA, 20 bp, Artificial Sequence
  chemically synthesized
ggggttatacaggataatat

SEQ ID NO: 265943 - DNA, 20 bp, Artificial Sequence
  chemically synthesized
ctttatagtaggggttatac

SEQ ID NO: 265944 - DNA, 20 bp, Artificial Sequence
  chemically synthesized
tctttatagtaggggttata

SEQ ID NO: 265945 - DNA, 20 bp, Artificial Sequence
  chemically synthesized
atcaggtttctttatagtag

SEQ ID NO: 265946 - DNA, 20 bp, Artificial Sequence
  chemically synthesized
cctgtataacccctactata

SEQ ID NO: 265947 - DNA, 20 bp, Artificial Sequence
  chemically synthesized
aatcaggtttctttatagta

SEQ ID NO: 265948 - DNA, 20 bp, Artificial Sequence
  chemically synthesized
aaatcaggtttctttatagt

SEQ ID NO: 265949 - DNA, 20 bp, Artificial Sequence
  chemically synthesized
aaaatcaggtttctttatag

SEQ ID NO: 265950 - DNA, 20 bp, Artificial Sequence
  chemically synthesized
ctcaaaatcaggtttcttta

SEQ ID NO: 265951 - DNA, 20 bp, Artificial Sequence
  chemically synthesized
ctataaagaaacctgatttt

SEQ ID NO: 265952 - DNA, 20 bp, Artificial Sequence
  chemically synthesized
tagcctttgatctcaaaatc

SEQ ID NO: 265953 - DNA, 20 bp, Artificial Sequence
  chemically synthesized
gtagcctttgatctcaaaat

SEQ ID NO: 265954 - DNA, 20 bp, Artificial Sequence
  chemically synthesized
gaaacctgattttgagatca

SEQ ID NO: 265955 - DNA, 20 bp, Artificial Sequence
  chemically synthesized
aaacctgattttgagatcaa

SEQ ID NO: 265956 - DNA, 20 bp, Artificial Sequence
  chemically synthesized
gtgctggaggttttaggggg

SEQ ID NO: 265957 - DNA, 20 bp, Artificial Sequence
  chemically synthesized
gaagtgctggaggttttagg

SEQ ID NO: 265958 - DNA, 20 bp, Artificial Sequence
  chemically synthesized
tgaagtgctggaggttttag

SEQ ID NO: 265959 - DNA, 20 bp, Artificial Sequence
  chemically synthesized
ctgaagtgctggaggtttta

SEQ ID NO: 265960 - DNA, 20 bp, Artificial Sequence
  chemically synthesized
gctgaagtgctggaggtttt

SEQ ID NO: 265961 - DNA, 20 bp, Artificial Sequence
  chemically synthesized
aggctaccccctaaaacctc

SEQ ID NO: 265962 - DNA, 20 bp, Artificial Sequence
  chemically synthesized
tgctgaagtgctggaggttt

SEQ ID NO: 265963 - DNA, 20 bp, Artificial Sequence
  chemically synthesized
gggaagtgctgaagtgctgg

SEQ ID NO: 265964 - DNA, 20 bp, Artificial Sequence
  chemically synthesized
agggaagtgctgaagtgctg

SEQ ID NO: 265965 - DNA, 20 bp, Artificial Sequence
  chemically synthesized
ccctaaaacctccagcactt

SEQ ID NO: 265966 - DNA, 20 bp, Artificial Sequence
  chemically synthesized
gtagggaagtgctgaagtgc

SEQ ID NO: 265967 - DNA, 20 bp, Artificial Sequence
  chemically synthesized
tctggagtagggaagtgctg

SEQ ID NO: 265968 - DNA, 20 bp, Artificial Sequence
  chemically synthesized
gtgtttgctctggagtaggg

SEQ ID NO: 265969 - DNA, 20 bp, Artificial Sequence
  chemically synthesized
acttcagcacttccctactc

SEQ ID NO: 265970 - DNA, 20 bp, Artificial Sequence
  chemically synthesized
ttcagcacttccctactcca

SEQ ID NO: 265971 - DNA, 20 bp, Artificial Sequence
  chemically synthesized
tgtgtgtttgctctggagta

SEQ ID NO: 265972 - DNA, 20 bp, Artificial Sequence
  chemically synthesized
gtgtgtgtttgctctggagt

SEQ ID NO: 265973 - DNA, 20 bp, Artificial Sequence
  chemically synthesized
tgtgtgtgtttgctctggag

SEQ ID NO: 265974 - DNA, 20 bp, Artificial Sequence
  chemically synthesized
tcttgtgtgtgtttgctctg

SEQ ID NO: 265975 - DNA, 20 bp, Artificial Sequence
  chemically synthesized
tgtcttgtgtgtgtttgctc

SEQ ID NO: 265976 - DNA, 20 bp, Artificial Sequence
  chemically synthesized
actccagagcaaacacacac

SEQ ID NO: 265977 - DNA, 20 bp, Artificial Sequence
  chemically synthesized
aatcttttgttgattacaat

SEQ ID NO: 265978 - DNA, 20 bp, Artificial Sequence
  chemically synthesized
tttcttattgtaatcaacaa

SEQ ID NO: 265979 - DNA, 20 bp, Artificial Sequence
  chemically synthesized
atcaacaaaagattactgaa

SEQ ID NO: 265980 - DNA, 20 bp, Artificial Sequence
  chemically synthesized
cgttctaaaatttggctatt

SEQ ID NO: 265981 - DNA, 20 bp, Artificial Sequence
  chemically synthesized
attactgaatagccaaattt

SEQ ID NO: 265982 - DNA, 20 bp, Artificial Sequence
  chemically synthesized
tccctgctcgttctaaaatt

SEQ ID NO: 265983 - DNA, 20 bp, Artificial Sequence
  chemically synthesized
gaatagccaaattttagaac

SEQ ID NO: 265984 - DNA, 20 bp, Artificial Sequence
  chemically synthesized
tagccaaattttagaacgag

SEQ ID NO: 265985 - DNA, 20 bp, Artificial Sequence
  chemically synthesized
agccaaattttagaacgagc

SEQ ID NO: 265986 - DNA, 20 bp, Artificial Sequence
  chemically synthesized
gccaaattttagaacgagca

SEQ ID NO: 265987 - DNA, 20 bp, Artificial Sequence
  chemically synthesized
ttgaaatttctaaattagat

SEQ ID NO: 265988 - DNA, 20 bp, Artificial Sequence
  chemically synthesized
atttatgaactaatctaatt

SEQ ID NO: 265989 - DNA, 20 bp, Artificial Sequence
  chemically synthesized
atggtttgaaatttctaaat

SEQ ID NO: 265990 - DNA, 20 bp, Artificial Sequence
  chemically synthesized
taaattatgctcatagaaca

SEQ ID NO: 265991 - DNA, 20 bp, Artificial Sequence
  chemically synthesized
aatttcaaaccatgttctat

SEQ ID NO: 265992 - DNA, 20 bp, Artificial Sequence
  chemically synthesized
ggaagtataaattatgctca

SEQ ID NO: 265993 - DNA, 20 bp, Artificial Sequence
  chemically synthesized
ttcctatgattgaattcagg

SEQ ID NO: 265994 - DNA, 20 bp, Artificial Sequence
  chemically synthesized
tccttcctatgattgaattc

SEQ ID NO: 265995 - DNA, 20 bp, Artificial Sequence
  chemically synthesized
ctccttcctatgattgaatt

SEQ ID NO: 265996 - DNA, 20 bp, Artificial Sequence
  chemically synthesized
atacttcctgaattcaatca

SEQ ID NO: 265997 - DNA, 20 bp, Artificial Sequence
  chemically synthesized
tacttcctgaattcaatcat

SEQ ID NO: 265998 - DNA, 20 bp, Artificial Sequence
  chemically synthesized
ttcctgaattcaatcatagg

SEQ ID NO: 265999 - DNA, 20 bp, Artificial Sequence
  chemically synthesized
tcctgaattcaatcatagga

SEQ ID NO: 266000 - DNA, 20 bp, Artificial Sequence
  chemically synthesized
ctgaattcaatcataggaag

SEQ ID NO: 266001 - DNA, 20 bp, Artificial Sequence
  chemically synthesized
attcaatcataggaaggaga

SEQ ID NO: 266002 - DNA, 20 bp, Artificial Sequence
  chemically synthesized
taggaaggagaaagataaaa

SEQ ID NO: 266003 - DNA, 20 bp, Artificial Sequence
  chemically synthesized
gaaggagaaagataaaatgg

SEQ ID NO: 266004 - DNA, 20 bp, Artificial Sequence
  chemically synthesized
tggcagatatttcccccatc

SEQ ID NO: 266005 - DNA, 20 bp, Artificial Sequence
  chemically synthesized
ataatagagttactagatgg

SEQ ID NO: 266006 - DNA, 20 bp, Artificial Sequence
  chemically synthesized
aataatagagttactagatg

SEQ ID NO: 266007 - DNA, 20 bp, Artificial Sequence
  chemically synthesized
aaataatagagttactagat

SEQ ID NO: 266008 - DNA, 20 bp, Artificial Sequence
  chemically synthesized
aaaataatagagttactaga

SEQ ID NO: 266009 - DNA, 20 bp, Artificial Sequence
  chemically synthesized
ttggaaaataatagagttac

SEQ ID NO: 266010 - DNA, 20 bp, Artificial Sequence
  chemically synthesized
taataaattggaaaataata

SEQ ID NO: 266011 - DNA, 20 bp, Artificial Sequence
  chemically synthesized
attaataaattggaaaataa

SEQ ID NO: 266012 - DNA, 20 bp, Artificial Sequence
  chemically synthesized
ttaaaattaaattaataaat

SEQ ID NO: 266013 - DNA, 20 bp, Artificial Sequence
  chemically synthesized
aaatattattatttaaaata

SEQ ID NO: 266014 - DNA, 20 bp, Artificial Sequence
  chemically synthesized
tattttaaataataatattt

SEQ ID NO: 266015 - DNA, 20 bp, Artificial Sequence
  chemically synthesized
attttaaataataatatttt

SEQ ID NO: 266016 - DNA, 20 bp, Artificial Sequence
  chemically synthesized
ttaaataataatattttggg

SEQ ID NO: 266017 - DNA, 20 bp, Artificial Sequence
  chemically synthesized
taaataataatattttgggc

SEQ ID NO: 266018 - DNA, 20 bp, Artificial Sequence
  chemically synthesized
taataatattttgggcagga

SEQ ID NO: 266019 - DNA, 20 bp, Artificial Sequence
  chemically synthesized
aataatattttgggcaggat

SEQ ID NO: 266020 - DNA, 20 bp, Artificial Sequence
  chemically synthesized
aatagactaacaatttttaa

SEQ ID NO: 266021 - DNA, 20 bp, Artificial Sequence
  chemically synthesized
ggttttcttttaaaaattgt

SEQ ID NO: 266022 - DNA, 20 bp, Artificial Sequence
  chemically synthesized
gtaagatgaggaagttaaaa

SEQ ID NO: 266023 - DNA, 20 bp, Artificial Sequence
  chemically synthesized
tcattgtttgtaagatgagg

SEQ ID NO: 266024 - DNA, 20 bp, Artificial Sequence
  chemically synthesized
atttcattgtttgtaagatg

SEQ ID NO: 266025 - DNA, 20 bp, Artificial Sequence
  chemically synthesized
catttcattgtttgtaagat

SEQ ID NO: 266026 - DNA, 20 bp, Artificial Sequence
  chemically synthesized
atatccatttcattgtttgt

SEQ ID NO: 266027 - DNA, 20 bp, Artificial Sequence
  chemically synthesized
tcatcttacaaacaatgaaa

SEQ ID NO: 266028 - DNA, 20 bp, Artificial Sequence
  chemically synthesized
caaacaatgaaatggatatg

SEQ ID NO: 266029 - DNA, 20 bp, Artificial Sequence
  chemically synthesized
tgcagaaaaatcacatattc

SEQ ID NO: 266030 - DNA, 20 bp, Artificial Sequence
  chemically synthesized
ctaactttttcagtagtagc

SEQ ID NO: 266031 - DNA, 20 bp, Artificial Sequence
  chemically synthesized
aggcctaactttttcagtag

SEQ ID NO: 266032 - DNA, 20 bp, Artificial Sequence
  chemically synthesized
tattctggctactactgaaa

SEQ ID NO: 266033 - DNA, 20 bp, Artificial Sequence
  chemically synthesized
tttaggcctaactttttcag

SEQ ID NO: 266034 - DNA, 20 bp, Artificial Sequence
  chemically synthesized
ctggctactactgaaaaagt

SEQ ID NO: 266035 - DNA, 20 bp, Artificial Sequence
  chemically synthesized
agatttaggcctaacttttt

SEQ ID NO: 266036 - DNA, 20 bp, Artificial Sequence
  chemically synthesized
tggctactactgaaaaagtt

SEQ ID NO: 266037 - DNA, 20 bp, Artificial Sequence
  chemically synthesized
gatttagaagattgagattt

SEQ ID NO: 266038 - DNA, 20 bp, Artificial Sequence
  chemically synthesized
ggatttagaagattgagatt

SEQ ID NO: 266039 - DNA, 20 bp, Artificial Sequence
  chemically synthesized
aacagtggatttagaagatt

SEQ ID NO: 266040 - DNA, 20 bp, Artificial Sequence
  chemically synthesized
agagaaaacagtggatttag

SEQ ID NO: 266041 - DNA, 20 bp, Artificial Sequence
  chemically synthesized
accagagaaaacagtggatt

SEQ ID NO: 266042 - DNA, 20 bp, Artificial Sequence
  chemically synthesized
aatctcaccagagaaaacag

SEQ ID NO: 266043 - DNA, 20 bp, Artificial Sequence
  chemically synthesized
tctaaatccactgttttctc

SEQ ID NO: 266044 - DNA, 20 bp, Artificial Sequence
  chemically synthesized
ggtaatctcaccagagaaaa

SEQ ID NO: 266045 - DNA, 20 bp, Artificial Sequence
  chemically synthesized
aatccactgttttctctggt

SEQ ID NO: 266046 - DNA, 20 bp, Artificial Sequence
  chemically synthesized
tttagaaggtaatctcacca

SEQ ID NO: 266047 - DNA, 20 bp, Artificial Sequence
  chemically synthesized
gatttagaaggtaatctcac

SEQ ID NO: 266048 - DNA, 20 bp, Artificial Sequence
  chemically synthesized
gagagaacaatagatttaga

SEQ ID NO: 266049 - DNA, 20 bp, Artificial Sequence
  chemically synthesized
agagagaacaatagatttag

SEQ ID NO: 266050 - DNA, 20 bp, Artificial Sequence
  chemically synthesized
ggcagagagaacaatagatt

SEQ ID NO: 266051 - DNA, 20 bp, Artificial Sequence
  chemically synthesized
gatctcggcagagagaacaa

SEQ ID NO: 266052 - DNA, 20 bp, Artificial Sequence
  chemically synthesized
aatctattgttctctctgcc

SEQ ID NO: 266053 - DNA, 20 bp, Artificial Sequence
  chemically synthesized
ggtgagatgatctcggcaga

SEQ ID NO: 266054 - DNA, 20 bp, Artificial Sequence
  chemically synthesized
atggtgagatgatctcggca

SEQ ID NO: 266055 - DNA, 20 bp, Artificial Sequence
  chemically synthesized
taatggtgagatgatctcgg

SEQ ID NO: 266056 - DNA, 20 bp, Artificial Sequence
  chemically synthesized
aaataatggtgagatgatct

SEQ ID NO: 266057 - DNA, 20 bp, Artificial Sequence
  chemically synthesized
ggggatgttcaaataatggt

SEQ ID NO: 266058 - DNA, 20 bp, Artificial Sequence
  chemically synthesized
tcatggggatgttcaaataa

SEQ ID NO: 266059 - DNA, 20 bp, Artificial Sequence
  chemically synthesized
attatttgaacatccccatg

SEQ ID NO: 266060 - DNA, 20 bp, Artificial Sequence
  chemically synthesized
aacactaattcatcttcatg

SEQ ID NO: 266061 - DNA, 20 bp, Artificial Sequence
  chemically synthesized
taacactaattcatcttcat

SEQ ID NO: 266062 - DNA, 20 bp, Artificial Sequence
  chemically synthesized
ttaacactaattcatcttca

SEQ ID NO: 266063 - DNA, 20 bp, Artificial Sequence
  chemically synthesized
acatccccatgaagatgaat

SEQ ID NO: 266064 - DNA, 20 bp, Artificial Sequence
  chemically synthesized
acatattttatgattatact

SEQ ID NO: 266065 - DNA, 20 bp, Artificial Sequence
  chemically synthesized
ttcaaacagaaatgaatact

SEQ ID NO: 266066 - DNA, 20 bp, Artificial Sequence
  chemically synthesized
aagaaatacatgttttcaaa

SEQ ID NO: 266067 - DNA, 20 bp, Artificial Sequence
  chemically synthesized
tttgaaaacatgtatttctt

SEQ ID NO: 266068 - DNA, 20 bp, Artificial Sequence
  chemically synthesized
aaaacatgtatttcttaagc

SEQ ID NO: 266069 - DNA, 20 bp, Artificial Sequence
  chemically synthesized
aaacatgtatttcttaagca

SEQ ID NO: 266070 - DNA, 20 bp, Artificial Sequence
  chemically synthesized
gggtataaagatccttgctt

SEQ ID NO: 266071 - DNA, 20 bp, Artificial Sequence
  chemically synthesized
tgagaagatacaagggtata

SEQ ID NO: 266072 - DNA, 20 bp, Artificial Sequence
  chemically synthesized
attgtggtgagaagatacaa

SEQ ID NO: 266073 - DNA, 20 bp, Artificial Sequence
  chemically synthesized
gattgtggtgagaagataca

SEQ ID NO: 266074 - DNA, 20 bp, Artificial Sequence
  chemically synthesized
agattgtggtgagaagatac

SEQ ID NO: 266075 - DNA, 20 bp, Artificial Sequence
  chemically synthesized
gtgttagagattgtggtgag

SEQ ID NO: 266076 - DNA, 20 bp, Artificial Sequence
  chemically synthesized
attgtgttagagattgtggt

SEQ ID NO: 266077 - DNA, 20 bp, Artificial Sequence
  chemically synthesized
ttccattgtgttagagattg

SEQ ID NO: 266078 - DNA, 20 bp, Artificial Sequence
  chemically synthesized
attgagcttccattgtgtta

SEQ ID NO: 266079 - DNA, 20 bp, Artificial Sequence
  chemically synthesized
caccacaatctctaacacaa

SEQ ID NO: 266080 - DNA, 20 bp, Artificial Sequence
  chemically synthesized
ggattgagcttccattgtgt

SEQ ID NO: 266081 - DNA, 20 bp, Artificial Sequence
  chemically synthesized
cacaatctctaacacaatgg

SEQ ID NO: 266082 - DNA, 20 bp, Artificial Sequence
  chemically synthesized
ttgcatcagctaatgggatt

SEQ ID NO: 266083 - DNA, 20 bp, Artificial Sequence
  chemically synthesized
caatggaagctcaatcccat

SEQ ID NO: 266084 - DNA, 20 bp, Artificial Sequence
  chemically synthesized
tattcattgcatcagctaat

SEQ ID NO: 266085 - DNA, 20 bp, Artificial Sequence
  chemically synthesized
atattcattgcatcagctaa

SEQ ID NO: 266086 - DNA, 20 bp, Artificial Sequence
  chemically synthesized
tgcttatatattcattgcat

SEQ ID NO: 266087 - DNA, 20 bp, Artificial Sequence
  chemically synthesized
agctgatgcaatgaatatat

SEQ ID NO: 266088 - DNA, 20 bp, Artificial Sequence
  chemically synthesized
atgcaatgaatatataagca

SEQ ID NO: 266089 - DNA, 20 bp, Artificial Sequence
  chemically synthesized
tgaatatataagcaaagtgt

SEQ ID NO: 266090 - DNA, 20 bp, Artificial Sequence
  chemically synthesized
aaatgaaaaacacagaaata

SEQ ID NO: 266091 - DNA, 20 bp, Artificial Sequence
  chemically synthesized
tcacgatgaaatgaaaaaca

SEQ ID NO: 266092 - DNA, 20 bp, Artificial Sequence
  chemically synthesized
ttttcatttcatcgtgataa

SEQ ID NO: 266093 - DNA, 20 bp, Artificial Sequence
  chemically synthesized
ttcatttcatcgtgataata

SEQ ID NO: 266094 - DNA, 20 bp, Artificial Sequence
  chemically synthesized
atagagcataattatctctt

SEQ ID NO: 266095 - DNA, 20 bp, Artificial Sequence
  chemically synthesized
agagcataattatctcttca

SEQ ID NO: 266096 - DNA, 20 bp, Artificial Sequence
  chemically synthesized
ccccattttagggctctgaa

SEQ ID NO: 266097 - DNA, 20 bp, Artificial Sequence
  chemically synthesized
gaccccattttagggctctg

SEQ ID NO: 266098 - DNA, 20 bp, Artificial Sequence
  chemically synthesized
atctcttcagagccctaaaa

SEQ ID NO: 266099 - DNA, 20 bp, Artificial Sequence
  chemically synthesized
tctcttcagagccctaaaat

SEQ ID NO: 266100 - DNA, 20 bp, Artificial Sequence
  chemically synthesized
ctcttcagagccctaaaatg

SEQ ID NO: 266101 - DNA, 20 bp, Artificial Sequence
  chemically synthesized
gtaacaatgaccccatttta

SEQ ID NO: 266102 - DNA, 20 bp, Artificial Sequence
  chemically synthesized
tgtaacaatgaccccatttt

SEQ ID NO: 266103 - DNA, 20 bp, Artificial Sequence
  chemically synthesized
gtgtaacaatgaccccattt

SEQ ID NO: 266104 - DNA, 20 bp, Artificial Sequence
  chemically synthesized
aatggggtcattgttacact

SEQ ID NO: 266105 - DNA, 20 bp, Artificial Sequence
  chemically synthesized
ctaaattagtaaaggcaact

SEQ ID NO: 266106 - DNA, 20 bp, Artificial Sequence
  chemically synthesized
gtttttctctaaattagtaa

SEQ ID NO: 266107 - DNA, 20 bp, Artificial Sequence
  chemically synthesized
tgtttttctctaaattagta

SEQ ID NO: 266108 - DNA, 20 bp, Artificial Sequence
  chemically synthesized
ctcagttgcctttactaatt

SEQ ID NO: 266109 - DNA, 20 bp, Artificial Sequence
  chemically synthesized
cagttgcctttactaattta

SEQ ID NO: 266110 - DNA, 20 bp, Artificial Sequence
  chemically synthesized
gtatttgtttttctctaaat

SEQ ID NO: 266111 - DNA, 20 bp, Artificial Sequence
  chemically synthesized
agaaaaacaaatactttgaa

SEQ ID NO: 266112 - DNA, 20 bp, Artificial Sequence
  chemically synthesized
aatcacatgtttgcttttca

SEQ ID NO: 266113 - DNA, 20 bp, Artificial Sequence
  chemically synthesized
ttaacatataattgaaaatc

SEQ ID NO: 266114 - DNA, 20 bp, Artificial Sequence
  chemically synthesized
taacatataattgaaaatct

SEQ ID NO: 266115 - DNA, 20 bp, Artificial Sequence
  chemically synthesized
aacatataattgaaaatctg

SEQ ID NO: 266116 - DNA, 20 bp, Artificial Sequence
  chemically synthesized
tataattgaaaatctggggc

SEQ ID NO: 266117 - DNA, 20 bp, Artificial Sequence
  chemically synthesized
ataattgaaaatctggggcc

SEQ ID NO: 266118 - DNA, 20 bp, Artificial Sequence
  chemically synthesized
tgaaccactgtgcctggccc

SEQ ID NO: 266119 - DNA, 20 bp, Artificial Sequence
  chemically synthesized
tgaaaatctggggccaggca

SEQ ID NO: 266120 - DNA, 20 bp, Artificial Sequence
  chemically synthesized
aaatctggggccaggcacag

SEQ ID NO: 266121 - DNA, 20 bp, Artificial Sequence
  chemically synthesized
caagcgtgaaccactgtgcc

SEQ ID NO: 266122 - DNA, 20 bp, Artificial Sequence
  chemically synthesized
gtggttcacgcttgtaatcc

SEQ ID NO: 266123 - DNA, 20 bp, Artificial Sequence
  chemically synthesized
tctcaaagtgctgggattac

SEQ ID NO: 266124 - DNA, 20 bp, Artificial Sequence
  chemically synthesized
cctgggcctctcaaagtgct

SEQ ID NO: 266125 - DNA, 20 bp, Artificial Sequence
  chemically synthesized
gcttgtaatcccagcacttt

SEQ ID NO: 266126 - DNA, 20 bp, Artificial Sequence
  chemically synthesized
gcctgggcctctcaaagtgc

SEQ ID NO: 266127 - DNA, 20 bp, Artificial Sequence
  chemically synthesized
ttgtaatcccagcactttga

SEQ ID NO: 266128 - DNA, 20 bp, Artificial Sequence
  chemically synthesized
tgtaatcccagcactttgag

SEQ ID NO: 266129 - DNA, 20 bp, Artificial Sequence
  chemically synthesized
cctcctgcctgggcctctca

SEQ ID NO: 266130 - DNA, 20 bp, Artificial Sequence
  chemically synthesized
tcccagcactttgagaggcc

SEQ ID NO: 266131 - DNA, 20 bp, Artificial Sequence
  chemically synthesized
cccagcactttgagaggccc

SEQ ID NO: 266132 - DNA, 20 bp, Artificial Sequence
  chemically synthesized
agcactttgagaggcccagg

SEQ ID NO: 266133 - DNA, 20 bp, Artificial Sequence
  chemically synthesized
gcactttgagaggcccaggc

SEQ ID NO: 266134 - DNA, 20 bp, Artificial Sequence
  chemically synthesized
actttgagaggcccaggcag

SEQ ID NO: 266135 - DNA, 20 bp, Artificial Sequence
  chemically synthesized
ctttgagaggcccaggcagg

SEQ ID NO: 266136 - DNA, 20 bp, Artificial Sequence
  chemically synthesized
ctcaagtgatcctcctgcct

SEQ ID NO: 266137 - DNA, 20 bp, Artificial Sequence
  chemically synthesized
cctcaagtgatcctcctgcc

SEQ ID NO: 266138 - DNA, 20 bp, Artificial Sequence
  chemically synthesized
cccaggcaggaggatcactt

SEQ ID NO: 266139 - DNA, 20 bp, Artificial Sequence
  chemically synthesized
ccaggcaggaggatcacttg

SEQ ID NO: 266140 - DNA, 20 bp, Artificial Sequence
  chemically synthesized
gcaggaggatcacttgaggt

SEQ ID NO: 266141 - DNA, 20 bp, Artificial Sequence
  chemically synthesized
caggaggatcacttgaggtc

SEQ ID NO: 266142 - DNA, 20 bp, Artificial Sequence
  chemically synthesized
ggtctggaactcctgacctc

SEQ ID NO: 266143 - DNA, 20 bp, Artificial Sequence
  chemically synthesized
ggaggatcacttgaggtcag

SEQ ID NO: 266144 - DNA, 20 bp, Artificial Sequence
  chemically synthesized
tcacttgaggtcaggagttc

SEQ ID NO: 266145 - DNA, 20 bp, Artificial Sequence
  chemically synthesized
tgaggtcaggagttccagac

SEQ ID NO: 266146 - DNA, 20 bp, Artificial Sequence
  chemically synthesized
ccacgttggccaggctggtc

SEQ ID NO: 266147 - DNA, 20 bp, Artificial Sequence
  chemically synthesized
tcaggagttccagaccagcc

SEQ ID NO: 266148 - DNA, 20 bp, Artificial Sequence
  chemically synthesized
tttcaccacgttggccaggc

SEQ ID NO: 266149 - DNA, 20 bp, Artificial Sequence
  chemically synthesized
ggggtttcaccacgttggcc

SEQ ID NO: 266150 - DNA, 20 bp, Artificial Sequence
  chemically synthesized
ccagaccagcctggccaacg

SEQ ID NO: 266151 - DNA, 20 bp, Artificial Sequence
  chemically synthesized
cggggtttcaccacgttggc

SEQ ID NO: 266152 - DNA, 20 bp, Artificial Sequence
  chemically synthesized
gagacggggtttcaccacgt

SEQ ID NO: 266153 - DNA, 20 bp, Artificial Sequence
  chemically synthesized
tttgtattttggcagagacg

SEQ ID NO: 266154 - DNA, 20 bp, Artificial Sequence
  chemically synthesized
ttttgtattttggcagagac

SEQ ID NO: 266155 - DNA, 20 bp, Artificial Sequence
  chemically synthesized
tttttgtattttggcagaga

SEQ ID NO: 266156 - DNA, 20 bp, Artificial Sequence
  chemically synthesized
ctaatttttgtattttggca

SEQ ID NO: 266157 - DNA, 20 bp, Artificial Sequence
  chemically synthesized
ggctaatttttgtattttgg

SEQ ID NO: 266158 - DNA, 20 bp, Artificial Sequence
  chemically synthesized
cctggctaatttttgtattt

SEQ ID NO: 266159 - DNA, 20 bp, Artificial Sequence
  chemically synthesized
ctctgccaaaatacaaaaat

SEQ ID NO: 266160 - DNA, 20 bp, Artificial Sequence
  chemically synthesized
gccaaaatacaaaaattagc

SEQ ID NO: 266161 - DNA, 20 bp, Artificial Sequence
  chemically synthesized
ccaaaatacaaaaattagcc

SEQ ID NO: 266162 - DNA, 20 bp, Artificial Sequence
  chemically synthesized
caaaaattagccaggtgtca

SEQ ID NO: 266163 - DNA, 20 bp, Artificial Sequence
  chemically synthesized
cgggcgggcgccgtgacacc

SEQ ID NO: 266164 - DNA, 20 bp, Artificial Sequence
  chemically synthesized
aagtagctgggattacgggc

SEQ ID NO: 266165 - DNA, 20 bp, Artificial Sequence
  chemically synthesized
caagtagctgggattacggg

SEQ ID NO: 266166 - DNA, 20 bp, Artificial Sequence
  chemically synthesized
acggcgcccgcccgtaatcc

SEQ ID NO: 266167 - DNA, 20 bp, Artificial Sequence
  chemically synthesized
tcccaagtagctgggattac

SEQ ID NO: 266168 - DNA, 20 bp, Artificial Sequence
  chemically synthesized
ctcccaagtagctgggatta

SEQ ID NO: 266169 - DNA, 20 bp, Artificial Sequence
  chemically synthesized
cgcccgtaatcccagctact

SEQ ID NO: 266170 - DNA, 20 bp, Artificial Sequence
  chemically synthesized
cctcagcctcccaagtagct

SEQ ID NO: 266171 - DNA, 20 bp, Artificial Sequence
  chemically synthesized
gcccgtaatcccagctactt

SEQ ID NO: 266172 - DNA, 20 bp, Artificial Sequence
  chemically synthesized
gcctcagcctcccaagtagc

SEQ ID NO: 266173 - DNA, 20 bp, Artificial Sequence
  chemically synthesized
ccgtaatcccagctacttgg

SEQ ID NO: 266174 - DNA, 20 bp, Artificial Sequence
  chemically synthesized
cgtaatcccagctacttggg

SEQ ID NO: 266175 - DNA, 20 bp, Artificial Sequence
  chemically synthesized
tcctgcctcagcctcccaag

SEQ ID NO: 266176 - DNA, 20 bp, Artificial Sequence
  chemically synthesized
ttctcctgcctcagcctccc

SEQ ID NO: 266177 - DNA, 20 bp, Artificial Sequence
  chemically synthesized
tcccagctacttgggaggct

SEQ ID NO: 266178 - DNA, 20 bp, Artificial Sequence
  chemically synthesized
cccagctacttgggaggctg

SEQ ID NO: 266179 - DNA, 20 bp, Artificial Sequence
  chemically synthesized
agctacttgggaggctgagg

SEQ ID NO: 266180 - DNA, 20 bp, Artificial Sequence
  chemically synthesized
gctacttgggaggctgaggc

SEQ ID NO: 266181 - DNA, 20 bp, Artificial Sequence
  chemically synthesized
tacttgggaggctgaggcag

SEQ ID NO: 266182 - DNA, 20 bp, Artificial Sequence
  chemically synthesized
atcaagtgattctcctgcct

SEQ ID NO: 266183 - DNA, 20 bp, Artificial Sequence
  chemically synthesized
gcaggagaatcacttgattc

SEQ ID NO: 266184 - DNA, 20 bp, Artificial Sequence
  chemically synthesized
caggagaatcacttgattcc

SEQ ID NO: 266185 - DNA, 20 bp, Artificial Sequence
  chemically synthesized
aacctctgcctcctggaatc

SEQ ID NO: 266186 - DNA, 20 bp, Artificial Sequence
  chemically synthesized
ggagaatcacttgattccag

SEQ ID NO: 266187 - DNA, 20 bp, Artificial Sequence
  chemically synthesized
gagaatcacttgattccagg

SEQ ID NO: 266188 - DNA, 20 bp, Artificial Sequence
  chemically synthesized
aatcacttgattccaggagg

SEQ ID NO: 266189 - DNA, 20 bp, Artificial Sequence
  chemically synthesized
tcacttgattccaggaggca

SEQ ID NO: 266190 - DNA, 20 bp, Artificial Sequence
  chemically synthesized
tcactgcaacctctgcctcc

SEQ ID NO: 266191 - DNA, 20 bp, Artificial Sequence
  chemically synthesized
cacttgattccaggaggcag

SEQ ID NO: 266192 - DNA, 20 bp, Artificial Sequence
  chemically synthesized
attccaggaggcagaggttg

SEQ ID NO: 266193 - DNA, 20 bp, Artificial Sequence
  chemically synthesized
caggaggcagaggttgcagt

SEQ ID NO: 266194 - DNA, 20 bp, Artificial Sequence
  chemically synthesized
ggcagaggttgcagtgagct

SEQ ID NO: 266195 - DNA, 20 bp, Artificial Sequence
  chemically synthesized
gcagaggttgcagtgagctg

SEQ ID NO: 266196 - DNA, 20 bp, Artificial Sequence
  chemically synthesized
ggagtgctgtggcataacct

SEQ ID NO: 266197 - DNA, 20 bp, Artificial Sequence
  chemically synthesized
agtgagctgaggttatgcca

SEQ ID NO: 266198 - DNA, 20 bp, Artificial Sequence
  chemically synthesized
ttgcccaggctggagtgctg

SEQ ID NO: 266199 - DNA, 20 bp, Artificial Sequence
  chemically synthesized
gaggttatgccacagcactc

SEQ ID NO: 266200 - DNA, 20 bp, Artificial Sequence
  chemically synthesized
tatgccacagcactccagcc

SEQ ID NO: 266201 - DNA, 20 bp, Artificial Sequence
  chemically synthesized
atgccacagcactccagcct

SEQ ID NO: 266202 - DNA, 20 bp, Artificial Sequence
  chemically synthesized
tctctctgttgcccaggctg

SEQ ID NO: 266203 - DNA, 20 bp, Artificial Sequence
  chemically synthesized
actctctctgttgcccaggc

SEQ ID NO: 266204 - DNA, 20 bp, Artificial Sequence
  chemically synthesized
cagcactccagcctgggcaa

SEQ ID NO: 266205 - DNA, 20 bp, Artificial Sequence
  chemically synthesized
ggagactctctctgttgccc

SEQ ID NO: 266206 - DNA, 20 bp, Artificial Sequence
  chemically synthesized
gcactccagcctgggcaaca

SEQ ID NO: 266207 - DNA, 20 bp, Artificial Sequence
  chemically synthesized
tggagactctctctgttgcc

SEQ ID NO: 266208 - DNA, 20 bp, Artificial Sequence
  chemically synthesized
actccagcctgggcaacaga

SEQ ID NO: 266209 - DNA, 20 bp, Artificial Sequence
  chemically synthesized
tccagcctgggcaacagaga

SEQ ID NO: 266210 - DNA, 20 bp, Artificial Sequence
  chemically synthesized
ttgtgtgtgtgtgtgtggtg

SEQ ID NO: 266211 - DNA, 20 bp, Artificial Sequence
  chemically synthesized
ttttgtgtgtgtgtgtgtgg

SEQ ID NO: 266212 - DNA, 20 bp, Artificial Sequence
  chemically synthesized
ttattttgtgtgtgtgtgtg

SEQ ID NO: 266213 - DNA, 20 bp, Artificial Sequence
  chemically synthesized
aataataaatgaatattcac

SEQ ID NO: 266214 - DNA, 20 bp, Artificial Sequence
  chemically synthesized
cataaggcataagaaatttc

SEQ ID NO: 266215 - DNA, 20 bp, Artificial Sequence
  chemically synthesized
tccctagaaacataaggcat

SEQ ID NO: 266216 - DNA, 20 bp, Artificial Sequence
  chemically synthesized
ttattttccctagaaacata

SEQ ID NO: 266217 - DNA, 20 bp, Artificial Sequence
  chemically synthesized
tttcttatgccttatgtttc

SEQ ID NO: 266218 - DNA, 20 bp, Artificial Sequence
  chemically synthesized
tttattttccctagaaacat

SEQ ID NO: 266219 - DNA, 20 bp, Artificial Sequence
  chemically synthesized
ttcttatgccttatgtttct

SEQ ID NO: 266220 - DNA, 20 bp, Artificial Sequence
  chemically synthesized
tcttatgccttatgtttcta

SEQ ID NO: 266221 - DNA, 20 bp, Artificial Sequence
  chemically synthesized
tgaacttcttttattttccc

SEQ ID NO: 266222 - DNA, 20 bp, Artificial Sequence
  chemically synthesized
tatgtttctagggaaaataa

SEQ ID NO: 266223 - DNA, 20 bp, Artificial Sequence
  chemically synthesized
gtttctagggaaaataaaag

SEQ ID NO: 266224 - DNA, 20 bp, Artificial Sequence
  chemically synthesized
gggaaaataaaagaagttca

SEQ ID NO: 266225 - DNA, 20 bp, Artificial Sequence
  chemically synthesized
gaaaataaaagaagttcata

SEQ ID NO: 266226 - DNA, 20 bp, Artificial Sequence
  chemically synthesized
aataaaagaagttcatagag

SEQ ID NO: 266227 - DNA, 20 bp, Artificial Sequence
  chemically synthesized
acttctggaaatcatgcata

SEQ ID NO: 266228 - DNA, 20 bp, Artificial Sequence
  chemically synthesized
atcactttatgcatgatttc

SEQ ID NO: 266229 - DNA, 20 bp, Artificial Sequence
  chemically synthesized
actttatgcatgatttccag

SEQ ID NO: 266230 - DNA, 20 bp, Artificial Sequence
  chemically synthesized
tgaatttgtaagtatacttc

SEQ ID NO: 266231 - DNA, 20 bp, Artificial Sequence
  chemically synthesized
cacattctgcatgaatttgt

SEQ ID NO: 266232 - DNA, 20 bp, Artificial Sequence
  chemically synthesized
agtatacttacaaattcatg

SEQ ID NO: 266233 - DNA, 20 bp, Artificial Sequence
  chemically synthesized
tgtgaccaagacaagtttgt

SEQ ID NO: 266234 - DNA, 20 bp, Artificial Sequence
  chemically synthesized
gaaaactcacaaacttgtct

SEQ ID NO: 266235 - DNA, 20 bp, Artificial Sequence
  chemically synthesized
tacaagtttgtgaccaagac

SEQ ID NO: 266236 - DNA, 20 bp, Artificial Sequence
  chemically synthesized
gccaatacaagtttgtgacc

SEQ ID NO: 266237 - DNA, 20 bp, Artificial Sequence
  chemically synthesized
tcttggtcacaaacttgtat

SEQ ID NO: 266238 - DNA, 20 bp, Artificial Sequence
  chemically synthesized
gtgacagacccagccaatac

SEQ ID NO: 266239 - DNA, 20 bp, Artificial Sequence
  chemically synthesized
ggtcacaaacttgtattggc

SEQ ID NO: 266240 - DNA, 20 bp, Artificial Sequence
  chemically synthesized
gtcacaaacttgtattggct

SEQ ID NO: 266241 - DNA, 20 bp, Artificial Sequence
  chemically synthesized
caccacagatgtgacagacc

SEQ ID NO: 266242 - DNA, 20 bp, Artificial Sequence
  chemically synthesized
gctctccaccacagatgtga

SEQ ID NO: 266243 - DNA, 20 bp, Artificial Sequence
  chemically synthesized
ggctgggtctgtcacatctg

SEQ ID NO: 266244 - DNA, 20 bp, Artificial Sequence
  chemically synthesized
tgggtctgtcacatctgtgg

SEQ ID NO: 266245 - DNA, 20 bp, Artificial Sequence
  chemically synthesized
ggtctgtcacatctgtggtg

SEQ ID NO: 266246 - DNA, 20 bp, Artificial Sequence
  chemically synthesized
tctgtcacatctgtggtgga

SEQ ID NO: 266247 - DNA, 20 bp, Artificial Sequence
  chemically synthesized
gtagaatttgctctccacca

SEQ ID NO: 266248 - DNA, 20 bp, Artificial Sequence
  chemically synthesized
cacagatattaaaaaatggg

SEQ ID NO: 266249 - DNA, 20 bp, Artificial Sequence
  chemically synthesized
gttcacagatattaaaaaat

SEQ ID NO: 266250 - DNA, 20 bp, Artificial Sequence
  chemically synthesized
ggttcacagatattaaaaaa

SEQ ID NO: 266251 - DNA, 20 bp, Artificial Sequence
  chemically synthesized
tgttacaagattgtggttca

SEQ ID NO: 266252 - DNA, 20 bp, Artificial Sequence
  chemically synthesized
taaattgtgttacaagattg

SEQ ID NO: 266253 - DNA, 20 bp, Artificial Sequence
  chemically synthesized
ctttggataaattgtgttac

SEQ ID NO: 266254 - DNA, 20 bp, Artificial Sequence
  chemically synthesized
cttgtaacacaatttatcca

SEQ ID NO: 266255 - DNA, 20 bp, Artificial Sequence
  chemically synthesized
agaaaataaggtattatctt

SEQ ID NO: 266256 - DNA, 20 bp, Artificial Sequence
  chemically synthesized
agaatatttaagagaaaata

SEQ ID NO: 266257 - DNA, 20 bp, Artificial Sequence
  chemically synthesized
tagaatatttaagagaaaat

SEQ ID NO: 266258 - DNA, 20 bp, Artificial Sequence
  chemically synthesized
ctaagctatagaatatttaa

SEQ ID NO: 266259 - DNA, 20 bp, Artificial Sequence
  chemically synthesized
cactaagctatagaatattt

SEQ ID NO: 266260 - DNA, 20 bp, Artificial Sequence
  chemically synthesized
attttctcttaaatattcta

SEQ ID NO: 266261 - DNA, 20 bp, Artificial Sequence
  chemically synthesized
ctcttaaatattctatagct

SEQ ID NO: 266262 - DNA, 20 bp, Artificial Sequence
  chemically synthesized
tttaataaatcactaagcta

SEQ ID NO: 266263 - DNA, 20 bp, Artificial Sequence
  chemically synthesized
gcacattttaataaatcact

SEQ ID NO: 266264 - DNA, 20 bp, Artificial Sequence
  chemically synthesized
atgtgtgtgtgtctatatct

SEQ ID NO: 266265 - DNA, 20 bp, Artificial Sequence
  chemically synthesized
actacttcattactaagata

SEQ ID NO: 266266 - DNA, 20 bp, Artificial Sequence
  chemically synthesized
gtgtctatatcttagtaatg

SEQ ID NO: 266267 - DNA, 20 bp, Artificial Sequence
  chemically synthesized
aatgctactacttcattact

SEQ ID NO: 266268 - DNA, 20 bp, Artificial Sequence
  chemically synthesized
tctatatcttagtaatgaag

SEQ ID NO: 266269 - DNA, 20 bp, Artificial Sequence
  chemically synthesized
atatcttagtaatgaagtag

SEQ ID NO: 266270 - DNA, 20 bp, Artificial Sequence
  chemically synthesized
atgaagtagtagcatttttt

SEQ ID NO: 266271 - DNA, 20 bp, Artificial Sequence
  chemically synthesized
tgaagtagtagcatttttta

SEQ ID NO: 266272 - DNA, 20 bp, Artificial Sequence
  chemically synthesized
taataacaagacaatgaatg

SEQ ID NO: 266273 - DNA, 20 bp, Artificial Sequence
  chemically synthesized
tgtaataacaagacaatgaa

SEQ ID NO: 266274 - DNA, 20 bp, Artificial Sequence
  chemically synthesized
tcaatggcttatgtaataac

SEQ ID NO: 266275 - DNA, 20 bp, Artificial Sequence
  chemically synthesized
tcattgtcttgttattacat

SEQ ID NO: 266276 - DNA, 20 bp, Artificial Sequence
  chemically synthesized
tttacttctaaagatatcaa

SEQ ID NO: 266277 - DNA, 20 bp, Artificial Sequence
  chemically synthesized
acataagccattgatatctt

SEQ ID NO: 266278 - DNA, 20 bp, Artificial Sequence
  chemically synthesized
taagccattgatatctttag

SEQ ID NO: 266279 - DNA, 20 bp, Artificial Sequence
  chemically synthesized
gacaattgtttttacttcta

SEQ ID NO: 266280 - DNA, 20 bp, Artificial Sequence
  chemically synthesized
gtaaaaacaattgtctttgt

SEQ ID NO: 266281 - DNA, 20 bp, Artificial Sequence
  chemically synthesized
agaatgtattgttacttaca

SEQ ID NO: 266282 - DNA, 20 bp, Artificial Sequence
  chemically synthesized
aaaattgattaaagttttga

SEQ ID NO: 266283 - DNA, 20 bp, Artificial Sequence
  chemically synthesized
caggctcttaaaattgatta

SEQ ID NO: 266284 - DNA, 20 bp, Artificial Sequence
  chemically synthesized
tcaaaactttaatcaatttt

SEQ ID NO: 266285 - DNA, 20 bp, Artificial Sequence
  chemically synthesized
aaaactttaatcaattttaa

SEQ ID NO: 266286 - DNA, 20 bp, Artificial Sequence
  chemically synthesized
tacctgcaaaaaaatgtgac

SEQ ID NO: 266287 - DNA, 20 bp, Artificial Sequence
  chemically synthesized
ttacctgcaaaaaaatgtga

SEQ ID NO: 266288 - DNA, 20 bp, Artificial Sequence
  chemically synthesized
gagcctgtcacatttttttg

SEQ ID NO: 266289 - DNA, 20 bp, Artificial Sequence
  chemically synthesized
agcctgtcacatttttttgc

SEQ ID NO: 266290 - DNA, 20 bp, Artificial Sequence
  chemically synthesized
acaaatatatatatttgagt

SEQ ID NO: 266291 - DNA, 20 bp, Artificial Sequence
  chemically synthesized
tgtcacaaatatatatattt

SEQ ID NO: 266292 - DNA, 20 bp, Artificial Sequence
  chemically synthesized
tcaaatatatatatttgtga

SEQ ID NO: 266293 - DNA, 20 bp, Artificial Sequence
  chemically synthesized
atttgtgacagttaactact

SEQ ID NO: 266294 - DNA, 20 bp, Artificial Sequence
  chemically synthesized
gacagcatgagagaacttag

SEQ ID NO: 266295 - DNA, 20 bp, Artificial Sequence
  chemically synthesized
agagacagcatgagagaact

SEQ ID NO: 266296 - DNA, 20 bp, Artificial Sequence
  chemically synthesized
tatggagagagacagcatga

SEQ ID NO: 266297 - DNA, 20 bp, Artificial Sequence
  chemically synthesized
catatggagagagacagcat

SEQ ID NO: 266298 - DNA, 20 bp, Artificial Sequence
  chemically synthesized
tctctacatatggagagaga

SEQ ID NO: 266299 - DNA, 20 bp, Artificial Sequence
  chemically synthesized
atattctctacatatggaga

SEQ ID NO: 266300 - DNA, 20 bp, Artificial Sequence
  chemically synthesized
ctatattctctacatatgga

SEQ ID NO: 266301 - DNA, 20 bp, Artificial Sequence
  chemically synthesized
atgctgtctctctccatatg

SEQ ID NO: 266302 - DNA, 20 bp, Artificial Sequence
  chemically synthesized
ggctatattctctacatatg

SEQ ID NO: 266303 - DNA, 20 bp, Artificial Sequence
  chemically synthesized
gctgtctctctccatatgta

SEQ ID NO: 266304 - DNA, 20 bp, Artificial Sequence
  chemically synthesized
aaggctatattctctacata

SEQ ID NO: 266305 - DNA, 20 bp, Artificial Sequence
  chemically synthesized
ctctccatatgtagagaata

SEQ ID NO: 266306 - DNA, 20 bp, Artificial Sequence
  chemically synthesized
tagagaatatagccttttaa

SEQ ID NO: 266307 - DNA, 20 bp, Artificial Sequence
  chemically synthesized
ttatatagttgacttttaaa

SEQ ID NO: 266308 - DNA, 20 bp, Artificial Sequence
  chemically synthesized
cttatatagttgacttttaa

SEQ ID NO: 266309 - DNA, 20 bp, Artificial Sequence
  chemically synthesized
cttttaaaagtcaactatat

SEQ ID NO: 266310 - DNA, 20 bp, Artificial Sequence
  chemically synthesized
ttttaaaagtcaactatata

SEQ ID NO: 266311 - DNA, 20 bp, Artificial Sequence
  chemically synthesized
ccatacatagagaccttata

SEQ ID NO: 266312 - DNA, 20 bp, Artificial Sequence
  chemically synthesized
ctatataaggtctctatgta

SEQ ID NO: 266313 - DNA, 20 bp, Artificial Sequence
  chemically synthesized
actctctctctccatacata

SEQ ID NO: 266314 - DNA, 20 bp, Artificial Sequence
  chemically synthesized
atataaggtctctatgtatg

SEQ ID NO: 266315 - DNA, 20 bp, Artificial Sequence
  chemically synthesized
gtactctctctctccataca

SEQ ID NO: 266316 - DNA, 20 bp, Artificial Sequence
  chemically synthesized
ataaggtctctatgtatgga

SEQ ID NO: 266317 - DNA, 20 bp, Artificial Sequence
  chemically synthesized
aaggtctctatgtatggaga

SEQ ID NO: 266318 - DNA, 20 bp, Artificial Sequence
  chemically synthesized
ggtctctatgtatggagaga

SEQ ID NO: 266319 - DNA, 20 bp, Artificial Sequence
  chemically synthesized
tctctatgtatggagagaga

SEQ ID NO: 266320 - DNA, 20 bp, Artificial Sequence
  chemically synthesized
tgtatggagagagagagtac

SEQ ID NO: 266321 - DNA, 20 bp, Artificial Sequence
  chemically synthesized
tatggagagagagagtacaa

SEQ ID NO: 266322 - DNA, 20 bp, Artificial Sequence
  chemically synthesized
agagagagtacaagagaact

SEQ ID NO: 266323 - DNA, 20 bp, Artificial Sequence
  chemically synthesized
gagagtacaagagaactaag

SEQ ID NO: 266324 - DNA, 20 bp, Artificial Sequence
  chemically synthesized
atttttaatagttaactact

SEQ ID NO: 266325 - DNA, 20 bp, Artificial Sequence
  chemically synthesized
tcattgcaagttatttttaa

SEQ ID NO: 266326 - DNA, 20 bp, Artificial Sequence
  chemically synthesized
agtttaccttaattcattgc

SEQ ID NO: 266327 - DNA, 20 bp, Artificial Sequence
  chemically synthesized
aaaataacttgcaatgaatt

SEQ ID NO: 266328 - DNA, 20 bp, Artificial Sequence
  chemically synthesized
aaataacttgcaatgaatta

SEQ ID NO: 266329 - DNA, 20 bp, Artificial Sequence
  chemically synthesized
ttcccaaattaaaaagttgt

SEQ ID NO: 266330 - DNA, 20 bp, Artificial Sequence
  chemically synthesized
aaactaacaactttttaatt

SEQ ID NO: 266331 - DNA, 20 bp, Artificial Sequence
  chemically synthesized
attcaccttcccaaattaaa

SEQ ID NO: 266332 - DNA, 20 bp, Artificial Sequence
  chemically synthesized
aactaacaactttttaattt

SEQ ID NO: 266333 - DNA, 20 bp, Artificial Sequence
  chemically synthesized
taacaactttttaatttggg

SEQ ID NO: 266334 - DNA, 20 bp, Artificial Sequence
  chemically synthesized
aacaactttttaatttggga

SEQ ID NO: 266335 - DNA, 20 bp, Artificial Sequence
  chemically synthesized
atttgggaaggtgaattttg

SEQ ID NO: 266336 - DNA, 20 bp, Artificial Sequence
  chemically synthesized
tttgggaaggtgaattttga

SEQ ID NO: 266337 - DNA, 20 bp, Artificial Sequence
  chemically synthesized
ttgggaaggtgaattttgaa

SEQ ID NO: 266338 - DNA, 20 bp, Artificial Sequence
  chemically synthesized
tagcttgtatgcatgagaca

SEQ ID NO: 266339 - DNA, 20 bp, Artificial Sequence
  chemically synthesized
atagtttagcttgtatgcat

SEQ ID NO: 266340 - DNA, 20 bp, Artificial Sequence
  chemically synthesized
taactgtgtctcatgcatac

SEQ ID NO: 266341 - DNA, 20 bp, Artificial Sequence
  chemically synthesized
tgcatacaagctaaactatt

SEQ ID NO: 266342 - DNA, 20 bp, Artificial Sequence
  chemically synthesized
atgataaattctaaatagtt

SEQ ID NO: 266343 - DNA, 20 bp, Artificial Sequence
  chemically synthesized
gtgacatgataaattctaaa

SEQ ID NO: 266344 - DNA, 20 bp, Artificial Sequence
  chemically synthesized
tttaaagtagttttcaaaat

SEQ ID NO: 266345 - DNA, 20 bp, Artificial Sequence
  chemically synthesized
ataatagtacatatttaaag

SEQ ID NO: 266346 - DNA, 20 bp, Artificial Sequence
  chemically synthesized
tatataatagtacatattta

SEQ ID NO: 266347 - DNA, 20 bp, Artificial Sequence
  chemically synthesized
tgtctcatcatgttatataa

SEQ ID NO: 266348 - DNA, 20 bp, Artificial Sequence
  chemically synthesized
gtactattatataacatgat

SEQ ID NO: 266349 - DNA, 20 bp, Artificial Sequence
  chemically synthesized
ctgcactttctaaggcatta

SEQ ID NO: 266350 - DNA, 20 bp, Artificial Sequence
  chemically synthesized
gatgagacactgtaatgcct

SEQ ID NO: 266351 - DNA, 20 bp, Artificial Sequence
  chemically synthesized
agacactgtaatgccttaga

SEQ ID NO: 266352 - DNA, 20 bp, Artificial Sequence
  chemically synthesized
cacaattgctgcactttcta

SEQ ID NO: 266353 - DNA, 20 bp, Artificial Sequence
  chemically synthesized
tcacaattgctgcactttct

SEQ ID NO: 266354 - DNA, 20 bp, Artificial Sequence
  chemically synthesized
ctgtaatgccttagaaagtg

SEQ ID NO: 266355 - DNA, 20 bp, Artificial Sequence
  chemically synthesized
ataagcaaccagtaatagca

SEQ ID NO: 266356 - DNA, 20 bp, Artificial Sequence
  chemically synthesized
ttgtgaaaccatgctattac

SEQ ID NO: 266357 - DNA, 20 bp, Artificial Sequence
  chemically synthesized
tagatataagcaaccagtaa

SEQ ID NO: 266358 - DNA, 20 bp, Artificial Sequence
  chemically synthesized
ttttgatagatataagcaac

SEQ ID NO: 266359 - DNA, 20 bp, Artificial Sequence
  chemically synthesized
aaaaatattttgatagatat

SEQ ID NO: 266360 - DNA, 20 bp, Artificial Sequence
  chemically synthesized
attttcaaaaaatattttga

SEQ ID NO: 266361 - DNA, 20 bp, Artificial Sequence
  chemically synthesized
ttgaaaatgttctatttttc

SEQ ID NO: 266362 - DNA, 20 bp, Artificial Sequence
  chemically synthesized
tgaaaatgttctatttttcc

SEQ ID NO: 266363 - DNA, 20 bp, Artificial Sequence
  chemically synthesized
agtattgattcctggaaaaa

SEQ ID NO: 266364 - DNA, 20 bp, Artificial Sequence
  chemically synthesized
gtcaggtaagtattgattcc

SEQ ID NO: 266365 - DNA, 20 bp, Artificial Sequence
  chemically synthesized
tatgatgcagtatgtcaggt

SEQ ID NO: 266366 - DNA, 20 bp, Artificial Sequence
  chemically synthesized
aaaatatgatgcagtatgtc

SEQ ID NO: 266367 - DNA, 20 bp, Artificial Sequence
  chemically synthesized
gaaaatatgatgcagtatgt

SEQ ID NO: 266368 - DNA, 20 bp, Artificial Sequence
  chemically synthesized
atttatgagaaaatatgatg

SEQ ID NO: 266369 - DNA, 20 bp, Artificial Sequence
  chemically synthesized
aaaaacattggagtatttat

SEQ ID NO: 266370 - DNA, 20 bp, Artificial Sequence
  chemically synthesized
ctgaaatgaaaaaaacattg

SEQ ID NO: 266371 - DNA, 20 bp, Artificial Sequence
  chemically synthesized
atctgaaatgaaaaaaacat

SEQ ID NO: 266372 - DNA, 20 bp, Artificial Sequence
  chemically synthesized
ctccaatgtttttttcattt

SEQ ID NO: 266373 - DNA, 20 bp, Artificial Sequence
  chemically synthesized
ttaggtatatagataattgt

SEQ ID NO: 266374 - DNA, 20 bp, Artificial Sequence
  chemically synthesized
aatatatgtatttaggtata

SEQ ID NO: 266375 - DNA, 20 bp, Artificial Sequence
  chemically synthesized
taaaatcaatatatgtattt

SEQ ID NO: 266376 - DNA, 20 bp, Artificial Sequence
  chemically synthesized
ataaaatcaatatatgtatt

SEQ ID NO: 266377 - DNA, 20 bp, Artificial Sequence
  chemically synthesized
atatacatttttatgtttga

SEQ ID NO: 266378 - DNA, 20 bp, Artificial Sequence
  chemically synthesized
tattgaaatttatcaaacta

SEQ ID NO: 266379 - DNA, 20 bp, Artificial Sequence
  chemically synthesized
acctagaaatttatatactg

SEQ ID NO: 266380 - DNA, 20 bp, Artificial Sequence
  chemically synthesized
aactacagtatataaatttc

SEQ ID NO: 266381 - DNA, 20 bp, Artificial Sequence
  chemically synthesized
actacagtatataaatttct

SEQ ID NO: 266382 - DNA, 20 bp, Artificial Sequence
  chemically synthesized
ttgaaatgcaagtaattacc

SEQ ID NO: 266383 - DNA, 20 bp, Artificial Sequence
  chemically synthesized
tttgggaagatttgaaatgc

SEQ ID NO: 266384 - DNA, 20 bp, Artificial Sequence
  chemically synthesized
ttgcatttcaaatcttccca

SEQ ID NO: 266385 - DNA, 20 bp, Artificial Sequence
  chemically synthesized
gcatttcaaatcttcccaaa

SEQ ID NO: 266386 - DNA, 20 bp, Artificial Sequence
  chemically synthesized
tagaatttcagctctttggg

SEQ ID NO: 266387 - DNA, 20 bp, Artificial Sequence
  chemically synthesized
ttatagaatttcagctcttt

SEQ ID NO: 266388 - DNA, 20 bp, Artificial Sequence
  chemically synthesized
gttatagaatttcagctctt

SEQ ID NO: 266389 - DNA, 20 bp, Artificial Sequence
  chemically synthesized
aatatagtgttatagaattt

SEQ ID NO: 266390 - DNA, 20 bp, Artificial Sequence
  chemically synthesized
aatgtataaatatagtgtta

SEQ ID NO: 266391 - DNA, 20 bp, Artificial Sequence
  chemically synthesized
tttgcaaaaatgtataaata

SEQ ID NO: 266392 - DNA, 20 bp, Artificial Sequence
  chemically synthesized
agaaagtcttatttaataag

SEQ ID NO: 266393 - DNA, 20 bp, Artificial Sequence
  chemically synthesized
ttgcaaactacttattaaat

SEQ ID NO: 266394 - DNA, 20 bp, Artificial Sequence
  chemically synthesized
aagagaaagtcttatttaat

SEQ ID NO: 266395 - DNA, 20 bp, Artificial Sequence
  chemically synthesized
tgtatgatttgatgaagaga

SEQ ID NO: 266396 - DNA, 20 bp, Artificial Sequence
  chemically synthesized
tttgtgtatgatttgatgaa

SEQ ID NO: 266397 - DNA, 20 bp, Artificial Sequence
  chemically synthesized
tatttgtgtatgatttgatg

SEQ ID NO: 266398 - DNA, 20 bp, Artificial Sequence
  chemically synthesized
tcaaatcatacacaaatata

SEQ ID NO: 266399 - DNA, 20 bp, Artificial Sequence
  chemically synthesized
aatatggaacttttgcgtga

SEQ ID NO: 266400 - DNA, 20 bp, Artificial Sequence
  chemically synthesized
atataaagtctatcacgcaa

SEQ ID NO: 266401 - DNA, 20 bp, Artificial Sequence
  chemically synthesized
cgcaaaagttccatattccc

SEQ ID NO: 266402 - DNA, 20 bp, Artificial Sequence
  chemically synthesized
ttaagaagaaccagggaata

SEQ ID NO: 266403 - DNA, 20 bp, Artificial Sequence
  chemically synthesized
ttactgtttaagaagaacca

SEQ ID NO: 266404 - DNA, 20 bp, Artificial Sequence
  chemically synthesized
attactgtttaagaagaacc

SEQ ID NO: 266405 - DNA, 20 bp, Artificial Sequence
  chemically synthesized
tattactgtttaagaagaac

SEQ ID NO: 266406 - DNA, 20 bp, Artificial Sequence
  chemically synthesized
attccctggttcttcttaaa

SEQ ID NO: 266407 - DNA, 20 bp, Artificial Sequence
  chemically synthesized
tatttatattactgtttaag

SEQ ID NO: 266408 - DNA, 20 bp, Artificial Sequence
  chemically synthesized
gcctatttatattactgttt

SEQ ID NO: 266409 - DNA, 20 bp, Artificial Sequence
  chemically synthesized
ttcttaaacagtaatataaa

SEQ ID NO: 266410 - DNA, 20 bp, Artificial Sequence
  chemically synthesized
tcttaaacagtaatataaat

SEQ ID NO: 266411 - DNA, 20 bp, Artificial Sequence
  chemically synthesized
gcatataaaattacaaaaat

SEQ ID NO: 266412 - DNA, 20 bp, Artificial Sequence
  chemically synthesized
catataaaattacaaaaatt

SEQ ID NO: 266413 - DNA, 20 bp, Artificial Sequence
  chemically synthesized
ttacaaaaattaggatatgt

SEQ ID NO: 266414 - DNA, 20 bp, Artificial Sequence
  chemically synthesized
catgaaaacaaatcattgca

SEQ ID NO: 266415 - DNA, 20 bp, Artificial Sequence
  chemically synthesized
tttgcaatgatttgttttca

SEQ ID NO: 266416 - DNA, 20 bp, Artificial Sequence
  chemically synthesized
atggcgtgatcatttcatta

SEQ ID NO: 266417 - DNA, 20 bp, Artificial Sequence
  chemically synthesized
acactgtgacaaaattcatt

SEQ ID NO: 266418 - DNA, 20 bp, Artificial Sequence
  chemically synthesized
gacactgtgacaaaattcat

SEQ ID NO: 266419 - DNA, 20 bp, Artificial Sequence
  chemically synthesized
tagcctaatgaattttgtca

SEQ ID NO: 266420 - DNA, 20 bp, Artificial Sequence
  chemically synthesized
tttgtcacagtgtctacaac

SEQ ID NO: 266421 - DNA, 20 bp, Artificial Sequence
  chemically synthesized
taacttgcttttgctagttg

SEQ ID NO: 266422 - DNA, 20 bp, Artificial Sequence
  chemically synthesized
acagtgtctacaactagcaa

SEQ ID NO: 266423 - DNA, 20 bp, Artificial Sequence
  chemically synthesized
tttgtttaacttgcttttgc

SEQ ID NO: 266424 - DNA, 20 bp, Artificial Sequence
  chemically synthesized
tgtctacaactagcaaaagc

SEQ ID NO: 266425 - DNA, 20 bp, Artificial Sequence
  chemically synthesized
aacaaacacacttgcacaac

SEQ ID NO: 266426 - DNA, 20 bp, Artificial Sequence
  chemically synthesized
tacctctttactggttgtgc

SEQ ID NO: 266427 - DNA, 20 bp, Artificial Sequence
  chemically synthesized
acacacttgcacaaccagta

SEQ ID NO: 266428 - DNA, 20 bp, Artificial Sequence
  chemically synthesized
acacttgcacaaccagtaaa

SEQ ID NO: 266429 - DNA, 20 bp, Artificial Sequence
  chemically synthesized
cacttgcacaaccagtaaag

SEQ ID NO: 266430 - DNA, 20 bp, Artificial Sequence
  chemically synthesized
gtgtttttttacctctttac

SEQ ID NO: 266431 - DNA, 20 bp, Artificial Sequence
  chemically synthesized
aaagaggtaaaaaaacaccc

SEQ ID NO: 266432 - DNA, 20 bp, Artificial Sequence
  chemically synthesized
tacatcttctgcacggtcta

SEQ ID NO: 266433 - DNA, 20 bp, Artificial Sequence
  chemically synthesized
gtacatcttctgcacggtct

SEQ ID NO: 266434 - DNA, 20 bp, Artificial Sequence
  chemically synthesized
aaaaaacaccctagaccgtg

SEQ ID NO: 266435 - DNA, 20 bp, Artificial Sequence
  chemically synthesized
tgtacatcttctgcacggtc

SEQ ID NO: 266436 - DNA, 20 bp, Artificial Sequence
  chemically synthesized
aaacaccctagaccgtgcag

SEQ ID NO: 266437 - DNA, 20 bp, Artificial Sequence
  chemically synthesized
ggtcttgtacatcttctgca

SEQ ID NO: 266438 - DNA, 20 bp, Artificial Sequence
  chemically synthesized
agaccgtgcagaagatgtac

SEQ ID NO: 266439 - DNA, 20 bp, Artificial Sequence
  chemically synthesized
agatgtacaagacctcattt

SEQ ID NO: 266440 - DNA, 20 bp, Artificial Sequence
  chemically synthesized
tggatcaaatatccaaaatg

SEQ ID NO: 266441 - DNA, 20 bp, Artificial Sequence
  chemically synthesized
gtggatcaaatatccaaaat

SEQ ID NO: 266442 - DNA, 20 bp, Artificial Sequence
  chemically synthesized
aatattgcttgtatgtaatg

SEQ ID NO: 266443 - DNA, 20 bp, Artificial Sequence
  chemically synthesized
atttgatccacattacatac

SEQ ID NO: 266444 - DNA, 20 bp, Artificial Sequence
  chemically synthesized
acatacaagcaatattgtat

SEQ ID NO: 266445 - DNA, 20 bp, Artificial Sequence
  chemically synthesized
tattgtatcagtactgcttt

SEQ ID NO: 266446 - DNA, 20 bp, Artificial Sequence
  chemically synthesized
ccgataaattttgccaaaag

SEQ ID NO: 266447 - DNA, 20 bp, Artificial Sequence
  chemically synthesized
ctaccgataaattttgccaa

SEQ ID NO: 266448 - DNA, 20 bp, Artificial Sequence
  chemically synthesized
ctgcttttggcaaaatttat

SEQ ID NO: 266449 - DNA, 20 bp, Artificial Sequence
  chemically synthesized
cttttggcaaaatttatcgg

SEQ ID NO: 266450 - DNA, 20 bp, Artificial Sequence
  chemically synthesized
acaagtcatccatcaacata

SEQ ID NO: 266451 - DNA, 20 bp, Artificial Sequence
  chemically synthesized
tcggtagtgctttatgttga

SEQ ID NO: 266452 - DNA, 20 bp, Artificial Sequence
  chemically synthesized
aaataaaaccaaaagcacac

SEQ ID NO: 266453 - DNA, 20 bp, Artificial Sequence
  chemically synthesized
atggatgacttgtgtgcttt

SEQ ID NO: 266454 - DNA, 20 bp, Artificial Sequence
  chemically synthesized
aaaaaaataaataaaaccaa

SEQ ID NO: 266455 - DNA, 20 bp, Artificial Sequence
  chemically synthesized
tttggttttatttatttttt

SEQ ID NO: 266456 - DNA, 20 bp, Artificial Sequence
  chemically synthesized
ttatttatttttttggcctt

SEQ ID NO: 266457 - DNA, 20 bp, Artificial Sequence
  chemically synthesized
aataacaaatagcatgctga

SEQ ID NO: 266458 - DNA, 20 bp, Artificial Sequence
  chemically synthesized
aaataacaaatagcatgctg

SEQ ID NO: 266459 - DNA, 20 bp, Artificial Sequence
  chemically synthesized
ctacagaaaaaaataacaaa

SEQ ID NO: 266460 - DNA, 20 bp, Artificial Sequence
  chemically synthesized
ctatttgttatttttttctg

SEQ ID NO: 266461 - DNA, 20 bp, Artificial Sequence
  chemically synthesized
tatttgttatttttttctgt

SEQ ID NO: 266462 - DNA, 20 bp, Artificial Sequence
  chemically synthesized
gtactttcaggggtcaccta

SEQ ID NO: 266463 - DNA, 20 bp, Artificial Sequence
  chemically synthesized
tttctgtaggtgacccctga

SEQ ID NO: 266464 - DNA, 20 bp, Artificial Sequence
  chemically synthesized
gtttacatacgtactttcag

SEQ ID NO: 266465 - DNA, 20 bp, Artificial Sequence
  chemically synthesized
agtttacatacgtactttca

SEQ ID NO: 266466 - DNA, 20 bp, Artificial Sequence
  chemically synthesized
cagtttacatacgtactttc

SEQ ID NO: 266467 - DNA, 20 bp, Artificial Sequence
  chemically synthesized
gcagtttacatacgtacttt

SEQ ID NO: 266468 - DNA, 20 bp, Artificial Sequence
  chemically synthesized
gaaagtacgtatgtaaactg

SEQ ID NO: 266469 - DNA, 20 bp, Artificial Sequence
  chemically synthesized
tacgtatgtaaactgcagca

SEQ ID NO: 266470 - DNA, 20 bp, Artificial Sequence
  chemically synthesized
taggactgcattctatgctg

SEQ ID NO: 266471 - DNA, 20 bp, Artificial Sequence
  chemically synthesized
gtaaactgcagcatagaatg

SEQ ID NO: 266472 - DNA, 20 bp, Artificial Sequence
  chemically synthesized
tgcagcatagaatgcagtcc

SEQ ID NO: 266473 - DNA, 20 bp, Artificial Sequence
  chemically synthesized
tttgctgccatagatattct

SEQ ID NO: 266474 - DNA, 20 bp, Artificial Sequence
  chemically synthesized
ttttgctgccatagatattc

SEQ ID NO: 266475 - DNA, 20 bp, Artificial Sequence
  chemically synthesized
atgcagtcctagaatatcta

SEQ ID NO: 266476 - DNA, 20 bp, Artificial Sequence
  chemically synthesized
cagtcctagaatatctatgg

SEQ ID NO: 266477 - DNA, 20 bp, Artificial Sequence
  chemically synthesized
tctctcatcttttgctgcca

SEQ ID NO: 266478 - DNA, 20 bp, Artificial Sequence
  chemically synthesized
tagaatatctatggcagcaa

SEQ ID NO: 266479 - DNA, 20 bp, Artificial Sequence
  chemically synthesized
tatctatggcagcaaaagat

SEQ ID NO: 266480 - DNA, 20 bp, Artificial Sequence
  chemically synthesized
tctatggcagcaaaagatga

SEQ ID NO: 266481 - DNA, 20 bp, Artificial Sequence
  chemically synthesized
tatggcagcaaaagatgaga

SEQ ID NO: 266482 - DNA, 20 bp, Artificial Sequence
  chemically synthesized
agcaaaagatgagagagaaa

SEQ ID NO: 266483 - DNA, 20 bp, Artificial Sequence
  chemically synthesized
caaaagatgagagagaaaaa

SEQ ID NO: 266484 - DNA, 20 bp, Artificial Sequence
  chemically synthesized
agatgagagagaaaaagaga

SEQ ID NO: 266485 - DNA, 20 bp, Artificial Sequence
  chemically synthesized
atgagagagaaaaagagaca

SEQ ID NO: 266486 - DNA, 20 bp, Artificial Sequence
  chemically synthesized
gagagagaaaaagagacaga

SEQ ID NO: 266487 - DNA, 20 bp, Artificial Sequence
  chemically synthesized
gagagaaaaagagacagaga

SEQ ID NO: 266488 - DNA, 20 bp, Artificial Sequence
  chemically synthesized
gaaaaagagacagagagaga

SEQ ID NO: 266489 - DNA, 20 bp, Artificial Sequence
  chemically synthesized
aaaagagacagagagagaca

SEQ ID NO: 266490 - DNA, 20 bp, Artificial Sequence
  chemically synthesized
aagagacagagagagacaga

SEQ ID NO: 266491 - DNA, 20 bp, Artificial Sequence
  chemically synthesized
gagacagagagagacagaga

SEQ ID NO: 266492 - DNA, 20 bp, Artificial Sequence
  chemically synthesized
cagagagagacagagagaga

SEQ ID NO: 266493 - DNA, 20 bp, Artificial Sequence
  chemically synthesized
gagagagacagagagagaca

SEQ ID NO: 266494 - DNA, 20 bp, Artificial Sequence
  chemically synthesized
gagacagagagagacagaga

SEQ ID NO: 266495 - DNA, 20 bp, Artificial Sequence
  chemically synthesized
agacagagagagacagagac

SEQ ID NO: 266496 - DNA, 20 bp, Artificial Sequence
  chemically synthesized
gacagagagagacagagacg

SEQ ID NO: 266497 - DNA, 20 bp, Artificial Sequence
  chemically synthesized
cagagagagacagagacggg

SEQ ID NO: 266498 - DNA, 20 bp, Artificial Sequence
  chemically synthesized
agagagagacagagacgggg

SEQ ID NO: 266499 - DNA, 20 bp, Artificial Sequence
  chemically synthesized
agagagacagagacggggag

SEQ ID NO: 266500 - DNA, 20 bp, Artificial Sequence
  chemically synthesized
gagacagagacggggaggag

SEQ ID NO: 266501 - DNA, 20 bp, Artificial Sequence
  chemically synthesized
tttaccactgattataatgg

SEQ ID NO: 266502 - DNA, 20 bp, Artificial Sequence
  chemically synthesized
attttaccactgattataat

SEQ ID NO: 266503 - DNA, 20 bp, Artificial Sequence
  chemically synthesized
cgtttatctcccattataat

SEQ ID NO: 266504 - DNA, 20 bp, Artificial Sequence
  chemically synthesized
aattttaccactgattataa

SEQ ID NO: 266505 - DNA, 20 bp, Artificial Sequence
  chemically synthesized
ttatctcccattataatcag

SEQ ID NO: 266506 - DNA, 20 bp, Artificial Sequence
  chemically synthesized
tgaatgccaaaatgtattta

SEQ ID NO: 266507 - DNA, 20 bp, Artificial Sequence
  chemically synthesized
atgaatgccaaaatgtattt

SEQ ID NO: 266508 - DNA, 20 bp, Artificial Sequence
  chemically synthesized
aaatttccttaaatacattt

SEQ ID NO: 266509 - DNA, 20 bp, Artificial Sequence
  chemically synthesized
cccacagcaaggttttcaaa

SEQ ID NO: 266510 - DNA, 20 bp, Artificial Sequence
  chemically synthesized
ccccacagcaaggttttcaa

SEQ ID NO: 266511 - DNA, 20 bp, Artificial Sequence
  chemically synthesized
tccttttgaaaaccttgctg

SEQ ID NO: 266512 - DNA, 20 bp, Artificial Sequence
  chemically synthesized
ccttttgaaaaccttgctgt

SEQ ID NO: 266513 - DNA, 20 bp, Artificial Sequence
  chemically synthesized
cttttgaaaaccttgctgtg

SEQ ID NO: 266514 - DNA, 20 bp, Artificial Sequence
  chemically synthesized
ggcaagtagaccccacagca

SEQ ID NO: 266515 - DNA, 20 bp, Artificial Sequence
  chemically synthesized
gggcaagtagaccccacagc

SEQ ID NO: 266516 - DNA, 20 bp, Artificial Sequence
  chemically synthesized
aaaggggcaagtagacccca

SEQ ID NO: 266517 - DNA, 20 bp, Artificial Sequence
  chemically synthesized
agtactctgaaaggggcaag

SEQ ID NO: 266518 - DNA, 20 bp, Artificial Sequence
  chemically synthesized
cgcagtactctgaaaggggc

SEQ ID NO: 266519 - DNA, 20 bp, Artificial Sequence
  chemically synthesized
tggggtctacttgccccttt

SEQ ID NO: 266520 - DNA, 20 bp, Artificial Sequence
  chemically synthesized
gggtctacttgcccctttca

SEQ ID NO: 266521 - DNA, 20 bp, Artificial Sequence
  chemically synthesized
gttgcgcagtactctgaaag

SEQ ID NO: 266522 - DNA, 20 bp, Artificial Sequence
  chemically synthesized
ggttgcgcagtactctgaaa

SEQ ID NO: 266523 - DNA, 20 bp, Artificial Sequence
  chemically synthesized
aggttgcgcagtactctgaa

SEQ ID NO: 266524 - DNA, 20 bp, Artificial Sequence
  chemically synthesized
aaggttgcgcagtactctga

SEQ ID NO: 266525 - DNA, 20 bp, Artificial Sequence
  chemically synthesized
ggtctcttgcgaaggttgcg

SEQ ID NO: 266526 - DNA, 20 bp, Artificial Sequence
  chemically synthesized
gagtactgcgcaaccttcgc

SEQ ID NO: 266527 - DNA, 20 bp, Artificial Sequence
  chemically synthesized
gtactgcgcaaccttcgcaa

SEQ ID NO: 266528 - DNA, 20 bp, Artificial Sequence
  chemically synthesized
tgctaaatggtctcttgcga

SEQ ID NO: 266529 - DNA, 20 bp, Artificial Sequence
  chemically synthesized
gtgctaaatggtctcttgcg

SEQ ID NO: 266530 - DNA, 20 bp, Artificial Sequence
  chemically synthesized
aaccttcgcaagagaccatt

SEQ ID NO: 266531 - DNA, 20 bp, Artificial Sequence
  chemically synthesized
aggtggaaacttgtgctaaa

SEQ ID NO: 266532 - DNA, 20 bp, Artificial Sequence
  chemically synthesized
cgcaagagaccatttagcac

SEQ ID NO: 266533 - DNA, 20 bp, Artificial Sequence
  chemically synthesized
tttagcacaagtttccacct

SEQ ID NO: 266534 - DNA, 20 bp, Artificial Sequence
  chemically synthesized
tagcacaagtttccaccttg

SEQ ID NO: 266535 - DNA, 20 bp, Artificial Sequence
  chemically synthesized
taggaagatctactccaagg

SEQ ID NO: 266536 - DNA, 20 bp, Artificial Sequence
  chemically synthesized
cacaagtttccaccttggag

SEQ ID NO: 266537 - DNA, 20 bp, Artificial Sequence
  chemically synthesized
aggtaggaagatctactcca

SEQ ID NO: 266538 - DNA, 20 bp, Artificial Sequence
  chemically synthesized
aaggtaggaagatctactcc

SEQ ID NO: 266539 - DNA, 20 bp, Artificial Sequence
  chemically synthesized
attaagactggaaaggtagg

SEQ ID NO: 266540 - DNA, 20 bp, Artificial Sequence
  chemically synthesized
agtagatcttcctacctttc

SEQ ID NO: 266541 - DNA, 20 bp, Artificial Sequence
  chemically synthesized
agaattaagactggaaaggt

SEQ ID NO: 266542 - DNA, 20 bp, Artificial Sequence
  chemically synthesized
cagaattaagactggaaagg

SEQ ID NO: 266543 - DNA, 20 bp, Artificial Sequence
  chemically synthesized
acacagaattaagactggaa

SEQ ID NO: 266544 - DNA, 20 bp, Artificial Sequence
  chemically synthesized
cacacagaattaagactgga

SEQ ID NO: 266545 - DNA, 20 bp, Artificial Sequence
  chemically synthesized
atttcacacagaattaagac

SEQ ID NO: 266546 - DNA, 20 bp, Artificial Sequence
  chemically synthesized
cagccatttcacacagaatt

SEQ ID NO: 266547 - DNA, 20 bp, Artificial Sequence
  chemically synthesized
agtcttaattctgtgtgaaa

SEQ ID NO: 266548 - DNA, 20 bp, Artificial Sequence
  chemically synthesized
cgatttgcagccatttcaca

SEQ ID NO: 266549 - DNA, 20 bp, Artificial Sequence
  chemically synthesized
agagctcaaccatcgatttg

SEQ ID NO: 266550 - DNA, 20 bp, Artificial Sequence
  chemically synthesized
gtgaaatggctgcaaatcga

SEQ ID NO: 266551 - DNA, 20 bp, Artificial Sequence
  chemically synthesized
atggctgcaaatcgatggtt

SEQ ID NO: 266552 - DNA, 20 bp, Artificial Sequence
  chemically synthesized
caaatcgatggttgagctct

SEQ ID NO: 266553 - DNA, 20 bp, Artificial Sequence
  chemically synthesized
gatggttgagctctgagatt

SEQ ID NO: 266554 - DNA, 20 bp, Artificial Sequence
  chemically synthesized
tagtagagccccaaatctca

SEQ ID NO: 266555 - DNA, 20 bp, Artificial Sequence
  chemically synthesized
atggttgagctctgagattt

SEQ ID NO: 266556 - DNA, 20 bp, Artificial Sequence
  chemically synthesized
tggttgagctctgagatttg

SEQ ID NO: 266557 - DNA, 20 bp, Artificial Sequence
  chemically synthesized
attagtagagccccaaatct

SEQ ID NO: 266558 - DNA, 20 bp, Artificial Sequence
  chemically synthesized
accactgcaggaaattagta

SEQ ID NO: 266559 - DNA, 20 bp, Artificial Sequence
  chemically synthesized
tgaccactgcaggaaattag

SEQ ID NO: 266560 - DNA, 20 bp, Artificial Sequence
  chemically synthesized
cggtgaccactgcaggaaat

SEQ ID NO: 266561 - DNA, 20 bp, Artificial Sequence
  chemically synthesized
ggggctctactaatttcctg

SEQ ID NO: 266562 - DNA, 20 bp, Artificial Sequence
  chemically synthesized
gctctactaatttcctgcag

SEQ ID NO: 266563 - DNA, 20 bp, Artificial Sequence
  chemically synthesized
caaaccgcggtgaccactgc

SEQ ID NO: 266564 - DNA, 20 bp, Artificial Sequence
  chemically synthesized
gcaaaccgcggtgaccactg

SEQ ID NO: 266565 - DNA, 20 bp, Artificial Sequence
  chemically synthesized
atttcctgcagtggtcaccg

SEQ ID NO: 266566 - DNA, 20 bp, Artificial Sequence
  chemically synthesized
gcaaacttgatggcaaaccg

SEQ ID NO: 266567 - DNA, 20 bp, Artificial Sequence
  chemically synthesized
ggtcaccgcggtttgccatc

SEQ ID NO: 266568 - DNA, 20 bp, Artificial Sequence
  chemically synthesized
tgaccaagcagcaaacttga

SEQ ID NO: 266569 - DNA, 20 bp, Artificial Sequence
  chemically synthesized
ttgccatcaagtttgctgct

SEQ ID NO: 266570 - DNA, 20 bp, Artificial Sequence
  chemically synthesized
ggactctacacgtgaccaag

SEQ ID NO: 266571 - DNA, 20 bp, Artificial Sequence
  chemically synthesized
ggtggactctacacgtgacc

SEQ ID NO: 266572 - DNA, 20 bp, Artificial Sequence
  chemically synthesized
gtttgctgcttggtcacgtg

SEQ ID NO: 266573 - DNA, 20 bp, Artificial Sequence
  chemically synthesized
ttgctgcttggtcacgtgta

SEQ ID NO: 266574 - DNA, 20 bp, Artificial Sequence
  chemically synthesized
tcacgtgtagagtccacctt

SEQ ID NO: 266575 - DNA, 20 bp, Artificial Sequence
  chemically synthesized
cacgtgtagagtccaccttt

SEQ ID NO: 266576 - DNA, 20 bp, Artificial Sequence
  chemically synthesized
gaatgacatacgcccaaagg

SEQ ID NO: 266577 - DNA, 20 bp, Artificial Sequence
  chemically synthesized
actgaatgacatacgcccaa

SEQ ID NO: 266578 - DNA, 20 bp, Artificial Sequence
  chemically synthesized
aactgaatgacatacgccca

SEQ ID NO: 266579 - DNA, 20 bp, Artificial Sequence
  chemically synthesized
acctttgggcgtatgtcatt

SEQ ID NO: 266580 - DNA, 20 bp, Artificial Sequence
  chemically synthesized
tggaatatagcgtttaaagg

SEQ ID NO: 266581 - DNA, 20 bp, Artificial Sequence
  chemically synthesized
tcatggaatatagcgtttaa

SEQ ID NO: 266582 - DNA, 20 bp, Artificial Sequence
  chemically synthesized
ctcatggaatatagcgttta

SEQ ID NO: 266583 - DNA, 20 bp, Artificial Sequence
  chemically synthesized
tatctcttgctcatggaata

SEQ ID NO: 266584 - DNA, 20 bp, Artificial Sequence
  chemically synthesized
ctttaaacgctatattccat

SEQ ID NO: 266585 - DNA, 20 bp, Artificial Sequence
  chemically synthesized
aaacgctatattccatgagc

SEQ ID NO: 266586 - DNA, 20 bp, Artificial Sequence
  chemically synthesized
acgctatattccatgagcaa

SEQ ID NO: 266587 - DNA, 20 bp, Artificial Sequence
  chemically synthesized
caagtcctatctcttgctca

SEQ ID NO: 266588 - DNA, 20 bp, Artificial Sequence
  chemically synthesized
tatattccatgagcaagaga

SEQ ID NO: 266589 - DNA, 20 bp, Artificial Sequence
  chemically synthesized
atattccatgagcaagagat

SEQ ID NO: 266590 - DNA, 20 bp, Artificial Sequence
  chemically synthesized
tgagcaagagataggacttg

SEQ ID NO: 266591 - DNA, 20 bp, Artificial Sequence
  chemically synthesized
caagagataggacttgaagt

SEQ ID NO: 266592 - DNA, 20 bp, Artificial Sequence
  chemically synthesized
cttcattaattactaacttc

SEQ ID NO: 266593 - DNA, 20 bp, Artificial Sequence
  chemically synthesized
cttgaagttagtaattaatg

SEQ ID NO: 266594 - DNA, 20 bp, Artificial Sequence
  chemically synthesized
ttgaagttagtaattaatga

SEQ ID NO: 266595 - DNA, 20 bp, Artificial Sequence
  chemically synthesized
gttagtaattaatgaaggtc

SEQ ID NO: 266596 - DNA, 20 bp, Artificial Sequence
  chemically synthesized
gtaattaatgaaggtcaaga

SEQ ID NO: 266597 - DNA, 20 bp, Artificial Sequence
  chemically synthesized
aatgaaggtcaagatagaaa

SEQ ID NO: 266598 - DNA, 20 bp, Artificial Sequence
  chemically synthesized
tgaaggtcaagatagaaaaa

SEQ ID NO: 266599 - DNA, 20 bp, Artificial Sequence
  chemically synthesized
aaggtcaagatagaaaaaga

SEQ ID NO: 266600 - DNA, 20 bp, Artificial Sequence
  chemically synthesized
gatagaaaaagagagccaaa

SEQ ID NO: 266601 - DNA, 20 bp, Artificial Sequence
  chemically synthesized
tagaaaaagagagccaaaca

SEQ ID NO: 266602 - DNA, 20 bp, Artificial Sequence
  chemically synthesized
acttgctcactcgctctgtt

SEQ ID NO: 266603 - DNA, 20 bp, Artificial Sequence
  chemically synthesized
aaaagagagccaaacagagc

SEQ ID NO: 266604 - DNA, 20 bp, Artificial Sequence
  chemically synthesized
gagagccaaacagagcgagt

SEQ ID NO: 266605 - DNA, 20 bp, Artificial Sequence
  chemically synthesized
gccaaacagagcgagtgagc

SEQ ID NO: 266606 - DNA, 20 bp, Artificial Sequence
  chemically synthesized
aacagagcgagtgagcaagt

SEQ ID NO: 266607 - DNA, 20 bp, Artificial Sequence
  chemically synthesized
gagcgagtgagcaagtgagc

SEQ ID NO: 266608 - DNA, 20 bp, Artificial Sequence
  chemically synthesized
cgagtgagcaagtgagcgag

SEQ ID NO: 266609 - DNA, 20 bp, Artificial Sequence
  chemically synthesized
agtgagcaagtgagcgagaa

SEQ ID NO: 266610 - DNA, 20 bp, Artificial Sequence
  chemically synthesized
agcaagtgagcgagaagagt

SEQ ID NO: 266611 - DNA, 20 bp, Artificial Sequence
  chemically synthesized
agtgagcgagaagagtgaga

SEQ ID NO: 266612 - DNA, 20 bp, Artificial Sequence
  chemically synthesized
tgagcgagaagagtgagaaa

SEQ ID NO: 266613 - DNA, 20 bp, Artificial Sequence
  chemically synthesized
agcgagaagagtgagaaaga

SEQ ID NO: 266614 - DNA, 20 bp, Artificial Sequence
  chemically synthesized
cgagaagagtgagaaagaga

SEQ ID NO: 266615 - DNA, 20 bp, Artificial Sequence
  chemically synthesized
agaagagtgagaaagagaga

SEQ ID NO: 266616 - DNA, 20 bp, Artificial Sequence
  chemically synthesized
aagagtgagaaagagagaga

SEQ ID NO: 266617 - DNA, 20 bp, Artificial Sequence
  chemically synthesized
gtgagaaagagagagagaga

SEQ ID NO: 266618 - DNA, 20 bp, Artificial Sequence
  chemically synthesized
gaaagagagagagagaaagt

SEQ ID NO: 266619 - DNA, 20 bp, Artificial Sequence
  chemically synthesized
gagagagaaagtaagaaaat

SEQ ID NO: 266620 - DNA, 20 bp, Artificial Sequence
  chemically synthesized
gagagaaagtaagaaaatga

SEQ ID NO: 266621 - DNA, 20 bp, Artificial Sequence
  chemically synthesized
gaaagtaagaaaatgagagc

SEQ ID NO: 266622 - DNA, 20 bp, Artificial Sequence
  chemically synthesized
aaaatgagagcaagcacatg

SEQ ID NO: 266623 - DNA, 20 bp, Artificial Sequence
  chemically synthesized
aagcacatgcagaaaataca

SEQ ID NO: 266624 - DNA, 20 bp, Artificial Sequence
  chemically synthesized
agcacatgcagaaaatacaa

SEQ ID NO: 266625 - DNA, 20 bp, Artificial Sequence
  chemically synthesized
gcacatgcagaaaatacaaa

SEQ ID NO: 266626 - DNA, 20 bp, Artificial Sequence
  chemically synthesized
acatgcagaaaatacaaagg

SEQ ID NO: 266627 - DNA, 20 bp, Artificial Sequence
  chemically synthesized
gtcctgttttatggaagttg

SEQ ID NO: 266628 - DNA, 20 bp, Artificial Sequence
  chemically synthesized
attttagtcctgttttatgg

SEQ ID NO: 266629 - DNA, 20 bp, Artificial Sequence
  chemically synthesized
aaaccacaacttccataaaa

SEQ ID NO: 266630 - DNA, 20 bp, Artificial Sequence
  chemically synthesized
aaccacaacttccataaaac

SEQ ID NO: 266631 - DNA, 20 bp, Artificial Sequence
  chemically synthesized
ttcattttagtcctgtttta

SEQ ID NO: 266632 - DNA, 20 bp, Artificial Sequence
  chemically synthesized
aatcacacgcattttcattt

SEQ ID NO: 266633 - DNA, 20 bp, Artificial Sequence
  chemically synthesized
aatgaaaatgcgtgtgattt

SEQ ID NO: 266634 - DNA, 20 bp, Artificial Sequence
  chemically synthesized
tgcgtgtgatttcagaaaaa

SEQ ID NO: 266635 - DNA, 20 bp, Artificial Sequence
  chemically synthesized
aaaaatagatcaccgtcctt

SEQ ID NO: 266636 - DNA, 20 bp, Artificial Sequence
  chemically synthesized
acatgcatcaaacttaagga

SEQ ID NO: 266637 - DNA, 20 bp, Artificial Sequence
  chemically synthesized
atagacatgcatcaaactta

SEQ ID NO: 266638 - DNA, 20 bp, Artificial Sequence
  chemically synthesized
aatagacatgcatcaaactt

SEQ ID NO: 266639 - DNA, 20 bp, Artificial Sequence
  chemically synthesized
gactaaataaacattttaaa

SEQ ID NO: 266640 - DNA, 20 bp, Artificial Sequence
  chemically synthesized
gtctatttaaaatgtttatt

SEQ ID NO: 266641 - DNA, 20 bp, Artificial Sequence
  chemically synthesized
ttaaaatgtttatttagtcc

SEQ ID NO: 266642 - DNA, 20 bp, Artificial Sequence
  chemically synthesized
taaaatgtttatttagtccg

SEQ ID NO: 266643 - DNA, 20 bp, Artificial Sequence
  chemically synthesized
aatgtttatttagtccgagg

SEQ ID NO: 266644 - DNA, 20 bp, Artificial Sequence
  chemically synthesized
atgtttatttagtccgagga

SEQ ID NO: 266645 - DNA, 20 bp, Artificial Sequence
  chemically synthesized
aaaacatccctgtccttcct

SEQ ID NO: 266646 - DNA, 20 bp, Artificial Sequence
  chemically synthesized
ttatttagtccgaggaagga

SEQ ID NO: 266647 - DNA, 20 bp, Artificial Sequence
  chemically synthesized
tatttagtccgaggaaggac

SEQ ID NO: 266648 - DNA, 20 bp, Artificial Sequence
  chemically synthesized
atttagtccgaggaaggaca

SEQ ID NO: 266649 - DNA, 20 bp, Artificial Sequence
  chemically synthesized
atagttgcaacaacatagtt

SEQ ID NO: 266650 - DNA, 20 bp, Artificial Sequence
  chemically synthesized
gatagttgcaacaacatagt

SEQ ID NO: 266651 - DNA, 20 bp, Artificial Sequence
  chemically synthesized
ttatgatagttgcaacaaca

SEQ ID NO: 266652 - DNA, 20 bp, Artificial Sequence
  chemically synthesized
ctaaatagaatatattatga

SEQ ID NO: 266653 - DNA, 20 bp, Artificial Sequence
  chemically synthesized
ctatcataatatattctatt

SEQ ID NO: 266654 - DNA, 20 bp, Artificial Sequence
  chemically synthesized
tataataaaataagactaaa

SEQ ID NO: 266655 - DNA, 20 bp, Artificial Sequence
  chemically synthesized
cagtaacgatataataaaat

SEQ ID NO: 266656 - DNA, 20 bp, Artificial Sequence
  chemically synthesized
tatatcgttactgaatttaa

SEQ ID NO: 266657 - DNA, 20 bp, Artificial Sequence
  chemically synthesized
cattccacaactattaaatt

SEQ ID NO: 266658 - DNA, 20 bp, Artificial Sequence
  chemically synthesized
gttactgaatttaatagttg

SEQ ID NO: 266659 - DNA, 20 bp, Artificial Sequence
  chemically synthesized
taatagttgtggaatgaact

SEQ ID NO: 266660 - DNA, 20 bp, Artificial Sequence
  chemically synthesized
tgacctcctgagcacatact

SEQ ID NO: 266661 - DNA, 20 bp, Artificial Sequence
  chemically synthesized
gaatgaactaagtatgtgct

SEQ ID NO: 266662 - DNA, 20 bp, Artificial Sequence
  chemically synthesized
aatgaactaagtatgtgctc

SEQ ID NO: 266663 - DNA, 20 bp, Artificial Sequence
  chemically synthesized
tgaactaagtatgtgctcag

SEQ ID NO: 266664 - DNA, 20 bp, Artificial Sequence
  chemically synthesized
gaactaagtatgtgctcagg

SEQ ID NO: 266665 - DNA, 20 bp, Artificial Sequence
  chemically synthesized
taagtatgtgctcaggaggt

SEQ ID NO: 266666 - DNA, 20 bp, Artificial Sequence
  chemically synthesized
cttcagctacctgacctcct

SEQ ID NO: 266667 - DNA, 20 bp, Artificial Sequence
  chemically synthesized
aagtatgtgctcaggaggtc

SEQ ID NO: 266668 - DNA, 20 bp, Artificial Sequence
  chemically synthesized
tatgtgctcaggaggtcagg

SEQ ID NO: 266669 - DNA, 20 bp, Artificial Sequence
  chemically synthesized
ctcaggaggtcaggtagctg

SEQ ID NO: 266670 - DNA, 20 bp, Artificial Sequence
  chemically synthesized
aggaatagaaaagtgttctt

SEQ ID NO: 266671 - DNA, 20 bp, Artificial Sequence
  chemically synthesized
agtgctaggaaggaatagaa

SEQ ID NO: 266672 - DNA, 20 bp, Artificial Sequence
  chemically synthesized
ttgaaagtgctaggaaggaa

SEQ ID NO: 266673 - DNA, 20 bp, Artificial Sequence
  chemically synthesized
aacacttttctattccttcc

SEQ ID NO: 266674 - DNA, 20 bp, Artificial Sequence
  chemically synthesized
ggaacttgaaagtgctagga

SEQ ID NO: 266675 - DNA, 20 bp, Artificial Sequence
  chemically synthesized
aggaacttgaaagtgctagg

SEQ ID NO: 266676 - DNA, 20 bp, Artificial Sequence
  chemically synthesized
aagaggaacttgaaagtgct

SEQ ID NO: 266677 - DNA, 20 bp, Artificial Sequence
  chemically synthesized
aaagaggaacttgaaagtgc

SEQ ID NO: 266678 - DNA, 20 bp, Artificial Sequence
  chemically synthesized
tattccttcctagcactttc

SEQ ID NO: 266679 - DNA, 20 bp, Artificial Sequence
  chemically synthesized
tgtaataaagaggaacttga

SEQ ID NO: 266680 - DNA, 20 bp, Artificial Sequence
  chemically synthesized
tgacactcaatgtaataaag

SEQ ID NO: 266681 - DNA, 20 bp, Artificial Sequence
  chemically synthesized
atgacactcaatgtaataaa

SEQ ID NO: 266682 - DNA, 20 bp, Artificial Sequence
  chemically synthesized
ttatgacactcaatgtaata

SEQ ID NO: 266683 - DNA, 20 bp, Artificial Sequence
  chemically synthesized
aagttcctctttattacatt

SEQ ID NO: 266684 - DNA, 20 bp, Artificial Sequence
  chemically synthesized
tttattacattgagtgtcat

SEQ ID NO: 266685 - DNA, 20 bp, Artificial Sequence
  chemically synthesized
attgagtgtcataagaaaaa

SEQ ID NO: 266686 - DNA, 20 bp, Artificial Sequence
  chemically synthesized
gacagaaaattcgtatgtgt

SEQ ID NO: 266687 - DNA, 20 bp, Artificial Sequence
  chemically synthesized
tacgaattttctgtcacata

SEQ ID NO: 266688 - DNA, 20 bp, Artificial Sequence
  chemically synthesized
ctcagtacctctgtatgtga

SEQ ID NO: 266689 - DNA, 20 bp, Artificial Sequence
  chemically synthesized
cgaattttctgtcacataca

SEQ ID NO: 266690 - DNA, 20 bp, Artificial Sequence
  chemically synthesized
gaattttctgtcacatacag

SEQ ID NO: 266691 - DNA, 20 bp, Artificial Sequence
  chemically synthesized
ctgtcacatacagaggtact

SEQ ID NO: 266692 - DNA, 20 bp, Artificial Sequence
  chemically synthesized
tgtcacatacagaggtactg

SEQ ID NO: 266693 - DNA, 20 bp, Artificial Sequence
  chemically synthesized
aggtcaggaagaacattcct

SEQ ID NO: 266694 - DNA, 20 bp, Artificial Sequence
  chemically synthesized
ctgtgacccggcaggtcagg

SEQ ID NO: 266695 - DNA, 20 bp, Artificial Sequence
  chemically synthesized
gaatgttcttcctgacctgc

SEQ ID NO: 266696 - DNA, 20 bp, Artificial Sequence
  chemically synthesized
cctctgtgacccggcaggtc

SEQ ID NO: 266697 - DNA, 20 bp, Artificial Sequence
  chemically synthesized
aatgttcttcctgacctgcc

SEQ ID NO: 266698 - DNA, 20 bp, Artificial Sequence
  chemically synthesized
acctctgtgacccggcaggt

SEQ ID NO: 266699 - DNA, 20 bp, Artificial Sequence
  chemically synthesized
ttcaacctctgtgacccggc

SEQ ID NO: 266700 - DNA, 20 bp, Artificial Sequence
  chemically synthesized
cttcaacctctgtgacccgg

SEQ ID NO: 266701 - DNA, 20 bp, Artificial Sequence
  chemically synthesized
cttcctgacctgccgggtca

SEQ ID NO: 266702 - DNA, 20 bp, Artificial Sequence
  chemically synthesized
tcctgacctgccgggtcaca

SEQ ID NO: 266703 - DNA, 20 bp, Artificial Sequence
  chemically synthesized
taacttcaacctctgtgacc

SEQ ID NO: 266704 - DNA, 20 bp, Artificial Sequence
  chemically synthesized
cctgacctgccgggtcacag

SEQ ID NO: 266705 - DNA, 20 bp, Artificial Sequence
  chemically synthesized
ctgccgggtcacagaggttg

SEQ ID NO: 266706 - DNA, 20 bp, Artificial Sequence
  chemically synthesized
gaggttgaagttaaataact

SEQ ID NO: 266707 - DNA, 20 bp, Artificial Sequence
  chemically synthesized
ctttttgaataatagggtct

SEQ ID NO: 266708 - DNA, 20 bp, Artificial Sequence
  chemically synthesized
tcaaggctttttgaataata

SEQ ID NO: 266709 - DNA, 20 bp, Artificial Sequence
  chemically synthesized
ttcaaggctttttgaataat

SEQ ID NO: 266710 - DNA, 20 bp, Artificial Sequence
  chemically synthesized
cttcaaggctttttgaataa

SEQ ID NO: 266711 - DNA, 20 bp, Artificial Sequence
  chemically synthesized
ctcagaccctattattcaaa

SEQ ID NO: 266712 - DNA, 20 bp, Artificial Sequence
  chemically synthesized
ctattattcaaaaagccttg

SEQ ID NO: 266713 - DNA, 20 bp, Artificial Sequence
  chemically synthesized
tattattcaaaaagccttga

SEQ ID NO: 266714 - DNA, 20 bp, Artificial Sequence
  chemically synthesized
cttatggtgaatttccttca

SEQ ID NO: 266715 - DNA, 20 bp, Artificial Sequence
  chemically synthesized
tcttatggtgaatttccttc

SEQ ID NO: 266716 - DNA, 20 bp, Artificial Sequence
  chemically synthesized
ccttgaaggaaattcaccat

SEQ ID NO: 266717 - DNA, 20 bp, Artificial Sequence
  chemically synthesized
tagtcagagatgtcatctta

SEQ ID NO: 266718 - DNA, 20 bp, Artificial Sequence
  chemically synthesized
tatcccttgatgtatagtca

SEQ ID NO: 266719 - DNA, 20 bp, Artificial Sequence
  chemically synthesized
attatcccttgatgtatagt

SEQ ID NO: 266720 - DNA, 20 bp, Artificial Sequence
  chemically synthesized
gacatctctgactatacatc

SEQ ID NO: 266721 - DNA, 20 bp, Artificial Sequence
  chemically synthesized
acatctctgactatacatca

SEQ ID NO: 266722 - DNA, 20 bp, Artificial Sequence
  chemically synthesized
cttcattatcccttgatgta

SEQ ID NO: 266723 - DNA, 20 bp, Artificial Sequence
  chemically synthesized
catctctgactatacatcaa

SEQ ID NO: 266724 - DNA, 20 bp, Artificial Sequence
  chemically synthesized
ctatacatcaagggataatg

SEQ ID NO: 266725 - DNA, 20 bp, Artificial Sequence
  chemically synthesized
atacatcaagggataatgaa

SEQ ID NO: 266726 - DNA, 20 bp, Artificial Sequence
  chemically synthesized
ggataatgaagagcacaata

SEQ ID NO: 266727 - DNA, 20 bp, Artificial Sequence
  chemically synthesized
gtctgaagcttattttgatg

SEQ ID NO: 266728 - DNA, 20 bp, Artificial Sequence
  chemically synthesized
atacagatccacatcaaaat

SEQ ID NO: 266729 - DNA, 20 bp, Artificial Sequence
  chemically synthesized
atccacatcaaaataagctt

SEQ ID NO: 266730 - DNA, 20 bp, Artificial Sequence
  chemically synthesized
tcaaaataagcttcagacaa

SEQ ID NO: 266731 - DNA, 20 bp, Artificial Sequence
  chemically synthesized
cacatttatgccattgtctg

SEQ ID NO: 266732 - DNA, 20 bp, Artificial Sequence
  chemically synthesized
acaatggcataaatgtgttt

SEQ ID NO: 266733 - DNA, 20 bp, Artificial Sequence
  chemically synthesized
caatggcataaatgtgtttt

SEQ ID NO: 266734 - DNA, 20 bp, Artificial Sequence
  chemically synthesized
aatggcataaatgtgttttg

SEQ ID NO: 266735 - DNA, 20 bp, Artificial Sequence
  chemically synthesized
gcataaatgtgttttgggga

SEQ ID NO: 266736 - DNA, 20 bp, Artificial Sequence
  chemically synthesized
aatgtgttttggggatagcc

SEQ ID NO: 266737 - DNA, 20 bp, Artificial Sequence
  chemically synthesized
aaaaactataaattcattcc

SEQ ID NO: 266738 - DNA, 20 bp, Artificial Sequence
  chemically synthesized
gaaaaactataaattcattc

SEQ ID NO: 266739 - DNA, 20 bp, Artificial Sequence
  chemically synthesized
gatagcctggaatgaattta

SEQ ID NO: 266740 - DNA, 20 bp, Artificial Sequence
  chemically synthesized
gaatttatagtttttcatta

SEQ ID NO: 266741 - DNA, 20 bp, Artificial Sequence
  chemically synthesized
aatttatagtttttcattaa

SEQ ID NO: 266742 - DNA, 20 bp, Artificial Sequence
  chemically synthesized
taaaggtatatcgtaatctg

SEQ ID NO: 266743 - DNA, 20 bp, Artificial Sequence
  chemically synthesized
tatgcctctgatattttcca

SEQ ID NO: 266744 - DNA, 20 bp, Artificial Sequence
  chemically synthesized
tcgtaatctgtggaaaatat

SEQ ID NO: 266745 - DNA, 20 bp, Artificial Sequence
  chemically synthesized
gtaatctgtggaaaatatca

SEQ ID NO: 266746 - DNA, 20 bp, Artificial Sequence
  chemically synthesized
taatctgtggaaaatatcag

SEQ ID NO: 266747 - DNA, 20 bp, Artificial Sequence
  chemically synthesized
aggcataaaaataaattgca

SEQ ID NO: 266748 - DNA, 20 bp, Artificial Sequence
  chemically synthesized
ataaaaataaattgcataga

SEQ ID NO: 266749 - DNA, 20 bp, Artificial Sequence
  chemically synthesized
tagaaagaaacataattttt

SEQ ID NO: 266750 - DNA, 20 bp, Artificial Sequence
  chemically synthesized
atttttgagttttctttaaa

SEQ ID NO: 266751 - DNA, 20 bp, Artificial Sequence
  chemically synthesized
gattagttgtttactattta

SEQ ID NO: 266752 - DNA, 20 bp, Artificial Sequence
  chemically synthesized
tgtttgataaatttattgat

SEQ ID NO: 266753 - DNA, 20 bp, Artificial Sequence
  chemically synthesized
aataaatttatcaaacattg

SEQ ID NO: 266754 - DNA, 20 bp, Artificial Sequence
  chemically synthesized
aataaaaaatgtttattgaa

SEQ ID NO: 266755 - DNA, 20 bp, Artificial Sequence
  chemically synthesized
taaaaaatgtttattgaaaa

SEQ ID NO: 266756 - DNA, 20 bp, Artificial Sequence
  chemically synthesized
aaaaatgtttattgaaaaga

SEQ ID NO: 266757 - DNA, 20 bp, Artificial Sequence
  chemically synthesized
taggtagagttgaattttaa

SEQ ID NO: 266758 - DNA, 20 bp, Artificial Sequence
  chemically synthesized
ttttcccaattaaataggta

SEQ ID NO: 266759 - DNA, 20 bp, Artificial Sequence
  chemically synthesized
tcttttcccaattaaatagg

SEQ ID NO: 266760 - DNA, 20 bp, Artificial Sequence
  chemically synthesized
ttcaactctacctatttaat

SEQ ID NO: 266761 - DNA, 20 bp, Artificial Sequence
  chemically synthesized
gtctcttttcccaattaaat

SEQ ID NO: 266762 - DNA, 20 bp, Artificial Sequence
  chemically synthesized
tcaactctacctatttaatt

SEQ ID NO: 266763 - DNA, 20 bp, Artificial Sequence
  chemically synthesized
tgtctcttttcccaattaaa

SEQ ID NO: 266764 - DNA, 20 bp, Artificial Sequence
  chemically synthesized
tctacctatttaattgggaa

SEQ ID NO: 266765 - DNA, 20 bp, Artificial Sequence
  chemically synthesized
tacctatttaattgggaaaa

SEQ ID NO: 266766 - DNA, 20 bp, Artificial Sequence
  chemically synthesized
ggaaaagagacatcatcaaa

SEQ ID NO: 266767 - DNA, 20 bp, Artificial Sequence
  chemically synthesized
atcatcaaatagaaacaatg

SEQ ID NO: 266768 - DNA, 20 bp, Artificial Sequence
  chemically synthesized
agaaacaatgtagtgtctat

SEQ ID NO: 266769 - DNA, 20 bp, Artificial Sequence
  chemically synthesized
gaaacaatgtagtgtctata

SEQ ID NO: 266770 - DNA, 20 bp, Artificial Sequence
  chemically synthesized
taatacgcaaatatacctta

SEQ ID NO: 266771 - DNA, 20 bp, Artificial Sequence
  chemically synthesized
ttccgataaaagggtatgag

SEQ ID NO: 266772 - DNA, 20 bp, Artificial Sequence
  chemically synthesized
attccgataaaagggtatga

SEQ ID NO: 266773 - DNA, 20 bp, Artificial Sequence
  chemically synthesized
tgattccgataaaagggtat

SEQ ID NO: 266774 - DNA, 20 bp, Artificial Sequence
  chemically synthesized
cacctctcatacccttttat

SEQ ID NO: 266775 - DNA, 20 bp, Artificial Sequence
  chemically synthesized
aaaaaatgattccgataaaa

SEQ ID NO: 266776 - DNA, 20 bp, Artificial Sequence
  chemically synthesized
taaaaaatgattccgataaa

SEQ ID NO: 266777 - DNA, 20 bp, Artificial Sequence
  chemically synthesized
ttaaaaaatgattccgataa

SEQ ID NO: 266778 - DNA, 20 bp, Artificial Sequence
  chemically synthesized
tttatcggaatcatttttta

SEQ ID NO: 266779 - DNA, 20 bp, Artificial Sequence
  chemically synthesized
cggaatcattttttaaagaa

SEQ ID NO: 266780 - DNA, 20 bp, Artificial Sequence
  chemically synthesized
cattttttaaagaaaagatt

SEQ ID NO: 266781 - DNA, 20 bp, Artificial Sequence
  chemically synthesized
agattaagttccccttgaaa

SEQ ID NO: 266782 - DNA, 20 bp, Artificial Sequence
  chemically synthesized
gccctgtcttctttttcaag

SEQ ID NO: 266783 - DNA, 20 bp, Artificial Sequence
  chemically synthesized
tgccctgtcttctttttcaa

SEQ ID NO: 266784 - DNA, 20 bp, Artificial Sequence
  chemically synthesized
atgccctgtcttctttttca

SEQ ID NO: 266785 - DNA, 20 bp, Artificial Sequence
  chemically synthesized
ttaagttccccttgaaaaag

SEQ ID NO: 266786 - DNA, 20 bp, Artificial Sequence
  chemically synthesized
gatgccctgtcttctttttc

SEQ ID NO: 266787 - DNA, 20 bp, Artificial Sequence
  chemically synthesized
gttccccttgaaaaagaaga

SEQ ID NO: 266788 - DNA, 20 bp, Artificial Sequence
  chemically synthesized
ttccccttgaaaaagaagac

SEQ ID NO: 266789 - DNA, 20 bp, Artificial Sequence
  chemically synthesized
tccccttgaaaaagaagaca

SEQ ID NO: 266790 - DNA, 20 bp, Artificial Sequence
  chemically synthesized
aagaagacagggcatcctaa

SEQ ID NO: 266791 - DNA, 20 bp, Artificial Sequence
  chemically synthesized
agacagggcatcctaacagt

SEQ ID NO: 266792 - DNA, 20 bp, Artificial Sequence
  chemically synthesized
tagtctcaaaactgactgtt

SEQ ID NO: 266793 - DNA, 20 bp, Artificial Sequence
  chemically synthesized
ttagtctcaaaactgactgt

SEQ ID NO: 266794 - DNA, 20 bp, Artificial Sequence
  chemically synthesized
gcatcctaacagtcagtttt

SEQ ID NO: 266795 - DNA, 20 bp, Artificial Sequence
  chemically synthesized
acagtcagttttgagactaa

SEQ ID NO: 266796 - DNA, 20 bp, Artificial Sequence
  chemically synthesized
tcagttttgagactaaaaga

SEQ ID NO: 266797 - DNA, 20 bp, Artificial Sequence
  chemically synthesized
aggctttgggttctttcttt

SEQ ID NO: 266798 - DNA, 20 bp, Artificial Sequence
  chemically synthesized
agactaaaagaaagaaccca

SEQ ID NO: 266799 - DNA, 20 bp, Artificial Sequence
  chemically synthesized
aaaagaaagaacccaaagcc

SEQ ID NO: 266800 - DNA, 20 bp, Artificial Sequence
  chemically synthesized
ctacatgtaaactaggcttt

SEQ ID NO: 266801 - DNA, 20 bp, Artificial Sequence
  chemically synthesized
actacatgtaaactaggctt

SEQ ID NO: 266802 - DNA, 20 bp, Artificial Sequence
  chemically synthesized
tttttaactacatgtaaact

SEQ ID NO: 266803 - DNA, 20 bp, Artificial Sequence
  chemically synthesized
atttttaactacatgtaaac

SEQ ID NO: 266804 - DNA, 20 bp, Artificial Sequence
  chemically synthesized
cccaaagcctagtttacatg

SEQ ID NO: 266805 - DNA, 20 bp, Artificial Sequence
  chemically synthesized
gtagttaaaaatgaaaacct

SEQ ID NO: 266806 - DNA, 20 bp, Artificial Sequence
  chemically synthesized
gttgggcttatgtaaagctg

SEQ ID NO: 266807 - DNA, 20 bp, Artificial Sequence
  chemically synthesized
tgttgggcttatgtaaagct

SEQ ID NO: 266808 - DNA, 20 bp, Artificial Sequence
  chemically synthesized
tgaaaacctcagctttacat

SEQ ID NO: 266809 - DNA, 20 bp, Artificial Sequence
  chemically synthesized
cttaatgttgggcttatgta

SEQ ID NO: 266810 - DNA, 20 bp, Artificial Sequence
  chemically synthesized
ctttacataagcccaacatt

SEQ ID NO: 266811 - DNA, 20 bp, Artificial Sequence
  chemically synthesized
tggtaattagtcttaatgtt

SEQ ID NO: 266812 - DNA, 20 bp, Artificial Sequence
  chemically synthesized
ttggtaattagtcttaatgt

SEQ ID NO: 266813 - DNA, 20 bp, Artificial Sequence
  chemically synthesized
caacattaagactaattacc

SEQ ID NO: 266814 - DNA, 20 bp, Artificial Sequence
  chemically synthesized
catatccaaatcttggtaat

SEQ ID NO: 266815 - DNA, 20 bp, Artificial Sequence
  chemically synthesized
taagactaattaccaagatt

SEQ ID NO: 266816 - DNA, 20 bp, Artificial Sequence
  chemically synthesized
cctatgccatatccaaatct

SEQ ID NO: 266817 - DNA, 20 bp, Artificial Sequence
  chemically synthesized
taattaccaagatttggata

SEQ ID NO: 266818 - DNA, 20 bp, Artificial Sequence
  chemically synthesized
accaagatttggatatggca

SEQ ID NO: 266819 - DNA, 20 bp, Artificial Sequence
  chemically synthesized
ccaagatttggatatggcat

SEQ ID NO: 266820 - DNA, 20 bp, Artificial Sequence
  chemically synthesized
tatggcataggcaaaaaaat

SEQ ID NO: 266821 - DNA, 20 bp, Artificial Sequence
  chemically synthesized
aggcaaaaaaatcagctgac

SEQ ID NO: 266822 - DNA, 20 bp, Artificial Sequence
  chemically synthesized
atgaacacctgaaatccagt

SEQ ID NO: 266823 - DNA, 20 bp, Artificial Sequence
  chemically synthesized
aaaatcagctgactggattt

SEQ ID NO: 266824 - DNA, 20 bp, Artificial Sequence
  chemically synthesized
aaatcagctgactggatttc

SEQ ID NO: 266825 - DNA, 20 bp, Artificial Sequence
  chemically synthesized
ctgaatgaacacctgaaatc

SEQ ID NO: 266826 - DNA, 20 bp, Artificial Sequence
  chemically synthesized
ctggatttcaggtgttcatt

SEQ ID NO: 266827 - DNA, 20 bp, Artificial Sequence
  chemically synthesized
atttcaggtgttcattcaga

SEQ ID NO: 266828 - DNA, 20 bp, Artificial Sequence
  chemically synthesized
tttcaggtgttcattcagat

SEQ ID NO: 266829 - DNA, 20 bp, Artificial Sequence
  chemically synthesized
atctgacactatcattcatt

SEQ ID NO: 266830 - DNA, 20 bp, Artificial Sequence
  chemically synthesized
cagatgggctaaatgaatga

SEQ ID NO: 266831 - DNA, 20 bp, Artificial Sequence
  chemically synthesized
ggctaaatgaatgatagtgt

SEQ ID NO: 266832 - DNA, 20 bp, Artificial Sequence
  chemically synthesized
tgtcagattgttctttgtgt

SEQ ID NO: 266833 - DNA, 20 bp, Artificial Sequence
  chemically synthesized
acattcttgtgtctaacaca

SEQ ID NO: 266834 - DNA, 20 bp, Artificial Sequence
  chemically synthesized
ttgttctttgtgttagacac

SEQ ID NO: 266835 - DNA, 20 bp, Artificial Sequence
  chemically synthesized
ttgtgttagacacaagaatg

SEQ ID NO: 266836 - DNA, 20 bp, Artificial Sequence
  chemically synthesized
atttctgcctttgtcaatgg

SEQ ID NO: 266837 - DNA, 20 bp, Artificial Sequence
  chemically synthesized
atgtagtaccaccattgaca

SEQ ID NO: 266838 - DNA, 20 bp, Artificial Sequence
  chemically synthesized
tgtagtaccaccattgacaa

SEQ ID NO: 266839 - DNA, 20 bp, Artificial Sequence
  chemically synthesized
caaatttctgcctttgtcaa

SEQ ID NO: 266840 - DNA, 20 bp, Artificial Sequence
  chemically synthesized
agtaccaccattgacaaagg

SEQ ID NO: 266841 - DNA, 20 bp, Artificial Sequence
  chemically synthesized
tatgatttcaaaataaatct

SEQ ID NO: 266842 - DNA, 20 bp, Artificial Sequence
  chemically synthesized
tccgttcagaaagatattcc

SEQ ID NO: 266843 - DNA, 20 bp, Artificial Sequence
  chemically synthesized
tcttggaatatctttctgaa

SEQ ID NO: 266844 - DNA, 20 bp, Artificial Sequence
  chemically synthesized
caatgtaaactccgttcaga

SEQ ID NO: 266845 - DNA, 20 bp, Artificial Sequence
  chemically synthesized
ttggaatatctttctgaacg

SEQ ID NO: 266846 - DNA, 20 bp, Artificial Sequence
  chemically synthesized
tacccaatgtaaactccgtt

SEQ ID NO: 266847 - DNA, 20 bp, Artificial Sequence
  chemically synthesized
tttctgaacggagtttacat

SEQ ID NO: 266848 - DNA, 20 bp, Artificial Sequence
  chemically synthesized
ttctgaacggagtttacatt

SEQ ID NO: 266849 - DNA, 20 bp, Artificial Sequence
  chemically synthesized
tacattgggtataattaact

SEQ ID NO: 266850 - DNA, 20 bp, Artificial Sequence
  chemically synthesized
gggtataattaactgagtga

SEQ ID NO: 266851 - DNA, 20 bp, Artificial Sequence
  chemically synthesized
ttctgttcaaatccatcact

SEQ ID NO: 266852 - DNA, 20 bp, Artificial Sequence
  chemically synthesized
aactgagtgatggatttgaa

SEQ ID NO: 266853 - DNA, 20 bp, Artificial Sequence
  chemically synthesized
gagtgatggatttgaacaga

SEQ ID NO: 266854 - DNA, 20 bp, Artificial Sequence
  chemically synthesized
gatggatttgaacagaaagt

SEQ ID NO: 266855 - DNA, 20 bp, Artificial Sequence
  chemically synthesized
ttgaacagaaagtcagatta

SEQ ID NO: 266856 - DNA, 20 bp, Artificial Sequence
  chemically synthesized
tggaaatgaatgattttgaa

SEQ ID NO: 266857 - DNA, 20 bp, Artificial Sequence
  chemically synthesized
aatggaaatgaatgattttg

SEQ ID NO: 266858 - DNA, 20 bp, Artificial Sequence
  chemically synthesized
aaatcattcatttccattca

SEQ ID NO: 266859 - DNA, 20 bp, Artificial Sequence
  chemically synthesized
aatcattcatttccattcaa

SEQ ID NO: 266860 - DNA, 20 bp, Artificial Sequence
  chemically synthesized
atcattcatttccattcaaa

SEQ ID NO: 266861 - DNA, 20 bp, Artificial Sequence
  chemically synthesized
tcattcatttccattcaaag

SEQ ID NO: 266862 - DNA, 20 bp, Artificial Sequence
  chemically synthesized
tccttccttccccctttgaa

SEQ ID NO: 266863 - DNA, 20 bp, Artificial Sequence
  chemically synthesized
cattcatttccattcaaagg

SEQ ID NO: 266864 - DNA, 20 bp, Artificial Sequence
  chemically synthesized
tcatttccattcaaaggggg

SEQ ID NO: 266865 - DNA, 20 bp, Artificial Sequence
  chemically synthesized
catttccattcaaaggggga

SEQ ID NO: 266866 - DNA, 20 bp, Artificial Sequence
  chemically synthesized
ttccattcaaagggggaagg

SEQ ID NO: 266867 - DNA, 20 bp, Artificial Sequence
  chemically synthesized
tccattcaaagggggaagga

SEQ ID NO: 266868 - DNA, 20 bp, Artificial Sequence
  chemically synthesized
caaagggggaaggaaggaaa

SEQ ID NO: 266869 - DNA, 20 bp, Artificial Sequence
  chemically synthesized
aaagggggaaggaaggaaaa

SEQ ID NO: 266870 - DNA, 20 bp, Artificial Sequence
  chemically synthesized
aagggggaaggaaggaaaaa

SEQ ID NO: 266871 - DNA, 20 bp, Artificial Sequence
  chemically synthesized
gggaaggaaggaaaaaggga

SEQ ID NO: 266872 - DNA, 20 bp, Artificial Sequence
  chemically synthesized
gaaggaaaaagggaaagata

SEQ ID NO: 266873 - DNA, 20 bp, Artificial Sequence
  chemically synthesized
aaggaaaaagggaaagataa

SEQ ID NO: 266874 - DNA, 20 bp, Artificial Sequence
  chemically synthesized
gaaaaagggaaagataaagg

SEQ ID NO: 266875 - DNA, 20 bp, Artificial Sequence
  chemically synthesized
aaaaagggaaagataaagga

SEQ ID NO: 266876 - DNA, 20 bp, Artificial Sequence
  chemically synthesized
aagggaaagataaaggaagg

SEQ ID NO: 266877 - DNA, 20 bp, Artificial Sequence
  chemically synthesized
gaaagataaaggaaggaaga

SEQ ID NO: 266878 - DNA, 20 bp, Artificial Sequence
  chemically synthesized
aaagataaaggaaggaagaa

SEQ ID NO: 266879 - DNA, 20 bp, Artificial Sequence
  chemically synthesized
aggattgttttactcttatt

SEQ ID NO: 266880 - DNA, 20 bp, Artificial Sequence
  chemically synthesized
tactaaggacgtcttaataa

SEQ ID NO: 266881 - DNA, 20 bp, Artificial Sequence
  chemically synthesized
gatactaaggacgtcttaat

SEQ ID NO: 266882 - DNA, 20 bp, Artificial Sequence
  chemically synthesized
tactcttattaagacgtcct

SEQ ID NO: 266883 - DNA, 20 bp, Artificial Sequence
  chemically synthesized
ctttgtcctaaaagatacta

SEQ ID NO: 266884 - DNA, 20 bp, Artificial Sequence
  chemically synthesized
tctttgtcctaaaagatact

SEQ ID NO: 266885 - DNA, 20 bp, Artificial Sequence
  chemically synthesized
aagacgtccttagtatcttt

SEQ ID NO: 266886 - DNA, 20 bp, Artificial Sequence
  chemically synthesized
agacgtccttagtatctttt

SEQ ID NO: 266887 - DNA, 20 bp, Artificial Sequence
  chemically synthesized
ttcaatcatctttgtcctaa

SEQ ID NO: 266888 - DNA, 20 bp, Artificial Sequence
  chemically synthesized
ccttagtatcttttaggaca

SEQ ID NO: 266889 - DNA, 20 bp, Artificial Sequence
  chemically synthesized
ttttaggacaaagatgattg

SEQ ID NO: 266890 - DNA, 20 bp, Artificial Sequence
  chemically synthesized
acaaagatgattgaagtaac

SEQ ID NO: 266891 - DNA, 20 bp, Artificial Sequence
  chemically synthesized
gtaatgtccaaattgtacac

SEQ ID NO: 266892 - DNA, 20 bp, Artificial Sequence
  chemically synthesized
gaagtaactggtgtacaatt

SEQ ID NO: 266893 - DNA, 20 bp, Artificial Sequence
  chemically synthesized
ggtagcaaataaaatatgaa

SEQ ID NO: 266894 - DNA, 20 bp, Artificial Sequence
  chemically synthesized
catattttatttgctacctt

SEQ ID NO: 266895 - DNA, 20 bp, Artificial Sequence
  chemically synthesized
aaaagaagacgtgcttaagg

SEQ ID NO: 266896 - DNA, 20 bp, Artificial Sequence
  chemically synthesized
gcaaaaagaagacgtgctta

SEQ ID NO: 266897 - DNA, 20 bp, Artificial Sequence
  chemically synthesized
agcaaaaagaagacgtgctt

SEQ ID NO: 266898 - DNA, 20 bp, Artificial Sequence
  chemically synthesized
aaagaaaccccagcaaaaag

SEQ ID NO: 266899 - DNA, 20 bp, Artificial Sequence
  chemically synthesized
taagcacgtcttctttttgc

SEQ ID NO: 266900 - DNA, 20 bp, Artificial Sequence
  chemically synthesized
aagcacgtcttctttttgct

SEQ ID NO: 266901 - DNA, 20 bp, Artificial Sequence
  chemically synthesized
agcacgtcttctttttgctg

SEQ ID NO: 266902 - DNA, 20 bp, Artificial Sequence
  chemically synthesized
gaaaaagaaaccccagcaaa

SEQ ID NO: 266903 - DNA, 20 bp, Artificial Sequence
  chemically synthesized
aatcagagaaaaagaaaccc

SEQ ID NO: 266904 - DNA, 20 bp, Artificial Sequence
  chemically synthesized
ttttggatgaatcagagaaa

SEQ ID NO: 266905 - DNA, 20 bp, Artificial Sequence
  chemically synthesized
acacacttttggatgaatca

SEQ ID NO: 266906 - DNA, 20 bp, Artificial Sequence
  chemically synthesized
tgacacacttttggatgaat

SEQ ID NO: 266907 - DNA, 20 bp, Artificial Sequence
  chemically synthesized
tttttctctgattcatccaa

SEQ ID NO: 266908 - DNA, 20 bp, Artificial Sequence
  chemically synthesized
cattcaggctgacacacttt

SEQ ID NO: 266909 - DNA, 20 bp, Artificial Sequence
  chemically synthesized
tgattcatccaaaagtgtgt

SEQ ID NO: 266910 - DNA, 20 bp, Artificial Sequence
  chemically synthesized
catcacaaagtggatcattc

SEQ ID NO: 266911 - DNA, 20 bp, Artificial Sequence
  chemically synthesized
acatcacaaagtggatcatt

SEQ ID NO: 266912 - DNA, 20 bp, Artificial Sequence
  chemically synthesized
atgtggaccacatcacaaag

SEQ ID NO: 266913 - DNA, 20 bp, Artificial Sequence
  chemically synthesized
gaatgatccactttgtgatg

SEQ ID NO: 266914 - DNA, 20 bp, Artificial Sequence
  chemically synthesized
agaatgtggaccacatcaca

SEQ ID NO: 266915 - DNA, 20 bp, Artificial Sequence
  chemically synthesized
ttgtgatgtggtccacattc

SEQ ID NO: 266916 - DNA, 20 bp, Artificial Sequence
  chemically synthesized
ggaaacttttgaccagaatg

SEQ ID NO: 266917 - DNA, 20 bp, Artificial Sequence
  chemically synthesized
gtggtccacattctggtcaa

SEQ ID NO: 266918 - DNA, 20 bp, Artificial Sequence
  chemically synthesized
aacacatggaaacttttgac

SEQ ID NO: 266919 - DNA, 20 bp, Artificial Sequence
  chemically synthesized
taaggaataccagaaacaca

SEQ ID NO: 266920 - DNA, 20 bp, Artificial Sequence
  chemically synthesized
caaaagtttccatgtgtttc

SEQ ID NO: 266921 - DNA, 20 bp, Artificial Sequence
  chemically synthesized
tctgtacaattaaggaatac

SEQ ID NO: 266922 - DNA, 20 bp, Artificial Sequence
  chemically synthesized
ggtatgtctctgtacaatta

SEQ ID NO: 266923 - DNA, 20 bp, Artificial Sequence
  chemically synthesized
tctggtattccttaattgta

SEQ ID NO: 266924 - DNA, 20 bp, Artificial Sequence
  chemically synthesized
tggtatgtctctgtacaatt

SEQ ID NO: 266925 - DNA, 20 bp, Artificial Sequence
  chemically synthesized
tggtattccttaattgtaca

SEQ ID NO: 266926 - DNA, 20 bp, Artificial Sequence
  chemically synthesized
aattgtacagagacatacca

SEQ ID NO: 266927 - DNA, 20 bp, Artificial Sequence
  chemically synthesized
ttgtctaaccaataatgcca

SEQ ID NO: 266928 - DNA, 20 bp, Artificial Sequence
  chemically synthesized
gagacataccatggcattat

SEQ ID NO: 266929 - DNA, 20 bp, Artificial Sequence
  chemically synthesized
cataccatggcattattggt

SEQ ID NO: 266930 - DNA, 20 bp, Artificial Sequence
  chemically synthesized
ttggttagacaatattctta

SEQ ID NO: 266931 - DNA, 20 bp, Artificial Sequence
  chemically synthesized
gaacataggaaaaattcttt

SEQ ID NO: 266932 - DNA, 20 bp, Artificial Sequence
  chemically synthesized
ttttaaacattttagaacat

SEQ ID NO: 266933 - DNA, 20 bp, Artificial Sequence
  chemically synthesized
cttttaaacattttagaaca

SEQ ID NO: 266934 - DNA, 20 bp, Artificial Sequence
  chemically synthesized
ttgttgtcttttaaacattt

SEQ ID NO: 266935 - DNA, 20 bp, Artificial Sequence
  chemically synthesized
ctatgttctaaaatgtttaa

SEQ ID NO: 266936 - DNA, 20 bp, Artificial Sequence
  chemically synthesized
atgtttaaaagacaacaata

SEQ ID NO: 266937 - DNA, 20 bp, Artificial Sequence
  chemically synthesized
gacaacaataaagtttcatt

SEQ ID NO: 266938 - DNA, 20 bp, Artificial Sequence
  chemically synthesized
caataaagtttcattgagat

SEQ ID NO: 266939 - DNA, 20 bp, Artificial Sequence
  chemically synthesized
gtttcattgagattagtttt

SEQ ID NO: 266940 - DNA, 20 bp, Artificial Sequence
  chemically synthesized
tcattgagattagttttaag

SEQ ID NO: 266941 - DNA, 20 bp, Artificial Sequence
  chemically synthesized
ttttaagtggtattttcata

SEQ ID NO: 266942 - DNA, 20 bp, Artificial Sequence
  chemically synthesized
tagaatattgcgtaaatata

SEQ ID NO: 266943 - DNA, 20 bp, Artificial Sequence
  chemically synthesized
aatatattaaaatattgtta

SEQ ID NO: 266944 - DNA, 20 bp, Artificial Sequence
  chemically synthesized
attgttatagatattgaatt

SEQ ID NO: 266945 - DNA, 20 bp, Artificial Sequence
  chemically synthesized
tgttatagatattgaattaa

SEQ ID NO: 266946 - DNA, 20 bp, Artificial Sequence
  chemically synthesized
atagatattgaattaagagc

SEQ ID NO: 266947 - DNA, 20 bp, Artificial Sequence
  chemically synthesized
tctcaattctacgtatatgc

SEQ ID NO: 266948 - DNA, 20 bp, Artificial Sequence
  chemically synthesized
attaagagccagcatatacg

SEQ ID NO: 266949 - DNA, 20 bp, Artificial Sequence
  chemically synthesized
gccagcatatacgtagaatt

SEQ ID NO: 266950 - DNA, 20 bp, Artificial Sequence
  chemically synthesized
aattgagaaattttcaaaca

SEQ ID NO: 266951 - DNA, 20 bp, Artificial Sequence
  chemically synthesized
ttcaaacacagaattgttac

SEQ ID NO: 266952 - DNA, 20 bp, Artificial Sequence
  chemically synthesized
gaaaaagatacataagtgac

SEQ ID NO: 266953 - DNA, 20 bp, Artificial Sequence
  chemically synthesized
gtcacgagaaaaagatacat

SEQ ID NO: 266954 - DNA, 20 bp, Artificial Sequence
  chemically synthesized
cccttctctgtcacgagaaa

SEQ ID NO: 266955 - DNA, 20 bp, Artificial Sequence
  chemically synthesized
tatgtatctttttctcgtga

SEQ ID NO: 266956 - DNA, 20 bp, Artificial Sequence
  chemically synthesized
tgtatctttttctcgtgaca

SEQ ID NO: 266957 - DNA, 20 bp, Artificial Sequence
  chemically synthesized
tttacacccttctctgtcac

SEQ ID NO: 266958 - DNA, 20 bp, Artificial Sequence
  chemically synthesized
atctttttctcgtgacagag

SEQ ID NO: 266959 - DNA, 20 bp, Artificial Sequence
  chemically synthesized
tctttttctcgtgacagaga

SEQ ID NO: 266960 - DNA, 20 bp, Artificial Sequence
  chemically synthesized
ctttttctcgtgacagagaa

SEQ ID NO: 266961 - DNA, 20 bp, Artificial Sequence
  chemically synthesized
cgtgacagagaagggtgtaa

SEQ ID NO: 266962 - DNA, 20 bp, Artificial Sequence
  chemically synthesized
gagaagggtgtaaaagcttc

SEQ ID NO: 266963 - DNA, 20 bp, Artificial Sequence
  chemically synthesized
ttggtaagagaaaaggctag

SEQ ID NO: 266964 - DNA, 20 bp, Artificial Sequence
  chemically synthesized
ttgttggtaagagaaaaggc

SEQ ID NO: 266965 - DNA, 20 bp, Artificial Sequence
  chemically synthesized
tcttttgttggtaagagaaa

SEQ ID NO: 266966 - DNA, 20 bp, Artificial Sequence
  chemically synthesized
atcttttgttggtaagagaa

SEQ ID NO: 266967 - DNA, 20 bp, Artificial Sequence
  chemically synthesized
gttaaatcttttgttggtaa

SEQ ID NO: 266968 - DNA, 20 bp, Artificial Sequence
  chemically synthesized
tggttaaatcttttgttggt

SEQ ID NO: 266969 - DNA, 20 bp, Artificial Sequence
  chemically synthesized
gccttttctcttaccaacaa

SEQ ID NO: 266970 - DNA, 20 bp, Artificial Sequence
  chemically synthesized
agagtggttaaatcttttgt

SEQ ID NO: 266971 - DNA, 20 bp, Artificial Sequence
  chemically synthesized
tcacctcccgagcagaagag

SEQ ID NO: 266972 - DNA, 20 bp, Artificial Sequence
  chemically synthesized
gatttaaccactcttctgct

SEQ ID NO: 266973 - DNA, 20 bp, Artificial Sequence
  chemically synthesized
ctgtcacctcccgagcagaa

SEQ ID NO: 266974 - DNA, 20 bp, Artificial Sequence
  chemically synthesized
atttaaccactcttctgctc

SEQ ID NO: 266975 - DNA, 20 bp, Artificial Sequence
  chemically synthesized
agctgtcacctcccgagcag

SEQ ID NO: 266976 - DNA, 20 bp, Artificial Sequence
  chemically synthesized
ttaaccactcttctgctcgg

SEQ ID NO: 266977 - DNA, 20 bp, Artificial Sequence
  chemically synthesized
taaccactcttctgctcggg

SEQ ID NO: 266978 - DNA, 20 bp, Artificial Sequence
  chemically synthesized
gatagctgtcacctcccgag

SEQ ID NO: 266979 - DNA, 20 bp, Artificial Sequence
  chemically synthesized
ctggatagctgtcacctccc

SEQ ID NO: 266980 - DNA, 20 bp, Artificial Sequence
  chemically synthesized
ctcttctgctcgggaggtga

SEQ ID NO: 266981 - DNA, 20 bp, Artificial Sequence
  chemically synthesized
ctcgggaggtgacagctatc

SEQ ID NO: 266982 - DNA, 20 bp, Artificial Sequence
  chemically synthesized
tcttctgaatagtaactgga

SEQ ID NO: 266983 - DNA, 20 bp, Artificial Sequence
  chemically synthesized
tcagtcttctgaatagtaac

SEQ ID NO: 266984 - DNA, 20 bp, Artificial Sequence
  chemically synthesized
acagctatccagttactatt

SEQ ID NO: 266985 - DNA, 20 bp, Artificial Sequence
  chemically synthesized
gctatccagttactattcag

SEQ ID NO: 266986 - DNA, 20 bp, Artificial Sequence
  chemically synthesized
gataaactcagtcttctgaa

SEQ ID NO: 266987 - DNA, 20 bp, Artificial Sequence
  chemically synthesized
cagttactattcagaagact

SEQ ID NO: 266988 - DNA, 20 bp, Artificial Sequence
  chemically synthesized
acgttggtggaagataaact

SEQ ID NO: 266989 - DNA, 20 bp, Artificial Sequence
  chemically synthesized
caagaaggagacgttggtgg

SEQ ID NO: 266990 - DNA, 20 bp, Artificial Sequence
  chemically synthesized
gggcaagaaggagacgttgg

SEQ ID NO: 266991 - DNA, 20 bp, Artificial Sequence
  chemically synthesized
tttgggcaagaaggagacgt

SEQ ID NO: 266992 - DNA, 20 bp, Artificial Sequence
  chemically synthesized
aaacagttttgggcaagaag

SEQ ID NO: 266993 - DNA, 20 bp, Artificial Sequence
  chemically synthesized
gaaaacagttttgggcaaga

SEQ ID NO: 266994 - DNA, 20 bp, Artificial Sequence
  chemically synthesized
tgaaaacagttttgggcaag

SEQ ID NO: 266995 - DNA, 20 bp, Artificial Sequence
  chemically synthesized
ccttgaaaacagttttgggc

SEQ ID NO: 266996 - DNA, 20 bp, Artificial Sequence
  chemically synthesized
gaggccttgaaaacagtttt

SEQ ID NO: 266997 - DNA, 20 bp, Artificial Sequence
  chemically synthesized
agaggccttgaaaacagttt

SEQ ID NO: 266998 - DNA, 20 bp, Artificial Sequence
  chemically synthesized
tcttgcccaaaactgttttc

SEQ ID NO: 266999 - DNA, 20 bp, Artificial Sequence
  chemically synthesized
cttgcccaaaactgttttca

SEQ ID NO: 267000 - DNA, 20 bp, Artificial Sequence
  chemically synthesized
ggtaggagaggccttgaaaa

SEQ ID NO: 267001 - DNA, 20 bp, Artificial Sequence
  chemically synthesized
gagtatcacagaggtaggag

SEQ ID NO: 267002 - DNA, 20 bp, Artificial Sequence
  chemically synthesized
agagtatcacagaggtagga

SEQ ID NO: 267003 - DNA, 20 bp, Artificial Sequence
  chemically synthesized
gaagagtatcacagaggtag

SEQ ID NO: 267004 - DNA, 20 bp, Artificial Sequence
  chemically synthesized
ctgaagagtatcacagaggt

SEQ ID NO: 267005 - DNA, 20 bp, Artificial Sequence
  chemically synthesized
cctgaagagtatcacagagg

SEQ ID NO: 267006 - DNA, 20 bp, Artificial Sequence
  chemically synthesized
gcacctgaagagtatcacag

SEQ ID NO: 267007 - DNA, 20 bp, Artificial Sequence
  chemically synthesized
tgcacctgaagagtatcaca

SEQ ID NO: 267008 - DNA, 20 bp, Artificial Sequence
  chemically synthesized
ggtgcacctgaagagtatca

SEQ ID NO: 267009 - DNA, 20 bp, Artificial Sequence
  chemically synthesized
cctacctctgtgatactctt

SEQ ID NO: 267010 - DNA, 20 bp, Artificial Sequence
  chemically synthesized
ctacctctgtgatactcttc

SEQ ID NO: 267011 - DNA, 20 bp, Artificial Sequence
  chemically synthesized
aaacagaaggtgcacctgaa

SEQ ID NO: 267012 - DNA, 20 bp, Artificial Sequence
  chemically synthesized
agaaacagaaggtgcacctg

SEQ ID NO: 267013 - DNA, 20 bp, Artificial Sequence
  chemically synthesized
aaaagagattgagaaacaga

SEQ ID NO: 267014 - DNA, 20 bp, Artificial Sequence
  chemically synthesized
aaaaagagattgagaaacag

SEQ ID NO: 267015 - DNA, 20 bp, Artificial Sequence
  chemically synthesized
ctcaaaaagagattgagaaa

SEQ ID NO: 267016 - DNA, 20 bp, Artificial Sequence
  chemically synthesized
aggctactcaaaaagagatt

SEQ ID NO: 267017 - DNA, 20 bp, Artificial Sequence
  chemically synthesized
ctgtttctcaatctcttttt

SEQ ID NO: 267018 - DNA, 20 bp, Artificial Sequence
  chemically synthesized
tttcacaggctactcaaaaa

SEQ ID NO: 267019 - DNA, 20 bp, Artificial Sequence
  chemically synthesized
tttctcaatctctttttgag

SEQ ID NO: 267020 - DNA, 20 bp, Artificial Sequence
  chemically synthesized
cttttcacaggctactcaaa

SEQ ID NO: 267021 - DNA, 20 bp, Artificial Sequence
  chemically synthesized
ctttttgagtagcctgtgaa

SEQ ID NO: 267022 - DNA, 20 bp, Artificial Sequence
  chemically synthesized
tttttgagtagcctgtgaaa

SEQ ID NO: 267023 - DNA, 20 bp, Artificial Sequence
  chemically synthesized
gtcaatgctctccttttcac

SEQ ID NO: 267024 - DNA, 20 bp, Artificial Sequence
  chemically synthesized
tttgagtagcctgtgaaaag

SEQ ID NO: 267025 - DNA, 20 bp, Artificial Sequence
  chemically synthesized
ggtcaatgctctccttttca

SEQ ID NO: 267026 - DNA, 20 bp, Artificial Sequence
  chemically synthesized
tgagtagcctgtgaaaagga

SEQ ID NO: 267027 - DNA, 20 bp, Artificial Sequence
  chemically synthesized
aaaggagagcattgaccttc

SEQ ID NO: 267028 - DNA, 20 bp, Artificial Sequence
  chemically synthesized
gactacaagacattacttga

SEQ ID NO: 267029 - DNA, 20 bp, Artificial Sequence
  chemically synthesized
agactacaagacattacttg

SEQ ID NO: 267030 - DNA, 20 bp, Artificial Sequence
  chemically synthesized
gaccttcaagtaatgtcttg

SEQ ID NO: 267031 - DNA, 20 bp, Artificial Sequence
  chemically synthesized
gcattaaatcttaagactac

SEQ ID NO: 267032 - DNA, 20 bp, Artificial Sequence
  chemically synthesized
aagtaatgtcttgtagtctt

SEQ ID NO: 267033 - DNA, 20 bp, Artificial Sequence
  chemically synthesized
tttcataagcattaaatctt

SEQ ID NO: 267034 - DNA, 20 bp, Artificial Sequence
  chemically synthesized
aagatttaatgcttatgaaa

SEQ ID NO: 267035 - DNA, 20 bp, Artificial Sequence
  chemically synthesized
catacagaaagccgtttcat

SEQ ID NO: 267036 - DNA, 20 bp, Artificial Sequence
  chemically synthesized
ttatgaaacggctttctgta

SEQ ID NO: 267037 - DNA, 20 bp, Artificial Sequence
  chemically synthesized
aatcatagtaaccatacaga

SEQ ID NO: 267038 - DNA, 20 bp, Artificial Sequence
  chemically synthesized
gcagaatcatagtaaccata

SEQ ID NO: 267039 - DNA, 20 bp, Artificial Sequence
  chemically synthesized
tttaaaaccttgcagaatca

SEQ ID NO: 267040 - DNA, 20 bp, Artificial Sequence
  chemically synthesized
tatggttactatgattctgc

SEQ ID NO: 267041 - DNA, 20 bp, Artificial Sequence
  chemically synthesized
atggttactatgattctgca

SEQ ID NO: 267042 - DNA, 20 bp, Artificial Sequence
  chemically synthesized
gttataggtttaaaaccttg

SEQ ID NO: 267043 - DNA, 20 bp, Artificial Sequence
  chemically synthesized
attcattaatacatagttat

SEQ ID NO: 267044 - DNA, 20 bp, Artificial Sequence
  chemically synthesized
gattcattaatacatagtta

SEQ ID NO: 267045 - DNA, 20 bp, Artificial Sequence
  chemically synthesized
tttcatgattcattaataca

SEQ ID NO: 267046 - DNA, 20 bp, Artificial Sequence
  chemically synthesized
aagcttcagtatatatggta

SEQ ID NO: 267047 - DNA, 20 bp, Artificial Sequence
  chemically synthesized
caatgaagcttcagtatata

SEQ ID NO: 267048 - DNA, 20 bp, Artificial Sequence
  chemically synthesized
aaaccataccatatatactg

SEQ ID NO: 267049 - DNA, 20 bp, Artificial Sequence
  chemically synthesized
gttacccaacaatgaagctt

SEQ ID NO: 267050 - DNA, 20 bp, Artificial Sequence
  chemically synthesized
atatactgaagcttcattgt

SEQ ID NO: 267051 - DNA, 20 bp, Artificial Sequence
  chemically synthesized
tatactgaagcttcattgtt

SEQ ID NO: 267052 - DNA, 20 bp, Artificial Sequence
  chemically synthesized
ttcatagttacccaacaatg

SEQ ID NO: 267053 - DNA, 20 bp, Artificial Sequence
  chemically synthesized
tatgtacatatatatgttca

SEQ ID NO: 267054 - DNA, 20 bp, Artificial Sequence
  chemically synthesized
atgaacatatatatgtacat

SEQ ID NO: 267055 - DNA, 20 bp, Artificial Sequence
  chemically synthesized
aaatatttataatgaaaaat

SEQ ID NO: 267056 - DNA, 20 bp, Artificial Sequence
  chemically synthesized
taaataaatataaatatatt

SEQ ID NO: 267057 - DNA, 20 bp, Artificial Sequence
  chemically synthesized
atttatttaatttatacatg

SEQ ID NO: 267058 - DNA, 20 bp, Artificial Sequence
  chemically synthesized
tatttaatttatacatgtag

SEQ ID NO: 267059 - DNA, 20 bp, Artificial Sequence
  chemically synthesized
atttatacatgtagtggcta

SEQ ID NO: 267060 - DNA, 20 bp, Artificial Sequence
  chemically synthesized
tttatacatgtagtggctaa

SEQ ID NO: 267061 - DNA, 20 bp, Artificial Sequence
  chemically synthesized
atacatgtagtggctaaagg

SEQ ID NO: 267062 - DNA, 20 bp, Artificial Sequence
  chemically synthesized
gattttcaaatatctgcctt

SEQ ID NO: 267063 - DNA, 20 bp, Artificial Sequence
  chemically synthesized
ggcagtttcttatttgtgga

SEQ ID NO: 267064 - DNA, 20 bp, Artificial Sequence
  chemically synthesized
ttgaaaatccatccacaaat

SEQ ID NO: 267065 - DNA, 20 bp, Artificial Sequence
  chemically synthesized
taagggcagtttcttatttg

SEQ ID NO: 267066 - DNA, 20 bp, Artificial Sequence
  chemically synthesized
cacaaataagaaactgccct

SEQ ID NO: 267067 - DNA, 20 bp, Artificial Sequence
  chemically synthesized
actgtagaattttctaaggg

SEQ ID NO: 267068 - DNA, 20 bp, Artificial Sequence
  chemically synthesized
catactgtagaattttctaa

SEQ ID NO: 267069 - DNA, 20 bp, Artificial Sequence
  chemically synthesized
ccatactgtagaattttcta

SEQ ID NO: 267070 - DNA, 20 bp, Artificial Sequence
  chemically synthesized
accatactgtagaattttct

SEQ ID NO: 267071 - DNA, 20 bp, Artificial Sequence
  chemically synthesized
actgcccttagaaaattcta

SEQ ID NO: 267072 - DNA, 20 bp, Artificial Sequence
  chemically synthesized
ccttagaaaattctacagta

SEQ ID NO: 267073 - DNA, 20 bp, Artificial Sequence
  chemically synthesized
aatacagtagcaccatactg

SEQ ID NO: 267074 - DNA, 20 bp, Artificial Sequence
  chemically synthesized
tccctgctgcagaaatacag

SEQ ID NO: 267075 - DNA, 20 bp, Artificial Sequence
  chemically synthesized
aaatccctgctgcagaaata

SEQ ID NO: 267076 - DNA, 20 bp, Artificial Sequence
  chemically synthesized
atggtgctactgtatttctg

SEQ ID NO: 267077 - DNA, 20 bp, Artificial Sequence
  chemically synthesized
gtgctactgtatttctgcag

SEQ ID NO: 267078 - DNA, 20 bp, Artificial Sequence
  chemically synthesized
tgctactgtatttctgcagc

SEQ ID NO: 267079 - DNA, 20 bp, Artificial Sequence
  chemically synthesized
gctactgtatttctgcagca

SEQ ID NO: 267080 - DNA, 20 bp, Artificial Sequence
  chemically synthesized
ggctaaaaaaatccctgctg

SEQ ID NO: 267081 - DNA, 20 bp, Artificial Sequence
  chemically synthesized
ttctgcagcagggatttttt

SEQ ID NO: 267082 - DNA, 20 bp, Artificial Sequence
  chemically synthesized
cagggatttttttagccttt

SEQ ID NO: 267083 - DNA, 20 bp, Artificial Sequence
  chemically synthesized
aaaagatccatggcactaaa

SEQ ID NO: 267084 - DNA, 20 bp, Artificial Sequence
  chemically synthesized
aaaaagatccatggcactaa

SEQ ID NO: 267085 - DNA, 20 bp, Artificial Sequence
  chemically synthesized
tttttagccttttagtgcca

SEQ ID NO: 267086 - DNA, 20 bp, Artificial Sequence
  chemically synthesized
acagatgccaaaaagatcca

SEQ ID NO: 267087 - DNA, 20 bp, Artificial Sequence
  chemically synthesized
tttagtgccatggatctttt

SEQ ID NO: 267088 - DNA, 20 bp, Artificial Sequence
  chemically synthesized
aagcttcaacagatgccaaa

SEQ ID NO: 267089 - DNA, 20 bp, Artificial Sequence
  chemically synthesized
gatctttttggcatctgttg

SEQ ID NO: 267090 - DNA, 20 bp, Artificial Sequence
  chemically synthesized
aatgggtttttaagcttcaa

SEQ ID NO: 267091 - DNA, 20 bp, Artificial Sequence
  chemically synthesized
tattatgagaatgggttttt

SEQ ID NO: 267092 - DNA, 20 bp, Artificial Sequence
  chemically synthesized
aaaagcattattatgagaat

SEQ ID NO: 267093 - DNA, 20 bp, Artificial Sequence
  chemically synthesized
taaaagcattattatgagaa

SEQ ID NO: 267094 - DNA, 20 bp, Artificial Sequence
  chemically synthesized
gcatttaaaagcattattat

SEQ ID NO: 267095 - DNA, 20 bp, Artificial Sequence
  chemically synthesized
attttgttttatgcatttaa

SEQ ID NO: 267096 - DNA, 20 bp, Artificial Sequence
  chemically synthesized
aatgcataaaacaaaataca

SEQ ID NO: 267097 - DNA, 20 bp, Artificial Sequence
  chemically synthesized
atgcataaaacaaaatacat

SEQ ID NO: 267098 - DNA, 20 bp, Artificial Sequence
  chemically synthesized
atgtgttgcacattgtattt

SEQ ID NO: 267099 - DNA, 20 bp, Artificial Sequence
  chemically synthesized
ttttttaaatatttgtgatg

SEQ ID NO: 267100 - DNA, 20 bp, Artificial Sequence
  chemically synthesized
atcttgttaattaacatatt

SEQ ID NO: 267101 - DNA, 20 bp, Artificial Sequence
  chemically synthesized
gatcttgttaattaacatat

SEQ ID NO: 267102 - DNA, 20 bp, Artificial Sequence
  chemically synthesized
ttcctaatatgttaattaac

SEQ ID NO: 267103 - DNA, 20 bp, Artificial Sequence
  chemically synthesized
atatgttaattaacaagatc

SEQ ID NO: 267104 - DNA, 20 bp, Artificial Sequence
  chemically synthesized
taattaacaagatctagcat

SEQ ID NO: 267105 - DNA, 20 bp, Artificial Sequence
  chemically synthesized
aattaacaagatctagcatc

SEQ ID NO: 267106 - DNA, 20 bp, Artificial Sequence
  chemically synthesized
ttatcctaaagacctgatgc

SEQ ID NO: 267107 - DNA, 20 bp, Artificial Sequence
  chemically synthesized
aagatctagcatcaggtctt

SEQ ID NO: 267108 - DNA, 20 bp, Artificial Sequence
  chemically synthesized
agatctagcatcaggtcttt

SEQ ID NO: 267109 - DNA, 20 bp, Artificial Sequence
  chemically synthesized
actacattgaaattatccta

SEQ ID NO: 267110 - DNA, 20 bp, Artificial Sequence
  chemically synthesized
tctttaggataatttcaatg

SEQ ID NO: 267111 - DNA, 20 bp, Artificial Sequence
  chemically synthesized
aatttcaatgtagtgatgac

SEQ ID NO: 267112 - DNA, 20 bp, Artificial Sequence
  chemically synthesized
gtagtgatgacgagcataac

SEQ ID NO: 267113 - DNA, 20 bp, Artificial Sequence
  chemically synthesized
ttgtacatacttaaaaatac

SEQ ID NO: 267114 - DNA, 20 bp, Artificial Sequence
  chemically synthesized
cgagcataactggtattttt

SEQ ID NO: 267115 - DNA, 20 bp, Artificial Sequence
  chemically synthesized
ttttaagtatgtacaatgtc

SEQ ID NO: 267116 - DNA, 20 bp, Artificial Sequence
  chemically synthesized
gatacttttataacgtgttc

SEQ ID NO: 267117 - DNA, 20 bp, Artificial Sequence
  chemically synthesized
atgtctggaacacgttataa

SEQ ID NO: 267118 - DNA, 20 bp, Artificial Sequence
  chemically synthesized
tttgtcactaatagaaatga

SEQ ID NO: 267119 - DNA, 20 bp, Artificial Sequence
  chemically synthesized
aaagtatctgtcatttctat

SEQ ID NO: 267120 - DNA, 20 bp, Artificial Sequence
  chemically synthesized
acccatgactttgtcactaa

SEQ ID NO: 267121 - DNA, 20 bp, Artificial Sequence
  chemically synthesized
tgtcatttctattagtgaca

SEQ ID NO: 267122 - DNA, 20 bp, Artificial Sequence
  chemically synthesized
ttctattagtgacaaagtca

SEQ ID NO: 267123 - DNA, 20 bp, Artificial Sequence
  chemically synthesized
tctattagtgacaaagtcat

SEQ ID NO: 267124 - DNA, 20 bp, Artificial Sequence
  chemically synthesized
gtcatgggtatctctattgc

SEQ ID NO: 267125 - DNA, 20 bp, Artificial Sequence
  chemically synthesized
agcaacaaactccagcaata

SEQ ID NO: 267126 - DNA, 20 bp, Artificial Sequence
  chemically synthesized
catgggtatctctattgctg

SEQ ID NO: 267127 - DNA, 20 bp, Artificial Sequence
  chemically synthesized
tgagcaacaaactccagcaa

SEQ ID NO: 267128 - DNA, 20 bp, Artificial Sequence
  chemically synthesized
aaaatgtgagcaacaaactc

SEQ ID NO: 267129 - DNA, 20 bp, Artificial Sequence
  chemically synthesized
agttttttcagttaaaatgt

SEQ ID NO: 267130 - DNA, 20 bp, Artificial Sequence
  chemically synthesized
ccaaaagtaagcagtttttt

SEQ ID NO: 267131 - DNA, 20 bp, Artificial Sequence
  chemically synthesized
caattaaaaccaaaagtaag

SEQ ID NO: 267132 - DNA, 20 bp, Artificial Sequence
  chemically synthesized
ctgaaaaaactgcttacttt

SEQ ID NO: 267133 - DNA, 20 bp, Artificial Sequence
  chemically synthesized
attcaattaaaaccaaaagt

SEQ ID NO: 267134 - DNA, 20 bp, Artificial Sequence
  chemically synthesized
ttgtattcaattaaaaccaa

SEQ ID NO: 267135 - DNA, 20 bp, Artificial Sequence
  chemically synthesized
gttttaattgaatacaaata

SEQ ID NO: 267136 - DNA, 20 bp, Artificial Sequence
  chemically synthesized
attgaatacaaataaagata

SEQ ID NO: 267137 - DNA, 20 bp, Artificial Sequence
  chemically synthesized
ataaagttttcccccaatcc

SEQ ID NO: 267138 - DNA, 20 bp, Artificial Sequence
  chemically synthesized
ggtctgtgaacttggattgg

SEQ ID NO: 267139 - DNA, 20 bp, Artificial Sequence
  chemically synthesized
aggtctgtgaacttggattg

SEQ ID NO: 267140 - DNA, 20 bp, Artificial Sequence
  chemically synthesized
aaggtctgtgaacttggatt

SEQ ID NO: 267141 - DNA, 20 bp, Artificial Sequence
  chemically synthesized
taaggtctgtgaacttggat

SEQ ID NO: 267142 - DNA, 20 bp, Artificial Sequence
  chemically synthesized
tttcccccaatccaagttca

SEQ ID NO: 267143 - DNA, 20 bp, Artificial Sequence
  chemically synthesized
agaaataaggtctgtgaact

SEQ ID NO: 267144 - DNA, 20 bp, Artificial Sequence
  chemically synthesized
agggtatgtggatagaaata

SEQ ID NO: 267145 - DNA, 20 bp, Artificial Sequence
  chemically synthesized
tagggtatgtggatagaaat

SEQ ID NO: 267146 - DNA, 20 bp, Artificial Sequence
  chemically synthesized
tttagtctagggtatgtgga

SEQ ID NO: 267147 - DNA, 20 bp, Artificial Sequence
  chemically synthesized
ttatttctatccacataccc

SEQ ID NO: 267148 - DNA, 20 bp, Artificial Sequence
  chemically synthesized
agattttagtctagggtatg

SEQ ID NO: 267149 - DNA, 20 bp, Artificial Sequence
  chemically synthesized
tcttaggagattttagtcta

SEQ ID NO: 267150 - DNA, 20 bp, Artificial Sequence
  chemically synthesized
ctcttaggagattttagtct

SEQ ID NO: 267151 - DNA, 20 bp, Artificial Sequence
  chemically synthesized
tctcttaggagattttagtc

SEQ ID NO: 267152 - DNA, 20 bp, Artificial Sequence
  chemically synthesized
ggtattctcttaggagattt

SEQ ID NO: 267153 - DNA, 20 bp, Artificial Sequence
  chemically synthesized
accctagactaaaatctcct

SEQ ID NO: 267154 - DNA, 20 bp, Artificial Sequence
  chemically synthesized
cctagactaaaatctcctaa

SEQ ID NO: 267155 - DNA, 20 bp, Artificial Sequence
  chemically synthesized
aaatagtggtattctcttag

SEQ ID NO: 267156 - DNA, 20 bp, Artificial Sequence
  chemically synthesized
ggaaatagtggtattctctt

SEQ ID NO: 267157 - DNA, 20 bp, Artificial Sequence
  chemically synthesized
aggaaatagtggtattctct

SEQ ID NO: 267158 - DNA, 20 bp, Artificial Sequence
  chemically synthesized
aatcacctcttaggaaatag

SEQ ID NO: 267159 - DNA, 20 bp, Artificial Sequence
  chemically synthesized
agagaataccactatttcct

SEQ ID NO: 267160 - DNA, 20 bp, Artificial Sequence
  chemically synthesized
ataaatcacctcttaggaaa

SEQ ID NO: 267161 - DNA, 20 bp, Artificial Sequence
  chemically synthesized
agaataccactatttcctaa

SEQ ID NO: 267162 - DNA, 20 bp, Artificial Sequence
  chemically synthesized
gaataccactatttcctaag

SEQ ID NO: 267163 - DNA, 20 bp, Artificial Sequence
  chemically synthesized
tgttttataaatcacctctt

SEQ ID NO: 267164 - DNA, 20 bp, Artificial Sequence
  chemically synthesized
atgttttataaatcacctct

SEQ ID NO: 267165 - DNA, 20 bp, Artificial Sequence
  chemically synthesized
aatcacatttaacatgaaaa

SEQ ID NO: 267166 - DNA, 20 bp, Artificial Sequence
  chemically synthesized
acatttaacatgaaaaaaga

SEQ ID NO: 267167 - DNA, 20 bp, Artificial Sequence
  chemically synthesized
atttaacatgaaaaaagata

SEQ ID NO: 267168 - DNA, 20 bp, Artificial Sequence
  chemically synthesized
ttaacatgaaaaaagataga

SEQ ID NO: 267169 - DNA, 20 bp, Artificial Sequence
  chemically synthesized
acatgaaaaaagatagagag

SEQ ID NO: 267170 - DNA, 20 bp, Artificial Sequence
  chemically synthesized
aaaaagatagagagtagtga

SEQ ID NO: 267171 - DNA, 20 bp, Artificial Sequence
  chemically synthesized
atagagagtagtgatggaaa

SEQ ID NO: 267172 - DNA, 20 bp, Artificial Sequence
  chemically synthesized
agtgatggaaaaagtgatct

SEQ ID NO: 267173 - DNA, 20 bp, Artificial Sequence
  chemically synthesized
gaaaaagtgatcttagtaca

SEQ ID NO: 267174 - DNA, 20 bp, Artificial Sequence
  chemically synthesized
aaaaagtgatcttagtacaa

SEQ ID NO: 267175 - DNA, 20 bp, Artificial Sequence
  chemically synthesized
aggtagtaaacctttgtact

SEQ ID NO: 267176 - DNA, 20 bp, Artificial Sequence
  chemically synthesized
ggggctttatgcagggcagg

SEQ ID NO: 267177 - DNA, 20 bp, Artificial Sequence
  chemically synthesized
aaaggggctttatgcagggc

SEQ ID NO: 267178 - DNA, 20 bp, Artificial Sequence
  chemically synthesized
gaaaggggctttatgcaggg

SEQ ID NO: 267179 - DNA, 20 bp, Artificial Sequence
  chemically synthesized
tttactacctgccctgcata

SEQ ID NO: 267180 - DNA, 20 bp, Artificial Sequence
  chemically synthesized
caggaaaggggctttatgca

SEQ ID NO: 267181 - DNA, 20 bp, Artificial Sequence
  chemically synthesized
ccaggaaaggggctttatgc

SEQ ID NO: 267182 - DNA, 20 bp, Artificial Sequence
  chemically synthesized
accaggaaaggggctttatg

SEQ ID NO: 267183 - DNA, 20 bp, Artificial Sequence
  chemically synthesized
cctgcataaagcccctttcc

SEQ ID NO: 267184 - DNA, 20 bp, Artificial Sequence
  chemically synthesized
cgtgccatgtaccaggaaag

SEQ ID NO: 267185 - DNA, 20 bp, Artificial Sequence
  chemically synthesized
ccgtgccatgtaccaggaaa

SEQ ID NO: 267186 - DNA, 20 bp, Artificial Sequence
  chemically synthesized
gccgtgccatgtaccaggaa

SEQ ID NO: 267187 - DNA, 20 bp, Artificial Sequence
  chemically synthesized
agccgtgccatgtaccagga

SEQ ID NO: 267188 - DNA, 20 bp, Artificial Sequence
  chemically synthesized
aaagcccctttcctggtaca

SEQ ID NO: 267189 - DNA, 20 bp, Artificial Sequence
  chemically synthesized
tgtcagccgtgccatgtacc

SEQ ID NO: 267190 - DNA, 20 bp, Artificial Sequence
  chemically synthesized
ctgtcagccgtgccatgtac

SEQ ID NO: 267191 - DNA, 20 bp, Artificial Sequence
  chemically synthesized
ccctttcctggtacatggca

SEQ ID NO: 267192 - DNA, 20 bp, Artificial Sequence
  chemically synthesized
ctggtacatggcacggctga

SEQ ID NO: 267193 - DNA, 20 bp, Artificial Sequence
  chemically synthesized
cgagtggccacattgtctgt

SEQ ID NO: 267194 - DNA, 20 bp, Artificial Sequence
  chemically synthesized
ggcacggctgacagacaatg

SEQ ID NO: 267195 - DNA, 20 bp, Artificial Sequence
  chemically synthesized
tgacagacaatgtggccact

SEQ ID NO: 267196 - DNA, 20 bp, Artificial Sequence
  chemically synthesized
agactcagtggaatgccgag

SEQ ID NO: 267197 - DNA, 20 bp, Artificial Sequence
  chemically synthesized
cacagactcagtggaatgcc

SEQ ID NO: 267198 - DNA, 20 bp, Artificial Sequence
  chemically synthesized
tggccactcggcattccact

SEQ ID NO: 267199 - DNA, 20 bp, Artificial Sequence
  chemically synthesized
agaaccaggcacagactcag

SEQ ID NO: 267200 - DNA, 20 bp, Artificial Sequence
  chemically synthesized
gaaagaaccaggcacagact

SEQ ID NO: 267201 - DNA, 20 bp, Artificial Sequence
  chemically synthesized
cattccactgagtctgtgcc

SEQ ID NO: 267202 - DNA, 20 bp, Artificial Sequence
  chemically synthesized
ggcagggaaagaaccaggca

SEQ ID NO: 267203 - DNA, 20 bp, Artificial Sequence
  chemically synthesized
agacaggcagggaaagaacc

SEQ ID NO: 267204 - DNA, 20 bp, Artificial Sequence
  chemically synthesized
tagacaggcagggaaagaac

SEQ ID NO: 267205 - DNA, 20 bp, Artificial Sequence
  chemically synthesized
gctaactagacaggcaggga

SEQ ID NO: 267206 - DNA, 20 bp, Artificial Sequence
  chemically synthesized
gctggctaactagacaggca

SEQ ID NO: 267207 - DNA, 20 bp, Artificial Sequence
  chemically synthesized
tggttctttccctgcctgtc

SEQ ID NO: 267208 - DNA, 20 bp, Artificial Sequence
  chemically synthesized
agctggctaactagacaggc

SEQ ID NO: 267209 - DNA, 20 bp, Artificial Sequence
  chemically synthesized
cagctggctaactagacagg

SEQ ID NO: 267210 - DNA, 20 bp, Artificial Sequence
  chemically synthesized
tctttccctgcctgtctagt

SEQ ID NO: 267211 - DNA, 20 bp, Artificial Sequence
  chemically synthesized
ccacagctggctaactagac

SEQ ID NO: 267212 - DNA, 20 bp, Artificial Sequence
  chemically synthesized
cccacagctggctaactaga

SEQ ID NO: 267213 - DNA, 20 bp, Artificial Sequence
  chemically synthesized
tccctgcctgtctagttagc

SEQ ID NO: 267214 - DNA, 20 bp, Artificial Sequence
  chemically synthesized
atgtcccacagctggctaac

SEQ ID NO: 267215 - DNA, 20 bp, Artificial Sequence
  chemically synthesized
cctgtctagttagccagctg

SEQ ID NO: 267216 - DNA, 20 bp, Artificial Sequence
  chemically synthesized
ctgtctagttagccagctgt

SEQ ID NO: 267217 - DNA, 20 bp, Artificial Sequence
  chemically synthesized
ctctgtgaatgtcccacagc

SEQ ID NO: 267218 - DNA, 20 bp, Artificial Sequence
  chemically synthesized
agctctctgtgaatgtccca

SEQ ID NO: 267219 - DNA, 20 bp, Artificial Sequence
  chemically synthesized
agccagctgtgggacattca

SEQ ID NO: 267220 - DNA, 20 bp, Artificial Sequence
  chemically synthesized
ccagctgtgggacattcaca

SEQ ID NO: 267221 - DNA, 20 bp, Artificial Sequence
  chemically synthesized
agctgtgggacattcacaga

SEQ ID NO: 267222 - DNA, 20 bp, Artificial Sequence
  chemically synthesized
tgggacattcacagagagct

SEQ ID NO: 267223 - DNA, 20 bp, Artificial Sequence
  chemically synthesized
acattcacagagagctgagc

SEQ ID NO: 267224 - DNA, 20 bp, Artificial Sequence
  chemically synthesized
attcacagagagctgagcca

SEQ ID NO: 267225 - DNA, 20 bp, Artificial Sequence
  chemically synthesized
gggtctgttgggctctggct

SEQ ID NO: 267226 - DNA, 20 bp, Artificial Sequence
  chemically synthesized
aaaaagggtctgttgggctc

SEQ ID NO: 267227 - DNA, 20 bp, Artificial Sequence
  chemically synthesized
agagctgagccagagcccaa

SEQ ID NO: 267228 - DNA, 20 bp, Artificial Sequence
  chemically synthesized
aaggagaaaaagggtctgtt

SEQ ID NO: 267229 - DNA, 20 bp, Artificial Sequence
  chemically synthesized
aaaggagaaaaagggtctgt

SEQ ID NO: 267230 - DNA, 20 bp, Artificial Sequence
  chemically synthesized
ttattgagaaaggagaaaaa

SEQ ID NO: 267231 - DNA, 20 bp, Artificial Sequence
  chemically synthesized
cttattgagaaaggagaaaa

SEQ ID NO: 267232 - DNA, 20 bp, Artificial Sequence
  chemically synthesized
ccttattgagaaaggagaaa

SEQ ID NO: 267233 - DNA, 20 bp, Artificial Sequence
  chemically synthesized
tgttaaccttattgagaaag

SEQ ID NO: 267234 - DNA, 20 bp, Artificial Sequence
  chemically synthesized
tctgttaaccttattgagaa

SEQ ID NO: 267235 - DNA, 20 bp, Artificial Sequence
  chemically synthesized
cctttttctcctttctcaat

SEQ ID NO: 267236 - DNA, 20 bp, Artificial Sequence
  chemically synthesized
atctgttaaccttattgaga

SEQ ID NO: 267237 - DNA, 20 bp, Artificial Sequence
  chemically synthesized
ctttttctcctttctcaata

SEQ ID NO: 267238 - DNA, 20 bp, Artificial Sequence
  chemically synthesized
ctgtatctgttaaccttatt

SEQ ID NO: 267239 - DNA, 20 bp, Artificial Sequence
  chemically synthesized
tcctttctcaataaggttaa

SEQ ID NO: 267240 - DNA, 20 bp, Artificial Sequence
  chemically synthesized
ctcaataaggttaacagata

SEQ ID NO: 267241 - DNA, 20 bp, Artificial Sequence
  chemically synthesized
caataaggttaacagataca

SEQ ID NO: 267242 - DNA, 20 bp, Artificial Sequence
  chemically synthesized
acagatacagagactgtgat

SEQ ID NO: 267243 - DNA, 20 bp, Artificial Sequence
  chemically synthesized
ttcaactcgagtgccaatca

SEQ ID NO: 267244 - DNA, 20 bp, Artificial Sequence
  chemically synthesized
agagactgtgattggcactc

SEQ ID NO: 267245 - DNA, 20 bp, Artificial Sequence
  chemically synthesized
cgcaaatagcttttcaactc

SEQ ID NO: 267246 - DNA, 20 bp, Artificial Sequence
  chemically synthesized
tgattggcactcgagttgaa

SEQ ID NO: 267247 - DNA, 20 bp, Artificial Sequence
  chemically synthesized
cgagttgaaaagctatttgc

SEQ ID NO: 267248 - DNA, 20 bp, Artificial Sequence
  chemically synthesized
acatcagctccactcgcaaa

SEQ ID NO: 267249 - DNA, 20 bp, Artificial Sequence
  chemically synthesized
gttgaaaagctatttgcgag

SEQ ID NO: 267250 - DNA, 20 bp, Artificial Sequence
  chemically synthesized
tgaaaagctatttgcgagtg

SEQ ID NO: 267251 - DNA, 20 bp, Artificial Sequence
  chemically synthesized
gctttctgtgattaagacat

SEQ ID NO: 267252 - DNA, 20 bp, Artificial Sequence
  chemically synthesized
tggagctgatgtcttaatca

SEQ ID NO: 267253 - DNA, 20 bp, Artificial Sequence
  chemically synthesized
tgctttggctttctgtgatt

SEQ ID NO: 267254 - DNA, 20 bp, Artificial Sequence
  chemically synthesized
gctgatgtcttaatcacaga

SEQ ID NO: 267255 - DNA, 20 bp, Artificial Sequence
  chemically synthesized
gtcttaatcacagaaagcca

SEQ ID NO: 267256 - DNA, 20 bp, Artificial Sequence
  chemically synthesized
tcaatgattttgttttgctt

SEQ ID NO: 267257 - DNA, 20 bp, Artificial Sequence
  chemically synthesized
caaagcaaaacaaaatcatt

SEQ ID NO: 267258 - DNA, 20 bp, Artificial Sequence
  chemically synthesized
aaaacaaaatcattgagaaa

SEQ ID NO: 267259 - DNA, 20 bp, Artificial Sequence
  chemically synthesized
tcattgagaaacagcaataa

SEQ ID NO: 267260 - DNA, 20 bp, Artificial Sequence
  chemically synthesized
cattgagaaacagcaataac

SEQ ID NO: 267261 - DNA, 20 bp, Artificial Sequence
  chemically synthesized
gagaaacagcaataacagga

SEQ ID NO: 267262 - DNA, 20 bp, Artificial Sequence
  chemically synthesized
aaacagcaataacaggaaag

SEQ ID NO: 267263 - DNA, 20 bp, Artificial Sequence
  chemically synthesized
acagcaataacaggaaagtg

SEQ ID NO: 267264 - DNA, 20 bp, Artificial Sequence
  chemically synthesized
caataacaggaaagtggaga

SEQ ID NO: 267265 - DNA, 20 bp, Artificial Sequence
  chemically synthesized
acaggaaagtggagaaagtc

SEQ ID NO: 267266 - DNA, 20 bp, Artificial Sequence
  chemically synthesized
attaattgattatttgtatc

SEQ ID NO: 267267 - DNA, 20 bp, Artificial Sequence
  chemically synthesized
taatcaattaataaacacac

SEQ ID NO: 267268 - DNA, 20 bp, Artificial Sequence
  chemically synthesized
aatcaattaataaacacaca

SEQ ID NO: 267269 - DNA, 20 bp, Artificial Sequence
  chemically synthesized
tcaattaataaacacacaag

SEQ ID NO: 267270 - DNA, 20 bp, Artificial Sequence
  chemically synthesized
attaataaacacacaaggag

SEQ ID NO: 267271 - DNA, 20 bp, Artificial Sequence
  chemically synthesized
agatgtaggctggcattaca

SEQ ID NO: 267272 - DNA, 20 bp, Artificial Sequence
  chemically synthesized
aaggagcagctctgtaatgc

SEQ ID NO: 267273 - DNA, 20 bp, Artificial Sequence
  chemically synthesized
ttagatgtaggctggcatta

SEQ ID NO: 267274 - DNA, 20 bp, Artificial Sequence
  chemically synthesized
ttaagaaattagatgtaggc

SEQ ID NO: 267275 - DNA, 20 bp, Artificial Sequence
  chemically synthesized
tttcttaagaaattagatgt

SEQ ID NO: 267276 - DNA, 20 bp, Artificial Sequence
  chemically synthesized
ttttcttaagaaattagatg

SEQ ID NO: 267277 - DNA, 20 bp, Artificial Sequence
  chemically synthesized
cagcctacatctaatttctt

SEQ ID NO: 267278 - DNA, 20 bp, Artificial Sequence
  chemically synthesized
taatttttttcttaagaaat

SEQ ID NO: 267279 - DNA, 20 bp, Artificial Sequence
  chemically synthesized
tgtactgtaatttttttctt

SEQ ID NO: 267280 - DNA, 20 bp, Artificial Sequence
  chemically synthesized
atttcttaagaaaaaaatta

SEQ ID NO: 267281 - DNA, 20 bp, Artificial Sequence
  chemically synthesized
taagaaaaaaattacagtac

SEQ ID NO: 267282 - DNA, 20 bp, Artificial Sequence
  chemically synthesized
agaaaaaaattacagtacaa

SEQ ID NO: 267283 - DNA, 20 bp, Artificial Sequence
  chemically synthesized
aaaaattacagtacaagagt

SEQ ID NO: 267284 - DNA, 20 bp, Artificial Sequence
  chemically synthesized
acagtacaagagtaagaaat

SEQ ID NO: 267285 - DNA, 20 bp, Artificial Sequence
  chemically synthesized
cagtacaagagtaagaaatt

SEQ ID NO: 267286 - DNA, 20 bp, Artificial Sequence
  chemically synthesized
caagagtaagaaattaggta

SEQ ID NO: 267287 - DNA, 20 bp, Artificial Sequence
  chemically synthesized
aagagtaagaaattaggtat

SEQ ID NO: 267288 - DNA, 20 bp, Artificial Sequence
  chemically synthesized
gtaagaaattaggtataggc

SEQ ID NO: 267289 - DNA, 20 bp, Artificial Sequence
  chemically synthesized
ttaggtataggctggcctca

SEQ ID NO: 267290 - DNA, 20 bp, Artificial Sequence
  chemically synthesized
tgagagtgactctatgaggc

SEQ ID NO: 267291 - DNA, 20 bp, Artificial Sequence
  chemically synthesized
aggtataggctggcctcata

SEQ ID NO: 267292 - DNA, 20 bp, Artificial Sequence
  chemically synthesized
atgttgagagtgactctatg

SEQ ID NO: 267293 - DNA, 20 bp, Artificial Sequence
  chemically synthesized
catgttgagagtgactctat

SEQ ID NO: 267294 - DNA, 20 bp, Artificial Sequence
  chemically synthesized
agatagaaaagacatgttga

SEQ ID NO: 267295 - DNA, 20 bp, Artificial Sequence
  chemically synthesized
aaagatagaaaagacatgtt

SEQ ID NO: 267296 - DNA, 20 bp, Artificial Sequence
  chemically synthesized
ggtatattataaagatagaa

SEQ ID NO: 267297 - DNA, 20 bp, Artificial Sequence
  chemically synthesized
acttaggtatattataaaga

SEQ ID NO: 267298 - DNA, 20 bp, Artificial Sequence
  chemically synthesized
gactacttaggtatattata

SEQ ID NO: 267299 - DNA, 20 bp, Artificial Sequence
  chemically synthesized
tctatctttataatatacct

SEQ ID NO: 267300 - DNA, 20 bp, Artificial Sequence
  chemically synthesized
atctttataatatacctaag

SEQ ID NO: 267301 - DNA, 20 bp, Artificial Sequence
  chemically synthesized
agacagccacaggactactt

SEQ ID NO: 267302 - DNA, 20 bp, Artificial Sequence
  chemically synthesized
aagacagccacaggactact

SEQ ID NO: 267303 - DNA, 20 bp, Artificial Sequence
  chemically synthesized
aatatacctaagtagtcctg

SEQ ID NO: 267304 - DNA, 20 bp, Artificial Sequence
  chemically synthesized
cgtggcagaaagacagccac

SEQ ID NO: 267305 - DNA, 20 bp, Artificial Sequence
  chemically synthesized
gcgtggcagaaagacagcca

SEQ ID NO: 267306 - DNA, 20 bp, Artificial Sequence
  chemically synthesized
cttatggcgtggcagaaaga

SEQ ID NO: 267307 - DNA, 20 bp, Artificial Sequence
  chemically synthesized
ggaccttatggcgtggcaga

SEQ ID NO: 267308 - DNA, 20 bp, Artificial Sequence
  chemically synthesized
accaggaccttatggcgtgg

SEQ ID NO: 267309 - DNA, 20 bp, Artificial Sequence
  chemically synthesized
ctgtctttctgccacgccat

SEQ ID NO: 267310 - DNA, 20 bp, Artificial Sequence
  chemically synthesized
tgtctttctgccacgccata

SEQ ID NO: 267311 - DNA, 20 bp, Artificial Sequence
  chemically synthesized
tggaccaggaccttatggcg

SEQ ID NO: 267312 - DNA, 20 bp, Artificial Sequence
  chemically synthesized
tcgagtggaccaggacctta

SEQ ID NO: 267313 - DNA, 20 bp, Artificial Sequence
  chemically synthesized
tctgccacgccataaggtcc

SEQ ID NO: 267314 - DNA, 20 bp, Artificial Sequence
  chemically synthesized
gaagtgatttcgagtggacc

SEQ ID NO: 267315 - DNA, 20 bp, Artificial Sequence
  chemically synthesized
agaagtgatttcgagtggac

SEQ ID NO: 267316 - DNA, 20 bp, Artificial Sequence
  chemically synthesized
gtatgagaagtgatttcgag

SEQ ID NO: 267317 - DNA, 20 bp, Artificial Sequence
  chemically synthesized
aaagtatgagaagtgatttc

SEQ ID NO: 267318 - DNA, 20 bp, Artificial Sequence
  chemically synthesized
accaaaacagaaagtatgag

SEQ ID NO: 267319 - DNA, 20 bp, Artificial Sequence
  chemically synthesized
aaaaccaaaacagaaagtat

SEQ ID NO: 267320 - DNA, 20 bp, Artificial Sequence
  chemically synthesized
acttctcatactttctgttt

SEQ ID NO: 267321 - DNA, 20 bp, Artificial Sequence
  chemically synthesized
aaaggcaaaaccaaaacaga

SEQ ID NO: 267322 - DNA, 20 bp, Artificial Sequence
  chemically synthesized
tgccaaaggcaaaaccaaaa

SEQ ID NO: 267323 - DNA, 20 bp, Artificial Sequence
  chemically synthesized
ttctgttttggttttgcctt

SEQ ID NO: 267324 - DNA, 20 bp, Artificial Sequence
  chemically synthesized
tttggttttgcctttggcat

SEQ ID NO: 267325 - DNA, 20 bp, Artificial Sequence
  chemically synthesized
tcctgtttatccgatgccaa

SEQ ID NO: 267326 - DNA, 20 bp, Artificial Sequence
  chemically synthesized
ctcctgtttatccgatgcca

SEQ ID NO: 267327 - DNA, 20 bp, Artificial Sequence
  chemically synthesized
tgcctttggcatcggataaa

SEQ ID NO: 267328 - DNA, 20 bp, Artificial Sequence
  chemically synthesized
gcctttggcatcggataaac

SEQ ID NO: 267329 - DNA, 20 bp, Artificial Sequence
  chemically synthesized
ctttggcatcggataaacag

SEQ ID NO: 267330 - DNA, 20 bp, Artificial Sequence
  chemically synthesized
gataaacaggagaaataaat

SEQ ID NO: 267331 - DNA, 20 bp, Artificial Sequence
  chemically synthesized
ataaacaggagaaataaatg

SEQ ID NO: 267332 - DNA, 20 bp, Artificial Sequence
  chemically synthesized
atgtataaaaatttttatgc

SEQ ID NO: 267333 - DNA, 20 bp, Artificial Sequence
  chemically synthesized
atatcttagaattgaagaaa

SEQ ID NO: 267334 - DNA, 20 bp, Artificial Sequence
  chemically synthesized
aacactgtttcttcaattct

SEQ ID NO: 267335 - DNA, 20 bp, Artificial Sequence
  chemically synthesized
aaaaccatatcttagaattg

SEQ ID NO: 267336 - DNA, 20 bp, Artificial Sequence
  chemically synthesized
gtttcttcaattctaagata

SEQ ID NO: 267337 - DNA, 20 bp, Artificial Sequence
  chemically synthesized
tgtgacataaaaccatatct

SEQ ID NO: 267338 - DNA, 20 bp, Artificial Sequence
  chemically synthesized
ataaaaacatgcctgaaatt

SEQ ID NO: 267339 - DNA, 20 bp, Artificial Sequence
  chemically synthesized
taaaaacatgcctgaaatta

SEQ ID NO: 267340 - DNA, 20 bp, Artificial Sequence
  chemically synthesized
gcattaagtaccttaatttc

SEQ ID NO: 267341 - DNA, 20 bp, Artificial Sequence
  chemically synthesized
ggcattaagtaccttaattt

SEQ ID NO: 267342 - DNA, 20 bp, Artificial Sequence
  chemically synthesized
gaaattaaggtacttaatgc

SEQ ID NO: 267343 - DNA, 20 bp, Artificial Sequence
  chemically synthesized
tgtcgagttcatctggcatt

SEQ ID NO: 267344 - DNA, 20 bp, Artificial Sequence
  chemically synthesized
tgatagctgtcgagttcatc

SEQ ID NO: 267345 - DNA, 20 bp, Artificial Sequence
  chemically synthesized
ttaatgccagatgaactcga

SEQ ID NO: 267346 - DNA, 20 bp, Artificial Sequence
  chemically synthesized
ccccatgcatgatagctgtc

SEQ ID NO: 267347 - DNA, 20 bp, Artificial Sequence
  chemically synthesized
aactcgacagctatcatgca

SEQ ID NO: 267348 - DNA, 20 bp, Artificial Sequence
  chemically synthesized
atgaagaaccccatgcatga

SEQ ID NO: 267349 - DNA, 20 bp, Artificial Sequence
  chemically synthesized
actcgacagctatcatgcat

SEQ ID NO: 267350 - DNA, 20 bp, Artificial Sequence
  chemically synthesized
ctcgacagctatcatgcatg

SEQ ID NO: 267351 - DNA, 20 bp, Artificial Sequence
  chemically synthesized
tgcatggggttcttcatatg

SEQ ID NO: 267352 - DNA, 20 bp, Artificial Sequence
  chemically synthesized
gcatggggttcttcatatgt

SEQ ID NO: 267353 - DNA, 20 bp, Artificial Sequence
  chemically synthesized
acaaatagcacctacatatg

SEQ ID NO: 267354 - DNA, 20 bp, Artificial Sequence
  chemically synthesized
gctcacctgtgtgcaacaaa

SEQ ID NO: 267355 - DNA, 20 bp, Artificial Sequence
  chemically synthesized
taggtgctatttgttgcaca

SEQ ID NO: 267356 - DNA, 20 bp, Artificial Sequence
  chemically synthesized
aggtgctatttgttgcacac

SEQ ID NO: 267357 - DNA, 20 bp, Artificial Sequence
  chemically synthesized
gctatttgttgcacacaggt

SEQ ID NO: 267358 - DNA, 20 bp, Artificial Sequence
  chemically synthesized
ttgttgcacacaggtgagct

SEQ ID NO: 267359 - DNA, 20 bp, Artificial Sequence
  chemically synthesized
aattgcttttatgaattgct

SEQ ID NO: 267360 - DNA, 20 bp, Artificial Sequence
  chemically synthesized
gtgagcttagcaattcataa

SEQ ID NO: 267361 - DNA, 20 bp, Artificial Sequence
  chemically synthesized
acacttacgattgataaatg

SEQ ID NO: 267362 - DNA, 20 bp, Artificial Sequence
  chemically synthesized
tttcttcatttatcaatcgt

SEQ ID NO: 267363 - DNA, 20 bp, Artificial Sequence
  chemically synthesized
atcaatcgtaagtgttgcct

SEQ ID NO: 267364 - DNA, 20 bp, Artificial Sequence
  chemically synthesized
ctggcatataataggagctc

SEQ ID NO: 267365 - DNA, 20 bp, Artificial Sequence
  chemically synthesized
actggcatataataggagct

SEQ ID NO: 267366 - DNA, 20 bp, Artificial Sequence
  chemically synthesized
tagtaactggcatataatag

SEQ ID NO: 267367 - DNA, 20 bp, Artificial Sequence
  chemically synthesized
agtagtaactggcatataat

SEQ ID NO: 267368 - DNA, 20 bp, Artificial Sequence
  chemically synthesized
cagtagtaactggcatataa

SEQ ID NO: 267369 - DNA, 20 bp, Artificial Sequence
  chemically synthesized
cctgagctcctattatatgc

SEQ ID NO: 267370 - DNA, 20 bp, Artificial Sequence
  chemically synthesized
gattctgctacagtagtaac

SEQ ID NO: 267371 - DNA, 20 bp, Artificial Sequence
  chemically synthesized
ttatatgccagttactactg

SEQ ID NO: 267372 - DNA, 20 bp, Artificial Sequence
  chemically synthesized
tatgccagttactactgtag

SEQ ID NO: 267373 - DNA, 20 bp, Artificial Sequence
  chemically synthesized
tacatatgattctgctacag

SEQ ID NO: 267374 - DNA, 20 bp, Artificial Sequence
  chemically synthesized
aattacatatgattctgcta

SEQ ID NO: 267375 - DNA, 20 bp, Artificial Sequence
  chemically synthesized
atctcccagaatatattgag

SEQ ID NO: 267376 - DNA, 20 bp, Artificial Sequence
  chemically synthesized
taatctcccagaatatattg

SEQ ID NO: 267377 - DNA, 20 bp, Artificial Sequence
  chemically synthesized
ataatctcccagaatatatt

SEQ ID NO: 267378 - DNA, 20 bp, Artificial Sequence
  chemically synthesized
taattctcctcaatatattc

SEQ ID NO: 267379 - DNA, 20 bp, Artificial Sequence
  chemically synthesized
aattctcctcaatatattct

SEQ ID NO: 267380 - DNA, 20 bp, Artificial Sequence
  chemically synthesized
ttctcctcaatatattctgg

SEQ ID NO: 267381 - DNA, 20 bp, Artificial Sequence
  chemically synthesized
agagacttctaataatctcc

SEQ ID NO: 267382 - DNA, 20 bp, Artificial Sequence
  chemically synthesized
aatatattctgggagattat

SEQ ID NO: 267383 - DNA, 20 bp, Artificial Sequence
  chemically synthesized
atattctgggagattattag

SEQ ID NO: 267384 - DNA, 20 bp, Artificial Sequence
  chemically synthesized
attattagaagtctctcatt

SEQ ID NO: 267385 - DNA, 20 bp, Artificial Sequence
  chemically synthesized
ttattagaagtctctcattt

SEQ ID NO: 267386 - DNA, 20 bp, Artificial Sequence
  chemically synthesized
gtctgtatctacccaaatga

SEQ ID NO: 267387 - DNA, 20 bp, Artificial Sequence
  chemically synthesized
ttagaagtctctcatttggg

SEQ ID NO: 267388 - DNA, 20 bp, Artificial Sequence
  chemically synthesized
gggtctgtatctacccaaat

SEQ ID NO: 267389 - DNA, 20 bp, Artificial Sequence
  chemically synthesized
gtctctcatttgggtagata

SEQ ID NO: 267390 - DNA, 20 bp, Artificial Sequence
  chemically synthesized
ttgggtagatacagaccctt

SEQ ID NO: 267391 - DNA, 20 bp, Artificial Sequence
  chemically synthesized
gggtagatacagacccttta

SEQ ID NO: 267392 - DNA, 20 bp, Artificial Sequence
  chemically synthesized
ctctgaagttaagctctaaa

SEQ ID NO: 267393 - DNA, 20 bp, Artificial Sequence
  chemically synthesized
actctgaagttaagctctaa

SEQ ID NO: 267394 - DNA, 20 bp, Artificial Sequence
  chemically synthesized
tactctgaagttaagctcta

SEQ ID NO: 267395 - DNA, 20 bp, Artificial Sequence
  chemically synthesized
gaccctttagagcttaactt

SEQ ID NO: 267396 - DNA, 20 bp, Artificial Sequence
  chemically synthesized
ccctttagagcttaacttca

SEQ ID NO: 267397 - DNA, 20 bp, Artificial Sequence
  chemically synthesized
tctatgtctactctgaagtt

SEQ ID NO: 267398 - DNA, 20 bp, Artificial Sequence
  chemically synthesized
tttagagcttaacttcagag

SEQ ID NO: 267399 - DNA, 20 bp, Artificial Sequence
  chemically synthesized
tctagtctatgtctactctg

SEQ ID NO: 267400 - DNA, 20 bp, Artificial Sequence
  chemically synthesized
gcttaacttcagagtagaca

SEQ ID NO: 267401 - DNA, 20 bp, Artificial Sequence
  chemically synthesized
acttcagagtagacatagac

SEQ ID NO: 267402 - DNA, 20 bp, Artificial Sequence
  chemically synthesized
gtattaaaaggaataaaatc

SEQ ID NO: 267403 - DNA, 20 bp, Artificial Sequence
  chemically synthesized
gttgaagtcaaagtattaaa

SEQ ID NO: 267404 - DNA, 20 bp, Artificial Sequence
  chemically synthesized
ggttgaagtcaaagtattaa

SEQ ID NO: 267405 - DNA, 20 bp, Artificial Sequence
  chemically synthesized
actacaaaaggttgaagtca

SEQ ID NO: 267406 - DNA, 20 bp, Artificial Sequence
  chemically synthesized
ttgtatactacaaaaggttg

SEQ ID NO: 267407 - DNA, 20 bp, Artificial Sequence
  chemically synthesized
actttgacttcaaccttttg

SEQ ID NO: 267408 - DNA, 20 bp, Artificial Sequence
  chemically synthesized
tagaggttgtatactacaaa

SEQ ID NO: 267409 - DNA, 20 bp, Artificial Sequence
  chemically synthesized
gtagaggttgtatactacaa

SEQ ID NO: 267410 - DNA, 20 bp, Artificial Sequence
  chemically synthesized
gctaacatctatggttgtag

SEQ ID NO: 267411 - DNA, 20 bp, Artificial Sequence
  chemically synthesized
ggctaacatctatggttgta

SEQ ID NO: 267412 - DNA, 20 bp, Artificial Sequence
  chemically synthesized
gtatacaacctctacaacca

SEQ ID NO: 267413 - DNA, 20 bp, Artificial Sequence
  chemically synthesized
atggctaacatctatggttg

SEQ ID NO: 267414 - DNA, 20 bp, Artificial Sequence
  chemically synthesized
acctctacaaccatagatgt

SEQ ID NO: 267415 - DNA, 20 bp, Artificial Sequence
  chemically synthesized
gtaacaatggctaacatcta

SEQ ID NO: 267416 - DNA, 20 bp, Artificial Sequence
  chemically synthesized
tagatgttagccattgttac

SEQ ID NO: 267417 - DNA, 20 bp, Artificial Sequence
  chemically synthesized
cccacagagcctagtaacaa

SEQ ID NO: 267418 - DNA, 20 bp, Artificial Sequence
  chemically synthesized
agatgttagccattgttact

SEQ ID NO: 267419 - DNA, 20 bp, Artificial Sequence
  chemically synthesized
gccattgttactaggctctg

SEQ ID NO: 267420 - DNA, 20 bp, Artificial Sequence
  chemically synthesized
ccgttttatcccacagagcc

SEQ ID NO: 267421 - DNA, 20 bp, Artificial Sequence
  chemically synthesized
ccattgttactaggctctgt

SEQ ID NO: 267422 - DNA, 20 bp, Artificial Sequence
  chemically synthesized
ctctaccgttttatcccaca

SEQ ID NO: 267423 - DNA, 20 bp, Artificial Sequence
  chemically synthesized
ttctctaccgttttatccca

SEQ ID NO: 267424 - DNA, 20 bp, Artificial Sequence
  chemically synthesized
ctaggctctgtgggataaaa

SEQ ID NO: 267425 - DNA, 20 bp, Artificial Sequence
  chemically synthesized
ggctctgtgggataaaacgg

SEQ ID NO: 267426 - DNA, 20 bp, Artificial Sequence
  chemically synthesized
ctctgtgggataaaacggta

SEQ ID NO: 267427 - DNA, 20 bp, Artificial Sequence
  chemically synthesized
tgtgggataaaacggtagag

SEQ ID NO: 267428 - DNA, 20 bp, Artificial Sequence
  chemically synthesized
atataagtttttgaaggatg

SEQ ID NO: 267429 - DNA, 20 bp, Artificial Sequence
  chemically synthesized
gatataagtttttgaaggat

SEQ ID NO: 267430 - DNA, 20 bp, Artificial Sequence
  chemically synthesized
ggatataagtttttgaagga

SEQ ID NO: 267431 - DNA, 20 bp, Artificial Sequence
  chemically synthesized
acttggatataagtttttga

SEQ ID NO: 267432 - DNA, 20 bp, Artificial Sequence
  chemically synthesized
tacttggatataagtttttg

SEQ ID NO: 267433 - DNA, 20 bp, Artificial Sequence
  chemically synthesized
tccttcaaaaacttatatcc

SEQ ID NO: 267434 - DNA, 20 bp, Artificial Sequence
  chemically synthesized
acaaactcatacttggatat

SEQ ID NO: 267435 - DNA, 20 bp, Artificial Sequence
  chemically synthesized
aaaaacttatatccaagtat

SEQ ID NO: 267436 - DNA, 20 bp, Artificial Sequence
  chemically synthesized
ctctttgacaaactcatact

SEQ ID NO: 267437 - DNA, 20 bp, Artificial Sequence
  chemically synthesized
atccaagtatgagtttgtca

SEQ ID NO: 267438 - DNA, 20 bp, Artificial Sequence
  chemically synthesized
ccaagtatgagtttgtcaaa

SEQ ID NO: 267439 - DNA, 20 bp, Artificial Sequence
  chemically synthesized
gtatgagtttgtcaaagaga

SEQ ID NO: 267440 - DNA, 20 bp, Artificial Sequence
  chemically synthesized
agatggacatatacgcaaat

SEQ ID NO: 267441 - DNA, 20 bp, Artificial Sequence
  chemically synthesized
gtagactggaatatagaaag

SEQ ID NO: 267442 - DNA, 20 bp, Artificial Sequence
  chemically synthesized
ccagtagactggaatataga

SEQ ID NO: 267443 - DNA, 20 bp, Artificial Sequence
  chemically synthesized
attatctactttctatattc

SEQ ID NO: 267444 - DNA, 20 bp, Artificial Sequence
  chemically synthesized
gatgccagtagactggaata

SEQ ID NO: 267445 - DNA, 20 bp, Artificial Sequence
  chemically synthesized
ctttctatattccagtctac

SEQ ID NO: 267446 - DNA, 20 bp, Artificial Sequence
  chemically synthesized
acagcgagatgccagtagac

SEQ ID NO: 267447 - DNA, 20 bp, Artificial Sequence
  chemically synthesized
caactacagcgagatgccag

SEQ ID NO: 267448 - DNA, 20 bp, Artificial Sequence
  chemically synthesized
aatcaactacagcgagatgc

SEQ ID NO: 267449 - DNA, 20 bp, Artificial Sequence
  chemically synthesized
agtctactggcatctcgctg

SEQ ID NO: 267450 - DNA, 20 bp, Artificial Sequence
  chemically synthesized
gtgaataaatcaactacagc

SEQ ID NO: 267451 - DNA, 20 bp, Artificial Sequence
  chemically synthesized
ctttgtgaataaatcaacta

SEQ ID NO: 267452 - DNA, 20 bp, Artificial Sequence
  chemically synthesized
ctgtagttgatttattcaca

SEQ ID NO: 267453 - DNA, 20 bp, Artificial Sequence
  chemically synthesized
tgtagttgatttattcacaa

SEQ ID NO: 267454 - DNA, 20 bp, Artificial Sequence
  chemically synthesized
cacaaaggtaacccttcaca

SEQ ID NO: 267455 - DNA, 20 bp, Artificial Sequence
  chemically synthesized
ttaagcttcaactttgtgaa

SEQ ID NO: 267456 - DNA, 20 bp, Artificial Sequence
  chemically synthesized
attaagcttcaactttgtga

SEQ ID NO: 267457 - DNA, 20 bp, Artificial Sequence
  chemically synthesized
aattaagcttcaactttgtg

SEQ ID NO: 267458 - DNA, 20 bp, Artificial Sequence
  chemically synthesized
ggtaacccttcacaaagttg

SEQ ID NO: 267459 - DNA, 20 bp, Artificial Sequence
  chemically synthesized
tagtaatccaaatataaatt

SEQ ID NO: 267460 - DNA, 20 bp, Artificial Sequence
  chemically synthesized
gttgaagcttaatttatatt

SEQ ID NO: 267461 - DNA, 20 bp, Artificial Sequence
  chemically synthesized
aagacttattaagagataat

SEQ ID NO: 267462 - DNA, 20 bp, Artificial Sequence
  chemically synthesized
attactaattatctcttaat

SEQ ID NO: 267463 - DNA, 20 bp, Artificial Sequence
  chemically synthesized
tctttatgaagacttattaa

SEQ ID NO: 267464 - DNA, 20 bp, Artificial Sequence
  chemically synthesized
catctttatgaagacttatt

SEQ ID NO: 267465 - DNA, 20 bp, Artificial Sequence
  chemically synthesized
tctcttaataagtcttcata

SEQ ID NO: 267466 - DNA, 20 bp, Artificial Sequence
  chemically synthesized
aatatagtgtcatctttatg

SEQ ID NO: 267467 - DNA, 20 bp, Artificial Sequence
  chemically synthesized
ataaagatgacactatattt

SEQ ID NO: 267468 - DNA, 20 bp, Artificial Sequence
  chemically synthesized
tttacattgatgctaaaata

SEQ ID NO: 267469 - DNA, 20 bp, Artificial Sequence
  chemically synthesized
tattttagcatcaatgtaaa

SEQ ID NO: 267470 - DNA, 20 bp, Artificial Sequence
  chemically synthesized
gtaaaaagttattgtgtaca

SEQ ID NO: 267471 - DNA, 20 bp, Artificial Sequence
  chemically synthesized
gattttgtttcttacatgac

SEQ ID NO: 267472 - DNA, 20 bp, Artificial Sequence
  chemically synthesized
aattgcattgcttgtcatgt

SEQ ID NO: 267473 - DNA, 20 bp, Artificial Sequence
  chemically synthesized
catgacaagcaatgcaatta

SEQ ID NO: 267474 - DNA, 20 bp, Artificial Sequence
  chemically synthesized
atgacaagcaatgcaattaa

SEQ ID NO: 267475 - DNA, 20 bp, Artificial Sequence
  chemically synthesized
agcaatgcaattaaaggcaa

SEQ ID NO: 267476 - DNA, 20 bp, Artificial Sequence
  chemically synthesized
caatggaattttccaaaact

SEQ ID NO: 267477 - DNA, 20 bp, Artificial Sequence
  chemically synthesized
ttgtgatctcttctgagttt

SEQ ID NO: 267478 - DNA, 20 bp, Artificial Sequence
  chemically synthesized
tggaattttccaaaactcag

SEQ ID NO: 267479 - DNA, 20 bp, Artificial Sequence
  chemically synthesized
gaattttccaaaactcagaa

SEQ ID NO: 267480 - DNA, 20 bp, Artificial Sequence
  chemically synthesized
aaacttttgtgatctcttct

SEQ ID NO: 267481 - DNA, 20 bp, Artificial Sequence
  chemically synthesized
aaactcagaagagatcacaa

SEQ ID NO: 267482 - DNA, 20 bp, Artificial Sequence
  chemically synthesized
gatcacaaaagttttgaact

SEQ ID NO: 267483 - DNA, 20 bp, Artificial Sequence
  chemically synthesized
atcacaaaagttttgaactt

SEQ ID NO: 267484 - DNA, 20 bp, Artificial Sequence
  chemically synthesized
tcacaaaagttttgaactta

SEQ ID NO: 267485 - DNA, 20 bp, Artificial Sequence
  chemically synthesized
cacaaaagttttgaacttag

SEQ ID NO: 267486 - DNA, 20 bp, Artificial Sequence
  chemically synthesized
tacctgcaacattatcccct

SEQ ID NO: 267487 - DNA, 20 bp, Artificial Sequence
  chemically synthesized
gaacttaggggataatgttg

SEQ ID NO: 267488 - DNA, 20 bp, Artificial Sequence
  chemically synthesized
aacttaggggataatgttgc

SEQ ID NO: 267489 - DNA, 20 bp, Artificial Sequence
  chemically synthesized
ttaggggataatgttgcagg

SEQ ID NO: 267490 - DNA, 20 bp, Artificial Sequence
  chemically synthesized
ataatgttgcaggtagttcc

SEQ ID NO: 267491 - DNA, 20 bp, Artificial Sequence
  chemically synthesized
taatgttgcaggtagttcct

SEQ ID NO: 267492 - DNA, 20 bp, Artificial Sequence
  chemically synthesized
tgcaggtagttcctgggtca

SEQ ID NO: 267493 - DNA, 20 bp, Artificial Sequence
  chemically synthesized
cataatggtttctgtgaccc

SEQ ID NO: 267494 - DNA, 20 bp, Artificial Sequence
  chemically synthesized
acataatggtttctgtgacc

SEQ ID NO: 267495 - DNA, 20 bp, Artificial Sequence
  chemically synthesized
ggccagatgttgacacataa

SEQ ID NO: 267496 - DNA, 20 bp, Artificial Sequence
  chemically synthesized
aaccattatgtgtcaacatc

SEQ ID NO: 267497 - DNA, 20 bp, Artificial Sequence
  chemically synthesized
attagctggaggaatttggc

SEQ ID NO: 267498 - DNA, 20 bp, Artificial Sequence
  chemically synthesized
ttaaattagctggaggaatt

SEQ ID NO: 267499 - DNA, 20 bp, Artificial Sequence
  chemically synthesized
aacatctggccaaattcctc

SEQ ID NO: 267500 - DNA, 20 bp, Artificial Sequence
  chemically synthesized
acattgtttaaattagctgg

SEQ ID NO: 267501 - DNA, 20 bp, Artificial Sequence
  chemically synthesized
gacattgtttaaattagctg

SEQ ID NO: 267502 - DNA, 20 bp, Artificial Sequence
  chemically synthesized
tggacattgtttaaattagc

SEQ ID NO: 267503 - DNA, 20 bp, Artificial Sequence
  chemically synthesized
tcactggacattgtttaaat

SEQ ID NO: 267504 - DNA, 20 bp, Artificial Sequence
  chemically synthesized
cagctaatttaaacaatgtc

SEQ ID NO: 267505 - DNA, 20 bp, Artificial Sequence
  chemically synthesized
tcccatcaactgaacatcac

SEQ ID NO: 267506 - DNA, 20 bp, Artificial Sequence
  chemically synthesized
aaacaatgtccagtgatgtt

SEQ ID NO: 267507 - DNA, 20 bp, Artificial Sequence
  chemically synthesized
gtccagtgatgttcagttga

SEQ ID NO: 267508 - DNA, 20 bp, Artificial Sequence
  chemically synthesized
tccagtgatgttcagttgat

SEQ ID NO: 267509 - DNA, 20 bp, Artificial Sequence
  chemically synthesized
ttcagttgatgggaacaaaa

SEQ ID NO: 267510 - DNA, 20 bp, Artificial Sequence
  chemically synthesized
tcagttgatgggaacaaaat

SEQ ID NO: 267511 - DNA, 20 bp, Artificial Sequence
  chemically synthesized
tgggaacaaaataggaaatg

SEQ ID NO: 267512 - DNA, 20 bp, Artificial Sequence
  chemically synthesized
aggaaatgtggactaatttc

SEQ ID NO: 267513 - DNA, 20 bp, Artificial Sequence
  chemically synthesized
cttaagaaggcactagaaat

SEQ ID NO: 267514 - DNA, 20 bp, Artificial Sequence
  chemically synthesized
tgtggaacttaagaaggcac

SEQ ID NO: 267515 - DNA, 20 bp, Artificial Sequence
  chemically synthesized
ctaatttctagtgccttctt

SEQ ID NO: 267516 - DNA, 20 bp, Artificial Sequence
  chemically synthesized
taattttgtggaacttaaga

SEQ ID NO: 267517 - DNA, 20 bp, Artificial Sequence
  chemically synthesized
ataattttgtggaacttaag

SEQ ID NO: 267518 - DNA, 20 bp, Artificial Sequence
  chemically synthesized
tttataattttgtggaactt

SEQ ID NO: 267519 - DNA, 20 bp, Artificial Sequence
  chemically synthesized
agttttaatttataattttg

SEQ ID NO: 267520 - DNA, 20 bp, Artificial Sequence
  chemically synthesized
aaattataaattaaaactaa

SEQ ID NO: 267521 - DNA, 20 bp, Artificial Sequence
  chemically synthesized
gtgataaattgaacatcttt

SEQ ID NO: 267522 - DNA, 20 bp, Artificial Sequence
  chemically synthesized
tttcaaatacaagttgataa

SEQ ID NO: 267523 - DNA, 20 bp, Artificial Sequence
  chemically synthesized
tcactgcttttttcaaatac

SEQ ID NO: 267524 - DNA, 20 bp, Artificial Sequence
  chemically synthesized
tatcaacttgtatttgaaaa

SEQ ID NO: 267525 - DNA, 20 bp, Artificial Sequence
  chemically synthesized
caacttgtatttgaaaaaag

SEQ ID NO: 267526 - DNA, 20 bp, Artificial Sequence
  chemically synthesized
tgaaaaaagcagtgatatga

SEQ ID NO: 267527 - DNA, 20 bp, Artificial Sequence
  chemically synthesized
aaaaagcagtgatatgatgg

SEQ ID NO: 267528 - DNA, 20 bp, Artificial Sequence
  chemically synthesized
tggtggtttataactgctaa

SEQ ID NO: 267529 - DNA, 20 bp, Artificial Sequence
  chemically synthesized
gaatcacttttgaccattag

SEQ ID NO: 267530 - DNA, 20 bp, Artificial Sequence
  chemically synthesized
tgtgaatcacttttgaccat

SEQ ID NO: 267531 - DNA, 20 bp, Artificial Sequence
  chemically synthesized
ttataactgctaatggtcaa

SEQ ID NO: 267532 - DNA, 20 bp, Artificial Sequence
  chemically synthesized
taatggtcaaaagtgattca

SEQ ID NO: 267533 - DNA, 20 bp, Artificial Sequence
  chemically synthesized
aatggtcaaaagtgattcac

SEQ ID NO: 267534 - DNA, 20 bp, Artificial Sequence
  chemically synthesized
tctaggtctctttttttaca

SEQ ID NO: 267535 - DNA, 20 bp, Artificial Sequence
  chemically synthesized
caatttacactctgtaaaaa

SEQ ID NO: 267536 - DNA, 20 bp, Artificial Sequence
  chemically synthesized
actctaggtctcttttttta

SEQ ID NO: 267537 - DNA, 20 bp, Artificial Sequence
  chemically synthesized
atttacactctgtaaaaaaa

SEQ ID NO: 267538 - DNA, 20 bp, Artificial Sequence
  chemically synthesized
actctgtaaaaaaagagacc

SEQ ID NO: 267539 - DNA, 20 bp, Artificial Sequence
  chemically synthesized
tctgtaaaaaaagagaccta

SEQ ID NO: 267540 - DNA, 20 bp, Artificial Sequence
  chemically synthesized
atacataaaagtttaactct

SEQ ID NO: 267541 - DNA, 20 bp, Artificial Sequence
  chemically synthesized
catacataaaagtttaactc

SEQ ID NO: 267542 - DNA, 20 bp, Artificial Sequence
  chemically synthesized
ttgttgaatagcatacataa

SEQ ID NO: 267543 - DNA, 20 bp, Artificial Sequence
  chemically synthesized
actggttccttattgttgaa

SEQ ID NO: 267544 - DNA, 20 bp, Artificial Sequence
  chemically synthesized
tatgtatgctattcaacaat

SEQ ID NO: 267545 - DNA, 20 bp, Artificial Sequence
  chemically synthesized
atgtatgctattcaacaata

SEQ ID NO: 267546 - DNA, 20 bp, Artificial Sequence
  chemically synthesized
gctattcaacaataaggaac

SEQ ID NO: 267547 - DNA, 20 bp, Artificial Sequence
  chemically synthesized
gtatacaaatgattgaatac

SEQ ID NO: 267548 - DNA, 20 bp, Artificial Sequence
  chemically synthesized
catttgtatacatgctgttt

SEQ ID NO: 267549 - DNA, 20 bp, Artificial Sequence
  chemically synthesized
atttgtatacatgctgtttt

SEQ ID NO: 267550 - DNA, 20 bp, Artificial Sequence
  chemically synthesized
tattttttcctaacccaaaa

SEQ ID NO: 267551 - DNA, 20 bp, Artificial Sequence
  chemically synthesized
gtatacatgctgttttgggt

SEQ ID NO: 267552 - DNA, 20 bp, Artificial Sequence
  chemically synthesized
tatacatgctgttttgggtt

SEQ ID NO: 267553 - DNA, 20 bp, Artificial Sequence
  chemically synthesized
gaaaaaatattgtgttaatt

SEQ ID NO: 267554 - DNA, 20 bp, Artificial Sequence
  chemically synthesized
aaaatattgtgttaatttag

SEQ ID NO: 267555 - DNA, 20 bp, Artificial Sequence
  chemically synthesized
aaatattgtgttaatttagt

SEQ ID NO: 267556 - DNA, 20 bp, Artificial Sequence
  chemically synthesized
acatttgagggaaaaattta

SEQ ID NO: 267557 - DNA, 20 bp, Artificial Sequence
  chemically synthesized
cacatttgagggaaaaattt

SEQ ID NO: 267558 - DNA, 20 bp, Artificial Sequence
  chemically synthesized
ttgattaaaaacacatttga

SEQ ID NO: 267559 - DNA, 20 bp, Artificial Sequence
  chemically synthesized
tttgattaaaaacacatttg

SEQ ID NO: 267560 - DNA, 20 bp, Artificial Sequence
  chemically synthesized
ctttgattaaaaacacattt

SEQ ID NO: 267561 - DNA, 20 bp, Artificial Sequence
  chemically synthesized
ctcaaatgtgtttttaatca

SEQ ID NO: 267562 - DNA, 20 bp, Artificial Sequence
  chemically synthesized
tttaatcaaagatatgactt

SEQ ID NO: 267563 - DNA, 20 bp, Artificial Sequence
  chemically synthesized
aaagatatgacttaagaaat

SEQ ID NO: 267564 - DNA, 20 bp, Artificial Sequence
  chemically synthesized
ttatttaagtcttatttctt

SEQ ID NO: 267565 - DNA, 20 bp, Artificial Sequence
  chemically synthesized
ttaagaaataagacttaaat

SEQ ID NO: 267566 - DNA, 20 bp, Artificial Sequence
  chemically synthesized
ttaaaggctaagtcttattt

SEQ ID NO: 267567 - DNA, 20 bp, Artificial Sequence
  chemically synthesized
aataagacttaaataagact

SEQ ID NO: 267568 - DNA, 20 bp, Artificial Sequence
  chemically synthesized
cagcatagtatttaaaggct

SEQ ID NO: 267569 - DNA, 20 bp, Artificial Sequence
  chemically synthesized
aagctcagcatagtatttaa

SEQ ID NO: 267570 - DNA, 20 bp, Artificial Sequence
  chemically synthesized
caagctcagcatagtattta

SEQ ID NO: 267571 - DNA, 20 bp, Artificial Sequence
  chemically synthesized
tagcctttaaatactatgct

SEQ ID NO: 267572 - DNA, 20 bp, Artificial Sequence
  chemically synthesized
tccagaaagcaagctcagca

SEQ ID NO: 267573 - DNA, 20 bp, Artificial Sequence
  chemically synthesized
agatctccagaaagcaagct

SEQ ID NO: 267574 - DNA, 20 bp, Artificial Sequence
  chemically synthesized
actatgctgagcttgctttc

SEQ ID NO: 267575 - DNA, 20 bp, Artificial Sequence
  chemically synthesized
atttcagatctccagaaagc

SEQ ID NO: 267576 - DNA, 20 bp, Artificial Sequence
  chemically synthesized
tatgctgagcttgctttctg

SEQ ID NO: 267577 - DNA, 20 bp, Artificial Sequence
  chemically synthesized
tagtatttcagatctccaga

SEQ ID NO: 267578 - DNA, 20 bp, Artificial Sequence
  chemically synthesized
caattagtatttcagatctc

SEQ ID NO: 267579 - DNA, 20 bp, Artificial Sequence
  chemically synthesized
acattggtcaattagtattt

SEQ ID NO: 267580 - DNA, 20 bp, Artificial Sequence
  chemically synthesized
cctgatatacattggtcaat

SEQ ID NO: 267581 - DNA, 20 bp, Artificial Sequence
  chemically synthesized
attaggcacctgatatacat

SEQ ID NO: 267582 - DNA, 20 bp, Artificial Sequence
  chemically synthesized
actaattgaccaatgtatat

SEQ ID NO: 267583 - DNA, 20 bp, Artificial Sequence
  chemically synthesized
ctaattgaccaatgtatatc

SEQ ID NO: 267584 - DNA, 20 bp, Artificial Sequence
  chemically synthesized
tatatcaggtgcctaatatc

SEQ ID NO: 267585 - DNA, 20 bp, Artificial Sequence
  chemically synthesized
cacagtacagactggatatt

SEQ ID NO: 267586 - DNA, 20 bp, Artificial Sequence
  chemically synthesized
gcacagtacagactggatat

SEQ ID NO: 267587 - DNA, 20 bp, Artificial Sequence
  chemically synthesized
gtgaatagcacagtacagac

SEQ ID NO: 267588 - DNA, 20 bp, Artificial Sequence
  chemically synthesized
tggcagtgaatagcacagta

SEQ ID NO: 267589 - DNA, 20 bp, Artificial Sequence
  chemically synthesized
atctctggcagtgaatagca

SEQ ID NO: 267590 - DNA, 20 bp, Artificial Sequence
  chemically synthesized
tcctcatctctggcagtgaa

SEQ ID NO: 267591 - DNA, 20 bp, Artificial Sequence
  chemically synthesized
tgtactgtgctattcactgc

SEQ ID NO: 267592 - DNA, 20 bp, Artificial Sequence
  chemically synthesized
tactgtgctattcactgcca

SEQ ID NO: 267593 - DNA, 20 bp, Artificial Sequence
  chemically synthesized
acctcattcctcatctctgg

SEQ ID NO: 267594 - DNA, 20 bp, Artificial Sequence
  chemically synthesized
tgctattcactgccagagat

SEQ ID NO: 267595 - DNA, 20 bp, Artificial Sequence
  chemically synthesized
gctattcactgccagagatg

SEQ ID NO: 267596 - DNA, 20 bp, Artificial Sequence
  chemically synthesized
attacctcattcctcatctc

SEQ ID NO: 267597 - DNA, 20 bp, Artificial Sequence
  chemically synthesized
cactgccagagatgaggaat

SEQ ID NO: 267598 - DNA, 20 bp, Artificial Sequence
  chemically synthesized
actgccagagatgaggaatg

SEQ ID NO: 267599 - DNA, 20 bp, Artificial Sequence
  chemically synthesized
tgattagagtgaggtttgca

SEQ ID NO: 267600 - DNA, 20 bp, Artificial Sequence
  chemically synthesized
ctgtaggcatgattagagtg

SEQ ID NO: 267601 - DNA, 20 bp, Artificial Sequence
  chemically synthesized
actgtaggcatgattagagt

SEQ ID NO: 267602 - DNA, 20 bp, Artificial Sequence
  chemically synthesized
ctacactgtaggcatgatta

SEQ ID NO: 267603 - DNA, 20 bp, Artificial Sequence
  chemically synthesized
agctacactgtaggcatgat

SEQ ID NO: 267604 - DNA, 20 bp, Artificial Sequence
  chemically synthesized
cctcactctaatcatgccta

SEQ ID NO: 267605 - DNA, 20 bp, Artificial Sequence
  chemically synthesized
ctctaatcatgcctacagtg

SEQ ID NO: 267606 - DNA, 20 bp, Artificial Sequence
  chemically synthesized
ttcctctgcagctacactgt

SEQ ID NO: 267607 - DNA, 20 bp, Artificial Sequence
  chemically synthesized
tttcctctgcagctacactg

SEQ ID NO: 267608 - DNA, 20 bp, Artificial Sequence
  chemically synthesized
tcatgcctacagtgtagctg

SEQ ID NO: 267609 - DNA, 20 bp, Artificial Sequence
  chemically synthesized
atgcctacagtgtagctgca

SEQ ID NO: 267610 - DNA, 20 bp, Artificial Sequence
  chemically synthesized
tgcctacagtgtagctgcag

SEQ ID NO: 267611 - DNA, 20 bp, Artificial Sequence
  chemically synthesized
tacagtgtagctgcagagga

SEQ ID NO: 267612 - DNA, 20 bp, Artificial Sequence
  chemically synthesized
tgcatttaagctttcctctg

SEQ ID NO: 267613 - DNA, 20 bp, Artificial Sequence
  chemically synthesized
caaattgttttattgcattt

SEQ ID NO: 267614 - DNA, 20 bp, Artificial Sequence
  chemically synthesized
aaaacaatttgatatcatac

SEQ ID NO: 267615 - DNA, 20 bp, Artificial Sequence
  chemically synthesized
aaaaaaatgtgatttttttc

SEQ ID NO: 267616 - DNA, 20 bp, Artificial Sequence
  chemically synthesized
aaaaaaatcacatttttttt

SEQ ID NO: 267617 - DNA, 20 bp, Artificial Sequence
  chemically synthesized
atcacatttttttttggaaa

SEQ ID NO: 267618 - DNA, 20 bp, Artificial Sequence
  chemically synthesized
atttttttttggaaacagat

SEQ ID NO: 267619 - DNA, 20 bp, Artificial Sequence
  chemically synthesized
ttttggaaacagatgagcca

SEQ ID NO: 267620 - DNA, 20 bp, Artificial Sequence
  chemically synthesized
ggaaacagatgagccatggc

SEQ ID NO: 267621 - DNA, 20 bp, Artificial Sequence
  chemically synthesized
attcatgcttattccagcca

SEQ ID NO: 267622 - DNA, 20 bp, Artificial Sequence
  chemically synthesized
agatgagccatggctggaat

SEQ ID NO: 267623 - DNA, 20 bp, Artificial Sequence
  chemically synthesized
gtagtcattcatgcttattc

SEQ ID NO: 267624 - DNA, 20 bp, Artificial Sequence
  chemically synthesized
gaataagcatgaatgactac

SEQ ID NO: 267625 - DNA, 20 bp, Artificial Sequence
  chemically synthesized
aataagcatgaatgactaca

SEQ ID NO: 267626 - DNA, 20 bp, Artificial Sequence
  chemically synthesized
ataagcatgaatgactacaa

SEQ ID NO: 267627 - DNA, 20 bp, Artificial Sequence
  chemically synthesized
gcatgaatgactacaaggga

SEQ ID NO: 267628 - DNA, 20 bp, Artificial Sequence
  chemically synthesized
caagtgtcacctttcccttg

SEQ ID NO: 267629 - DNA, 20 bp, Artificial Sequence
  chemically synthesized
catgaatgactacaagggaa

SEQ ID NO: 267630 - DNA, 20 bp, Artificial Sequence
  chemically synthesized
caagggaaaggtgacacttg

SEQ ID NO: 267631 - DNA, 20 bp, Artificial Sequence
  chemically synthesized
aagggaaaggtgacacttga

SEQ ID NO: 267632 - DNA, 20 bp, Artificial Sequence
  chemically synthesized
ggaaaggtgacacttgaagg

SEQ ID NO: 267633 - DNA, 20 bp, Artificial Sequence
  chemically synthesized
aaaggtgacacttgaaggcg

SEQ ID NO: 267634 - DNA, 20 bp, Artificial Sequence
  chemically synthesized
cccatgcacactccgccttc

SEQ ID NO: 267635 - DNA, 20 bp, Artificial Sequence
  chemically synthesized
acttgaaggcggagtgtgca

SEQ ID NO: 267636 - DNA, 20 bp, Artificial Sequence
  chemically synthesized
cttgaaggcggagtgtgcat

SEQ ID NO: 267637 - DNA, 20 bp, Artificial Sequence
  chemically synthesized
aaggcggagtgtgcatggga

SEQ ID NO: 267638 - DNA, 20 bp, Artificial Sequence
  chemically synthesized
ggagtgtgcatgggatggtt

SEQ ID NO: 267639 - DNA, 20 bp, Artificial Sequence
  chemically synthesized
gggatggtttggattgacta

SEQ ID NO: 267640 - DNA, 20 bp, Artificial Sequence
  chemically synthesized
gtttggattgactaaagaca

SEQ ID NO: 267641 - DNA, 20 bp, Artificial Sequence
  chemically synthesized
gttgcttcgtactttgtctt

SEQ ID NO: 267642 - DNA, 20 bp, Artificial Sequence
  chemically synthesized
ttgactaaagacaaagtacg

SEQ ID NO: 267643 - DNA, 20 bp, Artificial Sequence
  chemically synthesized
aagacaaagtacgaagcaac

SEQ ID NO: 267644 - DNA, 20 bp, Artificial Sequence
  chemically synthesized
acaaagtacgaagcaacgag

SEQ ID NO: 267645 - DNA, 20 bp, Artificial Sequence
  chemically synthesized
caaagtacgaagcaacgaga

SEQ ID NO: 267646 - DNA, 20 bp, Artificial Sequence
  chemically synthesized
gaagcaacgagaaggtatga

SEQ ID NO: 267647 - DNA, 20 bp, Artificial Sequence
  chemically synthesized
caacgagaaggtatgaaagt

SEQ ID NO: 267648 - DNA, 20 bp, Artificial Sequence
  chemically synthesized
aggtatgaaagttagaatac

SEQ ID NO: 267649 - DNA, 20 bp, Artificial Sequence
  chemically synthesized
ggtatgaaagttagaataca

SEQ ID NO: 267650 - DNA, 20 bp, Artificial Sequence
  chemically synthesized
gttagaatacaaggctgcca

SEQ ID NO: 267651 - DNA, 20 bp, Artificial Sequence
  chemically synthesized
tagaatacaaggctgccata

SEQ ID NO: 267652 - DNA, 20 bp, Artificial Sequence
  chemically synthesized
agaatacaaggctgccatag

SEQ ID NO: 267653 - DNA, 20 bp, Artificial Sequence
  chemically synthesized
aattccctgttcctctatgg

SEQ ID NO: 267654 - DNA, 20 bp, Artificial Sequence
  chemically synthesized
aagaattccctgttcctcta

SEQ ID NO: 267655 - DNA, 20 bp, Artificial Sequence
  chemically synthesized
acaaggctgccatagaggaa

SEQ ID NO: 267656 - DNA, 20 bp, Artificial Sequence
  chemically synthesized
caaggctgccatagaggaac

SEQ ID NO: 267657 - DNA, 20 bp, Artificial Sequence
  chemically synthesized
aaggctgccatagaggaaca

SEQ ID NO: 267658 - DNA, 20 bp, Artificial Sequence
  chemically synthesized
gtattcttttagtttacagt

SEQ ID NO: 267659 - DNA, 20 bp, Artificial Sequence
  chemically synthesized
aaatgtattcttttagttta

SEQ ID NO: 267660 - DNA, 20 bp, Artificial Sequence
  chemically synthesized
gaattcttactgtaaactaa

SEQ ID NO: 267661 - DNA, 20 bp, Artificial Sequence
  chemically synthesized
cctcatcaaatgtattcttt

SEQ ID NO: 267662 - DNA, 20 bp, Artificial Sequence
  chemically synthesized
actaaaagaatacatttgat

SEQ ID NO: 267663 - DNA, 20 bp, Artificial Sequence
  chemically synthesized
ctaaaagaatacatttgatg

SEQ ID NO: 267664 - DNA, 20 bp, Artificial Sequence
  chemically synthesized
tgttgacgaaccattttctc

SEQ ID NO: 267665 - DNA, 20 bp, Artificial Sequence
  chemically synthesized
actattagagccagagaaaa

SEQ ID NO: 267666 - DNA, 20 bp, Artificial Sequence
  chemically synthesized
gtgggaaactattagagcca

SEQ ID NO: 267667 - DNA, 20 bp, Artificial Sequence
  chemically synthesized
accattttctctggctctaa

SEQ ID NO: 267668 - DNA, 20 bp, Artificial Sequence
  chemically synthesized
ttgtgggaaactattagagc

SEQ ID NO: 267669 - DNA, 20 bp, Artificial Sequence
  chemically synthesized
tgtgttgtgggaaactatta

SEQ ID NO: 267670 - DNA, 20 bp, Artificial Sequence
  chemically synthesized
cttgtgttgtgggaaactat

SEQ ID NO: 267671 - DNA, 20 bp, Artificial Sequence
  chemically synthesized
ctaatagtttcccacaacac

SEQ ID NO: 267672 - DNA, 20 bp, Artificial Sequence
  chemically synthesized
tgcagacattcttgtgttgt

SEQ ID NO: 267673 - DNA, 20 bp, Artificial Sequence
  chemically synthesized
atgcagacattcttgtgttg

SEQ ID NO: 267674 - DNA, 20 bp, Artificial Sequence
  chemically synthesized
cacaagaatgtctgcatctt

SEQ ID NO: 267675 - DNA, 20 bp, Artificial Sequence
  chemically synthesized
tctccatacatctgaagatg

SEQ ID NO: 267676 - DNA, 20 bp, Artificial Sequence
  chemically synthesized
gttggttctccatacatctg

SEQ ID NO: 267677 - DNA, 20 bp, Artificial Sequence
  chemically synthesized
tgtctgcatcttcagatgta

SEQ ID NO: 267678 - DNA, 20 bp, Artificial Sequence
  chemically synthesized
tctgcatcttcagatgtatg

SEQ ID NO: 267679 - DNA, 20 bp, Artificial Sequence
  chemically synthesized
agatgtatggagaaccaacc

SEQ ID NO: 267680 - DNA, 20 bp, Artificial Sequence
  chemically synthesized
atgtatggagaaccaaccta

SEQ ID NO: 267681 - DNA, 20 bp, Artificial Sequence
  chemically synthesized
ccaaggcaatagctctaggt

SEQ ID NO: 267682 - DNA, 20 bp, Artificial Sequence
  chemically synthesized
atggccaaggcaatagctct

SEQ ID NO: 267683 - DNA, 20 bp, Artificial Sequence
  chemically synthesized
aatggccaaggcaatagctc

SEQ ID NO: 267684 - DNA, 20 bp, Artificial Sequence
  chemically synthesized
ccaacctagagctattgcct

SEQ ID NO: 267685 - DNA, 20 bp, Artificial Sequence
  chemically synthesized
aaagacaatggccaaggcaa

SEQ ID NO: 267686 - DNA, 20 bp, Artificial Sequence
  chemically synthesized
aggtataaagacaatggcca

SEQ ID NO: 267687 - DNA, 20 bp, Artificial Sequence
  chemically synthesized
caggtataaagacaatggcc

SEQ ID NO: 267688 - DNA, 20 bp, Artificial Sequence
  chemically synthesized
gagtacaggtataaagacaa

SEQ ID NO: 267689 - DNA, 20 bp, Artificial Sequence
  chemically synthesized
gaggaatgagtacaggtata

SEQ ID NO: 267690 - DNA, 20 bp, Artificial Sequence
  chemically synthesized
cctttgagaggaatgagtac

SEQ ID NO: 267691 - DNA, 20 bp, Artificial Sequence
  chemically synthesized
ccctttgagaggaatgagta

SEQ ID NO: 267692 - DNA, 20 bp, Artificial Sequence
  chemically synthesized
gagctccctttgagaggaat

SEQ ID NO: 267693 - DNA, 20 bp, Artificial Sequence
  chemically synthesized
acctgtactcattcctctca

SEQ ID NO: 267694 - DNA, 20 bp, Artificial Sequence
  chemically synthesized
cctgtactcattcctctcaa

SEQ ID NO: 267695 - DNA, 20 bp, Artificial Sequence
  chemically synthesized
ctgtactcattcctctcaaa

SEQ ID NO: 267696 - DNA, 20 bp, Artificial Sequence
  chemically synthesized
aataaggagctccctttgag

SEQ ID NO: 267697 - DNA, 20 bp, Artificial Sequence
  chemically synthesized
gtactcattcctctcaaagg

SEQ ID NO: 267698 - DNA, 20 bp, Artificial Sequence
  chemically synthesized
aaataaggagctccctttga

SEQ ID NO: 267699 - DNA, 20 bp, Artificial Sequence
  chemically synthesized
ataaataaggagctcccttt

SEQ ID NO: 267700 - DNA, 20 bp, Artificial Sequence
  chemically synthesized
tcgccaaccctataaataag

SEQ ID NO: 267701 - DNA, 20 bp, Artificial Sequence
  chemically synthesized
caaagggagctccttattta

SEQ ID NO: 267702 - DNA, 20 bp, Artificial Sequence
  chemically synthesized
aaagggagctccttatttat

SEQ ID NO: 267703 - DNA, 20 bp, Artificial Sequence
  chemically synthesized
tctcgccaaccctataaata

SEQ ID NO: 267704 - DNA, 20 bp, Artificial Sequence
  chemically synthesized
aagggagctccttatttata

SEQ ID NO: 267705 - DNA, 20 bp, Artificial Sequence
  chemically synthesized
atctcgccaaccctataaat

SEQ ID NO: 267706 - DNA, 20 bp, Artificial Sequence
  chemically synthesized
gagctccttatttatagggt

SEQ ID NO: 267707 - DNA, 20 bp, Artificial Sequence
  chemically synthesized
tccttatttatagggttggc

SEQ ID NO: 267708 - DNA, 20 bp, Artificial Sequence
  chemically synthesized
tatttatagggttggcgaga

SEQ ID NO: 267709 - DNA, 20 bp, Artificial Sequence
  chemically synthesized
tatagggttggcgagatgga

SEQ ID NO: 267710 - DNA, 20 bp, Artificial Sequence
  chemically synthesized
gttggcgagatggaaagaaa

SEQ ID NO: 267711 - DNA, 20 bp, Artificial Sequence
  chemically synthesized
gatggaaagaaacagctgaa

SEQ ID NO: 267712 - DNA, 20 bp, Artificial Sequence
  chemically synthesized
gaggaaatgccatatctttt

SEQ ID NO: 267713 - DNA, 20 bp, Artificial Sequence
  chemically synthesized
aagaaacagctgaaaagata

SEQ ID NO: 267714 - DNA, 20 bp, Artificial Sequence
  chemically synthesized
atcggatgcttttgaaaagg

SEQ ID NO: 267715 - DNA, 20 bp, Artificial Sequence
  chemically synthesized
aatcggatgcttttgaaaag

SEQ ID NO: 267716 - DNA, 20 bp, Artificial Sequence
  chemically synthesized
tggcatttcctccttttcaa

SEQ ID NO: 267717 - DNA, 20 bp, Artificial Sequence
  chemically synthesized
agaatcggatgcttttgaaa

SEQ ID NO: 267718 - DNA, 20 bp, Artificial Sequence
  chemically synthesized
gagaatcggatgcttttgaa

SEQ ID NO: 267719 - DNA, 20 bp, Artificial Sequence
  chemically synthesized
tttcaaaagcatccgattct

SEQ ID NO: 267720 - DNA, 20 bp, Artificial Sequence
  chemically synthesized
aaggcatgtatgctgagaat

SEQ ID NO: 267721 - DNA, 20 bp, Artificial Sequence
  chemically synthesized
cagaagaaggcatgtatgct

SEQ ID NO: 267722 - DNA, 20 bp, Artificial Sequence
  chemically synthesized
tcacctcacaaggcagaaga

SEQ ID NO: 267723 - DNA, 20 bp, Artificial Sequence
  chemically synthesized
ctcacctcacaaggcagaag

SEQ ID NO: 267724 - DNA, 20 bp, Artificial Sequence
  chemically synthesized
cttctcacctcacaaggcag

SEQ ID NO: 267725 - DNA, 20 bp, Artificial Sequence
  chemically synthesized
catgccttcttctgccttgt

SEQ ID NO: 267726 - DNA, 20 bp, Artificial Sequence
  chemically synthesized
atgccttcttctgccttgtg

SEQ ID NO: 267727 - DNA, 20 bp, Artificial Sequence
  chemically synthesized
ccacttctcacctcacaagg

SEQ ID NO: 267728 - DNA, 20 bp, Artificial Sequence
  chemically synthesized
tctccacttctcacctcaca

SEQ ID NO: 267729 - DNA, 20 bp, Artificial Sequence
  chemically synthesized
cttcttctgccttgtgaggt

SEQ ID NO: 267730 - DNA, 20 bp, Artificial Sequence
  chemically synthesized
ctctccacttctcacctcac

SEQ ID NO: 267731 - DNA, 20 bp, Artificial Sequence
  chemically synthesized
cttctgccttgtgaggtgag

SEQ ID NO: 267732 - DNA, 20 bp, Artificial Sequence
  chemically synthesized
ctgccttgtgaggtgagaag

SEQ ID NO: 267733 - DNA, 20 bp, Artificial Sequence
  chemically synthesized
gccttgtgaggtgagaagtg

SEQ ID NO: 267734 - DNA, 20 bp, Artificial Sequence
  chemically synthesized
cttgtgaggtgagaagtgga

SEQ ID NO: 267735 - DNA, 20 bp, Artificial Sequence
  chemically synthesized
ttgtgaggtgagaagtggag

SEQ ID NO: 267736 - DNA, 20 bp, Artificial Sequence
  chemically synthesized
tgtgaggtgagaagtggaga

SEQ ID NO: 267737 - DNA, 20 bp, Artificial Sequence
  chemically synthesized
gtgagaagtggagagggttc

SEQ ID NO: 267738 - DNA, 20 bp, Artificial Sequence
  chemically synthesized
agaagtggagagggttctag

SEQ ID NO: 267739 - DNA, 20 bp, Artificial Sequence
  chemically synthesized
cttcagaagagtagatcttc

SEQ ID NO: 267740 - DNA, 20 bp, Artificial Sequence
  chemically synthesized
aacttgctccttcagaagag

SEQ ID NO: 267741 - DNA, 20 bp, Artificial Sequence
  chemically synthesized
ctagaagatctactcttctg

SEQ ID NO: 267742 - DNA, 20 bp, Artificial Sequence
  chemically synthesized
tagaagatctactcttctga

SEQ ID NO: 267743 - DNA, 20 bp, Artificial Sequence
  chemically synthesized
ttgaacttgctccttcagaa

SEQ ID NO: 267744 - DNA, 20 bp, Artificial Sequence
  chemically synthesized
gaagatctactcttctgaag

SEQ ID NO: 267745 - DNA, 20 bp, Artificial Sequence
  chemically synthesized
atttgaacttgctccttcag

SEQ ID NO: 267746 - DNA, 20 bp, Artificial Sequence
  chemically synthesized
atctactcttctgaaggagc

SEQ ID NO: 267747 - DNA, 20 bp, Artificial Sequence
  chemically synthesized
tgaatttgaacttgctcctt

SEQ ID NO: 267748 - DNA, 20 bp, Artificial Sequence
  chemically synthesized
gagttataatttagtgaatt

SEQ ID NO: 267749 - DNA, 20 bp, Artificial Sequence
  chemically synthesized
aaagtgtctgagttataatt

SEQ ID NO: 267750 - DNA, 20 bp, Artificial Sequence
  chemically synthesized
aaattcactaaattataact

SEQ ID NO: 267751 - DNA, 20 bp, Artificial Sequence
  chemically synthesized
ctgaaaaacctaaagtgtct

SEQ ID NO: 267752 - DNA, 20 bp, Artificial Sequence
  chemically synthesized
aaattataactcagacactt

SEQ ID NO: 267753 - DNA, 20 bp, Artificial Sequence
  chemically synthesized
aattataactcagacacttt

SEQ ID NO: 267754 - DNA, 20 bp, Artificial Sequence
  chemically synthesized
ctacatgactgaaaaaccta

SEQ ID NO: 267755 - DNA, 20 bp, Artificial Sequence
  chemically synthesized
ctcagacactttaggttttt

SEQ ID NO: 267756 - DNA, 20 bp, Artificial Sequence
  chemically synthesized
ctttaggtttttcagtcatg

SEQ ID NO: 267757 - DNA, 20 bp, Artificial Sequence
  chemically synthesized
tgtagtaatgtgattgctgc

SEQ ID NO: 267758 - DNA, 20 bp, Artificial Sequence
  chemically synthesized
gtagtaatgtgattgctgct

SEQ ID NO: 267759 - DNA, 20 bp, Artificial Sequence
  chemically synthesized
agccctaaaatcgatcctag

SEQ ID NO: 267760 - DNA, 20 bp, Artificial Sequence
  chemically synthesized
ttcagccctaaaatcgatcc

SEQ ID NO: 267761 - DNA, 20 bp, Artificial Sequence
  chemically synthesized
attgctgctaggatcgattt

SEQ ID NO: 267762 - DNA, 20 bp, Artificial Sequence
  chemically synthesized
ttgctgctaggatcgatttt

SEQ ID NO: 267763 - DNA, 20 bp, Artificial Sequence
  chemically synthesized
tgctgctaggatcgatttta

SEQ ID NO: 267764 - DNA, 20 bp, Artificial Sequence
  chemically synthesized
taggatcgattttagggctg

SEQ ID NO: 267765 - DNA, 20 bp, Artificial Sequence
  chemically synthesized
cgattttagggctgaagaaa

SEQ ID NO: 267766 - DNA, 20 bp, Artificial Sequence
  chemically synthesized
acacaatcttgctttttctt

SEQ ID NO: 267767 - DNA, 20 bp, Artificial Sequence
  chemically synthesized
tttagggctgaagaaaaagc

SEQ ID NO: 267768 - DNA, 20 bp, Artificial Sequence
  chemically synthesized
aaagcaagattgtgtacact

SEQ ID NO: 267769 - DNA, 20 bp, Artificial Sequence
  chemically synthesized
tcataggtcaagttaaaact

SEQ ID NO: 267770 - DNA, 20 bp, Artificial Sequence
  chemically synthesized
ttacaatcatgtcataggtc

SEQ ID NO: 267771 - DNA, 20 bp, Artificial Sequence
  chemically synthesized
tggacttacaatcatgtcat

SEQ ID NO: 267772 - DNA, 20 bp, Artificial Sequence
  chemically synthesized
gtggacttacaatcatgtca

SEQ ID NO: 267773 - DNA, 20 bp, Artificial Sequence
  chemically synthesized
ttgacctatgacatgattgt

SEQ ID NO: 267774 - DNA, 20 bp, Artificial Sequence
  chemically synthesized
catgattgtaagtccacctt

SEQ ID NO: 267775 - DNA, 20 bp, Artificial Sequence
  chemically synthesized
atgattgtaagtccaccttc

SEQ ID NO: 267776 - DNA, 20 bp, Artificial Sequence
  chemically synthesized
gattgtaagtccaccttcag

SEQ ID NO: 267777 - DNA, 20 bp, Artificial Sequence
  chemically synthesized
tctcttgaatctcctgaagg

SEQ ID NO: 267778 - DNA, 20 bp, Artificial Sequence
  chemically synthesized
ccttctcttgaatctcctga

SEQ ID NO: 267779 - DNA, 20 bp, Artificial Sequence
  chemically synthesized
accttctcttgaatctcctg

SEQ ID NO: 267780 - DNA, 20 bp, Artificial Sequence
  chemically synthesized
agtccaccttcaggagattc

SEQ ID NO: 267781 - DNA, 20 bp, Artificial Sequence
  chemically synthesized
tccaccttcaggagattcaa

SEQ ID NO: 267782 - DNA, 20 bp, Artificial Sequence
  chemically synthesized
accttcaggagattcaagag

SEQ ID NO: 267783 - DNA, 20 bp, Artificial Sequence
  chemically synthesized
ccttcaggagattcaagaga

SEQ ID NO: 267784 - DNA, 20 bp, Artificial Sequence
  chemically synthesized
gtgaacgcaaactatatact

SEQ ID NO: 267785 - DNA, 20 bp, Artificial Sequence
  chemically synthesized
aacccttagtgccaagtata

SEQ ID NO: 267786 - DNA, 20 bp, Artificial Sequence
  chemically synthesized
caaactatatacttggcact

SEQ ID NO: 267787 - DNA, 20 bp, Artificial Sequence
  chemically synthesized
aaactatatacttggcacta

SEQ ID NO: 267788 - DNA, 20 bp, Artificial Sequence
  chemically synthesized
tcataaaaacccttagtgcc

SEQ ID NO: 267789 - DNA, 20 bp, Artificial Sequence
  chemically synthesized
aactatatacttggcactaa

SEQ ID NO: 267790 - DNA, 20 bp, Artificial Sequence
  chemically synthesized
ccctctatcataaaaaccct

SEQ ID NO: 267791 - DNA, 20 bp, Artificial Sequence
  chemically synthesized
ggcactaagggtttttatga

SEQ ID NO: 267792 - DNA, 20 bp, Artificial Sequence
  chemically synthesized
cactaagggtttttatgata

SEQ ID NO: 267793 - DNA, 20 bp, Artificial Sequence
  chemically synthesized
actaagggtttttatgatag

SEQ ID NO: 267794 - DNA, 20 bp, Artificial Sequence
  chemically synthesized
ctaagggtttttatgataga

SEQ ID NO: 267795 - DNA, 20 bp, Artificial Sequence
  chemically synthesized
taagggtttttatgatagag

SEQ ID NO: 267796 - DNA, 20 bp, Artificial Sequence
  chemically synthesized
gaggggaaaatatctgacat

SEQ ID NO: 267797 - DNA, 20 bp, Artificial Sequence
  chemically synthesized
taattggattttacttatgt

SEQ ID NO: 267798 - DNA, 20 bp, Artificial Sequence
  chemically synthesized
gtgagaatttatagtttaat

SEQ ID NO: 267799 - DNA, 20 bp, Artificial Sequence
  chemically synthesized
ttagacattgtgagaattta

SEQ ID NO: 267800 - DNA, 20 bp, Artificial Sequence
  chemically synthesized
aataatatgttagacattgt

SEQ ID NO: 267801 - DNA, 20 bp, Artificial Sequence
  chemically synthesized
acatatggaaaataatatgt

SEQ ID NO: 267802 - DNA, 20 bp, Artificial Sequence
  chemically synthesized
aaatgttacaaagtaacata

SEQ ID NO: 267803 - DNA, 20 bp, Artificial Sequence
  chemically synthesized
tggagctatcaaatgttaca

SEQ ID NO: 267804 - DNA, 20 bp, Artificial Sequence
  chemically synthesized
tgttactttgtaacatttga

SEQ ID NO: 267805 - DNA, 20 bp, Artificial Sequence
  chemically synthesized
tttgtaacatttgatagctc

SEQ ID NO: 267806 - DNA, 20 bp, Artificial Sequence
  chemically synthesized
tatttggactatttatactg

SEQ ID NO: 267807 - DNA, 20 bp, Artificial Sequence
  chemically synthesized
tttgatagctccagtataaa

SEQ ID NO: 267808 - DNA, 20 bp, Artificial Sequence
  chemically synthesized
agtatttggactatttatac

SEQ ID NO: 267809 - DNA, 20 bp, Artificial Sequence
  chemically synthesized
gtataaatagtccaaatact

SEQ ID NO: 267810 - DNA, 20 bp, Artificial Sequence
  chemically synthesized
ggaagttagtgcttagtatt

SEQ ID NO: 267811 - DNA, 20 bp, Artificial Sequence
  chemically synthesized
aaatcatggaagttagtgct

SEQ ID NO: 267812 - DNA, 20 bp, Artificial Sequence
  chemically synthesized
ttgtttgaaatcatggaagt

SEQ ID NO: 267813 - DNA, 20 bp, Artificial Sequence
  chemically synthesized
aaatttgtttgaaatcatgg

SEQ ID NO: 267814 - DNA, 20 bp, Artificial Sequence
  chemically synthesized
agcaaatttgtttgaaatca

SEQ ID NO: 267815 - DNA, 20 bp, Artificial Sequence
  chemically synthesized
aattatggctaagaagtaga

SEQ ID NO: 267816 - DNA, 20 bp, Artificial Sequence
  chemically synthesized
caaatttgctgtctacttct

SEQ ID NO: 267817 - DNA, 20 bp, Artificial Sequence
  chemically synthesized
tacaaattatggctaagaag

SEQ ID NO: 267818 - DNA, 20 bp, Artificial Sequence
  chemically synthesized
atttacaaattatggctaag

SEQ ID NO: 267819 - DNA, 20 bp, Artificial Sequence
  chemically synthesized
agcatttacaaattatggct

SEQ ID NO: 267820 - DNA, 20 bp, Artificial Sequence
  chemically synthesized
agagtagcatttacaaatta

SEQ ID NO: 267821 - DNA, 20 bp, Artificial Sequence
  chemically synthesized
ttataataaggaaattagag

SEQ ID NO: 267822 - DNA, 20 bp, Artificial Sequence
  chemically synthesized
cttttataataaggaaatta

SEQ ID NO: 267823 - DNA, 20 bp, Artificial Sequence
  chemically synthesized
ttcttttataataaggaaat

SEQ ID NO: 267824 - DNA, 20 bp, Artificial Sequence
  chemically synthesized
atactcattcttttataata

SEQ ID NO: 267825 - DNA, 20 bp, Artificial Sequence
  chemically synthesized
ctctaatttccttattataa

SEQ ID NO: 267826 - DNA, 20 bp, Artificial Sequence
  chemically synthesized
tatactcattcttttataat

SEQ ID NO: 267827 - DNA, 20 bp, Artificial Sequence
  chemically synthesized
tttccttattataaaagaat

SEQ ID NO: 267828 - DNA, 20 bp, Artificial Sequence
  chemically synthesized
tataaaagaatgagtataat

SEQ ID NO: 267829 - DNA, 20 bp, Artificial Sequence
  chemically synthesized
tataatgagttaatttcttc

SEQ ID NO: 267830 - DNA, 20 bp, Artificial Sequence
  chemically synthesized
tgagttaatttcttccagtg

SEQ ID NO: 267831 - DNA, 20 bp, Artificial Sequence
  chemically synthesized
atggggcatgacttcactgg

SEQ ID NO: 267832 - DNA, 20 bp, Artificial Sequence
  chemically synthesized
aacatggggcatgacttcac

SEQ ID NO: 267833 - DNA, 20 bp, Artificial Sequence
  chemically synthesized
tcatccttcccatcaacatg

SEQ ID NO: 267834 - DNA, 20 bp, Artificial Sequence
  chemically synthesized
gaagtcatgccccatgttga

SEQ ID NO: 267835 - DNA, 20 bp, Artificial Sequence
  chemically synthesized
ttcatccttcccatcaacat

SEQ ID NO: 267836 - DNA, 20 bp, Artificial Sequence
  chemically synthesized
aagtcatgccccatgttgat

SEQ ID NO: 267837 - DNA, 20 bp, Artificial Sequence
  chemically synthesized
cttcatccttcccatcaaca

SEQ ID NO: 267838 - DNA, 20 bp, Artificial Sequence
  chemically synthesized
tcatgccccatgttgatggg

SEQ ID NO: 267839 - DNA, 20 bp, Artificial Sequence
  chemically synthesized
catgccccatgttgatggga

SEQ ID NO: 267840 - DNA, 20 bp, Artificial Sequence
  chemically synthesized
ccatgttgatgggaaggatg

SEQ ID NO: 267841 - DNA, 20 bp, Artificial Sequence
  chemically synthesized
tgtagatatggggaatgaat

SEQ ID NO: 267842 - DNA, 20 bp, Artificial Sequence
  chemically synthesized
caattatacttgtagatatg

SEQ ID NO: 267843 - DNA, 20 bp, Artificial Sequence
  chemically synthesized
gcaattatacttgtagatat

SEQ ID NO: 267844 - DNA, 20 bp, Artificial Sequence
  chemically synthesized
gattcattccccatatctac

SEQ ID NO: 267845 - DNA, 20 bp, Artificial Sequence
  chemically synthesized
agcaattatacttgtagata

SEQ ID NO: 267846 - DNA, 20 bp, Artificial Sequence
  chemically synthesized
tctacaagcaattatacttg

SEQ ID NO: 267847 - DNA, 20 bp, Artificial Sequence
  chemically synthesized
tctacaagtataattgcttg

SEQ ID NO: 267848 - DNA, 20 bp, Artificial Sequence
  chemically synthesized
atgcctttttaaatttctac

SEQ ID NO: 267849 - DNA, 20 bp, Artificial Sequence
  chemically synthesized
attgcttgtagaaatttaaa

SEQ ID NO: 267850 - DNA, 20 bp, Artificial Sequence
  chemically synthesized
ttgcttgtagaaatttaaaa

SEQ ID NO: 267851 - DNA, 20 bp, Artificial Sequence
  chemically synthesized
gaaatttaaaaaggcatgtt

SEQ ID NO: 267852 - DNA, 20 bp, Artificial Sequence
  chemically synthesized
ttaaaaaggcatgttcggtt

SEQ ID NO: 267853 - DNA, 20 bp, Artificial Sequence
  chemically synthesized
taaaaaggcatgttcggttc

SEQ ID NO: 267854 - DNA, 20 bp, Artificial Sequence
  chemically synthesized
aaaaaggcatgttcggttca

SEQ ID NO: 267855 - DNA, 20 bp, Artificial Sequence
  chemically synthesized
ggcatgttcggttcagggtt

SEQ ID NO: 267856 - DNA, 20 bp, Artificial Sequence
  chemically synthesized
tcggttcagggttcagctat

SEQ ID NO: 267857 - DNA, 20 bp, Artificial Sequence
  chemically synthesized
gtatcagtgaagtgagccga

SEQ ID NO: 267858 - DNA, 20 bp, Artificial Sequence
  chemically synthesized
tgctactgtatcagtgaagt

SEQ ID NO: 267859 - DNA, 20 bp, Artificial Sequence
  chemically synthesized
atcttgctactgtatcagtg

SEQ ID NO: 267860 - DNA, 20 bp, Artificial Sequence
  chemically synthesized
atcggctcacttcactgata

SEQ ID NO: 267861 - DNA, 20 bp, Artificial Sequence
  chemically synthesized
ggctcacttcactgatacag

SEQ ID NO: 267862 - DNA, 20 bp, Artificial Sequence
  chemically synthesized
tttccatcttgctactgtat

SEQ ID NO: 267863 - DNA, 20 bp, Artificial Sequence
  chemically synthesized
cacttcactgatacagtagc

SEQ ID NO: 267864 - DNA, 20 bp, Artificial Sequence
  chemically synthesized
tcactgatacagtagcaaga

SEQ ID NO: 267865 - DNA, 20 bp, Artificial Sequence
  chemically synthesized
gatggaaaaaccttctccat

SEQ ID NO: 267866 - DNA, 20 bp, Artificial Sequence
  chemically synthesized
tcagcagagaccaatggaga

SEQ ID NO: 267867 - DNA, 20 bp, Artificial Sequence
  chemically synthesized
atcagcagagaccaatggag

SEQ ID NO: 267868 - DNA, 20 bp, Artificial Sequence
  chemically synthesized
ataatcagcagagaccaatg

SEQ ID NO: 267869 - DNA, 20 bp, Artificial Sequence
  chemically synthesized
gtataatcagcagagaccaa

SEQ ID NO: 267870 - DNA, 20 bp, Artificial Sequence
  chemically synthesized
tgctgatggtataatcagca

SEQ ID NO: 267871 - DNA, 20 bp, Artificial Sequence
  chemically synthesized
aatgctgatggtataatcag

SEQ ID NO: 267872 - DNA, 20 bp, Artificial Sequence
  chemically synthesized
aaaaatgctgatggtataat

SEQ ID NO: 267873 - DNA, 20 bp, Artificial Sequence
  chemically synthesized
gtctctgctgattataccat

SEQ ID NO: 267874 - DNA, 20 bp, Artificial Sequence
  chemically synthesized
aaaataatgaaaaatgctga

SEQ ID NO: 267875 - DNA, 20 bp, Artificial Sequence
  chemically synthesized
ttttcattatttttatttaa

SEQ ID NO: 267876 - DNA, 20 bp, Artificial Sequence
  chemically synthesized
tcattatttttatttaatgg

SEQ ID NO: 267877 - DNA, 20 bp, Artificial Sequence
  chemically synthesized
atttttatttaatggtagaa

SEQ ID NO: 267878 - DNA, 20 bp, Artificial Sequence
  chemically synthesized
ggtagaacggtaaaaattat

SEQ ID NO: 267879 - DNA, 20 bp, Artificial Sequence
  chemically synthesized
aaattattggaaaaatcatc

SEQ ID NO: 267880 - DNA, 20 bp, Artificial Sequence
  chemically synthesized
ggaaaaatcatctggtccta

SEQ ID NO: 267881 - DNA, 20 bp, Artificial Sequence
  chemically synthesized
gaaaaatcatctggtcctat

SEQ ID NO: 267882 - DNA, 20 bp, Artificial Sequence
  chemically synthesized
taaaggtgttcctataggac

SEQ ID NO: 267883 - DNA, 20 bp, Artificial Sequence
  chemically synthesized
gtttgtaaaggtgttcctat

SEQ ID NO: 267884 - DNA, 20 bp, Artificial Sequence
  chemically synthesized
tgtttgtaaaggtgttccta

SEQ ID NO: 267885 - DNA, 20 bp, Artificial Sequence
  chemically synthesized
ctgaagggaaatgtttgtaa

SEQ ID NO: 267886 - DNA, 20 bp, Artificial Sequence
  chemically synthesized
cctgaagggaaatgtttgta

SEQ ID NO: 267887 - DNA, 20 bp, Artificial Sequence
  chemically synthesized
cctttacaaacatttccctt

SEQ ID NO: 267888 - DNA, 20 bp, Artificial Sequence
  chemically synthesized
ctttacaaacatttcccttc

SEQ ID NO: 267889 - DNA, 20 bp, Artificial Sequence
  chemically synthesized
tttacaaacatttcccttca

SEQ ID NO: 267890 - DNA, 20 bp, Artificial Sequence
  chemically synthesized
ttacaaacatttcccttcag

SEQ ID NO: 267891 - DNA, 20 bp, Artificial Sequence
  chemically synthesized
tacatttctttacccctgaa

SEQ ID NO: 267892 - DNA, 20 bp, Artificial Sequence
  chemically synthesized
ctacatttctttacccctga

SEQ ID NO: 267893 - DNA, 20 bp, Artificial Sequence
  chemically synthesized
gctacatttctttacccctg

SEQ ID NO: 267894 - DNA, 20 bp, Artificial Sequence
  chemically synthesized
aacatttcccttcaggggta

SEQ ID NO: 267895 - DNA, 20 bp, Artificial Sequence
  chemically synthesized
ccttcaggggtaaagaaatg

SEQ ID NO: 267896 - DNA, 20 bp, Artificial Sequence
  chemically synthesized
ggagagaatagaggttaagt

SEQ ID NO: 267897 - DNA, 20 bp, Artificial Sequence
  chemically synthesized
tggaggagagaatagaggtt

SEQ ID NO: 267898 - DNA, 20 bp, Artificial Sequence
  chemically synthesized
atgggtggaggagagaatag

SEQ ID NO: 267899 - DNA, 20 bp, Artificial Sequence
  chemically synthesized
aatgggtggaggagagaata

SEQ ID NO: 267900 - DNA, 20 bp, Artificial Sequence
  chemically synthesized
gaaatgggtggaggagagaa

SEQ ID NO: 267901 - DNA, 20 bp, Artificial Sequence
  chemically synthesized
aatacgaaatgggtggagga

SEQ ID NO: 267902 - DNA, 20 bp, Artificial Sequence
  chemically synthesized
aaaatacgaaatgggtggag

SEQ ID NO: 267903 - DNA, 20 bp, Artificial Sequence
  chemically synthesized
tgaaaatacgaaatgggtgg

SEQ ID NO: 267904 - DNA, 20 bp, Artificial Sequence
  chemically synthesized
gtgaaaatacgaaatgggtg

SEQ ID NO: 267905 - DNA, 20 bp, Artificial Sequence
  chemically synthesized
ttgtgaaaatacgaaatggg

SEQ ID NO: 267906 - DNA, 20 bp, Artificial Sequence
  chemically synthesized
aacttgtgaaaatacgaaat

SEQ ID NO: 267907 - DNA, 20 bp, Artificial Sequence
  chemically synthesized
aaacttgtgaaaatacgaaa

SEQ ID NO: 267908 - DNA, 20 bp, Artificial Sequence
  chemically synthesized
cacccatttcgtattttcac

SEQ ID NO: 267909 - DNA, 20 bp, Artificial Sequence
  chemically synthesized
tcgtattttcacaagttttc

SEQ ID NO: 267910 - DNA, 20 bp, Artificial Sequence
  chemically synthesized
agaaaatctgtggaaggtac

SEQ ID NO: 267911 - DNA, 20 bp, Artificial Sequence
  chemically synthesized
aagttttccagtaccttcca

SEQ ID NO: 267912 - DNA, 20 bp, Artificial Sequence
  chemically synthesized
attccaagaaaatctgtgga

SEQ ID NO: 267913 - DNA, 20 bp, Artificial Sequence
  chemically synthesized
aattccaagaaaatctgtgg

SEQ ID NO: 267914 - DNA, 20 bp, Artificial Sequence
  chemically synthesized
agaaattccaagaaaatctg

SEQ ID NO: 267915 - DNA, 20 bp, Artificial Sequence
  chemically synthesized
gtaccttccacagattttct

SEQ ID NO: 267916 - DNA, 20 bp, Artificial Sequence
  chemically synthesized
ataagtccctgagaaattcc

SEQ ID NO: 267917 - DNA, 20 bp, Artificial Sequence
  chemically synthesized
cagattttcttggaatttct

SEQ ID NO: 267918 - DNA, 20 bp, Artificial Sequence
  chemically synthesized
agattttcttggaatttctc

SEQ ID NO: 267919 - DNA, 20 bp, Artificial Sequence
  chemically synthesized
gattttcttggaatttctca

SEQ ID NO: 267920 - DNA, 20 bp, Artificial Sequence
  chemically synthesized
tcttaagaatataagtccct

SEQ ID NO: 267921 - DNA, 20 bp, Artificial Sequence
  chemically synthesized
agaagttatcttaagaatat

SEQ ID NO: 267922 - DNA, 20 bp, Artificial Sequence
  chemically synthesized
tctcagggacttatattctt

SEQ ID NO: 267923 - DNA, 20 bp, Artificial Sequence
  chemically synthesized
tcagacagagaagttatctt

SEQ ID NO: 267924 - DNA, 20 bp, Artificial Sequence
  chemically synthesized
aaaaaagagatcagacagag

SEQ ID NO: 267925 - DNA, 20 bp, Artificial Sequence
  chemically synthesized
tggaaaaaagagatcagaca

SEQ ID NO: 267926 - DNA, 20 bp, Artificial Sequence
  chemically synthesized
ggtggaaaaaagagatcaga

SEQ ID NO: 267927 - DNA, 20 bp, Artificial Sequence
  chemically synthesized
agggggtggaaaaaagagat

SEQ ID NO: 267928 - DNA, 20 bp, Artificial Sequence
  chemically synthesized
aaaagagggggtggaaaaaa

SEQ ID NO: 267929 - DNA, 20 bp, Artificial Sequence
  chemically synthesized
taaaaagagggggtggaaaa

SEQ ID NO: 267930 - DNA, 20 bp, Artificial Sequence
  chemically synthesized
atttgtttaaaaagaggggg

SEQ ID NO: 267931 - DNA, 20 bp, Artificial Sequence
  chemically synthesized
aaaatttgtttaaaaagagg

SEQ ID NO: 267932 - DNA, 20 bp, Artificial Sequence
  chemically synthesized
taaaatttgtttaaaaagag

SEQ ID NO: 267933 - DNA, 20 bp, Artificial Sequence
  chemically synthesized
ataaaatttgtttaaaaaga

SEQ ID NO: 267934 - DNA, 20 bp, Artificial Sequence
  chemically synthesized
aataaaatttgtttaaaaag

SEQ ID NO: 267935 - DNA, 20 bp, Artificial Sequence
  chemically synthesized
taataaaatttgtttaaaaa

SEQ ID NO: 267936 - DNA, 20 bp, Artificial Sequence
  chemically synthesized
gataataaaatttgtttaaa

SEQ ID NO: 267937 - DNA, 20 bp, Artificial Sequence
  chemically synthesized
taaacaaattttattatctt

SEQ ID NO: 267938 - DNA, 20 bp, Artificial Sequence
  chemically synthesized
aacaaattttattatcttaa

SEQ ID NO: 267939 - DNA, 20 bp, Artificial Sequence
  chemically synthesized
ctagagaacaggagactctt

SEQ ID NO: 267940 - DNA, 20 bp, Artificial Sequence
  chemically synthesized
agataagctctagagaacag

SEQ ID NO: 267941 - DNA, 20 bp, Artificial Sequence
  chemically synthesized
cttaagagtctcctgttctc

SEQ ID NO: 267942 - DNA, 20 bp, Artificial Sequence
  chemically synthesized
gaagataagctctagagaac

SEQ ID NO: 267943 - DNA, 20 bp, Artificial Sequence
  chemically synthesized
taagagtctcctgttctcta

SEQ ID NO: 267944 - DNA, 20 bp, Artificial Sequence
  chemically synthesized
tgaagataagctctagagaa

SEQ ID NO: 267945 - DNA, 20 bp, Artificial Sequence
  chemically synthesized
ctgattgaagataagctcta

SEQ ID NO: 267946 - DNA, 20 bp, Artificial Sequence
  chemically synthesized
tgctgattgaagataagctc

SEQ ID NO: 267947 - DNA, 20 bp, Artificial Sequence
  chemically synthesized
atgtggtgctgattgaagat

SEQ ID NO: 267948 - DNA, 20 bp, Artificial Sequence
  chemically synthesized
ctctagagcttatcttcaat

SEQ ID NO: 267949 - DNA, 20 bp, Artificial Sequence
  chemically synthesized
aataaatgtggtgctgattg

SEQ ID NO: 267950 - DNA, 20 bp, Artificial Sequence
  chemically synthesized
ggtacgtaggtaaataaatg

SEQ ID NO: 267951 - DNA, 20 bp, Artificial Sequence
  chemically synthesized
gaaatgatgttaaggtacgt

SEQ ID NO: 267952 - DNA, 20 bp, Artificial Sequence
  chemically synthesized
ggaaatgatgttaaggtacg

SEQ ID NO: 267953 - DNA, 20 bp, Artificial Sequence
  chemically synthesized
tctataaggaaatgatgtta

SEQ ID NO: 267954 - DNA, 20 bp, Artificial Sequence
  chemically synthesized
atctataaggaaatgatgtt

SEQ ID NO: 267955 - DNA, 20 bp, Artificial Sequence
  chemically synthesized
accttaacatcatttcctta

SEQ ID NO: 267956 - DNA, 20 bp, Artificial Sequence
  chemically synthesized
agtaaagggaggaatctata

SEQ ID NO: 267957 - DNA, 20 bp, Artificial Sequence
  chemically synthesized
tagtaaagggaggaatctat

SEQ ID NO: 267958 - DNA, 20 bp, Artificial Sequence
  chemically synthesized
aattgagtcctagtaaaggg

SEQ ID NO: 267959 - DNA, 20 bp, Artificial Sequence
  chemically synthesized
ttatagattcctccctttac

SEQ ID NO: 267960 - DNA, 20 bp, Artificial Sequence
  chemically synthesized
taattgagtcctagtaaagg

SEQ ID NO: 267961 - DNA, 20 bp, Artificial Sequence
  chemically synthesized
tatagattcctccctttact

SEQ ID NO: 267962 - DNA, 20 bp, Artificial Sequence
  chemically synthesized
tttaattgagtcctagtaaa

SEQ ID NO: 267963 - DNA, 20 bp, Artificial Sequence
  chemically synthesized
atttaattgagtcctagtaa

SEQ ID NO: 267964 - DNA, 20 bp, Artificial Sequence
  chemically synthesized
aatttaattgagtcctagta

SEQ ID NO: 267965 - DNA, 20 bp, Artificial Sequence
  chemically synthesized
gtctgaatttaattgagtcc

SEQ ID NO: 267966 - DNA, 20 bp, Artificial Sequence
  chemically synthesized
aaataagtctgaatttaatt

SEQ ID NO: 267967 - DNA, 20 bp, Artificial Sequence
  chemically synthesized
tactaggactcaattaaatt

SEQ ID NO: 267968 - DNA, 20 bp, Artificial Sequence
  chemically synthesized
aattaaattcagacttattt

SEQ ID NO: 267969 - DNA, 20 bp, Artificial Sequence
  chemically synthesized
gagaaaggaatagctaaaat

SEQ ID NO: 267970 - DNA, 20 bp, Artificial Sequence
  chemically synthesized
acatgagtaagagaaaggaa

SEQ ID NO: 267971 - DNA, 20 bp, Artificial Sequence
  chemically synthesized
agggaacatgagtaagagaa

SEQ ID NO: 267972 - DNA, 20 bp, Artificial Sequence
  chemically synthesized
cagggaacatgagtaagaga

SEQ ID NO: 267973 - DNA, 20 bp, Artificial Sequence
  chemically synthesized
attacagggaacatgagtaa

SEQ ID NO: 267974 - DNA, 20 bp, Artificial Sequence
  chemically synthesized
atattacagggaacatgagt

SEQ ID NO: 267975 - DNA, 20 bp, Artificial Sequence
  chemically synthesized
attcatattacagggaacat

SEQ ID NO: 267976 - DNA, 20 bp, Artificial Sequence
  chemically synthesized
agccttttattcatattaca

SEQ ID NO: 267977 - DNA, 20 bp, Artificial Sequence
  chemically synthesized
tagccttttattcatattac

SEQ ID NO: 267978 - DNA, 20 bp, Artificial Sequence
  chemically synthesized
ttagccttttattcatatta

SEQ ID NO: 267979 - DNA, 20 bp, Artificial Sequence
  chemically synthesized
gttccctgtaatatgaataa

SEQ ID NO: 267980 - DNA, 20 bp, Artificial Sequence
  chemically synthesized
ttccctgtaatatgaataaa

SEQ ID NO: 267981 - DNA, 20 bp, Artificial Sequence
  chemically synthesized
tatgaataaaaggctaacta

SEQ ID NO: 267982 - DNA, 20 bp, Artificial Sequence
  chemically synthesized
ccttttatggatgctttagt

SEQ ID NO: 267983 - DNA, 20 bp, Artificial Sequence
  chemically synthesized
gatgccttttatggatgctt

SEQ ID NO: 267984 - DNA, 20 bp, Artificial Sequence
  chemically synthesized
gctaactaaagcatccataa

SEQ ID NO: 267985 - DNA, 20 bp, Artificial Sequence
  chemically synthesized
ctaactaaagcatccataaa

SEQ ID NO: 267986 - DNA, 20 bp, Artificial Sequence
  chemically synthesized
acttctcaagatgcctttta

SEQ ID NO: 267987 - DNA, 20 bp, Artificial Sequence
  chemically synthesized
gcatccataaaaggcatctt

SEQ ID NO: 267988 - DNA, 20 bp, Artificial Sequence
  chemically synthesized
tccataaaaggcatcttgag

SEQ ID NO: 267989 - DNA, 20 bp, Artificial Sequence
  chemically synthesized
cctgggtagggggacttctc

SEQ ID NO: 267990 - DNA, 20 bp, Artificial Sequence
  chemically synthesized
tcttgagaagtccccctacc

SEQ ID NO: 267991 - DNA, 20 bp, Artificial Sequence
  chemically synthesized
cttgagaagtccccctaccc

SEQ ID NO: 267992 - DNA, 20 bp, Artificial Sequence
  chemically synthesized
gcagaattcacctgggtagg

SEQ ID NO: 267993 - DNA, 20 bp, Artificial Sequence
  chemically synthesized
tgcagaattcacctgggtag

SEQ ID NO: 267994 - DNA, 20 bp, Artificial Sequence
  chemically synthesized
gtgcagaattcacctgggta

SEQ ID NO: 267995 - DNA, 20 bp, Artificial Sequence
  chemically synthesized
agtgcagaattcacctgggt

SEQ ID NO: 267996 - DNA, 20 bp, Artificial Sequence
  chemically synthesized
aagtgcagaattcacctggg

SEQ ID NO: 267997 - DNA, 20 bp, Artificial Sequence
  chemically synthesized
actaagtgcagaattcacct

SEQ ID NO: 267998 - DNA, 20 bp, Artificial Sequence
  chemically synthesized
tactaagtgcagaattcacc

SEQ ID NO: 267999 - DNA, 20 bp, Artificial Sequence
  chemically synthesized
acccaggtgaattctgcact

SEQ ID NO: 268000 - DNA, 20 bp, Artificial Sequence
  chemically synthesized
atatttgcaaatactaagtg

SEQ ID NO: 268001 - DNA, 20 bp, Artificial Sequence
  chemically synthesized
gtataatatttgcaaatact

SEQ ID NO: 268002 - DNA, 20 bp, Artificial Sequence
  chemically synthesized
ctgttctctgtgatcagaaa

SEQ ID NO: 268003 - DNA, 20 bp, Artificial Sequence
  chemically synthesized
tattataccatttctgatca

SEQ ID NO: 268004 - DNA, 20 bp, Artificial Sequence
  chemically synthesized
ttataccatttctgatcaca

SEQ ID NO: 268005 - DNA, 20 bp, Artificial Sequence
  chemically synthesized
cctctcctgttctctgtgat

SEQ ID NO: 268006 - DNA, 20 bp, Artificial Sequence
  chemically synthesized
ccatttctgatcacagagaa

SEQ ID NO: 268007 - DNA, 20 bp, Artificial Sequence
  chemically synthesized
catttctgatcacagagaac

SEQ ID NO: 268008 - DNA, 20 bp, Artificial Sequence
  chemically synthesized
tttctgatcacagagaacag

SEQ ID NO: 268009 - DNA, 20 bp, Artificial Sequence
  chemically synthesized
tctgatcacagagaacagga

SEQ ID NO: 268010 - DNA, 20 bp, Artificial Sequence
  chemically synthesized
ctgatcacagagaacaggag

SEQ ID NO: 268011 - DNA, 20 bp, Artificial Sequence
  chemically synthesized
tgatcacagagaacaggaga

SEQ ID NO: 268012 - DNA, 20 bp, Artificial Sequence
  chemically synthesized
gttacgtagctaaaaggtga

SEQ ID NO: 268013 - DNA, 20 bp, Artificial Sequence
  chemically synthesized
gagagggttctttcaccttt

SEQ ID NO: 268014 - DNA, 20 bp, Artificial Sequence
  chemically synthesized
gaatatgttacgtagctaaa

SEQ ID NO: 268015 - DNA, 20 bp, Artificial Sequence
  chemically synthesized
cgaatatgttacgtagctaa

SEQ ID NO: 268016 - DNA, 20 bp, Artificial Sequence
  chemically synthesized
ctttccacgaatatgttacg

SEQ ID NO: 268017 - DNA, 20 bp, Artificial Sequence
  chemically synthesized
ttagctacgtaacatattcg

SEQ ID NO: 268018 - DNA, 20 bp, Artificial Sequence
  chemically synthesized
ctacgtaacatattcgtgga

SEQ ID NO: 268019 - DNA, 20 bp, Artificial Sequence
  chemically synthesized
taacatattcgtggaaagaa

SEQ ID NO: 268020 - DNA, 20 bp, Artificial Sequence
  chemically synthesized
aacatattcgtggaaagaaa

SEQ ID NO: 268021 - DNA, 20 bp, Artificial Sequence
  chemically synthesized
atcttagaattgcagtaata

SEQ ID NO: 268022 - DNA, 20 bp, Artificial Sequence
  chemically synthesized
tgccatattactgcaattct

SEQ ID NO: 268023 - DNA, 20 bp, Artificial Sequence
  chemically synthesized
aaatgcacatcttagaattg

SEQ ID NO: 268024 - DNA, 20 bp, Artificial Sequence
  chemically synthesized
aatgtgacaaatgcacatct

SEQ ID NO: 268025 - DNA, 20 bp, Artificial Sequence
  chemically synthesized
atgtgcatttgtcacatttt

SEQ ID NO: 268026 - DNA, 20 bp, Artificial Sequence
  chemically synthesized
tgtgcatttgtcacatttta

SEQ ID NO: 268027 - DNA, 20 bp, Artificial Sequence
  chemically synthesized
tttgtcacattttaaggatt

SEQ ID NO: 268028 - DNA, 20 bp, Artificial Sequence
  chemically synthesized
attttaaggattcggaaatt

SEQ ID NO: 268029 - DNA, 20 bp, Artificial Sequence
  chemically synthesized
ttgagatgtaacatacaatt

SEQ ID NO: 268030 - DNA, 20 bp, Artificial Sequence
  chemically synthesized
tgagatgtaacatacaatta

SEQ ID NO: 268031 - DNA, 20 bp, Artificial Sequence
  chemically synthesized
acaattaaggtttaccttga

SEQ ID NO: 268032 - DNA, 20 bp, Artificial Sequence
  chemically synthesized
attaaggtttaccttgaaag

SEQ ID NO: 268033 - DNA, 20 bp, Artificial Sequence
  chemically synthesized
aaaaaacactaccactttca

SEQ ID NO: 268034 - DNA, 20 bp, Artificial Sequence
  chemically synthesized
aaaaaaacactaccactttc

SEQ ID NO: 268035 - DNA, 20 bp, Artificial Sequence
  chemically synthesized
aaggtttaccttgaaagtgg

SEQ ID NO: 268036 - DNA, 20 bp, Artificial Sequence
  chemically synthesized
tttttttttttttaaattct

SEQ ID NO: 268037 - DNA, 20 bp, Artificial Sequence
  chemically synthesized
ttttttttttaaattctcag

SEQ ID NO: 268038 - DNA, 20 bp, Artificial Sequence
  chemically synthesized
ttgatatgattacagctgct

SEQ ID NO: 268039 - DNA, 20 bp, Artificial Sequence
  chemically synthesized
atgcaccattgatatgatta

SEQ ID NO: 268040 - DNA, 20 bp, Artificial Sequence
  chemically synthesized
agcagctgtaatcatatcaa

SEQ ID NO: 268041 - DNA, 20 bp, Artificial Sequence
  chemically synthesized
tcctcatgtttaagacatgt

SEQ ID NO: 268042 - DNA, 20 bp, Artificial Sequence
  chemically synthesized
atctaacatgtcttaaacat

SEQ ID NO: 268043 - DNA, 20 bp, Artificial Sequence
  chemically synthesized
tctaacatgtcttaaacatg

SEQ ID NO: 268044 - DNA, 20 bp, Artificial Sequence
  chemically synthesized
catctcatttcctcatgttt

SEQ ID NO: 268045 - DNA, 20 bp, Artificial Sequence
  chemically synthesized
tgtcttaaacatgaggaaat

SEQ ID NO: 268046 - DNA, 20 bp, Artificial Sequence
  chemically synthesized
ttgggggctgtaaaagcaat

SEQ ID NO: 268047 - DNA, 20 bp, Artificial Sequence
  chemically synthesized
tgagatgctaattgctttta

SEQ ID NO: 268048 - DNA, 20 bp, Artificial Sequence
  chemically synthesized
agtaattttgggggctgtaa

SEQ ID NO: 268049 - DNA, 20 bp, Artificial Sequence
  chemically synthesized
ccatgatagagtaattttgg

SEQ ID NO: 268050 - DNA, 20 bp, Artificial Sequence
  chemically synthesized
gccatgatagagtaattttg

SEQ ID NO: 268051 - DNA, 20 bp, Artificial Sequence
  chemically synthesized
agccatgatagagtaatttt

SEQ ID NO: 268052 - DNA, 20 bp, Artificial Sequence
  chemically synthesized
tagccatgatagagtaattt

SEQ ID NO: 268053 - DNA, 20 bp, Artificial Sequence
  chemically synthesized
cccccaaaattactctatca

SEQ ID NO: 268054 - DNA, 20 bp, Artificial Sequence
  chemically synthesized
ctaaacctctagccatgata

SEQ ID NO: 268055 - DNA, 20 bp, Artificial Sequence
  chemically synthesized
caaaattactctatcatggc

SEQ ID NO: 268056 - DNA, 20 bp, Artificial Sequence
  chemically synthesized
tcctaaacctctagccatga

SEQ ID NO: 268057 - DNA, 20 bp, Artificial Sequence
  chemically synthesized
aaattactctatcatggcta

SEQ ID NO: 268058 - DNA, 20 bp, Artificial Sequence
  chemically synthesized
aattactctatcatggctag

SEQ ID NO: 268059 - DNA, 20 bp, Artificial Sequence
  chemically synthesized
ctctatcatggctagaggtt

SEQ ID NO: 268060 - DNA, 20 bp, Artificial Sequence
  chemically synthesized
tctatcatggctagaggttt

SEQ ID NO: 268061 - DNA, 20 bp, Artificial Sequence
  chemically synthesized
taaaatatgtcctaaacctc

SEQ ID NO: 268062 - DNA, 20 bp, Artificial Sequence
  chemically synthesized
tttaggacatattttactat

SEQ ID NO: 268063 - DNA, 20 bp, Artificial Sequence
  chemically synthesized
ttaggacatattttactatt

SEQ ID NO: 268064 - DNA, 20 bp, Artificial Sequence
  chemically synthesized
attctgtcacattagcctaa

SEQ ID NO: 268065 - DNA, 20 bp, Artificial Sequence
  chemically synthesized
ttactattaggctaatgtga

SEQ ID NO: 268066 - DNA, 20 bp, Artificial Sequence
  chemically synthesized
attatattattctgtcacat

SEQ ID NO: 268067 - DNA, 20 bp, Artificial Sequence
  chemically synthesized
aatataatgatacattcaaa

SEQ ID NO: 268068 - DNA, 20 bp, Artificial Sequence
  chemically synthesized
atacattcaaaaagaacata

SEQ ID NO: 268069 - DNA, 20 bp, Artificial Sequence
  chemically synthesized
aaagaacataaagcattaaa

SEQ ID NO: 268070 - DNA, 20 bp, Artificial Sequence
  chemically synthesized
gaacataaagcattaaatag

SEQ ID NO: 268071 - DNA, 20 bp, Artificial Sequence
  chemically synthesized
gcattaaatagtggattcta

SEQ ID NO: 268072 - DNA, 20 bp, Artificial Sequence
  chemically synthesized
aaagtcaatacacattgcta

SEQ ID NO: 268073 - DNA, 20 bp, Artificial Sequence
  chemically synthesized
aacaatacagtgttattaaa

SEQ ID NO: 268074 - DNA, 20 bp, Artificial Sequence
  chemically synthesized
ttcttctttaataaacaata

SEQ ID NO: 268075 - DNA, 20 bp, Artificial Sequence
  chemically synthesized
taacactgtattgtttatta

SEQ ID NO: 268076 - DNA, 20 bp, Artificial Sequence
  chemically synthesized
cactgtattgtttattaaag

SEQ ID NO: 268077 - DNA, 20 bp, Artificial Sequence
  chemically synthesized
attaaagaagaatttcatga

SEQ ID NO: 268078 - DNA, 20 bp, Artificial Sequence
  chemically synthesized
aaagaagaatttcatgaaag

SEQ ID NO: 268079 - DNA, 20 bp, Artificial Sequence
  chemically synthesized
tgaaagcagaatgaactgaa

SEQ ID NO: 268080 - DNA, 20 bp, Artificial Sequence
  chemically synthesized
ttagagctgttatttctgtt

SEQ ID NO: 268081 - DNA, 20 bp, Artificial Sequence
  chemically synthesized
aatgaactgaacagaaataa

SEQ ID NO: 268082 - DNA, 20 bp, Artificial Sequence
  chemically synthesized
attcactgtcattatagtta

SEQ ID NO: 268083 - DNA, 20 bp, Artificial Sequence
  chemically synthesized
ctattcactgtcattatagt

SEQ ID NO: 268084 - DNA, 20 bp, Artificial Sequence
  chemically synthesized
aacagctctaactataatga

SEQ ID NO: 268085 - DNA, 20 bp, Artificial Sequence
  chemically synthesized
gtcactattcactgtcatta

SEQ ID NO: 268086 - DNA, 20 bp, Artificial Sequence
  chemically synthesized
ctaactataatgacagtgaa

SEQ ID NO: 268087 - DNA, 20 bp, Artificial Sequence
  chemically synthesized
acagtgaatagtgactccaa

SEQ ID NO: 268088 - DNA, 20 bp, Artificial Sequence
  chemically synthesized
acatctgttacatgccattg

SEQ ID NO: 268089 - DNA, 20 bp, Artificial Sequence
  chemically synthesized
gaacatctgttacatgccat

SEQ ID NO: 268090 - DNA, 20 bp, Artificial Sequence
  chemically synthesized
gtgactccaatggcatgtaa

SEQ ID NO: 268091 - DNA, 20 bp, Artificial Sequence
  chemically synthesized
taacagatgttctattttct

SEQ ID NO: 268092 - DNA, 20 bp, Artificial Sequence
  chemically synthesized
agcagctgttacttagaaaa

SEQ ID NO: 268093 - DNA, 20 bp, Artificial Sequence
  chemically synthesized
atgttctattttctaagtaa

SEQ ID NO: 268094 - DNA, 20 bp, Artificial Sequence
  chemically synthesized
tgcatcaagcagctgttact

SEQ ID NO: 268095 - DNA, 20 bp, Artificial Sequence
  chemically synthesized
ggtgcaatgaatgcatcaag

SEQ ID NO: 268096 - DNA, 20 bp, Artificial Sequence
  chemically synthesized
cttggtgcaatgaatgcatc

SEQ ID NO: 268097 - DNA, 20 bp, Artificial Sequence
  chemically synthesized
cttgatgcattcattgcacc

SEQ ID NO: 268098 - DNA, 20 bp, Artificial Sequence
  chemically synthesized
acactagcagatcattaact

SEQ ID NO: 268099 - DNA, 20 bp, Artificial Sequence
  chemically synthesized
gcaccaagttaatgatctgc

SEQ ID NO: 268100 - DNA, 20 bp, Artificial Sequence
  chemically synthesized
gtgaagtgaaataacactag

SEQ ID NO: 268101 - DNA, 20 bp, Artificial Sequence
  chemically synthesized
tctgtgaagtgaaataacac

SEQ ID NO: 268102 - DNA, 20 bp, Artificial Sequence
  chemically synthesized
gctagtgttatttcacttca

SEQ ID NO: 268103 - DNA, 20 bp, Artificial Sequence
  chemically synthesized
agcagagtaatttatctgtg

SEQ ID NO: 268104 - DNA, 20 bp, Artificial Sequence
  chemically synthesized
ttttttttttaaagtgagca

SEQ ID NO: 268105 - DNA, 20 bp, Artificial Sequence
  chemically synthesized
tcttttttttttaaagtgag

SEQ ID NO: 268106 - DNA, 20 bp, Artificial Sequence
  chemically synthesized
gtatcttttttttttaaagt

SEQ ID NO: 268107 - DNA, 20 bp, Artificial Sequence
  chemically synthesized
ttacgtatctttttttttta

SEQ ID NO: 268108 - DNA, 20 bp, Artificial Sequence
  chemically synthesized
tctgctcactttaaaaaaaa

SEQ ID NO: 268109 - DNA, 20 bp, Artificial Sequence
  chemically synthesized
aaaaaagatacgtaattttt

SEQ ID NO: 268110 - DNA, 20 bp, Artificial Sequence
  chemically synthesized
aaaaagatacgtaatttttc

SEQ ID NO: 268111 - DNA, 20 bp, Artificial Sequence
  chemically synthesized
aaaagatacgtaatttttca

SEQ ID NO: 268112 - DNA, 20 bp, Artificial Sequence
  chemically synthesized
aaagatacgtaatttttcag

SEQ ID NO: 268113 - DNA, 20 bp, Artificial Sequence
  chemically synthesized
acgtaatttttcaggggaat

SEQ ID NO: 268114 - DNA, 20 bp, Artificial Sequence
  chemically synthesized
gtaatttttcaggggaatga

SEQ ID NO: 268115 - DNA, 20 bp, Artificial Sequence
  chemically synthesized
tcaggggaatgagagtataa

SEQ ID NO: 268116 - DNA, 20 bp, Artificial Sequence
  chemically synthesized
aatgagagtataacagactt

SEQ ID NO: 268117 - DNA, 20 bp, Artificial Sequence
  chemically synthesized
tgagagtataacagacttta

SEQ ID NO: 268118 - DNA, 20 bp, Artificial Sequence
  chemically synthesized
agtataacagactttagagt

SEQ ID NO: 268119 - DNA, 20 bp, Artificial Sequence
  chemically synthesized
aagaactattacttactcta

SEQ ID NO: 268120 - DNA, 20 bp, Artificial Sequence
  chemically synthesized
acagactttagagtaagtaa

SEQ ID NO: 268121 - DNA, 20 bp, Artificial Sequence
  chemically synthesized
cctcttagctataaaaatat

SEQ ID NO: 268122 - DNA, 20 bp, Artificial Sequence
  chemically synthesized
taatagttcttatattttta

SEQ ID NO: 268123 - DNA, 20 bp, Artificial Sequence
  chemically synthesized
gttcttatatttttatagct

SEQ ID NO: 268124 - DNA, 20 bp, Artificial Sequence
  chemically synthesized
tcttatatttttatagctaa

SEQ ID NO: 268125 - DNA, 20 bp, Artificial Sequence
  chemically synthesized
cttatatttttatagctaag

SEQ ID NO: 268126 - DNA, 20 bp, Artificial Sequence
  chemically synthesized
cctcaactcatcattcctct

SEQ ID NO: 268127 - DNA, 20 bp, Artificial Sequence
  chemically synthesized
ttatagctaagaggaatgat

SEQ ID NO: 268128 - DNA, 20 bp, Artificial Sequence
  chemically synthesized
gctaagaggaatgatgagtt

SEQ ID NO: 268129 - DNA, 20 bp, Artificial Sequence
  chemically synthesized
ctaagaggaatgatgagttg

SEQ ID NO: 268130 - DNA, 20 bp, Artificial Sequence
  chemically synthesized
agaggaatgatgagttgagg

SEQ ID NO: 268131 - DNA, 20 bp, Artificial Sequence
  chemically synthesized
gatgagttgaggcagttatc

SEQ ID NO: 268132 - DNA, 20 bp, Artificial Sequence
  chemically synthesized
aggcagttatccagataatc

SEQ ID NO: 268133 - DNA, 20 bp, Artificial Sequence
  chemically synthesized
gtttctggtcctagattatc

SEQ ID NO: 268134 - DNA, 20 bp, Artificial Sequence
  chemically synthesized
ggcagttatccagataatct

SEQ ID NO: 268135 - DNA, 20 bp, Artificial Sequence
  chemically synthesized
ttatccagataatctaggac

SEQ ID NO: 268136 - DNA, 20 bp, Artificial Sequence
  chemically synthesized
agagatctggtttctggtcc

SEQ ID NO: 268137 - DNA, 20 bp, Artificial Sequence
  chemically synthesized
gataatctaggaccagaaac

SEQ ID NO: 268138 - DNA, 20 bp, Artificial Sequence
  chemically synthesized
gtttaaagagatctggtttc

SEQ ID NO: 268139 - DNA, 20 bp, Artificial Sequence
  chemically synthesized
tttcacagtttaaagagatc

SEQ ID NO: 268140 - DNA, 20 bp, Artificial Sequence
  chemically synthesized
gtaagatttcacagtttaaa

SEQ ID NO: 268141 - DNA, 20 bp, Artificial Sequence
  chemically synthesized
cagtaagatttcacagttta

SEQ ID NO: 268142 - DNA, 20 bp, Artificial Sequence
  chemically synthesized
tttataacagtaagatttca

SEQ ID NO: 268143 - DNA, 20 bp, Artificial Sequence
  chemically synthesized
tatatattttttataacagt

SEQ ID NO: 268144 - DNA, 20 bp, Artificial Sequence
  chemically synthesized
tgtatatatattttttataa

SEQ ID NO: 268145 - DNA, 20 bp, Artificial Sequence
  chemically synthesized
gttataaaaaatatatatac

SEQ ID NO: 268146 - DNA, 20 bp, Artificial Sequence
  chemically synthesized
aaaaatatatatacaagaca

SEQ ID NO: 268147 - DNA, 20 bp, Artificial Sequence
  chemically synthesized
tatacaagacatggttgact

SEQ ID NO: 268148 - DNA, 20 bp, Artificial Sequence
  chemically synthesized
acgagagcctaaattcagct

SEQ ID NO: 268149 - DNA, 20 bp, Artificial Sequence
  chemically synthesized
atggttgactgagctgaatt

SEQ ID NO: 268150 - DNA, 20 bp, Artificial Sequence
  chemically synthesized
tggttgactgagctgaattt

SEQ ID NO: 268151 - DNA, 20 bp, Artificial Sequence
  chemically synthesized
gtctgacgagagcctaaatt

SEQ ID NO: 268152 - DNA, 20 bp, Artificial Sequence
  chemically synthesized
agctgaatttaggctctcgt

SEQ ID NO: 268153 - DNA, 20 bp, Artificial Sequence
  chemically synthesized
aatttcaagctgtctgacga

SEQ ID NO: 268154 - DNA, 20 bp, Artificial Sequence
  chemically synthesized
gaatttaggctctcgtcaga

SEQ ID NO: 268155 - DNA, 20 bp, Artificial Sequence
  chemically synthesized
cgaatttcaagctgtctgac

SEQ ID NO: 268156 - DNA, 20 bp, Artificial Sequence
  chemically synthesized
atacaagatccgcgaatttc

SEQ ID NO: 268157 - DNA, 20 bp, Artificial Sequence
  chemically synthesized
gtcagacagcttgaaattcg

SEQ ID NO: 268158 - DNA, 20 bp, Artificial Sequence
  chemically synthesized
atcactagataatgtgatac

SEQ ID NO: 268159 - DNA, 20 bp, Artificial Sequence
  chemically synthesized
ggatcttgtatcacattatc

SEQ ID NO: 268160 - DNA, 20 bp, Artificial Sequence
  chemically synthesized
tcagcaaagttgagaatcac

SEQ ID NO: 268161 - DNA, 20 bp, Artificial Sequence
  chemically synthesized
ctctcttattcagcaaagtt

SEQ ID NO: 268162 - DNA, 20 bp, Artificial Sequence
  chemically synthesized
actagctctcttattcagca

SEQ ID NO: 268163 - DNA, 20 bp, Artificial Sequence
  chemically synthesized
gattctcaactttgctgaat

SEQ ID NO: 268164 - DNA, 20 bp, Artificial Sequence
  chemically synthesized
ttctcaactttgctgaataa

SEQ ID NO: 268165 - DNA, 20 bp, Artificial Sequence
  chemically synthesized
ctcaactttgctgaataaga

SEQ ID NO: 268166 - DNA, 20 bp, Artificial Sequence
  chemically synthesized
ctctaactagctctcttatt

SEQ ID NO: 268167 - DNA, 20 bp, Artificial Sequence
  chemically synthesized
actttgctgaataagagagc

SEQ ID NO: 268168 - DNA, 20 bp, Artificial Sequence
  chemically synthesized
tgctgaataagagagctagt

SEQ ID NO: 268169 - DNA, 20 bp, Artificial Sequence
  chemically synthesized
ctgaataagagagctagtta

SEQ ID NO: 268170 - DNA, 20 bp, Artificial Sequence
  chemically synthesized
ttaattggtctaactctaac

SEQ ID NO: 268171 - DNA, 20 bp, Artificial Sequence
  chemically synthesized
ataagagagctagttagagt

SEQ ID NO: 268172 - DNA, 20 bp, Artificial Sequence
  chemically synthesized
tagagttagaccaattaaat

SEQ ID NO: 268173 - DNA, 20 bp, Artificial Sequence
  chemically synthesized
tccagagattctgatttaat

SEQ ID NO: 268174 - DNA, 20 bp, Artificial Sequence
  chemically synthesized
accaattaaatcagaatctc

SEQ ID NO: 268175 - DNA, 20 bp, Artificial Sequence
  chemically synthesized
aattaaatcagaatctctgg

SEQ ID NO: 268176 - DNA, 20 bp, Artificial Sequence
  chemically synthesized
taaatcagaatctctggaag

SEQ ID NO: 268177 - DNA, 20 bp, Artificial Sequence
  chemically synthesized
aaatcagaatctctggaagt

SEQ ID NO: 268178 - DNA, 20 bp, Artificial Sequence
  chemically synthesized
atgtttggggcccacttcca

SEQ ID NO: 268179 - DNA, 20 bp, Artificial Sequence
  chemically synthesized
caatgtttggggcccacttc

SEQ ID NO: 268180 - DNA, 20 bp, Artificial Sequence
  chemically synthesized
tggaagtgggccccaaacat

SEQ ID NO: 268181 - DNA, 20 bp, Artificial Sequence
  chemically synthesized
gaaaagtatcccaatgtttg

SEQ ID NO: 268182 - DNA, 20 bp, Artificial Sequence
  chemically synthesized
ggaagtgggccccaaacatt

SEQ ID NO: 268183 - DNA, 20 bp, Artificial Sequence
  chemically synthesized
tgaaaagtatcccaatgttt

SEQ ID NO: 268184 - DNA, 20 bp, Artificial Sequence
  chemically synthesized
ttgaaaagtatcccaatgtt

SEQ ID NO: 268185 - DNA, 20 bp, Artificial Sequence
  chemically synthesized
caaacattgggatacttttc

SEQ ID NO: 268186 - DNA, 20 bp, Artificial Sequence
  chemically synthesized
aatcacccgagaaacttgaa

SEQ ID NO: 268187 - DNA, 20 bp, Artificial Sequence
  chemically synthesized
gggatacttttcaagtttct

SEQ ID NO: 268188 - DNA, 20 bp, Artificial Sequence
  chemically synthesized
ggatacttttcaagtttctc

SEQ ID NO: 268189 - DNA, 20 bp, Artificial Sequence
  chemically synthesized
gttgcacatcaaaatcaccc

SEQ ID NO: 268190 - DNA, 20 bp, Artificial Sequence
  chemically synthesized
ttgcctgtggttttcaacat

SEQ ID NO: 268191 - DNA, 20 bp, Artificial Sequence
  chemically synthesized
gcaaccaatgttgaaaacca

SEQ ID NO: 268192 - DNA, 20 bp, Artificial Sequence
  chemically synthesized
caaccaatgttgaaaaccac

SEQ ID NO: 268193 - DNA, 20 bp, Artificial Sequence
  chemically synthesized
tgcatctttctgtttgcctg

SEQ ID NO: 268194 - DNA, 20 bp, Artificial Sequence
  chemically synthesized
tgttgaaaaccacaggcaaa

SEQ ID NO: 268195 - DNA, 20 bp, Artificial Sequence
  chemically synthesized
gaaaaccacaggcaaacaga

SEQ ID NO: 268196 - DNA, 20 bp, Artificial Sequence
  chemically synthesized
caaacagaaagatgcattct

SEQ ID NO: 268197 - DNA, 20 bp, Artificial Sequence
  chemically synthesized
actatcactcaataaaaact

SEQ ID NO: 268198 - DNA, 20 bp, Artificial Sequence
  chemically synthesized
atgcattctgagtttttatt

SEQ ID NO: 268199 - DNA, 20 bp, Artificial Sequence
  chemically synthesized
tctgagtttttattgagtga

SEQ ID NO: 268200 - DNA, 20 bp, Artificial Sequence
  chemically synthesized
agtgatagtcattaaattct

SEQ ID NO: 268201 - DNA, 20 bp, Artificial Sequence
  chemically synthesized
tgatagtcattaaattctaa

SEQ ID NO: 268202 - DNA, 20 bp, Artificial Sequence
  chemically synthesized
tttggctttcagttcactct

SEQ ID NO: 268203 - DNA, 20 bp, Artificial Sequence
  chemically synthesized
aaattctaagagtgaactga

SEQ ID NO: 268204 - DNA, 20 bp, Artificial Sequence
  chemically synthesized
taagagtgaactgaaagcca

SEQ ID NO: 268205 - DNA, 20 bp, Artificial Sequence
  chemically synthesized
ctcaattatcctttggcttt

SEQ ID NO: 268206 - DNA, 20 bp, Artificial Sequence
  chemically synthesized
aagagtgaactgaaagccaa

SEQ ID NO: 268207 - DNA, 20 bp, Artificial Sequence
  chemically synthesized
ttggttgctcaattatcctt

SEQ ID NO: 268208 - DNA, 20 bp, Artificial Sequence
  chemically synthesized
ctgaaagccaaaggataatt

SEQ ID NO: 268209 - DNA, 20 bp, Artificial Sequence
  chemically synthesized
acctcaggaagaacaaacat

SEQ ID NO: 268210 - DNA, 20 bp, Artificial Sequence
  chemically synthesized
aaccaatgtttgttcttcct

SEQ ID NO: 268211 - DNA, 20 bp, Artificial Sequence
  chemically synthesized
accaatgtttgttcttcctg

SEQ ID NO: 268212 - DNA, 20 bp, Artificial Sequence
  chemically synthesized
ttataatatttaacctcagg

SEQ ID NO: 268213 - DNA, 20 bp, Artificial Sequence
  chemically synthesized
gttttataatatttaacctc

SEQ ID NO: 268214 - DNA, 20 bp, Artificial Sequence
  chemically synthesized
agttttataatatttaacct

SEQ ID NO: 268215 - DNA, 20 bp, Artificial Sequence
  chemically synthesized
tcacgtttattttggaaaca

SEQ ID NO: 268216 - DNA, 20 bp, Artificial Sequence
  chemically synthesized
cgtgtttttcacgtttattt

SEQ ID NO: 268217 - DNA, 20 bp, Artificial Sequence
  chemically synthesized
caaaataaacgtgaaaaaca

SEQ ID NO: 268218 - DNA, 20 bp, Artificial Sequence
  chemically synthesized
aacacggtaatttgttaaac

SEQ ID NO: 268219 - DNA, 20 bp, Artificial Sequence
  chemically synthesized
acggtaatttgttaaacaag

SEQ ID NO: 268220 - DNA, 20 bp, Artificial Sequence
  chemically synthesized
ttgttaaacaagtggctatt

SEQ ID NO: 268221 - DNA, 20 bp, Artificial Sequence
  chemically synthesized
cagaataatctatgtctaaa

SEQ ID NO: 268222 - DNA, 20 bp, Artificial Sequence
  chemically synthesized
aacaagtggctatttagaca

SEQ ID NO: 268223 - DNA, 20 bp, Artificial Sequence
  chemically synthesized
ttaactgaaggtgttaaatg

SEQ ID NO: 268224 - DNA, 20 bp, Artificial Sequence
  chemically synthesized
tattctgcatttaacacctt

SEQ ID NO: 268225 - DNA, 20 bp, Artificial Sequence
  chemically synthesized
gtattaataaatttaactga

SEQ ID NO: 268226 - DNA, 20 bp, Artificial Sequence
  chemically synthesized
ggtattaataaatttaactg

SEQ ID NO: 268227 - DNA, 20 bp, Artificial Sequence
  chemically synthesized
caaacacacacgcacacaaa

SEQ ID NO: 268228 - DNA, 20 bp, Artificial Sequence
  chemically synthesized
gtgtttgtgtgtgttcctct

SEQ ID NO: 268229 - DNA, 20 bp, Artificial Sequence
  chemically synthesized
tgtttgtgtgtgttcctctc

SEQ ID NO: 268230 - DNA, 20 bp, Artificial Sequence
  chemically synthesized
tatgccaagagttgcctgag

SEQ ID NO: 268231 - DNA, 20 bp, Artificial Sequence
  chemically synthesized
gtatgccaagagttgcctga

SEQ ID NO: 268232 - DNA, 20 bp, Artificial Sequence
  chemically synthesized
tagtatgccaagagttgcct

SEQ ID NO: 268233 - DNA, 20 bp, Artificial Sequence
  chemically synthesized
tgttcctctcaggcaactct

SEQ ID NO: 268234 - DNA, 20 bp, Artificial Sequence
  chemically synthesized
cagtagtcttagtatgccaa

SEQ ID NO: 268235 - DNA, 20 bp, Artificial Sequence
  chemically synthesized
aacagtagtcttagtatgcc

SEQ ID NO: 268236 - DNA, 20 bp, Artificial Sequence
  chemically synthesized
caggcaactcttggcatact

SEQ ID NO: 268237 - DNA, 20 bp, Artificial Sequence
  chemically synthesized
tgttttattaacagtagtct

SEQ ID NO: 268238 - DNA, 20 bp, Artificial Sequence
  chemically synthesized
accgcctgttttattaacag

SEQ ID NO: 268239 - DNA, 20 bp, Artificial Sequence
  chemically synthesized
cctaccgcctgttttattaa

SEQ ID NO: 268240 - DNA, 20 bp, Artificial Sequence
  chemically synthesized
taagactactgttaataaaa

SEQ ID NO: 268241 - DNA, 20 bp, Artificial Sequence
  chemically synthesized
aagactactgttaataaaac

SEQ ID NO: 268242 - DNA, 20 bp, Artificial Sequence
  chemically synthesized
actactgttaataaaacagg

SEQ ID NO: 268243 - DNA, 20 bp, Artificial Sequence
  chemically synthesized
actgttaataaaacaggcgg

SEQ ID NO: 268244 - DNA, 20 bp, Artificial Sequence
  chemically synthesized
ctgttaataaaacaggcggt

SEQ ID NO: 268245 - DNA, 20 bp, Artificial Sequence
  chemically synthesized
gcggtaggatgaacatacta

SEQ ID NO: 268246 - DNA, 20 bp, Artificial Sequence
  chemically synthesized
cggtaggatgaacatactat

SEQ ID NO: 268247 - DNA, 20 bp, Artificial Sequence
  chemically synthesized
aaaaaaaaaatttggtccta

SEQ ID NO: 268248 - DNA, 20 bp, Artificial Sequence
  chemically synthesized
ttttctggaaaaaaaaaatt

SEQ ID NO: 268249 - DNA, 20 bp, Artificial Sequence
  chemically synthesized
aggaccaaattttttttttc

SEQ ID NO: 268250 - DNA, 20 bp, Artificial Sequence
  chemically synthesized
aatggtagaataagattttc

SEQ ID NO: 268251 - DNA, 20 bp, Artificial Sequence
  chemically synthesized
gaaagttcaaatggtagaat

SEQ ID NO: 268252 - DNA, 20 bp, Artificial Sequence
  chemically synthesized
tcatctgaaagttcaaatgg

SEQ ID NO: 268253 - DNA, 20 bp, Artificial Sequence
  chemically synthesized
gtgtcatctgaaagttcaaa

SEQ ID NO: 268254 - DNA, 20 bp, Artificial Sequence
  chemically synthesized
tattctaccatttgaacttt

SEQ ID NO: 268255 - DNA, 20 bp, Artificial Sequence
  chemically synthesized
atatccatggtgtcatctga

SEQ ID NO: 268256 - DNA, 20 bp, Artificial Sequence
  chemically synthesized
tgaactttcagatgacacca

SEQ ID NO: 268257 - DNA, 20 bp, Artificial Sequence
  chemically synthesized
attaaacccctaaatatcca

SEQ ID NO: 268258 - DNA, 20 bp, Artificial Sequence
  chemically synthesized
cagatgacaccatggatatt

SEQ ID NO: 268259 - DNA, 20 bp, Artificial Sequence
  chemically synthesized
agatgacaccatggatattt

SEQ ID NO: 268260 - DNA, 20 bp, Artificial Sequence
  chemically synthesized
gatgacaccatggatattta

SEQ ID NO: 268261 - DNA, 20 bp, Artificial Sequence
  chemically synthesized
atgacaccatggatatttag

SEQ ID NO: 268262 - DNA, 20 bp, Artificial Sequence
  chemically synthesized
atggatatttaggggtttaa

SEQ ID NO: 268263 - DNA, 20 bp, Artificial Sequence
  chemically synthesized
tccaactcagttaaataatt

SEQ ID NO: 268264 - DNA, 20 bp, Artificial Sequence
  chemically synthesized
tggaactaaattatttaact

SEQ ID NO: 268265 - DNA, 20 bp, Artificial Sequence
  chemically synthesized
actaaattatttaactgagt

SEQ ID NO: 268266 - DNA, 20 bp, Artificial Sequence
  chemically synthesized
aagcatcaaagattccaact

SEQ ID NO: 268267 - DNA, 20 bp, Artificial Sequence
  chemically synthesized
taattttgttttaagcatca

SEQ ID NO: 268268 - DNA, 20 bp, Artificial Sequence
  chemically synthesized
tttatttctaattttgtttt

SEQ ID NO: 268269 - DNA, 20 bp, Artificial Sequence
  chemically synthesized
tttgatgcttaaaacaaaat

SEQ ID NO: 268270 - DNA, 20 bp, Artificial Sequence
  chemically synthesized
caaaattagaaataaaatgt

SEQ ID NO: 268271 - DNA, 20 bp, Artificial Sequence
  chemically synthesized
taaaatgttagtgattaaat

SEQ ID NO: 268272 - DNA, 20 bp, Artificial Sequence
  chemically synthesized
gattaaatcagaaaatcata

SEQ ID NO: 268273 - DNA, 20 bp, Artificial Sequence
  chemically synthesized
aatcagaaaatcatatagat

SEQ ID NO: 268274 - DNA, 20 bp, Artificial Sequence
  chemically synthesized
atatagattagactttgtca

SEQ ID NO: 268275 - DNA, 20 bp, Artificial Sequence
  chemically synthesized
gggaaatacaagctttgaca

SEQ ID NO: 268276 - DNA, 20 bp, Artificial Sequence
  chemically synthesized
tcattatgtttgggaaatac

SEQ ID NO: 268277 - DNA, 20 bp, Artificial Sequence
  chemically synthesized
ccctgaagatcattatgttt

SEQ ID NO: 268278 - DNA, 20 bp, Artificial Sequence
  chemically synthesized
tccctgaagatcattatgtt

SEQ ID NO: 268279 - DNA, 20 bp, Artificial Sequence
  chemically synthesized
ttcccaaacataatgatctt

SEQ ID NO: 268280 - DNA, 20 bp, Artificial Sequence
  chemically synthesized
tcccaaacataatgatcttc

SEQ ID NO: 268281 - DNA, 20 bp, Artificial Sequence
  chemically synthesized
cccaaacataatgatcttca

SEQ ID NO: 268282 - DNA, 20 bp, Artificial Sequence
  chemically synthesized
aaacataatgatcttcaggg

SEQ ID NO: 268283 - DNA, 20 bp, Artificial Sequence
  chemically synthesized
attagaggtttacttccctg

SEQ ID NO: 268284 - DNA, 20 bp, Artificial Sequence
  chemically synthesized
atatgtatgtgattaattag

SEQ ID NO: 268285 - DNA, 20 bp, Artificial Sequence
  chemically synthesized
aatatgtatgtgattaatta

SEQ ID NO: 268286 - DNA, 20 bp, Artificial Sequence
  chemically synthesized
taaatatgtatgtgattaat

SEQ ID NO: 268287 - DNA, 20 bp, Artificial Sequence
  chemically synthesized
catacatatttactttccta

SEQ ID NO: 268288 - DNA, 20 bp, Artificial Sequence
  chemically synthesized
acgaaaacataaccatagga

SEQ ID NO: 268289 - DNA, 20 bp, Artificial Sequence
  chemically synthesized
gatcacgaaaacataaccat

SEQ ID NO: 268290 - DNA, 20 bp, Artificial Sequence
  chemically synthesized
tgatcacgaaaacataacca

SEQ ID NO: 268291 - DNA, 20 bp, Artificial Sequence
  chemically synthesized
cattactggccaatattgtt

SEQ ID NO: 268292 - DNA, 20 bp, Artificial Sequence
  chemically synthesized
attcatatgctaaacaatat

SEQ ID NO: 268293 - DNA, 20 bp, Artificial Sequence
  chemically synthesized
atatgctaaacaatattggc

SEQ ID NO: 268294 - DNA, 20 bp, Artificial Sequence
  chemically synthesized
taaacaatattggccagtaa

SEQ ID NO: 268295 - DNA, 20 bp, Artificial Sequence
  chemically synthesized
aaacaatattggccagtaat

SEQ ID NO: 268296 - DNA, 20 bp, Artificial Sequence
  chemically synthesized
caatctgaacatcccattac

SEQ ID NO: 268297 - DNA, 20 bp, Artificial Sequence
  chemically synthesized
ttggccagtaatgggatgtt

SEQ ID NO: 268298 - DNA, 20 bp, Artificial Sequence
  chemically synthesized
cactctgattagttgagtgt

SEQ ID NO: 268299 - DNA, 20 bp, Artificial Sequence
  chemically synthesized
tttacttacactcaactaat

SEQ ID NO: 268300 - DNA, 20 bp, Artificial Sequence
  chemically synthesized
taatatcactctgattagtt

SEQ ID NO: 268301 - DNA, 20 bp, Artificial Sequence
  chemically synthesized
tacttacactcaactaatca

SEQ ID NO: 268302 - DNA, 20 bp, Artificial Sequence
  chemically synthesized
tatcttaatatcactctgat

SEQ ID NO: 268303 - DNA, 20 bp, Artificial Sequence
  chemically synthesized
caactaatcagagtgatatt

SEQ ID NO: 268304 - DNA, 20 bp, Artificial Sequence
  chemically synthesized
agatttcaaatattgtttgt

SEQ ID NO: 268305 - DNA, 20 bp, Artificial Sequence
  chemically synthesized
tgtccccactgttgtgattt

SEQ ID NO: 268306 - DNA, 20 bp, Artificial Sequence
  chemically synthesized
tttgaaatctaaaatcacaa

SEQ ID NO: 268307 - DNA, 20 bp, Artificial Sequence
  chemically synthesized
gaaatctaaaatcacaacag

SEQ ID NO: 268308 - DNA, 20 bp, Artificial Sequence
  chemically synthesized
aaatctaaaatcacaacagt

SEQ ID NO: 268309 - DNA, 20 bp, Artificial Sequence
  chemically synthesized
aatctaaaatcacaacagtg

SEQ ID NO: 268310 - DNA, 20 bp, Artificial Sequence
  chemically synthesized
taaaatcacaacagtgggga

SEQ ID NO: 268311 - DNA, 20 bp, Artificial Sequence
  chemically synthesized
acaacagtggggacagacta

SEQ ID NO: 268312 - DNA, 20 bp, Artificial Sequence
  chemically synthesized
tggggacagactacagactg

SEQ ID NO: 268313 - DNA, 20 bp, Artificial Sequence
  chemically synthesized
ctatcacctactacagtctg

SEQ ID NO: 268314 - DNA, 20 bp, Artificial Sequence
  chemically synthesized
ggacagactacagactgtag

SEQ ID NO: 268315 - DNA, 20 bp, Artificial Sequence
  chemically synthesized
gacagactacagactgtagt

SEQ ID NO: 268316 - DNA, 20 bp, Artificial Sequence
  chemically synthesized
tgtgtatctatcacctacta

SEQ ID NO: 268317 - DNA, 20 bp, Artificial Sequence
  chemically synthesized
ctacagactgtagtaggtga

SEQ ID NO: 268318 - DNA, 20 bp, Artificial Sequence
  chemically synthesized
tagtaggtgatagatacaca

SEQ ID NO: 268319 - DNA, 20 bp, Artificial Sequence
  chemically synthesized
agtaggtgatagatacacac

SEQ ID NO: 268320 - DNA, 20 bp, Artificial Sequence
  chemically synthesized
tttcattttattattttaat

SEQ ID NO: 268321 - DNA, 20 bp, Artificial Sequence
  chemically synthesized
ttcattttattattttaatg

SEQ ID NO: 268322 - DNA, 20 bp, Artificial Sequence
  chemically synthesized
atttcaagtgcagaaaatat

SEQ ID NO: 268323 - DNA, 20 bp, Artificial Sequence
  chemically synthesized
ccatggctaaatttcaagtg

SEQ ID NO: 268324 - DNA, 20 bp, Artificial Sequence
  chemically synthesized
tattttctgcacttgaaatt

SEQ ID NO: 268325 - DNA, 20 bp, Artificial Sequence
  chemically synthesized
acaaaccatggctaaatttc

SEQ ID NO: 268326 - DNA, 20 bp, Artificial Sequence
  chemically synthesized
ctgcacttgaaatttagcca

SEQ ID NO: 268327 - DNA, 20 bp, Artificial Sequence
  chemically synthesized
aataagcatgaaacaaacca

SEQ ID NO: 268328 - DNA, 20 bp, Artificial Sequence
  chemically synthesized
aaaagctacttattcacaat

SEQ ID NO: 268329 - DNA, 20 bp, Artificial Sequence
  chemically synthesized
gtttcatgcttattgtgaat

SEQ ID NO: 268330 - DNA, 20 bp, Artificial Sequence
  chemically synthesized
tcatgcttattgtgaataag

SEQ ID NO: 268331 - DNA, 20 bp, Artificial Sequence
  chemically synthesized
tctaagcttaaaataacaaa

SEQ ID NO: 268332 - DNA, 20 bp, Artificial Sequence
  chemically synthesized
aagtagctttttgttatttt

SEQ ID NO: 268333 - DNA, 20 bp, Artificial Sequence
  chemically synthesized
gctttttgttattttaagct

SEQ ID NO: 268334 - DNA, 20 bp, Artificial Sequence
  chemically synthesized
tagtaattttaaagtaatct

SEQ ID NO: 268335 - DNA, 20 bp, Artificial Sequence
  chemically synthesized
cttattttctagtaatttta

SEQ ID NO: 268336 - DNA, 20 bp, Artificial Sequence
  chemically synthesized
ttagattactttaaaattac

SEQ ID NO: 268337 - DNA, 20 bp, Artificial Sequence
  chemically synthesized
ctttaaaattactagaaaat

SEQ ID NO: 268338 - DNA, 20 bp, Artificial Sequence
  chemically synthesized
tcataagaagtcttattttc

SEQ ID NO: 268339 - DNA, 20 bp, Artificial Sequence
  chemically synthesized
ctataccaaattatcataag

SEQ ID NO: 268340 - DNA, 20 bp, Artificial Sequence
  chemically synthesized
ccactataccaaattatcat

SEQ ID NO: 268341 - DNA, 20 bp, Artificial Sequence
  chemically synthesized
taagacttcttatgataatt

SEQ ID NO: 268342 - DNA, 20 bp, Artificial Sequence
  chemically synthesized
cttcttatgataatttggta

SEQ ID NO: 268343 - DNA, 20 bp, Artificial Sequence
  chemically synthesized
cttatgataatttggtatag

SEQ ID NO: 268344 - DNA, 20 bp, Artificial Sequence
  chemically synthesized
gtggaaaaaactgttgaaat

SEQ ID NO: 268345 - DNA, 20 bp, Artificial Sequence
  chemically synthesized
aatactatgcctgatttcaa

SEQ ID NO: 268346 - DNA, 20 bp, Artificial Sequence
  chemically synthesized
tggaaaaaactgttgaaatc

SEQ ID NO: 268347 - DNA, 20 bp, Artificial Sequence
  chemically synthesized
aaaactgttgaaatcaggca

SEQ ID NO: 268348 - DNA, 20 bp, Artificial Sequence
  chemically synthesized
tgaaatcaggcatagtatta

SEQ ID NO: 268349 - DNA, 20 bp, Artificial Sequence
  chemically synthesized
attacagttttgctatgtac

SEQ ID NO: 268350 - DNA, 20 bp, Artificial Sequence
  chemically synthesized
ttacagttttgctatgtacc

SEQ ID NO: 268351 - DNA, 20 bp, Artificial Sequence
  chemically synthesized
caaatacaagtcctggtaca

SEQ ID NO: 268352 - DNA, 20 bp, Artificial Sequence
  chemically synthesized
agatgaacaaatacaagtcc

SEQ ID NO: 268353 - DNA, 20 bp, Artificial Sequence
  chemically synthesized
ttttatagatgaacaaatac

SEQ ID NO: 268354 - DNA, 20 bp, Artificial Sequence
  chemically synthesized
gtatttgttcatctataaaa

SEQ ID NO: 268355 - DNA, 20 bp, Artificial Sequence
  chemically synthesized
tatttgttcatctataaaac

SEQ ID NO: 268356 - DNA, 20 bp, Artificial Sequence
  chemically synthesized
gatcaaatgttcccgtttta

SEQ ID NO: 268357 - DNA, 20 bp, Artificial Sequence
  chemically synthesized
ataaaacgggaacatttgat

SEQ ID NO: 268358 - DNA, 20 bp, Artificial Sequence
  chemically synthesized
taaaacgggaacatttgatc

SEQ ID NO: 268359 - DNA, 20 bp, Artificial Sequence
  chemically synthesized
atttacatttaaaattgtac

SEQ ID NO: 268360 - DNA, 20 bp, Artificial Sequence
  chemically synthesized
gtacaattttaaatgtaaat

SEQ ID NO: 268361 - DNA, 20 bp, Artificial Sequence
  chemically synthesized
cagcatttttctcttctctc

SEQ ID NO: 268362 - DNA, 20 bp, Artificial Sequence
  chemically synthesized
caaagcagttcttgagagaa

SEQ ID NO: 268363 - DNA, 20 bp, Artificial Sequence
  chemically synthesized
gacaaagcagttcttgagag

SEQ ID NO: 268364 - DNA, 20 bp, Artificial Sequence
  chemically synthesized
aatgacaaagcagttcttga

SEQ ID NO: 268365 - DNA, 20 bp, Artificial Sequence
  chemically synthesized
ataatgacaaagcagttctt

SEQ ID NO: 268366 - DNA, 20 bp, Artificial Sequence
  chemically synthesized
tgcaaattataatgacaaag

SEQ ID NO: 268367 - DNA, 20 bp, Artificial Sequence
  chemically synthesized
agttgcaaattataatgaca

SEQ ID NO: 268368 - DNA, 20 bp, Artificial Sequence
  chemically synthesized
aaacgtaacttgcaaattaa

SEQ ID NO: 268369 - DNA, 20 bp, Artificial Sequence
  chemically synthesized
atttgcaactcttaatttgc

SEQ ID NO: 268370 - DNA, 20 bp, Artificial Sequence
  chemically synthesized
ttaaacgtaacttgcaaatt

SEQ ID NO: 268371 - DNA, 20 bp, Artificial Sequence
  chemically synthesized
atttgcaagttacgtttaaa

SEQ ID NO: 268372 - DNA, 20 bp, Artificial Sequence
  chemically synthesized
cgtttaaacagatatttcat

SEQ ID NO: 268373 - DNA, 20 bp, Artificial Sequence
  chemically synthesized
catgagtatgtcctatgtgt

SEQ ID NO: 268374 - DNA, 20 bp, Artificial Sequence
  chemically synthesized
atgagtatgtcctatgtgtc

SEQ ID NO: 268375 - DNA, 20 bp, Artificial Sequence
  chemically synthesized
taagatattgcctgacacat

SEQ ID NO: 268376 - DNA, 20 bp, Artificial Sequence
  chemically synthesized
ataagatattgcctgacaca

SEQ ID NO: 268377 - DNA, 20 bp, Artificial Sequence
  chemically synthesized
caggcaatatcttatgtaca

SEQ ID NO: 268378 - DNA, 20 bp, Artificial Sequence
  chemically synthesized
ctgatatttcccatgtacat

SEQ ID NO: 268379 - DNA, 20 bp, Artificial Sequence
  chemically synthesized
aggcaatatcttatgtacat

SEQ ID NO: 268380 - DNA, 20 bp, Artificial Sequence
  chemically synthesized
cttatgtacatgggaaatat

SEQ ID NO: 268381 - DNA, 20 bp, Artificial Sequence
  chemically synthesized
tatgtacatgggaaatatca

SEQ ID NO: 268382 - DNA, 20 bp, Artificial Sequence
  chemically synthesized
gacagggaaaatgtgtattt

SEQ ID NO: 268383 - DNA, 20 bp, Artificial Sequence
  chemically synthesized
attcattcagcaaaaggaca

SEQ ID NO: 268384 - DNA, 20 bp, Artificial Sequence
  chemically synthesized
aattcattcagcaaaaggac

SEQ ID NO: 268385 - DNA, 20 bp, Artificial Sequence
  chemically synthesized
taattcattcagcaaaagga

SEQ ID NO: 268386 - DNA, 20 bp, Artificial Sequence
  chemically synthesized
atagtaattcattcagcaaa

SEQ ID NO: 268387 - DNA, 20 bp, Artificial Sequence
  chemically synthesized
aatagtaattcattcagcaa

SEQ ID NO: 268388 - DNA, 20 bp, Artificial Sequence
  chemically synthesized
gtaggcaatagtaattcatt

SEQ ID NO: 268389 - DNA, 20 bp, Artificial Sequence
  chemically synthesized
ttggactgttatgtaggcaa

SEQ ID NO: 268390 - DNA, 20 bp, Artificial Sequence
  chemically synthesized
aattactattgcctacataa

SEQ ID NO: 268391 - DNA, 20 bp, Artificial Sequence
  chemically synthesized
actctcttggactgttatgt

SEQ ID NO: 268392 - DNA, 20 bp, Artificial Sequence
  chemically synthesized
tactctcttggactgttatg

SEQ ID NO: 268393 - DNA, 20 bp, Artificial Sequence
  chemically synthesized
tattgcctacataacagtcc

SEQ ID NO: 268394 - DNA, 20 bp, Artificial Sequence
  chemically synthesized
ttgcctacataacagtccaa

SEQ ID NO: 268395 - DNA, 20 bp, Artificial Sequence
  chemically synthesized
gcctacataacagtccaaga

SEQ ID NO: 268396 - DNA, 20 bp, Artificial Sequence
  chemically synthesized
tacataacagtccaagagag

SEQ ID NO: 268397 - DNA, 20 bp, Artificial Sequence
  chemically synthesized
acataacagtccaagagagt

SEQ ID NO: 268398 - DNA, 20 bp, Artificial Sequence
  chemically synthesized
catgataacccctactctct

SEQ ID NO: 268399 - DNA, 20 bp, Artificial Sequence
  chemically synthesized
cataacagtccaagagagta

SEQ ID NO: 268400 - DNA, 20 bp, Artificial Sequence
  chemically synthesized
ataacagtccaagagagtag

SEQ ID NO: 268401 - DNA, 20 bp, Artificial Sequence
  chemically synthesized
gagagtaggggttatcatga

SEQ ID NO: 268402 - DNA, 20 bp, Artificial Sequence
  chemically synthesized
aggggttatcatgaaagctc

SEQ ID NO: 268403 - DNA, 20 bp, Artificial Sequence
  chemically synthesized
ggggttatcatgaaagctca

SEQ ID NO: 268404 - DNA, 20 bp, Artificial Sequence
  chemically synthesized
tggaactgcacaagttcctt

SEQ ID NO: 268405 - DNA, 20 bp, Artificial Sequence
  chemically synthesized
gaaagctcaaggaacttgtg

SEQ ID NO: 268406 - DNA, 20 bp, Artificial Sequence
  chemically synthesized
tttgaatactggaactgcac

SEQ ID NO: 268407 - DNA, 20 bp, Artificial Sequence
  chemically synthesized
tcaaggaacttgtgcagttc

SEQ ID NO: 268408 - DNA, 20 bp, Artificial Sequence
  chemically synthesized
cacctgaagagtttgaatac

SEQ ID NO: 268409 - DNA, 20 bp, Artificial Sequence
  chemically synthesized
gttccagtattcaaactctt

SEQ ID NO: 268410 - DNA, 20 bp, Artificial Sequence
  chemically synthesized
ttccagtattcaaactcttc

SEQ ID NO: 268411 - DNA, 20 bp, Artificial Sequence
  chemically synthesized
ggagattactagcacctgaa

SEQ ID NO: 268412 - DNA, 20 bp, Artificial Sequence
  chemically synthesized
tattcaaactcttcaggtgc

SEQ ID NO: 268413 - DNA, 20 bp, Artificial Sequence
  chemically synthesized
caggagattactagcacctg

SEQ ID NO: 268414 - DNA, 20 bp, Artificial Sequence
  chemically synthesized
ggcaatctacaggagattac

SEQ ID NO: 268415 - DNA, 20 bp, Artificial Sequence
  chemically synthesized
caggtgctagtaatctcctg

SEQ ID NO: 268416 - DNA, 20 bp, Artificial Sequence
  chemically synthesized
aatggcaaggcaatctacag

SEQ ID NO: 268417 - DNA, 20 bp, Artificial Sequence
  chemically synthesized
gaaatggcaaggcaatctac

SEQ ID NO: 268418 - DNA, 20 bp, Artificial Sequence
  chemically synthesized
ggaaatggcaaggcaatcta

SEQ ID NO: 268419 - DNA, 20 bp, Artificial Sequence
  chemically synthesized
gatgatggaaggaaatggca

SEQ ID NO: 268420 - DNA, 20 bp, Artificial Sequence
  chemically synthesized
agatgatggaaggaaatggc

SEQ ID NO: 268421 - DNA, 20 bp, Artificial Sequence
  chemically synthesized
atagagatgatggaaggaaa

SEQ ID NO: 268422 - DNA, 20 bp, Artificial Sequence
  chemically synthesized
tgtagaatagagatgatgga

SEQ ID NO: 268423 - DNA, 20 bp, Artificial Sequence
  chemically synthesized
ctgtagaatagagatgatgg

SEQ ID NO: 268424 - DNA, 20 bp, Artificial Sequence
  chemically synthesized
tagctgtagaatagagatga

SEQ ID NO: 268425 - DNA, 20 bp, Artificial Sequence
  chemically synthesized
cttccatcatctctattcta

SEQ ID NO: 268426 - DNA, 20 bp, Artificial Sequence
  chemically synthesized
acactgatagctgtagaata

SEQ ID NO: 268427 - DNA, 20 bp, Artificial Sequence
  chemically synthesized
aaacactgatagctgtagaa

SEQ ID NO: 268428 - DNA, 20 bp, Artificial Sequence
  chemically synthesized
catctctattctacagctat

SEQ ID NO: 268429 - DNA, 20 bp, Artificial Sequence
  chemically synthesized
gtgacaaacactgatagctg

SEQ ID NO: 268430 - DNA, 20 bp, Artificial Sequence
  chemically synthesized
gctgaggtgacaaacactga

SEQ ID NO: 268431 - DNA, 20 bp, Artificial Sequence
  chemically synthesized
gctatcagtgtttgtcacct

SEQ ID NO: 268432 - DNA, 20 bp, Artificial Sequence
  chemically synthesized
cagtgtttgtcacctcagcc

SEQ ID NO: 268433 - DNA, 20 bp, Artificial Sequence
  chemically synthesized
taatggaattttctaggctg

SEQ ID NO: 268434 - DNA, 20 bp, Artificial Sequence
  chemically synthesized
ttaatggaattttctaggct

SEQ ID NO: 268435 - DNA, 20 bp, Artificial Sequence
  chemically synthesized
ttctgttaatggaattttct

SEQ ID NO: 268436 - DNA, 20 bp, Artificial Sequence
  chemically synthesized
tttctgttaatggaattttc

SEQ ID NO: 268437 - DNA, 20 bp, Artificial Sequence
  chemically synthesized
agcctagaaaattccattaa

SEQ ID NO: 268438 - DNA, 20 bp, Artificial Sequence
  chemically synthesized
tacttttccttttctgttaa

SEQ ID NO: 268439 - DNA, 20 bp, Artificial Sequence
  chemically synthesized
agaaaattccattaacagaa

SEQ ID NO: 268440 - DNA, 20 bp, Artificial Sequence
  chemically synthesized
gaaaattccattaacagaaa

SEQ ID NO: 268441 - DNA, 20 bp, Artificial Sequence
  chemically synthesized
ttccattaacagaaaaggaa

SEQ ID NO: 268442 - DNA, 20 bp, Artificial Sequence
  chemically synthesized
tttatcaccccataaatgtt

SEQ ID NO: 268443 - DNA, 20 bp, Artificial Sequence
  chemically synthesized
gaaaagtatctgaacattta

SEQ ID NO: 268444 - DNA, 20 bp, Artificial Sequence
  chemically synthesized
aaaagtatctgaacatttat

SEQ ID NO: 268445 - DNA, 20 bp, Artificial Sequence
  chemically synthesized
aaagtatctgaacatttatg

SEQ ID NO: 268446 - DNA, 20 bp, Artificial Sequence
  chemically synthesized
ggtgataaatatcactgtga

SEQ ID NO: 268447 - DNA, 20 bp, Artificial Sequence
  chemically synthesized
atgccacgaggcagccatca

SEQ ID NO: 268448 - DNA, 20 bp, Artificial Sequence
  chemically synthesized
tcactgtgatggctgcctcg

SEQ ID NO: 268449 - DNA, 20 bp, Artificial Sequence
  chemically synthesized
acaacagcaatgccacgagg

SEQ ID NO: 268450 - DNA, 20 bp, Artificial Sequence
  chemically synthesized
cagacaacagcaatgccacg

SEQ ID NO: 268451 - DNA, 20 bp, Artificial Sequence
  chemically synthesized
ccagacaacagcaatgccac

SEQ ID NO: 268452 - DNA, 20 bp, Artificial Sequence
  chemically synthesized
ctcgtggcattgctgttgtc

SEQ ID NO: 268453 - DNA, 20 bp, Artificial Sequence
  chemically synthesized
tagctgcatggtccagacaa

SEQ ID NO: 268454 - DNA, 20 bp, Artificial Sequence
  chemically synthesized
ttgctgttgtctggaccatg

SEQ ID NO: 268455 - DNA, 20 bp, Artificial Sequence
  chemically synthesized
tcctagctagctgcatggtc

SEQ ID NO: 268456 - DNA, 20 bp, Artificial Sequence
  chemically synthesized
tgttgtctggaccatgcagc

SEQ ID NO: 268457 - DNA, 20 bp, Artificial Sequence
  chemically synthesized
atcaatcctagctagctgca

SEQ ID NO: 268458 - DNA, 20 bp, Artificial Sequence
  chemically synthesized
gtctggaccatgcagctagc

SEQ ID NO: 268459 - DNA, 20 bp, Artificial Sequence
  chemically synthesized
tctggaccatgcagctagct

SEQ ID NO: 268460 - DNA, 20 bp, Artificial Sequence
  chemically synthesized
aaatatggatcaatcctagc

SEQ ID NO: 268461 - DNA, 20 bp, Artificial Sequence
  chemically synthesized
ttaaaaatatggatcaatcc

SEQ ID NO: 268462 - DNA, 20 bp, Artificial Sequence
  chemically synthesized
atgttaagtttttaaaaata

SEQ ID NO: 268463 - DNA, 20 bp, Artificial Sequence
  chemically synthesized
aagagggtaaaattaatgtt

SEQ ID NO: 268464 - DNA, 20 bp, Artificial Sequence
  chemically synthesized
aatcagagtagtattaaaga

SEQ ID NO: 268465 - DNA, 20 bp, Artificial Sequence
  chemically synthesized
caatcagagtagtattaaag

SEQ ID NO: 268466 - DNA, 20 bp, Artificial Sequence
  chemically synthesized
tcaatcagagtagtattaaa

SEQ ID NO: 268467 - DNA, 20 bp, Artificial Sequence
  chemically synthesized
cttcaatcagagtagtatta

SEQ ID NO: 268468 - DNA, 20 bp, Artificial Sequence
  chemically synthesized
aattcacccttcaatcagag

SEQ ID NO: 268469 - DNA, 20 bp, Artificial Sequence
  chemically synthesized
ctttaatactactctgattg

SEQ ID NO: 268470 - DNA, 20 bp, Artificial Sequence
  chemically synthesized
tttaatactactctgattga

SEQ ID NO: 268471 - DNA, 20 bp, Artificial Sequence
  chemically synthesized
ttaaattcacccttcaatca

SEQ ID NO: 268472 - DNA, 20 bp, Artificial Sequence
  chemically synthesized
ttaatactactctgattgaa

SEQ ID NO: 268473 - DNA, 20 bp, Artificial Sequence
  chemically synthesized
ttttaaattcacccttcaat

SEQ ID NO: 268474 - DNA, 20 bp, Artificial Sequence
  chemically synthesized
gaagggtgaatttaaaaata

SEQ ID NO: 268475 - DNA, 20 bp, Artificial Sequence
  chemically synthesized
tgaatttaaaaatacagtga

SEQ ID NO: 268476 - DNA, 20 bp, Artificial Sequence
  chemically synthesized
gaatttaaaaatacagtgaa

SEQ ID NO: 268477 - DNA, 20 bp, Artificial Sequence
  chemically synthesized
aatttaaaaatacagtgaaa

SEQ ID NO: 268478 - DNA, 20 bp, Artificial Sequence
  chemically synthesized
tgcaacttcctacagcgaca

SEQ ID NO: 268479 - DNA, 20 bp, Artificial Sequence
  chemically synthesized
gtgaaagggctatgtcgctg

SEQ ID NO: 268480 - DNA, 20 bp, Artificial Sequence
  chemically synthesized
tgaaagggctatgtcgctgt

SEQ ID NO: 268481 - DNA, 20 bp, Artificial Sequence
  chemically synthesized
aagggctatgtcgctgtagg

SEQ ID NO: 268482 - DNA, 20 bp, Artificial Sequence
  chemically synthesized
atgctaattgcaacttccta

SEQ ID NO: 268483 - DNA, 20 bp, Artificial Sequence
  chemically synthesized
tcgctgtaggaagttgcaat

SEQ ID NO: 268484 - DNA, 20 bp, Artificial Sequence
  chemically synthesized
aatattaacaaatgagataa

SEQ ID NO: 268485 - DNA, 20 bp, Artificial Sequence
  chemically synthesized
atttgagaatattaacaaat

SEQ ID NO: 268486 - DNA, 20 bp, Artificial Sequence
  chemically synthesized
catttgttaatattctcaaa

SEQ ID NO: 268487 - DNA, 20 bp, Artificial Sequence
  chemically synthesized
tgacaggaggaaagccattt

SEQ ID NO: 268488 - DNA, 20 bp, Artificial Sequence
  chemically synthesized
aaattaaaatgacaggagga

SEQ ID NO: 268489 - DNA, 20 bp, Artificial Sequence
  chemically synthesized
ttttaaattaaaatgacagg

SEQ ID NO: 268490 - DNA, 20 bp, Artificial Sequence
  chemically synthesized
tttttaaattaaaatgacag

SEQ ID NO: 268491 - DNA, 20 bp, Artificial Sequence
  chemically synthesized
aatttttaaattaaaatgac

SEQ ID NO: 268492 - DNA, 20 bp, Artificial Sequence
  chemically synthesized
aaatttttaaattaaaatga

SEQ ID NO: 268493 - DNA, 20 bp, Artificial Sequence
  chemically synthesized
tccaaattgtttaaaaggta

SEQ ID NO: 268494 - DNA, 20 bp, Artificial Sequence
  chemically synthesized
agtattccaaattgtttaaa

SEQ ID NO: 268495 - DNA, 20 bp, Artificial Sequence
  chemically synthesized
aagtattccaaattgtttaa

SEQ ID NO: 268496 - DNA, 20 bp, Artificial Sequence
  chemically synthesized
tctttaccttttaaacaatt

SEQ ID NO: 268497 - DNA, 20 bp, Artificial Sequence
  chemically synthesized
aaaaaaagaatatattttaa

SEQ ID NO: 268498 - DNA, 20 bp, Artificial Sequence
  chemically synthesized
aaattatagttacagaaaaa

SEQ ID NO: 268499 - DNA, 20 bp, Artificial Sequence
  chemically synthesized
atgtttccaaattatagtta

SEQ ID NO: 268500 - DNA, 20 bp, Artificial Sequence
  chemically synthesized
ttttttctgtaactataatt

SEQ ID NO: 268501 - DNA, 20 bp, Artificial Sequence
  chemically synthesized
gtgaccatgtttccaaatta

SEQ ID NO: 268502 - DNA, 20 bp, Artificial Sequence
  chemically synthesized
gtaactataatttggaaaca

SEQ ID NO: 268503 - DNA, 20 bp, Artificial Sequence
  chemically synthesized
ataatttggaaacatggtca

SEQ ID NO: 268504 - DNA, 20 bp, Artificial Sequence
  chemically synthesized
taatttggaaacatggtcac

SEQ ID NO: 268505 - DNA, 20 bp, Artificial Sequence
  chemically synthesized
aatttggaaacatggtcaca

SEQ ID NO: 268506 - DNA, 20 bp, Artificial Sequence
  chemically synthesized
tggaaacatggtcacagggt

SEQ ID NO: 268507 - DNA, 20 bp, Artificial Sequence
  chemically synthesized
ggaaacatggtcacagggta

SEQ ID NO: 268508 - DNA, 20 bp, Artificial Sequence
  chemically synthesized
gaaacatggtcacagggtaa

SEQ ID NO: 268509 - DNA, 20 bp, Artificial Sequence
  chemically synthesized
aaacatggtcacagggtaag

SEQ ID NO: 268510 - DNA, 20 bp, Artificial Sequence
  chemically synthesized
ggtcacagggtaaggggaca

SEQ ID NO: 268511 - DNA, 20 bp, Artificial Sequence
  chemically synthesized
gtcacagggtaaggggacac

SEQ ID NO: 268512 - DNA, 20 bp, Artificial Sequence
  chemically synthesized
cagggtaaggggacacagga

SEQ ID NO: 268513 - DNA, 20 bp, Artificial Sequence
  chemically synthesized
caggacagttttcttacctg

SEQ ID NO: 268514 - DNA, 20 bp, Artificial Sequence
  chemically synthesized
ctgaagggacagctgcaggt

SEQ ID NO: 268515 - DNA, 20 bp, Artificial Sequence
  chemically synthesized
ttaactgaagggacagctgc

SEQ ID NO: 268516 - DNA, 20 bp, Artificial Sequence
  chemically synthesized
attaactgaagggacagctg

SEQ ID NO: 268517 - DNA, 20 bp, Artificial Sequence
  chemically synthesized
cttacctgcagctgtccctt

SEQ ID NO: 268518 - DNA, 20 bp, Artificial Sequence
  chemically synthesized
ggggtgattaactgaaggga

SEQ ID NO: 268519 - DNA, 20 bp, Artificial Sequence
  chemically synthesized
gtcaggggtgattaactgaa

SEQ ID NO: 268520 - DNA, 20 bp, Artificial Sequence
  chemically synthesized
ggtcaggggtgattaactga

SEQ ID NO: 268521 - DNA, 20 bp, Artificial Sequence
  chemically synthesized
tggtcaggggtgattaactg

SEQ ID NO: 268522 - DNA, 20 bp, Artificial Sequence
  chemically synthesized
agtagtgaggatgtggtcag

SEQ ID NO: 268523 - DNA, 20 bp, Artificial Sequence
  chemically synthesized
aagtagtgaggatgtggtca

SEQ ID NO: 268524 - DNA, 20 bp, Artificial Sequence
  chemically synthesized
gaagtagtgaggatgtggtc

SEQ ID NO: 268525 - DNA, 20 bp, Artificial Sequence
  chemically synthesized
agaagtagtgaggatgtggt

SEQ ID NO: 268526 - DNA, 20 bp, Artificial Sequence
  chemically synthesized
ttccagaagtagtgaggatg

SEQ ID NO: 268527 - DNA, 20 bp, Artificial Sequence
  chemically synthesized
gagaacttccagaagtagtg

SEQ ID NO: 268528 - DNA, 20 bp, Artificial Sequence
  chemically synthesized
ggagaacttccagaagtagt

SEQ ID NO: 268529 - DNA, 20 bp, Artificial Sequence
  chemically synthesized
gaccacatcctcactacttc

SEQ ID NO: 268530 - DNA, 20 bp, Artificial Sequence
  chemically synthesized
cacatcctcactacttctgg

SEQ ID NO: 268531 - DNA, 20 bp, Artificial Sequence
  chemically synthesized
aatgggagaacttccagaag

SEQ ID NO: 268532 - DNA, 20 bp, Artificial Sequence
  chemically synthesized
aagaatgggagaacttccag

SEQ ID NO: 268533 - DNA, 20 bp, Artificial Sequence
  chemically synthesized
agaaagaatgggagaacttc

SEQ ID NO: 268534 - DNA, 20 bp, Artificial Sequence
  chemically synthesized
atcccacagagaaagaatgg

SEQ ID NO: 268535 - DNA, 20 bp, Artificial Sequence
  chemically synthesized
tgatcccacagagaaagaat

SEQ ID NO: 268536 - DNA, 20 bp, Artificial Sequence
  chemically synthesized
atgatcccacagagaaagaa

SEQ ID NO: 268537 - DNA, 20 bp, Artificial Sequence
  chemically synthesized
gttctcccattctttctctg

SEQ ID NO: 268538 - DNA, 20 bp, Artificial Sequence
  chemically synthesized
ttctcccattctttctctgt

SEQ ID NO: 268539 - DNA, 20 bp, Artificial Sequence
  chemically synthesized
tcttaatgatcccacagaga

SEQ ID NO: 268540 - DNA, 20 bp, Artificial Sequence
  chemically synthesized
taattcttaatgatcccaca

SEQ ID NO: 268541 - DNA, 20 bp, Artificial Sequence
  chemically synthesized
tctaattcttaatgatccca

SEQ ID NO: 268542 - DNA, 20 bp, Artificial Sequence
  chemically synthesized
tctttctctgtgggatcatt

SEQ ID NO: 268543 - DNA, 20 bp, Artificial Sequence
  chemically synthesized
tctgtgggatcattaagaat

SEQ ID NO: 268544 - DNA, 20 bp, Artificial Sequence
  chemically synthesized
cattaagaattagaatacct

SEQ ID NO: 268545 - DNA, 20 bp, Artificial Sequence
  chemically synthesized
tacgaactcaagaatgtctt

SEQ ID NO: 268546 - DNA, 20 bp, Artificial Sequence
  chemically synthesized
ttacgaactcaagaatgtct

SEQ ID NO: 268547 - DNA, 20 bp, Artificial Sequence
  chemically synthesized
agaatacctaagacattctt

SEQ ID NO: 268548 - DNA, 20 bp, Artificial Sequence
  chemically synthesized
ttgaagagaattacgaactc

SEQ ID NO: 268549 - DNA, 20 bp, Artificial Sequence
  chemically synthesized
ttgagttcgtaattctcttc

SEQ ID NO: 268550 - DNA, 20 bp, Artificial Sequence
  chemically synthesized
agttcgtaattctcttcaag

SEQ ID NO: 268551 - DNA, 20 bp, Artificial Sequence
  chemically synthesized
aaagataccatctacttgaa

SEQ ID NO: 268552 - DNA, 20 bp, Artificial Sequence
  chemically synthesized
ttaaagataccatctacttg

SEQ ID NO: 268553 - DNA, 20 bp, Artificial Sequence
  chemically synthesized
cgtaattctcttcaagtaga

SEQ ID NO: 268554 - DNA, 20 bp, Artificial Sequence
  chemically synthesized
gacacaatttaagatgttta

SEQ ID NO: 268555 - DNA, 20 bp, Artificial Sequence
  chemically synthesized
ggtggtgcgtgacacaattt

SEQ ID NO: 268556 - DNA, 20 bp, Artificial Sequence
  chemically synthesized
aaattgtgtcacgcaccacc

SEQ ID NO: 268557 - DNA, 20 bp, Artificial Sequence
  chemically synthesized
cccttccaaaagatactggg

SEQ ID NO: 268558 - DNA, 20 bp, Artificial Sequence
  chemically synthesized
tagcccttccaaaagatact

SEQ ID NO: 268559 - DNA, 20 bp, Artificial Sequence
  chemically synthesized
atagcccttccaaaagatac

SEQ ID NO: 268560 - DNA, 20 bp, Artificial Sequence
  chemically synthesized
acgcaccacccagtatcttt

SEQ ID NO: 268561 - DNA, 20 bp, Artificial Sequence
  chemically synthesized
caccacccagtatcttttgg

SEQ ID NO: 268562 - DNA, 20 bp, Artificial Sequence
  chemically synthesized
accacccagtatcttttgga

SEQ ID NO: 268563 - DNA, 20 bp, Artificial Sequence
  chemically synthesized
ccacccagtatcttttggaa

SEQ ID NO: 268564 - DNA, 20 bp, Artificial Sequence
  chemically synthesized
agaatgcatagcccttccaa

SEQ ID NO: 268565 - DNA, 20 bp, Artificial Sequence
  chemically synthesized
tttggaagggctatgcattc

SEQ ID NO: 268566 - DNA, 20 bp, Artificial Sequence
  chemically synthesized
accatagatactagaatgca

SEQ ID NO: 268567 - DNA, 20 bp, Artificial Sequence
  chemically synthesized
gctatgcattctagtatcta

SEQ ID NO: 268568 - DNA, 20 bp, Artificial Sequence
  chemically synthesized
atattccaaaccatagatac

SEQ ID NO: 268569 - DNA, 20 bp, Artificial Sequence
  chemically synthesized
gcattctagtatctatggtt

SEQ ID NO: 268570 - DNA, 20 bp, Artificial Sequence
  chemically synthesized
tagtaacatattccaaacca

SEQ ID NO: 268571 - DNA, 20 bp, Artificial Sequence
  chemically synthesized
tcttcctgctcagaattaaa

SEQ ID NO: 268572 - DNA, 20 bp, Artificial Sequence
  chemically synthesized
atatgttactatttaattct

SEQ ID NO: 268573 - DNA, 20 bp, Artificial Sequence
  chemically synthesized
tgttactatttaattctgag

SEQ ID NO: 268574 - DNA, 20 bp, Artificial Sequence
  chemically synthesized
gttactatttaattctgagc

SEQ ID NO: 268575 - DNA, 20 bp, Artificial Sequence
  chemically synthesized
actatttaattctgagcagg

SEQ ID NO: 268576 - DNA, 20 bp, Artificial Sequence
  chemically synthesized
atctaagttttcttcctgct

SEQ ID NO: 268577 - DNA, 20 bp, Artificial Sequence
  chemically synthesized
ttctgagcaggaagaaaact

SEQ ID NO: 268578 - DNA, 20 bp, Artificial Sequence
  chemically synthesized
ctaaatagaatgattcatct

SEQ ID NO: 268579 - DNA, 20 bp, Artificial Sequence
  chemically synthesized
cttagatgaatcattctatt

SEQ ID NO: 268580 - DNA, 20 bp, Artificial Sequence
  chemically synthesized
ttagatgaatcattctattt

SEQ ID NO: 268581 - DNA, 20 bp, Artificial Sequence
  chemically synthesized
atgaatcattctatttagga

SEQ ID NO: 268582 - DNA, 20 bp, Artificial Sequence
  chemically synthesized
tagaattggtctttcctaaa

SEQ ID NO: 268583 - DNA, 20 bp, Artificial Sequence
  chemically synthesized
ggccagtggcgttgtagaat

SEQ ID NO: 268584 - DNA, 20 bp, Artificial Sequence
  chemically synthesized
ttgataggccagtggcgttg

SEQ ID NO: 268585 - DNA, 20 bp, Artificial Sequence
  chemically synthesized
gaccaattctacaacgccac

SEQ ID NO: 268586 - DNA, 20 bp, Artificial Sequence
  chemically synthesized
ggatccttttgataggccag

SEQ ID NO: 268587 - DNA, 20 bp, Artificial Sequence
  chemically synthesized
ctgggatccttttgataggc

SEQ ID NO: 268588 - DNA, 20 bp, Artificial Sequence
  chemically synthesized
caacgccactggcctatcaa

SEQ ID NO: 268589 - DNA, 20 bp, Artificial Sequence
  chemically synthesized
aacgccactggcctatcaaa

SEQ ID NO: 268590 - DNA, 20 bp, Artificial Sequence
  chemically synthesized
atttctgggatccttttgat

SEQ ID NO: 268591 - DNA, 20 bp, Artificial Sequence
  chemically synthesized
catttctgggatccttttga

SEQ ID NO: 268592 - DNA, 20 bp, Artificial Sequence
  chemically synthesized
ctggcctatcaaaaggatcc

SEQ ID NO: 268593 - DNA, 20 bp, Artificial Sequence
  chemically synthesized
atcagaggtttgacatttct

SEQ ID NO: 268594 - DNA, 20 bp, Artificial Sequence
  chemically synthesized
tatcagaggtttgacatttc

SEQ ID NO: 268595 - DNA, 20 bp, Artificial Sequence
  chemically synthesized
tcttcttgaatgagtatcag

SEQ ID NO: 268596 - DNA, 20 bp, Artificial Sequence
  chemically synthesized
ttcttcttgaatgagtatca

SEQ ID NO: 268597 - DNA, 20 bp, Artificial Sequence
  chemically synthesized
tcttcttcttgaatgagtat

SEQ ID NO: 268598 - DNA, 20 bp, Artificial Sequence
  chemically synthesized
caaacctctgatactcattc

SEQ ID NO: 268599 - DNA, 20 bp, Artificial Sequence
  chemically synthesized
acctctgatactcattcaag

SEQ ID NO: 268600 - DNA, 20 bp, Artificial Sequence
  chemically synthesized
gccatgtcttcttcttgaat

SEQ ID NO: 268601 - DNA, 20 bp, Artificial Sequence
  chemically synthesized
tctgatactcattcaagaag

SEQ ID NO: 268602 - DNA, 20 bp, Artificial Sequence
  chemically synthesized
actcattcaagaagaagaca

SEQ ID NO: 268603 - DNA, 20 bp, Artificial Sequence
  chemically synthesized
gaagacatggcaaaattcta

SEQ ID NO: 268604 - DNA, 20 bp, Artificial Sequence
  chemically synthesized
agcagcaccctgtttgacca

SEQ ID NO: 268605 - DNA, 20 bp, Artificial Sequence
  chemically synthesized
ggcaaaattctatggtcaaa

SEQ ID NO: 268606 - DNA, 20 bp, Artificial Sequence
  chemically synthesized
gcaaaattctatggtcaaac

SEQ ID NO: 268607 - DNA, 20 bp, Artificial Sequence
  chemically synthesized
caaaattctatggtcaaaca

SEQ ID NO: 268608 - DNA, 20 bp, Artificial Sequence
  chemically synthesized
gaggaaagctaatatagaag

SEQ ID NO: 268609 - DNA, 20 bp, Artificial Sequence
  chemically synthesized
acagggtgctgcttctatat

SEQ ID NO: 268610 - DNA, 20 bp, Artificial Sequence
  chemically synthesized
ctagaggaaagctaatatag

SEQ ID NO: 268611 - DNA, 20 bp, Artificial Sequence
  chemically synthesized
gaactagaggaaagctaata

SEQ ID NO: 268612 - DNA, 20 bp, Artificial Sequence
  chemically synthesized
cttctatattagctttcctc

SEQ ID NO: 268613 - DNA, 20 bp, Artificial Sequence
  chemically synthesized
caaactcctgaactagagga

SEQ ID NO: 268614 - DNA, 20 bp, Artificial Sequence
  chemically synthesized
atattagctttcctctagtt

SEQ ID NO: 268615 - DNA, 20 bp, Artificial Sequence
  chemically synthesized
tattagctttcctctagttc

SEQ ID NO: 268616 - DNA, 20 bp, Artificial Sequence
  chemically synthesized
tattcaaactcctgaactag

SEQ ID NO: 268617 - DNA, 20 bp, Artificial Sequence
  chemically synthesized
atattcaaactcctgaacta

SEQ ID NO: 268618 - DNA, 20 bp, Artificial Sequence
  chemically synthesized
ttagctttcctctagttcag

SEQ ID NO: 268619 - DNA, 20 bp, Artificial Sequence
  chemically synthesized
acatattcaaactcctgaac

SEQ ID NO: 268620 - DNA, 20 bp, Artificial Sequence
  chemically synthesized
gtttgaatatgttctgtgaa

SEQ ID NO: 268621 - DNA, 20 bp, Artificial Sequence
  chemically synthesized
aactactatgtggccattca

SEQ ID NO: 268622 - DNA, 20 bp, Artificial Sequence
  chemically synthesized
atgttctgtgaatggccaca

SEQ ID NO: 268623 - DNA, 20 bp, Artificial Sequence
  chemically synthesized
ttctgtgaatggccacatag

SEQ ID NO: 268624 - DNA, 20 bp, Artificial Sequence
  chemically synthesized
agcctagaacaactactatg

SEQ ID NO: 268625 - DNA, 20 bp, Artificial Sequence
  chemically synthesized
tggccacatagtagttgttc

SEQ ID NO: 268626 - DNA, 20 bp, Artificial Sequence
  chemically synthesized
ggccacatagtagttgttct

SEQ ID NO: 268627 - DNA, 20 bp, Artificial Sequence
  chemically synthesized
actgcatggctcacaaagcc

SEQ ID NO: 268628 - DNA, 20 bp, Artificial Sequence
  chemically synthesized
gtagttgttctaggctttgt

SEQ ID NO: 268629 - DNA, 20 bp, Artificial Sequence
  chemically synthesized
cagagactgcatggctcaca

SEQ ID NO: 268630 - DNA, 20 bp, Artificial Sequence
  chemically synthesized
tctaggctttgtgagccatg

SEQ ID NO: 268631 - DNA, 20 bp, Artificial Sequence
  chemically synthesized
taattgtgacagagactgca

SEQ ID NO: 268632 - DNA, 20 bp, Artificial Sequence
  chemically synthesized
agagttgagtaattgtgaca

SEQ ID NO: 268633 - DNA, 20 bp, Artificial Sequence
  chemically synthesized
gcagagttgagtaattgtga

SEQ ID NO: 268634 - DNA, 20 bp, Artificial Sequence
  chemically synthesized
tgtgctaaaacagcagagtt

SEQ ID NO: 268635 - DNA, 20 bp, Artificial Sequence
  chemically synthesized
gcttttgtgctaaaacagca

SEQ ID NO: 268636 - DNA, 20 bp, Artificial Sequence
  chemically synthesized
attactcaactctgctgttt

SEQ ID NO: 268637 - DNA, 20 bp, Artificial Sequence
  chemically synthesized
ctgcttttgtgctaaaacag

SEQ ID NO: 268638 - DNA, 20 bp, Artificial Sequence
  chemically synthesized
tggctgcttttgtgctaaaa

SEQ ID NO: 268639 - DNA, 20 bp, Artificial Sequence
  chemically synthesized
actctgctgttttagcacaa

SEQ ID NO: 268640 - DNA, 20 bp, Artificial Sequence
  chemically synthesized
ctgctgttttagcacaaaag

SEQ ID NO: 268641 - DNA, 20 bp, Artificial Sequence
  chemically synthesized
tgttttagcacaaaagcagc

SEQ ID NO: 268642 - DNA, 20 bp, Artificial Sequence
  chemically synthesized
ttatatttgtttattttttc

SEQ ID NO: 268643 - DNA, 20 bp, Artificial Sequence
  chemically synthesized
tataaattgatacacttcaa

SEQ ID NO: 268644 - DNA, 20 bp, Artificial Sequence
  chemically synthesized
gtctgtacataagactattg

SEQ ID NO: 268645 - DNA, 20 bp, Artificial Sequence
  chemically synthesized
cacttcaatagtcttatgta

SEQ ID NO: 268646 - DNA, 20 bp, Artificial Sequence
  chemically synthesized
atatgtcagtgtctgtacat

SEQ ID NO: 268647 - DNA, 20 bp, Artificial Sequence
  chemically synthesized
attattaaaaatgcatatgt

SEQ ID NO: 268648 - DNA, 20 bp, Artificial Sequence
  chemically synthesized
aataatttttatgtgtcctg

SEQ ID NO: 268649 - DNA, 20 bp, Artificial Sequence
  chemically synthesized
aaagaagaactagatacttc

SEQ ID NO: 268650 - DNA, 20 bp, Artificial Sequence
  chemically synthesized
tttatgtgtcctgaagtatc

SEQ ID NO: 268651 - DNA, 20 bp, Artificial Sequence
  chemically synthesized
aaaagaagaactagatactt

SEQ ID NO: 268652 - DNA, 20 bp, Artificial Sequence
  chemically synthesized
gaaaaaatcaaaagaagaac

SEQ ID NO: 268653 - DNA, 20 bp, Artificial Sequence
  chemically synthesized
tggttggaaaaaatcaaaag

SEQ ID NO: 268654 - DNA, 20 bp, Artificial Sequence
  chemically synthesized
aaatggttggaaaaaatcaa

SEQ ID NO: 268655 - DNA, 20 bp, Artificial Sequence
  chemically synthesized
attgtttttatgtaaatggt

SEQ ID NO: 268656 - DNA, 20 bp, Artificial Sequence
  chemically synthesized
gaaaattgtttttatgtaaa

SEQ ID NO: 268657 - DNA, 20 bp, Artificial Sequence
  chemically synthesized
atttacataaaaacaatttt

SEQ ID NO: 268658 - DNA, 20 bp, Artificial Sequence
  chemically synthesized
taaaaacaattttcagccca

SEQ ID NO: 268659 - DNA, 20 bp, Artificial Sequence
  chemically synthesized
aaaaacaattttcagcccat

SEQ ID NO: 268660 - DNA, 20 bp, Artificial Sequence
  chemically synthesized
ccttcttttgtacagcccat

SEQ ID NO: 268661 - DNA, 20 bp, Artificial Sequence
  chemically synthesized
accttcttttgtacagccca

SEQ ID NO: 268662 - DNA, 20 bp, Artificial Sequence
  chemically synthesized
tcagcccatgggctgtacaa

SEQ ID NO: 268663 - DNA, 20 bp, Artificial Sequence
  chemically synthesized
ttcagccaccttcttttgta

SEQ ID NO: 268664 - DNA, 20 bp, Artificial Sequence
  chemically synthesized
gcccatgggctgtacaaaag

SEQ ID NO: 268665 - DNA, 20 bp, Artificial Sequence
  chemically synthesized
cccatgggctgtacaaaaga

SEQ ID NO: 268666 - DNA, 20 bp, Artificial Sequence
  chemically synthesized
atgggctgtacaaaagaagg

SEQ ID NO: 268667 - DNA, 20 bp, Artificial Sequence
  chemically synthesized
tacaaaagaaggtggctgaa

SEQ ID NO: 268668 - DNA, 20 bp, Artificial Sequence
  chemically synthesized
aagaaggtggctgaatggat

SEQ ID NO: 268669 - DNA, 20 bp, Artificial Sequence
  chemically synthesized
attggtaggcctaatccatt

SEQ ID NO: 268670 - DNA, 20 bp, Artificial Sequence
  chemically synthesized
agaaggtggctgaatggatt

SEQ ID NO: 268671 - DNA, 20 bp, Artificial Sequence
  chemically synthesized
atgggcaaactataattggt

SEQ ID NO: 268672 - DNA, 20 bp, Artificial Sequence
  chemically synthesized
tggattaggcctaccaatta

SEQ ID NO: 268673 - DNA, 20 bp, Artificial Sequence
  chemically synthesized
gatgggcaaactataattgg

SEQ ID NO: 268674 - DNA, 20 bp, Artificial Sequence
  chemically synthesized
agagatgggcaaactataat

SEQ ID NO: 268675 - DNA, 20 bp, Artificial Sequence
  chemically synthesized
agataaatgagagcagagat

SEQ ID NO: 268676 - DNA, 20 bp, Artificial Sequence
  chemically synthesized
cagataaatgagagcagaga

SEQ ID NO: 268677 - DNA, 20 bp, Artificial Sequence
  chemically synthesized
tagtcagataaatgagagca

SEQ ID NO: 268678 - DNA, 20 bp, Artificial Sequence
  chemically synthesized
actagtcagataaatgagag

SEQ ID NO: 268679 - DNA, 20 bp, Artificial Sequence
  chemically synthesized
ttaactagtcagataaatga

SEQ ID NO: 268680 - DNA, 20 bp, Artificial Sequence
  chemically synthesized
aattaactagtcagataaat

SEQ ID NO: 268681 - DNA, 20 bp, Artificial Sequence
  chemically synthesized
tctgctctcatttatctgac

SEQ ID NO: 268682 - DNA, 20 bp, Artificial Sequence
  chemically synthesized
aggaaggcaaattaactagt

SEQ ID NO: 268683 - DNA, 20 bp, Artificial Sequence
  chemically synthesized
caagaggaaggcaaattaac

SEQ ID NO: 268684 - DNA, 20 bp, Artificial Sequence
  chemically synthesized
tagttaatttgccttcctct

SEQ ID NO: 268685 - DNA, 20 bp, Artificial Sequence
  chemically synthesized
agactctctcaccaagagga

SEQ ID NO: 268686 - DNA, 20 bp, Artificial Sequence
  chemically synthesized
gagactctctcaccaagagg

SEQ ID NO: 268687 - DNA, 20 bp, Artificial Sequence
  chemically synthesized
taatttgccttcctcttggt

SEQ ID NO: 268688 - DNA, 20 bp, Artificial Sequence
  chemically synthesized
taagagactctctcaccaag

SEQ ID NO: 268689 - DNA, 20 bp, Artificial Sequence
  chemically synthesized
atttgccttcctcttggtga

SEQ ID NO: 268690 - DNA, 20 bp, Artificial Sequence
  chemically synthesized
ctaagagactctctcaccaa

SEQ ID NO: 268691 - DNA, 20 bp, Artificial Sequence
  chemically synthesized
ttgccttcctcttggtgaga

SEQ ID NO: 268692 - DNA, 20 bp, Artificial Sequence
  chemically synthesized
gcctaagagactctctcacc

SEQ ID NO: 268693 - DNA, 20 bp, Artificial Sequence
  chemically synthesized
ctcttggtgagagagtctct

SEQ ID NO: 268694 - DNA, 20 bp, Artificial Sequence
  chemically synthesized
tcttggtgagagagtctctt

SEQ ID NO: 268695 - DNA, 20 bp, Artificial Sequence
  chemically synthesized
taatagagaagaatgcctaa

SEQ ID NO: 268696 - DNA, 20 bp, Artificial Sequence
  chemically synthesized
cctaatagagaagaatgcct

SEQ ID NO: 268697 - DNA, 20 bp, Artificial Sequence
  chemically synthesized
tcttaggcattcttctctat

SEQ ID NO: 268698 - DNA, 20 bp, Artificial Sequence
  chemically synthesized
cttaggcattcttctctatt

SEQ ID NO: 268699 - DNA, 20 bp, Artificial Sequence
  chemically synthesized
tcttgagcttcctaatagag

SEQ ID NO: 268700 - DNA, 20 bp, Artificial Sequence
  chemically synthesized
aggcattcttctctattagg

SEQ ID NO: 268701 - DNA, 20 bp, Artificial Sequence
  chemically synthesized
acttcttgagcttcctaata

SEQ ID NO: 268702 - DNA, 20 bp, Artificial Sequence
  chemically synthesized
caacttcttgagcttcctaa

SEQ ID NO: 268703 - DNA, 20 bp, Artificial Sequence
  chemically synthesized
tcttctctattaggaagctc

SEQ ID NO: 268704 - DNA, 20 bp, Artificial Sequence
  chemically synthesized
tctctattaggaagctcaag

SEQ ID NO: 268705 - DNA, 20 bp, Artificial Sequence
  chemically synthesized
tattaggaagctcaagaagt

SEQ ID NO: 268706 - DNA, 20 bp, Artificial Sequence
  chemically synthesized
tcaattctagccaacttctt

SEQ ID NO: 268707 - DNA, 20 bp, Artificial Sequence
  chemically synthesized
aggaagctcaagaagttggc

SEQ ID NO: 268708 - DNA, 20 bp, Artificial Sequence
  chemically synthesized
aataggggccatatcaattc

SEQ ID NO: 268709 - DNA, 20 bp, Artificial Sequence
  chemically synthesized
gaagttggctagaattgata

SEQ ID NO: 268710 - DNA, 20 bp, Artificial Sequence
  chemically synthesized
agaattgatatggcccctat

SEQ ID NO: 268711 - DNA, 20 bp, Artificial Sequence
  chemically synthesized
gaattgatatggcccctatt

SEQ ID NO: 268712 - DNA, 20 bp, Artificial Sequence
  chemically synthesized
gaaaagagctgacctaatag

SEQ ID NO: 268713 - DNA, 20 bp, Artificial Sequence
  chemically synthesized
tgaaaagagctgacctaata

SEQ ID NO: 268714 - DNA, 20 bp, Artificial Sequence
  chemically synthesized
tgatatggcccctattaggt

SEQ ID NO: 268715 - DNA, 20 bp, Artificial Sequence
  chemically synthesized
atgaaaagagctgacctaat

SEQ ID NO: 268716 - DNA, 20 bp, Artificial Sequence
  chemically synthesized
catgaaaagagctgacctaa

SEQ ID NO: 268717 - DNA, 20 bp, Artificial Sequence
  chemically synthesized
tattaggtcagctcttttca

SEQ ID NO: 268718 - DNA, 20 bp, Artificial Sequence
  chemically synthesized
taccatgggaaccatgaaaa

SEQ ID NO: 268719 - DNA, 20 bp, Artificial Sequence
  chemically synthesized
gttaccatgggaaccatgaa

SEQ ID NO: 268720 - DNA, 20 bp, Artificial Sequence
  chemically synthesized
agctcttttcatggttccca

SEQ ID NO: 268721 - DNA, 20 bp, Artificial Sequence
  chemically synthesized
atgaggattaatgttaccat

SEQ ID NO: 268722 - DNA, 20 bp, Artificial Sequence
  chemically synthesized
tatgaggattaatgttacca

SEQ ID NO: 268723 - DNA, 20 bp, Artificial Sequence
  chemically synthesized
gtaacattaatcctcatatt

SEQ ID NO: 268724 - DNA, 20 bp, Artificial Sequence
  chemically synthesized
taacattaatcctcatattg

SEQ ID NO: 268725 - DNA, 20 bp, Artificial Sequence
  chemically synthesized
ggtccaggatcctcaatatg

SEQ ID NO: 268726 - DNA, 20 bp, Artificial Sequence
  chemically synthesized
gggtccaggatcctcaatat

SEQ ID NO: 268727 - DNA, 20 bp, Artificial Sequence
  chemically synthesized
aatcctcatattgaggatcc

SEQ ID NO: 268728 - DNA, 20 bp, Artificial Sequence
  chemically synthesized
tttcaaagtcatgtgggtcc

SEQ ID NO: 268729 - DNA, 20 bp, Artificial Sequence
  chemically synthesized
atttcaaagtcatgtgggtc

SEQ ID NO: 268730 - DNA, 20 bp, Artificial Sequence
  chemically synthesized
taaggatttcaaagtcatgt

SEQ ID NO: 268731 - DNA, 20 bp, Artificial Sequence
  chemically synthesized
ctaaggatttcaaagtcatg

SEQ ID NO: 268732 - DNA, 20 bp, Artificial Sequence
  chemically synthesized
attcactcctaaggatttca

SEQ ID NO: 268733 - DNA, 20 bp, Artificial Sequence
  chemically synthesized
ccacatgactttgaaatcct

SEQ ID NO: 268734 - DNA, 20 bp, Artificial Sequence
  chemically synthesized
cacatgactttgaaatcctt

SEQ ID NO: 268735 - DNA, 20 bp, Artificial Sequence
  chemically synthesized
catgactttgaaatccttag

SEQ ID NO: 268736 - DNA, 20 bp, Artificial Sequence
  chemically synthesized
gtaatagtcattcactccta

SEQ ID NO: 268737 - DNA, 20 bp, Artificial Sequence
  chemically synthesized
tgtaatagtcattcactcct

SEQ ID NO: 268738 - DNA, 20 bp, Artificial Sequence
  chemically synthesized
gaccatgattacatttgtaa

SEQ ID NO: 268739 - DNA, 20 bp, Artificial Sequence
  chemically synthesized
gactattacaaatgtaatca

SEQ ID NO: 268740 - DNA, 20 bp, Artificial Sequence
  chemically synthesized
taatcatggtcaccctatga

SEQ ID NO: 268741 - DNA, 20 bp, Artificial Sequence
  chemically synthesized
ggatgttgattgctttcata

SEQ ID NO: 268742 - DNA, 20 bp, Artificial Sequence
  chemically synthesized
cggatgttgattgctttcat

SEQ ID NO: 268743 - DNA, 20 bp, Artificial Sequence
  chemically synthesized
acggatgttgattgctttca

SEQ ID NO: 268744 - DNA, 20 bp, Artificial Sequence
  chemically synthesized
gttaaaaagtcagaaaataa

SEQ ID NO: 268745 - DNA, 20 bp, Artificial Sequence
  chemically synthesized
aatggcttttgttaaaaagt

SEQ ID NO: 268746 - DNA, 20 bp, Artificial Sequence
  chemically synthesized
tctgaatggcttttgttaaa

SEQ ID NO: 268747 - DNA, 20 bp, Artificial Sequence
  chemically synthesized
attttctgactttttaacaa

SEQ ID NO: 268748 - DNA, 20 bp, Artificial Sequence
  chemically synthesized
actttttaacaaaagccatt

SEQ ID NO: 268749 - DNA, 20 bp, Artificial Sequence
  chemically synthesized
ttaacaaaagccattcagac

SEQ ID NO: 268750 - DNA, 20 bp, Artificial Sequence
  chemically synthesized
ccatctcacaccagtctgaa

SEQ ID NO: 268751 - DNA, 20 bp, Artificial Sequence
  chemically synthesized
aaagccattcagactggtgt

SEQ ID NO: 268752 - DNA, 20 bp, Artificial Sequence
  chemically synthesized
aataagataccatctcacac

SEQ ID NO: 268753 - DNA, 20 bp, Artificial Sequence
  chemically synthesized
ccattcagactggtgtgaga

SEQ ID NO: 268754 - DNA, 20 bp, Artificial Sequence
  chemically synthesized
gtgtgagatggtatcttatt

SEQ ID NO: 268755 - DNA, 20 bp, Artificial Sequence
  chemically synthesized
tgtgagatggtatcttattt

SEQ ID NO: 268756 - DNA, 20 bp, Artificial Sequence
  chemically synthesized
gtgagatggtatcttattta

SEQ ID NO: 268757 - DNA, 20 bp, Artificial Sequence
  chemically synthesized
atgccaattaaaccctaaat

SEQ ID NO: 268758 - DNA, 20 bp, Artificial Sequence
  chemically synthesized
tatcttatttagggtttaat

SEQ ID NO: 268759 - DNA, 20 bp, Artificial Sequence
  chemically synthesized
caatatcactaatcatcaga

SEQ ID NO: 268760 - DNA, 20 bp, Artificial Sequence
  chemically synthesized
attggcatctctctgatgat

SEQ ID NO: 268761 - DNA, 20 bp, Artificial Sequence
  chemically synthesized
ttcaatatcactaatcatca

SEQ ID NO: 268762 - DNA, 20 bp, Artificial Sequence
  chemically synthesized
tcttcaatatcactaatcat

SEQ ID NO: 268763 - DNA, 20 bp, Artificial Sequence
  chemically synthesized
tctgatgattagtgatattg

SEQ ID NO: 268764 - DNA, 20 bp, Artificial Sequence
  chemically synthesized
agattttttaatatgctcat

SEQ ID NO: 268765 - DNA, 20 bp, Artificial Sequence
  chemically synthesized
aagacatacaagcggccaat

SEQ ID NO: 268766 - DNA, 20 bp, Artificial Sequence
  chemically synthesized
ctcgaaagaagacatacaag

SEQ ID NO: 268767 - DNA, 20 bp, Artificial Sequence
  chemically synthesized
ctcctcgaaagaagacatac

SEQ ID NO: 268768 - DNA, 20 bp, Artificial Sequence
  chemically synthesized
ccgcttgtatgtcttctttc

SEQ ID NO: 268769 - DNA, 20 bp, Artificial Sequence
  chemically synthesized
cgcttgtatgtcttctttcg

SEQ ID NO: 268770 - DNA, 20 bp, Artificial Sequence
  chemically synthesized
gaatagacactcctcgaaag

SEQ ID NO: 268771 - DNA, 20 bp, Artificial Sequence
  chemically synthesized
cttgtatgtcttctttcgag

SEQ ID NO: 268772 - DNA, 20 bp, Artificial Sequence
  chemically synthesized
cgtgaatagacactcctcga

SEQ ID NO: 268773 - DNA, 20 bp, Artificial Sequence
  chemically synthesized
aacaggacaaagaacgtgaa

SEQ ID NO: 268774 - DNA, 20 bp, Artificial Sequence
  chemically synthesized
aacagattaaaaacaggaca

SEQ ID NO: 268775 - DNA, 20 bp, Artificial Sequence
  chemically synthesized
aaaaaaaacagattaaaaac

SEQ ID NO: 268776 - DNA, 20 bp, Artificial Sequence
  chemically synthesized
aaaaaaaaacagattaaaaa

SEQ ID NO: 268777 - DNA, 20 bp, Artificial Sequence
  chemically synthesized
aacaagaaattaaaaaaaaa

SEQ ID NO: 268778 - DNA, 20 bp, Artificial Sequence
  chemically synthesized
ttttttaatttcttgttgac

SEQ ID NO: 268779 - DNA, 20 bp, Artificial Sequence
  chemically synthesized
aggaacttaaacttgtcaac

SEQ ID NO: 268780 - DNA, 20 bp, Artificial Sequence
  chemically synthesized
aatttcttgttgacaagttt

SEQ ID NO: 268781 - DNA, 20 bp, Artificial Sequence
  chemically synthesized
tgacaagtttaagttcctta

SEQ ID NO: 268782 - DNA, 20 bp, Artificial Sequence
  chemically synthesized
aataatatccagaatctata

SEQ ID NO: 268783 - DNA, 20 bp, Artificial Sequence
  chemically synthesized
gaataatatccagaatctat

SEQ ID NO: 268784 - DNA, 20 bp, Artificial Sequence
  chemically synthesized
tttaagttccttatagattc

SEQ ID NO: 268785 - DNA, 20 bp, Artificial Sequence
  chemically synthesized
tctgacaaaagaataatatc

SEQ ID NO: 268786 - DNA, 20 bp, Artificial Sequence
  chemically synthesized
tctggatattattcttttgt

SEQ ID NO: 268787 - DNA, 20 bp, Artificial Sequence
  chemically synthesized
gcaaactttgcatctgacaa

SEQ ID NO: 268788 - DNA, 20 bp, Artificial Sequence
  chemically synthesized
ttattcttttgtcagatgca

SEQ ID NO: 268789 - DNA, 20 bp, Artificial Sequence
  chemically synthesized
tgcaaatattttctcccatt

SEQ ID NO: 268790 - DNA, 20 bp, Artificial Sequence
  chemically synthesized
gcaaatattttctcccattc

SEQ ID NO: 268791 - DNA, 20 bp, Artificial Sequence
  chemically synthesized
acagataacctcctgaatgg

SEQ ID NO: 268792 - DNA, 20 bp, Artificial Sequence
  chemically synthesized
aaatattttctcccattcag

SEQ ID NO: 268793 - DNA, 20 bp, Artificial Sequence
  chemically synthesized
aatattttctcccattcagg

SEQ ID NO: 268794 - DNA, 20 bp, Artificial Sequence
  chemically synthesized
aaacagataacctcctgaat

SEQ ID NO: 268795 - DNA, 20 bp, Artificial Sequence
  chemically synthesized
taaacagataacctcctgaa

SEQ ID NO: 268796 - DNA, 20 bp, Artificial Sequence
  chemically synthesized
gaaacaatcaacacagtaaa

SEQ ID NO: 268797 - DNA, 20 bp, Artificial Sequence
  chemically synthesized
agaaaaagaaacaatcaaca

SEQ ID NO: 268798 - DNA, 20 bp, Artificial Sequence
  chemically synthesized
ttaaagcttctgtacagaaa

SEQ ID NO: 268799 - DNA, 20 bp, Artificial Sequence
  chemically synthesized
tgattgtttctttttctgta

SEQ ID NO: 268800 - DNA, 20 bp, Artificial Sequence
  chemically synthesized
ttgtttctttttctgtacag

SEQ ID NO: 268801 - DNA, 20 bp, Artificial Sequence
  chemically synthesized
attaaattaaagcttctgta

SEQ ID NO: 268802 - DNA, 20 bp, Artificial Sequence
  chemically synthesized
aatgagagttaattaaatta

SEQ ID NO: 268803 - DNA, 20 bp, Artificial Sequence
  chemically synthesized
aaacaaaaattgacaaatga

SEQ ID NO: 268804 - DNA, 20 bp, Artificial Sequence
  chemically synthesized
aaaaacaaaaattgacaaat

SEQ ID NO: 268805 - DNA, 20 bp, Artificial Sequence
  chemically synthesized
tttttgttgcatttgtcatt

SEQ ID NO: 268806 - DNA, 20 bp, Artificial Sequence
  chemically synthesized
ttttgttgcatttgtcattg

SEQ ID NO: 268807 - DNA, 20 bp, Artificial Sequence
  chemically synthesized
tgcatttgtcattgaggtct

SEQ ID NO: 268808 - DNA, 20 bp, Artificial Sequence
  chemically synthesized
taggcaaagaatttatgacc

SEQ ID NO: 268809 - DNA, 20 bp, Artificial Sequence
  chemically synthesized
tggtcataaattctttgcct

SEQ ID NO: 268810 - DNA, 20 bp, Artificial Sequence
  chemically synthesized
tctggacactggcttaggca

SEQ ID NO: 268811 - DNA, 20 bp, Artificial Sequence
  chemically synthesized
cataaattctttgcctaagc

SEQ ID NO: 268812 - DNA, 20 bp, Artificial Sequence
  chemically synthesized
gttcttctggacactggctt

SEQ ID NO: 268813 - DNA, 20 bp, Artificial Sequence
  chemically synthesized
agttcttctggacactggct

SEQ ID NO: 268814 - DNA, 20 bp, Artificial Sequence
  chemically synthesized
tctttgcctaagccagtgtc

SEQ ID NO: 268815 - DNA, 20 bp, Artificial Sequence
  chemically synthesized
ggaaaagttcttctggacac

SEQ ID NO: 268816 - DNA, 20 bp, Artificial Sequence
  chemically synthesized
ttgcctaagccagtgtccag

SEQ ID NO: 268817 - DNA, 20 bp, Artificial Sequence
  chemically synthesized
aaacctaggaaaagttcttc

SEQ ID NO: 268818 - DNA, 20 bp, Artificial Sequence
  chemically synthesized
gtgtccagaagaacttttcc

SEQ ID NO: 268819 - DNA, 20 bp, Artificial Sequence
  chemically synthesized
tgtccagaagaacttttcct

SEQ ID NO: 268820 - DNA, 20 bp, Artificial Sequence
  chemically synthesized
cctagaataaaacctaggaa

SEQ ID NO: 268821 - DNA, 20 bp, Artificial Sequence
  chemically synthesized
aaaatcctagaataaaacct

SEQ ID NO: 268822 - DNA, 20 bp, Artificial Sequence
  chemically synthesized
aaaaatcctagaataaaacc

SEQ ID NO: 268823 - DNA, 20 bp, Artificial Sequence
  chemically synthesized
acttttcctaggttttattc

SEQ ID NO: 268824 - DNA, 20 bp, Artificial Sequence
  chemically synthesized
cttttcctaggttttattct

SEQ ID NO: 268825 - DNA, 20 bp, Artificial Sequence
  chemically synthesized
aggttttattctaggatttt

SEQ ID NO: 268826 - DNA, 20 bp, Artificial Sequence
  chemically synthesized
cctgaaactactaaaaatcc

SEQ ID NO: 268827 - DNA, 20 bp, Artificial Sequence
  chemically synthesized
ttttattctaggatttttag

SEQ ID NO: 268828 - DNA, 20 bp, Artificial Sequence
  chemically synthesized
tctaggatttttagtagttt

SEQ ID NO: 268829 - DNA, 20 bp, Artificial Sequence
  chemically synthesized
ctaggatttttagtagtttc

SEQ ID NO: 268830 - DNA, 20 bp, Artificial Sequence
  chemically synthesized
taggatttttagtagtttca

SEQ ID NO: 268831 - DNA, 20 bp, Artificial Sequence
  chemically synthesized
tagtttcagggcttacattt

SEQ ID NO: 268832 - DNA, 20 bp, Artificial Sequence
  chemically synthesized
tggattaaagtcttaaatgt

SEQ ID NO: 268833 - DNA, 20 bp, Artificial Sequence
  chemically synthesized
aattaactcaagatggatta

SEQ ID NO: 268834 - DNA, 20 bp, Artificial Sequence
  chemically synthesized
ttaagactttaatccatctt

SEQ ID NO: 268835 - DNA, 20 bp, Artificial Sequence
  chemically synthesized
atacaaaaattaactcaaga

SEQ ID NO: 268836 - DNA, 20 bp, Artificial Sequence
  chemically synthesized
ccatatacaaaaattaactc

SEQ ID NO: 268837 - DNA, 20 bp, Artificial Sequence
  chemically synthesized
cttgagttaatttttgtata

SEQ ID NO: 268838 - DNA, 20 bp, Artificial Sequence
  chemically synthesized
ttaatttttgtatatggtga

SEQ ID NO: 268839 - DNA, 20 bp, Artificial Sequence
  chemically synthesized
taatttttgtatatggtgaa

SEQ ID NO: 268840 - DNA, 20 bp, Artificial Sequence
  chemically synthesized
tttttgtatatggtgaaagg

SEQ ID NO: 268841 - DNA, 20 bp, Artificial Sequence
  chemically synthesized
ttttgtatatggtgaaaggt

SEQ ID NO: 268842 - DNA, 20 bp, Artificial Sequence
  chemically synthesized
tttgtatatggtgaaaggta

SEQ ID NO: 268843 - DNA, 20 bp, Artificial Sequence
  chemically synthesized
ttgtatatggtgaaaggtag

SEQ ID NO: 268844 - DNA, 20 bp, Artificial Sequence
  chemically synthesized
tatggtgaaaggtaggggtc

SEQ ID NO: 268845 - DNA, 20 bp, Artificial Sequence
  chemically synthesized
atggtgaaaggtaggggtcc

SEQ ID NO: 268846 - DNA, 20 bp, Artificial Sequence
  chemically synthesized
catatatagaggaatgaacc

SEQ ID NO: 268847 - DNA, 20 bp, Artificial Sequence
  chemically synthesized
caggttcattcctctatata

SEQ ID NO: 268848 - DNA, 20 bp, Artificial Sequence
  chemically synthesized
agctggctagccatatatag

SEQ ID NO: 268849 - DNA, 20 bp, Artificial Sequence
  chemically synthesized
tagctggctagccatatata

SEQ ID NO: 268850 - DNA, 20 bp, Artificial Sequence
  chemically synthesized
gatagctggctagccatata

SEQ ID NO: 268851 - DNA, 20 bp, Artificial Sequence
  chemically synthesized
ttcattcctctatatatggc

SEQ ID NO: 268852 - DNA, 20 bp, Artificial Sequence
  chemically synthesized
ttcctctatatatggctagc

SEQ ID NO: 268853 - DNA, 20 bp, Artificial Sequence
  chemically synthesized
atattgctaggatagctggc

SEQ ID NO: 268854 - DNA, 20 bp, Artificial Sequence
  chemically synthesized
atatggctagccagctatcc

SEQ ID NO: 268855 - DNA, 20 bp, Artificial Sequence
  chemically synthesized
ttaaatattgctaggatagc

SEQ ID NO: 268856 - DNA, 20 bp, Artificial Sequence
  chemically synthesized
ttcattaaatattgctagga

SEQ ID NO: 268857 - DNA, 20 bp, Artificial Sequence
  chemically synthesized
cttattcattaaatattgct

SEQ ID NO: 268858 - DNA, 20 bp, Artificial Sequence
  chemically synthesized
ccttattcattaaatattgc

SEQ ID NO: 268859 - DNA, 20 bp, Artificial Sequence
  chemically synthesized
cctagcaatatttaatgaat

SEQ ID NO: 268860 - DNA, 20 bp, Artificial Sequence
  chemically synthesized
ctagcaatatttaatgaata

SEQ ID NO: 268861 - DNA, 20 bp, Artificial Sequence
  chemically synthesized
caaaaataagcaacagagaa

SEQ ID NO: 268862 - DNA, 20 bp, Artificial Sequence
  chemically synthesized
gcaaaaataagcaacagaga

SEQ ID NO: 268863 - DNA, 20 bp, Artificial Sequence
  chemically synthesized
ggcaaaaataagcaacagag

SEQ ID NO: 268864 - DNA, 20 bp, Artificial Sequence
  chemically synthesized
gttggcaaaaataagcaaca

SEQ ID NO: 268865 - DNA, 20 bp, Artificial Sequence
  chemically synthesized
aagttggcaaaaataagcaa

SEQ ID NO: 268866 - DNA, 20 bp, Artificial Sequence
  chemically synthesized
ttgacaaagttggcaaaaat

SEQ ID NO: 268867 - DNA, 20 bp, Artificial Sequence
  chemically synthesized
caactgatttttgacaaagt

SEQ ID NO: 268868 - DNA, 20 bp, Artificial Sequence
  chemically synthesized
caaccaactgatttttgaca

SEQ ID NO: 268869 - DNA, 20 bp, Artificial Sequence
  chemically synthesized
ttgccaactttgtcaaaaat

SEQ ID NO: 268870 - DNA, 20 bp, Artificial Sequence
  chemically synthesized
caactttgtcaaaaatcagt

SEQ ID NO: 268871 - DNA, 20 bp, Artificial Sequence
  chemically synthesized
tgtcaaaaatcagttggttg

SEQ ID NO: 268872 - DNA, 20 bp, Artificial Sequence
  chemically synthesized
gtcaaaaatcagttggttgt

SEQ ID NO: 268873 - DNA, 20 bp, Artificial Sequence
  chemically synthesized
atcagttggttgtaggtgtg

SEQ ID NO: 268874 - DNA, 20 bp, Artificial Sequence
  chemically synthesized
aggtgtgcagctttatttct

SEQ ID NO: 268875 - DNA, 20 bp, Artificial Sequence
  chemically synthesized
gaatagagaactcagaaata

SEQ ID NO: 268876 - DNA, 20 bp, Artificial Sequence
  chemically synthesized
atggaacagaatagagaact

SEQ ID NO: 268877 - DNA, 20 bp, Artificial Sequence
  chemically synthesized
tagatcaatggaacagaata

SEQ ID NO: 268878 - DNA, 20 bp, Artificial Sequence
  chemically synthesized
cctagatcaatggaacagaa

SEQ ID NO: 268879 - DNA, 20 bp, Artificial Sequence
  chemically synthesized
agacacctagatcaatggaa

SEQ ID NO: 268880 - DNA, 20 bp, Artificial Sequence
  chemically synthesized
tctattctgttccattgatc

SEQ ID NO: 268881 - DNA, 20 bp, Artificial Sequence
  chemically synthesized
ctattctgttccattgatct

SEQ ID NO: 268882 - DNA, 20 bp, Artificial Sequence
  chemically synthesized
gatatagacacctagatcaa

SEQ ID NO: 268883 - DNA, 20 bp, Artificial Sequence
  chemically synthesized
ctattacagatatagacacc

SEQ ID NO: 268884 - DNA, 20 bp, Artificial Sequence
  chemically synthesized
gcataatactattacagata

SEQ ID NO: 268885 - DNA, 20 bp, Artificial Sequence
  chemically synthesized
ctaggtgtctatatctgtaa

SEQ ID NO: 268886 - DNA, 20 bp, Artificial Sequence
  chemically synthesized
caaacagcataatactatta

SEQ ID NO: 268887 - DNA, 20 bp, Artificial Sequence
  chemically synthesized
caaagctgtagtaacgcaaa

SEQ ID NO: 268888 - DNA, 20 bp, Artificial Sequence
  chemically synthesized
ttatgctgtttgcgttacta

SEQ ID NO: 268889 - DNA, 20 bp, Artificial Sequence
  chemically synthesized
taaaatatactacaaagctg

SEQ ID NO: 268890 - DNA, 20 bp, Artificial Sequence
  chemically synthesized
tttgcgttactacagctttg

SEQ ID NO: 268891 - DNA, 20 bp, Artificial Sequence
  chemically synthesized
cccacttaaaatatactaca

SEQ ID NO: 268892 - DNA, 20 bp, Artificial Sequence
  chemically synthesized
acagctttgtagtatatttt

SEQ ID NO: 268893 - DNA, 20 bp, Artificial Sequence
  chemically synthesized
gctttgtagtatattttaag

SEQ ID NO: 268894 - DNA, 20 bp, Artificial Sequence
  chemically synthesized
ctttgtagtatattttaagt

SEQ ID NO: 268895 - DNA, 20 bp, Artificial Sequence
  chemically synthesized
tttgtagtatattttaagtg

SEQ ID NO: 268896 - DNA, 20 bp, Artificial Sequence
  chemically synthesized
agccaaaagaacaaagttga

SEQ ID NO: 268897 - DNA, 20 bp, Artificial Sequence
  chemically synthesized
aagccaaaagaacaaagttg

SEQ ID NO: 268898 - DNA, 20 bp, Artificial Sequence
  chemically synthesized
taagccaaaagaacaaagtt

SEQ ID NO: 268899 - DNA, 20 bp, Artificial Sequence
  chemically synthesized
aatcctaagccaaaagaaca

SEQ ID NO: 268900 - DNA, 20 bp, Artificial Sequence
  chemically synthesized
tgccctcaactttgttcttt

SEQ ID NO: 268901 - DNA, 20 bp, Artificial Sequence
  chemically synthesized
tcaactttgttcttttggct

SEQ ID NO: 268902 - DNA, 20 bp, Artificial Sequence
  chemically synthesized
caactttgttcttttggctt

SEQ ID NO: 268903 - DNA, 20 bp, Artificial Sequence
  chemically synthesized
ctaaagcaatcctaagccaa

SEQ ID NO: 268904 - DNA, 20 bp, Artificial Sequence
  chemically synthesized
tgaacagctaaagcaatcct

SEQ ID NO: 268905 - DNA, 20 bp, Artificial Sequence
  chemically synthesized
cttttggcttaggattgctt

SEQ ID NO: 268906 - DNA, 20 bp, Artificial Sequence
  chemically synthesized
agaaagggcctgaacagcta

SEQ ID NO: 268907 - DNA, 20 bp, Artificial Sequence
  chemically synthesized
ttaggattgctttagctgtt

SEQ ID NO: 268908 - DNA, 20 bp, Artificial Sequence
  chemically synthesized
taggattgctttagctgttc

SEQ ID NO: 268909 - DNA, 20 bp, Artificial Sequence
  chemically synthesized
gaaccaagaaagggcctgaa

SEQ ID NO: 268910 - DNA, 20 bp, Artificial Sequence
  chemically synthesized
tagctgttcaggccctttct

SEQ ID NO: 268911 - DNA, 20 bp, Artificial Sequence
  chemically synthesized
attcatatggaaccaagaaa

SEQ ID NO: 268912 - DNA, 20 bp, Artificial Sequence
  chemically synthesized
aattcatatggaaccaagaa

SEQ ID NO: 268913 - DNA, 20 bp, Artificial Sequence
  chemically synthesized
aaattcatatggaaccaaga

SEQ ID NO: 268914 - DNA, 20 bp, Artificial Sequence
  chemically synthesized
tctaaaattcatatggaacc

SEQ ID NO: 268915 - DNA, 20 bp, Artificial Sequence
  chemically synthesized
taacaattctaaaattcata

SEQ ID NO: 268916 - DNA, 20 bp, Artificial Sequence
  chemically synthesized
tcttggttccatatgaattt

SEQ ID NO: 268917 - DNA, 20 bp, Artificial Sequence
  chemically synthesized
catgtgcaagtttgttacat

SEQ ID NO: 268918 - DNA, 20 bp, Artificial Sequence
  chemically synthesized
acatgtgcaagtttgttaca

SEQ ID NO: 268919 - DNA, 20 bp, Artificial Sequence
  chemically synthesized
gattcaggggttacatgtgc

SEQ ID NO: 268920 - DNA, 20 bp, Artificial Sequence
  chemically synthesized
taaaattactttagattcag

SEQ ID NO: 268921 - DNA, 20 bp, Artificial Sequence
  chemically synthesized
ttaaaattactttagattca

SEQ ID NO: 268922 - DNA, 20 bp, Artificial Sequence
  chemically synthesized
acatgtaacccctgaatcta

SEQ ID NO: 268923 - DNA, 20 bp, Artificial Sequence
  chemically synthesized
tttaaaattactttagattc

SEQ ID NO: 268924 - DNA, 20 bp, Artificial Sequence
  chemically synthesized
ttttaaaattactttagatt

SEQ ID NO: 268925 - DNA, 20 bp, Artificial Sequence
  chemically synthesized
ctttctttttaaaattactt

SEQ ID NO: 268926 - DNA, 20 bp, Artificial Sequence
  chemically synthesized
gaatctaaagtaattttaaa

SEQ ID NO: 268927 - DNA, 20 bp, Artificial Sequence
  chemically synthesized
ctaaagtaattttaaaaaga

SEQ ID NO: 268928 - DNA, 20 bp, Artificial Sequence
  chemically synthesized
attttaaaaagaaagtaatc

SEQ ID NO: 268929 - DNA, 20 bp, Artificial Sequence
  chemically synthesized
aaaagaaagtaatcgagaaa

SEQ ID NO: 268930 - DNA, 20 bp, Artificial Sequence
  chemically synthesized
aagaaagtaatcgagaaaca

SEQ ID NO: 268931 - DNA, 20 bp, Artificial Sequence
  chemically synthesized
aagtaatcgagaaacagaga

SEQ ID NO: 268932 - DNA, 20 bp, Artificial Sequence
  chemically synthesized
agtaatcgagaaacagagaa

SEQ ID NO: 268933 - DNA, 20 bp, Artificial Sequence
  chemically synthesized
gtaatcgagaaacagagaaa

SEQ ID NO: 268934 - DNA, 20 bp, Artificial Sequence
  chemically synthesized
gagaaacagagaaagggata

SEQ ID NO: 268935 - DNA, 20 bp, Artificial Sequence
  chemically synthesized
gaaacagagaaagggatatg

SEQ ID NO: 268936 - DNA, 20 bp, Artificial Sequence
  chemically synthesized
gggatatggagctttttgca

SEQ ID NO: 268937 - DNA, 20 bp, Artificial Sequence
  chemically synthesized
aaacaagaaaactgtgcaaa

SEQ ID NO: 268938 - DNA, 20 bp, Artificial Sequence
  chemically synthesized
ttatttccctttttgtaaac

SEQ ID NO: 268939 - DNA, 20 bp, Artificial Sequence
  chemically synthesized
acagttttcttgtttacaaa

SEQ ID NO: 268940 - DNA, 20 bp, Artificial Sequence
  chemically synthesized
cagttttcttgtttacaaaa

SEQ ID NO: 268941 - DNA, 20 bp, Artificial Sequence
  chemically synthesized
agttttcttgtttacaaaaa

SEQ ID NO: 268942 - DNA, 20 bp, Artificial Sequence
  chemically synthesized
ttgtttacaaaaagggaaat

SEQ ID NO: 268943 - DNA, 20 bp, Artificial Sequence
  chemically synthesized
aagggaaataagatcatttt

SEQ ID NO: 268944 - DNA, 20 bp, Artificial Sequence
  chemically synthesized
gggaaataagatcattttca

SEQ ID NO: 268945 - DNA, 20 bp, Artificial Sequence
  chemically synthesized
ggaaataagatcattttcag

SEQ ID NO: 268946 - DNA, 20 bp, Artificial Sequence
  chemically synthesized
gatcattttcagaggacctt

SEQ ID NO: 268947 - DNA, 20 bp, Artificial Sequence
  chemically synthesized
tgaggtaacatcagaactga

SEQ ID NO: 268948 - DNA, 20 bp, Artificial Sequence
  chemically synthesized
gtgaggtaacatcagaactg

SEQ ID NO: 268949 - DNA, 20 bp, Artificial Sequence
  chemically synthesized
gtcactgggtgaggtaacat

SEQ ID NO: 268950 - DNA, 20 bp, Artificial Sequence
  chemically synthesized
agttctgatgttacctcacc

SEQ ID NO: 268951 - DNA, 20 bp, Artificial Sequence
  chemically synthesized
gatctgtaagtcactgggtg

SEQ ID NO: 268952 - DNA, 20 bp, Artificial Sequence
  chemically synthesized
agatctgtaagtcactgggt

SEQ ID NO: 268953 - DNA, 20 bp, Artificial Sequence
  chemically synthesized
ggacagatctgtaagtcact

SEQ ID NO: 268954 - DNA, 20 bp, Artificial Sequence
  chemically synthesized
aggacagatctgtaagtcac

SEQ ID NO: 268955 - DNA, 20 bp, Artificial Sequence
  chemically synthesized
ttacctcacccagtgactta

SEQ ID NO: 268956 - DNA, 20 bp, Artificial Sequence
  chemically synthesized
attagagaggacagatctgt

SEQ ID NO: 268957 - DNA, 20 bp, Artificial Sequence
  chemically synthesized
agaatcgttattagagagga

SEQ ID NO: 268958 - DNA, 20 bp, Artificial Sequence
  chemically synthesized
agagagaatcgttattagag

SEQ ID NO: 268959 - DNA, 20 bp, Artificial Sequence
  chemically synthesized
cagagagaatcgttattaga

SEQ ID NO: 268960 - DNA, 20 bp, Artificial Sequence
  chemically synthesized
ttcagagagaatcgttatta

SEQ ID NO: 268961 - DNA, 20 bp, Artificial Sequence
  chemically synthesized
tattcagagagaatcgttat

SEQ ID NO: 268962 - DNA, 20 bp, Artificial Sequence
  chemically synthesized
taataacgattctctctgaa

SEQ ID NO: 268963 - DNA, 20 bp, Artificial Sequence
  chemically synthesized
taagaacacttctattcaga

SEQ ID NO: 268964 - DNA, 20 bp, Artificial Sequence
  chemically synthesized
taacgattctctctgaatag

SEQ ID NO: 268965 - DNA, 20 bp, Artificial Sequence
  chemically synthesized
cttaagaacacttctattca

SEQ ID NO: 268966 - DNA, 20 bp, Artificial Sequence
  chemically synthesized
tccttaagaacacttctatt

SEQ ID NO: 268967 - DNA, 20 bp, Artificial Sequence
  chemically synthesized
ctctgaatagaagtgttctt

SEQ ID NO: 268968 - DNA, 20 bp, Artificial Sequence
  chemically synthesized
tctgaatagaagtgttctta

SEQ ID NO: 268969 - DNA, 20 bp, Artificial Sequence
  chemically synthesized
aatagaagtgttcttaagga

SEQ ID NO: 268970 - DNA, 20 bp, Artificial Sequence
  chemically synthesized
agcagtgctgttctatcctt

SEQ ID NO: 268971 - DNA, 20 bp, Artificial Sequence
  chemically synthesized
aagtgttcttaaggatagaa

SEQ ID NO: 268972 - DNA, 20 bp, Artificial Sequence
  chemically synthesized
atggtcagtttgtgtggcag

SEQ ID NO: 268973 - DNA, 20 bp, Artificial Sequence
  chemically synthesized
tgtatggtcagtttgtgtgg

SEQ ID NO: 268974 - DNA, 20 bp, Artificial Sequence
  chemically synthesized
ctgtgtatggtcagtttgtg

SEQ ID NO: 268975 - DNA, 20 bp, Artificial Sequence
  chemically synthesized
aaagttagcctgtgtatggt

SEQ ID NO: 268976 - DNA, 20 bp, Artificial Sequence
  chemically synthesized
ccacacaaactgaccataca

SEQ ID NO: 268977 - DNA, 20 bp, Artificial Sequence
  chemically synthesized
cacacaaactgaccatacac

SEQ ID NO: 268978 - DNA, 20 bp, Artificial Sequence
  chemically synthesized
accaaaagttagcctgtgta

SEQ ID NO: 268979 - DNA, 20 bp, Artificial Sequence
  chemically synthesized
accatacacaggctaacttt

SEQ ID NO: 268980 - DNA, 20 bp, Artificial Sequence
  chemically synthesized
atcaaagtggaaccaaaagt

SEQ ID NO: 268981 - DNA, 20 bp, Artificial Sequence
  chemically synthesized
tttcatcaaagtggaaccaa

SEQ ID NO: 268982 - DNA, 20 bp, Artificial Sequence
  chemically synthesized
actgagaattttcatcaaag

SEQ ID NO: 268983 - DNA, 20 bp, Artificial Sequence
  chemically synthesized
agaactgagaattttcatca

SEQ ID NO: 268984 - DNA, 20 bp, Artificial Sequence
  chemically synthesized
tccactttgatgaaaattct

SEQ ID NO: 268985 - DNA, 20 bp, Artificial Sequence
  chemically synthesized
tgatgaaaattctcagttct

SEQ ID NO: 268986 - DNA, 20 bp, Artificial Sequence
  chemically synthesized
aatagcgcaaaccgagaact

SEQ ID NO: 268987 - DNA, 20 bp, Artificial Sequence
  chemically synthesized
gggaatgaatagcgcaaacc

SEQ ID NO: 268988 - DNA, 20 bp, Artificial Sequence
  chemically synthesized
agcagagtcaagggaatgaa

SEQ ID NO: 268989 - DNA, 20 bp, Artificial Sequence
  chemically synthesized
ccttgtgaaagcagagtcaa

SEQ ID NO: 268990 - DNA, 20 bp, Artificial Sequence
  chemically synthesized
tccttgtgaaagcagagtca

SEQ ID NO: 268991 - DNA, 20 bp, Artificial Sequence
  chemically synthesized
ttccttgtgaaagcagagtc

SEQ ID NO: 268992 - DNA, 20 bp, Artificial Sequence
  chemically synthesized
atgatttccttgtgaaagca

SEQ ID NO: 268993 - DNA, 20 bp, Artificial Sequence
  chemically synthesized
tcccttgactctgctttcac

SEQ ID NO: 268994 - DNA, 20 bp, Artificial Sequence
  chemically synthesized
caatgatttccttgtgaaag

SEQ ID NO: 268995 - DNA, 20 bp, Artificial Sequence
  chemically synthesized
cccttgactctgctttcaca

SEQ ID NO: 268996 - DNA, 20 bp, Artificial Sequence
  chemically synthesized
tatcaatgatttccttgtga

SEQ ID NO: 268997 - DNA, 20 bp, Artificial Sequence
  chemically synthesized
ttcacaaggaaatcattgat

SEQ ID NO: 268998 - DNA, 20 bp, Artificial Sequence
  chemically synthesized
ctacattgaagcatgatcga

SEQ ID NO: 268999 - DNA, 20 bp, Artificial Sequence
  chemically synthesized
ctgtcgatcatgcttcaatg

SEQ ID NO: 269000 - DNA, 20 bp, Artificial Sequence
  chemically synthesized
tttctttattatctacattg

SEQ ID NO: 269001 - DNA, 20 bp, Artificial Sequence
  chemically synthesized
atgcttcaatgtagataata

SEQ ID NO: 269002 - DNA, 20 bp, Artificial Sequence
  chemically synthesized
gtagataataaagaaaaaaa

SEQ ID NO: 269003 - DNA, 20 bp, Artificial Sequence
  chemically synthesized
aataaagaaaaaaaaagcca

SEQ ID NO: 269004 - DNA, 20 bp, Artificial Sequence
  chemically synthesized
ttttaaagaggatgtttctg

SEQ ID NO: 269005 - DNA, 20 bp, Artificial Sequence
  chemically synthesized
tgtctttccagtttttaaag

SEQ ID NO: 269006 - DNA, 20 bp, Artificial Sequence
  chemically synthesized
ttgtctttccagtttttaaa

SEQ ID NO: 269007 - DNA, 20 bp, Artificial Sequence
  chemically synthesized
gaaacatcctctttaaaaac

SEQ ID NO: 269008 - DNA, 20 bp, Artificial Sequence
  chemically synthesized
cattgtctttccagttttta

SEQ ID NO: 269009 - DNA, 20 bp, Artificial Sequence
  chemically synthesized
catcctctttaaaaactgga

SEQ ID NO: 269010 - DNA, 20 bp, Artificial Sequence
  chemically synthesized
aataaggaacattgtctttc

SEQ ID NO: 269011 - DNA, 20 bp, Artificial Sequence
  chemically synthesized
taattccagcgagatgaata

SEQ ID NO: 269012 - DNA, 20 bp, Artificial Sequence
  chemically synthesized
ttaattccagcgagatgaat

SEQ ID NO: 269013 - DNA, 20 bp, Artificial Sequence
  chemically synthesized
atgttccttattcatctcgc

SEQ ID NO: 269014 - DNA, 20 bp, Artificial Sequence
  chemically synthesized
cctagcagattaattccagc

SEQ ID NO: 269015 - DNA, 20 bp, Artificial Sequence
  chemically synthesized
ggaacctagcagattaattc

SEQ ID NO: 269016 - DNA, 20 bp, Artificial Sequence
  chemically synthesized
tctcgctggaattaatctgc

SEQ ID NO: 269017 - DNA, 20 bp, Artificial Sequence
  chemically synthesized
ctcgctggaattaatctgct

SEQ ID NO: 269018 - DNA, 20 bp, Artificial Sequence
  chemically synthesized
gcaacaggacaggaacctag

SEQ ID NO: 269019 - DNA, 20 bp, Artificial Sequence
  chemically synthesized
tgagcaacaggacaggaacc

SEQ ID NO: 269020 - DNA, 20 bp, Artificial Sequence
  chemically synthesized
tgctgattgagcaacaggac

SEQ ID NO: 269021 - DNA, 20 bp, Artificial Sequence
  chemically synthesized
ctgctgattgagcaacagga

SEQ ID NO: 269022 - DNA, 20 bp, Artificial Sequence
  chemically synthesized
tctcctgctgattgagcaac

SEQ ID NO: 269023 - DNA, 20 bp, Artificial Sequence
  chemically synthesized
ttctcctgctgattgagcaa

SEQ ID NO: 269024 - DNA, 20 bp, Artificial Sequence
  chemically synthesized
ttcctgtcctgttgctcaat

SEQ ID NO: 269025 - DNA, 20 bp, Artificial Sequence
  chemically synthesized
ctgtcctgttgctcaatcag

SEQ ID NO: 269026 - DNA, 20 bp, Artificial Sequence
  chemically synthesized
tgtcctgttgctcaatcagc

SEQ ID NO: 269027 - DNA, 20 bp, Artificial Sequence
  chemically synthesized
caaagattctcctgctgatt

SEQ ID NO: 269028 - DNA, 20 bp, Artificial Sequence
  chemically synthesized
tcctgttgctcaatcagcag

SEQ ID NO: 269029 - DNA, 20 bp, Artificial Sequence
  chemically synthesized
tcaatcagcaggagaatctt

SEQ ID NO: 269030 - DNA, 20 bp, Artificial Sequence
  chemically synthesized
gtttgcctaagcattggcca

SEQ ID NO: 269031 - DNA, 20 bp, Artificial Sequence
  chemically synthesized
gagaatctttggccaatgct

SEQ ID NO: 269032 - DNA, 20 bp, Artificial Sequence
  chemically synthesized
agaatctttggccaatgctt

SEQ ID NO: 269033 - DNA, 20 bp, Artificial Sequence
  chemically synthesized
cattcggtttgcctaagcat

SEQ ID NO: 269034 - DNA, 20 bp, Artificial Sequence
  chemically synthesized
actgttcattcggtttgcct

SEQ ID NO: 269035 - DNA, 20 bp, Artificial Sequence
  chemically synthesized
gcttaggcaaaccgaatgaa

SEQ ID NO: 269036 - DNA, 20 bp, Artificial Sequence
  chemically synthesized
gagcatggccactgttcatt

SEQ ID NO: 269037 - DNA, 20 bp, Artificial Sequence
  chemically synthesized
taggcaaaccgaatgaacag

SEQ ID NO: 269038 - DNA, 20 bp, Artificial Sequence
  chemically synthesized
ttattggtttcaaaagagca

SEQ ID NO: 269039 - DNA, 20 bp, Artificial Sequence
  chemically synthesized
gagtattattggtttcaaaa

SEQ ID NO: 269040 - DNA, 20 bp, Artificial Sequence
  chemically synthesized
gtgagtattattggtttcaa

SEQ ID NO: 269041 - DNA, 20 bp, Artificial Sequence
  chemically synthesized
acccacttcgtgagtattat

SEQ ID NO: 269042 - DNA, 20 bp, Artificial Sequence
  chemically synthesized
tgaaaccaataatactcacg

SEQ ID NO: 269043 - DNA, 20 bp, Artificial Sequence
  chemically synthesized
aaccaataatactcacgaag

SEQ ID NO: 269044 - DNA, 20 bp, Artificial Sequence
  chemically synthesized
accaataatactcacgaagt

SEQ ID NO: 269045 - DNA, 20 bp, Artificial Sequence
  chemically synthesized
ttaaggaacacccacttcgt

SEQ ID NO: 269046 - DNA, 20 bp, Artificial Sequence
  chemically synthesized
aagataacgcttagtaatta

SEQ ID NO: 269047 - DNA, 20 bp, Artificial Sequence
  chemically synthesized
gtgggtgttccttaattact

SEQ ID NO: 269048 - DNA, 20 bp, Artificial Sequence
  chemically synthesized
taagataacgcttagtaatt

SEQ ID NO: 269049 - DNA, 20 bp, Artificial Sequence
  chemically synthesized
aggttctgtaagataacgct

SEQ ID NO: 269050 - DNA, 20 bp, Artificial Sequence
  chemically synthesized
aattactaagcgttatctta

SEQ ID NO: 269051 - DNA, 20 bp, Artificial Sequence
  chemically synthesized
ctccactagccaggttctgt

SEQ ID NO: 269052 - DNA, 20 bp, Artificial Sequence
  chemically synthesized
aagcgttatcttacagaacc

SEQ ID NO: 269053 - DNA, 20 bp, Artificial Sequence
  chemically synthesized
gttatcttacagaacctggc

SEQ ID NO: 269054 - DNA, 20 bp, Artificial Sequence
  chemically synthesized
atcttacagaacctggctag

SEQ ID NO: 269055 - DNA, 20 bp, Artificial Sequence
  chemically synthesized
ttttggaaactccactagcc

SEQ ID NO: 269056 - DNA, 20 bp, Artificial Sequence
  chemically synthesized
cttacagaacctggctagtg

SEQ ID NO: 269057 - DNA, 20 bp, Artificial Sequence
  chemically synthesized
cttttggaaactccactagc

SEQ ID NO: 269058 - DNA, 20 bp, Artificial Sequence
  chemically synthesized
tttccttttggaaactccac

SEQ ID NO: 269059 - DNA, 20 bp, Artificial Sequence
  chemically synthesized
ctggctagtggagtttccaa

SEQ ID NO: 269060 - DNA, 20 bp, Artificial Sequence
  chemically synthesized
tggctagtggagtttccaaa

SEQ ID NO: 269061 - DNA, 20 bp, Artificial Sequence
  chemically synthesized
atgcttgggatttttccttt

SEQ ID NO: 269062 - DNA, 20 bp, Artificial Sequence
  chemically synthesized
tttccaaaaggaaaaatccc

SEQ ID NO: 269063 - DNA, 20 bp, Artificial Sequence
  chemically synthesized
acatacaaaagcaaatgctt

SEQ ID NO: 269064 - DNA, 20 bp, Artificial Sequence
  chemically synthesized
aacatacaaaagcaaatgct

SEQ ID NO: 269065 - DNA, 20 bp, Artificial Sequence
  chemically synthesized
gaacataagaaaacatacaa

SEQ ID NO: 269066 - DNA, 20 bp, Artificial Sequence
  chemically synthesized
aaaatcacatataagaacat

SEQ ID NO: 269067 - DNA, 20 bp, Artificial Sequence
  chemically synthesized
gtgtgtctaaaatcacatat

SEQ ID NO: 269068 - DNA, 20 bp, Artificial Sequence
  chemically synthesized
tatgttcttatatgtgattt

SEQ ID NO: 269069 - DNA, 20 bp, Artificial Sequence
  chemically synthesized
tatatgtgattttagacaca

SEQ ID NO: 269070 - DNA, 20 bp, Artificial Sequence
  chemically synthesized
tgtgattttagacacacaga

SEQ ID NO: 269071 - DNA, 20 bp, Artificial Sequence
  chemically synthesized
acagaagtaatgattacatt

SEQ ID NO: 269072 - DNA, 20 bp, Artificial Sequence
  chemically synthesized
aagatgagttatgcatacag

SEQ ID NO: 269073 - DNA, 20 bp, Artificial Sequence
  chemically synthesized
cttaagatgagttatgcata

SEQ ID NO: 269074 - DNA, 20 bp, Artificial Sequence
  chemically synthesized
ctgtatgcataactcatctt

SEQ ID NO: 269075 - DNA, 20 bp, Artificial Sequence
  chemically synthesized
tgtatgcataactcatctta

SEQ ID NO: 269076 - DNA, 20 bp, Artificial Sequence
  chemically synthesized
aatatttcattccttaagat

SEQ ID NO: 269077 - DNA, 20 bp, Artificial Sequence
  chemically synthesized
cttgtaatatttcattcctt

SEQ ID NO: 269078 - DNA, 20 bp, Artificial Sequence
  chemically synthesized
cttaaggaatgaaatattac

SEQ ID NO: 269079 - DNA, 20 bp, Artificial Sequence
  chemically synthesized
aaatattacaagtatcattt

SEQ ID NO: 269080 - DNA, 20 bp, Artificial Sequence
  chemically synthesized
gaattgggtgggatatgaac

SEQ ID NO: 269081 - DNA, 20 bp, Artificial Sequence
  chemically synthesized
agaattgggtgggatatgaa

SEQ ID NO: 269082 - DNA, 20 bp, Artificial Sequence
  chemically synthesized
gaaagacaaaagaattgggt

SEQ ID NO: 269083 - DNA, 20 bp, Artificial Sequence
  chemically synthesized
ggaaagacaaaagaattggg

SEQ ID NO: 269084 - DNA, 20 bp, Artificial Sequence
  chemically synthesized
tgaggaaagacaaaagaatt

SEQ ID NO: 269085 - DNA, 20 bp, Artificial Sequence
  chemically synthesized
gtgaggaaagacaaaagaat

SEQ ID NO: 269086 - DNA, 20 bp, Artificial Sequence
  chemically synthesized
atctctgtgaggaaagacaa

SEQ ID NO: 269087 - DNA, 20 bp, Artificial Sequence
  chemically synthesized
aattcttttgtctttcctca

SEQ ID NO: 269088 - DNA, 20 bp, Artificial Sequence
  chemically synthesized
aagagctatctctgtgagga

SEQ ID NO: 269089 - DNA, 20 bp, Artificial Sequence
  chemically synthesized
ttcttttgtctttcctcaca

SEQ ID NO: 269090 - DNA, 20 bp, Artificial Sequence
  chemically synthesized
gaacaagagctatctctgtg

SEQ ID NO: 269091 - DNA, 20 bp, Artificial Sequence
  chemically synthesized
tttgtctttcctcacagaga

SEQ ID NO: 269092 - DNA, 20 bp, Artificial Sequence
  chemically synthesized
agaacaagagctatctctgt

SEQ ID NO: 269093 - DNA, 20 bp, Artificial Sequence
  chemically synthesized
ataaactgaatacagaacaa

SEQ ID NO: 269094 - DNA, 20 bp, Artificial Sequence
  chemically synthesized
atataaactgaatacagaac

SEQ ID NO: 269095 - DNA, 20 bp, Artificial Sequence
  chemically synthesized
gatagctcttgttctgtatt

SEQ ID NO: 269096 - DNA, 20 bp, Artificial Sequence
  chemically synthesized
gaattaatataaactgaata

SEQ ID NO: 269097 - DNA, 20 bp, Artificial Sequence
  chemically synthesized
gtaaaagcagaaagatgttt

SEQ ID NO: 269098 - DNA, 20 bp, Artificial Sequence
  chemically synthesized
agtaaaagcagaaagatgtt

SEQ ID NO: 269099 - DNA, 20 bp, Artificial Sequence
  chemically synthesized
taatatatagtaaaagcaga

SEQ ID NO: 269100 - DNA, 20 bp, Artificial Sequence
  chemically synthesized
tatataatatatagtaaaag

SEQ ID NO: 269101 - DNA, 20 bp, Artificial Sequence
  chemically synthesized
ttatatataatatatagtaa

SEQ ID NO: 269102 - DNA, 20 bp, Artificial Sequence
  chemically synthesized
atttagttatatataatata

SEQ ID NO: 269103 - DNA, 20 bp, Artificial Sequence
  chemically synthesized
atgtagaaatatacattatt

SEQ ID NO: 269104 - DNA, 20 bp, Artificial Sequence
  chemically synthesized
tacacaaaggataaaatatg

SEQ ID NO: 269105 - DNA, 20 bp, Artificial Sequence
  chemically synthesized
gtgtgttaccatttacacaa

SEQ ID NO: 269106 - DNA, 20 bp, Artificial Sequence
  chemically synthesized
agtgtgttaccatttacaca

SEQ ID NO: 269107 - DNA, 20 bp, Artificial Sequence
  chemically synthesized
tattttatcctttgtgtaaa

SEQ ID NO: 269108 - DNA, 20 bp, Artificial Sequence
  chemically synthesized
tggaaacaccttaaatgttg

SEQ ID NO: 269109 - DNA, 20 bp, Artificial Sequence
  chemically synthesized
ggtaacacactgcaacattt

SEQ ID NO: 269110 - DNA, 20 bp, Artificial Sequence
  chemically synthesized
gtaacacactgcaacattta

SEQ ID NO: 269111 - DNA, 20 bp, Artificial Sequence
  chemically synthesized
cttgagaaatatagtaaaat

SEQ ID NO: 269112 - DNA, 20 bp, Artificial Sequence
  chemically synthesized
atcaagcttcttgagaaata

SEQ ID NO: 269113 - DNA, 20 bp, Artificial Sequence
  chemically synthesized
ccaattttactatatttctc

SEQ ID NO: 269114 - DNA, 20 bp, Artificial Sequence
  chemically synthesized
attttactatatttctcaag

SEQ ID NO: 269115 - DNA, 20 bp, Artificial Sequence
  chemically synthesized
ttataaaaatcaagcttctt

SEQ ID NO: 269116 - DNA, 20 bp, Artificial Sequence
  chemically synthesized
aaagagatgttataaaaatc

SEQ ID NO: 269117 - DNA, 20 bp, Artificial Sequence
  chemically synthesized
ggttgcctaaaacgatgaaa

SEQ ID NO: 269118 - DNA, 20 bp, Artificial Sequence
  chemically synthesized
aaggttgcctaaaacgatga

SEQ ID NO: 269119 - DNA, 20 bp, Artificial Sequence
  chemically synthesized
taacatctctttcatcgttt

SEQ ID NO: 269120 - DNA, 20 bp, Artificial Sequence
  chemically synthesized
aacatctctttcatcgtttt

SEQ ID NO: 269121 - DNA, 20 bp, Artificial Sequence
  chemically synthesized
ccctttaaaaaggaagggga

SEQ ID NO: 269122 - DNA, 20 bp, Artificial Sequence
  chemically synthesized
gccctttaaaaaggaagggg

SEQ ID NO: 269123 - DNA, 20 bp, Artificial Sequence
  chemically synthesized
tgtgccctttaaaaaggaag

SEQ ID NO: 269124 - DNA, 20 bp, Artificial Sequence
  chemically synthesized
ctgtgccctttaaaaaggaa

SEQ ID NO: 269125 - DNA, 20 bp, Artificial Sequence
  chemically synthesized
gctgtgccctttaaaaagga

SEQ ID NO: 269126 - DNA, 20 bp, Artificial Sequence
  chemically synthesized
tgctgtgccctttaaaaagg

SEQ ID NO: 269127 - DNA, 20 bp, Artificial Sequence
  chemically synthesized
aaccttccccttccttttta

SEQ ID NO: 269128 - DNA, 20 bp, Artificial Sequence
  chemically synthesized
accttccccttcctttttaa

SEQ ID NO: 269129 - DNA, 20 bp, Artificial Sequence
  chemically synthesized
ccttccccttcctttttaaa

SEQ ID NO: 269130 - DNA, 20 bp, Artificial Sequence
  chemically synthesized
taatgctgtgccctttaaaa

SEQ ID NO: 269131 - DNA, 20 bp, Artificial Sequence
  chemically synthesized
ctaatgctgtgccctttaaa

SEQ ID NO: 269132 - DNA, 20 bp, Artificial Sequence
  chemically synthesized
cccttcctttttaaagggca

SEQ ID NO: 269133 - DNA, 20 bp, Artificial Sequence
  chemically synthesized
ctttttaaagggcacagcat

SEQ ID NO: 269134 - DNA, 20 bp, Artificial Sequence
  chemically synthesized
gcacagcattagaaaacaaa

SEQ ID NO: 269135 - DNA, 20 bp, Artificial Sequence
  chemically synthesized
caaatggtgaattgccccct

SEQ ID NO: 269136 - DNA, 20 bp, Artificial Sequence
  chemically synthesized
aaacttggcataggcttagg

SEQ ID NO: 269137 - DNA, 20 bp, Artificial Sequence
  chemically synthesized
taaacttggcataggcttag

SEQ ID NO: 269138 - DNA, 20 bp, Artificial Sequence
  chemically synthesized
ataaacttggcataggctta

SEQ ID NO: 269139 - DNA, 20 bp, Artificial Sequence
  chemically synthesized
tataaacttggcataggctt

SEQ ID NO: 269140 - DNA, 20 bp, Artificial Sequence
  chemically synthesized
ttataaacttggcataggct

SEQ ID NO: 269141 - DNA, 20 bp, Artificial Sequence
  chemically synthesized
ttgccccctaagcctatgcc

SEQ ID NO: 269142 - DNA, 20 bp, Artificial Sequence
  chemically synthesized
gttctttataaacttggcat

SEQ ID NO: 269143 - DNA, 20 bp, Artificial Sequence
  chemically synthesized
tgttctttataaacttggca

SEQ ID NO: 269144 - DNA, 20 bp, Artificial Sequence
  chemically synthesized
agttatgttctttataaact

SEQ ID NO: 269145 - DNA, 20 bp, Artificial Sequence
  chemically synthesized
aagcctatgccaagtttata

SEQ ID NO: 269146 - DNA, 20 bp, Artificial Sequence
  chemically synthesized
aaagaacataactgatcttt

SEQ ID NO: 269147 - DNA, 20 bp, Artificial Sequence
  chemically synthesized
tcttacactggccaaaagat

SEQ ID NO: 269148 - DNA, 20 bp, Artificial Sequence
  chemically synthesized
aacataactgatcttttggc

SEQ ID NO: 269149 - DNA, 20 bp, Artificial Sequence
  chemically synthesized
gagtttcttacactggccaa

SEQ ID NO: 269150 - DNA, 20 bp, Artificial Sequence
  chemically synthesized
actgatcttttggccagtgt

SEQ ID NO: 269151 - DNA, 20 bp, Artificial Sequence
  chemically synthesized
gccagaagagtttcttacac

SEQ ID NO: 269152 - DNA, 20 bp, Artificial Sequence
  chemically synthesized
gccagtgtaagaaactcttc

SEQ ID NO: 269153 - DNA, 20 bp, Artificial Sequence
  chemically synthesized
gtgtaagaaactcttctggc

SEQ ID NO: 269154 - DNA, 20 bp, Artificial Sequence
  chemically synthesized
gtcaccacacccggccagaa

SEQ ID NO: 269155 - DNA, 20 bp, Artificial Sequence
  chemically synthesized
tgtaagaaactcttctggcc

SEQ ID NO: 269156 - DNA, 20 bp, Artificial Sequence
  chemically synthesized
gagtcaccacacccggccag

SEQ ID NO: 269157 - DNA, 20 bp, Artificial Sequence
  chemically synthesized
tgtgagtcaccacacccggc

SEQ ID NO: 269158 - DNA, 20 bp, Artificial Sequence
  chemically synthesized
gaaactcttctggccgggtg

SEQ ID NO: 269159 - DNA, 20 bp, Artificial Sequence
  chemically synthesized
caggtgtgagtcaccacacc

SEQ ID NO: 269160 - DNA, 20 bp, Artificial Sequence
  chemically synthesized
agtgctgggattacaggtgt

SEQ ID NO: 269161 - DNA, 20 bp, Artificial Sequence
  chemically synthesized
gtgactcacacctgtaatcc

SEQ ID NO: 269162 - DNA, 20 bp, Artificial Sequence
  chemically synthesized
tcccaaagtgctgggattac

SEQ ID NO: 269163 - DNA, 20 bp, Artificial Sequence
  chemically synthesized
ctcccaaagtgctgggatta

SEQ ID NO: 269164 - DNA, 20 bp, Artificial Sequence
  chemically synthesized
cacctgtaatcccagcactt

SEQ ID NO: 269165 - DNA, 20 bp, Artificial Sequence
  chemically synthesized
cctcggcctcccaaagtgct

SEQ ID NO: 269166 - DNA, 20 bp, Artificial Sequence
  chemically synthesized
acctgtaatcccagcacttt

SEQ ID NO: 269167 - DNA, 20 bp, Artificial Sequence
  chemically synthesized
gcctcggcctcccaaagtgc

SEQ ID NO: 269168 - DNA, 20 bp, Artificial Sequence
  chemically synthesized
ctgtaatcccagcactttgg

SEQ ID NO: 269169 - DNA, 20 bp, Artificial Sequence
  chemically synthesized
tgtaatcccagcactttggg

SEQ ID NO: 269170 - DNA, 20 bp, Artificial Sequence
  chemically synthesized
ccacctgcctcggcctccca

SEQ ID NO: 269171 - DNA, 20 bp, Artificial Sequence
  chemically synthesized
tcccagcactttgggaggcc

SEQ ID NO: 269172 - DNA, 20 bp, Artificial Sequence
  chemically synthesized
cccagcactttgggaggccg

SEQ ID NO: 269173 - DNA, 20 bp, Artificial Sequence
  chemically synthesized
agcactttgggaggccgagg

SEQ ID NO: 269174 - DNA, 20 bp, Artificial Sequence
  chemically synthesized
gcactttgggaggccgaggc

SEQ ID NO: 269175 - DNA, 20 bp, Artificial Sequence
  chemically synthesized
ctttgggaggccgaggcagg

SEQ ID NO: 269176 - DNA, 20 bp, Artificial Sequence
  chemically synthesized
ctcaggtcatccacctgcct

SEQ ID NO: 269177 - DNA, 20 bp, Artificial Sequence
  chemically synthesized
ccgaggcaggtggatgacct

SEQ ID NO: 269178 - DNA, 20 bp, Artificial Sequence
  chemically synthesized
cgaggcaggtggatgacctg

SEQ ID NO: 269179 - DNA, 20 bp, Artificial Sequence
  chemically synthesized
gcaggtggatgacctgaggt

SEQ ID NO: 269180 - DNA, 20 bp, Artificial Sequence
  chemically synthesized
caggtggatgacctgaggtc

SEQ ID NO: 269181 - DNA, 20 bp, Artificial Sequence
  chemically synthesized
ggtctcgaactcctgacctc

SEQ ID NO: 269182 - DNA, 20 bp, Artificial Sequence
  chemically synthesized
ggtggatgacctgaggtcag

SEQ ID NO: 269183 - DNA, 20 bp, Artificial Sequence
  chemically synthesized
tggtctcgaactcctgacct

SEQ ID NO: 269184 - DNA, 20 bp, Artificial Sequence
  chemically synthesized
tgacctgaggtcaggagttc

SEQ ID NO: 269185 - DNA, 20 bp, Artificial Sequence
  chemically synthesized
tgaggtcaggagttcgagac

SEQ ID NO: 269186 - DNA, 20 bp, Artificial Sequence
  chemically synthesized
tttcaccatgatggtcaggc

SEQ ID NO: 269187 - DNA, 20 bp, Artificial Sequence
  chemically synthesized
ggagtttcaccatgatggtc

SEQ ID NO: 269188 - DNA, 20 bp, Artificial Sequence
  chemically synthesized
cgagaccagcctgaccatca

SEQ ID NO: 269189 - DNA, 20 bp, Artificial Sequence
  chemically synthesized
tggagtttcaccatgatggt

SEQ ID NO: 269190 - DNA, 20 bp, Artificial Sequence
  chemically synthesized
gagttggagtttcaccatga

SEQ ID NO: 269191 - DNA, 20 bp, Artificial Sequence
  chemically synthesized
ttgtgttttcggtagagttg

SEQ ID NO: 269192 - DNA, 20 bp, Artificial Sequence
  chemically synthesized
ttttgtgttttcggtagagt

SEQ ID NO: 269193 - DNA, 20 bp, Artificial Sequence
  chemically synthesized
aattttttgtgttttcggta

SEQ ID NO: 269194 - DNA, 20 bp, Artificial Sequence
  chemically synthesized
ctaattttttgtgttttcgg

SEQ ID NO: 269195 - DNA, 20 bp, Artificial Sequence
  chemically synthesized
ctgctaattttttgtgtttt

SEQ ID NO: 269196 - DNA, 20 bp, Artificial Sequence
  chemically synthesized
ctaccgaaaacacaaaaaat

SEQ ID NO: 269197 - DNA, 20 bp, Artificial Sequence
  chemically synthesized
ccgaaaacacaaaaaattag

SEQ ID NO: 269198 - DNA, 20 bp, Artificial Sequence
  chemically synthesized
cgaaaacacaaaaaattagc

SEQ ID NO: 269199 - DNA, 20 bp, Artificial Sequence
  chemically synthesized
gaaaacacaaaaaattagca

SEQ ID NO: 269200 - DNA, 20 bp, Artificial Sequence
  chemically synthesized
cacaaaaaattagcagggta

SEQ ID NO: 269201 - DNA, 20 bp, Artificial Sequence
  chemically synthesized
aaaaaattagcagggtatgg

SEQ ID NO: 269202 - DNA, 20 bp, Artificial Sequence
  chemically synthesized
aaattagcagggtatggtgg

SEQ ID NO: 269203 - DNA, 20 bp, Artificial Sequence
  chemically synthesized
aattagcagggtatggtggc

SEQ ID NO: 269204 - DNA, 20 bp, Artificial Sequence
  chemically synthesized
gtggcaggtgtctgtaatcc

SEQ ID NO: 269205 - DNA, 20 bp, Artificial Sequence
  chemically synthesized
ctcccgggtagctgggatta

SEQ ID NO: 269206 - DNA, 20 bp, Artificial Sequence
  chemically synthesized
tgtctgtaatcccagctacc

SEQ ID NO: 269207 - DNA, 20 bp, Artificial Sequence
  chemically synthesized
ccccagcctcccgggtagct

SEQ ID NO: 269208 - DNA, 20 bp, Artificial Sequence
  chemically synthesized
gtctgtaatcccagctaccc

SEQ ID NO: 269209 - DNA, 20 bp, Artificial Sequence
  chemically synthesized
gccccagcctcccgggtagc

SEQ ID NO: 269210 - DNA, 20 bp, Artificial Sequence
  chemically synthesized
ctgtaatcccagctacccgg

SEQ ID NO: 269211 - DNA, 20 bp, Artificial Sequence
  chemically synthesized
tgtaatcccagctacccggg

SEQ ID NO: 269212 - DNA, 20 bp, Artificial Sequence
  chemically synthesized
tcctgccccagcctcccggg

SEQ ID NO: 269213 - DNA, 20 bp, Artificial Sequence
  chemically synthesized
atcccagctacccgggaggc

SEQ ID NO: 269214 - DNA, 20 bp, Artificial Sequence
  chemically synthesized
ttctcctgccccagcctccc

SEQ ID NO: 269215 - DNA, 20 bp, Artificial Sequence
  chemically synthesized
tcccagctacccgggaggct

SEQ ID NO: 269216 - DNA, 20 bp, Artificial Sequence
  chemically synthesized
gttctcctgccccagcctcc

SEQ ID NO: 269217 - DNA, 20 bp, Artificial Sequence
  chemically synthesized
cccagctacccgggaggctg

SEQ ID NO: 269218 - DNA, 20 bp, Artificial Sequence
  chemically synthesized
agctacccgggaggctgggg

SEQ ID NO: 269219 - DNA, 20 bp, Artificial Sequence
  chemically synthesized
gctacccgggaggctggggc

SEQ ID NO: 269220 - DNA, 20 bp, Artificial Sequence
  chemically synthesized
tacccgggaggctggggcag

SEQ ID NO: 269221 - DNA, 20 bp, Artificial Sequence
  chemically synthesized
ttcaagcagttctcctgccc

SEQ ID NO: 269222 - DNA, 20 bp, Artificial Sequence
  chemically synthesized
tgcaacctcctgggttcaag

SEQ ID NO: 269223 - DNA, 20 bp, Artificial Sequence
  chemically synthesized
gcaggagaactgcttgaacc

SEQ ID NO: 269224 - DNA, 20 bp, Artificial Sequence
  chemically synthesized
caggagaactgcttgaaccc

SEQ ID NO: 269225 - DNA, 20 bp, Artificial Sequence
  chemically synthesized
cactgcaacctcctgggttc

SEQ ID NO: 269226 - DNA, 20 bp, Artificial Sequence
  chemically synthesized
ggagaactgcttgaacccag

SEQ ID NO: 269227 - DNA, 20 bp, Artificial Sequence
  chemically synthesized
gagaactgcttgaacccagg

SEQ ID NO: 269228 - DNA, 20 bp, Artificial Sequence
  chemically synthesized
tcggctcactgcaacctcct

SEQ ID NO: 269229 - DNA, 20 bp, Artificial Sequence
  chemically synthesized
ctcggctcactgcaacctcc

SEQ ID NO: 269230 - DNA, 20 bp, Artificial Sequence
  chemically synthesized
tgcttgaacccaggaggttg

SEQ ID NO: 269231 - DNA, 20 bp, Artificial Sequence
  chemically synthesized
tgaacccaggaggttgcagt

SEQ ID NO: 269232 - DNA, 20 bp, Artificial Sequence
  chemically synthesized
ccaggaggttgcagtgagcc

SEQ ID NO: 269233 - DNA, 20 bp, Artificial Sequence
  chemically synthesized
aggttgcagtgagccgagat

SEQ ID NO: 269234 - DNA, 20 bp, Artificial Sequence
  chemically synthesized
ggttgcagtgagccgagatc

SEQ ID NO: 269235 - DNA, 20 bp, Artificial Sequence
  chemically synthesized
ggagtgcaatggcccgatct

SEQ ID NO: 269236 - DNA, 20 bp, Artificial Sequence
  chemically synthesized
tcaccgatcctggagtgcaa

SEQ ID NO: 269237 - DNA, 20 bp, Artificial Sequence
  chemically synthesized
gagatcgggccattgcactc

SEQ ID NO: 269238 - DNA, 20 bp, Artificial Sequence
  chemically synthesized
agatcgggccattgcactcc

SEQ ID NO: 269239 - DNA, 20 bp, Artificial Sequence
  chemically synthesized
gggccattgcactccaggat

SEQ ID NO: 269240 - DNA, 20 bp, Artificial Sequence
  chemically synthesized
tgctcttgtcaccgatcctg

SEQ ID NO: 269241 - DNA, 20 bp, Artificial Sequence
  chemically synthesized
cttgctcttgtcaccgatcc

SEQ ID NO: 269242 - DNA, 20 bp, Artificial Sequence
  chemically synthesized
tgcactccaggatcggtgac

SEQ ID NO: 269243 - DNA, 20 bp, Artificial Sequence
  chemically synthesized
cactccaggatcggtgacaa

SEQ ID NO: 269244 - DNA, 20 bp, Artificial Sequence
  chemically synthesized
ccaggatcggtgacaagagc

SEQ ID NO: 269245 - DNA, 20 bp, Artificial Sequence
  chemically synthesized
tatttatttattttgagatg

SEQ ID NO: 269246 - DNA, 20 bp, Artificial Sequence
  chemically synthesized
cttatttatttattttgaga

SEQ ID NO: 269247 - DNA, 20 bp, Artificial Sequence
  chemically synthesized
tattcttatttatttatttt

SEQ ID NO: 269248 - DNA, 20 bp, Artificial Sequence
  chemically synthesized
ccatctcaaaataaataaat

SEQ ID NO: 269249 - DNA, 20 bp, Artificial Sequence
  chemically synthesized
taagaataaactctttcttt

SEQ ID NO: 269250 - DNA, 20 bp, Artificial Sequence
  chemically synthesized
caaatagataccgaaagaaa

SEQ ID NO: 269251 - DNA, 20 bp, Artificial Sequence
  chemically synthesized
accaaatagataccgaaaga

SEQ ID NO: 269252 - DNA, 20 bp, Artificial Sequence
  chemically synthesized
ggaaaccaaatagataccga

SEQ ID NO: 269253 - DNA, 20 bp, Artificial Sequence
  chemically synthesized
tctttctttcggtatctatt

SEQ ID NO: 269254 - DNA, 20 bp, Artificial Sequence
  chemically synthesized
caacttgtagggaaaccaaa

SEQ ID NO: 269255 - DNA, 20 bp, Artificial Sequence
  chemically synthesized
tatctatttggtttccctac

SEQ ID NO: 269256 - DNA, 20 bp, Artificial Sequence
  chemically synthesized
tatttggtttccctacaagt

SEQ ID NO: 269257 - DNA, 20 bp, Artificial Sequence
  chemically synthesized
atgaattattccaacttgta

SEQ ID NO: 269258 - DNA, 20 bp, Artificial Sequence
  chemically synthesized
gatgaattattccaacttgt

SEQ ID NO: 269259 - DNA, 20 bp, Artificial Sequence
  chemically synthesized
agatgaattattccaacttg

SEQ ID NO: 269260 - DNA, 20 bp, Artificial Sequence
  chemically synthesized
ggaataattcatctcaatgc

SEQ ID NO: 269261 - DNA, 20 bp, Artificial Sequence
  chemically synthesized
agagaggtactactagcatt

SEQ ID NO: 269262 - DNA, 20 bp, Artificial Sequence
  chemically synthesized
ataattcatctcaatgctag

SEQ ID NO: 269263 - DNA, 20 bp, Artificial Sequence
  chemically synthesized
caccttcagagaggtactac

SEQ ID NO: 269264 - DNA, 20 bp, Artificial Sequence
  chemically synthesized
atgctagtagtacctctctg

SEQ ID NO: 269265 - DNA, 20 bp, Artificial Sequence
  chemically synthesized
tgctagtagtacctctctga

SEQ ID NO: 269266 - DNA, 20 bp, Artificial Sequence
  chemically synthesized
agccccatgcaccttcagag

SEQ ID NO: 269267 - DNA, 20 bp, Artificial Sequence
  chemically synthesized
cagccccatgcaccttcaga

SEQ ID NO: 269268 - DNA, 20 bp, Artificial Sequence
  chemically synthesized
gtcagccccatgcaccttca

SEQ ID NO: 269269 - DNA, 20 bp, Artificial Sequence
  chemically synthesized
aagtcagccccatgcacctt

SEQ ID NO: 269270 - DNA, 20 bp, Artificial Sequence
  chemically synthesized
agtacctctctgaaggtgca

SEQ ID NO: 269271 - DNA, 20 bp, Artificial Sequence
  chemically synthesized
gtacctctctgaaggtgcat

SEQ ID NO: 269272 - DNA, 20 bp, Artificial Sequence
  chemically synthesized
tacctctctgaaggtgcatg

SEQ ID NO: 269273 - DNA, 20 bp, Artificial Sequence
  chemically synthesized
aaggtgcatggggctgactt

SEQ ID NO: 269274 - DNA, 20 bp, Artificial Sequence
  chemically synthesized
tgtgtgagcaatacttaagt

SEQ ID NO: 269275 - DNA, 20 bp, Artificial Sequence
  chemically synthesized
tcattgtgtgagcaatactt

SEQ ID NO: 269276 - DNA, 20 bp, Artificial Sequence
  chemically synthesized
tgagacaaccatcattgtgt

SEQ ID NO: 269277 - DNA, 20 bp, Artificial Sequence
  chemically synthesized
aagtattgctcacacaatga

SEQ ID NO: 269278 - DNA, 20 bp, Artificial Sequence
  chemically synthesized
atacacagaattaataaaat

SEQ ID NO: 269279 - DNA, 20 bp, Artificial Sequence
  chemically synthesized
taggcctaccataaaataca

SEQ ID NO: 269280 - DNA, 20 bp, Artificial Sequence
  chemically synthesized
tattaattctgtgtatttta

SEQ ID NO: 269281 - DNA, 20 bp, Artificial Sequence
  chemically synthesized
taattctgtgtattttatgg

SEQ ID NO: 269282 - DNA, 20 bp, Artificial Sequence
  chemically synthesized
aattctgtgtattttatggt

SEQ ID NO: 269283 - DNA, 20 bp, Artificial Sequence
  chemically synthesized
tttatggtaggcctaaatga

SEQ ID NO: 269284 - DNA, 20 bp, Artificial Sequence
  chemically synthesized
tcccatcacaactatcattt

SEQ ID NO: 269285 - DNA, 20 bp, Artificial Sequence
  chemically synthesized
gtcccatcacaactatcatt

SEQ ID NO: 269286 - DNA, 20 bp, Artificial Sequence
  chemically synthesized
ggcctaaatgatagttgtga

SEQ ID NO: 269287 - DNA, 20 bp, Artificial Sequence
  chemically synthesized
gcctaaatgatagttgtgat

SEQ ID NO: 269288 - DNA, 20 bp, Artificial Sequence
  chemically synthesized
agttgtgatgggaccttatt

SEQ ID NO: 269289 - DNA, 20 bp, Artificial Sequence
  chemically synthesized
taccaccaaaattctcaata

SEQ ID NO: 269290 - DNA, 20 bp, Artificial Sequence
  chemically synthesized
gtaccaccaaaattctcaat

SEQ ID NO: 269291 - DNA, 20 bp, Artificial Sequence
  chemically synthesized
tgggaccttattgagaattt

SEQ ID NO: 269292 - DNA, 20 bp, Artificial Sequence
  chemically synthesized
gaccttattgagaattttgg

SEQ ID NO: 269293 - DNA, 20 bp, Artificial Sequence
  chemically synthesized
attgagaattttggtggtac

SEQ ID NO: 269294 - DNA, 20 bp, Artificial Sequence
  chemically synthesized
tccatgtgcaagcagttttc

SEQ ID NO: 269295 - DNA, 20 bp, Artificial Sequence
  chemically synthesized
ggccatagtccatgtgcaag

SEQ ID NO: 269296 - DNA, 20 bp, Artificial Sequence
  chemically synthesized
actggaaaactgcttgcaca

SEQ ID NO: 269297 - DNA, 20 bp, Artificial Sequence
  chemically synthesized
tagggccatagtccatgtgc

SEQ ID NO: 269298 - DNA, 20 bp, Artificial Sequence
  chemically synthesized
aactgcttgcacatggacta

SEQ ID NO: 269299 - DNA, 20 bp, Artificial Sequence
  chemically synthesized
atcgcctatttatagggcca

SEQ ID NO: 269300 - DNA, 20 bp, Artificial Sequence
  chemically synthesized
atggactatggccctataaa

SEQ ID NO: 269301 - DNA, 20 bp, Artificial Sequence
  chemically synthesized
tggactatggccctataaat

SEQ ID NO: 269302 - DNA, 20 bp, Artificial Sequence
  chemically synthesized
tatttcatcgcctatttata

SEQ ID NO: 269303 - DNA, 20 bp, Artificial Sequence
  chemically synthesized
gtatttcatcgcctatttat

SEQ ID NO: 269304 - DNA, 20 bp, Artificial Sequence
  chemically synthesized
agtatttcatcgcctattta

SEQ ID NO: 269305 - DNA, 20 bp, Artificial Sequence
  chemically synthesized
atgttatttaattaatttaa

SEQ ID NO: 269306 - DNA, 20 bp, Artificial Sequence
  chemically synthesized
attaattaaataacataatc

SEQ ID NO: 269307 - DNA, 20 bp, Artificial Sequence
  chemically synthesized
attaaataacataatctagt

SEQ ID NO: 269308 - DNA, 20 bp, Artificial Sequence
  chemically synthesized
gctgttccttcatttcttac

SEQ ID NO: 269309 - DNA, 20 bp, Artificial Sequence
  chemically synthesized
acataatctagtaagaaatg

SEQ ID NO: 269310 - DNA, 20 bp, Artificial Sequence
  chemically synthesized
cataatctagtaagaaatga

SEQ ID NO: 269311 - DNA, 20 bp, Artificial Sequence
  chemically synthesized
tctagtaagaaatgaaggaa

SEQ ID NO: 269312 - DNA, 20 bp, Artificial Sequence
  chemically synthesized
gtaagaaatgaaggaacagc

SEQ ID NO: 269313 - DNA, 20 bp, Artificial Sequence
  chemically synthesized
gaaggaacagcaagaatgcc

SEQ ID NO: 269314 - DNA, 20 bp, Artificial Sequence
  chemically synthesized
tggtgaccaccaaagcagcc

SEQ ID NO: 269315 - DNA, 20 bp, Artificial Sequence
  chemically synthesized
gcaagaatgcctggctgctt

SEQ ID NO: 269316 - DNA, 20 bp, Artificial Sequence
  chemically synthesized
ttggtgaccaccaaagcagc

SEQ ID NO: 269317 - DNA, 20 bp, Artificial Sequence
  chemically synthesized
agaatgcctggctgctttgg

SEQ ID NO: 269318 - DNA, 20 bp, Artificial Sequence
  chemically synthesized
tatgttggtgaccaccaaag

SEQ ID NO: 269319 - DNA, 20 bp, Artificial Sequence
  chemically synthesized
aactatgttggtgaccacca

SEQ ID NO: 269320 - DNA, 20 bp, Artificial Sequence
  chemically synthesized
tgctttggtggtcaccaaca

SEQ ID NO: 269321 - DNA, 20 bp, Artificial Sequence
  chemically synthesized
gtctataatataaactatgt

SEQ ID NO: 269322 - DNA, 20 bp, Artificial Sequence
  chemically synthesized
caccaacatagtttatatta

SEQ ID NO: 269323 - DNA, 20 bp, Artificial Sequence
  chemically synthesized
attatagacaatgcatcatc

SEQ ID NO: 269324 - DNA, 20 bp, Artificial Sequence
  chemically synthesized
ttatagacaatgcatcatct

SEQ ID NO: 269325 - DNA, 20 bp, Artificial Sequence
  chemically synthesized
tatagacaatgcatcatctg

SEQ ID NO: 269326 - DNA, 20 bp, Artificial Sequence
  chemically synthesized
ccgtggctgtgggcaggccc

SEQ ID NO: 269327 - DNA, 20 bp, Artificial Sequence
  chemically synthesized
catcatctggggcctgccca

SEQ ID NO: 269328 - DNA, 20 bp, Artificial Sequence
  chemically synthesized
tccttaccgtggctgtgggc

SEQ ID NO: 269329 - DNA, 20 bp, Artificial Sequence
  chemically synthesized
ctccttaccgtggctgtggg

SEQ ID NO: 269330 - DNA, 20 bp, Artificial Sequence
  chemically synthesized
ctggggcctgcccacagcca

SEQ ID NO: 269331 - DNA, 20 bp, Artificial Sequence
  chemically synthesized
cacctccttaccgtggctgt

SEQ ID NO: 269332 - DNA, 20 bp, Artificial Sequence
  chemically synthesized
tcacctccttaccgtggctg

SEQ ID NO: 269333 - DNA, 20 bp, Artificial Sequence
  chemically synthesized
ggcctgcccacagccacggt

SEQ ID NO: 269334 - DNA, 20 bp, Artificial Sequence
  chemically synthesized
gcctgcccacagccacggta

SEQ ID NO: 269335 - DNA, 20 bp, Artificial Sequence
  chemically synthesized
ctgcccacagccacggtaag

SEQ ID NO: 269336 - DNA, 20 bp, Artificial Sequence
  chemically synthesized
ctcatttcacctccttaccg

SEQ ID NO: 269337 - DNA, 20 bp, Artificial Sequence
  chemically synthesized
tgcccacagccacggtaagg

SEQ ID NO: 269338 - DNA, 20 bp, Artificial Sequence
  chemically synthesized
ccacggtaaggaggtgaaat

SEQ ID NO: 269339 - DNA, 20 bp, Artificial Sequence
  chemically synthesized
gtaaggaggtgaaatgagta

SEQ ID NO: 269340 - DNA, 20 bp, Artificial Sequence
  chemically synthesized
aaggaggtgaaatgagtata

SEQ ID NO: 269341 - DNA, 20 bp, Artificial Sequence
  chemically synthesized
ttatgagaaaaaaaaaaaat

SEQ ID NO: 269342 - DNA, 20 bp, Artificial Sequence
  chemically synthesized
tctaacacttaagtttttat

SEQ ID NO: 269343 - DNA, 20 bp, Artificial Sequence
  chemically synthesized
tttttttctcataaaaactt

SEQ ID NO: 269344 - DNA, 20 bp, Artificial Sequence
  chemically synthesized
tctcataaaaacttaagtgt

SEQ ID NO: 269345 - DNA, 20 bp, Artificial Sequence
  chemically synthesized
tccacaatgatctaacactt

SEQ ID NO: 269346 - DNA, 20 bp, Artificial Sequence
  chemically synthesized
acttaagtgttagatcattg

SEQ ID NO: 269347 - DNA, 20 bp, Artificial Sequence
  chemically synthesized
taagtgttagatcattgtgg

SEQ ID NO: 269348 - DNA, 20 bp, Artificial Sequence
  chemically synthesized
aagtgttagatcattgtgga

SEQ ID NO: 269349 - DNA, 20 bp, Artificial Sequence
  chemically synthesized
agtgttagatcattgtggaa

SEQ ID NO: 269350 - DNA, 20 bp, Artificial Sequence
  chemically synthesized
aatccctgtcatatcaaatc

SEQ ID NO: 269351 - DNA, 20 bp, Artificial Sequence
  chemically synthesized
aagggcttgatttgatatga

SEQ ID NO: 269352 - DNA, 20 bp, Artificial Sequence
  chemically synthesized
agggcttgatttgatatgac

SEQ ID NO: 269353 - DNA, 20 bp, Artificial Sequence
  chemically synthesized
gggcttgatttgatatgaca

SEQ ID NO: 269354 - DNA, 20 bp, Artificial Sequence
  chemically synthesized
ggatttttgataaaccgcat

SEQ ID NO: 269355 - DNA, 20 bp, Artificial Sequence
  chemically synthesized
ctgtattcatgtcaccaatg

SEQ ID NO: 269356 - DNA, 20 bp, Artificial Sequence
  chemically synthesized
ccgcattggtgacatgaata

SEQ ID NO: 269357 - DNA, 20 bp, Artificial Sequence
  chemically synthesized
attggtgacatgaatacagt

SEQ ID NO: 269358 - DNA, 20 bp, Artificial Sequence
  chemically synthesized
gtgacatgaatacagtaagc

SEQ ID NO: 269359 - DNA, 20 bp, Artificial Sequence
  chemically synthesized
atgaatacagtaagccagac

SEQ ID NO: 269360 - DNA, 20 bp, Artificial Sequence
  chemically synthesized
aaatcaaaagcaatctggtc

SEQ ID NO: 269361 - DNA, 20 bp, Artificial Sequence
  chemically synthesized
cattaaaatcaaaagcaatc

SEQ ID NO: 269362 - DNA, 20 bp, Artificial Sequence
  chemically synthesized
gaatctaacattaaaatcaa

SEQ ID NO: 269363 - DNA, 20 bp, Artificial Sequence
  chemically synthesized
attgcttttgattttaatgt

SEQ ID NO: 269364 - DNA, 20 bp, Artificial Sequence
  chemically synthesized
aatgttagattcatttttct

SEQ ID NO: 269365 - DNA, 20 bp, Artificial Sequence
  chemically synthesized
ttttcttacattacgaagct

SEQ ID NO: 269366 - DNA, 20 bp, Artificial Sequence
  chemically synthesized
tcagtttttcttacattacg

SEQ ID NO: 269367 - DNA, 20 bp, Artificial Sequence
  chemically synthesized
ttttctcagcttcgtaatgt

SEQ ID NO: 269368 - DNA, 20 bp, Artificial Sequence
  chemically synthesized
agcatatttaaagttcaatt

SEQ ID NO: 269369 - DNA, 20 bp, Artificial Sequence
  chemically synthesized
gaaaagtataagcatattta

SEQ ID NO: 269370 - DNA, 20 bp, Artificial Sequence
  chemically synthesized
atcctaaattagaaaagtat

SEQ ID NO: 269371 - DNA, 20 bp, Artificial Sequence
  chemically synthesized
tttcctatcctaaattagaa

SEQ ID NO: 269372 - DNA, 20 bp, Artificial Sequence
  chemically synthesized
atgcttatacttttctaatt

SEQ ID NO: 269373 - DNA, 20 bp, Artificial Sequence
  chemically synthesized
tgcttatacttttctaattt

SEQ ID NO: 269374 - DNA, 20 bp, Artificial Sequence
  chemically synthesized
ggaaatttcctatcctaaat

SEQ ID NO: 269375 - DNA, 20 bp, Artificial Sequence
  chemically synthesized
tatacttttctaatttagga

SEQ ID NO: 269376 - DNA, 20 bp, Artificial Sequence
  chemically synthesized
atacttttctaatttaggat

SEQ ID NO: 269377 - DNA, 20 bp, Artificial Sequence
  chemically synthesized
ctagccgtgttatataatcg

SEQ ID NO: 269378 - DNA, 20 bp, Artificial Sequence
  chemically synthesized
actagccgtgttatataatc

SEQ ID NO: 269379 - DNA, 20 bp, Artificial Sequence
  chemically synthesized
atttcctcgattatataaca

SEQ ID NO: 269380 - DNA, 20 bp, Artificial Sequence
  chemically synthesized
cctcgattatataacacggc

SEQ ID NO: 269381 - DNA, 20 bp, Artificial Sequence
  chemically synthesized
ttagggttttggtttttaac

SEQ ID NO: 269382 - DNA, 20 bp, Artificial Sequence
  chemically synthesized
acacaaaagttttagggttt

SEQ ID NO: 269383 - DNA, 20 bp, Artificial Sequence
  chemically synthesized
catgtgacacaaaagtttta

SEQ ID NO: 269384 - DNA, 20 bp, Artificial Sequence
  chemically synthesized
tcatgtgacacaaaagtttt

SEQ ID NO: 269385 - DNA, 20 bp, Artificial Sequence
  chemically synthesized
ttcatgtgacacaaaagttt

SEQ ID NO: 269386 - DNA, 20 bp, Artificial Sequence
  chemically synthesized
aaagtcttcatgtgacacaa

SEQ ID NO: 269387 - DNA, 20 bp, Artificial Sequence
  chemically synthesized
taaaacttttgtgtcacatg

SEQ ID NO: 269388 - DNA, 20 bp, Artificial Sequence
  chemically synthesized
atagtaatatatatttcata

SEQ ID NO: 269389 - DNA, 20 bp, Artificial Sequence
  chemically synthesized
ttatgaaatatatattacta

SEQ ID NO: 269390 - DNA, 20 bp, Artificial Sequence
  chemically synthesized
aaatatatattactatagat

SEQ ID NO: 269391 - DNA, 20 bp, Artificial Sequence
  chemically synthesized
atacagattttactaatcta

SEQ ID NO: 269392 - DNA, 20 bp, Artificial Sequence
  chemically synthesized
aagtcaccttaaaaacaata

SEQ ID NO: 269393 - DNA, 20 bp, Artificial Sequence
  chemically synthesized
gtaaaatctgtattgttttt

SEQ ID NO: 269394 - DNA, 20 bp, Artificial Sequence
  chemically synthesized
taaaatctgtattgttttta

SEQ ID NO: 269395 - DNA, 20 bp, Artificial Sequence
  chemically synthesized
tgctccaattggagaatcag

SEQ ID NO: 269396 - DNA, 20 bp, Artificial Sequence
  chemically synthesized
tattgctccaattggagaat

SEQ ID NO: 269397 - DNA, 20 bp, Artificial Sequence
  chemically synthesized
gtgacttctgattctccaat

SEQ ID NO: 269398 - DNA, 20 bp, Artificial Sequence
  chemically synthesized
gacttctgattctccaattg

SEQ ID NO: 269399 - DNA, 20 bp, Artificial Sequence
  chemically synthesized
tggaagtattgctccaattg

SEQ ID NO: 269400 - DNA, 20 bp, Artificial Sequence
  chemically synthesized
tttggaagtattgctccaat

SEQ ID NO: 269401 - DNA, 20 bp, Artificial Sequence
  chemically synthesized
aaaattagcaaagaatttgg

SEQ ID NO: 269402 - DNA, 20 bp, Artificial Sequence
  chemically synthesized
atcaaaattagcaaagaatt

SEQ ID NO: 269403 - DNA, 20 bp, Artificial Sequence
  chemically synthesized
tttcaagatcaaaattagca

SEQ ID NO: 269404 - DNA, 20 bp, Artificial Sequence
  chemically synthesized
tcacttttcaagatcaaaat

SEQ ID NO: 269405 - DNA, 20 bp, Artificial Sequence
  chemically synthesized
ttgctaattttgatcttgaa

SEQ ID NO: 269406 - DNA, 20 bp, Artificial Sequence
  chemically synthesized
aaaactagaattcacttttc

SEQ ID NO: 269407 - DNA, 20 bp, Artificial Sequence
  chemically synthesized
tgatcttgaaaagtgaattc

SEQ ID NO: 269408 - DNA, 20 bp, Artificial Sequence
  chemically synthesized
ttcctgtgatatgagaaaac

SEQ ID NO: 269409 - DNA, 20 bp, Artificial Sequence
  chemically synthesized
attctagttttctcatatca

SEQ ID NO: 269410 - DNA, 20 bp, Artificial Sequence
  chemically synthesized
ttctagttttctcatatcac

SEQ ID NO: 269411 - DNA, 20 bp, Artificial Sequence
  chemically synthesized
actagtttttcctgtgatat

SEQ ID NO: 269412 - DNA, 20 bp, Artificial Sequence
  chemically synthesized
tctcatatcacaggaaaaac

SEQ ID NO: 269413 - DNA, 20 bp, Artificial Sequence
  chemically synthesized
acaggaaaaactagtacatt

SEQ ID NO: 269414 - DNA, 20 bp, Artificial Sequence
  chemically synthesized
aatactgagtctaaatgtac

SEQ ID NO: 269415 - DNA, 20 bp, Artificial Sequence
  chemically synthesized
aaaactagtacatttagact

SEQ ID NO: 269416 - DNA, 20 bp, Artificial Sequence
  chemically synthesized
tactggttaatgataatact

SEQ ID NO: 269417 - DNA, 20 bp, Artificial Sequence
  chemically synthesized
gactcagtattatcattaac

SEQ ID NO: 269418 - DNA, 20 bp, Artificial Sequence
  chemically synthesized
tgtgatgaaaattaatatac

SEQ ID NO: 269419 - DNA, 20 bp, Artificial Sequence
  chemically synthesized
atattaattttcatcacact

SEQ ID NO: 269420 - DNA, 20 bp, Artificial Sequence
  chemically synthesized
ggcatgaagtatcaagtact

SEQ ID NO: 269421 - DNA, 20 bp, Artificial Sequence
  chemically synthesized
tatagggggcatgaagtatc

SEQ ID NO: 269422 - DNA, 20 bp, Artificial Sequence
  chemically synthesized
aatgttttatagggggcatg

SEQ ID NO: 269423 - DNA, 20 bp, Artificial Sequence
  chemically synthesized
aagtgagaatgttttatagg

SEQ ID NO: 269424 - DNA, 20 bp, Artificial Sequence
  chemically synthesized
gaagtgagaatgttttatag

SEQ ID NO: 269425 - DNA, 20 bp, Artificial Sequence
  chemically synthesized
tgaagtgagaatgttttata

SEQ ID NO: 269426 - DNA, 20 bp, Artificial Sequence
  chemically synthesized
gtgaagtgagaatgttttat

SEQ ID NO: 269427 - DNA, 20 bp, Artificial Sequence
  chemically synthesized
ggtgaagtgagaatgtttta

SEQ ID NO: 269428 - DNA, 20 bp, Artificial Sequence
  chemically synthesized
tggcatttaaaaggtgaagt

SEQ ID NO: 269429 - DNA, 20 bp, Artificial Sequence
  chemically synthesized
atgatggcatttaaaaggtg

SEQ ID NO: 269430 - DNA, 20 bp, Artificial Sequence
  chemically synthesized
acttgatgatggcatttaaa

SEQ ID NO: 269431 - DNA, 20 bp, Artificial Sequence
  chemically synthesized
tacttgatgatggcatttaa

SEQ ID NO: 269432 - DNA, 20 bp, Artificial Sequence
  chemically synthesized
accttttaaatgccatcatc

SEQ ID NO: 269433 - DNA, 20 bp, Artificial Sequence
  chemically synthesized
agtactctcttacttgatga

SEQ ID NO: 269434 - DNA, 20 bp, Artificial Sequence
  chemically synthesized
tttaaatgccatcatcaagt

SEQ ID NO: 269435 - DNA, 20 bp, Artificial Sequence
  chemically synthesized
taaatgccatcatcaagtaa

SEQ ID NO: 269436 - DNA, 20 bp, Artificial Sequence
  chemically synthesized
aatgccatcatcaagtaaga

SEQ ID NO: 269437 - DNA, 20 bp, Artificial Sequence
  chemically synthesized
tcaagtaagagagtactact

SEQ ID NO: 269438 - DNA, 20 bp, Artificial Sequence
  chemically synthesized
ctattgaaaataaagctcag

SEQ ID NO: 269439 - DNA, 20 bp, Artificial Sequence
  chemically synthesized
aagctattgaaaataaagct

SEQ ID NO: 269440 - DNA, 20 bp, Artificial Sequence
  chemically synthesized
tgtaaaagctattgaaaata

SEQ ID NO: 269441 - DNA, 20 bp, Artificial Sequence
  chemically synthesized
ctactgagctttattttcaa

SEQ ID NO: 269442 - DNA, 20 bp, Artificial Sequence
  chemically synthesized
tttattttcaatagctttta

SEQ ID NO: 269443 - DNA, 20 bp, Artificial Sequence
  chemically synthesized
ggctattactttagctgtaa

SEQ ID NO: 269444 - DNA, 20 bp, Artificial Sequence
  chemically synthesized
ttcaatagcttttacagcta

SEQ ID NO: 269445 - DNA, 20 bp, Artificial Sequence
  chemically synthesized
agcttttacagctaaagtaa

SEQ ID NO: 269446 - DNA, 20 bp, Artificial Sequence
  chemically synthesized
acacagttgggctattactt

SEQ ID NO: 269447 - DNA, 20 bp, Artificial Sequence
  chemically synthesized
atttatttgaaaacacagtt

SEQ ID NO: 269448 - DNA, 20 bp, Artificial Sequence
  chemically synthesized
tatttatttgaaaacacagt

SEQ ID NO: 269449 - DNA, 20 bp, Artificial Sequence
  chemically synthesized
aatgtatttatttgaaaaca

SEQ ID NO: 269450 - DNA, 20 bp, Artificial Sequence
  chemically synthesized
ttcaaataaatacattcact

SEQ ID NO: 269451 - DNA, 20 bp, Artificial Sequence
  chemically synthesized
caaataaatacattcactga

SEQ ID NO: 269452 - DNA, 20 bp, Artificial Sequence
  chemically synthesized
aggaacctgtatcaatctct

SEQ ID NO: 269453 - DNA, 20 bp, Artificial Sequence
  chemically synthesized
cattcactgagagattgata

SEQ ID NO: 269454 - DNA, 20 bp, Artificial Sequence
  chemically synthesized
attcactgagagattgatac

SEQ ID NO: 269455 - DNA, 20 bp, Artificial Sequence
  chemically synthesized
gagagattgatacaggttcc

SEQ ID NO: 269456 - DNA, 20 bp, Artificial Sequence
  chemically synthesized
gagattgatacaggttccta

SEQ ID NO: 269457 - DNA, 20 bp, Artificial Sequence
  chemically synthesized
attgatacaggttcctagag

SEQ ID NO: 269458 - DNA, 20 bp, Artificial Sequence
  chemically synthesized
caaaatatgttgacttctct

SEQ ID NO: 269459 - DNA, 20 bp, Artificial Sequence
  chemically synthesized
tcaaaatatgttgacttctc

SEQ ID NO: 269460 - DNA, 20 bp, Artificial Sequence
  chemically synthesized
tagagaagtcaacatatttt

SEQ ID NO: 269461 - DNA, 20 bp, Artificial Sequence
  chemically synthesized
aacatattttgagttgtcga

SEQ ID NO: 269462 - DNA, 20 bp, Artificial Sequence
  chemically synthesized
tattttgagttgtcgatggt

SEQ ID NO: 269463 - DNA, 20 bp, Artificial Sequence
  chemically synthesized
gtgccaagcataattgaaga

SEQ ID NO: 269464 - DNA, 20 bp, Artificial Sequence
  chemically synthesized
tttcgtgccaagcataattg

SEQ ID NO: 269465 - DNA, 20 bp, Artificial Sequence
  chemically synthesized
tttctttcttcaattatgct

SEQ ID NO: 269466 - DNA, 20 bp, Artificial Sequence
  chemically synthesized
ctattgagccttttcgtgcc

SEQ ID NO: 269467 - DNA, 20 bp, Artificial Sequence
  chemically synthesized
tcaattatgcttggcacgaa

SEQ ID NO: 269468 - DNA, 20 bp, Artificial Sequence
  chemically synthesized
caattatgcttggcacgaaa

SEQ ID NO: 269469 - DNA, 20 bp, Artificial Sequence
  chemically synthesized
cttggcacgaaaaggctcaa

SEQ ID NO: 269470 - DNA, 20 bp, Artificial Sequence
  chemically synthesized
tcacagagaaattggctatt

SEQ ID NO: 269471 - DNA, 20 bp, Artificial Sequence
  chemically synthesized
tgaaccagtcacagagaaat

SEQ ID NO: 269472 - DNA, 20 bp, Artificial Sequence
  chemically synthesized
atagccaatttctctgtgac

SEQ ID NO: 269473 - DNA, 20 bp, Artificial Sequence
  chemically synthesized
ttgggtttgaaccagtcaca

SEQ ID NO: 269474 - DNA, 20 bp, Artificial Sequence
  chemically synthesized
ttttgggtttgaaccagtca

SEQ ID NO: 269475 - DNA, 20 bp, Artificial Sequence
  chemically synthesized
atagagttttgggtttgaac

SEQ ID NO: 269476 - DNA, 20 bp, Artificial Sequence
  chemically synthesized
ttttgctaacatagagtttt

SEQ ID NO: 269477 - DNA, 20 bp, Artificial Sequence
  chemically synthesized
tttttgctaacatagagttt

SEQ ID NO: 269478 - DNA, 20 bp, Artificial Sequence
  chemically synthesized
tcaaacccaaaactctatgt

SEQ ID NO: 269479 - DNA, 20 bp, Artificial Sequence
  chemically synthesized
taaaaatttttgctaacata

SEQ ID NO: 269480 - DNA, 20 bp, Artificial Sequence
  chemically synthesized
gctaaaaatttttgctaaca

SEQ ID NO: 269481 - DNA, 20 bp, Artificial Sequence
  chemically synthesized
tctatgttagcaaaaatttt

SEQ ID NO: 269482 - DNA, 20 bp, Artificial Sequence
  chemically synthesized
gcaaaaatttttagctattg

SEQ ID NO: 269483 - DNA, 20 bp, Artificial Sequence
  chemically synthesized
atagtactagaaggcttcaa

SEQ ID NO: 269484 - DNA, 20 bp, Artificial Sequence
  chemically synthesized
ttttagctattgaagccttc

SEQ ID NO: 269485 - DNA, 20 bp, Artificial Sequence
  chemically synthesized
gtgtatgtcatagtactaga

SEQ ID NO: 269486 - DNA, 20 bp, Artificial Sequence
  chemically synthesized
tgtgtatgtcatagtactag

SEQ ID NO: 269487 - DNA, 20 bp, Artificial Sequence
  chemically synthesized
tcatgtgtatgtcatagtac

SEQ ID NO: 269488 - DNA, 20 bp, Artificial Sequence
  chemically synthesized
tcatattcatgtgtatgtca

SEQ ID NO: 269489 - DNA, 20 bp, Artificial Sequence
  chemically synthesized
atgacatacacatgaatatg

SEQ ID NO: 269490 - DNA, 20 bp, Artificial Sequence
  chemically synthesized
ctatatctaattggaaagca

SEQ ID NO: 269491 - DNA, 20 bp, Artificial Sequence
  chemically synthesized
cctatatctaattggaaagc

SEQ ID NO: 269492 - DNA, 20 bp, Artificial Sequence
  chemically synthesized
ccctatatctaattggaaag

SEQ ID NO: 269493 - DNA, 20 bp, Artificial Sequence
  chemically synthesized
atgaagccctgctttccaat

SEQ ID NO: 269494 - DNA, 20 bp, Artificial Sequence
  chemically synthesized
tggccctatatctaattgga

SEQ ID NO: 269495 - DNA, 20 bp, Artificial Sequence
  chemically synthesized
tacttggccctatatctaat

SEQ ID NO: 269496 - DNA, 20 bp, Artificial Sequence
  chemically synthesized
ccctgctttccaattagata

SEQ ID NO: 269497 - DNA, 20 bp, Artificial Sequence
  chemically synthesized
cctgctttccaattagatat

SEQ ID NO: 269498 - DNA, 20 bp, Artificial Sequence
  chemically synthesized
ctgctttccaattagatata

SEQ ID NO: 269499 - DNA, 20 bp, Artificial Sequence
  chemically synthesized
ttccaattagatatagggcc

SEQ ID NO: 269500 - DNA, 20 bp, Artificial Sequence
  chemically synthesized
attagatatagggccaagta

SEQ ID NO: 269501 - DNA, 20 bp, Artificial Sequence
  chemically synthesized
tgagaacacatttctatact

SEQ ID NO: 269502 - DNA, 20 bp, Artificial Sequence
  chemically synthesized
caagtatagaaatgtgttct

SEQ ID NO: 269503 - DNA, 20 bp, Artificial Sequence
  chemically synthesized
tatagaaatgtgttctcagt

SEQ ID NO: 269504 - DNA, 20 bp, Artificial Sequence
  chemically synthesized
aagccagattgtttctaact

SEQ ID NO: 269505 - DNA, 20 bp, Artificial Sequence
  chemically synthesized
gttctcagttagaaacaatc

SEQ ID NO: 269506 - DNA, 20 bp, Artificial Sequence
  chemically synthesized
tctttttcctggaaagaagc

SEQ ID NO: 269507 - DNA, 20 bp, Artificial Sequence
  chemically synthesized
gaaacaatctggcttctttc

SEQ ID NO: 269508 - DNA, 20 bp, Artificial Sequence
  chemically synthesized
aaacaatctggcttctttcc

SEQ ID NO: 269509 - DNA, 20 bp, Artificial Sequence
  chemically synthesized
tgtatctttttcctggaaag

SEQ ID NO: 269510 - DNA, 20 bp, Artificial Sequence
  chemically synthesized
ttctgtatctttttcctgga

SEQ ID NO: 269511 - DNA, 20 bp, Artificial Sequence
  chemically synthesized
tctggcttctttccaggaaa

SEQ ID NO: 269512 - DNA, 20 bp, Artificial Sequence
  chemically synthesized
aattttctgtatctttttcc

SEQ ID NO: 269513 - DNA, 20 bp, Artificial Sequence
  chemically synthesized
ttctttccaggaaaaagata

SEQ ID NO: 269514 - DNA, 20 bp, Artificial Sequence
  chemically synthesized
agaaaatttttttctgtatt

SEQ ID NO: 269515 - DNA, 20 bp, Artificial Sequence
  chemically synthesized
aaaatttttttctgtattca

SEQ ID NO: 269516 - DNA, 20 bp, Artificial Sequence
  chemically synthesized
ttatttattttctctgaata

SEQ ID NO: 269517 - DNA, 20 bp, Artificial Sequence
  chemically synthesized
attagacatcagagatttga

SEQ ID NO: 269518 - DNA, 20 bp, Artificial Sequence
  chemically synthesized
aattagacatcagagatttg

SEQ ID NO: 269519 - DNA, 20 bp, Artificial Sequence
  chemically synthesized
ttaagtagaattagacatca

SEQ ID NO: 269520 - DNA, 20 bp, Artificial Sequence
  chemically synthesized
ttttaagtagaattagacat

SEQ ID NO: 269521 - DNA, 20 bp, Artificial Sequence
  chemically synthesized
actgagcttttaagtagaat

SEQ ID NO: 269522 - DNA, 20 bp, Artificial Sequence
  chemically synthesized
tgatgtctaattctacttaa

SEQ ID NO: 269523 - DNA, 20 bp, Artificial Sequence
  chemically synthesized
cctgcaactgagcttttaag

SEQ ID NO: 269524 - DNA, 20 bp, Artificial Sequence
  chemically synthesized
tctaattctacttaaaagct

SEQ ID NO: 269525 - DNA, 20 bp, Artificial Sequence
  chemically synthesized
tttcctgcaactgagctttt

SEQ ID NO: 269526 - DNA, 20 bp, Artificial Sequence
  chemically synthesized
tctacttaaaagctcagttg

SEQ ID NO: 269527 - DNA, 20 bp, Artificial Sequence
  chemically synthesized
ctacttaaaagctcagttgc

SEQ ID NO: 269528 - DNA, 20 bp, Artificial Sequence
  chemically synthesized
gaatatgctttcctgcaact

SEQ ID NO: 269529 - DNA, 20 bp, Artificial Sequence
  chemically synthesized
ttaaaagctcagttgcagga

SEQ ID NO: 269530 - DNA, 20 bp, Artificial Sequence
  chemically synthesized
gttgcaggaaagcatattca

SEQ ID NO: 269531 - DNA, 20 bp, Artificial Sequence
  chemically synthesized
gcaggaaagcatattcacag

SEQ ID NO: 269532 - DNA, 20 bp, Artificial Sequence
  chemically synthesized
caggaaagcatattcacaga

SEQ ID NO: 269533 - DNA, 20 bp, Artificial Sequence
  chemically synthesized
tataggagacatttttatac

SEQ ID NO: 269534 - DNA, 20 bp, Artificial Sequence
  chemically synthesized
ttataggagacatttttata

SEQ ID NO: 269535 - DNA, 20 bp, Artificial Sequence
  chemically synthesized
tatatatttatgaattatag

SEQ ID NO: 269536 - DNA, 20 bp, Artificial Sequence
  chemically synthesized
tgtatatatttatgaattat

SEQ ID NO: 269537 - DNA, 20 bp, Artificial Sequence
  chemically synthesized
gtgtatatatttatgaatta

SEQ ID NO: 269538 - DNA, 20 bp, Artificial Sequence
  chemically synthesized
aattcataaatatatacacc

SEQ ID NO: 269539 - DNA, 20 bp, Artificial Sequence
  chemically synthesized
attttgtatggatacatact

SEQ ID NO: 269540 - DNA, 20 bp, Artificial Sequence
  chemically synthesized
aattttgtatggatacatac

SEQ ID NO: 269541 - DNA, 20 bp, Artificial Sequence
  chemically synthesized
tattaatttttaattttgta

SEQ ID NO: 269542 - DNA, 20 bp, Artificial Sequence
  chemically synthesized
aaaattaaaaattaataaaa

SEQ ID NO: 269543 - DNA, 20 bp, Artificial Sequence
  chemically synthesized
aattaaaaattaataaaata

SEQ ID NO: 269544 - DNA, 20 bp, Artificial Sequence
  chemically synthesized
agcaattgttttcagatttt

SEQ ID NO: 269545 - DNA, 20 bp, Artificial Sequence
  chemically synthesized
agtagtctagcaattgtttt

SEQ ID NO: 269546 - DNA, 20 bp, Artificial Sequence
  chemically synthesized
gaaaatctgaaaacaattgc

SEQ ID NO: 269547 - DNA, 20 bp, Artificial Sequence
  chemically synthesized
agcagaagtctaaagtagtc

SEQ ID NO: 269548 - DNA, 20 bp, Artificial Sequence
  chemically synthesized
aaacaattgctagactactt

SEQ ID NO: 269549 - DNA, 20 bp, Artificial Sequence
  chemically synthesized
attggagcagaagtctaaag

SEQ ID NO: 269550 - DNA, 20 bp, Artificial Sequence
  chemically synthesized
aatattggagcagaagtcta

SEQ ID NO: 269551 - DNA, 20 bp, Artificial Sequence
  chemically synthesized
aggaaaaaatattggagcag

SEQ ID NO: 269552 - DNA, 20 bp, Artificial Sequence
  chemically synthesized
gagaggaaaaaatattggag

SEQ ID NO: 269553 - DNA, 20 bp, Artificial Sequence
  chemically synthesized
tatgagaggaaaaaatattg

SEQ ID NO: 269554 - DNA, 20 bp, Artificial Sequence
  chemically synthesized
tctatgagaggaaaaaatat

SEQ ID NO: 269555 - DNA, 20 bp, Artificial Sequence
  chemically synthesized
tccaatattttttcctctca

SEQ ID NO: 269556 - DNA, 20 bp, Artificial Sequence
  chemically synthesized
aggaaaagcaattctatgag

SEQ ID NO: 269557 - DNA, 20 bp, Artificial Sequence
  chemically synthesized
caggaaaagcaattctatga

SEQ ID NO: 269558 - DNA, 20 bp, Artificial Sequence
  chemically synthesized
ttcaggaaaagcaattctat

SEQ ID NO: 269559 - DNA, 20 bp, Artificial Sequence
  chemically synthesized
gctaaagggccattcaggaa

SEQ ID NO: 269560 - DNA, 20 bp, Artificial Sequence
  chemically synthesized
atagaattgcttttcctgaa

SEQ ID NO: 269561 - DNA, 20 bp, Artificial Sequence
  chemically synthesized
ttagtgctaaagggccattc

SEQ ID NO: 269562 - DNA, 20 bp, Artificial Sequence
  chemically synthesized
tttagtgctaaagggccatt

SEQ ID NO: 269563 - DNA, 20 bp, Artificial Sequence
  chemically synthesized
gcttttcctgaatggccctt

SEQ ID NO: 269564 - DNA, 20 bp, Artificial Sequence
  chemically synthesized
aagaaaaatttagtgctaaa

SEQ ID NO: 269565 - DNA, 20 bp, Artificial Sequence
  chemically synthesized
aaagaaaaatttagtgctaa

SEQ ID NO: 269566 - DNA, 20 bp, Artificial Sequence
  chemically synthesized
aaaagaaaaatttagtgcta

SEQ ID NO: 269567 - DNA, 20 bp, Artificial Sequence
  chemically synthesized
ctccatgaaaaagaaaaatt

SEQ ID NO: 269568 - DNA, 20 bp, Artificial Sequence
  chemically synthesized
cactaaatttttctttttca

SEQ ID NO: 269569 - DNA, 20 bp, Artificial Sequence
  chemically synthesized
ctaaatttttctttttcatg

SEQ ID NO: 269570 - DNA, 20 bp, Artificial Sequence
  chemically synthesized
accaacatggctccatgaaa

SEQ ID NO: 269571 - DNA, 20 bp, Artificial Sequence
  chemically synthesized
tctttttcatggagccatgt

SEQ ID NO: 269572 - DNA, 20 bp, Artificial Sequence
  chemically synthesized
ttttcatggagccatgttgg

SEQ ID NO: 269573 - DNA, 20 bp, Artificial Sequence
  chemically synthesized
tttatttttttctaccaaca

SEQ ID NO: 269574 - DNA, 20 bp, Artificial Sequence
  chemically synthesized
atattcttataataaacaat

SEQ ID NO: 269575 - DNA, 20 bp, Artificial Sequence
  chemically synthesized
acattcttattgtttattat

SEQ ID NO: 269576 - DNA, 20 bp, Artificial Sequence
  chemically synthesized
tttattataagaatatgaat

SEQ ID NO: 269577 - DNA, 20 bp, Artificial Sequence
  chemically synthesized
aataaatgggagggtcataa

SEQ ID NO: 269578 - DNA, 20 bp, Artificial Sequence
  chemically synthesized
aaataaatgggagggtcata

SEQ ID NO: 269579 - DNA, 20 bp, Artificial Sequence
  chemically synthesized
ccagaagaaaataaatggga

SEQ ID NO: 269580 - DNA, 20 bp, Artificial Sequence
  chemically synthesized
gccagaagaaaataaatggg

SEQ ID NO: 269581 - DNA, 20 bp, Artificial Sequence
  chemically synthesized
tgccagaagaaaataaatgg

SEQ ID NO: 269582 - DNA, 20 bp, Artificial Sequence
  chemically synthesized
agtgccagaagaaaataaat

SEQ ID NO: 269583 - DNA, 20 bp, Artificial Sequence
  chemically synthesized
tagtgccagaagaaaataaa

SEQ ID NO: 269584 - DNA, 20 bp, Artificial Sequence
  chemically synthesized
ccctcccatttattttcttc

SEQ ID NO: 269585 - DNA, 20 bp, Artificial Sequence
  chemically synthesized
ttgctagaacttagtgccag

SEQ ID NO: 269586 - DNA, 20 bp, Artificial Sequence
  chemically synthesized
atttattttcttctggcact

SEQ ID NO: 269587 - DNA, 20 bp, Artificial Sequence
  chemically synthesized
tttttgctagaacttagtgc

SEQ ID NO: 269588 - DNA, 20 bp, Artificial Sequence
  chemically synthesized
tttcttctggcactaagttc

SEQ ID NO: 269589 - DNA, 20 bp, Artificial Sequence
  chemically synthesized
gttagctttttgctagaact

SEQ ID NO: 269590 - DNA, 20 bp, Artificial Sequence
  chemically synthesized
tggcactaagttctagcaaa

SEQ ID NO: 269591 - DNA, 20 bp, Artificial Sequence
  chemically synthesized
gtagtatgttagctttttgc

SEQ ID NO: 269592 - DNA, 20 bp, Artificial Sequence
  chemically synthesized
taactttactagtagtatgt

SEQ ID NO: 269593 - DNA, 20 bp, Artificial Sequence
  chemically synthesized
gcaaaaagctaacatactac

SEQ ID NO: 269594 - DNA, 20 bp, Artificial Sequence
  chemically synthesized
aagctaacatactactagta

SEQ ID NO: 269595 - DNA, 20 bp, Artificial Sequence
  chemically synthesized
aataattttaactttactag

SEQ ID NO: 269596 - DNA, 20 bp, Artificial Sequence
  chemically synthesized
taaaataattttaactttac

SEQ ID NO: 269597 - DNA, 20 bp, Artificial Sequence
  chemically synthesized
taattattattttaataatt

SEQ ID NO: 269598 - DNA, 20 bp, Artificial Sequence
  chemically synthesized
ttttaataatttggaaactt

SEQ ID NO: 269599 - DNA, 20 bp, Artificial Sequence
  chemically synthesized
tttaataatttggaaacttt

SEQ ID NO: 269600 - DNA, 20 bp, Artificial Sequence
  chemically synthesized
aaacatatttttgagaccca

SEQ ID NO: 269601 - DNA, 20 bp, Artificial Sequence
  chemically synthesized
caagaagtaaacatattttt

SEQ ID NO: 269602 - DNA, 20 bp, Artificial Sequence
  chemically synthesized
tcaaaaatatgtttacttct

SEQ ID NO: 269603 - DNA, 20 bp, Artificial Sequence
  chemically synthesized
tcctaaaagacaaaaccaag

SEQ ID NO: 269604 - DNA, 20 bp, Artificial Sequence
  chemically synthesized
gcttcctaaaagacaaaacc

SEQ ID NO: 269605 - DNA, 20 bp, Artificial Sequence
  chemically synthesized
tacttcttggttttgtcttt

SEQ ID NO: 269606 - DNA, 20 bp, Artificial Sequence
  chemically synthesized
acttcttggttttgtctttt

SEQ ID NO: 269607 - DNA, 20 bp, Artificial Sequence
  chemically synthesized
tcttggttttgtcttttagg

SEQ ID NO: 269608 - DNA, 20 bp, Artificial Sequence
  chemically synthesized
attggcgccaagcttcctaa

SEQ ID NO: 269609 - DNA, 20 bp, Artificial Sequence
  chemically synthesized
gttttgtcttttaggaagct

SEQ ID NO: 269610 - DNA, 20 bp, Artificial Sequence
  chemically synthesized
taaagccacaaattggcgcc

SEQ ID NO: 269611 - DNA, 20 bp, Artificial Sequence
  chemically synthesized
ggaagcttggcgccaatttg

SEQ ID NO: 269612 - DNA, 20 bp, Artificial Sequence
  chemically synthesized
aacattttaaagccacaaat

SEQ ID NO: 269613 - DNA, 20 bp, Artificial Sequence
  chemically synthesized
aatggacagggaacatttta

SEQ ID NO: 269614 - DNA, 20 bp, Artificial Sequence
  chemically synthesized
catgggtggtggaatggaca

SEQ ID NO: 269615 - DNA, 20 bp, Artificial Sequence
  chemically synthesized
tcatgggtggtggaatggac

SEQ ID NO: 269616 - DNA, 20 bp, Artificial Sequence
  chemically synthesized
atcatgggtggtggaatgga

SEQ ID NO: 269617 - DNA, 20 bp, Artificial Sequence
  chemically synthesized
atgtatcatgggtggtggaa

SEQ ID NO: 269618 - DNA, 20 bp, Artificial Sequence
  chemically synthesized
ccacaatgtatcatgggtgg

SEQ ID NO: 269619 - DNA, 20 bp, Artificial Sequence
  chemically synthesized
tatccacaatgtatcatggg

SEQ ID NO: 269620 - DNA, 20 bp, Artificial Sequence
  chemically synthesized
atatatccacaatgtatcat

SEQ ID NO: 269621 - DNA, 20 bp, Artificial Sequence
  chemically synthesized
aatatatccacaatgtatca

SEQ ID NO: 269622 - DNA, 20 bp, Artificial Sequence
  chemically synthesized
ccaccacccatgatacattg

SEQ ID NO: 269623 - DNA, 20 bp, Artificial Sequence
  chemically synthesized
ttgtggatatatttctatgc

SEQ ID NO: 269624 - DNA, 20 bp, Artificial Sequence
  chemically synthesized
aataataaaaaattcttgca

SEQ ID NO: 269625 - DNA, 20 bp, Artificial Sequence
  chemically synthesized
taggaaaaggaaaattatag

SEQ ID NO: 269626 - DNA, 20 bp, Artificial Sequence
  chemically synthesized
aactaggaaaaggaaaatta

SEQ ID NO: 269627 - DNA, 20 bp, Artificial Sequence
  chemically synthesized
tactataattttccttttcc

SEQ ID NO: 269628 - DNA, 20 bp, Artificial Sequence
  chemically synthesized
taaattggaaaactaggaaa

SEQ ID NO: 269629 - DNA, 20 bp, Artificial Sequence
  chemically synthesized
ataaattggaaaactaggaa

SEQ ID NO: 269630 - DNA, 20 bp, Artificial Sequence
  chemically synthesized
cctaaataaattggaaaact

SEQ ID NO: 269631 - DNA, 20 bp, Artificial Sequence
  chemically synthesized
gcctaaataaattggaaaac

SEQ ID NO: 269632 - DNA, 20 bp, Artificial Sequence
  chemically synthesized
tcctagttttccaatttatt

SEQ ID NO: 269633 - DNA, 20 bp, Artificial Sequence
  chemically synthesized
cttgagaagcctaaataaat

SEQ ID NO: 269634 - DNA, 20 bp, Artificial Sequence
  chemically synthesized
cctagttttccaatttattt

SEQ ID NO: 269635 - DNA, 20 bp, Artificial Sequence
  chemically synthesized
ccaatttatttaggcttctc

SEQ ID NO: 269636 - DNA, 20 bp, Artificial Sequence
  chemically synthesized
tacatatggcacaacttgag

SEQ ID NO: 269637 - DNA, 20 bp, Artificial Sequence
  chemically synthesized
agatacatatggcacaactt

SEQ ID NO: 269638 - DNA, 20 bp, Artificial Sequence
  chemically synthesized
gtggcttgaagagatacata

SEQ ID NO: 269639 - DNA, 20 bp, Artificial Sequence
  chemically synthesized
tgtgccatatgtatctcttc

SEQ ID NO: 269640 - DNA, 20 bp, Artificial Sequence
  chemically synthesized
attatttagtgtggcttgaa

SEQ ID NO: 269641 - DNA, 20 bp, Artificial Sequence
  chemically synthesized
aaattatttagtgtggcttg

SEQ ID NO: 269642 - DNA, 20 bp, Artificial Sequence
  chemically synthesized
tccagaaaaattatttagtg

SEQ ID NO: 269643 - DNA, 20 bp, Artificial Sequence
  chemically synthesized
taaattccagaaaaattatt

SEQ ID NO: 269644 - DNA, 20 bp, Artificial Sequence
  chemically synthesized
gccacactaaataatttttc

SEQ ID NO: 269645 - DNA, 20 bp, Artificial Sequence
  chemically synthesized
atttaatatatattaaattc

SEQ ID NO: 269646 - DNA, 20 bp, Artificial Sequence
  chemically synthesized
aatatatattaaatataatt

SEQ ID NO: 269647 - DNA, 20 bp, Artificial Sequence
  chemically synthesized
aaatataattaagatacttt

SEQ ID NO: 269648 - DNA, 20 bp, Artificial Sequence
  chemically synthesized
atagtatcagttttatctta

SEQ ID NO: 269649 - DNA, 20 bp, Artificial Sequence
  chemically synthesized
tgactatagttaaatagtat

SEQ ID NO: 269650 - DNA, 20 bp, Artificial Sequence
  chemically synthesized
gtacattgactatagttaaa

SEQ ID NO: 269651 - DNA, 20 bp, Artificial Sequence
  chemically synthesized
aaactgatactatttaacta

SEQ ID NO: 269652 - DNA, 20 bp, Artificial Sequence
  chemically synthesized
aatttcaagtacattgacta

SEQ ID NO: 269653 - DNA, 20 bp, Artificial Sequence
  chemically synthesized
tccaaacaaagcataatttc

SEQ ID NO: 269654 - DNA, 20 bp, Artificial Sequence
  chemically synthesized
acttgaaattatgctttgtt

SEQ ID NO: 269655 - DNA, 20 bp, Artificial Sequence
  chemically synthesized
acctttagtttatccaaaca

SEQ ID NO: 269656 - DNA, 20 bp, Artificial Sequence
  chemically synthesized
tgctttgtttggataaacta

SEQ ID NO: 269657 - DNA, 20 bp, Artificial Sequence
  chemically synthesized
gctttgtttggataaactaa

SEQ ID NO: 269658 - DNA, 20 bp, Artificial Sequence
  chemically synthesized
tgaagtgattttttgacctt

SEQ ID NO: 269659 - DNA, 20 bp, Artificial Sequence
  chemically synthesized
aggtcaaaaaatcacttcat

SEQ ID NO: 269660 - DNA, 20 bp, Artificial Sequence
  chemically synthesized
aaaaatgtcaattactcatg

SEQ ID NO: 269661 - DNA, 20 bp, Artificial Sequence
  chemically synthesized
tgtatttgaatatttgaaac

SEQ ID NO: 269662 - DNA, 20 bp, Artificial Sequence
  chemically synthesized
tatgaaagtatttgaacatc

SEQ ID NO: 269663 - DNA, 20 bp, Artificial Sequence
  chemically synthesized
ttatatttattttcgtatga

SEQ ID NO: 269664 - DNA, 20 bp, Artificial Sequence
  chemically synthesized
gaaaataaatataatgttct

SEQ ID NO: 269665 - DNA, 20 bp, Artificial Sequence
  chemically synthesized
aaaataaatataatgttctt

SEQ ID NO: 269666 - DNA, 20 bp, Artificial Sequence
  chemically synthesized
atataatgttcttgggtcaa

SEQ ID NO: 269667 - DNA, 20 bp, Artificial Sequence
  chemically synthesized
tctcccagttctgttgaccc

SEQ ID NO: 269668 - DNA, 20 bp, Artificial Sequence
  chemically synthesized
tgttcttgggtcaacagaac

SEQ ID NO: 269669 - DNA, 20 bp, Artificial Sequence
  chemically synthesized
gttcttgggtcaacagaact

SEQ ID NO: 269670 - DNA, 20 bp, Artificial Sequence
  chemically synthesized
tcttgggtcaacagaactgg

SEQ ID NO: 269671 - DNA, 20 bp, Artificial Sequence
  chemically synthesized
tatatctgctgaatttctcc

SEQ ID NO: 269672 - DNA, 20 bp, Artificial Sequence
  chemically synthesized
caacagaactgggagaaatt

SEQ ID NO: 269673 - DNA, 20 bp, Artificial Sequence
  chemically synthesized
cagaactgggagaaattcag

SEQ ID NO: 269674 - DNA, 20 bp, Artificial Sequence
  chemically synthesized
ttattattttaaaaaatttt

SEQ ID NO: 269675 - DNA, 20 bp, Artificial Sequence
  chemically synthesized
aattttttaaaataataaaa

SEQ ID NO: 269676 - DNA, 20 bp, Artificial Sequence
  chemically synthesized
aataaaaaagaaattgactc

SEQ ID NO: 269677 - DNA, 20 bp, Artificial Sequence
  chemically synthesized
gcagcaaatttgaatatcta

SEQ ID NO: 269678 - DNA, 20 bp, Artificial Sequence
  chemically synthesized
ctgcagcaaatttgaatatc

SEQ ID NO: 269679 - DNA, 20 bp, Artificial Sequence
  chemically synthesized
ctagatattcaaatttgctg

SEQ ID NO: 269680 - DNA, 20 bp, Artificial Sequence
  chemically synthesized
aagtatttggaatgtgactg

SEQ ID NO: 269681 - DNA, 20 bp, Artificial Sequence
  chemically synthesized
gcagtcacattccaaatact

SEQ ID NO: 269682 - DNA, 20 bp, Artificial Sequence
  chemically synthesized
tgccgatcattccaagtatt

SEQ ID NO: 269683 - DNA, 20 bp, Artificial Sequence
  chemically synthesized
atgtagttgccgatcattcc

SEQ ID NO: 269684 - DNA, 20 bp, Artificial Sequence
  chemically synthesized
ttccaaatacttggaatgat

SEQ ID NO: 269685 - DNA, 20 bp, Artificial Sequence
  chemically synthesized
taaatgcaatacattaaatg

SEQ ID NO: 269686 - DNA, 20 bp, Artificial Sequence
  chemically synthesized
gcatttaaatgaatttaatt

SEQ ID NO: 269687 - DNA, 20 bp, Artificial Sequence
  chemically synthesized
gtgacatttatcttttgaaa

SEQ ID NO: 269688 - DNA, 20 bp, Artificial Sequence
  chemically synthesized
agtttcatctgctgtttcaa

SEQ ID NO: 269689 - DNA, 20 bp, Artificial Sequence
  chemically synthesized
acatttatcttttgaaacag

SEQ ID NO: 269690 - DNA, 20 bp, Artificial Sequence
  chemically synthesized
gaaacagcagatgaaactta

SEQ ID NO: 269691 - DNA, 20 bp, Artificial Sequence
  chemically synthesized
gagagcttaattcaagctat

SEQ ID NO: 269692 - DNA, 20 bp, Artificial Sequence
  chemically synthesized
tgaaacttatagcttgaatt

SEQ ID NO: 269693 - DNA, 20 bp, Artificial Sequence
  chemically synthesized
gtaggtggagagcttaattc

SEQ ID NO: 269694 - DNA, 20 bp, Artificial Sequence
  chemically synthesized
atggtttcttggtaggtgga

SEQ ID NO: 269695 - DNA, 20 bp, Artificial Sequence
  chemically synthesized
tcatggtttcttggtaggtg

SEQ ID NO: 269696 - DNA, 20 bp, Artificial Sequence
  chemically synthesized
aattaagctctccacctacc

SEQ ID NO: 269697 - DNA, 20 bp, Artificial Sequence
  chemically synthesized
tctcatggtttcttggtagg

SEQ ID NO: 269698 - DNA, 20 bp, Artificial Sequence
  chemically synthesized
atttctcatggtttcttggt

SEQ ID NO: 269699 - DNA, 20 bp, Artificial Sequence
  chemically synthesized
catttctcatggtttcttgg

SEQ ID NO: 269700 - DNA, 20 bp, Artificial Sequence
  chemically synthesized
tctcatttctcatggtttct

SEQ ID NO: 269701 - DNA, 20 bp, Artificial Sequence
  chemically synthesized
tccacctaccaagaaaccat

SEQ ID NO: 269702 - DNA, 20 bp, Artificial Sequence
  chemically synthesized
gagtacattctcatttctca

SEQ ID NO: 269703 - DNA, 20 bp, Artificial Sequence
  chemically synthesized
accaagaaaccatgagaaat

SEQ ID NO: 269704 - DNA, 20 bp, Artificial Sequence
  chemically synthesized
agaaatgagaatgtactcaa

SEQ ID NO: 269705 - DNA, 20 bp, Artificial Sequence
  chemically synthesized
tatgaaaccccgtgactatt

SEQ ID NO: 269706 - DNA, 20 bp, Artificial Sequence
  chemically synthesized
gagaatgtactcaatagtca

SEQ ID NO: 269707 - DNA, 20 bp, Artificial Sequence
  chemically synthesized
agaatgtactcaatagtcac

SEQ ID NO: 269708 - DNA, 20 bp, Artificial Sequence
  chemically synthesized
gaatgtactcaatagtcacg

SEQ ID NO: 269709 - DNA, 20 bp, Artificial Sequence
  chemically synthesized
agtcacggggtttcatatat

SEQ ID NO: 269710 - DNA, 20 bp, Artificial Sequence
  chemically synthesized
tcacggggtttcatatatga

SEQ ID NO: 269711 - DNA, 20 bp, Artificial Sequence
  chemically synthesized
tgaattttatgttaaaatat

SEQ ID NO: 269712 - DNA, 20 bp, Artificial Sequence
  chemically synthesized
atgattatcataaatgtgac

SEQ ID NO: 269713 - DNA, 20 bp, Artificial Sequence
  chemically synthesized
tatcataaatgtgactggct

SEQ ID NO: 269714 - DNA, 20 bp, Artificial Sequence
  chemically synthesized
tatgccctgcagatctaagc

SEQ ID NO: 269715 - DNA, 20 bp, Artificial Sequence
  chemically synthesized
atgtgactggcttagatctg

SEQ ID NO: 269716 - DNA, 20 bp, Artificial Sequence
  chemically synthesized
aatatatgccctgcagatct

SEQ ID NO: 269717 - DNA, 20 bp, Artificial Sequence
  chemically synthesized
tgtgactggcttagatctgc

SEQ ID NO: 269718 - DNA, 20 bp, Artificial Sequence
  chemically synthesized
gtgactggcttagatctgca

SEQ ID NO: 269719 - DNA, 20 bp, Artificial Sequence
  chemically synthesized
ataaaagaatatatgccctg

SEQ ID NO: 269720 - DNA, 20 bp, Artificial Sequence
  chemically synthesized
tttaaaaataacaatcataa

SEQ ID NO: 269721 - DNA, 20 bp, Artificial Sequence
  chemically synthesized
ttttatgattgttattttta

SEQ ID NO: 269722 - DNA, 20 bp, Artificial Sequence
  chemically synthesized
gttatttttaaagaaataat

SEQ ID NO: 269723 - DNA, 20 bp, Artificial Sequence
  chemically synthesized
tttttaccaatttatttgga

SEQ ID NO: 269724 - DNA, 20 bp, Artificial Sequence
  chemically synthesized
ttttttaccaatttatttgg

SEQ ID NO: 269725 - DNA, 20 bp, Artificial Sequence
  chemically synthesized
tgagaaccttccaaataaat

SEQ ID NO: 269726 - DNA, 20 bp, Artificial Sequence
  chemically synthesized
tttttttttaccaatttatt

SEQ ID NO: 269727 - DNA, 20 bp, Artificial Sequence
  chemically synthesized
aaattggtaaaaaaaaaaaa

SEQ ID NO: 269728 - DNA, 20 bp, Artificial Sequence
  chemically synthesized
aaaaaaaaagttctgtaatt

SEQ ID NO: 269729 - DNA, 20 bp, Artificial Sequence
  chemically synthesized
attcatttgcatctgaatta

SEQ ID NO: 269730 - DNA, 20 bp, Artificial Sequence
  chemically synthesized
aatctcttagttgtcaaata

SEQ ID NO: 269731 - DNA, 20 bp, Artificial Sequence
  chemically synthesized
atatactttatttgacaact

SEQ ID NO: 269732 - DNA, 20 bp, Artificial Sequence
  chemically synthesized
atactttatttgacaactaa

SEQ ID NO: 269733 - DNA, 20 bp, Artificial Sequence
  chemically synthesized
tgacatactctaaaatctct

SEQ ID NO: 269734 - DNA, 20 bp, Artificial Sequence
  chemically synthesized
atttgacaactaagagattt

SEQ ID NO: 269735 - DNA, 20 bp, Artificial Sequence
  chemically synthesized
ttgacaactaagagatttta

SEQ ID NO: 269736 - DNA, 20 bp, Artificial Sequence
  chemically synthesized
attttagagtatgtcattaa

SEQ ID NO: 269737 - DNA, 20 bp, Artificial Sequence
  chemically synthesized
agagtatgtcattaacagct

SEQ ID NO: 269738 - DNA, 20 bp, Artificial Sequence
  chemically synthesized
tctagatcttttcaaacact

SEQ ID NO: 269739 - DNA, 20 bp, Artificial Sequence
  chemically synthesized
ttaacagcttagtgtttgaa

SEQ ID NO: 269740 - DNA, 20 bp, Artificial Sequence
  chemically synthesized
gcttagtgtttgaaaagatc

SEQ ID NO: 269741 - DNA, 20 bp, Artificial Sequence
  chemically synthesized
agtgtttgaaaagatctaga

SEQ ID NO: 269742 - DNA, 20 bp, Artificial Sequence
  chemically synthesized
tgtttgaaaagatctagata

SEQ ID NO: 269743 - DNA, 20 bp, Artificial Sequence
  chemically synthesized
agataatttatcactctatc

SEQ ID NO: 269744 - DNA, 20 bp, Artificial Sequence
  chemically synthesized
ttttctttctttatagaata

SEQ ID NO: 269745 - DNA, 20 bp, Artificial Sequence
  chemically synthesized
taaattatctttattctata

SEQ ID NO: 269746 - DNA, 20 bp, Artificial Sequence
  chemically synthesized
ttatctttattctataaaga

SEQ ID NO: 269747 - DNA, 20 bp, Artificial Sequence
  chemically synthesized
gcatttattttctttcttta

SEQ ID NO: 269748 - DNA, 20 bp, Artificial Sequence
  chemically synthesized
taaagaaagaaaataaatgc

SEQ ID NO: 269749 - DNA, 20 bp, Artificial Sequence
  chemically synthesized
aaaataaatgccagttttct

SEQ ID NO: 269750 - DNA, 20 bp, Artificial Sequence
  chemically synthesized
aaaaaaaaagcttagaaaac

SEQ ID NO: 269751 - DNA, 20 bp, Artificial Sequence
  chemically synthesized
agtaggaaaaaaaaaaagct

SEQ ID NO: 269752 - DNA, 20 bp, Artificial Sequence
  chemically synthesized
gatctagtaggaaaaaaaaa

SEQ ID NO: 269753 - DNA, 20 bp, Artificial Sequence
  chemically synthesized
aagctttttttttttcctac

SEQ ID NO: 269754 - DNA, 20 bp, Artificial Sequence
  chemically synthesized
aagctactgtgagatctagt

SEQ ID NO: 269755 - DNA, 20 bp, Artificial Sequence
  chemically synthesized
aaagctactgtgagatctag

SEQ ID NO: 269756 - DNA, 20 bp, Artificial Sequence
  chemically synthesized
ttttttcctactagatctca

SEQ ID NO: 269757 - DNA, 20 bp, Artificial Sequence
  chemically synthesized
agcaaagctactgtgagatc

SEQ ID NO: 269758 - DNA, 20 bp, Artificial Sequence
  chemically synthesized
tttcctactagatctcacag

SEQ ID NO: 269759 - DNA, 20 bp, Artificial Sequence
  chemically synthesized
tcaaggagcaaagctactgt

SEQ ID NO: 269760 - DNA, 20 bp, Artificial Sequence
  chemically synthesized
tttcataacgtcaaggagca

SEQ ID NO: 269761 - DNA, 20 bp, Artificial Sequence
  chemically synthesized
gtatttttcataacgtcaag

SEQ ID NO: 269762 - DNA, 20 bp, Artificial Sequence
  chemically synthesized
aagtatttttcataacgtca

SEQ ID NO: 269763 - DNA, 20 bp, Artificial Sequence
  chemically synthesized
aaagtatttttcataacgtc

SEQ ID NO: 269764 - DNA, 20 bp, Artificial Sequence
  chemically synthesized
acgttatgaaaaatactttc

SEQ ID NO: 269765 - DNA, 20 bp, Artificial Sequence
  chemically synthesized
cgttatgaaaaatactttcc

SEQ ID NO: 269766 - DNA, 20 bp, Artificial Sequence
  chemically synthesized
tatgaaaaatactttccagg

SEQ ID NO: 269767 - DNA, 20 bp, Artificial Sequence
  chemically synthesized
gcttgttgaatctgcctgga

SEQ ID NO: 269768 - DNA, 20 bp, Artificial Sequence
  chemically synthesized
gtctgcttgttgaatctgcc

SEQ ID NO: 269769 - DNA, 20 bp, Artificial Sequence
  chemically synthesized
actttccaggcagattcaac

SEQ ID NO: 269770 - DNA, 20 bp, Artificial Sequence
  chemically synthesized
ttccaggcagattcaacaag

SEQ ID NO: 269771 - DNA, 20 bp, Artificial Sequence
  chemically synthesized
tcaacaagcagacaattctc

SEQ ID NO: 269772 - DNA, 20 bp, Artificial Sequence
  chemically synthesized
tagaaggcttgaatagtctg

SEQ ID NO: 269773 - DNA, 20 bp, Artificial Sequence
  chemically synthesized
tatagaaggcttgaatagtc

SEQ ID NO: 269774 - DNA, 20 bp, Artificial Sequence
  chemically synthesized
gacaattctccagactattc

SEQ ID NO: 269775 - DNA, 20 bp, Artificial Sequence
  chemically synthesized
tctcatatagaaggcttgaa

SEQ ID NO: 269776 - DNA, 20 bp, Artificial Sequence
  chemically synthesized
actattcaagccttctatat

SEQ ID NO: 269777 - DNA, 20 bp, Artificial Sequence
  chemically synthesized
ggttatccttctcatataga

SEQ ID NO: 269778 - DNA, 20 bp, Artificial Sequence
  chemically synthesized
aggttatccttctcatatag

SEQ ID NO: 269779 - DNA, 20 bp, Artificial Sequence
  chemically synthesized
attcaagccttctatatgag

SEQ ID NO: 269780 - DNA, 20 bp, Artificial Sequence
  chemically synthesized
ttcaagccttctatatgaga

SEQ ID NO: 269781 - DNA, 20 bp, Artificial Sequence
  chemically synthesized
tctaggttatccttctcata

SEQ ID NO: 269782 - DNA, 20 bp, Artificial Sequence
  chemically synthesized
tctatatgagaaggataacc

SEQ ID NO: 269783 - DNA, 20 bp, Artificial Sequence
  chemically synthesized
tgacctttgcagaggtttct

SEQ ID NO: 269784 - DNA, 20 bp, Artificial Sequence
  chemically synthesized
atgacctttgcagaggtttc

SEQ ID NO: 269785 - DNA, 20 bp, Artificial Sequence
  chemically synthesized
ataacctagaaacctctgca

SEQ ID NO: 269786 - DNA, 20 bp, Artificial Sequence
  chemically synthesized
taacctagaaacctctgcaa

SEQ ID NO: 269787 - DNA, 20 bp, Artificial Sequence
  chemically synthesized
taaggtaatgacctttgcag

SEQ ID NO: 269788 - DNA, 20 bp, Artificial Sequence
  chemically synthesized
ataaggtaatgacctttgca

SEQ ID NO: 269789 - DNA, 20 bp, Artificial Sequence
  chemically synthesized
ttataaggtaatgacctttg

SEQ ID NO: 269790 - DNA, 20 bp, Artificial Sequence
  chemically synthesized
gaaatcattcaaatgttata

SEQ ID NO: 269791 - DNA, 20 bp, Artificial Sequence
  chemically synthesized
tgaaatcattcaaatgttat

SEQ ID NO: 269792 - DNA, 20 bp, Artificial Sequence
  chemically synthesized
ataacatttgaatgatttca

SEQ ID NO: 269793 - DNA, 20 bp, Artificial Sequence
  chemically synthesized
catttgaatgatttcatggt

SEQ ID NO: 269794 - DNA, 20 bp, Artificial Sequence
  chemically synthesized
atttgaatgatttcatggtg

SEQ ID NO: 269795 - DNA, 20 bp, Artificial Sequence
  chemically synthesized
tacttgaggtatttttgcat

SEQ ID NO: 269796 - DNA, 20 bp, Artificial Sequence
  chemically synthesized
ggctaatgcaaaaatacctc

SEQ ID NO: 269797 - DNA, 20 bp, Artificial Sequence
  chemically synthesized
tcattcaaacatattacttg

SEQ ID NO: 269798 - DNA, 20 bp, Artificial Sequence
  chemically synthesized
atcattcaaacatattactt

SEQ ID NO: 269799 - DNA, 20 bp, Artificial Sequence
  chemically synthesized
aagtaatatgtttgaatgat

SEQ ID NO: 269800 - DNA, 20 bp, Artificial Sequence
  chemically synthesized
tttgaatgataagaaaaaat

SEQ ID NO: 269801 - DNA, 20 bp, Artificial Sequence
  chemically synthesized
ttgaatgataagaaaaaata

SEQ ID NO: 269802 - DNA, 20 bp, Artificial Sequence
  chemically synthesized
agaaaaaataaggctaatgt

SEQ ID NO: 269803 - DNA, 20 bp, Artificial Sequence
  chemically synthesized
atacaggttaaaactcacat

SEQ ID NO: 269804 - DNA, 20 bp, Artificial Sequence
  chemically synthesized
aaggaagatacagtatatac

SEQ ID NO: 269805 - DNA, 20 bp, Artificial Sequence
  chemically synthesized
caaggaagatacagtatata

SEQ ID NO: 269806 - DNA, 20 bp, Artificial Sequence
  chemically synthesized
ttactatagcaaggaagata

SEQ ID NO: 269807 - DNA, 20 bp, Artificial Sequence
  chemically synthesized
atgagattactatagcaagg

SEQ ID NO: 269808 - DNA, 20 bp, Artificial Sequence
  chemically synthesized
atactgtatcttccttgcta

SEQ ID NO: 269809 - DNA, 20 bp, Artificial Sequence
  chemically synthesized
tacatgagattactatagca

SEQ ID NO: 269810 - DNA, 20 bp, Artificial Sequence
  chemically synthesized
atacatgagattactatagc

SEQ ID NO: 269811 - DNA, 20 bp, Artificial Sequence
  chemically synthesized
gatcatacatgagattacta

SEQ ID NO: 269812 - DNA, 20 bp, Artificial Sequence
  chemically synthesized
agttattcaggatcatacat

SEQ ID NO: 269813 - DNA, 20 bp, Artificial Sequence
  chemically synthesized
atattgaattatagttattc

SEQ ID NO: 269814 - DNA, 20 bp, Artificial Sequence
  chemically synthesized
gatattgaattatagttatt

SEQ ID NO: 269815 - DNA, 20 bp, Artificial Sequence
  chemically synthesized
ttagataagatattgaatta

SEQ ID NO: 269816 - DNA, 20 bp, Artificial Sequence
  chemically synthesized
gaataaatgtaatgttagat

SEQ ID NO: 269817 - DNA, 20 bp, Artificial Sequence
  chemically synthesized
tttcagaataaatgtaatgt

SEQ ID NO: 269818 - DNA, 20 bp, Artificial Sequence
  chemically synthesized
taacattacatttattctga

SEQ ID NO: 269819 - DNA, 20 bp, Artificial Sequence
  chemically synthesized
acattacatttattctgaaa

SEQ ID NO: 269820 - DNA, 20 bp, Artificial Sequence
  chemically synthesized
ttacatttattctgaaagag

SEQ ID NO: 269821 - DNA, 20 bp, Artificial Sequence
  chemically synthesized
aaattgtttttcttctcttt

SEQ ID NO: 269822 - DNA, 20 bp, Artificial Sequence
  chemically synthesized
atatttccaaataaatagta

SEQ ID NO: 269823 - DNA, 20 bp, Artificial Sequence
  chemically synthesized
aatatttccaaataaatagt

SEQ ID NO: 269824 - DNA, 20 bp, Artificial Sequence
  chemically synthesized
aaatatttccaaataaatag

SEQ ID NO: 269825 - DNA, 20 bp, Artificial Sequence
  chemically synthesized
ttaattccctactatttatt

SEQ ID NO: 269826 - DNA, 20 bp, Artificial Sequence
  chemically synthesized
ataaaatatttccaaataaa

SEQ ID NO: 269827 - DNA, 20 bp, Artificial Sequence
  chemically synthesized
atgtagattcagagaacaag

SEQ ID NO: 269828 - DNA, 20 bp, Artificial Sequence
  chemically synthesized
tttatgtagattcagagaac

SEQ ID NO: 269829 - DNA, 20 bp, Artificial Sequence
  chemically synthesized
actgtctttatgtagattca

SEQ ID NO: 269830 - DNA, 20 bp, Artificial Sequence
  chemically synthesized
aaactgtctttatgtagatt

SEQ ID NO: 269831 - DNA, 20 bp, Artificial Sequence
  chemically synthesized
ttgttctctgaatctacata

SEQ ID NO: 269832 - DNA, 20 bp, Artificial Sequence
  chemically synthesized
aactgaaaactgtctttatg

SEQ ID NO: 269833 - DNA, 20 bp, Artificial Sequence
  chemically synthesized
tctctgaatctacataaaga

SEQ ID NO: 269834 - DNA, 20 bp, Artificial Sequence
  chemically synthesized
atctacataaagacagtttt

SEQ ID NO: 269835 - DNA, 20 bp, Artificial Sequence
  chemically synthesized
cataaagacagttttcagtt

SEQ ID NO: 269836 - DNA, 20 bp, Artificial Sequence
  chemically synthesized
ataaagacagttttcagttt

SEQ ID NO: 269837 - DNA, 20 bp, Artificial Sequence
  chemically synthesized
aaacttacaatcgtataaat

SEQ ID NO: 269838 - DNA, 20 bp, Artificial Sequence
  chemically synthesized
ggtctcatttatacgattgt

SEQ ID NO: 269839 - DNA, 20 bp, Artificial Sequence
  chemically synthesized
acgattgtaagtttttacat

SEQ ID NO: 269840 - DNA, 20 bp, Artificial Sequence
  chemically synthesized
cgattgtaagtttttacata

SEQ ID NO: 269841 - DNA, 20 bp, Artificial Sequence
  chemically synthesized
tatccagattattcaaagtt

SEQ ID NO: 269842 - DNA, 20 bp, Artificial Sequence
  chemically synthesized
ctatccagattattcaaagt

SEQ ID NO: 269843 - DNA, 20 bp, Artificial Sequence
  chemically synthesized
gtggctatccagattattca

SEQ ID NO: 269844 - DNA, 20 bp, Artificial Sequence
  chemically synthesized
tttcccaactttgaataatc

SEQ ID NO: 269845 - DNA, 20 bp, Artificial Sequence
  chemically synthesized
ccaactttgaataatctgga

SEQ ID NO: 269846 - DNA, 20 bp, Artificial Sequence
  chemically synthesized
tttaattcaatgtggctatc

SEQ ID NO: 269847 - DNA, 20 bp, Artificial Sequence
  chemically synthesized
actttatttttaattcaatg

SEQ ID NO: 269848 - DNA, 20 bp, Artificial Sequence
  chemically synthesized
gccacattgaattaaaaata

SEQ ID NO: 269849 - DNA, 20 bp, Artificial Sequence
  chemically synthesized
gtataaacgtcttatacatc

SEQ ID NO: 269850 - DNA, 20 bp, Artificial Sequence
  chemically synthesized
accaaattaactagatgtat

SEQ ID NO: 269851 - DNA, 20 bp, Artificial Sequence
  chemically synthesized
tcttatacatctagttaatt

SEQ ID NO: 269852 - DNA, 20 bp, Artificial Sequence
  chemically synthesized
tttaaagttaccaaattaac

SEQ ID NO: 269853 - DNA, 20 bp, Artificial Sequence
  chemically synthesized
tacacccacttaatgtttta

SEQ ID NO: 269854 - DNA, 20 bp, Artificial Sequence
  chemically synthesized
tttggtaactttaaaacatt

SEQ ID NO: 269855 - DNA, 20 bp, Artificial Sequence
  chemically synthesized
ggtaactttaaaacattaag

SEQ ID NO: 269856 - DNA, 20 bp, Artificial Sequence
  chemically synthesized
gtaactttaaaacattaagt

SEQ ID NO: 269857 - DNA, 20 bp, Artificial Sequence
  chemically synthesized
aaacattaagtgggtgtaaa

SEQ ID NO: 269858 - DNA, 20 bp, Artificial Sequence
  chemically synthesized
tgggtgtaaatggcctaaca

SEQ ID NO: 269859 - DNA, 20 bp, Artificial Sequence
  chemically synthesized
gtgtaaatggcctaacacag

SEQ ID NO: 269860 - DNA, 20 bp, Artificial Sequence
  chemically synthesized
tcaaaatttgccactgtgtt

SEQ ID NO: 269861 - DNA, 20 bp, Artificial Sequence
  chemically synthesized
ctcaaaatttgccactgtgt

SEQ ID NO: 269862 - DNA, 20 bp, Artificial Sequence
  chemically synthesized
ctaacacagtggcaaatttt

SEQ ID NO: 269863 - DNA, 20 bp, Artificial Sequence
  chemically synthesized
taacacagtggcaaattttg

SEQ ID NO: 269864 - DNA, 20 bp, Artificial Sequence
  chemically synthesized
gtaaaacatgttatcaatat

SEQ ID NO: 269865 - DNA, 20 bp, Artificial Sequence
  chemically synthesized
gtgtgttgatataaagaaaa

SEQ ID NO: 269866 - DNA, 20 bp, Artificial Sequence
  chemically synthesized
cctgaaagtgtgttgatata

SEQ ID NO: 269867 - DNA, 20 bp, Artificial Sequence
  chemically synthesized
tctttatatcaacacacttt

SEQ ID NO: 269868 - DNA, 20 bp, Artificial Sequence
  chemically synthesized
ctttatatcaacacactttc

SEQ ID NO: 269869 - DNA, 20 bp, Artificial Sequence
  chemically synthesized
ttcattaccagattacctga

SEQ ID NO: 269870 - DNA, 20 bp, Artificial Sequence
  chemically synthesized
caacacactttcaggtaatc

SEQ ID NO: 269871 - DNA, 20 bp, Artificial Sequence
  chemically synthesized
ttttactgtttattcattac

SEQ ID NO: 269872 - DNA, 20 bp, Artificial Sequence
  chemically synthesized
gtaatctggtaatgaataaa

SEQ ID NO: 269873 - DNA, 20 bp, Artificial Sequence
  chemically synthesized
acagtaaaaaaaaaaatact

SEQ ID NO: 269874 - DNA, 20 bp, Artificial Sequence
  chemically synthesized
aaaaaaaaatactaagctat

SEQ ID NO: 269875 - DNA, 20 bp, Artificial Sequence
  chemically synthesized
tagtcaagagactcatagct

SEQ ID NO: 269876 - DNA, 20 bp, Artificial Sequence
  chemically synthesized
gaacttagtcaagagactca

SEQ ID NO: 269877 - DNA, 20 bp, Artificial Sequence
  chemically synthesized
aagctatgagtctcttgact

SEQ ID NO: 269878 - DNA, 20 bp, Artificial Sequence
  chemically synthesized
gctgcttagaacttagtcaa

SEQ ID NO: 269879 - DNA, 20 bp, Artificial Sequence
  chemically synthesized
atgctgcttagaacttagtc

SEQ ID NO: 269880 - DNA, 20 bp, Artificial Sequence
  chemically synthesized
gagtctcttgactaagttct

SEQ ID NO: 269881 - DNA, 20 bp, Artificial Sequence
  chemically synthesized
atttcatgctgcttagaact

SEQ ID NO: 269882 - DNA, 20 bp, Artificial Sequence
  chemically synthesized
tctcttgactaagttctaag

SEQ ID NO: 269883 - DNA, 20 bp, Artificial Sequence
  chemically synthesized
gccaatcatttcatgctgct

SEQ ID NO: 269884 - DNA, 20 bp, Artificial Sequence
  chemically synthesized
tctaagcagcatgaaatgat

SEQ ID NO: 269885 - DNA, 20 bp, Artificial Sequence
  chemically synthesized
agcatgaaatgattggccat

SEQ ID NO: 269886 - DNA, 20 bp, Artificial Sequence
  chemically synthesized
catgaaatgattggccatca

SEQ ID NO: 269887 - DNA, 20 bp, Artificial Sequence
  chemically synthesized
aaatgattggccatcagaga

SEQ ID NO: 269888 - DNA, 20 bp, Artificial Sequence
  chemically synthesized
aattcttgccctttctctga

SEQ ID NO: 269889 - DNA, 20 bp, Artificial Sequence
  chemically synthesized
aatgattggccatcagagaa

SEQ ID NO: 269890 - DNA, 20 bp, Artificial Sequence
  chemically synthesized
atgattggccatcagagaaa

SEQ ID NO: 269891 - DNA, 20 bp, Artificial Sequence
  chemically synthesized
ttggccatcagagaaagggc

SEQ ID NO: 269892 - DNA, 20 bp, Artificial Sequence
  chemically synthesized
gagaaagggcaagaatttaa

SEQ ID NO: 269893 - DNA, 20 bp, Artificial Sequence
  chemically synthesized
aatttaacggctaatgatta

SEQ ID NO: 269894 - DNA, 20 bp, Artificial Sequence
  chemically synthesized
acagcgactcctgtaatcat

SEQ ID NO: 269895 - DNA, 20 bp, Artificial Sequence
  chemically synthesized
atttaacggctaatgattac

SEQ ID NO: 269896 - DNA, 20 bp, Artificial Sequence
  chemically synthesized
ttaacggctaatgattacag

SEQ ID NO: 269897 - DNA, 20 bp, Artificial Sequence
  chemically synthesized
acaggagtcgctgtgtcatt

SEQ ID NO: 269898 - DNA, 20 bp, Artificial Sequence
  chemically synthesized
atttccatcaccaaatgaca

SEQ ID NO: 269899 - DNA, 20 bp, Artificial Sequence
  chemically synthesized
gtcgctgtgtcatttggtga

SEQ ID NO: 269900 - DNA, 20 bp, Artificial Sequence
  chemically synthesized
tcatttggtgatggaaatga

SEQ ID NO: 269901 - DNA, 20 bp, Artificial Sequence
  chemically synthesized
tggaaatgatagcccctgca

SEQ ID NO: 269902 - DNA, 20 bp, Artificial Sequence
  chemically synthesized
atctcaaggtgtctatgcag

SEQ ID NO: 269903 - DNA, 20 bp, Artificial Sequence
  chemically synthesized
aatctcaaggtgtctatgca

SEQ ID NO: 269904 - DNA, 20 bp, Artificial Sequence
  chemically synthesized
gaatctcaaggtgtctatgc

SEQ ID NO: 269905 - DNA, 20 bp, Artificial Sequence
  chemically synthesized
agaatctcaaggtgtctatg

SEQ ID NO: 269906 - DNA, 20 bp, Artificial Sequence
  chemically synthesized
agcccctgcatagacacctt

SEQ ID NO: 269907 - DNA, 20 bp, Artificial Sequence
  chemically synthesized
gcatttcagaaagaatctca

SEQ ID NO: 269908 - DNA, 20 bp, Artificial Sequence
  chemically synthesized
cgcatttcagaaagaatctc

SEQ ID NO: 269909 - DNA, 20 bp, Artificial Sequence
  chemically synthesized
tgccaaagtcgcatttcaga

SEQ ID NO: 269910 - DNA, 20 bp, Artificial Sequence
  chemically synthesized
atattgccaaagtcgcattt

SEQ ID NO: 269911 - DNA, 20 bp, Artificial Sequence
  chemically synthesized
ttctttctgaaatgcgactt

SEQ ID NO: 269912 - DNA, 20 bp, Artificial Sequence
  chemically synthesized
gcaagattagcatattgcca

SEQ ID NO: 269913 - DNA, 20 bp, Artificial Sequence
  chemically synthesized
tggcaatatgctaatcttgc

SEQ ID NO: 269914 - DNA, 20 bp, Artificial Sequence
  chemically synthesized
ctggacaggacttgcaagat

SEQ ID NO: 269915 - DNA, 20 bp, Artificial Sequence
  chemically synthesized
ttgggctggacaggacttgc

SEQ ID NO: 269916 - DNA, 20 bp, Artificial Sequence
  chemically synthesized
ctaatcttgcaagtcctgtc

SEQ ID NO: 269917 - DNA, 20 bp, Artificial Sequence
  chemically synthesized
tgaagacagttgggctggac

SEQ ID NO: 269918 - DNA, 20 bp, Artificial Sequence
  chemically synthesized
ttgaagacagttgggctgga

SEQ ID NO: 269919 - DNA, 20 bp, Artificial Sequence
  chemically synthesized
gagattgaagacagttgggc

SEQ ID NO: 269920 - DNA, 20 bp, Artificial Sequence
  chemically synthesized
cacagagattgaagacagtt

SEQ ID NO: 269921 - DNA, 20 bp, Artificial Sequence
  chemically synthesized
acacagagattgaagacagt

SEQ ID NO: 269922 - DNA, 20 bp, Artificial Sequence
  chemically synthesized
aaggacacagagattgaaga

SEQ ID NO: 269923 - DNA, 20 bp, Artificial Sequence
  chemically synthesized
gggcaaggacacagagattg

SEQ ID NO: 269924 - DNA, 20 bp, Artificial Sequence
  chemically synthesized
atgaagagggcaaggacaca

SEQ ID NO: 269925 - DNA, 20 bp, Artificial Sequence
  chemically synthesized
ccatgaagagggcaaggaca

SEQ ID NO: 269926 - DNA, 20 bp, Artificial Sequence
  chemically synthesized
ccacagccatgaagagggca

SEQ ID NO: 269927 - DNA, 20 bp, Artificial Sequence
  chemically synthesized
cccacagccatgaagagggc

SEQ ID NO: 269928 - DNA, 20 bp, Artificial Sequence
  chemically synthesized
ctgtgtccttgccctcttca

SEQ ID NO: 269929 - DNA, 20 bp, Artificial Sequence
  chemically synthesized
gaatcccacagccatgaaga

SEQ ID NO: 269930 - DNA, 20 bp, Artificial Sequence
  chemically synthesized
tgaatcccacagccatgaag

SEQ ID NO: 269931 - DNA, 20 bp, Artificial Sequence
  chemically synthesized
atgaatcccacagccatgaa

SEQ ID NO: 269932 - DNA, 20 bp, Artificial Sequence
  chemically synthesized
agatgaatcccacagccatg

SEQ ID NO: 269933 - DNA, 20 bp, Artificial Sequence
  chemically synthesized
ccttgccctcttcatggctg

SEQ ID NO: 269934 - DNA, 20 bp, Artificial Sequence
  chemically synthesized
cttgccctcttcatggctgt

SEQ ID NO: 269935 - DNA, 20 bp, Artificial Sequence
  chemically synthesized
tactgcccagatgaatccca

SEQ ID NO: 269936 - DNA, 20 bp, Artificial Sequence
  chemically synthesized
tcatggctgtgggattcatc

SEQ ID NO: 269937 - DNA, 20 bp, Artificial Sequence
  chemically synthesized
catggctgtgggattcatct

SEQ ID NO: 269938 - DNA, 20 bp, Artificial Sequence
  chemically synthesized
ggctgtgggattcatctggg

SEQ ID NO: 269939 - DNA, 20 bp, Artificial Sequence
  chemically synthesized
tgggattcatctgggcagta

SEQ ID NO: 269940 - DNA, 20 bp, Artificial Sequence
  chemically synthesized
ttgcctaagaccatactgcc

SEQ ID NO: 269941 - DNA, 20 bp, Artificial Sequence
  chemically synthesized
tcatctgggcagtatggtct

SEQ ID NO: 269942 - DNA, 20 bp, Artificial Sequence
  chemically synthesized
catctgggcagtatggtctt

SEQ ID NO: 269943 - DNA, 20 bp, Artificial Sequence
  chemically synthesized
tgggcagtatggtcttaggc

SEQ ID NO: 269944 - DNA, 20 bp, Artificial Sequence
  chemically synthesized
tataatgtactggcttgcct

SEQ ID NO: 269945 - DNA, 20 bp, Artificial Sequence
  chemically synthesized
cagtatggtcttaggcaagc

SEQ ID NO: 269946 - DNA, 20 bp, Artificial Sequence
  chemically synthesized
gatgagatcctataatgtac

SEQ ID NO: 269947 - DNA, 20 bp, Artificial Sequence
  chemically synthesized
ttaggcaagccagtacatta

SEQ ID NO: 269948 - DNA, 20 bp, Artificial Sequence
  chemically synthesized
taggcaagccagtacattat

SEQ ID NO: 269949 - DNA, 20 bp, Artificial Sequence
  chemically synthesized
acattataggatctcatctc

SEQ ID NO: 269950 - DNA, 20 bp, Artificial Sequence
  chemically synthesized
ctgaaaattggtccagagat

SEQ ID NO: 269951 - DNA, 20 bp, Artificial Sequence
  chemically synthesized
ttagtctgaaaattggtcca

SEQ ID NO: 269952 - DNA, 20 bp, Artificial Sequence
  chemically synthesized
cattagtctgaaaattggtc

SEQ ID NO: 269953 - DNA, 20 bp, Artificial Sequence
  chemically synthesized
ctcatctctggaccaatttt

SEQ ID NO: 269954 - DNA, 20 bp, Artificial Sequence
  chemically synthesized
taggtcattagtctgaaaat

SEQ ID NO: 269955 - DNA, 20 bp, Artificial Sequence
  chemically synthesized
ttaagaaatacataggtcat

SEQ ID NO: 269956 - DNA, 20 bp, Artificial Sequence
  chemically synthesized
taagaccttaagaaatacat

SEQ ID NO: 269957 - DNA, 20 bp, Artificial Sequence
  chemically synthesized
ataagaccttaagaaataca

SEQ ID NO: 269958 - DNA, 20 bp, Artificial Sequence
  chemically synthesized
taatgacctatgtatttctt

SEQ ID NO: 269959 - DNA, 20 bp, Artificial Sequence
  chemically synthesized
aatgacctatgtatttctta

SEQ ID NO: 269960 - DNA, 20 bp, Artificial Sequence
  chemically synthesized
taaattatgaataagacctt

SEQ ID NO: 269961 - DNA, 20 bp, Artificial Sequence
  chemically synthesized
gagttcagtaaattatgaat

SEQ ID NO: 269962 - DNA, 20 bp, Artificial Sequence
  chemically synthesized
ttcataatttactgaactct

SEQ ID NO: 269963 - DNA, 20 bp, Artificial Sequence
  chemically synthesized
tcataatttactgaactcta

SEQ ID NO: 269964 - DNA, 20 bp, Artificial Sequence
  chemically synthesized
ccaaaagcttccttagagtt

SEQ ID NO: 269965 - DNA, 20 bp, Artificial Sequence
  chemically synthesized
taatttactgaactctaagg

SEQ ID NO: 269966 - DNA, 20 bp, Artificial Sequence
  chemically synthesized
tctctccaaaagcttcctta

SEQ ID NO: 269967 - DNA, 20 bp, Artificial Sequence
  chemically synthesized
agtctctccaaaagcttcct

SEQ ID NO: 269968 - DNA, 20 bp, Artificial Sequence
  chemically synthesized
ctgaactctaaggaagcttt

SEQ ID NO: 269969 - DNA, 20 bp, Artificial Sequence
  chemically synthesized
gaactctaaggaagcttttg

SEQ ID NO: 269970 - DNA, 20 bp, Artificial Sequence
  chemically synthesized
actctaaggaagcttttgga

SEQ ID NO: 269971 - DNA, 20 bp, Artificial Sequence
  chemically synthesized
tttagcaggagtctctccaa

SEQ ID NO: 269972 - DNA, 20 bp, Artificial Sequence
  chemically synthesized
ttttggagagactcctgcta

SEQ ID NO: 269973 - DNA, 20 bp, Artificial Sequence
  chemically synthesized
ccaatggtaagctttagcag

SEQ ID NO: 269974 - DNA, 20 bp, Artificial Sequence
  chemically synthesized
aaccaatggtaagctttagc

SEQ ID NO: 269975 - DNA, 20 bp, Artificial Sequence
  chemically synthesized
aaaccaatggtaagctttag

SEQ ID NO: 269976 - DNA, 20 bp, Artificial Sequence
  chemically synthesized
ataaaaccaatggtaagctt

SEQ ID NO: 269977 - DNA, 20 bp, Artificial Sequence
  chemically synthesized
ctcctgctaaagcttaccat

SEQ ID NO: 269978 - DNA, 20 bp, Artificial Sequence
  chemically synthesized
accatgataaaaccaatggt

SEQ ID NO: 269979 - DNA, 20 bp, Artificial Sequence
  chemically synthesized
caggaccatgataaaaccaa

SEQ ID NO: 269980 - DNA, 20 bp, Artificial Sequence
  chemically synthesized
gcttaccattggttttatca

SEQ ID NO: 269981 - DNA, 20 bp, Artificial Sequence
  chemically synthesized
ggttttatcatggtcctgaa

SEQ ID NO: 269982 - DNA, 20 bp, Artificial Sequence
  chemically synthesized
aaaattaatctgtgcttttc

SEQ ID NO: 269983 - DNA, 20 bp, Artificial Sequence
  chemically synthesized
tatcatggtcctgaaaagca

SEQ ID NO: 269984 - DNA, 20 bp, Artificial Sequence
  chemically synthesized
aaaaattaatctgtgctttt

SEQ ID NO: 269985 - DNA, 20 bp, Artificial Sequence
  chemically synthesized
aaaagcacagattaattttt

SEQ ID NO: 269986 - DNA, 20 bp, Artificial Sequence
  chemically synthesized
gcacagattaatttttaaga

SEQ ID NO: 269987 - DNA, 20 bp, Artificial Sequence
  chemically synthesized
cacagattaatttttaagaa

SEQ ID NO: 269988 - DNA, 20 bp, Artificial Sequence
  chemically synthesized
acagattaatttttaagaaa

SEQ ID NO: 269989 - DNA, 20 bp, Artificial Sequence
  chemically synthesized
gtattaacatgtagcaataa

SEQ ID NO: 269990 - DNA, 20 bp, Artificial Sequence
  chemically synthesized
tgtaaggaagtattaacatg

SEQ ID NO: 269991 - DNA, 20 bp, Artificial Sequence
  chemically synthesized
cataatatgattttgtaagg

SEQ ID NO: 269992 - DNA, 20 bp, Artificial Sequence
  chemically synthesized
acacataatatgattttgta

SEQ ID NO: 269993 - DNA, 20 bp, Artificial Sequence
  chemically synthesized
aacacataatatgattttgt

SEQ ID NO: 269994 - DNA, 20 bp, Artificial Sequence
  chemically synthesized
cgtatgttcaaaataacctt

SEQ ID NO: 269995 - DNA, 20 bp, Artificial Sequence
  chemically synthesized
ggtaaaacctatatcactga

SEQ ID NO: 269996 - DNA, 20 bp, Artificial Sequence
  chemically synthesized
aggtaaaacctatatcactg

SEQ ID NO: 269997 - DNA, 20 bp, Artificial Sequence
  chemically synthesized
caaaataaccttcagtgata

SEQ ID NO: 269998 - DNA, 20 bp, Artificial Sequence
  chemically synthesized
aaaataaccttcagtgatat

SEQ ID NO: 269999 - DNA, 20 bp, Artificial Sequence
  chemically synthesized
atataggttttacctttccc

SEQ ID NO: 270000 - DNA, 20 bp, Artificial Sequence
  chemically synthesized
tataggttttacctttcccc

SEQ ID NO: 270001 - DNA, 20 bp, Artificial Sequence
  chemically synthesized
ttctgaagttgcctggggaa

SEQ ID NO: 270002 - DNA, 20 bp, Artificial Sequence
  chemically synthesized
attctgaagttgcctgggga

SEQ ID NO: 270003 - DNA, 20 bp, Artificial Sequence
  chemically synthesized
ttggattctgaagttgcctg

SEQ ID NO: 270004 - DNA, 20 bp, Artificial Sequence
  chemically synthesized
tttggattctgaagttgcct

SEQ ID NO: 270005 - DNA, 20 bp, Artificial Sequence
  chemically synthesized
atttggattctgaagttgcc

SEQ ID NO: 270006 - DNA, 20 bp, Artificial Sequence
  chemically synthesized
tacctttccccaggcaactt

SEQ ID NO: 270007 - DNA, 20 bp, Artificial Sequence
  chemically synthesized
gcctagtaatttggattctg

SEQ ID NO: 270008 - DNA, 20 bp, Artificial Sequence
  chemically synthesized
aacttcagaatccaaattac

SEQ ID NO: 270009 - DNA, 20 bp, Artificial Sequence
  chemically synthesized
acttcagaatccaaattact

SEQ ID NO: 270010 - DNA, 20 bp, Artificial Sequence
  chemically synthesized
tgaaggaatgcctagtaatt

SEQ ID NO: 270011 - DNA, 20 bp, Artificial Sequence
  chemically synthesized
tcagcagttgaaggaatgcc

SEQ ID NO: 270012 - DNA, 20 bp, Artificial Sequence
  chemically synthesized
acaaagagatcagcagttga

SEQ ID NO: 270013 - DNA, 20 bp, Artificial Sequence
  chemically synthesized
gacaaagagatcagcagttg

SEQ ID NO: 270014 - DNA, 20 bp, Artificial Sequence
  chemically synthesized
ggaattgacaaagagatcag

SEQ ID NO: 270015 - DNA, 20 bp, Artificial Sequence
  chemically synthesized
tatggaattgacaaagagat

SEQ ID NO: 270016 - DNA, 20 bp, Artificial Sequence
  chemically synthesized
acagatatggaattgacaaa

SEQ ID NO: 270017 - DNA, 20 bp, Artificial Sequence
  chemically synthesized
ctacagatatggaattgaca

SEQ ID NO: 270018 - DNA, 20 bp, Artificial Sequence
  chemically synthesized
ctttgtcaattccatatctg

SEQ ID NO: 270019 - DNA, 20 bp, Artificial Sequence
  chemically synthesized
atggctggcagctacagata

SEQ ID NO: 270020 - DNA, 20 bp, Artificial Sequence
  chemically synthesized
aattccatatctgtagctgc

SEQ ID NO: 270021 - DNA, 20 bp, Artificial Sequence
  chemically synthesized
gacagaatggctggcagcta

SEQ ID NO: 270022 - DNA, 20 bp, Artificial Sequence
  chemically synthesized
tgtcttgacagaatggctgg

SEQ ID NO: 270023 - DNA, 20 bp, Artificial Sequence
  chemically synthesized
gaatgtcttgacagaatggc

SEQ ID NO: 270024 - DNA, 20 bp, Artificial Sequence
  chemically synthesized
tagctgccagccattctgtc

SEQ ID NO: 270025 - DNA, 20 bp, Artificial Sequence
  chemically synthesized
aaatgaatgtcttgacagaa

SEQ ID NO: 270026 - DNA, 20 bp, Artificial Sequence
  chemically synthesized
aaaggaaatgaatgtcttga

SEQ ID NO: 270027 - DNA, 20 bp, Artificial Sequence
  chemically synthesized
attgtcccgtaagatgcgaa

SEQ ID NO: 270028 - DNA, 20 bp, Artificial Sequence
  chemically synthesized
aattgtcccgtaagatgcga

SEQ ID NO: 270029 - DNA, 20 bp, Artificial Sequence
  chemically synthesized
tcatttcctttcgcatctta

SEQ ID NO: 270030 - DNA, 20 bp, Artificial Sequence
  chemically synthesized
catttcctttcgcatcttac

SEQ ID NO: 270031 - DNA, 20 bp, Artificial Sequence
  chemically synthesized
aatgcttgaaattgtcccgt

SEQ ID NO: 270032 - DNA, 20 bp, Artificial Sequence
  chemically synthesized
gcatcttacgggacaatttc

SEQ ID NO: 270033 - DNA, 20 bp, Artificial Sequence
  chemically synthesized
cagaaagaaagcaacagttg

SEQ ID NO: 270034 - DNA, 20 bp, Artificial Sequence
  chemically synthesized
aacagaaagaaagcaacagt

SEQ ID NO: 270035 - DNA, 20 bp, Artificial Sequence
  chemically synthesized
aggtaacagaaagaaagcaa

SEQ ID NO: 270036 - DNA, 20 bp, Artificial Sequence
  chemically synthesized
cttttcaggtaacagaaaga

SEQ ID NO: 270037 - DNA, 20 bp, Artificial Sequence
  chemically synthesized
aattcttttcaggtaacaga

SEQ ID NO: 270038 - DNA, 20 bp, Artificial Sequence
  chemically synthesized
ttataattcttttcaggtaa

SEQ ID NO: 270039 - DNA, 20 bp, Artificial Sequence
  chemically synthesized
ctttctttctgttacctgaa

SEQ ID NO: 270040 - DNA, 20 bp, Artificial Sequence
  chemically synthesized
atttcattataattcttttc

SEQ ID NO: 270041 - DNA, 20 bp, Artificial Sequence
  chemically synthesized
catttcattataattctttt

SEQ ID NO: 270042 - DNA, 20 bp, Artificial Sequence
  chemically synthesized
aattataatgaaatgtaatt

SEQ ID NO: 270043 - DNA, 20 bp, Artificial Sequence
  chemically synthesized
ataacgaaatttgaattaaa

SEQ ID NO: 270044 - DNA, 20 bp, Artificial Sequence
  chemically synthesized
ttataacgaaatttgaatta

SEQ ID NO: 270045 - DNA, 20 bp, Artificial Sequence
  chemically synthesized
tttcgttataaccacttatt

SEQ ID NO: 270046 - DNA, 20 bp, Artificial Sequence
  chemically synthesized
atataaaagttccaaataag

SEQ ID NO: 270047 - DNA, 20 bp, Artificial Sequence
  chemically synthesized
gaaatataaaagttccaaat

SEQ ID NO: 270048 - DNA, 20 bp, Artificial Sequence
  chemically synthesized
tttaaataacagaaatataa

SEQ ID NO: 270049 - DNA, 20 bp, Artificial Sequence
  chemically synthesized
aaaatagttattttaaataa

SEQ ID NO: 270050 - DNA, 20 bp, Artificial Sequence
  chemically synthesized
ttttaaaacgtgtaagaaaa

SEQ ID NO: 270051 - DNA, 20 bp, Artificial Sequence
  chemically synthesized
aatattattttaaaacgtgt

SEQ ID NO: 270052 - DNA, 20 bp, Artificial Sequence
  chemically synthesized
aatcatatattctgaatatt

SEQ ID NO: 270053 - DNA, 20 bp, Artificial Sequence
  chemically synthesized
ttttattcactcttaatatt

SEQ ID NO: 270054 - DNA, 20 bp, Artificial Sequence
  chemically synthesized
tcatatattctgaatattaa

SEQ ID NO: 270055 - DNA, 20 bp, Artificial Sequence
  chemically synthesized
aagagtgaataaaaactgtc

SEQ ID NO: 270056 - DNA, 20 bp, Artificial Sequence
  chemically synthesized
agagtgaataaaaactgtct

SEQ ID NO: 270057 - DNA, 20 bp, Artificial Sequence
  chemically synthesized
gagtgaataaaaactgtcta

SEQ ID NO: 270058 - DNA, 20 bp, Artificial Sequence
  chemically synthesized
tgaataaaaactgtctaggg

SEQ ID NO: 270059 - DNA, 20 bp, Artificial Sequence
  chemically synthesized
acgatgtcatctgccctaga

SEQ ID NO: 270060 - DNA, 20 bp, Artificial Sequence
  chemically synthesized
acaaacgatgtcatctgccc

SEQ ID NO: 270061 - DNA, 20 bp, Artificial Sequence
  chemically synthesized
agatgacatcgtttgtccaa

SEQ ID NO: 270062 - DNA, 20 bp, Artificial Sequence
  chemically synthesized
gacatcgtttgtccaaaaga

SEQ ID NO: 270063 - DNA, 20 bp, Artificial Sequence
  chemically synthesized
acatcgtttgtccaaaagat

SEQ ID NO: 270064 - DNA, 20 bp, Artificial Sequence
  chemically synthesized
catcgtttgtccaaaagata

SEQ ID NO: 270065 - DNA, 20 bp, Artificial Sequence
  chemically synthesized
acatacaagaccctatcttt

SEQ ID NO: 270066 - DNA, 20 bp, Artificial Sequence
  chemically synthesized
tttctaccatgacgacatac

SEQ ID NO: 270067 - DNA, 20 bp, Artificial Sequence
  chemically synthesized
tagggtcttgtatgtcgtca

SEQ ID NO: 270068 - DNA, 20 bp, Artificial Sequence
  chemically synthesized
ggtcttgtatgtcgtcatgg

SEQ ID NO: 270069 - DNA, 20 bp, Artificial Sequence
  chemically synthesized
tgtatgtcgtcatggtagaa

SEQ ID NO: 270070 - DNA, 20 bp, Artificial Sequence
  chemically synthesized
tcttagagaaaaattcgtat

SEQ ID NO: 270071 - DNA, 20 bp, Artificial Sequence
  chemically synthesized
atcttagagaaaaattcgta

SEQ ID NO: 270072 - DNA, 20 bp, Artificial Sequence
  chemically synthesized
acctatacgaatttttctct

SEQ ID NO: 270073 - DNA, 20 bp, Artificial Sequence
  chemically synthesized
tttggctataaattatctta

SEQ ID NO: 270074 - DNA, 20 bp, Artificial Sequence
  chemically synthesized
actttggctataaattatct

SEQ ID NO: 270075 - DNA, 20 bp, Artificial Sequence
  chemically synthesized
tttttctctaagataattta

SEQ ID NO: 270076 - DNA, 20 bp, Artificial Sequence
  chemically synthesized
tctaagataatttatagcca

SEQ ID NO: 270077 - DNA, 20 bp, Artificial Sequence
  chemically synthesized
attgtatttatcataaactt

SEQ ID NO: 270078 - DNA, 20 bp, Artificial Sequence
  chemically synthesized
tatgataaatacaatgatat

SEQ ID NO: 270079 - DNA, 20 bp, Artificial Sequence
  chemically synthesized
caatgatataagtcaaactg

SEQ ID NO: 270080 - DNA, 20 bp, Artificial Sequence
  chemically synthesized
tgagaaatgagttttatctt

SEQ ID NO: 270081 - DNA, 20 bp, Artificial Sequence
  chemically synthesized
gtaagttttcagtgagaaat

SEQ ID NO: 270082 - DNA, 20 bp, Artificial Sequence
  chemically synthesized
catgacagtaagttttcagt

SEQ ID NO: 270083 - DNA, 20 bp, Artificial Sequence
  chemically synthesized
gacacatgacagtaagtttt

SEQ ID NO: 270084 - DNA, 20 bp, Artificial Sequence
  chemically synthesized
tattattgacacatgacagt

SEQ ID NO: 270085 - DNA, 20 bp, Artificial Sequence
  chemically synthesized
gccatattattgacacatga

SEQ ID NO: 270086 - DNA, 20 bp, Artificial Sequence
  chemically synthesized
actgtcatgtgtcaataata

SEQ ID NO: 270087 - DNA, 20 bp, Artificial Sequence
  chemically synthesized
tcatgtgtcaataatatggc

SEQ ID NO: 270088 - DNA, 20 bp, Artificial Sequence
  chemically synthesized
tgtgtcaataatatggcaag

SEQ ID NO: 270089 - DNA, 20 bp, Artificial Sequence
  chemically synthesized
gtgtcaataatatggcaaga

SEQ ID NO: 270090 - DNA, 20 bp, Artificial Sequence
  chemically synthesized
ctagtctcacttgtatatag

SEQ ID NO: 270091 - DNA, 20 bp, Artificial Sequence
  chemically synthesized
gtttacaatcctctatatac

SEQ ID NO: 270092 - DNA, 20 bp, Artificial Sequence
  chemically synthesized
gctagtctcacttgtatata

SEQ ID NO: 270093 - DNA, 20 bp, Artificial Sequence
  chemically synthesized
gagctagtctcacttgtata

SEQ ID NO: 270094 - DNA, 20 bp, Artificial Sequence
  chemically synthesized
acaatcctctatatacaagt

SEQ ID NO: 270095 - DNA, 20 bp, Artificial Sequence
  chemically synthesized
cctctatatacaagtgagac

SEQ ID NO: 270096 - DNA, 20 bp, Artificial Sequence
  chemically synthesized
gattccttaccagcatgagc

SEQ ID NO: 270097 - DNA, 20 bp, Artificial Sequence
  chemically synthesized
caagtgagactagctcatgc

SEQ ID NO: 270098 - DNA, 20 bp, Artificial Sequence
  chemically synthesized
ttttgattccttaccagcat

SEQ ID NO: 270099 - DNA, 20 bp, Artificial Sequence
  chemically synthesized
tgagactagctcatgctggt

SEQ ID NO: 270100 - DNA, 20 bp, Artificial Sequence
  chemically synthesized
gagactagctcatgctggta

SEQ ID NO: 270101 - DNA, 20 bp, Artificial Sequence
  chemically synthesized
tcttcattttgattccttac

SEQ ID NO: 270102 - DNA, 20 bp, Artificial Sequence
  chemically synthesized
gctggtaaggaatcaaaatg

SEQ ID NO: 270103 - DNA, 20 bp, Artificial Sequence
  chemically synthesized
gtaaggaatcaaaatgaaga

SEQ ID NO: 270104 - DNA, 20 bp, Artificial Sequence
  chemically synthesized
aggaatcaaaatgaagatag

SEQ ID NO: 270105 - DNA, 20 bp, Artificial Sequence
  chemically synthesized
tagaagattaattctctcaa

SEQ ID NO: 270106 - DNA, 20 bp, Artificial Sequence
  chemically synthesized
agaagattaattctctcaaa

SEQ ID NO: 270107 - DNA, 20 bp, Artificial Sequence
  chemically synthesized
caaatacttttaccttttga

SEQ ID NO: 270108 - DNA, 20 bp, Artificial Sequence
  chemically synthesized
cacaaatacttttacctttt

SEQ ID NO: 270109 - DNA, 20 bp, Artificial Sequence
  chemically synthesized
ttaattctctcaaaaggtaa

SEQ ID NO: 270110 - DNA, 20 bp, Artificial Sequence
  chemically synthesized
aaaagtatttgtgtaatacc

SEQ ID NO: 270111 - DNA, 20 bp, Artificial Sequence
  chemically synthesized
aggatacagttgagaattct

SEQ ID NO: 270112 - DNA, 20 bp, Artificial Sequence
  chemically synthesized
gaggatacagttgagaattc

SEQ ID NO: 270113 - DNA, 20 bp, Artificial Sequence
  chemically synthesized
gatgtaacgaggatacagtt

SEQ ID NO: 270114 - DNA, 20 bp, Artificial Sequence
  chemically synthesized
ttaaagatgtaacgaggata

SEQ ID NO: 270115 - DNA, 20 bp, Artificial Sequence
  chemically synthesized
gacactttaaagatgtaacg

SEQ ID NO: 270116 - DNA, 20 bp, Artificial Sequence
  chemically synthesized
agacactttaaagatgtaac

SEQ ID NO: 270117 - DNA, 20 bp, Artificial Sequence
  chemically synthesized
gtatcctcgttacatcttta

SEQ ID NO: 270118 - DNA, 20 bp, Artificial Sequence
  chemically synthesized
agcagatgtgagacacttta

SEQ ID NO: 270119 - DNA, 20 bp, Artificial Sequence
  chemically synthesized
tattgtttttgagcagatgt

SEQ ID NO: 270120 - DNA, 20 bp, Artificial Sequence
  chemically synthesized
ttcactgtattgtttttgag

SEQ ID NO: 270121 - DNA, 20 bp, Artificial Sequence
  chemically synthesized
ctattcactgtattgttttt

SEQ ID NO: 270122 - DNA, 20 bp, Artificial Sequence
  chemically synthesized
acatctgctcaaaaacaata

SEQ ID NO: 270123 - DNA, 20 bp, Artificial Sequence
  chemically synthesized
ctcaaaaacaatacagtgaa

SEQ ID NO: 270124 - DNA, 20 bp, Artificial Sequence
  chemically synthesized
tcaaaaacaatacagtgaat

SEQ ID NO: 270125 - DNA, 20 bp, Artificial Sequence
  chemically synthesized
caaaattatgtttaaggagg

SEQ ID NO: 270126 - DNA, 20 bp, Artificial Sequence
  chemically synthesized
tggcaaaattatgtttaagg

SEQ ID NO: 270127 - DNA, 20 bp, Artificial Sequence
  chemically synthesized
atggcaaaattatgtttaag

SEQ ID NO: 270128 - DNA, 20 bp, Artificial Sequence
  chemically synthesized
ggatggcaaaattatgttta

SEQ ID NO: 270129 - DNA, 20 bp, Artificial Sequence
  chemically synthesized
tggatggcaaaattatgttt

SEQ ID NO: 270130 - DNA, 20 bp, Artificial Sequence
  chemically synthesized
aacataattttgccatccaa

SEQ ID NO: 270131 - DNA, 20 bp, Artificial Sequence
  chemically synthesized
acataattttgccatccaat

SEQ ID NO: 270132 - DNA, 20 bp, Artificial Sequence
  chemically synthesized
cataattttgccatccaata

SEQ ID NO: 270133 - DNA, 20 bp, Artificial Sequence
  chemically synthesized
atctttttgtccctattgga

SEQ ID NO: 270134 - DNA, 20 bp, Artificial Sequence
  chemically synthesized
attcatctttttgtccctat

SEQ ID NO: 270135 - DNA, 20 bp, Artificial Sequence
  chemically synthesized
tgccatccaatagggacaaa

SEQ ID NO: 270136 - DNA, 20 bp, Artificial Sequence
  chemically synthesized
gggacaaaaagatgaatgtg

SEQ ID NO: 270137 - DNA, 20 bp, Artificial Sequence
  chemically synthesized
acaatattcattcccattaa

SEQ ID NO: 270138 - DNA, 20 bp, Artificial Sequence
  chemically synthesized
taattagtttttctattaat

SEQ ID NO: 270139 - DNA, 20 bp, Artificial Sequence
  chemically synthesized
gtaattagtttttctattaa

SEQ ID NO: 270140 - DNA, 20 bp, Artificial Sequence
  chemically synthesized
ggagcacaggatcaagtaat

SEQ ID NO: 270141 - DNA, 20 bp, Artificial Sequence
  chemically synthesized
gagaacaggagcacaggatc

SEQ ID NO: 270142 - DNA, 20 bp, Artificial Sequence
  chemically synthesized
aacactgagaacaggagcac

SEQ ID NO: 270143 - DNA, 20 bp, Artificial Sequence
  chemically synthesized
aaacactgagaacaggagca

SEQ ID NO: 270144 - DNA, 20 bp, Artificial Sequence
  chemically synthesized
tgatcctgtgctcctgttct

SEQ ID NO: 270145 - DNA, 20 bp, Artificial Sequence
  chemically synthesized
gtatcaaacactgagaacag

SEQ ID NO: 270146 - DNA, 20 bp, Artificial Sequence
  chemically synthesized
tggtatcaaacactgagaac

SEQ ID NO: 270147 - DNA, 20 bp, Artificial Sequence
  chemically synthesized
ttggtatcaaacactgagaa

SEQ ID NO: 270148 - DNA, 20 bp, Artificial Sequence
  chemically synthesized
gggtgttggtatcaaacact

SEQ ID NO: 270149 - DNA, 20 bp, Artificial Sequence
  chemically synthesized
taatttgcttttgagggtgt

SEQ ID NO: 270150 - DNA, 20 bp, Artificial Sequence
  chemically synthesized
tttgataccaacaccctcaa

SEQ ID NO: 270151 - DNA, 20 bp, Artificial Sequence
  chemically synthesized
tatggataatttgcttttga

SEQ ID NO: 270152 - DNA, 20 bp, Artificial Sequence
  chemically synthesized
atatggataatttgcttttg

SEQ ID NO: 270153 - DNA, 20 bp, Artificial Sequence
  chemically synthesized
aatatggataatttgctttt

SEQ ID NO: 270154 - DNA, 20 bp, Artificial Sequence
  chemically synthesized
tcatttcttatgtgagaata

SEQ ID NO: 270155 - DNA, 20 bp, Artificial Sequence
  chemically synthesized
aattatccatattctcacat

SEQ ID NO: 270156 - DNA, 20 bp, Artificial Sequence
  chemically synthesized
gatttgttcatttcttatgt

SEQ ID NO: 270157 - DNA, 20 bp, Artificial Sequence
  chemically synthesized
gagaaggtggtggagaaata

SEQ ID NO: 270158 - DNA, 20 bp, Artificial Sequence
  chemically synthesized
gcacatctgagaaggtggtg

SEQ ID NO: 270159 - DNA, 20 bp, Artificial Sequence
  chemically synthesized
aggcacatctgagaaggtgg

SEQ ID NO: 270160 - DNA, 20 bp, Artificial Sequence
  chemically synthesized
gtatttctccaccaccttct

SEQ ID NO: 270161 - DNA, 20 bp, Artificial Sequence
  chemically synthesized
tataggcacatctgagaagg

SEQ ID NO: 270162 - DNA, 20 bp, Artificial Sequence
  chemically synthesized
aaatataggcacatctgaga

SEQ ID NO: 270163 - DNA, 20 bp, Artificial Sequence
  chemically synthesized
aaaatataggcacatctgag

SEQ ID NO: 270164 - DNA, 20 bp, Artificial Sequence
  chemically synthesized
aacaaaatataggcacatct

SEQ ID NO: 270165 - DNA, 20 bp, Artificial Sequence
  chemically synthesized
tgaaaatcttaacaaaatat

SEQ ID NO: 270166 - DNA, 20 bp, Artificial Sequence
  chemically synthesized
ctgaaaatcttaacaaaata

SEQ ID NO: 270167 - DNA, 20 bp, Artificial Sequence
  chemically synthesized
agatgtgcctatattttgtt

SEQ ID NO: 270168 - DNA, 20 bp, Artificial Sequence
  chemically synthesized
ctatattttgttaagatttt

SEQ ID NO: 270169 - DNA, 20 bp, Artificial Sequence
  chemically synthesized
attttgttaagattttcagt

SEQ ID NO: 270170 - DNA, 20 bp, Artificial Sequence
  chemically synthesized
tgttaagattttcagttggt

SEQ ID NO: 270171 - DNA, 20 bp, Artificial Sequence
  chemically synthesized
ggttggtttaataaaaatcc

SEQ ID NO: 270172 - DNA, 20 bp, Artificial Sequence
  chemically synthesized
ctttagtagaaagagatgct

SEQ ID NO: 270173 - DNA, 20 bp, Artificial Sequence
  chemically synthesized
cctttagtagaaagagatgc

SEQ ID NO: 270174 - DNA, 20 bp, Artificial Sequence
  chemically synthesized
ttgactgcctttagtagaaa

SEQ ID NO: 270175 - DNA, 20 bp, Artificial Sequence
  chemically synthesized
cccagcatctctttctacta

SEQ ID NO: 270176 - DNA, 20 bp, Artificial Sequence
  chemically synthesized
atttgactgcctttagtaga

SEQ ID NO: 270177 - DNA, 20 bp, Artificial Sequence
  chemically synthesized
ccagcatctctttctactaa

SEQ ID NO: 270178 - DNA, 20 bp, Artificial Sequence
  chemically synthesized
gcatctctttctactaaagg

SEQ ID NO: 270179 - DNA, 20 bp, Artificial Sequence
  chemically synthesized
gatgatttgactgcctttag

SEQ ID NO: 270180 - DNA, 20 bp, Artificial Sequence
  chemically synthesized
gttgatgatttgactgcctt

SEQ ID NO: 270181 - DNA, 20 bp, Artificial Sequence
  chemically synthesized
ggcagtcaaatcatcaacaa

SEQ ID NO: 270182 - DNA, 20 bp, Artificial Sequence
  chemically synthesized
gtcaaatcatcaacaaaagc

SEQ ID NO: 270183 - DNA, 20 bp, Artificial Sequence
  chemically synthesized
ttaagaaattgtaatttatc

SEQ ID NO: 270184 - DNA, 20 bp, Artificial Sequence
  chemically synthesized
agataaattacaatttctta

SEQ ID NO: 270185 - DNA, 20 bp, Artificial Sequence
  chemically synthesized
gataaattacaatttcttaa

SEQ ID NO: 270186 - DNA, 20 bp, Artificial Sequence
  chemically synthesized
aggcaagaagatttgccttt

SEQ ID NO: 270187 - DNA, 20 bp, Artificial Sequence
  chemically synthesized
ctaaagatgtgtgaggcaag

SEQ ID NO: 270188 - DNA, 20 bp, Artificial Sequence
  chemically synthesized
aatctaaagatgtgtgaggc

SEQ ID NO: 270189 - DNA, 20 bp, Artificial Sequence
  chemically synthesized
gagtaatctaaagatgtgtg

SEQ ID NO: 270190 - DNA, 20 bp, Artificial Sequence
  chemically synthesized
ggagtaatctaaagatgtgt

SEQ ID NO: 270191 - DNA, 20 bp, Artificial Sequence
  chemically synthesized
cttcttgcctcacacatctt

SEQ ID NO: 270192 - DNA, 20 bp, Artificial Sequence
  chemically synthesized
gagtagagaggagtaatcta

SEQ ID NO: 270193 - DNA, 20 bp, Artificial Sequence
  chemically synthesized
gaactttcaggagtagagag

SEQ ID NO: 270194 - DNA, 20 bp, Artificial Sequence
  chemically synthesized
aggaactttcaggagtagag

SEQ ID NO: 270195 - DNA, 20 bp, Artificial Sequence
  chemically synthesized
aaggaactttcaggagtaga

SEQ ID NO: 270196 - DNA, 20 bp, Artificial Sequence
  chemically synthesized
tcaaggaactttcaggagta

SEQ ID NO: 270197 - DNA, 20 bp, Artificial Sequence
  chemically synthesized
ttactcctctctactcctga

SEQ ID NO: 270198 - DNA, 20 bp, Artificial Sequence
  chemically synthesized
gttcaaggaactttcaggag

SEQ ID NO: 270199 - DNA, 20 bp, Artificial Sequence
  chemically synthesized
tttgttcaaggaactttcag

SEQ ID NO: 270200 - DNA, 20 bp, Artificial Sequence
  chemically synthesized
tctttgttcaaggaactttc

SEQ ID NO: 270201 - DNA, 20 bp, Artificial Sequence
  chemically synthesized
ttctttgttcaaggaacttt

SEQ ID NO: 270202 - DNA, 20 bp, Artificial Sequence
  chemically synthesized
tcctgaaagttccttgaaca

SEQ ID NO: 270203 - DNA, 20 bp, Artificial Sequence
  chemically synthesized
gtgagacctttctttgttca

SEQ ID NO: 270204 - DNA, 20 bp, Artificial Sequence
  chemically synthesized
agtgagacctttctttgttc

SEQ ID NO: 270205 - DNA, 20 bp, Artificial Sequence
  chemically synthesized
gaaagttccttgaacaaaga

SEQ ID NO: 270206 - DNA, 20 bp, Artificial Sequence
  chemically synthesized
aaagttccttgaacaaagaa

SEQ ID NO: 270207 - DNA, 20 bp, Artificial Sequence
  chemically synthesized
atacataaagcatatttagt

SEQ ID NO: 270208 - DNA, 20 bp, Artificial Sequence
  chemically synthesized
ttcaatacataaagcatatt

SEQ ID NO: 270209 - DNA, 20 bp, Artificial Sequence
  chemically synthesized
attcctttattcaatacata

SEQ ID NO: 270210 - DNA, 20 bp, Artificial Sequence
  chemically synthesized
tatgctttatgtattgaata

SEQ ID NO: 270211 - DNA, 20 bp, Artificial Sequence
  chemically synthesized
atgctttatgtattgaataa

SEQ ID NO: 270212 - DNA, 20 bp, Artificial Sequence
  chemically synthesized
attgaataaaggaatgaatg

SEQ ID NO: 270213 - DNA, 20 bp, Artificial Sequence
  chemically synthesized
acttgtaattaacgatttgc

SEQ ID NO: 270214 - DNA, 20 bp, Artificial Sequence
  chemically synthesized
acttgcaaatcgttaattac

SEQ ID NO: 270215 - DNA, 20 bp, Artificial Sequence
  chemically synthesized
gcaaatcgttaattacaagt

SEQ ID NO: 270216 - DNA, 20 bp, Artificial Sequence
  chemically synthesized
tacaagttagaaaatataac

SEQ ID NO: 270217 - DNA, 20 bp, Artificial Sequence
  chemically synthesized
aagttagaaaatataactgg

SEQ ID NO: 270218 - DNA, 20 bp, Artificial Sequence
  chemically synthesized
actctttatgtaaattctac

SEQ ID NO: 270219 - DNA, 20 bp, Artificial Sequence
  chemically synthesized
taactggtagaatttacata

SEQ ID NO: 270220 - DNA, 20 bp, Artificial Sequence
  chemically synthesized
actggtagaatttacataaa

SEQ ID NO: 270221 - DNA, 20 bp, Artificial Sequence
  chemically synthesized
taaagagtttatactcttac

SEQ ID NO: 270222 - DNA, 20 bp, Artificial Sequence
  chemically synthesized
aaaccaggagcaacttgtaa

SEQ ID NO: 270223 - DNA, 20 bp, Artificial Sequence
  chemically synthesized
gaaaaccaggagcaacttgt

SEQ ID NO: 270224 - DNA, 20 bp, Artificial Sequence
  chemically synthesized
atactcttacaagttgctcc

SEQ ID NO: 270225 - DNA, 20 bp, Artificial Sequence
  chemically synthesized
accaaagaaaagaaaaccag

SEQ ID NO: 270226 - DNA, 20 bp, Artificial Sequence
  chemically synthesized
ataccaaagaaaagaaaacc

SEQ ID NO: 270227 - DNA, 20 bp, Artificial Sequence
  chemically synthesized
cataccaaagaaaagaaaac

SEQ ID NO: 270228 - DNA, 20 bp, Artificial Sequence
  chemically synthesized
gctcctggttttcttttctt

SEQ ID NO: 270229 - DNA, 20 bp, Artificial Sequence
  chemically synthesized
tgaaaacacataccaaagaa

SEQ ID NO: 270230 - DNA, 20 bp, Artificial Sequence
  chemically synthesized
aaaggtgaaaacacatacca

SEQ ID NO: 270231 - DNA, 20 bp, Artificial Sequence
  chemically synthesized
caagggttttttttaaaaaa

SEQ ID NO: 270232 - DNA, 20 bp, Artificial Sequence
  chemically synthesized
acaagggttttttttaaaaa

SEQ ID NO: 270233 - DNA, 20 bp, Artificial Sequence
  chemically synthesized
ccaggcttcatgacagacaa

SEQ ID NO: 270234 - DNA, 20 bp, Artificial Sequence
  chemically synthesized
cccaggcttcatgacagaca

SEQ ID NO: 270235 - DNA, 20 bp, Artificial Sequence
  chemically synthesized
tcccaggcttcatgacagac

SEQ ID NO: 270236 - DNA, 20 bp, Artificial Sequence
  chemically synthesized
aaaaacccttgtctgtcatg

SEQ ID NO: 270237 - DNA, 20 bp, Artificial Sequence
  chemically synthesized
cagattcccaggcttcatga

SEQ ID NO: 270238 - DNA, 20 bp, Artificial Sequence
  chemically synthesized
cccttgtctgtcatgaagcc

SEQ ID NO: 270239 - DNA, 20 bp, Artificial Sequence
  chemically synthesized
ccttgtctgtcatgaagcct

SEQ ID NO: 270240 - DNA, 20 bp, Artificial Sequence
  chemically synthesized
tatctattgttcagattccc

SEQ ID NO: 270241 - DNA, 20 bp, Artificial Sequence
  chemically synthesized
atatctattgttcagattcc

SEQ ID NO: 270242 - DNA, 20 bp, Artificial Sequence
  chemically synthesized
aagcctgggaatctgaacaa

SEQ ID NO: 270243 - DNA, 20 bp, Artificial Sequence
  chemically synthesized
aaatatttatatctattgtt

SEQ ID NO: 270244 - DNA, 20 bp, Artificial Sequence
  chemically synthesized
gaacaatagatataaatatt

SEQ ID NO: 270245 - DNA, 20 bp, Artificial Sequence
  chemically synthesized
gatataaatatttggctctg

SEQ ID NO: 270246 - DNA, 20 bp, Artificial Sequence
  chemically synthesized
tccatcatgctgtttctgca

SEQ ID NO: 270247 - DNA, 20 bp, Artificial Sequence
  chemically synthesized
aatatttggctctgcagaaa

SEQ ID NO: 270248 - DNA, 20 bp, Artificial Sequence
  chemically synthesized
attccatcatgctgtttctg

SEQ ID NO: 270249 - DNA, 20 bp, Artificial Sequence
  chemically synthesized
gctctgcagaaacagcatga

SEQ ID NO: 270250 - DNA, 20 bp, Artificial Sequence
  chemically synthesized
gaaacagcatgatggaatgt

SEQ ID NO: 270251 - DNA, 20 bp, Artificial Sequence
  chemically synthesized
atgatggaatgtaagtatgt

SEQ ID NO: 270252 - DNA, 20 bp, Artificial Sequence
  chemically synthesized
tgatggaatgtaagtatgtt

SEQ ID NO: 270253 - DNA, 20 bp, Artificial Sequence
  chemically synthesized
agagtccactacgtatcgca

SEQ ID NO: 270254 - DNA, 20 bp, Artificial Sequence
  chemically synthesized
atgttaggctctgcgatacg

SEQ ID NO: 270255 - DNA, 20 bp, Artificial Sequence
  chemically synthesized
cgagagtccactacgtatcg

SEQ ID NO: 270256 - DNA, 20 bp, Artificial Sequence
  chemically synthesized
ttaggctctgcgatacgtag

SEQ ID NO: 270257 - DNA, 20 bp, Artificial Sequence
  chemically synthesized
acgtagtggactctcgactt

SEQ ID NO: 270258 - DNA, 20 bp, Artificial Sequence
  chemically synthesized
aaaaatcatactcaagtcga

SEQ ID NO: 270259 - DNA, 20 bp, Artificial Sequence
  chemically synthesized
ccaaaaatcatactcaagtc

SEQ ID NO: 270260 - DNA, 20 bp, Artificial Sequence
  chemically synthesized
ttctgccaaaaatcatactc

SEQ ID NO: 270261 - DNA, 20 bp, Artificial Sequence
  chemically synthesized
ctcgacttgagtatgatttt

SEQ ID NO: 270262 - DNA, 20 bp, Artificial Sequence
  chemically synthesized
gacttgagtatgatttttgg

SEQ ID NO: 270263 - DNA, 20 bp, Artificial Sequence
  chemically synthesized
cagatgtgttgagaaaaatg

SEQ ID NO: 270264 - DNA, 20 bp, Artificial Sequence
  chemically synthesized
acagatgtgttgagaaaaat

SEQ ID NO: 270265 - DNA, 20 bp, Artificial Sequence
  chemically synthesized
tcccatttgacagatgtgtt

SEQ ID NO: 270266 - DNA, 20 bp, Artificial Sequence
  chemically synthesized
ttctcaacacatctgtcaaa

SEQ ID NO: 270267 - DNA, 20 bp, Artificial Sequence
  chemically synthesized
tctcaacacatctgtcaaat

SEQ ID NO: 270268 - DNA, 20 bp, Artificial Sequence
  chemically synthesized
agtatagtaatcccatttga

SEQ ID NO: 270269 - DNA, 20 bp, Artificial Sequence
  chemically synthesized
ctgtgttctattaataagta

SEQ ID NO: 270270 - DNA, 20 bp, Artificial Sequence
  chemically synthesized
gggattactatacttattaa

SEQ ID NO: 270271 - DNA, 20 bp, Artificial Sequence
  chemically synthesized
tattcctgtgttctattaat

SEQ ID NO: 270272 - DNA, 20 bp, Artificial Sequence
  chemically synthesized
ctatacttattaatagaaca

SEQ ID NO: 270273 - DNA, 20 bp, Artificial Sequence
  chemically synthesized
tatacttattaatagaacac

SEQ ID NO: 270274 - DNA, 20 bp, Artificial Sequence
  chemically synthesized
atagaacacaggaatattgc

SEQ ID NO: 270275 - DNA, 20 bp, Artificial Sequence
  chemically synthesized
tagaacacaggaatattgcg

SEQ ID NO: 270276 - DNA, 20 bp, Artificial Sequence
  chemically synthesized
agaacacaggaatattgcga

SEQ ID NO: 270277 - DNA, 20 bp, Artificial Sequence
  chemically synthesized
acaggaatattgcgagggta

SEQ ID NO: 270278 - DNA, 20 bp, Artificial Sequence
  chemically synthesized
caggaatattgcgagggtaa

SEQ ID NO: 270279 - DNA, 20 bp, Artificial Sequence
  chemically synthesized
gaatattgcgagggtaaagg

SEQ ID NO: 270280 - DNA, 20 bp, Artificial Sequence
  chemically synthesized
gcgagggtaaaggcagacaa

SEQ ID NO: 270281 - DNA, 20 bp, Artificial Sequence
  chemically synthesized
gtaaaggcagacaacagttt

SEQ ID NO: 270282 - DNA, 20 bp, Artificial Sequence
  chemically synthesized
aaaggcagacaacagtttga

SEQ ID NO: 270283 - DNA, 20 bp, Artificial Sequence
  chemically synthesized
aggcagacaacagtttgaga

SEQ ID NO: 270284 - DNA, 20 bp, Artificial Sequence
  chemically synthesized
aataaaggaagggattgagg

SEQ ID NO: 270285 - DNA, 20 bp, Artificial Sequence
  chemically synthesized
gagaataaaggaagggattg

SEQ ID NO: 270286 - DNA, 20 bp, Artificial Sequence
  chemically synthesized
tgagaataaaggaagggatt

SEQ ID NO: 270287 - DNA, 20 bp, Artificial Sequence
  chemically synthesized
aaataatgagaataaaggaa

SEQ ID NO: 270288 - DNA, 20 bp, Artificial Sequence
  chemically synthesized
taaataatgagaataaagga

SEQ ID NO: 270289 - DNA, 20 bp, Artificial Sequence
  chemically synthesized
gtaaataatgagaataaagg

SEQ ID NO: 270290 - DNA, 20 bp, Artificial Sequence
  chemically synthesized
aaggtaaataatgagaataa

SEQ ID NO: 270291 - DNA, 20 bp, Artificial Sequence
  chemically synthesized
aaaggtaaataatgagaata

SEQ ID NO: 270292 - DNA, 20 bp, Artificial Sequence
  chemically synthesized
catccctaaaggtaaataat

SEQ ID NO: 270293 - DNA, 20 bp, Artificial Sequence
  chemically synthesized
ttattctcattatttacctt

SEQ ID NO: 270294 - DNA, 20 bp, Artificial Sequence
  chemically synthesized
tattctcattatttaccttt

SEQ ID NO: 270295 - DNA, 20 bp, Artificial Sequence
  chemically synthesized
attctcattatttaccttta

SEQ ID NO: 270296 - DNA, 20 bp, Artificial Sequence
  chemically synthesized
tcattatttacctttaggga

SEQ ID NO: 270297 - DNA, 20 bp, Artificial Sequence
  chemically synthesized
ttttattgaaccatccctaa

SEQ ID NO: 270298 - DNA, 20 bp, Artificial Sequence
  chemically synthesized
tttttattgaaccatcccta

SEQ ID NO: 270299 - DNA, 20 bp, Artificial Sequence
  chemically synthesized
ttgctctatacattcaggca

SEQ ID NO: 270300 - DNA, 20 bp, Artificial Sequence
  chemically synthesized
aaaaactgtgcctgaatgta

SEQ ID NO: 270301 - DNA, 20 bp, Artificial Sequence
  chemically synthesized
agcttttgctctatacattc

SEQ ID NO: 270302 - DNA, 20 bp, Artificial Sequence
  chemically synthesized
aagcttttgctctatacatt

SEQ ID NO: 270303 - DNA, 20 bp, Artificial Sequence
  chemically synthesized
aaactgtgcctgaatgtata

SEQ ID NO: 270304 - DNA, 20 bp, Artificial Sequence
  chemically synthesized
tgcctgaatgtatagagcaa

SEQ ID NO: 270305 - DNA, 20 bp, Artificial Sequence
  chemically synthesized
tagtaaaataaatgtaaata

SEQ ID NO: 270306 - DNA, 20 bp, Artificial Sequence
  chemically synthesized
acatttattttactacctta

SEQ ID NO: 270307 - DNA, 20 bp, Artificial Sequence
  chemically synthesized
catttattttactaccttac

SEQ ID NO: 270308 - DNA, 20 bp, Artificial Sequence
  chemically synthesized
tgttttatttacctgtaagg

SEQ ID NO: 270309 - DNA, 20 bp, Artificial Sequence
  chemically synthesized
ccatgttttatttacctgta

SEQ ID NO: 270310 - DNA, 20 bp, Artificial Sequence
  chemically synthesized
tccatgttttatttacctgt

SEQ ID NO: 270311 - DNA, 20 bp, Artificial Sequence
  chemically synthesized
ccttacaggtaaataaaaca

SEQ ID NO: 270312 - DNA, 20 bp, Artificial Sequence
  chemically synthesized
caggtaaataaaacatggac

SEQ ID NO: 270313 - DNA, 20 bp, Artificial Sequence
  chemically synthesized
aataaaacatggacaagatt

SEQ ID NO: 270314 - DNA, 20 bp, Artificial Sequence
  chemically synthesized
ttcagatttcttagcaacaa

SEQ ID NO: 270315 - DNA, 20 bp, Artificial Sequence
  chemically synthesized
aagatttggcttttgttgct

SEQ ID NO: 270316 - DNA, 20 bp, Artificial Sequence
  chemically synthesized
agtctacctttcagatttct

SEQ ID NO: 270317 - DNA, 20 bp, Artificial Sequence
  chemically synthesized
tttgttgctaagaaatctga

SEQ ID NO: 270318 - DNA, 20 bp, Artificial Sequence
  chemically synthesized
ttgttgctaagaaatctgaa

SEQ ID NO: 270319 - DNA, 20 bp, Artificial Sequence
  chemically synthesized
ttgctaagaaatctgaaagg

SEQ ID NO: 270320 - DNA, 20 bp, Artificial Sequence
  chemically synthesized
ttaatctggagtctaccttt

SEQ ID NO: 270321 - DNA, 20 bp, Artificial Sequence
  chemically synthesized
gaaatctgaaaggtagactc

SEQ ID NO: 270322 - DNA, 20 bp, Artificial Sequence
  chemically synthesized
ttacaattgaaattaatctg

SEQ ID NO: 270323 - DNA, 20 bp, Artificial Sequence
  chemically synthesized
cattacaattgaaattaatc

SEQ ID NO: 270324 - DNA, 20 bp, Artificial Sequence
  chemically synthesized
cagattaatttcaattgtaa

SEQ ID NO: 270325 - DNA, 20 bp, Artificial Sequence
  chemically synthesized
aatttcaattgtaatggaat

SEQ ID NO: 270326 - DNA, 20 bp, Artificial Sequence
  chemically synthesized
taaaacaataccaccaccac

SEQ ID NO: 270327 - DNA, 20 bp, Artificial Sequence
  chemically synthesized
aaataacgcacttgtggtgg

SEQ ID NO: 270328 - DNA, 20 bp, Artificial Sequence
  chemically synthesized
cacaaataacgcacttgtgg

SEQ ID NO: 270329 - DNA, 20 bp, Artificial Sequence
  chemically synthesized
atgcacaaataacgcacttg

SEQ ID NO: 270330 - DNA, 20 bp, Artificial Sequence
  chemically synthesized
ttatttgtgcattatgccct

SEQ ID NO: 270331 - DNA, 20 bp, Artificial Sequence
  chemically synthesized
agtggtgcctattgggctta

SEQ ID NO: 270332 - DNA, 20 bp, Artificial Sequence
  chemically synthesized
cagtggtgcctattgggctt

SEQ ID NO: 270333 - DNA, 20 bp, Artificial Sequence
  chemically synthesized
gcattatgccctaagcccaa

SEQ ID NO: 270334 - DNA, 20 bp, Artificial Sequence
  chemically synthesized
tcagtggtgcctattgggct

SEQ ID NO: 270335 - DNA, 20 bp, Artificial Sequence
  chemically synthesized
cattatgccctaagcccaat

SEQ ID NO: 270336 - DNA, 20 bp, Artificial Sequence
  chemically synthesized
atcagtcagtggtgcctatt

SEQ ID NO: 270337 - DNA, 20 bp, Artificial Sequence
  chemically synthesized
tatcagtcagtggtgcctat

SEQ ID NO: 270338 - DNA, 20 bp, Artificial Sequence
  chemically synthesized
taaatatatgtatcagtcag

SEQ ID NO: 270339 - DNA, 20 bp, Artificial Sequence
  chemically synthesized
acataaatatatgtatcagt

SEQ ID NO: 270340 - DNA, 20 bp, Artificial Sequence
  chemically synthesized
tatgacataaatatatgtat

SEQ ID NO: 270341 - DNA, 20 bp, Artificial Sequence
  chemically synthesized
gttgtacacacacatacaca

SEQ ID NO: 270342 - DNA, 20 bp, Artificial Sequence
  chemically synthesized
tgtgtgtgtacaaccaaaat

SEQ ID NO: 270343 - DNA, 20 bp, Artificial Sequence
  chemically synthesized
ttatagatagattcttattt

SEQ ID NO: 270344 - DNA, 20 bp, Artificial Sequence
  chemically synthesized
caaaataagaatctatctat

SEQ ID NO: 270345 - DNA, 20 bp, Artificial Sequence
  chemically synthesized
gtgtttttcttgcttataga

SEQ ID NO: 270346 - DNA, 20 bp, Artificial Sequence
  chemically synthesized
ataagaatctatctataagc

SEQ ID NO: 270347 - DNA, 20 bp, Artificial Sequence
  chemically synthesized
ttttgtgtttttcttgctta

SEQ ID NO: 270348 - DNA, 20 bp, Artificial Sequence
  chemically synthesized
tataagcaagaaaaacacaa

SEQ ID NO: 270349 - DNA, 20 bp, Artificial Sequence
  chemically synthesized
aaaagataaaaatatgtata

SEQ ID NO: 270350 - DNA, 20 bp, Artificial Sequence
  chemically synthesized
ttatttcgattgtagcattt

SEQ ID NO: 270351 - DNA, 20 bp, Artificial Sequence
  chemically synthesized
cagaatatttatttcgattg

SEQ ID NO: 270352 - DNA, 20 bp, Artificial Sequence
  chemically synthesized
tacaatcgaaataaatattc

SEQ ID NO: 270353 - DNA, 20 bp, Artificial Sequence
  chemically synthesized
tggaattgttatcaaggttc

SEQ ID NO: 270354 - DNA, 20 bp, Artificial Sequence
  chemically synthesized
tggaattggaattgttatca

SEQ ID NO: 270355 - DNA, 20 bp, Artificial Sequence
  chemically synthesized
ttggaattggaattgttatc

SEQ ID NO: 270356 - DNA, 20 bp, Artificial Sequence
  chemically synthesized
ggaattttattatttggaat

SEQ ID NO: 270357 - DNA, 20 bp, Artificial Sequence
  chemically synthesized
aaataaggaattttattatt

SEQ ID NO: 270358 - DNA, 20 bp, Artificial Sequence
  chemically synthesized
cacctctcctaaagaaaata

SEQ ID NO: 270359 - DNA, 20 bp, Artificial Sequence
  chemically synthesized
acacctctcctaaagaaaat

SEQ ID NO: 270360 - DNA, 20 bp, Artificial Sequence
  chemically synthesized
ataaaattccttattttctt

SEQ ID NO: 270361 - DNA, 20 bp, Artificial Sequence
  chemically synthesized
taaaattccttattttcttt

SEQ ID NO: 270362 - DNA, 20 bp, Artificial Sequence
  chemically synthesized
aaattccttattttctttag

SEQ ID NO: 270363 - DNA, 20 bp, Artificial Sequence
  chemically synthesized
attccttattttctttagga

SEQ ID NO: 270364 - DNA, 20 bp, Artificial Sequence
  chemically synthesized
ttccttattttctttaggag

SEQ ID NO: 270365 - DNA, 20 bp, Artificial Sequence
  chemically synthesized
atgtacgcacacctctccta

SEQ ID NO: 270366 - DNA, 20 bp, Artificial Sequence
  chemically synthesized
aggagaggtgtgcgtacatt

SEQ ID NO: 270367 - DNA, 20 bp, Artificial Sequence
  chemically synthesized
gcgtacatttagaaaacatt

SEQ ID NO: 270368 - DNA, 20 bp, Artificial Sequence
  chemically synthesized
ttagaaaacatttagttgct

SEQ ID NO: 270369 - DNA, 20 bp, Artificial Sequence
  chemically synthesized
tagaaaacatttagttgctg

SEQ ID NO: 270370 - DNA, 20 bp, Artificial Sequence
  chemically synthesized
aaaaaatgaatttacagcct

SEQ ID NO: 270371 - DNA, 20 bp, Artificial Sequence
  chemically synthesized
ctgtttaaaaaatgaattta

SEQ ID NO: 270372 - DNA, 20 bp, Artificial Sequence
  chemically synthesized
ctgtaaattcattttttaaa

SEQ ID NO: 270373 - DNA, 20 bp, Artificial Sequence
  chemically synthesized
taggaaaaaaaaaaatagaa

SEQ ID NO: 270374 - DNA, 20 bp, Artificial Sequence
  chemically synthesized
ttaggaaaaaaaaaaataga

SEQ ID NO: 270375 - DNA, 20 bp, Artificial Sequence
  chemically synthesized
cttaggaaaaaaaaaaatag

SEQ ID NO: 270376 - DNA, 20 bp, Artificial Sequence
  chemically synthesized
ttacttaggaaaaaaaaaaa

SEQ ID NO: 270377 - DNA, 20 bp, Artificial Sequence
  chemically synthesized
cttctatttttttttttcct

SEQ ID NO: 270378 - DNA, 20 bp, Artificial Sequence
  chemically synthesized
tttttttttttcctaagtaa

SEQ ID NO: 270379 - DNA, 20 bp, Artificial Sequence
  chemically synthesized
aagggcagatgcttttactt

SEQ ID NO: 270380 - DNA, 20 bp, Artificial Sequence
  chemically synthesized
aaagggcagatgcttttact

SEQ ID NO: 270381 - DNA, 20 bp, Artificial Sequence
  chemically synthesized
aattcttgcagtcaaaaggg

SEQ ID NO: 270382 - DNA, 20 bp, Artificial Sequence
  chemically synthesized
caaaattcttgcagtcaaaa

SEQ ID NO: 270383 - DNA, 20 bp, Artificial Sequence
  chemically synthesized
acaaaattcttgcagtcaaa

SEQ ID NO: 270384 - DNA, 20 bp, Artificial Sequence
  chemically synthesized
cacaaaattcttgcagtcaa

SEQ ID NO: 270385 - DNA, 20 bp, Artificial Sequence
  chemically synthesized
gcatctgcccttttgactgc

SEQ ID NO: 270386 - DNA, 20 bp, Artificial Sequence
  chemically synthesized
cctacaacacaaaattcttg

SEQ ID NO: 270387 - DNA, 20 bp, Artificial Sequence
  chemically synthesized
actgcaagaattttgtgttg

SEQ ID NO: 270388 - DNA, 20 bp, Artificial Sequence
  chemically synthesized
ctgcaagaattttgtgttgt

SEQ ID NO: 270389 - DNA, 20 bp, Artificial Sequence
  chemically synthesized
tgcaagaattttgtgttgta

SEQ ID NO: 270390 - DNA, 20 bp, Artificial Sequence
  chemically synthesized
gcaagaattttgtgttgtag

SEQ ID NO: 270391 - DNA, 20 bp, Artificial Sequence
  chemically synthesized
ttttgtgttgtaggggtgtg

SEQ ID NO: 270392 - DNA, 20 bp, Artificial Sequence
  chemically synthesized
tttgtgttgtaggggtgtgt

SEQ ID NO: 270393 - DNA, 20 bp, Artificial Sequence
  chemically synthesized
ttgtgttgtaggggtgtgtg

SEQ ID NO: 270394 - DNA, 20 bp, Artificial Sequence
  chemically synthesized
tgtgttgtaggggtgtgtgg

SEQ ID NO: 270395 - DNA, 20 bp, Artificial Sequence
  chemically synthesized
gtgttgtaggggtgtgtggg

SEQ ID NO: 270396 - DNA, 20 bp, Artificial Sequence
  chemically synthesized
tgtaggggtgtgtggggggt

SEQ ID NO: 270397 - DNA, 20 bp, Artificial Sequence
  chemically synthesized
gtaggggtgtgtggggggtg

SEQ ID NO: 270398 - DNA, 20 bp, Artificial Sequence
  chemically synthesized
taggggtgtgtggggggtga

SEQ ID NO: 270399 - DNA, 20 bp, Artificial Sequence
  chemically synthesized
gtgagggaaaatatacttta

SEQ ID NO: 270400 - DNA, 20 bp, Artificial Sequence
  chemically synthesized
atgcatagaaacacaccata

SEQ ID NO: 270401 - DNA, 20 bp, Artificial Sequence
  chemically synthesized
atgcataggaaaaatatgca

SEQ ID NO: 270402 - DNA, 20 bp, Artificial Sequence
  chemically synthesized
tttttctaccaataatgcat

SEQ ID NO: 270403 - DNA, 20 bp, Artificial Sequence
  chemically synthesized
atttttctaccaataatgca

SEQ ID NO: 270404 - DNA, 20 bp, Artificial Sequence
  chemically synthesized
atatttttcctatgcattat

SEQ ID NO: 270405 - DNA, 20 bp, Artificial Sequence
  chemically synthesized
tttttcctatgcattattgg

SEQ ID NO: 270406 - DNA, 20 bp, Artificial Sequence
  chemically synthesized
tattggtagaaaaatgattc

SEQ ID NO: 270407 - DNA, 20 bp, Artificial Sequence
  chemically synthesized
tttctttgaaatattgaatc

SEQ ID NO: 270408 - DNA, 20 bp, Artificial Sequence
  chemically synthesized
attccagattcaatatttca

SEQ ID NO: 270409 - DNA, 20 bp, Artificial Sequence
  chemically synthesized
tcaaagaaattctatcttcc

SEQ ID NO: 270410 - DNA, 20 bp, Artificial Sequence
  chemically synthesized
ctgcattagctctgggaaga

SEQ ID NO: 270411 - DNA, 20 bp, Artificial Sequence
  chemically synthesized
aaagaaattctatcttccca

SEQ ID NO: 270412 - DNA, 20 bp, Artificial Sequence
  chemically synthesized
aatactgcattagctctggg

SEQ ID NO: 270413 - DNA, 20 bp, Artificial Sequence
  chemically synthesized
atcaatactgcattagctct

SEQ ID NO: 270414 - DNA, 20 bp, Artificial Sequence
  chemically synthesized
aatcaatactgcattagctc

SEQ ID NO: 270415 - DNA, 20 bp, Artificial Sequence
  chemically synthesized
ctatcttcccagagctaatg

SEQ ID NO: 270416 - DNA, 20 bp, Artificial Sequence
  chemically synthesized
aataaaaatcaatactgcat

SEQ ID NO: 270417 - DNA, 20 bp, Artificial Sequence
  chemically synthesized
tatttcattttgtttatttc

SEQ ID NO: 270418 - DNA, 20 bp, Artificial Sequence
  chemically synthesized
tttttaaaaatgtatttagc

SEQ ID NO: 270419 - DNA, 20 bp, Artificial Sequence
  chemically synthesized
ctgttttttaaaaatgtatt

SEQ ID NO: 270420 - DNA, 20 bp, Artificial Sequence
  chemically synthesized
ctaaatacatttttaaaaaa

SEQ ID NO: 270421 - DNA, 20 bp, Artificial Sequence
  chemically synthesized
taaatacatttttaaaaaac

SEQ ID NO: 270422 - DNA, 20 bp, Artificial Sequence
  chemically synthesized
aatacatttttaaaaaacag

SEQ ID NO: 270423 - DNA, 20 bp, Artificial Sequence
  chemically synthesized
acaggagacactgccatctt

SEQ ID NO: 270424 - DNA, 20 bp, Artificial Sequence
  chemically synthesized
ctcaattttccttaagatgg

SEQ ID NO: 270425 - DNA, 20 bp, Artificial Sequence
  chemically synthesized
caggagacactgccatctta

SEQ ID NO: 270426 - DNA, 20 bp, Artificial Sequence
  chemically synthesized
aaactcaattttccttaaga

SEQ ID NO: 270427 - DNA, 20 bp, Artificial Sequence
  chemically synthesized
tataaaactcaattttcctt

SEQ ID NO: 270428 - DNA, 20 bp, Artificial Sequence
  chemically synthesized
ctgccatcttaaggaaaatt

SEQ ID NO: 270429 - DNA, 20 bp, Artificial Sequence
  chemically synthesized
attcctcgcatacacacaca

SEQ ID NO: 270430 - DNA, 20 bp, Artificial Sequence
  chemically synthesized
tatactttgtgtgtgtatgc

SEQ ID NO: 270431 - DNA, 20 bp, Artificial Sequence
  chemically synthesized
atactttgtgtgtgtatgcg

SEQ ID NO: 270432 - DNA, 20 bp, Artificial Sequence
  chemically synthesized
ttgtgtgtgtatgcgaggaa

SEQ ID NO: 270433 - DNA, 20 bp, Artificial Sequence
  chemically synthesized
gtttaacacaatgccacctg

SEQ ID NO: 270434 - DNA, 20 bp, Artificial Sequence
  chemically synthesized
ctaaaacattttactgcagg

SEQ ID NO: 270435 - DNA, 20 bp, Artificial Sequence
  chemically synthesized
ctactaaaacattttactgc

SEQ ID NO: 270436 - DNA, 20 bp, Artificial Sequence
  chemically synthesized
actactaaaacattttactg

SEQ ID NO: 270437 - DNA, 20 bp, Artificial Sequence
  chemically synthesized
ccacctgcagtaaaatgttt

SEQ ID NO: 270438 - DNA, 20 bp, Artificial Sequence
  chemically synthesized
cctgcagtaaaatgttttag

SEQ ID NO: 270439 - DNA, 20 bp, Artificial Sequence
  chemically synthesized
ttagtagtcattgtttcacg

SEQ ID NO: 270440 - DNA, 20 bp, Artificial Sequence
  chemically synthesized
acgaagttaacaatgtattt

SEQ ID NO: 270441 - DNA, 20 bp, Artificial Sequence
  chemically synthesized
cgaagttaacaatgtattta

SEQ ID NO: 270442 - DNA, 20 bp, Artificial Sequence
  chemically synthesized
gaagttaacaatgtatttaa

SEQ ID NO: 270443 - DNA, 20 bp, Artificial Sequence
  chemically synthesized
atgtatttaagggatgatat

SEQ ID NO: 270444 - DNA, 20 bp, Artificial Sequence
  chemically synthesized
tttatggaaatttacataaa

SEQ ID NO: 270445 - DNA, 20 bp, Artificial Sequence
  chemically synthesized
atgtaaatttccataaaaat

SEQ ID NO: 270446 - DNA, 20 bp, Artificial Sequence
  chemically synthesized
tctctatgctctgattttta

SEQ ID NO: 270447 - DNA, 20 bp, Artificial Sequence
  chemically synthesized
gtaaatttccataaaaatca

SEQ ID NO: 270448 - DNA, 20 bp, Artificial Sequence
  chemically synthesized
tttccataaaaatcagagca

SEQ ID NO: 270449 - DNA, 20 bp, Artificial Sequence
  chemically synthesized
tccataaaaatcagagcata

SEQ ID NO: 270450 - DNA, 20 bp, Artificial Sequence
  chemically synthesized
tcagagcatagagaaataaa

SEQ ID NO: 270451 - DNA, 20 bp, Artificial Sequence
  chemically synthesized
cagagcatagagaaataaaa

SEQ ID NO: 270452 - DNA, 20 bp, Artificial Sequence
  chemically synthesized
agagcatagagaaataaaaa

SEQ ID NO: 270453 - DNA, 20 bp, Artificial Sequence
  chemically synthesized
gagcatagagaaataaaaag

SEQ ID NO: 270454 - DNA, 20 bp, Artificial Sequence
  chemically synthesized
agagaaataaaaaggggtta

SEQ ID NO: 270455 - DNA, 20 bp, Artificial Sequence
  chemically synthesized
gagaaataaaaaggggttat

SEQ ID NO: 270456 - DNA, 20 bp, Artificial Sequence
  chemically synthesized
tataggtattattacatcaa

SEQ ID NO: 270457 - DNA, 20 bp, Artificial Sequence
  chemically synthesized
tattattacatcaatggtgc

SEQ ID NO: 270458 - DNA, 20 bp, Artificial Sequence
  chemically synthesized
ttattaagagatattaaagc

SEQ ID NO: 270459 - DNA, 20 bp, Artificial Sequence
  chemically synthesized
taatttattaagagatatta

SEQ ID NO: 270460 - DNA, 20 bp, Artificial Sequence
  chemically synthesized
aaatataattaatttattaa

SEQ ID NO: 270461 - DNA, 20 bp, Artificial Sequence
  chemically synthesized
gaaaatataattaatttatt

SEQ ID NO: 270462 - DNA, 20 bp, Artificial Sequence
  chemically synthesized
tacatggtgatgagtgggga

SEQ ID NO: 270463 - DNA, 20 bp, Artificial Sequence
  chemically synthesized
cttacatggtgatgagtggg

SEQ ID NO: 270464 - DNA, 20 bp, Artificial Sequence
  chemically synthesized
ttcttacatggtgatgagtg

SEQ ID NO: 270465 - DNA, 20 bp, Artificial Sequence
  chemically synthesized
attcttacatggtgatgagt

SEQ ID NO: 270466 - DNA, 20 bp, Artificial Sequence
  chemically synthesized
tattcttacatggtgatgag

SEQ ID NO: 270467 - DNA, 20 bp, Artificial Sequence
  chemically synthesized
ctgtattcttacatggtgat

SEQ ID NO: 270468 - DNA, 20 bp, Artificial Sequence
  chemically synthesized
ctccccactcatcaccatgt

SEQ ID NO: 270469 - DNA, 20 bp, Artificial Sequence
  chemically synthesized
ctttttgctgtattcttaca

SEQ ID NO: 270470 - DNA, 20 bp, Artificial Sequence
  chemically synthesized
ctcatcaccatgtaagaata

SEQ ID NO: 270471 - DNA, 20 bp, Artificial Sequence
  chemically synthesized
ccatgtaagaatacagcaaa

SEQ ID NO: 270472 - DNA, 20 bp, Artificial Sequence
  chemically synthesized
catgtaagaatacagcaaaa

SEQ ID NO: 270473 - DNA, 20 bp, Artificial Sequence
  chemically synthesized
taagaatacagcaaaaaggt

SEQ ID NO: 270474 - DNA, 20 bp, Artificial Sequence
  chemically synthesized
atacagcaaaaaggtaagac

SEQ ID NO: 270475 - DNA, 20 bp, Artificial Sequence
  chemically synthesized
cagcaaaaaggtaagacaag

SEQ ID NO: 270476 - DNA, 20 bp, Artificial Sequence
  chemically synthesized
aaaaaggtaagacaagaaga

SEQ ID NO: 270477 - DNA, 20 bp, Artificial Sequence
  chemically synthesized
gacaagaagaaagctctcct

SEQ ID NO: 270478 - DNA, 20 bp, Artificial Sequence
  chemically synthesized
acaagaagaaagctctcctc

SEQ ID NO: 270479 - DNA, 20 bp, Artificial Sequence
  chemically synthesized
atccatttcattcctgagga

SEQ ID NO: 270480 - DNA, 20 bp, Artificial Sequence
  chemically synthesized
tgatccatttcattcctgag

SEQ ID NO: 270481 - DNA, 20 bp, Artificial Sequence
  chemically synthesized
gctgatccatttcattcctg

SEQ ID NO: 270482 - DNA, 20 bp, Artificial Sequence
  chemically synthesized
tgctgatccatttcattcct

SEQ ID NO: 270483 - DNA, 20 bp, Artificial Sequence
  chemically synthesized
agctctcctcaggaatgaaa

SEQ ID NO: 270484 - DNA, 20 bp, Artificial Sequence
  chemically synthesized
tcctcaggaatgaaatggat

SEQ ID NO: 270485 - DNA, 20 bp, Artificial Sequence
  chemically synthesized
agtctgggagtgcaagatca

SEQ ID NO: 270486 - DNA, 20 bp, Artificial Sequence
  chemically synthesized
gagtctgggagtgcaagatc

SEQ ID NO: 270487 - DNA, 20 bp, Artificial Sequence
  chemically synthesized
gcaccttgatcttgcactcc

SEQ ID NO: 270488 - DNA, 20 bp, Artificial Sequence
  chemically synthesized
agtgtggagtctgggagtgc

SEQ ID NO: 270489 - DNA, 20 bp, Artificial Sequence
  chemically synthesized
tctgcaagtgtggagtctgg

SEQ ID NO: 270490 - DNA, 20 bp, Artificial Sequence
  chemically synthesized
tttctgcaagtgtggagtct

SEQ ID NO: 270491 - DNA, 20 bp, Artificial Sequence
  chemically synthesized
atttctgcaagtgtggagtc

SEQ ID NO: 270492 - DNA, 20 bp, Artificial Sequence
  chemically synthesized
aattgatttctgcaagtgtg

SEQ ID NO: 270493 - DNA, 20 bp, Artificial Sequence
  chemically synthesized
actcccagactccacacttg

SEQ ID NO: 270494 - DNA, 20 bp, Artificial Sequence
  chemically synthesized
taaattgatttctgcaagtg

SEQ ID NO: 270495 - DNA, 20 bp, Artificial Sequence
  chemically synthesized
ctaggtaaattgatttctgc

SEQ ID NO: 270496 - DNA, 20 bp, Artificial Sequence
  chemically synthesized
cttgcagaaatcaatttacc

SEQ ID NO: 270497 - DNA, 20 bp, Artificial Sequence
  chemically synthesized
ataacacaataaaataaact

SEQ ID NO: 270498 - DNA, 20 bp, Artificial Sequence
  chemically synthesized
cataacacaataaaataaac

SEQ ID NO: 270499 - DNA, 20 bp, Artificial Sequence
  chemically synthesized
tagtttattttattgtgtta

SEQ ID NO: 270500 - DNA, 20 bp, Artificial Sequence
  chemically synthesized
tttattttattgtgttatgg

SEQ ID NO: 270501 - DNA, 20 bp, Artificial Sequence
  chemically synthesized
ttttattgtgttatggcagc

SEQ ID NO: 270502 - DNA, 20 bp, Artificial Sequence
  chemically synthesized
ttattgtgttatggcagcca

SEQ ID NO: 270503 - DNA, 20 bp, Artificial Sequence
  chemically synthesized
ctttttggagtaatcagctc

SEQ ID NO: 270504 - DNA, 20 bp, Artificial Sequence
  chemically synthesized
cattacctttttggagtaat

SEQ ID NO: 270505 - DNA, 20 bp, Artificial Sequence
  chemically synthesized
ccagagctgattactccaaa

SEQ ID NO: 270506 - DNA, 20 bp, Artificial Sequence
  chemically synthesized
cagagctgattactccaaaa

SEQ ID NO: 270507 - DNA, 20 bp, Artificial Sequence
  chemically synthesized
gagtatgcattacctttttg

SEQ ID NO: 270508 - DNA, 20 bp, Artificial Sequence
  chemically synthesized
ttgagtatgcattacctttt

SEQ ID NO: 270509 - DNA, 20 bp, Artificial Sequence
  chemically synthesized
aggtaatgcatactcaattg

SEQ ID NO: 270510 - DNA, 20 bp, Artificial Sequence
  chemically synthesized
tggttgtgtctgccacaatt

SEQ ID NO: 270511 - DNA, 20 bp, Artificial Sequence
  chemically synthesized
taatgcatactcaattgtgg

SEQ ID NO: 270512 - DNA, 20 bp, Artificial Sequence
  chemically synthesized
aaccatcttcagaatttata

SEQ ID NO: 270513 - DNA, 20 bp, Artificial Sequence
  chemically synthesized
acacaaccatataaattctg

SEQ ID NO: 270514 - DNA, 20 bp, Artificial Sequence
  chemically synthesized
aaccatataaattctgaaga

SEQ ID NO: 270515 - DNA, 20 bp, Artificial Sequence
  chemically synthesized
ccttctattttaaccatctt

SEQ ID NO: 270516 - DNA, 20 bp, Artificial Sequence
  chemically synthesized
aattctgaagatggttaaaa

SEQ ID NO: 270517 - DNA, 20 bp, Artificial Sequence
  chemically synthesized
tctgaagatggttaaaatag

SEQ ID NO: 270518 - DNA, 20 bp, Artificial Sequence
  chemically synthesized
ctgaagatggttaaaataga

SEQ ID NO: 270519 - DNA, 20 bp, Artificial Sequence
  chemically synthesized
tgaagatggttaaaatagaa

SEQ ID NO: 270520 - DNA, 20 bp, Artificial Sequence
  chemically synthesized
attattctttttatgtaaga

SEQ ID NO: 270521 - DNA, 20 bp, Artificial Sequence
  chemically synthesized
cattattctttttatgtaag

SEQ ID NO: 270522 - DNA, 20 bp, Artificial Sequence
  chemically synthesized
agggttccttcttacataaa

SEQ ID NO: 270523 - DNA, 20 bp, Artificial Sequence
  chemically synthesized
ttacattattctttttatgt

SEQ ID NO: 270524 - DNA, 20 bp, Artificial Sequence
  chemically synthesized
aatgaaagcaaaggcaacaa

SEQ ID NO: 270525 - DNA, 20 bp, Artificial Sequence
  chemically synthesized
taatgaaagcaaaggcaaca

SEQ ID NO: 270526 - DNA, 20 bp, Artificial Sequence
  chemically synthesized
gctttgtctaatgaaagcaa

SEQ ID NO: 270527 - DNA, 20 bp, Artificial Sequence
  chemically synthesized
agctttgtctaatgaaagca

SEQ ID NO: 270528 - DNA, 20 bp, Artificial Sequence
  chemically synthesized
tttgttgcctttgctttcat

SEQ ID NO: 270529 - DNA, 20 bp, Artificial Sequence
  chemically synthesized
gcagtagctttgtctaatga

SEQ ID NO: 270530 - DNA, 20 bp, Artificial Sequence
  chemically synthesized
gcctttgctttcattagaca

SEQ ID NO: 270531 - DNA, 20 bp, Artificial Sequence
  chemically synthesized
caaaatattttcaacagcag

SEQ ID NO: 270532 - DNA, 20 bp, Artificial Sequence
  chemically synthesized
actcaaaatattttcaacag

SEQ ID NO: 270533 - DNA, 20 bp, Artificial Sequence
  chemically synthesized
ttgactcaaaatattttcaa

SEQ ID NO: 270534 - DNA, 20 bp, Artificial Sequence
  chemically synthesized
actgctgttgaaaatatttt

SEQ ID NO: 270535 - DNA, 20 bp, Artificial Sequence
  chemically synthesized
aaatattttgagtcaaaatc

SEQ ID NO: 270536 - DNA, 20 bp, Artificial Sequence
  chemically synthesized
ctgagaataaaaatattgtc

SEQ ID NO: 270537 - DNA, 20 bp, Artificial Sequence
  chemically synthesized
ccagacaatatttttattct

SEQ ID NO: 270538 - DNA, 20 bp, Artificial Sequence
  chemically synthesized
cagacaatatttttattctc

SEQ ID NO: 270539 - DNA, 20 bp, Artificial Sequence
  chemically synthesized
aatatttttattctcaggca

SEQ ID NO: 270540 - DNA, 20 bp, Artificial Sequence
  chemically synthesized
aagtcctatattctttgcct

SEQ ID NO: 270541 - DNA, 20 bp, Artificial Sequence
  chemically synthesized
ttattctcaggcaaagaata

SEQ ID NO: 270542 - DNA, 20 bp, Artificial Sequence
  chemically synthesized
tattctcaggcaaagaatat

SEQ ID NO: 270543 - DNA, 20 bp, Artificial Sequence
  chemically synthesized
ggcaaagaatataggactta

SEQ ID NO: 270544 - DNA, 20 bp, Artificial Sequence
  chemically synthesized
ccatcttataaaaatgctgt

SEQ ID NO: 270545 - DNA, 20 bp, Artificial Sequence
  chemically synthesized
aggacttacagcatttttat

SEQ ID NO: 270546 - DNA, 20 bp, Artificial Sequence
  chemically synthesized
cttacagcatttttataaga

SEQ ID NO: 270547 - DNA, 20 bp, Artificial Sequence
  chemically synthesized
ggtatttatacatgatccct

SEQ ID NO: 270548 - DNA, 20 bp, Artificial Sequence
  chemically synthesized
gtagaaacatttgtgactaa

SEQ ID NO: 270549 - DNA, 20 bp, Artificial Sequence
  chemically synthesized
tgtagaaacatttgtgacta

SEQ ID NO: 270550 - DNA, 20 bp, Artificial Sequence
  chemically synthesized
atgtagaaacatttgtgact

SEQ ID NO: 270551 - DNA, 20 bp, Artificial Sequence
  chemically synthesized
ttttgaagtaaatattgatg

SEQ ID NO: 270552 - DNA, 20 bp, Artificial Sequence
  chemically synthesized
aggccaaacatttatttttg

SEQ ID NO: 270553 - DNA, 20 bp, Artificial Sequence
  chemically synthesized
ttacttcaaaaataaatgtt

SEQ ID NO: 270554 - DNA, 20 bp, Artificial Sequence
  chemically synthesized
acagaatacagcaaaaacat

SEQ ID NO: 270555 - DNA, 20 bp, Artificial Sequence
  chemically synthesized
cacagaatacagcaaaaaca

SEQ ID NO: 270556 - DNA, 20 bp, Artificial Sequence
  chemically synthesized
tttaatagtatcacagaata

SEQ ID NO: 270557 - DNA, 20 bp, Artificial Sequence
  chemically synthesized
atttaactttaatagtatca

SEQ ID NO: 270558 - DNA, 20 bp, Artificial Sequence
  chemically synthesized
tgtattctgtgatactatta

SEQ ID NO: 270559 - DNA, 20 bp, Artificial Sequence
  chemically synthesized
gaaatcatatttaactttaa

SEQ ID NO: 270560 - DNA, 20 bp, Artificial Sequence
  chemically synthesized
aagcaaaataaaagtgtatg

SEQ ID NO: 270561 - DNA, 20 bp, Artificial Sequence
  chemically synthesized
atatccttaaagcaaaataa

SEQ ID NO: 270562 - DNA, 20 bp, Artificial Sequence
  chemically synthesized
atacacttttattttgcttt

SEQ ID NO: 270563 - DNA, 20 bp, Artificial Sequence
  chemically synthesized
tacacttttattttgcttta

SEQ ID NO: 270564 - DNA, 20 bp, Artificial Sequence
  chemically synthesized
gccacatagtaatatcctta

SEQ ID NO: 270565 - DNA, 20 bp, Artificial Sequence
  chemically synthesized
gctttaaggatattactatg

SEQ ID NO: 270566 - DNA, 20 bp, Artificial Sequence
  chemically synthesized
tattctaaccatttgccaca

SEQ ID NO: 270567 - DNA, 20 bp, Artificial Sequence
  chemically synthesized
ggatattactatgtggcaaa

SEQ ID NO: 270568 - DNA, 20 bp, Artificial Sequence
  chemically synthesized
attactatgtggcaaatggt

SEQ ID NO: 270569 - DNA, 20 bp, Artificial Sequence
  chemically synthesized
caaatggttagaataaacac

SEQ ID NO: 270570 - DNA, 20 bp, Artificial Sequence
  chemically synthesized
ttagaataaacacaagctct

SEQ ID NO: 270571 - DNA, 20 bp, Artificial Sequence
  chemically synthesized
tcctgaaaatacatatctga

SEQ ID NO: 270572 - DNA, 20 bp, Artificial Sequence
  chemically synthesized
attcctgaaaatacatatct

SEQ ID NO: 270573 - DNA, 20 bp, Artificial Sequence
  chemically synthesized
agctctcagatatgtatttt

SEQ ID NO: 270574 - DNA, 20 bp, Artificial Sequence
  chemically synthesized
gctctcagatatgtattttc

SEQ ID NO: 270575 - DNA, 20 bp, Artificial Sequence
  chemically synthesized
tatgtattttcaggaataaa

SEQ ID NO: 270576 - DNA, 20 bp, Artificial Sequence
  chemically synthesized
atgtattttcaggaataaat

SEQ ID NO: 270577 - DNA, 20 bp, Artificial Sequence
  chemically synthesized
tgtattttcaggaataaata

SEQ ID NO: 270578 - DNA, 20 bp, Artificial Sequence
  chemically synthesized
atagggtttgacatcattac

SEQ ID NO: 270579 - DNA, 20 bp, Artificial Sequence
  chemically synthesized
gccctgagttgattattatt

SEQ ID NO: 270580 - DNA, 20 bp, Artificial Sequence
  chemically synthesized
tttctgaataataatcaact

SEQ ID NO: 270581 - DNA, 20 bp, Artificial Sequence
  chemically synthesized
ttctgaataataatcaactc

SEQ ID NO: 270582 - DNA, 20 bp, Artificial Sequence
  chemically synthesized
tctgaataataatcaactca

SEQ ID NO: 270583 - DNA, 20 bp, Artificial Sequence
  chemically synthesized
tagacgaataatagtgccct

SEQ ID NO: 270584 - DNA, 20 bp, Artificial Sequence
  chemically synthesized
aagtgacattagacgaataa

SEQ ID NO: 270585 - DNA, 20 bp, Artificial Sequence
  chemically synthesized
taaagcaatgaaagtgacat

SEQ ID NO: 270586 - DNA, 20 bp, Artificial Sequence
  chemically synthesized
attagaatttaaagcaatga

SEQ ID NO: 270587 - DNA, 20 bp, Artificial Sequence
  chemically synthesized
aataaatcaattagaattta

SEQ ID NO: 270588 - DNA, 20 bp, Artificial Sequence
  chemically synthesized
aaataacagaataaatcaat

SEQ ID NO: 270589 - DNA, 20 bp, Artificial Sequence
  chemically synthesized
gtaaatttaacataaaataa

SEQ ID NO: 270590 - DNA, 20 bp, Artificial Sequence
  chemically synthesized
tttttacgaaatcattgcaa

SEQ ID NO: 270591 - DNA, 20 bp, Artificial Sequence
  chemically synthesized
aatttttacgaaatcattgc

SEQ ID NO: 270592 - DNA, 20 bp, Artificial Sequence
  chemically synthesized
gtgggctttttatttgtcat

SEQ ID NO: 270593 - DNA, 20 bp, Artificial Sequence
  chemically synthesized
tgtgggctttttatttgtca

SEQ ID NO: 270594 - DNA, 20 bp, Artificial Sequence
  chemically synthesized
aaattcctatgacaaataaa

SEQ ID NO: 270595 - DNA, 20 bp, Artificial Sequence
  chemically synthesized
aatagaggttttttgtgtgt

SEQ ID NO: 270596 - DNA, 20 bp, Artificial Sequence
  chemically synthesized
aaatagaggttttttgtgtg

SEQ ID NO: 270597 - DNA, 20 bp, Artificial Sequence
  chemically synthesized
cagtttactttttaaaatag

SEQ ID NO: 270598 - DNA, 20 bp, Artificial Sequence
  chemically synthesized
tcagtttactttttaaaata

SEQ ID NO: 270599 - DNA, 20 bp, Artificial Sequence
  chemically synthesized
caaaaaacctctattttaaa

SEQ ID NO: 270600 - DNA, 20 bp, Artificial Sequence
  chemically synthesized
tctcagtttactttttaaaa

SEQ ID NO: 270601 - DNA, 20 bp, Artificial Sequence
  chemically synthesized
tctattttaaaaagtaaact

SEQ ID NO: 270602 - DNA, 20 bp, Artificial Sequence
  chemically synthesized
tttggtaaaggggagtttct

SEQ ID NO: 270603 - DNA, 20 bp, Artificial Sequence
  chemically synthesized
atatatgttttggtaaaggg

SEQ ID NO: 270604 - DNA, 20 bp, Artificial Sequence
  chemically synthesized
aaatatatgttttggtaaag

SEQ ID NO: 270605 - DNA, 20 bp, Artificial Sequence
  chemically synthesized
aaaatatatgttttggtaaa

SEQ ID NO: 270606 - DNA, 20 bp, Artificial Sequence
  chemically synthesized
gaaaatatatgttttggtaa

SEQ ID NO: 270607 - DNA, 20 bp, Artificial Sequence
  chemically synthesized
agaaaatatatgttttggta

SEQ ID NO: 270608 - DNA, 20 bp, Artificial Sequence
  chemically synthesized
aattaagaaaatatatgttt

SEQ ID NO: 270609 - DNA, 20 bp, Artificial Sequence
  chemically synthesized
ggatgagtattttttaaatt

SEQ ID NO: 270610 - DNA, 20 bp, Artificial Sequence
  chemically synthesized
tactaaaataatgtatggat

SEQ ID NO: 270611 - DNA, 20 bp, Artificial Sequence
  chemically synthesized
ctttatactaaaataatgta

SEQ ID NO: 270612 - DNA, 20 bp, Artificial Sequence
  chemically synthesized
tactcatccatacattattt

SEQ ID NO: 270613 - DNA, 20 bp, Artificial Sequence
  chemically synthesized
ccatacattattttagtata

SEQ ID NO: 270614 - DNA, 20 bp, Artificial Sequence
  chemically synthesized
tattttagtataaagtcaca

SEQ ID NO: 270615 - DNA, 20 bp, Artificial Sequence
  chemically synthesized
attttagtataaagtcacac

SEQ ID NO: 270616 - DNA, 20 bp, Artificial Sequence
  chemically synthesized
agttataaattacaaatttt

SEQ ID NO: 270617 - DNA, 20 bp, Artificial Sequence
  chemically synthesized
aataaaatgaatgtatgtta

SEQ ID NO: 270618 - DNA, 20 bp, Artificial Sequence
  chemically synthesized
ttacaaaaacaatatatctc

SEQ ID NO: 270619 - DNA, 20 bp, Artificial Sequence
  chemically synthesized
atgctacagcttcagttctg

SEQ ID NO: 270620 - DNA, 20 bp, Artificial Sequence
  chemically synthesized
acaatatatctccagaactg

SEQ ID NO: 270621 - DNA, 20 bp, Artificial Sequence
  chemically synthesized
taatgctacagcttcagttc

SEQ ID NO: 270622 - DNA, 20 bp, Artificial Sequence
  chemically synthesized
tatctccagaactgaagctg

SEQ ID NO: 270623 - DNA, 20 bp, Artificial Sequence
  chemically synthesized
taatcctaatgctacagctt

SEQ ID NO: 270624 - DNA, 20 bp, Artificial Sequence
  chemically synthesized
cagaactgaagctgtagcat

SEQ ID NO: 270625 - DNA, 20 bp, Artificial Sequence
  chemically synthesized
agaactgaagctgtagcatt

SEQ ID NO: 270626 - DNA, 20 bp, Artificial Sequence
  chemically synthesized
taatattaatcctaatgcta

SEQ ID NO: 270627 - DNA, 20 bp, Artificial Sequence
  chemically synthesized
tgtagcattaggattaatat

SEQ ID NO: 270628 - DNA, 20 bp, Artificial Sequence
  chemically synthesized
tagcattaggattaatatta

SEQ ID NO: 270629 - DNA, 20 bp, Artificial Sequence
  chemically synthesized
ctctagtctcaaatgtatta

SEQ ID NO: 270630 - DNA, 20 bp, Artificial Sequence
  chemically synthesized
atctctagtctcaaatgtat

SEQ ID NO: 270631 - DNA, 20 bp, Artificial Sequence
  chemically synthesized
attcaatctctaatacattt

SEQ ID NO: 270632 - DNA, 20 bp, Artificial Sequence
  chemically synthesized
atctctaatacatttgagac

SEQ ID NO: 270633 - DNA, 20 bp, Artificial Sequence
  chemically synthesized
ctctaatacatttgagacta

SEQ ID NO: 270634 - DNA, 20 bp, Artificial Sequence
  chemically synthesized
acgaaggactgagtaatctc

SEQ ID NO: 270635 - DNA, 20 bp, Artificial Sequence
  chemically synthesized
atttgagactagagattact

SEQ ID NO: 270636 - DNA, 20 bp, Artificial Sequence
  chemically synthesized
aacatcaattacgaaggact

SEQ ID NO: 270637 - DNA, 20 bp, Artificial Sequence
  chemically synthesized
atatttaacatcaattacga

SEQ ID NO: 270638 - DNA, 20 bp, Artificial Sequence
  chemically synthesized
catatttaacatcaattacg

SEQ ID NO: 270639 - DNA, 20 bp, Artificial Sequence
  chemically synthesized
gatgttaaatatgaaataat

SEQ ID NO: 270640 - DNA, 20 bp, Artificial Sequence
  chemically synthesized
ccggtgcttatcaattttta

SEQ ID NO: 270641 - DNA, 20 bp, Artificial Sequence
  chemically synthesized
tggcatctataaaaattgat

SEQ ID NO: 270642 - DNA, 20 bp, Artificial Sequence
  chemically synthesized
ctataaaaattgataagcac

SEQ ID NO: 270643 - DNA, 20 bp, Artificial Sequence
  chemically synthesized
aaattgataagcaccggaat

SEQ ID NO: 270644 - DNA, 20 bp, Artificial Sequence
  chemically synthesized
aattgataagcaccggaata

SEQ ID NO: 270645 - DNA, 20 bp, Artificial Sequence
  chemically synthesized
ctgcacttgataccttattc

SEQ ID NO: 270646 - DNA, 20 bp, Artificial Sequence
  chemically synthesized
aagcaccggaataaggtatc

SEQ ID NO: 270647 - DNA, 20 bp, Artificial Sequence
  chemically synthesized
ccggaataaggtatcaagtg

SEQ ID NO: 270648 - DNA, 20 bp, Artificial Sequence
  chemically synthesized
agatacaatttttctgtctg

SEQ ID NO: 270649 - DNA, 20 bp, Artificial Sequence
  chemically synthesized
tgtttaaagatcaccacaga

SEQ ID NO: 270650 - DNA, 20 bp, Artificial Sequence
  chemically synthesized
tcattgtttaaagatcacca

SEQ ID NO: 270651 - DNA, 20 bp, Artificial Sequence
  chemically synthesized
gagaaatttatcattgttta

SEQ ID NO: 270652 - DNA, 20 bp, Artificial Sequence
  chemically synthesized
taaacaatgataaatttctc

SEQ ID NO: 270653 - DNA, 20 bp, Artificial Sequence
  chemically synthesized
aacaatgataaatttctcta

SEQ ID NO: 270654 - DNA, 20 bp, Artificial Sequence
  chemically synthesized
acaatgataaatttctctag

SEQ ID NO: 270655 - DNA, 20 bp, Artificial Sequence
  chemically synthesized
agatacctttatatcctcta

SEQ ID NO: 270656 - DNA, 20 bp, Artificial Sequence
  chemically synthesized
tgagatacctttatatcctc

SEQ ID NO: 270657 - DNA, 20 bp, Artificial Sequence
  chemically synthesized
aaatttctctagaggatata

SEQ ID NO: 270658 - DNA, 20 bp, Artificial Sequence
  chemically synthesized
aatttctctagaggatataa

SEQ ID NO: 270659 - DNA, 20 bp, Artificial Sequence
  chemically synthesized
tataaaggtatctcattcca

SEQ ID NO: 270660 - DNA, 20 bp, Artificial Sequence
  chemically synthesized
ataaaggtatctcattccaa

SEQ ID NO: 270661 - DNA, 20 bp, Artificial Sequence
  chemically synthesized
taccaaggtacctttggaat

SEQ ID NO: 270662 - DNA, 20 bp, Artificial Sequence
  chemically synthesized
ttggtctaccaaggtacctt

SEQ ID NO: 270663 - DNA, 20 bp, Artificial Sequence
  chemically synthesized
atctcattccaaaggtacct

SEQ ID NO: 270664 - DNA, 20 bp, Artificial Sequence
  chemically synthesized
tcattccaaaggtaccttgg

SEQ ID NO: 270665 - DNA, 20 bp, Artificial Sequence
  chemically synthesized
actgttcatttggtctacca

SEQ ID NO: 270666 - DNA, 20 bp, Artificial Sequence
  chemically synthesized
aactgttcatttggtctacc

SEQ ID NO: 270667 - DNA, 20 bp, Artificial Sequence
  chemically synthesized
accttggtagaccaaatgaa

SEQ ID NO: 270668 - DNA, 20 bp, Artificial Sequence
  chemically synthesized
atacatttcaactgttcatt

SEQ ID NO: 270669 - DNA, 20 bp, Artificial Sequence
  chemically synthesized
gttgaaatgtattttatttc

SEQ ID NO: 270670 - DNA, 20 bp, Artificial Sequence
  chemically synthesized
ctgatactcaattgatggga

SEQ ID NO: 270671 - DNA, 20 bp, Artificial Sequence
  chemically synthesized
ataatgctttcccatcaatt

SEQ ID NO: 270672 - DNA, 20 bp, Artificial Sequence
  chemically synthesized
aacactgatactcaattgat

SEQ ID NO: 270673 - DNA, 20 bp, Artificial Sequence
  chemically synthesized
aaacactgatactcaattga

SEQ ID NO: 270674 - DNA, 20 bp, Artificial Sequence
  chemically synthesized
ctttcccatcaattgagtat

SEQ ID NO: 270675 - DNA, 20 bp, Artificial Sequence
  chemically synthesized
ctcctactttgtttcaaaat

SEQ ID NO: 270676 - DNA, 20 bp, Artificial Sequence
  chemically synthesized
gtgtttcttattttgaaaca

SEQ ID NO: 270677 - DNA, 20 bp, Artificial Sequence
  chemically synthesized
tttcttattttgaaacaaag

SEQ ID NO: 270678 - DNA, 20 bp, Artificial Sequence
  chemically synthesized
ttcttattttgaaacaaagt

SEQ ID NO: 270679 - DNA, 20 bp, Artificial Sequence
  chemically synthesized
cttattttgaaacaaagtag

SEQ ID NO: 270680 - DNA, 20 bp, Artificial Sequence
  chemically synthesized
agtaggagaatcttttgtca

SEQ ID NO: 270681 - DNA, 20 bp, Artificial Sequence
  chemically synthesized
gtaggagaatcttttgtcat

SEQ ID NO: 270682 - DNA, 20 bp, Artificial Sequence
  chemically synthesized
ttgttgccatcctatgacaa

SEQ ID NO: 270683 - DNA, 20 bp, Artificial Sequence
  chemically synthesized
gagaatcttttgtcatagga

SEQ ID NO: 270684 - DNA, 20 bp, Artificial Sequence
  chemically synthesized
atatttgttatgttttaaac

SEQ ID NO: 270685 - DNA, 20 bp, Artificial Sequence
  chemically synthesized
aaaacataacaaatattaat

SEQ ID NO: 270686 - DNA, 20 bp, Artificial Sequence
  chemically synthesized
aacataacaaatattaatta

SEQ ID NO: 270687 - DNA, 20 bp, Artificial Sequence
  chemically synthesized
acataacaaatattaattag

SEQ ID NO: 270688 - DNA, 20 bp, Artificial Sequence
  chemically synthesized
cataacaaatattaattaga

SEQ ID NO: 270689 - DNA, 20 bp, Artificial Sequence
  chemically synthesized
ggtttttaaaatataaaaac

SEQ ID NO: 270690 - DNA, 20 bp, Artificial Sequence
  chemically synthesized
atataaaaacaagactatct

SEQ ID NO: 270691 - DNA, 20 bp, Artificial Sequence
  chemically synthesized
aagtaatcatttttcttaga

SEQ ID NO: 270692 - DNA, 20 bp, Artificial Sequence
  chemically synthesized
ctggaagtaatcatttttct

SEQ ID NO: 270693 - DNA, 20 bp, Artificial Sequence
  chemically synthesized
ctaagaaaaatgattacttc

SEQ ID NO: 270694 - DNA, 20 bp, Artificial Sequence
  chemically synthesized
ataattaagttgaaatctgg

SEQ ID NO: 270695 - DNA, 20 bp, Artificial Sequence
  chemically synthesized
tttataattaagttgaaatc

SEQ ID NO: 270696 - DNA, 20 bp, Artificial Sequence
  chemically synthesized
agaaagtaaattttataatt

SEQ ID NO: 270697 - DNA, 20 bp, Artificial Sequence
  chemically synthesized
attataaaatttactttcta

SEQ ID NO: 270698 - DNA, 20 bp, Artificial Sequence
  chemically synthesized
tgccaattccttaccataga

SEQ ID NO: 270699 - DNA, 20 bp, Artificial Sequence
  chemically synthesized
taaaatttactttctatggt

SEQ ID NO: 270700 - DNA, 20 bp, Artificial Sequence
  chemically synthesized
aaaatttactttctatggta

SEQ ID NO: 270701 - DNA, 20 bp, Artificial Sequence
  chemically synthesized
tagttgccaattccttacca

SEQ ID NO: 270702 - DNA, 20 bp, Artificial Sequence
  chemically synthesized
tactttctatggtaaggaat

SEQ ID NO: 270703 - DNA, 20 bp, Artificial Sequence
  chemically synthesized
aggttatatcttcaagatat

SEQ ID NO: 270704 - DNA, 20 bp, Artificial Sequence
  chemically synthesized
aattggcaactaatatcttg

SEQ ID NO: 270705 - DNA, 20 bp, Artificial Sequence
  chemically synthesized
agattgaaggttatatcttc

SEQ ID NO: 270706 - DNA, 20 bp, Artificial Sequence
  chemically synthesized
tcagcctgaaagtagattga

SEQ ID NO: 270707 - DNA, 20 bp, Artificial Sequence
  chemically synthesized
ctcagcctgaaagtagattg

SEQ ID NO: 270708 - DNA, 20 bp, Artificial Sequence
  chemically synthesized
tataaccttcaatctacttt

SEQ ID NO: 270709 - DNA, 20 bp, Artificial Sequence
  chemically synthesized
ataaccttcaatctactttc

SEQ ID NO: 270710 - DNA, 20 bp, Artificial Sequence
  chemically synthesized
cttgcatctcagcctgaaag

SEQ ID NO: 270711 - DNA, 20 bp, Artificial Sequence
  chemically synthesized
cttcaatctactttcaggct

SEQ ID NO: 270712 - DNA, 20 bp, Artificial Sequence
  chemically synthesized
tttcttgcatctcagcctga

SEQ ID NO: 270713 - DNA, 20 bp, Artificial Sequence
  chemically synthesized
ctactttcaggctgagatgc

SEQ ID NO: 270714 - DNA, 20 bp, Artificial Sequence
  chemically synthesized
gaggcatatttcttgcatct

SEQ ID NO: 270715 - DNA, 20 bp, Artificial Sequence
  chemically synthesized
gcaagaaatatgcctctcct

SEQ ID NO: 270716 - DNA, 20 bp, Artificial Sequence
  chemically synthesized
tttgagaaatagctaaggag

SEQ ID NO: 270717 - DNA, 20 bp, Artificial Sequence
  chemically synthesized
gtttgagaaatagctaagga

SEQ ID NO: 270718 - DNA, 20 bp, Artificial Sequence
  chemically synthesized
atgtttgagaaatagctaag

SEQ ID NO: 270719 - DNA, 20 bp, Artificial Sequence
  chemically synthesized
ccatgtttgagaaatagcta

SEQ ID NO: 270720 - DNA, 20 bp, Artificial Sequence
  chemically synthesized
tccatgtttgagaaatagct

SEQ ID NO: 270721 - DNA, 20 bp, Artificial Sequence
  chemically synthesized
gaatgtccatgtttgagaaa

SEQ ID NO: 270722 - DNA, 20 bp, Artificial Sequence
  chemically synthesized
ccttagctatttctcaaaca

SEQ ID NO: 270723 - DNA, 20 bp, Artificial Sequence
  chemically synthesized
aaatatgaatgtccatgttt

SEQ ID NO: 270724 - DNA, 20 bp, Artificial Sequence
  chemically synthesized
ggacattcatatttctgtct

SEQ ID NO: 270725 - DNA, 20 bp, Artificial Sequence
  chemically synthesized
aattgtcacctcatcttaga

SEQ ID NO: 270726 - DNA, 20 bp, Artificial Sequence
  chemically synthesized
ttcatatttctgtctaagat

SEQ ID NO: 270727 - DNA, 20 bp, Artificial Sequence
  chemically synthesized
tcatatttctgtctaagatg

SEQ ID NO: 270728 - DNA, 20 bp, Artificial Sequence
  chemically synthesized
ataaaattgtcacctcatct

SEQ ID NO: 270729 - DNA, 20 bp, Artificial Sequence
  chemically synthesized
agatgaggtgacaattttat

SEQ ID NO: 270730 - DNA, 20 bp, Artificial Sequence
  chemically synthesized
tgatgttgttctattcacta

SEQ ID NO: 270731 - DNA, 20 bp, Artificial Sequence
  chemically synthesized
aggttctcaactttagtgaa

SEQ ID NO: 270732 - DNA, 20 bp, Artificial Sequence
  chemically synthesized
ttgttctattcactaaagtt

SEQ ID NO: 270733 - DNA, 20 bp, Artificial Sequence
  chemically synthesized
acaactcaggttctcaactt

SEQ ID NO: 270734 - DNA, 20 bp, Artificial Sequence
  chemically synthesized
ttcactaaagttgagaacct

SEQ ID NO: 270735 - DNA, 20 bp, Artificial Sequence
  chemically synthesized
aagttatatttttacaactc

SEQ ID NO: 270736 - DNA, 20 bp, Artificial Sequence
  chemically synthesized
aaagttatatttttacaact

SEQ ID NO: 270737 - DNA, 20 bp, Artificial Sequence
  chemically synthesized
tgaatttcttggaggataaa

SEQ ID NO: 270738 - DNA, 20 bp, Artificial Sequence
  chemically synthesized
aatataactttttatcctcc

SEQ ID NO: 270739 - DNA, 20 bp, Artificial Sequence
  chemically synthesized
gaaagaactgaatttcttgg

SEQ ID NO: 270740 - DNA, 20 bp, Artificial Sequence
  chemically synthesized
tgaaagaactgaatttcttg

SEQ ID NO: 270741 - DNA, 20 bp, Artificial Sequence
  chemically synthesized
tttttatcctccaagaaatt

SEQ ID NO: 270742 - DNA, 20 bp, Artificial Sequence
  chemically synthesized
actgaaagaactgaatttct

SEQ ID NO: 270743 - DNA, 20 bp, Artificial Sequence
  chemically synthesized
tccaagaaattcagttcttt

SEQ ID NO: 270744 - DNA, 20 bp, Artificial Sequence
  chemically synthesized
agaaattcagttctttcagt

SEQ ID NO: 270745 - DNA, 20 bp, Artificial Sequence
  chemically synthesized
tttaatttcgttctgactga

SEQ ID NO: 270746 - DNA, 20 bp, Artificial Sequence
  chemically synthesized
tcagaacgaaattaaaatgt

SEQ ID NO: 270747 - DNA, 20 bp, Artificial Sequence
  chemically synthesized
gaacgaaattaaaatgttag

SEQ ID NO: 270748 - DNA, 20 bp, Artificial Sequence
  chemically synthesized
aaatgttagaagtccatttt

SEQ ID NO: 270749 - DNA, 20 bp, Artificial Sequence
  chemically synthesized
tatcttagtatttccaaaaa

SEQ ID NO: 270750 - DNA, 20 bp, Artificial Sequence
  chemically synthesized
agtccatttttggaaatact

SEQ ID NO: 270751 - DNA, 20 bp, Artificial Sequence
  chemically synthesized
ctttccataaacggatatct

SEQ ID NO: 270752 - DNA, 20 bp, Artificial Sequence
  chemically synthesized
aatactaagatatccgttta

SEQ ID NO: 270753 - DNA, 20 bp, Artificial Sequence
  chemically synthesized
atgggatatctttccataaa

SEQ ID NO: 270754 - DNA, 20 bp, Artificial Sequence
  chemically synthesized
ctaagatatccgtttatgga

SEQ ID NO: 270755 - DNA, 20 bp, Artificial Sequence
  chemically synthesized
ggaaagatatcccatattca

SEQ ID NO: 270756 - DNA, 20 bp, Artificial Sequence
  chemically synthesized
ttattccaatccatgaatat

SEQ ID NO: 270757 - DNA, 20 bp, Artificial Sequence
  chemically synthesized
tttattccaatccatgaata

SEQ ID NO: 270758 - DNA, 20 bp, Artificial Sequence
  chemically synthesized
gatatcccatattcatggat

SEQ ID NO: 270759 - DNA, 20 bp, Artificial Sequence
  chemically synthesized
ttggaataaataatattgtt

SEQ ID NO: 270760 - DNA, 20 bp, Artificial Sequence
  chemically synthesized
gtaaattgctttgagtggta

SEQ ID NO: 270761 - DNA, 20 bp, Artificial Sequence
  chemically synthesized
taagatgtctgtaccactca

SEQ ID NO: 270762 - DNA, 20 bp, Artificial Sequence
  chemically synthesized
agtctgtaaattgctttgag

SEQ ID NO: 270763 - DNA, 20 bp, Artificial Sequence
  chemically synthesized
ttaagtctgtaaattgcttt

SEQ ID NO: 270764 - DNA, 20 bp, Artificial Sequence
  chemically synthesized
gtaccactcaaagcaattta

SEQ ID NO: 270765 - DNA, 20 bp, Artificial Sequence
  chemically synthesized
attttaatagggattgcatt

SEQ ID NO: 270766 - DNA, 20 bp, Artificial Sequence
  chemically synthesized
atgtcactggaattttaata

SEQ ID NO: 270767 - DNA, 20 bp, Artificial Sequence
  chemically synthesized
aatgtcactggaattttaat

SEQ ID NO: 270768 - DNA, 20 bp, Artificial Sequence
  chemically synthesized
aaatgtcactggaattttaa

SEQ ID NO: 270769 - DNA, 20 bp, Artificial Sequence
  chemically synthesized
tgcaatccctattaaaattc

SEQ ID NO: 270770 - DNA, 20 bp, Artificial Sequence
  chemically synthesized
acatctgccaaaaatgtcac

SEQ ID NO: 270771 - DNA, 20 bp, Artificial Sequence
  chemically synthesized
taaaattccagtgacatttt

SEQ ID NO: 270772 - DNA, 20 bp, Artificial Sequence
  chemically synthesized
aattccagtgacatttttgg

SEQ ID NO: 270773 - DNA, 20 bp, Artificial Sequence
  chemically synthesized
agtgacatttttggcagatg

SEQ ID NO: 270774 - DNA, 20 bp, Artificial Sequence
  chemically synthesized
gacatttttggcagatgtag

SEQ ID NO: 270775 - DNA, 20 bp, Artificial Sequence
  chemically synthesized
tttttggcagatgtagaaga

SEQ ID NO: 270776 - DNA, 20 bp, Artificial Sequence
  chemically synthesized
tgttgttcaaaatgaaattt

SEQ ID NO: 270777 - DNA, 20 bp, Artificial Sequence
  chemically synthesized
ttgttgttcaaaatgaaatt

SEQ ID NO: 270778 - DNA, 20 bp, Artificial Sequence
  chemically synthesized
aatttcattttgaacaacaa

SEQ ID NO: 270779 - DNA, 20 bp, Artificial Sequence
  chemically synthesized
attttgaacaacaaaagacc

SEQ ID NO: 270780 - DNA, 20 bp, Artificial Sequence
  chemically synthesized
gaacaacaaaagacccagaa

SEQ ID NO: 270781 - DNA, 20 bp, Artificial Sequence
  chemically synthesized
aagattgctttggctattct

SEQ ID NO: 270782 - DNA, 20 bp, Artificial Sequence
  chemically synthesized
taagattgctttggctattc

SEQ ID NO: 270783 - DNA, 20 bp, Artificial Sequence
  chemically synthesized
caaaagacccagaatagcca

SEQ ID NO: 270784 - DNA, 20 bp, Artificial Sequence
  chemically synthesized
cttttggcttaagattgctt

SEQ ID NO: 270785 - DNA, 20 bp, Artificial Sequence
  chemically synthesized
agaatagccaaagcaatctt

SEQ ID NO: 270786 - DNA, 20 bp, Artificial Sequence
  chemically synthesized
ccaaagcaatcttaagccaa

SEQ ID NO: 270787 - DNA, 20 bp, Artificial Sequence
  chemically synthesized
cagcttcgttcttttggctt

SEQ ID NO: 270788 - DNA, 20 bp, Artificial Sequence
  chemically synthesized
tacctccagcttcgttcttt

SEQ ID NO: 270789 - DNA, 20 bp, Artificial Sequence
  chemically synthesized
aatcttaagccaaaagaacg

SEQ ID NO: 270790 - DNA, 20 bp, Artificial Sequence
  chemically synthesized
ttaagccaaaagaacgaagc

SEQ ID NO: 270791 - DNA, 20 bp, Artificial Sequence
  chemically synthesized
aagccaaaagaacgaagctg

SEQ ID NO: 270792 - DNA, 20 bp, Artificial Sequence
  chemically synthesized
agccaaaagaacgaagctgg

SEQ ID NO: 270793 - DNA, 20 bp, Artificial Sequence
  chemically synthesized
tcaggtaattatgatacctc

SEQ ID NO: 270794 - DNA, 20 bp, Artificial Sequence
  chemically synthesized
ttatagaatatttttgaatc

SEQ ID NO: 270795 - DNA, 20 bp, Artificial Sequence
  chemically synthesized
attatagaatatttttgaat

SEQ ID NO: 270796 - DNA, 20 bp, Artificial Sequence
  chemically synthesized
ttttaattactagagcatta

SEQ ID NO: 270797 - DNA, 20 bp, Artificial Sequence
  chemically synthesized
aaaaatattctataatgctc

SEQ ID NO: 270798 - DNA, 20 bp, Artificial Sequence
  chemically synthesized
tcctgctcttttaattacta

SEQ ID NO: 270799 - DNA, 20 bp, Artificial Sequence
  chemically synthesized
catcctgctcttttaattac

SEQ ID NO: 270800 - DNA, 20 bp, Artificial Sequence
  chemically synthesized
tataatgctctagtaattaa

SEQ ID NO: 270801 - DNA, 20 bp, Artificial Sequence
  chemically synthesized
taatgctctagtaattaaaa

SEQ ID NO: 270802 - DNA, 20 bp, Artificial Sequence
  chemically synthesized
tgctctagtaattaaaagag

SEQ ID NO: 270803 - DNA, 20 bp, Artificial Sequence
  chemically synthesized
gctctagtaattaaaagagc

SEQ ID NO: 270804 - DNA, 20 bp, Artificial Sequence
  chemically synthesized
tagtaattaaaagagcagga

SEQ ID NO: 270805 - DNA, 20 bp, Artificial Sequence
  chemically synthesized
taattaaaagagcaggatgg

SEQ ID NO: 270806 - DNA, 20 bp, Artificial Sequence
  chemically synthesized
gcaggatggtagtataaaaa

SEQ ID NO: 270807 - DNA, 20 bp, Artificial Sequence
  chemically synthesized
gtagtataaaaacagacata

SEQ ID NO: 270808 - DNA, 20 bp, Artificial Sequence
  chemically synthesized
aaaaacagacatatagacca

SEQ ID NO: 270809 - DNA, 20 bp, Artificial Sequence
  chemically synthesized
aaaacagacatatagaccaa

SEQ ID NO: 270810 - DNA, 20 bp, Artificial Sequence
  chemically synthesized
agacatatagaccaaaggaa

SEQ ID NO: 270811 - DNA, 20 bp, Artificial Sequence
  chemically synthesized
ggctctctattctgttcctt

SEQ ID NO: 270812 - DNA, 20 bp, Artificial Sequence
  chemically synthesized
tatagaccaaaggaacagaa

SEQ ID NO: 270813 - DNA, 20 bp, Artificial Sequence
  chemically synthesized
tagaccaaaggaacagaata

SEQ ID NO: 270814 - DNA, 20 bp, Artificial Sequence
  chemically synthesized
gaccaaaggaacagaataga

SEQ ID NO: 270815 - DNA, 20 bp, Artificial Sequence
  chemically synthesized
aaatatgtggatttattatt

SEQ ID NO: 270816 - DNA, 20 bp, Artificial Sequence
  chemically synthesized
taaatatgtggatttattat

SEQ ID NO: 270817 - DNA, 20 bp, Artificial Sequence
  chemically synthesized
atcagttgatcataaatatg

SEQ ID NO: 270818 - DNA, 20 bp, Artificial Sequence
  chemically synthesized
ttatgatcaactgatcaacc

SEQ ID NO: 270819 - DNA, 20 bp, Artificial Sequence
  chemically synthesized
ttctcggccccttggttgat

SEQ ID NO: 270820 - DNA, 20 bp, Artificial Sequence
  chemically synthesized
tatgatcaactgatcaacca

SEQ ID NO: 270821 - DNA, 20 bp, Artificial Sequence
  chemically synthesized
atgatcaactgatcaaccaa

SEQ ID NO: 270822 - DNA, 20 bp, Artificial Sequence
  chemically synthesized
tgatcaactgatcaaccaag

SEQ ID NO: 270823 - DNA, 20 bp, Artificial Sequence
  chemically synthesized
aactgatcaaccaaggggcc

SEQ ID NO: 270824 - DNA, 20 bp, Artificial Sequence
  chemically synthesized
attgtgtattctcggcccct

SEQ ID NO: 270825 - DNA, 20 bp, Artificial Sequence
  chemically synthesized
cttttttcattgtgtattct

SEQ ID NO: 270826 - DNA, 20 bp, Artificial Sequence
  chemically synthesized
ccgagaatacacaatgaaaa

SEQ ID NO: 270827 - DNA, 20 bp, Artificial Sequence
  chemically synthesized
cgagaatacacaatgaaaaa

SEQ ID NO: 270828 - DNA, 20 bp, Artificial Sequence
  chemically synthesized
tctcagaaccatttattgaa

SEQ ID NO: 270829 - DNA, 20 bp, Artificial Sequence
  chemically synthesized
aggacattctcttcaataaa

SEQ ID NO: 270830 - DNA, 20 bp, Artificial Sequence
  chemically synthesized
tttctcagaaccatttattg

SEQ ID NO: 270831 - DNA, 20 bp, Artificial Sequence
  chemically synthesized
tctcttcaataaatggttct

SEQ ID NO: 270832 - DNA, 20 bp, Artificial Sequence
  chemically synthesized
aataaatggttctgagaaat

SEQ ID NO: 270833 - DNA, 20 bp, Artificial Sequence
  chemically synthesized
catttggatatccaatttct

SEQ ID NO: 270834 - DNA, 20 bp, Artificial Sequence
  chemically synthesized
caattgcattttcatgcatt

SEQ ID NO: 270835 - DNA, 20 bp, Artificial Sequence
  chemically synthesized
caaatgcatgaaaatgcaat

SEQ ID NO: 270836 - DNA, 20 bp, Artificial Sequence
  chemically synthesized
gcaattggacacttatctca

SEQ ID NO: 270837 - DNA, 20 bp, Artificial Sequence
  chemically synthesized
ttttttatatgctgtgagat

SEQ ID NO: 270838 - DNA, 20 bp, Artificial Sequence
  chemically synthesized
actggttttttatatgctgt

SEQ ID NO: 270839 - DNA, 20 bp, Artificial Sequence
  chemically synthesized
tctcacagcatataaaaaac

SEQ ID NO: 270840 - DNA, 20 bp, Artificial Sequence
  chemically synthesized
gtcttgagtccattttgaac

SEQ ID NO: 270841 - DNA, 20 bp, Artificial Sequence
  chemically synthesized
tataaaaaaccagttcaaaa

SEQ ID NO: 270842 - DNA, 20 bp, Artificial Sequence
  chemically synthesized
aaccagttcaaaatggactc

SEQ ID NO: 270843 - DNA, 20 bp, Artificial Sequence
  chemically synthesized
aggttcaggttttaagtctt

SEQ ID NO: 270844 - DNA, 20 bp, Artificial Sequence
  chemically synthesized
attttataggttcaggtttt

SEQ ID NO: 270845 - DNA, 20 bp, Artificial Sequence
  chemically synthesized
tcaaatcattttataggttc

SEQ ID NO: 270846 - DNA, 20 bp, Artificial Sequence
  chemically synthesized
ttcaaatcattttataggtt

SEQ ID NO: 270847 - DNA, 20 bp, Artificial Sequence
  chemically synthesized
ttttcttcaaatcattttat

SEQ ID NO: 270848 - DNA, 20 bp, Artificial Sequence
  chemically synthesized
gttttcttcaaatcatttta

SEQ ID NO: 270849 - DNA, 20 bp, Artificial Sequence
  chemically synthesized
tgaacctataaaatgatttg

SEQ ID NO: 270850 - DNA, 20 bp, Artificial Sequence
  chemically synthesized
ataaaatgatttgaagaaaa

SEQ ID NO: 270851 - DNA, 20 bp, Artificial Sequence
  chemically synthesized
taaaatgatttgaagaaaac

SEQ ID NO: 270852 - DNA, 20 bp, Artificial Sequence
  chemically synthesized
gatttgaagaaaacaggaaa

SEQ ID NO: 270853 - DNA, 20 bp, Artificial Sequence
  chemically synthesized
ttgcccagaacaatgtcagg

SEQ ID NO: 270854 - DNA, 20 bp, Artificial Sequence
  chemically synthesized
tgtttgcccagaacaatgtc

SEQ ID NO: 270855 - DNA, 20 bp, Artificial Sequence
  chemically synthesized
atgtttgcccagaacaatgt

SEQ ID NO: 270856 - DNA, 20 bp, Artificial Sequence
  chemically synthesized
aaagcttcctgacattgttc

SEQ ID NO: 270857 - DNA, 20 bp, Artificial Sequence
  chemically synthesized
aagcttcctgacattgttct

SEQ ID NO: 270858 - DNA, 20 bp, Artificial Sequence
  chemically synthesized
atccaaaaaaaatgtttgcc

SEQ ID NO: 270859 - DNA, 20 bp, Artificial Sequence
  chemically synthesized
ttctgggcaaacattttttt

SEQ ID NO: 270860 - DNA, 20 bp, Artificial Sequence
  chemically synthesized
ttttttggatctgactccca

SEQ ID NO: 270861 - DNA, 20 bp, Artificial Sequence
  chemically synthesized
gttgcctgtgctttgggagt

SEQ ID NO: 270862 - DNA, 20 bp, Artificial Sequence
  chemically synthesized
tcttgttgcctgtgctttgg

SEQ ID NO: 270863 - DNA, 20 bp, Artificial Sequence
  chemically synthesized
tggatctgactcccaaagca

SEQ ID NO: 270864 - DNA, 20 bp, Artificial Sequence
  chemically synthesized
ggatctgactcccaaagcac

SEQ ID NO: 270865 - DNA, 20 bp, Artificial Sequence
  chemically synthesized
cctcttgttgcctgtgcttt

SEQ ID NO: 270866 - DNA, 20 bp, Artificial Sequence
  chemically synthesized
tcctcttgttgcctgtgctt

SEQ ID NO: 270867 - DNA, 20 bp, Artificial Sequence
  chemically synthesized
actcccaaagcacaggcaac

SEQ ID NO: 270868 - DNA, 20 bp, Artificial Sequence
  chemically synthesized
tcccaaagcacaggcaacaa

SEQ ID NO: 270869 - DNA, 20 bp, Artificial Sequence
  chemically synthesized
cccaaagcacaggcaacaag

SEQ ID NO: 270870 - DNA, 20 bp, Artificial Sequence
  chemically synthesized
acaggcaacaagaggaaaac

SEQ ID NO: 270871 - DNA, 20 bp, Artificial Sequence
  chemically synthesized
ttgatgcgataacagtcgtc

SEQ ID NO: 270872 - DNA, 20 bp, Artificial Sequence
  chemically synthesized
tttttaggttgatgcgataa

SEQ ID NO: 270873 - DNA, 20 bp, Artificial Sequence
  chemically synthesized
tgttatcgcatcaacctaaa

SEQ ID NO: 270874 - DNA, 20 bp, Artificial Sequence
  chemically synthesized
ttgctgagcagaagcttttt

SEQ ID NO: 270875 - DNA, 20 bp, Artificial Sequence
  chemically synthesized
tttgctgagcagaagctttt

SEQ ID NO: 270876 - DNA, 20 bp, Artificial Sequence
  chemically synthesized
caacctaaaaagcttctgct

SEQ ID NO: 270877 - DNA, 20 bp, Artificial Sequence
  chemically synthesized
ttgtttgttttgctgagcag

SEQ ID NO: 270878 - DNA, 20 bp, Artificial Sequence
  chemically synthesized
tgattgtttgttttgctgag

SEQ ID NO: 270879 - DNA, 20 bp, Artificial Sequence
  chemically synthesized
tgttgattgtttgttttgct

SEQ ID NO: 270880 - DNA, 20 bp, Artificial Sequence
  chemically synthesized
tcagcaaaacaaacaatcaa

SEQ ID NO: 270881 - DNA, 20 bp, Artificial Sequence
  chemically synthesized
agcaaaacaaacaatcaaca

SEQ ID NO: 270882 - DNA, 20 bp, Artificial Sequence
  chemically synthesized
aacaaacaatcaacagagtg

SEQ ID NO: 270883 - DNA, 20 bp, Artificial Sequence
  chemically synthesized
caaacaatcaacagagtgaa

SEQ ID NO: 270884 - DNA, 20 bp, Artificial Sequence
  chemically synthesized
gtatagattatgatagtaag

SEQ ID NO: 270885 - DNA, 20 bp, Artificial Sequence
  chemically synthesized
tctgtatagattatgatagt

SEQ ID NO: 270886 - DNA, 20 bp, Artificial Sequence
  chemically synthesized
atattctgtatagattatga

SEQ ID NO: 270887 - DNA, 20 bp, Artificial Sequence
  chemically synthesized
acttactatcataatctata

SEQ ID NO: 270888 - DNA, 20 bp, Artificial Sequence
  chemically synthesized
ctcaactcaaatattctgta

SEQ ID NO: 270889 - DNA, 20 bp, Artificial Sequence
  chemically synthesized
ataatctatacagaatattt

SEQ ID NO: 270890 - DNA, 20 bp, Artificial Sequence
  chemically synthesized
ctatacagaatatttgagtt

SEQ ID NO: 270891 - DNA, 20 bp, Artificial Sequence
  chemically synthesized
cagaatatttgagttgagcg

SEQ ID NO: 270892 - DNA, 20 bp, Artificial Sequence
  chemically synthesized
atatttgagttgagcgaagt

SEQ ID NO: 270893 - DNA, 20 bp, Artificial Sequence
  chemically synthesized
ttgagttgagcgaagtgaga

SEQ ID NO: 270894 - DNA, 20 bp, Artificial Sequence
  chemically synthesized
gagttgagcgaagtgagatg

SEQ ID NO: 270895 - DNA, 20 bp, Artificial Sequence
  chemically synthesized
gttgagcgaagtgagatgga

SEQ ID NO: 270896 - DNA, 20 bp, Artificial Sequence
  chemically synthesized
cgaagtgagatggagagata

SEQ ID NO: 270897 - DNA, 20 bp, Artificial Sequence
  chemically synthesized
gaagtgagatggagagatat

SEQ ID NO: 270898 - DNA, 20 bp, Artificial Sequence
  chemically synthesized
gagatataggcatcttgaat

SEQ ID NO: 270899 - DNA, 20 bp, Artificial Sequence
  chemically synthesized
atataggcatcttgaattag

SEQ ID NO: 270900 - DNA, 20 bp, Artificial Sequence
  chemically synthesized
ctccacttcactgctaattc

SEQ ID NO: 270901 - DNA, 20 bp, Artificial Sequence
  chemically synthesized
ggcatcttgaattagcagtg

SEQ ID NO: 270902 - DNA, 20 bp, Artificial Sequence
  chemically synthesized
atcttgaattagcagtgaag

SEQ ID NO: 270903 - DNA, 20 bp, Artificial Sequence
  chemically synthesized
cttgaattagcagtgaagtg

SEQ ID NO: 270904 - DNA, 20 bp, Artificial Sequence
  chemically synthesized
aattagcagtgaagtggagc

SEQ ID NO: 270905 - DNA, 20 bp, Artificial Sequence
  chemically synthesized
agtgaagtggagctggtcat

SEQ ID NO: 270906 - DNA, 20 bp, Artificial Sequence
  chemically synthesized
cctgatcagagtctcatgac

SEQ ID NO: 270907 - DNA, 20 bp, Artificial Sequence
  chemically synthesized
gctggtcatgagactctgat

SEQ ID NO: 270908 - DNA, 20 bp, Artificial Sequence
  chemically synthesized
ctggtcatgagactctgatc

SEQ ID NO: 270909 - DNA, 20 bp, Artificial Sequence
  chemically synthesized
ttgtatcattgtcctgatca

SEQ ID NO: 270910 - DNA, 20 bp, Artificial Sequence
  chemically synthesized
ttttgtatcattgtcctgat

SEQ ID NO: 270911 - DNA, 20 bp, Artificial Sequence
  chemically synthesized
caatgatacaaaaataatta

SEQ ID NO: 270912 - DNA, 20 bp, Artificial Sequence
  chemically synthesized
atgatacaaaaataattaca

SEQ ID NO: 270913 - DNA, 20 bp, Artificial Sequence
  chemically synthesized
caaaaataattacagagacg

SEQ ID NO: 270914 - DNA, 20 bp, Artificial Sequence
  chemically synthesized
aaaaataattacagagacgt

SEQ ID NO: 270915 - DNA, 20 bp, Artificial Sequence
  chemically synthesized
acagagacgtaggtcttaac

SEQ ID NO: 270916 - DNA, 20 bp, Artificial Sequence
  chemically synthesized
gatagcatggatagccagtt

SEQ ID NO: 270917 - DNA, 20 bp, Artificial Sequence
  chemically synthesized
aataagatagcatggatagc

SEQ ID NO: 270918 - DNA, 20 bp, Artificial Sequence
  chemically synthesized
ggctaataagatagcatgga

SEQ ID NO: 270919 - DNA, 20 bp, Artificial Sequence
  chemically synthesized
acttggctaataagatagca

SEQ ID NO: 270920 - DNA, 20 bp, Artificial Sequence
  chemically synthesized
ggctatccatgctatcttat

SEQ ID NO: 270921 - DNA, 20 bp, Artificial Sequence
  chemically synthesized
accacacttggctaataaga

SEQ ID NO: 270922 - DNA, 20 bp, Artificial Sequence
  chemically synthesized
tccatgctatcttattagcc

SEQ ID NO: 270923 - DNA, 20 bp, Artificial Sequence
  chemically synthesized
atctaccacacttggctaat

SEQ ID NO: 270924 - DNA, 20 bp, Artificial Sequence
  chemically synthesized
gctatcttattagccaagtg

SEQ ID NO: 270925 - DNA, 20 bp, Artificial Sequence
  chemically synthesized
atcttattagccaagtgtgg

SEQ ID NO: 270926 - DNA, 20 bp, Artificial Sequence
  chemically synthesized
cttgcaaaatctaccacact

SEQ ID NO: 270927 - DNA, 20 bp, Artificial Sequence
  chemically synthesized
ccaagtgtggtagattttgc

SEQ ID NO: 270928 - DNA, 20 bp, Artificial Sequence
  chemically synthesized
gtggtagattttgcaagtct

SEQ ID NO: 270929 - DNA, 20 bp, Artificial Sequence
  chemically synthesized
ttttgcaagtcttggccata

SEQ ID NO: 270930 - DNA, 20 bp, Artificial Sequence
  chemically synthesized
aattatttccctatatggcc

SEQ ID NO: 270931 - DNA, 20 bp, Artificial Sequence
  chemically synthesized
tttgcaagtcttggccatat

SEQ ID NO: 270932 - DNA, 20 bp, Artificial Sequence
  chemically synthesized
ttgcaagtcttggccatata

SEQ ID NO: 270933 - DNA, 20 bp, Artificial Sequence
  chemically synthesized
acagtaattatttccctata

SEQ ID NO: 270934 - DNA, 20 bp, Artificial Sequence
  chemically synthesized
cattaagtttaaaaattaca

SEQ ID NO: 270935 - DNA, 20 bp, Artificial Sequence
  chemically synthesized
tgtaatttttaaacttaatg

SEQ ID NO: 270936 - DNA, 20 bp, Artificial Sequence
  chemically synthesized
tattccacagagaccacatt

SEQ ID NO: 270937 - DNA, 20 bp, Artificial Sequence
  chemically synthesized
taaacttaatgtggtctctg

SEQ ID NO: 270938 - DNA, 20 bp, Artificial Sequence
  chemically synthesized
tgttgttaacatattccaca

SEQ ID NO: 270939 - DNA, 20 bp, Artificial Sequence
  chemically synthesized
aatgttgttaacatattcca

SEQ ID NO: 270940 - DNA, 20 bp, Artificial Sequence
  chemically synthesized
gtggaatatgttaacaacat

SEQ ID NO: 270941 - DNA, 20 bp, Artificial Sequence
  chemically synthesized
aactgtatctatttatatgt

SEQ ID NO: 270942 - DNA, 20 bp, Artificial Sequence
  chemically synthesized
aaactgtatctatttatatg

SEQ ID NO: 270943 - DNA, 20 bp, Artificial Sequence
  chemically synthesized
acattagacctacatataaa

SEQ ID NO: 270944 - DNA, 20 bp, Artificial Sequence
  chemically synthesized
gacctacatataaatagata

SEQ ID NO: 270945 - DNA, 20 bp, Artificial Sequence
  chemically synthesized
atacagtttataatatttac

SEQ ID NO: 270946 - DNA, 20 bp, Artificial Sequence
  chemically synthesized
tataatatttaccagtcttc

SEQ ID NO: 270947 - DNA, 20 bp, Artificial Sequence
  chemically synthesized
acttgtgatgacttgaagac

SEQ ID NO: 270948 - DNA, 20 bp, Artificial Sequence
  chemically synthesized
tatctacttgtgatgacttg

SEQ ID NO: 270949 - DNA, 20 bp, Artificial Sequence
  chemically synthesized
accagtcttcaagtcatcac

SEQ ID NO: 270950 - DNA, 20 bp, Artificial Sequence
  chemically synthesized
agtcttcaagtcatcacaag

SEQ ID NO: 270951 - DNA, 20 bp, Artificial Sequence
  chemically synthesized
tagatatatataatgaaaat

SEQ ID NO: 270952 - DNA, 20 bp, Artificial Sequence
  chemically synthesized
agatatatataatgaaaata

SEQ ID NO: 270953 - DNA, 20 bp, Artificial Sequence
  chemically synthesized
aataaggaacacttacaact

SEQ ID NO: 270954 - DNA, 20 bp, Artificial Sequence
  chemically synthesized
taaaagggtttcttagttgt

SEQ ID NO: 270955 - DNA, 20 bp, Artificial Sequence
  chemically synthesized
atagctctaaaagggtttct

SEQ ID NO: 270956 - DNA, 20 bp, Artificial Sequence
  chemically synthesized
ttacaactaagaaacccttt

SEQ ID NO: 270957 - DNA, 20 bp, Artificial Sequence
  chemically synthesized
acaactaagaaaccctttta

SEQ ID NO: 270958 - DNA, 20 bp, Artificial Sequence
  chemically synthesized
tccatcagatagctctaaaa

SEQ ID NO: 270959 - DNA, 20 bp, Artificial Sequence
  chemically synthesized
gtccatcagatagctctaaa

SEQ ID NO: 270960 - DNA, 20 bp, Artificial Sequence
  chemically synthesized
ggtccatcagatagctctaa

SEQ ID NO: 270961 - DNA, 20 bp, Artificial Sequence
  chemically synthesized
acccttttagagctatctga

SEQ ID NO: 270962 - DNA, 20 bp, Artificial Sequence
  chemically synthesized
gtttttcctggtccatcaga

SEQ ID NO: 270963 - DNA, 20 bp, Artificial Sequence
  chemically synthesized
tttagagctatctgatggac

SEQ ID NO: 270964 - DNA, 20 bp, Artificial Sequence
  chemically synthesized
ttagagctatctgatggacc

SEQ ID NO: 270965 - DNA, 20 bp, Artificial Sequence
  chemically synthesized
ggaggtttttcctggtccat

SEQ ID NO: 270966 - DNA, 20 bp, Artificial Sequence
  chemically synthesized
acgctcagggaggtttttcc

SEQ ID NO: 270967 - DNA, 20 bp, Artificial Sequence
  chemically synthesized
ggaccaggaaaaacctccct

SEQ ID NO: 270968 - DNA, 20 bp, Artificial Sequence
  chemically synthesized
aaaatacgtaacgctcaggg

SEQ ID NO: 270969 - DNA, 20 bp, Artificial Sequence
  chemically synthesized
aaaaatacgtaacgctcagg

SEQ ID NO: 270970 - DNA, 20 bp, Artificial Sequence
  chemically synthesized
tgaaaaatacgtaacgctca

SEQ ID NO: 270971 - DNA, 20 bp, Artificial Sequence
  chemically synthesized
ttgaaaaatacgtaacgctc

SEQ ID NO: 270972 - DNA, 20 bp, Artificial Sequence
  chemically synthesized
attgaaaaatacgtaacgct

SEQ ID NO: 270973 - DNA, 20 bp, Artificial Sequence
  chemically synthesized
acgtatttttcaatctgaat

SEQ ID NO: 270974 - DNA, 20 bp, Artificial Sequence
  chemically synthesized
tatttttcaatctgaataag

SEQ ID NO: 270975 - DNA, 20 bp, Artificial Sequence
  chemically synthesized
tcagtgaggctctgcttatt

SEQ ID NO: 270976 - DNA, 20 bp, Artificial Sequence
  chemically synthesized
tttttcaatctgaataagca

SEQ ID NO: 270977 - DNA, 20 bp, Artificial Sequence
  chemically synthesized
gaaacaataattaatcagtg

SEQ ID NO: 270978 - DNA, 20 bp, Artificial Sequence
  chemically synthesized
agaaacaataattaatcagt

SEQ ID NO: 270979 - DNA, 20 bp, Artificial Sequence
  chemically synthesized
attaagaaacaataattaat

SEQ ID NO: 270980 - DNA, 20 bp, Artificial Sequence
  chemically synthesized
attaattattgtttcttaat

SEQ ID NO: 270981 - DNA, 20 bp, Artificial Sequence
  chemically synthesized
ttcgatgtggaattctcatt

SEQ ID NO: 270982 - DNA, 20 bp, Artificial Sequence
  chemically synthesized
catatacacatatttcgatg

SEQ ID NO: 270983 - DNA, 20 bp, Artificial Sequence
  chemically synthesized
tatatgtacacatatacaca

SEQ ID NO: 270984 - DNA, 20 bp, Artificial Sequence
  chemically synthesized
tatatacgtatacatataca

SEQ ID NO: 270985 - DNA, 20 bp, Artificial Sequence
  chemically synthesized
tatacgtatacatatacata

SEQ ID NO: 270986 - DNA, 20 bp, Artificial Sequence
  chemically synthesized
tacgtatacatatacataga

SEQ ID NO: 270987 - DNA, 20 bp, Artificial Sequence
  chemically synthesized
cgtatacatatacatagaga

SEQ ID NO: 270988 - DNA, 20 bp, Artificial Sequence
  chemically synthesized
tatacatatacatagagaga

SEQ ID NO: 270989 - DNA, 20 bp, Artificial Sequence
  chemically synthesized
tacatatacatagagagaga

SEQ ID NO: 270990 - DNA, 20 bp, Artificial Sequence
  chemically synthesized
acatatacatagagagagag

SEQ ID NO: 270991 - DNA, 20 bp, Artificial Sequence
  chemically synthesized
catagagagagagaggtgtt

SEQ ID NO: 270992 - DNA, 20 bp, Artificial Sequence
  chemically synthesized
gagaggtgtttagaattgct

SEQ ID NO: 270993 - DNA, 20 bp, Artificial Sequence
  chemically synthesized
attatgtatgattagagtct

SEQ ID NO: 270994 - DNA, 20 bp, Artificial Sequence
  chemically synthesized
caataaattatgtatgatta

SEQ ID NO: 270995 - DNA, 20 bp, Artificial Sequence
  chemically synthesized
ggcaataaattatgtatgat

SEQ ID NO: 270996 - DNA, 20 bp, Artificial Sequence
  chemically synthesized
cttataaattgtaaagcaac

SEQ ID NO: 270997 - DNA, 20 bp, Artificial Sequence
  chemically synthesized
ccttataaattgtaaagcaa

SEQ ID NO: 270998 - DNA, 20 bp, Artificial Sequence
  chemically synthesized
cactttccttataaattgta

SEQ ID NO: 270999 - DNA, 20 bp, Artificial Sequence
  chemically synthesized
cccgttgctttacaatttat

SEQ ID NO: 271000 - DNA, 20 bp, Artificial Sequence
  chemically synthesized
ccgttgctttacaatttata

SEQ ID NO: 271001 - DNA, 20 bp, Artificial Sequence
  chemically synthesized
tgctttacaatttataagga

SEQ ID NO: 271002 - DNA, 20 bp, Artificial Sequence
  chemically synthesized
tttacaatttataaggaaag

SEQ ID NO: 271003 - DNA, 20 bp, Artificial Sequence
  chemically synthesized
caatttataaggaaagtgga

SEQ ID NO: 271004 - DNA, 20 bp, Artificial Sequence
  chemically synthesized
tttataaggaaagtggaaag

SEQ ID NO: 271005 - DNA, 20 bp, Artificial Sequence
  chemically synthesized
aaagtggaaagaagtgtttg

SEQ ID NO: 271006 - DNA, 20 bp, Artificial Sequence
  chemically synthesized
gaaagaagtgtttgtggtct

SEQ ID NO: 271007 - DNA, 20 bp, Artificial Sequence
  chemically synthesized
agcaaaggtgtgtgcatgct

SEQ ID NO: 271008 - DNA, 20 bp, Artificial Sequence
  chemically synthesized
catgcacacacctttgctcc

SEQ ID NO: 271009 - DNA, 20 bp, Artificial Sequence
  chemically synthesized
ttataatgagctgggagcaa

SEQ ID NO: 271010 - DNA, 20 bp, Artificial Sequence
  chemically synthesized
attataatgagctgggagca

SEQ ID NO: 271011 - DNA, 20 bp, Artificial Sequence
  chemically synthesized
attgcattataatgagctgg

SEQ ID NO: 271012 - DNA, 20 bp, Artificial Sequence
  chemically synthesized
aaattgcattataatgagct

SEQ ID NO: 271013 - DNA, 20 bp, Artificial Sequence
  chemically synthesized
gaaattgcattataatgagc

SEQ ID NO: 271014 - DNA, 20 bp, Artificial Sequence
  chemically synthesized
ctttgaaattgcattataat

SEQ ID NO: 271015 - DNA, 20 bp, Artificial Sequence
  chemically synthesized
ctcattataatgcaatttca

SEQ ID NO: 271016 - DNA, 20 bp, Artificial Sequence
  chemically synthesized
agaacttgatgaaagagtaa

SEQ ID NO: 271017 - DNA, 20 bp, Artificial Sequence
  chemically synthesized
aaagctgttactctttcatc

SEQ ID NO: 271018 - DNA, 20 bp, Artificial Sequence
  chemically synthesized
tcccaaagaacttgatgaaa

SEQ ID NO: 271019 - DNA, 20 bp, Artificial Sequence
  chemically synthesized
aatcccaaagaacttgatga

SEQ ID NO: 271020 - DNA, 20 bp, Artificial Sequence
  chemically synthesized
tactctttcatcaagttctt

SEQ ID NO: 271021 - DNA, 20 bp, Artificial Sequence
  chemically synthesized
actctttcatcaagttcttt

SEQ ID NO: 271022 - DNA, 20 bp, Artificial Sequence
  chemically synthesized
aaagcagacggaaaatccca

SEQ ID NO: 271023 - DNA, 20 bp, Artificial Sequence
  chemically synthesized
gattgtacagaaaaagcaga

SEQ ID NO: 271024 - DNA, 20 bp, Artificial Sequence
  chemically synthesized
gtcagattgtacagaaaaag

SEQ ID NO: 271025 - DNA, 20 bp, Artificial Sequence
  chemically synthesized
gacgtcagattgtacagaaa

SEQ ID NO: 271026 - DNA, 20 bp, Artificial Sequence
  chemically synthesized
agactggacgtcagattgta

SEQ ID NO: 271027 - DNA, 20 bp, Artificial Sequence
  chemically synthesized
tttctgtacaatctgacgtc

SEQ ID NO: 271028 - DNA, 20 bp, Artificial Sequence
  chemically synthesized
tggtgataaagactggacgt

SEQ ID NO: 271029 - DNA, 20 bp, Artificial Sequence
  chemically synthesized
gtggaaatggtgataaagac

SEQ ID NO: 271030 - DNA, 20 bp, Artificial Sequence
  chemically synthesized
ctgaagtggaaatggtgata

SEQ ID NO: 271031 - DNA, 20 bp, Artificial Sequence
  chemically synthesized
agtgaagtctgaagtggaaa

SEQ ID NO: 271032 - DNA, 20 bp, Artificial Sequence
  chemically synthesized
ctttatcaccatttccactt

SEQ ID NO: 271033 - DNA, 20 bp, Artificial Sequence
  chemically synthesized
gagtgaagtgaagtctgaag

SEQ ID NO: 271034 - DNA, 20 bp, Artificial Sequence
  chemically synthesized
tctgagtgaagtgaagtctg

SEQ ID NO: 271035 - DNA, 20 bp, Artificial Sequence
  chemically synthesized
ataaaagtctgagtgaagtg

SEQ ID NO: 271036 - DNA, 20 bp, Artificial Sequence
  chemically synthesized
acttcagacttcacttcact

SEQ ID NO: 271037 - DNA, 20 bp, Artificial Sequence
  chemically synthesized
cttgtataaaagtctgagtg

SEQ ID NO: 271038 - DNA, 20 bp, Artificial Sequence
  chemically synthesized
tagaacttgtataaaagtct

SEQ ID NO: 271039 - DNA, 20 bp, Artificial Sequence
  chemically synthesized
cttcactcagacttttatac

SEQ ID NO: 271040 - DNA, 20 bp, Artificial Sequence
  chemically synthesized
taaacttagaacttgtataa

SEQ ID NO: 271041 - DNA, 20 bp, Artificial Sequence
  chemically synthesized
cagacttttatacaagttct

SEQ ID NO: 271042 - DNA, 20 bp, Artificial Sequence
  chemically synthesized
ttttgttttatgtttaaact

SEQ ID NO: 271043 - DNA, 20 bp, Artificial Sequence
  chemically synthesized
ataaaacaaaacatgataat

SEQ ID NO: 271044 - DNA, 20 bp, Artificial Sequence
  chemically synthesized
aaacaaaacatgataatcag

SEQ ID NO: 271045 - DNA, 20 bp, Artificial Sequence
  chemically synthesized
acaaaacatgataatcagta

SEQ ID NO: 271046 - DNA, 20 bp, Artificial Sequence
  chemically synthesized
ttatttcataatattatgaa

SEQ ID NO: 271047 - DNA, 20 bp, Artificial Sequence
  chemically synthesized
atattatgaacagaaataaa

SEQ ID NO: 271048 - DNA, 20 bp, Artificial Sequence
  chemically synthesized
attatgaacagaaataaata

SEQ ID NO: 271049 - DNA, 20 bp, Artificial Sequence
  chemically synthesized
aacatggaatagcaattaag

SEQ ID NO: 271050 - DNA, 20 bp, Artificial Sequence
  chemically synthesized
aaacatggaatagcaattaa

SEQ ID NO: 271051 - DNA, 20 bp, Artificial Sequence
  chemically synthesized
caaacatggaatagcaatta

SEQ ID NO: 271052 - DNA, 20 bp, Artificial Sequence
  chemically synthesized
tcaaacatggaatagcaatt

SEQ ID NO: 271053 - DNA, 20 bp, Artificial Sequence
  chemically synthesized
ttaaaatttcaaacatggaa

SEQ ID NO: 271054 - DNA, 20 bp, Artificial Sequence
  chemically synthesized
ctctattaaaatttcaaaca

SEQ ID NO: 271055 - DNA, 20 bp, Artificial Sequence
  chemically synthesized
ttccatgtttgaaattttaa

SEQ ID NO: 271056 - DNA, 20 bp, Artificial Sequence
  chemically synthesized
ccatgtttgaaattttaata

SEQ ID NO: 271057 - DNA, 20 bp, Artificial Sequence
  chemically synthesized
tgtttgaaattttaatagag

SEQ ID NO: 271058 - DNA, 20 bp, Artificial Sequence
  chemically synthesized
tttaatagagtagcattttg

SEQ ID NO: 271059 - DNA, 20 bp, Artificial Sequence
  chemically synthesized
aatagagtagcattttgcag

SEQ ID NO: 271060 - DNA, 20 bp, Artificial Sequence
  chemically synthesized
agagtagcattttgcagcgg

SEQ ID NO: 271061 - DNA, 20 bp, Artificial Sequence
  chemically synthesized
ttgcagcggtggtcaatatc

SEQ ID NO: 271062 - DNA, 20 bp, Artificial Sequence
  chemically synthesized
tcaacagaaaatgcaaaagc

SEQ ID NO: 271063 - DNA, 20 bp, Artificial Sequence
  chemically synthesized
taaatcaacagaaaatgcaa

SEQ ID NO: 271064 - DNA, 20 bp, Artificial Sequence
  chemically synthesized
aattagaaatattaaatcaa

SEQ ID NO: 271065 - DNA, 20 bp, Artificial Sequence
  chemically synthesized
tatgcatgtgtgtagacaat

SEQ ID NO: 271066 - DNA, 20 bp, Artificial Sequence
  chemically synthesized
gacacatatatgcatgtgtg

SEQ ID NO: 271067 - DNA, 20 bp, Artificial Sequence
  chemically synthesized
atgcatatatgtgtcatttg

SEQ ID NO: 271068 - DNA, 20 bp, Artificial Sequence
  chemically synthesized
aactctctgtttaataagaa

SEQ ID NO: 271069 - DNA, 20 bp, Artificial Sequence
  chemically synthesized
ttgcagctattcttattaaa

SEQ ID NO: 271070 - DNA, 20 bp, Artificial Sequence
  chemically synthesized
tgattaactctctgtttaat

SEQ ID NO: 271071 - DNA, 20 bp, Artificial Sequence
  chemically synthesized
gcagctattcttattaaaca

SEQ ID NO: 271072 - DNA, 20 bp, Artificial Sequence
  chemically synthesized
agctattcttattaaacaga

SEQ ID NO: 271073 - DNA, 20 bp, Artificial Sequence
  chemically synthesized
ttttgtgatatatatatatt

SEQ ID NO: 271074 - DNA, 20 bp, Artificial Sequence
  chemically synthesized
tatatttagttcttcaatca

SEQ ID NO: 271075 - DNA, 20 bp, Artificial Sequence
  chemically synthesized
acatttatgttctttgattg

SEQ ID NO: 271076 - DNA, 20 bp, Artificial Sequence
  chemically synthesized
aatagaagtcatgtaaaatt

SEQ ID NO: 271077 - DNA, 20 bp, Artificial Sequence
  chemically synthesized
aactccaacatttaaaatag

SEQ ID NO: 271078 - DNA, 20 bp, Artificial Sequence
  chemically synthesized
tataactccaacatttaaaa

SEQ ID NO: 271079 - DNA, 20 bp, Artificial Sequence
  chemically synthesized
atgacttctattttaaatgt

SEQ ID NO: 271080 - DNA, 20 bp, Artificial Sequence
  chemically synthesized
gacttctattttaaatgttg

SEQ ID NO: 271081 - DNA, 20 bp, Artificial Sequence
  chemically synthesized
atgttggagttatataattc

SEQ ID NO: 271082 - DNA, 20 bp, Artificial Sequence
  chemically synthesized
aattcatccaaatttatggc

SEQ ID NO: 271083 - DNA, 20 bp, Artificial Sequence
  chemically synthesized
tataattctagccataaatt

SEQ ID NO: 271084 - DNA, 20 bp, Artificial Sequence
  chemically synthesized
aattaattcatccaaattta

SEQ ID NO: 271085 - DNA, 20 bp, Artificial Sequence
  chemically synthesized
gaattaattcactcctacat

SEQ ID NO: 271086 - DNA, 20 bp, Artificial Sequence
  chemically synthesized
aattaattcactcctacatc

SEQ ID NO: 271087 - DNA, 20 bp, Artificial Sequence
  chemically synthesized
tcaataaatacccgatgtag

SEQ ID NO: 271088 - DNA, 20 bp, Artificial Sequence
  chemically synthesized
actcaataaatacccgatgt

SEQ ID NO: 271089 - DNA, 20 bp, Artificial Sequence
  chemically synthesized
cactcaataaatacccgatg

SEQ ID NO: 271090 - DNA, 20 bp, Artificial Sequence
  chemically synthesized
tcctacatcgggtatttatt

SEQ ID NO: 271091 - DNA, 20 bp, Artificial Sequence
  chemically synthesized
tacatcgggtatttattgag

SEQ ID NO: 271092 - DNA, 20 bp, Artificial Sequence
  chemically synthesized
attgagtggttactatcaat

SEQ ID NO: 271093 - DNA, 20 bp, Artificial Sequence
  chemically synthesized
ttcaaatactatctgattga

SEQ ID NO: 271094 - DNA, 20 bp, Artificial Sequence
  chemically synthesized
agtggttactatcaatcaga

SEQ ID NO: 271095 - DNA, 20 bp, Artificial Sequence
  chemically synthesized
tcagatagtatttgaatcac

SEQ ID NO: 271096 - DNA, 20 bp, Artificial Sequence
  chemically synthesized
cagatagtatttgaatcact

SEQ ID NO: 271097 - DNA, 20 bp, Artificial Sequence
  chemically synthesized
atagtatttgaatcactggg

SEQ ID NO: 271098 - DNA, 20 bp, Artificial Sequence
  chemically synthesized
tatttgaatcactgggaagt

SEQ ID NO: 271099 - DNA, 20 bp, Artificial Sequence
  chemically synthesized
tttggccaccactgacttcc

SEQ ID NO: 271100 - DNA, 20 bp, Artificial Sequence
  chemically synthesized
ttgaatcactgggaagtcag

SEQ ID NO: 271101 - DNA, 20 bp, Artificial Sequence
  chemically synthesized
aatcactgggaagtcagtgg

SEQ ID NO: 271102 - DNA, 20 bp, Artificial Sequence
  chemically synthesized
aatagtgaatgtgtgtgttt

SEQ ID NO: 271103 - DNA, 20 bp, Artificial Sequence
  chemically synthesized
tgtaagtaccatgagaacaa

SEQ ID NO: 271104 - DNA, 20 bp, Artificial Sequence
  chemically synthesized
cacattcactattgttctca

SEQ ID NO: 271105 - DNA, 20 bp, Artificial Sequence
  chemically synthesized
tactaatatgtaagtaccat

SEQ ID NO: 271106 - DNA, 20 bp, Artificial Sequence
  chemically synthesized
ttctcatggtacttacatat

SEQ ID NO: 271107 - DNA, 20 bp, Artificial Sequence
  chemically synthesized
ctttaatgttactaatatgt

SEQ ID NO: 271108 - DNA, 20 bp, Artificial Sequence
  chemically synthesized
cttacatattagtaacatta

SEQ ID NO: 271109 - DNA, 20 bp, Artificial Sequence
  chemically synthesized
aaattatgatgtagaaattt

SEQ ID NO: 271110 - DNA, 20 bp, Artificial Sequence
  chemically synthesized
gaaattatgatgtagaaatt

SEQ ID NO: 271111 - DNA, 20 bp, Artificial Sequence
  chemically synthesized
tatatattgaaattatgatg

SEQ ID NO: 271112 - DNA, 20 bp, Artificial Sequence
  chemically synthesized
atatatattgtatcatatat

SEQ ID NO: 271113 - DNA, 20 bp, Artificial Sequence
  chemically synthesized
atattgtatcatatataaga

SEQ ID NO: 271114 - DNA, 20 bp, Artificial Sequence
  chemically synthesized
tgtatcatatataagaaagt

SEQ ID NO: 271115 - DNA, 20 bp, Artificial Sequence
  chemically synthesized
gtatcatatataagaaagta

SEQ ID NO: 271116 - DNA, 20 bp, Artificial Sequence
  chemically synthesized
taatttaattaacattgaaa

SEQ ID NO: 271117 - DNA, 20 bp, Artificial Sequence
  chemically synthesized
gtaatttaattaacattgaa

SEQ ID NO: 271118 - DNA, 20 bp, Artificial Sequence
  chemically synthesized
tcagcacttttaagaaaata

SEQ ID NO: 271119 - DNA, 20 bp, Artificial Sequence
  chemically synthesized
acacaactttattttcttaa

SEQ ID NO: 271120 - DNA, 20 bp, Artificial Sequence
  chemically synthesized
tggttttcatcagcactttt

SEQ ID NO: 271121 - DNA, 20 bp, Artificial Sequence
  chemically synthesized
tttttatatctggttttcat

SEQ ID NO: 271122 - DNA, 20 bp, Artificial Sequence
  chemically synthesized
ttaaaagtgctgatgaaaac

SEQ ID NO: 271123 - DNA, 20 bp, Artificial Sequence
  chemically synthesized
gtcaataatatttttatatc

SEQ ID NO: 271124 - DNA, 20 bp, Artificial Sequence
  chemically synthesized
acatgtacatcacaaatata

SEQ ID NO: 271125 - DNA, 20 bp, Artificial Sequence
  chemically synthesized
aaatataaagcacacacata

SEQ ID NO: 271126 - DNA, 20 bp, Artificial Sequence
  chemically synthesized
acatacggtttcacaaaaca

SEQ ID NO: 271127 - DNA, 20 bp, Artificial Sequence
  chemically synthesized
catacggtttcacaaaacat

SEQ ID NO: 271128 - DNA, 20 bp, Artificial Sequence
  chemically synthesized
aaacataggttgctataaaa

SEQ ID NO: 271129 - DNA, 20 bp, Artificial Sequence
  chemically synthesized
tgtcttatgatgctttttta

SEQ ID NO: 271130 - DNA, 20 bp, Artificial Sequence
  chemically synthesized
ttgctataaaaaagcatcat

SEQ ID NO: 271131 - DNA, 20 bp, Artificial Sequence
  chemically synthesized
ataaaaaagcatcataagac

SEQ ID NO: 271132 - DNA, 20 bp, Artificial Sequence
  chemically synthesized
taagacaagtgtcataactt

SEQ ID NO: 271133 - DNA, 20 bp, Artificial Sequence
  chemically synthesized
gacaagtgtcataactttgg

SEQ ID NO: 271134 - DNA, 20 bp, Artificial Sequence
  chemically synthesized
agtgtcataactttggaaga

SEQ ID NO: 271135 - DNA, 20 bp, Artificial Sequence
  chemically synthesized
gtgaacatagctgtcttcca

SEQ ID NO: 271136 - DNA, 20 bp, Artificial Sequence
  chemically synthesized
tggtggtataattgtgaaca

SEQ ID NO: 271137 - DNA, 20 bp, Artificial Sequence
  chemically synthesized
tggtgttggagtggtgttgg

SEQ ID NO: 271138 - DNA, 20 bp, Artificial Sequence
  chemically synthesized
aagtggtgttggagtggtgt

SEQ ID NO: 271139 - DNA, 20 bp, Artificial Sequence
  chemically synthesized
gacatcaagtggtgttggag

SEQ ID NO: 271140 - DNA, 20 bp, Artificial Sequence
  chemically synthesized
taagacatcaagtggtgttg

SEQ ID NO: 271141 - DNA, 20 bp, Artificial Sequence
  chemically synthesized
attaagacatcaagtggtgt

SEQ ID NO: 271142 - DNA, 20 bp, Artificial Sequence
  chemically synthesized
agcaaaattaagacatcaag

SEQ ID NO: 271143 - DNA, 20 bp, Artificial Sequence
  chemically synthesized
caaagcaaaattaagacatc

SEQ ID NO: 271144 - DNA, 20 bp, Artificial Sequence
  chemically synthesized
gaaaactacaaagcaaaatt

SEQ ID NO: 271145 - DNA, 20 bp, Artificial Sequence
  chemically synthesized
gatgtcttaattttgctttg

SEQ ID NO: 271146 - DNA, 20 bp, Artificial Sequence
  chemically synthesized
atatttctaggaaaactaca

SEQ ID NO: 271147 - DNA, 20 bp, Artificial Sequence
  chemically synthesized
attttgctttgtagttttcc

SEQ ID NO: 271148 - DNA, 20 bp, Artificial Sequence
  chemically synthesized
atacaaagacatatatttct

SEQ ID NO: 271149 - DNA, 20 bp, Artificial Sequence
  chemically synthesized
catacaaagacatatatttc

SEQ ID NO: 271150 - DNA, 20 bp, Artificial Sequence
  chemically synthesized
tacatggccacatacataca

SEQ ID NO: 271151 - DNA, 20 bp, Artificial Sequence
  chemically synthesized
tatatgtctttgtatgtatg

SEQ ID NO: 271152 - DNA, 20 bp, Artificial Sequence
  chemically synthesized
cgtacatatatttgaataca

SEQ ID NO: 271153 - DNA, 20 bp, Artificial Sequence
  chemically synthesized
acgtatacacgtatatataa

SEQ ID NO: 271154 - DNA, 20 bp, Artificial Sequence
  chemically synthesized
tgactaaacaaattaaagca

SEQ ID NO: 271155 - DNA, 20 bp, Artificial Sequence
  chemically synthesized
tatgactaaacaaattaaag

SEQ ID NO: 271156 - DNA, 20 bp, Artificial Sequence
  chemically synthesized
atttatgactaaacaaatta

SEQ ID NO: 271157 - DNA, 20 bp, Artificial Sequence
  chemically synthesized
tatctctgctttaatttgtt

SEQ ID NO: 271158 - DNA, 20 bp, Artificial Sequence
  chemically synthesized
tagtcataaatctgaactat

SEQ ID NO: 271159 - DNA, 20 bp, Artificial Sequence
  chemically synthesized
taaaataagtactgatagtt

SEQ ID NO: 271160 - DNA, 20 bp, Artificial Sequence
  chemically synthesized
aatactaaaataagtactga

SEQ ID NO: 271161 - DNA, 20 bp, Artificial Sequence
  chemically synthesized
tgaactatcagtacttattt

SEQ ID NO: 271162 - DNA, 20 bp, Artificial Sequence
  chemically synthesized
ttttttggtaatactaaaat

SEQ ID NO: 271163 - DNA, 20 bp, Artificial Sequence
  chemically synthesized
ctactgtcaggtttattttt

SEQ ID NO: 271164 - DNA, 20 bp, Artificial Sequence
  chemically synthesized
ttaccaaaaaataaacctga

SEQ ID NO: 271165 - DNA, 20 bp, Artificial Sequence
  chemically synthesized
ccaaaaaataaacctgacag

SEQ ID NO: 271166 - DNA, 20 bp, Artificial Sequence
  chemically synthesized
caaaaaataaacctgacagt

SEQ ID NO: 271167 - DNA, 20 bp, Artificial Sequence
  chemically synthesized
aaaaacaattacctactgtc

SEQ ID NO: 271168 - DNA, 20 bp, Artificial Sequence
  chemically synthesized
taaaaacaattacctactgt

SEQ ID NO: 271169 - DNA, 20 bp, Artificial Sequence
  chemically synthesized
acagtaggtaattgttttta

SEQ ID NO: 271170 - DNA, 20 bp, Artificial Sequence
  chemically synthesized
ggtaattgtttttatggaat

SEQ ID NO: 271171 - DNA, 20 bp, Artificial Sequence
  chemically synthesized
tatggaattagaacaaaaat

SEQ ID NO: 271172 - DNA, 20 bp, Artificial Sequence
  chemically synthesized
atggaattagaacaaaaatt

SEQ ID NO: 271173 - DNA, 20 bp, Artificial Sequence
  chemically synthesized
ttgggtttaatttctctttt

SEQ ID NO: 271174 - DNA, 20 bp, Artificial Sequence
  chemically synthesized
cattacttttaaactgaaaa

SEQ ID NO: 271175 - DNA, 20 bp, Artificial Sequence
  chemically synthesized
gacattacttttaaactgaa

SEQ ID NO: 271176 - DNA, 20 bp, Artificial Sequence
  chemically synthesized
aatttctcttttcagtttaa

SEQ ID NO: 271177 - DNA, 20 bp, Artificial Sequence
  chemically synthesized
taaaagtaatgtctaaaaaa

SEQ ID NO: 271178 - DNA, 20 bp, Artificial Sequence
  chemically synthesized
ctttacaaaatgcttttttt

SEQ ID NO: 271179 - DNA, 20 bp, Artificial Sequence
  chemically synthesized
ctaaaaaaaagcattttgta

SEQ ID NO: 271180 - DNA, 20 bp, Artificial Sequence
  chemically synthesized
taaaaaaaagcattttgtaa

SEQ ID NO: 271181 - DNA, 20 bp, Artificial Sequence
  chemically synthesized
aaaaagcattttgtaaaggc

SEQ ID NO: 271182 - DNA, 20 bp, Artificial Sequence
  chemically synthesized
gcattgatcagataattgtc

SEQ ID NO: 271183 - DNA, 20 bp, Artificial Sequence
  chemically synthesized
aatatacatgtagcattgat

SEQ ID NO: 271184 - DNA, 20 bp, Artificial Sequence
  chemically synthesized
ttaatatggaaatatacatg

SEQ ID NO: 271185 - DNA, 20 bp, Artificial Sequence
  chemically synthesized
tttgtcaaagaggattaata

SEQ ID NO: 271186 - DNA, 20 bp, Artificial Sequence
  chemically synthesized
gttaacatcatttgtcaaag

SEQ ID NO: 271187 - DNA, 20 bp, Artificial Sequence
  chemically synthesized
tgttaacatcatttgtcaaa

SEQ ID NO: 271188 - DNA, 20 bp, Artificial Sequence
  chemically synthesized
aatgttaacatcatttgtca

SEQ ID NO: 271189 - DNA, 20 bp, Artificial Sequence
  chemically synthesized
gtcataattattagtgatga

SEQ ID NO: 271190 - DNA, 20 bp, Artificial Sequence
  chemically synthesized
agtcataattattagtgatg

SEQ ID NO: 271191 - DNA, 20 bp, Artificial Sequence
  chemically synthesized
cagacaaaagtcataattat

SEQ ID NO: 271192 - DNA, 20 bp, Artificial Sequence
  chemically synthesized
aataattatgacttttgtct

SEQ ID NO: 271193 - DNA, 20 bp, Artificial Sequence
  chemically synthesized
catctgggaaactcagacaa

SEQ ID NO: 271194 - DNA, 20 bp, Artificial Sequence
  chemically synthesized
tgacttttgtctgagtttcc

SEQ ID NO: 271195 - DNA, 20 bp, Artificial Sequence
  chemically synthesized
ataatatcatctgggaaact

SEQ ID NO: 271196 - DNA, 20 bp, Artificial Sequence
  chemically synthesized
tgaagtaaataatatcatct

SEQ ID NO: 271197 - DNA, 20 bp, Artificial Sequence
  chemically synthesized
atgaagtaaataatatcatc

SEQ ID NO: 271198 - DNA, 20 bp, Artificial Sequence
  chemically synthesized
tctaagaaaaaagtaaaatg

SEQ ID NO: 271199 - DNA, 20 bp, Artificial Sequence
  chemically synthesized
acttcattttacttttttct

SEQ ID NO: 271200 - DNA, 20 bp, Artificial Sequence
  chemically synthesized
ttttatatcttctaagaaaa

SEQ ID NO: 271201 - DNA, 20 bp, Artificial Sequence
  chemically synthesized
tcattttacttttttcttag

SEQ ID NO: 271202 - DNA, 20 bp, Artificial Sequence
  chemically synthesized
cagatatttttatatcttct

SEQ ID NO: 271203 - DNA, 20 bp, Artificial Sequence
  chemically synthesized
tataaaaatatctgtgtatc

SEQ ID NO: 271204 - DNA, 20 bp, Artificial Sequence
  chemically synthesized
tttcagtgtttccagataca

SEQ ID NO: 271205 - DNA, 20 bp, Artificial Sequence
  chemically synthesized
ataattaatttcagtgtttc

SEQ ID NO: 271206 - DNA, 20 bp, Artificial Sequence
  chemically synthesized
tccaacataataattaattt

SEQ ID NO: 271207 - DNA, 20 bp, Artificial Sequence
  chemically synthesized
actgaaattaattattatgt

SEQ ID NO: 271208 - DNA, 20 bp, Artificial Sequence
  chemically synthesized
ggaaatcaacgatgctaatt

SEQ ID NO: 271209 - DNA, 20 bp, Artificial Sequence
  chemically synthesized
aaaaatctctgattccaaat

SEQ ID NO: 271210 - DNA, 20 bp, Artificial Sequence
  chemically synthesized
caacgatgctaatttggaat

SEQ ID NO: 271211 - DNA, 20 bp, Artificial Sequence
  chemically synthesized
acgatgctaatttggaatca

SEQ ID NO: 271212 - DNA, 20 bp, Artificial Sequence
  chemically synthesized
agttcagagagtaaataatt

SEQ ID NO: 271213 - DNA, 20 bp, Artificial Sequence
  chemically synthesized
tatattttttgaagttcaga

SEQ ID NO: 271214 - DNA, 20 bp, Artificial Sequence
  chemically synthesized
tttatattttttgaagttca

SEQ ID NO: 271215 - DNA, 20 bp, Artificial Sequence
  chemically synthesized
catttatattttttgaagtt

SEQ ID NO: 271216 - DNA, 20 bp, Artificial Sequence
  chemically synthesized
taaagcatttatattttttg

SEQ ID NO: 271217 - DNA, 20 bp, Artificial Sequence
  chemically synthesized
gaactttcttcatcaaaata

SEQ ID NO: 271218 - DNA, 20 bp, Artificial Sequence
  chemically synthesized
ataaatgctttattttgatg

SEQ ID NO: 271219 - DNA, 20 bp, Artificial Sequence
  chemically synthesized
atgctttattttgatgaaga

SEQ ID NO: 271220 - DNA, 20 bp, Artificial Sequence
  chemically synthesized
ttgatgaagaaagttccctc

SEQ ID NO: 271221 - DNA, 20 bp, Artificial Sequence
  chemically synthesized
tgatgaagaaagttccctca

SEQ ID NO: 271222 - DNA, 20 bp, Artificial Sequence
  chemically synthesized
aatggctaacggtaccttga

SEQ ID NO: 271223 - DNA, 20 bp, Artificial Sequence
  chemically synthesized
taatggctaacggtaccttg

SEQ ID NO: 271224 - DNA, 20 bp, Artificial Sequence
  chemically synthesized
ttaatggctaacggtacctt

SEQ ID NO: 271225 - DNA, 20 bp, Artificial Sequence
  chemically synthesized
aagttccctcaaggtaccgt

SEQ ID NO: 271226 - DNA, 20 bp, Artificial Sequence
  chemically synthesized
gaaacaatgttaatggctaa

SEQ ID NO: 271227 - DNA, 20 bp, Artificial Sequence
  chemically synthesized
attgaatgaaacaatgttaa

SEQ ID NO: 271228 - DNA, 20 bp, Artificial Sequence
  chemically synthesized
attaacattgtttcattcaa

SEQ ID NO: 271229 - DNA, 20 bp, Artificial Sequence
  chemically synthesized
ttaacattgtttcattcaat

SEQ ID NO: 271230 - DNA, 20 bp, Artificial Sequence
  chemically synthesized
cattgtttcattcaataggc

SEQ ID NO: 271231 - DNA, 20 bp, Artificial Sequence
  chemically synthesized
aagtaaaatatttataaaca

SEQ ID NO: 271232 - DNA, 20 bp, Artificial Sequence
  chemically synthesized
agtaaaatatttataaacaa

SEQ ID NO: 271233 - DNA, 20 bp, Artificial Sequence
  chemically synthesized
gtaaaatatttataaacaaa

SEQ ID NO: 271234 - DNA, 20 bp, Artificial Sequence
  chemically synthesized
taaaatatttataaacaaag

SEQ ID NO: 271235 - DNA, 20 bp, Artificial Sequence
  chemically synthesized
aaatatttataaacaaaggg

SEQ ID NO: 271236 - DNA, 20 bp, Artificial Sequence
  chemically synthesized
atttatatttgtgttcatga

SEQ ID NO: 271237 - DNA, 20 bp, Artificial Sequence
  chemically synthesized
atatttgtgttcatgaaagt

SEQ ID NO: 271238 - DNA, 20 bp, Artificial Sequence
  chemically synthesized
gaaagtaagacttttataaa

SEQ ID NO: 271239 - DNA, 20 bp, Artificial Sequence
  chemically synthesized
acatgtttgtctatttataa

SEQ ID NO: 271240 - DNA, 20 bp, Artificial Sequence
  chemically synthesized
aaatagacaaacatgtcttg

SEQ ID NO: 271241 - DNA, 20 bp, Artificial Sequence
  chemically synthesized
aatagacaaacatgtcttga

SEQ ID NO: 271242 - DNA, 20 bp, Artificial Sequence
  chemically synthesized
gacaaacatgtcttgaaggc

SEQ ID NO: 271243 - DNA, 20 bp, Artificial Sequence
  chemically synthesized
ataatcatagtcttgccttc

SEQ ID NO: 271244 - DNA, 20 bp, Artificial Sequence
  chemically synthesized
tgaaggcaagactatgatta

SEQ ID NO: 271245 - DNA, 20 bp, Artificial Sequence
  chemically synthesized
tgtggtgtataccataatca

SEQ ID NO: 271246 - DNA, 20 bp, Artificial Sequence
  chemically synthesized
tgattatggtatacaccaca

SEQ ID NO: 271247 - DNA, 20 bp, Artificial Sequence
  chemically synthesized
tcattgtttacgatgctttg

SEQ ID NO: 271248 - DNA, 20 bp, Artificial Sequence
  chemically synthesized
taaacaatgaaaaaactaaa

SEQ ID NO: 271249 - DNA, 20 bp, Artificial Sequence
  chemically synthesized
aagaatatccttacactgtt

SEQ ID NO: 271250 - DNA, 20 bp, Artificial Sequence
  chemically synthesized
atgaaaaaactaaacagtgt

SEQ ID NO: 271251 - DNA, 20 bp, Artificial Sequence
  chemically synthesized
tgaaaaaactaaacagtgta

SEQ ID NO: 271252 - DNA, 20 bp, Artificial Sequence
  chemically synthesized
gtgtaaggatattcttatga

SEQ ID NO: 271253 - DNA, 20 bp, Artificial Sequence
  chemically synthesized
aattgaagcagttctttcat

SEQ ID NO: 271254 - DNA, 20 bp, Artificial Sequence
  chemically synthesized
tatgaaagaactgcttcaat

SEQ ID NO: 271255 - DNA, 20 bp, Artificial Sequence
  chemically synthesized
aatgtcaggaccaattgaag

SEQ ID NO: 271256 - DNA, 20 bp, Artificial Sequence
  chemically synthesized
ttaaatgtcaggaccaattg

SEQ ID NO: 271257 - DNA, 20 bp, Artificial Sequence
  chemically synthesized
ctggttctggtttaaatgtc

SEQ ID NO: 271258 - DNA, 20 bp, Artificial Sequence
  chemically synthesized
tctggttctggtttaaatgt

SEQ ID NO: 271259 - DNA, 20 bp, Artificial Sequence
  chemically synthesized
attggtcctgacatttaaac

SEQ ID NO: 271260 - DNA, 20 bp, Artificial Sequence
  chemically synthesized
cctgacatttaaaccagaac

SEQ ID NO: 271261 - DNA, 20 bp, Artificial Sequence
  chemically synthesized
gctcaattggtttctggttc

SEQ ID NO: 271262 - DNA, 20 bp, Artificial Sequence
  chemically synthesized
gcatttgctcaattggtttc

SEQ ID NO: 271263 - DNA, 20 bp, Artificial Sequence
  chemically synthesized
accagaaccagaaaccaatt

SEQ ID NO: 271264 - DNA, 20 bp, Artificial Sequence
  chemically synthesized
gctcaaggcatttgctcaat

SEQ ID NO: 271265 - DNA, 20 bp, Artificial Sequence
  chemically synthesized
accaattgagcaaatgcctt

SEQ ID NO: 271266 - DNA, 20 bp, Artificial Sequence
  chemically synthesized
aattgagcaaatgccttgag

SEQ ID NO: 271267 - DNA, 20 bp, Artificial Sequence
  chemically synthesized
agtacaaaggaaactgctca

SEQ ID NO: 271268 - DNA, 20 bp, Artificial Sequence
  chemically synthesized
cagtacaaaggaaactgctc

SEQ ID NO: 271269 - DNA, 20 bp, Artificial Sequence
  chemically synthesized
tgtgccctgcgtcagtacaa

SEQ ID NO: 271270 - DNA, 20 bp, Artificial Sequence
  chemically synthesized
ctgtgccctgcgtcagtaca

SEQ ID NO: 271271 - DNA, 20 bp, Artificial Sequence
  chemically synthesized
cagtttcctttgtactgacg

SEQ ID NO: 271272 - DNA, 20 bp, Artificial Sequence
  chemically synthesized
agtttcctttgtactgacgc

SEQ ID NO: 271273 - DNA, 20 bp, Artificial Sequence
  chemically synthesized
gtttcctttgtactgacgca

SEQ ID NO: 271274 - DNA, 20 bp, Artificial Sequence
  chemically synthesized
gctgtgactgtgccctgcgt

SEQ ID NO: 271275 - DNA, 20 bp, Artificial Sequence
  chemically synthesized
ctttgtactgacgcagggca

SEQ ID NO: 271276 - DNA, 20 bp, Artificial Sequence
  chemically synthesized
actgacgcagggcacagtca

SEQ ID NO: 271277 - DNA, 20 bp, Artificial Sequence
  chemically synthesized
ggcacagtcacagcttgaca

SEQ ID NO: 271278 - DNA, 20 bp, Artificial Sequence
  chemically synthesized
gcacagtcacagcttgacac

SEQ ID NO: 271279 - DNA, 20 bp, Artificial Sequence
  chemically synthesized
aaaacaatctcacctgtgtc

SEQ ID NO: 271280 - DNA, 20 bp, Artificial Sequence
  chemically synthesized
agtcacagcttgacacaggt

SEQ ID NO: 271281 - DNA, 20 bp, Artificial Sequence
  chemically synthesized
gacacaggtgagattgtttt

SEQ ID NO: 271282 - DNA, 20 bp, Artificial Sequence
  chemically synthesized
atgtatccaacagtaaatat

SEQ ID NO: 271283 - DNA, 20 bp, Artificial Sequence
  chemically synthesized
tttcagctcatatttactgt

SEQ ID NO: 271284 - DNA, 20 bp, Artificial Sequence
  chemically synthesized
accttataaaatgtatccaa

SEQ ID NO: 271285 - DNA, 20 bp, Artificial Sequence
  chemically synthesized
tactgttggatacattttat

SEQ ID NO: 271286 - DNA, 20 bp, Artificial Sequence
  chemically synthesized
actgttggatacattttata

SEQ ID NO: 271287 - DNA, 20 bp, Artificial Sequence
  chemically synthesized
tacattttataaggtaacat

SEQ ID NO: 271288 - DNA, 20 bp, Artificial Sequence
  chemically synthesized
cattttataaggtaacatta

SEQ ID NO: 271289 - DNA, 20 bp, Artificial Sequence
  chemically synthesized
taacattagagacctgtttc

SEQ ID NO: 271290 - DNA, 20 bp, Artificial Sequence
  chemically synthesized
tttcgttcttttctagaaac

SEQ ID NO: 271291 - DNA, 20 bp, Artificial Sequence
  chemically synthesized
ttttcgttcttttctagaaa

SEQ ID NO: 271292 - DNA, 20 bp, Artificial Sequence
  chemically synthesized
ttagagacctgtttctagaa

SEQ ID NO: 271293 - DNA, 20 bp, Artificial Sequence
  chemically synthesized
gagcacttttcgttcttttc

SEQ ID NO: 271294 - DNA, 20 bp, Artificial Sequence
  chemically synthesized
tgtttctagaaaagaacgaa

SEQ ID NO: 271295 - DNA, 20 bp, Artificial Sequence
  chemically synthesized
atgactaatatttgcaaagt

SEQ ID NO: 271296 - DNA, 20 bp, Artificial Sequence
  chemically synthesized
attcatgactaatatttgca

SEQ ID NO: 271297 - DNA, 20 bp, Artificial Sequence
  chemically synthesized
agtgctcactttgcaaatat

SEQ ID NO: 271298 - DNA, 20 bp, Artificial Sequence
  chemically synthesized
tgcaaatattagtcatgaat

SEQ ID NO: 271299 - DNA, 20 bp, Artificial Sequence
  chemically synthesized
gcaaatattagtcatgaata

SEQ ID NO: 271300 - DNA, 20 bp, Artificial Sequence
  chemically synthesized
ttagtcatgaataaggcact

SEQ ID NO: 271301 - DNA, 20 bp, Artificial Sequence
  chemically synthesized
tagtcatgaataaggcactt

SEQ ID NO: 271302 - DNA, 20 bp, Artificial Sequence
  chemically synthesized
aaggaaagcataaatgaccc

SEQ ID NO: 271303 - DNA, 20 bp, Artificial Sequence
  chemically synthesized
gccaaaaaaaaaaaaaagga

SEQ ID NO: 271304 - DNA, 20 bp, Artificial Sequence
  chemically synthesized
ttttgccaaaaaaaaaaaaa

SEQ ID NO: 271305 - DNA, 20 bp, Artificial Sequence
  chemically synthesized
attttgccaaaaaaaaaaaa

SEQ ID NO: 271306 - DNA, 20 bp, Artificial Sequence
  chemically synthesized
gctttccttttttttttttt

SEQ ID NO: 271307 - DNA, 20 bp, Artificial Sequence
  chemically synthesized
ttttttttttggcaaaattt

SEQ ID NO: 271308 - DNA, 20 bp, Artificial Sequence
  chemically synthesized
ttttttggcaaaatttaaga

SEQ ID NO: 271309 - DNA, 20 bp, Artificial Sequence
  chemically synthesized
tttttggcaaaatttaagat

SEQ ID NO: 271310 - DNA, 20 bp, Artificial Sequence
  chemically synthesized
gagtaaggataggaatatat

SEQ ID NO: 271311 - DNA, 20 bp, Artificial Sequence
  chemically synthesized
tgagtaaggataggaatata

SEQ ID NO: 271312 - DNA, 20 bp, Artificial Sequence
  chemically synthesized
gatattagatgagtaaggat

SEQ ID NO: 271313 - DNA, 20 bp, Artificial Sequence
  chemically synthesized
tgatattagatgagtaagga

SEQ ID NO: 271314 - DNA, 20 bp, Artificial Sequence
  chemically synthesized
tagttgatattagatgagta

SEQ ID NO: 271315 - DNA, 20 bp, Artificial Sequence
  chemically synthesized
ttagttgatattagatgagt

SEQ ID NO: 271316 - DNA, 20 bp, Artificial Sequence
  chemically synthesized
gtagttagttgatattagat

SEQ ID NO: 271317 - DNA, 20 bp, Artificial Sequence
  chemically synthesized
agaaagtagttagttgatat

SEQ ID NO: 271318 - DNA, 20 bp, Artificial Sequence
  chemically synthesized
tagaaatgatagaaagtagt

SEQ ID NO: 271319 - DNA, 20 bp, Artificial Sequence
  chemically synthesized
ggaatagaaatgatagaaag

SEQ ID NO: 271320 - DNA, 20 bp, Artificial Sequence
  chemically synthesized
cttggaatagaaatgataga

SEQ ID NO: 271321 - DNA, 20 bp, Artificial Sequence
  chemically synthesized
gaaacttggaatagaaatga

SEQ ID NO: 271322 - DNA, 20 bp, Artificial Sequence
  chemically synthesized
ctttctatcatttctattcc

SEQ ID NO: 271323 - DNA, 20 bp, Artificial Sequence
  chemically synthesized
ccccaaaaagaaacttggaa

SEQ ID NO: 271324 - DNA, 20 bp, Artificial Sequence
  chemically synthesized
ctcacccccaaaaagaaact

SEQ ID NO: 271325 - DNA, 20 bp, Artificial Sequence
  chemically synthesized
ttctattccaagtttctttt

SEQ ID NO: 271326 - DNA, 20 bp, Artificial Sequence
  chemically synthesized
tctattccaagtttcttttt

SEQ ID NO: 271327 - DNA, 20 bp, Artificial Sequence
  chemically synthesized
ctattccaagtttctttttg

SEQ ID NO: 271328 - DNA, 20 bp, Artificial Sequence
  chemically synthesized
tattccaagtttctttttgg

SEQ ID NO: 271329 - DNA, 20 bp, Artificial Sequence
  chemically synthesized
taattattctcacccccaaa

SEQ ID NO: 271330 - DNA, 20 bp, Artificial Sequence
  chemically synthesized
ccaagtttctttttgggggt

SEQ ID NO: 271331 - DNA, 20 bp, Artificial Sequence
  chemically synthesized
tttgggggtgagaataatta

SEQ ID NO: 271332 - DNA, 20 bp, Artificial Sequence
  chemically synthesized
taattcaagctgcattttag

SEQ ID NO: 271333 - DNA, 20 bp, Artificial Sequence
  chemically synthesized
gtaattataccactaaaatg

SEQ ID NO: 271334 - DNA, 20 bp, Artificial Sequence
  chemically synthesized
tcataattcaagctgcattt

SEQ ID NO: 271335 - DNA, 20 bp, Artificial Sequence
  chemically synthesized
ataatatattttcataattc

SEQ ID NO: 271336 - DNA, 20 bp, Artificial Sequence
  chemically synthesized
atgaaaatatattatcgaat

SEQ ID NO: 271337 - DNA, 20 bp, Artificial Sequence
  chemically synthesized
atttatgtgtgaaaaatatg

SEQ ID NO: 271338 - DNA, 20 bp, Artificial Sequence
  chemically synthesized
tatttatgtgtgaaaaatat

SEQ ID NO: 271339 - DNA, 20 bp, Artificial Sequence
  chemically synthesized
taaatatatgtatttatttt

SEQ ID NO: 271340 - DNA, 20 bp, Artificial Sequence
  chemically synthesized
attttaagatatttgttaaa

SEQ ID NO: 271341 - DNA, 20 bp, Artificial Sequence
  chemically synthesized
tcgtagtcatatcatgaatg

SEQ ID NO: 271342 - DNA, 20 bp, Artificial Sequence
  chemically synthesized
atcgtagtcatatcatgaat

SEQ ID NO: 271343 - DNA, 20 bp, Artificial Sequence
  chemically synthesized
catcgtagtcatatcatgaa

SEQ ID NO: 271344 - DNA, 20 bp, Artificial Sequence
  chemically synthesized
agagtccttcagatacatcg

SEQ ID NO: 271345 - DNA, 20 bp, Artificial Sequence
  chemically synthesized
atatgactacgatgtatctg

SEQ ID NO: 271346 - DNA, 20 bp, Artificial Sequence
  chemically synthesized
tatgactacgatgtatctga

SEQ ID NO: 271347 - DNA, 20 bp, Artificial Sequence
  chemically synthesized
caatgaaaaacagagtcctt

SEQ ID NO: 271348 - DNA, 20 bp, Artificial Sequence
  chemically synthesized
cataatatcaatgaaaaaca

SEQ ID NO: 271349 - DNA, 20 bp, Artificial Sequence
  chemically synthesized
tccataatatcaatgaaaaa

SEQ ID NO: 271350 - DNA, 20 bp, Artificial Sequence
  chemically synthesized
tctgtttttcattgatatta

SEQ ID NO: 271351 - DNA, 20 bp, Artificial Sequence
  chemically synthesized
tgtttttcattgatattatg

SEQ ID NO: 271352 - DNA, 20 bp, Artificial Sequence
  chemically synthesized
ttttcattgatattatggag

SEQ ID NO: 271353 - DNA, 20 bp, Artificial Sequence
  chemically synthesized
ttgatattatggagtagatg

SEQ ID NO: 271354 - DNA, 20 bp, Artificial Sequence
  chemically synthesized
tatttagtacttgatatttt

SEQ ID NO: 271355 - DNA, 20 bp, Artificial Sequence
  chemically synthesized
gaaacaatacttaaaatatc

SEQ ID NO: 271356 - DNA, 20 bp, Artificial Sequence
  chemically synthesized
ttaaaatatcaagtactaaa

SEQ ID NO: 271357 - DNA, 20 bp, Artificial Sequence
  chemically synthesized
aaagggaaaacaagtctatt

SEQ ID NO: 271358 - DNA, 20 bp, Artificial Sequence
  chemically synthesized
aatgttattaaagggaaaac

SEQ ID NO: 271359 - DNA, 20 bp, Artificial Sequence
  chemically synthesized
aaacacagaatgttattaaa

SEQ ID NO: 271360 - DNA, 20 bp, Artificial Sequence
  chemically synthesized
aaaacacagaatgttattaa

SEQ ID NO: 271361 - DNA, 20 bp, Artificial Sequence
  chemically synthesized
gaaaacacagaatgttatta

SEQ ID NO: 271362 - DNA, 20 bp, Artificial Sequence
  chemically synthesized
agtcacataaaatgaaaaca

SEQ ID NO: 271363 - DNA, 20 bp, Artificial Sequence
  chemically synthesized
ctatcggccattagagtggg

SEQ ID NO: 271364 - DNA, 20 bp, Artificial Sequence
  chemically synthesized
tatgtgacttcccactctaa

SEQ ID NO: 271365 - DNA, 20 bp, Artificial Sequence
  chemically synthesized
gtactatcggccattagagt

SEQ ID NO: 271366 - DNA, 20 bp, Artificial Sequence
  chemically synthesized
tgtactatcggccattagag

SEQ ID NO: 271367 - DNA, 20 bp, Artificial Sequence
  chemically synthesized
acatgtactatcggccatta

SEQ ID NO: 271368 - DNA, 20 bp, Artificial Sequence
  chemically synthesized
ctacatgtactatcggccat

SEQ ID NO: 271369 - DNA, 20 bp, Artificial Sequence
  chemically synthesized
cttcccactctaatggccga

SEQ ID NO: 271370 - DNA, 20 bp, Artificial Sequence
  chemically synthesized
tataactctacatgtactat

SEQ ID NO: 271371 - DNA, 20 bp, Artificial Sequence
  chemically synthesized
ctaatggccgatagtacatg

SEQ ID NO: 271372 - DNA, 20 bp, Artificial Sequence
  chemically synthesized
aatggccgatagtacatgta

SEQ ID NO: 271373 - DNA, 20 bp, Artificial Sequence
  chemically synthesized
tgcatctactcgagtaacat

SEQ ID NO: 271374 - DNA, 20 bp, Artificial Sequence
  chemically synthesized
taataatacttatgttactc

SEQ ID NO: 271375 - DNA, 20 bp, Artificial Sequence
  chemically synthesized
taatacttatgttactcgag

SEQ ID NO: 271376 - DNA, 20 bp, Artificial Sequence
  chemically synthesized
aggtatgattgcatctactc

SEQ ID NO: 271377 - DNA, 20 bp, Artificial Sequence
  chemically synthesized
gagtagatgcaatcatacct

SEQ ID NO: 271378 - DNA, 20 bp, Artificial Sequence
  chemically synthesized
ttcctctgaaaacaaagctg

SEQ ID NO: 271379 - DNA, 20 bp, Artificial Sequence
  chemically synthesized
attcctctgaaaacaaagct

SEQ ID NO: 271380 - DNA, 20 bp, Artificial Sequence
  chemically synthesized
tcatacctcagctttgtttt

SEQ ID NO: 271381 - DNA, 20 bp, Artificial Sequence
  chemically synthesized
agatgattcctctgaaaaca

SEQ ID NO: 271382 - DNA, 20 bp, Artificial Sequence
  chemically synthesized
atacctcagctttgttttca

SEQ ID NO: 271383 - DNA, 20 bp, Artificial Sequence
  chemically synthesized
tacctcagctttgttttcag

SEQ ID NO: 271384 - DNA, 20 bp, Artificial Sequence
  chemically synthesized
tgttttcagaggaatcatct

SEQ ID NO: 271385 - DNA, 20 bp, Artificial Sequence
  chemically synthesized
ttcagaggaatcatctcagt

SEQ ID NO: 271386 - DNA, 20 bp, Artificial Sequence
  chemically synthesized
gaggaatcatctcagttggt

SEQ ID NO: 271387 - DNA, 20 bp, Artificial Sequence
  chemically synthesized
ttattggaaactcaccaact

SEQ ID NO: 271388 - DNA, 20 bp, Artificial Sequence
  chemically synthesized
agttggtgagtttccaataa

SEQ ID NO: 271389 - DNA, 20 bp, Artificial Sequence
  chemically synthesized
gtgtcctatgttgctgttat

SEQ ID NO: 271390 - DNA, 20 bp, Artificial Sequence
  chemically synthesized
agtttccaataacagcaaca

SEQ ID NO: 271391 - DNA, 20 bp, Artificial Sequence
  chemically synthesized
gtttccaataacagcaacat

SEQ ID NO: 271392 - DNA, 20 bp, Artificial Sequence
  chemically synthesized
ttaaactttataatattgaa

SEQ ID NO: 271393 - DNA, 20 bp, Artificial Sequence
  chemically synthesized
ggacaccgttcaatattata

SEQ ID NO: 271394 - DNA, 20 bp, Artificial Sequence
  chemically synthesized
caatattataaagtttaaat

SEQ ID NO: 271395 - DNA, 20 bp, Artificial Sequence
  chemically synthesized
tttaaatcagatttatactt

SEQ ID NO: 271396 - DNA, 20 bp, Artificial Sequence
  chemically synthesized
ttaaatcagatttatacttt

SEQ ID NO: 271397 - DNA, 20 bp, Artificial Sequence
  chemically synthesized
ggaaaggtacaaatagccta

SEQ ID NO: 271398 - DNA, 20 bp, Artificial Sequence
  chemically synthesized
aaggcatggaaaggtacaaa

SEQ ID NO: 271399 - DNA, 20 bp, Artificial Sequence
  chemically synthesized
ccgaattaaaaggcatggaa

SEQ ID NO: 271400 - DNA, 20 bp, Artificial Sequence
  chemically synthesized
accgaattaaaaggcatgga

SEQ ID NO: 271401 - DNA, 20 bp, Artificial Sequence
  chemically synthesized
caacaccgaattaaaaggca

SEQ ID NO: 271402 - DNA, 20 bp, Artificial Sequence
  chemically synthesized
cctttccatgccttttaatt

SEQ ID NO: 271403 - DNA, 20 bp, Artificial Sequence
  chemically synthesized
caagacaacaccgaattaaa

SEQ ID NO: 271404 - DNA, 20 bp, Artificial Sequence
  chemically synthesized
tcaagacaacaccgaattaa

SEQ ID NO: 271405 - DNA, 20 bp, Artificial Sequence
  chemically synthesized
ttttaattcggtgttgtctt

SEQ ID NO: 271406 - DNA, 20 bp, Artificial Sequence
  chemically synthesized
tttaattcggtgttgtcttg

SEQ ID NO: 271407 - DNA, 20 bp, Artificial Sequence
  chemically synthesized
gatatacagtgaaatgcctc

SEQ ID NO: 271408 - DNA, 20 bp, Artificial Sequence
  chemically synthesized
gaggcatttcactgtatatc

SEQ ID NO: 271409 - DNA, 20 bp, Artificial Sequence
  chemically synthesized
aaacaccagtactggatata

SEQ ID NO: 271410 - DNA, 20 bp, Artificial Sequence
  chemically synthesized
tttcactgtatatccagtac

SEQ ID NO: 271411 - DNA, 20 bp, Artificial Sequence
  chemically synthesized
tttcctttaaacaccagtac

SEQ ID NO: 271412 - DNA, 20 bp, Artificial Sequence
  chemically synthesized
atatccagtactggtgttta

SEQ ID NO: 271413 - DNA, 20 bp, Artificial Sequence
  chemically synthesized
aataactttcctttaaacac

SEQ ID NO: 271414 - DNA, 20 bp, Artificial Sequence
  chemically synthesized
tatccagtactggtgtttaa

SEQ ID NO: 271415 - DNA, 20 bp, Artificial Sequence
  chemically synthesized
cagtactggtgtttaaagga

SEQ ID NO: 271416 - DNA, 20 bp, Artificial Sequence
  chemically synthesized
tgtttaaaggaaagttatta

SEQ ID NO: 271417 - DNA, 20 bp, Artificial Sequence
  chemically synthesized
aaaggaaagttattaaagtt

SEQ ID NO: 271418 - DNA, 20 bp, Artificial Sequence
  chemically synthesized
aagttattaaagtttggaat

SEQ ID NO: 271419 - DNA, 20 bp, Artificial Sequence
  chemically synthesized
gttattaaagtttggaataa

SEQ ID NO: 271420 - DNA, 20 bp, Artificial Sequence
  chemically synthesized
tggaataagagtacctgaat

SEQ ID NO: 271421 - DNA, 20 bp, Artificial Sequence
  chemically synthesized
gcaaagcaagattccaattc

SEQ ID NO: 271422 - DNA, 20 bp, Artificial Sequence
  chemically synthesized
ggcaaagcaagattccaatt

SEQ ID NO: 271423 - DNA, 20 bp, Artificial Sequence
  chemically synthesized
cagctggtgaatggcaaagc

SEQ ID NO: 271424 - DNA, 20 bp, Artificial Sequence
  chemically synthesized
caaacagctggtgaatggca

SEQ ID NO: 271425 - DNA, 20 bp, Artificial Sequence
  chemically synthesized
aatcttgctttgccattcac

SEQ ID NO: 271426 - DNA, 20 bp, Artificial Sequence
  chemically synthesized
aaggacaaacagctggtgaa

SEQ ID NO: 271427 - DNA, 20 bp, Artificial Sequence
  chemically synthesized
agaatttaaggacaaacagc

SEQ ID NO: 271428 - DNA, 20 bp, Artificial Sequence
  chemically synthesized
tgagagaatttaaggacaaa

SEQ ID NO: 271429 - DNA, 20 bp, Artificial Sequence
  chemically synthesized
agattacctgagagaattta

SEQ ID NO: 271430 - DNA, 20 bp, Artificial Sequence
  chemically synthesized
cagattacctgagagaattt

SEQ ID NO: 271431 - DNA, 20 bp, Artificial Sequence
  chemically synthesized
tgtttgtccttaaattctct

SEQ ID NO: 271432 - DNA, 20 bp, Artificial Sequence
  chemically synthesized
gtttgtccttaaattctctc

SEQ ID NO: 271433 - DNA, 20 bp, Artificial Sequence
  chemically synthesized
taaggctacagattacctga

SEQ ID NO: 271434 - DNA, 20 bp, Artificial Sequence
  chemically synthesized
cttaaggctacagattacct

SEQ ID NO: 271435 - DNA, 20 bp, Artificial Sequence
  chemically synthesized
aaattctctcaggtaatctg

SEQ ID NO: 271436 - DNA, 20 bp, Artificial Sequence
  chemically synthesized
ctcaggtaatctgtagcctt

SEQ ID NO: 271437 - DNA, 20 bp, Artificial Sequence
  chemically synthesized
acctttaattcttaaggcta

SEQ ID NO: 271438 - DNA, 20 bp, Artificial Sequence
  chemically synthesized
gaagtcacctttaattctta

SEQ ID NO: 271439 - DNA, 20 bp, Artificial Sequence
  chemically synthesized
agaagtcacctttaattctt

SEQ ID NO: 271440 - DNA, 20 bp, Artificial Sequence
  chemically synthesized
atctgtagccttaagaatta

SEQ ID NO: 271441 - DNA, 20 bp, Artificial Sequence
  chemically synthesized
tctgtagccttaagaattaa

SEQ ID NO: 271442 - DNA, 20 bp, Artificial Sequence
  chemically synthesized
gtaaactacgtgacatacag

SEQ ID NO: 271443 - DNA, 20 bp, Artificial Sequence
  chemically synthesized
caggtaaactacgtgacata

SEQ ID NO: 271444 - DNA, 20 bp, Artificial Sequence
  chemically synthesized
ggtgacttctgtatgtcacg

SEQ ID NO: 271445 - DNA, 20 bp, Artificial Sequence
  chemically synthesized
tgtatgtcacgtagtttacc

SEQ ID NO: 271446 - DNA, 20 bp, Artificial Sequence
  chemically synthesized
cttcagaaataatggatgcc

SEQ ID NO: 271447 - DNA, 20 bp, Artificial Sequence
  chemically synthesized
acttcagaaataatggatgc

SEQ ID NO: 271448 - DNA, 20 bp, Artificial Sequence
  chemically synthesized
cctaacaacttcagaaataa

SEQ ID NO: 271449 - DNA, 20 bp, Artificial Sequence
  chemically synthesized
cctggcatccattatttctg

SEQ ID NO: 271450 - DNA, 20 bp, Artificial Sequence
  chemically synthesized
tccattatttctgaagttgt

SEQ ID NO: 271451 - DNA, 20 bp, Artificial Sequence
  chemically synthesized
tgcaataatcctaacaactt

SEQ ID NO: 271452 - DNA, 20 bp, Artificial Sequence
  chemically synthesized
ccattatttctgaagttgtt

SEQ ID NO: 271453 - DNA, 20 bp, Artificial Sequence
  chemically synthesized
aaaaatagtaacaacaacag

SEQ ID NO: 271454 - DNA, 20 bp, Artificial Sequence
  chemically synthesized
tctaaaaatagtaacaacaa

SEQ ID NO: 271455 - DNA, 20 bp, Artificial Sequence
  chemically synthesized
actgttgttgttactatttt

SEQ ID NO: 271456 - DNA, 20 bp, Artificial Sequence
  chemically synthesized
gaaatatattaatctaaaaa

SEQ ID NO: 271457 - DNA, 20 bp, Artificial Sequence
  chemically synthesized
agattaatatatttcctttc

SEQ ID NO: 271458 - DNA, 20 bp, Artificial Sequence
  chemically synthesized
ttttaaatggaaatctagaa

SEQ ID NO: 271459 - DNA, 20 bp, Artificial Sequence
  chemically synthesized
attttaaatggaaatctaga

SEQ ID NO: 271460 - DNA, 20 bp, Artificial Sequence
  chemically synthesized
atatattttaaatggaaatc

SEQ ID NO: 271461 - DNA, 20 bp, Artificial Sequence
  chemically synthesized
ttctttaaatatattttaaa

SEQ ID NO: 271462 - DNA, 20 bp, Artificial Sequence
  chemically synthesized
ttccatttaaaatatattta

SEQ ID NO: 271463 - DNA, 20 bp, Artificial Sequence
  chemically synthesized
gaatcataaaaattaaacac

SEQ ID NO: 271464 - DNA, 20 bp, Artificial Sequence
  chemically synthesized
agaactgtgcagaatataaa

SEQ ID NO: 271465 - DNA, 20 bp, Artificial Sequence
  chemically synthesized
aagaactgtgcagaatataa

SEQ ID NO: 271466 - DNA, 20 bp, Artificial Sequence
  chemically synthesized
acatccttttatattctgca

SEQ ID NO: 271467 - DNA, 20 bp, Artificial Sequence
  chemically synthesized
taattctgctaagaactgtg

SEQ ID NO: 271468 - DNA, 20 bp, Artificial Sequence
  chemically synthesized
tttatattctgcacagttct

SEQ ID NO: 271469 - DNA, 20 bp, Artificial Sequence
  chemically synthesized
atattctgcacagttcttag

SEQ ID NO: 271470 - DNA, 20 bp, Artificial Sequence
  chemically synthesized
tttgagtctataattctgct

SEQ ID NO: 271471 - DNA, 20 bp, Artificial Sequence
  chemically synthesized
cacagttcttagcagaatta

SEQ ID NO: 271472 - DNA, 20 bp, Artificial Sequence
  chemically synthesized
gcagaattatagactcaaaa

SEQ ID NO: 271473 - DNA, 20 bp, Artificial Sequence
  chemically synthesized
ctattctgtgtgtctttttt

SEQ ID NO: 271474 - DNA, 20 bp, Artificial Sequence
  chemically synthesized
atagactcaaaaaagacaca

SEQ ID NO: 271475 - DNA, 20 bp, Artificial Sequence
  chemically synthesized
ctcaaaaaagacacacagaa

SEQ ID NO: 271476 - DNA, 20 bp, Artificial Sequence
  chemically synthesized
tcaaaaaagacacacagaat

SEQ ID NO: 271477 - DNA, 20 bp, Artificial Sequence
  chemically synthesized
aaaaattggcacatgtattg

SEQ ID NO: 271478 - DNA, 20 bp, Artificial Sequence
  chemically synthesized
ttaagattgagaacaaaaat

SEQ ID NO: 271479 - DNA, 20 bp, Artificial Sequence
  chemically synthesized
tactatgtaattttaagatt

SEQ ID NO: 271480 - DNA, 20 bp, Artificial Sequence
  chemically synthesized
taattatactatgtaatttt

SEQ ID NO: 271481 - DNA, 20 bp, Artificial Sequence
  chemically synthesized
ttctcaatcttaaaattaca

SEQ ID NO: 271482 - DNA, 20 bp, Artificial Sequence
  chemically synthesized
attacatagtataattatta

SEQ ID NO: 271483 - DNA, 20 bp, Artificial Sequence
  chemically synthesized
ttataagagagaattgtttt

SEQ ID NO: 271484 - DNA, 20 bp, Artificial Sequence
  chemically synthesized
gtaactgctcttttataaga

SEQ ID NO: 271485 - DNA, 20 bp, Artificial Sequence
  chemically synthesized
aaaacaattctctcttataa

SEQ ID NO: 271486 - DNA, 20 bp, Artificial Sequence
  chemically synthesized
aagtaactgctcttttataa

SEQ ID NO: 271487 - DNA, 20 bp, Artificial Sequence
  chemically synthesized
aacaattctctcttataaaa

SEQ ID NO: 271488 - DNA, 20 bp, Artificial Sequence
  chemically synthesized
agaagtaactgctcttttat

SEQ ID NO: 271489 - DNA, 20 bp, Artificial Sequence
  chemically synthesized
aattctctcttataaaagag

SEQ ID NO: 271490 - DNA, 20 bp, Artificial Sequence
  chemically synthesized
aagagcagttacttcttaat

SEQ ID NO: 271491 - DNA, 20 bp, Artificial Sequence
  chemically synthesized
agagcagttacttcttaatg

SEQ ID NO: 271492 - DNA, 20 bp, Artificial Sequence
  chemically synthesized
ccttgactttcctcattaag

SEQ ID NO: 271493 - DNA, 20 bp, Artificial Sequence
  chemically synthesized
accccttgactttcctcatt

SEQ ID NO: 271494 - DNA, 20 bp, Artificial Sequence
  chemically synthesized
cagttacttcttaatgagga

SEQ ID NO: 271495 - DNA, 20 bp, Artificial Sequence
  chemically synthesized
acttcttaatgaggaaagtc

SEQ ID NO: 271496 - DNA, 20 bp, Artificial Sequence
  chemically synthesized
cttcttaatgaggaaagtca

SEQ ID NO: 271497 - DNA, 20 bp, Artificial Sequence
  chemically synthesized
ttcttaatgaggaaagtcaa

SEQ ID NO: 271498 - DNA, 20 bp, Artificial Sequence
  chemically synthesized
tcttaatgaggaaagtcaag

SEQ ID NO: 271499 - DNA, 20 bp, Artificial Sequence
  chemically synthesized
atttctggtggcaaatacgc

SEQ ID NO: 271500 - DNA, 20 bp, Artificial Sequence
  chemically synthesized
tatttctggtggcaaatacg

SEQ ID NO: 271501 - DNA, 20 bp, Artificial Sequence
  chemically synthesized
ggtacctgcgtatttgccac

SEQ ID NO: 271502 - DNA, 20 bp, Artificial Sequence
  chemically synthesized
tgtgtggtatgtatttctgg

SEQ ID NO: 271503 - DNA, 20 bp, Artificial Sequence
  chemically synthesized
cattgtgtggtatgtatttc

SEQ ID NO: 271504 - DNA, 20 bp, Artificial Sequence
  chemically synthesized
gtcacagctaaatcattgtg

SEQ ID NO: 271505 - DNA, 20 bp, Artificial Sequence
  chemically synthesized
atacataccacacaatgatt

SEQ ID NO: 271506 - DNA, 20 bp, Artificial Sequence
  chemically synthesized
aacaggaagtagtacagtca

SEQ ID NO: 271507 - DNA, 20 bp, Artificial Sequence
  chemically synthesized
gtgtggaacaggaagtagta

SEQ ID NO: 271508 - DNA, 20 bp, Artificial Sequence
  chemically synthesized
aaagagtgtggaacaggaag

SEQ ID NO: 271509 - DNA, 20 bp, Artificial Sequence
  chemically synthesized
aacaaagagtgtggaacagg

SEQ ID NO: 271510 - DNA, 20 bp, Artificial Sequence
  chemically synthesized
ggaaacaaagagtgtggaac

SEQ ID NO: 271511 - DNA, 20 bp, Artificial Sequence
  chemically synthesized
tggaaacaaagagtgtggaa

SEQ ID NO: 271512 - DNA, 20 bp, Artificial Sequence
  chemically synthesized
tgcattggaaacaaagagtg

SEQ ID NO: 271513 - DNA, 20 bp, Artificial Sequence
  chemically synthesized
ttgcctgcattggaaacaaa

SEQ ID NO: 271514 - DNA, 20 bp, Artificial Sequence
  chemically synthesized
acttgcctgcattggaaaca

SEQ ID NO: 271515 - DNA, 20 bp, Artificial Sequence
  chemically synthesized
cacactctttgtttccaatg

SEQ ID NO: 271516 - DNA, 20 bp, Artificial Sequence
  chemically synthesized
acactctttgtttccaatgc

SEQ ID NO: 271517 - DNA, 20 bp, Artificial Sequence
  chemically synthesized
gaagatgcacttgcctgcat

SEQ ID NO: 271518 - DNA, 20 bp, Artificial Sequence
  chemically synthesized
tctttgtttccaatgcaggc

SEQ ID NO: 271519 - DNA, 20 bp, Artificial Sequence
  chemically synthesized
agatgattttagatgaagtg

SEQ ID NO: 271520 - DNA, 20 bp, Artificial Sequence
  chemically synthesized
aagtaagatgattttagatg

SEQ ID NO: 271521 - DNA, 20 bp, Artificial Sequence
  chemically synthesized
acaagaaagtaagatgattt

SEQ ID NO: 271522 - DNA, 20 bp, Artificial Sequence
  chemically synthesized
agcagcgtctacaagaaagt

SEQ ID NO: 271523 - DNA, 20 bp, Artificial Sequence
  chemically synthesized
aaaatcatcttactttcttg

SEQ ID NO: 271524 - DNA, 20 bp, Artificial Sequence
  chemically synthesized
tttgagcagcgtctacaaga

SEQ ID NO: 271525 - DNA, 20 bp, Artificial Sequence
  chemically synthesized
caattttgagcagcgtctac

SEQ ID NO: 271526 - DNA, 20 bp, Artificial Sequence
  chemically synthesized
agaaaccagccaattttgag

SEQ ID NO: 271527 - DNA, 20 bp, Artificial Sequence
  chemically synthesized
ttgtagacgctgctcaaaat

SEQ ID NO: 271528 - DNA, 20 bp, Artificial Sequence
  chemically synthesized
tccagaaaccagccaatttt

SEQ ID NO: 271529 - DNA, 20 bp, Artificial Sequence
  chemically synthesized
agacgctgctcaaaattggc

SEQ ID NO: 271530 - DNA, 20 bp, Artificial Sequence
  chemically synthesized
gctcaaaattggctggtttc

SEQ ID NO: 271531 - DNA, 20 bp, Artificial Sequence
  chemically synthesized
gtttcgattattccagaaac

SEQ ID NO: 271532 - DNA, 20 bp, Artificial Sequence
  chemically synthesized
ccatgaagtttcgattattc

SEQ ID NO: 271533 - DNA, 20 bp, Artificial Sequence
  chemically synthesized
ctggaataatcgaaacttca

SEQ ID NO: 271534 - DNA, 20 bp, Artificial Sequence
  chemically synthesized
ggaataatcgaaacttcatg

SEQ ID NO: 271535 - DNA, 20 bp, Artificial Sequence
  chemically synthesized
aattacaagatgtctccatg

SEQ ID NO: 271536 - DNA, 20 bp, Artificial Sequence
  chemically synthesized
gtccttacagaaaaaattac

SEQ ID NO: 271537 - DNA, 20 bp, Artificial Sequence
  chemically synthesized
catcttgtaattttttctgt

SEQ ID NO: 271538 - DNA, 20 bp, Artificial Sequence
  chemically synthesized
atcttgtaattttttctgta

SEQ ID NO: 271539 - DNA, 20 bp, Artificial Sequence
  chemically synthesized
tgtaattttttctgtaagga

SEQ ID NO: 271540 - DNA, 20 bp, Artificial Sequence
  chemically synthesized
gcctttttacactgtcctta

SEQ ID NO: 271541 - DNA, 20 bp, Artificial Sequence
  chemically synthesized
ttctgtaaggacagtgtaaa

SEQ ID NO: 271542 - DNA, 20 bp, Artificial Sequence
  chemically synthesized
tctgtaaggacagtgtaaaa

SEQ ID NO: 271543 - DNA, 20 bp, Artificial Sequence
  chemically synthesized
tttgaaaggcaaaattaaat

SEQ ID NO: 271544 - DNA, 20 bp, Artificial Sequence
  chemically synthesized
aggaccagttattgtttgaa

SEQ ID NO: 271545 - DNA, 20 bp, Artificial Sequence
  chemically synthesized
taggaccagttattgtttga

SEQ ID NO: 271546 - DNA, 20 bp, Artificial Sequence
  chemically synthesized
tttgcctttcaaacaataac

SEQ ID NO: 271547 - DNA, 20 bp, Artificial Sequence
  chemically synthesized
tctatcaataaaaataggac

SEQ ID NO: 271548 - DNA, 20 bp, Artificial Sequence
  chemically synthesized
gcagatctatcaataaaaat

SEQ ID NO: 271549 - DNA, 20 bp, Artificial Sequence
  chemically synthesized
ggcagatctatcaataaaaa

SEQ ID NO: 271550 - DNA, 20 bp, Artificial Sequence
  chemically synthesized
actggtcctatttttattga

SEQ ID NO: 271551 - DNA, 20 bp, Artificial Sequence
  chemically synthesized
tatatcttcagaaataaagg

SEQ ID NO: 271552 - DNA, 20 bp, Artificial Sequence
  chemically synthesized
ctgtatatcttcagaaataa

SEQ ID NO: 271553 - DNA, 20 bp, Artificial Sequence
  chemically synthesized
tctgtatatcttcagaaata

SEQ ID NO: 271554 - DNA, 20 bp, Artificial Sequence
  chemically synthesized
tagatctgcctttatttctg

SEQ ID NO: 271555 - DNA, 20 bp, Artificial Sequence
  chemically synthesized
tttatttttctgtatatctt

SEQ ID NO: 271556 - DNA, 20 bp, Artificial Sequence
  chemically synthesized
cctttatttctgaagatata

SEQ ID NO: 271557 - DNA, 20 bp, Artificial Sequence
  chemically synthesized
agaaaaataaaaacaaaata

SEQ ID NO: 271558 - DNA, 20 bp, Artificial Sequence
  chemically synthesized
aaaataaaaacaaaataaag

SEQ ID NO: 271559 - DNA, 20 bp, Artificial Sequence
  chemically synthesized
gttttcctgtgttggatgaa

SEQ ID NO: 271560 - DNA, 20 bp, Artificial Sequence
  chemically synthesized
atttttccattcatccaaca

SEQ ID NO: 271561 - DNA, 20 bp, Artificial Sequence
  chemically synthesized
tttttccattcatccaacac

SEQ ID NO: 271562 - DNA, 20 bp, Artificial Sequence
  chemically synthesized
aaatgtatgttttcctgtgt

SEQ ID NO: 271563 - DNA, 20 bp, Artificial Sequence
  chemically synthesized
aacacaggaaaacatacatt

SEQ ID NO: 271564 - DNA, 20 bp, Artificial Sequence
  chemically synthesized
acacaggaaaacatacattt

SEQ ID NO: 271565 - DNA, 20 bp, Artificial Sequence
  chemically synthesized
acaggaaaacatacatttgg

SEQ ID NO: 271566 - DNA, 20 bp, Artificial Sequence
  chemically synthesized
atacatttgggagaatgatt

SEQ ID NO: 271567 - DNA, 20 bp, Artificial Sequence
  chemically synthesized
catttgggagaatgattcag

SEQ ID NO: 271568 - DNA, 20 bp, Artificial Sequence
  chemically synthesized
cttttatttagtataacatt

SEQ ID NO: 271569 - DNA, 20 bp, Artificial Sequence
  chemically synthesized
cttaatgttatactaaataa

SEQ ID NO: 271570 - DNA, 20 bp, Artificial Sequence
  chemically synthesized
ttaatgttatactaaataaa

SEQ ID NO: 271571 - DNA, 20 bp, Artificial Sequence
  chemically synthesized
ttaataaattaccttttatt

SEQ ID NO: 271572 - DNA, 20 bp, Artificial Sequence
  chemically synthesized
ctacattttaaagataaaat

SEQ ID NO: 271573 - DNA, 20 bp, Artificial Sequence
  chemically synthesized
tctacattttaaagataaaa

SEQ ID NO: 271574 - DNA, 20 bp, Artificial Sequence
  chemically synthesized
cctattttatctttaaaatg

SEQ ID NO: 271575 - DNA, 20 bp, Artificial Sequence
  chemically synthesized
gttttgctctctacatttta

SEQ ID NO: 271576 - DNA, 20 bp, Artificial Sequence
  chemically synthesized
tattttatctttaaaatgta

SEQ ID NO: 271577 - DNA, 20 bp, Artificial Sequence
  chemically synthesized
ttttatctttaaaatgtaga

SEQ ID NO: 271578 - DNA, 20 bp, Artificial Sequence
  chemically synthesized
agagcaaaacactcattgtt

SEQ ID NO: 271579 - DNA, 20 bp, Artificial Sequence
  chemically synthesized
taatttgatgtctaaacaat

SEQ ID NO: 271580 - DNA, 20 bp, Artificial Sequence
  chemically synthesized
attgtttagacatcaaatta

SEQ ID NO: 271581 - DNA, 20 bp, Artificial Sequence
  chemically synthesized
tattggcaagattggatttg

SEQ ID NO: 271582 - DNA, 20 bp, Artificial Sequence
  chemically synthesized
ttattggcaagattggattt

SEQ ID NO: 271583 - DNA, 20 bp, Artificial Sequence
  chemically synthesized
aacttgattattggcaagat

SEQ ID NO: 271584 - DNA, 20 bp, Artificial Sequence
  chemically synthesized
tggacaacttgattattggc

SEQ ID NO: 271585 - DNA, 20 bp, Artificial Sequence
  chemically synthesized
atccaatcttgccaataatc

SEQ ID NO: 271586 - DNA, 20 bp, Artificial Sequence
  chemically synthesized
atattggacaacttgattat

SEQ ID NO: 271587 - DNA, 20 bp, Artificial Sequence
  chemically synthesized
aataatcaagttgtccaata

SEQ ID NO: 271588 - DNA, 20 bp, Artificial Sequence
  chemically synthesized
cattatactccagtctatat

SEQ ID NO: 271589 - DNA, 20 bp, Artificial Sequence
  chemically synthesized
tcaagttgtccaatatagac

SEQ ID NO: 271590 - DNA, 20 bp, Artificial Sequence
  chemically synthesized
aagttgtccaatatagactg

SEQ ID NO: 271591 - DNA, 20 bp, Artificial Sequence
  chemically synthesized
tttcgttgggcattatactc

SEQ ID NO: 271592 - DNA, 20 bp, Artificial Sequence
  chemically synthesized
ctaaggaacgtgttttcgtt

SEQ ID NO: 271593 - DNA, 20 bp, Artificial Sequence
  chemically synthesized
actaaggaacgtgttttcgt

SEQ ID NO: 271594 - DNA, 20 bp, Artificial Sequence
  chemically synthesized
cccaacgaaaacacgttcct

SEQ ID NO: 271595 - DNA, 20 bp, Artificial Sequence
  chemically synthesized
atatgttatttcagaaacta

SEQ ID NO: 271596 - DNA, 20 bp, Artificial Sequence
  chemically synthesized
tatatgttatttcagaaact

SEQ ID NO: 271597 - DNA, 20 bp, Artificial Sequence
  chemically synthesized
tgcacaggtatatgttattt

SEQ ID NO: 271598 - DNA, 20 bp, Artificial Sequence
  chemically synthesized
gtctcagattgatgttgcac

SEQ ID NO: 271599 - DNA, 20 bp, Artificial Sequence
  chemically synthesized
tgtctcagattgatgttgca

SEQ ID NO: 271600 - DNA, 20 bp, Artificial Sequence
  chemically synthesized
tacctgtgcaacatcaatct

SEQ ID NO: 271601 - DNA, 20 bp, Artificial Sequence
  chemically synthesized
tgtgcaacatcaatctgaga

SEQ ID NO: 271602 - DNA, 20 bp, Artificial Sequence
  chemically synthesized
gtgcaacatcaatctgagac

SEQ ID NO: 271603 - DNA, 20 bp, Artificial Sequence
  chemically synthesized
ctgcccaaagagtcctgtct

SEQ ID NO: 271604 - DNA, 20 bp, Artificial Sequence
  chemically synthesized
caatctgagacaggactctt

SEQ ID NO: 271605 - DNA, 20 bp, Artificial Sequence
  chemically synthesized
aatctgagacaggactcttt

SEQ ID NO: 271606 - DNA, 20 bp, Artificial Sequence
  chemically synthesized
ctgagacaggactctttggg

SEQ ID NO: 271607 - DNA, 20 bp, Artificial Sequence
  chemically synthesized
ggggaaggaggctgcccaaa

SEQ ID NO: 271608 - DNA, 20 bp, Artificial Sequence
  chemically synthesized
caggggaaggaggctgccca

SEQ ID NO: 271609 - DNA, 20 bp, Artificial Sequence
  chemically synthesized
gaaacataatcaggggaagg

SEQ ID NO: 271610 - DNA, 20 bp, Artificial Sequence
  chemically synthesized
agaaacataatcaggggaag

SEQ ID NO: 271611 - DNA, 20 bp, Artificial Sequence
  chemically synthesized
gaagaaacataatcagggga

SEQ ID NO: 271612 - DNA, 20 bp, Artificial Sequence
  chemically synthesized
tgaagaaacataatcagggg

SEQ ID NO: 271613 - DNA, 20 bp, Artificial Sequence
  chemically synthesized
aaatgaagaaacataatcag

SEQ ID NO: 271614 - DNA, 20 bp, Artificial Sequence
  chemically synthesized
gaaatgaagaaacataatca

SEQ ID NO: 271615 - DNA, 20 bp, Artificial Sequence
  chemically synthesized
agaaatgaagaaacataatc

SEQ ID NO: 271616 - DNA, 20 bp, Artificial Sequence
  chemically synthesized
aagaaatgaagaaacataat

SEQ ID NO: 271617 - DNA, 20 bp, Artificial Sequence
  chemically synthesized
agatcagtttagaagaaatg

SEQ ID NO: 271618 - DNA, 20 bp, Artificial Sequence
  chemically synthesized
aagtcatgagatcagtttag

SEQ ID NO: 271619 - DNA, 20 bp, Artificial Sequence
  chemically synthesized
gacaagtcatgagatcagtt

SEQ ID NO: 271620 - DNA, 20 bp, Artificial Sequence
  chemically synthesized
gatttgacaagtcatgagat

SEQ ID NO: 271621 - DNA, 20 bp, Artificial Sequence
  chemically synthesized
aatctgatttgacaagtcat

SEQ ID NO: 271622 - DNA, 20 bp, Artificial Sequence
  chemically synthesized
gatctcatgacttgtcaaat

SEQ ID NO: 271623 - DNA, 20 bp, Artificial Sequence
  chemically synthesized
aaaatccaatctgatttgac

SEQ ID NO: 271624 - DNA, 20 bp, Artificial Sequence
  chemically synthesized
catgacttgtcaaatcagat

SEQ ID NO: 271625 - DNA, 20 bp, Artificial Sequence
  chemically synthesized
aatcagattggattttctgt

SEQ ID NO: 271626 - DNA, 20 bp, Artificial Sequence
  chemically synthesized
atcagattggattttctgtt

SEQ ID NO: 271627 - DNA, 20 bp, Artificial Sequence
  chemically synthesized
cagattggattttctgttgg

SEQ ID NO: 271628 - DNA, 20 bp, Artificial Sequence
  chemically synthesized
agattggattttctgttggg

SEQ ID NO: 271629 - DNA, 20 bp, Artificial Sequence
  chemically synthesized
taataatgctatcctcccaa

SEQ ID NO: 271630 - DNA, 20 bp, Artificial Sequence
  chemically synthesized
tggattttctgttgggagga

SEQ ID NO: 271631 - DNA, 20 bp, Artificial Sequence
  chemically synthesized
tgttgggaggatagcattat

SEQ ID NO: 271632 - DNA, 20 bp, Artificial Sequence
  chemically synthesized
gggaggatagcattattagt

SEQ ID NO: 271633 - DNA, 20 bp, Artificial Sequence
  chemically synthesized
attagtcagcatgctctaca

SEQ ID NO: 271634 - DNA, 20 bp, Artificial Sequence
  chemically synthesized
aaagttagttgttctttgta

SEQ ID NO: 271635 - DNA, 20 bp, Artificial Sequence
  chemically synthesized
ggaaagttagttgttctttg

SEQ ID NO: 271636 - DNA, 20 bp, Artificial Sequence
  chemically synthesized
caaagaacaactaactttcc

SEQ ID NO: 271637 - DNA, 20 bp, Artificial Sequence
  chemically synthesized
atttcgtcttcttggaaagt

SEQ ID NO: 271638 - DNA, 20 bp, Artificial Sequence
  chemically synthesized
agaacaactaactttccaag

SEQ ID NO: 271639 - DNA, 20 bp, Artificial Sequence
  chemically synthesized
ctgaatttcgtcttcttgga

SEQ ID NO: 271640 - DNA, 20 bp, Artificial Sequence
  chemically synthesized
gtttctgaatttcgtcttct

SEQ ID NO: 271641 - DNA, 20 bp, Artificial Sequence
  chemically synthesized
ctttccaagaagacgaaatt

SEQ ID NO: 271642 - DNA, 20 bp, Artificial Sequence
  chemically synthesized
atggtagaggtggttgagga

SEQ ID NO: 271643 - DNA, 20 bp, Artificial Sequence
  chemically synthesized
acatggtagaggtggttgag

SEQ ID NO: 271644 - DNA, 20 bp, Artificial Sequence
  chemically synthesized
ctacatggtagaggtggttg

SEQ ID NO: 271645 - DNA, 20 bp, Artificial Sequence
  chemically synthesized
gctacatggtagaggtggtt

SEQ ID NO: 271646 - DNA, 20 bp, Artificial Sequence
  chemically synthesized
aggaagctacatggtagagg

SEQ ID NO: 271647 - DNA, 20 bp, Artificial Sequence
  chemically synthesized
taaaggaagctacatggtag

SEQ ID NO: 271648 - DNA, 20 bp, Artificial Sequence
  chemically synthesized
cctcaaccacctctaccatg

SEQ ID NO: 271649 - DNA, 20 bp, Artificial Sequence
  chemically synthesized
ttaaaggaagctacatggta

SEQ ID NO: 271650 - DNA, 20 bp, Artificial Sequence
  chemically synthesized
ttttaaaggaagctacatgg

SEQ ID NO: 271651 - DNA, 20 bp, Artificial Sequence
  chemically synthesized
tcattttaaaggaagctaca

SEQ ID NO: 271652 - DNA, 20 bp, Artificial Sequence
  chemically synthesized
atttacggtcattttaaagg

SEQ ID NO: 271653 - DNA, 20 bp, Artificial Sequence
  chemically synthesized
ccaatttacggtcattttaa

SEQ ID NO: 271654 - DNA, 20 bp, Artificial Sequence
  chemically synthesized
gccaatttacggtcatttta

SEQ ID NO: 271655 - DNA, 20 bp, Artificial Sequence
  chemically synthesized
cctttaaaatgaccgtaaat

SEQ ID NO: 271656 - DNA, 20 bp, Artificial Sequence
  chemically synthesized
caccactcttggccaattta

SEQ ID NO: 271657 - DNA, 20 bp, Artificial Sequence
  chemically synthesized
aaaatgaccgtaaattggcc

SEQ ID NO: 271658 - DNA, 20 bp, Artificial Sequence
  chemically synthesized
aatgaccgtaaattggccaa

SEQ ID NO: 271659 - DNA, 20 bp, Artificial Sequence
  chemically synthesized
gaccgtaaattggccaagag

SEQ ID NO: 271660 - DNA, 20 bp, Artificial Sequence
  chemically synthesized
cgtaaattggccaagagtgg

SEQ ID NO: 271661 - DNA, 20 bp, Artificial Sequence
  chemically synthesized
caggtgtgaaccaccactct

SEQ ID NO: 271662 - DNA, 20 bp, Artificial Sequence
  chemically synthesized
gtggttcacacctgtaatcc

SEQ ID NO: 271663 - DNA, 20 bp, Artificial Sequence
  chemically synthesized
tcccaaagtgctaggattac

SEQ ID NO: 271664 - DNA, 20 bp, Artificial Sequence
  chemically synthesized
ctcccaaagtgctaggatta

SEQ ID NO: 271665 - DNA, 20 bp, Artificial Sequence
  chemically synthesized
cacctgtaatcctagcactt

SEQ ID NO: 271666 - DNA, 20 bp, Artificial Sequence
  chemically synthesized
cctcgacctcccaaagtgct

SEQ ID NO: 271667 - DNA, 20 bp, Artificial Sequence
  chemically synthesized
acctgtaatcctagcacttt

SEQ ID NO: 271668 - DNA, 20 bp, Artificial Sequence
  chemically synthesized
gcctcgacctcccaaagtgc

SEQ ID NO: 271669 - DNA, 20 bp, Artificial Sequence
  chemically synthesized
ctgtaatcctagcactttgg

SEQ ID NO: 271670 - DNA, 20 bp, Artificial Sequence
  chemically synthesized
tgtaatcctagcactttggg

SEQ ID NO: 271671 - DNA, 20 bp, Artificial Sequence
  chemically synthesized
ccacctgcctcgacctccca

SEQ ID NO: 271672 - DNA, 20 bp, Artificial Sequence
  chemically synthesized
tcctagcactttgggaggtc

SEQ ID NO: 271673 - DNA, 20 bp, Artificial Sequence
  chemically synthesized
cctagcactttgggaggtcg

SEQ ID NO: 271674 - DNA, 20 bp, Artificial Sequence
  chemically synthesized
agcactttgggaggtcgagg

SEQ ID NO: 271675 - DNA, 20 bp, Artificial Sequence
  chemically synthesized
gcactttgggaggtcgaggc

SEQ ID NO: 271676 - DNA, 20 bp, Artificial Sequence
  chemically synthesized
ctttgggaggtcgaggcagg

SEQ ID NO: 271677 - DNA, 20 bp, Artificial Sequence
  chemically synthesized
aggcaggtggatcacctaaa

SEQ ID NO: 271678 - DNA, 20 bp, Artificial Sequence
  chemically synthesized
tatttatgataattctattt

SEQ ID NO: 271679 - DNA, 20 bp, Artificial Sequence
  chemically synthesized
atatttatgataattctatt

SEQ ID NO: 271680 - DNA, 20 bp, Artificial Sequence
  chemically synthesized
ttcacttggataatttatga

SEQ ID NO: 271681 - DNA, 20 bp, Artificial Sequence
  chemically synthesized
tttactttcataaattatcc

SEQ ID NO: 271682 - DNA, 20 bp, Artificial Sequence
  chemically synthesized
aagaaataaatcgtttcact

SEQ ID NO: 271683 - DNA, 20 bp, Artificial Sequence
  chemically synthesized
aacgatttatttcttcccta

SEQ ID NO: 271684 - DNA, 20 bp, Artificial Sequence
  chemically synthesized
acgatttatttcttccctat

SEQ ID NO: 271685 - DNA, 20 bp, Artificial Sequence
  chemically synthesized
ttcataataatcccataggg

SEQ ID NO: 271686 - DNA, 20 bp, Artificial Sequence
  chemically synthesized
tttttcataataatcccata

SEQ ID NO: 271687 - DNA, 20 bp, Artificial Sequence
  chemically synthesized
ttttttcataataatcccat

SEQ ID NO: 271688 - DNA, 20 bp, Artificial Sequence
  chemically synthesized
cttttttcataataatccca

SEQ ID NO: 271689 - DNA, 20 bp, Artificial Sequence
  chemically synthesized
ctatgggattattatgaaaa

SEQ ID NO: 271690 - DNA, 20 bp, Artificial Sequence
  chemically synthesized
aaaaaagcaataatcatttt

SEQ ID NO: 271691 - DNA, 20 bp, Artificial Sequence
  chemically synthesized
tgagtcaatatcaactattt

SEQ ID NO: 271692 - DNA, 20 bp, Artificial Sequence
  chemically synthesized
attgaaaatgatatctgaaa

SEQ ID NO: 271693 - DNA, 20 bp, Artificial Sequence
  chemically synthesized
atttcagatatcattttcaa

SEQ ID NO: 271694 - DNA, 20 bp, Artificial Sequence
  chemically synthesized
tttcagatatcattttcaat

SEQ ID NO: 271695 - DNA, 20 bp, Artificial Sequence
  chemically synthesized
ggtaatttatatattatatg

SEQ ID NO: 271696 - DNA, 20 bp, Artificial Sequence
  chemically synthesized
attgatatgttttatctttg

SEQ ID NO: 271697 - DNA, 20 bp, Artificial Sequence
  chemically synthesized
ccgatttgagtgtgacttca

SEQ ID NO: 271698 - DNA, 20 bp, Artificial Sequence
  chemically synthesized
ctttgaagtcacactcaaat

SEQ ID NO: 271699 - DNA, 20 bp, Artificial Sequence
  chemically synthesized
tcatgtctttggtccgattt

SEQ ID NO: 271700 - DNA, 20 bp, Artificial Sequence
  chemically synthesized
gtcacactcaaatcggacca

SEQ ID NO: 271701 - DNA, 20 bp, Artificial Sequence
  chemically synthesized
acagattaacatcatgtctt

SEQ ID NO: 271702 - DNA, 20 bp, Artificial Sequence
  chemically synthesized
aagacatgatgttaatctgt

SEQ ID NO: 271703 - DNA, 20 bp, Artificial Sequence
  chemically synthesized
tgatgttaatctgtaagatt

SEQ ID NO: 271704 - DNA, 20 bp, Artificial Sequence
  chemically synthesized
tcacagttggctgaatctta

SEQ ID NO: 271705 - DNA, 20 bp, Artificial Sequence
  chemically synthesized
taagattcagccaactgtga

SEQ ID NO: 271706 - DNA, 20 bp, Artificial Sequence
  chemically synthesized
tatctcatccctgtcacagt

SEQ ID NO: 271707 - DNA, 20 bp, Artificial Sequence
  chemically synthesized
aagattcagccaactgtgac

SEQ ID NO: 271708 - DNA, 20 bp, Artificial Sequence
  chemically synthesized
agattcagccaactgtgaca

SEQ ID NO: 271709 - DNA, 20 bp, Artificial Sequence
  chemically synthesized
attatatctcatccctgtca

SEQ ID NO: 271710 - DNA, 20 bp, Artificial Sequence
  chemically synthesized
cagccaactgtgacagggat

SEQ ID NO: 271711 - DNA, 20 bp, Artificial Sequence
  chemically synthesized
tgacagggatgagatataat

SEQ ID NO: 271712 - DNA, 20 bp, Artificial Sequence
  chemically synthesized
tataatgagaaaattgcatg

SEQ ID NO: 271713 - DNA, 20 bp, Artificial Sequence
  chemically synthesized
ataaaaagaaggtaattaag

SEQ ID NO: 271714 - DNA, 20 bp, Artificial Sequence
  chemically synthesized
aaataaaaagaaggtaatta

SEQ ID NO: 271715 - DNA, 20 bp, Artificial Sequence
  chemically synthesized
aaaataaaaagaaggtaatt

SEQ ID NO: 271716 - DNA, 20 bp, Artificial Sequence
  chemically synthesized
aataaaataaaataaaaaga

SEQ ID NO: 271717 - DNA, 20 bp, Artificial Sequence
  chemically synthesized
aaataaaataaaataaaaag

SEQ ID NO: 271718 - DNA, 20 bp, Artificial Sequence
  chemically synthesized
ataaaataaaataaaataaa

SEQ ID NO: 271719 - DNA, 20 bp, Artificial Sequence
  chemically synthesized
ttttattttattttattttg

SEQ ID NO: 271720 - DNA, 20 bp, Artificial Sequence
  chemically synthesized
ttattttattttattttgta

SEQ ID NO: 271721 - DNA, 20 bp, Artificial Sequence
  chemically synthesized
tattttattttattttgtag

SEQ ID NO: 271722 - DNA, 20 bp, Artificial Sequence
  chemically synthesized
tttattttattttgtagagg

SEQ ID NO: 271723 - DNA, 20 bp, Artificial Sequence
  chemically synthesized
tattttattttgtagaggca

SEQ ID NO: 271724 - DNA, 20 bp, Artificial Sequence
  chemically synthesized
accaggctgggtcacatagc

SEQ ID NO: 271725 - DNA, 20 bp, Artificial Sequence
  chemically synthesized
cagagtcttgctatgtgacc

SEQ ID NO: 271726 - DNA, 20 bp, Artificial Sequence
  chemically synthesized
tgggaccaggctgggtcaca

SEQ ID NO: 271727 - DNA, 20 bp, Artificial Sequence
  chemically synthesized
tcttgctatgtgacccagcc

SEQ ID NO: 271728 - DNA, 20 bp, Artificial Sequence
  chemically synthesized
caggagtttgggaccaggct

SEQ ID NO: 271729 - DNA, 20 bp, Artificial Sequence
  chemically synthesized
ccaggagtttgggaccaggc

SEQ ID NO: 271730 - DNA, 20 bp, Artificial Sequence
  chemically synthesized
aagaccaggagtttgggacc

SEQ ID NO: 271731 - DNA, 20 bp, Artificial Sequence
  chemically synthesized
taagaccaggagtttgggac

SEQ ID NO: 271732 - DNA, 20 bp, Artificial Sequence
  chemically synthesized
ccagcctggtcccaaactcc

SEQ ID NO: 271733 - DNA, 20 bp, Artificial Sequence
  chemically synthesized
ttgcttaagaccaggagttt

SEQ ID NO: 271734 - DNA, 20 bp, Artificial Sequence
  chemically synthesized
attgcttaagaccaggagtt

SEQ ID NO: 271735 - DNA, 20 bp, Artificial Sequence
  chemically synthesized
ggagaattgcttaagaccag

SEQ ID NO: 271736 - DNA, 20 bp, Artificial Sequence
  chemically synthesized
ggtcccaaactcctggtctt

SEQ ID NO: 271737 - DNA, 20 bp, Artificial Sequence
  chemically synthesized
caggagaattgcttaagacc

SEQ ID NO: 271738 - DNA, 20 bp, Artificial Sequence
  chemically synthesized
acaggagaattgcttaagac

SEQ ID NO: 271739 - DNA, 20 bp, Artificial Sequence
  chemically synthesized
ctgagacaggagaattgctt

SEQ ID NO: 271740 - DNA, 20 bp, Artificial Sequence
  chemically synthesized
cttaagcaattctcctgtct

SEQ ID NO: 271741 - DNA, 20 bp, Artificial Sequence
  chemically synthesized
tctgtgggaggctgagacag

SEQ ID NO: 271742 - DNA, 20 bp, Artificial Sequence
  chemically synthesized
gctctgtgggaggctgagac

SEQ ID NO: 271743 - DNA, 20 bp, Artificial Sequence
  chemically synthesized
agctctgtgggaggctgaga

SEQ ID NO: 271744 - DNA, 20 bp, Artificial Sequence
  chemically synthesized
tcacagctctgtgggaggct

SEQ ID NO: 271745 - DNA, 20 bp, Artificial Sequence
  chemically synthesized
tctcctgtctcagcctccca

SEQ ID NO: 271746 - DNA, 20 bp, Artificial Sequence
  chemically synthesized
tcctgtctcagcctcccaca

SEQ ID NO: 271747 - DNA, 20 bp, Artificial Sequence
  chemically synthesized
tataatcacagctctgtggg

SEQ ID NO: 271748 - DNA, 20 bp, Artificial Sequence
  chemically synthesized
ctataatcacagctctgtgg

SEQ ID NO: 271749 - DNA, 20 bp, Artificial Sequence
  chemically synthesized
gcctataatcacagctctgt

SEQ ID NO: 271750 - DNA, 20 bp, Artificial Sequence
  chemically synthesized
cgcctataatcacagctctg

SEQ ID NO: 271751 - DNA, 20 bp, Artificial Sequence
  chemically synthesized
ctcccacagagctgtgatta

SEQ ID NO: 271752 - DNA, 20 bp, Artificial Sequence
  chemically synthesized
tcccacagagctgtgattat

SEQ ID NO: 271753 - DNA, 20 bp, Artificial Sequence
  chemically synthesized
gtggctcacgcctataatca

SEQ ID NO: 271754 - DNA, 20 bp, Artificial Sequence
  chemically synthesized
agagctgtgattataggcgt

SEQ ID NO: 271755 - DNA, 20 bp, Artificial Sequence
  chemically synthesized
taggcgtgagccactgtgcc

SEQ ID NO: 271756 - DNA, 20 bp, Artificial Sequence
  chemically synthesized
tacactaaggccaggcacag

SEQ ID NO: 271757 - DNA, 20 bp, Artificial Sequence
  chemically synthesized
gactacactaaggccaggca

SEQ ID NO: 271758 - DNA, 20 bp, Artificial Sequence
  chemically synthesized
tgagccactgtgcctggcct

SEQ ID NO: 271759 - DNA, 20 bp, Artificial Sequence
  chemically synthesized
gagtagactacactaaggcc

SEQ ID NO: 271760 - DNA, 20 bp, Artificial Sequence
  chemically synthesized
tgagtagactacactaaggc

SEQ ID NO: 271761 - DNA, 20 bp, Artificial Sequence
  chemically synthesized
cactgtgcctggccttagtg

SEQ ID NO: 271762 - DNA, 20 bp, Artificial Sequence
  chemically synthesized
tgactgagtagactacacta

SEQ ID NO: 271763 - DNA, 20 bp, Artificial Sequence
  chemically synthesized
atgactgagtagactacact

SEQ ID NO: 271764 - DNA, 20 bp, Artificial Sequence
  chemically synthesized
tggccttagtgtagtctact

SEQ ID NO: 271765 - DNA, 20 bp, Artificial Sequence
  chemically synthesized
tatggcacataatgactgag

SEQ ID NO: 271766 - DNA, 20 bp, Artificial Sequence
  chemically synthesized
aaatatggcacataatgact

SEQ ID NO: 271767 - DNA, 20 bp, Artificial Sequence
  chemically synthesized
agtcattatgtgccatattt

SEQ ID NO: 271768 - DNA, 20 bp, Artificial Sequence
  chemically synthesized
cctgaaatttaactgaaata

SEQ ID NO: 271769 - DNA, 20 bp, Artificial Sequence
  chemically synthesized
gccatatttcagttaaattt

SEQ ID NO: 271770 - DNA, 20 bp, Artificial Sequence
  chemically synthesized
ccatatttcagttaaatttc

SEQ ID NO: 271771 - DNA, 20 bp, Artificial Sequence
  chemically synthesized
catatttcagttaaatttca

SEQ ID NO: 271772 - DNA, 20 bp, Artificial Sequence
  chemically synthesized
atttcagttaaatttcaggg

SEQ ID NO: 271773 - DNA, 20 bp, Artificial Sequence
  chemically synthesized
ttcagggaagctatgaatct

SEQ ID NO: 271774 - DNA, 20 bp, Artificial Sequence
  chemically synthesized
acttccatttcttagattca

SEQ ID NO: 271775 - DNA, 20 bp, Artificial Sequence
  chemically synthesized
gaagctatgaatctaagaaa

SEQ ID NO: 271776 - DNA, 20 bp, Artificial Sequence
  chemically synthesized
ggcatttgacttccatttct

SEQ ID NO: 271777 - DNA, 20 bp, Artificial Sequence
  chemically synthesized
gctatgaatctaagaaatgg

SEQ ID NO: 271778 - DNA, 20 bp, Artificial Sequence
  chemically synthesized
tggaagtcaaatgccccaaa

SEQ ID NO: 271779 - DNA, 20 bp, Artificial Sequence
  chemically synthesized
ggaagtcaaatgccccaaac

SEQ ID NO: 271780 - DNA, 20 bp, Artificial Sequence
  chemically synthesized
caaatagcaatacctgtttg

SEQ ID NO: 271781 - DNA, 20 bp, Artificial Sequence
  chemically synthesized
acaaatagcaatacctgttt

SEQ ID NO: 271782 - DNA, 20 bp, Artificial Sequence
  chemically synthesized
gacaaatagcaatacctgtt

SEQ ID NO: 271783 - DNA, 20 bp, Artificial Sequence
  chemically synthesized
tcaaatatctatcagacaaa

SEQ ID NO: 271784 - DNA, 20 bp, Artificial Sequence
  chemically synthesized
aggtattgctatttgtctga

SEQ ID NO: 271785 - DNA, 20 bp, Artificial Sequence
  chemically synthesized
ggaagccatcaaatatctat

SEQ ID NO: 271786 - DNA, 20 bp, Artificial Sequence
  chemically synthesized
tttgtctgatagatatttga

SEQ ID NO: 271787 - DNA, 20 bp, Artificial Sequence
  chemically synthesized
gatagatatttgatggcttc

SEQ ID NO: 271788 - DNA, 20 bp, Artificial Sequence
  chemically synthesized
agatatttgatggcttccgg

SEQ ID NO: 271789 - DNA, 20 bp, Artificial Sequence
  chemically synthesized
tcacaatcagtatctgccgg

SEQ ID NO: 271790 - DNA, 20 bp, Artificial Sequence
  chemically synthesized
aattcacaatcagtatctgc

SEQ ID NO: 271791 - DNA, 20 bp, Artificial Sequence
  chemically synthesized
agttatctaaaattcacaat

SEQ ID NO: 271792 - DNA, 20 bp, Artificial Sequence
  chemically synthesized
cagatactgattgtgaattt

SEQ ID NO: 271793 - DNA, 20 bp, Artificial Sequence
  chemically synthesized
ataaatattgaaatgtttta

SEQ ID NO: 271794 - DNA, 20 bp, Artificial Sequence
  chemically synthesized
caatatttatatattcaata

SEQ ID NO: 271795 - DNA, 20 bp, Artificial Sequence
  chemically synthesized
caataaagacattttcgatc

SEQ ID NO: 271796 - DNA, 20 bp, Artificial Sequence
  chemically synthesized
acattttcgatcaagttcta

SEQ ID NO: 271797 - DNA, 20 bp, Artificial Sequence
  chemically synthesized
ttcgatcaagttctatagta

SEQ ID NO: 271798 - DNA, 20 bp, Artificial Sequence
  chemically synthesized
atgcagaatatactttacta

SEQ ID NO: 271799 - DNA, 20 bp, Artificial Sequence
  chemically synthesized
agaaattcatatgttaaatg

SEQ ID NO: 271800 - DNA, 20 bp, Artificial Sequence
  chemically synthesized
catttaacatatgaatttct

SEQ ID NO: 271801 - DNA, 20 bp, Artificial Sequence
  chemically synthesized
taacatatgaatttctgagc

SEQ ID NO: 271802 - DNA, 20 bp, Artificial Sequence
  chemically synthesized
atccctgcctataactggct

SEQ ID NO: 271803 - DNA, 20 bp, Artificial Sequence
  chemically synthesized
atgaatttctgagccagtta

SEQ ID NO: 271804 - DNA, 20 bp, Artificial Sequence
  chemically synthesized
tgaatttctgagccagttat

SEQ ID NO: 271805 - DNA, 20 bp, Artificial Sequence
  chemically synthesized
cagagatccctgcctataac

SEQ ID NO: 271806 - DNA, 20 bp, Artificial Sequence
  chemically synthesized
atttctgagccagttatagg

SEQ ID NO: 271807 - DNA, 20 bp, Artificial Sequence
  chemically synthesized
tttctgagccagttataggc

SEQ ID NO: 271808 - DNA, 20 bp, Artificial Sequence
  chemically synthesized
ttctgagccagttataggca

SEQ ID NO: 271809 - DNA, 20 bp, Artificial Sequence
  chemically synthesized
gttataggcagggatctctg

SEQ ID NO: 271810 - DNA, 20 bp, Artificial Sequence
  chemically synthesized
gttcgtgtccacatgctgca

SEQ ID NO: 271811 - DNA, 20 bp, Artificial Sequence
  chemically synthesized
gcagggatctctgcagcatg

SEQ ID NO: 271812 - DNA, 20 bp, Artificial Sequence
  chemically synthesized
gtgttcgtgtccacatgctg

SEQ ID NO: 271813 - DNA, 20 bp, Artificial Sequence
  chemically synthesized
ctgattttgtatggatttga

SEQ ID NO: 271814 - DNA, 20 bp, Artificial Sequence
  chemically synthesized
gaccgctagctgattttgta

SEQ ID NO: 271815 - DNA, 20 bp, Artificial Sequence
  chemically synthesized
ctgtcaaatccatacaaaat

SEQ ID NO: 271816 - DNA, 20 bp, Artificial Sequence
  chemically synthesized
caaatccatacaaaatcagc

SEQ ID NO: 271817 - DNA, 20 bp, Artificial Sequence
  chemically synthesized
atccatacaaaatcagctag

SEQ ID NO: 271818 - DNA, 20 bp, Artificial Sequence
  chemically synthesized
aattagaatgatttgaccgc

SEQ ID NO: 271819 - DNA, 20 bp, Artificial Sequence
  chemically synthesized
ataatgactgaattttaaat

SEQ ID NO: 271820 - DNA, 20 bp, Artificial Sequence
  chemically synthesized
aatcattctaatttaaaatt

SEQ ID NO: 271821 - DNA, 20 bp, Artificial Sequence
  chemically synthesized
atttaaaattcagtcattat

SEQ ID NO: 271822 - DNA, 20 bp, Artificial Sequence
  chemically synthesized
attattagattattataatt

SEQ ID NO: 271823 - DNA, 20 bp, Artificial Sequence
  chemically synthesized
tattagattattataattta

SEQ ID NO: 271824 - DNA, 20 bp, Artificial Sequence
  chemically synthesized
tagattattataatttagag

SEQ ID NO: 271825 - DNA, 20 bp, Artificial Sequence
  chemically synthesized
atgggcactctggtataatt

SEQ ID NO: 271826 - DNA, 20 bp, Artificial Sequence
  chemically synthesized
gagcagaaactaaattatac

SEQ ID NO: 271827 - DNA, 20 bp, Artificial Sequence
  chemically synthesized
gcagaaactaaattatacca

SEQ ID NO: 271828 - DNA, 20 bp, Artificial Sequence
  chemically synthesized
tgataatgttatgggcactc

SEQ ID NO: 271829 - DNA, 20 bp, Artificial Sequence
  chemically synthesized
gatctgcatgataatgttat

SEQ ID NO: 271830 - DNA, 20 bp, Artificial Sequence
  chemically synthesized
tgatctgcatgataatgtta

SEQ ID NO: 271831 - DNA, 20 bp, Artificial Sequence
  chemically synthesized
gtgcccataacattatcatg

SEQ ID NO: 271832 - DNA, 20 bp, Artificial Sequence
  chemically synthesized
tcattttgcataacgtatat

SEQ ID NO: 271833 - DNA, 20 bp, Artificial Sequence
  chemically synthesized
tgcataacgtatattagtgt

SEQ ID NO: 271834 - DNA, 20 bp, Artificial Sequence
  chemically synthesized
gtaagtgaatttacaccaat

SEQ ID NO: 271835 - DNA, 20 bp, Artificial Sequence
  chemically synthesized
aagtgaatttacaccaattg

SEQ ID NO: 271836 - DNA, 20 bp, Artificial Sequence
  chemically synthesized
gtatcagaatttactccaat

SEQ ID NO: 271837 - DNA, 20 bp, Artificial Sequence
  chemically synthesized
tatcttctaatgatatgtat

SEQ ID NO: 271838 - DNA, 20 bp, Artificial Sequence
  chemically synthesized
taaattctgatacatatcat

SEQ ID NO: 271839 - DNA, 20 bp, Artificial Sequence
  chemically synthesized
attctgatacatatcattag

SEQ ID NO: 271840 - DNA, 20 bp, Artificial Sequence
  chemically synthesized
atatcattagaagataacat

SEQ ID NO: 271841 - DNA, 20 bp, Artificial Sequence
  chemically synthesized
aagataacatcagttttgct

SEQ ID NO: 271842 - DNA, 20 bp, Artificial Sequence
  chemically synthesized
ataacatcagttttgcttag

SEQ ID NO: 271843 - DNA, 20 bp, Artificial Sequence
  chemically synthesized
agttcgctctggaaactgct

SEQ ID NO: 271844 - DNA, 20 bp, Artificial Sequence
  chemically synthesized
cagttttgcttagcagtttc

SEQ ID NO: 271845 - DNA, 20 bp, Artificial Sequence
  chemically synthesized
gttttgcttagcagtttcca

SEQ ID NO: 271846 - DNA, 20 bp, Artificial Sequence
  chemically synthesized
ttcagggctatagttcgctc

SEQ ID NO: 271847 - DNA, 20 bp, Artificial Sequence
  chemically synthesized
gcagtttccagagcgaacta

SEQ ID NO: 271848 - DNA, 20 bp, Artificial Sequence
  chemically synthesized
cattactcagttcagggcta

SEQ ID NO: 271849 - DNA, 20 bp, Artificial Sequence
  chemically synthesized
gcgaactatagccctgaact

SEQ ID NO: 271850 - DNA, 20 bp, Artificial Sequence
  chemically synthesized
aattctcattactcagttca

SEQ ID NO: 271851 - DNA, 20 bp, Artificial Sequence
  chemically synthesized
taattctcattactcagttc

SEQ ID NO: 271852 - DNA, 20 bp, Artificial Sequence
  chemically synthesized
ataattctcattactcagtt

SEQ ID NO: 271853 - DNA, 20 bp, Artificial Sequence
  chemically synthesized
atagccctgaactgagtaat

SEQ ID NO: 271854 - DNA, 20 bp, Artificial Sequence
  chemically synthesized
ttggtataattctcattact

SEQ ID NO: 271855 - DNA, 20 bp, Artificial Sequence
  chemically synthesized
tgagtaatgagaattatacc

SEQ ID NO: 271856 - DNA, 20 bp, Artificial Sequence
  chemically synthesized
tgagaattataccaagaaca

SEQ ID NO: 271857 - DNA, 20 bp, Artificial Sequence
  chemically synthesized
aaccacttagtccatgttct

SEQ ID NO: 271858 - DNA, 20 bp, Artificial Sequence
  chemically synthesized
ttataccaagaacatggact

SEQ ID NO: 271859 - DNA, 20 bp, Artificial Sequence
  chemically synthesized
taccaagaacatggactaag

SEQ ID NO: 271860 - DNA, 20 bp, Artificial Sequence
  chemically synthesized
agaacatggactaagtggtt

SEQ ID NO: 271861 - DNA, 20 bp, Artificial Sequence
  chemically synthesized
taaggagctccttaaccact

SEQ ID NO: 271862 - DNA, 20 bp, Artificial Sequence
  chemically synthesized
gaacatggactaagtggtta

SEQ ID NO: 271863 - DNA, 20 bp, Artificial Sequence
  chemically synthesized
acatggactaagtggttaag

SEQ ID NO: 271864 - DNA, 20 bp, Artificial Sequence
  chemically synthesized
ggttaaggagctccttatgc

SEQ ID NO: 271865 - DNA, 20 bp, Artificial Sequence
  chemically synthesized
aatttataaccttgcataag

SEQ ID NO: 271866 - DNA, 20 bp, Artificial Sequence
  chemically synthesized
gttaaggagctccttatgca

SEQ ID NO: 271867 - DNA, 20 bp, Artificial Sequence
  chemically synthesized
tgaatttataaccttgcata

SEQ ID NO: 271868 - DNA, 20 bp, Artificial Sequence
  chemically synthesized
gtgaatttataaccttgcat

SEQ ID NO: 271869 - DNA, 20 bp, Artificial Sequence
  chemically synthesized
tatgcaaggttataaattca

SEQ ID NO: 271870 - DNA, 20 bp, Artificial Sequence
  chemically synthesized
tattctaaggaataatattg

SEQ ID NO: 271871 - DNA, 20 bp, Artificial Sequence
  chemically synthesized
atattctaaggaataatatt

SEQ ID NO: 271872 - DNA, 20 bp, Artificial Sequence
  chemically synthesized
tgtacctcaatattattcct

SEQ ID NO: 271873 - DNA, 20 bp, Artificial Sequence
  chemically synthesized
ttgttaggattaatattcta

SEQ ID NO: 271874 - DNA, 20 bp, Artificial Sequence
  chemically synthesized
attgttaggattaatattct

SEQ ID NO: 271875 - DNA, 20 bp, Artificial Sequence
  chemically synthesized
gatttgcctctataattgtt

SEQ ID NO: 271876 - DNA, 20 bp, Artificial Sequence
  chemically synthesized
aatattaatcctaacaatta

SEQ ID NO: 271877 - DNA, 20 bp, Artificial Sequence
  chemically synthesized
tgatttgcctctataattgt

SEQ ID NO: 271878 - DNA, 20 bp, Artificial Sequence
  chemically synthesized
tattaatcctaacaattata

SEQ ID NO: 271879 - DNA, 20 bp, Artificial Sequence
  chemically synthesized
attaatcctaacaattatag

SEQ ID NO: 271880 - DNA, 20 bp, Artificial Sequence
  chemically synthesized
tcaattatgaattacctaaa

SEQ ID NO: 271881 - DNA, 20 bp, Artificial Sequence
  chemically synthesized
ttatgaattacctaaatagt

SEQ ID NO: 271882 - DNA, 20 bp, Artificial Sequence
  chemically synthesized
aggcagaattctaactattt

SEQ ID NO: 271883 - DNA, 20 bp, Artificial Sequence
  chemically synthesized
aaggcagaattctaactatt

SEQ ID NO: 271884 - DNA, 20 bp, Artificial Sequence
  chemically synthesized
tgctctcatttgttttaagg

SEQ ID NO: 271885 - DNA, 20 bp, Artificial Sequence
  chemically synthesized
atttgctctcatttgtttta

SEQ ID NO: 271886 - DNA, 20 bp, Artificial Sequence
  chemically synthesized
tatttgctctcatttgtttt

SEQ ID NO: 271887 - DNA, 20 bp, Artificial Sequence
  chemically synthesized
aattctgccttaaaacaaat

SEQ ID NO: 271888 - DNA, 20 bp, Artificial Sequence
  chemically synthesized
ttctgccttaaaacaaatga

SEQ ID NO: 271889 - DNA, 20 bp, Artificial Sequence
  chemically synthesized
catcgatatggtaataaaat

SEQ ID NO: 271890 - DNA, 20 bp, Artificial Sequence
  chemically synthesized
accaatgaagatcatcgata

SEQ ID NO: 271891 - DNA, 20 bp, Artificial Sequence
  chemically synthesized
accatatcgatgatcttcat

SEQ ID NO: 271892 - DNA, 20 bp, Artificial Sequence
  chemically synthesized
aggtagttattcaaccaatg

SEQ ID NO: 271893 - DNA, 20 bp, Artificial Sequence
  chemically synthesized
tcaatatttctcacacaagg

SEQ ID NO: 271894 - DNA, 20 bp, Artificial Sequence
  chemically synthesized
gttgaataactaccttgtgt

SEQ ID NO: 271895 - DNA, 20 bp, Artificial Sequence
  chemically synthesized
atatcaatatttctcacaca

SEQ ID NO: 271896 - DNA, 20 bp, Artificial Sequence
  chemically synthesized
catatcaatatttctcacac

SEQ ID NO: 271897 - DNA, 20 bp, Artificial Sequence
  chemically synthesized
attgatatgtttcgtgaacc

SEQ ID NO: 271898 - DNA, 20 bp, Artificial Sequence
  chemically synthesized
tgtttcgtgaacctagaatc

SEQ ID NO: 271899 - DNA, 20 bp, Artificial Sequence
  chemically synthesized
gtttcgtgaacctagaatct

SEQ ID NO: 271900 - DNA, 20 bp, Artificial Sequence
  chemically synthesized
gatccctactcccagattct

SEQ ID NO: 271901 - DNA, 20 bp, Artificial Sequence
  chemically synthesized
ggatccctactcccagattc

SEQ ID NO: 271902 - DNA, 20 bp, Artificial Sequence
  chemically synthesized
ttcgtgaacctagaatctgg

SEQ ID NO: 271903 - DNA, 20 bp, Artificial Sequence
  chemically synthesized
gtgaacctagaatctgggag

SEQ ID NO: 271904 - DNA, 20 bp, Artificial Sequence
  chemically synthesized
tgaacctagaatctgggagt

SEQ ID NO: 271905 - DNA, 20 bp, Artificial Sequence
  chemically synthesized
gaacctagaatctgggagta

SEQ ID NO: 271906 - DNA, 20 bp, Artificial Sequence
  chemically synthesized
cctagatggatccctactcc

SEQ ID NO: 271907 - DNA, 20 bp, Artificial Sequence
  chemically synthesized
tctgggagtagggatccatc

SEQ ID NO: 271908 - DNA, 20 bp, Artificial Sequence
  chemically synthesized
ctgggagtagggatccatct

SEQ ID NO: 271909 - DNA, 20 bp, Artificial Sequence
  chemically synthesized
aataacgtcatgcacctaga

SEQ ID NO: 271910 - DNA, 20 bp, Artificial Sequence
  chemically synthesized
tataaataacgtcatgcacc

SEQ ID NO: 271911 - DNA, 20 bp, Artificial Sequence
  chemically synthesized
taggtgcatgacgttattta

SEQ ID NO: 271912 - DNA, 20 bp, Artificial Sequence
  chemically synthesized
ggtgcatgacgttatttata

SEQ ID NO: 271913 - DNA, 20 bp, Artificial Sequence
  chemically synthesized
catgacgttatttatagagc

SEQ ID NO: 271914 - DNA, 20 bp, Artificial Sequence
  chemically synthesized
ttatagagcaagaaacatca

SEQ ID NO: 271915 - DNA, 20 bp, Artificial Sequence
  chemically synthesized
catcacagaatctataaaat

SEQ ID NO: 271916 - DNA, 20 bp, Artificial Sequence
  chemically synthesized
catacttccatccaatttta

SEQ ID NO: 271917 - DNA, 20 bp, Artificial Sequence
  chemically synthesized
acagaatctataaaattgga

SEQ ID NO: 271918 - DNA, 20 bp, Artificial Sequence
  chemically synthesized
gaatctataaaattggatgg

SEQ ID NO: 271919 - DNA, 20 bp, Artificial Sequence
  chemically synthesized
taaaattggatggaagtatg

SEQ ID NO: 271920 - DNA, 20 bp, Artificial Sequence
  chemically synthesized
aaaattggatggaagtatgc

SEQ ID NO: 271921 - DNA, 20 bp, Artificial Sequence
  chemically synthesized
aaattggatggaagtatgca

SEQ ID NO: 271922 - DNA, 20 bp, Artificial Sequence
  chemically synthesized
ttggatggaagtatgcaggg

SEQ ID NO: 271923 - DNA, 20 bp, Artificial Sequence
  chemically synthesized
ggatggaagtatgcagggtg

SEQ ID NO: 271924 - DNA, 20 bp, Artificial Sequence
  chemically synthesized
agggtggagtgatgcttgta

SEQ ID NO: 271925 - DNA, 20 bp, Artificial Sequence
  chemically synthesized
ggtggagtgatgcttgtacg

SEQ ID NO: 271926 - DNA, 20 bp, Artificial Sequence
  chemically synthesized
gtggagtgatgcttgtacgg

SEQ ID NO: 271927 - DNA, 20 bp, Artificial Sequence
  chemically synthesized
ccttatgacatcctccgtac

SEQ ID NO: 271928 - DNA, 20 bp, Artificial Sequence
  chemically synthesized
gcttgtacggaggatgtcat

SEQ ID NO: 271929 - DNA, 20 bp, Artificial Sequence
  chemically synthesized
cttgtacggaggatgtcata

SEQ ID NO: 271930 - DNA, 20 bp, Artificial Sequence
  chemically synthesized
ttgtacggaggatgtcataa

SEQ ID NO: 271931 - DNA, 20 bp, Artificial Sequence
  chemically synthesized
gtacggaggatgtcataagg

SEQ ID NO: 271932 - DNA, 20 bp, Artificial Sequence
  chemically synthesized
tcataagggagttgatgtta

SEQ ID NO: 271933 - DNA, 20 bp, Artificial Sequence
  chemically synthesized
taagggagttgatgttaaag

SEQ ID NO: 271934 - DNA, 20 bp, Artificial Sequence
  chemically synthesized
caatgcttactaattattga

SEQ ID NO: 271935 - DNA, 20 bp, Artificial Sequence
  chemically synthesized
aaagtagaactttcaataat

SEQ ID NO: 271936 - DNA, 20 bp, Artificial Sequence
  chemically synthesized
tagaactttcaataattagt

SEQ ID NO: 271937 - DNA, 20 bp, Artificial Sequence
  chemically synthesized
caataattagtaagcattgc

SEQ ID NO: 271938 - DNA, 20 bp, Artificial Sequence
  chemically synthesized
aataattagtaagcattgct

SEQ ID NO: 271939 - DNA, 20 bp, Artificial Sequence
  chemically synthesized
taattagtaagcattgctgg

SEQ ID NO: 271940 - DNA, 20 bp, Artificial Sequence
  chemically synthesized
gtaagcattgctgggagtaa

SEQ ID NO: 271941 - DNA, 20 bp, Artificial Sequence
  chemically synthesized
tctaaagcatctgttactcc

SEQ ID NO: 271942 - DNA, 20 bp, Artificial Sequence
  chemically synthesized
gctgggagtaacagatgctt

SEQ ID NO: 271943 - DNA, 20 bp, Artificial Sequence
  chemically synthesized
tgggagtaacagatgcttta

SEQ ID NO: 271944 - DNA, 20 bp, Artificial Sequence
  chemically synthesized
gggagtaacagatgctttag

SEQ ID NO: 271945 - DNA, 20 bp, Artificial Sequence
  chemically synthesized
ggagtaacagatgctttaga

SEQ ID NO: 271946 - DNA, 20 bp, Artificial Sequence
  chemically synthesized
gagtaacagatgctttagag

SEQ ID NO: 271947 - DNA, 20 bp, Artificial Sequence
  chemically synthesized
ccctagccataacccctcta

SEQ ID NO: 271948 - DNA, 20 bp, Artificial Sequence
  chemically synthesized
cagatgctttagaggggtta

SEQ ID NO: 271949 - DNA, 20 bp, Artificial Sequence
  chemically synthesized
tgctttagaggggttatggc

SEQ ID NO: 271950 - DNA, 20 bp, Artificial Sequence
  chemically synthesized
gctttagaggggttatggct

SEQ ID NO: 271951 - DNA, 20 bp, Artificial Sequence
  chemically synthesized
ctttagaggggttatggcta

SEQ ID NO: 271952 - DNA, 20 bp, Artificial Sequence
  chemically synthesized
atttccaagatgaaaggccc

SEQ ID NO: 271953 - DNA, 20 bp, Artificial Sequence
  chemically synthesized
atggctagggcctttcatct

SEQ ID NO: 271954 - DNA, 20 bp, Artificial Sequence
  chemically synthesized
attaacatttccaagatgaa

SEQ ID NO: 271955 - DNA, 20 bp, Artificial Sequence
  chemically synthesized
gattaacatttccaagatga

SEQ ID NO: 271956 - DNA, 20 bp, Artificial Sequence
  chemically synthesized
tgaggaggattaacatttcc

SEQ ID NO: 271957 - DNA, 20 bp, Artificial Sequence
  chemically synthesized
aaatgttaatcctcctcaaa

SEQ ID NO: 271958 - DNA, 20 bp, Artificial Sequence
  chemically synthesized
actggcccacctttttgagg

SEQ ID NO: 271959 - DNA, 20 bp, Artificial Sequence
  chemically synthesized
aatgttaatcctcctcaaaa

SEQ ID NO: 271960 - DNA, 20 bp, Artificial Sequence
  chemically synthesized
tactggcccacctttttgag

SEQ ID NO: 271961 - DNA, 20 bp, Artificial Sequence
  chemically synthesized
gttactggcccacctttttg

SEQ ID NO: 271962 - DNA, 20 bp, Artificial Sequence
  chemically synthesized
gttaatcctcctcaaaaagg

SEQ ID NO: 271963 - DNA, 20 bp, Artificial Sequence
  chemically synthesized
tgttactggcccaccttttt

SEQ ID NO: 271964 - DNA, 20 bp, Artificial Sequence
  chemically synthesized
ttaatcctcctcaaaaaggt

SEQ ID NO: 271965 - DNA, 20 bp, Artificial Sequence
  chemically synthesized
tcctcctcaaaaaggtgggc

SEQ ID NO: 271966 - DNA, 20 bp, Artificial Sequence
  chemically synthesized
ggcacagacatggttgttac

SEQ ID NO: 271967 - DNA, 20 bp, Artificial Sequence
  chemically synthesized
agaattacgtggcacagaca

SEQ ID NO: 271968 - DNA, 20 bp, Artificial Sequence
  chemically synthesized
ttggccagaattacgtggca

SEQ ID NO: 271969 - DNA, 20 bp, Artificial Sequence
  chemically synthesized
tggagttggccagaattacg

SEQ ID NO: 271970 - DNA, 20 bp, Artificial Sequence
  chemically synthesized
atgtctgtgccacgtaattc

SEQ ID NO: 271971 - DNA, 20 bp, Artificial Sequence
  chemically synthesized
acccataacatggagttggc

SEQ ID NO: 271972 - DNA, 20 bp, Artificial Sequence
  chemically synthesized
gatcacccataacatggagt

SEQ ID NO: 271973 - DNA, 20 bp, Artificial Sequence
  chemically synthesized
ttctggccaactccatgtta

SEQ ID NO: 271974 - DNA, 20 bp, Artificial Sequence
  chemically synthesized
ttctgatcacccataacatg

SEQ ID NO: 271975 - DNA, 20 bp, Artificial Sequence
  chemically synthesized
tctggccaactccatgttat

SEQ ID NO: 271976 - DNA, 20 bp, Artificial Sequence
  chemically synthesized
tattctgatcacccataaca

SEQ ID NO: 271977 - DNA, 20 bp, Artificial Sequence
  chemically synthesized
aactccatgttatgggtgat

SEQ ID NO: 271978 - DNA, 20 bp, Artificial Sequence
  chemically synthesized
atacacacaatgcttgtgtt

SEQ ID NO: 271979 - DNA, 20 bp, Artificial Sequence
  chemically synthesized
acacacaatgcttgtgttaa

SEQ ID NO: 271980 - DNA, 20 bp, Artificial Sequence
  chemically synthesized
tgatgattctctcttaacac

SEQ ID NO: 271981 - DNA, 20 bp, Artificial Sequence
  chemically synthesized
acacaatgcttgtgttaaga

SEQ ID NO: 271982 - DNA, 20 bp, Artificial Sequence
  chemically synthesized
ttgtgttaagagagaatcat

SEQ ID NO: 271983 - DNA, 20 bp, Artificial Sequence
  chemically synthesized
agaatcatcagaatctctct

SEQ ID NO: 271984 - DNA, 20 bp, Artificial Sequence
  chemically synthesized
tcaattctaattttctgaga

SEQ ID NO: 271985 - DNA, 20 bp, Artificial Sequence
  chemically synthesized
tgtcaattctaattttctga

SEQ ID NO: 271986 - DNA, 20 bp, Artificial Sequence
  chemically synthesized
cagaatctctctcagaaaat

SEQ ID NO: 271987 - DNA, 20 bp, Artificial Sequence
  chemically synthesized
tctgtcaattctaattttct

SEQ ID NO: 271988 - DNA, 20 bp, Artificial Sequence
  chemically synthesized
tctcagaaaattagaattga

SEQ ID NO: 271989 - DNA, 20 bp, Artificial Sequence
  chemically synthesized
cagaaaattagaattgacag

SEQ ID NO: 271990 - DNA, 20 bp, Artificial Sequence
  chemically synthesized
gaaaattagaattgacagaa

SEQ ID NO: 271991 - DNA, 20 bp, Artificial Sequence
  chemically synthesized
ttagaattgacagaagagtc

SEQ ID NO: 271992 - DNA, 20 bp, Artificial Sequence
  chemically synthesized
cgaagcactcacagtttgac

SEQ ID NO: 271993 - DNA, 20 bp, Artificial Sequence
  chemically synthesized
gaagagtctggtcaaactgt

SEQ ID NO: 271994 - DNA, 20 bp, Artificial Sequence
  chemically synthesized
gacacaattcgaagcactca

SEQ ID NO: 271995 - DNA, 20 bp, Artificial Sequence
  chemically synthesized
agtatatgtgacacaattcg

SEQ ID NO: 271996 - DNA, 20 bp, Artificial Sequence
  chemically synthesized
tcgaattgtgtcacatatac

SEQ ID NO: 271997 - DNA, 20 bp, Artificial Sequence
  chemically synthesized
acttcgtaagcacaatttgc

SEQ ID NO: 271998 - DNA, 20 bp, Artificial Sequence
  chemically synthesized
actagcaaattgtgcttacg

SEQ ID NO: 271999 - DNA, 20 bp, Artificial Sequence
  chemically synthesized
ctgcaaactagggacttcgt

SEQ ID NO: 272000 - DNA, 20 bp, Artificial Sequence
  chemically synthesized
aattgtgcttacgaagtccc

SEQ ID NO: 272001 - DNA, 20 bp, Artificial Sequence
  chemically synthesized
cttacgaagtccctagtttg

SEQ ID NO: 272002 - DNA, 20 bp, Artificial Sequence
  chemically synthesized
tcaatccactctgcaaacta

SEQ ID NO: 272003 - DNA, 20 bp, Artificial Sequence
  chemically synthesized
ctcaatccactctgcaaact

SEQ ID NO: 272004 - DNA, 20 bp, Artificial Sequence
  chemically synthesized
tacgaagtccctagtttgca

SEQ ID NO: 272005 - DNA, 20 bp, Artificial Sequence
  chemically synthesized
cctcaatccactctgcaaac

SEQ ID NO: 272006 - DNA, 20 bp, Artificial Sequence
  chemically synthesized
gaagtccctagtttgcagag

SEQ ID NO: 272007 - DNA, 20 bp, Artificial Sequence
  chemically synthesized
cctagtttgcagagtggatt

SEQ ID NO: 272008 - DNA, 20 bp, Artificial Sequence
  chemically synthesized
ctagtttgcagagtggattg

SEQ ID NO: 272009 - DNA, 20 bp, Artificial Sequence
  chemically synthesized
gtttgcagagtggattgagg

SEQ ID NO: 272010 - DNA, 20 bp, Artificial Sequence
  chemically synthesized
ttgcagagtggattgaggaa

SEQ ID NO: 272011 - DNA, 20 bp, Artificial Sequence
  chemically synthesized
gagtggattgaggaagagca

SEQ ID NO: 272012 - DNA, 20 bp, Artificial Sequence
  chemically synthesized
agtggattgaggaagagcaa

SEQ ID NO: 272013 - DNA, 20 bp, Artificial Sequence
  chemically synthesized
gaagagcaaaggtccatgaa

SEQ ID NO: 272014 - DNA, 20 bp, Artificial Sequence
  chemically synthesized
agagcaaaggtccatgaaca

SEQ ID NO: 272015 - DNA, 20 bp, Artificial Sequence
  chemically synthesized
ctttcttctctctctgttca

SEQ ID NO: 272016 - DNA, 20 bp, Artificial Sequence
  chemically synthesized
agcaaaggtccatgaacaga

SEQ ID NO: 272017 - DNA, 20 bp, Artificial Sequence
  chemically synthesized
caaaggtccatgaacagaga

SEQ ID NO: 272018 - DNA, 20 bp, Artificial Sequence
  chemically synthesized
aggtccatgaacagagagag

SEQ ID NO: 272019 - DNA, 20 bp, Artificial Sequence
  chemically synthesized
ccatgaacagagagagaaga

SEQ ID NO: 272020 - DNA, 20 bp, Artificial Sequence
  chemically synthesized
tgaacagagagagaagaaag

SEQ ID NO: 272021 - DNA, 20 bp, Artificial Sequence
  chemically synthesized
acagagagagaagaaagaag

SEQ ID NO: 272022 - DNA, 20 bp, Artificial Sequence
  chemically synthesized
agaagaaagaagtagatgca

SEQ ID NO: 272023 - DNA, 20 bp, Artificial Sequence
  chemically synthesized
gaagaaagaagtagatgcat

SEQ ID NO: 272024 - DNA, 20 bp, Artificial Sequence
  chemically synthesized
aagaaagaagtagatgcata

SEQ ID NO: 272025 - DNA, 20 bp, Artificial Sequence
  chemically synthesized
gaaagaagtagatgcatagg

SEQ ID NO: 272026 - DNA, 20 bp, Artificial Sequence
  chemically synthesized
gaagtagatgcatagggagt

SEQ ID NO: 272027 - DNA, 20 bp, Artificial Sequence
  chemically synthesized
aagtagatgcatagggagtg

SEQ ID NO: 272028 - DNA, 20 bp, Artificial Sequence
  chemically synthesized
tagatgcatagggagtgagg

SEQ ID NO: 272029 - DNA, 20 bp, Artificial Sequence
  chemically synthesized
ggtggtaacaaaaacactga

SEQ ID NO: 272030 - DNA, 20 bp, Artificial Sequence
  chemically synthesized
cataccgcattggaagccat

SEQ ID NO: 272031 - DNA, 20 bp, Artificial Sequence
  chemically synthesized
aacactgatggcttccaatg

SEQ ID NO: 272032 - DNA, 20 bp, Artificial Sequence
  chemically synthesized
ataaagccataccgcattgg

SEQ ID NO: 272033 - DNA, 20 bp, Artificial Sequence
  chemically synthesized
taaataaagccataccgcat

SEQ ID NO: 272034 - DNA, 20 bp, Artificial Sequence
  chemically synthesized
tgatggcttccaatgcggta

SEQ ID NO: 272035 - DNA, 20 bp, Artificial Sequence
  chemically synthesized
actaactaaataaataaata

SEQ ID NO: 272036 - DNA, 20 bp, Artificial Sequence
  chemically synthesized
tatggctttatttatttatt

SEQ ID NO: 272037 - DNA, 20 bp, Artificial Sequence
  chemically synthesized
gctttatttatttatttagt

SEQ ID NO: 272038 - DNA, 20 bp, Artificial Sequence
  chemically synthesized
tagttagttatttatgtttt

SEQ ID NO: 272039 - DNA, 20 bp, Artificial Sequence
  chemically synthesized
tagttatttatgttttgaga

SEQ ID NO: 272040 - DNA, 20 bp, Artificial Sequence
  chemically synthesized
tccagcctgggtgacagagc

SEQ ID NO: 272041 - DNA, 20 bp, Artificial Sequence
  chemically synthesized
tggaatctcgctctgtcacc

SEQ ID NO: 272042 - DNA, 20 bp, Artificial Sequence
  chemically synthesized
gcgttccagcctgggtgaca

SEQ ID NO: 272043 - DNA, 20 bp, Artificial Sequence
  chemically synthesized
ggaatctcgctctgtcaccc

SEQ ID NO: 272044 - DNA, 20 bp, Artificial Sequence
  chemically synthesized
ttgcgttccagcctgggtga

SEQ ID NO: 272045 - DNA, 20 bp, Artificial Sequence
  chemically synthesized
tctcgctctgtcacccaggc

SEQ ID NO: 272046 - DNA, 20 bp, Artificial Sequence
  chemically synthesized
gtgctattgcgttccagcct

SEQ ID NO: 272047 - DNA, 20 bp, Artificial Sequence
  chemically synthesized
cgtgctattgcgttccagcc

SEQ ID NO: 272048 - DNA, 20 bp, Artificial Sequence
  chemically synthesized
aagatcgtgctattgcgttc

SEQ ID NO: 272049 - DNA, 20 bp, Artificial Sequence
  chemically synthesized
tcacccaggctggaacgcaa

SEQ ID NO: 272050 - DNA, 20 bp, Artificial Sequence
  chemically synthesized
ggaacgcaatagcacgatct

SEQ ID NO: 272051 - DNA, 20 bp, Artificial Sequence
  chemically synthesized
ggcggaggttgcagtgagcc

SEQ ID NO: 272052 - DNA, 20 bp, Artificial Sequence
  chemically synthesized
tgggaggcggaggttgcagt

SEQ ID NO: 272053 - DNA, 20 bp, Artificial Sequence
  chemically synthesized
aacctgggaggcggaggttg

SEQ ID NO: 272054 - DNA, 20 bp, Artificial Sequence
  chemically synthesized
cgcttgaacctgggaggcgg

SEQ ID NO: 272055 - DNA, 20 bp, Artificial Sequence
  chemically synthesized
tcactgcaacctccgcctcc

SEQ ID NO: 272056 - DNA, 20 bp, Artificial Sequence
  chemically synthesized
tcgcttgaacctgggaggcg

SEQ ID NO: 272057 - DNA, 20 bp, Artificial Sequence
  chemically synthesized
cactgcaacctccgcctccc

SEQ ID NO: 272058 - DNA, 20 bp, Artificial Sequence
  chemically synthesized
aatcgcttgaacctgggagg

SEQ ID NO: 272059 - DNA, 20 bp, Artificial Sequence
  chemically synthesized
gagaatcgcttgaacctggg

SEQ ID NO: 272060 - DNA, 20 bp, Artificial Sequence
  chemically synthesized
ggagaatcgcttgaacctgg

SEQ ID NO: 272061 - DNA, 20 bp, Artificial Sequence
  chemically synthesized
aacctccgcctcccaggttc

SEQ ID NO: 272062 - DNA, 20 bp, Artificial Sequence
  chemically synthesized
caggagaatcgcttgaacct

SEQ ID NO: 272063 - DNA, 20 bp, Artificial Sequence
  chemically synthesized
gcaggagaatcgcttgaacc

SEQ ID NO: 272064 - DNA, 20 bp, Artificial Sequence
  chemically synthesized
ttcaagcgattctcctgcct

SEQ ID NO: 272065 - DNA, 20 bp, Artificial Sequence
  chemically synthesized
tacttggttggctgaggcag

SEQ ID NO: 272066 - DNA, 20 bp, Artificial Sequence
  chemically synthesized
gctacttggttggctgaggc

SEQ ID NO: 272067 - DNA, 20 bp, Artificial Sequence
  chemically synthesized
agctacttggttggctgagg

SEQ ID NO: 272068 - DNA, 20 bp, Artificial Sequence
  chemically synthesized
cgcagctacttggttggctg

SEQ ID NO: 272069 - DNA, 20 bp, Artificial Sequence
  chemically synthesized
tcgcagctacttggttggct

SEQ ID NO: 272070 - DNA, 20 bp, Artificial Sequence
  chemically synthesized
ttctcctgcctcagccaacc

SEQ ID NO: 272071 - DNA, 20 bp, Artificial Sequence
  chemically synthesized
tcctgcctcagccaaccaag

SEQ ID NO: 272072 - DNA, 20 bp, Artificial Sequence
  chemically synthesized
tgtaatcgcagctacttggt

SEQ ID NO: 272073 - DNA, 20 bp, Artificial Sequence
  chemically synthesized
cacctgtaatcgcagctact

SEQ ID NO: 272074 - DNA, 20 bp, Artificial Sequence
  chemically synthesized
caaccaagtagctgcgatta

SEQ ID NO: 272075 - DNA, 20 bp, Artificial Sequence
  chemically synthesized
aaccaagtagctgcgattac

SEQ ID NO: 272076 - DNA, 20 bp, Artificial Sequence
  chemically synthesized
gtggtgggcacctgtaatcg

SEQ ID NO: 272077 - DNA, 20 bp, Artificial Sequence
  chemically synthesized
aattagctgagcatggtggt

SEQ ID NO: 272078 - DNA, 20 bp, Artificial Sequence
  chemically synthesized
aaattagctgagcatggtgg

SEQ ID NO: 272079 - DNA, 20 bp, Artificial Sequence
  chemically synthesized
caggtgcccaccaccatgct

SEQ ID NO: 272080 - DNA, 20 bp, Artificial Sequence
  chemically synthesized
taaaaattagctgagcatgg

SEQ ID NO: 272081 - DNA, 20 bp, Artificial Sequence
  chemically synthesized
atataaaaattagctgagca

SEQ ID NO: 272082 - DNA, 20 bp, Artificial Sequence
  chemically synthesized
aaaaaatataaaaattagct

SEQ ID NO: 272083 - DNA, 20 bp, Artificial Sequence
  chemically synthesized
ctactaaaaaatataaaaat

SEQ ID NO: 272084 - DNA, 20 bp, Artificial Sequence
  chemically synthesized
cagctaatttttatattttt

SEQ ID NO: 272085 - DNA, 20 bp, Artificial Sequence
  chemically synthesized
ctaatttttatattttttag

SEQ ID NO: 272086 - DNA, 20 bp, Artificial Sequence
  chemically synthesized
tttatattttttagtagcga

SEQ ID NO: 272087 - DNA, 20 bp, Artificial Sequence
  chemically synthesized
ttatattttttagtagcgac

SEQ ID NO: 272088 - DNA, 20 bp, Artificial Sequence
  chemically synthesized
tatattttttagtagcgaca

SEQ ID NO: 272089 - DNA, 20 bp, Artificial Sequence
  chemically synthesized
gcgacagggttttaccatgt

SEQ ID NO: 272090 - DNA, 20 bp, Artificial Sequence
  chemically synthesized
cagggttttaccatgttggt

SEQ ID NO: 272091 - DNA, 20 bp, Artificial Sequence
  chemically synthesized
cgagaccatcctgaccaaca

SEQ ID NO: 272092 - DNA, 20 bp, Artificial Sequence
  chemically synthesized
agggttttaccatgttggtc

SEQ ID NO: 272093 - DNA, 20 bp, Artificial Sequence
  chemically synthesized
ttttaccatgttggtcagga

SEQ ID NO: 272094 - DNA, 20 bp, Artificial Sequence
  chemically synthesized
tcacctgaggtcaggcattc

SEQ ID NO: 272095 - DNA, 20 bp, Artificial Sequence
  chemically synthesized
tggtctcgaatgcctgacct

SEQ ID NO: 272096 - DNA, 20 bp, Artificial Sequence
  chemically synthesized
ggtctcgaatgcctgacctc

SEQ ID NO: 272097 - DNA, 20 bp, Artificial Sequence
  chemically synthesized
caggtggatcacctgaggtc

SEQ ID NO: 272098 - DNA, 20 bp, Artificial Sequence
  chemically synthesized
gcaggtggatcacctgaggt

SEQ ID NO: 272099 - DNA, 20 bp, Artificial Sequence
  chemically synthesized
cgaggcaggtggatcacctg

SEQ ID NO: 272100 - DNA, 20 bp, Artificial Sequence
  chemically synthesized
ccgaggcaggtggatcacct

SEQ ID NO: 272101 - DNA, 20 bp, Artificial Sequence
  chemically synthesized
ctcaggtgatccacctgcct

SEQ ID NO: 272102 - DNA, 20 bp, Artificial Sequence
  chemically synthesized
ctttgggaagccgaggcagg

SEQ ID NO: 272103 - DNA, 20 bp, Artificial Sequence
  chemically synthesized
gcactttgggaagccgaggc

SEQ ID NO: 272104 - DNA, 20 bp, Artificial Sequence
  chemically synthesized
agcactttgggaagccgagg

SEQ ID NO: 272105 - DNA, 20 bp, Artificial Sequence
  chemically synthesized
cccagcactttgggaagccg

SEQ ID NO: 272106 - DNA, 20 bp, Artificial Sequence
  chemically synthesized
tcccagcactttgggaagcc

SEQ ID NO: 272107 - DNA, 20 bp, Artificial Sequence
  chemically synthesized
ccacctgcctcggcttccca

SEQ ID NO: 272108 - DNA, 20 bp, Artificial Sequence
  chemically synthesized
tgtaatcccagcactttggg

SEQ ID NO: 272109 - DNA, 20 bp, Artificial Sequence
  chemically synthesized
gcctcggcttcccaaagtgc

SEQ ID NO: 272110 - DNA, 20 bp, Artificial Sequence
  chemically synthesized
acctgtaatcccagcacttt

SEQ ID NO: 272111 - DNA, 20 bp, Artificial Sequence
  chemically synthesized
cctcggcttcccaaagtgct

SEQ ID NO: 272112 - DNA, 20 bp, Artificial Sequence
  chemically synthesized
cacctgtaatcccagcactt

SEQ ID NO: 272113 - DNA, 20 bp, Artificial Sequence
  chemically synthesized
ttcccaaagtgctgggatta

SEQ ID NO: 272114 - DNA, 20 bp, Artificial Sequence
  chemically synthesized
tcccaaagtgctgggattac

SEQ ID NO: 272115 - DNA, 20 bp, Artificial Sequence
  chemically synthesized
gtggctcacacctgtaatcc

SEQ ID NO: 272116 - DNA, 20 bp, Artificial Sequence
  chemically synthesized
agtgctgggattacaggtgt

SEQ ID NO: 272117 - DNA, 20 bp, Artificial Sequence
  chemically synthesized
caggtgtgagccaccgtgcc

SEQ ID NO: 272118 - DNA, 20 bp, Artificial Sequence
  chemically synthesized
tatctacgggctgggcacgg

SEQ ID NO: 272119 - DNA, 20 bp, Artificial Sequence
  chemically synthesized
tgctatctacgggctgggca

SEQ ID NO: 272120 - DNA, 20 bp, Artificial Sequence
  chemically synthesized
gagccaccgtgcccagcccg

SEQ ID NO: 272121 - DNA, 20 bp, Artificial Sequence
  chemically synthesized
gaaaatgctatctacgggct

SEQ ID NO: 272122 - DNA, 20 bp, Artificial Sequence
  chemically synthesized
cgaaaatgctatctacgggc

SEQ ID NO: 272123 - DNA, 20 bp, Artificial Sequence
  chemically synthesized
caccgtgcccagcccgtaga

SEQ ID NO: 272124 - DNA, 20 bp, Artificial Sequence
  chemically synthesized
ctttcgaaaatgctatctac

SEQ ID NO: 272125 - DNA, 20 bp, Artificial Sequence
  chemically synthesized
tctttcgaaaatgctatcta

SEQ ID NO: 272126 - DNA, 20 bp, Artificial Sequence
  chemically synthesized
cccgtagatagcattttcga

SEQ ID NO: 272127 - DNA, 20 bp, Artificial Sequence
  chemically synthesized
cgtagatagcattttcgaaa

SEQ ID NO: 272128 - DNA, 20 bp, Artificial Sequence
  chemically synthesized
gtagatagcattttcgaaag

SEQ ID NO: 272129 - DNA, 20 bp, Artificial Sequence
  chemically synthesized
tagatagcattttcgaaaga

SEQ ID NO: 272130 - DNA, 20 bp, Artificial Sequence
  chemically synthesized
tcgaaagagggctgcaataa

SEQ ID NO: 272131 - DNA, 20 bp, Artificial Sequence
  chemically synthesized
tgctgtgggagctattattg

SEQ ID NO: 272132 - DNA, 20 bp, Artificial Sequence
  chemically synthesized
ggctgcaataatagctccca

SEQ ID NO: 272133 - DNA, 20 bp, Artificial Sequence
  chemically synthesized
aagaggagcatgtgctgtgg

SEQ ID NO: 272134 - DNA, 20 bp, Artificial Sequence
  chemically synthesized
gtaagaggagcatgtgctgt

SEQ ID NO: 272135 - DNA, 20 bp, Artificial Sequence
  chemically synthesized
ggtaagaggagcatgtgctg

SEQ ID NO: 272136 - DNA, 20 bp, Artificial Sequence
  chemically synthesized
tgttgagggagtggtaagag

SEQ ID NO: 272137 - DNA, 20 bp, Artificial Sequence
  chemically synthesized
cttgttgagggagtggtaag

SEQ ID NO: 272138 - DNA, 20 bp, Artificial Sequence
  chemically synthesized
tcttgttgagggagtggtaa

SEQ ID NO: 272139 - DNA, 20 bp, Artificial Sequence
  chemically synthesized
cctcttgttgagggagtggt

SEQ ID NO: 272140 - DNA, 20 bp, Artificial Sequence
  chemically synthesized
ttcacctcttgttgagggag

SEQ ID NO: 272141 - DNA, 20 bp, Artificial Sequence
  chemically synthesized
cctcttaccactccctcaac

SEQ ID NO: 272142 - DNA, 20 bp, Artificial Sequence
  chemically synthesized
aacttcacctcttgttgagg

SEQ ID NO: 272143 - DNA, 20 bp, Artificial Sequence
  chemically synthesized
tcttaccactccctcaacaa

SEQ ID NO: 272144 - DNA, 20 bp, Artificial Sequence
  chemically synthesized
taaacttcacctcttgttga

SEQ ID NO: 272145 - DNA, 20 bp, Artificial Sequence
  chemically synthesized
cttaccactccctcaacaag

SEQ ID NO: 272146 - DNA, 20 bp, Artificial Sequence
  chemically synthesized
ataaacttcacctcttgttg

SEQ ID NO: 272147 - DNA, 20 bp, Artificial Sequence
  chemically synthesized
aataaacttcacctcttgtt

SEQ ID NO: 272148 - DNA, 20 bp, Artificial Sequence
  chemically synthesized
cactccctcaacaagaggtg

SEQ ID NO: 272149 - DNA, 20 bp, Artificial Sequence
  chemically synthesized
agaggtgaagtttatttctt

SEQ ID NO: 272150 - DNA, 20 bp, Artificial Sequence
  chemically synthesized
aacccagatttaaagagctg

SEQ ID NO: 272151 - DNA, 20 bp, Artificial Sequence
  chemically synthesized
agagtcaacccagatttaaa

SEQ ID NO: 272152 - DNA, 20 bp, Artificial Sequence
  chemically synthesized
tttcttcagctctttaaatc

SEQ ID NO: 272153 - DNA, 20 bp, Artificial Sequence
  chemically synthesized
ttcttcagctctttaaatct

SEQ ID NO: 272154 - DNA, 20 bp, Artificial Sequence
  chemically synthesized
aaagagtcaacccagattta

SEQ ID NO: 272155 - DNA, 20 bp, Artificial Sequence
  chemically synthesized
aagcagtcaaagagtcaacc

SEQ ID NO: 272156 - DNA, 20 bp, Artificial Sequence
  chemically synthesized
tattggtcaaagcagtcaaa

SEQ ID NO: 272157 - DNA, 20 bp, Artificial Sequence
  chemically synthesized
tctattggtcaaagcagtca

SEQ ID NO: 272158 - DNA, 20 bp, Artificial Sequence
  chemically synthesized
ctatattctattggtcaaag

SEQ ID NO: 272159 - DNA, 20 bp, Artificial Sequence
  chemically synthesized
tctttgactgctttgaccaa

SEQ ID NO: 272160 - DNA, 20 bp, Artificial Sequence
  chemically synthesized
ggactatattctattggtca

SEQ ID NO: 272161 - DNA, 20 bp, Artificial Sequence
  chemically synthesized
gcacttggactatattctat

SEQ ID NO: 272162 - DNA, 20 bp, Artificial Sequence
  chemically synthesized
ctgctttgaccaatagaata

SEQ ID NO: 272163 - DNA, 20 bp, Artificial Sequence
  chemically synthesized
tgaccaatagaatatagtcc

SEQ ID NO: 272164 - DNA, 20 bp, Artificial Sequence
  chemically synthesized
atagaatatagtccaagtgc

SEQ ID NO: 272165 - DNA, 20 bp, Artificial Sequence
  chemically synthesized
cttttgccataactggcact

SEQ ID NO: 272166 - DNA, 20 bp, Artificial Sequence
  chemically synthesized
tatagtccaagtgccagtta

SEQ ID NO: 272167 - DNA, 20 bp, Artificial Sequence
  chemically synthesized
ttaaggacttttgccataac

SEQ ID NO: 272168 - DNA, 20 bp, Artificial Sequence
  chemically synthesized
ccaagtgccagttatggcaa

SEQ ID NO: 272169 - DNA, 20 bp, Artificial Sequence
  chemically synthesized
cagttatggcaaaagtcctt

SEQ ID NO: 272170 - DNA, 20 bp, Artificial Sequence
  chemically synthesized
ttatggcaaaagtccttaag

SEQ ID NO: 272171 - DNA, 20 bp, Artificial Sequence
  chemically synthesized
ggaagctgccaggccactta

SEQ ID NO: 272172 - DNA, 20 bp, Artificial Sequence
  chemically synthesized
tggaagctgccaggccactt

SEQ ID NO: 272173 - DNA, 20 bp, Artificial Sequence
  chemically synthesized
gcaaaagtccttaagtggcc

SEQ ID NO: 272174 - DNA, 20 bp, Artificial Sequence
  chemically synthesized
aaagtccttaagtggcctgg

SEQ ID NO: 272175 - DNA, 20 bp, Artificial Sequence
  chemically synthesized
agatagacgtggaagctgcc

SEQ ID NO: 272176 - DNA, 20 bp, Artificial Sequence
  chemically synthesized
aagatagacgtggaagctgc

SEQ ID NO: 272177 - DNA, 20 bp, Artificial Sequence
  chemically synthesized
ttctaaaaagatagacgtgg

SEQ ID NO: 272178 - DNA, 20 bp, Artificial Sequence
  chemically synthesized
ctgttctaaaaagatagacg

SEQ ID NO: 272179 - DNA, 20 bp, Artificial Sequence
  chemically synthesized
agcttccacgtctatctttt

SEQ ID NO: 272180 - DNA, 20 bp, Artificial Sequence
  chemically synthesized
gaatgactgttctaaaaaga

SEQ ID NO: 272181 - DNA, 20 bp, Artificial Sequence
  chemically synthesized
ccacgtctatctttttagaa

SEQ ID NO: 272182 - DNA, 20 bp, Artificial Sequence
  chemically synthesized
ctaagaatgactgttctaaa

SEQ ID NO: 272183 - DNA, 20 bp, Artificial Sequence
  chemically synthesized
ctttttagaacagtcattct

SEQ ID NO: 272184 - DNA, 20 bp, Artificial Sequence
  chemically synthesized
tttttagaacagtcattctt

SEQ ID NO: 272185 - DNA, 20 bp, Artificial Sequence
  chemically synthesized
ttttagaacagtcattctta

SEQ ID NO: 272186 - DNA, 20 bp, Artificial Sequence
  chemically synthesized
attctaaaagggagcaccct

SEQ ID NO: 272187 - DNA, 20 bp, Artificial Sequence
  chemically synthesized
attcttagggtgctcccttt

SEQ ID NO: 272188 - DNA, 20 bp, Artificial Sequence
  chemically synthesized
gttggatggattctaaaagg

SEQ ID NO: 272189 - DNA, 20 bp, Artificial Sequence
  chemically synthesized
atgttggatggattctaaaa

SEQ ID NO: 272190 - DNA, 20 bp, Artificial Sequence
  chemically synthesized
tatgttggatggattctaaa

SEQ ID NO: 272191 - DNA, 20 bp, Artificial Sequence
  chemically synthesized
atatgttggatggattctaa

SEQ ID NO: 272192 - DNA, 20 bp, Artificial Sequence
  chemically synthesized
tcagagcataatatgttgga

SEQ ID NO: 272193 - DNA, 20 bp, Artificial Sequence
  chemically synthesized
tttctcagagcataatatgt

SEQ ID NO: 272194 - DNA, 20 bp, Artificial Sequence
  chemically synthesized
catccaacatattatgctct

SEQ ID NO: 272195 - DNA, 20 bp, Artificial Sequence
  chemically synthesized
caacatattatgctctgaga

SEQ ID NO: 272196 - DNA, 20 bp, Artificial Sequence
  chemically synthesized
gatgttacttagctttctca

SEQ ID NO: 272197 - DNA, 20 bp, Artificial Sequence
  chemically synthesized
tcgatgttacttagctttct

SEQ ID NO: 272198 - DNA, 20 bp, Artificial Sequence
  chemically synthesized
tattatgctctgagaaagct

SEQ ID NO: 272199 - DNA, 20 bp, Artificial Sequence
  chemically synthesized
catggcctttcgatgttact

SEQ ID NO: 272200 - DNA, 20 bp, Artificial Sequence
  chemically synthesized
agaaagctaagtaacatcga

SEQ ID NO: 272201 - DNA, 20 bp, Artificial Sequence
  chemically synthesized
gaaagctaagtaacatcgaa

SEQ ID NO: 272202 - DNA, 20 bp, Artificial Sequence
  chemically synthesized
taagtaacatcgaaaggcca

SEQ ID NO: 272203 - DNA, 20 bp, Artificial Sequence
  chemically synthesized
aacatcgaaaggccatggat

SEQ ID NO: 272204 - DNA, 20 bp, Artificial Sequence
  chemically synthesized
gttgctgaagcacttatcca

SEQ ID NO: 272205 - DNA, 20 bp, Artificial Sequence
  chemically synthesized
aaggccatggataagtgctt

SEQ ID NO: 272206 - DNA, 20 bp, Artificial Sequence
  chemically synthesized
ccttgttgtgattgttgctg

SEQ ID NO: 272207 - DNA, 20 bp, Artificial Sequence
  chemically synthesized
gcttcagcaacaatcacaac

SEQ ID NO: 272208 - DNA, 20 bp, Artificial Sequence
  chemically synthesized
cttcagcaacaatcacaaca

SEQ ID NO: 272209 - DNA, 20 bp, Artificial Sequence
  chemically synthesized
aacaatcacaacaaggcttt

SEQ ID NO: 272210 - DNA, 20 bp, Artificial Sequence
  chemically synthesized
gcctagcagttgttggctga

SEQ ID NO: 272211 - DNA, 20 bp, Artificial Sequence
  chemically synthesized
ttcacatgcctagcagttgt

SEQ ID NO: 272212 - DNA, 20 bp, Artificial Sequence
  chemically synthesized
ggctttcagccaacaactgc

SEQ ID NO: 272213 - DNA, 20 bp, Artificial Sequence
  chemically synthesized
gctttcagccaacaactgct

SEQ ID NO: 272214 - DNA, 20 bp, Artificial Sequence
  chemically synthesized
tcactcattcacatgcctag

SEQ ID NO: 272215 - DNA, 20 bp, Artificial Sequence
  chemically synthesized
agatcactcattcacatgcc

SEQ ID NO: 272216 - DNA, 20 bp, Artificial Sequence
  chemically synthesized
caactgctaggcatgtgaat

SEQ ID NO: 272217 - DNA, 20 bp, Artificial Sequence
  chemically synthesized
ggcatgtgaatgagtgatct

SEQ ID NO: 272218 - DNA, 20 bp, Artificial Sequence
  chemically synthesized
aatgagtgatcttggacgtt

SEQ ID NO: 272219 - DNA, 20 bp, Artificial Sequence
  chemically synthesized
ctcaactgggctgaacgtcc

SEQ ID NO: 272220 - DNA, 20 bp, Artificial Sequence
  chemically synthesized
gtgatcttggacgttcagcc

SEQ ID NO: 272221 - DNA, 20 bp, Artificial Sequence
  chemically synthesized
cttggacgttcagcccagtt

SEQ ID NO: 272222 - DNA, 20 bp, Artificial Sequence
  chemically synthesized
agtaacctgaatgctcaact

SEQ ID NO: 272223 - DNA, 20 bp, Artificial Sequence
  chemically synthesized
tagtaacctgaatgctcaac

SEQ ID NO: 272224 - DNA, 20 bp, Artificial Sequence
  chemically synthesized
gttcagcccagttgagcatt

SEQ ID NO: 272225 - DNA, 20 bp, Artificial Sequence
  chemically synthesized
ttcagcccagttgagcattc

SEQ ID NO: 272226 - DNA, 20 bp, Artificial Sequence
  chemically synthesized
gttgagcattcaggttacta

SEQ ID NO: 272227 - DNA, 20 bp, Artificial Sequence
  chemically synthesized
cattcaggttactatagtat

SEQ ID NO: 272228 - DNA, 20 bp, Artificial Sequence
  chemically synthesized
tccattgttgtctgatacta

SEQ ID NO: 272229 - DNA, 20 bp, Artificial Sequence
  chemically synthesized
actatagtatcagacaacaa

SEQ ID NO: 272230 - DNA, 20 bp, Artificial Sequence
  chemically synthesized
tgtggtttcttatgtgattt

SEQ ID NO: 272231 - DNA, 20 bp, Artificial Sequence
  chemically synthesized
acaatggactaaaatcacat

SEQ ID NO: 272232 - DNA, 20 bp, Artificial Sequence
  chemically synthesized
aatcacataagaaaccacaa

SEQ ID NO: 272233 - DNA, 20 bp, Artificial Sequence
  chemically synthesized
tcacataagaaaccacaaaa

SEQ ID NO: 272234 - DNA, 20 bp, Artificial Sequence
  chemically synthesized
acctggatggttctcttttg

SEQ ID NO: 272235 - DNA, 20 bp, Artificial Sequence
  chemically synthesized
aaccacaaaagagaaccatc

SEQ ID NO: 272236 - DNA, 20 bp, Artificial Sequence
  chemically synthesized
accacaaaagagaaccatcc

SEQ ID NO: 272237 - DNA, 20 bp, Artificial Sequence
  chemically synthesized
caaaagagaaccatccaggt

SEQ ID NO: 272238 - DNA, 20 bp, Artificial Sequence
  chemically synthesized
gttgagaaagctcacctgga

SEQ ID NO: 272239 - DNA, 20 bp, Artificial Sequence
  chemically synthesized
gcgtgttgagaaagctcacc

SEQ ID NO: 272240 - DNA, 20 bp, Artificial Sequence
  chemically synthesized
aatggttttgcgtgttgaga

SEQ ID NO: 272241 - DNA, 20 bp, Artificial Sequence
  chemically synthesized
cactaatggttttgcgtgtt

SEQ ID NO: 272242 - DNA, 20 bp, Artificial Sequence
  chemically synthesized
ttctcaacacgcaaaaccat

SEQ ID NO: 272243 - DNA, 20 bp, Artificial Sequence
  chemically synthesized
tcaacacgcaaaaccattag

SEQ ID NO: 272244 - DNA, 20 bp, Artificial Sequence
  chemically synthesized
caacacgcaaaaccattagt

SEQ ID NO: 272245 - DNA, 20 bp, Artificial Sequence
  chemically synthesized
ccatttattattcccactaa

SEQ ID NO: 272246 - DNA, 20 bp, Artificial Sequence
  chemically synthesized
ccattagtgggaataataaa

SEQ ID NO: 272247 - DNA, 20 bp, Artificial Sequence
  chemically synthesized
tgtgttttggttatttatga

SEQ ID NO: 272248 - DNA, 20 bp, Artificial Sequence
  chemically synthesized
tatcataaataaccaaaaca

SEQ ID NO: 272249 - DNA, 20 bp, Artificial Sequence
  chemically synthesized
atcataaataaccaaaacac

SEQ ID NO: 272250 - DNA, 20 bp, Artificial Sequence
  chemically synthesized
agggactaatgcctgtgttt

SEQ ID NO: 272251 - DNA, 20 bp, Artificial Sequence
  chemically synthesized
aataaccaaaacacaggcat

SEQ ID NO: 272252 - DNA, 20 bp, Artificial Sequence
  chemically synthesized
acaggcattagtcccttctt

SEQ ID NO: 272253 - DNA, 20 bp, Artificial Sequence
  chemically synthesized
ataaagttttgactcaagaa

SEQ ID NO: 272254 - DNA, 20 bp, Artificial Sequence
  chemically synthesized
aataaagttttgactcaaga

SEQ ID NO: 272255 - DNA, 20 bp, Artificial Sequence
  chemically synthesized
taataaagttttgactcaag

SEQ ID NO: 272256 - DNA, 20 bp, Artificial Sequence
  chemically synthesized
cagtaataaagttttgactc

SEQ ID NO: 272257 - DNA, 20 bp, Artificial Sequence
  chemically synthesized
agaatccaagggcagtaata

SEQ ID NO: 272258 - DNA, 20 bp, Artificial Sequence
  chemically synthesized
caaaactttattactgccct

SEQ ID NO: 272259 - DNA, 20 bp, Artificial Sequence
  chemically synthesized
tgtgtcatagaatccaaggg

SEQ ID NO: 272260 - DNA, 20 bp, Artificial Sequence
  chemically synthesized
gaatgtgtcatagaatccaa

SEQ ID NO: 272261 - DNA, 20 bp, Artificial Sequence
  chemically synthesized
ggaatgtgtcatagaatcca

SEQ ID NO: 272262 - DNA, 20 bp, Artificial Sequence
  chemically synthesized
aggaatgtgtcatagaatcc

SEQ ID NO: 272263 - DNA, 20 bp, Artificial Sequence
  chemically synthesized
atggaaacaggaatgtgtca

SEQ ID NO: 272264 - DNA, 20 bp, Artificial Sequence
  chemically synthesized
aaggtttttcatatggaaac

SEQ ID NO: 272265 - DNA, 20 bp, Artificial Sequence
  chemically synthesized
aaaggtttttcatatggaaa

SEQ ID NO: 272266 - DNA, 20 bp, Artificial Sequence
  chemically synthesized
agagagaaaggtttttcata

SEQ ID NO: 272267 - DNA, 20 bp, Artificial Sequence
  chemically synthesized
gcaaaacaaatgagagagaa

SEQ ID NO: 272268 - DNA, 20 bp, Artificial Sequence
  chemically synthesized
agcaaaacaaatgagagaga

SEQ ID NO: 272269 - DNA, 20 bp, Artificial Sequence
  chemically synthesized
ctaaagcaaaacaaatgaga

SEQ ID NO: 272270 - DNA, 20 bp, Artificial Sequence
  chemically synthesized
aactaaagcaaaacaaatga

SEQ ID NO: 272271 - DNA, 20 bp, Artificial Sequence
  chemically synthesized
gtaactaaagcaaaacaaat

SEQ ID NO: 272272 - DNA, 20 bp, Artificial Sequence
  chemically synthesized
ctctctcatttgttttgctt

SEQ ID NO: 272273 - DNA, 20 bp, Artificial Sequence
  chemically synthesized
taacaaaattgaagtaacta

SEQ ID NO: 272274 - DNA, 20 bp, Artificial Sequence
  chemically synthesized
atttagaagtaacaaaattg

SEQ ID NO: 272275 - DNA, 20 bp, Artificial Sequence
  chemically synthesized
caattttgttacttctaaat

SEQ ID NO: 272276 - DNA, 20 bp, Artificial Sequence
  chemically synthesized
tatttaggactctcatttag

SEQ ID NO: 272277 - DNA, 20 bp, Artificial Sequence
  chemically synthesized
attttgttacttctaaatga

SEQ ID NO: 272278 - DNA, 20 bp, Artificial Sequence
  chemically synthesized
cagtatttaggactctcatt

SEQ ID NO: 272279 - DNA, 20 bp, Artificial Sequence
  chemically synthesized
agtatgcatatacagtattt

SEQ ID NO: 272280 - DNA, 20 bp, Artificial Sequence
  chemically synthesized
cagtatgcatatacagtatt

SEQ ID NO: 272281 - DNA, 20 bp, Artificial Sequence
  chemically synthesized
gcgtatccagtatgcatata

SEQ ID NO: 272282 - DNA, 20 bp, Artificial Sequence
  chemically synthesized
taaatactgtatatgcatac

SEQ ID NO: 272283 - DNA, 20 bp, Artificial Sequence
  chemically synthesized
tatatgcatactggatacgc

SEQ ID NO: 272284 - DNA, 20 bp, Artificial Sequence
  chemically synthesized
ctcctatatccttgcgtatc

SEQ ID NO: 272285 - DNA, 20 bp, Artificial Sequence
  chemically synthesized
atatgcatactggatacgca

SEQ ID NO: 272286 - DNA, 20 bp, Artificial Sequence
  chemically synthesized
atactggatacgcaaggata

SEQ ID NO: 272287 - DNA, 20 bp, Artificial Sequence
  chemically synthesized
tactggatacgcaaggatat

SEQ ID NO: 272288 - DNA, 20 bp, Artificial Sequence
  chemically synthesized
ctggatacgcaaggatatag

SEQ ID NO: 272289 - DNA, 20 bp, Artificial Sequence
  chemically synthesized
tataggagttgtaaaaacaa

SEQ ID NO: 272290 - DNA, 20 bp, Artificial Sequence
  chemically synthesized
tgtaaaaacaaaagcatttc

SEQ ID NO: 272291 - DNA, 20 bp, Artificial Sequence
  chemically synthesized
aacaaaagcatttctggttg

SEQ ID NO: 272292 - DNA, 20 bp, Artificial Sequence
  chemically synthesized
caaaagcatttctggttgaa

SEQ ID NO: 272293 - DNA, 20 bp, Artificial Sequence
  chemically synthesized
acaccttgtctctcttcaac

SEQ ID NO: 272294 - DNA, 20 bp, Artificial Sequence
  chemically synthesized
aaagcatttctggttgaaga

SEQ ID NO: 272295 - DNA, 20 bp, Artificial Sequence
  chemically synthesized
atttctggttgaagagagac

SEQ ID NO: 272296 - DNA, 20 bp, Artificial Sequence
  chemically synthesized
tttctggttgaagagagaca

SEQ ID NO: 272297 - DNA, 20 bp, Artificial Sequence
  chemically synthesized
ggttgaagagagacaaggtg

SEQ ID NO: 272298 - DNA, 20 bp, Artificial Sequence
  chemically synthesized
ttgaagagagacaaggtgtg

SEQ ID NO: 272299 - DNA, 20 bp, Artificial Sequence
  chemically synthesized
agagagacaaggtgtggaga

SEQ ID NO: 272300 - DNA, 20 bp, Artificial Sequence
  chemically synthesized
gagagacaaggtgtggagac

SEQ ID NO: 272301 - DNA, 20 bp, Artificial Sequence
  chemically synthesized
agagacaaggtgtggagaca

SEQ ID NO: 272302 - DNA, 20 bp, Artificial Sequence
  chemically synthesized
ggtgtggagacagggcactg

SEQ ID NO: 272303 - DNA, 20 bp, Artificial Sequence
  chemically synthesized
tgtggagacagggcactgaa

SEQ ID NO: 272304 - DNA, 20 bp, Artificial Sequence
  chemically synthesized
gccaaactccttatgctctt

SEQ ID NO: 272305 - DNA, 20 bp, Artificial Sequence
  chemically synthesized
gacagggcactgaagagcat

SEQ ID NO: 272306 - DNA, 20 bp, Artificial Sequence
  chemically synthesized
acagggcactgaagagcata

SEQ ID NO: 272307 - DNA, 20 bp, Artificial Sequence
  chemically synthesized
agggcactgaagagcataag

SEQ ID NO: 272308 - DNA, 20 bp, Artificial Sequence
  chemically synthesized
actgaagagcataaggagtt

SEQ ID NO: 272309 - DNA, 20 bp, Artificial Sequence
  chemically synthesized
ggagtttggcaaaatttaac

SEQ ID NO: 272310 - DNA, 20 bp, Artificial Sequence
  chemically synthesized
gcaaaatttaacaagaaatg

SEQ ID NO: 272311 - DNA, 20 bp, Artificial Sequence
  chemically synthesized
caaaatttaacaagaaatgt

SEQ ID NO: 272312 - DNA, 20 bp, Artificial Sequence
  chemically synthesized
aatttaacaagaaatgtagg

SEQ ID NO: 272313 - DNA, 20 bp, Artificial Sequence
  chemically synthesized
caagaaatgtaggtagaaat

SEQ ID NO: 272314 - DNA, 20 bp, Artificial Sequence
  chemically synthesized
aagaaatgtaggtagaaatc

SEQ ID NO: 272315 - DNA, 20 bp, Artificial Sequence
  chemically synthesized
aaccattcatttgggacata

SEQ ID NO: 272316 - DNA, 20 bp, Artificial Sequence
  chemically synthesized
aactttatgtcccaaatgaa

SEQ ID NO: 272317 - DNA, 20 bp, Artificial Sequence
  chemically synthesized
atagtggtaaccattcattt

SEQ ID NO: 272318 - DNA, 20 bp, Artificial Sequence
  chemically synthesized
aatagtggtaaccattcatt

SEQ ID NO: 272319 - DNA, 20 bp, Artificial Sequence
  chemically synthesized
tatcttcgtgatcaaaatag

SEQ ID NO: 272320 - DNA, 20 bp, Artificial Sequence
  chemically synthesized
atttatcttcgtgatcaaaa

SEQ ID NO: 272321 - DNA, 20 bp, Artificial Sequence
  chemically synthesized
ttaccactattttgatcacg

SEQ ID NO: 272322 - DNA, 20 bp, Artificial Sequence
  chemically synthesized
tttgaaattgatcataatca

SEQ ID NO: 272323 - DNA, 20 bp, Artificial Sequence
  chemically synthesized
ttgatcataatcacagataa

SEQ ID NO: 272324 - DNA, 20 bp, Artificial Sequence
  chemically synthesized
atcataatcacagataacag

SEQ ID NO: 272325 - DNA, 20 bp, Artificial Sequence
  chemically synthesized
ttagttatcggatcaaatat

SEQ ID NO: 272326 - DNA, 20 bp, Artificial Sequence
  chemically synthesized
taatatttgatccgataact

SEQ ID NO: 272327 - DNA, 20 bp, Artificial Sequence
  chemically synthesized
aatatttgatccgataacta

SEQ ID NO: 272328 - DNA, 20 bp, Artificial Sequence
  chemically synthesized
ctatgaatttccttagttat

SEQ ID NO: 272329 - DNA, 20 bp, Artificial Sequence
  chemically synthesized
ttcctccctatgaatttcct

SEQ ID NO: 272330 - DNA, 20 bp, Artificial Sequence
  chemically synthesized
ccgataactaaggaaattca

SEQ ID NO: 272331 - DNA, 20 bp, Artificial Sequence
  chemically synthesized
cgataactaaggaaattcat

SEQ ID NO: 272332 - DNA, 20 bp, Artificial Sequence
  chemically synthesized
gataactaaggaaattcata

SEQ ID NO: 272333 - DNA, 20 bp, Artificial Sequence
  chemically synthesized
taactaaggaaattcatagg

SEQ ID NO: 272334 - DNA, 20 bp, Artificial Sequence
  chemically synthesized
aactaaggaaattcataggg

SEQ ID NO: 272335 - DNA, 20 bp, Artificial Sequence
  chemically synthesized
gaggaaatgcgactgtaaat

SEQ ID NO: 272336 - DNA, 20 bp, Artificial Sequence
  chemically synthesized
ttcaacatactgctgattta

SEQ ID NO: 272337 - DNA, 20 bp, Artificial Sequence
  chemically synthesized
gaaatgcgactgtaaatcag

SEQ ID NO: 272338 - DNA, 20 bp, Artificial Sequence
  chemically synthesized
tgtaaatcagcagtatgttg

SEQ ID NO: 272339 - DNA, 20 bp, Artificial Sequence
  chemically synthesized
aatcagcagtatgttgaagt

SEQ ID NO: 272340 - DNA, 20 bp, Artificial Sequence
  chemically synthesized
tctctctgtacagacacaca

SEQ ID NO: 272341 - DNA, 20 bp, Artificial Sequence
  chemically synthesized
aatcactatgtgtgtctgta

SEQ ID NO: 272342 - DNA, 20 bp, Artificial Sequence
  chemically synthesized
tcactatgtgtgtctgtaca

SEQ ID NO: 272343 - DNA, 20 bp, Artificial Sequence
  chemically synthesized
actatgtgtgtctgtacaga

SEQ ID NO: 272344 - DNA, 20 bp, Artificial Sequence
  chemically synthesized
tttccctctttctctctgta

SEQ ID NO: 272345 - DNA, 20 bp, Artificial Sequence
  chemically synthesized
tgtgtgtctgtacagagaga

SEQ ID NO: 272346 - DNA, 20 bp, Artificial Sequence
  chemically synthesized
tgtgtctgtacagagagaaa

SEQ ID NO: 272347 - DNA, 20 bp, Artificial Sequence
  chemically synthesized
gtgtctgtacagagagaaag

SEQ ID NO: 272348 - DNA, 20 bp, Artificial Sequence
  chemically synthesized
tgtctgtacagagagaaaga

SEQ ID NO: 272349 - DNA, 20 bp, Artificial Sequence
  chemically synthesized
tacagagagaaagagggaaa

SEQ ID NO: 272350 - DNA, 20 bp, Artificial Sequence
  chemically synthesized
acagagagaaagagggaaac

SEQ ID NO: 272351 - DNA, 20 bp, Artificial Sequence
  chemically synthesized
cagagagaaagagggaaaca

SEQ ID NO: 272352 - DNA, 20 bp, Artificial Sequence
  chemically synthesized
ttgtataatatgtatttttt

SEQ ID NO: 272353 - DNA, 20 bp, Artificial Sequence
  chemically synthesized
tgtattttttcagtgttttc

SEQ ID NO: 272354 - DNA, 20 bp, Artificial Sequence
  chemically synthesized
ttttcagtgttttcaagcgt

SEQ ID NO: 272355 - DNA, 20 bp, Artificial Sequence
  chemically synthesized
ttcagtgttttcaagcgtta

SEQ ID NO: 272356 - DNA, 20 bp, Artificial Sequence
  chemically synthesized
tcagtgttttcaagcgttag

SEQ ID NO: 272357 - DNA, 20 bp, Artificial Sequence
  chemically synthesized
tgttttcaagcgttagagga

SEQ ID NO: 272358 - DNA, 20 bp, Artificial Sequence
  chemically synthesized
tttcaagcgttagaggaaag

SEQ ID NO: 272359 - DNA, 20 bp, Artificial Sequence
  chemically synthesized
aagcgttagaggaaagcaga

SEQ ID NO: 272360 - DNA, 20 bp, Artificial Sequence
  chemically synthesized
gcgttagaggaaagcagaaa

SEQ ID NO: 272361 - DNA, 20 bp, Artificial Sequence
  chemically synthesized
gttagaggaaagcagaaaga

SEQ ID NO: 272362 - DNA, 20 bp, Artificial Sequence
  chemically synthesized
gaaagcagaaagagagaaca

SEQ ID NO: 272363 - DNA, 20 bp, Artificial Sequence
  chemically synthesized
aagcagaaagagagaacaaa

SEQ ID NO: 272364 - DNA, 20 bp, Artificial Sequence
  chemically synthesized
gcagaaagagagaacaaaga

SEQ ID NO: 272365 - DNA, 20 bp, Artificial Sequence
  chemically synthesized
agagaacaaagagagaacca

SEQ ID NO: 272366 - DNA, 20 bp, Artificial Sequence
  chemically synthesized
agaacaaagagagaaccatg

SEQ ID NO: 272367 - DNA, 20 bp, Artificial Sequence
  chemically synthesized
agttaaatttgtgttctcca

SEQ ID NO: 272368 - DNA, 20 bp, Artificial Sequence
  chemically synthesized
gaacacaaatttaactgaca

SEQ ID NO: 272369 - DNA, 20 bp, Artificial Sequence
  chemically synthesized
acaaatttaactgacatgga

SEQ ID NO: 272370 - DNA, 20 bp, Artificial Sequence
  chemically synthesized
tggtgcttttctttccatgt

SEQ ID NO: 272371 - DNA, 20 bp, Artificial Sequence
  chemically synthesized
tttaactgacatggaaagaa

SEQ ID NO: 272372 - DNA, 20 bp, Artificial Sequence
  chemically synthesized
ggaaagaaaagcaccaaata

SEQ ID NO: 272373 - DNA, 20 bp, Artificial Sequence
  chemically synthesized
aaagaaaagcaccaaataaa

SEQ ID NO: 272374 - DNA, 20 bp, Artificial Sequence
  chemically synthesized
gactgttctttctctttatt

SEQ ID NO: 272375 - DNA, 20 bp, Artificial Sequence
  chemically synthesized
aaaagcaccaaataaagaga

SEQ ID NO: 272376 - DNA, 20 bp, Artificial Sequence
  chemically synthesized
caccaaataaagagaaagaa

SEQ ID NO: 272377 - DNA, 20 bp, Artificial Sequence
  chemically synthesized
ataaagagaaagaacagtca

SEQ ID NO: 272378 - DNA, 20 bp, Artificial Sequence
  chemically synthesized
aaagagaaagaacagtcaaa

SEQ ID NO: 272379 - DNA, 20 bp, Artificial Sequence
  chemically synthesized
agaaagaacagtcaaagaga

SEQ ID NO: 272380 - DNA, 20 bp, Artificial Sequence
  chemically synthesized
gaacagtcaaagagaaagaa

SEQ ID NO: 272381 - DNA, 20 bp, Artificial Sequence
  chemically synthesized
cagtcaaagagaaagaaaag

SEQ ID NO: 272382 - DNA, 20 bp, Artificial Sequence
  chemically synthesized
aagagaaagaaaagaagaac

SEQ ID NO: 272383 - DNA, 20 bp, Artificial Sequence
  chemically synthesized
aaagaaaagaagaactagaa

SEQ ID NO: 272384 - DNA, 20 bp, Artificial Sequence
  chemically synthesized
agaaaagaagaactagaaaa

SEQ ID NO: 272385 - DNA, 20 bp, Artificial Sequence
  chemically synthesized
aaaagaagaactagaaaaga

SEQ ID NO: 272386 - DNA, 20 bp, Artificial Sequence
  chemically synthesized
gtgagattttctctcttttc

SEQ ID NO: 272387 - DNA, 20 bp, Artificial Sequence
  chemically synthesized
attctcacatcaattgatgt

SEQ ID NO: 272388 - DNA, 20 bp, Artificial Sequence
  chemically synthesized
aatctcacatcaattgatgt

SEQ ID NO: 272389 - DNA, 20 bp, Artificial Sequence
  chemically synthesized
tcaattgatgtgagaatttt

SEQ ID NO: 272390 - DNA, 20 bp, Artificial Sequence
  chemically synthesized
gatgtgagaattttaagaat

SEQ ID NO: 272391 - DNA, 20 bp, Artificial Sequence
  chemically synthesized
tgtgagaattttaagaatga

SEQ ID NO: 272392 - DNA, 20 bp, Artificial Sequence
  chemically synthesized
tgagaattttaagaatgaga

SEQ ID NO: 272393 - DNA, 20 bp, Artificial Sequence
  chemically synthesized
agaattttaagaatgagaga

SEQ ID NO: 272394 - DNA, 20 bp, Artificial Sequence
  chemically synthesized
aattttaagaatgagagaga

SEQ ID NO: 272395 - DNA, 20 bp, Artificial Sequence
  chemically synthesized
attttaagaatgagagagag

SEQ ID NO: 272396 - DNA, 20 bp, Artificial Sequence
  chemically synthesized
gaatgagagagagaggtcaa

SEQ ID NO: 272397 - DNA, 20 bp, Artificial Sequence
  chemically synthesized
gagagagaggtcaacagtga

SEQ ID NO: 272398 - DNA, 20 bp, Artificial Sequence
  chemically synthesized
gaggtcaacagtgacagttt

SEQ ID NO: 272399 - DNA, 20 bp, Artificial Sequence
  chemically synthesized
tcaacagtgacagtttgaga

SEQ ID NO: 272400 - DNA, 20 bp, Artificial Sequence
  chemically synthesized
caacagtgacagtttgagat

SEQ ID NO: 272401 - DNA, 20 bp, Artificial Sequence
  chemically synthesized
acagtttgagataggttcaa

SEQ ID NO: 272402 - DNA, 20 bp, Artificial Sequence
  chemically synthesized
cagtttgagataggttcaat

SEQ ID NO: 272403 - DNA, 20 bp, Artificial Sequence
  chemically synthesized
gataggttcaatgggatcaa

SEQ ID NO: 272404 - DNA, 20 bp, Artificial Sequence
  chemically synthesized
tcaatgggatcaatagtaat

SEQ ID NO: 272405 - DNA, 20 bp, Artificial Sequence
  chemically synthesized
caatgggatcaatagtaatc

SEQ ID NO: 272406 - DNA, 20 bp, Artificial Sequence
  chemically synthesized
aatgggatcaatagtaatca

SEQ ID NO: 272407 - DNA, 20 bp, Artificial Sequence
  chemically synthesized
caatagtaatcagggtacat

SEQ ID NO: 272408 - DNA, 20 bp, Artificial Sequence
  chemically synthesized
tagctgcaatggtcattgac

SEQ ID NO: 272409 - DNA, 20 bp, Artificial Sequence
  chemically synthesized
gagctcgtcaatgaccattg

SEQ ID NO: 272410 - DNA, 20 bp, Artificial Sequence
  chemically synthesized
tcgtcaatgaccattgcagc

SEQ ID NO: 272411 - DNA, 20 bp, Artificial Sequence
  chemically synthesized
cttctctcttctagctgcaa

SEQ ID NO: 272412 - DNA, 20 bp, Artificial Sequence
  chemically synthesized
tcaatgaccattgcagctag

SEQ ID NO: 272413 - DNA, 20 bp, Artificial Sequence
  chemically synthesized
aatgaccattgcagctagaa

SEQ ID NO: 272414 - DNA, 20 bp, Artificial Sequence
  chemically synthesized
tgaccattgcagctagaaga

SEQ ID NO: 272415 - DNA, 20 bp, Artificial Sequence
  chemically synthesized
cgtcatccacttctctcttc

SEQ ID NO: 272416 - DNA, 20 bp, Artificial Sequence
  chemically synthesized
ccattgcagctagaagagag

SEQ ID NO: 272417 - DNA, 20 bp, Artificial Sequence
  chemically synthesized
ttgcagctagaagagagaag

SEQ ID NO: 272418 - DNA, 20 bp, Artificial Sequence
  chemically synthesized
agaagagagaagtggatgac

SEQ ID NO: 272419 - DNA, 20 bp, Artificial Sequence
  chemically synthesized
aagagagaagtggatgacga

SEQ ID NO: 272420 - DNA, 20 bp, Artificial Sequence
  chemically synthesized
agagaagtggatgacgagag

SEQ ID NO: 272421 - DNA, 20 bp, Artificial Sequence
  chemically synthesized
agagcagaaatcgtattttc

SEQ ID NO: 272422 - DNA, 20 bp, Artificial Sequence
  chemically synthesized
gagcagaaatcgtattttca

SEQ ID NO: 272423 - DNA, 20 bp, Artificial Sequence
  chemically synthesized
agcagaaatcgtattttcaa

SEQ ID NO: 272424 - DNA, 20 bp, Artificial Sequence
  chemically synthesized
gaaatcgtattttcaagggc

SEQ ID NO: 272425 - DNA, 20 bp, Artificial Sequence
  chemically synthesized
tccttgatccttaatcaggc

SEQ ID NO: 272426 - DNA, 20 bp, Artificial Sequence
  chemically synthesized
tttcaagggctggcctgatt

SEQ ID NO: 272427 - DNA, 20 bp, Artificial Sequence
  chemically synthesized
ttcaagggctggcctgatta

SEQ ID NO: 272428 - DNA, 20 bp, Artificial Sequence
  chemically synthesized
gtgctccttgatccttaatc

SEQ ID NO: 272429 - DNA, 20 bp, Artificial Sequence
  chemically synthesized
agtgctccttgatccttaat

SEQ ID NO: 272430 - DNA, 20 bp, Artificial Sequence
  chemically synthesized
ggctggcctgattaaggatc

SEQ ID NO: 272431 - DNA, 20 bp, Artificial Sequence
  chemically synthesized
gctggcctgattaaggatca

SEQ ID NO: 272432 - DNA, 20 bp, Artificial Sequence
  chemically synthesized
tggcctgattaaggatcaag

SEQ ID NO: 272433 - DNA, 20 bp, Artificial Sequence
  chemically synthesized
aatttaaactatttttatta

SEQ ID NO: 272434 - DNA, 20 bp, Artificial Sequence
  chemically synthesized
aaggagcactctaataaaaa

SEQ ID NO: 272435 - DNA, 20 bp, Artificial Sequence
  chemically synthesized
gtaatttaaactatttttat

SEQ ID NO: 272436 - DNA, 20 bp, Artificial Sequence
  chemically synthesized
aatagtttaaattacttttg

SEQ ID NO: 272437 - DNA, 20 bp, Artificial Sequence
  chemically synthesized
gtggagacaaaagtctgcaa

SEQ ID NO: 272438 - DNA, 20 bp, Artificial Sequence
  chemically synthesized
tttattatgtgtggagacaa

SEQ ID NO: 272439 - DNA, 20 bp, Artificial Sequence
  chemically synthesized
cctgaattttattatgtgtg

SEQ ID NO: 272440 - DNA, 20 bp, Artificial Sequence
  chemically synthesized
gacctgaattttattatgtg

SEQ ID NO: 272441 - DNA, 20 bp, Artificial Sequence
  chemically synthesized
tctccacacataataaaatt

SEQ ID NO: 272442 - DNA, 20 bp, Artificial Sequence
  chemically synthesized
ctccacacataataaaattc

SEQ ID NO: 272443 - DNA, 20 bp, Artificial Sequence
  chemically synthesized
ataataaaattcaggtcaat

SEQ ID NO: 272444 - DNA, 20 bp, Artificial Sequence
  chemically synthesized
tgtagccttaaagtatgttc

SEQ ID NO: 272445 - DNA, 20 bp, Artificial Sequence
  chemically synthesized
atcagacttgaacatacttt

SEQ ID NO: 272446 - DNA, 20 bp, Artificial Sequence
  chemically synthesized
tcagacttgaacatacttta

SEQ ID NO: 272447 - DNA, 20 bp, Artificial Sequence
  chemically synthesized
gcttctttcatgtagcctta

SEQ ID NO: 272448 - DNA, 20 bp, Artificial Sequence
  chemically synthesized
catactttaaggctacatga

SEQ ID NO: 272449 - DNA, 20 bp, Artificial Sequence
  chemically synthesized
atgtgttggcttctttcatg

SEQ ID NO: 272450 - DNA, 20 bp, Artificial Sequence
  chemically synthesized
actttaaggctacatgaaag

SEQ ID NO: 272451 - DNA, 20 bp, Artificial Sequence
  chemically synthesized
atgaaagaagccaacacata

SEQ ID NO: 272452 - DNA, 20 bp, Artificial Sequence
  chemically synthesized
aaaaaaatcactttatgtgt

SEQ ID NO: 272453 - DNA, 20 bp, Artificial Sequence
  chemically synthesized
aagtgattttttttaaatgt

SEQ ID NO: 272454 - DNA, 20 bp, Artificial Sequence
  chemically synthesized
tgattttttttaaatgtaag

SEQ ID NO: 272455 - DNA, 20 bp, Artificial Sequence
  chemically synthesized
aaacaggtttttttaaaatc

SEQ ID NO: 272456 - DNA, 20 bp, Artificial Sequence
  chemically synthesized
attttaaaaaaacctgttta

SEQ ID NO: 272457 - DNA, 20 bp, Artificial Sequence
  chemically synthesized
ctggttttcttgctttaaac

SEQ ID NO: 272458 - DNA, 20 bp, Artificial Sequence
  chemically synthesized
tctggttttcttgctttaaa

SEQ ID NO: 272459 - DNA, 20 bp, Artificial Sequence
  chemically synthesized
taaaaaaacctgtttaaagc

SEQ ID NO: 272460 - DNA, 20 bp, Artificial Sequence
  chemically synthesized
cctgtttaaagcaagaaaac

SEQ ID NO: 272461 - DNA, 20 bp, Artificial Sequence
  chemically synthesized
tgtttaaagcaagaaaacca

SEQ ID NO: 272462 - DNA, 20 bp, Artificial Sequence
  chemically synthesized
aaagcaagaaaaccagagtg

SEQ ID NO: 272463 - DNA, 20 bp, Artificial Sequence
  chemically synthesized
ctgagctttgtgcttcactc

SEQ ID NO: 272464 - DNA, 20 bp, Artificial Sequence
  chemically synthesized
gaaaaccagagtgaagcaca

SEQ ID NO: 272465 - DNA, 20 bp, Artificial Sequence
  chemically synthesized
ccagagtgaagcacaaagct

SEQ ID NO: 272466 - DNA, 20 bp, Artificial Sequence
  chemically synthesized
cagagtgaagcacaaagctc

SEQ ID NO: 272467 - DNA, 20 bp, Artificial Sequence
  chemically synthesized
agagtgaagcacaaagctca

SEQ ID NO: 272468 - DNA, 20 bp, Artificial Sequence
  chemically synthesized
tgatattttccgttggccct

SEQ ID NO: 272469 - DNA, 20 bp, Artificial Sequence
  chemically synthesized
agcacaaagctcagggccaa

SEQ ID NO: 272470 - DNA, 20 bp, Artificial Sequence
  chemically synthesized
ctcctgttgatattttccgt

SEQ ID NO: 272471 - DNA, 20 bp, Artificial Sequence
  chemically synthesized
gggccaacggaaaatatcaa

SEQ ID NO: 272472 - DNA, 20 bp, Artificial Sequence
  chemically synthesized
ggccaacggaaaatatcaac

SEQ ID NO: 272473 - DNA, 20 bp, Artificial Sequence
  chemically synthesized
ccaacggaaaatatcaacag

SEQ ID NO: 272474 - DNA, 20 bp, Artificial Sequence
  chemically synthesized
caacggaaaatatcaacagg

SEQ ID NO: 272475 - DNA, 20 bp, Artificial Sequence
  chemically synthesized
acggaaaatatcaacaggag

SEQ ID NO: 272476 - DNA, 20 bp, Artificial Sequence
  chemically synthesized
ggaaaatatcaacaggagga

SEQ ID NO: 272477 - DNA, 20 bp, Artificial Sequence
  chemically synthesized
gaaaatatcaacaggaggag

SEQ ID NO: 272478 - DNA, 20 bp, Artificial Sequence
  chemically synthesized
aatatcaacaggaggagagg

SEQ ID NO: 272479 - DNA, 20 bp, Artificial Sequence
  chemically synthesized
gaggagaggtggctcttttt

SEQ ID NO: 272480 - DNA, 20 bp, Artificial Sequence
  chemically synthesized
tacttttgttttctgaaaaa

SEQ ID NO: 272481 - DNA, 20 bp, Artificial Sequence
  chemically synthesized
cttacttttgttttctgaaa

SEQ ID NO: 272482 - DNA, 20 bp, Artificial Sequence
  chemically synthesized
ggctctttttcagaaaacaa

SEQ ID NO: 272483 - DNA, 20 bp, Artificial Sequence
  chemically synthesized
ctttttcagaaaacaaaagt

SEQ ID NO: 272484 - DNA, 20 bp, Artificial Sequence
  chemically synthesized
gaaaacaaaagtaagatgtg

SEQ ID NO: 272485 - DNA, 20 bp, Artificial Sequence
  chemically synthesized
aaagtaagatgtgaagacgc

SEQ ID NO: 272486 - DNA, 20 bp, Artificial Sequence
  chemically synthesized
gtaagatgtgaagacgcaag

SEQ ID NO: 272487 - DNA, 20 bp, Artificial Sequence
  chemically synthesized
gaagttgaatgcttcctaca

SEQ ID NO: 272488 - DNA, 20 bp, Artificial Sequence
  chemically synthesized
ctctgagagcaccatgtagg

SEQ ID NO: 272489 - DNA, 20 bp, Artificial Sequence
  chemically synthesized
atactctgagagcaccatgt

SEQ ID NO: 272490 - DNA, 20 bp, Artificial Sequence
  chemically synthesized
gatactctgagagcaccatg

SEQ ID NO: 272491 - DNA, 20 bp, Artificial Sequence
  chemically synthesized
tgcttcctacatggtgctct

SEQ ID NO: 272492 - DNA, 20 bp, Artificial Sequence
  chemically synthesized
cttcctacatggtgctctca

SEQ ID NO: 272493 - DNA, 20 bp, Artificial Sequence
  chemically synthesized
atttcaccctgatactctga

SEQ ID NO: 272494 - DNA, 20 bp, Artificial Sequence
  chemically synthesized
acatggtgctctcagagtat

SEQ ID NO: 272495 - DNA, 20 bp, Artificial Sequence
  chemically synthesized
tgatttcaccctgatactct

SEQ ID NO: 272496 - DNA, 20 bp, Artificial Sequence
  chemically synthesized
catggtgctctcagagtatc

SEQ ID NO: 272497 - DNA, 20 bp, Artificial Sequence
  chemically synthesized
atggtgctctcagagtatca

SEQ ID NO: 272498 - DNA, 20 bp, Artificial Sequence
  chemically synthesized
tcagggtgaaatcatgttaa

SEQ ID NO: 272499 - DNA, 20 bp, Artificial Sequence
  chemically synthesized
gaaatcatgttaacagtaac

SEQ ID NO: 272500 - DNA, 20 bp, Artificial Sequence
  chemically synthesized
aaatcatgttaacagtaacc

SEQ ID NO: 272501 - DNA, 20 bp, Artificial Sequence
  chemically synthesized
gagccctgaaatttaaatcc

SEQ ID NO: 272502 - DNA, 20 bp, Artificial Sequence
  chemically synthesized
agtaaccaggatttaaattt

SEQ ID NO: 272503 - DNA, 20 bp, Artificial Sequence
  chemically synthesized
gtaaccaggatttaaatttc

SEQ ID NO: 272504 - DNA, 20 bp, Artificial Sequence
  chemically synthesized
taaccaggatttaaatttca

SEQ ID NO: 272505 - DNA, 20 bp, Artificial Sequence
  chemically synthesized
ttgcccaaggtggcaagaga

SEQ ID NO: 272506 - DNA, 20 bp, Artificial Sequence
  chemically synthesized
ctttgcccaaggtggcaaga

SEQ ID NO: 272507 - DNA, 20 bp, Artificial Sequence
  chemically synthesized
tgctttgcccaaggtggcaa

SEQ ID NO: 272508 - DNA, 20 bp, Artificial Sequence
  chemically synthesized
agggctctctcttgccacct

SEQ ID NO: 272509 - DNA, 20 bp, Artificial Sequence
  chemically synthesized
gatgctttgcccaaggtggc

SEQ ID NO: 272510 - DNA, 20 bp, Artificial Sequence
  chemically synthesized
gggctctctcttgccacctt

SEQ ID NO: 272511 - DNA, 20 bp, Artificial Sequence
  chemically synthesized
tgttgatgctttgcccaagg

SEQ ID NO: 272512 - DNA, 20 bp, Artificial Sequence
  chemically synthesized
ctctcttgccaccttgggca

SEQ ID NO: 272513 - DNA, 20 bp, Artificial Sequence
  chemically synthesized
acatgttgatgctttgccca

SEQ ID NO: 272514 - DNA, 20 bp, Artificial Sequence
  chemically synthesized
aacatgttgatgctttgccc

SEQ ID NO: 272515 - DNA, 20 bp, Artificial Sequence
  chemically synthesized
gacatgagaaaatcaaggtt

SEQ ID NO: 272516 - DNA, 20 bp, Artificial Sequence
  chemically synthesized
ggctagacatgagaaaatca

SEQ ID NO: 272517 - DNA, 20 bp, Artificial Sequence
  chemically synthesized
gggctagacatgagaaaatc

SEQ ID NO: 272518 - DNA, 20 bp, Artificial Sequence
  chemically synthesized
aaccttgattttctcatgtc

SEQ ID NO: 272519 - DNA, 20 bp, Artificial Sequence
  chemically synthesized
atcattcttgggctagacat

SEQ ID NO: 272520 - DNA, 20 bp, Artificial Sequence
  chemically synthesized
gattttctcatgtctagccc

SEQ ID NO: 272521 - DNA, 20 bp, Artificial Sequence
  chemically synthesized
tgctattatcattcttgggc

SEQ ID NO: 272522 - DNA, 20 bp, Artificial Sequence
  chemically synthesized
ggcttgctattatcattctt

SEQ ID NO: 272523 - DNA, 20 bp, Artificial Sequence
  chemically synthesized
tggcttgctattatcattct

SEQ ID NO: 272524 - DNA, 20 bp, Artificial Sequence
  chemically synthesized
gtctagcccaagaatgataa

SEQ ID NO: 272525 - DNA, 20 bp, Artificial Sequence
  chemically synthesized
agcccaagaatgataatagc

SEQ ID NO: 272526 - DNA, 20 bp, Artificial Sequence
  chemically synthesized
caagaatgataatagcaagc

SEQ ID NO: 272527 - DNA, 20 bp, Artificial Sequence
  chemically synthesized
ataatagcaagccagcaatg

SEQ ID NO: 272528 - DNA, 20 bp, Artificial Sequence
  chemically synthesized
agataagaaaacttcattgc

SEQ ID NO: 272529 - DNA, 20 bp, Artificial Sequence
  chemically synthesized
gcaatgaagttttcttatct

SEQ ID NO: 272530 - DNA, 20 bp, Artificial Sequence
  chemically synthesized
gaaatgagaatttctcagat

SEQ ID NO: 272531 - DNA, 20 bp, Artificial Sequence
  chemically synthesized
ctgaagaaatgagaatttct

SEQ ID NO: 272532 - DNA, 20 bp, Artificial Sequence
  chemically synthesized
ctgagaaattctcatttctt

SEQ ID NO: 272533 - DNA, 20 bp, Artificial Sequence
  chemically synthesized
tagttgactactgaagaaat

SEQ ID NO: 272534 - DNA, 20 bp, Artificial Sequence
  chemically synthesized
agaaattctcatttcttcag

SEQ ID NO: 272535 - DNA, 20 bp, Artificial Sequence
  chemically synthesized
accaatgtagttgactactg

SEQ ID NO: 272536 - DNA, 20 bp, Artificial Sequence
  chemically synthesized
tcttcagtagtcaactacat

SEQ ID NO: 272537 - DNA, 20 bp, Artificial Sequence
  chemically synthesized
ctttttgaccaaaaccaatg

SEQ ID NO: 272538 - DNA, 20 bp, Artificial Sequence
  chemically synthesized
gtagtcaactacattggttt

SEQ ID NO: 272539 - DNA, 20 bp, Artificial Sequence
  chemically synthesized
ctacattggttttggtcaaa

SEQ ID NO: 272540 - DNA, 20 bp, Artificial Sequence
  chemically synthesized
ttggttttggtcaaaaagat

SEQ ID NO: 272541 - DNA, 20 bp, Artificial Sequence
  chemically synthesized
gtcaaaaagatcagatgtga

SEQ ID NO: 272542 - DNA, 20 bp, Artificial Sequence
  chemically synthesized
tttgtgcaaataacatggac

SEQ ID NO: 272543 - DNA, 20 bp, Artificial Sequence
  chemically synthesized
atttgtgcaaataacatgga

SEQ ID NO: 272544 - DNA, 20 bp, Artificial Sequence
  chemically synthesized
aaatatttgtgcaaataaca

SEQ ID NO: 272545 - DNA, 20 bp, Artificial Sequence
  chemically synthesized
atgttatttgcacaaatatt

SEQ ID NO: 272546 - DNA, 20 bp, Artificial Sequence
  chemically synthesized
ttgcacaaatatttagttat

SEQ ID NO: 272547 - DNA, 20 bp, Artificial Sequence
  chemically synthesized
aatatttagttataagttat

SEQ ID NO: 272548 - DNA, 20 bp, Artificial Sequence
  chemically synthesized
ataacatgtcatttcctcgt

SEQ ID NO: 272549 - DNA, 20 bp, Artificial Sequence
  chemically synthesized
cctagggttttgtgcttacg

SEQ ID NO: 272550 - DNA, 20 bp, Artificial Sequence
  chemically synthesized
acctagggttttgtgcttac

SEQ ID NO: 272551 - DNA, 20 bp, Artificial Sequence
  chemically synthesized
tcctcgtaagcacaaaaccc

SEQ ID NO: 272552 - DNA, 20 bp, Artificial Sequence
  chemically synthesized
cctcgtaagcacaaaaccct

SEQ ID NO: 272553 - DNA, 20 bp, Artificial Sequence
  chemically synthesized
tcatcctcagcagataccta

SEQ ID NO: 272554 - DNA, 20 bp, Artificial Sequence
  chemically synthesized
ctcatcctcagcagatacct

SEQ ID NO: 272555 - DNA, 20 bp, Artificial Sequence
  chemically synthesized
tctcatcctcagcagatacc

SEQ ID NO: 272556 - DNA, 20 bp, Artificial Sequence
  chemically synthesized
caaaaccctaggtatctgct

SEQ ID NO: 272557 - DNA, 20 bp, Artificial Sequence
  chemically synthesized
aaaaccctaggtatctgctg

SEQ ID NO: 272558 - DNA, 20 bp, Artificial Sequence
  chemically synthesized
ttctctcctctcatcctcag

SEQ ID NO: 272559 - DNA, 20 bp, Artificial Sequence
  chemically synthesized
cctaggtatctgctgaggat

SEQ ID NO: 272560 - DNA, 20 bp, Artificial Sequence
  chemically synthesized
taggtatctgctgaggatga

SEQ ID NO: 272561 - DNA, 20 bp, Artificial Sequence
  chemically synthesized
tgattctctcctctcatcct

SEQ ID NO: 272562 - DNA, 20 bp, Artificial Sequence
  chemically synthesized
aggtatctgctgaggatgag

SEQ ID NO: 272563 - DNA, 20 bp, Artificial Sequence
  chemically synthesized
gtatctgctgaggatgagag

SEQ ID NO: 272564 - DNA, 20 bp, Artificial Sequence
  chemically synthesized
atctgctgaggatgagagga

SEQ ID NO: 272565 - DNA, 20 bp, Artificial Sequence
  chemically synthesized
gaggatgagaggagagaatc

SEQ ID NO: 272566 - DNA, 20 bp, Artificial Sequence
  chemically synthesized
aggatgagaggagagaatca

SEQ ID NO: 272567 - DNA, 20 bp, Artificial Sequence
  chemically synthesized
atgagaggagagaatcaagg

SEQ ID NO: 272568 - DNA, 20 bp, Artificial Sequence
  chemically synthesized
tcaaggtggaatttaaatca

SEQ ID NO: 272569 - DNA, 20 bp, Artificial Sequence
  chemically synthesized
aatttaaatcaaagtgataa

SEQ ID NO: 272570 - DNA, 20 bp, Artificial Sequence
  chemically synthesized
tcaaagtgataaaagttcaa

SEQ ID NO: 272571 - DNA, 20 bp, Artificial Sequence
  chemically synthesized
taaaagttcaatagcaattg

SEQ ID NO: 272572 - DNA, 20 bp, Artificial Sequence
  chemically synthesized
aaagttcaatagcaattgtg

SEQ ID NO: 272573 - DNA, 20 bp, Artificial Sequence
  chemically synthesized
agcaattgtggagactgtga

SEQ ID NO: 272574 - DNA, 20 bp, Artificial Sequence
  chemically synthesized
gcaattgtggagactgtgaa

SEQ ID NO: 272575 - DNA, 20 bp, Artificial Sequence
  chemically synthesized
tttaaatcagtttcctttca
